United States Patent 7,709,616 (MICRORNAS AND USES THEREOF) - sequence listing, part 21

SEQ ID NO: 644342 - RNA, 65 nt, hsa
ccucccgggcucaagcgauucucucaccucagccuccugaguaggugggauuacagaugcccgcc

SEQ ID NO: 644343 - RNA, 65 nt, hsa
cccagaagcaggcugaagaggaaaggcaggaggaaccugaguaugagaauguuguacccaucucc

SEQ ID NO: 644344 - RNA, 65 nt, hsa
cguccugggcucaaaugauccucccaccucagccuccugaguagcugggacuacaggcucaugcc

SEQ ID NO: 644345 - RNA, 65 nt, hsa
ccaucucccagguucaagcgauucuccugccuccuccugaguagcugggacuacaggugcucacc

SEQ ID NO: 644346 - RNA, 65 nt, hsa
ccucccacguucaagcgauccuccugccucaggcuccugaguagcugggauuacaggcgucggcc

SEQ ID NO: 644347 - RNA, 65 nt, hsa
uaaagucauuggauauaaaagagugauuuuccucaccugaguacaugaaaagaaaaugcugaaau

SEQ ID NO: 644348 - RNA, 65 nt, hsa
ccucccaggcucaagugauccucccaccccagccuccugaguagcugggacuacaggcuugcgcc

SEQ ID NO: 644349 - RNA, 65 nt, hsa
acuccugaccucacacaauccuccugccuuagccuccugaguaacugagauuacaggcacaagcu

SEQ ID NO: 644350 - RNA, 65 nt, hsa
acucccaggcucaagcgauccucccaucucagccuccugaguagcugggacuacaggcacaggcc

SEQ ID NO: 644351 - RNA, 54 nt, hsa; identical to SEQ ID NO: 643992

SEQ ID NO: 644352 - RNA, 65 nt, hsa
ugugagcuaucagcaucugccagucucuuguccucccugaguaucucacaguccauauccugaug

SEQ ID NO: 644353 - RNA, 65 nt, hsa
ggucaugggcucaugggauucuccuaccucagccuccugaguagcugggauuacagguguaugcc

SEQ ID NO: 644354 - RNA, 65 nt, hsa
cuugaccucccaggcgcacaaaauccuccucucagccugaguaacugggacuacagguguguacc

SEQ ID NO: 644355 - RNA, 65 nt, hsa
ccuccuggguucaagugauucucauggcucagccgccugaguagcugggauuacaggugugagcc

SEQ ID NO: 644356 - RNA, 65 nt, hsa
ccucccagguucaagcaguucuccugccucagccuccugaguagcugggaugacaggcacccgcc

SEQ ID NO: 644357 - RNA, 65 nt, hsa
ccucccggguucacgccauucuccugccucagccuccugaguagcugggacuacaggcgcccacc

SEQ ID NO: 644358 - RNA, 65 nt, hsa
ccucccggguucaagugauucuccugccucagccuccugaguagcugggauuacaggcacccacc

SEQ ID NO: 644359 - RNA, 65 nt, hsa
ccuuccgggcucaagcgauucuccagccucagccuccugaguagcuaggacugcaggugcuccac

SEQ ID NO: 644360 - RNA, 65 nt, hsa
ccuuuugggcucaagugauccucccaccucagccuccugaguagcugggaccauaggcucacaac

SEQ ID NO: 644361 - RNA, 65 nt, hsa
ggaaggcguccuuuuuccuuguagcuaacguuaggccugaguagcuccccuccauccuuguagac

SEQ ID NO: 644362 - RNA, 65 nt, hsa
ccuccaggguucaagcaauucuccugccucagucuccugaguagcugggacuacaggcaugcgcc

SEQ ID NO: 644363 - RNA, 65 nt, hsa
ccuccaggguucaagcaacucuccugcuucagccuccugaguagcugggacuacaggcaugcacc

SEQ ID NO: 644364 - RNA, 65 nt, hsa
cuugccaggcucaagcaguucuccugccucagccuccugaguagcugggacuacaggcacccgcc

SEQ ID NO: 644365 - RNA, 65 nt, hsa
ucuccggggcucaagcgcuucuccugccucagccuccugaguagcugggauuacaggcaugugcc

SEQ ID NO: 644366 - RNA, 65 nt, hsa
cuccugggguucaagugauccucccaccucagccuccugaguagcugggauuacaggcacccgcc

SEQ ID NO: 644367 - RNA, 65 nt, hsa
caagugaucuccaagugacccuccugccucagccuccugaguacccuccuggggacuacaggugc

SEQ ID NO: 644368 - RNA, 65 nt, hsa
cuucucaacgccaagucauccucccaccucagccuccugaguagcuaugacuacagguaugugcc

SEQ ID NO: 644369 - RNA, 65 nt, hsa
ccucccggguucacgccauucuccugccucagccuccugaguagcugggacuacaggccccugcc

SEQ ID NO: 644370 - RNA, 65 nt, hsa
ccuccuggguugaagugauucucgugccucagccuccugaguagcugggacugcaggcacgcgcc

SEQ ID NO: 644371 - RNA, 65 nt, hsa
ccuccuggguucaagcgauucuccugccucagccuccugaguagcugggauuacaggugugcgcc

SEQ ID NO: 644372 - RNA, 65 nt, hsa
ccuccugggaucaagugauucuccugccacagccuccugaguaccugagauuacaggcacccacc

SEQ ID NO: 644373 - RNA, 65 nt, hsa
augagagccaacacaugcucacugccagcuccuguccugaguacugggaaguuucuccugaagcc

SEQ ID NO: 644374 - RNA, 65 nt, hsa
uccagaugcagccccaucuccucagcaccccaggaccugaguauccccagcucagguggugaguc

SEQ ID NO: 644375 - RNA, 65 nt, hsa; identical to SEQ ID NO: 644224

SEQ ID NO: 644376 - RNA, 65 nt, hsa
cuucucagguucaagcaauucuccugccucagccuccugaguagcugggacuauaggcgcgugcc

SEQ ID NO: 644377 - RNA, 65 nt, hsa
ccuccuggguucaagugauucuccugccucagccuccugaguagcugggauuacagcacccgcca

SEQ ID NO: 644378 - RNA, 65 nt, hsa
caaauacagaccccaugucacccagaaagagauucccugaguagcaccuucaggcuagucccuau

SEQ ID NO: 644379 - RNA, 65 nt, hsa
cgccacccagguuaaaaauucuccugccucagccuccugaguagcugggacuacaggcaugcgca

SEQ ID NO: 644380 - RNA, 65 nt, hsa
ccuccuggguucacaccauucuccugccucagccuccugaguagcugggacuacaggcgccugcc

SEQ ID NO: 644381 - RNA, 65 nt, hsa
ucucccgggcucaagcgauucucuugccucagccuccugaguagcuaggacuacaggugcaugcc

SEQ ID NO: 644382 - RNA, 65 nt, hsa
cugccucccggguucaugccauucugccucagccuccugaguagcugggacuacaggcgcccgcc

SEQ ID NO: 644383 - RNA, 65 nt, hsa
ccuccuguguucaagcgauucuccugucucagccuccugaguagaugggacuacaggcacaggcc

SEQ ID NO: 644384 - RNA, 65 nt, hsa
cuugaguuuugugagcccuguagcaaauuaucaaaccugaguagggcagugggaacucggaauuu

SEQ ID NO: 644385 - RNA, 65 nt, hsa
ccucccagguucaugcaauucuccugccucagucuccugaguagcugggacuacaggugcgugcc

SEQ ID NO: 644386 - RNA, 65 nt, hsa
ugaguccagucucauuaaauauuggagaauacacaccugaguaagauccugugauugcagcaaau

SEQ ID NO: 644387 - RNA, 65 nt, hsa
ccuccuggguucaagugauucucgugccucagccuccugaguagcugggcugacaggcacccacc

SEQ ID NO: 644388 - RNA, 65 nt, hsa
acuccuggccuuaagugauccucccaccucagccuccugaguagcugggacuacaggcaugagcc

SEQ ID NO: 644389 - RNA, 65 nt, hsa
auuucacacccugcucaguauggcuagccagcaguccugaguaggaguccaggacucccacuguc

SEQ ID NO: 644390 - RNA, 65 nt, hsa
uaauccuagguuauugcuagccaaaauauuuuuguccugaguagugucacugggccaaaagauag

SEQ ID NO: 644391 - RNA, 65 nt, hsa
gacugacgcaacccacguguaacugucagccgggcccugaguaaucgcuuaaagauguuccuacg

SEQ ID NO: 644392 - RNA, 65 nt, hsa
ccucccagguucaagcgauucuccugccucagccuccugaguagcugggauuacaggcgcacgcc

SEQ ID NO: 644393 - RNA, 65 nt, hsa
aaauuuguuccuggucuaauuuggcacccuuccaaccugaguauuguaggggaaggaaauuuaca

SEQ ID NO: 644394 - RNA, 65 nt, hsa
ccuccaggguucaagugauucuccugccucagccuccugaguagcugggauuacaggcauguacc

SEQ ID NO: 644395 - RNA, 65 nt, hsa
uugagaaacacugccccauccuccaugcccugaacccugaguagacagccccaagcauggccagg

SEQ ID NO: 644396 - RNA, 65 nt, hsa
gucagaaacagaacccagguuucuugauucccacuccugaguaaaauuaaauagguuuuauguau

SEQ ID NO: 644397 - RNA, 65 nt, hsa
ugggggucaccgauggucagagucacuagaaguuaccugaguaucucugggaggccucaugucuc

SEQ ID NO: 644398 - RNA, 65 nt, hsa
ugcauguugcagaagccggcguuuuuauuagcgguccugaguaauuucccuuggcaaaauuccca

SEQ ID NO: 644399 - RNA, 65 nt, hsa
gauuuugaugauuaaaaagaauaaacacaguguuuccugaguagcagugauuguuaugccuugcu

SEQ ID NO: 644400 - RNA, 65 nt, hsa
ccucccguguucacaccauucuccugccucagccuccugaguagcugggacuacaggcacccgcc

SEQ ID NO: 644401 - RNA, 65 nt, hsa
ccucccagguuccaacgauugucuugucucagccuccugaguagcugagauuauaagcacgcacc

SEQ ID NO: 644402 - RNA, 61 nt, hsa; identical to SEQ ID NO: 644043

SEQ ID NO: 644403 - RNA, 65 nt, hsa
ccucuuauguucaagcaauucuccuuccuuagccuccugaguagcugggauuacaggcaugcgcc

SEQ ID NO: 644404 - RNA, 65 nt, hsa
accucccuggcucaagcgaucccuccccucagccuccugaguagcugagacuacaggugagugcc

SEQ ID NO: 644405 - RNA, 65 nt, hsa
caaaaaguacaauuguuaacagugacuuuaagccuccugaguagcugggacuacaggcaugcacc

SEQ ID NO: 644406 - RNA, 65 nt, hsa
uucaucugcugcuuggaauaaaaaaugcagcuggcccugaguacagggaaguggaacauaggcag

SEQ ID NO: 644407 - RNA, 65 nt, hsa
ucuugguagcugucacuucaaaagaagacaguuucccugaguaaucaucaccuacauggccauua

SEQ ID NO: 644408 - RNA, 65 nt, hsa
gucauggagccucaugccccugggucgugagcucgccugaguaugggguggugucauggagccgc

SEQ ID NO: 644409 - RNA, 65 nt, hsa
cugggcccuggugccugcugaagauucccucuaucccugaguacuuagucuucucccccuucccu

SEQ ID NO: 644410 - RNA, 65 nt, hsa
aaugagaguuaaaaaaaaaaaaaaaaaucuguaugccugaguaccauccuggaugaaucuagaag

SEQ ID NO: 644411 - RNA, 65 nt, hsa
gagauucuccaaggacagauggcaguggagcuagaccugaguagggggcagggaguucaggacaa

SEQ ID NO: 644412 - RNA, 65 nt, hsa
cucccggguucaagcggauucucgugccucagccuccugaguagcugggauuacaggcaugcacc

SEQ ID NO: 644413 - RNA, 65 nt, hsa
ccuccuggguucaagcgauuccccugcuucagccuccugaguagcugggacuacaggugcgugcc

SEQ ID NO: 644414 - RNA, 65 nt, hsa
aguccccccuccuuugugugucccagcacccuuggccugaguaaacuuggaaaggggcucccucc

SEQ ID NO: 644415 - RNA, 65 nt, hsa
agggcgggucugugucccauguguccugucaguccccugaguauguguguggguguggcgcaugu

SEQ ID NO: 644416 - RNA, 65 nt, hsa
ccuccuggguucaagcgauucuccugccucagccuccugaguagcugggaauacaggcaugcgcc

SEQ ID NO: 644417 - RNA, 65 nt, hsa
ccuauuuaaagacaaauuaugggacguuuguagaaccugaguauuuuucuuuuuaccaguuuuuu

SEQ ID NO: 644418 - RNA, 65 nt, hsa
cuaccggauucaaggaauucucccugccucagccuccugaguagcuaggauuacaggugccugcc

SEQ ID NO: 644419 - RNA, 65 nt, hsa
accugccgcugaucagccuuauguucccaaagagcccugaguagugcuuugguguucacagucug

SEQ ID NO: 644420 - RNA, 65 nt, hsa
cucccuggguucaagcgauucuccugccugagccuccugaguagcugggacuacaggcacgugcc

SEQ ID NO: 644421 - RNA, 65 nt, hsa
ccucccggauucaagugauucuccagccucagccuccugaguagcugggauuacaggcacacacc

SEQ ID NO: 644422 - RNA, 65 nt, hsa
ccuucuggguucaagcgauucucgugccucagcuuccugaguagcuggaauuacaggcaggugcc

SEQ ID NO: 644423 - RNA, 65 nt, hsa
uauggaugccgugggaguacaaaaguggaguguggccugaguaaugcauuaugggugguuuacca

SEQ ID NO: 644424 - RNA, 65 nt, hsa
ccuccuggguucaagcgauucuccugccucagccuccugaguagcugggacuacaggcgccagcc

SEQ ID NO: 644425 - RNA, 65 nt, hsa
gagcagccacagcagcagcuugaccugguauucuaccugaguagaugaagcagaagaucagcaag

SEQ ID NO: 644426 - RNA, 65 nt, hsa
acuccugggcuuaagggauccuuccgccucagccuccugaguagcugggacuacaguugugcacc

SEQ ID NO: 644427 - RNA, 65 nt, hsa
aaucaauauaaucugaauuauuguuaucuuuaccuccugaguaauaagcauggugucaguuuugu

SEQ ID NO: 644428 - RNA, 65 nt, hsa
aaauggacagucuucucuguugaucacagagggagccugaguacaggcuuggagaaauggcuagg

SEQ ID NO: 644429 - RNA, 65 nt, hsa
cccugggagaauugucccauucuuguugcuucucuccugaguacccacuaccacaaugucuucug

SEQ ID NO: 644430 - RNA, 64 nt, hsa; identical to SEQ ID NO: 77753

SEQ ID NO: 644431 - RNA, 64 nt, hsa; identical to SEQ ID NO: 77754

SEQ ID NO: 644432 - RNA, 64 nt, hsa; identical to SEQ ID NO: 77755

SEQ ID NO: 644433 - RNA, 64 nt, hsa; identical to SEQ ID NO: 77756

SEQ ID NO: 644434 - RNA, 64 nt, hsa; identical to SEQ ID NO: 77757

SEQ ID NO: 644435 - RNA, 64 nt, hsa; identical to SEQ ID NO: 77758

SEQ ID NO: 644436 - RNA, 64 nt, hsa; identical to SEQ ID NO: 77759

SEQ ID NO: 644437 - RNA, 64 nt, hsa; identical to SEQ ID NO: 77760

SEQ ID NO: 644438 - RNA, 64 nt, hsa; identical to SEQ ID NO: 77761

SEQ ID NO: 644439 - RNA, 64 nt, hsa; identical to SEQ ID NO: 77762

SEQ ID NO: 644440 - RNA, 64 nt, hsa; identical to SEQ ID NO: 77763

SEQ ID NO: 644441 - RNA, 64 nt, hsa; identical to SEQ ID NO: 77764

SEQ ID NO: 644442 - RNA, 64 nt, hsa; identical to SEQ ID NO: 77765

SEQ ID NO: 644443 - RNA, 64 nt, hsa; identical to SEQ ID NO: 77766

SEQ ID NO: 644444 - RNA, 64 nt, hsa; identical to SEQ ID NO: 77767

SEQ ID NO: 644445 - RNA, 64 nt, hsa; identical to SEQ ID NO: 77768

SEQ ID NO: 644446 - RNA, 64 nt, hsa; identical to SEQ ID NO: 77769

SEQ ID NO: 644447 - RNA, 64 nt, hsa; identical to SEQ ID NO: 77770

SEQ ID NO: 644448 - RNA, 64 nt, hsa; identical to SEQ ID NO: 77771

SEQ ID NO: 644449 - RNA, 64 nt, hsa; identical to SEQ ID NO: 77772

SEQ ID NO: 644450 - RNA, 64 nt, hsa; identical to SEQ ID NO: 77773

SEQ ID NO: 644451 - RNA, 64 nt, hsa; identical to SEQ ID NO: 77774

SEQ ID NO: 644452 - RNA, 64 nt, hsa; identical to SEQ ID NO: 77775

SEQ ID NO: 644453 - RNA, 64 nt, hsa; identical to SEQ ID NO: 77776

SEQ ID NO: 644454 - RNA, 64 nt, hsa; identical to SEQ ID NO: 77777

SEQ ID NO: 644455 - RNA, 64 nt, hsa; identical to SEQ ID NO: 77778

SEQ ID NO: 644456 - RNA, 64 nt, hsa; identical to SEQ ID NO: 77779

SEQ ID NO: 644457 - RNA, 64 nt, hsa; identical to SEQ ID NO: 77780

SEQ ID NO: 644458 - RNA, 64 nt, hsa; identical to SEQ ID NO: 77781

SEQ ID NO: 644459 - RNA, 64 nt, hsa; identical to SEQ ID NO: 77782

SEQ ID NO: 644460 - RNA, 64 nt, hsa; identical to SEQ ID NO: 77783

SEQ ID NO: 644461 - RNA, 64 nt, hsa; identical to SEQ ID NO: 77784

SEQ ID NO: 644462 - RNA, 64 nt, hsa; identical to SEQ ID NO: 77785

SEQ ID NO: 644463 - RNA, 64 nt, hsa; identical to SEQ ID NO: 516300

SEQ ID NO: 644464 - RNA, 64 nt, hsa; identical to SEQ ID NO: 516301

SEQ ID NO: 644465 - RNA, 64 nt, hsa; identical to SEQ ID NO: 516302

SEQ ID NO: 644466 - RNA, 64 nt, hsa; identical to SEQ ID NO: 516303

SEQ ID NO: 644467 - RNA, 64 nt, hsa; identical to SEQ ID NO: 411751

SEQ ID NO: 644468 - RNA, 64 nt, hsa; identical to SEQ ID NO: 411752

SEQ ID NO: 644469 - RNA, 64 nt, hsa; identical to SEQ ID NO: 411753

SEQ ID NO: 644470 - RNA, 64 nt, hsa; identical to SEQ ID NO: 411754

SEQ ID NO: 644471 - RNA, 64 nt, hsa; identical to SEQ ID NO: 411755

SEQ ID NO: 644472 - RNA, 64 nt, hsa; identical to SEQ ID NO: 411756

SEQ ID NO: 644473 - RNA, 64 nt, hsa; identical to SEQ ID NO: 411757

SEQ ID NO: 644474 - RNA, 64 nt, hsa; identical to SEQ ID NO: 411758

SEQ ID NO: 644475 - RNA, 64 nt, hsa; identical to SEQ ID NO: 411759

SEQ ID NO: 644476 - RNA, 64 nt, hsa; identical to SEQ ID NO: 411760

SEQ ID NO: 644477 - RNA, 64 nt, hsa; identical to SEQ ID NO: 411761

SEQ ID NO: 644478 - RNA, 64 nt, hsa; identical to SEQ ID NO: 411762

SEQ ID NO: 644479 - RNA, 64 nt, hsa; identical to SEQ ID NO: 411763

SEQ ID NO: 644480 - RNA, 64 nt, hsa; identical to SEQ ID NO: 411764

SEQ ID NO: 644481 - RNA, 64 nt, hsa; identical to SEQ ID NO: 411765

SEQ ID NO: 644482 - RNA, 64 nt, hsa; identical to SEQ ID NO: 411766

SEQ ID NO: 644483 - RNA, 64 nt, hsa; identical to SEQ ID NO: 411767

SEQ ID NO: 644484 - RNA, 64 nt, hsa; identical to SEQ ID NO: 411768

SEQ ID NO: 644485 - RNA, 64 nt, hsa; identical to SEQ ID NO: 411769

SEQ ID NO: 644486 - RNA, 64 nt, hsa; identical to SEQ ID NO: 411770

SEQ ID NO: 644487 - RNA, 64 nt, hsa; identical to SEQ ID NO: 98813

SEQ ID NO: 644488 - RNA, 64 nt, hsa; identical to SEQ ID NO: 98814

SEQ ID NO: 644489 - RNA, 64 nt, hsa; identical to SEQ ID NO: 98815

SEQ ID NO: 644490 - RNA, 64 nt, hsa; identical to SEQ ID NO: 98816

SEQ ID NO: 644491 - RNA, 64 nt, hsa; identical to SEQ ID NO: 98817

SEQ ID NO: 644492 - RNA, 64 nt, hsa; identical to SEQ ID NO: 98818

SEQ ID NO: 644493 - RNA, 64 nt, hsa; identical to SEQ ID NO: 98819

SEQ ID NO: 644494 - RNA, 64 nt, hsa; identical to SEQ ID NO: 98820

SEQ ID NO: 644495 - RNA, 64 nt, hsa; identical to SEQ ID NO: 98821

SEQ ID NO: 644496 - RNA, 64 nt, hsa; identical to SEQ ID NO: 98822

SEQ ID NO: 644497 - RNA, 64 nt, hsa; identical to SEQ ID NO: 98823

SEQ ID NO: 644498 - RNA, 64 nt, hsa; identical to SEQ ID NO: 98824

SEQ ID NO: 644499 - RNA, 64 nt, hsa; identical to SEQ ID NO: 98825

SEQ ID NO: 644500 - RNA, 64 nt, hsa; identical to SEQ ID NO: 98826

SEQ ID NO: 644501 - RNA, 64 nt, hsa; identical to SEQ ID NO: 98827

SEQ ID NO: 644502 - RNA, 64 nt, hsa; identical to SEQ ID NO: 98828

SEQ ID NO: 644503 - RNA, 64 nt, hsa; identical to SEQ ID NO: 98829

SEQ ID NO: 644504 - RNA, 64 nt, hsa; identical to SEQ ID NO: 98830

SEQ ID NO: 644505 - RNA, 64 nt, hsa; identical to SEQ ID NO: 98831

SEQ ID NO: 644506 - RNA, 64 nt, hsa; identical to SEQ ID NO: 98832

SEQ ID NO: 644507 - RNA, 64 nt, hsa; identical to SEQ ID NO: 98833

SEQ ID NO: 644508 - RNA, 64 nt, hsa; identical to SEQ ID NO: 98834

SEQ ID NO: 644509 - RNA, 64 nt, hsa; identical to SEQ ID NO: 98835

SEQ ID NO: 644510 - RNA, 64 nt, hsa; identical to SEQ ID NO: 98836

SEQ ID NO: 644511 - RNA, 64 nt, hsa; identical to SEQ ID NO: 98837

SEQ ID NO: 644512 - RNA, 64 nt, hsa; identical to SEQ ID NO: 98838

SEQ ID NO: 644513 - RNA, 64 nt, hsa; identical to SEQ ID NO: 98839

SEQ ID NO: 644514 - RNA, 64 nt, hsa; identical to SEQ ID NO: 98840

SEQ ID NO: 644515 - RNA, 64 nt, hsa; identical to SEQ ID NO: 98841

SEQ ID NO: 644516 - RNA, 64 nt, hsa; identical to SEQ ID NO: 98842

SEQ ID NO: 644517 - RNA, 64 nt, hsa; identical to SEQ ID NO: 98843

SEQ ID NO: 644518 - RNA, 64 nt, hsa; identical to SEQ ID NO: 98844

SEQ ID NO: 644519 - RNA, 64 nt, hsa; identical to SEQ ID NO: 98845

SEQ ID NO: 644520 - RNA, 64 nt, hsa; identical to SEQ ID NO: 98846

SEQ ID NO: 644521 - RNA, 64 nt, hsa; identical to SEQ ID NO: 98847

SEQ ID NO: 644522 - RNA, 64 nt, hsa; identical to SEQ ID NO: 98848

SEQ ID NO: 644523 - RNA, 64 nt, hsa; identical to SEQ ID NO: 98849

SEQ ID NO: 644524 - RNA, 64 nt, hsa; identical to SEQ ID NO: 98850

SEQ ID NO: 644525 - RNA, 64 nt, hsa; identical to SEQ ID NO: 98851

SEQ ID NO: 644526 - RNA, 64 nt, hsa; identical to SEQ ID NO: 98852

SEQ ID NO: 644527 - RNA, 64 nt, hsa; identical to SEQ ID NO: 98853

SEQ ID NO: 644528 - RNA, 64 nt, hsa; identical to SEQ ID NO: 98854

SEQ ID NO: 644529 - RNA, 64 nt, hsa; identical to SEQ ID NO: 98855

SEQ ID NO: 644530 - RNA, 64 nt, hsa; identical to SEQ ID NO: 98856

SEQ ID NO: 644531 - RNA, 64 nt, hsa; identical to SEQ ID NO: 98857

SEQ ID NO: 644532 - RNA, 64 nt, hsa; identical to SEQ ID NO: 98858

SEQ ID NO: 644533 - RNA, 64 nt, hsa; identical to SEQ ID NO: 98859

SEQ ID NO: 644534 - RNA, 64 nt, hsa; identical to SEQ ID NO: 98860

SEQ ID NO: 644535 - RNA, 64 nt, hsa; identical to SEQ ID NO: 98861

SEQ ID NO: 644536 - RNA, 64 nt, hsa; identical to SEQ ID NO: 98862

SEQ ID NO: 644537 - RNA, 64 nt, hsa; identical to SEQ ID NO: 98863

SEQ ID NO: 644538 - RNA, 64 nt, hsa; identical to SEQ ID NO: 98864

SEQ ID NO: 644539 - RNA, 64 nt, hsa; identical to SEQ ID NO: 98865

SEQ ID NO: 644540 - RNA, 64 nt, hsa; identical to SEQ ID NO: 98866

SEQ ID NO: 644541 - RNA, 64 nt, hsa; identical to SEQ ID NO: 98867

SEQ ID NO: 644542 - RNA, 64 nt, hsa; identical to SEQ ID NO: 98868

SEQ ID NO: 644543 - RNA, 64 nt, hsa; identical to SEQ ID NO: 98869

SEQ ID NO: 644544 - RNA, 64 nt, hsa; identical to SEQ ID NO: 98870

SEQ ID NO: 644545 - RNA, 64 nt, hsa; identical to SEQ ID NO: 98871

SEQ ID NO: 644546 - RNA, 64 nt, hsa; identical to SEQ ID NO: 98872

SEQ ID NO: 644547 - RNA, 64 nt, hsa; identical to SEQ ID NO: 98873

SEQ ID NO: 644548 - RNA, 64 nt, hsa; identical to SEQ ID NO: 98874

SEQ ID NO: 644549 - RNA, 64 nt, hsa; identical to SEQ ID NO: 98875

SEQ ID NO: 644550 - RNA, 64 nt, hsa; identical to SEQ ID NO: 98876

SEQ ID NO: 644551 - RNA, 64 nt, hsa; identical to SEQ ID NO: 98877

SEQ ID NO: 644552 - RNA, 64 nt, hsa; identical to SEQ ID NO: 98878

SEQ ID NO: 644553 - RNA, 64 nt, hsa; identical to SEQ ID NO: 98879

SEQ ID NO: 644554 - RNA, 64 nt, hsa; identical to SEQ ID NO: 98880

SEQ ID NO: 644555 - RNA, 64 nt, hsa; identical to SEQ ID NO: 98881

SEQ ID NO: 644556 - RNA, 64 nt, hsa; identical to SEQ ID NO: 98882

SEQ ID NO: 644557 - RNA, 64 nt, hsa; identical to SEQ ID NO: 98883

SEQ ID NO: 644558 - RNA, 64 nt, hsa; identical to SEQ ID NO: 98884

SEQ ID NO: 644559 - RNA, 64 nt, hsa; identical to SEQ ID NO: 98885

SEQ ID NO: 644560 - RNA, 64 nt, hsa; identical to SEQ ID NO: 98886

SEQ ID NO: 644561 - RNA, 64 nt, hsa; identical to SEQ ID NO: 98887

SEQ ID NO: 644562 - RNA, 64 nt, hsa; identical to SEQ ID NO: 98888

SEQ ID NO: 644563 - RNA, 64 nt, hsa; identical to SEQ ID NO: 98889

SEQ ID NO: 644564 - RNA, 64 nt, hsa; identical to SEQ ID NO: 98890

SEQ ID NO: 644565 - RNA, 64 nt, hsa; identical to SEQ ID NO: 98891

SEQ ID NO: 644566 - RNA, 64 nt, hsa; identical to SEQ ID NO: 98892

SEQ ID NO: 644567 - RNA, 64 nt, hsa; identical to SEQ ID NO: 98893

SEQ ID NO: 644568 - RNA, 64 nt, hsa; identical to SEQ ID NO: 98894

SEQ ID NO: 644569 - RNA, 64 nt, hsa; identical to SEQ ID NO: 98895

SEQ ID NO: 644570 - RNA, 64 nt, hsa; identical to SEQ ID NO: 98896

SEQ ID NO: 644571 - RNA, 64 nt, hsa; identical to SEQ ID NO: 98897

SEQ ID NO: 644572 - RNA, 64 nt, hsa; identical to SEQ ID NO: 98898

SEQ ID NO: 644573 - RNA, 64 nt, hsa; identical to SEQ ID NO: 98899

SEQ ID NO: 644574 - RNA, 64 nt, hsa; identical to SEQ ID NO: 98900

SEQ ID NO: 644575 - RNA, 64 nt, hsa; identical to SEQ ID NO: 98901

SEQ ID NO: 644576 - RNA, 64 nt, hsa; identical to SEQ ID NO: 98902

SEQ ID NO: 644577 - RNA, 64 nt, hsa; identical to SEQ ID NO: 98903

SEQ ID NO: 644578 - RNA, 64 nt, hsa; identical to SEQ ID NO: 98904

SEQ ID NO: 644579 - RNA, 64 nt, hsa; identical to SEQ ID NO: 98905

SEQ ID NO: 644580 - RNA, 64 nt, hsa; identical to SEQ ID NO: 98906

SEQ ID NO: 644581 - RNA, 64 nt, hsa; identical to SEQ ID NO: 98907

SEQ ID NO: 644582 - RNA, 64 nt, hsa; identical to SEQ ID NO: 98908

SEQ ID NO: 644583 - RNA, 64 nt, hsa; identical to SEQ ID NO: 98909

SEQ ID NO: 644584 - RNA, 64 nt, hsa; identical to SEQ ID NO: 98910

SEQ ID NO: 644585 - RNA, 64 nt, hsa; identical to SEQ ID NO: 98911

SEQ ID NO: 644586 - RNA, 64 nt, hsa; identical to SEQ ID NO: 98912

SEQ ID NO: 644587 - RNA, 64 nt, hsa; identical to SEQ ID NO: 434057

SEQ ID NO: 644588 - RNA, 64 nt, hsa; identical to SEQ ID NO: 434058

SEQ ID NO: 644589 - RNA, 64 nt, hsa; identical to SEQ ID NO: 434059

SEQ ID NO: 644590 - RNA, 64 nt, hsa; identical to SEQ ID NO: 434060

SEQ ID NO: 644591 - RNA, 64 nt, hsa; identical to SEQ ID NO: 434061

SEQ ID NO: 644592 - RNA, 64 nt, hsa; identical to SEQ ID NO: 434062

SEQ ID NO: 644593 - RNA, 64 nt, hsa; identical to SEQ ID NO: 434063

SEQ ID NO: 644594 - RNA, 64 nt, hsa; identical to SEQ ID NO: 434064

SEQ ID NO: 644595 - RNA, 64 nt, hsa; identical to SEQ ID NO: 434065

SEQ ID NO: 644596 - RNA, 64 nt, hsa; identical to SEQ ID NO: 434066

SEQ ID NO: 644597 - RNA, 63 nt, hsa
cuggaacugggacuggucucggucugcugacgucagggucagcucccccgcggagcugacuuc

SEQ ID NO: 644598 - RNA, 63 nt, hsa
accggguccagucuggggucuagucucgagcaucagggucaggcucggggcagggcuggguua

SEQ ID NO: 644599 - RNA, 63 nt, hsa
cggggcagcuggcuguguccauggccagguggccagggucagggcugcaagccagggguccag

SEQ ID NO: 644600 - RNA, 63 nt, hsa
aauucuucaacccuugggugugugaguuugaggcagggucauuugugugauguguuuggccuu

SEQ ID NO: 644601 - RNA, 63 nt, hsa
agacggaggugccugaggguggggugggauuugcagggucauuaucagaacaugaggauaacu

SEQ ID NO: 644602 - RNA, 63 nt, hsa
aacuugagucucagggaagugaagugacuugcccagggucacucagguagaguugagauucaa

SEQ ID NO: 644603 - RNA, 63 nt, hsa
uccuacuugccauucacccaucaaugugaaagucagggucacagcuggucuguguguccaguu

SEQ ID NO: 644604 - RNA, 63 nt, hsa
aaauggugaggagggggaagagaauuacauuuccagggucagaaacuuggcaacaguuuuccu

SEQ ID NO: 644605 - RNA, 63 nt, hsa
cugcauggcugcaaugaucccacuguuagcuggcagggucaggcuuagcuccuugacugcaga

SEQ ID NO: 644606 - RNA, 63 nt, hsa
uaaccuuuaguggcagggauauaaaaaauugcucagggucacuugcagauauuuuauuuuuaa

SEQ ID NO: 644607 - RNA, 63 nt, hsa
uucuuauuuucagcacuuacaucauuugguacacagggucaaauagggcaaauaauuuugucu

SEQ ID NO: 644608 - RNA, 63 nt, hsa
ucacagcaaugcucuccuugucaaggcauggaccagggucauucagacacauucagauacugc

SEQ ID NO: 644609 - RNA, 63 nt, hsa
gcacuggcgggucucuccaugcaggccacaacacagggucaguguucaccuggugucacuucc

SEQ ID NO: 644610 - RNA, 63 nt, hsa
gcugccgcuuuggacaccaacacucccuucucccagggucaugcagggaucugcucccuccug

SEQ ID NO: 644611 - RNA, 63 nt, hsa
uccugacugggaaggacauaaaagguuuaaugucagggucaaacuacauugagccccugagga

SEQ ID NO: 644612 - RNA, 63 nt, hsa
caugcugcugauccccaccugcgcacuauagcucagggucagcaguggaaugaagggccuuag

SEQ ID NO: 644613 - RNA, 63 nt, hsa
aaggaggagcgagggaaugacggagguagggugcagggucagggcucccgcaggggccugcau

SEQ ID NO: 644614 - RNA, 63 nt, hsa
gagcguaggauuuguugcauuaugcuagagcaccagggucagggugcaaggaagaggcuuaag

SEQ ID NO: 644615 - RNA, 63 nt, hsa
gucccagccagggcagggagggaccauggcccgcagggucaaggggccccgaugugcacagcu

SEQ ID NO: 644616 - RNA, 63 nt, hsa
ucccucuagccuguggacaccagcugggggauccagggucaggcccccuccucuccccaguuu

SEQ ID NO: 644617 - RNA, 63 nt, hsa
ccuuagaagaagugggaagaagaaggagcucuacagggucagcuuuguuugauuuguccaguc

SEQ ID NO: 644618 - RNA, 63 nt, hsa
uauuacuuucaucacgacugauccccaccuccucagggucaaagggcuacuuucuggaagucu

SEQ ID NO: 644619 - RNA, 63 nt, hsa
aagcuggucuuaaggguugggcuugggaauaggcagggucagauuccagggcauggcucugga

SEQ ID NO: 644620 - RNA, 63 nt, hsa
uagccagguaggcgagacacaaaaggccugggacagggucaguacaagucaggucaggcuuca

SEQ ID NO: 644621 - RNA, 63 nt, hsa
uagucuacauggaccaguagggacaaccuguaccagggucacagccuggcacaggcuacaggg

SEQ ID NO: 644622 - RNA, 63 nt, hsa
uggaguuccgcuuuuccaacugccccagguagucagggucagggaccuuggacuugucucuua

SEQ ID NO: 644623 - RNA, 63 nt, hsa
ccugaggcuuggcccagcucuaggagcaguccccagggucagggagccccugguguggaaaga

SEQ ID NO: 644624 - RNA, 63 nt, hsa
aaugauguuugaagugaaaaaaaaaaggauauucagggucaaaucauguacauuacagauauu

SEQ ID NO: 644625 - RNA, 63 nt, hsa
guaugauagauggggccuggacacccaucucaacagggucacuugguaauuaacaauagccau

SEQ ID NO: 644626 - RNA, 63 nt, hsa
gagaugguggaaucuucccuguuuuuauccccucagggucaguuacauagaagcugcuucuug

SEQ ID NO: 644627 - RNA, 63 nt, hsa
gaagcaaggccuggaguggccugcaccgaguagcagggucaggguucgugugcuccuccuccu

SEQ ID NO: 644628 - RNA, 63 nt, hsa
caccuagagagcuuggcuguuuccaaaaacaaucagggucauaaccauccaugcagacaugga

SEQ ID NO: 644629 - RNA, 63 nt, hsa
aaugacuugaaaaaaagucacauccagcaaaugcagggucacaugaaauaugggccuccugga

SEQ ID NO: 644630 - RNA, 63 nt, hsa
aaaugcuuugaaggaauaaacgaaauguuaaaacagggucaauccauuugaagaaaaaguugg

SEQ ID NO: 644631 - RNA, 63 nt, hsa
aggcggcugucugagggcuguccccgccuaggacagggucaaucgaggaaugccagaugugca

SEQ ID NO: 644632 - RNA, 63 nt, hsa
uauccuccucacaccguguauuucccacccacucagggucacagccuacuaauuccucaaacu

SEQ ID NO: 644633 - RNA, 63 nt, hsa
cugaggugggaggaucuuuugaacccaggaguucagggucauagcaugcugugauugugccua

SEQ ID NO: 644634 - RNA, 63 nt, hsa
ggggccaaacuggagcccagauggguuaauuuccagggucagacauuacggucucuccucccc

SEQ ID NO: 644635 - RNA, 63 nt, hsa
agacucaggggcuccaccaaugccaucccaaaacagggucagacacugcccagcuucccucca

SEQ ID NO: 644636 - RNA, 63 nt, hsa
guguuuucccuuuucuuucuggggccaggaagucagggucaacucccaggccucagaugcagg

SEQ ID NO: 644637 - RNA, 63 nt, hsa
aaaaaaaaaauauuuuuagcagaacaggacuuacagggucauuguccccacaaugugccaguc

SEQ ID NO: 644638 - RNA, 63 nt, hsa
ggaccuaucgaugucuauuugugugaaguggagcagggucagaccaguaacaaaaggucugaa

SEQ ID NO: 644639 - RNA, 63 nt, hsa
gacaucggugugaagggaagggacugggcccugcagggucagaaccuccccacccccagggga

SEQ ID NO: 644640 - RNA, 63 nt, hsa
gucaguaauuucugcuuuuuagcagggccagugcagggucaguuaaugcuacaguuacuguau

SEQ ID NO: 644641 - RNA, 63 nt, hsa
auggucuuccauccccagcaagggggugcagcccagggucaggcccuucagagccagggcaga

SEQ ID NO: 644642 - RNA, 63 nt, hsa
ggagccguggucccgaguucccugggaggcugacagggucaagccacccugcccaccacccuc

SEQ ID NO: 644643 - RNA, 60 nt, hsa
gcaggaccagcaucaucugagaggcuggagcagggucacccacggacagagaccaagaga

SEQ ID NO: 644644 - RNA, 63 nt, hsa
aaacugaaucaccuagaaguggaauaaugugcucagggucaccauagcccauuaguggaagga

SEQ ID NO: 644645 - RNA, 63 nt, hsa
cacacuggaguguggaggggucgaugacuugugcagggucauaugguaccuaaggggcagauc

SEQ ID NO: 644646 - RNA, 63 nt, hsa
caguauuuuaacacccacauuaguauaugcguccagggucauaacccccuaaaauccaucaug

SEQ ID NO: 644647 - RNA, 63 nt, hsa
ccaugucuuccaggagacuagacuacuguuguccagggucaauuugaguguaaagaaaaugua

SEQ ID NO: 644648 - RNA, 63 nt, hsa
ggugugacugcucugacaaccuguggcaugcugcagggucaggcuccugauaggaggauuuca

SEQ ID NO: 644649 - RNA, 63 nt, hsa
agaauaugcucacugcuaagcuacaaacucggacagggucagaaacagaggugucccauccca

SEQ ID NO: 644650 - RNA, 63 nt, hsa
gccacaaauuccaggccuaguucagucugggggcagggucaguccuucucccaggccagcccu

SEQ ID NO: 644651 - RNA, 63 nt, hsa
gccagacccacaaggccagguccugugcuaucacagggucaccucuuuuacaguuagaaacac

SEQ ID NO: 644652 - RNA, 63 nt, hsa
uuugugccaguauucaagugguauagcucugagcagggucacauuuggccaaaccugacacug

SEQ ID NO: 644653 - RNA, 63 nt, hsa
cacugucuugcugcauucuccuuuggcaaacaucagggucagaauucaggauagcccuuccua

SEQ ID NO: 644654 - RNA, 63 nt, hsa
cugaaaugugcucaggcccuggccaggagggcccagggucauucuuuuaacaaaaggauuauu

SEQ ID NO: 644655 - RNA, 63 nt, hsa
gggagacagccucugggauuggaggccagaggccagggucagacccagccaggacuccucauu

SEQ ID NO: 644656 - RNA, 63 nt, hsa
ccuagggaaaaaauuuaaggagguauucacacucagggucaugcacuugcacaauguugagaa

SEQ ID NO: 644657 - RNA, 63 nt, hsa
auauuaaaaauuagcaaacaaaagugacuugcucagggucaugcagcugggugaugauagaag

SEQ ID NO: 644658 - RNA, 63 nt, hsa
ucuaccccugcuaaggaguucucaucccucugucagggucaguaaggaaaacgguggccuagg

SEQ ID NO: 644659 - RNA, 63 nt, hsa
uguuucuuggggaaggagaggagggaaaaggaccagggucaagggggaccagagguugaccac

SEQ ID NO: 644660 - RNA, 63 nt, hsa
caucccuccaucuucuccuccauuaucaucuagcagggucagacugggaaaccugguuggcca

SEQ ID NO: 644661 - RNA, 63 nt, hsa
gccucaguggggucgccguaccaggggcccuggcagggucagcugcaagaacaucaaaccaga

SEQ ID NO: 644662 - RNA, 63 nt, hsa
cacuugucuguucuucagugcuggagguccuggcagggucaggcugggguaagccgggguucc

SEQ ID NO: 644663 - RNA, 63 nt, hsa
gaauucugaagccauugucuccuugaguaccaacagggucagggaagacugggccuccugaau

SEQ ID NO: 644664 - RNA, 63 nt, hsa
uuuaaauaugccuuuaaaauaagucacuguugacagggucaugaguuuccgaguauaguuuuc

SEQ ID NO: 644665 - RNA, 63 nt, hsa
ucuaaaauucagagcauaucaucugggcuaccucagggucaccacccauguauugggcuuagu

SEQ ID NO: 644666 - RNA, 63 nt, hsa
cuuuuaacauagagaacugucacccugagguaacagggucaacuggcgaagccugagcaggca

SEQ ID NO: 644667 - RNA, 63 nt, hsa
uuaaagcccaggccccacuuacguaaaacauuucagggucacuggaaacagugaagugccauu

SEQ ID NO: 644668 - RNA, 63 nt, hsa
gaagugaaaaucuuggagacccugcaaacagaacagggucauguuugcaggggugacggcccu

SEQ ID NO: 644669 - RNA, 63 nt, hsa
uguuuuuguguagaguggcgauugaaugcugcccagggucaguguaucuaauuccccgagacc

SEQ ID NO: 644670 - RNA, 63 nt, hsa
cugcugcaguaaauauuuugcaugaugaaauuccagggucacacuuuuccaaguuuaucagug

SEQ ID NO: 644671 - RNA, 63 nt, hsa
aggcagcuucaugaugugcaggcaguagccagacagggucaugggaagggggcccugugcuuc

SEQ ID NO: 644672 - RNA, 63 nt, hsa
cggaaaaaaaccaugcugauacagcuggcuauucagggucacccagcaguccuccagcaaggu

SEQ ID NO: 644673 - RNA, 63 nt, hsa
ugaucucagggcucaguggcaggaaauccucaacagggucaccaaccagcccgcucaaugcag

SEQ ID NO: 644674 - RNA, 63 nt, hsa
gcuaagggauaaacaaaagcaaugccuagacaucagggucagggccuggucuggugaaguaug

SEQ ID NO: 644675 - RNA, 63 nt, hsa
caagacugcugagcagaaugccuuauaaaccugcagggucacucaucuaaagucuagugaccu

SEQ ID NO: 644676 - RNA, 63 nt, hsa
gaagaacgugcuucuuaggucauaacgcuuuugcagggucaaugguguugagccgcucauagc

SEQ ID NO: 644677 - RNA, 63 nt, hsa
uauucuugguucuuugcaauucuaugaauauuucagggucagcaugucaacuccauugaaaaa

SEQ ID NO: 644678 - RNA, 63 nt, hsa
caccuucuggagccagcucaucagcucagagcccagggucaggaguucguucaguaacgcagc

SEQ ID NO: 644679 - RNA, 63 nt, hsa
uugauccuagggugcuccuuuuguuuuacagagcagggucacuugauuugcuagcugguggca

SEQ ID NO: 644680 - RNA, 63 nt, hsa
uuccccugugaugagcagaugaccaccgcccuccagggucagcguuuggcuguuugugugccu

SEQ ID NO: 644681 - RNA, 63 nt, hsa
ugauccaggcgcuggagggauggccuaggacaccagggucacaccaggaacaugggagggccg

SEQ ID NO: 644682 - RNA, 63 nt, hsa
ucuggcucugggagccccuaucucaggaauuuucagggucauuugugacuuuucauuucuuaa

SEQ ID NO: 644683 - RNA, 63 nt, hsa
aacuauacuauauagagaaucuuaagugauaaccagggucacggauuccaaacaugucauuau

SEQ ID NO: 644684 - RNA, 63 nt, hsa
ccaacccugcauucaaguguaacagcauucugucagggucacuuugaauugugcacauaagaa

SEQ ID NO: 644685 - RNA, 63 nt, hsa
aauaguguuggaacugaggaggaagccauagcucagggucaucaagaaaaauaauagacaaaa

SEQ ID NO: 644686 - RNA, 63 nt, hsa
ugggguccuggggccucggagccucauccgaggcagggucaggagaggggcagaacagccgcu

SEQ ID NO: 644687 - RNA, 63 nt, hsa
gacaggccugaacucuagagggaacuugaaauccagggucaaagguuaaggggcagcagcugg

SEQ ID NO: 644688 - RNA, 63 nt, hsa
guggagggcuguaggggagggccagugcccagacagggucauggggcucagaccagcccacug

SEQ ID NO: 644689 - RNA, 63 nt, hsa
gagcaaauuucucuuucuagaaggggagggucacagggucacagauucaccaaagcugaaagg

SEQ ID NO: 644690 - RNA, 63 nt, hsa
accucucaucaccccaccuucaucaucaugcuccagggucacccuggccagcucuugugcugg

SEQ ID NO: 644691 - RNA, 63 nt, hsa
uucuucuuucuuuuaagcagacccauaccuuuccagggucaaaguacagaauagaauacauug

SEQ ID NO: 644692 - RNA, 63 nt, hsa
ucuacaguauuuuggaaggucugaaaacuugcacagggucaucuuuguaauuauauaacccca

SEQ ID NO: 644693 - RNA, 63 nt, hsa
cccuggcuccaugacccaccccacucuggaugccagggucacugggguugggcuggggagagg

SEQ ID NO: 644694 - RNA, 63 nt, hsa
aggacaugcuccauuuauuuuccauggaagacacagggucagagaucugucagaggaaaaugg

SEQ ID NO: 644695 - RNA, 63 nt, hsa
cuucgcuccugccugcauuuccagagcuggugccagggucagcccagcgaggagucccugcaa

SEQ ID NO: 644696 - RNA, 63 nt, hsa
aaacaaaauaggugaggggauagcgaaugcacucagggucagcaguggaguuuaaaaauuguc

SEQ ID NO: 644697 - RNA, 63 nt, hsa
uauaaaagaguucaaacuauugcccauguuccccagggucagaaguucuaauuaugaugauag

SEQ ID NO: 644698 - RNA, 63 nt, hsa
acagguugggaugugggaaugacuggggugaggcagggucaagugcuacgggccuccuucccg

SEQ ID NO: 644699 - RNA, 63 nt, hsa
gggacuagaagagcugcaugaugguggcugagacagggucaccuugggaaggcuugggagcca

SEQ ID NO: 644700 - RNA, 63 nt, hsa
agaauaaacugcagacugaaagaaacaugccugcagggucaggaacugggccacuguucccag

SEQ ID NO: 644701 - RNA, 63 nt, hsa
gcauuauaaaaugaagagacagacaugauuacucagggucagcaaccuagugaguuagaaaaa

SEQ ID NO: 644702 - RNA, 63 nt, hsa
gcaguccuuugcauuugccaauucaagguaaaacagggucagugacaucugcagugucccagu

SEQ ID NO: 644703 - RNA, 63 nt, hsa
aucuuguaaucauagcaaaaagucugcaaaccccagggucaagccugcucugccacaggguug

SEQ ID NO: 644704 - RNA, 63 nt, hsa
aauggcagucggaggcgcaggacaccaugaagacagggucaucgaccaacaacaacgaggagg

SEQ ID NO: 644705 - RNA, 60 nt, hsa
acucugauaccuccaacugaucuugccccucagggucacaggggugggggcucucacaag

SEQ ID NO: 644706 - RNA, 63 nt, hsa
gggagagggggcguguugaacauccugcagucacagggucaggggucaggugguuguagucug

SEQ ID NO: 644707 - RNA, 63 nt, hsa
gagagccagggauauggauccagggugcuguugcagggucaccugccuguuaccacaccccca

SEQ ID NO: 644708 - RNA, 63 nt, hsa
cugaggcauuuuguggccuuaaaacgggguguucagggucagcccucagggugcuggggcccu

SEQ ID NO: 644709 - RNA, 63 nt, hsa
gcugugaccaggcagcuaagagccucugggcugcagggucagccucucccaagacugaagugc

SEQ ID NO: 644710 - RNA, 63 nt, hsa
aagcuacaguuuuuagcuggugcgggccacaggcagggucagauugagaagaagcaaagcugg

SEQ ID NO: 644711 - RNA, 63 nt, hsa
uccucccugugcugcucugagguggagccuucucagggucaguccagcucuggagccccucuc

SEQ ID NO: 644712 - RNA, 63 nt, hsa
ccaggcagcugccaagcacucccucccuggcuucagggucagagugcccagcguuuaucagag

SEQ ID NO: 644713 - RNA, 63 nt, hsa
gucaagaaaacaagauggcaacauauaugcuuucagggucaaauuugagcaaacuguaaacug

SEQ ID NO: 644714 - RNA, 63 nt, hsa
acgacuucugcccauucucuccaguguguguaacagggucacaagaauucgacagccagaugc

SEQ ID NO: 644715 - RNA, 63 nt, hsa
acugguggugauaagaggagccgucuggugugucagggucacgaacccguuacauuucaggac

SEQ ID NO: 644716 - RNA, 63 nt, hsa
cccugaggacucccacccucacccccacccccacagggucagcaacugcuuccgguuacaccc

SEQ ID NO: 644717 - RNA, 63 nt, hsa
agcggccccggcuccagcccagccagcacucugcagggucacacgcaccguguccccacccag

SEQ ID NO: 644718 - RNA, 63 nt, hsa
caggagcuacuuugaguuugguguuacuaggaucagggucagucuuuggcuuaucaauaaauu

SEQ ID NO: 644719 - RNA, 63 nt, hsa
gccgucuagaagcgaugcuuuaguggccuaacccagggucaaauacagcucuuucuagcaaaa

SEQ ID NO: 644720 - RNA, 63 nt, hsa
cagcacugcggggugcgacuagggcugcgcugccagggucacuucccgccuccuccuuuugcc

SEQ ID NO: 644721 - RNA, 63 nt, hsa
gaccucaucuuccugagggcucugucuugccugcagggucauagcucagacucuucccccacc

SEQ ID NO: 644722 - RNA, 63 nt, hsa
aucugcucuguggaaagaaagaacugucucuaccagggucaagagcaugaacgcaucaauaga

SEQ ID NO: 644723 - RNA, 63 nt, hsa
ggccagacacagucacccaguuuuuguucauaccagggucaugcguugagcuacugacaaacu

SEQ ID NO: 644724 - RNA, 63 nt, hsa
cggcaggauuaugcgaucacggaucagucagagcagggucaggagacggggcugacggcacgg

SEQ ID NO: 644725 - RNA, 63 nt, hsa
cugaccaagugcuggcccacccaguccaugcuccagggucaggcggagcugcugagugacagc

SEQ ID NO: 644726 - RNA, 63 nt, hsa
uuaugguuuauggccucgauucugcaaaccuaacagggucacauauguucucuaaugcagucc

SEQ ID NO: 644727 - RNA, 63 nt, hsa
ucaagagcuccucugcuccucgcuugaaugauucagggucagggagguggcucagaguccacc

SEQ ID NO: 644728 - RNA, 63 nt, hsa
uuuuucucccuaaccccagaugcaaugcgaucacagggucauuaccaucucuuuauuaauugu

SEQ ID NO: 644729 - RNA, 63 nt, hsa
gcacggaauaagcacauaguaaaaagggaacaucagggucaaauggaaaucaccugagacagg

SEQ ID NO: 644730 - RNA, 63 nt, hsa
aggccagccugcuugggcgcucggucuccaccccagggucauaaguggggagagagcccuucc

SEQ ID NO: 644731 - RNA, 63 nt, hsa
cccagacuggcuggaaaccauguuuucagagugcagggucaaguggcguguaggacucuguca

SEQ ID NO: 644732 - RNA, 60 nt, hsa
accuggagcuguuugagugacagccuccaucagggucauccuacagccuccaagcgggcu

SEQ ID NO: 644733 - RNA, 63 nt, hsa
ccgcucuacuacaucuaggacgccuccggugagcagggucaguggaagccccaacgggaaagg

SEQ ID NO: 644734 - RNA, 63 nt, hsa
caaugcccacccgcaucgccauucuguagucuucagggucagcuguugauaaaggggcaggcu

SEQ ID NO: 644735 - RNA, 63 nt, hsa
cagguacuccaaauugacuuugcagcaggguggcagggucaggagagucugguccugccuagc

SEQ ID NO: 644736 - RNA, 63 nt, hsa
gugcaacagcagaaagaugcuugcaagcagagucagggucaccagugaaugccacaaaaguuc

SEQ ID NO: 644737 - RNA, 63 nt, hsa
cgacuaaccuaucuaugaacaacaguaguuucucagggucacuguccuugaacccaacagucc

SEQ ID NO: 644738 - RNA, 55 nt, hsa
augaccucucuguacucuaggaacccagggucacccagaugucccuuugauggcc

SEQ ID NO: 644739 - RNA, 63 nt, hsa
acuuaaucuuuuaagcaagcaaaaauuuauucucagggucagcuguacacuuuauugaccagu

SEQ ID NO: 644740 - RNA, 63 nt, hsa
acugcuugguccaagccuggcccuggcacuugucagggucagccuaaggagaugggaauaaag

SEQ ID NO: 644741 - RNA, 63 nt, hsa
acuccugagauccagaccacgagaagugaccuucagggucaucaggcugucccagagaggucc

SEQ ID NO: 644742 - RNA, 63 nt, hsa
augguaggaaauauagagagcaaguucuucugccagggucacacuguggucucugaacugacc

SEQ ID NO: 644743 - RNA, 63 nt, hsa
ggucagguggcagcuauuccccaccaagagauucagggucacagguuuuuccccacaccucug

SEQ ID NO: 644744 - RNA, 63 nt, hsa
cucaguuccaggccugaucuugccugucuggcucagggucaaagacagaaugguggaguguag

SEQ ID NO: 644745 - RNA, 63 nt, hsa
uuccagcgaagaccacaggcauuccuuaggguccagggucagcaggcuccgggcucacaugug

SEQ ID NO: 644746 - RNA, 63 nt, hsa
cccacggcuuguggcugcccuuggcuggaaguccagggucauacgacgccauugccagaauga

SEQ ID NO: 644747 - RNA, 63 nt, hsa
cuugccuguccccuaaaacuugacuguggcacucagggucaaacagacuauccauuccccagc

SEQ ID NO: 644748 - RNA, 63 nt, hsa
gcaccucuuugagccuuggcugccuuggugcagcagggucaucuguagggccaccccacagcu

SEQ ID NO: 644749 - RNA, 63 nt, hsa
uuauauuguccuaugcuucgagccaugggucuacagggucauccuuaugagacucuuaaauau

SEQ ID NO: 644750 - RNA, 63 nt, hsa
gagaccuggacacaggccugcucucuuuuucuccagggucagaaacaggaccggguggaaggg

SEQ ID NO: 644751 - RNA, 63 nt, hsa
aaccaugugguaaguggccaaccaagcccuacccagggucacccaacacacucugccuugagc

SEQ ID NO: 644752 - RNA, 63 nt, hsa
aagguuggagcaagcaaaguccuucucugcccucagggucagcugcccagacuggggcggaug

SEQ ID NO: 644753 - RNA, 63 nt, hsa
cuuucccgggccugaaagcuuccccgagguuugcagggucagggaggaggaacggugggggug

SEQ ID NO: 644754 - RNA, 63 nt, hsa
cugcccuggcaugagcagagcccaggauggggucagggucaggcccugccagaggcuggaggg

SEQ ID NO: 644755 - RNA, 63 nt, hsa
gaacuaggccaggccugacuggggucugaagaucagggucaguguggcugugccugggaauuc

SEQ ID NO: 644756 - RNA, 63 nt, hsa
guccaggcagcucccuccugcacacagaaugcucagggucacugaaccacugcuucucuuuug

SEQ ID NO: 644757 - RNA, 63 nt, hsa
ugcggccugugccagagaggcugccuguacagccagggucaguuuggccccaaacagggauuc

SEQ ID NO: 644758 - RNA, 63 nt, hsa
gugguuuugugcuucugguuuccuggccaaccccagggucacuugucuggaggcccagcuggg

SEQ ID NO: 644759 - RNA, 63 nt, hsa
cggucugaggaagggaacagaaggucaugaguucagggucagacgcagccgcucagcacagga

SEQ ID NO: 644760 - RNA, 63 nt, hsa
ucauggggugagcccaggcccugccacaaccuacagggucacucaguaugccaaccuccuggc

SEQ ID NO: 644761 - RNA, 63 nt, hsa
ucccuggggagguagaggcacgggauaaggggccagggucagagguccagccucuauacccgu

SEQ ID NO: 644762 - RNA, 63 nt, hsa
cagcuucuggcucaagaguugaaggugccaucgcagggucaggccugcccugucccgaaguga

SEQ ID NO: 644763 - RNA, 63 nt, hsa
ccacuuacgcuucaaguuucauuuauugaauaccagggucauaucuuagaauuguauauaaaa

SEQ ID NO: 644764 - RNA, 63 nt, hsa
uaaaauuuccccuuuuuuucauaaaaaucuggucagggucauuuauauauuagaacaguuaga

SEQ ID NO: 644765 - RNA, 63 nt, hsa
cagagacggggacagcccagucugcugaccucacagggucagcugggccccccuggugcuuca

SEQ ID NO: 644766 - RNA, 63 nt, hsa
ccucuugucauuuuggccugaaggcuacaaauucagggucagcuguaugcacuaagucaaaua

SEQ ID NO: 644767 - RNA, 63 nt, hsa
cacaagggaaccaugcuucucuuagagguuaagcagggucauuaacauccucccccagucccu

SEQ ID NO: 644768 - RNA, 63 nt, hsa
aagggcccccagucuuuuggaauguccuggucacagggucaugucagcugccaguucucgucu

SEQ ID NO: 644769 - RNA, 63 nt, hsa
cugcgggcccacgugguuggggcccugcccuggcagggucauccugugcucggaggccaucuc

SEQ ID NO: 644770 - RNA, 63 nt, hsa
cagagcaggaggauucuacgaagccuuggggaucagggucagugugagcagcuaacauccuac

SEQ ID NO: 644771 - RNA, 63 nt, hsa
caguacacugucagcagggacuguaaacacagacagggucaaaguguuuucucugaacacauu

SEQ ID NO: 644772 - RNA, 63 nt, hsa
ugagccacacacuucuccccccagacagggacacagggucacugagcuuuguguccccaggaa

SEQ ID NO: 644773 - RNA, 63 nt, hsa
auuggucuuuauuuccaguagaugggcaguaaacagggucaggguggucaagggauaugauua

SEQ ID NO: 644774 - RNA, 63 nt, hsa
ucuugguccuguguuuuuucugccaccaaaggccagggucacugaaggccuggcccacagcag

SEQ ID NO: 644775 - RNA, 63 nt, hsa
ccauagccacaccaaggcuucugggagauucugcagggucagcuuuccaggcuguucccaaau

SEQ ID NO: 644776 - RNA, 63 nt, hsa
gagcgugggaggggacaaacauucaaaccauagcagggucauaggccccaagaaggcuuccag

SEQ ID NO: 644777 - RNA, 63 nt, hsa
cauaggccauguggggaguggcugccccugccucagggucauucuccugccaugcgagggcac

SEQ ID NO: 644778 - RNA, 63 nt, hsa
uaggugaaagucuagagaaagaggcuaccugcccagggucacagcaaggcugggaccauggca

SEQ ID NO: 644779 - RNA, 63 nt, hsa
gcacguguucacacacccuccuguguacccccccagggucaccgaaguccccacacgcuggcu

SEQ ID NO: 644780 - RNA, 63 nt, hsa
cauuuuacaguuuauauuccagcacucaaaacucagggucaaguuuuaacaaaagagguaugu

SEQ ID NO: 644781 - RNA, 63 nt, hsa
gaagacuuuggaaauuuccuuucucuuuuaggacagggucaggauuuaggacucauagccuga

SEQ ID NO: 644782 - RNA, 63 nt, hsa
gugcuggugaggguucgccagcccuccccuccccagggucauagagggggccaugaggcugga

SEQ ID NO: 644783 - RNA, 63 nt, hsa
agggagaaacagcagggaagaggggcaauacaacagggucaagggugcagaggccaggcagag

SEQ ID NO: 644784 - RNA, 63 nt, hsa
ccuggcagcucucacuacggccaaccaggacggcagggucauccugagccgccaagguaauca

SEQ ID NO: 644785 - RNA, 63 nt, hsa
caggcuguuggacgcagccuggguggcagagggcagggucaucacccucuagcaucagugccu

SEQ ID NO: 644786 - RNA, 63 nt, hsa
ugaauuuucaucuaguuccccaaucgaugcucucagggucaucucggggaucacagggauccu

SEQ ID NO: 644787 - RNA, 63 nt, hsa
caacaagaaaugaacuugcccaaggucaucugccagggucagugcugagacuguugaagcucu

SEQ ID NO: 644788 - RNA, 63 nt, hsa
agugguggggccauggacccaugcgggggguuccagggucacacgccacauaacagacaaaaa

SEQ ID NO: 644789 - RNA, 63 nt, hsa
uuaacaugagaaggcgccaacagcacacagggucagggucacuucuagaaauagcccaccaag

SEQ ID NO: 644790 - RNA, 63 nt, hsa
agugguuuaacaugagaaggcgccaacagcacacagggucagggucacuucuagaaauagccc

SEQ ID NO: 644791 - RNA, 63 nt, hsa
augcaaaauagugccagaucuuuaacuguauaucagggucaguuuuuguucaugcccaaauca

SEQ ID NO: 644792 - RNA, 63 nt, hsa
ucuccagcagcugaggaaagaagggacacggaacagggucacccaggaggguggaugccaggu

SEQ ID NO: 644793 - RNA, 63 nt, hsa
gaggggggguggcagguaccacaguguaggcagcagggucagggccaaagucuaugcguucca

SEQ ID NO: 644794 - RNA, 63 nt, hsa
aguggggaucugaucccaaagauggggugaccccagggucagggaggcugcccccaggccugu

SEQ ID NO: 644795 - RNA, 63 nt, hsa
gaacuugugccccagaaagggcaguuacccggccagggucacaucaaccgccagaaguggagu

SEQ ID NO: 644796 - RNA, 63 nt, hsa
guuuugacacgccccagugcccuggagaacaaccagggucaucugcacuugaugacugcuccc

SEQ ID NO: 644797 - RNA, 63 nt, hsa
aguuuagcauggcuaggucuggaacuauaauagcagggucagacuguggguuccucuucuccu

SEQ ID NO: 644798 - RNA, 63 nt, hsa
uguggccacggcaggcccgcucucucaggcccucagggucaaggccuugguuggaccugccca

SEQ ID NO: 644799 - RNA, 63 nt, hsa
aaggcagugaaguugggaguacugcuuacaaaacagggucaccagugcauuauguggcguguu

SEQ ID NO: 644800 - RNA, 63 nt, hsa
augucauaacaggcauugccaaccucacugacacagggucauaguguauaauaauauacugua

SEQ ID NO: 644801 - RNA, 63 nt, hsa
acuuaacuguuuaccuauaaaccccauacaaagcagggucauaauuugugaucugugguggau

SEQ ID NO: 644802 - RNA, 63 nt, hsa
caaauugugacagagcugagugcuccuaucuuacagggucaaugaacuacuuauuaagccuua

SEQ ID NO: 644803 - RNA, 63 nt, hsa
cauuuuaaagaagguucuuauuguguuguggaucagggucacagauuggguagcuuggacacc

SEQ ID NO: 644804 - RNA, 63 nt, hsa
ggcauaaccuacauccuucucugauuucuucagcagggucaaaagacaguuacuagcaauggg

SEQ ID NO: 644805 - RNA, 63 nt, hsa
ggaagcuaaggccuagaagguuaaggauguccccagggucacacagugagcggggcucagagc

SEQ ID NO: 644806 - RNA, 63 nt, hsa
agaggauggcuugagcccaagaggcagagguugcagggucaagaucgcaccacuugcacugca

SEQ ID NO: 644807 - RNA, 63 nt, hsa
uuauuguaguauuuauauuacaaaguuggcauacagggucaauaucuaauuuacuguuguguu

SEQ ID NO: 644808 - RNA, 63 nt, hsa
ucugccaggcaugcuguggaagggauuucuguacagggucauucuaggugagcuuacacauuc

SEQ ID NO: 644809 - RNA, 63 nt, hsa
uuuucccuccucugaagcucccaacaacucugacagggucagaucucuuuaaagcaucuucag

SEQ ID NO: 644810 - RNA, 63 nt, hsa
ccuucucaaggcaguguuccuggaggcucccaucagggucagcccaugcaccugcccugggug

SEQ ID NO: 644811 - RNA, 63 nt, hsa
uggagccagacagccaagccccuuccacaucuacagggucacugucauccucaccacagccag

SEQ ID NO: 644812 - RNA, 63 nt, hsa
aauuuguaugcucuuagagcccaacagccaaggcagggucaagaagauaaguaauaaaagagg

SEQ ID NO: 644813 - RNA, 63 nt, hsa
ucugggagcugggcuaacaggcugacacuucggcagggucaccaggaggcacagcuaggggca

SEQ ID NO: 644814 - RNA, 63 nt, hsa
cccccauuuccuaacucccccagugugaauucucagggucacuucugccuccucccguuuccc

SEQ ID NO: 644815 - RNA, 63 nt, hsa
guaagggaggcuaaguggguaacagcccagcaucagggucacuguggcaacagcaggcucuag

SEQ ID NO: 644816 - RNA, 63 nt, hsa
uguacccggccccgagauccucugcuguaacugcagggucacaggcaucccgggagaaugggc

SEQ ID NO: 644817 - RNA, 63 nt, hsa
ccaaaacaaggacaaaucuuguuguauuaacagcagggucacuucucauuuucuuugcugacu

SEQ ID NO: 644818 - RNA, 63 nt, hsa
agaaaugccugggaggaagggaagccugauauucagggucaaaacagcccuucuaauucacaa

SEQ ID NO: 644819 - RNA, 63 nt, hsa
ccuggcacuuugauuuucaugggaugguccuaacagggucagucaccuccgagcaguuuggga

SEQ ID NO: 644820 - RNA, 63 nt, hsa
cugggccagcuucuggagcaugagaaccugagccagggucacccuuguggggccuggacauga

SEQ ID NO: 644821 - RNA, 63 nt, hsa
cuaccuggcuuccugcaaggccuucacgccugccagggucagcugcagcccccacucugccaa

SEQ ID NO: 644822 - RNA, 63 nt, hsa
caguggacagaagggauuauccucagccagucgcagggucagcuuaaguuaguuagaucacuc

SEQ ID NO: 644823 - RNA, 63 nt, hsa
uccaggccaaguagagccccgcagggccuccagcagggucagccauucacacccauccacuca

SEQ ID NO: 644824 - RNA, 63 nt, hsa
agugucauccagggccugugucccucccgaacccagggucaaccugccuaccacaggcacuag

SEQ ID NO: 644825 - RNA, 63 nt, hsa
cacugaaggccagcagacaggccuaggcuggggcagggucacggcuggccuuuaccugcucag

SEQ ID NO: 644826 - RNA, 63 nt, hsa
caggccacgugugacuucuguucuuagcacugccagggucauugacuuccaucuaagcuugca

SEQ ID NO: 644827 - RNA, 63 nt, hsa
gguggagucugcagaguggacccagccaagggucagggucagcacugggucagcgacuccaau

SEQ ID NO: 644828 - RNA, 63 nt, hsa
cagggauacgcccaacaccauggccugcaaccccagggucaagggugaaggaaagcaagcuca

SEQ ID NO: 644829 - RNA, 63 nt, hsa
cucuuaggggucauccagcugggccuaggggugcagggucagugcugaggccugggcagggcc

SEQ ID NO: 644830 - RNA, 63 nt, hsa
cucuggggcugaagccgccgcugggucacagagcagggucacccugcaagccugaagcugggg

SEQ ID NO: 644831 - RNA, 63 nt, hsa
auagauguuuuuuaaguuuucuuuuuuucccuacagggucacccucaggaucucuccaagaaa

SEQ ID NO: 644832 - RNA, 63 nt, hsa
gcugaggggcuguucaccaccauccucguucuccagggucaaggaaguguuuuaacaugucgu

SEQ ID NO: 644833 - RNA, 63 nt, hsa
gcaaaggagaagcacagcuccugccagggugagcagggucaagccucuuauuccaggagaagg

SEQ ID NO: 644834 - RNA, 63 nt, hsa
acaaauacacguauguuauaaccaucagcccgccagggucagggaaaggacucaccugacuuu

SEQ ID NO: 644835 - RNA, 63 nt, hsa
uuuccagcauacccugccccuggaugggaaaggcagggucagggcccacugagacccaugcag

SEQ ID NO: 644836 - RNA, 63 nt, hsa
aaaaaaaaagaaggaaaaggaauuauagacccccagggucagccaguuaagagcucuacccac

SEQ ID NO: 644837 - RNA, 63 nt, hsa
uagccccucuccaccucaccccauguugaugcccagggucacucuugcuacccgcugggcccc

SEQ ID NO: 644838 - RNA, 63 nt, hsa
ggcucuggccuucucaugcagagagguccgggacagggucaguaucgugggcauguguauagc

SEQ ID NO: 644839 - RNA, 63 nt, hsa
gccccuucagaccagcugcuuccaucagaauuccagggucacagccccaacagaagcagcagu

SEQ ID NO: 644840 - RNA, 63 nt, hsa
ugcugaccgaaugcucauagagguugacccccacagggucacgcaggacucggacacugcccu

SEQ ID NO: 644841 - RNA, 63 nt, hsa
ccaaccuccaggagcuaguggagggguguguaacagggucauacccccucccucuuguccacc

SEQ ID NO: 644842 - RNA, 63 nt, hsa
augaucuggauccaccaagacuuguuuuaugcucagggucaauuucuuuuuucuuuuuuuuuu

SEQ ID NO: 644843 - RNA, 63 nt, hsa
cugccucugcuuucuccugcaucccaugcuaagcagggucauggucugaacuacucagauugg

SEQ ID NO: 644844 - RNA, 63 nt, hsa
cucuaugagugggccccuagugucagcucuguacagggucagaucccagguucuaugaccaaa

SEQ ID NO: 644845 - RNA, 63 nt, hsa
ucgcaggaaauagauuguucuaaucuuugaaaucagggucaauuacagauagcuauaauaaag

SEQ ID NO: 644846 - RNA, 63 nt, hsa
auuauggaaagugauugugaugcuauuuaucuucagggucacucugggcaaagagaagguccu

SEQ ID NO: 644847 - RNA, 63 nt, hsa
auuuccccaauccuggcaaaagcccaaagaucccagggucaggagagaccccucuguaucccc

SEQ ID NO: 644848 - RNA, 63 nt, hsa
ccaccugggagauagcagggggcacagagagagcagggucagcucccucggcugggaccuccc

SEQ ID NO: 644849 - RNA, 63 nt, hsa
gagagcacccuguugucuucugguaaaugugugcagggucauccugucuccuguaccuccugg

SEQ ID NO: 644850 - RNA, 63 nt, hsa
uggucagggagucugggaagaguggagaagaggcagggucaggccucagcaucucacauccac

SEQ ID NO: 644851 - RNA, 63 nt, hsa
ggccuggacacugucacacucaacaucaccucucagggucagcaguucccagcgcuccucacg

SEQ ID NO: 644852 - RNA, 63 nt, hsa
caguccucuguauguacuccucuuuacacuggccagggucagaguuaaauagaguauaugcac

SEQ ID NO: 644853 - RNA, 63 nt, hsa
guaaacuaaggguucacuucuagagcugagaagcagggucaaagcacaauacugggcaauuca

SEQ ID NO: 644854 - RNA, 63 nt, hsa
ccugguacacacggaaaggcggcugugcggacgcagggucaccgugcuccggguuuucugaca

SEQ ID NO: 644855 - RNA, 63 nt, hsa
gcguccuggccuagggugccggggccugaaggucagggucacccaagcaacaaagucccgagc

SEQ ID NO: 644856 - RNA, 63 nt, hsa
gcuaugcuggggucccaggguggccgcagcagucagggucacugugggagcccugggguggag

SEQ ID NO: 644857 - RNA, 63 nt, hsa
gcugugacuccguggggcucagccaggcuccagcagggucagacgugcuguuaagagcaaagc

SEQ ID NO: 644858 - RNA, 63 nt, hsa
aaacagagccccacgcagguucaccaugaaccucagggucagggaaugagccaggcacggggg

SEQ ID NO: 644859 - RNA, 63 nt, hsa
ucccacccacagcgcuggccacagggcucccugcagggucagggaccagaccacgcccagagg

SEQ ID NO: 644860 - RNA, 63 nt, hsa
aagugcaaugauuuuucaguucgguuggcuaaacagggucagagcugagagcgaagcagaagg

SEQ ID NO: 644861 - RNA, 63 nt, hsa
ccuuuccuggccuugacuuccccaucugcaaaucagggucauuggcucacccuccagggcuga

SEQ ID NO: 644862 - RNA, 63 nt, hsa
uaguuauuuuuaaauuuacaauguuauugauuacagggucauuuuuauggucauaauaaaaaa

SEQ ID NO: 644863 - RNA, 63 nt, hsa
aaccauaccccaagagcucccaaagccugagaccagggucauuuguccccaacuccccaucug

SEQ ID NO: 644864 - RNA, 63 nt, hsa
ugaaggggcugagggaagggggucaaaggauuccagggucauucaguguccccgccucuguag

SEQ ID NO: 644865 - RNA, 63 nt, hsa
gcauaucacauaagaccagaaguggcccagguccagggucaguuaauuuagcggcuccacaaa

SEQ ID NO: 644866 - RNA, 63 nt, hsa
ccacuuccacuuuccaggaggcuggauggcuuccagggucacuccuugcccuggguggcuccc

SEQ ID NO: 644867 - RNA, 63 nt, hsa
ucaagccacuggcuguggaaggaguuuguccaacagggucagugucacagccacaacuucaga

SEQ ID NO: 644868 - RNA, 63 nt, hsa
ccugugccucacagaagagguggggaccgcagucagggucaccuggaccauggugaacaugug

SEQ ID NO: 644869 - RNA, 63 nt, hsa
acccuccauccaagcccugugucuuuccauagucagggucaggcccugcaucuauuccaaggg

SEQ ID NO: 644870 - RNA, 63 nt, hsa
cagagggccugccugggcagucugucuccgggccagggucagggacccucugccucuggcagc

SEQ ID NO: 644871 - RNA, 63 nt, hsa
uuaauucccuggcgcagauacgcauaggaccaacagggucaccaagcagacagggagcccgcg

SEQ ID NO: 644872 - RNA, 63 nt, hsa
aucgcgccgcgcggcuuccuggccaacuacugccagggucagugcgcgcugcccgucgcgcug

SEQ ID NO: 644873 - RNA, 53 nt, hsa
ugucuuuucugucguucuaguuccagggucacccccgagaggacaacaggcau

SEQ ID NO: 644874 - RNA, 63 nt, hsa
gagugucugaguccccggcaggcggccuucacucagggucagcgggcaccagguugcucugga

SEQ ID NO: 644875 - RNA, 63 nt, hsa
ccuccuccucaccuggagagacuacaggaacuucagggucacuccccguggucacauggaggu

SEQ ID NO: 644876 - RNA, 63 nt, hsa
acucgggcucagaggucacucagggucaauacucagggucagugcagguuaugagauccuugg

SEQ ID NO: 644877 - RNA, 63 nt, hsa
aagcaucagggccacucgggcucagaggucacucagggucaauacucagggucagugcagguu

SEQ ID NO: 644878 - RNA, 63 nt, hsa
auuuaguuuccuuuucccaugugaaccaaauuucagggucaccagaaguucaucaaauucaaa

SEQ ID NO: 644879 - RNA, 63 nt, hsa
ggagugggccccuggugugacacccaagccggacagggucacacugggucggcauguggagca

SEQ ID NO: 644880 - RNA, 63 nt, hsa
auucuagaacauucauuccccuuuaugcaugagcagggucacuguuacacucauccauguuca

SEQ ID NO: 644881 - RNA, 63 nt, hsa
gguggugggggcuggggggccgcuugccugccccagggucaggcugggcaaggucccuagcuc

SEQ ID NO: 644882 - RNA, 63 nt, hsa
ggaaagcaacuuaaaggagggccugcaagcagccagggucagagacagggcuugguucugcuu

SEQ ID NO: 644883 - RNA, 63 nt, hsa
cagguagaugaaaacuaaacugaugccuaggcccagggucagucucagauggaagcugggccu

SEQ ID NO: 644884 - RNA, 63 nt, hsa
ugcccaccagggggcuggugcaccugcugaccucagggucacaguugagucauuugccaguug

SEQ ID NO: 644885 - RNA, 63 nt, hsa
gcagcccccaggaaggccuuccagaucuggcuccagggucaccaccugucacagcaauaccug

SEQ ID NO: 644886 - RNA, 63 nt, hsa
caacagaccugaaaaugagccauggcauugggacagggucacuucugacaggggaaguggguc

SEQ ID NO: 644887 - RNA, 63 nt, hsa
gauuguggcccagaucucaggagucucugccuucagggucauccaaaaguggaccuugggagc

SEQ ID NO: 644888 - RNA, 63 nt, hsa
cucaagaaccaagaugggggaccagcaaccccccagggucauggaggacccaggacccuccaa

SEQ ID NO: 644889 - RNA, 63 nt, hsa
aggugaccuggccaaguagcaauaauuuggguccagggucaccuauugcccccagaggccucu

SEQ ID NO: 644890 - RNA, 63 nt, hsa
caggcgagugcuugggcagaagagguucgaguccagggucacaagucucugguaccaaaaggg

SEQ ID NO: 644891 - RNA, 63 nt, hsa
ugagaaacccagggucucugcuuuaccacggagcagggucaccaacccagaucuccaggccca

SEQ ID NO: 644892 - RNA, 63 nt, hsa
ugcugaguuuugaugucaaauauauuucucuuucagggucaugaucaaaaaaugaaaagucug

SEQ ID NO: 644893 - RNA, 63 nt, hsa
gaccucaucauuaugugggggcuuuguucuccacagggucagguaagagauggccuucuuggc

SEQ ID NO: 644894 - RNA, 63 nt, hsa
uccuucuuacuucccagaauccccugacauucccagggucagccaggaccuguuacagcccug

SEQ ID NO: 644895 - RNA, 63 nt, hsa
ccguggaaggugcagcagugccucagggguccucagggucagggagccccccucacccucuug

SEQ ID NO: 644896 - RNA, 63 nt, hsa
cuguggugaucccauaaaaggccaguccauuugcagggucaucagacagucaccuuuggccuc

SEQ ID NO: 644897 - RNA, 63 nt, hsa
ggaggccaaauaagccgccacugcaaaaaaaaacagggucagaaaauuacuuggguggguaga

SEQ ID NO: 644898 - RNA, 63 nt, hsa
uccccacccacccccacauuugcacaccuuccacagggucaggauggaguagcugccuugcga

SEQ ID NO: 644899 - RNA, 63 nt, hsa
aggacgagaagagccaagguccgccuacugccacagggucaaaggagguuuucgaucagccca

SEQ ID NO: 644900 - RNA, 63 nt, hsa
cagcgaaccugggcuccugcccaggacaggcaccagggucauggccugggaccuggacacugg

SEQ ID NO: 644901 - RNA, 63 nt, hsa
aaugccucuguggugcuguuuggucucuagaaacagggucacuuuuuuaauguaguaaagaag

SEQ ID NO: 644902 - RNA, 63 nt, hsa
ggaacuucacgggucacugggggcccacucuuccagggucaucgaugcauccugggcugugcu

SEQ ID NO: 644903 - RNA, 63 nt, hsa
cuggcucucacgcugggguuuuggacacacggucagggucagggccauuucagcuugaccucc

SEQ ID NO: 644904 - RNA, 63 nt, hsa
cauugaggcaagccuggagaggagcccggggagcagggucaugaacuuuuuucuuuagugaag

SEQ ID NO: 644905 - RNA, 63 nt, hsa
aggccaggcaagcauggacaggagccaagggagcagggucauuaacuuuuucuucuuugcaaa

SEQ ID NO: 644906 - RNA, 63 nt, hsa
cuggggagggugaggcagggcagggacagucuccagggucagucccuggaugggugguuaccu

SEQ ID NO: 644907 - RNA, 63 nt, hsa
cgcauuaguuuuggcgcaagcgagccuaugcugcagggucacuuuuggcuggucagagaagga

SEQ ID NO: 644908 - RNA, 63 nt, hsa
acuuggagccaacaguaacuugccaccuuaaggcagggucauccccgggccaggaggaugagg

SEQ ID NO: 644909 - RNA, 63 nt, hsa
ucauugugaagaaucccgaauccugggccuguccagggucaaauggaguuuuugguauuaaua

SEQ ID NO: 644910 - RNA, 63 nt, hsa
uugccuuccauuaggcuccugagaguuauuucucagggucauguugcaucuuggagccacaug

SEQ ID NO: 644911 - RNA, 63 nt, hsa
cacucgcugcuugaaaguacuggagcacguggucagggucaaugcaagaguucucauuuccua

SEQ ID NO: 644912 - RNA, 63 nt, hsa
auaguaaacuaagagccaugaaaaucacuuggccagggucaaggacucgugacuccuagcucu

SEQ ID NO: 644913 - RNA, 62 nt, hsa
cucugcucagcaccccagccggggcucuggacccaggguaacagccccaguucaucccaacc

SEQ ID NO: 644914 - RNA, 62 nt, hsa
cagaggacugagggaauccuguacaggaugucccaggguagauggggagcaggauugggacc

SEQ ID NO: 644915 - RNA, 62 nt, hsa
gucugaaagagcagugggaugggagcuggugaccaggguaccccaggaggcaugaugugccg

SEQ ID NO: 644916 - RNA, 62 nt, hsa
ccucucacacugaccuccccccuuacggcccaccaggguauguaaauaucucuuuucuacca

SEQ ID NO: 644917 - RNA, 62 nt, hsa
aaagaggcccacaccuugauauccaggccauaccaggguaucccuugucccuucacccccau

SEQ ID NO: 644918 - RNA, 62 nt, hsa
uauaugcugaauguucugcuguugcaaacuugccaggguauuagccaguguuugugccaagc

SEQ ID NO: 644919 - RNA, 62 nt, hsa
ccgaugucuggcuccccugcaggagggaggcuccaggguaagacagggcuggcaggagcaga

SEQ ID NO: 644920 - RNA, 62 nt, hsa
cucccuccccgcaacccugccccaccuugcauccaggguaugguguaaauaaaccuguguug

SEQ ID NO: 644921 - RNA, 62 nt, hsa
ucaguauuucuucuacuuagaaggcuuggggcccaggguaaugaggcaccagaugaagauaa

SEQ ID NO: 644922 - RNA, 55 nt, hsa
cuaccuggccguccaaauagaucccccaggguaccacggaggcgaaggaguugga

SEQ ID NO: 644923 - RNA, 62 nt, hsa
guuuccucaucccauuuacaguuuuucuaacuccaggguaguguuuaguguuaauauuuggg

SEQ ID NO: 644924 - RNA, 62 nt, hsa
cuccuggccuugaucccugccccuccagguguccaggguaaaguguaacucagacugaccug

SEQ ID NO: 644925 - RNA, 62 nt, hsa
cuaaaguccugcucccugucacuuuuuaaaagccaggguagcaguaacaugacaaacggcug

SEQ ID NO: 644926 - RNA, 62 nt, hsa
cggaggggagcccagggccauccauacccaccccaggguaacggggcuggccuggcauuagu

SEQ ID NO: 644927 - RNA, 62 nt, hsa
aguauucucagguguucuucguucuggcccuuccaggguaauuaggaaggcagaacaagaca

SEQ ID NO: 644928 - RNA, 62 nt, hsa
ucagcacuuuuuggugggaacuguuggaaauuccaggguaaggaggaagaugccuguucucc

SEQ ID NO: 644929 - RNA, 62 nt, hsa
ggaaagcgcaggaggugaaaaugcuuucuuggccaggguaguaagaauuagagguuaaugca

SEQ ID NO: 644930 - RNA, 62 nt, hsa
uuaaaaaaaaaaaaaaaagauuuuggagacuaccaggguaagauuccaacuuguccaaaagc

SEQ ID NO: 644931 - RNA, 62 nt, hsa
cagucuaguccuggggguaaagcccucagaucccaggguacacucuucuccauucccuccac

SEQ ID NO: 644932 - RNA, 62 nt, hsa
ggaagaagccccguuuccagggcauccgcagcccaggguagggagaaauauucucuccacuu

SEQ ID NO: 644933 - RNA, 62 nt, hsa
cccugcugcccaccccucugagccuuuucuccccaggguauggcuccugcugaguuucuugu

SEQ ID NO: 644934 - RNA, 62 nt, hsa
ccagcaccaccucagagacacuguucccugcuccaggguagaccugagaugaaccucccugg

SEQ ID NO: 644935 - RNA, 62 nt, hsa
cucauuuagaaauaaaucaucugguuguuccuccaggguacuuucuaagauaagccuuaaac

SEQ ID NO: 644936 - RNA, 62 nt, hsa
agcucuaaagggagaagucaggcccugccucuccaggguauagacggcccugcuaggcccca

SEQ ID NO: 644937 - RNA, 62 nt, hsa
ucugcaauacuuuaaaacauuuagaaaacaccccaggguaggucuguggcccuuagacagug

SEQ ID NO: 644938 - RNA, 62 nt, hsa
uuuucauuacauacuuguuuaaacucugucuuccaggguaaaaauaauaagguugaaucauu

SEQ ID NO: 644939 - RNA, 62 nt, hsa
gaccagaaauucuaccacuucccagauccuuuccaggguaccacccuauuaagcauuaauuu

SEQ ID NO: 644940 - RNA, 62 nt, hsa
ugacccuugggcuggcaggggcagugacccuuccaggguaccacugagggaagggccugggu

SEQ ID NO: 644941 - RNA, 62 nt, hsa
gguguacgaugucaagauggauucuuugagagccaggguagaucauaugacugccuuucugu

SEQ ID NO: 644942 - RNA, 62 nt, hsa
cuguuuucuucucuuuucacuuuuuguuucuaccaggguagaggccauguugaacuggccuc

SEQ ID NO: 644943 - RNA, 62 nt, hsa
agggcccaggagugggagcccaggcccucccuccaggguagagaugcaccgaauggaaauug

SEQ ID NO: 644944 - RNA, 62 nt, hsa
gucaguuggguacagcaggacacgccaccauuccaggguagcugguaccgccagaaacagga

SEQ ID NO: 644945 - RNA, 62 nt, hsa
ugcucaaacacaccagagggggcaggcaccagccaggguaugauggcuacuacccuuuucug

SEQ ID NO: 644946 - RNA, 62 nt, hsa
gggcucauuuugguuauucuacugccucuaggccaggguaguccuaacacagccugacauag

SEQ ID NO: 644947 - RNA, 62 nt, hsa
uggcagccuacucuccuugaguguaugaguagccaggguaagggguaaaaggauaguaagca

SEQ ID NO: 644948 - RNA, 62 nt, hsa
aucagguccuucugcacuuugguggaagucucccaggguagguuuccuauuugaaacagugg

SEQ ID NO: 644949 - RNA, 62 nt, hsa
aaaacuucauuuaaaagguuuuucuacugaauccaggguauucugaagaucgaagccugugu

SEQ ID NO: 644950 - RNA, 62 nt, hsa
ugcugguaauaucgggaaagauuuuaaugaaaccaggguagaauuguuuggcaaugcacuga

SEQ ID NO: 644951 - RNA, 62 nt, hsa
cugcggggaggacccgggaccacagcugcuggccaggguagacuuggagcuguccuccagag

SEQ ID NO: 644952 - RNA, 62 nt, hsa
agcgagcuuaauugcguaaucccuguuguccuccaggguaagcugacacgucuacauaacug

SEQ ID NO: 644953 - RNA, 62 nt, hsa
augggaccauguuagcugaugccaguugaaggccaggguauuugggaaggggaaggguauua

SEQ ID NO: 644954 - RNA, 62 nt, hsa
uugcaaaacagaaguaaauaagaguucgggacccaggguaaaaugguagcuucauccaauau

SEQ ID NO: 644955 - RNA, 62 nt, hsa
uauguccuaauauaaaguacuggcucauagggccaggguauuauuauagaauauuauucucg

SEQ ID NO: 644956 - RNA, 62 nt, hsa
gggguauaccugggaggauccagcaguaauccccaggguacuaggauuacuaguacucugau

SEQ ID NO: 644957 - RNA, 62 nt, hsa
gccaacaguaccaaaagugauuuuugagugugccaggguaaaggcuuccaguucagccucag

SEQ ID NO: 644958 - RNA, 62 nt, hsa
ccccucagcucucccucacaccucccuucaucccaggguauccaccugcaccccacucccaa

SEQ ID NO: 644959 - RNA, 62 nt, hsa
auugagggaugcugggcacugcugccggguggccaggguauggggcaugugcccagcaaugu

SEQ ID NO: 644960 - RNA, 62 nt, hsa
caaucaaugucacaugaacaaacaagcugcccccaggguaccauuuggggaggggaaaucuu

SEQ ID NO: 644961 - RNA, 62 nt, hsa
ccuuuuagacuuccaucugaaugagucagucaccaggguauucugcauagcauuguauauuc

SEQ ID NO: 644962 - RNA, 62 nt, hsa
cuagcugccugggaggaauuguuaacugaguaccaggguaccuuuaaagaagacccuuggag

SEQ ID NO: 644963 - RNA, 62 nt, hsa
guguauguugacuuuuuaaaauucugagugauccaggguaugaccuagggaaugaacuagcu

SEQ ID NO: 644964 - RNA, 62 nt, hsa
uggaggcuggggugcuggggcuugggguggccccaggguagguaacagucuuaggacuuagc

SEQ ID NO: 644965 - RNA, 62 nt, hsa
acuggccaccuagagcccuuggcugugguaauccaggguaauugcgcagaggcaucugaugu

SEQ ID NO: 644966 - RNA, 62 nt, hsa
auuucaguggaaauacaaaaccacuucagagaccaggguaucuccucuggaaggaucuaaga

SEQ ID NO: 644967 - RNA, 62 nt, hsa
agaaauguaaccaaaaaaauguuaaguguucaccaggguauuaaaauacagaggaguauggu

SEQ ID NO: 644968 - RNA, 62 nt, hsa
ugcugacuuucaggucccuggaccccagaaacccaggguagacauggacucuacucuccuuc

SEQ ID NO: 644969 - RNA, 62 nt, hsa
gcgaccucgguucugugggcucuggaaggccaccaggguagggucuccccagggcuccuccc

SEQ ID NO: 644970 - RNA, 62 nt, hsa
aaucaucuuggaggaaccauaagaaaagguguccaggguaucuauauaaagaggguuaaauu

SEQ ID NO: 644971 - RNA, 62 nt, hsa
cccaaggcagcuacugccccuaacccuucccaccaggguagcuuugggcacugcagcucugg

SEQ ID NO: 644972 - RNA, 62 nt, hsa
ggaagggguugcuaggggguggggacggcuaaccaggguaagaauguucagggggcugccca

SEQ ID NO: 644973 - RNA, 62 nt, hsa
uggcuagaauuauucagacgauuuggcagcguccaggguaagcugguguuauaauacgcugc

SEQ ID NO: 644974 - RNA, 62 nt, hsa
aauguuggucauuuuauguuaagggaagaauuccaggguauggccauggaguguacaaguau

SEQ ID NO: 644975 - RNA, 62 nt, hsa
guucccuuuucugaguggauuucaagcauuugccaggguaugcuggaggagggacuccuaaa

SEQ ID NO: 644976 - RNA, 62 nt, hsa
ugccguagacacaaagaagggaacaauagacaccaggguauacuugaggguggaggguggca

SEQ ID NO: 644977 - RNA, 62 nt, hsa
uauccuugccauuuauguuuccugcuguaaagccaggguagcugcaugcacuggcauuugaa

SEQ ID NO: 644978 - RNA, 62 nt, hsa
cagaauuuaauuucucgagcuguuuuucucauccaggguauauguggcagccuuugccauau

SEQ ID NO: 644979 - RNA, 62 nt, hsa
aaucaucuuggaggaaccauaagaaaaaguguccaggguaucuauauaaagaggguuaaauu

SEQ ID NO: 644980 - RNA, 62 nt, hsa
gugacuuccccaagccgcaggugagaccugguccaggguaagaaugggaucgguggagagcc

SEQ ID NO: 644981 - RNA, 62 nt, hsa
ugaauauauagaaaucugugccuggccggaguccaggguaaauuaguagcaugguguuagau

SEQ ID NO: 644982 - RNA, 62 nt, hsa
ggaccguggacaggcccagcgcggccagcgucccaggguacccgccugagcuccugcugcgg

SEQ ID NO: 644983 - RNA, 62 nt, hsa
uugccaacucccuguuucuaaugaccaaagacccaggguaccuaaaaggacuuugcaaccaa

SEQ ID NO: 644984 - RNA, 62 nt, hsa
ccaaauggugugaugcuccuuguagcaggauaccaggguacuggggggcaaugcuaugauua

SEQ ID NO: 644985 - RNA, 62 nt, hsa
cuugguaccuguggguuagcaucaaguucuccccaggguagaauucaaucagagcuccaguu

SEQ ID NO: 644986 - RNA, 62 nt, hsa
gcucccuucccuccauagccacgcuccaaaccccaggguagccauggccggguaaagcaagg

SEQ ID NO: 644987 - RNA, 62 nt, hsa
uuguuuacagcuuuucuagagcagcugugcgaccaggguagagaguguugaaauucaauacc

SEQ ID NO: 644988 - RNA, 62 nt, hsa
guaaagaagguuuacuuuuuggugucucauacccaggguaaucuguacaucucuacuuauuu

SEQ ID NO: 644989 - RNA, 62 nt, hsa
caagcugggccccagcccacccuccugucuucccaggguagcccgccugccaguccuagcug

SEQ ID NO: 644990 - RNA, 62 nt, hsa
auuuaaaaacaagaacagccaaggguuguucgccaggguaggaugugucuuaaagauugguc

SEQ ID NO: 644991 - RNA, 62 nt, hsa
uaagucuguacauugacguguauggacuaaauccaggguaaaaucaauguuacaaaauuuaa

SEQ ID NO: 644992 - RNA, 62 nt, hsa
acagauuuuaaaugccauguucauuaagaaauccaggguauucagauucugggguuuuucau

SEQ ID NO: 644993 - RNA, 62 nt, hsa
agcagcuccucucaagcucacucucuaggucuccaggguaggaguguuuuucuagcaagaau

SEQ ID NO: 644994 - RNA, 62 nt, hsa
aucaguauaccuaucugcugcaccuucacucuccaggguacaugcuuuaaaaccgacccgca

SEQ ID NO: 644995 - RNA, 62 nt, hsa
gccagcugggcgccuuccucccaccugccagcccaggguaccccagacuccaguuucauccu

SEQ ID NO: 644996 - RNA, 62 nt, hsa
cuccgcccaggcaugguagccugagcgcgcccccaggguaguagggggcaccugaggagcag

SEQ ID NO: 644997 - RNA, 62 nt, hsa
aguccugaaauaaagugaugggcuuugcaaauccaggguagaggcccuaacaggcacagaga

SEQ ID NO: 644998 - RNA, 62 nt, hsa
guccuguagguuuauuuuggaagggacuguggccaggguaguucucagguugugcuagagca

SEQ ID NO: 644999 - RNA, 62 nt, hsa
uucggcagcggcggcagcgcacagccguugcaccaggguacugcagccggggccgcgugcgc

SEQ ID NO: 645000 - RNA, 62 nt, hsa
ccuccuuccccuuugccaacaaggccugaaggccaggguagauuggggggugggacaaugaa

SEQ ID NO: 645001 - RNA, 62 nt, hsa
uccugccagcacccagcaacuuggcaaagcaaccaggguaggggagaaccacgagagaagca

SEQ ID NO: 645002 - RNA, 62 nt, hsa
ccuguuaaaaggaggaggcaaaauagucaaacccaggguaguuuacacuuaaugcuagggag

SEQ ID NO: 645003 - RNA, 62 nt, hsa
uuggcacaaagcaugaagaaaccccauuuuucccaggguaaucaugaaagaaggcucagaga

SEQ ID NO: 645004 - RNA, 62 nt, hsa
cacguucucuagcucuccagucacccacucauccaggguaggagggguucucccugcccccc

SEQ ID NO: 645005 - RNA, 62 nt, hsa
cgccagaggacaaggaagugggggccgcuggcccaggguaggggaggguggggcaaugggga

SEQ ID NO: 645006 - RNA, 62 nt, hsa
ccauuuccuaugugccaagcugugccagcaguccaggguacccugacugucccucuguagac

SEQ ID NO: 645007 - RNA, 62 nt, hsa
agggagcccuuuccucgguucuggccuccagaccaggguaagggcaggccccuccaacaggu

SEQ ID NO: 645008 - RNA, 62 nt, hsa
aggucugcccgacccaugucuaugcucuacccccaggguagcaucucagcuuccgaacccug

SEQ ID NO: 645009 - RNA, 62 nt, hsa
guggacacugcuggcuugcgggcagucggucuccaggguaccuguugucucuuuuccgaugu

SEQ ID NO: 645010 - RNA, 62 nt, hsa
aauuauuguuaaacauaucauaacuaaucauaccaggguacugcaauaccacuguuuauaag

SEQ ID NO: 645011 - RNA, 62 nt, hsa
auaaagcuccuuuggcagaaucccccaaagaaccaggguauucuuuuuccaucccuagccau

SEQ ID NO: 645012 - RNA, 62 nt, hsa
ucauaaguugcaaauauuacuauuuuccuaaaccaggguacacaauuuaaguugccacuuau

SEQ ID NO: 645013 - RNA, 62 nt, hsa
aaacuauaaaugcaguuguguccaguuggaggccaggguaccacaugucacaggcggccuua

SEQ ID NO: 645014 - RNA, 62 nt, hsa
cagcauaugugccauaaacagaacaaauggauccaggguauaccucuaauaaccuuuaucua

SEQ ID NO: 645015 - RNA, 62 nt, hsa
ucagaaagggacuguucuggguggcuggaucuccaggguacccuccaccccagcugccaagc

SEQ ID NO: 645016 - RNA, 62 nt, hsa
aggagcgccucaucuucccaggccucagccacccaggguaaaaggugccagggaaguugugg

SEQ ID NO: 645017 - RNA, 62 nt, hsa
aguauuacggugccucuucucugcccccuuucccaggguaucuguggguugccaggcugggg

SEQ ID NO: 645018 - RNA, 62 nt, hsa
ucugccccaccccuacucaaggagucaggugcccaggguagggaauaagucuaggaaagggg

SEQ ID NO: 645019 - RNA, 62 nt, hsa
ggauguggucucuacacuaaccuucuugauguccaggguagauaaagggucgaaucucucug

SEQ ID NO: 645020 - RNA, 62 nt, hsa
aaacuagucucaugaagaauucuggcgugcagccaggguagcugaaguuugggucugggacu

SEQ ID NO: 645021 - RNA, 62 nt, hsa
cagguuuugcccaaggcuuugauaccugucacccaggguaucuuaaaagcaaguuguucucc

SEQ ID NO: 645022 - RNA, 62 nt, hsa
ucugcaccucuuccucagcugcuccagaccggccaggguaaccagcuaaccaugccuggcau

SEQ ID NO: 645023 - RNA, 62 nt, hsa
cagcaggcuugaagcaggguaagcaggcuggcccaggguaagggcuguugagguaccuuaag

SEQ ID NO: 645024 - RNA, 62 nt, hsa
cugcuuuugugaagcaacuauuuauuugaagaccaggguaugggcacuuuugccuucucucc

SEQ ID NO: 645025 - RNA, 62 nt, hsa
uccuuaauuagacuaauuauuuuauccccaucccaggguauaaacaggaauuguuuugauag

SEQ ID NO: 645026 - RNA, 62 nt, hsa
uccuaggaacaauggaagaagaaaggacugaaccaggguauuuuuguuagguuuucuaugug

SEQ ID NO: 645027 - RNA, 62 nt, hsa
uuaaugugcauuacccuaucuuguuuuugaagccaggguaguuguaugauuuuguuaccagc

SEQ ID NO: 645028 - RNA, 62 nt, hsa
ucaggagcaggaacagccaggggaccucagacccaggguauuuucauaccagacuauuugca

SEQ ID NO: 645029 - RNA, 62 nt, hsa
ucaaaacucuuaaaucaguaguuugacuuuugccaggguaaucuucaguuggcccugauuca

SEQ ID NO: 645030 - RNA, 62 nt, hsa
ccuuauuucacugaagaugaaaaaaagcuaauccaggguaccuuugacuuuuuggcuuuaag

SEQ ID NO: 645031 - RNA, 62 nt, hsa
aaggcaacccuauuucuacuguuucucucuugccaggguauuaggaaggacaggaaaaguag

SEQ ID NO: 645032 - RNA, 62 nt, hsa
ucuccgaauuagcauuucuggauauguuucauccaggguaucauugauuuaugauggaaaac

SEQ ID NO: 645033 - RNA, 62 nt, hsa
gcugaugcaaaaggauuuuucaacacacuaaaccaggguagggaaaggaaccgagaaagaaa

SEQ ID NO: 645034 - RNA, 62 nt, hsa
gaaguccuccugugccagggaauuuacuaucuccaggguagcacauucccuguguagacggu

SEQ ID NO: 645035 - RNA, 62 nt, hsa
gagacaaaucggugugccauugacaacaugagccaggguaaaggcacccuuuggaauuacug

SEQ ID NO: 645036 - RNA, 62 nt, hsa
gaucaaaaggauauauugacaguuaucuauagccaggguaguuguuaauaccugcuuguuug

SEQ ID NO: 645037 - RNA, 51 nt, hsa
uuuccaucucagaugacuaagccaggguagggagggaccuccugccuacuc

SEQ ID NO: 645038 - RNA, 62 nt, hsa
uuccugaauucuuuaaauaugaaauaucauugccaggguauggcuuacagugacuacuauua

SEQ ID NO: 645039 - RNA, 62 nt, hsa
uggucauccuguuagaguacaucuuuggaaauccaggguaauauucucuuucagagaugcuc

SEQ ID NO: 645040 - RNA, 62 nt, hsa
ugcccuugcucucuaacuucugagcccaccucccaggguaggcaccugggggcaugcaggug

SEQ ID NO: 645041 - RNA, 62 nt, hsa
uaggcaccugggggcaugcaggugcccaccucccaggguaggcaccugggggcaugcaggua

SEQ ID NO: 645042 - RNA, 62 nt, hsa
guucugggcuccaggggagggagcuggggaggccaggguauaagaaaagcaucagaacucuc

SEQ ID NO: 645043 - RNA, 62 nt, hsa
uccucgcuggccuugccagagguugagccgccccaggguaugaggagaugaauaacuccaca

SEQ ID NO: 645044 - RNA, 62 nt, hsa
gacccagugagaauguagcauuuuguucauccccaggguagcugcccuggggucugggcacu

SEQ ID NO: 645045 - RNA, 62 nt, hsa
guuuguucacuaaugugaaauaagcuauguguccaggguauugcuccccugaguguauauga

SEQ ID NO: 645046 - RNA, 62 nt, hsa
ggagagaaauaaggggauguaaccagcaauggccaggguacaacagcccuggaaaacaguag

SEQ ID NO: 645047 - RNA, 62 nt, hsa
uccugcccuggagcugguuugggcugucaaaaccaggguaaccuccuacaugggucaugacu

SEQ ID NO: 645048 - RNA, 62 nt, hsa
cuguggccaccucccgggcuguccgagggaccccaggguaccucacacucggagcucgccug

SEQ ID NO: 645049 - RNA, 62 nt, hsa
ugggaaaacggaccgcucuuggcuccugacucccaggguacagcgcccaguaacucauccuu

SEQ ID NO: 645050 - RNA, 62 nt, hsa
ggguaaaauaggucugcaagcuuuauauuugcccaggguaucauucauucuucagguguuga

SEQ ID NO: 645051 - RNA, 62 nt, hsa
uucuucgagucggagagcuacaaggacagcguccaggguagggugagagggggaccaugagu

SEQ ID NO: 645052 - RNA, 62 nt, hsa
ccaaagcucagcccucugggcgguccccuugcccaggguaucuccuacgguaccucuucaga

SEQ ID NO: 645053 - RNA, 62 nt, hsa
ugaggcacuguugaagaaaucucacuuuucagccaggguacugguucugguacauauggauc

SEQ ID NO: 645054 - RNA, 62 nt, hsa
accugccccugccgccugugcccuugcuggguccaggguaggcaaggcugccggcugcaccc

SEQ ID NO: 645055 - RNA, 62 nt, hsa
aacaacuguccccucacccaccagcuauuuccccaggguagagugggcaauucucaccuuca

SEQ ID NO: 645056 - RNA, 62 nt, hsa
ugucccuguuucaguugcacugggguuggagcccaggguagggguuuccagcuuccccaggc

SEQ ID NO: 645057 - RNA, 62 nt, hsa
caguguagccccaagaaggcuggggcuauuuaccaggguagaaaaaggagcuuaccucccac

SEQ ID NO: 645058 - RNA, 62 nt, hsa
ugccaggaggaugacaaaaauguuccuguguuccaggguaaugccagguggguuuugagagc

SEQ ID NO: 645059 - RNA, 62 nt, hsa
agcccagagggucugggggcacaagacugacgccaggguaugaagaguguuauuuucauuca

SEQ ID NO: 645060 - RNA, 62 nt, hsa
gucauacccccucccucuuguccacccuacccccaggguaaggggagccucucuccuucccc

SEQ ID NO: 645061 - RNA, 62 nt, hsa
ucccugggauagagugagcccucuugcgucuuccaggguagcucagguuggcccaguuuggg

SEQ ID NO: 645062 - RNA, 62 nt, hsa
gcaggauuaacuugaccauggugggaacugcaccaggguacuccucacagcgccaucaccaa

SEQ ID NO: 645063 - RNA, 62 nt, hsa
gaacacuucuccagccaccucauacccccuucccaggguaagugcccacgaaagcccagucc

SEQ ID NO: 645064 - RNA, 62 nt, hsa
ggccugagguaugggguaugugcauguggaggccaggguaaggugaauggggaggcugggag

SEQ ID NO: 645065 - RNA, 62 nt, hsa
uguguaaauauuuuucccuccgggcaggggagccaggguagagcaaaggagacaaagcagga

SEQ ID NO: 645066 - RNA, 62 nt, hsa
gugagaaagagagcaggcucgggaggcccugcccaggguaggaggagcuuccugcuuugcac

SEQ ID NO: 645067 - RNA, 62 nt, hsa
cauagguggcccauucagccucaaggggaaauccaggguaggaagcagcagcucugcuggac

SEQ ID NO: 645068 - RNA, 62 nt, hsa
cccacgugcaccauaccuggggaguuccugguccaggguauccuggggccacccucccugcc

SEQ ID NO: 645069 - RNA, 62 nt, hsa
ucuucucugccucucaccaggacagccgccccccaggguacuccugcccuugcuugacucag

SEQ ID NO: 645070 - RNA, 62 nt, hsa
uuuuuaguagagacgggguuucaccauguuggccaggguagucuugaacuccugacuucaaa

SEQ ID NO: 645071 - RNA, 62 nt, hsa
cuagccagcuguggacacauaggaaugcuggaccaggguaccagauuuuuucaacaaagggg

SEQ ID NO: 645072 - RNA, 62 nt, hsa
gguggcuuauaacuguaagggagauggcagccccaggguacagccagcaggcauugagcagc

SEQ ID NO: 645073 - RNA, 62 nt, hsa
cucacacccugcuaccacccuaacguggacacccaggguaacauaugccuggacauccugaa

SEQ ID NO: 645074 - RNA, 62 nt, hsa
ccccuuuuucauucccugugcugaaagagggaccaggguagaugcccccugcccucgaaucc

SEQ ID NO: 645075 - RNA, 62 nt, hsa
guuuuuaaaaucuccaguggccauaaaacuagccaggguagcucaugcuuuuacugguugga

SEQ ID NO: 645076 - RNA, 62 nt, hsa
augccuggcgugagagccagcagacagccaggccaggguaggcagugccugcuucugcucca

SEQ ID NO: 645077 - RNA, 62 nt, hsa
gugcaccagcugcacuggcuucccccucagcaccaggguaccaggugagccagaggccugag

SEQ ID NO: 645078 - RNA, 62 nt, hsa
uuccuggcgcccugagguggcucagcaccugcccaggguaggccuggcaugagggguuaggu

SEQ ID NO: 645079 - RNA, 62 nt, hsa
agguugaggugggggccuugcaucggggguccccaggguaugggguaggggugggggugggc

SEQ ID NO: 645080 - RNA, 62 nt, hsa
agcggucaaggcaaggaugucaugcuugaaggccaggguagacuugagagaguucacauucc

SEQ ID NO: 645081 - RNA, 62 nt, hsa
agucaaaagauaaauuggggccuuguaaaaggccaggguaaaaugucucaggcaagcaaaag

SEQ ID NO: 645082 - RNA, 62 nt, hsa
gugaacaauauggagagagaccugggaaaaguccaggguagcuugcccaggggaagacagca

SEQ ID NO: 645083 - RNA, 62 nt, hsa
agugguggcaucuucaccugaauucuucaaugccaggguaauaaaccaaaauaguccuaauc

SEQ ID NO: 645084 - RNA, 62 nt, hsa
cugucgccucagucugcgcacaggcaugcaccccaggguagugccugcagggaugcaugugu

SEQ ID NO: 645085 - RNA, 62 nt, hsa
guccacacaccuguaggccucugagccagcguccaggguacaggugcgggugguggggauga

SEQ ID NO: 645086 - RNA, 62 nt, hsa
guggggcgugguguuuagacacagauaggaguccaggguaugacugauggaggccccggccc

SEQ ID NO: 645087 - RNA, 62 nt, hsa
cucucagcucucgggccagugcucugcucuguccaggguagguaauacugggagacuccugu

SEQ ID NO: 645088 - RNA, 62 nt, hsa
ccucaucagccucugccuugucccacugagguccaggguagcucggggcagggguggggcag

SEQ ID NO: 645089 - RNA, 62 nt, hsa
caaccucugagccaucccagagccuggggaggccaggguagaggcugacggcgcaagaccag

SEQ ID NO: 645090 - RNA, 62 nt, hsa
acguaccuugaaacucucuaucucuggacacuccaggguagagaaugaaggguauggaagua

SEQ ID NO: 645091 - RNA, 62 nt, hsa
ccagugccccugagcuugcuuuccacauucucccaggguauggagaccuagaccugucuuug

SEQ ID NO: 645092 - RNA, 62 nt, hsa
ggcucaagacgggguggggaaggggcugggagccaggguacuccaaugcguggcucuccugc

SEQ ID NO: 645093 - RNA, 62 nt, hsa
aguuuauuuucagaaaauaaaauaauaaaagcccaggguauuuuaaaugcuucuaauauaag

SEQ ID NO: 645094 - RNA, 62 nt, hsa
guaccccuuugguaaguaggcuucagugcauaccaggguaucacuggagaugggaguuagug

SEQ ID NO: 645095 - RNA, 62 nt, hsa
ccuacuccaggcuccccaucucccugaagcuuccaggguagcagcuggugggacacugaucu

SEQ ID NO: 645096 - RNA, 62 nt, hsa
agcuuaaggcagggcuggcacuauuuccuuggccaggguaccuuauggggccauauccuaca

SEQ ID NO: 645097 - RNA, 62 nt, hsa
gguuugucagaggcuauugggaacagcugggcccaggguauuugcucaguaaauauuuuggg

SEQ ID NO: 645098 - RNA, 62 nt, hsa
uguauggcaggcugggcagaauguauacugauccaggguauagacuagauauuuuugcuguu

SEQ ID NO: 645099 - RNA, 62 nt, hsa
agcugcccccauaacuggcagcauucccagacccaggguacucuaauaggggcggcucaggc

SEQ ID NO: 645100 - RNA, 62 nt, hsa
ugaagaagcaacacauaaguuucaaaaaauauccaggguacuccuggacaguguccccuuuu

SEQ ID NO: 645101 - RNA, 62 nt, hsa
gggguagcccugccgcacuuugucacgggagcccaggguacccgccuccuuuucguaacacu

SEQ ID NO: 645102 - RNA, 63 nt, hsa
ucucugcucagcaccccagccggggcucuggacccaggguaacagccccaguucaucccaacc

SEQ ID NO: 645103 - RNA, 63 nt, hsa
ccagaggacugagggaauccuguacaggaugucccaggguagauggggagcaggauugggacc

SEQ ID NO: 645104 - RNA, 63 nt, hsa
agucugaaagagcagugggaugggagcuggugaccaggguaccccaggaggcaugaugugccg

SEQ ID NO: 645105 - RNA, 63 nt, hsa
cccucucacacugaccuccccccuuacggcccaccaggguauguaaauaucucuuuucuacca

SEQ ID NO: 645106 - RNA, 63 nt, hsa
aaaagaggcccacaccuugauauccaggccauaccaggguaucccuugucccuucacccccau

SEQ ID NO: 645107 - RNA, 63 nt, hsa
cuauaugcugaauguucugcuguugcaaacuugccaggguauuagccaguguuugugccaagc

SEQ ID NO: 645108 - RNA, 63 nt, hsa
cccgaugucuggcuccccugcaggagggaggcuccaggguaagacagggcuggcaggagcaga

SEQ ID NO: 645109 - RNA, 63 nt, hsa
ucucccuccccgcaacccugccccaccuugcauccaggguaugguguaaauaaaccuguguug

SEQ ID NO: 645110 - RNA, 63 nt, hsa
aucaguauuucuucuacuuagaaggcuuggggcccaggguaaugaggcaccagaugaagauaa

SEQ ID NO: 645111 - RNA, 55 nt, hsa; identical to SEQ ID NO: 644922

SEQ ID NO: 645112 - RNA, 63 nt, hsa
aguuuccucaucccauuuacaguuuuucuaacuccaggguaguguuuaguguuaauauuuggg

SEQ ID NO: 645113 - RNA, 63 nt, hsa
gcuccuggccuugaucccugccccuccagguguccaggguaaaguguaacucagacugaccug

SEQ ID NO: 645114 - RNA, 63 nt, hsa
ucuaaaguccugcucccugucacuuuuuaaaagccaggguagcaguaacaugacaaacggcug

SEQ ID NO: 645115 - RNA, 63 nt, hsa
acggaggggagcccagggccauccauacccaccccaggguaacggggcuggccuggcauuagu

SEQ ID NO: 645116 - RNA, 63 nt, hsa
caguauucucagguguucuucguucuggcccuuccaggguaauuaggaaggcagaacaagaca

SEQ ID NO: 645117 - RNA, 63 nt, hsa
uucagcacuuuuuggugggaacuguuggaaauuccaggguaaggaggaagaugccuguucucc

SEQ ID NO: 645118 - RNA, 63 nt, hsa
aggaaagcgcaggaggugaaaaugcuuucuuggccaggguaguaagaauuagagguuaaugca

SEQ ID NO: 645119 - RNA, 63 nt, hsa
uuuaaaaaaaaaaaaaaaagauuuuggagacuaccaggguaagauuccaacuuguccaaaagc

SEQ ID NO: 645120 - RNA, 63 nt, hsa
gcagucuaguccuggggguaaagcccucagaucccaggguacacucuucuccauucccuccac

SEQ ID NO: 645121 - RNA, 63 nt, hsa
aggaagaagccccguuuccagggcauccgcagcccaggguagggagaaauauucucuccacuu

SEQ ID NO: 645122 - RNA, 63 nt, hsa
ucccugcugcccaccccucugagccuuuucuccccaggguauggcuccugcugaguuucuugu

SEQ ID NO: 645123 - RNA, 63 nt, hsa
gccagcaccaccucagagacacuguucccugcuccaggguagaccugagaugaaccucccugg

SEQ ID NO: 645124 - RNA, 63 nt, hsa
gcucauuuagaaauaaaucaucugguuguuccuccaggguacuuucuaagauaagccuuaaac

SEQ ID NO: 645125 - RNA, 63 nt, hsa
aagcucuaaagggagaagucaggcccugccucuccaggguauagacggcccugcuaggcccca

SEQ ID NO: 645126 - RNA, 63 nt, hsa
uucugcaauacuuuaaaacauuuagaaaacaccccaggguaggucuguggcccuuagacagug

SEQ ID NO: 645127 - RNA, 63 nt, hsa
cuuuucauuacauacuuguuuaaacucugucuuccaggguaaaaauaauaagguugaaucauu

SEQ ID NO: 645128 - RNA, 63 nt, hsa
agaccagaaauucuaccacuucccagauccuuuccaggguaccacccuauuaagcauuaauuu

SEQ ID NO: 645129 - RNA, 63 nt, hsa
augacccuugggcuggcaggggcagugacccuuccaggguaccacugagggaagggccugggu

SEQ ID NO: 645130 - RNA, 63 nt, hsa
agguguacgaugucaagauggauucuuugagagccaggguagaucauaugacugccuuucugu

SEQ ID NO: 645131 - RNA, 63 nt, hsa
ucuguuuucuucucuuuucacuuuuuguuucuaccaggguagaggccauguugaacuggccuc

SEQ ID NO: 645132 - RNA, 63 nt, hsa
cagggcccaggagugggagcccaggcccucccuccaggguagagaugcaccgaauggaaauug

SEQ ID NO: 645133 - RNA, 63 nt, hsa
agucaguuggguacagcaggacacgccaccauuccaggguagcugguaccgccagaaacagga

SEQ ID NO: 645134 - RNA, 63 nt, hsa
gugcucaaacacaccagagggggcaggcaccagccaggguaugauggcuacuacccuuuucug

SEQ ID NO: 645135 - RNA, 63 nt, hsa
agggcucauuuugguuauucuacugccucuaggccaggguaguccuaacacagccugacauag

SEQ ID NO: 645136 - RNA, 63 nt, hsa
auggcagccuacucuccuugaguguaugaguagccaggguaagggguaaaaggauaguaagca

SEQ ID NO: 645137 - RNA, 63 nt, hsa
caucagguccuucugcacuuugguggaagucucccaggguagguuuccuauuugaaacagugg

SEQ ID NO: 645138 - RNA, 63 nt, hsa
caaaacuucauuuaaaagguuuuucuacugaauccaggguauucugaagaucgaagccugugu

SEQ ID NO: 645139 - RNA, 63 nt, hsa
cugcugguaauaucgggaaagauuuuaaugaaaccaggguagaauuguuuggcaaugcacuga

SEQ ID NO: 645140 - RNA, 63 nt, hsa
ucugcggggaggacccgggaccacagcugcuggccaggguagacuuggagcuguccuccagag

SEQ ID NO: 645141 - RNA, 63 nt, hsa
cagcgagcuuaauugcguaaucccuguuguccuccaggguaagcugacacgucuacauaacug

SEQ ID NO: 645142 - RNA, 63 nt, hsa
caugggaccauguuagcugaugccaguugaaggccaggguauuugggaaggggaaggguauua

SEQ ID NO: 645143 - RNA, 63 nt, hsa
cuugcaaaacagaaguaaauaagaguucgggacccaggguaaaaugguagcuucauccaauau

SEQ ID NO: 645144 - RNA, 63 nt, hsa
uuauguccuaauauaaaguacuggcucauagggccaggguauuauuauagaauauuauucucg

SEQ ID NO: 645145 - RNA, 63 nt, hsa
agggguauaccugggaggauccagcaguaauccccaggguacuaggauuacuaguacucugau

SEQ ID NO: 645146 - RNA, 63 nt, hsa
agccaacaguaccaaaagugauuuuugagugugccaggguaaaggcuuccaguucagccucag

SEQ ID NO: 645147 - RNA, 63 nt, hsa
cccccucagcucucccucacaccucccuucaucccaggguauccaccugcaccccacucccaa

SEQ ID NO: 645148 - RNA, 63 nt, hsa
cauugagggaugcugggcacugcugccggguggccaggguauggggcaugugcccagcaaugu

SEQ ID NO: 645149 - RNA, 63 nt, hsa
ccaaucaaugucacaugaacaaacaagcugcccccaggguaccauuuggggaggggaaaucuu

SEQ ID NO: 645150 - RNA, 63 nt, hsa
cccuuuuagacuuccaucugaaugagucagucaccaggguauucugcauagcauuguauauuc

SEQ ID NO: 645151 - RNA, 63 nt, hsa
gcuagcugccugggaggaauuguuaacugaguaccaggguaccuuuaaagaagacccuuggag

SEQ ID NO: 645152 - RNA, 63 nt, hsa
uguguauguugacuuuuuaaaauucugagugauccaggguaugaccuagggaaugaacuagcu

SEQ ID NO: 645153 - RNA, 63 nt, hsa
cuggaggcuggggugcuggggcuugggguggccccaggguagguaacagucuuaggacuuagc

SEQ ID NO: 645154 - RNA, 63 nt, hsa
cacuggccaccuagagcccuuggcugugguaauccaggguaauugcgcagaggcaucugaugu

SEQ ID NO: 645155 - RNA, 63 nt, hsa
uauuucaguggaaauacaaaaccacuucagagaccaggguaucuccucuggaaggaucuaaga

SEQ ID NO: 645156 - RNA, 63 nt, hsa
uagaaauguaaccaaaaaaauguuaaguguucaccaggguauuaaaauacagaggaguauggu

SEQ ID NO: 645157 - RNA, 63 nt, hsa
gugcugacuuucaggucccuggaccccagaaacccaggguagacauggacucuacucuccuuc

SEQ ID NO: 645158 - RNA, 63 nt, hsa
ugcgaccucgguucugugggcucuggaaggccaccaggguagggucuccccagggcuccuccc

SEQ ID NO: 645159 - RNA, 63 nt, hsa
uaaucaucuuggaggaaccauaagaaaagguguccaggguaucuauauaaagaggguuaaauu

SEQ ID NO: 645160 - RNA, 63 nt, hsa
ccccaaggcagcuacugccccuaacccuucccaccaggguagcuuugggcacugcagcucugg

SEQ ID NO: 645161 - RNA, 63 nt, hsa
gggaagggguugcuaggggguggggacggcuaaccaggguaagaauguucagggggcugccca

SEQ ID NO: 645162 - RNA, 63 nt, hsa
auggcuagaauuauucagacgauuuggcagcguccaggguaagcugguguuauaauacgcugc

SEQ ID NO: 645163 - RNA, 63 nt, hsa
aaauguuggucauuuuauguuaagggaagaauuccaggguauggccauggaguguacaaguau

SEQ ID NO: 645164 - RNA, 63 nt, hsa
aguucccuuuucugaguggauuucaagcauuugccaggguaugcuggaggagggacuccuaaa

SEQ ID NO: 645165 - RNA, 63 nt, hsa
gugccguagacacaaagaagggaacaauagacaccaggguauacuugaggguggaggguggca

SEQ ID NO: 645166 - RNA, 63 nt, hsa
auauccuugccauuuauguuuccugcuguaaagccaggguagcugcaugcacuggcauuugaa

SEQ ID NO: 645167 - RNA, 63 nt, hsa
acagaauuuaauuucucgagcuguuuuucucauccaggguauauguggcagccuuugccauau

SEQ ID NO: 645168 - RNA, 63 nt, hsa
uaaucaucuuggaggaaccauaagaaaaaguguccaggguaucuauauaaagaggguuaaauu

SEQ ID NO: 645169 - RNA, 63 nt, hsa
ugugacuuccccaagccgcaggugagaccugguccaggguaagaaugggaucgguggagagcc

SEQ ID NO: 645170 - RNA, 63 nt, hsa
gugaauauauagaaaucugugccuggccggaguccaggguaaauuaguagcaugguguuagau

SEQ ID NO: 645171 - RNA, 63 nt, hsa
uggaccguggacaggcccagcgcggccagcgucccaggguacccgccugagcuccugcugcgg

SEQ ID NO: 645172 - RNA, 63 nt, hsa
guugccaacucccuguuucuaaugaccaaagacccaggguaccuaaaaggacuuugcaaccaa

SEQ ID NO: 645173 - RNA, 63 nt, hsa
cccaaauggugugaugcuccuuguagcaggauaccaggguacuggggggcaaugcuaugauua

SEQ ID NO: 645174 - RNA, 63 nt, hsa
ucuugguaccuguggguuagcaucaaguucuccccaggguagaauucaaucagagcuccaguu

SEQ ID NO: 645175 - RNA, 63 nt, hsa
cgcucccuucccuccauagccacgcuccaaaccccaggguagccauggccggguaaagcaagg

SEQ ID NO: 645176 - RNA, 63 nt, hsa
guuguuuacagcuuuucuagagcagcugugcgaccaggguagagaguguugaaauucaauacc

SEQ ID NO: 645177 - RNA, 63 nt, hsa
uguaaagaagguuuacuuuuuggugucucauacccaggguaaucuguacaucucuacuuauuu

SEQ ID NO: 645178 - RNA, 63 nt, hsa
ccaagcugggccccagcccacccuccugucuucccaggguagcccgccugccaguccuagcug

SEQ ID NO: 645179 - RNA, 63 nt, hsa
uauuuaaaaacaagaacagccaaggguuguucgccaggguaggaugugucuuaaagauugguc

SEQ ID NO: 645180 - RNA, 63 nt, hsa
auaagucuguacauugacguguauggacuaaauccaggguaaaaucaauguuacaaaauuuaa

SEQ ID NO: 645181 - RNA, 63 nt, hsa
uacagauuuuaaaugccauguucauuaagaaauccaggguauucagauucugggguuuuucau

SEQ ID NO: 645182 - RNA, 63 nt, hsa
cagcagcuccucucaagcucacucucuaggucuccaggguaggaguguuuuucuagcaagaau

SEQ ID NO: 645183 - RNA, 63 nt, hsa
aaucaguauaccuaucugcugcaccuucacucuccaggguacaugcuuuaaaaccgacccgca

SEQ ID NO: 645184 - RNA, 63 nt, hsa
ggccagcugggcgccuuccucccaccugccagcccaggguaccccagacuccaguuucauccu

SEQ ID NO: 645185 - RNA, 63 nt, hsa
gcuccgcccaggcaugguagccugagcgcgcccccaggguaguagggggcaccugaggagcag

SEQ ID NO: 645186 - RNA, 63 nt, hsa
aaguccugaaauaaagugaugggcuuugcaaauccaggguagaggcccuaacaggcacagaga

SEQ ID NO: 645187 - RNA, 63 nt, hsa
aguccuguagguuuauuuuggaagggacuguggccaggguaguucucagguugugcuagagca

SEQ ID NO: 645188 - RNA, 63 nt, hsa
cuucggcagcggcggcagcgcacagccguugcaccaggguacugcagccggggccgcgugcgc

SEQ ID NO: 645189 - RNA, 63 nt, hsa
uccuccuuccccuuugccaacaaggccugaaggccaggguagauuggggggugggacaaugaa

SEQ ID NO: 645190 - RNA, 63 nt, hsa
guccugccagcacccagcaacuuggcaaagcaaccaggguaggggagaaccacgagagaagca

SEQ ID NO: 645191 - RNA, 63 nt, hsa
cccuguuaaaaggaggaggcaaaauagucaaacccaggguaguuuacacuuaaugcuagggag

SEQ ID NO: 645192 - RNA, 63 nt, hsa
auuggcacaaagcaugaagaaaccccauuuuucccaggguaaucaugaaagaaggcucagaga

SEQ ID NO: 645193 - RNA, 63 nt, hsa
ccacguucucuagcucuccagucacccacucauccaggguaggagggguucucccugcccccc

SEQ ID NO: 645194 - RNA, 63 nt, hsa
ccgccagaggacaaggaagugggggccgcuggcccaggguaggggaggguggggcaaugggga

SEQ ID NO: 645195 - RNA, 63 nt, hsa
accauuuccuaugugccaagcugugccagcaguccaggguacccugacugucccucuguagac

SEQ ID NO: 645196 - RNA, 63 nt, hsa
cagggagcccuuuccucgguucuggccuccagaccaggguaagggcaggccccuccaacaggu

SEQ ID NO: 645197 - RNA, 63 nt, hsa
aaggucugcccgacccaugucuaugcucuacccccaggguagcaucucagcuuccgaacccug

SEQ ID NO: 645198 - RNA, 63 nt, hsa
cguggacacugcuggcuugcgggcagucggucuccaggguaccuguugucucuuuuccgaugu

SEQ ID NO: 645199 - RNA, 63 nt, hsa
aaauuauuguuaaacauaucauaacuaaucauaccaggguacugcaauaccacuguuuauaag

SEQ ID NO: 645200 - RNA, 63 nt, hsa
aauaaagcuccuuuggcagaaucccccaaagaaccaggguauucuuuuuccaucccuagccau

SEQ ID NO: 645201 - RNA, 63 nt, hsa
uucauaaguugcaaauauuacuauuuuccuaaaccaggguacacaauuuaaguugccacuuau

SEQ ID NO: 645202 - RNA, 63 nt, hsa
uaaacuauaaaugcaguuguguccaguuggaggccaggguaccacaugucacaggcggccuua

SEQ ID NO: 645203 - RNA, 63 nt, hsa
ccagcauaugugccauaaacagaacaaauggauccaggguauaccucuaauaaccuuuaucua

SEQ ID NO: 645204 - RNA, 63 nt, hsa
uucagaaagggacuguucuggguggcuggaucuccaggguacccuccaccccagcugccaagc

SEQ ID NO: 645205 - RNA, 63 nt, hsa
caggagcgccucaucuucccaggccucagccacccaggguaaaaggugccagggaaguugugg

SEQ ID NO: 645206 - RNA, 63 nt, hsa
caguauuacggugccucuucucugcccccuuucccaggguaucuguggguugccaggcugggg

SEQ ID NO: 645207 - RNA, 63 nt, hsa
cucugccccaccccuacucaaggagucaggugcccaggguagggaauaagucuaggaaagggg

SEQ ID NO: 645208 - RNA, 63 nt, hsa
uggauguggucucuacacuaaccuucuugauguccaggguagauaaagggucgaaucucucug

SEQ ID NO: 645209 - RNA, 63 nt, hsa
caaacuagucucaugaagaauucuggcgugcagccaggguagcugaaguuugggucugggacu

SEQ ID NO: 645210 - RNA, 63 nt, hsa
acagguuuugcccaaggcuuugauaccugucacccaggguaucuuaaaagcaaguuguucucc

SEQ ID NO: 645211 - RNA, 63 nt, hsa
cucugcaccucuuccucagcugcuccagaccggccaggguaaccagcuaaccaugccuggcau

SEQ ID NO: 645212 - RNA, 63 nt, hsa
ccagcaggcuugaagcaggguaagcaggcuggcccaggguaagggcuguugagguaccuuaag

SEQ ID NO: 645213 - RNA, 63 nt, hsa
ucugcuuuugugaagcaacuauuuauuugaagaccaggguaugggcacuuuugccuucucucc

SEQ ID NO: 645214 - RNA, 63 nt, hsa
uuccuuaauuagacuaauuauuuuauccccaucccaggguauaaacaggaauuguuuugauag

SEQ ID NO: 645215 - RNA, 63 nt, hsa
uuccuaggaacaauggaagaagaaaggacugaaccaggguauuuuuguuagguuuucuaugug

SEQ ID NO: 645216 - RNA, 63 nt, hsa
auuaaugugcauuacccuaucuuguuuuugaagccaggguaguuguaugauuuuguuaccagc

SEQ ID NO: 645217 - RNA, 63 nt, hsa
cucaggagcaggaacagccaggggaccucagacccaggguauuuucauaccagacuauuugca

SEQ ID NO: 645218 - RNA, 63 nt, hsa
uucaaaacucuuaaaucaguaguuugacuuuugccaggguaaucuucaguuggcccugauuca

SEQ ID NO: 645219 - RNA, 63 nt, hsa
uccuuauuucacugaagaugaaaaaaagcuaauccaggguaccuuugacuuuuuggcuuuaag

SEQ ID NO: 645220 - RNA, 63 nt, hsa
gaaggcaacccuauuucuacuguuucucucuugccaggguauuaggaaggacaggaaaaguag

SEQ ID NO: 645221 - RNA, 63 nt, hsa
aucuccgaauuagcauuucuggauauguuucauccaggguaucauugauuuaugauggaaaac

SEQ ID NO: 645222 - RNA, 63 nt, hsa
ugcugaugcaaaaggauuuuucaacacacuaaaccaggguagggaaaggaaccgagaaagaaa

SEQ ID NO: 645223 - RNA, 63 nt, hsa
ugaaguccuccugugccagggaauuuacuaucuccaggguagcacauucccuguguagacggu

SEQ ID NO: 645224 - RNA, 63 nt, hsa
ggagacaaaucggugugccauugacaacaugagccaggguaaaggcacccuuuggaauuacug

SEQ ID NO: 645225 - RNA, 63 nt, hsa
ugaucaaaaggauauauugacaguuaucuauagccaggguaguuguuaauaccugcuuguuug

SEQ ID NO: 645226 - RNA, 51 nt, hsa; identical to SEQ ID NO: 645037

SEQ ID NO: 645227 - RNA, 63 nt, hsa
cuuccugaauucuuuaaauaugaaauaucauugccaggguauggcuuacagugacuacuauua

SEQ ID NO: 645228 - RNA, 63 nt, hsa
cuggucauccuguuagaguacaucuuuggaaauccaggguaauauucucuuucagagaugcuc

SEQ ID NO: 645229 - RNA, 63 nt, hsa
gugcccuugcucucuaacuucugagcccaccucccaggguaggcaccugggggcaugcaggug

SEQ ID NO: 645230 - RNA, 63 nt, hsa
guaggcaccugggggcaugcaggugcccaccucccaggguaggcaccugggggcaugcaggua

SEQ ID NO: 645231 - RNA, 63 nt, hsa
gguucugggcuccaggggagggagcuggggaggccaggguauaagaaaagcaucagaacucuc

SEQ ID NO: 645232 - RNA, 63 nt, hsa
guccucgcuggccuugccagagguugagccgccccaggguaugaggagaugaauaacuccaca

SEQ ID NO: 645233 - RNA, 63 nt, hsa
agacccagugagaauguagcauuuuguucauccccaggguagcugcccuggggucugggcacu

SEQ ID NO: 645234 - RNA, 63 nt, hsa
aguuuguucacuaaugugaaauaagcuauguguccaggguauugcuccccugaguguauauga

SEQ ID NO: 645235 - RNA, 63 nt, hsa
cggagagaaauaaggggauguaaccagcaauggccaggguacaacagcccuggaaaacaguag

SEQ ID NO: 645236 - RNA, 63 nt, hsa
cuccugcccuggagcugguuugggcugucaaaaccaggguaaccuccuacaugggucaugacu

SEQ ID NO: 645237 - RNA, 63 nt, hsa
ucuguggccaccucccgggcuguccgagggaccccaggguaccucacacucggagcucgccug

SEQ ID NO: 645238 - RNA, 63 nt, hsa
gugggaaaacggaccgcucuuggcuccugacucccaggguacagcgcccaguaacucauccuu

SEQ ID NO: 645239 - RNA, 63 nt, hsa
uggguaaaauaggucugcaagcuuuauauuugcccaggguaucauucauucuucagguguuga

SEQ ID NO: 645240 - RNA, 63 nt, hsa
cuucuucgagucggagagcuacaaggacagcguccaggguagggugagagggggaccaugagu

SEQ ID NO: 645241 - RNA, 63 nt, hsa
cccaaagcucagcccucugggcgguccccuugcccaggguaucuccuacgguaccucuucaga

SEQ ID NO: 645242 - RNA, 63 nt, hsa
uugaggcacuguugaagaaaucucacuuuucagccaggguacugguucugguacauauggauc

SEQ ID NO: 645243 - RNA, 63 nt, hsa
gaccugccccugccgccugugcccuugcuggguccaggguaggcaaggcugccggcugcaccc

SEQ ID NO: 645244 - RNA, 63 nt, hsa
uaacaacuguccccucacccaccagcuauuuccccaggguagagugggcaauucucaccuuca

SEQ ID NO: 645245 - RNA, 63 nt, hsa
gugucccuguuucaguugcacugggguuggagcccaggguagggguuuccagcuuccccaggc

SEQ ID NO: 645246 - RNA, 63 nt, hsa
ucaguguagccccaagaaggcuggggcuauuuaccaggguagaaaaaggagcuuaccucccac

SEQ ID NO: 645247 - RNA, 63 nt, hsa
gugccaggaggaugacaaaaauguuccuguguuccaggguaaugccagguggguuuugagagc

SEQ ID NO: 645248 - RNA, 63 nt, hsa
aagcccagagggucugggggcacaagacugacgccaggguaugaagaguguuauuuucauuca

SEQ ID NO: 645249 - RNA, 63 nt, hsa
ggucauacccccucccucuuguccacccuacccccaggguaaggggagccucucuccuucccc

SEQ ID NO: 645250 - RNA, 63 nt, hsa
aucccugggauagagugagcccucuugcgucuuccaggguagcucagguuggcccaguuuggg

SEQ ID NO: 645251 - RNA, 63 nt, hsa
agcaggauuaacuugaccauggugggaacugcaccaggguacuccucacagcgccaucaccaa

SEQ ID NO: 645252 - RNA, 63 nt, hsa
ugaacacuucuccagccaccucauacccccuucccaggguaagugcccacgaaagcccagucc

SEQ ID NO: 645253 - RNA, 63 nt, hsa
uggccugagguaugggguaugugcauguggaggccaggguaaggugaauggggaggcugggag

SEQ ID NO: 645254 - RNA, 63 nt, hsa
cuguguaaauauuuuucccuccgggcaggggagccaggguagagcaaaggagacaaagcagga

SEQ ID NO: 645255 - RNA, 63 nt, hsa
agugagaaagagagcaggcucgggaggcccugcccaggguaggaggagcuuccugcuuugcac

SEQ ID NO: 645256 - RNA, 63 nt, hsa
acauagguggcccauucagccucaaggggaaauccaggguaggaagcagcagcucugcuggac

SEQ ID NO: 645257 - RNA, 63 nt, hsa
ccccacgugcaccauaccuggggaguuccugguccaggguauccuggggccacccucccugcc

SEQ ID NO: 645258 - RNA, 63 nt, hsa
cucuucucugccucucaccaggacagccgccccccaggguacuccugcccuugcuugacucag

SEQ ID NO: 645259 - RNA, 63 nt, hsa
auuuuuaguagagacgggguuucaccauguuggccaggguagucuugaacuccugacuucaaa

SEQ ID NO: 645260 - RNA, 63 nt, hsa
ucuagccagcuguggacacauaggaaugcuggaccaggguaccagauuuuuucaacaaagggg

SEQ ID NO: 645261 - RNA, 63 nt, hsa
ugguggcuuauaacuguaagggagauggcagccccaggguacagccagcaggcauugagcagc

SEQ ID NO: 645262 - RNA, 63 nt, hsa
ccucacacccugcuaccacccuaacguggacacccaggguaacauaugccuggacauccugaa

SEQ ID NO: 645263 - RNA, 63 nt, hsa
uccccuuuuucauucccugugcugaaagagggaccaggguagaugcccccugcccucgaaucc

SEQ ID NO: 645264 - RNA, 63 nt, hsa
gguuuuuaaaaucuccaguggccauaaaacuagccaggguagcucaugcuuuuacugguugga

SEQ ID NO: 645265 - RNA, 63 nt, hsa
aaugccuggcgugagagccagcagacagccaggccaggguaggcagugccugcuucugcucca

SEQ ID NO: 645266 - RNA, 63 nt, hsa
ugugcaccagcugcacuggcuucccccucagcaccaggguaccaggugagccagaggccugag

SEQ ID NO: 645267 - RNA, 63 nt, hsa
guuccuggcgcccugagguggcucagcaccugcccaggguaggccuggcaugagggguuaggu

SEQ ID NO: 645268 - RNA, 63 nt, hsa
cagguugaggugggggccuugcaucggggguccccaggguaugggguaggggugggggugggc

SEQ ID NO: 645269 - RNA, 63 nt, hsa
cagcggucaaggcaaggaugucaugcuugaaggccaggguagacuugagagaguucacauucc

SEQ ID NO: 645270 - RNA, 63 nt, hsa
aagucaaaagauaaauuggggccuuguaaaaggccaggguaaaaugucucaggcaagcaaaag

SEQ ID NO: 645271 - RNA, 63 nt, hsa
ggugaacaauauggagagagaccugggaaaaguccaggguagcuugcccaggggaagacagca

SEQ ID NO: 645272 - RNA, 63 nt, hsa
gagugguggcaucuucaccugaauucuucaaugccaggguaauaaaccaaaauaguccuaauc

SEQ ID NO: 645273 - RNA, 63 nt, hsa
gcugucgccucagucugcgcacaggcaugcaccccaggguagugccugcagggaugcaugugu

SEQ ID NO: 645274 - RNA, 63 nt, hsa
uguccacacaccuguaggccucugagccagcguccaggguacaggugcgggugguggggauga

SEQ ID NO: 645275 - RNA, 63 nt, hsa
gguggggcgugguguuuagacacagauaggaguccaggguaugacugauggaggccccggccc

SEQ ID NO: 645276 - RNA, 63 nt, hsa
gcucucagcucucgggccagugcucugcucuguccaggguagguaauacugggagacuccugu

SEQ ID NO: 645277 - RNA, 63 nt, hsa
gccucaucagccucugccuugucccacugagguccaggguagcucggggcagggguggggcag

SEQ ID NO: 645278 - RNA, 63 nt, hsa
gcaaccucugagccaucccagagccuggggaggccaggguagaggcugacggcgcaagaccag

SEQ ID NO: 645279 - RNA, 63 nt, hsa
aacguaccuugaaacucucuaucucuggacacuccaggguagagaaugaaggguauggaagua

SEQ ID NO: 645280 - RNA, 63 nt, hsa
gccagugccccugagcuugcuuuccacauucucccaggguauggagaccuagaccugucuuug

SEQ ID NO: 645281 - RNA, 63 nt, hsa
uggcucaagacgggguggggaaggggcugggagccaggguacuccaaugcguggcucuccugc

SEQ ID NO: 645282 - RNA, 63 nt, hsa
aaguuuauuuucagaaaauaaaauaauaaaagcccaggguauuuuaaaugcuucuaauauaag

SEQ ID NO: 645283 - RNA, 63 nt, hsa
gguaccccuuugguaaguaggcuucagugcauaccaggguaucacuggagaugggaguuagug

SEQ ID NO: 645284 - RNA, 63 nt, hsa
cccuacuccaggcuccccaucucccugaagcuuccaggguagcagcuggugggacacugaucu

SEQ ID NO: 645285 - RNA, 63 nt, hsa
gagcuuaaggcagggcuggcacuauuuccuuggccaggguaccuuauggggccauauccuaca

SEQ ID NO: 645286 - RNA, 63 nt, hsa
ugguuugucagaggcuauugggaacagcugggcccaggguauuugcucaguaaauauuuuggg

SEQ ID NO: 645287 - RNA, 63 nt, hsa
auguauggcaggcugggcagaauguauacugauccaggguauagacuagauauuuuugcuguu

SEQ ID NO: 645288 - RNA, 63 nt, hsa
cagcugcccccauaacuggcagcauucccagacccaggguacucuaauaggggcggcucaggc

SEQ ID NO: 645289 - RNA, 63 nt, hsa
augaagaagcaacacauaaguuucaaaaaauauccaggguacuccuggacaguguccccuuuu

SEQ ID NO: 645290 - RNA, 63 nt, hsa
ggggguagcccugccgcacuuugucacgggagcccaggguacccgccuccuuuucguaacacu

SEQ ID NO: 645291 - RNA, 64 nt, hsa
auuauuuccacugugagauucuuaaaacuuuuuugcuucauaauaauaaaacaacucauguuag

SEQ ID NO: 645292 - RNA, 64 nt, hsa
uuauugcguaccaagaguugauuacaaccuccaugcuucauaagcggacgccacguuaggguug

SEQ ID NO: 645293 - RNA, 64 nt, hsa
guguauuuccaauuuggucuucaauucaagagaugcuucauaaaacacuuauagccuuaaacca

SEQ ID NO: 645294 - RNA, 64 nt, hsa
cauagcauaccugccacucuggauguuuuccugggcuucauaucuguauggcaaggagggagcu

SEQ ID NO: 645295 - RNA, 64 nt, hsa
aaacucgcucacugcuaagaauauuugaauguaugcuucauacagggaugguguucaaaaaacu

SEQ ID NO: 645296 - RNA, 64 nt, hsa
cucuaagacuccagcggcuggaauuggguggggggcuucauacacaugagauaauaugcagauu

SEQ ID NO: 645297 - RNA, 64 nt, hsa
guacuguauguaugcauugguaauagcuacuuuugcuucauagcuucauaccaacaaaauauau

SEQ ID NO: 645298 - RNA, 64 nt, hsa
uguaugcauugguaauagcuacuuuugcuucauagcuucauaccaacaaaauauauuuauuaga

SEQ ID NO: 645299 - RNA, 64 nt, hsa
uugguguugcaaaaaguaacauauuuucaucauugcuucauacgacauggaguuaggacaggga

SEQ ID NO: 645300 - RNA, 64 nt, hsa
ucuauuauguaaugcuguagaccuguccgugucugcuucauaaggaguaacgacugacauuagc

SEQ ID NO: 645301 - RNA, 64 nt, hsa
guccccagcggugacgggagguguccuggcugcuccaggacaaaagacaaucgucucugugggu

SEQ ID NO: 645302 - RNA, 64 nt, hsa
ggggagggcaaggcucuccucccagccagggacgccaggacauagcugcuccuggucaguggag

SEQ ID NO: 645303 - RNA, 64 nt, hsa
cuuuggcauuuuaaaggaguaugaggugggugacccaggacagagaacgcuacuggauccuggg

SEQ ID NO: 645304 - RNA, 64 nt, hsa
gacuggucuuggaaacccucagcaaacucagcauccaggacaacaauguggaccugauucuggc

SEQ ID NO: 645305 - RNA, 64 nt, hsa
uucccagcagguuuuugccuuagacgugcuggccccaggacagugaugaagacagagccugucu

SEQ ID NO: 645306 - RNA, 64 nt, hsa
uaauaaaaguugugccucaccauacuugaagcucccaggacaaggguugagaggcucaaccccu

SEQ ID NO: 645307 - RNA, 64 nt, hsa
aaaucaguagagugaggugauccuuagcaacgugccaggacacuuccugugugccugcaguugu

SEQ ID NO: 645308 - RNA, 64 nt, hsa
aagaacaaacauuagcuauuuuaugcugcaagaaccaggacacacaauucgccaaucaucccac

SEQ ID NO: 645309 - RNA, 64 nt, hsa
cugugaguggcauguccacuugcuggauuaucagccaggacacuauagaacaggaccagcugag

SEQ ID NO: 645310 - RNA, 64 nt, hsa
gggagaaggugccauggucuuaggugucugugccccaggacagacccuaggacccuaaauccaa

SEQ ID NO: 645311 - RNA, 64 nt, hsa
aaaaggcccccacauacccugcaguuuucucuguccaggacagcagguaaaaaggaauccccag

SEQ ID NO: 645312 - RNA, 64 nt, hsa
gagccuguagggaguuuuccaggcagguccuuugccaggacagcaugguccugcccuguugucc

SEQ ID NO: 645313 - RNA, 64 nt, hsa
cagggcccaggaggcauuccacacaggcacugccccaggacaacacaacaaggacagucacaac

SEQ ID NO: 645314 - RNA, 64 nt, hsa
ucaugguggguggaguggggguggcugggcucccccaggacagaggggacccugagguuggcaa

SEQ ID NO: 645315 - RNA, 64 nt, hsa
cauaggggaaaggaucuacccuucuccuggcuccccaggacacucaguucuuucaaagaccagg

SEQ ID NO: 645316 - RNA, 64 nt, hsa
uggagucugcaccuccuggaaauccugccaccaaccaggacacagcagccaccguauugaucag

SEQ ID NO: 645317 - RNA, 64 nt, hsa
caggagagagggacagguucuguugggggugacaccaggacacaggaauagguucugucgggag

SEQ ID NO: 645318 - RNA, 64 nt, hsa
caggacacagggacagguucugucgggggugacaccaggacacagggacagguucugucauggg

SEQ ID NO: 645319 - RNA, 64 nt, hsa
caggagagagggacagguucugucaggggugacaccaggacacagggacagguucugucggggg

SEQ ID NO: 645320 - RNA, 64 nt, hsa
gcugagcagagcccauccaggacacuccacacugccaggacacacccaggcggcccgcccuugc

SEQ ID NO: 645321 - RNA, 64 nt, hsa
uuucucugccagcagggggcugagcagagcccauccaggacacuccacacugccaggacacacc

SEQ ID NO: 645322 - RNA, 64 nt, hsa
caucacugccucuccagggacccuccucuccugcccaggacagacccagccagaaccacugcua

SEQ ID NO: 645323 - RNA, 64 nt, hsa
uugcugaguccccugccaagcgcucggagcccccccaggacacucugcacccccucaccccggu

SEQ ID NO: 645324 - RNA, 64 nt, hsa
ccuugggaagcccguuagcccagggugggucccaccaggacaguagggaaacaguuguuucccu

SEQ ID NO: 645325 - RNA, 64 nt, hsa
ugcucacggcccugcagcagagcagggcgcaaacccaggacaucugugccaggcuucccaugcc

SEQ ID NO: 645326 - RNA, 64 nt, hsa
gugguuucugcccugcagaugucuaacacauaagccaggacauucugcugugagugacuuauug

SEQ ID NO: 645327 - RNA, 64 nt, hsa
ugaaacagcuaaaagaaaacaucggggaaucucuccaggacauuggagugggcaaagauuucuu

SEQ ID NO: 645328 - RNA, 64 nt, hsa
ggucugcuccugcugaggaccagcuguggcugggccaggacagaggacucaacccugcuccucc

SEQ ID NO: 645329 - RNA, 64 nt, hsa
cucccccuaacugcaugacauguuaacugugugcccaggacagccgugguggggaccggguaug

SEQ ID NO: 645330 - RNA, 64 nt, hsa
ugcccucgugcccaucaagugcagucgggaccucccaggacaagcacgaggccucaggucggcc

SEQ ID NO: 645331 - RNA, 64 nt, hsa
aguguguguucuuccccaagguccccccacagcuccaggacaccgcuguccuggcauuuguggc

SEQ ID NO: 645332 - RNA, 64 nt, hsa
uuggcaaaauaguggagaacgcaggacacaguuuccaggacauggccguggaggugggugcggg

SEQ ID NO: 645333 - RNA, 64 nt, hsa
gcuuugcucagaagccuccugucuccagcucucuccaggacaggcccaguccucugaggcacgg

SEQ ID NO: 645334 - RNA, 64 nt, hsa
gacaacaagagcgaaacuccgucuuagaaguggaccaggacaggaccagauuuuggagucaugg

SEQ ID NO: 645335 - RNA, 64 nt, hsa
cucacccaagcauauauaacuagcuagaagugggccaggacaggcccggcgcgguggcucacgc

SEQ ID NO: 645336 - RNA, 64 nt, hsa
gccaucauccaccauuuaguaaaauguagcuggcccaggacauguaaaaaaaaaaaaaaaacaa

SEQ ID NO: 645337 - RNA, 64 nt, hsa
uauuugauuauuaaagugagcuauguguuaagugccaggacauuucuagcuuuugugagaaugu

SEQ ID NO: 645338 - RNA, 64 nt, hsa
uguacaucuaggccaccccagccuggccacgcagccaggacaccgggcagggccgcccgggccc

SEQ ID NO: 645339 - RNA, 64 nt, hsa
gccacugacugcagggacacgggcagccuggcucccaggacacgacuuguaaugaaaguuuggg

SEQ ID NO: 645340 - RNA, 64 nt, hsa
aacuucucccuuaccagugaccccagagacagagccaggacaggagugggggccagccugagga

SEQ ID NO: 645341 - RNA, 64 nt, hsa
uagaacuuggacuuuuccccugugaagggggcugccaggacaucucagcacucccgccuggagc

SEQ ID NO: 645342 - RNA, 64 nt, hsa
cagccuugguggcaaauaucucaucugccggcccccaggacaagugguaugaccagugauaaug

SEQ ID NO: 645343 - RNA, 64 nt, hsa
ugaggcuccagaggagacuuugaguugaugggggccaggacaccaguccagguaguguugagac

SEQ ID NO: 645344 - RNA, 64 nt, hsa
gcaucucucgaggacucuggucccaggaugucucccaggacaagccagucugccucuuccuccu

SEQ ID NO: 645345 - RNA, 64 nt, hsa
cacacacacacacacgcuuguucacacucagaacccaggacagccacagccaccgcuuagggga

SEQ ID NO: 645346 - RNA, 64 nt, hsa
cugguucugcccaugcuagggggugggggagcucccaggacagaccagccuuguuucucaugua

SEQ ID NO: 645347 - RNA, 64 nt, hsa
ucguguagaaaugggggaauugguuccccauggcccaggacagcugagaggagguggaggggcc

SEQ ID NO: 645348 - RNA, 64 nt, hsa
cagggcugaauggucgcugagacagagauggaagccaggacaagggagcccaccgggcccagau

SEQ ID NO: 645349 - RNA, 64 nt, hsa
cggagccaggcgcuuagaggaagaccaaaugcugccaggacacggauuguccagggauuacauu

SEQ ID NO: 645350 - RNA, 64 nt, hsa
ggauggggagcccucuggggaugagcaaggccuuccaggacaggcucgguucugguccccugcu

SEQ ID NO: 645351 - RNA, 64 nt, hsa; identical to SEQ ID NO: 21758

SEQ ID NO: 645352 - RNA, 64 nt, hsa; identical to SEQ ID NO: 21759

SEQ ID NO: 645353 - RNA, 64 nt, hsa; identical to SEQ ID NO: 21760

SEQ ID NO: 645354 - RNA, 64 nt, hsa; identical to SEQ ID NO: 21761

SEQ ID NO: 645355 - RNA, 64 nt, hsa; identical to SEQ ID NO: 21762

SEQ ID NO: 645356 - RNA, 64 nt, hsa; identical to SEQ ID NO: 21763

SEQ ID NO: 645357 - RNA, 64 nt, hsa; identical to SEQ ID NO: 21764

SEQ ID NO: 645358 - RNA, 64 nt, hsa; identical to SEQ ID NO: 21765

SEQ ID NO: 645359 - RNA, 64 nt, hsa; identical to SEQ ID NO: 21766

SEQ ID NO: 645360 - RNA, 64 nt, hsa; identical to SEQ ID NO: 21767

SEQ ID NO: 645361 - RNA, 64 nt, hsa; identical to SEQ ID NO: 21768

SEQ ID NO: 645362 - RNA, 64 nt, hsa; identical to SEQ ID NO: 21769

SEQ ID NO: 645363 - RNA, 64 nt, hsa; identical to SEQ ID NO: 21770

SEQ ID NO: 645364 - RNA, 64 nt, hsa; identical to SEQ ID NO: 21771

SEQ ID NO: 645365 - RNA, 64 nt, hsa; identical to SEQ ID NO: 21772

SEQ ID NO: 645366 - RNA, 64 nt, hsa; identical to SEQ ID NO: 21773

SEQ ID NO: 645367 - RNA, 64 nt, hsa; identical to SEQ ID NO: 21774

SEQ ID NO: 645368 - RNA, 64 nt, hsa; identical to SEQ ID NO: 21775

SEQ ID NO: 645369 - RNA, 64 nt, hsa; identical to SEQ ID NO: 21775

SEQ ID NO: 645370 - RNA, 64 nt, hsa; identical to SEQ ID NO: 21777

SEQ ID NO: 645371 - RNA, 64 nt, hsa; identical to SEQ ID NO: 21778

SEQ ID NO: 645372 - RNA, 64 nt, hsa; identical to SEQ ID NO: 21779

SEQ ID NO: 645373 - RNA, 64 nt, hsa; identical to SEQ ID NO: 21780

SEQ ID NO: 645374 - RNA, 64 nt, hsa; identical to SEQ ID NO: 21781

SEQ ID NO: 645375 - RNA, 64 nt, hsa; identical to SEQ ID NO: 68768

SEQ ID NO: 645376 - RNA, 64 nt, hsa; identical to SEQ ID NO: 68769

SEQ ID NO: 645377 - RNA, 64 nt, hsa; identical to SEQ ID NO: 68770

SEQ ID NO: 645378 - RNA, 64 nt, hsa; identical to SEQ ID NO: 68771

SEQ ID NO: 645379 - RNA, 64 nt, hsa; identical to SEQ ID NO: 68772

SEQ ID NO: 645380 - RNA, 64 nt, hsa; identical to SEQ ID NO: 68773

SEQ ID NO: 645381 - RNA, 64 nt, hsa; identical to SEQ ID NO: 68774

SEQ ID NO: 645382 - RNA, 64 nt, hsa; identical to SEQ ID NO: 68775

SEQ ID NO: 645383 - RNA, 64 nt, hsa; identical to SEQ ID NO: 68776

SEQ ID NO: 645384 - RNA, 64 nt, hsa; identical to SEQ ID NO: 68777

SEQ ID NO: 645385 - RNA, 64 nt, hsa; identical to SEQ ID NO: 68778

SEQ ID NO: 645386 - RNA, 64 nt, hsa; identical to SEQ ID NO: 68779

SEQ ID NO: 645387 - RNA, 64 nt, hsa; identical to SEQ ID NO: 68780

SEQ ID NO: 645388 - RNA, 64 nt, hsa; identical to SEQ ID NO: 68781

SEQ ID NO: 645389 - RNA, 64 nt, hsa; identical to SEQ ID NO: 68782

SEQ ID NO: 645390 - RNA, 64 nt, hsa; identical to SEQ ID NO: 68783

SEQ ID NO: 645391 - RNA, 64 nt, hsa; identical to SEQ ID NO: 68784

SEQ ID NO: 645392 - RNA, 64 nt, hsa; identical to SEQ ID NO: 68785

SEQ ID NO: 645393 - RNA, 64 nt, hsa; identical to SEQ ID NO: 68786

SEQ ID NO: 645394 - RNA, 64 nt, hsa; identical to SEQ ID NO: 68787

SEQ ID NO: 645395 - RNA, 64 nt, hsa; identical to SEQ ID NO: 68788

SEQ ID NO: 645396 - RNA, 64 nt, hsa; identical to SEQ ID NO: 68789

SEQ ID NO: 645397 - RNA, 64 nt, hsa; identical to SEQ ID NO: 68790

SEQ ID NO: 645398 - RNA, 64 nt, hsa; identical to SEQ ID NO: 68791

SEQ ID NO: 645399 - RNA, 64 nt, hsa; identical to SEQ ID NO: 68792

SEQ ID NO: 645400 - RNA, 64 nt, hsa; identical to SEQ ID NO: 68793

SEQ ID NO: 645401 - RNA, 64 nt, hsa; identical to SEQ ID NO: 68794

SEQ ID NO: 645402 - RNA, 64 nt, hsa; identical to SEQ ID NO: 68795

SEQ ID NO: 645403 - RNA, 64 nt, hsa; identical to SEQ ID NO: 68796

SEQ ID NO: 645404 - RNA, 64 nt, hsa; identical to SEQ ID NO: 68797

SEQ ID NO: 645405 - RNA, 64 nt, hsa; identical to SEQ ID NO: 68798

SEQ ID NO: 645406 - RNA, 64 nt, hsa; identical to SEQ ID NO: 68799

SEQ ID NO: 645407 - RNA, 64 nt, hsa; identical to SEQ ID NO: 68800

SEQ ID NO: 645408 - RNA, 64 nt, hsa; identical to SEQ ID NO: 68801

SEQ ID NO: 645409 - RNA, 59 nt, hsa; identical to SEQ ID NO: 68802

SEQ ID NO: 645410 - RNA, 64 nt, hsa; identical to SEQ ID NO: 68803

SEQ ID NO: 645411 - RNA, 64 nt, hsa; identical to SEQ ID NO: 68804

SEQ ID NO: 645412 - RNA, 64 nt, hsa; identical to SEQ ID NO: 68805

SEQ ID NO: 645413 - RNA, 64 nt, hsa; identical to SEQ ID NO: 68806

SEQ ID NO: 645414 - RNA, 64 nt, hsa; identical to SEQ ID NO: 68807

SEQ ID NO: 645415 - RNA, 64 nt, hsa; identical to SEQ ID NO: 68808

SEQ ID NO: 645416 - RNA, 64 nt, hsa; identical to SEQ ID NO: 68809

SEQ ID NO: 645417 - RNA, 64 nt, hsa; identical to SEQ ID NO: 68810

SEQ ID NO: 645418 - RNA, 64 nt, hsa; identical to SEQ ID NO: 68811

SEQ ID NO: 645419 - RNA, 64 nt, hsa; identical to SEQ ID NO: 68812

SEQ ID NO: 645420 - RNA, 64 nt, hsa
uuugcaggggacugggccauggguccucggcccaucuguccauccuccucuccaugcaagugcu

SEQ ID NO: 645421 - RNA, 64 nt, hsa
acacuccagaauuacccuuccucaucugugccugucuguccaaccccucccccacgucucucug

SEQ ID NO: 645422 - RNA, 64 nt, hsa
auuuuguuguuauguaauauucuuuggcuacgcaucuguccagcaucuuauuaaccauaauacu

SEQ ID NO: 645423 - RNA, 64 nt, hsa
uuucauucuuauaucuucauuaguucaucauaaaucuguccaguugaggccucaggaccacggc

SEQ ID NO: 645424 - RNA, 64 nt, hsa
acuugcauguuugggacucaaauuuuacuugaugucuguccauucuuguggcccuaucagccuu

SEQ ID NO: 645425 - RNA, 64 nt, hsa
gaaaccauauaaagaauucuuuugaggauggaauucuguccacaaaauaauuuugugagcccag

SEQ ID NO: 645426 - RNA, 64 nt, hsa
gaucuugauccacagaaauacaugaaaugucuggucuguccaccccaucaacaagucuugaaac

SEQ ID NO: 645427 - RNA, 64 nt, hsa
ucaacaagucuugaaacaagcaacagauggauagucuguccaaauggacauaagacagacagca

SEQ ID NO: 645428 - RNA, 64 nt, hsa
ggaaggaaggcaaggcugucuguccauccguccgucuguccaccuaccugucaguccacauagg

SEQ ID NO: 645429 - RNA, 64 nt, hsa
ggaguggaccgaggaaggaaggaaggcaaggcugucuguccauccguccgucuguccaccuacc

SEQ ID NO: 645430 - RNA, 64 nt, hsa
auguguucgcuuguagggugcuggcugaauagacucuguccagcccuguucuguagucucaagc

SEQ ID NO: 645431 - RNA, 64 nt, hsa
agacaaggaagguagggcaccugcugcacacgauucuguccagagugagcacuggaugguggag

SEQ ID NO: 645432 - RNA, 64 nt, hsa
caggucgguccugacucuccugacucuccaucgcucuguccaaggagaacccggagaggcucug

SEQ ID NO: 645433 - RNA, 64 nt, hsa
uaauuuuucccuuuucaaccugaacaaaucacauucuguccagauuccucuuguaaaauaaccc

SEQ ID NO: 645434 - RNA, 64 nt, hsa
guccugggagagaagaggaggaucucaucucucaucuguccaaacaaggcaaggagacuuucuc

SEQ ID NO: 645435 - RNA, 64 nt, hsa
auauugaguuaauagaacgguaucuuguauuucuucuguccaguuauacuuauaaaugccugca

SEQ ID NO: 645436 - RNA, 64 nt, hsa
gagaggcugguuacagcuucagucccuuugucugucuguccauccauuccuccauccacccauc

SEQ ID NO: 645437 - RNA, 64 nt, hsa
ugucugucuguccauccauuccuccauccacccaucuguccauccgcccaucugcccguccauc

SEQ ID NO: 645438 - RNA, 64 nt, hsa
uccugguuaguccagcucuuuacucuaaacccuuucuguccaaaaugagucauuuucaguugua

SEQ ID NO: 645439 - RNA, 64 nt, hsa
ccccuccccaccaaauaaacaugauauuucauucucuguccagcagucaugaaccccuucaccu

SEQ ID NO: 645440 - RNA, 64 nt, hsa
gcucgguaccgaugcgugggcugggcuaggucccucuguccaucugggccuuuguaugagcugc

SEQ ID NO: 645441 - RNA, 64 nt, hsa
cuccaggcgcccucggccgcccaucaugguuaauucuguccaacaaacacacacggguagauug

SEQ ID NO: 645442 - RNA, 64 nt, hsa
cagugucaugagacgggagcccuuugcugugugcucuguccagugucaugagacgggagcccuu

SEQ ID NO: 645443 - RNA, 64 nt, hsa
cagugucaugagacgggagcccuuugcugugugcucuguccagugucaugaggcagguguuugc

SEQ ID NO: 645444 - RNA, 64 nt, hsa
ccugguaggaucuguccaugggauggagaaccacucuguccagaucugggguugggucaugaca

SEQ ID NO: 645445 - RNA, 64 nt, hsa
aggccuucaccuacgugaagaccuccugguaggaucuguccaugggauggagaaccacucuguc

SEQ ID NO: 645446 - RNA, 64 nt, hsa
cucagaauccuggugccuugaaguucucugugcaucuguccauccucccuauggcccuggccag

SEQ ID NO: 645447 - RNA, 64 nt, hsa
caggccaucucuggcugucuuccugucucuccugucuguccaccuccuccucuuccucuccuuu

SEQ ID NO: 645448 - RNA, 64 nt, hsa
ccccuggugucauggacuuagucuuugccagcauucuguccauguguucucuggucuucucuca

SEQ ID NO: 645449 - RNA, 64 nt, hsa
ugagcaucuucacccauuuggucguugagacauaucuguccaugucugucuaaaaggggaggag

SEQ ID NO: 645450 - RNA, 64 nt, hsa
ccucuguccaguccuuaauccuguguugcaauucucuguccagacaaucucaacucugagguug

SEQ ID NO: 645451 - RNA, 64 nt, hsa
ugaaccuaggcugugaccuuuugccuucacaaccucuguccaguccuuaauccuguguugcaau

SEQ ID NO: 645452 - RNA, 64 nt, hsa
ccuugaccucaccccugccccuacccgaaggcccucuguccacacaacaugaaccuaggcugug

SEQ ID NO: 645453 - RNA, 64 nt, hsa
uuuccuaagaagacauugcuggaguugacuuucuucuguccaaacaaacaaacaaaaacuaaac

SEQ ID NO: 645454 - RNA, 64 nt, hsa
caauauguacacgcuaaggaaaaacuagcacccuucuguccacucagcaauaagagggaucucu

SEQ ID NO: 645455 - RNA, 64 nt, hsa; identical to SEQ ID NO: 43747

SEQ ID NO: 645456 - RNA, 64 nt, hsa; identical to SEQ ID NO: 43748

SEQ ID NO: 645457 - RNA, 64 nt, hsa; identical to SEQ ID NO: 43749

SEQ ID NO: 645458 - RNA, 64 nt, hsa; identical to SEQ ID NO: 43750

SEQ ID NO: 645459 - RNA, 64 nt, hsa; identical to SEQ ID NO: 43751

SEQ ID NO: 645460 - RNA, 64 nt, hsa; identical to SEQ ID NO: 43752

SEQ ID NO: 645461 - RNA, 64 nt, hsa; identical to SEQ ID NO: 43753

SEQ ID NO: 645462 - RNA, 64 nt, hsa; identical to SEQ ID NO: 43754

SEQ ID NO: 645463 - RNA, 64 nt, hsa; identical to SEQ ID NO: 43755

SEQ ID NO: 645464 - RNA, 64 nt, hsa; identical to SEQ ID NO: 43756

SEQ ID NO: 645465 - RNA, 64 nt, hsa; identical to SEQ ID NO: 43757

SEQ ID NO: 645466 - RNA, 64 nt, hsa; identical to SEQ ID NO: 43758

SEQ ID NO: 645467 - RNA, 64 nt, hsa; identical to SEQ ID NO: 43759

SEQ ID NO: 645468 - RNA, 64 nt, hsa; identical to SEQ ID NO: 43760

SEQ ID NO: 645469 - RNA, 64 nt, hsa; identical to SEQ ID NO: 43761

SEQ ID NO: 645470 - RNA, 64 nt, hsa; identical to SEQ ID NO: 165842

SEQ ID NO: 645471 - RNA, 64 nt, hsa; identical to SEQ ID NO: 165843

SEQ ID NO: 645472 - RNA, 64 nt, hsa
auaauucccaacucauaaauugcuuuccuaacaacuagcaaaagcuauuguucauaauggcauu

SEQ ID NO: 645473 - RNA, 64 nt, hsa
cccaugaacagcuaauguguagugaaagaaugagcuagcaaaugaguuuuagcggggacaaaaa

SEQ ID NO: 645474 - RNA, 64 nt, hsa
aagagaauugguuuggcugaaucacaacaaauaacuagcaaagcuucagugcuuuugcaaacuu

SEQ ID NO: 645475 - RNA, 64 nt, hsa
auuucacaauuuaaauaguuauuuuaaugauuuucuagcaaauaauagagaauaauguuuaugc

SEQ ID NO: 645476 - RNA, 64 nt, hsa
cagcugauuuaaauaauuuguaaaauccugcuaacuagcaaauucacauugagauuuucuauug

SEQ ID NO: 645477 - RNA, 64 nt, hsa
uuuuuagccuggcuccguucugguguaacccggucuagcaaaagcuaagccuggauugcagggc

SEQ ID NO: 645478 - RNA, 64 nt, hsa
gugccauuuagcaaaacgucuuuagucuaugcaacuagcaaaaaucugcauaaugcaacaacac

SEQ ID NO: 645479 - RNA, 64 nt, hsa
ugagggguucuucacgauucuccuggaacccagucuagcaaaaugagaggaaaggcccuaggga

SEQ ID NO: 645480 - RNA, 64 nt, hsa
uuucacaccagcccacaccauuccagugcucagccuagcaaaugugcuuuaaugcacacuucuc

SEQ ID NO: 645481 - RNA, 64 nt, hsa
ccaggcaaccaacaccugauuuugucucaacuggcuagcaaaugcccagccuucagagugugca

SEQ ID NO: 645482 - RNA, 64 nt, hsa
ggcggaaacagcauuugccuucugagagaagagacuagcaaaaagcugcagagaggauucggcc

SEQ ID NO: 645483 - RNA, 64 nt, hsa
cugagccgucugagggccuucaugccggcagcagcuagcaaagccagaaagcaagucuaacagg

SEQ ID NO: 645484 - RNA, 64 nt, hsa
uuucauuaaauggaauaauaugaugccacuuugcagcuaaaauaagcucagugauaccuccuug

SEQ ID NO: 645485 - RNA, 64 nt, hsa
gggcuucuguaccacacuagaauucaugugagaaagcuaaaaugguggucuucuccaccagccc

SEQ ID NO: 645486 - RNA, 64 nt, hsa
uucuucugguaaagcuaaaauucuggaccacugaagcuaaaagcccuauugcaaguaugaaauu

SEQ ID NO: 645487 - RNA, 64 nt, hsa
cauagggaggauaagaagaguguucuucugguaaagcuaaaauucuggaccacugaagcuaaaa

SEQ ID NO: 645488 - RNA, 64 nt, hsa
cuagccagaauaauuuuagaucugaucagguaguagcuaaaauuagaaaaaaacaaaauagaug

SEQ ID NO: 645489 - RNA, 64 nt, hsa
agugaaaugucagugucaaaauauuauagauuauagcuaaaauccagauuaauacucauuuggg

SEQ ID NO: 645490 - RNA, 64 nt, hsa
ccaaauggcauaugacccuguuuacacagccuaaagcuaaaaauauuacucuaguuuauucuaa

SEQ ID NO: 645491 - RNA, 64 nt, hsa
uuauuucuguuauuuuuaagcuuuuauuucuuguagcuaaaaauaaaacaucauaaaucuggua

SEQ ID NO: 645492 - RNA, 64 nt, hsa
aguuaagaacauuauauuccauuuaguuucaaauagcuaaaaggagauuuuguccccaacaaaa

SEQ ID NO: 645493 - RNA, 64 nt, hsa
aguuaaacauugcauguuauuacuuauauguggaagcuaaaaaaauugauaucauagaaguaaa

SEQ ID NO: 645494 - RNA, 64 nt, hsa
uauacuucugaccuuugggcuuucuuuucuacuaagcuaaaaauuccuuuuuaucaaaguguac

SEQ ID NO: 645495 - RNA, 64 nt, hsa
agaccuuuaagcaaacuacuacagccaacucaaaagcuaaaacugaacaaauuugauguuaugc

SEQ ID NO: 645496 - RNA, 64 nt, hsa
auugauggacucauuucucucaagagauuggacaagcuaaaauucuagagaguucaaaaguguu

SEQ ID NO: 645497 - RNA, 64 nt, hsa
aggcucuagcauguggcauggaauuuuggcaucuagcuaaaauuccucaacccauaguuaagcu

SEQ ID NO: 645498 - RNA, 64 nt, hsa
ccccacgaguggaaaauagacuucuacauaggaaagcuaaaauauguuaauauuuuuaaauuaa

SEQ ID NO: 645499 - RNA, 64 nt, hsa
aaaaaaauacagauuaccaauuucaagugcugccagcuaaaauaacuguuuuaacggguaucuu

SEQ ID NO: 645500 - RNA, 64 nt, hsa
uaaaaauauuaguuugguguguauuggggaaaauagcuaaaagucuaauuuuuacccauuuaga

SEQ ID NO: 645501 - RNA, 64 nt, hsa
uauuuucuaauguucaguacaauaaauauaaggaagcuaaaacaccaauguggaauuccuguuu

SEQ ID NO: 645502 - RNA, 64 nt, hsa
uaaauucugaacuguauccauauuuuaaggaaggagcuaaaaauggaaauucaugaaacauaaa

SEQ ID NO: 645503 - RNA, 64 nt, hsa
ugcuuuaaaaauggccuuccuacacauuagcuccagcuaaaaagacacauuggagagcuuagag

SEQ ID NO: 645504 - RNA, 64 nt, hsa
auggaauggcacuucauauauucucauuugugggagcuaaaaauuacaauaaucaaacuuaagg

SEQ ID NO: 645505 - RNA, 64 nt, hsa
aguuauauucucaaguuuauuuuuuuccaaguguagcuaaaauauuuuugcagguaaaauaaag

SEQ ID NO: 645506 - RNA, 64 nt, hsa
auuaucagccagaagugcaacauguaugugcaaaagcuaaaauggcuuaacaucaugcuacacu

SEQ ID NO: 645507 - RNA, 64 nt, hsa
uuuuuuucuuccagaaugucuuauuuaaaaagaaagcuaaaagcauacuucuaagucagagccu

SEQ ID NO: 645508 - RNA, 64 nt, hsa
cacuugaaugaagcugagagagagaucuagcaaaagcuaaaacucauguugucuaucuuugaac

SEQ ID NO: 645509 - RNA, 64 nt, hsa
uuuuugguaacucuuuggguuucugauuuguuuuagcuaaaauuuuggggauaugauuuggguc

SEQ ID NO: 645510 - RNA, 64 nt, hsa
aaagcaugugugccuguuucaucuaaucaagcagagcuaaaauguucauaccgaauaaauuuau

SEQ ID NO: 645511 - RNA, 64 nt, hsa
ugucucaauuauauauguguguguauguuuuuaaagcuaaaaacauuacuuuuagaucccuaga

SEQ ID NO: 645512 - RNA, 64 nt, hsa
agcauugggcugugguagccaaaaaccauagguuagcuaaaaagaucaugauacaauuauuuua

SEQ ID NO: 645513 - RNA, 64 nt, hsa
ugugaaagcaguucuuacagcuuuguuuucaaccagcuaaaaauguuuuauauauuacucuaac

SEQ ID NO: 645514 - RNA, 64 nt, hsa
cuggcuuuccuuuuuaaaagauauuuuacugaagagcuaaaaacuggccagugugggguuagca

SEQ ID NO: 645515 - RNA, 64 nt, hsa
acaaaagucucuauauucuuugccuauuccaaagagcuaaaaaagucuaacccaggaaagcuuu

SEQ ID NO: 645516 - RNA, 64 nt, hsa
guuauuguccuacaagcauacugacagugguuacagcuaaaaaagaaagcaugaagaaacaacu

SEQ ID NO: 645517 - RNA, 64 nt, hsa
agucuaagauuauuaccuucauuaauaccaacaggcugcaaagcaagaguauagauuauuguau

SEQ ID NO: 645518 - RNA, 64 nt, hsa
guuugagaaaaggagggaaguuugcuacaaaggggcugcaaagggaauaggcugauggagcugu

SEQ ID NO: 645519 - RNA, 64 nt, hsa
cuucuuuggcccagcugggacuccuauugagacagcugcaaaacaggcugauuucaauuaggca

SEQ ID NO: 645520 - RNA, 64 nt, hsa
ugguaccucuaguagauaguguguucauuucccugcugcaaauuuugaaguauuugggcaggug

SEQ ID NO: 645521 - RNA, 64 nt, hsa
uuucaccugagagcuucaguucuucugcagaauggcugcaaauuuaauugcauuaaggcaagaa

SEQ ID NO: 645522 - RNA, 64 nt, hsa
aggucaguacccuuugguauuucgauuagaagaagcugcaaaagaaaggcagcccauuuuacca

SEQ ID NO: 645523 - RNA, 64 nt, hsa
uaguguaugaauugcugugcugcaaagccaaacagcugcaaaauguugaaaaaucaucgaaaug

SEQ ID NO: 645524 - RNA, 64 nt, hsa
guaauuuuguacaguauaguguaugaauugcugugcugcaaagccaaacagcugcaaaauguug

SEQ ID NO: 645525 - RNA, 64 nt, hsa
uagaguaauuaauuuaauaaaguaaauuaguauugcugcaaauaguuaaauuauauuuauuuga

SEQ ID NO: 645526 - RNA, 64 nt, hsa
aaauuuaaaaaugaauaaaaagacauacuucucagcugcaaauauuauggagaauuggggcacc

SEQ ID NO: 645527 - RNA, 64 nt, hsa
ucauuguguuaaauguauacuuguaaauaaaauagcugcaaaccucaguccuuugugcuacuug

SEQ ID NO: 645528 - RNA, 54 nt, hsa
cuucaugcucggugaugugauucugcugcaaagccugaggacacugggaauaua

SEQ ID NO: 645529 - RNA, 64 nt, hsa
aagggauggaugcaaccuagcuuaacaguauaaugcugcaaauuuuccuccauuaucagccaga

SEQ ID NO: 645530 - RNA, 64 nt, hsa
ucuuggagccugccagauauuguuagguccuggggcugcaaagagguccucaacaggauguaaa

SEQ ID NO: 645531 - RNA, 64 nt, hsa
ccugcagggcccucccuuuucccauuguuccugcgcugcaaauugcaggccccagcaaucguga

SEQ ID NO: 645532 - RNA, 64 nt, hsa
aaccaggggaggccugaggcuucaguuuuacucugcugcaaaaugaaggcgggccugcaagccg

SEQ ID NO: 645533 - RNA, 64 nt, hsa
gauaugaucccagaaaacaucugucucuacuucggcugcaaaacccaugguuuaaaucuauaug

SEQ ID NO: 645534 - RNA, 64 nt, hsa
aaucaggaaaacaggaaaacacagcuuucuagcagcugcaaaaugguuuaaugcccccuacaua

SEQ ID NO: 645535 - RNA, 64 nt, hsa
ugaaaaugcacaaaguuaugaaaguuaaagguaugcugcaaauaacuagccauuauucuaugua

SEQ ID NO: 645536 - RNA, 64 nt, hsa
gucccuuuuucaauaucacauuaccaaaaagauggcugcaaauguaauuuggaccuuucauuaa

SEQ ID NO: 645537 - RNA, 64 nt, hsa
uaauaauagggaauaaguuugcaacuaaucucaugcugcaaacuuguguuaauucuguuuaaua

SEQ ID NO: 645538 - RNA, 64 nt, hsa
acaaauuaagagagcugauuagacauaggcaaaugcugcaaacuuccaauauguucauaucguu

SEQ ID NO: 645539 - RNA, 64 nt, hsa; identical to SEQ ID NO: 564100

SEQ ID NO: 645540 - RNA, 64 nt, hsa; identical to SEQ ID NO: 564101

SEQ ID NO: 645541 - RNA, 64 nt, hsa; identical to SEQ ID NO: 564102

SEQ ID NO: 645542 - RNA, 64 nt, hsa; identical to SEQ ID NO: 564103

SEQ ID NO: 645543 - RNA, 64 nt, hsa; identical to SEQ ID NO: 564104

SEQ ID NO: 645544 - RNA, 64 nt, hsa; identical to SEQ ID NO: 564105

SEQ ID NO: 645545 - RNA, 64 nt, hsa; identical to SEQ ID NO: 564106

SEQ ID NO: 645546 - RNA, 64 nt, hsa; identical to SEQ ID NO: 564107

SEQ ID NO: 645547 - RNA, 64 nt, hsa; identical to SEQ ID NO: 564108

SEQ ID NO: 645548 - RNA, 64 nt, hsa; identical to SEQ ID NO: 564109

SEQ ID NO: 645549 - RNA, 64 nt, hsa; identical to SEQ ID NO: 564110

SEQ ID NO: 645550 - RNA, 64 nt, hsa; identical to SEQ ID NO: 564111

SEQ ID NO: 645551 - RNA, 64 nt, hsa; identical to SEQ ID NO: 564112

SEQ ID NO: 645552 - RNA, 64 nt, hsa; identical to SEQ ID NO: 564113

SEQ ID NO: 645553 - RNA, 64 nt, hsa; identical to SEQ ID NO: 564114

SEQ ID NO: 645554 - RNA, 64 nt, hsa; identical to SEQ ID NO: 564115

SEQ ID NO: 645555 - RNA, 64 nt, hsa; identical to SEQ ID NO: 564116

SEQ ID NO: 645556 - RNA, 64 nt, hsa; identical to SEQ ID NO: 564117

SEQ ID NO: 645557 - RNA, 64 nt, hsa; identical to SEQ ID NO: 564118

SEQ ID NO: 645558 - RNA, 64 nt, hsa; identical to SEQ ID NO: 564119

SEQ ID NO: 645559 - RNA, 64 nt, hsa; identical to SEQ ID NO: 564120

SEQ ID NO: 645560 - RNA, 64 nt, hsa; identical to SEQ ID NO: 564121

SEQ ID NO: 645561 - RNA, 64 nt, hsa; identical to SEQ ID NO: 564122

SEQ ID NO: 645562 - RNA, 64 nt, hsa; identical to SEQ ID NO: 564123

SEQ ID NO: 645563 - RNA, 64 nt, hsa; identical to SEQ ID NO: 564124

SEQ ID NO: 645564 - RNA, 64 nt, hsa; identical to SEQ ID NO: 564125

SEQ ID NO: 645565 - RNA, 64 nt, hsa; identical to SEQ ID NO: 564126

SEQ ID NO: 645566 - RNA, 64 nt, hsa; identical to SEQ ID NO: 564127

SEQ ID NO: 645567 - RNA, 64 nt, hsa; identical to SEQ ID NO: 564128

SEQ ID NO: 645568 - RNA, 64 nt, hsa; identical to SEQ ID NO: 564129

SEQ ID NO: 645569 - RNA, 64 nt, hsa; identical to SEQ ID NO: 564130

SEQ ID NO: 645570 - RNA, 64 nt, hsa; identical to SEQ ID NO: 564131

SEQ ID NO: 645571 - RNA, 64 nt, hsa; identical to SEQ ID NO: 564132

SEQ ID NO: 645572 - RNA, 64 nt, hsa; identical to SEQ ID NO: 564133

SEQ ID NO: 645573 - RNA, 64 nt, hsa; identical to SEQ ID NO: 564134

SEQ ID NO: 645574 - RNA, 64 nt, hsa; identical to SEQ ID NO: 564135

SEQ ID NO: 645575 - RNA, 64 nt, hsa; identical to SEQ ID NO: 564136

SEQ ID NO: 645576 - RNA, 64 nt, hsa; identical to SEQ ID NO: 564137

SEQ ID NO: 645577 - RNA, 64 nt, hsa; identical to SEQ ID NO: 564138

SEQ ID NO: 645578 - RNA, 64 nt, hsa; identical to SEQ ID NO: 564139

SEQ ID NO: 645579 - RNA, 64 nt, hsa; identical to SEQ ID NO: 564140

SEQ ID NO: 645580 - RNA, 64 nt, hsa; identical to SEQ ID NO: 564141

SEQ ID NO: 645581 - RNA, 64 nt, hsa; identical to SEQ ID NO: 564142

SEQ ID NO: 645582 - RNA, 64 nt, hsa; identical to SEQ ID NO: 564143

SEQ ID NO: 645583 - RNA, 64 nt, hsa; identical to SEQ ID NO: 564144

SEQ ID NO: 645584 - RNA, 64 nt, hsa; identical to SEQ ID NO: 564145

SEQ ID NO: 645585 - RNA, 64 nt, hsa; identical to SEQ ID NO: 564146

SEQ ID NO: 645586 - RNA, 64 nt, hsa; identical to SEQ ID NO: 564147

SEQ ID NO: 645587 - RNA, 64 nt, hsa; identical to SEQ ID NO: 564148

SEQ ID NO: 645588 - RNA, 64 nt, hsa; identical to SEQ ID NO: 564149

SEQ ID NO: 645589 - RNA, 64 nt, hsa; identical to SEQ ID NO: 564150

SEQ ID NO: 645590 - RNA, 64 nt, hsa; identical to SEQ ID NO: 564151

SEQ ID NO: 645591 - RNA, 64 nt, hsa; identical to SEQ ID NO: 564152

SEQ ID NO: 645592 - RNA, 64 nt, hsa; identical to SEQ ID NO: 564153

SEQ ID NO: 645593 - RNA, 64 nt, hsa; identical to SEQ ID NO: 564154

SEQ ID NO: 645594 - RNA, 64 nt, hsa; identical to SEQ ID NO: 564155

SEQ ID NO: 645595 - RNA, 64 nt, hsa; identical to SEQ ID NO: 564156

SEQ ID NO: 645596 - RNA, 64 nt, hsa; identical to SEQ ID NO: 564157

SEQ ID NO: 645597 - RNA, 64 nt, hsa; identical to SEQ ID NO: 564158

SEQ ID NO: 645598 - RNA, 64 nt, hsa; identical to SEQ ID NO: 564159

SEQ ID NO: 645599 - RNA, 64 nt, hsa; identical to SEQ ID NO: 564160

SEQ ID NO: 645600 - RNA, 64 nt, hsa; identical to SEQ ID NO: 564161

SEQ ID NO: 645601 - RNA, 64 nt, hsa; identical to SEQ ID NO: 564162

SEQ ID NO: 645602 - RNA, 64 nt, hsa; identical to SEQ ID NO: 564163

SEQ ID NO: 645603 - RNA, 64 nt, hsa; identical to SEQ ID NO: 564164

SEQ ID NO: 645604 - RNA, 64 nt, hsa; identical to SEQ ID NO: 564165

SEQ ID NO: 645605 - RNA, 64 nt, hsa; identical to SEQ ID NO: 564166

SEQ ID NO: 645606 - RNA, 64 nt, hsa; identical to SEQ ID NO: 564167

SEQ ID NO: 645607 - RNA, 64 nt, hsa; identical to SEQ ID NO: 564168

SEQ ID NO: 645608 - RNA, 64 nt, hsa; identical to SEQ ID NO: 564169

SEQ ID NO: 645609 - RNA, 64 nt, hsa; identical to SEQ ID NO: 564170

SEQ ID NO: 645610 - RNA, 64 nt, hsa; identical to SEQ ID NO: 564171

SEQ ID NO: 645611 - RNA, 52 nt, hsa; identical to SEQ ID NO: 564172

SEQ ID NO: 645612 - RNA, 64 nt, hsa; identical to SEQ ID NO: 564173

SEQ ID NO: 645613 - RNA, 64 nt, hsa; identical to SEQ ID NO: 564174

SEQ ID NO: 645614 - RNA, 64 nt, hsa; identical to SEQ ID NO: 564175

SEQ ID NO: 645615 - RNA, 64 nt, hsa; identical to SEQ ID NO: 564176

SEQ ID NO: 645616 - RNA, 64 nt, hsa; identical to SEQ ID NO: 564177

SEQ ID NO: 645617 - RNA, 64 nt, hsa; identical to SEQ ID NO: 564178

SEQ ID NO: 645618 - RNA, 64 nt, hsa; identical to SEQ ID NO: 564179

SEQ ID NO: 645619 - RNA, 64 nt, hsa; identical to SEQ ID NO: 564180

SEQ ID NO: 645620 - RNA, 64 nt, hsa; identical to SEQ ID NO: 564181

SEQ ID NO: 645621 - RNA, 64 nt, hsa; identical to SEQ ID NO: 564182

SEQ ID NO: 645622 - RNA, 64 nt, hsa; identical to SEQ ID NO: 564183

SEQ ID NO: 645623 - RNA, 64 nt, hsa; identical to SEQ ID NO: 564184

SEQ ID NO: 645624 - RNA, 64 nt, hsa; identical to SEQ ID NO: 564185

SEQ ID NO: 645625 - RNA, 64 nt, hsa; identical to SEQ ID NO: 564186

SEQ ID NO: 645626 - RNA, 64 nt, hsa; identical to SEQ ID NO: 564187

SEQ ID NO: 645627 - RNA, 64 nt, hsa; identical to SEQ ID NO: 564188

SEQ ID NO: 645628 - RNA, 64 nt, hsa; identical to SEQ ID NO: 564189

SEQ ID NO: 645629 - RNA, 64 nt, hsa; identical to SEQ ID NO: 564190

SEQ ID NO: 645630 - RNA, 64 nt, hsa; identical to SEQ ID NO: 564191

SEQ ID NO: 645631 - RNA, 64 nt, hsa; identical to SEQ ID NO: 564192

SEQ ID NO: 645632 - RNA, 64 nt, hsa; identical to SEQ ID NO: 564193

SEQ ID NO: 645633 - RNA, 64 nt, hsa; identical to SEQ ID NO: 564194

SEQ ID NO: 645634 - RNA, 64 nt, hsa; identical to SEQ ID NO: 564195

SEQ ID NO: 645635 - RNA, 64 nt, hsa; identical to SEQ ID NO: 564196

SEQ ID NO: 645636 - RNA, 64 nt, hsa; identical to SEQ ID NO: 564197

SEQ ID NO: 645637 - RNA, 64 nt, hsa; identical to SEQ ID NO: 564198

SEQ ID NO: 645638 - RNA, 64 nt, hsa; identical to SEQ ID NO: 564199

SEQ ID NO: 645639 - RNA, 64 nt, hsa; identical to SEQ ID NO: 564200

SEQ ID NO: 645640 - RNA, 64 nt, hsa; identical to SEQ ID NO: 564201

SEQ ID NO: 645641 - RNA, 64 nt, hsa; identical to SEQ ID NO: 564202

SEQ ID NO: 645642 - RNA, 64 nt, hsa; identical to SEQ ID NO: 564203

SEQ ID NO: 645643 - RNA, 64 nt, hsa; identical to SEQ ID NO: 564204

SEQ ID NO: 645644 - RNA, 64 nt, hsa; identical to SEQ ID NO: 564205

SEQ ID NO: 645645 - RNA, 64 nt, hsa; identical to SEQ ID NO: 564206

SEQ ID NO: 645646 - RNA, 64 nt, hsa; identical to SEQ ID NO: 564207

SEQ ID NO: 645647 - RNA, 64 nt, hsa; identical to SEQ ID NO: 564208

SEQ ID NO: 645648 - RNA, 64 nt, hsa; identical to SEQ ID NO: 564209

SEQ ID NO: 645649 - RNA, 64 nt, hsa; identical to SEQ ID NO: 564210

SEQ ID NO: 645650 - RNA, 64 nt, hsa; identical to SEQ ID NO: 564211

SEQ ID NO: 645651 - RNA, 64 nt, hsa; identical to SEQ ID NO: 564212

SEQ ID NO: 645652 - RNA, 64 nt, hsa; identical to SEQ ID NO: 564213

SEQ ID NO: 645653 - RNA, 64 nt, hsa; identical to SEQ ID NO: 564214

SEQ ID NO: 645654 - RNA, 64 nt, hsa; identical to SEQ ID NO: 564215

SEQ ID NO: 645655 - RNA, 64 nt, hsa; identical to SEQ ID NO: 564216

SEQ ID NO: 645656 - RNA, 64 nt, hsa; identical to SEQ ID NO: 564217

SEQ ID NO: 645657 - RNA, 64 nt, hsa; identical to SEQ ID NO: 564218

SEQ ID NO: 645658 - RNA, 64 nt, hsa; identical to SEQ ID NO: 564219

SEQ ID NO: 645659 - RNA, 64 nt, hsa; identical to SEQ ID NO: 564220

SEQ ID NO: 645660 - RNA, 64 nt, hsa; identical to SEQ ID NO: 564221

SEQ ID NO: 645661 - RNA, 64 nt, hsa; identical to SEQ ID NO: 564222

SEQ ID NO: 645662 - RNA, 64 nt, hsa; identical to SEQ ID NO: 564223

SEQ ID NO: 645663 - RNA, 64 nt, hsa; identical to SEQ ID NO: 564224

SEQ ID NO: 645664 - RNA, 64 nt, hsa; identical to SEQ ID NO: 564225

SEQ ID NO: 645665 - RNA, 64 nt, hsa; identical to SEQ ID NO: 564226

SEQ ID NO: 645666 - RNA, 64 nt, hsa; identical to SEQ ID NO: 564227

SEQ ID NO: 645667 - RNA, 64 nt, hsa; identical to SEQ ID NO: 564228

SEQ ID NO: 645668 - RNA, 64 nt, hsa; identical to SEQ ID NO: 564229

SEQ ID NO: 645669 - RNA, 64 nt, hsa; identical to SEQ ID NO: 564230

SEQ ID NO: 645670 - RNA, 64 nt, hsa; identical to SEQ ID NO: 564231

SEQ ID NO: 645671 - RNA, 64 nt, hsa; identical to SEQ ID NO: 564232

SEQ ID NO: 645672 - RNA, 64 nt, hsa; identical to SEQ ID NO: 564233

SEQ ID NO: 645673 - RNA, 64 nt, hsa; identical to SEQ ID NO: 564234

SEQ ID NO: 645674 - RNA, 64 nt, hsa; identical to SEQ ID NO: 564235

SEQ ID NO: 645675 - RNA, 64 nt, hsa; identical to SEQ ID NO: 564236

SEQ ID NO: 645676 - RNA, 64 nt, hsa; identical to SEQ ID NO: 564237

SEQ ID NO: 645677 - RNA, 64 nt, hsa; identical to SEQ ID NO: 564238

SEQ ID NO: 645678 - RNA, 64 nt, hsa; identical to SEQ ID NO: 564239

SEQ ID NO: 645679 - RNA, 64 nt, hsa; identical to SEQ ID NO: 564240

SEQ ID NO: 645680 - RNA, 64 nt, hsa; identical to SEQ ID NO: 564241

SEQ ID NO: 645681 - RNA, 64 nt, hsa; identical to SEQ ID NO: 564242

SEQ ID NO: 645682 - RNA, 64 nt, hsa; identical to SEQ ID NO: 564243

SEQ ID NO: 645683 - RNA, 64 nt, hsa; identical to SEQ ID NO: 564244

SEQ ID NO: 645684 - RNA, 64 nt, hsa; identical to SEQ ID NO: 564245

SEQ ID NO: 645685 - RNA, 64 nt, hsa; identical to SEQ ID NO: 564246

SEQ ID NO: 645686 - RNA, 64 nt, hsa; identical to SEQ ID NO: 564247

SEQ ID NO: 645687 - RNA, 64 nt, hsa; identical to SEQ ID NO: 564248

SEQ ID NO: 645688 - RNA, 64 nt, hsa; identical to SEQ ID NO: 564249

SEQ ID NO: 645689 - RNA, 64 nt, hsa; identical to SEQ ID NO: 564250

SEQ ID NO: 645690 - RNA, 64 nt, hsa; identical to SEQ ID NO: 564251

SEQ ID NO: 645691 - RNA, 64 nt, hsa; identical to SEQ ID NO: 564252

SEQ ID NO: 645692 - RNA, 64 nt, hsa; identical to SEQ ID NO: 564253

SEQ ID NO: 645693 - RNA, 64 nt, hsa; identical to SEQ ID NO: 564254

SEQ ID NO: 645694 - RNA, 64 nt, hsa; identical to SEQ ID NO: 564255

SEQ ID NO: 645695 - RNA, 64 nt, hsa; identical to SEQ ID NO: 564256

SEQ ID NO: 645696 - RNA, 64 nt, hsa; identical to SEQ ID NO: 564257

SEQ ID NO: 645697 - RNA, 64 nt, hsa; identical to SEQ ID NO: 564258

SEQ ID NO: 645698 - RNA, 64 nt, hsa; identical to SEQ ID NO: 564259

SEQ ID NO: 645699 - RNA, 64 nt, hsa; identical to SEQ ID NO: 564260

SEQ ID NO: 645700 - RNA, 64 nt, hsa; identical to SEQ ID NO: 564261

SEQ ID NO: 645701 - RNA, 64 nt, hsa; identical to SEQ ID NO: 564262

SEQ ID NO: 645702 - RNA, 64 nt, hsa; identical to SEQ ID NO: 564263

SEQ ID NO: 645703 - RNA, 64 nt, hsa; identical to SEQ ID NO: 564264

SEQ ID NO: 645704 - RNA, 64 nt, hsa; identical to SEQ ID NO: 564265

SEQ ID NO: 645705 - RNA, 64 nt, hsa; identical to SEQ ID NO: 564266

SEQ ID NO: 645706 - RNA, 64 nt, hsa; identical to SEQ ID NO: 564267

SEQ ID NO: 645707 - RNA, 64 nt, hsa; identical to SEQ ID NO: 564268

SEQ ID NO: 645708 - RNA, 64 nt, hsa; identical to SEQ ID NO: 564269

SEQ ID NO: 645709 - RNA, 64 nt, hsa; identical to SEQ ID NO: 564270

SEQ ID NO: 645710 - RNA, 64 nt, hsa; identical to SEQ ID NO: 564271

SEQ ID NO: 645711 - RNA, 64 nt, hsa; identical to SEQ ID NO: 564272

SEQ ID NO: 645712 - RNA, 64 nt, hsa; identical to SEQ ID NO: 564273

SEQ ID NO: 645713 - RNA, 64 nt, hsa; identical to SEQ ID NO: 564274

SEQ ID NO: 645714 - RNA, 64 nt, hsa; identical to SEQ ID NO: 564275

SEQ ID NO: 645715 - RNA, 64 nt, hsa; identical to SEQ ID NO: 564276

SEQ ID NO: 645716 - RNA, 64 nt, hsa; identical to SEQ ID NO: 564277

SEQ ID NO: 645717 - RNA, 64 nt, hsa; identical to SEQ ID NO: 564278

SEQ ID NO: 645718 - RNA, 64 nt, hsa; identical to SEQ ID NO: 564279

SEQ ID NO: 645719 - RNA, 64 nt, hsa; identical to SEQ ID NO: 564280

SEQ ID NO: 645720 - RNA, 64 nt, hsa; identical to SEQ ID NO: 564281

SEQ ID NO: 645721 - RNA, 64 nt, hsa; identical to SEQ ID NO: 564282

SEQ ID NO: 645722 - RNA, 64 nt, hsa; identical to SEQ ID NO: 564283

SEQ ID NO: 645723 - RNA, 64 nt, hsa; identical to SEQ ID NO: 564284

SEQ ID NO: 645724 - RNA, 64 nt, hsa; identical to SEQ ID NO: 564285

SEQ ID NO: 645725 - RNA, 64 nt, hsa; identical to SEQ ID NO: 564286

SEQ ID NO: 645726 - RNA, 64 nt, hsa; identical to SEQ ID NO: 564287

SEQ ID NO: 645727 - RNA, 64 nt, hsa; identical to SEQ ID NO: 564288

SEQ ID NO: 645728 - RNA, 64 nt, hsa; identical to SEQ ID NO: 564289

SEQ ID NO: 645729 - RNA, 64 nt, hsa; identical to SEQ ID NO: 564290

SEQ ID NO: 645730 - RNA, 64 nt, hsa; identical to SEQ ID NO: 564291

SEQ ID NO: 645731 - RNA, 64 nt, hsa; identical to SEQ ID NO: 564292

SEQ ID NO: 645732 - RNA, 64 nt, hsa; identical to SEQ ID NO: 564293

SEQ ID NO: 645733 - RNA, 64 nt, hsa; identical to SEQ ID NO: 564294

SEQ ID NO: 645734 - RNA, 64 nt, hsa; identical to SEQ ID NO: 564295

SEQ ID NO: 645735 - RNA, 64 nt, hsa; identical to SEQ ID NO: 564296

SEQ ID NO: 645736 - RNA, 64 nt, hsa; identical to SEQ ID NO: 564297

SEQ ID NO: 645737 - RNA, 64 nt, hsa; identical to SEQ ID NO: 564298

SEQ ID NO: 645738 - RNA, 64 nt, hsa; identical to SEQ ID NO: 564299

SEQ ID NO: 645739 - RNA, 64 nt, hsa; identical to SEQ ID NO: 564300

SEQ ID NO: 645740 - RNA, 64 nt, hsa; identical to SEQ ID NO: 564301

SEQ ID NO: 645741 - RNA, 64 nt, hsa; identical to SEQ ID NO: 564302

SEQ ID NO: 645742 - RNA, 64 nt, hsa; identical to SEQ ID NO: 564303

SEQ ID NO: 645743 - RNA, 64 nt, hsa; identical to SEQ ID NO: 564304

SEQ ID NO: 645744 - RNA, 64 nt, hsa; identical to SEQ ID NO: 564305

SEQ ID NO: 645745 - RNA, 64 nt, hsa; identical to SEQ ID NO: 564306

SEQ ID NO: 645746 - RNA, 64 nt, hsa; identical to SEQ ID NO: 564307

SEQ ID NO: 645747 - RNA, 64 nt, hsa; identical to SEQ ID NO: 564308

SEQ ID NO: 645748 - RNA, 64 nt, hsa; identical to SEQ ID NO: 564309

SEQ ID NO: 645749 - RNA, 64 nt, hsa; identical to SEQ ID NO: 564310

SEQ ID NO: 645750 - RNA, 64 nt, hsa; identical to SEQ ID NO: 564311

SEQ ID NO: 645751 - RNA, 64 nt, hsa; identical to SEQ ID NO: 564312

SEQ ID NO: 645752 - RNA, 64 nt, hsa; identical to SEQ ID NO: 564313

SEQ ID NO: 645753 - RNA, 64 nt, hsa; identical to SEQ ID NO: 564314

SEQ ID NO: 645754 - RNA, 64 nt, hsa; identical to SEQ ID NO: 564315

SEQ ID NO: 645755 - RNA, 53 nt, hsa; identical to SEQ ID NO: 564316

SEQ ID NO: 645756 - RNA, 64 nt, hsa; identical to SEQ ID NO: 564317

SEQ ID NO: 645757 - RNA, 64 nt, hsa; identical to SEQ ID NO: 564318

SEQ ID NO: 645758 - RNA, 64 nt, hsa; identical to SEQ ID NO: 564319

SEQ ID NO: 645759 - RNA, 64 nt, hsa; identical to SEQ ID NO: 564320

SEQ ID NO: 645760 - RNA, 64 nt, hsa; identical to SEQ ID NO: 564321

SEQ ID NO: 645761 - RNA, 64 nt, hsa; identical to SEQ ID NO: 564322

SEQ ID NO: 645762 - RNA, 64 nt, hsa; identical to SEQ ID NO: 564323

SEQ ID NO: 645763 - RNA, 64 nt, hsa; identical to SEQ ID NO: 564324

SEQ ID NO: 645764 - RNA, 64 nt, hsa; identical to SEQ ID NO: 564325

SEQ ID NO: 645765 - RNA, 64 nt, hsa; identical to SEQ ID NO: 564326

SEQ ID NO: 645766 - RNA, 64 nt, hsa; identical to SEQ ID NO: 564327

SEQ ID NO: 645767 - RNA, 64 nt, hsa; identical to SEQ ID NO: 564328

SEQ ID NO: 645768 - RNA, 64 nt, hsa; identical to SEQ ID NO: 564329

SEQ ID NO: 645769 - RNA, 64 nt, hsa; identical to SEQ ID NO: 564330

SEQ ID NO: 645770 - RNA, 64 nt, hsa; identical to SEQ ID NO: 564331

SEQ ID NO: 645771 - RNA, 64 nt, hsa; identical to SEQ ID NO: 564332

SEQ ID NO: 645772 - RNA, 64 nt, hsa; identical to SEQ ID NO: 564333

SEQ ID NO: 645773 - RNA, 64 nt, hsa; identical to SEQ ID NO: 564334

SEQ ID NO: 645774 - RNA, 64 nt, hsa; identical to SEQ ID NO: 564335

SEQ ID NO: 645775 - RNA, 64 nt, hsa; identical to SEQ ID NO: 564336

SEQ ID NO: 645776 - RNA, 64 nt, hsa; identical to SEQ ID NO: 564337

SEQ ID NO: 645777 - RNA, 64 nt, hsa; identical to SEQ ID NO: 564338

SEQ ID NO: 645778 - RNA, 64 nt, hsa; identical to SEQ ID NO: 564339

SEQ ID NO: 645779 - RNA, 64 nt, hsa; identical to SEQ ID NO: 564340

SEQ ID NO: 645780 - RNA, 64 nt, hsa; identical to SEQ ID NO: 564341

SEQ ID NO: 645781 - RNA, 64 nt, hsa; identical to SEQ ID NO: 564342

SEQ ID NO: 645782 - RNA, 64 nt, hsa; identical to SEQ ID NO: 564343

SEQ ID NO: 645783 - RNA, 64 nt, hsa; identical to SEQ ID NO: 564344

SEQ ID NO: 645784 - RNA, 64 nt, hsa; identical to SEQ ID NO: 564345

SEQ ID NO: 645785 - RNA, 64 nt, hsa; identical to SEQ ID NO: 564346

SEQ ID NO: 645786 - RNA, 64 nt, hsa; identical to SEQ ID NO: 564347

SEQ ID NO: 645787 - RNA, 64 nt, hsa; identical to SEQ ID NO: 564348

SEQ ID NO: 645788 - RNA, 64 nt, hsa; identical to SEQ ID NO: 564349

SEQ ID NO: 645789 - RNA, 64 nt, hsa; identical to SEQ ID NO: 564350

SEQ ID NO: 645790 - RNA, 64 nt, hsa; identical to SEQ ID NO: 564351

SEQ ID NO: 645791 - RNA, 64 nt, hsa; identical to SEQ ID NO: 564352

SEQ ID NO: 645792 - RNA, 64 nt, hsa; identical to SEQ ID NO: 564353

SEQ ID NO: 645793 - RNA, 64 nt, hsa; identical to SEQ ID NO: 564354

SEQ ID NO: 645794 - RNA, 64 nt, hsa; identical to SEQ ID NO: 564355

SEQ ID NO: 645795 - RNA, 64 nt, hsa; identical to SEQ ID NO: 564356

SEQ ID NO: 645796 - RNA, 64 nt, hsa; identical to SEQ ID NO: 564357

SEQ ID NO: 645797 - RNA, 64 nt, hsa; identical to SEQ ID NO: 564358

SEQ ID NO: 645798 - RNA, 64 nt, hsa; identical to SEQ ID NO: 564359

SEQ ID NO: 645799 - RNA, 64 nt, hsa; identical to SEQ ID NO: 564360

SEQ ID NO: 645800 - RNA, 64 nt, hsa; identical to SEQ ID NO: 564361

SEQ ID NO: 645801 - RNA, 64 nt, hsa; identical to SEQ ID NO: 564362

SEQ ID NO: 645802 - RNA, 64 nt, hsa; identical to SEQ ID NO: 564363

SEQ ID NO: 645803 - RNA, 64 nt, hsa; identical to SEQ ID NO: 564364

SEQ ID NO: 645804 - RNA, 64 nt, hsa; identical to SEQ ID NO: 564365

SEQ ID NO: 645805 - RNA, 64 nt, hsa; identical to SEQ ID NO: 564366

SEQ ID NO: 645806 - RNA, 64 nt, hsa; identical to SEQ ID NO: 564367

SEQ ID NO: 645807 - RNA, 64 nt, hsa; identical to SEQ ID NO: 564368

SEQ ID NO: 645808 - RNA, 64 nt, hsa; identical to SEQ ID NO: 564369

SEQ ID NO: 645809 - RNA, 64 nt, hsa; identical to SEQ ID NO: 564370

SEQ ID NO: 645810 - RNA, 64 nt, hsa; identical to SEQ ID NO: 564371

SEQ ID NO: 645811 - RNA, 64 nt, hsa; identical to SEQ ID NO: 564372

SEQ ID NO: 645812 - RNA, 64 nt, hsa; identical to SEQ ID NO: 564373

SEQ ID NO: 645813 - RNA, 64 nt, hsa; identical to SEQ ID NO: 564374

SEQ ID NO: 645814 - RNA, 64 nt, hsa; identical to SEQ ID NO: 564375

SEQ ID NO: 645815 - RNA, 64 nt, hsa; identical to SEQ ID NO: 564376

SEQ ID NO: 645816 - RNA, 64 nt, hsa; identical to SEQ ID NO: 564377

SEQ ID NO: 645817 - RNA, 64 nt, hsa; identical to SEQ ID NO: 564378

SEQ ID NO: 645818 - RNA, 64 nt, hsa; identical to SEQ ID NO: 564379

SEQ ID NO: 645819 - RNA, 64 nt, hsa; identical to SEQ ID NO: 564380

SEQ ID NO: 645820 - RNA, 64 nt, hsa; identical to SEQ ID NO: 564381

SEQ ID NO: 645821 - RNA, 64 nt, hsa; identical to SEQ ID NO: 564382

SEQ ID NO: 645822 - RNA, 64 nt, hsa; identical to SEQ ID NO: 564383

SEQ ID NO: 645823 - RNA, 64 nt, hsa; identical to SEQ ID NO: 564384

SEQ ID NO: 645824 - RNA, 64 nt, hsa; identical to SEQ ID NO: 564385

SEQ ID NO: 645825 - RNA, 64 nt, hsa; identical to SEQ ID NO: 564386

SEQ ID NO: 645826 - RNA, 64 nt, hsa; identical to SEQ ID NO: 564387

SEQ ID NO: 645827 - RNA, 64 nt, hsa; identical to SEQ ID NO: 564388

SEQ ID NO: 645828 - RNA, 64 nt, hsa; identical to SEQ ID NO: 564389

SEQ ID NO: 645829 - RNA, 64 nt, hsa; identical to SEQ ID NO: 564390

SEQ ID NO: 645830 - RNA, 64 nt, hsa; identical to SEQ ID NO: 564391

SEQ ID NO: 645831 - RNA, 64 nt, hsa; identical to SEQ ID NO: 564392

SEQ ID NO: 645832 - RNA, 64 nt, hsa; identical to SEQ ID NO: 564393

SEQ ID NO: 645833 - RNA, 64 nt, hsa; identical to SEQ ID NO: 564394

SEQ ID NO: 645834 - RNA, 64 nt, hsa; identical to SEQ ID NO: 564395

SEQ ID NO: 645835 - RNA, 64 nt, hsa; identical to SEQ ID NO: 564396

SEQ ID NO: 645836 - RNA, 64 nt, hsa; identical to SEQ ID NO: 564397

SEQ ID NO: 645837 - RNA, 64 nt, hsa; identical to SEQ ID NO: 564398

SEQ ID NO: 645838 - RNA, 64 nt, hsa; identical to SEQ ID NO: 564399

SEQ ID NO: 645839 - RNA, 64 nt, hsa; identical to SEQ ID NO: 564400

SEQ ID NO: 645840 - RNA, 64 nt, hsa; identical to SEQ ID NO: 564401

SEQ ID NO: 645841 - RNA, 64 nt, hsa; identical to SEQ ID NO: 564402

SEQ ID NO: 645842 - RNA, 64 nt, hsa; identical to SEQ ID NO: 564403

SEQ ID NO: 645843 - RNA, 64 nt, hsa; identical to SEQ ID NO: 564404

SEQ ID NO: 645844 - RNA, 64 nt, hsa; identical to SEQ ID NO: 564405

SEQ ID NO: 645845 - RNA, 64 nt, hsa; identical to SEQ ID NO: 564406

SEQ ID NO: 645846 - RNA, 64 nt, hsa; identical to SEQ ID NO: 564407

SEQ ID NO: 645847 - RNA, 64 nt, hsa; identical to SEQ ID NO: 564408

SEQ ID NO: 645848 - RNA, 64 nt, hsa; identical to SEQ ID NO: 564409

SEQ ID NO: 645849 - RNA, 64 nt, hsa; identical to SEQ ID NO: 564410

SEQ ID NO: 645850 - RNA, 64 nt, hsa; identical to SEQ ID NO: 564411

SEQ ID NO: 645851 - RNA, 64 nt, hsa; identical to SEQ ID NO: 564400

SEQ ID NO: 645852 - RNA, 64 nt, hsa; identical to SEQ ID NO: 564413

SEQ ID NO: 645853 - RNA, 64 nt, hsa; identical to SEQ ID NO: 225055

SEQ ID NO: 645854 - RNA, 64 nt, hsa; identical to SEQ ID NO: 225056

SEQ ID NO: 645855 - RNA, 64 nt, hsa; identical to SEQ ID NO: 225057

SEQ ID NO: 645856 - RNA, 64 nt, hsa; identical to SEQ ID NO: 225058

SEQ ID NO: 645857 - RNA, 64 nt, hsa; identical to SEQ ID NO: 225059

SEQ ID NO: 645858 - RNA, 64 nt, hsa; identical to SEQ ID NO: 225060

SEQ ID NO: 645859 - RNA, 64 nt, hsa; identical to SEQ ID NO: 225061

SEQ ID NO: 645860 - RNA, 64 nt, hsa; identical to SEQ ID NO: 225062

SEQ ID NO: 645861 - RNA, 64 nt, hsa; identical to SEQ ID NO: 225063

SEQ ID NO: 645862 - RNA, 64 nt, hsa; identical to SEQ ID NO: 225064

SEQ ID NO: 645863 - RNA, 64 nt, hsa; identical to SEQ ID NO: 225065

SEQ ID NO: 645864 - RNA, 64 nt, hsa; identical to SEQ ID NO: 225066

SEQ ID NO: 645865 - RNA, 64 nt, hsa; identical to SEQ ID NO: 225067

SEQ ID NO: 645866 - RNA, 64 nt, hsa; identical to SEQ ID NO: 225068

SEQ ID NO: 645867 - RNA, 64 nt, hsa; identical to SEQ ID NO: 225069

SEQ ID NO: 645868 - RNA, 64 nt, hsa; identical to SEQ ID NO: 225070

SEQ ID NO: 645869 - RNA, 64 nt, hsa; identical to SEQ ID NO: 225071

SEQ ID NO: 645870 - RNA, 64 nt, hsa; identical to SEQ ID NO: 225072

SEQ ID NO: 645871 - RNA, 64 nt, hsa; identical to SEQ ID NO: 225073

SEQ ID NO: 645872 - RNA, 64 nt, hsa; identical to SEQ ID NO: 225074

SEQ ID NO: 645873 - RNA, 64 nt, hsa; identical to SEQ ID NO: 225075

SEQ ID NO: 645874 - RNA, 64 nt, hsa; identical to SEQ ID NO: 225076

SEQ ID NO: 645875 - RNA, 64 nt, hsa; identical to SEQ ID NO: 225077

SEQ ID NO: 645876 - RNA, 64 nt, hsa; identical to SEQ ID NO: 225078

SEQ ID NO: 645877 - RNA, 64 nt, hsa; identical to SEQ ID NO: 95053

SEQ ID NO: 645878 - RNA, 64 nt, hsa; identical to SEQ ID NO: 95054

SEQ ID NO: 645879 - RNA, 64 nt, hsa; identical to SEQ ID NO: 95055

SEQ ID NO: 645880 - RNA, 64 nt, hsa; identical to SEQ ID NO: 95056

SEQ ID NO: 645881 - RNA, 64 nt, hsa; identical to SEQ ID NO: 95057

SEQ ID NO: 645882 - RNA, 64 nt, hsa; identical to SEQ ID NO: 95058

SEQ ID NO: 645883 - RNA, 64 nt, hsa; identical to SEQ ID NO: 95059

SEQ ID NO: 645884 - RNA, 64 nt, hsa; identical to SEQ ID NO: 95060

SEQ ID NO: 645885 - RNA, 64 nt, hsa; identical to SEQ ID NO: 95061

SEQ ID NO: 645886 - RNA, 64 nt, hsa; identical to SEQ ID NO: 95062

SEQ ID NO: 645887 - RNA, 64 nt, hsa; identical to SEQ ID NO: 95063

SEQ ID NO: 645888 - RNA, 64 nt, hsa; identical to SEQ ID NO: 95064

SEQ ID NO: 645889 - RNA, 64 nt, hsa; identical to SEQ ID NO: 95065

SEQ ID NO: 645890 - RNA, 64 nt, hsa; identical to SEQ ID NO: 95066

SEQ ID NO: 645891 - RNA, 64 nt, hsa; identical to SEQ ID NO: 95067

SEQ ID NO: 645892 - RNA, 64 nt, hsa; identical to SEQ ID NO: 95068

SEQ ID NO: 645893 - RNA, 64 nt, hsa; identical to SEQ ID NO: 95069

SEQ ID NO: 645894 - RNA, 64 nt, hsa; identical to SEQ ID NO: 95070

SEQ ID NO: 645895 - RNA, 64 nt, hsa; identical to SEQ ID NO: 95071

SEQ ID NO: 645896 - RNA, 64 nt, hsa; identical to SEQ ID NO: 95072

SEQ ID NO: 645897 - RNA, 64 nt, hsa; identical to SEQ ID NO: 95073

SEQ ID NO: 645898 - RNA, 64 nt, hsa; identical to SEQ ID NO: 95074

SEQ ID NO: 645899 - RNA, 64 nt, hsa; identical to SEQ ID NO: 95075

SEQ ID NO: 645900 - RNA, 64 nt, hsa; identical to SEQ ID NO: 95076

SEQ ID NO: 645901 - RNA, 64 nt, hsa; identical to SEQ ID NO: 95077

SEQ ID NO: 645902 - RNA, 64 nt, hsa; identical to SEQ ID NO: 95078

SEQ ID NO: 645903 - RNA, 64 nt, hsa; identical to SEQ ID NO: 95079

SEQ ID NO: 645904 - RNA, 64 nt, hsa; identical to SEQ ID NO: 119910

SEQ ID NO: 645905 - RNA, 64 nt, hsa; identical to SEQ ID NO: 119911

SEQ ID NO: 645906 - RNA, 64 nt, hsa; identical to SEQ ID NO: 119912

SEQ ID NO: 645907 - RNA, 64 nt, hsa; identical to SEQ ID NO: 119913

SEQ ID NO: 645908 - RNA, 64 nt, hsa; identical to SEQ ID NO: 119914

SEQ ID NO: 645909 - RNA, 64 nt, hsa; identical to SEQ ID NO: 119915

SEQ ID NO: 645910 - RNA, 64 nt, hsa; identical to SEQ ID NO: 119916

SEQ ID NO: 645911 - RNA, 64 nt, hsa; identical to SEQ ID NO: 119917

SEQ ID NO: 645912 - RNA, 64 nt, hsa; identical to SEQ ID NO: 119918

SEQ ID NO: 645913 - RNA, 64 nt, hsa; identical to SEQ ID NO: 119919

SEQ ID NO: 645914 - RNA, 64 nt, hsa; identical to SEQ ID NO: 119920

SEQ ID NO: 645915 - RNA, 64 nt, hsa; identical to SEQ ID NO: 119921

SEQ ID NO: 645916 - RNA, 64 nt, hsa; identical to SEQ ID NO: 119922

SEQ ID NO: 645917 - RNA, 64 nt, hsa; identical to SEQ ID NO: 119923

SEQ ID NO: 645918 - RNA, 64 nt, hsa; identical to SEQ ID NO: 119924

SEQ ID NO: 645919 - RNA, 64 nt, hsa; identical to SEQ ID NO: 119925

SEQ ID NO: 645920 - RNA, 64 nt, hsa; identical to SEQ ID NO: 119926

SEQ ID NO: 645921 - RNA, 64 nt, hsa; identical to SEQ ID NO: 119927

SEQ ID NO: 645922 - RNA, 64 nt, hsa; identical to SEQ ID NO: 119928

SEQ ID NO: 645923 - RNA, 64 nt, hsa; identical to SEQ ID NO: 119929

SEQ ID NO: 645924 - RNA, 64 nt, hsa; identical to SEQ ID NO: 119930

SEQ ID NO: 645925 - RNA, 64 nt, hsa; identical to SEQ ID NO: 119931

SEQ ID NO: 645926 - RNA, 64 nt, hsa; identical to SEQ ID NO: 119932

SEQ ID NO: 645927 - RNA, 64 nt, hsa; identical to SEQ ID NO: 119933

SEQ ID NO: 645928 - RNA, 64 nt, hsa; identical to SEQ ID NO: 119934

SEQ ID NO: 645929 - RNA, 64 nt, hsa; identical to SEQ ID NO: 119935

SEQ ID NO: 645930 - RNA, 64 nt, hsa; identical to SEQ ID NO: 119936

SEQ ID NO: 645931 - RNA, 64 nt, hsa; identical to SEQ ID NO: 119937

SEQ ID NO: 645932 - RNA, 64 nt, hsa; identical to SEQ ID NO: 119938

SEQ ID NO: 645933 - RNA, 64 nt, hsa; identical to SEQ ID NO: 119939

SEQ ID NO: 645934 - RNA, 64 nt, hsa; identical to SEQ ID NO: 119940

SEQ ID NO: 645935 - RNA, 64 nt, hsa; identical to SEQ ID NO: 119941

SEQ ID NO: 645936 - RNA, 64 nt, hsa; identical to SEQ ID NO: 119942

SEQ ID NO: 645937 - RNA, 64 nt, hsa; identical to SEQ ID NO: 119943

SEQ ID NO: 645938 - RNA, 64 nt, hsa; identical to SEQ ID NO: 119944

SEQ ID NO: 645939 - RNA, 64 nt, hsa; identical to SEQ ID NO: 119945

SEQ ID NO: 645940 - RNA, 64 nt, hsa; identical to SEQ ID NO: 119946

SEQ ID NO: 645941 - RNA, 64 nt, hsa; identical to SEQ ID NO: 119947

SEQ ID NO: 645942 - RNA, 64 nt, hsa; identical to SEQ ID NO: 119948

SEQ ID NO: 645943 - RNA, 64 nt, hsa; identical to SEQ ID NO: 119949

SEQ ID NO: 645944 - RNA, 64 nt, hsa; identical to SEQ ID NO: 119950

SEQ ID NO: 645945 - RNA, 64 nt, hsa; identical to SEQ ID NO: 119951

SEQ ID NO: 645946 - RNA, 64 nt, hsa; identical to SEQ ID NO: 119952

SEQ ID NO: 645947 - RNA, 64 nt, hsa; identical to SEQ ID NO: 119953

SEQ ID NO: 645948 - RNA, 64 nt, hsa; identical to SEQ ID NO: 119954

SEQ ID NO: 645949 - RNA, 64 nt, hsa; identical to SEQ ID NO: 119955

SEQ ID NO: 645950 - RNA, 64 nt, hsa; identical to SEQ ID NO: 119956

SEQ ID NO: 645951 - RNA, 64 nt, hsa; identical to SEQ ID NO: 119957

SEQ ID NO: 645952 - RNA, 64 nt, hsa; identical to SEQ ID NO: 119958

SEQ ID NO: 645953 - RNA, 64 nt, hsa; identical to SEQ ID NO: 119959

SEQ ID NO: 645954 - RNA, 64 nt, hsa; identical to SEQ ID NO: 119960

SEQ ID NO: 645955 - RNA, 64 nt, hsa; identical to SEQ ID NO: 119961

SEQ ID NO: 645956 - RNA, 58 nt, hsa; identical to SEQ ID NO: 119962

SEQ ID NO: 645957 - RNA, 64 nt, hsa; identical to SEQ ID NO: 119963

SEQ ID NO: 645958 - RNA, 64 nt, hsa; identical to SEQ ID NO: 119964

SEQ ID NO: 645959 - RNA, 64 nt, hsa; identical to SEQ ID NO: 119965

SEQ ID NO: 645960 - RNA, 64 nt, hsa; identical to SEQ ID NO: 119966

SEQ ID NO: 645961 - RNA, 64 nt, hsa; identical to SEQ ID NO: 119967

SEQ ID NO: 645962 - RNA, 64 nt, hsa; identical to SEQ ID NO: 119968

SEQ ID NO: 645963 - RNA, 64 nt, hsa; identical to SEQ ID NO: 119969

SEQ ID NO: 645964 - RNA, 64 nt, hsa; identical to SEQ ID NO: 119970

SEQ ID NO: 645965 - RNA, 55 nt, hsa; identical to SEQ ID NO: 119971

SEQ ID NO: 645966 - RNA, 64 nt, hsa; identical to SEQ ID NO: 119972

SEQ ID NO: 645967 - RNA, 64 nt, hsa; identical to SEQ ID NO: 119973

SEQ ID NO: 645968 - RNA, 64 nt, hsa; identical to SEQ ID NO: 119974

SEQ ID NO: 645969 - RNA, 64 nt, hsa; identical to SEQ ID NO: 119975

SEQ ID NO: 645970 - RNA, 64 nt, hsa; identical to SEQ ID NO: 119976

SEQ ID NO: 645971 - RNA, 64 nt, hsa; identical to SEQ ID NO: 119977

SEQ ID NO: 645972 - RNA, 64 nt, hsa; identical to SEQ ID NO: 119978

SEQ ID NO: 645973 - RNA, 64 nt, hsa; identical to SEQ ID NO: 119979

SEQ ID NO: 645974 - RNA, 64 nt, hsa; identical to SEQ ID NO: 119980

SEQ ID NO: 645975 - RNA, 64 nt, hsa; identical to SEQ ID NO: 119981

SEQ ID NO: 645976 - RNA, 64 nt, hsa; identical to SEQ ID NO: 119982

SEQ ID NO: 645977 - RNA, 64 nt, hsa; identical to SEQ ID NO: 119983

SEQ ID NO: 645978 - RNA, 64 nt, hsa; identical to SEQ ID NO: 119984

SEQ ID NO: 645979 - RNA, 64 nt, hsa; identical to SEQ ID NO: 119985

SEQ ID NO: 645980 - RNA, 64 nt, hsa; identical to SEQ ID NO: 119986

SEQ ID NO: 645981 - RNA, 64 nt, hsa; identical to SEQ ID NO: 119987

SEQ ID NO: 645982 - RNA, 55 nt, hsa; identical to SEQ ID NO: 119988

SEQ ID NO: 645983 - RNA, 64 nt, hsa; identical to SEQ ID NO: 119989

SEQ ID NO: 645984 - RNA, 64 nt, hsa; identical to SEQ ID NO: 119990

SEQ ID NO: 645985 - RNA, 64 nt, hsa; identical to SEQ ID NO: 119991

SEQ ID NO: 645986 - RNA, 64 nt, hsa; identical to SEQ ID NO: 119992

SEQ ID NO: 645987 - RNA, 64 nt, hsa; identical to SEQ ID NO: 119993

SEQ ID NO: 645988 - RNA, 64 nt, hsa; identical to SEQ ID NO: 119994

SEQ ID NO: 645989 - RNA, 64 nt, hsa; identical to SEQ ID NO: 119995

SEQ ID NO: 645990 - RNA, 64 nt, hsa; identical to SEQ ID NO: 119996

SEQ ID NO: 645991 - RNA, 64 nt, hsa; identical to SEQ ID NO: 119997

SEQ ID NO: 645992 - RNA, 64 nt, hsa; identical to SEQ ID NO: 119998

SEQ ID NO: 645993 - RNA, 62 nt, hsa; identical to SEQ ID NO: 119999

SEQ ID NO: 645994 - RNA, 64 nt, hsa; identical to SEQ ID NO: 120000

SEQ ID NO: 645995 - RNA, 64 nt, hsa; identical to SEQ ID NO: 120001

SEQ ID NO: 645996 - RNA, 64 nt, hsa; identical to SEQ ID NO: 120002

SEQ ID NO: 645997 - RNA, 64 nt, hsa; identical to SEQ ID NO: 120003

SEQ ID NO: 645998 - RNA, 64 nt, hsa; identical to SEQ ID NO: 120004

SEQ ID NO: 645999 - RNA, 64 nt, hsa; identical to SEQ ID NO: 120005

SEQ ID NO: 646000 - RNA, 64 nt, hsa; identical to SEQ ID NO: 120006

SEQ ID NO: 646001 - RNA, 64 nt, hsa; identical to SEQ ID NO: 120007

SEQ ID NO: 646002 - RNA, 64 nt, hsa; identical to SEQ ID NO: 120008

SEQ ID NO: 646003 - RNA, 64 nt, hsa; identical to SEQ ID NO: 239468

SEQ ID NO: 646004 - RNA, 64 nt, hsa; identical to SEQ ID NO: 239469

SEQ ID NO: 646005 - RNA, 64 nt, hsa; identical to SEQ ID NO: 239470

SEQ ID NO: 646006 - RNA, 64 nt, hsa; identical to SEQ ID NO: 239471

SEQ ID NO: 646007 - RNA, 64 nt, hsa; identical to SEQ ID NO: 239472

SEQ ID NO: 646008 - RNA, 64 nt, hsa; identical to SEQ ID NO: 239473

SEQ ID NO: 646009 - RNA, 64 nt, hsa; identical to SEQ ID NO: 239474

SEQ ID NO: 646010 - RNA, 64 nt, hsa; identical to SEQ ID NO: 239475

SEQ ID NO: 646011 - RNA, 64 nt, hsa; identical to SEQ ID NO: 239476

SEQ ID NO: 646012 - RNA, 64 nt, hsa; identical to SEQ ID NO: 239477

SEQ ID NO: 646013 - RNA, 64 nt, hsa; identical to SEQ ID NO: 239478

SEQ ID NO: 646014 - RNA, 64 nt, hsa; identical to SEQ ID NO: 239479

SEQ ID NO: 646015 - RNA, 64 nt, hsa; identical to SEQ ID NO: 239480

SEQ ID NO: 646016 - RNA, 64 nt, hsa; identical to SEQ ID NO: 239481

SEQ ID NO: 646017 - RNA, 64 nt, hsa; identical to SEQ ID NO: 239482

SEQ ID NO: 646018 - RNA, 64 nt, hsa; identical to SEQ ID NO: 239483

SEQ ID NO: 646019 - RNA, 64 nt, hsa; identical to SEQ ID NO: 239484

SEQ ID NO: 646020 - RNA, 64 nt, hsa; identical to SEQ ID NO: 239485

SEQ ID NO: 646021 - RNA, 64 nt, hsa; identical to SEQ ID NO: 239486

SEQ ID NO: 646022 - RNA, 64 nt, hsa; identical to SEQ ID NO: 239487

SEQ ID NO: 646023 - RNA, 64 nt, hsa; identical to SEQ ID NO: 239488

SEQ ID NO: 646024 - RNA, 64 nt, hsa; identical to SEQ ID NO: 239489

SEQ ID NO: 646025 - RNA, 64 nt, hsa; identical to SEQ ID NO: 239490

SEQ ID NO: 646026 - RNA, 64 nt, hsa; identical to SEQ ID NO: 239491

SEQ ID NO: 646027 - RNA, 64 nt, hsa; identical to SEQ ID NO: 239492

SEQ ID NO: 646028 - RNA, 64 nt, hsa; identical to SEQ ID NO: 239493

SEQ ID NO: 646029 - RNA, 64 nt, hsa; identical to SEQ ID NO: 239494

SEQ ID NO: 646030 - RNA, 64 nt, hsa; identical to SEQ ID NO: 239495

SEQ ID NO: 646031 - RNA, 64 nt, hsa; identical to SEQ ID NO: 239496

SEQ ID NO: 646032 - RNA, 64 nt, hsa; identical to SEQ ID NO: 239497

SEQ ID NO: 646033 - RNA, 64 nt, hsa; identical to SEQ ID NO: 239498

SEQ ID NO: 646034 - RNA, 64 nt, hsa; identical to SEQ ID NO: 239499

SEQ ID NO: 646035 - RNA, 64 nt, hsa; identical to SEQ ID NO: 239500

SEQ ID NO: 646036 - RNA, 64 nt, hsa; identical to SEQ ID NO: 239501

SEQ ID NO: 646037 - RNA, 64 nt, hsa; identical to SEQ ID NO: 239502

SEQ ID NO: 646038 - RNA, 64 nt, hsa; identical to SEQ ID NO: 239503

SEQ ID NO: 646039 - RNA, 64 nt, hsa; identical to SEQ ID NO: 239504

SEQ ID NO: 646040 - RNA, 64 nt, hsa; identical to SEQ ID NO: 239505

SEQ ID NO: 646041 - RNA, 64 nt, hsa; identical to SEQ ID NO: 239506

SEQ ID NO: 646042 - RNA, 64 nt, hsa; identical to SEQ ID NO: 239507

SEQ ID NO: 646043 - RNA, 64 nt, hsa; identical to SEQ ID NO: 239508

SEQ ID NO: 646044 - RNA, 64 nt, hsa; identical to SEQ ID NO: 239509

SEQ ID NO: 646045 - RNA, 64 nt, hsa; identical to SEQ ID NO: 239510

SEQ ID NO: 646046 - RNA, 64 nt, hsa; identical to SEQ ID NO: 239511

SEQ ID NO: 646047 - RNA, 64 nt, hsa; identical to SEQ ID NO: 239512

SEQ ID NO: 646048 - RNA, 64 nt, hsa; identical to SEQ ID NO: 239513

SEQ ID NO: 646049 - RNA, 64 nt, hsa; identical to SEQ ID NO: 239514

SEQ ID NO: 646050 - RNA, 64 nt, hsa
ucaucuuacucaucuuaagcccgagccauggaucaacuaggagcccauauaaaugaggcucagu

SEQ ID NO: 646051 - RNA, 64 nt, hsa
agaggggucuggaaagaaacccagaaugcggcagaacuaggaguaaguccaucucaagguggac

SEQ ID NO: 646052 - RNA, 64 nt, hsa; identical to SEQ ID NO: 172966

SEQ ID NO: 646053 - RNA, 64 nt, hsa; identical to SEQ ID NO: 172967

SEQ ID NO: 646054 - RNA, 64 nt, hsa; identical to SEQ ID NO: 172968

SEQ ID NO: 646055 - RNA, 64 nt, hsa; identical to SEQ ID NO: 172969

SEQ ID NO: 646056 - RNA, 64 nt, hsa; identical to SEQ ID NO: 172970

SEQ ID NO: 646057 - RNA, 64 nt, hsa; identical to SEQ ID NO: 172971

SEQ ID NO: 646058 - RNA, 64 nt, hsa; identical to SEQ ID NO: 172972

SEQ ID NO: 646059 - RNA, 64 nt, hsa; identical to SEQ ID NO: 172973

SEQ ID NO: 646060 - RNA, 64 nt, hsa
ucuuaacaaaaauauggauaugaauucaguagauaucuuaaauucaauaaaaucacuggaaguu

SEQ ID NO: 646061 - RNA, 64 nt, hsa
uuuucaugauaacuuauuuuaagaugccuuaaaaaucuuaaagucacaaaaggaaaaagguuuu

SEQ ID NO: 646062 - RNA, 64 nt, hsa
uuccagguuagguccuuuucuuucucauugaaucaucuuaaauaguucuuggcccugaauuuag

SEQ ID NO: 646063 - RNA, 64 nt, hsa
uuuuuuccuuaaaagccacaggggacaguuaaauaucuuaaaauaucuaaaacauuuuuuaaag

SEQ ID NO: 646064 - RNA, 64 nt, hsa
cucagcugcagccuggacaguagagcgagaccccaucuuaaaaauaaagaaggcugggcguggu

SEQ ID NO: 646065 - RNA, 64 nt, hsa
gcuuggauaacuggguacuuugaucuuagauuugaucuuaaaaucacuuugggacugggauccc

SEQ ID NO: 646066 - RNA, 64 nt, hsa
uguugcucaaacugcuuuauacuuauaaacagccaucuuaaauaagcaacguauugugaguacu

SEQ ID NO: 646067 - RNA, 64 nt, hsa
acauaaucuucuacauguaugauuugugccacugaucuuaaaccuaugauucaguaacuucuua

SEQ ID NO: 646068 - RNA, 64 nt, hsa
uuccuucuuugaagagaaucccaaaaguuaguucaucuuaaagugcaauauuguuuaaucuuaa

SEQ ID NO: 646069 - RNA, 64 nt, hsa
aaaguuaguucaucuuaaagugcaauauuguuuaaucuuaaaacugggcaacuuuggaagaacu

SEQ ID NO: 646070 - RNA, 64 nt, hsa
uuauaaucaggcuacauucacauuuucuuuucucaucuuaaaacccuuuauguucaaaauacau

SEQ ID NO: 646071 - RNA, 64 nt, hsa
augaaaaugaggacacuuucugauggucaguaaaaucuuaaaugauuuuugccacugguauucc

SEQ ID NO: 646072 - RNA, 64 nt, hsa
aaauaguuggugcuuacuuucauuuauguuuauuaucuuaaagcaauugauagauuuuacaucu

SEQ ID NO: 646073 - RNA, 64 nt, hsa
uaguuuuuaacuuuuauguuuaaauuuuuuuuaaaucuuaaaaccuucauaucuagguauccau

SEQ ID NO: 646074 - RNA, 64 nt, hsa
uuguacuaagcuccucuguaagacaacaucuuaaaucuuaaaaguguuguuaucaugacuggug

SEQ ID NO: 646075 - RNA, 64 nt, hsa
aaagcauuuguacuaagcuccucuguaagacaacaucuuaaaucuuaaaaguguuguuaucaug

SEQ ID NO: 646076 - RNA, 64 nt, hsa
acuucuucuuuauuaaagcaaauaacuggacauaaucuuaaaggauuccaccuccaucgucuuu

SEQ ID NO: 646077 - RNA, 64 nt, hsa
ugguucuaaaaaccagugaucuuacuuuagcuccaucuuaaaauuucaccuuaaguaaauggcc

SEQ ID NO: 646078 - RNA, 64 nt, hsa
gccuguagaguuucaaccucuuugagauauaaguaucuuaaauaucauagagcacugugauuca

SEQ ID NO: 646079 - RNA, 64 nt, hsa
gagcgagacuccaucucaaaaaaaaauaaaaagaaucuuaaaauaggaacauaauaaaagaucg

SEQ ID NO: 646080 - RNA, 64 nt, hsa
uaauggacuaaaaaaguagagaggaguuguagagaucuuaaaucauucuggaauuccuaauuau

SEQ ID NO: 646081 - RNA, 64 nt, hsa
uuccucauuucuccugauuucuauucuugucucaaucuuaaauuuagagaccaguuguuuuuau

SEQ ID NO: 646082 - RNA, 64 nt, hsa
agguaaaauccaucugggcacucauuuaaaguauaucuuaaaaaagcagcagcaagguaccuug

SEQ ID NO: 646083 - RNA, 64 nt, hsa
aaauccaacagaaaucuagaagucacaagcaaauaucuuaaagguaaaauccaucugggcacuc

SEQ ID NO: 646084 - RNA, 64 nt, hsa
uuaugaauuuuucagaacucauccaguccuuguaaucuuaaacagaugcaaauccuaccccugc

SEQ ID NO: 646085 - RNA, 64 nt, hsa
gcguugccucucacuuugaaagaaagacuccguaaucuuaaacagaugcaaauccaauuaggcg

SEQ ID NO: 646086 - RNA, 64 nt, hsa
gggguggggauggauuaugaugaaaucauuuucaaucuuaaaauauaauacaacaaucuugcaa

SEQ ID NO: 646087 - RNA, 64 nt, hsa
aauucaaguuuagaaacagguaaucagcuauuugaucuuaaaaggcaaugaauuguugggauau

SEQ ID NO: 646088 - RNA, 64 nt, hsa
uagacacuauauaaauccgcagugaugcuuauauaucuuaaauuaguaauaaugggugcuauau

SEQ ID NO: 646089 - RNA, 64 nt, hsa
ucucaaugugaagauuguaaccucaagauuaggaaucuuaaaagagccacuuagccugaauggg

SEQ ID NO: 646090 - RNA, 64 nt, hsa
aucuaaaauguuuuaugacauuuuucuggcugugaucuuaaaauaauucauaucuaaauaguau

SEQ ID NO: 646091 - RNA, 64 nt, hsa
agucuauaaugugaguaguuacuaaaauuuacacaucuuaaaaguguguaaaugcuuaaauuuc

SEQ ID NO: 646092 - RNA, 64 nt, hsa
aaaaugaaagcuuuagaaggcaugagauguuccuaucuuaaauaaagcauguuucuuuucuaua

SEQ ID NO: 646093 - RNA, 64 nt, hsa
aaaucccauggcaaaggguaauaaaaaggaccuaaucuuaaaaauacaauuucuaagcacuugu

SEQ ID NO: 646094 - RNA, 64 nt, hsa
ugguuuagugguuuaagccuuguguggcagauagaucuuaaagggcaaagcaguauauugguag

SEQ ID NO: 646095 - RNA, 64 nt, hsa
uuguuuucccuguugaaaaaaguuacaaaaauaaaucuuaaaguuaguuuuuuguaacacgaau

SEQ ID NO: 646096 - RNA, 64 nt, hsa
agcaucuuggugacuaaggugacuuuguauauucaucuuaaaaauuauguucuuuagacacugc

SEQ ID NO: 646097 - RNA, 64 nt, hsa
ugaguuauauuuauaaauauaucuucagaaauuaaucuuaaaagaggcauuaguucagaauacu

SEQ ID NO: 646098 - RNA, 64 nt, hsa
ccuuccaaccacccuccacacugcugccagagcaaucuuaaaaauguaaacuggcccuauuacu

SEQ ID NO: 646099 - RNA, 64 nt, hsa
acuuacuuuuccauaauauugcaaauaacauaaaaucuuaaaauaauuccaagcugagucuucu

SEQ ID NO: 646100 - RNA, 64 nt, hsa
ccuuuaacccugacauucagucuuaacacauuuuaucuuaaauaauuuauucauuccagaaugu

SEQ ID NO: 646101 - RNA, 64 nt, hsa
aggagacacugcaaagucuuagacaaucuuuggcaucuuaaaauaaaauagcaaaccaacauuu

SEQ ID NO: 646102 - RNA, 64 nt, hsa
acagaucuguuuauuucaguauguaguaaacaauaucuuaaaguguccgauucacuacuuguua

SEQ ID NO: 646103 - RNA, 64 nt, hsa
cacauuucagaggagagaaaaaaaguaauauugaaucuuaaaguguuuagcuaaaagcaugaau

SEQ ID NO: 646104 - RNA, 64 nt, hsa
uuuucucauugguaaaaugugggugcuggauuggaucuuaaagaucccuuccagcucugaaaug

SEQ ID NO: 646105 - RNA, 64 nt, hsa
uacgaguucugcugaucaggaaauuuaagaauuuaucuuaaaaaugcaaggaaaaaagacugcc

SEQ ID NO: 646106 - RNA, 64 nt, hsa
auuaaguuacuauaaauuuggggauccuagagugaucuuaaauauggcaagauacagcucauuu

SEQ ID NO: 646107 - RNA, 64 nt, hsa
aaauggcgcaaauauaccuccauuuauauuuuguaucuuaaaauguaguuuaaaaauaggacca

SEQ ID NO: 646108 - RNA, 64 nt, hsa
guagaugcuuuguauaucuuaaaucccuuaaaggaucuuaaagacaucccucagguguucuauu

SEQ ID NO: 646109 - RNA, 64 nt, hsa
uuugcccugucaguggaugguagaugcuuuguauaucuuaaaucccuuaaaggaucuuaaagac

SEQ ID NO: 646110 - RNA, 64 nt, hsa
aauuuucuuucuaaaaguauaauuuaauagaauuaucuuaaaauacaugaucaguauucagugc

SEQ ID NO: 646111 - RNA, 64 nt, hsa
guuuaugcauauugcaugaguauuaccaagaaaaaucuuaaaaguugugaugugacaugauaua

SEQ ID NO: 646112 - RNA, 64 nt, hsa
cuguuccuagacugcuagaaucuggccccuggccaucuuaaagugccaacauaugccugcaggg

SEQ ID NO: 646113 - RNA, 64 nt, hsa
ggcuagcaguucuaaugugacauucuuuaagcauaucuuaaaauaguauuuaaguaaauggucu

SEQ ID NO: 646114 - RNA, 64 nt, hsa
agugcaagcagaugacaaaaaggugcagaaggcaaucuuaaaacagaaaggugcaggagguacc

SEQ ID NO: 646115 - RNA, 64 nt, hsa
uuggaaaucaggucgauuugugguaacuguagucaucuuaaauuucaaaccauuuaccaucuga

SEQ ID NO: 646116 - RNA, 64 nt, hsa
uauaaagaaccaaagguuuagucaagaaacaaaaaucuuaaagauuauuauaacccagacuaag

SEQ ID NO: 646117 - RNA, 64 nt, hsa
uauuuacucaaaguuaagcuuaaaaauaaguuuuaucuuaaaaucauauuugaagacaguaaga

SEQ ID NO: 646118 - RNA, 64 nt, hsa; identical to SEQ ID NO: 50174

SEQ ID NO: 646119 - RNA, 64 nt, hsa; identical to SEQ ID NO: 50175

SEQ ID NO: 646120 - RNA, 64 nt, hsa; identical to SEQ ID NO: 50176

SEQ ID NO: 646121 - RNA, 64 nt, hsa; identical to SEQ ID NO: 50177

SEQ ID NO: 646122 - RNA, 64 nt, hsa; identical to SEQ ID NO: 50178

SEQ ID NO: 646123 - RNA, 64 nt, hsa; identical to SEQ ID NO: 50179

SEQ ID NO: 646124 - RNA, 64 nt, hsa; identical to SEQ ID NO: 50180

SEQ ID NO: 646125 - RNA, 64 nt, hsa; identical to SEQ ID NO: 50181

SEQ ID NO: 646126 - RNA, 64 nt, hsa; identical to SEQ ID NO: 50182

SEQ ID NO: 646127 - RNA, 64 nt, hsa; identical to SEQ ID NO: 50183

SEQ ID NO: 646128 - RNA, 64 nt, hsa; identical to SEQ ID NO: 50184

SEQ ID NO: 646129 - RNA, 64 nt, hsa; identical to SEQ ID NO: 50185

SEQ ID NO: 646130 - RNA, 64 nt, hsa; identical to SEQ ID NO: 50186

SEQ ID NO: 646131 - RNA, 64 nt, hsa; identical to SEQ ID NO: 50187

SEQ ID NO: 646132 - RNA, 64 nt, hsa; identical to SEQ ID NO: 50188

SEQ ID NO: 646133 - RNA, 64 nt, hsa; identical to SEQ ID NO: 50189

SEQ ID NO: 646134 - RNA, 64 nt, hsa; identical to SEQ ID NO: 50190

SEQ ID NO: 646135 - RNA, 64 nt, hsa; identical to SEQ ID NO: 50191

SEQ ID NO: 646136 - RNA, 64 nt, hsa; identical to SEQ ID NO: 50192

SEQ ID NO: 646137 - RNA, 64 nt, hsa; identical to SEQ ID NO: 50193

SEQ ID NO: 646138 - RNA, 64 nt, hsa; identical to SEQ ID NO: 50194

SEQ ID NO: 646139 - RNA, 64 nt, hsa; identical to SEQ ID NO: 50195

SEQ ID NO: 646140 - RNA, 64 nt, hsa; identical to SEQ ID NO: 50196

SEQ ID NO: 646141 - RNA, 64 nt, hsa; identical to SEQ ID NO: 50197

SEQ ID NO: 646142 - RNA, 64 nt, hsa; identical to SEQ ID NO: 50198

SEQ ID NO: 646143 - RNA, 64 nt, hsa; identical to SEQ ID NO: 50199

SEQ ID NO: 646144 - RNA, 64 nt, hsa; identical to SEQ ID NO: 50200

SEQ ID NO: 646145 - RNA, 64 nt, hsa; identical to SEQ ID NO: 50201

SEQ ID NO: 646146 - RNA, 64 nt, hsa; identical to SEQ ID NO: 50202

SEQ ID NO: 646147 - RNA, 64 nt, hsa; identical to SEQ ID NO: 50203

SEQ ID NO: 646148 - RNA, 64 nt, hsa; identical to SEQ ID NO: 50204

SEQ ID NO: 646149 - RNA, 64 nt, hsa; identical to SEQ ID NO: 50205

SEQ ID NO: 646150 - RNA, 64 nt, hsa; identical to SEQ ID NO: 50206

SEQ ID NO: 646151 - RNA, 64 nt, hsa; identical to SEQ ID NO: 50207

SEQ ID NO: 646152 - RNA, 64 nt, hsa; identical to SEQ ID NO: 50208

SEQ ID NO: 646153 - RNA, 64 nt, hsa; identical to SEQ ID NO: 50209

SEQ ID NO: 646154 - RNA, 64 nt, hsa; identical to SEQ ID NO: 50210

SEQ ID NO: 646155 - RNA, 64 nt, hsa; identical to SEQ ID NO: 50211

SEQ ID NO: 646156 - RNA, 64 nt, hsa; identical to SEQ ID NO: 50212

SEQ ID NO: 646157 - RNA, 64 nt, hsa; identical to SEQ ID NO: 50213

SEQ ID NO: 646158 - RNA, 64 nt, hsa; identical to SEQ ID NO: 50214

SEQ ID NO: 646159 - RNA, 64 nt, hsa; identical to SEQ ID NO: 50215

SEQ ID NO: 646160 - RNA, 64 nt, hsa; identical to SEQ ID NO: 50216

SEQ ID NO: 646161 - RNA, 64 nt, hsa; identical to SEQ ID NO: 50217

SEQ ID NO: 646162 - RNA, 64 nt, hsa; identical to SEQ ID NO: 50218

SEQ ID NO: 646163 - RNA, 64 nt, hsa; identical to SEQ ID NO: 50219

SEQ ID NO: 646164 - RNA, 64 nt, hsa; identical to SEQ ID NO: 50220

SEQ ID NO: 646165 - RNA, 64 nt, hsa; identical to SEQ ID NO: 50221

SEQ ID NO: 646166 - RNA, 64 nt, hsa; identical to SEQ ID NO: 50222

SEQ ID NO: 646167 - RNA, 64 nt, hsa; identical to SEQ ID NO: 50223

SEQ ID NO: 646168 - RNA, 64 nt, hsa; identical to SEQ ID NO: 50224

SEQ ID NO: 646169 - RNA, 64 nt, hsa; identical to SEQ ID NO: 50225

SEQ ID NO: 646170 - RNA, 64 nt, hsa; identical to SEQ ID NO: 50226

SEQ ID NO: 646171 - RNA, 64 nt, hsa; identical to SEQ ID NO: 50227

SEQ ID NO: 646172 - RNA, 64 nt, hsa; identical to SEQ ID NO: 50228

SEQ ID NO: 646173 - RNA, 64 nt, hsa; identical to SEQ ID NO: 50229

SEQ ID NO: 646174 - RNA, 64 nt, hsa; identical to SEQ ID NO: 50230

SEQ ID NO: 646175 - RNA, 64 nt, hsa; identical to SEQ ID NO: 50231

SEQ ID NO: 646176 - RNA, 64 nt, hsa; identical to SEQ ID NO: 50232

SEQ ID NO: 646177 - RNA, 64 nt, hsa; identical to SEQ ID NO: 50233

SEQ ID NO: 646178 - RNA, 64 nt, hsa; identical to SEQ ID NO: 50234

SEQ ID NO: 646179 - RNA, 64 nt, hsa; identical to SEQ ID NO: 50235

SEQ ID NO: 646180 - RNA, 64 nt, hsa; identical to SEQ ID NO: 50236

SEQ ID NO: 646181 - RNA, 64 nt, hsa; identical to SEQ ID NO: 50237

SEQ ID NO: 646182 - RNA, 64 nt, hsa; identical to SEQ ID NO: 50238

SEQ ID NO: 646183 - RNA, 64 nt, hsa; identical to SEQ ID NO: 50239

SEQ ID NO: 646184 - RNA, 64 nt, hsa; identical to SEQ ID NO: 50240

SEQ ID NO: 646185 - RNA, 64 nt, hsa; identical to SEQ ID NO: 50241

SEQ ID NO: 646186 - RNA, 64 nt, hsa; identical to SEQ ID NO: 50242

SEQ ID NO: 646187 - RNA, 64 nt, hsa; identical to SEQ ID NO: 50243

SEQ ID NO: 646188 - RNA, 64 nt, hsa; identical to SEQ ID NO: 392567

SEQ ID NO: 646189 - RNA, 64 nt, hsa; identical to SEQ ID NO: 392568

SEQ ID NO: 646190 - RNA, 64 nt, hsa; identical to SEQ ID NO: 392569

SEQ ID NO: 646191 - RNA, 64 nt, hsa; identical to SEQ ID NO: 392570

SEQ ID NO: 646192 - RNA, 64 nt, hsa; identical to SEQ ID NO: 392571

SEQ ID NO: 646193 - RNA, 64 nt, hsa; identical to SEQ ID NO: 392572

SEQ ID NO: 646194 - RNA, 64 nt, hsa; identical to SEQ ID NO: 392573

SEQ ID NO: 646195 - RNA, 64 nt, hsa; identical to SEQ ID NO: 392574

SEQ ID NO: 646196 - RNA, 64 nt, hsa; identical to SEQ ID NO: 392575

SEQ ID NO: 646197 - RNA, 64 nt, hsa; identical to SEQ ID NO: 392576

SEQ ID NO: 646198 - RNA, 64 nt, hsa; identical to SEQ ID NO: 392577

SEQ ID NO: 646199 - RNA, 64 nt, hsa; identical to SEQ ID NO: 392578

SEQ ID NO: 646200 - RNA, 64 nt, hsa; identical to SEQ ID NO: 392579

SEQ ID NO: 646201 - RNA, 64 nt, hsa; identical to SEQ ID NO: 392580

SEQ ID NO: 646202 - RNA, 64 nt, hsa; identical to SEQ ID NO: 392581

SEQ ID NO: 646203 - RNA, 64 nt, hsa; identical to SEQ ID NO: 392582

SEQ ID NO: 646204 - RNA, 64 nt, hsa; identical to SEQ ID NO: 392583

SEQ ID NO: 646205 - RNA, 64 nt, hsa; identical to SEQ ID NO: 392584

SEQ ID NO: 646206 - RNA, 64 nt, hsa; identical to SEQ ID NO: 392585

SEQ ID NO: 646207 - RNA, 64 nt, hsa; identical to SEQ ID NO: 392586

SEQ ID NO: 646208 - RNA, 64 nt, hsa; identical to SEQ ID NO: 392587

SEQ ID NO: 646209 - RNA, 64 nt, hsa; identical to SEQ ID NO: 392588

SEQ ID NO: 646210 - RNA, 64 nt, hsa; identical to SEQ ID NO: 50126

SEQ ID NO: 646211 - RNA, 64 nt, hsa; identical to SEQ ID NO: 50127

SEQ ID NO: 646212 - RNA, 64 nt, hsa; identical to SEQ ID NO: 50128

SEQ ID NO: 646213 - RNA, 64 nt, hsa; identical to SEQ ID NO: 50129

SEQ ID NO: 646214 - RNA, 64 nt, hsa; identical to SEQ ID NO: 50130

SEQ ID NO: 646215 - RNA, 64 nt, hsa; identical to SEQ ID NO: 50131

SEQ ID NO: 646216 - RNA, 64 nt, hsa; identical to SEQ ID NO: 50132

SEQ ID NO: 646217 - RNA, 64 nt, hsa; identical to SEQ ID NO: 50133

SEQ ID NO: 646218 - RNA, 64 nt, hsa; identical to SEQ ID NO: 263346

SEQ ID NO: 646219 - RNA, 64 nt, hsa; identical to SEQ ID NO: 263347

SEQ ID NO: 646220 - RNA, 64 nt, hsa; identical to SEQ ID NO: 263348

SEQ ID NO: 646221 - RNA, 64 nt, hsa; identical to SEQ ID NO: 263349

SEQ ID NO: 646222 - RNA, 64 nt, hsa; identical to SEQ ID NO: 263350

SEQ ID NO: 646223 - RNA, 64 nt, hsa; identical to SEQ ID NO: 263351

SEQ ID NO: 646224 - RNA, 64 nt, hsa; identical to SEQ ID NO: 263352

SEQ ID NO: 646225 - RNA, 64 nt, hsa; identical to SEQ ID NO: 263353

SEQ ID NO: 646226 - RNA, 64 nt, hsa; identical to SEQ ID NO: 263354

SEQ ID NO: 646227 - RNA, 64 nt, hsa; identical to SEQ ID NO: 263355

SEQ ID NO: 646228 - RNA, 64 nt, hsa; identical to SEQ ID NO: 263356

SEQ ID NO: 646229 - RNA, 64 nt, hsa; identical to SEQ ID NO: 263357

SEQ ID NO: 646230 - RNA, 64 nt, hsa; identical to SEQ ID NO: 263358

SEQ ID NO: 646231 - RNA, 64 nt, hsa; identical to SEQ ID NO: 263359

SEQ ID NO: 646232 - RNA, 64 nt, hsa; identical to SEQ ID NO: 263360

SEQ ID NO: 646233 - RNA, 64 nt, hsa; identical to SEQ ID NO: 263361

SEQ ID NO: 646234 - RNA, 64 nt, hsa; identical to SEQ ID NO: 263362

SEQ ID NO: 646235 - RNA, 64 nt, hsa; identical to SEQ ID NO: 263363

SEQ ID NO: 646236 - RNA, 64 nt, hsa; identical to SEQ ID NO: 263364

SEQ ID NO: 646237 - RNA, 64 nt, hsa; identical to SEQ ID NO: 263365

SEQ ID NO: 646238 - RNA, 64 nt, hsa; identical to SEQ ID NO: 263366

SEQ ID NO: 646239 - RNA, 64 nt, hsa; identical to SEQ ID NO: 263367

SEQ ID NO: 646240 - RNA, 64 nt, hsa; identical to SEQ ID NO: 263368

SEQ ID NO: 646241 - RNA, 64 nt, hsa; identical to SEQ ID NO: 263369

SEQ ID NO: 646242 - RNA, 64 nt, hsa; identical to SEQ ID NO: 263370

SEQ ID NO: 646243 - RNA, 64 nt, hsa; identical to SEQ ID NO: 263371

SEQ ID NO: 646244 - RNA, 64 nt, hsa; identical to SEQ ID NO: 263372

SEQ ID NO: 646245 - RNA, 64 nt, hsa; identical to SEQ ID NO: 263373

SEQ ID NO: 646246 - RNA, 64 nt, hsa; identical to SEQ ID NO: 263374

SEQ ID NO: 646247 - RNA, 64 nt, hsa; identical to SEQ ID NO: 263375

SEQ ID NO: 646248 - RNA, 64 nt, hsa; identical to SEQ ID NO: 263376

SEQ ID NO: 646249 - RNA, 64 nt, hsa; identical to SEQ ID NO: 263377

SEQ ID NO: 646250 - RNA, 64 nt, hsa; identical to SEQ ID NO: 263378

SEQ ID NO: 646251 - RNA, 64 nt, hsa; identical to SEQ ID NO: 263379

SEQ ID NO: 646252 - RNA, 64 nt, hsa; identical to SEQ ID NO: 263380

SEQ ID NO: 646253 - RNA, 64 nt, hsa; identical to SEQ ID NO: 263381

SEQ ID NO: 646254 - RNA, 64 nt, hsa; identical to SEQ ID NO: 263382

SEQ ID NO: 646255 - RNA, 64 nt, hsa; identical to SEQ ID NO: 263383

SEQ ID NO: 646256 - RNA, 64 nt, hsa; identical to SEQ ID NO: 263384

SEQ ID NO: 646257 - RNA, 64 nt, hsa; identical to SEQ ID NO: 263385

SEQ ID NO: 646258 - RNA, 64 nt, hsa; identical to SEQ ID NO: 263386

SEQ ID NO: 646259 - RNA, 64 nt, hsa; identical to SEQ ID NO: 263387

SEQ ID NO: 646260 - RNA, 64 nt, hsa; identical to SEQ ID NO: 263388

SEQ ID NO: 646261 - RNA, 64 nt, hsa; identical to SEQ ID NO: 263389

SEQ ID NO: 646262 - RNA, 64 nt, hsa; identical to SEQ ID NO: 263390

SEQ ID NO: 646263 - RNA, 64 nt, hsa; identical to SEQ ID NO: 263391

SEQ ID NO: 646264 - RNA, 64 nt, hsa; identical to SEQ ID NO: 263392

SEQ ID NO: 646265 - RNA, 64 nt, hsa; identical to SEQ ID NO: 263393

SEQ ID NO: 646266 - RNA, 64 nt, hsa; identical to SEQ ID NO: 263394

SEQ ID NO: 646267 - RNA, 64 nt, hsa; identical to SEQ ID NO: 263395

SEQ ID NO: 646268 - RNA, 64 nt, hsa; identical to SEQ ID NO: 263396

SEQ ID NO: 646269 - RNA, 64 nt, hsa; identical to SEQ ID NO: 263397

SEQ ID NO: 646270 - RNA, 64 nt, hsa; identical to SEQ ID NO: 263398

SEQ ID NO: 646271 - RNA, 64 nt, hsa; identical to SEQ ID NO: 263399

SEQ ID NO: 646272 - RNA, 64 nt, hsa; identical to SEQ ID NO: 263400

SEQ ID NO: 646273 - RNA, 64 nt, hsa; identical to SEQ ID NO: 263401

SEQ ID NO: 646274 - RNA, 64 nt, hsa; identical to SEQ ID NO: 263402

SEQ ID NO: 646275 - RNA, 64 nt, hsa; identical to SEQ ID NO: 263403

SEQ ID NO: 646276 - RNA, 64 nt, hsa; identical to SEQ ID NO: 263404

SEQ ID NO: 646277 - RNA, 64 nt, hsa; identical to SEQ ID NO: 263405

SEQ ID NO: 646278 - RNA, 64 nt, hsa; identical to SEQ ID NO: 263406

SEQ ID NO: 646279 - RNA, 64 nt, hsa; identical to SEQ ID NO: 263407

SEQ ID NO: 646280 - RNA, 64 nt, hsa; identical to SEQ ID NO: 263408

SEQ ID NO: 646281 - RNA, 64 nt, hsa; identical to SEQ ID NO: 263409

SEQ ID NO: 646282 - RNA, 64 nt, hsa; identical to SEQ ID NO: 263410

SEQ ID NO: 646283 - RNA, 64 nt, hsa; identical to SEQ ID NO: 263411

SEQ ID NO: 646284 - RNA, 64 nt, hsa; identical to SEQ ID NO: 263412

SEQ ID NO: 646285 - RNA, 64 nt, hsa; identical to SEQ ID NO: 263413

SEQ ID NO: 646286 - RNA, 64 nt, hsa; identical to SEQ ID NO: 263414

SEQ ID NO: 646287 - RNA, 64 nt, hsa; identical to SEQ ID NO: 263415

SEQ ID NO: 646288 - RNA, 64 nt, hsa; identical to SEQ ID NO: 263416

SEQ ID NO: 646289 - RNA, 64 nt, hsa; identical to SEQ ID NO: 263417

SEQ ID NO: 646290 - RNA, 64 nt, hsa; identical to SEQ ID NO: 263418

SEQ ID NO: 646291 - RNA, 64 nt, hsa; identical to SEQ ID NO: 263419

SEQ ID NO: 646292 - RNA, 64 nt, hsa; identical to SEQ ID NO: 263420

SEQ ID NO: 646293 - RNA, 64 nt, hsa; identical to SEQ ID NO: 263421

SEQ ID NO: 646294 - RNA, 64 nt, hsa; identical to SEQ ID NO: 263422

SEQ ID NO: 646295 - RNA, 64 nt, hsa; identical to SEQ ID NO: 263423

SEQ ID NO: 646296 - RNA, 64 nt, hsa; identical to SEQ ID NO: 263424

SEQ ID NO: 646297 - RNA, 64 nt, hsa; identical to SEQ ID NO: 263425

SEQ ID NO: 646298 - RNA, 64 nt, hsa; identical to SEQ ID NO: 263426

SEQ ID NO: 646299 - RNA, 64 nt, hsa; identical to SEQ ID NO: 263427

SEQ ID NO: 646300 - RNA, 64 nt, hsa; identical to SEQ ID NO: 263428

SEQ ID NO: 646301 - RNA, 64 nt, hsa; identical to SEQ ID NO: 263429

SEQ ID NO: 646302 - RNA, 64 nt, hsa; identical to SEQ ID NO: 263430

SEQ ID NO: 646303 - RNA, 64 nt, hsa; identical to SEQ ID NO: 263431

SEQ ID NO: 646304 - RNA, 64 nt, hsa; identical to SEQ ID NO: 263432

SEQ ID NO: 646305 - RNA, 64 nt, hsa; identical to SEQ ID NO: 263433

SEQ ID NO: 646306 - RNA, 64 nt, hsa; identical to SEQ ID NO: 263434

SEQ ID NO: 646307 - RNA, 64 nt, hsa; identical to SEQ ID NO: 263435

SEQ ID NO: 646308 - RNA, 64 nt, hsa; identical to SEQ ID NO: 263436

SEQ ID NO: 646309 - RNA, 64 nt, hsa; identical to SEQ ID NO: 263437

SEQ ID NO: 646310 - RNA, 64 nt, hsa; identical to SEQ ID NO: 263438

SEQ ID NO: 646311 - RNA, 64 nt, hsa; identical to SEQ ID NO: 263439

SEQ ID NO: 646312 - RNA, 64 nt, hsa; identical to SEQ ID NO: 263440

SEQ ID NO: 646313 - RNA, 64 nt, hsa; identical to SEQ ID NO: 263441

SEQ ID NO: 646314 - RNA, 64 nt, hsa; identical to SEQ ID NO: 263442

SEQ ID NO: 646315 - RNA, 64 nt, hsa; identical to SEQ ID NO: 263443

SEQ ID NO: 646316 - RNA, 64 nt, hsa; identical to SEQ ID NO: 263444

SEQ ID NO: 646317 - RNA, 64 nt, hsa; identical to SEQ ID NO: 263445

SEQ ID NO: 646318 - RNA, 64 nt, hsa; identical to SEQ ID NO: 263446

SEQ ID NO: 646319 - RNA, 64 nt, hsa; identical to SEQ ID NO: 263447

SEQ ID NO: 646320 - RNA, 64 nt, hsa; identical to SEQ ID NO: 263448

SEQ ID NO: 646321 - RNA, 64 nt, hsa; identical to SEQ ID NO: 263449

SEQ ID NO: 646322 - RNA, 64 nt, hsa; identical to SEQ ID NO: 263450

SEQ ID NO: 646323 - RNA, 64 nt, hsa; identical to SEQ ID NO: 263451

SEQ ID NO: 646324 - RNA, 64 nt, hsa; identical to SEQ ID NO: 263452

SEQ ID NO: 646325 - RNA, 64 nt, hsa; identical to SEQ ID NO: 263453

SEQ ID NO: 646326 - RNA, 64 nt, hsa; identical to SEQ ID NO: 263454

SEQ ID NO: 646327 - RNA, 64 nt, hsa; identical to SEQ ID NO: 263455

SEQ ID NO: 646328 - RNA, 64 nt, hsa; identical to SEQ ID NO: 263456

SEQ ID NO: 646329 - RNA, 64 nt, hsa; identical to SEQ ID NO: 263457

SEQ ID NO: 646330 - RNA, 64 nt, hsa; identical to SEQ ID NO: 263458

SEQ ID NO: 646331 - RNA, 64 nt, hsa; identical to SEQ ID NO: 263459

SEQ ID NO: 646332 - RNA, 64 nt, hsa; identical to SEQ ID NO: 263460

SEQ ID NO: 646333 - RNA, 64 nt, hsa; identical to SEQ ID NO: 263461

SEQ ID NO: 646334 - RNA, 64 nt, hsa; identical to SEQ ID NO: 263462

SEQ ID NO: 646335 - RNA, 64 nt, hsa; identical to SEQ ID NO: 263463

SEQ ID NO: 646336 - RNA, 64 nt, hsa; identical to SEQ ID NO: 263464

SEQ ID NO: 646337 - RNA, 64 nt, hsa; identical to SEQ ID NO: 263465

SEQ ID NO: 646338 - RNA, 64 nt, hsa; identical to SEQ ID NO: 263466

SEQ ID NO: 646339 - RNA, 64 nt, hsa; identical to SEQ ID NO: 263467

SEQ ID NO: 646340 - RNA, 64 nt, hsa; identical to SEQ ID NO: 263468

SEQ ID NO: 646341 - RNA, 64 nt, hsa; identical to SEQ ID NO: 263469

SEQ ID NO: 646342 - RNA, 64 nt, hsa; identical to SEQ ID NO: 263470

SEQ ID NO: 646343 - RNA, 64 nt, hsa; identical to SEQ ID NO: 263471

SEQ ID NO: 646344 - RNA, 64 nt, hsa; identical to SEQ ID NO: 263472

SEQ ID NO: 646345 - RNA, 64 nt, hsa; identical to SEQ ID NO: 263473

SEQ ID NO: 646346 - RNA, 64 nt, hsa; identical to SEQ ID NO: 263474

SEQ ID NO: 646347 - RNA, 64 nt, hsa; identical to SEQ ID NO: 263475

SEQ ID NO: 646348 - RNA, 64 nt, hsa; identical to SEQ ID NO: 263476

SEQ ID NO: 646349 - RNA, 64 nt, hsa; identical to SEQ ID NO: 263477

SEQ ID NO: 646350 - RNA, 64 nt, hsa; identical to SEQ ID NO: 263478

SEQ ID NO: 646351 - RNA, 64 nt, hsa; identical to SEQ ID NO: 263479

SEQ ID NO: 646352 - RNA, 64 nt, hsa; identical to SEQ ID NO: 263480

SEQ ID NO: 646353 - RNA, 64 nt, hsa; identical to SEQ ID NO: 263481

SEQ ID NO: 646354 - RNA, 64 nt, hsa; identical to SEQ ID NO: 263482

SEQ ID NO: 646355 - RNA, 64 nt, hsa; identical to SEQ ID NO: 263483

SEQ ID NO: 646356 - RNA, 64 nt, hsa; identical to SEQ ID NO: 263484

SEQ ID NO: 646357 - RNA, 64 nt, hsa; identical to SEQ ID NO: 263485

SEQ ID NO: 646358 - RNA, 64 nt, hsa; identical to SEQ ID NO: 263486

SEQ ID NO: 646359 - RNA, 64 nt, hsa; identical to SEQ ID NO: 263487

SEQ ID NO: 646360 - RNA, 64 nt, hsa; identical to SEQ ID NO: 263488

SEQ ID NO: 646361 - RNA, 64 nt, hsa; identical to SEQ ID NO: 263489

SEQ ID NO: 646362 - RNA, 64 nt, hsa; identical to SEQ ID NO: 263490

SEQ ID NO: 646363 - RNA, 64 nt, hsa; identical to SEQ ID NO: 263491

SEQ ID NO: 646364 - RNA, 64 nt, hsa; identical to SEQ ID NO: 263492

SEQ ID NO: 646365 - RNA, 64 nt, hsa; identical to SEQ ID NO: 263493

SEQ ID NO: 646366 - RNA, 64 nt, hsa; identical to SEQ ID NO: 263494

SEQ ID NO: 646367 - RNA, 64 nt, hsa; identical to SEQ ID NO: 263495

SEQ ID NO: 646368 - RNA, 64 nt, hsa; identical to SEQ ID NO: 263496

SEQ ID NO: 646369 - RNA, 64 nt, hsa; identical to SEQ ID NO: 263497

SEQ ID NO: 646370 - RNA, 64 nt, hsa; identical to SEQ ID NO: 263498

SEQ ID NO: 646371 - RNA, 64 nt, hsa; identical to SEQ ID NO: 263499

SEQ ID NO: 646372 - RNA, 64 nt, hsa; identical to SEQ ID NO: 263500

SEQ ID NO: 646373 - RNA, 64 nt, hsa; identical to SEQ ID NO: 263501

SEQ ID NO: 646374 - RNA, 64 nt, hsa; identical to SEQ ID NO: 263502

SEQ ID NO: 646375 - RNA, 64 nt, hsa; identical to SEQ ID NO: 263503

SEQ ID NO: 646376 - RNA, 64 nt, hsa; identical to SEQ ID NO: 263504

SEQ ID NO: 646377 - RNA, 64 nt, hsa; identical to SEQ ID NO: 263505

SEQ ID NO: 646378 - RNA, 64 nt, hsa; identical to SEQ ID NO: 263506

SEQ ID NO: 646379 - RNA, 64 nt, hsa; identical to SEQ ID NO: 263507

SEQ ID NO: 646380 - RNA, 64 nt, hsa; identical to SEQ ID NO: 263508

SEQ ID NO: 646381 - RNA, 64 nt, hsa; identical to SEQ ID NO: 263509

SEQ ID NO: 646382 - RNA, 64 nt, hsa; identical to SEQ ID NO: 263510

SEQ ID NO: 646383 - RNA, 64 nt, hsa; identical to SEQ ID NO: 263511

SEQ ID NO: 646384 - RNA, 64 nt, hsa; identical to SEQ ID NO: 263512

SEQ ID NO: 646385 - RNA, 64 nt, hsa; identical to SEQ ID NO: 263513

SEQ ID NO: 646386 - RNA, 64 nt, hsa; identical to SEQ ID NO: 263514

SEQ ID NO: 646387 - RNA, 64 nt, hsa; identical to SEQ ID NO: 263515

SEQ ID NO: 646388 - RNA, 64 nt, hsa; identical to SEQ ID NO: 263516

SEQ ID NO: 646389 - RNA, 64 nt, hsa; identical to SEQ ID NO: 263517

SEQ ID NO: 646390 - RNA, 64 nt, hsa; identical to SEQ ID NO: 263518

SEQ ID NO: 646391 - RNA, 64 nt, hsa; identical to SEQ ID NO: 263519

SEQ ID NO: 646392 - RNA, 64 nt, hsa; identical to SEQ ID NO: 263520

SEQ ID NO: 646393 - RNA, 64 nt, hsa; identical to SEQ ID NO: 263521

SEQ ID NO: 646394 - RNA, 64 nt, hsa; identical to SEQ ID NO: 263522

SEQ ID NO: 646395 - RNA, 64 nt, hsa; identical to SEQ ID NO: 263523

SEQ ID NO: 646396 - RNA, 64 nt, hsa; identical to SEQ ID NO: 263524

SEQ ID NO: 646397 - RNA, 64 nt, hsa; identical to SEQ ID NO: 263525

SEQ ID NO: 646398 - RNA, 64 nt, hsa; identical to SEQ ID NO: 263526

SEQ ID NO: 646399 - RNA, 64 nt, hsa; identical to SEQ ID NO: 263527

SEQ ID NO: 646400 - RNA, 64 nt, hsa; identical to SEQ ID NO: 263528

SEQ ID NO: 646401 - RNA, 64 nt, hsa; identical to SEQ ID NO: 263529

SEQ ID NO: 646402 - RNA, 64 nt, hsa; identical to SEQ ID NO: 263530

SEQ ID NO: 646403 - RNA, 64 nt, hsa; identical to SEQ ID NO: 263531

SEQ ID NO: 646404 - RNA, 64 nt, hsa; identical to SEQ ID NO: 263532

SEQ ID NO: 646405 - RNA, 64 nt, hsa; identical to SEQ ID NO: 263533

SEQ ID NO: 646406 - RNA, 64 nt, hsa; identical to SEQ ID NO: 263534

SEQ ID NO: 646407 - RNA, 64 nt, hsa; identical to SEQ ID NO: 263535

SEQ ID NO: 646408 - RNA, 64 nt, hsa; identical to SEQ ID NO: 263536

SEQ ID NO: 646409 - RNA, 64 nt, hsa; identical to SEQ ID NO: 263537

SEQ ID NO: 646410 - RNA, 64 nt, hsa; identical to SEQ ID NO: 263538

SEQ ID NO: 646411 - RNA, 64 nt, hsa; identical to SEQ ID NO: 263539

SEQ ID NO: 646412 - RNA, 64 nt, hsa; identical to SEQ ID NO: 263540

SEQ ID NO: 646413 - RNA, 64 nt, hsa; identical to SEQ ID NO: 263541

SEQ ID NO: 646414 - RNA, 64 nt, hsa; identical to SEQ ID NO: 263542

SEQ ID NO: 646415 - RNA, 64 nt, hsa; identical to SEQ ID NO: 263543

SEQ ID NO: 646416 - RNA, 64 nt, hsa; identical to SEQ ID NO: 263544

SEQ ID NO: 646417 - RNA, 64 nt, hsa; identical to SEQ ID NO: 263545

SEQ ID NO: 646418 - RNA, 64 nt, hsa; identical to SEQ ID NO: 263546

SEQ ID NO: 646419 - RNA, 64 nt, hsa; identical to SEQ ID NO: 263547

SEQ ID NO: 646420 - RNA, 64 nt, hsa; identical to SEQ ID NO: 263548

SEQ ID NO: 646421 - RNA, 64 nt, hsa; identical to SEQ ID NO: 263549

SEQ ID NO: 646422 - RNA, 64 nt, hsa; identical to SEQ ID NO: 263550

SEQ ID NO: 646423 - RNA, 64 nt, hsa; identical to SEQ ID NO: 263551

SEQ ID NO: 646424 - RNA, 64 nt, hsa; identical to SEQ ID NO: 263552

SEQ ID NO: 646425 - RNA, 64 nt, hsa; identical to SEQ ID NO: 263553

SEQ ID NO: 646426 - RNA, 64 nt, hsa; identical to SEQ ID NO: 263554

SEQ ID NO: 646427 - RNA, 64 nt, hsa; identical to SEQ ID NO: 263555

SEQ ID NO: 646428 - RNA, 64 nt, hsa; identical to SEQ ID NO: 263556

SEQ ID NO: 646429 - RNA, 64 nt, hsa; identical to SEQ ID NO: 263557

SEQ ID NO: 646430 - RNA, 64 nt, hsa; identical to SEQ ID NO: 263558

SEQ ID NO: 646431 - RNA, 64 nt, hsa; identical to SEQ ID NO: 263559

SEQ ID NO: 646432 - RNA, 64 nt, hsa; identical to SEQ ID NO: 263560

SEQ ID NO: 646433 - RNA, 64 nt, hsa; identical to SEQ ID NO: 263561

SEQ ID NO: 646434 - RNA, 64 nt, hsa; identical to SEQ ID NO: 263562

SEQ ID NO: 646435 - RNA, 64 nt, hsa; identical to SEQ ID NO: 263563

SEQ ID NO: 646436 - RNA, 64 nt, hsa; identical to SEQ ID NO: 263564

SEQ ID NO: 646437 - RNA, 64 nt, hsa; identical to SEQ ID NO: 263565

SEQ ID NO: 646438 - RNA, 64 nt, hsa; identical to SEQ ID NO: 263566

SEQ ID NO: 646439 - RNA, 64 nt, hsa; identical to SEQ ID NO: 263567

SEQ ID NO: 646440 - RNA, 64 nt, hsa; identical to SEQ ID NO: 263568

SEQ ID NO: 646441 - RNA, 64 nt, hsa; identical to SEQ ID NO: 263569

SEQ ID NO: 646442 - RNA, 64 nt, hsa; identical to SEQ ID NO: 263570

SEQ ID NO: 646443 - RNA, 64 nt, hsa; identical to SEQ ID NO: 263571

SEQ ID NO: 646444 - RNA, 64 nt, hsa; identical to SEQ ID NO: 263572

SEQ ID NO: 646445 - RNA, 64 nt, hsa; identical to SEQ ID NO: 263573

SEQ ID NO: 646446 - RNA, 64 nt, hsa; identical to SEQ ID NO: 263574

SEQ ID NO: 646447 - RNA, 64 nt, hsa; identical to SEQ ID NO: 263575

SEQ ID NO: 646448 - RNA, 64 nt, hsa; identical to SEQ ID NO: 263576

SEQ ID NO: 646449 - RNA, 64 nt, hsa; identical to SEQ ID NO: 263577

SEQ ID NO: 646450 - RNA, 64 nt, hsa; identical to SEQ ID NO: 263578

SEQ ID NO: 646451 - RNA, 64 nt, hsa; identical to SEQ ID NO: 263579

SEQ ID NO: 646452 - RNA, 64 nt, hsa; identical to SEQ ID NO: 263580

SEQ ID NO: 646453 - RNA, 64 nt, hsa; identical to SEQ ID NO: 263581

SEQ ID NO: 646454 - RNA, 64 nt, hsa; identical to SEQ ID NO: 263582

SEQ ID NO: 646455 - RNA, 64 nt, hsa; identical to SEQ ID NO: 263583

SEQ ID NO: 646456 - RNA, 64 nt, hsa; identical to SEQ ID NO: 263584

SEQ ID NO: 646457 - RNA, 64 nt, hsa; identical to SEQ ID NO: 263585

SEQ ID NO: 646458 - RNA, 64 nt, hsa; identical to SEQ ID NO: 263586

SEQ ID NO: 646459 - RNA, 64 nt, hsa; identical to SEQ ID NO: 263587

SEQ ID NO: 646460 - RNA, 64 nt, hsa; identical to SEQ ID NO: 263588

SEQ ID NO: 646461 - RNA, 64 nt, hsa; identical to SEQ ID NO: 263589

SEQ ID NO: 646462 - RNA, 64 nt, hsa; identical to SEQ ID NO: 263590

SEQ ID NO: 646463 - RNA, 64 nt, hsa; identical to SEQ ID NO: 263591

SEQ ID NO: 646464 - RNA, 64 nt, hsa; identical to SEQ ID NO: 263592

SEQ ID NO: 646465 - RNA, 64 nt, hsa; identical to SEQ ID NO: 263593

SEQ ID NO: 646466 - RNA, 64 nt, hsa; identical to SEQ ID NO: 263594

SEQ ID NO: 646467 - RNA, 64 nt, hsa; identical to SEQ ID NO: 263595

SEQ ID NO: 646468 - RNA, 64 nt, hsa; identical to SEQ ID NO: 263596

SEQ ID NO: 646469 - RNA, 64 nt, hsa; identical to SEQ ID NO: 263597

SEQ ID NO: 646470 - RNA, 64 nt, hsa; identical to SEQ ID NO: 263598

SEQ ID NO: 646471 - RNA, 64 nt, hsa; identical to SEQ ID NO: 263599

SEQ ID NO: 646472 - RNA, 64 nt, hsa; identical to SEQ ID NO: 263600

SEQ ID NO: 646473 - RNA, 64 nt, hsa; identical to SEQ ID NO: 263601

SEQ ID NO: 646474 - RNA, 64 nt, hsa; identical to SEQ ID NO: 263602

SEQ ID NO: 646475 - RNA, 64 nt, hsa; identical to SEQ ID NO: 263603

SEQ ID NO: 646476 - RNA, 64 nt, hsa; identical to SEQ ID NO: 263604

SEQ ID NO: 646477 - RNA, 64 nt, hsa; identical to SEQ ID NO: 263605

SEQ ID NO: 646478 - RNA, 64 nt, hsa; identical to SEQ ID NO: 263606

SEQ ID NO: 646479 - RNA, 64 nt, hsa; identical to SEQ ID NO: 263607

SEQ ID NO: 646480 - RNA, 64 nt, hsa; identical to SEQ ID NO: 263608

SEQ ID NO: 646481 - RNA, 64 nt, hsa; identical to SEQ ID NO: 263609

SEQ ID NO: 646482 - RNA, 64 nt, hsa; identical to SEQ ID NO: 263610

SEQ ID NO: 646483 - RNA, 64 nt, hsa; identical to SEQ ID NO: 263611

SEQ ID NO: 646484 - RNA, 64 nt, hsa; identical to SEQ ID NO: 263612

SEQ ID NO: 646485 - RNA, 64 nt, hsa; identical to SEQ ID NO: 263613

SEQ ID NO: 646486 - RNA, 64 nt, hsa; identical to SEQ ID NO: 263614

SEQ ID NO: 646487 - RNA, 64 nt, hsa; identical to SEQ ID NO: 263615

SEQ ID NO: 646488 - RNA, 64 nt, hsa; identical to SEQ ID NO: 263616

SEQ ID NO: 646489 - RNA, 64 nt, hsa; identical to SEQ ID NO: 263617

SEQ ID NO: 646490 - RNA, 64 nt, hsa; identical to SEQ ID NO: 263618

SEQ ID NO: 646491 - RNA, 64 nt, hsa; identical to SEQ ID NO: 263619

SEQ ID NO: 646492 - RNA, 64 nt, hsa; identical to SEQ ID NO: 263620

SEQ ID NO: 646493 - RNA, 64 nt, hsa; identical to SEQ ID NO: 263621

SEQ ID NO: 646494 - RNA, 64 nt, hsa; identical to SEQ ID NO: 263622

SEQ ID NO: 646495 - RNA, 64 nt, hsa; identical to SEQ ID NO: 263623

SEQ ID NO: 646496 - RNA, 64 nt, hsa; identical to SEQ ID NO: 263624

SEQ ID NO: 646497 - RNA, 64 nt, hsa; identical to SEQ ID NO: 263625

SEQ ID NO: 646498 - RNA, 64 nt, hsa; identical to SEQ ID NO: 263626

SEQ ID NO: 646499 - RNA, 64 nt, hsa; identical to SEQ ID NO: 263627

SEQ ID NO: 646500 - RNA, 64 nt, hsa; identical to SEQ ID NO: 263628

SEQ ID NO: 646501 - RNA, 64 nt, hsa; identical to SEQ ID NO: 263629

SEQ ID NO: 646502 - RNA, 64 nt, hsa; identical to SEQ ID NO: 263630

SEQ ID NO: 646503 - RNA, 64 nt, hsa; identical to SEQ ID NO: 263631

SEQ ID NO: 646504 - RNA, 64 nt, hsa; identical to SEQ ID NO: 263632

SEQ ID NO: 646505 - RNA, 64 nt, hsa; identical to SEQ ID NO: 263633

SEQ ID NO: 646506 - RNA, 64 nt, hsa; identical to SEQ ID NO: 263634

SEQ ID NO: 646507 - RNA, 64 nt, hsa; identical to SEQ ID NO: 263635

SEQ ID NO: 646508 - RNA, 64 nt, hsa; identical to SEQ ID NO: 263636

SEQ ID NO: 646509 - RNA, 64 nt, hsa; identical to SEQ ID NO: 263637

SEQ ID NO: 646510 - RNA, 64 nt, hsa; identical to SEQ ID NO: 263638

SEQ ID NO: 646511 - RNA, 64 nt, hsa; identical to SEQ ID NO: 263639

SEQ ID NO: 646512 - RNA, 64 nt, hsa; identical to SEQ ID NO: 263640

SEQ ID NO: 646513 - RNA, 64 nt, hsa; identical to SEQ ID NO: 263641

SEQ ID NO: 646514 - RNA, 64 nt, hsa; identical to SEQ ID NO: 263642

SEQ ID NO: 646515 - RNA, 64 nt, hsa; identical to SEQ ID NO: 263643

SEQ ID NO: 646516 - RNA, 64 nt, hsa; identical to SEQ ID NO: 263644

SEQ ID NO: 646517 - RNA, 64 nt, hsa; identical to SEQ ID NO: 263645

SEQ ID NO: 646518 - RNA, 64 nt, hsa; identical to SEQ ID NO: 263646

SEQ ID NO: 646519 - RNA, 64 nt, hsa; identical to SEQ ID NO: 263647

SEQ ID NO: 646520 - RNA, 64 nt, hsa; identical to SEQ ID NO: 263648

SEQ ID NO: 646521 - RNA, 64 nt, hsa; identical to SEQ ID NO: 263649

SEQ ID NO: 646522 - RNA, 64 nt, hsa; identical to SEQ ID NO: 263650

SEQ ID NO: 646523 - RNA, 64 nt, hsa; identical to SEQ ID NO: 263651

SEQ ID NO: 646524 - RNA, 64 nt, hsa; identical to SEQ ID NO: 263652

SEQ ID NO: 646525 - RNA, 64 nt, hsa; identical to SEQ ID NO: 263653

SEQ ID NO: 646526 - RNA, 64 nt, hsa; identical to SEQ ID NO: 263654

SEQ ID NO: 646527 - RNA, 64 nt, hsa; identical to SEQ ID NO: 263655

SEQ ID NO: 646528 - RNA, 64 nt, hsa; identical to SEQ ID NO: 263656

SEQ ID NO: 646529 - RNA, 64 nt, hsa; identical to SEQ ID NO: 263657

SEQ ID NO: 646530 - RNA, 64 nt, hsa; identical to SEQ ID NO: 263658

SEQ ID NO: 646531 - RNA, 64 nt, hsa; identical to SEQ ID NO: 263659

SEQ ID NO: 646532 - RNA, 64 nt, hsa; identical to SEQ ID NO: 263660

SEQ ID NO: 646533 - RNA, 64 nt, hsa; identical to SEQ ID NO: 263661

SEQ ID NO: 646534 - RNA, 64 nt, hsa; identical to SEQ ID NO: 263662

SEQ ID NO: 646535 - RNA, 64 nt, hsa; identical to SEQ ID NO: 263663

SEQ ID NO: 646536 - RNA, 64 nt, hsa; identical to SEQ ID NO: 263664

SEQ ID NO: 646537 - RNA, 64 nt, hsa; identical to SEQ ID NO: 263665

SEQ ID NO: 646538 - RNA, 64 nt, hsa; identical to SEQ ID NO: 263666

SEQ ID NO: 646539 - RNA, 64 nt, hsa; identical to SEQ ID NO: 263667

SEQ ID NO: 646540 - RNA, 64 nt, hsa; identical to SEQ ID NO: 263668

SEQ ID NO: 646541 - RNA, 64 nt, hsa; identical to SEQ ID NO: 263669

SEQ ID NO: 646542 - RNA, 64 nt, hsa; identical to SEQ ID NO: 263670

SEQ ID NO: 646543 - RNA, 64 nt, hsa; identical to SEQ ID NO: 263671

SEQ ID NO: 646544 - RNA, 64 nt, hsa; identical to SEQ ID NO: 263672

SEQ ID NO: 646545 - RNA, 64 nt, hsa; identical to SEQ ID NO: 263673

SEQ ID NO: 646546 - RNA, 64 nt, hsa; identical to SEQ ID NO: 263674

SEQ ID NO: 646547 - RNA, 64 nt, hsa; identical to SEQ ID NO: 263675

SEQ ID NO: 646548 - RNA, 64 nt, hsa; identical to SEQ ID NO: 263676

SEQ ID NO: 646549 - RNA, 64 nt, hsa; identical to SEQ ID NO: 263677

SEQ ID NO: 646550 - RNA, 64 nt, hsa; identical to SEQ ID NO: 263678

SEQ ID NO: 646551 - RNA, 64 nt, hsa; identical to SEQ ID NO: 263679

SEQ ID NO: 646552 - RNA, 64 nt, hsa; identical to SEQ ID NO: 263680

SEQ ID NO: 646553 - RNA, 64 nt, hsa; identical to SEQ ID NO: 263681

SEQ ID NO: 646554 - RNA, 64 nt, hsa; identical to SEQ ID NO: 263682

SEQ ID NO: 646555 - RNA, 64 nt, hsa; identical to SEQ ID NO: 263683

SEQ ID NO: 646556 - RNA, 64 nt, hsa; identical to SEQ ID NO: 263684

SEQ ID NO: 646557 - RNA, 64 nt, hsa; identical to SEQ ID NO: 263685

SEQ ID NO: 646558 - RNA, 64 nt, hsa; identical to SEQ ID NO: 263686

SEQ ID NO: 646559 - RNA, 64 nt, hsa; identical to SEQ ID NO: 263687

SEQ ID NO: 646560 - RNA, 64 nt, hsa; identical to SEQ ID NO: 263688

SEQ ID NO: 646561 - RNA, 64 nt, hsa; identical to SEQ ID NO: 263689

SEQ ID NO: 646562 - RNA, 64 nt, hsa; identical to SEQ ID NO: 263690

SEQ ID NO: 646563 - RNA, 64 nt, hsa; identical to SEQ ID NO: 263691

SEQ ID NO: 646564 - RNA, 64 nt, hsa; identical to SEQ ID NO: 263692

SEQ ID NO: 646565 - RNA, 64 nt, hsa; identical to SEQ ID NO: 263693

SEQ ID NO: 646566 - RNA, 64 nt, hsa; identical to SEQ ID NO: 263694

SEQ ID NO: 646567 - RNA, 64 nt, hsa; identical to SEQ ID NO: 263695

SEQ ID NO: 646568 - RNA, 64 nt, hsa; identical to SEQ ID NO: 263696

SEQ ID NO: 646569 - RNA, 64 nt, hsa; identical to SEQ ID NO: 263697

SEQ ID NO: 646570 - RNA, 64 nt, hsa; identical to SEQ ID NO: 263698

SEQ ID NO: 646571 - RNA, 64 nt, hsa; identical to SEQ ID NO: 263699

SEQ ID NO: 646572 - RNA, 64 nt, hsa; identical to SEQ ID NO: 263700

SEQ ID NO: 646573 - RNA, 64 nt, hsa; identical to SEQ ID NO: 263701

SEQ ID NO: 646574 - RNA, 64 nt, hsa; identical to SEQ ID NO: 263702

SEQ ID NO: 646575 - RNA, 64 nt, hsa; identical to SEQ ID NO: 263703

SEQ ID NO: 646576 - RNA, 64 nt, hsa; identical to SEQ ID NO: 263704

SEQ ID NO: 646577 - RNA, 64 nt, hsa; identical to SEQ ID NO: 263705

SEQ ID NO: 646578 - RNA, 64 nt, hsa; identical to SEQ ID NO: 263706

SEQ ID NO: 646579 - RNA, 64 nt, hsa; identical to SEQ ID NO: 263707

SEQ ID NO: 646580 - RNA, 64 nt, hsa; identical to SEQ ID NO: 263708

SEQ ID NO: 646581 - RNA, 64 nt, hsa; identical to SEQ ID NO: 263709

SEQ ID NO: 646582 - RNA, 64 nt, hsa; identical to SEQ ID NO: 263710

SEQ ID NO: 646583 - RNA, 64 nt, hsa; identical to SEQ ID NO: 263711

SEQ ID NO: 646584 - RNA, 64 nt, hsa; identical to SEQ ID NO: 263712

SEQ ID NO: 646585 - RNA, 64 nt, hsa; identical to SEQ ID NO: 263713

SEQ ID NO: 646586 - RNA, 64 nt, hsa; identical to SEQ ID NO: 263714

SEQ ID NO: 646587 - RNA, 64 nt, hsa; identical to SEQ ID NO: 263715

SEQ ID NO: 646588 - RNA, 64 nt, hsa; identical to SEQ ID NO: 263716

SEQ ID NO: 646589 - RNA, 64 nt, hsa; identical to SEQ ID NO: 263717

SEQ ID NO: 646590 - RNA, 64 nt, hsa; identical to SEQ ID NO: 263718

SEQ ID NO: 646591 - RNA, 64 nt, hsa; identical to SEQ ID NO: 263719

SEQ ID NO: 646592 - RNA, 64 nt, hsa; identical to SEQ ID NO: 263720

SEQ ID NO: 646593 - RNA, 64 nt, hsa; identical to SEQ ID NO: 263721

SEQ ID NO: 646594 - RNA, 64 nt, hsa; identical to SEQ ID NO: 263722

SEQ ID NO: 646595 - RNA, 64 nt, hsa; identical to SEQ ID NO: 263723

SEQ ID NO: 646596 - RNA, 64 nt, hsa; identical to SEQ ID NO: 263724

SEQ ID NO: 646597 - RNA, 64 nt, hsa; identical to SEQ ID NO: 263725

SEQ ID NO: 646598 - RNA, 64 nt, hsa; identical to SEQ ID NO: 263726

SEQ ID NO: 646599 - RNA, 64 nt, hsa; identical to SEQ ID NO: 263727

SEQ ID NO: 646600 - RNA, 64 nt, hsa; identical to SEQ ID NO: 263728

SEQ ID NO: 646601 - RNA, 64 nt, hsa; identical to SEQ ID NO: 263729

SEQ ID NO: 646602 - RNA, 64 nt, hsa; identical to SEQ ID NO: 263730

SEQ ID NO: 646603 - RNA, 64 nt, hsa; identical to SEQ ID NO: 263731

SEQ ID NO: 646604 - RNA, 64 nt, hsa; identical to SEQ ID NO: 263732

SEQ ID NO: 646605 - RNA, 64 nt, hsa; identical to SEQ ID NO: 263733

SEQ ID NO: 646606 - RNA, 64 nt, hsa; identical to SEQ ID NO: 263734

SEQ ID NO: 646607 - RNA, 64 nt, hsa; identical to SEQ ID NO: 263735

SEQ ID NO: 646608 - RNA, 64 nt, hsa; identical to SEQ ID NO: 263736

SEQ ID NO: 646609 - RNA, 64 nt, hsa; identical to SEQ ID NO: 263737

SEQ ID NO: 646610 - RNA, 64 nt, hsa; identical to SEQ ID NO: 263738

SEQ ID NO: 646611 - RNA, 64 nt, hsa; identical to SEQ ID NO: 263739

SEQ ID NO: 646612 - RNA, 64 nt, hsa; identical to SEQ ID NO: 263740

SEQ ID NO: 646613 - RNA, 64 nt, hsa; identical to SEQ ID NO: 263741

SEQ ID NO: 646614 - RNA, 64 nt, hsa; identical to SEQ ID NO: 263742

SEQ ID NO: 646615 - RNA, 64 nt, hsa; identical to SEQ ID NO: 263743

SEQ ID NO: 646616 - RNA, 64 nt, hsa; identical to SEQ ID NO: 263744

SEQ ID NO: 646617 - RNA, 64 nt, hsa; identical to SEQ ID NO: 263745

SEQ ID NO: 646618 - RNA, 64 nt, hsa; identical to SEQ ID NO: 263746

SEQ ID NO: 646619 - RNA, 64 nt, hsa; identical to SEQ ID NO: 263747

SEQ ID NO: 646620 - RNA, 64 nt, hsa; identical to SEQ ID NO: 263748

SEQ ID NO: 646621 - RNA, 64 nt, hsa; identical to SEQ ID NO: 263749

SEQ ID NO: 646622 - RNA, 64 nt, hsa; identical to SEQ ID NO: 263750

SEQ ID NO: 646623 - RNA, 64 nt, hsa; identical to SEQ ID NO: 263751

SEQ ID NO: 646624 - RNA, 64 nt, hsa; identical to SEQ ID NO: 263752

SEQ ID NO: 646625 - RNA, 64 nt, hsa; identical to SEQ ID NO: 263753

SEQ ID NO: 646626 - RNA, 64 nt, hsa; identical to SEQ ID NO: 263754

SEQ ID NO: 646627 - RNA, 64 nt, hsa; identical to SEQ ID NO: 263755

SEQ ID NO: 646628 - RNA, 64 nt, hsa; identical to SEQ ID NO: 263756

SEQ ID NO: 646629 - RNA, 64 nt, hsa; identical to SEQ ID NO: 263757

SEQ ID NO: 646630 - RNA, 64 nt, hsa; identical to SEQ ID NO: 263758

SEQ ID NO: 646631 - RNA, 64 nt, hsa; identical to SEQ ID NO: 263759

SEQ ID NO: 646632 - RNA, 64 nt, hsa; identical to SEQ ID NO: 263760

SEQ ID NO: 646633 - RNA, 64 nt, hsa; identical to SEQ ID NO: 263761

SEQ ID NO: 646634 - RNA, 64 nt, hsa; identical to SEQ ID NO: 263762

SEQ ID NO: 646635 - RNA, 64 nt, hsa; identical to SEQ ID NO: 263763

SEQ ID NO: 646636 - RNA, 64 nt, hsa; identical to SEQ ID NO: 263764

SEQ ID NO: 646637 - RNA, 64 nt, hsa; identical to SEQ ID NO: 263765

SEQ ID NO: 646638 - RNA, 64 nt, hsa; identical to SEQ ID NO: 263766

SEQ ID NO: 646639 - RNA, 64 nt, hsa; identical to SEQ ID NO: 263767

SEQ ID NO: 646640 - RNA, 64 nt, hsa; identical to SEQ ID NO: 263768

SEQ ID NO: 646641 - RNA, 64 nt, hsa; identical to SEQ ID NO: 263769

SEQ ID NO: 646642 - RNA, 64 nt, hsa; identical to SEQ ID NO: 263770

SEQ ID NO: 646643 - RNA, 64 nt, hsa; identical to SEQ ID NO: 263771

SEQ ID NO: 646644 - RNA, 64 nt, hsa; identical to SEQ ID NO: 263772

SEQ ID NO: 646645 - RNA, 64 nt, hsa; identical to SEQ ID NO: 263773

SEQ ID NO: 646646 - RNA, 64 nt, hsa; identical to SEQ ID NO: 263774

SEQ ID NO: 646647 - RNA, 64 nt, hsa; identical to SEQ ID NO: 263775

SEQ ID NO: 646648 - RNA, 64 nt, hsa; identical to SEQ ID NO: 263776

SEQ ID NO: 646649 - RNA, 64 nt, hsa; identical to SEQ ID NO: 263777

SEQ ID NO: 646650 - RNA, 64 nt, hsa; identical to SEQ ID NO: 263778

SEQ ID NO: 646651 - RNA, 64 nt, hsa; identical to SEQ ID NO: 263779

SEQ ID NO: 646652 - RNA, 64 nt, hsa; identical to SEQ ID NO: 263780

SEQ ID NO: 646653 - RNA, 64 nt, hsa; identical to SEQ ID NO: 263781

SEQ ID NO: 646654 - RNA, 64 nt, hsa; identical to SEQ ID NO: 263782

SEQ ID NO: 646655 - RNA, 64 nt, hsa; identical to SEQ ID NO: 263783

SEQ ID NO: 646656 - RNA, 64 nt, hsa; identical to SEQ ID NO: 263784

SEQ ID NO: 646657 - RNA, 64 nt, hsa; identical to SEQ ID NO: 263785

SEQ ID NO: 646658 - RNA, 64 nt, hsa; identical to SEQ ID NO: 263786

SEQ ID NO: 646659 - RNA, 64 nt, hsa; identical to SEQ ID NO: 263787

SEQ ID NO: 646660 - RNA, 64 nt, hsa; identical to SEQ ID NO: 263788

SEQ ID NO: 646661 - RNA, 64 nt, hsa; identical to SEQ ID NO: 263789

SEQ ID NO: 646662 - RNA, 64 nt, hsa; identical to SEQ ID NO: 263790

SEQ ID NO: 646663 - RNA, 64 nt, hsa; identical to SEQ ID NO: 263791

SEQ ID NO: 646664 - RNA, 64 nt, hsa; identical to SEQ ID NO: 263792

SEQ ID NO: 646665 - RNA, 64 nt, hsa; identical to SEQ ID NO: 263793

SEQ ID NO: 646666 - RNA, 64 nt, hsa; identical to SEQ ID NO: 263794

SEQ ID NO: 646667 - RNA, 64 nt, hsa; identical to SEQ ID NO: 263795

SEQ ID NO: 646668 - RNA, 64 nt, hsa; identical to SEQ ID NO: 263796

SEQ ID NO: 646669 - RNA, 64 nt, hsa; identical to SEQ ID NO: 263797

SEQ ID NO: 646670 - RNA, 64 nt, hsa; identical to SEQ ID NO: 263798

SEQ ID NO: 646671 - RNA, 64 nt, hsa; identical to SEQ ID NO: 263799

SEQ ID NO: 646672 - RNA, 64 nt, hsa; identical to SEQ ID NO: 263800

SEQ ID NO: 646673 - RNA, 64 nt, hsa; identical to SEQ ID NO: 263801

SEQ ID NO: 646674 - RNA, 64 nt, hsa; identical to SEQ ID NO: 263802

SEQ ID NO: 646675 - RNA, 64 nt, hsa; identical to SEQ ID NO: 263803

SEQ ID NO: 646676 - RNA, 64 nt, hsa; identical to SEQ ID NO: 263804

SEQ ID NO: 646677 - RNA, 64 nt, hsa; identical to SEQ ID NO: 263805

SEQ ID NO: 646678 - RNA, 64 nt, hsa; identical to SEQ ID NO: 263806

SEQ ID NO: 646679 - RNA, 64 nt, hsa; identical to SEQ ID NO: 263807

SEQ ID NO: 646680 - RNA, 64 nt, hsa; identical to SEQ ID NO: 263808

SEQ ID NO: 646681 - RNA, 64 nt, hsa; identical to SEQ ID NO: 263809

SEQ ID NO: 646682 - RNA, 64 nt, hsa; identical to SEQ ID NO: 263810

SEQ ID NO: 646683 - RNA, 64 nt, hsa; identical to SEQ ID NO: 263811

SEQ ID NO: 646684 - RNA, 64 nt, hsa; identical to SEQ ID NO: 263812

SEQ ID NO: 646685 - RNA, 64 nt, hsa; identical to SEQ ID NO: 263813

SEQ ID NO: 646686 - RNA, 64 nt, hsa; identical to SEQ ID NO: 263814

SEQ ID NO: 646687 - RNA, 64 nt, hsa; identical to SEQ ID NO: 263815

SEQ ID NO: 646688 - RNA, 64 nt, hsa; identical to SEQ ID NO: 263816

SEQ ID NO: 646689 - RNA, 64 nt, hsa; identical to SEQ ID NO: 263817

SEQ ID NO: 646690 - RNA, 64 nt, hsa; identical to SEQ ID NO: 263818

SEQ ID NO: 646691 - RNA, 64 nt, hsa; identical to SEQ ID NO: 263819

SEQ ID NO: 646692 - RNA, 64 nt, hsa; identical to SEQ ID NO: 263820

SEQ ID NO: 646693 - RNA, 64 nt, hsa; identical to SEQ ID NO: 263821

SEQ ID NO: 646694 - RNA, 64 nt, hsa; identical to SEQ ID NO: 263822

SEQ ID NO: 646695 - RNA, 64 nt, hsa; identical to SEQ ID NO: 263823

SEQ ID NO: 646696 - RNA, 64 nt, hsa; identical to SEQ ID NO: 263824

SEQ ID NO: 646697 - RNA, 64 nt, hsa; identical to SEQ ID NO: 263825

SEQ ID NO: 646698 - RNA, 64 nt, hsa; identical to SEQ ID NO: 263826

SEQ ID NO: 646699 - RNA, 64 nt, hsa; identical to SEQ ID NO: 263827

SEQ ID NO: 646700 - RNA, 64 nt, hsa; identical to SEQ ID NO: 263828

SEQ ID NO: 646701 - RNA, 64 nt, hsa; identical to SEQ ID NO: 263829

SEQ ID NO: 646702 - RNA, 64 nt, hsa; identical to SEQ ID NO: 263830

SEQ ID NO: 646703 - RNA, 64 nt, hsa; identical to SEQ ID NO: 263831

SEQ ID NO: 646704 - RNA, 64 nt, hsa; identical to SEQ ID NO: 263832

SEQ ID NO: 646705 - RNA, 64 nt, hsa; identical to SEQ ID NO: 263833

SEQ ID NO: 646706 - RNA, 64 nt, hsa; identical to SEQ ID NO: 263834

SEQ ID NO: 646707 - RNA, 64 nt, hsa; identical to SEQ ID NO: 263835

SEQ ID NO: 646708 - RNA, 64 nt, hsa; identical to SEQ ID NO: 263836

SEQ ID NO: 646709 - RNA, 64 nt, hsa; identical to SEQ ID NO: 263837

SEQ ID NO: 646710 - RNA, 64 nt, hsa; identical to SEQ ID NO: 263838

SEQ ID NO: 646711 - RNA, 64 nt, hsa; identical to SEQ ID NO: 263839

SEQ ID NO: 646712 - RNA, 64 nt, hsa; identical to SEQ ID NO: 263840

SEQ ID NO: 646713 - RNA, 64 nt, hsa; identical to SEQ ID NO: 263841

SEQ ID NO: 646714 - RNA, 64 nt, hsa; identical to SEQ ID NO: 263842

SEQ ID NO: 646715 - RNA, 64 nt, hsa; identical to SEQ ID NO: 263843

SEQ ID NO: 646716 - RNA, 64 nt, hsa; identical to SEQ ID NO: 263844

SEQ ID NO: 646717 - RNA, 64 nt, hsa; identical to SEQ ID NO: 263845

SEQ ID NO: 646718 - RNA, 64 nt, hsa; identical to SEQ ID NO: 263846

SEQ ID NO: 646719 - RNA, 64 nt, hsa; identical to SEQ ID NO: 263847

SEQ ID NO: 646720 - RNA, 64 nt, hsa; identical to SEQ ID NO: 263848

SEQ ID NO: 646721 - RNA, 64 nt, hsa; identical to SEQ ID NO: 263849

SEQ ID NO: 646722 - RNA, 64 nt, hsa; identical to SEQ ID NO: 263850

SEQ ID NO: 646723 - RNA, 64 nt, hsa; identical to SEQ ID NO: 263834

SEQ ID NO: 646724 - RNA, 64 nt, hsa; identical to SEQ ID NO: 263852

SEQ ID NO: 646725 - RNA, 64 nt, hsa; identical to SEQ ID NO: 263853

SEQ ID NO: 646726 - RNA, 64 nt, hsa; identical to SEQ ID NO: 263854

SEQ ID NO: 646727 - RNA, 64 nt, hsa; identical to SEQ ID NO: 263855

SEQ ID NO: 646728 - RNA, 64 nt, hsa; identical to SEQ ID NO: 263856

SEQ ID NO: 646729 - RNA, 64 nt, hsa; identical to SEQ ID NO: 263857

SEQ ID NO: 646730 - RNA, 64 nt, hsa; identical to SEQ ID NO: 263858

SEQ ID NO: 646731 - RNA, 64 nt, hsa; identical to SEQ ID NO: 263859

SEQ ID NO: 646732 - RNA, 64 nt, hsa; identical to SEQ ID NO: 263860

SEQ ID NO: 646733 - RNA, 64 nt, hsa; identical to SEQ ID NO: 263861

SEQ ID NO: 646734 - RNA, 64 nt, hsa; identical to SEQ ID NO: 263862

SEQ ID NO: 646735 - RNA, 64 nt, hsa; identical to SEQ ID NO: 263863

SEQ ID NO: 646736 - RNA, 64 nt, hsa; identical to SEQ ID NO: 263864

SEQ ID NO: 646737 - RNA, 64 nt, hsa; identical to SEQ ID NO: 263865

SEQ ID NO: 646738 - RNA, 64 nt, hsa; identical to SEQ ID NO: 263866

SEQ ID NO: 646739 - RNA, 64 nt, hsa; identical to SEQ ID NO: 263867

SEQ ID NO: 646740 - RNA, 64 nt, hsa; identical to SEQ ID NO: 263868

SEQ ID NO: 646741 - RNA, 64 nt, hsa; identical to SEQ ID NO: 263869

SEQ ID NO: 646742 - RNA, 64 nt, hsa; identical to SEQ ID NO: 263870

SEQ ID NO: 646743 - RNA, 64 nt, hsa; identical to SEQ ID NO: 511837

SEQ ID NO: 646744 - RNA, 64 nt, hsa; identical to SEQ ID NO: 511838

SEQ ID NO: 646745 - RNA, 64 nt, hsa; identical to SEQ ID NO: 511839

SEQ ID NO: 646746 - RNA, 64 nt, hsa; identical to SEQ ID NO: 511840

SEQ ID NO: 646747 - RNA, 64 nt, hsa; identical to SEQ ID NO: 511841

SEQ ID NO: 646748 - RNA, 64 nt, hsa; identical to SEQ ID NO: 511842

SEQ ID NO: 646749 - RNA, 64 nt, hsa; identical to SEQ ID NO: 511843

SEQ ID NO: 646750 - RNA, 64 nt, hsa; identical to SEQ ID NO: 511844

SEQ ID NO: 646751 - RNA, 64 nt, hsa; identical to SEQ ID NO: 511845

SEQ ID NO: 646752 - RNA, 64 nt, hsa; identical to SEQ ID NO: 511846

SEQ ID NO: 646753 - RNA, 64 nt, hsa; identical to SEQ ID NO: 511847

SEQ ID NO: 646754 - RNA, 64 nt, hsa; identical to SEQ ID NO: 511848

SEQ ID NO: 646755 - RNA, 64 nt, hsa; identical to SEQ ID NO: 511849

SEQ ID NO: 646756 - RNA, 64 nt, hsa; identical to SEQ ID NO: 511850

SEQ ID NO: 646757 - RNA, 64 nt, hsa; identical to SEQ ID NO: 511851

SEQ ID NO: 646758 - RNA, 64 nt, hsa; identical to SEQ ID NO: 511852

SEQ ID NO: 646759 - RNA, 64 nt, hsa; identical to SEQ ID NO: 511853

SEQ ID NO: 646760 - RNA, 64 nt, hsa; identical to SEQ ID NO: 511854

SEQ ID NO: 646761 - RNA, 64 nt, hsa; identical to SEQ ID NO: 505756

SEQ ID NO: 646762 - RNA, 64 nt, hsa; identical to SEQ ID NO: 505757

SEQ ID NO: 646763 - RNA, 64 nt, hsa; identical to SEQ ID NO: 505758

SEQ ID NO: 646764 - RNA, 64 nt, hsa; identical to SEQ ID NO: 505759

SEQ ID NO: 646765 - RNA, 64 nt, hsa; identical to SEQ ID NO: 505760

SEQ ID NO: 646766 - RNA, 64 nt, hsa; identical to SEQ ID NO: 505761

SEQ ID NO: 646767 - RNA, 64 nt, hsa; identical to SEQ ID NO: 505762

SEQ ID NO: 646768 - RNA, 64 nt, hsa; identical to SEQ ID NO: 505763

SEQ ID NO: 646769 - RNA, 64 nt, hsa
acuauggaguaaaagaauuaaacuggaccaucucucuccauaucaaucuggaccaucucuccuc

SEQ ID NO: 646770 - RNA, 64 nt, hsa
ucuauaaaucauauaauguaaaggauaucaagguucuccauagguucuucgagauaagcuuaaa

SEQ ID NO: 646771 - RNA, 64 nt, hsa
auucuuucuccauaucuuuuaaggaauuauucuuucuccauaucaucuuuuaauuccuguuauu

SEQ ID NO: 646772 - RNA, 64 nt, hsa
cuuaccuguaaaguuaucuuacggaauuauucuuucuccauaucuuuuaaggaauuauucuuuc

SEQ ID NO: 646773 - RNA, 64 nt, hsa
uccaccaaacuuaacuccguaucuccauauggugucuccauaucuacugugugagcuacuuaac

SEQ ID NO: 646774 - RNA, 64 nt, hsa
uuaauuccuaguauccaccaaacuuaacuccguaucuccauauggugucuccauaucuacugug

SEQ ID NO: 646775 - RNA, 64 nt, hsa
ugccaagcuccucaaucauagccaagaucccaucucuccauauacuuuggguaucagcaucugu

SEQ ID NO: 646776 - RNA, 64 nt, hsa
auauacuuuggguaucagcaucuguccucaucagucuccauaccccuucagcuuuccugagcug

SEQ ID NO: 646777 - RNA, 64 nt, hsa
gaaagcuugggaaccaccccuggccuuuggaaccucuccauauacuuucuaagcucugggggag

SEQ ID NO: 646778 - RNA, 64 nt, hsa
cuucccuuccuucuuuuuuuccucuacugacuucucuccauacucuuuccccucuauuucuuug

SEQ ID NO: 646779 - RNA, 64 nt, hsa
uugauuaauuaauacuauuugaguuauuaaauguuaaucaaaaugaguauaucauuuccugucu

SEQ ID NO: 646780 - RNA, 64 nt, hsa
auuacaaaugaauauuucauguuuauauaagcuguaaucaaaaaggacuaguaguaguaguaag

SEQ ID NO: 646781 - RNA, 64 nt, hsa
ggagguaggaaagguaacagaaaaccagcauauuuaaucaaagcaagaaguaaucgcugacagu

SEQ ID NO: 646782 - RNA, 64 nt, hsa
uauuucaacaauggacuaugccuugguuuuucacuaaucaaaaucaaaauuacucuuuaacaug

SEQ ID NO: 646783 - RNA, 64 nt, hsa
aauauugccagccagcuuggguucuaaagugauuuaaucaaauucaugcuccugaucuuuuuuu

SEQ ID NO: 646784 - RNA, 64 nt, hsa
guguaugaacuuguguuuuguggugacacauuaauaaucaaauugcuaaaacccugaaucugcu

SEQ ID NO: 646785 - RNA, 64 nt, hsa
guagaaauaacuuauuuuuuaguauucuacaguuuaaucaaauuacugaaacaggacuuuugau

SEQ ID NO: 646786 - RNA, 64 nt, hsa
cauuguaacuauguagaaaguguagacuaauguauaaucaaaaugcuaaggauuuuuauauggc

SEQ ID NO: 646787 - RNA, 64 nt, hsa
uucuaaguuuuggguaauguuaacucagaacacuuaaucaaauugagcuaugugccauaaggua

SEQ ID NO: 646788 - RNA, 64 nt, hsa
ggaauucagacacuguucuuaccguguuuguuuuuaaucaaauauuaccuaaaaauguacaaau

SEQ ID NO: 646789 - RNA, 64 nt, hsa
gagcuuagaacauuuaugguauaaaaauuuaaacuaaucaaaguugugugaugauuuccgggaa

SEQ ID NO: 646790 - RNA, 64 nt, hsa
auggacaaucauauuuacaaaauugauguuuuuauaaucaaauguauuuuuuuacuuauguagu

SEQ ID NO: 646791 - RNA, 64 nt, hsa
guugaugucaucaaagaucaccagggcauaauuauaaucaaaauuaguuuuauugaugcuugcu

SEQ ID NO: 646792 - RNA, 64 nt, hsa
agaacucucggccgggcgcgguggcucacaccuguaaucaaaacacuuugggaggcugagucgg

SEQ ID NO: 646793 - RNA, 64 nt, hsa
uaaaagacuugaaauuguaauuaaaauggcaagcuaaucaaacauaagcuucauuaagugggau

SEQ ID NO: 646794 - RNA, 64 nt, hsa
gaucucaccucuccauccaggaauggaguccauguaaucaaagugaacuuaaaaauaggacagu

SEQ ID NO: 646795 - RNA, 64 nt, hsa
ucauuuuuuuguacagauaacaggaguuucugacuaaucaaagcugguauuuccccgcaugucu

SEQ ID NO: 646796 - RNA, 64 nt, hsa
ugucuuauucuugcccuucccccaaccaguuuguuaaucaaacaauaaaaacauguuuuuuuuu

SEQ ID NO: 646797 - RNA, 64 nt, hsa
ucuuccucagcagaccucuuggaauuaggguuucuaaucaaacuaagucuugcaucauaaauuc

SEQ ID NO: 646798 - RNA, 64 nt, hsa
ggaaauagucucaacgugcauguaguagcuaaacuaaucaaaaucuuauaugaauaauuuugaa

SEQ ID NO: 646799 - RNA, 64 nt, hsa
ucuaaaauauccuccaaugugugcauggaacaaauaaucaaaagaaccagacugugucuuauuc

SEQ ID NO: 646800 - RNA, 64 nt, hsa
aguccaucucaaaaaaaaacaacuauuuuucacauaaucaaacucaccuugucucaugacuuuu

SEQ ID NO: 646801 - RNA, 64 nt, hsa
gguaaugcuuggaauggcaauaggguagaaugauuaaucaaaggcauaucuucuauaucugaag

SEQ ID NO: 646802 - RNA, 64 nt, hsa
ggguuuaauagacugagucagaugggucugauauuaaucaaaauugucucuucugaggaccgcu

SEQ ID NO: 646803 - RNA, 64 nt, hsa
gccagcagauagaggaaaagacacacauaaacucgcuucugagcguccacuucugcacucucug

SEQ ID NO: 646804 - RNA, 64 nt, hsa
ugucagaguugaauaucucuuucccuaucaugcugcuucugaaaauucaguuuuggagcaaguc

SEQ ID NO: 646805 - RNA, 64 nt, hsa
caauacuucaucauguauguaaccuuccauguuugcuucugauaaauggaaauguagguucacu

SEQ ID NO: 646806 - RNA, 64 nt, hsa
ggguaacuggagcgucaccaccggcggaaucgcagcuucugagacuggaacucuggaggaagac

SEQ ID NO: 646807 - RNA, 64 nt, hsa
aucucuuguacacauuuuaauaaaauaaggguuggcuucugaacuacaaaacaaaugugcuaug

SEQ ID NO: 646808 - RNA, 64 nt, hsa
ugugauuuggccugugaacuugggcugugccagggcuucugacuucagggacaaaacucaguga

SEQ ID NO: 646809 - RNA, 64 nt, hsa
agcuugaaaggccaauaccagaacacaggcugaugcuucugagaaagucuuuuccuaguauuua

SEQ ID NO: 646810 - RNA, 64 nt, hsa
gucagcucauuuccauuccacuauuucccauaaugcuucugagagccacuaacuugauugauaa

SEQ ID NO: 646811 - RNA, 64 nt, hsa
gugugugugucuugugcuuccucagaccuuucucgcuucugagcuugguggccuguucccucca

SEQ ID NO: 646812 - RNA, 64 nt, hsa
cccuuauccuucugguccagcgcaaggaggggcugcuucugaggucgguggcugucuuuccauu

SEQ ID NO: 646813 - RNA, 59 nt, hsa
aaaauuaacuauacaguuaaugguuuagaacuuagaacuacuuagaauuaaugcuaaag

SEQ ID NO: 646814 - RNA, 59 nt, hsa
auacaguuaaugguuuagaacuuagaacuacuuagaauuaaugcuaaagugucaggaag

SEQ ID NO: 646815 - RNA, 59 nt, hsa
agguagagaauacaacaaagaguucuaagacuuagaaaagacaauuuuguggugucauu

SEQ ID NO: 646816 - RNA, 59 nt, hsa
aauauacaaauuuuccuguaauaaagucaacuuagaaacuccaaggagguuacauguuu

SEQ ID NO: 646817 - RNA, 59 nt, hsa
aauacguaaacauacagugacaacauuaaacuuagaaaaguuuuaaaacuuaauggauc

SEQ ID NO: 646818 - RNA, 59 nt, hsa
uucgcacuucugagacggcaaagccaaccacuuagaagccuuccacaucuuugucaccu

SEQ ID NO: 646819 - RNA, 59 nt, hsa
aaaacccuucauaaaucaagaaggccaucacuuagaacgaaccccaaacaaaaaugcca

SEQ ID NO: 646820 - RNA, 59 nt, hsa
cuaagcaaucauuuuuccccccagaaguuacuuagaaggagaacugggaacacuugggg

SEQ ID NO: 646821 - RNA, 59 nt, hsa
cagucuugauaacugaaaugacuuauuucacuuagaauacauuucucccuucucugcca

SEQ ID NO: 646822 - RNA, 59 nt, hsa
uagcauuuuugcaccaguaaaaauagauaacuuagaacucagucuugauaacugaaaug

SEQ ID NO: 646823 - RNA, 59 nt, hsa
uauguuuauaaaguguaauuuuuagguucacuuagaauauauuuuauuuaauaaguuaa

SEQ ID NO: 646824 - RNA, 59 nt, hsa
ucuuauuuuuguacaguuuugaaguuuauacuuagaacugaccaccuccccggccacgc

SEQ ID NO: 646825 - RNA, 59 nt, hsa
ccaauccuaggaacuguauacuaguuccuacuuagaacaaaaguaucaaguuugcacac

SEQ ID NO: 646826 - RNA, 59 nt, hsa
aguacuuuacuuguauuaucccauuuaauacuuagaacaaccccgugagauaaguaguu

SEQ ID NO: 646827 - RNA, 59 nt, hsa
ucuugggugagcaacggcaccuauuuggaacuuagaaaagaucuugguuuuuccaaacu

SEQ ID NO: 646828 - RNA, 59 nt, hsa
ucgaugccucagguuucuagaggaagggaacuuagaagaagcugaaauacaaaagcaga

SEQ ID NO: 646829 - RNA, 59 nt, hsa
acucugguuguugugccaaauugugguacacuuagaaaauucuacagucgucgauuuuu

SEQ ID NO: 646830 - RNA, 59 nt, hsa
aggaggaaggaagggcaaccuaaaagcccacuuagaaacuuuuuggauaugccacugca

SEQ ID NO: 646831 - RNA, 59 nt, hsa
uaauagcagucauagugaagauuagcacuacuuagaauuaaauuaggaagucuuuuauc

SEQ ID NO: 646832 - RNA, 59 nt, hsa
uuagauguauagaaaaguaagaaaaucuuacuuagaaaaaagccccuugaaacuugcag

SEQ ID NO: 646833 - RNA, 59 nt, hsa
uuaucucuuuuuuucuaaaggagagaaagacuuagaacauacacagauccuaaguagaa

SEQ ID NO: 646834 - RNA, 59 nt, hsa
gagaauguuuuucucuaaaugagagaaagacuuagaauguacacagauccaaaauagaa

SEQ ID NO: 646835 - RNA, 59 nt, hsa
cugugguaagagauaugcucauuauuaccacuuagaagauguuguuaaaaacaugugaa

SEQ ID NO: 646836 - RNA, 59 nt, hsa
ucacugcuuuuuccuuagcuuaaugacuuacuuagaauuuauccuuuauuuuaaaugau

SEQ ID NO: 646837 - RNA, 59 nt, hsa
gauuaauuuugcguuaaagacugacacagacuuagaaucaaauuuauuuuucuggaauu

SEQ ID NO: 646838 - RNA, 59 nt, hsa
ugacuuuaaaagccuccuugaaguuuuuuacuuagaaauauaaggaauaagucuuugaa

SEQ ID NO: 646839 - RNA, 59 nt, hsa
ugacaaguauuuuuucugaacagaaguuuacuuagaaauaccaugcacuuggggguacc

SEQ ID NO: 646840 - RNA, 59 nt, hsa
uucauuacugcauccccaguaaugaaaguacuuagaaaauaauuauugaaugaaugaaa

SEQ ID NO: 646841 - RNA, 59 nt, hsa
auggaugaaacuauaacuuaaagaauaauacuuagaaggguuaauuggaaaucagaguu

SEQ ID NO: 646842 - RNA, 59 nt, hsa
uucauccuguugcuggcagugggauguggacuuagaaaaucaaguucuagcauuuuagu

SEQ ID NO: 646843 - RNA, 64 nt, hsa
agaaacagcccacagagcucaccaacaaguacuccaaaacuaaguaagaguuuaagcuuugaga

SEQ ID NO: 646844 - RNA, 50 nt, hsa
ucuccccauagguuuauuaacaaaacuaggauacccaagacugaagaaac

SEQ ID NO: 646845 - RNA, 64 nt, hsa
ucugaaaaucacauuucagaauaaaacaauugggcaaaacuaccuaggcuuuacucuugagugu

SEQ ID NO: 646846 - RNA, 64 nt, hsa
aacucaacuaugaaucuucaauuuuuuuuuaaagcaaaacuauuuauugacuuuauucauccau

SEQ ID NO: 646847 - RNA, 64 nt, hsa
cuuuuuguggaagauaaaauauuaaaacugcuuucaaaacuacaaauugacuuaaacugcuaua

SEQ ID NO: 646848 - RNA, 64 nt, hsa
aauauacagccuacuuuuaugucaccucuaccuucaaaacuacauauaauuuauuuuaggaguu

SEQ ID NO: 646849 - RNA, 64 nt, hsa
gaugauaugacaucuggcuaaaaagaaauuauugcaaaacuaaccacuauguacuuuuuuauaa

SEQ ID NO: 646850 - RNA, 64 nt, hsa
auacuuuauaaguaauucuaugcaaaaucauagccaaaacuaguauagaaaauaauacgaaacu

SEQ ID NO: 646851 - RNA, 56 nt, hsa
aguacuucuuaaugaaguaaacccaacaaaacuagagguaugaauuaaugcuacac

SEQ ID NO: 646852 - RNA, 64 nt, hsa
aaaugucaguguuuuggugcaccuuuuugaaaugcaaaacuaggaaaagguuaaacuggauuuu

SEQ ID NO: 646853 - RNA, 64 nt, hsa
uguauuuagaaaagguuuauauuauuagugaaaacaaaacuaaagggaaguucaaguucucaug

SEQ ID NO: 646854 - RNA, 64 nt, hsa
auugcuuagauaauuuagaauuuuuaacuaaugucaaaacuacagugucaaacauucuagguug

SEQ ID NO: 646855 - RNA, 64 nt, hsa
acuaguuuuguuuauaaauuggagaugcaaauagcaaaacuaaauacuugcuccauuuacaaac

SEQ ID NO: 646856 - RNA, 64 nt, hsa
ucagaacuuucugugccacuguagauagcucaggcaaaacuauuaccuggguauuuauccacua

SEQ ID NO: 646857 - RNA, 64 nt, hsa
guaugauugcaauuauaugacauucugggagaggcaaaacuaucgagcgagucaaaggaccagu

SEQ ID NO: 646858 - RNA, 64 nt, hsa
ucacagauuuuuuugaauuugugaaaguuuuuggcaaaacuacaaauaggauuauguuagcauu

SEQ ID NO: 646859 - RNA, 64 nt, hsa
aguccuugugcuggaugaguggcugccucaguagcaaaacuaccugacaguauuugacaguguc

SEQ ID NO: 646860 - RNA, 64 nt, hsa
cacacaauugacuggacagguccacgcgccaugacaaaacuauaaucaaguuauuaaaacuaaa

SEQ ID NO: 646861 - RNA, 64 nt, hsa
uguauaaucacaaaucuaauugauuuuauuauggcaaaacuaugcuuuugccaccuuccuguug

SEQ ID NO: 646862 - RNA, 64 nt, hsa
cauuauacuauguguauguuugauacagcgucgccaaaacuaguguucuuuauuagugccucuc

SEQ ID NO: 646863 - RNA, 64 nt, hsa
cugauuuaaaggcuuaggcauguucaaacgccugcaaaacuacuuaucacucagcuuuaguuuu

SEQ ID NO: 646864 - RNA, 64 nt, hsa
aucuaauuccgcaaaaauugaucauuugcaaagucaaaacuauagccauauccaaaucuuuucc

SEQ ID NO: 646865 - RNA, 64 nt, hsa
uccaaggugcuugaucaacaucucccugacaacacaaaacuagagccaggggccuccgugaacu

SEQ ID NO: 646866 - RNA, 64 nt, hsa
gaaaauauaagaugauaaagauaucauuaaaugucaaaacuaugacucuguucagaaaaaaaau

SEQ ID NO: 646867 - RNA, 64 nt, hsa
ucuugaugaccaaaguccuuuuuuuccaucuuuacaaaacuacaugagaacaaacagaucgaac

SEQ ID NO: 646868 - RNA, 64 nt, hsa
ucuugaaauuaagaaggcaaaaauguaaaggagucaaaacuacaaaucaaguauuugggaagug

SEQ ID NO: 646869 - RNA, 65 nt, hsa; identical to SEQ ID NO: 44973

SEQ ID NO: 646870 - RNA, 65 nt, hsa; identical to SEQ ID NO: 44974

SEQ ID NO: 646871 - RNA, 65 nt, hsa; identical to SEQ ID NO: 44975

SEQ ID NO: 646872 - RNA, 65 nt, hsa; identical to SEQ ID NO: 44976

SEQ ID NO: 646873 - RNA, 65 nt, hsa; identical to SEQ ID NO: 44977

SEQ ID NO: 646874 - RNA, 65 nt, hsa; identical to SEQ ID NO: 44978

SEQ ID NO: 646875 - RNA, 65 nt, hsa; identical to SEQ ID NO: 44979

SEQ ID NO: 646876 - RNA, 65 nt, hsa; identical to SEQ ID NO: 44980

SEQ ID NO: 646877 - RNA, 65 nt, hsa; identical to SEQ ID NO: 44981

SEQ ID NO: 646878 - RNA, 65 nt, hsa; identical to SEQ ID NO: 44982

SEQ ID NO: 646879 - RNA, 65 nt, hsa; identical to SEQ ID NO: 44983

SEQ ID NO: 646880 - RNA, 65 nt, hsa; identical to SEQ ID NO: 44984

SEQ ID NO: 646881 - RNA, 65 nt, hsa; identical to SEQ ID NO: 44985

SEQ ID NO: 646882 - RNA, 65 nt, hsa; identical to SEQ ID NO: 44986

SEQ ID NO: 646883 - RNA, 65 nt, hsa; identical to SEQ ID NO: 44987

SEQ ID NO: 646884 - RNA, 65 nt, hsa; identical to SEQ ID NO: 44988

SEQ ID NO: 646885 - RNA, 65 nt, hsa; identical to SEQ ID NO: 44989

SEQ ID NO: 646886 - RNA, 65 nt, hsa; identical to SEQ ID NO: 44990

SEQ ID NO: 646887 - RNA, 65 nt, hsa; identical to SEQ ID NO: 44991

SEQ ID NO: 646888 - RNA, 65 nt, hsa; identical to SEQ ID NO: 44992

SEQ ID NO: 646889 - RNA, 65 nt, hsa; identical to SEQ ID NO: 44993

SEQ ID NO: 646890 - RNA, 65 nt, hsa; identical to SEQ ID NO: 44994

SEQ ID NO: 646891 - RNA, 65 nt, hsa; identical to SEQ ID NO: 44995

SEQ ID NO: 646892 - RNA, 65 nt, hsa; identical to SEQ ID NO: 44996

SEQ ID NO: 646893 - RNA, 65 nt, hsa; identical to SEQ ID NO: 44997

SEQ ID NO: 646894 - RNA, 65 nt, hsa; identical to SEQ ID NO: 44998

SEQ ID NO: 646895 - RNA, 65 nt, hsa; identical to SEQ ID NO: 44999

SEQ ID NO: 646896 - RNA, 65 nt, hsa; identical to SEQ ID NO: 45000

SEQ ID NO: 646897 - RNA, 65 nt, hsa; identical to SEQ ID NO: 45001

SEQ ID NO: 646898 - RNA, 65 nt, hsa; identical to SEQ ID NO: 45002

SEQ ID NO: 646899 - RNA, 65 nt, hsa; identical to SEQ ID NO: 45003

SEQ ID NO: 646900 - RNA, 65 nt, hsa; identical to SEQ ID NO: 45004

SEQ ID NO: 646901 - RNA, 65 nt, hsa; identical to SEQ ID NO: 45005

SEQ ID NO: 646902 - RNA, 65 nt, hsa; identical to SEQ ID NO: 45006

SEQ ID NO: 646903 - RNA, 65 nt, hsa; identical to SEQ ID NO: 45007

SEQ ID NO: 646904 - RNA, 65 nt, hsa; identical to SEQ ID NO: 45008

SEQ ID NO: 646905 - RNA, 65 nt, hsa; identical to SEQ ID NO: 45009

SEQ ID NO: 646906 - RNA, 65 nt, hsa; identical to SEQ ID NO: 45010

SEQ ID NO: 646907 - RNA, 65 nt, hsa; identical to SEQ ID NO: 45011

SEQ ID NO: 646908 - RNA, 65 nt, hsa; identical to SEQ ID NO: 45012

SEQ ID NO: 646909 - RNA, 65 nt, hsa; identical to SEQ ID NO: 45013

SEQ ID NO: 646910 - RNA, 65 nt, hsa; identical to SEQ ID NO: 45014

SEQ ID NO: 646911 - RNA, 65 nt, hsa; identical to SEQ ID NO: 45015

SEQ ID NO: 646912 - RNA, 65 nt, hsa; identical to SEQ ID NO: 45016

SEQ ID NO: 646913 - RNA, 65 nt, hsa; identical to SEQ ID NO: 45017

SEQ ID NO: 646914 - RNA, 65 nt, hsa; identical to SEQ ID NO: 45018

SEQ ID NO: 646915 - RNA, 65 nt, hsa; identical to SEQ ID NO: 45019

SEQ ID NO: 646916 - RNA, 65 nt, hsa; identical to SEQ ID NO: 45020

SEQ ID NO: 646917 - RNA, 65 nt, hsa; identical to SEQ ID NO: 45021

SEQ ID NO: 646918 - RNA, 65 nt, hsa; identical to SEQ ID NO: 45022

SEQ ID NO: 646919 - RNA, 65 nt, hsa; identical to SEQ ID NO: 45023

SEQ ID NO: 646920 - RNA, 65 nt, hsa; identical to SEQ ID NO: 45024

SEQ ID NO: 646921 - RNA, 64 nt, hsa
gggugcccuauaggcacaagcccagcugaagaacagaauggagggcucugggaggaggcagcuc

SEQ ID NO: 646922 - RNA, 64 nt, hsa
gggauggacauaaaggaaaaagagugaugagaagagaauggagagaauuugaauaaaagguggg

SEQ ID NO: 646923 - RNA, 64 nt, hsa
aauaaggcaucucugagaaaguggccccagggagagaauggaggacugggaggagaagcauuaa

SEQ ID NO: 646924 - RNA, 64 nt, hsa
uuuugacuaaugacaaaccucuuuuuaagaugguagaauggaggugauagucacaaaaguaaau

SEQ ID NO: 646925 - RNA, 64 nt, hsa
ucccccggcugggccuccuucuuccacuucuccaagaauggaagccugaacugaggccuugugu

SEQ ID NO: 646926 - RNA, 64 nt, hsa
aggucacugucacugccgacaucccucccccagcagaauggaggcaggggacaagggaggcagu

SEQ ID NO: 646927 - RNA, 64 nt, hsa
acucuguaggguacuguaauuugucaaaaugcagagaauggaaaacagugaacggaaaacacag

SEQ ID NO: 646928 - RNA, 64 nt, hsa
uacauuugaguaaccaucaacacaauuaguuuacagaauggaaaaggagucugagaucuguacu

SEQ ID NO: 646929 - RNA, 64 nt, hsa
aaagacaaagguuagucugaucuccagacccgucagaauggaauacacagcccacaucugucac

SEQ ID NO: 646930 - RNA, 64 nt, hsa
uucauuuuucuuguacauauguguaaauaaugacagaauggagugggguaaaaguguauuuuga

SEQ ID NO: 646931 - RNA, 64 nt, hsa
aauaccugauguauugugaaagccacugauuuuaagaauggagagaaagggauuuuuuacugca

SEQ ID NO: 646932 - RNA, 64 nt, hsa
gaagugacuugcccuaggagcagacagcaugccaagaauggaauuaggcucaggauccagccug

SEQ ID NO: 646933 - RNA, 64 nt, hsa
uggacuuuuuuggccacugcccuggacuagugaaagaauggacucuaucuuuaucugcaagagg

SEQ ID NO: 646934 - RNA, 64 nt, hsa
gggccuccaguguauuguucugcaguguugaaacagaauggaaaugacaagaaauaucugcagu

SEQ ID NO: 646935 - RNA, 64 nt, hsa
auucagacugaaauguuugugucuucaacuuauuagaauggaagauaaugcagauauuucugug

SEQ ID NO: 646936 - RNA, 64 nt, hsa
gguuaagggaagugacaauuuuauuccauuccagagaauggacaaacucuuaacuuuuaucaag

SEQ ID NO: 646937 - RNA, 64 nt, hsa
guguaucuucuccccagugacagaaguagagaagagaauggaaagcagcacacuccguccccuc

SEQ ID NO: 646938 - RNA, 64 nt, hsa
gaaaaaaaugugacagaauguuccauagucugagagaauggaaucguugagcauuuaguacaag

SEQ ID NO: 646939 - RNA, 64 nt, hsa
agagccacaagcaggaagagcagcgcuguguugcagaauggaguuuccauggauuucuaccaga

SEQ ID NO: 646940 - RNA, 64 nt, hsa
uuauuaaaacuaaaucugaaauggaauagaaaauagaauggauuacauacagaugguuuccuug

SEQ ID NO: 646941 - RNA, 64 nt, hsa
aaaugucucaaagucaacagcccaauaagaaugaagaauggaaauggaaaaggguggcugcgac

SEQ ID NO: 646942 - RNA, 64 nt, hsa
aggaaccaacuccagguagagagccgcuccuuacagaauggagccuccaucaccggaaccagcg

SEQ ID NO: 646943 - RNA, 64 nt, hsa
gccagugaguuguagauuuaugcuggaagaauggagaauggaaacaggccuucagcccauuggc

SEQ ID NO: 646944 - RNA, 64 nt, hsa
uugugcugccagugaguuguagauuuaugcuggaagaauggagaauggaaacaggccuucagcc

SEQ ID NO: 646945 - RNA, 64 nt, hsa
aauguuuggacuugauuuccccacgucauaaugaagaauggaaguuuggaucugcuccucguca

SEQ ID NO: 646946 - RNA, 64 nt, hsa
cucugugccugacucacagcauauaggucaggaaagaauggagacggcauucuuggacuucacu

SEQ ID NO: 646947 - RNA, 64 nt, hsa
agagguuccucgaaaggggggagaagaaauuuugagaauggaaaaaucccccagcccagcccag

SEQ ID NO: 646948 - RNA, 64 nt, hsa
cagggggugaccccuggagcuaguugcgugucccagaauggaggguguucugacaccccacccu

SEQ ID NO: 646949 - RNA, 64 nt, hsa
guauugcccaguaggagcuaucacuauauuuugcagaauggaaacugcccugacucaugaauca

SEQ ID NO: 646950 - RNA, 64 nt, hsa
caaacucucauuuaggugacagccuggugacuccagaauggagccagucaugcuaaaugccaua

SEQ ID NO: 646951 - RNA, 64 nt, hsa
ugcuaaugugcagcugagugcacuuuauuuaaaaagaauggauaaaugcaauauucuugagguc

SEQ ID NO: 646952 - RNA, 64 nt, hsa
uuugauccagaggugggugcagcugaaaguaaacagaauggauugccaguuacauguaugccug

SEQ ID NO: 646953 - RNA, 64 nt, hsa
gaguauauugaauagaaauucugcauguguggggagaauggacaaggacuuaggaaaaaguccu

SEQ ID NO: 646954 - RNA, 64 nt, hsa
ccuugucuggggaguguuggggagcaucaguaaaagaauggacacucaggcacagaguggcccu

SEQ ID NO: 646955 - RNA, 64 nt, hsa; identical to SEQ ID NO: 159617

SEQ ID NO: 646956 - RNA, 64 nt, hsa; identical to SEQ ID NO: 159618

SEQ ID NO: 646957 - RNA, 64 nt, hsa; identical to SEQ ID NO: 159619

SEQ ID NO: 646958 - RNA, 64 nt, hsa; identical to SEQ ID NO: 159620

SEQ ID NO: 646959 - RNA, 64 nt, hsa; identical to SEQ ID NO: 159621

SEQ ID NO: 646960 - RNA, 64 nt, hsa; identical to SEQ ID NO: 159622

SEQ ID NO: 646961 - RNA, 64 nt, hsa; identical to SEQ ID NO: 159623

SEQ ID NO: 646962 - RNA, 64 nt, hsa; identical to SEQ ID NO: 159624

SEQ ID NO: 646963 - RNA, 64 nt, hsa; identical to SEQ ID NO: 159625

SEQ ID NO: 646964 - RNA, 64 nt, hsa; identical to SEQ ID NO: 159626

SEQ ID NO: 646965 - RNA, 64 nt, hsa; identical to SEQ ID NO: 159627

SEQ ID NO: 646966 - RNA, 64 nt, hsa; identical to SEQ ID NO: 159628

SEQ ID NO: 646967 - RNA, 64 nt, hsa; identical to SEQ ID NO: 159629

SEQ ID NO: 646968 - RNA, 64 nt, hsa; identical to SEQ ID NO: 159630

SEQ ID NO: 646969 - RNA, 64 nt, hsa; identical to SEQ ID NO: 159631

SEQ ID NO: 646970 - RNA, 64 nt, hsa; identical to SEQ ID NO: 159632

SEQ ID NO: 646971 - RNA, 64 nt, hsa; identical to SEQ ID NO: 159633

SEQ ID NO: 646972 - RNA, 64 nt, hsa; identical to SEQ ID NO: 159634

SEQ ID NO: 646973 - RNA, 64 nt, hsa; identical to SEQ ID NO: 159635

SEQ ID NO: 646974 - RNA, 64 nt, hsa; identical to SEQ ID NO: 159636

SEQ ID NO: 646975 - RNA, 64 nt, hsa; identical to SEQ ID NO: 159637

SEQ ID NO: 646976 - RNA, 64 nt, hsa; identical to SEQ ID NO: 159638

SEQ ID NO: 646977 - RNA, 64 nt, hsa; identical to SEQ ID NO: 159639

SEQ ID NO: 646978 - RNA, 64 nt, hsa; identical to SEQ ID NO: 159640

SEQ ID NO: 646979 - RNA, 64 nt, hsa; identical to SEQ ID NO: 159641

SEQ ID NO: 646980 - RNA, 64 nt, hsa; identical to SEQ ID NO: 159642

SEQ ID NO: 646981 - RNA, 64 nt, hsa; identical to SEQ ID NO: 159643

SEQ ID NO: 646982 - RNA, 64 nt, hsa; identical to SEQ ID NO: 159644

SEQ ID NO: 646983 - RNA, 64 nt, hsa; identical to SEQ ID NO: 159645

SEQ ID NO: 646984 - RNA, 64 nt, hsa; identical to SEQ ID NO: 159646

SEQ ID NO: 646985 - RNA, 64 nt, hsa; identical to SEQ ID NO: 159647

SEQ ID NO: 646986 - RNA, 64 nt, hsa; identical to SEQ ID NO: 159648

SEQ ID NO: 646987 - RNA, 64 nt, hsa; identical to SEQ ID NO: 159649

SEQ ID NO: 646988 - RNA, 64 nt, hsa; identical to SEQ ID NO: 159650

SEQ ID NO: 646989 - RNA, 64 nt, hsa; identical to SEQ ID NO: 159651

SEQ ID NO: 646990 - RNA, 64 nt, hsa; identical to SEQ ID NO: 159652

SEQ ID NO: 646991 - RNA, 64 nt, hsa; identical to SEQ ID NO: 159653

SEQ ID NO: 646992 - RNA, 64 nt, hsa; identical to SEQ ID NO: 159654

SEQ ID NO: 646993 - RNA, 64 nt, hsa; identical to SEQ ID NO: 159655

SEQ ID NO: 646994 - RNA, 64 nt, hsa; identical to SEQ ID NO: 159656

SEQ ID NO: 646995 - RNA, 64 nt, hsa; identical to SEQ ID NO: 159657

SEQ ID NO: 646996 - RNA, 64 nt, hsa; identical to SEQ ID NO: 159658

SEQ ID NO: 646997 - RNA, 64 nt, hsa; identical to SEQ ID NO: 637341

SEQ ID NO: 646998 - RNA, 64 nt, hsa; identical to SEQ ID NO: 637342

SEQ ID NO: 646999 - RNA, 64 nt, hsa; identical to SEQ ID NO: 637343

SEQ ID NO: 647000 - RNA, 64 nt, hsa; identical to SEQ ID NO: 637344

SEQ ID NO: 647001 - RNA, 64 nt, hsa; identical to SEQ ID NO: 637345

SEQ ID NO: 647002 - RNA, 64 nt, hsa; identical to SEQ ID NO: 637346

SEQ ID NO: 647003 - RNA, 64 nt, hsa; identical to SEQ ID NO: 637347

SEQ ID NO: 647004 - RNA, 64 nt, hsa; identical to SEQ ID NO: 637348

SEQ ID NO: 647005 - RNA, 64 nt, hsa; identical to SEQ ID NO: 637349

SEQ ID NO: 647006 - RNA, 64 nt, hsa; identical to SEQ ID NO: 637350

SEQ ID NO: 647007 - RNA, 64 nt, hsa; identical to SEQ ID NO: 637351

SEQ ID NO: 647008 - RNA, 64 nt, hsa; identical to SEQ ID NO: 637352

SEQ ID NO: 647009 - RNA, 64 nt, hsa; identical to SEQ ID NO: 637353

SEQ ID NO: 647010 - RNA, 64 nt, hsa; identical to SEQ ID NO: 637354

SEQ ID NO: 647011 - RNA, 64 nt, hsa; identical to SEQ ID NO: 637355

SEQ ID NO: 647012 - RNA, 64 nt, hsa; identical to SEQ ID NO: 637356

SEQ ID NO: 647013 - RNA, 64 nt, hsa; identical to SEQ ID NO: 637357

SEQ ID NO: 647014 - RNA, 64 nt, hsa; identical to SEQ ID NO: 637358

SEQ ID NO: 647015 - RNA, 64 nt, hsa; identical to SEQ ID NO: 637359

SEQ ID NO: 647016 - RNA, 64 nt, hsa; identical to SEQ ID NO: 637360

SEQ ID NO: 647017 - RNA, 64 nt, hsa; identical to SEQ ID NO: 637361

SEQ ID NO: 647018 - RNA, 64 nt, hsa; identical to SEQ ID NO: 637362

SEQ ID NO: 647019 - RNA, 64 nt, hsa; identical to SEQ ID NO: 637363

SEQ ID NO: 647020 - RNA, 64 nt, hsa; identical to SEQ ID NO: 637364

SEQ ID NO: 647021 - RNA, 64 nt, hsa; identical to SEQ ID NO: 144505

SEQ ID NO: 647022 - RNA, 64 nt, hsa; identical to SEQ ID NO: 144505

SEQ ID NO: 647023 - RNA, 64 nt, hsa; identical to SEQ ID NO: 144507

SEQ ID NO: 647024 - RNA, 64 nt, hsa; identical to SEQ ID NO: 144508

SEQ ID NO: 647025 - RNA, 64 nt, hsa
aauacacauucauuaaacuuuuguuguaauuaaacugcuauauauuguuugccauauauuaugg

SEQ ID NO: 647026 - RNA, 64 nt, hsa
uuauggaaaugaaauaugaaauuuuauuaaaaugcugcuauauuacauaaguugcuucauuaag

SEQ ID NO: 647027 - RNA, 64 nt, hsa
augagaauguuuugcguaggggcaacacagucugcugcuauauagugggggaagcgugcacuua

SEQ ID NO: 647028 - RNA, 64 nt, hsa
uaaacauuuuuaaucacaagcuguauuagcuuugcugcuauauagguguuauguguaaaugcca

SEQ ID NO: 647029 - RNA, 64 nt, hsa
gucugaguucuagcaggguccuggggguaucccacugcuauacuguucuacugcuucccucagu

SEQ ID NO: 647030 - RNA, 64 nt, hsa
cgugcugcuguguucugcuccuccccacgcuucccugcuauaguucccagcugcuguaacggag

SEQ ID NO: 647031 - RNA, 64 nt, hsa
ggacaauggaauaucccaggguggugacagcagauggagcuacuugggggagagcucaaguugg

SEQ ID NO: 647032 - RNA, 64 nt, hsa
uggagcuuugaagaccuaagaggcuagugguuccuggagcuagugguuaccugaacagguaugg

SEQ ID NO: 647033 - RNA, 64 nt, hsa
gccauguuguugacauuagguacuuaauaagccuuggagcuaguggagagggagaggaaagggu

SEQ ID NO: 647034 - RNA, 64 nt, hsa
caaagaaugagaaccucaagcaucugggauccaguggagcuaaucaguccugccuccugcucuc

SEQ ID NO: 647035 - RNA, 64 nt, hsa
gccaggacugcccugagccgcaaaaugucaaagcuggagcuauagagguagcccuaaaggcaac

SEQ ID NO: 647036 - RNA, 64 nt, hsa
gcccaggcagggcugcauggagaggaauggaaccuggagcuagaauuaauugcccacucuccca

SEQ ID NO: 647037 - RNA, 59 nt, hsa
ucugguugaccggcaugaaguacaucagccugucuuagccugagcugcuuugaagacca

SEQ ID NO: 647038 - RNA, 59 nt, hsa
auucuaaccaaaguugacagacugugcgucugucuuaauggaugucuuaggaguugguu

SEQ ID NO: 647039 - RNA, 59 nt, hsa
ccuccgccuccuggguucaagggauucuccugucuuagccuccugaguagcugugauua

SEQ ID NO: 647040 - RNA, 59 nt, hsa
agaggcucagucuguugagucuguugugacugucuuaugaaucaaucuguugugccaac

SEQ ID NO: 647041 - RNA, 59 nt, hsa
aaauuaaagagaaaauugagaguaaaugacugucuuaucacucuuauuugacauuucgu

SEQ ID NO: 647042 - RNA, 59 nt, hsa
agucacacugaaagcaauuuugagcuuaucugucuuauuuaugcuuugagugaaucauc

SEQ ID NO: 647043 - RNA, 59 nt, hsa
caaaacucuugguaauuuuugaagauagacugucuuaucaccaaggaaauuuauacaaa

SEQ ID NO: 647044 - RNA, 59 nt, hsa
uauaggauauauaaaccauuaccauugaucugucuuaugccauaaucuuaaaaaaaauu

SEQ ID NO: 647045 - RNA, 59 nt, hsa
cuccucccauccuuucccuuuuuaggucccugucuuauacaaccagagaaguggguguu

SEQ ID NO: 647046 - RNA, 59 nt, hsa
uuucagauuguaucugaacucacagacugcugucuuacuaauaggucuggaaggucacg

SEQ ID NO: 647047 - RNA, 59 nt, hsa
agcugaaagucccacuggcuggccucaggcugucuuauuccgcuugaaaauagccaaaa

SEQ ID NO: 647048 - RNA, 59 nt, hsa
uuguauaguuuugagacauucaauuaucacugucuuaguuguauuuuaauuuacuaaau

SEQ ID NO: 647049 - RNA, 59 nt, hsa
uacuuuuggaaauugaacaagaaaugcaucugucuuagaaacuggagauuauuugaugu

SEQ ID NO: 647050 - RNA, 59 nt, hsa
ggcuacacaaccuucucaggacaagcccacugucuuaagccacuuugacccugggagac

SEQ ID NO: 647051 - RNA, 59 nt, hsa
gcugaaaguacacugggaucacugggacacugucuuaugaagguuugcuugggaugaaa

SEQ ID NO: 647052 - RNA, 59 nt, hsa
ucugaagucccugcagguggaggccaugccugucuuaaacucaguugcaucccuggugc

SEQ ID NO: 647053 - RNA, 59 nt, hsa
auauacaguauaguuuaucugcucuauuucugucuuauagaaaucaugaauguggucug

SEQ ID NO: 647054 - RNA, 59 nt, hsa
aagcugagacacuugucauguggucagaucugucuuagucuuuugugucucccaaggug

SEQ ID NO: 647055 - RNA, 59 nt, hsa
uugagguacaaggggaaaagauggcgauucugucuuauaaccuccugggucccauccag

SEQ ID NO: 647056 - RNA, 59 nt, hsa
cacuccagccugggugacagagcaagacccugucuuaaaaaaagaggauucaacacaua

SEQ ID NO: 647057 - RNA, 59 nt, hsa
ccaguauuuguuccuguuuuacaaugcuucugucuuaagcugugucuuaacuuuuaaca

SEQ ID NO: 647058 - RNA, 59 nt, hsa
ccuaucuuggguccuugaacuacagccugcugucuuacaccaguggagcuacccuuuaa

SEQ ID NO: 647059 - RNA, 59 nt, hsa
caauauucuagaccaacuuugacuacuuccugucuuaguaauagaccaauacauggcuc

SEQ ID NO: 647060 - RNA, 59 nt, hsa
ugaaccaucuucguacaugaauaauaauacugucuuacguuuuucuggugcuuuauaau

SEQ ID NO: 647061 - RNA, 59 nt, hsa
agaguaaauuuaaauugucuuuucaauaucugucuuauaucagucaauaacauuggaug

SEQ ID NO: 647062 - RNA, 59 nt, hsa
cuggcauuugcugcccucuugucccuuaucugucuuaugcugguuauuucacugcuuca

SEQ ID NO: 647063 - RNA, 59 nt, hsa
uagcagcuaggugaguuuguuuuccgggucugucuuaacuggcagcuuccuguacauac

SEQ ID NO: 647064 - RNA, 59 nt, hsa
uaccaaaccugacucccuguaaaggagugcugucuuaaaaacaacugaagggguuaaag

SEQ ID NO: 647065 - RNA, 59 nt, hsa
gcccgugcauauuuaggucauuucccacacugucuuagagaacuugucaccagaaacca

SEQ ID NO: 647066 - RNA, 59 nt, hsa
ucccuguaggacucaauaguaaaugcugucugucuuacacauuuauaaggacccugcaa

SEQ ID NO: 647067 - RNA, 59 nt, hsa
cagucuaaggucucaugcuguugcugcuacugucuuacuauuauagcaacuuuaagaag

SEQ ID NO: 647068 - RNA, 59 nt, hsa
aaauuuuuauauaagaaaauccccagccucugucuuaaacuugugggacaaaaauccuu

SEQ ID NO: 647069 - RNA, 59 nt, hsa
cuuccauacaaauuugagauagaucucgccugucuuaaagcugccauuugcucauucua

SEQ ID NO: 647070 - RNA, 59 nt, hsa
gaaguugccaagaguucuuuaggugccuccugucuuauggcguugcaggccagguuaug

SEQ ID NO: 647071 - RNA, 59 nt, hsa
aaaauagcucauauaucucaucuuuccuccugucuuagaagaacagaccuaacuaguga

SEQ ID NO: 647072 - RNA, 59 nt, hsa
uagagaaaauagagaugaauuaggggacacugucuuauggauucauuuauaagaagaga

SEQ ID NO: 647073 - RNA, 59 nt, hsa
gacacaagggaacaguauuugcauuuguacugucuuagaauauuauuuauuuuuuugua

SEQ ID NO: 647074 - RNA, 59 nt, hsa
uugggguaguuguguuucaacggaaagugcugucuuaaacuaaaugugcaauagaaggu

SEQ ID NO: 647075 - RNA, 59 nt, hsa
caccucacaaugaaguacuacagccugugcugucuuaaugguuuaugucaggaaaugaa

SEQ ID NO: 647076 - RNA, 59 nt, hsa
uuaaaaacuaccaacauauaauauauaugcugucuuaaaaguuaaugauccaaguggca

SEQ ID NO: 647077 - RNA, 59 nt, hsa
gggcuugcuaaauccagcagaccccuuuccugucuuacuagaucugggcagcauuugac

SEQ ID NO: 647078 - RNA, 59 nt, hsa
agauugaaaaauauaaagguauccaaacucugucuuaauguaaauguaacuauuuuucc

SEQ ID NO: 647079 - RNA, 59 nt, hsa
ugagguauuuuaaaauuuacuuccuugcacugucuuacacagagugcuauaacuauaaa

SEQ ID NO: 647080 - RNA, 59 nt, hsa
augcuacaaaacaccuugucaaccucuuccugucuuaccaaacagugggagggaauucc

SEQ ID NO: 647081 - RNA, 59 nt, hsa
gaaucuuaaaaaaaaaaaaacguuucucacugucuuaaauagaauuuuuaaauaguaua

SEQ ID NO: 647082 - RNA, 59 nt, hsa
cuguuguguaaugucucuagaaaggaauccugucuuaaaacuggguuuugcuguuuuuu

SEQ ID NO: 647083 - RNA, 59 nt, hsa
gcacacacaaaaaggcuucuuacacauaccugucuuaaaccauguguagagcuuuaaaa

SEQ ID NO: 647084 - RNA, 59 nt, hsa
gagagccacaggaccguuuuggggcugaccugucuuauuacguauguacuucuagguug

SEQ ID NO: 647085 - RNA, 59 nt, hsa
ugaccaagagccuaguauauaguuggugccugucuuagucuguuuguguugcuauaaaa

SEQ ID NO: 647086 - RNA, 59 nt, hsa
cugagcuacagcccagaagccagacaugccugucuuagcugaccuguuuuugguccacu

SEQ ID NO: 647087 - RNA, 59 nt, hsa
uugcuaaaggaaggcuucugugucaaugccugucuuagaugucaagcugaaaacaaaca

SEQ ID NO: 647088 - RNA, 59 nt, hsa
uggaagagguccuguccucagggaauuaacugucuuauugggagacaacaacuguccuc

SEQ ID NO: 647089 - RNA, 59 nt, hsa
ugacuggaagaauuuaggaccacugcauccugucuuaauccaagguacuggaaaaccuu

SEQ ID NO: 647090 - RNA, 59 nt, hsa
ggucaguauggcccaacauagcuucugcucugucuuacugacucaauaccuuuaggauu

SEQ ID NO: 647091 - RNA, 59 nt, hsa
uacaauuuaaaaacucuuguuccaaaguccugucuuaacuauugaaacaccuuaaucug

SEQ ID NO: 647092 - RNA, 59 nt, hsa
ugacaggcucagcaugggcucagcagaugcugucuuaauuuguggaugauacagaaagc

SEQ ID NO: 647093 - RNA, 59 nt, hsa
cuccucccucuauuacuguuucaccagagcugucuuagcucaaaucuguuguguuucug

SEQ ID NO: 647094 - RNA, 59 nt, hsa
cccccaccugacagccccauccucaaagacugucuuaauuacucauggcagguucuaga

SEQ ID NO: 647095 - RNA, 59 nt, hsa
cuccauugccuggccccaauuuacuaauccugucuuauuucccacaaauccuuuauacu

SEQ ID NO: 647096 - RNA, 59 nt, hsa
uuuuaaugaccaauugaguaagaacaucccugucuuaacuggccuaaauuucuucuggu

SEQ ID NO: 647097 - RNA, 59 nt, hsa
uggggcuggaaaauguaugaauucuucaacugucuuacaagagaucugcuaauaaauuu

SEQ ID NO: 647098 - RNA, 59 nt, hsa
augcugacuuucuaucuuccuuucucaaacugucuuaggaaggaccuucagugcagauc

SEQ ID NO: 647099 - RNA, 59 nt, hsa
uuuuuuuuuuucuuuugaauggauuuaugcugucuuagcaauaugacaauaauccucug

SEQ ID NO: 647100 - RNA, 59 nt, hsa
guagcuaucucgccauucccuuuaaauaccugucuuaaccuccugcuuuucuuuccuac

SEQ ID NO: 647101 - RNA, 59 nt, hsa
uaguucagauacucaaaaaugucuucacucugucuuaaauuggacaguugaacuuaaaa

SEQ ID NO: 647102 - RNA, 59 nt, hsa
cucagcauuugaucaucacuuuuucuuagcugucuuaagcauuauagaauuucucuuac

SEQ ID NO: 647103 - RNA, 59 nt, hsa
aggaucuguagaagacauuuugggaaacacugucuuaaauaaaaacucaauguuuaguu

SEQ ID NO: 647104 - RNA, 59 nt, hsa
guauaauauaucucagacugaguuacugccugucuuaucaggauggauaaaacacuaca

SEQ ID NO: 647105 - RNA, 59 nt, hsa
aguuuucauugcugcuuuagcaaaccacgcugucuuacagugguacuuucuucuggcca

SEQ ID NO: 647106 - RNA, 59 nt, hsa
ucucaauucccaugugcugugacuguagacugucuuaccauagacugucuuacccaucc

SEQ ID NO: 647107 - RNA, 59 nt, hsa
gcugugacuguagacugucuuaccauagacugucuuacccauccccuggauaugcucuu

SEQ ID NO: 647108 - RNA, 59 nt, hsa
aaauaaggauuuaagaauuaugaggaaagcugucuuauguuucuuguucuuaaauuaua

SEQ ID NO: 647109 - RNA, 59 nt, hsa
aacucauacuucaaaaauauuaggaaaaucugucuuauaguuucucuaauaaauaucug

SEQ ID NO: 647110 - RNA, 59 nt, hsa
uugcauuucccucccuccaggggcuauuccugucuuaggcgauuuguggggugcaguga

SEQ ID NO: 647111 - RNA, 59 nt, hsa
uucuucuugugugcucauuauggaucucucugucuuaggaauugccucaggcauuuuuu

SEQ ID NO: 647112 - RNA, 59 nt, hsa
ccuguugcaaagucuguaugcaggugugccugucuuaaauuccaaagcuuuacauuuca

SEQ ID NO: 647113 - RNA, 59 nt, hsa
aaaauugaaaauauguuggaaaaaagauucugucuuauaggguaaaaaaagccaccgug

SEQ ID NO: 647114 - RNA, 59 nt, hsa
caaauaacuaauguuuuuacaacauaaaacugucuuauuuuugugaaaggauuauuuug

SEQ ID NO: 647115 - RNA, 59 nt, hsa
ccauagccuugcaaaaugcaacuugugcucugucuuauaaaaauggagaaaggagucau

SEQ ID NO: 647116 - RNA, 59 nt, hsa
uuuaauuuguauaucuuuuguauauguaucugucuuagauauuuggcuaauuuuaagug

SEQ ID NO: 647117 - RNA, 59 nt, hsa
uugugaaagagugugucuugcaucaacagcugucuuauuuaugauauauaaguagaaau

SEQ ID NO: 647118 - RNA, 59 nt, hsa
gugagaaggguguuguaguuuauaaaagacugucuuaauuugcauacuuaagcauuuag

SEQ ID NO: 647119 - RNA, 59 nt, hsa; identical to SEQ ID NO: 647118

SEQ ID NO: 647120 - RNA, 59 nt, hsa
aaacauucccaguggcagccugccuaagacugucuuaccuuauguuaaggaagucaggu

SEQ ID NO: 647121 - RNA, 59 nt, hsa
agcaguugcucaguagaaagucuagauuucugucuuauaggugauuucugucuuauagg

SEQ ID NO: 647122 - RNA, 59 nt, hsa
agucuagauuucugucuuauaggugauuucugucuuauaggugauuauaaucaagugua

SEQ ID NO: 647123 - RNA, 59 nt, hsa
ggugguaagccccagucucaggggucacccugucuuagagcuagagaugagguggcagg

SEQ ID NO: 647124 - RNA, 59 nt, hsa
uuauuuaaaaucagauuuuuguuuuuagacugucuuagaucuggggcuauuacgaauca

SEQ ID NO: 647125 - RNA, 59 nt, hsa
cgcaguaauucccaucugcuuuauugccucugucuuaaagaauuugaaaguuuccuuau

SEQ ID NO: 647126 - RNA, 59 nt, hsa
caagugaccugucuuuuaaaaaggcagugcugucuuaccucuugcuaguggguuaaaug

SEQ ID NO: 647127 - RNA, 59 nt, hsa
uguaucauacucuucuaaaacuugaguggcugucuuaaaagauauaaggggaaagauaa

SEQ ID NO: 647128 - RNA, 59 nt, hsa
ucggacaaaaaaaguagggaaaaacgaagcugucuuagagugggaccaacuuccuguug

SEQ ID NO: 647129 - RNA, 59 nt, hsa
aaauauuuagcaaauuuguuucauauauacugucuuauuucuagauuuguuuaaaauug

SEQ ID NO: 647130 - RNA, 59 nt, hsa
aguccagugaugggaaaaugaguauguuucugucuuagauuggggaacccaaagcagau

SEQ ID NO: 647131 - RNA, 59 nt, hsa
ucuggcuuggugcuugaccugguuaaauacugucuuaaagcucauacaaaacaaauagg

SEQ ID NO: 647132 - RNA, 59 nt, hsa
uuggguuuucgaaauauuuucaaaguguucugucuuaaucacaaauucauauuuuuaca

SEQ ID NO: 647133 - RNA, 59 nt, hsa
acucucaauucccugaaaaacuaguaauacugucuuaucugcuauaaacuuuacauauu

SEQ ID NO: 647134 - RNA, 59 nt, hsa
gaacaccuggcauucugugguguuucgugcugucuuaaauaauggugcauuuauuaugu

SEQ ID NO: 647135 - RNA, 59 nt, hsa
aauaauaauaacucuuguuucuuuccucccugucuuagacuuugaauguugacccucac

SEQ ID NO: 647136 - RNA, 59 nt, hsa
uugcaauauccccuaagaugcuuuuugagcugucuuacuuugauaucuguuguguaaug

SEQ ID NO: 647137 - RNA, 59 nt, hsa
cccugguaaaccugggguagguggggguucugucuuaacucgaggggcaccugggaucc

SEQ ID NO: 647138 - RNA, 59 nt, hsa
gauaucaacaaaauacucccucucuguuccugucuuagccagaggcgucgcuccugucu

SEQ ID NO: 647139 - RNA, 59 nt, hsa
gacuaccuauuugaaaggaacccuaucaacugucuuauguacguuacaugauuuuccua

SEQ ID NO: 647140 - RNA, 59 nt, hsa
guuauuuuuuguuugugaccacuaagcuucugucuuaauacaaagcuguuaccuucuac

SEQ ID NO: 647141 - RNA, 59 nt, hsa
uccaagcuuuuacauuaacgagcaggccucugucuuaaaagggacucaguauauuaauu

SEQ ID NO: 647142 - RNA, 59 nt, hsa
ugcacucuauccuggguaacagcgagacucugucuuaaaaauaauaacaauaauaauaa

SEQ ID NO: 647143 - RNA, 59 nt, hsa
auaugucagauguauuccuacuuccaaaccugucuuacuuugguuugaugguacacaua

SEQ ID NO: 647144 - RNA, 59 nt, hsa
aaauaccuuuuaagcuaguugaucuuugacugucuuauuuauuauaaccuuucagcaca

SEQ ID NO: 647145 - RNA, 59 nt, hsa
uaguccuccaacaaccaaagguugggacucugucuuacauaucugggugccccucauag

SEQ ID NO: 647146 - RNA, 59 nt, hsa
augagacuuaauuuugucuuucaaauuuacugucuuaaaucaguuuauuaaaucugaau

SEQ ID NO: 647147 - RNA, 59 nt, hsa
gagucugagaaaaccuuugguagaagcuccugucuuaucaggccccaaaaaaccuguuc

SEQ ID NO: 647148 - RNA, 59 nt, hsa
ugcaccuguguuucaguuacucucucucucugucuuagaucuuuuuguuucugccuagu

SEQ ID NO: 647149 - RNA, 59 nt, hsa
uacaagguuaucaggaacuuuguuuccuucugucuuauucagccauucccaguauguuu

SEQ ID NO: 647150 - RNA, 59 nt, hsa
aagcaucuucaaagacguuuucccauaugcugucuuaauucuuuucacucauucacccu

SEQ ID NO: 647151 - RNA, 57 nt, hsa
ccucugucuauucugcuugacagccuucugucuuaaagguuuuauaaugcugacuga

SEQ ID NO: 647152 - RNA, 59 nt, hsa
aaaaaaaaaaagaaaaaagaaaguacugucugucuuaaauuuugcugcaaauaaaaaug

SEQ ID NO: 647153 - RNA, 59 nt, hsa
auuuaaaauauucugcaugaauccuguggcugucuuauuuuaaauagcugcugcugugg

SEQ ID NO: 647154 - RNA, 59 nt, hsa
ugugccaugugauugacuuacaagugaaacugucuuauaauaugaaggucuuuuuguuu

SEQ ID NO: 647155 - RNA, 59 nt, hsa
uuuguuuuuguuuuguuuaguuuuuaauccugucuuagaagaacuuaucuuuauucuca

SEQ ID NO: 647156 - RNA, 59 nt, hsa
cuggcagacaccauguaaguuauaagugucugucuuaucuuuacuacacauauuguaac

SEQ ID NO: 647157 - RNA, 59 nt, hsa
uacuuuuauuuuaaaauaaaagaugaggucugucuuauguugcccaggcuggucucaaa

SEQ ID NO: 647158 - RNA, 59 nt, hsa
ggccuuagaaaaccacaauguuuacagcccugucuuagggccgcggcuucucuuaucuu

SEQ ID NO: 647159 - RNA, 59 nt, hsa
aacuaaaauuucagauuucugaggauauacugucuuagacuuauuguacacacuuaguu

SEQ ID NO: 647160 - RNA, 59 nt, hsa
caagagcccccagaacgagacccuguacucugucuuaaaggccuaaccaauggacagcc

SEQ ID NO: 647161 - RNA, 59 nt, hsa
gccauagucuuaacuggucuccuugcuuccugucuuauccuccaccgucuuucuuuuau

SEQ ID NO: 647162 - RNA, 59 nt, hsa
uucucaaguucuuucuuugagaccucaaucugucuuagcauuuuguaacuaauaacuga

SEQ ID NO: 647163 - RNA, 59 nt, hsa
aagcaaugguugaaauuuguagguacuaucugucuuauuuuguguguguuuagaggugu

SEQ ID NO: 647164 - RNA, 59 nt, hsa
agaaaaagcauuggcaugagccaaagagucugucuuaauguuacuuuugaaaaucugcu

SEQ ID NO: 647165 - RNA, 59 nt, hsa
ugcuuucugcuuugaucaaacccagcaagcugucuuaaguaucaggaccuucuuuggga

SEQ ID NO: 647166 - RNA, 59 nt, hsa
agaucuugguuuuuccaaacuggaccauccugucuuauggugaaaaaguaaagaagaaa

SEQ ID NO: 647167 - RNA, 59 nt, hsa
uauauuuaaauacuggggaaauugcuucacugucuuagaaccaagcaagauucaccugu

SEQ ID NO: 647168 - RNA, 59 nt, hsa
uucaguuuucucaaaacaaaacaauuauccugucuuaucugaagaugcaggguuguggg

SEQ ID NO: 647169 - RNA, 59 nt, hsa
agucuauuuucuacuugccagcagaguaucugucuuauuuuaggaugcagugugaaacu

SEQ ID NO: 647170 - RNA, 59 nt, hsa
uuccaguaacuacugauucccccacuuuucugucuuagaaaauugugggaauccccccu

SEQ ID NO: 647171 - RNA, 59 nt, hsa
gcaauaggaucuuauuuaguuauuugaaucugucuuagccaguuccuguagaacugaga

SEQ ID NO: 647172 - RNA, 59 nt, hsa
aaauacuuuguuguauuuggcuaauuuugcugucuuaaugcagccuauuaagaguuggg

SEQ ID NO: 647173 - RNA, 59 nt, hsa
ggucauguuuuuugaucuucucugacaaucugucuuaaaauuggugcauauguaccaua

SEQ ID NO: 647174 - RNA, 59 nt, hsa
acuguucuuauuauaaauugcaaagcaaccugucuuacauucuuacauuaucuuaaaau

SEQ ID NO: 647175 - RNA, 59 nt, hsa
uuuggacaucuuuuuccuagaccauguuucugucuuacucuuaaaccugguaacacuug

SEQ ID NO: 647176 - RNA, 59 nt, hsa
ggguggccggcuugcugcuccgguuugggcugucuuaccauaacaccgucccagggcuc

SEQ ID NO: 647177 - RNA, 59 nt, hsa
aauccaugcaaguguuuuaaagcacuguccugucuuaaucuuacaugcugaaagucuuc

SEQ ID NO: 647178 - RNA, 59 nt, hsa
ugguacagaguaccauauugcuaagaaaacugucuuauaaaagauguauaugugugaag

SEQ ID NO: 647179 - RNA, 59 nt, hsa
accugaauucuacugagucccuggcaagacugucuuaccuggcagcaaacugcugccug

SEQ ID NO: 647180 - RNA, 59 nt, hsa
ucugggcuuuugaauaaauaaaaugcucucugucuuagcaggagaauggcccaaaccug

SEQ ID NO: 647181 - RNA, 59 nt, hsa
aaaagagccugggcaauuuuuuuaagacucugucuuaaaaaaaacuaaaaagaaaaaaa

SEQ ID NO: 647182 - RNA, 59 nt, hsa
cuccaagacuaaacaaacagacagguccucugucuuaaaaagguuacuucuugguucuc

SEQ ID NO: 647183 - RNA, 59 nt, hsa
cagcuaaauuacaacuuuuacauauggcucugucuuauuguuucuucauacugugucug

SEQ ID NO: 647184 - RNA, 59 nt, hsa
uucugggacuauacucacaccaaggucugcugucuuauagccaagaauuacagcuuuau

SEQ ID NO: 647185 - RNA, 59 nt, hsa
ucaugcaaguuuagacaaguggauuuauacugucuuaugagugcccgccccugauauau

SEQ ID NO: 647186 - RNA, 59 nt, hsa
uuucaaugaacauauucugaaugugguuucugucuuagaccaggaggacagaguuugcu

SEQ ID NO: 647187 - RNA, 59 nt, hsa
uccauaaacaagugcaauuuuuuaaagugcugucuuacuaagucuuguuuauuaacucu

SEQ ID NO: 647188 - RNA, 59 nt, hsa
cggucugacaguccuugggguuaagucuccugucuuaugguccagaaacuccuguuucu

SEQ ID NO: 647189 - RNA, 59 nt, hsa
aaaaagaacaguaccccucuuuuaagaugcugucuuacauuaaugagcaucuaauggaa

SEQ ID NO: 647190 - RNA, 59 nt, hsa
cgguaccacgggcugccacagccccugcucugucuuagauuauggugcuuuacaaagag

SEQ ID NO: 647191 - RNA, 59 nt, hsa
cagaccuuggugauaaccugugcuucaaacugucuuaaacaauguuugucaccuuuccc

SEQ ID NO: 647192 - RNA, 59 nt, hsa
auauuuuguacuuuuuaguuguucagcaacugucuuauuuaauggggagauuuuaagua

SEQ ID NO: 647193 - RNA, 59 nt, hsa
cuuauguguaaccaguggugauuuggugccugucuuaaaggaaggccuuugaggacaca

SEQ ID NO: 647194 - RNA, 59 nt, hsa
uguucuccagaguuuuacauuacacuugucugucuuauaauugauauuuuaggauguuu

SEQ ID NO: 647195 - RNA, 59 nt, hsa
gucccagcccaggaacagugcugucuuugcugucuuaggccauucuuguuauuaagcug

SEQ ID NO: 647196 - RNA, 59 nt, hsa; identical to SEQ ID NO: 647147

SEQ ID NO: 647197 - RNA, 59 nt, hsa
cuucuagguuaacucacgaaguacauucucugucuuacugauacuguagguucacccau

SEQ ID NO: 647198 - RNA, 59 nt, hsa
gguggcauuuuucuuaacgagauuugcuucugucuuagccucacacagggaaaauaucc

SEQ ID NO: 647199 - RNA, 59 nt, hsa
ccugucucucuuaagaguagguucauugucugucuuagagucacuucuauugcaacuca

SEQ ID NO: 647200 - RNA, 59 nt, hsa
cuaaaaagcaaagcaaaacagaacuaguucugucuuaaugaaauauaucaacccaaaag

SEQ ID NO: 647201 - RNA, 59 nt, hsa
aaaaaaggccuugcaggaaacacccacuucugucuuacugcaucaccagauagggcuuu

SEQ ID NO: 647202 - RNA, 59 nt, hsa
acauaguggucagaaauggaacagagaagcugucuuaagccuuguucaagaagcaggaa

SEQ ID NO: 647203 - RNA, 59 nt, hsa
guguuuccagugacacaacucauccagaacugucuuagucauaccauccaucccuggug

SEQ ID NO: 647204 - RNA, 59 nt, hsa
guauacgcauacauauauauauuuuuacucugucuuacucugucacccaggcuagagug

SEQ ID NO: 647205 - RNA, 59 nt, hsa
guuagaguuacuguggauuucucuguuuucugucuuacaagaaacuugucuauguaccu

SEQ ID NO: 647206 - RNA, 59 nt, hsa
auacugugggacuauuaugguuaacagaacugucuuaauauguuuuaaaaugugcccau

SEQ ID NO: 647207 - RNA, 59 nt, hsa
auuugauaaaucuuauacuuuuucaguugcugucuuauucucuuuauuucucauugugc

SEQ ID NO: 647208 - RNA, 59 nt, hsa
ugaggccuggcucagagccuguuugcccucugucuuaaacaauuguaaauaucacuuaa

SEQ ID NO: 647209 - RNA, 59 nt, hsa
uguguuuucugugcugugauguccuuguacugucuuaaguuaguguugcuuguuuuugu

SEQ ID NO: 647210 - RNA, 59 nt, hsa
uuuggucucuauugauauuucauagggcccugucuuauucaacuuuacuuuuaaaauca

SEQ ID NO: 647211 - RNA, 59 nt, hsa
gaaagggaugaacugccuuuugcuggaagcugucuuaggcugugagacaggagcagggg

SEQ ID NO: 647212 - RNA, 59 nt, hsa
gguggaagaugaaucaaggaagcagggcccugucuuaugggucacgugucuuuggugag

SEQ ID NO: 647213 - RNA, 59 nt, hsa
uaaagcuuucuccaggacagauauuuucccugucuuaaccacugguccagucaucccag

SEQ ID NO: 647214 - RNA, 59 nt, hsa
cccugacccacagcgucaccccacucccucugucuuaugacuccccuccccaacccccu

SEQ ID NO: 647215 - RNA, 59 nt, hsa
caguguccugaagcccaucuuuucugugacugucuuaggugauguguagcccccuccac

SEQ ID NO: 647216 - RNA, 59 nt, hsa
cacuccaaccugagugacagagcaacacucugucuuaaaagaaaaaaaaaaaagagaga

SEQ ID NO: 647217 - RNA, 59 nt, hsa
uaauuuaguaagaccuugggcugccucuucugucuuaacugguucugcagcuuguccuu

SEQ ID NO: 647218 - RNA, 59 nt, hsa
ccagcagcucaccauggcuuuaaaacaugcugucuuagaucaggagaaacucgggcacu

SEQ ID NO: 647219 - RNA, 59 nt, hsa
ugagaaauauugucguuaauaauuauguacugucuuaaugugggcacuucauuuguuag

SEQ ID NO: 647220 - RNA, 59 nt, hsa
uugcacauggauugauuaaaagcaaauaccugucuuagggaauucugacaauuuaucuu

SEQ ID NO: 647221 - RNA, 59 nt, hsa
ggugaguggucggguaucuaguuuuugcacugucuuacuauucaagguaagaggauaca

SEQ ID NO: 647222 - RNA, 59 nt, hsa
uucacguuuucccauuucccuguggcucacugucuuacaaucacugcuguggaaucaug

SEQ ID NO: 647223 - RNA, 59 nt, hsa
aagagcugauaacauaguuuauuuuuacacugucuuauuauagagaaguaauagaccua

SEQ ID NO: 647224 - RNA, 59 nt, hsa
agaggcagagcaccuuggggcuccuccuucugucuuaagagaaagccaaggcacguaga

SEQ ID NO: 647225 - RNA, 59 nt, hsa
auguucaguguauuuuauuacuuuuaaugcugucuuaaaaugaacauucuuuaaaguug

SEQ ID NO: 647226 - RNA, 59 nt, hsa
ggcuaucuuggcacacuaaaugcuaagcacugucuuaagagguagagcuggugugagug

SEQ ID NO: 647227 - RNA, 59 nt, hsa
ugauuucauuaucacaugauuauagaaggcugucuuagugcaaaaaacauacuuacauu

SEQ ID NO: 647228 - RNA, 59 nt, hsa
cuguacuuuuacacuccuuugucuuggaacugucuuauuuuuguucuguaaaugucuau

SEQ ID NO: 647229 - RNA, 59 nt, hsa
cuccucucugcgccuaucccuugagaauucugucuuaccagugaaggguggggcugccc

SEQ ID NO: 647230 - RNA, 59 nt, hsa
uggguacaggauauccuccuaccccaugacugucuuagggagacuugggguaccuuaug

SEQ ID NO: 647231 - RNA, 59 nt, hsa
gccugucucucugcgguaaccccauggagcugucuuauugaugcuagaagccucauaac

SEQ ID NO: 647232 - RNA, 59 nt, hsa
auaucaaaagcugcugcuaugucucucuucugucuuauucucaaguaucuacugaugua

SEQ ID NO: 647233 - RNA, 59 nt, hsa
uuggauuuguuuuucuguucucuucuguccugucuuauacugcaacugugucuccuagg

SEQ ID NO: 647234 - RNA, 59 nt, hsa
ccaacuccuaauuuuaaauaauuucuacucugucuuaaaugagaaguacuugguuuuuu

SEQ ID NO: 647235 - RNA, 59 nt, hsa
aauauaaagaucauagcuccccuucacuucugucuuaacuugaacauggcguguuuaaa

SEQ ID NO: 647236 - RNA, 59 nt, hsa
uaauuuguuuugaagguuuuuuuuccugacugucuuaaagauuaugcuagcuuuagaac

SEQ ID NO: 647237 - RNA, 59 nt, hsa
gaguccagccugggugacauagcaagacccugucuuaaaagaaaaaugggaagaaagac

SEQ ID NO: 647238 - RNA, 59 nt, hsa
ucucuaguucuuggcuccuaacucuggaucugucuuaaggugucuccacuagcaaucug

SEQ ID NO: 647239 - RNA, 59 nt, hsa
auggggacaucacugaccugggccugacgcugucuuacgacgaggacgucaugggucag

SEQ ID NO: 647240 - RNA, 59 nt, hsa
auguugaaguuagcaaugccgaaagguuucugucuuaaaaaaaaaaauccuuguacuua

SEQ ID NO: 647241 - RNA, 59 nt, hsa
cagauccacaggaaaacuugaaugcacaacugucuuauuuuaaucuuauuguacauaag

SEQ ID NO: 647242 - RNA, 59 nt, hsa
aucucaguacacaaucauuuaauauuucccugucuuaccccuauucaagcaacuagagg

SEQ ID NO: 647243 - RNA, 59 nt, hsa
caaacuggcuuaauaauauuaauaagaaccugucuuauuaagacuggcuuuagaaccgu

SEQ ID NO: 647244 - RNA, 59 nt, hsa
acaaugcuuaugcuugguacaagcuuaugcugucuuaaauuauuuuaaaaaaauaaaua

SEQ ID NO: 647245 - RNA, 59 nt, hsa
uauuuauuguuuguccauuuagguaacaucugucuuaccuuccucacagacuuuguaca

SEQ ID NO: 647246 - RNA, 59 nt, hsa
gaagaguuuaaaggaggaagaagaaagaacugucuuacaccacuugagcucagaccucu

SEQ ID NO: 647247 - RNA, 59 nt, hsa
ucccaccauuuaucuucucugcccaagcccugucuuaaggcccagggggagguuaggag

SEQ ID NO: 647248 - RNA, 59 nt, hsa
uagauuuggcccccaacuccauuuccugucugucuuagacagcccuuccaacuguguca

SEQ ID NO: 647249 - RNA, 59 nt, hsa
uacuccagccugggugaagaagugagacucugucuuaaaaaaaaaaauuggugcugaua

SEQ ID NO: 647250 - RNA, 59 nt, hsa
cuauagucaaacagcucuuuugaagacaacugucuuauuuuauuacaaauuggcuugac

SEQ ID NO: 647251 - RNA, 59 nt, hsa
uuaugucaaguucuacaucaauaucaucccugucuuauuagggauuaccguuuccuaag

SEQ ID NO: 647252 - RNA, 59 nt, hsa
agccucaaaacaaaggccuaauucuaugccugucuuaauuuucuuucacuuaaguuagu

SEQ ID NO: 647253 - RNA, 59 nt, hsa
aaggcuuauuuaagccacacguacacacacugucuuagaguacugugagcccaccccac

SEQ ID NO: 647254 - RNA, 59 nt, hsa
gcccucaaacagaacagcuccccuuguagcugucuuacauauugggguucaggguaaga

SEQ ID NO: 647255 - RNA, 59 nt, hsa
aaaucugccuaguaccccgcuacccuguucugucuuauggagcagcccagauuaucuuu

SEQ ID NO: 647256 - RNA, 59 nt, hsa
gucauuuuugcuugaaaauuagcaugccucugucuuaaaagagaccaucaaaccuauua

SEQ ID NO: 647257 - RNA, 59 nt, hsa
gugauauuuugaaaaaaguuuguguuuuacugucuuagaucguucuuggaaaucacuaa

SEQ ID NO: 647258 - RNA, 59 nt, hsa
uuaggaagccacgugccaauaccuggcugcugucuuaacucguagucugggcacaggau

SEQ ID NO: 647259 - RNA, 59 nt, hsa
caaggaaaccuucauggaucuucccuugccugucuuagucacagagagaaauaagagga

SEQ ID NO: 647260 - RNA, 59 nt, hsa
ggguuguucucaauugugcugcugauuaccugucuuauguaacuacuugagaccaucug

SEQ ID NO: 647261 - RNA, 59 nt, hsa
ucugcgggggaggaaaagcucaagguuagcugucuuaacccaagugacuuaccaggccu

SEQ ID NO: 647262 - RNA, 59 nt, hsa
ucauaauaaauauguaagacuaggcuuuacugucuuaugcuuauggacauuguauauuu

SEQ ID NO: 647263 - RNA, 59 nt, hsa
agaguaauucuucacuuugcucuauugaacugucuuaaggauuuguuuaaacagcuaag

SEQ ID NO: 647264 - RNA, 59 nt, hsa
aaagagacuuuucccucucuugauaggaucugucuuagggacagagggaccaucgucuu

SEQ ID NO: 647265 - RNA, 59 nt, hsa
ugaugauacaugaucucugaaagacuagacugucuuauauuaugagauacuugaaugcu

SEQ ID NO: 647266 - RNA, 59 nt, hsa
ucauugggaagggagugcgcuucuuuucucugucuuagaaaagggagucaaggguuggc

SEQ ID NO: 647267 - RNA, 59 nt, hsa
uucucagugguugucucaugucucuuuuucugucuuaggugguuucauuaaaugcagca

SEQ ID NO: 647268 - RNA, 59 nt, hsa
auuuuuucuaaaguuaaauuuagugcacucugucuuaaaaauacguuuacaguauuggg

SEQ ID NO: 647269 - RNA, 59 nt, hsa
ugggucgaguggggccuuggagaacuuuucugucuuacaagaggauuguaaaaugcacc

SEQ ID NO: 647270 - RNA, 59 nt, hsa
caucuuaugcaaagccaggaacucacucacugucuuaagugagccagggcaaaauuuac

SEQ ID NO: 647271 - RNA, 59 nt, hsa
gcaugcuauuuuaaucucacauucuuuaucugucuuaaaguggaaauccauuugccuau

SEQ ID NO: 647272 - RNA, 59 nt, hsa
gucauugagcaauauuuuuuaauguguaccugucuuauggaagaaauaugcagguauau

SEQ ID NO: 647273 - RNA, 59 nt, hsa
ugaaggagcaaagggugcacugccagcgccugucuuacccgguggccuuggcccagaag

SEQ ID NO: 647274 - RNA, 59 nt, hsa
ucaugccuaguuauucauuguuaauauaacugucuuaguacaccauaaacuggguggau

SEQ ID NO: 647275 - RNA, 59 nt, hsa
uugugcugaauuucugggccauucuuuuccugucuuauuucuaaauuuccuucuuccaa

SEQ ID NO: 647276 - RNA, 59 nt, hsa
agggaaucuccagaugaacuauuaaugcacugucuuaugccucucauuggugauguuug

SEQ ID NO: 647277 - RNA, 59 nt, hsa
gaagaaaacccaaaauucaaucaacaauucugucuuauugaagaguugcuaggauucag

SEQ ID NO: 647278 - RNA, 59 nt, hsa
cugccccaauucaauccugccaauaaauccugucuuauuuguucauccuggagaauuga

SEQ ID NO: 647279 - RNA, 59 nt, hsa
uguuuuucaaaggccucaccuucaacugucugucuuagaauuccccucuggagggcuau

SEQ ID NO: 647280 - RNA, 59 nt, hsa
ggcccagagcccugucucacucaccccaccugucuuagaccccaguucccagccugaca

SEQ ID NO: 647281 - RNA, 59 nt, hsa
gguuaauauuuauaggucacuuuguuuuacugucuuaaguuuauacucuuauagacaac

SEQ ID NO: 647282 - RNA, 59 nt, hsa
ucugucauuuagcaccaugcugcuucugucugucuuaaugcuggcauuaagaucaugag

SEQ ID NO: 647283 - RNA, 59 nt, hsa
agcaauccugcagcacagggcagagaguacugucuuaggaauuauuaggaguugauucc

SEQ ID NO: 647284 - RNA, 59 nt, hsa
ccuaggccacgugugagcugcuccugucucugucuuauugcagcuccaggccugacguu

SEQ ID NO: 647285 - RNA, 59 nt, hsa
acuagugcaacaagggacacaaagaaauucugucuuaauaaagaaagcuacuucucaag

SEQ ID NO: 647286 - RNA, 59 nt, hsa
cuucagccugcacugauuuguagccugcacugucuuacugauuuacaaacugaaaucac

SEQ ID NO: 647287 - RNA, 59 nt, hsa
cugccccaacuacuguugggaucagccuccugucuuaugugggcacguuccaaaguuua

SEQ ID NO: 647288 - RNA, 59 nt, hsa
cacuccagcaagggaaauaaugcaguuuccugucuuauuuaagaaaaagagaaggcucu

SEQ ID NO: 647289 - RNA, 59 nt, hsa
uuucuaggcacugugguucuuggcaggggcugucuuagguaaaaggguaguuguggagc

SEQ ID NO: 647290 - RNA, 59 nt, hsa
gaaaaguaacaaagugauggcuuggaacacugucuuacacagcauuuuuaaaaaauaca

SEQ ID NO: 647291 - RNA, 59 nt, hsa
caaaaaaccuggugauguuaagcaauugacugucuuagaguccagcagaagaccuuaga

SEQ ID NO: 647292 - RNA, 59 nt, hsa
ugcuuguggaaguuucucagcguuucuggcugucuuagggcuggccucagaacccagca

SEQ ID NO: 647293 - RNA, 59 nt, hsa
ucuuuaaccuugugugucugugaucuccucugucuuaauccacgcucaggcuaaagaug

SEQ ID NO: 647294 - RNA, 59 nt, hsa
aacauucccuaauaggguauucagggaaccugucuuaaauugugcuuaucuaaaucuug

SEQ ID NO: 647295 - RNA, 59 nt, hsa
agaccggaaagauuugcauuuuauuaugucugucuuaucaugcaauggaaaugaugcuu

SEQ ID NO: 647296 - RNA, 59 nt, hsa
uccugaggauacagcugucccgugacugacugucuuaacugagcauuuucucaacucga

SEQ ID NO: 647297 - RNA, 59 nt, hsa
cccacacaugccuauuucugaagaggcuucugucuuauuugaaggccagcccacaccca

SEQ ID NO: 647298 - RNA, 59 nt, hsa
accaaggugaagauggccuaggaucuucacugucuuacucaagauacuggacuaagugg

SEQ ID NO: 647299 - RNA, 59 nt, hsa
uguuaguuucuuguugcuugaacugucuucugucuuauuucccuuccuuucuguguucc

SEQ ID NO: 647300 - RNA, 59 nt, hsa
ggcagaccccgccaaugauuucucuucaccugucuuaagauuaaauaaaaaagaguguc

SEQ ID NO: 647301 - RNA, 59 nt, hsa
aaacuuacacuacuucuccaagccuuuugcugucuuaagaauaagaccugagauuaaca

SEQ ID NO: 647302 - RNA, 59 nt, hsa
ccccgcuccagucaaugcucacugaaagucugucuuagcugccuguuugaaugacuguu

SEQ ID NO: 647303 - RNA, 59 nt, hsa
uucucaaguucuuucuuugagaucucaaucugucuuagcauuuuguaacuaauaacuga

SEQ ID NO: 647304 - RNA, 59 nt, hsa
aaaaaugaauuuuauuuuacuugucacaccugucuuaauaaacuggaguuuugcugcua

SEQ ID NO: 647305 - RNA, 59 nt, hsa
gggcauggaguaauggauucaaagagauucugucuuaccggugccagucaguacuccag

SEQ ID NO: 647306 - RNA, 59 nt, hsa
guuugcgucuguuuccucccucucuggcccugucuuaccccaucacccgacucuggcca

SEQ ID NO: 647307 - RNA, 59 nt, hsa
uuucuuuggggcagagaagagcauuagcccugucuuaucauuacauugccauccuguug

SEQ ID NO: 647308 - RNA, 59 nt, hsa
acacaguauuuauguacauaauauugucacugucuuagugucuuguucauguuguaggg

SEQ ID NO: 647309 - RNA, 59 nt, hsa
acaaugucuugguacuugcugcuauuuuacugucuuaauuaaguaaacuaaugaguuuc

SEQ ID NO: 647310 - RNA, 59 nt, hsa
ccucgaacuccuggucucaagcaguccuccugucuuagccucccaaagugcugggauua

SEQ ID NO: 647311 - RNA, 59 nt, hsa
aacccugugaugaucacccaagccccaggcugucuuagccccuggaguucagaaguccu

SEQ ID NO: 647312 - RNA, 59 nt, hsa
uuaucacugucuguagcacacuugugcaccugucuuacauucucuguugcuccccccca

SEQ ID NO: 647313 - RNA, 59 nt, hsa
uccuggaccuagcaggcccucaguccuagcugucuuaccugcgcucagcuuggagucag

SEQ ID NO: 647314 - RNA, 59 nt, hsa
guuucuaaauuuucuccuucugauuuugccugucuuauauaaugagcauaggaaaauuu

SEQ ID NO: 647315 - RNA, 59 nt, hsa
uagaguuaacaaaacagagucagagaccacugucuuaacaguggaagaugcaaauaagu

SEQ ID NO: 647316 - RNA, 59 nt, hsa
aacacaaaaguagaaagugcuugguauuucugucuuauacauaggaaaacauuuaaaau

SEQ ID NO: 647317 - RNA, 59 nt, hsa
ggcaucaguagcaucuguaacagcauuaacugucuuaaagagagagagagagaauuccg

SEQ ID NO: 647318 - RNA, 59 nt, hsa
acuccagccugggcaacaagagugaaacucugucuuaaaaaacacaaaaaaagacuugg

SEQ ID NO: 647319 - RNA, 59 nt, hsa
ccuuccgcagagaccugcgcccacaggugcugucuuaguggacugggacgugaaccuuu

SEQ ID NO: 647320 - RNA, 59 nt, hsa
agcgggguguuucauuuuuuugcuuuucccugucuuaggcucccagucuuugacugccu

SEQ ID NO: 647321 - RNA, 59 nt, hsa
gugauuuuugcagcuaaaugugaaggcaacugucuuaagucccuuccugcugcuguaac

SEQ ID NO: 647322 - RNA, 59 nt, hsa
ucucccacauuacccaagagggaaaugggcugucuuaccaugugcugauguaugugcuc

SEQ ID NO: 647323 - RNA, 59 nt, hsa
ugcccauagcuagcauucaacagagaacucugucuuaagcuucaacugugaaaaugaug

SEQ ID NO: 647324 - RNA, 59 nt, hsa
aggaagcccuaaaauguggacuggguuuccugucuuagcacugcccugcuagcucuucc

SEQ ID NO: 647325 - RNA, 59 nt, hsa
uucagcauggagaccuucuucuaccgccccugucuuaauaaagcugcguguuucacuuc

SEQ ID NO: 647326 - RNA, 59 nt, hsa
uggguugaauggggaccuggagaacuuuucugucuuacaagaggauuguaaaauggacc

SEQ ID NO: 647327 - RNA, 59 nt, hsa
ugucucaagcucuuccuuacucccaggcacugucuuaaggcaucugacaugcaucaucu

SEQ ID NO: 647328 - RNA, 59 nt, hsa
ugauuggagcaaaccacuucuuuagucaucugucuuaccccccugggacagcuguuacc

SEQ ID NO: 647329 - RNA, 59 nt, hsa
ccaaagaggcaaagcaugugcgacccuuucugucuuauuuuaccaaaagauggugcaaa

SEQ ID NO: 647330 - RNA, 59 nt, hsa
gcugggcguguaggacggugagagcacuucugucuuaaagguuuuuucugauugaagcu

SEQ ID NO: 647331 - RNA, 59 nt, hsa
ugcucucuccccaucuccuaccccacauccugucuuagccgcagucuccagaacccaug

SEQ ID NO: 647332 - RNA, 59 nt, hsa
cacuccagccugggugacagagcgagacccugucuuaaaaaaaaaaacaaaacaaaacc

SEQ ID NO: 647333 - RNA, 59 nt, hsa
ugcuugagauagaaaaugguggcuccuuucugucuuaucuccuaguuucuucaaugcuu

SEQ ID NO: 647334 - RNA, 59 nt, hsa
aaaagaaugaaaugaagcugggcuguuuucugucuuauuucucaguugagugagcaagg

SEQ ID NO: 647335 - RNA, 59 nt, hsa
auauuguuccuuggugucagcguagcugucugucuuaggagcugggucggcguuccgac

SEQ ID NO: 647336 - RNA, 59 nt, hsa
aaaguagugaugaaaaguacauguugauacugucuuagaagaaauuaauauauuaguga

SEQ ID NO: 647337 - RNA, 59 nt, hsa
ucuucauacaugacggugggcagagaggccugucuuaaaguuuccauggaauuguuuua

SEQ ID NO: 647338 - RNA, 59 nt, hsa
uaaguuuauuuuguaaaaacaugcauaaacugucuuagcaggaaaguacauuccuguua

SEQ ID NO: 647339 - RNA, 59 nt, hsa
ccagacccaucacugaccauuugccuuaccugucuuagucugaaauguaauaggaaaga

SEQ ID NO: 647340 - RNA, 59 nt, hsa
gcacuccagccuggugacagaacgagacucugucuuaaaaacaaacaaacaaaaaaaaa

SEQ ID NO: 647341 - RNA, 59 nt, hsa
ccucuguuugcacuggacauauucccuaccugucuuauuucauagguacaugaaguauu

SEQ ID NO: 647342 - RNA, 59 nt, hsa
gaaagcgaucagcaucaagggcuuugcuucugucuuagaauugagcuagcuugagucaa

SEQ ID NO: 647343 - RNA, 59 nt, hsa
gaauccuucccuggugauggucucucacccugucuuaccagcauccacucucccuuguc

SEQ ID NO: 647344 - RNA, 59 nt, hsa
cacuccagcuugggugacaaaguaagacccugucuuaaaaaaaaaaaaaaggaauuugg

SEQ ID NO: 647345 - RNA, 59 nt, hsa
ugguggugguuauuuggucuuuaagugaacugucuuaaaugagaaacguuuuugucauu

SEQ ID NO: 647346 - RNA, 59 nt, hsa
uacauagcaaacaagaccaagauuuagggcugucuuaaacaucacugccgucuugaagc

SEQ ID NO: 647347 - RNA, 59 nt, hsa
acucugugcaggggugggggcgggucuaacugucuuaacauucaagucacugcucuuca

SEQ ID NO: 647348 - RNA, 59 nt, hsa
guguaugcaucaacacaguauauguaaaacugucuuaaaaauccauuaacuucuaccua

SEQ ID NO: 647349 - RNA, 59 nt, hsa
uaaucaacauggaguggagaguuuauucacugucuuaucugcagaaauuugcugucaau

SEQ ID NO: 647350 - RNA, 59 nt, hsa
agauugaacuggaauauuguguaaacuaucugucuuacauuaguguagcauuuugcaau

SEQ ID NO: 647351 - RNA, 59 nt, hsa
aucuuccaggacaggugguauuagcuccacugucuuaacauaguacguggcacguuaug

SEQ ID NO: 647352 - RNA, 59 nt, hsa
auuuagaaaagaucuaauuucugucucagcugucuuaaagagagaacugaagcuuuuga

SEQ ID NO: 647353 - RNA, 59 nt, hsa
ccaaaagaaugugaccuauuugaaacuuucugucuuaagaugcuucuugacaugcugca

SEQ ID NO: 647354 - RNA, 59 nt, hsa
ucagcugguagggaaagacucugcaccugcugucuuagggaagaaaugguucaaaucca

SEQ ID NO: 647355 - RNA, 59 nt, hsa
gacgaugagacuagaaggagaaauacuuucugucuuauuaaaauuaauaaauuauuggu

SEQ ID NO: 647356 - RNA, 59 nt, hsa
guguaugggcuuguaccaauuuacugacacugucuuaaauccuaaaucuguuuuuauga

SEQ ID NO: 647357 - RNA, 59 nt, hsa
ggugucagguacggagaggauucucaugacugucuuaccucuacugaauauucuaguga

SEQ ID NO: 647358 - RNA, 59 nt, hsa
uugugaccaacauucaggccacgugagcacugucuuaucacaucgccaauuaguuguaa

SEQ ID NO: 647359 - RNA, 59 nt, hsa
augccuaaagcugugccuagaaauuucaucugucuuaaaaguaaaauauacuucaugcu

SEQ ID NO: 647360 - RNA, 59 nt, hsa
ugagauauauucauccucauguaccacaucugucuuaguguuugcgucugggguguguu

SEQ ID NO: 647361 - RNA, 59 nt, hsa
cuaccucagaaagauuugaugggccacaacugucuuagacugcuagcuuucuccuuacc

SEQ ID NO: 647362 - RNA, 64 nt, hsa; identical to SEQ ID NO: 206424

SEQ ID NO: 647363 - RNA, 64 nt, hsa; identical to SEQ ID NO: 206425

SEQ ID NO: 647364 - RNA, 64 nt, hsa; identical to SEQ ID NO: 206426

SEQ ID NO: 647365 - RNA, 64 nt, hsa; identical to SEQ ID NO: 206427

SEQ ID NO: 647366 - RNA, 64 nt, hsa; identical to SEQ ID NO: 206428

SEQ ID NO: 647367 - RNA, 64 nt, hsa; identical to SEQ ID NO: 206429

SEQ ID NO: 647368 - RNA, 64 nt, hsa
uguguguguguguguguguguguguguuggggggaucuccuaaauuauuucugugcaucuccuu

SEQ ID NO: 647369 - RNA, 64 nt, hsa
cuuagggaggcaccagauuggagacagaugugcuaucuccuaacagagugaugaggcuucaguu

SEQ ID NO: 647370 - RNA, 64 nt, hsa
caacagucuuuaugaugggauuaagguggacaagaucuccuaagaucugugaaugggauuaagg

SEQ ID NO: 647371 - RNA, 64 nt, hsa
ccuaagaucugugaaugggauuaagguggacaagaucuccuaagaucugaaaagaaaccuuaau

SEQ ID NO: 647372 - RNA, 64 nt, hsa
ugugguggcacgaucacagcucacugcagccuccaucuccuaggcucaagccauuuucccaccu

SEQ ID NO: 647373 - RNA, 64 nt, hsa
acaagacagacgucugucccgcugcucucuccccaucuccuaccccacauccugucuuagccgc

SEQ ID NO: 647374 - RNA, 64 nt, hsa; identical to SEQ ID NO: 228300

SEQ ID NO: 647375 - RNA, 64 nt, hsa; identical to SEQ ID NO: 228301

SEQ ID NO: 647376 - RNA, 64 nt, hsa; identical to SEQ ID NO: 228302

SEQ ID NO: 647377 - RNA, 64 nt, hsa; identical to SEQ ID NO: 228303

SEQ ID NO: 647378 - RNA, 64 nt, hsa; identical to SEQ ID NO: 228304

SEQ ID NO: 647379 - RNA, 64 nt, hsa; identical to SEQ ID NO: 228305

SEQ ID NO: 647380 - RNA, 64 nt, hsa; identical to SEQ ID NO: 228306

SEQ ID NO: 647381 - RNA, 64 nt, hsa; identical to SEQ ID NO: 228307

SEQ ID NO: 647382 - RNA, 64 nt, hsa; identical to SEQ ID NO: 228308

SEQ ID NO: 647383 - RNA, 64 nt, hsa; identical to SEQ ID NO: 228309

SEQ ID NO: 647384 - RNA, 64 nt, hsa; identical to SEQ ID NO: 228310

SEQ ID NO: 647385 - RNA, 64 nt, hsa; identical to SEQ ID NO: 228311

SEQ ID NO: 647386 - RNA, 64 nt, hsa; identical to SEQ ID NO: 228312

SEQ ID NO: 647387 - RNA, 64 nt, hsa; identical to SEQ ID NO: 228313

SEQ ID NO: 647388 - RNA, 64 nt, hsa; identical to SEQ ID NO: 491006

SEQ ID NO: 647389 - RNA, 64 nt, hsa; identical to SEQ ID NO: 491007

SEQ ID NO: 647390 - RNA, 64 nt, hsa; identical to SEQ ID NO: 491008

SEQ ID NO: 647391 - RNA, 64 nt, hsa; identical to SEQ ID NO: 491009

SEQ ID NO: 647392 - RNA, 64 nt, hsa; identical to SEQ ID NO: 491010

SEQ ID NO: 647393 - RNA, 64 nt, hsa; identical to SEQ ID NO: 491011

SEQ ID NO: 647394 - RNA, 64 nt, hsa; identical to SEQ ID NO: 491012

SEQ ID NO: 647395 - RNA, 64 nt, hsa; identical to SEQ ID NO: 491013

SEQ ID NO: 647396 - RNA, 64 nt, hsa; identical to SEQ ID NO: 491014

SEQ ID NO: 647397 - RNA, 64 nt, hsa; identical to SEQ ID NO: 491015

SEQ ID NO: 647398 - RNA, 64 nt, hsa; identical to SEQ ID NO: 491016

SEQ ID NO: 647399 - RNA, 64 nt, hsa; identical to SEQ ID NO: 491017

SEQ ID NO: 647400 - RNA, 64 nt, hsa; identical to SEQ ID NO: 491018

SEQ ID NO: 647401 - RNA, 64 nt, hsa; identical to SEQ ID NO: 491019

SEQ ID NO: 647402 - RNA, 64 nt, hsa; identical to SEQ ID NO: 491020

SEQ ID NO: 647403 - RNA, 64 nt, hsa; identical to SEQ ID NO: 491021

SEQ ID NO: 647404 - RNA, 64 nt, hsa; identical to SEQ ID NO: 491022

SEQ ID NO: 647405 - RNA, 64 nt, hsa; identical to SEQ ID NO: 491023

SEQ ID NO: 647406 - RNA, 64 nt, hsa; identical to SEQ ID NO: 491024

SEQ ID NO: 647407 - RNA, 64 nt, hsa; identical to SEQ ID NO: 491025

SEQ ID NO: 647408 - RNA, 64 nt, hsa; identical to SEQ ID NO: 491026

SEQ ID NO: 647409 - RNA, 64 nt, hsa; identical to SEQ ID NO: 491027

SEQ ID NO: 647410 - RNA, 64 nt, hsa; identical to SEQ ID NO: 491028

SEQ ID NO: 647411 - RNA, 64 nt, hsa; identical to SEQ ID NO: 491029

SEQ ID NO: 647412 - RNA, 64 nt, hsa; identical to SEQ ID NO: 491030

SEQ ID NO: 647413 - RNA, 64 nt, hsa; identical to SEQ ID NO: 491031

SEQ ID NO: 647414 - RNA, 64 nt, hsa; identical to SEQ ID NO: 491032

SEQ ID NO: 647415 - RNA, 64 nt, hsa; identical to SEQ ID NO: 491033

SEQ ID NO: 647416 - RNA, 64 nt, hsa; identical to SEQ ID NO: 491034

SEQ ID NO: 647417 - RNA, 64 nt, hsa; identical to SEQ ID NO: 491035

SEQ ID NO: 647418 - RNA, 64 nt, hsa; identical to SEQ ID NO: 491036

SEQ ID NO: 647419 - RNA, 64 nt, hsa; identical to SEQ ID NO: 491037

SEQ ID NO: 647420 - RNA, 64 nt, hsa; identical to SEQ ID NO: 491038

SEQ ID NO: 647421 - RNA, 64 nt, hsa; identical to SEQ ID NO: 491039

SEQ ID NO: 647422 - RNA, 64 nt, hsa; identical to SEQ ID NO: 491040

SEQ ID NO: 647423 - RNA, 64 nt, hsa; identical to SEQ ID NO: 491041

SEQ ID NO: 647424 - RNA, 64 nt, hsa; identical to SEQ ID NO: 491042

SEQ ID NO: 647425 - RNA, 64 nt, hsa; identical to SEQ ID NO: 491043

SEQ ID NO: 647426 - RNA, 64 nt, hsa; identical to SEQ ID NO: 491044

SEQ ID NO: 647427 - RNA, 64 nt, hsa; identical to SEQ ID NO: 491045

SEQ ID NO: 647428 - RNA, 64 nt, hsa; identical to SEQ ID NO: 491046

SEQ ID NO: 647429 - RNA, 64 nt, hsa; identical to SEQ ID NO: 491047

SEQ ID NO: 647430 - RNA, 64 nt, hsa; identical to SEQ ID NO: 491048

SEQ ID NO: 647431 - RNA, 64 nt, hsa; identical to SEQ ID NO: 491049

SEQ ID NO: 647432 - RNA, 64 nt, hsa; identical to SEQ ID NO: 491050

SEQ ID NO: 647433 - RNA, 64 nt, hsa; identical to SEQ ID NO: 491051

SEQ ID NO: 647434 - RNA, 64 nt, hsa; identical to SEQ ID NO: 491052

SEQ ID NO: 647435 - RNA, 64 nt, hsa; identical to SEQ ID NO: 491053

SEQ ID NO: 647436 - RNA, 64 nt, hsa; identical to SEQ ID NO: 491054

SEQ ID NO: 647437 - RNA, 64 nt, hsa; identical to SEQ ID NO: 491055

SEQ ID NO: 647438 - RNA, 64 nt, hsa; identical to SEQ ID NO: 491056

SEQ ID NO: 647439 - RNA, 57 nt, hsa; identical to SEQ ID NO: 491057

SEQ ID NO: 647440 - RNA, 64 nt, hsa; identical to SEQ ID NO: 491058

SEQ ID NO: 647441 - RNA, 64 nt, hsa; identical to SEQ ID NO: 491059

SEQ ID NO: 647442 - RNA, 64 nt, hsa; identical to SEQ ID NO: 491060

SEQ ID NO: 647443 - RNA, 64 nt, hsa; identical to SEQ ID NO: 491061

SEQ ID NO: 647444 - RNA, 64 nt, hsa; identical to SEQ ID NO: 491062

SEQ ID NO: 647445 - RNA, 64 nt, hsa; identical to SEQ ID NO: 491063

SEQ ID NO: 647446 - RNA, 64 nt, hsa; identical to SEQ ID NO: 491064

SEQ ID NO: 647447 - RNA, 64 nt, hsa; identical to SEQ ID NO: 491065

SEQ ID NO: 647448 - RNA, 64 nt, hsa; identical to SEQ ID NO: 491066

SEQ ID NO: 647449 - RNA, 64 nt, hsa; identical to SEQ ID NO: 491067

SEQ ID NO: 647450 - RNA, 64 nt, hsa; identical to SEQ ID NO: 491068

SEQ ID NO: 647451 - RNA, 64 nt, hsa; identical to SEQ ID NO: 491069

SEQ ID NO: 647452 - RNA, 64 nt, hsa; identical to SEQ ID NO: 491070

SEQ ID NO: 647453 - RNA, 64 nt, hsa; identical to SEQ ID NO: 491071

SEQ ID NO: 647454 - RNA, 64 nt, hsa; identical to SEQ ID NO: 76456

SEQ ID NO: 647455 - RNA, 64 nt, hsa; identical to SEQ ID NO: 76457

SEQ ID NO: 647456 - RNA, 64 nt, hsa; identical to SEQ ID NO: 76458

SEQ ID NO: 647457 - RNA, 64 nt, hsa; identical to SEQ ID NO: 76459

SEQ ID NO: 647458 - RNA, 64 nt, hsa; identical to SEQ ID NO: 76460

SEQ ID NO: 647459 - RNA, 64 nt, hsa; identical to SEQ ID NO: 76461

SEQ ID NO: 647460 - RNA, 64 nt, hsa; identical to SEQ ID NO: 76462

SEQ ID NO: 647461 - RNA, 64 nt, hsa; identical to SEQ ID NO: 76463

SEQ ID NO: 647462 - RNA, 64 nt, hsa; identical to SEQ ID NO: 76464

SEQ ID NO: 647463 - RNA, 64 nt, hsa; identical to SEQ ID NO: 76465

SEQ ID NO: 647464 - RNA, 64 nt, hsa; identical to SEQ ID NO: 76466

SEQ ID NO: 647465 - RNA, 64 nt, hsa; identical to SEQ ID NO: 76467

SEQ ID NO: 647466 - RNA, 64 nt, hsa
uuuaugguagaccuguuaauggggaaaaaauacaucaaaucaaauagaaucuuauaucuguaug

SEQ ID NO: 647467 - RNA, 64 nt, hsa
cuuuaucaaaguagaagagagggucacuucggagucaaaucauacacuaggccuuugaugcuuu

SEQ ID NO: 647468 - RNA, 64 nt, hsa
auaugaaauuauguaaauuucaaaugcuuaugaaucaaaucauuguugaacaaaagauuuguug

SEQ ID NO: 647469 - RNA, 64 nt, hsa
uaucaaaagcaauagugcaccaauuaagaugugcucaaaucaggacuuaaaucauaggcaccac

SEQ ID NO: 647470 - RNA, 64 nt, hsa
ugguuaaauuuuaagguauucgaaugaaauaaagucaaaucaauaaauuucaggcuuuaaaaag

SEQ ID NO: 647471 - RNA, 64 nt, hsa
agaauauauuauauaaagaauuuuaugucauauaucaaaucaucucuuuaaccuaagauguaag

SEQ ID NO: 647472 - RNA, 64 nt, hsa
caaaucgauuuaguaaguauguuuuuuauguuccucaaaucagugauaauugguuugacuguac

SEQ ID NO: 647473 - RNA, 64 nt, hsa
agucuuugagacuaaauucaaucaccaccagguaucaaaucaacuuuuaugcagcaaauauaug

SEQ ID NO: 647474 - RNA, 64 nt, hsa
ccuugcaauucaaccgcaguuugaauuaaucauaucaaaucaguuuuaauuuuuuaaauuguac

SEQ ID NO: 647475 - RNA, 64 nt, hsa
gucuucacuguuuauaauacggauggauuuuuuuucaaaucaguguguguuuugaggucuuaug

SEQ ID NO: 647476 - RNA, 64 nt, hsa
agggauagagcccaugccucaaccuauccagaguucaaaucaaagaguccccagugugauucaa

SEQ ID NO: 647477 - RNA, 64 nt, hsa
auuccuaauucuuaaaugccauucagucuggacuucaaaucacuugucuucagaaaauaaaaga

SEQ ID NO: 647478 - RNA, 64 nt, hsa
uucaaaaacacaugaacugcagaugccauaggccucaaaucagcuguaauucuaggagacacgu

SEQ ID NO: 647479 - RNA, 64 nt, hsa
uuucuuucaguugucuuugggaggggauguuaagucaaaucacuaaaacaggguucucuuugga

SEQ ID NO: 647480 - RNA, 64 nt, hsa
aaaggccuuuacacauguuuuaucaauaugauuaucaaaucacagcauauacagaaaagacuug

SEQ ID NO: 647481 - RNA, 64 nt, hsa
ggcacucaagaaacguacaaccacagugcuuucuucaaaucauaugagaaauacuaugcauagc

SEQ ID NO: 647482 - RNA, 64 nt, hsa
cauaccgagccugagauugugugauuaucucaaaucaaaucacuuugauggagauaaauaauca

SEQ ID NO: 647483 - RNA, 64 nt, hsa
uuuuacauaccgagccugagauugugugauuaucucaaaucaaaucacuuugauggagauaaau

SEQ ID NO: 647484 - RNA, 64 nt, hsa
ugagaaauuuguuuuuauuaugccauuugacauuucaaaucagugcucauauacaguaaacuug

SEQ ID NO: 647485 - RNA, 64 nt, hsa
caguuuauuuaugaaaauagcguauuaucacuugucaaaucauugaaauucauuuggggucaaa

SEQ ID NO: 647486 - RNA, 64 nt, hsa
uguuuguuugaaauuggcaggaaaaaugcagcuuucaaaucauuggggggagaaaaaggauguc

SEQ ID NO: 647487 - RNA, 64 nt, hsa
aaguaugugcuacuuuuuugucccuguaucuaacucaaaucaggaacuguauuuuuuuuaauga

SEQ ID NO: 647488 - RNA, 64 nt, hsa
uugaacacugucauccguuucagcugacagcugcucaaaucauuuaagaaggaguucugacauu

SEQ ID NO: 647489 - RNA, 64 nt, hsa
guuaucagggauuuuuauuuguagucuaauuuugucaaaucauggccaaaucgcagugauaguu

SEQ ID NO: 647490 - RNA, 64 nt, hsa; identical to SEQ ID NO: 546418

SEQ ID NO: 647491 - RNA, 64 nt, hsa; identical to SEQ ID NO: 546419

SEQ ID NO: 647492 - RNA, 64 nt, hsa; identical to SEQ ID NO: 546420

SEQ ID NO: 647493 - RNA, 64 nt, hsa; identical to SEQ ID NO: 546421

SEQ ID NO: 647494 - RNA, 64 nt, hsa; identical to SEQ ID NO: 546422

SEQ ID NO: 647495 - RNA, 64 nt, hsa; identical to SEQ ID NO: 546423

SEQ ID NO: 647496 - RNA, 64 nt, hsa; identical to SEQ ID NO: 546424

SEQ ID NO: 647497 - RNA, 64 nt, hsa; identical to SEQ ID NO: 546425

SEQ ID NO: 647498 - RNA, 64 nt, hsa; identical to SEQ ID NO: 546426

SEQ ID NO: 647499 - RNA, 64 nt, hsa; identical to SEQ ID NO: 546427

SEQ ID NO: 647500 - RNA, 64 nt, hsa; identical to SEQ ID NO: 546427

SEQ ID NO: 647501 - RNA, 64 nt, hsa; identical to SEQ ID NO: 546429

SEQ ID NO: 647502 - RNA, 64 nt, hsa; identical to SEQ ID NO: 546430

SEQ ID NO: 647503 - RNA, 64 nt, hsa; identical to SEQ ID NO: 604268

SEQ ID NO: 647504 - RNA, 64 nt, hsa; identical to SEQ ID NO: 604269

SEQ ID NO: 647505 - RNA, 64 nt, hsa; identical to SEQ ID NO: 604270

SEQ ID NO: 647506 - RNA, 64 nt, hsa; identical to SEQ ID NO: 604271

SEQ ID NO: 647507 - RNA, 64 nt, hsa; identical to SEQ ID NO: 604272

SEQ ID NO: 647508 - RNA, 64 nt, hsa; identical to SEQ ID NO: 604273

SEQ ID NO: 647509 - RNA, 64 nt, hsa; identical to SEQ ID NO: 604274

SEQ ID NO: 647510 - RNA, 64 nt, hsa; identical to SEQ ID NO: 604275

SEQ ID NO: 647511 - RNA, 64 nt, hsa
ggaaugacauaccugggcucaggggaagcaagggggcuuagaauuugugggguauucccaaaag

SEQ ID NO: 647512 - RNA, 64 nt, hsa
aaacugcucugcacuguuuaauccauuuccaaggggcuuagaaaagcuaacaaggguguguccc

SEQ ID NO: 647513 - RNA, 64 nt, hsa; identical to SEQ ID NO: 182371

SEQ ID NO: 647514 - RNA, 64 nt, hsa; identical to SEQ ID NO: 182372

SEQ ID NO: 647515 - RNA, 64 nt, hsa; identical to SEQ ID NO: 182373

SEQ ID NO: 647516 - RNA, 64 nt, hsa; identical to SEQ ID NO: 182374

SEQ ID NO: 647517 - RNA, 64 nt, hsa; identical to SEQ ID NO: 182375

SEQ ID NO: 647518 - RNA, 64 nt, hsa; identical to SEQ ID NO: 182376

SEQ ID NO: 647519 - RNA, 64 nt, hsa; identical to SEQ ID NO: 182377

SEQ ID NO: 647520 - RNA, 64 nt, hsa; identical to SEQ ID NO: 182378

SEQ ID NO: 647521 - RNA, 64 nt, hsa; identical to SEQ ID NO: 182379

SEQ ID NO: 647522 - RNA, 64 nt, hsa; identical to SEQ ID NO: 182380

SEQ ID NO: 647523 - RNA, 64 nt, hsa; identical to SEQ ID NO: 182381

SEQ ID NO: 647524 - RNA, 64 nt, hsa; identical to SEQ ID NO: 182382

SEQ ID NO: 647525 - RNA, 64 nt, hsa; identical to SEQ ID NO: 182383

SEQ ID NO: 647526 - RNA, 64 nt, hsa; identical to SEQ ID NO: 182384

SEQ ID NO: 647527 - RNA, 64 nt, hsa; identical to SEQ ID NO: 182385

SEQ ID NO: 647528 - RNA, 64 nt, hsa; identical to SEQ ID NO: 182386

SEQ ID NO: 647529 - RNA, 64 nt, hsa; identical to SEQ ID NO: 182387

SEQ ID NO: 647530 - RNA, 64 nt, hsa; identical to SEQ ID NO: 182388

SEQ ID NO: 647531 - RNA, 64 nt, hsa; identical to SEQ ID NO: 182389

SEQ ID NO: 647532 - RNA, 64 nt, hsa; identical to SEQ ID NO: 182390

SEQ ID NO: 647533 - RNA, 64 nt, hsa; identical to SEQ ID NO: 182391

SEQ ID NO: 647534 - RNA, 64 nt, hsa; identical to SEQ ID NO: 182392

SEQ ID NO: 647535 - RNA, 64 nt, hsa; identical to SEQ ID NO: 182393

SEQ ID NO: 647536 - RNA, 64 nt, hsa; identical to SEQ ID NO: 182394

SEQ ID NO: 647537 - RNA, 64 nt, hsa; identical to SEQ ID NO: 182395

SEQ ID NO: 647538 - RNA, 64 nt, hsa; identical to SEQ ID NO: 182396

SEQ ID NO: 647539 - RNA, 64 nt, hsa; identical to SEQ ID NO: 182397

SEQ ID NO: 647540 - RNA, 64 nt, hsa; identical to SEQ ID NO: 182398

SEQ ID NO: 647541 - RNA, 64 nt, hsa; identical to SEQ ID NO: 182399

SEQ ID NO: 647542 - RNA, 64 nt, hsa; identical to SEQ ID NO: 182400

SEQ ID NO: 647543 - RNA, 64 nt, hsa; identical to SEQ ID NO: 182401

SEQ ID NO: 647544 - RNA, 64 nt, hsa; identical to SEQ ID NO: 182402

SEQ ID NO: 647545 - RNA, 64 nt, hsa; identical to SEQ ID NO: 182403

SEQ ID NO: 647546 - RNA, 64 nt, hsa; identical to SEQ ID NO: 182404

SEQ ID NO: 647547 - RNA, 64 nt, hsa; identical to SEQ ID NO: 182405

SEQ ID NO: 647548 - RNA, 64 nt, hsa; identical to SEQ ID NO: 182406

SEQ ID NO: 647549 - RNA, 64 nt, hsa; identical to SEQ ID NO: 182407

SEQ ID NO: 647550 - RNA, 64 nt, hsa; identical to SEQ ID NO: 182408

SEQ ID NO: 647551 - RNA, 64 nt, hsa; identical to SEQ ID NO: 182409

SEQ ID NO: 647552 - RNA, 64 nt, hsa; identical to SEQ ID NO: 182410

SEQ ID NO: 647553 - RNA, 64 nt, hsa; identical to SEQ ID NO: 182411

SEQ ID NO: 647554 - RNA, 64 nt, hsa; identical to SEQ ID NO: 182412

SEQ ID NO: 647555 - RNA, 64 nt, hsa; identical to SEQ ID NO: 182413

SEQ ID NO: 647556 - RNA, 64 nt, hsa; identical to SEQ ID NO: 182414

SEQ ID NO: 647557 - RNA, 64 nt, hsa; identical to SEQ ID NO: 182415

SEQ ID NO: 647558 - RNA, 64 nt, hsa; identical to SEQ ID NO: 182416

SEQ ID NO: 647559 - RNA, 64 nt, hsa; identical to SEQ ID NO: 182417

SEQ ID NO: 647560 - RNA, 64 nt, hsa; identical to SEQ ID NO: 182418

SEQ ID NO: 647561 - RNA, 64 nt, hsa; identical to SEQ ID NO: 182419

SEQ ID NO: 647562 - RNA, 64 nt, hsa; identical to SEQ ID NO: 182420

SEQ ID NO: 647563 - RNA, 64 nt, hsa; identical to SEQ ID NO: 182421

SEQ ID NO: 647564 - RNA, 64 nt, hsa; identical to SEQ ID NO: 182422

SEQ ID NO: 647565 - RNA, 64 nt, hsa; identical to SEQ ID NO: 182423

SEQ ID NO: 647566 - RNA, 64 nt, hsa; identical to SEQ ID NO: 182424

SEQ ID NO: 647567 - RNA, 64 nt, hsa; identical to SEQ ID NO: 182425

SEQ ID NO: 647568 - RNA, 64 nt, hsa; identical to SEQ ID NO: 182426

SEQ ID NO: 647569 - RNA, 64 nt, hsa; identical to SEQ ID NO: 182427

SEQ ID NO: 647570 - RNA, 64 nt, hsa; identical to SEQ ID NO: 182428

SEQ ID NO: 647571 - RNA, 64 nt, hsa; identical to SEQ ID NO: 182429

SEQ ID NO: 647572 - RNA, 64 nt, hsa; identical to SEQ ID NO: 574358

SEQ ID NO: 647573 - RNA, 64 nt, hsa; identical to SEQ ID NO: 574359

SEQ ID NO: 647574 - RNA, 64 nt, hsa; identical to SEQ ID NO: 574360

SEQ ID NO: 647575 - RNA, 64 nt, hsa; identical to SEQ ID NO: 574361

SEQ ID NO: 647576 - RNA, 64 nt, hsa; identical to SEQ ID NO: 350758

SEQ ID NO: 647577 - RNA, 64 nt, hsa; identical to SEQ ID NO: 350759

SEQ ID NO: 647578 - RNA, 64 nt, hsa; identical to SEQ ID NO: 350760

SEQ ID NO: 647579 - RNA, 64 nt, hsa; identical to SEQ ID NO: 350761

SEQ ID NO: 647580 - RNA, 64 nt, hsa; identical to SEQ ID NO: 350762

SEQ ID NO: 647581 - RNA, 64 nt, hsa; identical to SEQ ID NO: 350763

SEQ ID NO: 647582 - RNA, 64 nt, hsa; identical to SEQ ID NO: 350764

SEQ ID NO: 647583 - RNA, 64 nt, hsa; identical to SEQ ID NO: 350765

SEQ ID NO: 647584 - RNA, 64 nt, hsa; identical to SEQ ID NO: 264286

SEQ ID NO: 647585 - RNA, 64 nt, hsa; identical to SEQ ID NO: 264287

SEQ ID NO: 647586 - RNA, 64 nt, hsa; identical to SEQ ID NO: 264288

SEQ ID NO: 647587 - RNA, 64 nt, hsa; identical to SEQ ID NO: 264289

SEQ ID NO: 647588 - RNA, 64 nt, hsa; identical to SEQ ID NO: 264290

SEQ ID NO: 647589 - RNA, 64 nt, hsa; identical to SEQ ID NO: 264291

SEQ ID NO: 647590 - RNA, 64 nt, hsa; identical to SEQ ID NO: 264292

SEQ ID NO: 647591 - RNA, 64 nt, hsa; identical to SEQ ID NO: 264293

SEQ ID NO: 647592 - RNA, 64 nt, hsa; identical to SEQ ID NO: 264294

SEQ ID NO: 647593 - RNA, 64 nt, hsa; identical to SEQ ID NO: 264295

SEQ ID NO: 647594 - RNA, 64 nt, hsa; identical to SEQ ID NO: 264296

SEQ ID NO: 647595 - RNA, 64 nt, hsa; identical to SEQ ID NO: 264297

SEQ ID NO: 647596 - RNA, 64 nt, hsa; identical to SEQ ID NO: 264298

SEQ ID NO: 647597 - RNA, 64 nt, hsa; identical to SEQ ID NO: 264299

SEQ ID NO: 647598 - RNA, 64 nt, hsa; identical to SEQ ID NO: 264300

SEQ ID NO: 647599 - RNA, 64 nt, hsa; identical to SEQ ID NO: 264301

SEQ ID NO: 647600 - RNA, 64 nt, hsa; identical to SEQ ID NO: 89905

SEQ ID NO: 647601 - RNA, 64 nt, hsa; identical to SEQ ID NO: 89906

SEQ ID NO: 647602 - RNA, 64 nt, hsa; identical to SEQ ID NO: 89907

SEQ ID NO: 647603 - RNA, 64 nt, hsa; identical to SEQ ID NO: 89908

SEQ ID NO: 647604 - RNA, 64 nt, hsa; identical to SEQ ID NO: 89909

SEQ ID NO: 647605 - RNA, 64 nt, hsa; identical to SEQ ID NO: 89910

SEQ ID NO: 647606 - RNA, 64 nt, hsa; identical to SEQ ID NO: 89911

SEQ ID NO: 647607 - RNA, 64 nt, hsa; identical to SEQ ID NO: 89912

SEQ ID NO: 647608 - RNA, 64 nt, hsa; identical to SEQ ID NO: 89913

SEQ ID NO: 647609 - RNA, 64 nt, hsa; identical to SEQ ID NO: 89914

SEQ ID NO: 647610 - RNA, 64 nt, hsa; identical to SEQ ID NO: 89915

SEQ ID NO: 647611 - RNA, 64 nt, hsa; identical to SEQ ID NO: 89916

SEQ ID NO: 647612 - RNA, 64 nt, hsa; identical to SEQ ID NO: 89917

SEQ ID NO: 647613 - RNA, 64 nt, hsa; identical to SEQ ID NO: 89918

SEQ ID NO: 647614 - RNA, 64 nt, hsa; identical to SEQ ID NO: 89919

SEQ ID NO: 647615 - RNA, 64 nt, hsa; identical to SEQ ID NO: 89920

SEQ ID NO: 647616 - RNA, 64 nt, hsa; identical to SEQ ID NO: 89921

SEQ ID NO: 647617 - RNA, 64 nt, hsa; identical to SEQ ID NO: 89922

SEQ ID NO: 647618 - RNA, 64 nt, hsa; identical to SEQ ID NO: 89923

SEQ ID NO: 647619 - RNA, 64 nt, hsa; identical to SEQ ID NO: 89924

SEQ ID NO: 647620 - RNA, 64 nt, hsa; identical to SEQ ID NO: 89925

SEQ ID NO: 647621 - RNA, 64 nt, hsa; identical to SEQ ID NO: 89926

SEQ ID NO: 647622 - RNA, 64 nt, hsa; identical to SEQ ID NO: 89927

SEQ ID NO: 647623 - RNA, 64 nt, hsa; identical to SEQ ID NO: 89928

SEQ ID NO: 647624 - RNA, 50 nt, hsa; identical to SEQ ID NO: 89929

SEQ ID NO: 647625 - RNA, 64 nt, hsa; identical to SEQ ID NO: 89930

SEQ ID NO: 647626 - RNA, 64 nt, hsa; identical to SEQ ID NO: 89931

SEQ ID NO: 647627 - RNA, 64 nt, hsa; identical to SEQ ID NO: 89932

SEQ ID NO: 647628 - RNA, 64 nt, hsa; identical to SEQ ID NO: 89933

SEQ ID NO: 647629 - RNA, 64 nt, hsa; identical to SEQ ID NO: 89934

SEQ ID NO: 647630 - RNA, 64 nt, hsa; identical to SEQ ID NO: 89935

SEQ ID NO: 647631 - RNA, 64 nt, hsa; identical to SEQ ID NO: 89936

SEQ ID NO: 647632 - RNA, 64 nt, hsa; identical to SEQ ID NO: 89937

SEQ ID NO: 647633 - RNA, 64 nt, hsa; identical to SEQ ID NO: 89938

SEQ ID NO: 647634 - RNA, 64 nt, hsa; identical to SEQ ID NO: 89939

SEQ ID NO: 647635 - RNA, 64 nt, hsa; identical to SEQ ID NO: 89940

SEQ ID NO: 647636 - RNA, 64 nt, hsa; identical to SEQ ID NO: 89941

SEQ ID NO: 647637 - RNA, 55 nt, hsa; identical to SEQ ID NO: 89942

SEQ ID NO: 647638 - RNA, 64 nt, hsa; identical to SEQ ID NO: 89943

SEQ ID NO: 647639 - RNA, 64 nt, hsa; identical to SEQ ID NO: 89944

SEQ ID NO: 647640 - RNA, 64 nt, hsa; identical to SEQ ID NO: 89945

SEQ ID NO: 647641 - RNA, 64 nt, hsa; identical to SEQ ID NO: 89946

SEQ ID NO: 647642 - RNA, 64 nt, hsa; identical to SEQ ID NO: 89947

SEQ ID NO: 647643 - RNA, 64 nt, hsa; identical to SEQ ID NO: 89948

SEQ ID NO: 647644 - RNA, 64 nt, hsa; identical to SEQ ID NO: 89949

SEQ ID NO: 647645 - RNA, 64 nt, hsa; identical to SEQ ID NO: 89950

SEQ ID NO: 647646 - RNA, 64 nt, hsa; identical to SEQ ID NO: 89951

SEQ ID NO: 647647 - RNA, 64 nt, hsa; identical to SEQ ID NO: 89952

SEQ ID NO: 647648 - RNA, 64 nt, hsa; identical to SEQ ID NO: 89953

SEQ ID NO: 647649 - RNA, 64 nt, hsa; identical to SEQ ID NO: 89954

SEQ ID NO: 647650 - RNA, 64 nt, hsa; identical to SEQ ID NO: 89955

SEQ ID NO: 647651 - RNA, 64 nt, hsa; identical to SEQ ID NO: 89956

SEQ ID NO: 647652 - RNA, 64 nt, hsa; identical to SEQ ID NO: 89957

SEQ ID NO: 647653 - RNA, 64 nt, hsa; identical to SEQ ID NO: 89958

SEQ ID NO: 647654 - RNA, 64 nt, hsa; identical to SEQ ID NO: 89959

SEQ ID NO: 647655 - RNA, 64 nt, hsa; identical to SEQ ID NO: 89960

SEQ ID NO: 647656 - RNA, 64 nt, hsa; identical to SEQ ID NO: 89961

SEQ ID NO: 647657 - RNA, 64 nt, hsa; identical to SEQ ID NO: 89962

SEQ ID NO: 647658 - RNA, 64 nt, hsa; identical to SEQ ID NO: 89963

SEQ ID NO: 647659 - RNA, 64 nt, hsa; identical to SEQ ID NO: 89964

SEQ ID NO: 647660 - RNA, 64 nt, hsa; identical to SEQ ID NO: 89965

SEQ ID NO: 647661 - RNA, 64 nt, hsa; identical to SEQ ID NO: 89966

SEQ ID NO: 647662 - RNA, 64 nt, hsa; identical to SEQ ID NO: 89967

SEQ ID NO: 647663 - RNA, 64 nt, hsa; identical to SEQ ID NO: 89968

SEQ ID NO: 647664 - RNA, 64 nt, hsa; identical to SEQ ID NO: 89969

SEQ ID NO: 647665 - RNA, 64 nt, hsa; identical to SEQ ID NO: 89970

SEQ ID NO: 647666 - RNA, 64 nt, hsa; identical to SEQ ID NO: 89971

SEQ ID NO: 647667 - RNA, 64 nt, hsa; identical to SEQ ID NO: 89972

SEQ ID NO: 647668 - RNA, 64 nt, hsa; identical to SEQ ID NO: 89973

SEQ ID NO: 647669 - RNA, 64 nt, hsa; identical to SEQ ID NO: 89974

SEQ ID NO: 647670 - RNA, 64 nt, hsa; identical to SEQ ID NO: 89975

SEQ ID NO: 647671 - RNA, 64 nt, hsa; identical to SEQ ID NO: 89976

SEQ ID NO: 647672 - RNA, 64 nt, hsa; identical to SEQ ID NO: 89977

SEQ ID NO: 647673 - RNA, 64 nt, hsa; identical to SEQ ID NO: 89978

SEQ ID NO: 647674 - RNA, 64 nt, hsa; identical to SEQ ID NO: 89979

SEQ ID NO: 647675 - RNA, 64 nt, hsa; identical to SEQ ID NO: 89980

SEQ ID NO: 647676 - RNA, 64 nt, hsa; identical to SEQ ID NO: 89981

SEQ ID NO: 647677 - RNA, 64 nt, hsa; identical to SEQ ID NO: 89982

SEQ ID NO: 647678 - RNA, 64 nt, hsa; identical to SEQ ID NO: 89983

SEQ ID NO: 647679 - RNA, 64 nt, hsa; identical to SEQ ID NO: 89984

SEQ ID NO: 647680 - RNA, 64 nt, hsa; identical to SEQ ID NO: 89985

SEQ ID NO: 647681 - RNA, 64 nt, hsa; identical to SEQ ID NO: 89986

SEQ ID NO: 647682 - RNA, 64 nt, hsa; identical to SEQ ID NO: 89987

SEQ ID NO: 647683 - RNA, 64 nt, hsa; identical to SEQ ID NO: 89988

SEQ ID NO: 647684 - RNA, 59 nt, hsa; identical to SEQ ID NO: 89989

SEQ ID NO: 647685 - RNA, 64 nt, hsa; identical to SEQ ID NO: 89990

SEQ ID NO: 647686 - RNA, 64 nt, hsa; identical to SEQ ID NO: 89991

SEQ ID NO: 647687 - RNA, 64 nt, hsa; identical to SEQ ID NO: 89992

SEQ ID NO: 647688 - RNA, 64 nt, hsa; identical to SEQ ID NO: 89993

SEQ ID NO: 647689 - RNA, 64 nt, hsa; identical to SEQ ID NO: 89994

SEQ ID NO: 647690 - RNA, 64 nt, hsa; identical to SEQ ID NO: 89995

SEQ ID NO: 647691 - RNA, 64 nt, hsa; identical to SEQ ID NO: 89996

SEQ ID NO: 647692 - RNA, 64 nt, hsa; identical to SEQ ID NO: 89997

SEQ ID NO: 647693 - RNA, 64 nt, hsa; identical to SEQ ID NO: 89998

SEQ ID NO: 647694 - RNA, 64 nt, hsa; identical to SEQ ID NO: 89999

SEQ ID NO: 647695 - RNA, 64 nt, hsa; identical to SEQ ID NO: 90000

SEQ ID NO: 647696 - RNA, 64 nt, hsa; identical to SEQ ID NO: 90001

SEQ ID NO: 647697 - RNA, 64 nt, hsa; identical to SEQ ID NO: 90002

SEQ ID NO: 647698 - RNA, 64 nt, hsa; identical to SEQ ID NO: 90003

SEQ ID NO: 647699 - RNA, 64 nt, hsa; identical to SEQ ID NO: 90004

SEQ ID NO: 647700 - RNA, 64 nt, hsa; identical to SEQ ID NO: 90005

SEQ ID NO: 647701 - RNA, 64 nt, hsa; identical to SEQ ID NO: 90006

SEQ ID NO: 647702 - RNA, 64 nt, hsa; identical to SEQ ID NO: 90007

SEQ ID NO: 647703 - RNA, 64 nt, hsa; identical to SEQ ID NO: 90008

SEQ ID NO: 647704 - RNA, 64 nt, hsa; identical to SEQ ID NO: 90009

SEQ ID NO: 647705 - RNA, 64 nt, hsa; identical to SEQ ID NO: 90010

SEQ ID NO: 647706 - RNA, 64 nt, hsa; identical to SEQ ID NO: 90011

SEQ ID NO: 647707 - RNA, 64 nt, hsa; identical to SEQ ID NO: 90012

SEQ ID NO: 647708 - RNA, 64 nt, hsa; identical to SEQ ID NO: 90013

SEQ ID NO: 647709 - RNA, 64 nt, hsa; identical to SEQ ID NO: 90014

SEQ ID NO: 647710 - RNA, 64 nt, hsa; identical to SEQ ID NO: 90015

SEQ ID NO: 647711 - RNA, 64 nt, hsa; identical to SEQ ID NO: 90016

SEQ ID NO: 647712 - RNA, 64 nt, hsa; identical to SEQ ID NO: 90017

SEQ ID NO: 647713 - RNA, 64 nt, hsa; identical to SEQ ID NO: 90018

SEQ ID NO: 647714 - RNA, 64 nt, hsa; identical to SEQ ID NO: 90019

SEQ ID NO: 647715 - RNA, 64 nt, hsa; identical to SEQ ID NO: 90020

SEQ ID NO: 647716 - RNA, 64 nt, hsa; identical to SEQ ID NO: 90021

SEQ ID NO: 647717 - RNA, 64 nt, hsa; identical to SEQ ID NO: 90022

SEQ ID NO: 647718 - RNA, 64 nt, hsa; identical to SEQ ID NO: 90023

SEQ ID NO: 647719 - RNA, 64 nt, hsa; identical to SEQ ID NO: 90024

SEQ ID NO: 647720 - RNA, 64 nt, hsa; identical to SEQ ID NO: 90025

SEQ ID NO: 647721 - RNA, 64 nt, hsa; identical to SEQ ID NO: 90026

SEQ ID NO: 647722 - RNA, 64 nt, hsa; identical to SEQ ID NO: 90027

SEQ ID NO: 647723 - RNA, 64 nt, hsa; identical to SEQ ID NO: 90028

SEQ ID NO: 647724 - RNA, 64 nt, hsa; identical to SEQ ID NO: 90029

SEQ ID NO: 647725 - RNA, 64 nt, hsa; identical to SEQ ID NO: 90030

SEQ ID NO: 647726 - RNA, 64 nt, hsa; identical to SEQ ID NO: 90031

SEQ ID NO: 647727 - RNA, 64 nt, hsa; identical to SEQ ID NO: 90032

SEQ ID NO: 647728 - RNA, 64 nt, hsa; identical to SEQ ID NO: 90033

SEQ ID NO: 647729 - RNA, 64 nt, hsa; identical to SEQ ID NO: 90034

SEQ ID NO: 647730 - RNA, 64 nt, hsa; identical to SEQ ID NO: 90035

SEQ ID NO: 647731 - RNA, 64 nt, hsa; identical to SEQ ID NO: 90036

SEQ ID NO: 647732 - RNA, 64 nt, hsa; identical to SEQ ID NO: 90037

SEQ ID NO: 647733 - RNA, 64 nt, hsa; identical to SEQ ID NO: 90038

SEQ ID NO: 647734 - RNA, 64 nt, hsa; identical to SEQ ID NO: 90039

SEQ ID NO: 647735 - RNA, 64 nt, hsa; identical to SEQ ID NO: 90040

SEQ ID NO: 647736 - RNA, 64 nt, hsa; identical to SEQ ID NO: 90041

SEQ ID NO: 647737 - RNA, 64 nt, hsa; identical to SEQ ID NO: 90042

SEQ ID NO: 647738 - RNA, 64 nt, hsa; identical to SEQ ID NO: 90043

SEQ ID NO: 647739 - RNA, 64 nt, hsa; identical to SEQ ID NO: 90044

SEQ ID NO: 647740 - RNA, 64 nt, hsa; identical to SEQ ID NO: 90045

SEQ ID NO: 647741 - RNA, 64 nt, hsa; identical to SEQ ID NO: 90046

SEQ ID NO: 647742 - RNA, 64 nt, hsa; identical to SEQ ID NO: 90047

SEQ ID NO: 647743 - RNA, 64 nt, hsa; identical to SEQ ID NO: 90048

SEQ ID NO: 647744 - RNA, 64 nt, hsa; identical to SEQ ID NO: 90049

SEQ ID NO: 647745 - RNA, 64 nt, hsa; identical to SEQ ID NO: 90050

SEQ ID NO: 647746 - RNA, 64 nt, hsa; identical to SEQ ID NO: 90051

SEQ ID NO: 647747 - RNA, 64 nt, hsa; identical to SEQ ID NO: 90052

SEQ ID NO: 647748 - RNA, 64 nt, hsa; identical to SEQ ID NO: 90053

SEQ ID NO: 647749 - RNA, 64 nt, hsa; identical to SEQ ID NO: 90054

SEQ ID NO: 647750 - RNA, 64 nt, hsa; identical to SEQ ID NO: 90055

SEQ ID NO: 647751 - RNA, 64 nt, hsa; identical to SEQ ID NO: 90056

SEQ ID NO: 647752 - RNA, 64 nt, hsa; identical to SEQ ID NO: 90057

SEQ ID NO: 647753 - RNA, 64 nt, hsa; identical to SEQ ID NO: 90058

SEQ ID NO: 647754 - RNA, 64 nt, hsa; identical to SEQ ID NO: 90059

SEQ ID NO: 647755 - RNA, 64 nt, hsa; identical to SEQ ID NO: 90060

SEQ ID NO: 647756 - RNA, 64 nt, hsa; identical to SEQ ID NO: 90061

SEQ ID NO: 647757 - RNA, 64 nt, hsa; identical to SEQ ID NO: 90062

SEQ ID NO: 647758 - RNA, 64 nt, hsa; identical to SEQ ID NO: 90063

SEQ ID NO: 647759 - RNA, 64 nt, hsa; identical to SEQ ID NO: 90064

SEQ ID NO: 647760 - RNA, 64 nt, hsa; identical to SEQ ID NO: 90065

SEQ ID NO: 647761 - RNA, 64 nt, hsa; identical to SEQ ID NO: 90066

SEQ ID NO: 647762 - RNA, 64 nt, hsa; identical to SEQ ID NO: 90067

SEQ ID NO: 647763 - RNA, 64 nt, hsa; identical to SEQ ID NO: 90068

SEQ ID NO: 647764 - RNA, 64 nt, hsa; identical to SEQ ID NO: 90069

SEQ ID NO: 647765 - RNA, 64 nt, hsa; identical to SEQ ID NO: 90070

SEQ ID NO: 647766 - RNA, 64 nt, hsa; identical to SEQ ID NO: 90071

SEQ ID NO: 647767 - RNA, 64 nt, hsa; identical to SEQ ID NO: 90072

SEQ ID NO: 647768 - RNA, 64 nt, hsa; identical to SEQ ID NO: 90073

SEQ ID NO: 647769 - RNA, 64 nt, hsa; identical to SEQ ID NO: 90074

SEQ ID NO: 647770 - RNA, 64 nt, hsa; identical to SEQ ID NO: 90075

SEQ ID NO: 647771 - RNA, 64 nt, hsa; identical to SEQ ID NO: 90076

SEQ ID NO: 647772 - RNA, 64 nt, hsa; identical to SEQ ID NO: 90077

SEQ ID NO: 647773 - RNA, 64 nt, hsa; identical to SEQ ID NO: 90078

SEQ ID NO: 647774 - RNA, 64 nt, hsa; identical to SEQ ID NO: 90079

SEQ ID NO: 647775 - RNA, 64 nt, hsa; identical to SEQ ID NO: 90080

SEQ ID NO: 647776 - RNA, 64 nt, hsa; identical to SEQ ID NO: 90081

SEQ ID NO: 647777 - RNA, 64 nt, hsa; identical to SEQ ID NO: 90082

SEQ ID NO: 647778 - RNA, 64 nt, hsa; identical to SEQ ID NO: 90083

SEQ ID NO: 647779 - RNA, 64 nt, hsa; identical to SEQ ID NO: 90084

SEQ ID NO: 647780 - RNA, 64 nt, hsa; identical to SEQ ID NO: 528508

SEQ ID NO: 647781 - RNA, 64 nt, hsa; identical to SEQ ID NO: 528509

SEQ ID NO: 647782 - RNA, 64 nt, hsa; identical to SEQ ID NO: 528510

SEQ ID NO: 647783 - RNA, 64 nt, hsa; identical to SEQ ID NO: 528511

SEQ ID NO: 647784 - RNA, 64 nt, hsa; identical to SEQ ID NO: 528512

SEQ ID NO: 647785 - RNA, 64 nt, hsa; identical to SEQ ID NO: 528513

SEQ ID NO: 647786 - RNA, 64 nt, hsa; identical to SEQ ID NO: 528514

SEQ ID NO: 647787 - RNA, 64 nt, hsa; identical to SEQ ID NO: 528515

SEQ ID NO: 647788 - RNA, 64 nt, hsa; identical to SEQ ID NO: 528516

SEQ ID NO: 647789 - RNA, 64 nt, hsa; identical to SEQ ID NO: 528517

SEQ ID NO: 647790 - RNA, 64 nt, hsa; identical to SEQ ID NO: 528518

SEQ ID NO: 647791 - RNA, 64 nt, hsa; identical to SEQ ID NO: 366291

SEQ ID NO: 647792 - RNA, 64 nt, hsa; identical to SEQ ID NO: 366292

SEQ ID NO: 647793 - RNA, 64 nt, hsa; identical to SEQ ID NO: 366293

SEQ ID NO: 647794 - RNA, 64 nt, hsa; identical to SEQ ID NO: 366294

SEQ ID NO: 647795 - RNA, 64 nt, hsa; identical to SEQ ID NO: 366295

SEQ ID NO: 647796 - RNA, 64 nt, hsa; identical to SEQ ID NO: 366296

SEQ ID NO: 647797 - RNA, 64 nt, hsa; identical to SEQ ID NO: 366297

SEQ ID NO: 647798 - RNA, 64 nt, hsa; identical to SEQ ID NO: 366298

SEQ ID NO: 647799 - RNA, 64 nt, hsa; identical to SEQ ID NO: 366299

SEQ ID NO: 647800 - RNA, 64 nt, hsa; identical to SEQ ID NO: 366300

SEQ ID NO: 647801 - RNA, 64 nt, hsa; identical to SEQ ID NO: 366301

SEQ ID NO: 647802 - RNA, 64 nt, hsa; identical to SEQ ID NO: 366302

SEQ ID NO: 647803 - RNA, 64 nt, hsa; identical to SEQ ID NO: 366303

SEQ ID NO: 647804 - RNA, 64 nt, hsa; identical to SEQ ID NO: 366304

SEQ ID NO: 647805 - RNA, 64 nt, hsa; identical to SEQ ID NO: 366305

SEQ ID NO: 647806 - RNA, 64 nt, hsa; identical to SEQ ID NO: 366306

SEQ ID NO: 647807 - RNA, 64 nt, hsa; identical to SEQ ID NO: 366307

SEQ ID NO: 647808 - RNA, 64 nt, hsa; identical to SEQ ID NO: 366308

SEQ ID NO: 647809 - RNA, 64 nt, hsa; identical to SEQ ID NO: 366309

SEQ ID NO: 647810 - RNA, 64 nt, hsa; identical to SEQ ID NO: 366310

SEQ ID NO: 647811 - RNA, 64 nt, hsa; identical to SEQ ID NO: 366311

SEQ ID NO: 647812 - RNA, 64 nt, hsa; identical to SEQ ID NO: 366312

SEQ ID NO: 647813 - RNA, 64 nt, hsa; identical to SEQ ID NO: 366313

SEQ ID NO: 647814 - RNA, 64 nt, hsa; identical to SEQ ID NO: 366314

SEQ ID NO: 647815 - RNA, 64 nt, hsa; identical to SEQ ID NO: 366315

SEQ ID NO: 647816 - RNA, 64 nt, hsa; identical to SEQ ID NO: 366316

SEQ ID NO: 647817 - RNA, 64 nt, hsa; identical to SEQ ID NO: 366317

SEQ ID NO: 647818 - RNA, 64 nt, hsa; identical to SEQ ID NO: 366318

SEQ ID NO: 647819 - RNA, 64 nt, hsa; identical to SEQ ID NO: 366319

SEQ ID NO: 647820 - RNA, 64 nt, hsa; identical to SEQ ID NO: 366320

SEQ ID NO: 647821 - RNA, 64 nt, hsa; identical to SEQ ID NO: 366321

SEQ ID NO: 647822 - RNA, 64 nt, hsa; identical to SEQ ID NO: 366322

SEQ ID NO: 647823 - RNA, 64 nt, hsa; identical to SEQ ID NO: 366323

SEQ ID NO: 647824 - RNA, 64 nt, hsa; identical to SEQ ID NO: 366324

SEQ ID NO: 647825 - RNA, 64 nt, hsa; identical to SEQ ID NO: 366325

SEQ ID NO: 647826 - RNA, 64 nt, hsa; identical to SEQ ID NO: 348445

SEQ ID NO: 647827 - RNA, 64 nt, hsa; identical to SEQ ID NO: 348446

SEQ ID NO: 647828 - RNA, 64 nt, hsa; identical to SEQ ID NO: 348447

SEQ ID NO: 647829 - RNA, 64 nt, hsa; identical to SEQ ID NO: 348448

SEQ ID NO: 647830 - RNA, 64 nt, hsa; identical to SEQ ID NO: 348449

SEQ ID NO: 647831 - RNA, 64 nt, hsa; identical to SEQ ID NO: 348450

SEQ ID NO: 647832 - RNA, 64 nt, hsa; identical to SEQ ID NO: 348451

SEQ ID NO: 647833 - RNA, 64 nt, hsa; identical to SEQ ID NO: 348452

SEQ ID NO: 647834 - RNA, 64 nt, hsa; identical to SEQ ID NO: 348453

SEQ ID NO: 647835 - RNA, 64 nt, hsa; identical to SEQ ID NO: 348454

SEQ ID NO: 647836 - RNA, 64 nt, hsa; identical to SEQ ID NO: 348455

SEQ ID NO: 647837 - RNA, 64 nt, hsa; identical to SEQ ID NO: 348456

SEQ ID NO: 647838 - RNA, 64 nt, hsa; identical to SEQ ID NO: 348457

SEQ ID NO: 647839 - RNA, 64 nt, hsa; identical to SEQ ID NO: 348458

SEQ ID NO: 647840 - RNA, 64 nt, hsa; identical to SEQ ID NO: 348459

SEQ ID NO: 647841 - RNA, 64 nt, hsa; identical to SEQ ID NO: 348460

SEQ ID NO: 647842 - RNA, 64 nt, hsa; identical to SEQ ID NO: 348461

SEQ ID NO: 647843 - RNA, 64 nt, hsa; identical to SEQ ID NO: 348462

SEQ ID NO: 647844 - RNA, 64 nt, hsa; identical to SEQ ID NO: 348463

SEQ ID NO: 647845 - RNA, 64 nt, hsa; identical to SEQ ID NO: 348464

SEQ ID NO: 647846 - RNA, 64 nt, hsa; identical to SEQ ID NO: 348465

SEQ ID NO: 647847 - RNA, 64 nt, hsa; identical to SEQ ID NO: 348466

SEQ ID NO: 647848 - RNA, 64 nt, hsa; identical to SEQ ID NO: 348467

SEQ ID NO: 647849 - RNA, 64 nt, hsa; identical to SEQ ID NO: 348468

SEQ ID NO: 647850 - RNA, 64 nt, hsa; identical to SEQ ID NO: 68831

SEQ ID NO: 647851 - RNA, 64 nt, hsa; identical to SEQ ID NO: 68832

SEQ ID NO: 647852 - RNA, 64 nt, hsa; identical to SEQ ID NO: 68833

SEQ ID NO: 647853 - RNA, 64 nt, hsa; identical to SEQ ID NO: 68834

SEQ ID NO: 647854 - RNA, 64 nt, hsa; identical to SEQ ID NO: 68835

SEQ ID NO: 647855 - RNA, 64 nt, hsa; identical to SEQ ID NO: 68836

SEQ ID NO: 647856 - RNA, 64 nt, hsa; identical to SEQ ID NO: 68837

SEQ ID NO: 647857 - RNA, 64 nt, hsa; identical to SEQ ID NO: 68838

SEQ ID NO: 647858 - RNA, 64 nt, hsa; identical to SEQ ID NO: 68839

SEQ ID NO: 647859 - RNA, 64 nt, hsa; identical to SEQ ID NO: 68840

SEQ ID NO: 647860 - RNA, 64 nt, hsa; identical to SEQ ID NO: 68841

SEQ ID NO: 647861 - RNA, 64 nt, hsa; identical to SEQ ID NO: 68842

SEQ ID NO: 647862 - RNA, 64 nt, hsa; identical to SEQ ID NO: 68843

SEQ ID NO: 647863 - RNA, 64 nt, hsa; identical to SEQ ID NO: 68844

SEQ ID NO: 647864 - RNA, 64 nt, hsa; identical to SEQ ID NO: 68845

SEQ ID NO: 647865 - RNA, 64 nt, hsa; identical to SEQ ID NO: 68846

SEQ ID NO: 647866 - RNA, 64 nt, hsa; identical to SEQ ID NO: 68847

SEQ ID NO: 647867 - RNA, 64 nt, hsa; identical to SEQ ID NO: 68848

SEQ ID NO: 647868 - RNA, 64 nt, hsa; identical to SEQ ID NO: 68849

SEQ ID NO: 647869 - RNA, 64 nt, hsa; identical to SEQ ID NO: 68850

SEQ ID NO: 647870 - RNA, 64 nt, hsa; identical to SEQ ID NO: 68851

SEQ ID NO: 647871 - RNA, 64 nt, hsa; identical to SEQ ID NO: 68852

SEQ ID NO: 647872 - RNA, 64 nt, hsa; identical to SEQ ID NO: 68853

SEQ ID NO: 647873 - RNA, 64 nt, hsa; identical to SEQ ID NO: 68854

SEQ ID NO: 647874 - RNA, 64 nt, hsa; identical to SEQ ID NO: 68855

SEQ ID NO: 647875 - RNA, 64 nt, hsa; identical to SEQ ID NO: 68856

SEQ ID NO: 647876 - RNA, 64 nt, hsa; identical to SEQ ID NO: 68857

SEQ ID NO: 647877 - RNA, 64 nt, hsa; identical to SEQ ID NO: 68858

SEQ ID NO: 647878 - RNA, 64 nt, hsa; identical to SEQ ID NO: 68859

SEQ ID NO: 647879 - RNA, 64 nt, hsa; identical to SEQ ID NO: 68860

SEQ ID NO: 647880 - RNA, 64 nt, hsa; identical to SEQ ID NO: 68861

SEQ ID NO: 647881 - RNA, 64 nt, hsa; identical to SEQ ID NO: 68862

SEQ ID NO: 647882 - RNA, 64 nt, hsa; identical to SEQ ID NO: 68863

SEQ ID NO: 647883 - RNA, 64 nt, hsa; identical to SEQ ID NO: 68864

SEQ ID NO: 647884 - RNA, 64 nt, hsa; identical to SEQ ID NO: 68865

SEQ ID NO: 647885 - RNA, 64 nt, hsa; identical to SEQ ID NO: 68866

SEQ ID NO: 647886 - RNA, 64 nt, hsa; identical to SEQ ID NO: 68867

SEQ ID NO: 647887 - RNA, 64 nt, hsa; identical to SEQ ID NO: 68868

SEQ ID NO: 647888 - RNA, 64 nt, hsa; identical to SEQ ID NO: 68869

SEQ ID NO: 647889 - RNA, 64 nt, hsa; identical to SEQ ID NO: 68870

SEQ ID NO: 647890 - RNA, 64 nt, hsa; identical to SEQ ID NO: 68871

SEQ ID NO: 647891 - RNA, 64 nt, hsa; identical to SEQ ID NO: 68872

SEQ ID NO: 647892 - RNA, 64 nt, hsa; identical to SEQ ID NO: 68873

SEQ ID NO: 647893 - RNA, 64 nt, hsa; identical to SEQ ID NO: 68874

SEQ ID NO: 647894 - RNA, 64 nt, hsa; identical to SEQ ID NO: 68875

SEQ ID NO: 647895 - RNA, 64 nt, hsa; identical to SEQ ID NO: 68876

SEQ ID NO: 647896 - RNA, 64 nt, hsa; identical to SEQ ID NO: 68877

SEQ ID NO: 647897 - RNA, 64 nt, hsa; identical to SEQ ID NO: 68877

SEQ ID NO: 647898 - RNA, 64 nt, hsa; identical to SEQ ID NO: 68879

SEQ ID NO: 647899 - RNA, 64 nt, hsa; identical to SEQ ID NO: 68880

SEQ ID NO: 647900 - RNA, 64 nt, hsa; identical to SEQ ID NO: 68881

SEQ ID NO: 647901 - RNA, 64 nt, hsa; identical to SEQ ID NO: 68882

SEQ ID NO: 647902 - RNA, 64 nt, hsa; identical to SEQ ID NO: 68883

SEQ ID NO: 647903 - RNA, 64 nt, hsa; identical to SEQ ID NO: 68884

SEQ ID NO: 647904 - RNA, 64 nt, hsa; identical to SEQ ID NO: 68885

SEQ ID NO: 647905 - RNA, 64 nt, hsa; identical to SEQ ID NO: 68886

SEQ ID NO: 647906 - RNA, 64 nt, hsa; identical to SEQ ID NO: 68887

SEQ ID NO: 647907 - RNA, 64 nt, hsa; identical to SEQ ID NO: 68888

SEQ ID NO: 647908 - RNA, 64 nt, hsa; identical to SEQ ID NO: 68889

SEQ ID NO: 647909 - RNA, 64 nt, hsa; identical to SEQ ID NO: 68890

SEQ ID NO: 647910 - RNA, 64 nt, hsa; identical to SEQ ID NO: 68891

SEQ ID NO: 647911 - RNA, 64 nt, hsa; identical to SEQ ID NO: 68892

SEQ ID NO: 647912 - RNA, 64 nt, hsa; identical to SEQ ID NO: 68893

SEQ ID NO: 647913 - RNA, 64 nt, hsa; identical to SEQ ID NO: 68894

SEQ ID NO: 647914 - RNA, 64 nt, hsa; identical to SEQ ID NO: 68895

SEQ ID NO: 647915 - RNA, 64 nt, hsa; identical to SEQ ID NO: 68896

SEQ ID NO: 647916 - RNA, 64 nt, hsa; identical to SEQ ID NO: 68897

SEQ ID NO: 647917 - RNA, 64 nt, hsa; identical to SEQ ID NO: 68898

SEQ ID NO: 647918 - RNA, 64 nt, hsa; identical to SEQ ID NO: 68899

SEQ ID NO: 647919 - RNA, 64 nt, hsa; identical to SEQ ID NO: 68900

SEQ ID NO: 647920 - RNA, 64 nt, hsa; identical to SEQ ID NO: 68901

SEQ ID NO: 647921 - RNA, 64 nt, hsa; identical to SEQ ID NO: 68902

SEQ ID NO: 647922 - RNA, 64 nt, hsa; identical to SEQ ID NO: 68903

SEQ ID NO: 647923 - RNA, 64 nt, hsa; identical to SEQ ID NO: 68904

SEQ ID NO: 647924 - RNA, 64 nt, hsa; identical to SEQ ID NO: 68905

SEQ ID NO: 647925 - RNA, 64 nt, hsa; identical to SEQ ID NO: 68906

SEQ ID NO: 647926 - RNA, 64 nt, hsa; identical to SEQ ID NO: 68907

SEQ ID NO: 647927 - RNA, 64 nt, hsa; identical to SEQ ID NO: 68908

SEQ ID NO: 647928 - RNA, 64 nt, hsa; identical to SEQ ID NO: 68909

SEQ ID NO: 647929 - RNA, 64 nt, hsa; identical to SEQ ID NO: 68910

SEQ ID NO: 647930 - RNA, 64 nt, hsa; identical to SEQ ID NO: 68911

SEQ ID NO: 647931 - RNA, 64 nt, hsa; identical to SEQ ID NO: 68912

SEQ ID NO: 647932 - RNA, 64 nt, hsa; identical to SEQ ID NO: 68913

SEQ ID NO: 647933 - RNA, 64 nt, hsa; identical to SEQ ID NO: 68914

SEQ ID NO: 647934 - RNA, 64 nt, hsa; identical to SEQ ID NO: 68915

SEQ ID NO: 647935 - RNA, 64 nt, hsa; identical to SEQ ID NO: 68916

SEQ ID NO: 647936 - RNA, 64 nt, hsa; identical to SEQ ID NO: 68917

SEQ ID NO: 647937 - RNA, 64 nt, hsa; identical to SEQ ID NO: 68918

SEQ ID NO: 647938 - RNA, 64 nt, hsa; identical to SEQ ID NO: 68919

SEQ ID NO: 647939 - RNA, 64 nt, hsa; identical to SEQ ID NO: 68920

SEQ ID NO: 647940 - RNA, 64 nt, hsa; identical to SEQ ID NO: 68921

SEQ ID NO: 647941 - RNA, 64 nt, hsa; identical to SEQ ID NO: 68922

SEQ ID NO: 647942 - RNA, 64 nt, hsa; identical to SEQ ID NO: 68923

SEQ ID NO: 647943 - RNA, 64 nt, hsa; identical to SEQ ID NO: 68924

SEQ ID NO: 647944 - RNA, 64 nt, hsa; identical to SEQ ID NO: 68925

SEQ ID NO: 647945 - RNA, 64 nt, hsa; identical to SEQ ID NO: 68926

SEQ ID NO: 647946 - RNA, 64 nt, hsa; identical to SEQ ID NO: 68927

SEQ ID NO: 647947 - RNA, 64 nt, hsa; identical to SEQ ID NO: 68928

SEQ ID NO: 647948 - RNA, 64 nt, hsa; identical to SEQ ID NO: 68929

SEQ ID NO: 647949 - RNA, 64 nt, hsa; identical to SEQ ID NO: 68930

SEQ ID NO: 647950 - RNA, 64 nt, hsa; identical to SEQ ID NO: 68931

SEQ ID NO: 647951 - RNA, 64 nt, hsa; identical to SEQ ID NO: 68932

SEQ ID NO: 647952 - RNA, 64 nt, hsa; identical to SEQ ID NO: 68933

SEQ ID NO: 647953 - RNA, 64 nt, hsa; identical to SEQ ID NO: 68934

SEQ ID NO: 647954 - RNA, 64 nt, hsa; identical to SEQ ID NO: 68935

SEQ ID NO: 647955 - RNA, 64 nt, hsa; identical to SEQ ID NO: 119606

SEQ ID NO: 647956 - RNA, 64 nt, hsa; identical to SEQ ID NO: 119607

SEQ ID NO: 647957 - RNA, 64 nt, hsa; identical to SEQ ID NO: 119608

SEQ ID NO: 647958 - RNA, 64 nt, hsa; identical to SEQ ID NO: 119609

SEQ ID NO: 647959 - RNA, 64 nt, hsa; identical to SEQ ID NO: 119610

SEQ ID NO: 647960 - RNA, 64 nt, hsa; identical to SEQ ID NO: 119611

SEQ ID NO: 647961 - RNA, 64 nt, hsa; identical to SEQ ID NO: 119612

SEQ ID NO: 647962 - RNA, 64 nt, hsa; identical to SEQ ID NO: 119613

SEQ ID NO: 647963 - RNA, 64 nt, hsa; identical to SEQ ID NO: 119614

SEQ ID NO: 647964 - RNA, 64 nt, hsa; identical to SEQ ID NO: 119615

SEQ ID NO: 647965 - RNA, 64 nt, hsa; identical to SEQ ID NO: 119616

SEQ ID NO: 647966 - RNA, 64 nt, hsa; identical to SEQ ID NO: 119617

SEQ ID NO: 647967 - RNA, 64 nt, hsa; identical to SEQ ID NO: 119618

SEQ ID NO: 647968 - RNA, 64 nt, hsa; identical to SEQ ID NO: 119619

SEQ ID NO: 647969 - RNA, 64 nt, hsa; identical to SEQ ID NO: 119620

SEQ ID NO: 647970 - RNA, 64 nt, hsa; identical to SEQ ID NO: 119621

SEQ ID NO: 647971 - RNA, 64 nt, hsa; identical to SEQ ID NO: 119622

SEQ ID NO: 647972 - RNA, 64 nt, hsa; identical to SEQ ID NO: 119623

SEQ ID NO: 647973 - RNA, 64 nt, hsa; identical to SEQ ID NO: 119624

SEQ ID NO: 647974 - RNA, 64 nt, hsa; identical to SEQ ID NO: 119625

SEQ ID NO: 647975 - RNA, 64 nt, hsa; identical to SEQ ID NO: 119626

SEQ ID NO: 647976 - RNA, 64 nt, hsa; identical to SEQ ID NO: 119627

SEQ ID NO: 647977 - RNA, 64 nt, hsa; identical to SEQ ID NO: 119628

SEQ ID NO: 647978 - RNA, 64 nt, hsa; identical to SEQ ID NO: 119629

SEQ ID NO: 647979 - RNA, 64 nt, hsa; identical to SEQ ID NO: 119630

SEQ ID NO: 647980 - RNA, 64 nt, hsa; identical to SEQ ID NO: 119631

SEQ ID NO: 647981 - RNA, 64 nt, hsa; identical to SEQ ID NO: 453185

SEQ ID NO: 647982 - RNA, 64 nt, hsa; identical to SEQ ID NO: 453186

SEQ ID NO: 647983 - RNA, 64 nt, hsa; identical to SEQ ID NO: 453187

SEQ ID NO: 647984 - RNA, 64 nt, hsa; identical to SEQ ID NO: 453188

SEQ ID NO: 647985 - RNA, 64 nt, hsa; identical to SEQ ID NO: 453189

SEQ ID NO: 647986 - RNA, 64 nt, hsa; identical to SEQ ID NO: 453190

SEQ ID NO: 647987 - RNA, 64 nt, hsa; identical to SEQ ID NO: 453191

SEQ ID NO: 647988 - RNA, 64 nt, hsa; identical to SEQ ID NO: 453192

SEQ ID NO: 647989 - RNA, 64 nt, hsa; identical to SEQ ID NO: 453193

SEQ ID NO: 647990 - RNA, 64 nt, hsa; identical to SEQ ID NO: 453194

SEQ ID NO: 647991 - RNA, 64 nt, hsa; identical to SEQ ID NO: 453195

SEQ ID NO: 647992 - RNA, 64 nt, hsa; identical to SEQ ID NO: 453196

SEQ ID NO: 647993 - RNA, 64 nt, hsa; identical to SEQ ID NO: 453197

SEQ ID NO: 647994 - RNA, 64 nt, hsa; identical to SEQ ID NO: 453198

SEQ ID NO: 647995 - RNA, 64 nt, hsa; identical to SEQ ID NO: 453198

SEQ ID NO: 647996 - RNA, 64 nt, hsa; identical to SEQ ID NO: 453200

SEQ ID NO: 647997 - RNA, 64 nt, hsa; identical to SEQ ID NO: 453201

SEQ ID NO: 647998 - RNA, 64 nt, hsa; identical to SEQ ID NO: 453202

SEQ ID NO: 647999 - RNA, 64 nt, hsa; identical to SEQ ID NO: 453203

SEQ ID NO: 648000 - RNA, 64 nt, hsa; identical to SEQ ID NO: 453204

SEQ ID NO: 648001 - RNA, 64 nt, hsa; identical to SEQ ID NO: 453205

SEQ ID NO: 648002 - RNA, 64 nt, hsa; identical to SEQ ID NO: 453206

SEQ ID NO: 648003 - RNA, 64 nt, hsa; identical to SEQ ID NO: 453207

SEQ ID NO: 648004 - RNA, 64 nt, hsa; identical to SEQ ID NO: 453208

SEQ ID NO: 648005 - RNA, 64 nt, hsa; identical to SEQ ID NO: 453209

SEQ ID NO: 648006 - RNA, 64 nt, hsa; identical to SEQ ID NO: 453210

SEQ ID NO: 648007 - RNA, 64 nt, hsa; identical to SEQ ID NO: 453211

SEQ ID NO: 648008 - RNA, 64 nt, hsa; identical to SEQ ID NO: 453212

SEQ ID NO: 648009 - RNA, 64 nt, hsa; identical to SEQ ID NO: 453213

SEQ ID NO: 648010 - RNA, 64 nt, hsa; identical to SEQ ID NO: 453214

SEQ ID NO: 648011 - RNA, 64 nt, hsa; identical to SEQ ID NO: 453215

SEQ ID NO: 648012 - RNA, 64 nt, hsa; identical to SEQ ID NO: 453216

SEQ ID NO: 648013 - RNA, 64 nt, hsa; identical to SEQ ID NO: 453217

SEQ ID NO: 648014 - RNA, 64 nt, hsa; identical to SEQ ID NO: 453218

SEQ ID NO: 648015 - RNA, 64 nt, hsa; identical to SEQ ID NO: 453219

SEQ ID NO: 648016 - RNA, 64 nt, hsa; identical to SEQ ID NO: 453220

SEQ ID NO: 648017 - RNA, 64 nt, hsa; identical to SEQ ID NO: 453221

SEQ ID NO: 648018 - RNA, 64 nt, hsa; identical to SEQ ID NO: 453222

SEQ ID NO: 648019 - RNA, 64 nt, hsa; identical to SEQ ID NO: 453223

SEQ ID NO: 648020 - RNA, 64 nt, hsa; identical to SEQ ID NO: 453224

SEQ ID NO: 648021 - RNA, 64 nt, hsa; identical to SEQ ID NO: 453225

SEQ ID NO: 648022 - RNA, 64 nt, hsa; identical to SEQ ID NO: 453226

SEQ ID NO: 648023 - RNA, 64 nt, hsa; identical to SEQ ID NO: 309634

SEQ ID NO: 648024 - RNA, 64 nt, hsa; identical to SEQ ID NO: 309635

SEQ ID NO: 648025 - RNA, 64 nt, hsa; identical to SEQ ID NO: 309636

SEQ ID NO: 648026 - RNA, 64 nt, hsa; identical to SEQ ID NO: 309637

SEQ ID NO: 648027 - RNA, 64 nt, hsa; identical to SEQ ID NO: 309638

SEQ ID NO: 648028 - RNA, 64 nt, hsa; identical to SEQ ID NO: 309639

SEQ ID NO: 648029 - RNA, 64 nt, hsa; identical to SEQ ID NO: 309640

SEQ ID NO: 648030 - RNA, 64 nt, hsa; identical to SEQ ID NO: 309641

SEQ ID NO: 648031 - RNA, 64 nt, hsa; identical to SEQ ID NO: 309642

SEQ ID NO: 648032 - RNA, 64 nt, hsa; identical to SEQ ID NO: 309643

SEQ ID NO: 648033 - RNA, 64 nt, hsa; identical to SEQ ID NO: 309644

SEQ ID NO: 648034 - RNA, 64 nt, hsa; identical to SEQ ID NO: 309645

SEQ ID NO: 648035 - RNA, 64 nt, hsa; identical to SEQ ID NO: 309646

SEQ ID NO: 648036 - RNA, 64 nt, hsa; identical to SEQ ID NO: 309647

SEQ ID NO: 648037 - RNA, 64 nt, hsa; identical to SEQ ID NO: 309648

SEQ ID NO: 648038 - RNA, 64 nt, hsa; identical to SEQ ID NO: 309649

SEQ ID NO: 648039 - RNA, 64 nt, hsa; identical to SEQ ID NO: 309650

SEQ ID NO: 648040 - RNA, 64 nt, hsa; identical to SEQ ID NO: 309651

SEQ ID NO: 648041 - RNA, 64 nt, hsa; identical to SEQ ID NO: 309652

SEQ ID NO: 648042 - RNA, 64 nt, hsa; identical to SEQ ID NO: 309653

SEQ ID NO: 648043 - RNA, 64 nt, hsa; identical to SEQ ID NO: 309654

SEQ ID NO: 648044 - RNA, 64 nt, hsa; identical to SEQ ID NO: 309655

SEQ ID NO: 648045 - RNA, 64 nt, hsa; identical to SEQ ID NO: 309656

SEQ ID NO: 648046 - RNA, 64 nt, hsa; identical to SEQ ID NO: 309657

SEQ ID NO: 648047 - RNA, 64 nt, hsa; identical to SEQ ID NO: 309658

SEQ ID NO: 648048 - RNA, 64 nt, hsa; identical to SEQ ID NO: 309659

SEQ ID NO: 648049 - RNA, 64 nt, hsa; identical to SEQ ID NO: 309660

SEQ ID NO: 648050 - RNA, 64 nt, hsa; identical to SEQ ID NO: 309661

SEQ ID NO: 648051 - RNA, 64 nt, hsa; identical to SEQ ID NO: 309662

SEQ ID NO: 648052 - RNA, 64 nt, hsa; identical to SEQ ID NO: 309663

SEQ ID NO: 648053 - RNA, 64 nt, hsa; identical to SEQ ID NO: 309664

SEQ ID NO: 648054 - RNA, 64 nt, hsa; identical to SEQ ID NO: 309665

SEQ ID NO: 648055 - RNA, 64 nt, hsa; identical to SEQ ID NO: 309666

SEQ ID NO: 648056 - RNA, 64 nt, hsa; identical to SEQ ID NO: 309667

SEQ ID NO: 648057 - RNA, 64 nt, hsa; identical to SEQ ID NO: 309668

SEQ ID NO: 648058 - RNA, 64 nt, hsa; identical to SEQ ID NO: 309669

SEQ ID NO: 648059 - RNA, 64 nt, hsa; identical to SEQ ID NO: 178992

SEQ ID NO: 648060 - RNA, 64 nt, hsa; identical to SEQ ID NO: 178993

SEQ ID NO: 648061 - RNA, 64 nt, hsa; identical to SEQ ID NO: 178994

SEQ ID NO: 648062 - RNA, 64 nt, hsa; identical to SEQ ID NO: 178995

SEQ ID NO: 648063 - RNA, 64 nt, hsa; identical to SEQ ID NO: 178996

SEQ ID NO: 648064 - RNA, 64 nt, hsa; identical to SEQ ID NO: 178997

SEQ ID NO: 648065 - RNA, 64 nt, hsa; identical to SEQ ID NO: 178998

SEQ ID NO: 648066 - RNA, 64 nt, hsa; identical to SEQ ID NO: 178999

SEQ ID NO: 648067 - RNA, 64 nt, hsa; identical to SEQ ID NO: 179000

SEQ ID NO: 648068 - RNA, 64 nt, hsa; identical to SEQ ID NO: 179001

SEQ ID NO: 648069 - RNA, 64 nt, hsa; identical to SEQ ID NO: 179002

SEQ ID NO: 648070 - RNA, 64 nt, hsa; identical to SEQ ID NO: 179003

SEQ ID NO: 648071 - RNA, 64 nt, hsa; identical to SEQ ID NO: 179004

SEQ ID NO: 648072 - RNA, 64 nt, hsa; identical to SEQ ID NO: 179005

SEQ ID NO: 648073 - RNA, 64 nt, hsa; identical to SEQ ID NO: 179006

SEQ ID NO: 648074 - RNA, 64 nt, hsa; identical to SEQ ID NO: 179007

SEQ ID NO: 648075 - RNA, 64 nt, hsa; identical to SEQ ID NO: 179008

SEQ ID NO: 648076 - RNA, 64 nt, hsa; identical to SEQ ID NO: 396681

SEQ ID NO: 648077 - RNA, 64 nt, hsa; identical to SEQ ID NO: 396682

SEQ ID NO: 648078 - RNA, 64 nt, hsa; identical to SEQ ID NO: 396683

SEQ ID NO: 648079 - RNA, 64 nt, hsa; identical to SEQ ID NO: 396684

SEQ ID NO: 648080 - RNA, 64 nt, hsa
aaaucauaauguauuauuuaaauguuuaacaucauugcauaacagcguuuauuauacaguggca

SEQ ID NO: 648081 - RNA, 64 nt, hsa
gagcuucagaaaggggcauuuuguacucuuguuuuugcauaacugguuuuguuuuuuugcagaa

SEQ ID NO: 648082 - RNA, 64 nt, hsa
cuggccugugauugguccauuccaggaccuucauuugcauaagguaucaaaccacaucagccuc

SEQ ID NO: 648083 - RNA, 64 nt, hsa
cuggccaaugauugguucauuccaggacauucauuugcauaaggagucaaaccacaccagucuu

SEQ ID NO: 648084 - RNA, 64 nt, hsa
uuuaaaagagagagagagaaaaaaaaaauaguauuugcauaacccugagcggugggggaggagg

SEQ ID NO: 648085 - RNA, 64 nt, hsa
cagcuguguuauucuuugcguguagcuauggaaguugcauaauuauuauuauuauuauuauaac

SEQ ID NO: 648086 - RNA, 64 nt, hsa
agagaugaagacuucucaauaugcuuauuuugcuuugcauaauuggcucuuuuuaagagcccaa

SEQ ID NO: 648087 - RNA, 64 nt, hsa
auauuauuuuagguaauauuuguacuuuaacauguugcauaauauaugcuuauguagcuuucca

SEQ ID NO: 648088 - RNA, 64 nt, hsa; identical to SEQ ID NO: 536153

SEQ ID NO: 648089 - RNA, 64 nt, hsa; identical to SEQ ID NO: 536154

SEQ ID NO: 648090 - RNA, 64 nt, hsa; identical to SEQ ID NO: 536155

SEQ ID NO: 648091 - RNA, 64 nt, hsa; identical to SEQ ID NO: 536156

SEQ ID NO: 648092 - RNA, 64 nt, hsa; identical to SEQ ID NO: 536157

SEQ ID NO: 648093 - RNA, 64 nt, hsa; identical to SEQ ID NO: 536158

SEQ ID NO: 648094 - RNA, 64 nt, hsa; identical to SEQ ID NO: 536159

SEQ ID NO: 648095 - RNA, 64 nt, hsa; identical to SEQ ID NO: 536160

SEQ ID NO: 648096 - RNA, 64 nt, hsa; identical to SEQ ID NO: 536161

SEQ ID NO: 648097 - RNA, 64 nt, hsa; identical to SEQ ID NO: 536162

SEQ ID NO: 648098 - RNA, 64 nt, hsa; identical to SEQ ID NO: 536163

SEQ ID NO: 648099 - RNA, 64 nt, hsa; identical to SEQ ID NO: 536164

SEQ ID NO: 648100 - RNA, 64 nt, hsa; identical to SEQ ID NO: 153305

SEQ ID NO: 648101 - RNA, 64 nt, hsa; identical to SEQ ID NO: 153306

SEQ ID NO: 648102 - RNA, 53 nt, hsa; identical to SEQ ID NO: 153307

SEQ ID NO: 648103 - RNA, 64 nt, hsa; identical to SEQ ID NO: 153308

SEQ ID NO: 648104 - RNA, 64 nt, hsa; identical to SEQ ID NO: 153309

SEQ ID NO: 648105 - RNA, 64 nt, hsa; identical to SEQ ID NO: 153310

SEQ ID NO: 648106 - RNA, 64 nt, hsa; identical to SEQ ID NO: 153311

SEQ ID NO: 648107 - RNA, 64 nt, hsa; identical to SEQ ID NO: 153312

SEQ ID NO: 648108 - RNA, 64 nt, hsa; identical to SEQ ID NO: 153313

SEQ ID NO: 648109 - RNA, 64 nt, hsa; identical to SEQ ID NO: 153314

SEQ ID NO: 648110 - RNA, 64 nt, hsa; identical to SEQ ID NO: 153315

SEQ ID NO: 648111 - RNA, 64 nt, hsa; identical to SEQ ID NO: 153312

SEQ ID NO: 648112 - RNA, 64 nt, hsa; identical to SEQ ID NO: 153317

SEQ ID NO: 648113 - RNA, 64 nt, hsa; identical to SEQ ID NO: 153318

SEQ ID NO: 648114 - RNA, 64 nt, hsa; identical to SEQ ID NO: 153315

SEQ ID NO: 648115 - RNA, 64 nt, hsa; identical to SEQ ID NO: 153320

SEQ ID NO: 648116 - RNA, 64 nt, hsa; identical to SEQ ID NO: 153321

SEQ ID NO: 648117 - RNA, 64 nt, hsa; identical to SEQ ID NO: 153322

SEQ ID NO: 648118 - RNA, 64 nt, hsa; identical to SEQ ID NO: 153323

SEQ ID NO: 648119 - RNA, 64 nt, hsa; identical to SEQ ID NO: 153324

SEQ ID NO: 648120 - RNA, 64 nt, hsa; identical to SEQ ID NO: 153325

SEQ ID NO: 648121 - RNA, 64 nt, hsa; identical to SEQ ID NO: 153326

SEQ ID NO: 648122 - RNA, 64 nt, hsa; identical to SEQ ID NO: 153327

SEQ ID NO: 648123 - RNA, 64 nt, hsa; identical to SEQ ID NO: 153328

SEQ ID NO: 648124 - RNA, 64 nt, hsa; identical to SEQ ID NO: 153329

SEQ ID NO: 648125 - RNA, 64 nt, hsa; identical to SEQ ID NO: 153330

SEQ ID NO: 648126 - RNA, 64 nt, hsa; identical to SEQ ID NO: 153331

SEQ ID NO: 648127 - RNA, 64 nt, hsa; identical to SEQ ID NO: 153332

SEQ ID NO: 648128 - RNA, 64 nt, hsa; identical to SEQ ID NO: 153333

SEQ ID NO: 648129 - RNA, 64 nt, hsa; identical to SEQ ID NO: 153334

SEQ ID NO: 648130 - RNA, 64 nt, hsa; identical to SEQ ID NO: 153335

SEQ ID NO: 648131 - RNA, 64 nt, hsa; identical to SEQ ID NO: 153336

SEQ ID NO: 648132 - RNA, 64 nt, hsa; identical to SEQ ID NO: 153337

SEQ ID NO: 648133 - RNA, 64 nt, hsa; identical to SEQ ID NO: 153338

SEQ ID NO: 648134 - RNA, 64 nt, hsa; identical to SEQ ID NO: 153339

SEQ ID NO: 648135 - RNA, 64 nt, hsa; identical to SEQ ID NO: 153340

SEQ ID NO: 648136 - RNA, 64 nt, hsa; identical to SEQ ID NO: 153341

SEQ ID NO: 648137 - RNA, 64 nt, hsa; identical to SEQ ID NO: 153342

SEQ ID NO: 648138 - RNA, 64 nt, hsa; identical to SEQ ID NO: 153343

SEQ ID NO: 648139 - RNA, 64 nt, hsa; identical to SEQ ID NO: 153344

SEQ ID NO: 648140 - RNA, 64 nt, hsa; identical to SEQ ID NO: 153345

SEQ ID NO: 648141 - RNA, 64 nt, hsa; identical to SEQ ID NO: 153346

SEQ ID NO: 648142 - RNA, 51 nt, hsa; identical to SEQ ID NO: 153347

SEQ ID NO: 648143 - RNA, 64 nt, hsa; identical to SEQ ID NO: 153348

SEQ ID NO: 648144 - RNA, 64 nt, hsa; identical to SEQ ID NO: 153349

SEQ ID NO: 648145 - RNA, 64 nt, hsa; identical to SEQ ID NO: 153350

SEQ ID NO: 648146 - RNA, 64 nt, hsa; identical to SEQ ID NO: 153351

SEQ ID NO: 648147 - RNA, 64 nt, hsa; identical to SEQ ID NO: 153352

SEQ ID NO: 648148 - RNA, 64 nt, hsa; identical to SEQ ID NO: 153353

SEQ ID NO: 648149 - RNA, 64 nt, hsa; identical to SEQ ID NO: 153354

SEQ ID NO: 648150 - RNA, 64 nt, hsa; identical to SEQ ID NO: 153355

SEQ ID NO: 648151 - RNA, 64 nt, hsa; identical to SEQ ID NO: 153356

SEQ ID NO: 648152 - RNA, 64 nt, hsa; identical to SEQ ID NO: 153357

SEQ ID NO: 648153 - RNA, 64 nt, hsa; identical to SEQ ID NO: 153358

SEQ ID NO: 648154 - RNA, 64 nt, hsa; identical to SEQ ID NO: 153359

SEQ ID NO: 648155 - RNA, 64 nt, hsa; identical to SEQ ID NO: 307734

SEQ ID NO: 648156 - RNA, 64 nt, hsa; identical to SEQ ID NO: 307735

SEQ ID NO: 648157 - RNA, 64 nt, hsa; identical to SEQ ID NO: 307736

SEQ ID NO: 648158 - RNA, 64 nt, hsa; identical to SEQ ID NO: 307737

SEQ ID NO: 648159 - RNA, 64 nt, hsa; identical to SEQ ID NO: 307738

SEQ ID NO: 648160 - RNA, 64 nt, hsa; identical to SEQ ID NO: 307739

SEQ ID NO: 648161 - RNA, 64 nt, hsa; identical to SEQ ID NO: 307740

SEQ ID NO: 648162 - RNA, 64 nt, hsa; identical to SEQ ID NO: 307741

SEQ ID NO: 648163 - RNA, 59 nt, hsa; identical to SEQ ID NO: 307742

SEQ ID NO: 648164 - RNA, 64 nt, hsa; identical to SEQ ID NO: 307743

SEQ ID NO: 648165 - RNA, 64 nt, hsa; identical to SEQ ID NO: 307744

SEQ ID NO: 648166 - RNA, 64 nt, hsa; identical to SEQ ID NO: 307745

SEQ ID NO: 648167 - RNA, 64 nt, hsa; identical to SEQ ID NO: 307746

SEQ ID NO: 648168 - RNA, 64 nt, hsa; identical to SEQ ID NO: 307747

SEQ ID NO: 648169 - RNA, 64 nt, hsa; identical to SEQ ID NO: 307748

SEQ ID NO: 648170 - RNA, 64 nt, hsa; identical to SEQ ID NO: 307749

SEQ ID NO: 648171 - RNA, 64 nt, hsa; identical to SEQ ID NO: 307750

SEQ ID NO: 648172 - RNA, 64 nt, hsa; identical to SEQ ID NO: 307751

SEQ ID NO: 648173 - RNA, 64 nt, hsa; identical to SEQ ID NO: 307752

SEQ ID NO: 648174 - RNA, 64 nt, hsa; identical to SEQ ID NO: 307753

SEQ ID NO: 648175 - RNA, 64 nt, hsa; identical to SEQ ID NO: 307754

SEQ ID NO: 648176 - RNA, 64 nt, hsa; identical to SEQ ID NO: 307755

SEQ ID NO: 648177 - RNA, 64 nt, hsa; identical to SEQ ID NO: 307756

SEQ ID NO: 648178 - RNA, 64 nt, hsa; identical to SEQ ID NO: 307757

SEQ ID NO: 648179 - RNA, 64 nt, hsa; identical to SEQ ID NO: 307758

SEQ ID NO: 648180 - RNA, 64 nt, hsa; identical to SEQ ID NO: 307759

SEQ ID NO: 648181 - RNA, 64 nt, hsa; identical to SEQ ID NO: 307760

SEQ ID NO: 648182 - RNA, 64 nt, hsa; identical to SEQ ID NO: 307761

SEQ ID NO: 648183 - RNA, 64 nt, hsa; identical to SEQ ID NO: 307762

SEQ ID NO: 648184 - RNA, 64 nt, hsa; identical to SEQ ID NO: 307763

SEQ ID NO: 648185 - RNA, 64 nt, hsa; identical to SEQ ID NO: 307764

SEQ ID NO: 648186 - RNA, 64 nt, hsa; identical to SEQ ID NO: 307765

SEQ ID NO: 648187 - RNA, 64 nt, hsa; identical to SEQ ID NO: 307766

SEQ ID NO: 648188 - RNA, 64 nt, hsa; identical to SEQ ID NO: 307767

SEQ ID NO: 648189 - RNA, 64 nt, hsa; identical to SEQ ID NO: 307768

SEQ ID NO: 648190 - RNA, 64 nt, hsa; identical to SEQ ID NO: 307769

SEQ ID NO: 648191 - RNA, 64 nt, hsa; identical to SEQ ID NO: 307770

SEQ ID NO: 648192 - RNA, 64 nt, hsa; identical to SEQ ID NO: 307771

SEQ ID NO: 648193 - RNA, 64 nt, hsa; identical to SEQ ID NO: 307772

SEQ ID NO: 648194 - RNA, 64 nt, hsa; identical to SEQ ID NO: 307773

SEQ ID NO: 648195 - RNA, 64 nt, hsa; identical to SEQ ID NO: 307774

SEQ ID NO: 648196 - RNA, 64 nt, hsa; identical to SEQ ID NO: 307775

SEQ ID NO: 648197 - RNA, 64 nt, hsa; identical to SEQ ID NO: 307776

SEQ ID NO: 648198 - RNA, 64 nt, hsa; identical to SEQ ID NO: 307777

SEQ ID NO: 648199 - RNA, 64 nt, hsa; identical to SEQ ID NO: 307778

SEQ ID NO: 648200 - RNA, 64 nt, hsa; identical to SEQ ID NO: 307779

SEQ ID NO: 648201 - RNA, 64 nt, hsa; identical to SEQ ID NO: 307780

SEQ ID NO: 648202 - RNA, 64 nt, hsa; identical to SEQ ID NO: 307781

SEQ ID NO: 648203 - RNA, 64 nt, hsa; identical to SEQ ID NO: 307782

SEQ ID NO: 648204 - RNA, 64 nt, hsa; identical to SEQ ID NO: 307783

SEQ ID NO: 648205 - RNA, 64 nt, hsa; identical to SEQ ID NO: 307784

SEQ ID NO: 648206 - RNA, 64 nt, hsa; identical to SEQ ID NO: 307785

SEQ ID NO: 648207 - RNA, 64 nt, hsa; identical to SEQ ID NO: 307786

SEQ ID NO: 648208 - RNA, 64 nt, hsa; identical to SEQ ID NO: 307787

SEQ ID NO: 648209 - RNA, 64 nt, hsa; identical to SEQ ID NO: 307788

SEQ ID NO: 648210 - RNA, 64 nt, hsa; identical to SEQ ID NO: 307789

SEQ ID NO: 648211 - RNA, 64 nt, hsa; identical to SEQ ID NO: 307790

SEQ ID NO: 648212 - RNA, 64 nt, hsa; identical to SEQ ID NO: 307791

SEQ ID NO: 648213 - RNA, 64 nt, hsa; identical to SEQ ID NO: 307792

SEQ ID NO: 648214 - RNA, 64 nt, hsa; identical to SEQ ID NO: 307793

SEQ ID NO: 648215 - RNA, 64 nt, hsa; identical to SEQ ID NO: 307794

SEQ ID NO: 648216 - RNA, 64 nt, hsa; identical to SEQ ID NO: 307795

SEQ ID NO: 648217 - RNA, 64 nt, hsa; identical to SEQ ID NO: 307796

SEQ ID NO: 648218 - RNA, 62 nt, hsa; identical to SEQ ID NO: 307797

SEQ ID NO: 648219 - RNA, 64 nt, hsa; identical to SEQ ID NO: 307798

SEQ ID NO: 648220 - RNA, 64 nt, hsa; identical to SEQ ID NO: 307799

SEQ ID NO: 648221 - RNA, 64 nt, hsa; identical to SEQ ID NO: 307800

SEQ ID NO: 648222 - RNA, 64 nt, hsa; identical to SEQ ID NO: 307801

SEQ ID NO: 648223 - RNA, 64 nt, hsa; identical to SEQ ID NO: 307802

SEQ ID NO: 648224 - RNA, 64 nt, hsa; identical to SEQ ID NO: 307803

SEQ ID NO: 648225 - RNA, 64 nt, hsa; identical to SEQ ID NO: 307804

SEQ ID NO: 648226 - RNA, 64 nt, hsa; identical to SEQ ID NO: 307805

SEQ ID NO: 648227 - RNA, 64 nt, hsa; identical to SEQ ID NO: 307806

SEQ ID NO: 648228 - RNA, 64 nt, hsa; identical to SEQ ID NO: 307807

SEQ ID NO: 648229 - RNA, 64 nt, hsa; identical to SEQ ID NO: 307808

SEQ ID NO: 648230 - RNA, 64 nt, hsa; identical to SEQ ID NO: 307809

SEQ ID NO: 648231 - RNA, 64 nt, hsa; identical to SEQ ID NO: 433812

SEQ ID NO: 648232 - RNA, 64 nt, hsa; identical to SEQ ID NO: 433813

SEQ ID NO: 648233 - RNA, 64 nt, hsa; identical to SEQ ID NO: 433814

SEQ ID NO: 648234 - RNA, 64 nt, hsa; identical to SEQ ID NO: 433815

SEQ ID NO: 648235 - RNA, 64 nt, hsa; identical to SEQ ID NO: 433816

SEQ ID NO: 648236 - RNA, 64 nt, hsa; identical to SEQ ID NO: 433817

SEQ ID NO: 648237 - RNA, 64 nt, hsa; identical to SEQ ID NO: 433818

SEQ ID NO: 648238 - RNA, 64 nt, hsa; identical to SEQ ID NO: 433819

SEQ ID NO: 648239 - RNA, 64 nt, hsa; identical to SEQ ID NO: 433820

SEQ ID NO: 648240 - RNA, 64 nt, hsa; identical to SEQ ID NO: 433821

SEQ ID NO: 648241 - RNA, 64 nt, hsa; identical to SEQ ID NO: 433822

SEQ ID NO: 648242 - RNA, 64 nt, hsa; identical to SEQ ID NO: 433823

SEQ ID NO: 648243 - RNA, 64 nt, hsa; identical to SEQ ID NO: 433824

SEQ ID NO: 648244 - RNA, 64 nt, hsa; identical to SEQ ID NO: 433825

SEQ ID NO: 648245 - RNA, 64 nt, hsa; identical to SEQ ID NO: 433826

SEQ ID NO: 648246 - RNA, 64 nt, hsa; identical to SEQ ID NO: 433827

SEQ ID NO: 648247 - RNA, 64 nt, hsa; identical to SEQ ID NO: 433828

SEQ ID NO: 648248 - RNA, 64 nt, hsa; identical to SEQ ID NO: 433829

SEQ ID NO: 648249 - RNA, 64 nt, hsa; identical to SEQ ID NO: 433830

SEQ ID NO: 648250 - RNA, 64 nt, hsa; identical to SEQ ID NO: 433831

SEQ ID NO: 648251 - RNA, 64 nt, hsa; identical to SEQ ID NO: 433832

SEQ ID NO: 648252 - RNA, 64 nt, hsa; identical to SEQ ID NO: 433833

SEQ ID NO: 648253 - RNA, 64 nt, hsa; identical to SEQ ID NO: 433834

SEQ ID NO: 648254 - RNA, 64 nt, hsa; identical to SEQ ID NO: 433835

SEQ ID NO: 648255 - RNA, 64 nt, hsa; identical to SEQ ID NO: 433836

SEQ ID NO: 648256 - RNA, 64 nt, hsa; identical to SEQ ID NO: 433837

SEQ ID NO: 648257 - RNA, 64 nt, hsa; identical to SEQ ID NO: 433838

SEQ ID NO: 648258 - RNA, 64 nt, hsa; identical to SEQ ID NO: 433839

SEQ ID NO: 648259 - RNA, 64 nt, hsa; identical to SEQ ID NO: 433840

SEQ ID NO: 648260 - RNA, 64 nt, hsa; identical to SEQ ID NO: 433841

SEQ ID NO: 648261 - RNA, 64 nt, hsa; identical to SEQ ID NO: 433842

SEQ ID NO: 648262 - RNA, 64 nt, hsa; identical to SEQ ID NO: 433843

SEQ ID NO: 648263 - RNA, 64 nt, hsa; identical to SEQ ID NO: 433844

SEQ ID NO: 648264 - RNA, 64 nt, hsa; identical to SEQ ID NO: 433845

SEQ ID NO: 648265 - RNA, 64 nt, hsa; identical to SEQ ID NO: 433846

SEQ ID NO: 648266 - RNA, 64 nt, hsa; identical to SEQ ID NO: 433847

SEQ ID NO: 648267 - RNA, 64 nt, hsa; identical to SEQ ID NO: 433848

SEQ ID NO: 648268 - RNA, 64 nt, hsa; identical to SEQ ID NO: 433849

SEQ ID NO: 648269 - RNA, 64 nt, hsa; identical to SEQ ID NO: 433850

SEQ ID NO: 648270 - RNA, 64 nt, hsa; identical to SEQ ID NO: 433851

SEQ ID NO: 648271 - RNA, 64 nt, hsa; identical to SEQ ID NO: 433852

SEQ ID NO: 648272 - RNA, 64 nt, hsa; identical to SEQ ID NO: 433853

SEQ ID NO: 648273 - RNA, 64 nt, hsa; identical to SEQ ID NO: 433854

SEQ ID NO: 648274 - RNA, 64 nt, hsa; identical to SEQ ID NO: 433855

SEQ ID NO: 648275 - RNA, 64 nt, hsa; identical to SEQ ID NO: 433856

SEQ ID NO: 648276 - RNA, 64 nt, hsa; identical to SEQ ID NO: 433857

SEQ ID NO: 648277 - RNA, 64 nt, hsa; identical to SEQ ID NO: 433858

SEQ ID NO: 648278 - RNA, 64 nt, hsa; identical to SEQ ID NO: 433859

SEQ ID NO: 648279 - RNA, 64 nt, hsa; identical to SEQ ID NO: 433860

SEQ ID NO: 648280 - RNA, 64 nt, hsa
cuagucaauacuacuuuauguaaacagcaguguaaaauccaaaaacuuccaguccuggaggcag

SEQ ID NO: 648281 - RNA, 64 nt, hsa
acucacauuacagcugaugugaaagagauucuggaaauccaaauguuccccagaaauucugaua

SEQ ID NO: 648282 - RNA, 64 nt, hsa
aagguaaaaucugauuauuuagcaugagaaaaaaaaauccaacucugcuuuuggucuugcuucu

SEQ ID NO: 648283 - RNA, 64 nt, hsa
cccucauucccgcugaccucacuggcccacuggcaaauccaaccagcaaccagaaauguucuag

SEQ ID NO: 648284 - RNA, 64 nt, hsa
gcauuauauuuagcgguugaguauccaaauccaaaaauccaaaauucaaaaugcuccaauaagc

SEQ ID NO: 648285 - RNA, 64 nt, hsa
gaauauuugcauuauauuuagcgguugaguauccaaauccaaaaauccaaaauucaaaaugcuc

SEQ ID NO: 648286 - RNA, 64 nt, hsa
acccuuuacucucucauacagccagaaauguuagaaauccaaaaucuuggugcauuauuuuuuc

SEQ ID NO: 648287 - RNA, 64 nt, hsa
agaauucuuaugaguuuaaaauuuguaaauuucuaaauccaaucauguaaaaugaaacuguugc

SEQ ID NO: 648288 - RNA, 64 nt, hsa
aaaauuuauuuggcucacaguucuggaaccugggaaauccaaaggcaugaugcuagcaucuggu

SEQ ID NO: 648289 - RNA, 64 nt, hsa
cuauuucugauuauuaagacuaguauaaaugagaaaauccaagcuauuaaguaccauuagcuac

SEQ ID NO: 648290 - RNA, 64 nt, hsa
caaaacaaauccugcauuuagauacaccucaacuaaauccaaaguccccauucaguauauucca

SEQ ID NO: 648291 - RNA, 64 nt, hsa
caugaguuccuagagaacuguccaaggguugggaaaauccaaauucucuuccugguuccagcac

SEQ ID NO: 648292 - RNA, 64 nt, hsa
acaagacauacaacauaacaaaaaguguugcuguaaauccaaaagaaauugcaucuaagggacu

SEQ ID NO: 648293 - RNA, 64 nt, hsa
uuucuucagugggccauuguuuuagauauuuaaaaaauccaacaguuucuaucauaauguaacu

SEQ ID NO: 648294 - RNA, 64 nt, hsa
uccguuguuaaaaagcaaacaaaaaaccaacaaaaaauccaagugugccuugaauuguacagag

SEQ ID NO: 648295 - RNA, 64 nt, hsa
uaaugcugacugaauuucagugaaauuaaaucaaaaauccaaaguaagauuguucugaaauaca

SEQ ID NO: 648296 - RNA, 64 nt, hsa
acuguguuugacaugagauaguuuaaguuccacaaaauccaaauuuaccauauuauuguuuuua

SEQ ID NO: 648297 - RNA, 64 nt, hsa
guagccuguuucuaacacaacugucauaauccugaaauccaaaauugcacuguguuugacauga

SEQ ID NO: 648298 - RNA, 64 nt, hsa
ugagugaggguuauuauuuguauuugaugaaagaaaauccaaauaaagcccaccuagaaauaga

SEQ ID NO: 648299 - RNA, 64 nt, hsa
gcaaaugauaagcuauucuaguagccuuuaguuuaaauccaacagaaaucuagaagucacaagc

SEQ ID NO: 648300 - RNA, 64 nt, hsa
uaugcgacaugcccugccugaacaggugcucaauaaauccaaguuuccuucucuugaguuccuc

SEQ ID NO: 648301 - RNA, 64 nt, hsa
uuguuuuauuuucuugagagaccucaaaauuauuaaauccaacagacgcugccggucggucaga

SEQ ID NO: 648302 - RNA, 64 nt, hsa
ccacuuuaggaaacuagaaaaagaagagcaaauuaaauccaaaguaaccugaaaaaacauuaga

SEQ ID NO: 648303 - RNA, 64 nt, hsa
aucauaucaauagguacagaaaaagcauuugacaaaauccaauauccauucauguuaaaaccuc

SEQ ID NO: 648304 - RNA, 64 nt, hsa
ugagacccaaaggaagaacuggauaaaaucuuccaaauccaaaagcaugagauuuuucuaucca

SEQ ID NO: 648305 - RNA, 64 nt, hsa
cuccccuuuguggauucuuuuuggaaacugagcgaaauccaagaugcuggcaccaagcguauuc

SEQ ID NO: 648306 - RNA, 64 nt, hsa
aucauaucaauagguacagaaaaagcauuugacaaaauccaauauccauucaugauaaaaccuc

SEQ ID NO: 648307 - RNA, 64 nt, hsa
ccacuuuggaaaacuagaaaaagaagagcaaauuaaauccaaaguaaccuggaaaaaaauuaga

SEQ ID NO: 648308 - RNA, 64 nt, hsa
accugugcaauauuuucccauggaaugcagcaguaaauccaaguagguauauccgugcucagag

SEQ ID NO: 648309 - RNA, 64 nt, hsa
caucacuuaauuacuuacucaaauucaaugaaucaaauccaauccaaucagugagaagaauagc

SEQ ID NO: 648310 - RNA, 64 nt, hsa
aauauacaauuucuugaacucaggacuagccugaaaauccaaaaugcauguagaguugacaugu

SEQ ID NO: 648311 - RNA, 64 nt, hsa
ccaucuaaauugacucuuccaauauaggucucagaaauccaauauuuggaguacaauuucuuuu

SEQ ID NO: 648312 - RNA, 64 nt, hsa
cuaaucugaacaguuaaaacccccaaaugccccaaaauccaaaccuuccugaacgcuaugacac

SEQ ID NO: 648313 - RNA, 64 nt, hsa
ucaacaagacacaagcaaaaauccagcaaugcucaaauccaaaagcacucggcaggacauuucu

SEQ ID NO: 648314 - RNA, 64 nt, hsa
aaaaaaaaaaaaaaaaaaagaaaaaagaaaaaaaaaauccaaaagagagaagaguuuuugcauu

SEQ ID NO: 648315 - RNA, 64 nt, hsa
aaaggaaauccaaaaaagcaaacacaagaaaucaaaauccaaaauuuguuugucacugccaaag

SEQ ID NO: 648316 - RNA, 64 nt, hsa
gccaaggauaccggacacaccucugcuccaaaggaaauccaaaaaagcaaacacaagaaaucaa

SEQ ID NO: 648317 - RNA, 64 nt, hsa
uuccuguaauguuaaacucuuuggcuuuaaguaaaaauccaaaaaguuuuuuuaaaaaagcaaa

SEQ ID NO: 648318 - RNA, 64 nt, hsa
agacuagccaaaaaugccguggcaaagagcucagaaauccaauuuggauaccaaagguuucuca

SEQ ID NO: 648319 - RNA, 64 nt, hsa
gguggggaaggaggugaugaaacauuaguuugugaaauccaaggcccuggcuugcuuucuuucu

SEQ ID NO: 648320 - RNA, 64 nt, hsa
uuuagcuuucuacuuuauaucauauacaaaaauaaaauccaacuaaagaccagaauauaaaaag

SEQ ID NO: 648321 - RNA, 64 nt, hsa
ucaagcaguaguaagauagugagcauucauacaaaaauccaagaagauacaggaauucugugua

SEQ ID NO: 648322 - RNA, 64 nt, hsa
caauaagccacugguaucugggggacuagaacacaaauccaacgcuuuucccaccucuuuggau

SEQ ID NO: 648323 - RNA, 64 nt, hsa
aaauaguguggagugaggcggggagcaugaagauaaauccaacucugacuguaaaauacauggu

SEQ ID NO: 648324 - RNA, 64 nt, hsa; identical to SEQ ID NO: 154556

SEQ ID NO: 648325 - RNA, 64 nt, hsa; identical to SEQ ID NO: 154557

SEQ ID NO: 648326 - RNA, 64 nt, hsa; identical to SEQ ID NO: 154558

SEQ ID NO: 648327 - RNA, 64 nt, hsa; identical to SEQ ID NO: 154559

SEQ ID NO: 648328 - RNA, 64 nt, hsa; identical to SEQ ID NO: 154560

SEQ ID NO: 648329 - RNA, 64 nt, hsa; identical to SEQ ID NO: 154561

SEQ ID NO: 648330 - RNA, 64 nt, hsa; identical to SEQ ID NO: 154562

SEQ ID NO: 648331 - RNA, 64 nt, hsa; identical to SEQ ID NO: 154563

SEQ ID NO: 648332 - RNA, 64 nt, hsa; identical to SEQ ID NO: 154564

SEQ ID NO: 648333 - RNA, 64 nt, hsa; identical to SEQ ID NO: 154565

SEQ ID NO: 648334 - RNA, 64 nt, hsa; identical to SEQ ID NO: 154566

SEQ ID NO: 648335 - RNA, 64 nt, hsa; identical to SEQ ID NO: 154567

SEQ ID NO: 648336 - RNA, 64 nt, hsa; identical to SEQ ID NO: 154568

SEQ ID NO: 648337 - RNA, 64 nt, hsa; identical to SEQ ID NO: 154569

SEQ ID NO: 648338 - RNA, 64 nt, hsa; identical to SEQ ID NO: 154570

SEQ ID NO: 648339 - RNA, 64 nt, hsa; identical to SEQ ID NO: 154571

SEQ ID NO: 648340 - RNA, 64 nt, hsa; identical to SEQ ID NO: 154572

SEQ ID NO: 648341 - RNA, 64 nt, hsa; identical to SEQ ID NO: 154573

SEQ ID NO: 648342 - RNA, 64 nt, hsa; identical to SEQ ID NO: 154574

SEQ ID NO: 648343 - RNA, 64 nt, hsa; identical to SEQ ID NO: 154575

SEQ ID NO: 648344 - RNA, 64 nt, hsa; identical to SEQ ID NO: 154576

SEQ ID NO: 648345 - RNA, 64 nt, hsa; identical to SEQ ID NO: 154577

SEQ ID NO: 648346 - RNA, 64 nt, hsa; identical to SEQ ID NO: 154578

SEQ ID NO: 648347 - RNA, 64 nt, hsa; identical to SEQ ID NO: 154579

SEQ ID NO: 648348 - RNA, 64 nt, hsa; identical to SEQ ID NO: 154580

SEQ ID NO: 648349 - RNA, 64 nt, hsa; identical to SEQ ID NO: 154581

SEQ ID NO: 648350 - RNA, 64 nt, hsa; identical to SEQ ID NO: 179620

SEQ ID NO: 648351 - RNA, 64 nt, hsa; identical to SEQ ID NO: 179621

SEQ ID NO: 648352 - RNA, 64 nt, hsa; identical to SEQ ID NO: 179622

SEQ ID NO: 648353 - RNA, 64 nt, hsa; identical to SEQ ID NO: 179623

SEQ ID NO: 648354 - RNA, 64 nt, hsa; identical to SEQ ID NO: 179624

SEQ ID NO: 648355 - RNA, 64 nt, hsa; identical to SEQ ID NO: 179625

SEQ ID NO: 648356 - RNA, 64 nt, hsa; identical to SEQ ID NO: 179626

SEQ ID NO: 648357 - RNA, 64 nt, hsa; identical to SEQ ID NO: 179627

SEQ ID NO: 648358 - RNA, 64 nt, hsa; identical to SEQ ID NO: 441009

SEQ ID NO: 648359 - RNA, 64 nt, hsa; identical to SEQ ID NO: 441010

SEQ ID NO: 648360 - RNA, 64 nt, hsa; identical to SEQ ID NO: 441011

SEQ ID NO: 648361 - RNA, 64 nt, hsa; identical to SEQ ID NO: 441012

SEQ ID NO: 648362 - RNA, 64 nt, hsa; identical to SEQ ID NO: 441013

SEQ ID NO: 648363 - RNA, 64 nt, hsa; identical to SEQ ID NO: 441014

SEQ ID NO: 648364 - RNA, 64 nt, hsa; identical to SEQ ID NO: 441015

SEQ ID NO: 648365 - RNA, 64 nt, hsa; identical to SEQ ID NO: 243972

SEQ ID NO: 648366 - RNA, 64 nt, hsa; identical to SEQ ID NO: 243973

SEQ ID NO: 648367 - RNA, 64 nt, hsa; identical to SEQ ID NO: 243974

SEQ ID NO: 648368 - RNA, 64 nt, hsa; identical to SEQ ID NO: 243975

SEQ ID NO: 648369 - RNA, 64 nt, hsa; identical to SEQ ID NO: 243976

SEQ ID NO: 648370 - RNA, 64 nt, hsa; identical to SEQ ID NO: 243977

SEQ ID NO: 648371 - RNA, 64 nt, hsa; identical to SEQ ID NO: 243978

SEQ ID NO: 648372 - RNA, 64 nt, hsa; identical to SEQ ID NO: 243979

SEQ ID NO: 648373 - RNA, 64 nt, hsa; identical to SEQ ID NO: 243980

SEQ ID NO: 648374 - RNA, 64 nt, hsa; identical to SEQ ID NO: 243981

SEQ ID NO: 648375 - RNA, 64 nt, hsa; identical to SEQ ID NO: 243982

SEQ ID NO: 648376 - RNA, 64 nt, hsa; identical to SEQ ID NO: 243983

SEQ ID NO: 648377 - RNA, 64 nt, hsa; identical to SEQ ID NO: 243984

SEQ ID NO: 648378 - RNA, 64 nt, hsa; identical to SEQ ID NO: 243985

SEQ ID NO: 648379 - RNA, 64 nt, hsa; identical to SEQ ID NO: 243986

SEQ ID NO: 648380 - RNA, 64 nt, hsa; identical to SEQ ID NO: 243987

SEQ ID NO: 648381 - RNA, 64 nt, hsa; identical to SEQ ID NO: 243988

SEQ ID NO: 648382 - RNA, 64 nt, hsa; identical to SEQ ID NO: 243989

SEQ ID NO: 648383 - RNA, 64 nt, hsa; identical to SEQ ID NO: 486961

SEQ ID NO: 648384 - RNA, 64 nt, hsa; identical to SEQ ID NO: 486962

SEQ ID NO: 648385 - RNA, 64 nt, hsa; identical to SEQ ID NO: 486963

SEQ ID NO: 648386 - RNA, 64 nt, hsa; identical to SEQ ID NO: 486964

SEQ ID NO: 648387 - RNA, 64 nt, hsa; identical to SEQ ID NO: 486965

SEQ ID NO: 648388 - RNA, 64 nt, hsa; identical to SEQ ID NO: 486966

SEQ ID NO: 648389 - RNA, 64 nt, hsa; identical to SEQ ID NO: 486967

SEQ ID NO: 648390 - RNA, 64 nt, hsa; identical to SEQ ID NO: 486968

SEQ ID NO: 648391 - RNA, 64 nt, hsa; identical to SEQ ID NO: 486969

SEQ ID NO: 648392 - RNA, 64 nt, hsa; identical to SEQ ID NO: 486970

SEQ ID NO: 648393 - RNA, 64 nt, hsa; identical to SEQ ID NO: 486971

SEQ ID NO: 648394 - RNA, 64 nt, hsa; identical to SEQ ID NO: 486972

SEQ ID NO: 648395 - RNA, 64 nt, hsa; identical to SEQ ID NO: 486973

SEQ ID NO: 648396 - RNA, 64 nt, hsa; identical to SEQ ID NO: 486974

SEQ ID NO: 648397 - RNA, 64 nt, hsa; identical to SEQ ID NO: 486975

SEQ ID NO: 648398 - RNA, 64 nt, hsa; identical to SEQ ID NO: 486976

SEQ ID NO: 648399 - RNA, 64 nt, hsa; identical to SEQ ID NO: 486977

SEQ ID NO: 648400 - RNA, 64 nt, hsa; identical to SEQ ID NO: 486978

SEQ ID NO: 648401 - RNA, 64 nt, hsa; identical to SEQ ID NO: 486979

SEQ ID NO: 648402 - RNA, 64 nt, hsa; identical to SEQ ID NO: 486980

SEQ ID NO: 648403 - RNA, 64 nt, hsa; identical to SEQ ID NO: 486981

SEQ ID NO: 648404 - RNA, 64 nt, hsa; identical to SEQ ID NO: 486982

SEQ ID NO: 648405 - RNA, 64 nt, hsa; identical to SEQ ID NO: 486983

SEQ ID NO: 648406 - RNA, 64 nt, hsa; identical to SEQ ID NO: 486984

SEQ ID NO: 648407 - RNA, 64 nt, hsa; identical to SEQ ID NO: 486985

SEQ ID NO: 648408 - RNA, 64 nt, hsa; identical to SEQ ID NO: 486986

SEQ ID NO: 648409 - RNA, 64 nt, hsa; identical to SEQ ID NO: 486987

SEQ ID NO: 648410 - RNA, 64 nt, hsa; identical to SEQ ID NO: 486988

SEQ ID NO: 648411 - RNA, 64 nt, hsa; identical to SEQ ID NO: 486989

SEQ ID NO: 648412 - RNA, 64 nt, hsa; identical to SEQ ID NO: 486990

SEQ ID NO: 648413 - RNA, 64 nt, hsa; identical to SEQ ID NO: 486991

SEQ ID NO: 648414 - RNA, 64 nt, hsa; identical to SEQ ID NO: 486992

SEQ ID NO: 648415 - RNA, 64 nt, hsa; identical to SEQ ID NO: 486993

SEQ ID NO: 648416 - RNA, 64 nt, hsa; identical to SEQ ID NO: 486994

SEQ ID NO: 648417 - RNA, 64 nt, hsa; identical to SEQ ID NO: 486995

SEQ ID NO: 648418 - RNA, 64 nt, hsa; identical to SEQ ID NO: 486996

SEQ ID NO: 648419 - RNA, 64 nt, hsa; identical to SEQ ID NO: 486997

SEQ ID NO: 648420 - RNA, 64 nt, hsa; identical to SEQ ID NO: 486998

SEQ ID NO: 648421 - RNA, 64 nt, hsa; identical to SEQ ID NO: 486999

SEQ ID NO: 648422 - RNA, 64 nt, hsa; identical to SEQ ID NO: 487000

SEQ ID NO: 648423 - RNA, 64 nt, hsa; identical to SEQ ID NO: 487001

SEQ ID NO: 648424 - RNA, 64 nt, hsa; identical to SEQ ID NO: 487002

SEQ ID NO: 648425 - RNA, 64 nt, hsa; identical to SEQ ID NO: 487003

SEQ ID NO: 648426 - RNA, 64 nt, hsa; identical to SEQ ID NO: 487004

SEQ ID NO: 648427 - RNA, 64 nt, hsa; identical to SEQ ID NO: 487005

SEQ ID NO: 648428 - RNA, 64 nt, hsa; identical to SEQ ID NO: 487006

SEQ ID NO: 648429 - RNA, 64 nt, hsa; identical to SEQ ID NO: 487007

SEQ ID NO: 648430 - RNA, 64 nt, hsa; identical to SEQ ID NO: 487008

SEQ ID NO: 648431 - RNA, 64 nt, hsa; identical to SEQ ID NO: 487009

SEQ ID NO: 648432 - RNA, 64 nt, hsa; identical to SEQ ID NO: 487010

SEQ ID NO: 648433 - RNA, 64 nt, hsa; identical to SEQ ID NO: 487011

SEQ ID NO: 648434 - RNA, 64 nt, hsa; identical to SEQ ID NO: 487012

SEQ ID NO: 648435 - RNA, 64 nt, hsa; identical to SEQ ID NO: 487013

SEQ ID NO: 648436 - RNA, 64 nt, hsa; identical to SEQ ID NO: 487014

SEQ ID NO: 648437 - RNA, 64 nt, hsa; identical to SEQ ID NO: 487015

SEQ ID NO: 648438 - RNA, 64 nt, hsa; identical to SEQ ID NO: 487016

SEQ ID NO: 648439 - RNA, 64 nt, hsa; identical to SEQ ID NO: 487017

SEQ ID NO: 648440 - RNA, 64 nt, hsa; identical to SEQ ID NO: 487018

SEQ ID NO: 648441 - RNA, 64 nt, hsa; identical to SEQ ID NO: 487019

SEQ ID NO: 648442 - RNA, 64 nt, hsa; identical to SEQ ID NO: 487020

SEQ ID NO: 648443 - RNA, 64 nt, hsa; identical to SEQ ID NO: 487021

SEQ ID NO: 648444 - RNA, 64 nt, hsa; identical to SEQ ID NO: 487022

SEQ ID NO: 648445 - RNA, 64 nt, hsa; identical to SEQ ID NO: 487023

SEQ ID NO: 648446 - RNA, 64 nt, hsa; identical to SEQ ID NO: 487024

SEQ ID NO: 648447 - RNA, 64 nt, hsa; identical to SEQ ID NO: 487025

SEQ ID NO: 648448 - RNA, 64 nt, hsa; identical to SEQ ID NO: 487026

SEQ ID NO: 648449 - RNA, 64 nt, hsa; identical to SEQ ID NO: 487027

SEQ ID NO: 648450 - RNA, 64 nt, hsa; identical to SEQ ID NO: 487028

SEQ ID NO: 648451 - RNA, 64 nt, hsa; identical to SEQ ID NO: 487029

SEQ ID NO: 648452 - RNA, 64 nt, hsa; identical to SEQ ID NO: 487030

SEQ ID NO: 648453 - RNA, 64 nt, hsa; identical to SEQ ID NO: 487031

SEQ ID NO: 648454 - RNA, 64 nt, hsa; identical to SEQ ID NO: 487032

SEQ ID NO: 648455 - RNA, 64 nt, hsa; identical to SEQ ID NO: 487033

SEQ ID NO: 648456 - RNA, 64 nt, hsa; identical to SEQ ID NO: 487034

SEQ ID NO: 648457 - RNA, 64 nt, hsa; identical to SEQ ID NO: 487035

SEQ ID NO: 648458 - RNA, 64 nt, hsa; identical to SEQ ID NO: 487036

SEQ ID NO: 648459 - RNA, 64 nt, hsa; identical to SEQ ID NO: 487037

SEQ ID NO: 648460 - RNA, 64 nt, hsa; identical to SEQ ID NO: 487038

SEQ ID NO: 648461 - RNA, 64 nt, hsa; identical to SEQ ID NO: 487039

SEQ ID NO: 648462 - RNA, 64 nt, hsa; identical to SEQ ID NO: 487040

SEQ ID NO: 648463 - RNA, 64 nt, hsa; identical to SEQ ID NO: 487041

SEQ ID NO: 648464 - RNA, 64 nt, hsa; identical to SEQ ID NO: 487042

SEQ ID NO: 648465 - RNA, 64 nt, hsa; identical to SEQ ID NO: 487043

SEQ ID NO: 648466 - RNA, 64 nt, hsa; identical to SEQ ID NO: 487044

SEQ ID NO: 648467 - RNA, 64 nt, hsa; identical to SEQ ID NO: 487045

SEQ ID NO: 648468 - RNA, 64 nt, hsa; identical to SEQ ID NO: 487046

SEQ ID NO: 648469 - RNA, 64 nt, hsa; identical to SEQ ID NO: 487047

SEQ ID NO: 648470 - RNA, 64 nt, hsa; identical to SEQ ID NO: 487048

SEQ ID NO: 648471 - RNA, 64 nt, hsa; identical to SEQ ID NO: 487049

SEQ ID NO: 648472 - RNA, 64 nt, hsa; identical to SEQ ID NO: 487050

SEQ ID NO: 648473 - RNA, 64 nt, hsa; identical to SEQ ID NO: 487051

SEQ ID NO: 648474 - RNA, 64 nt, hsa; identical to SEQ ID NO: 487052

SEQ ID NO: 648475 - RNA, 64 nt, hsa; identical to SEQ ID NO: 487053

SEQ ID NO: 648476 - RNA, 64 nt, hsa; identical to SEQ ID NO: 487054

SEQ ID NO: 648477 - RNA, 64 nt, hsa; identical to SEQ ID NO: 487055

SEQ ID NO: 648478 - RNA, 64 nt, hsa; identical to SEQ ID NO: 487056

SEQ ID NO: 648479 - RNA, 64 nt, hsa; identical to SEQ ID NO: 487057

SEQ ID NO: 648480 - RNA, 64 nt, hsa; identical to SEQ ID NO: 487058

SEQ ID NO: 648481 - RNA, 64 nt, hsa; identical to SEQ ID NO: 487059

SEQ ID NO: 648482 - RNA, 64 nt, hsa; identical to SEQ ID NO: 487060

SEQ ID NO: 648483 - RNA, 62 nt, hsa; identical to SEQ ID NO: 487061

SEQ ID NO: 648484 - RNA, 64 nt, hsa; identical to SEQ ID NO: 487062

SEQ ID NO: 648485 - RNA, 64 nt, hsa; identical to SEQ ID NO: 487063

SEQ ID NO: 648486 - RNA, 64 nt, hsa; identical to SEQ ID NO: 487064

SEQ ID NO: 648487 - RNA, 64 nt, hsa; identical to SEQ ID NO: 487065

SEQ ID NO: 648488 - RNA, 64 nt, hsa; identical to SEQ ID NO: 487066

SEQ ID NO: 648489 - RNA, 64 nt, hsa; identical to SEQ ID NO: 487067

SEQ ID NO: 648490 - RNA, 64 nt, hsa; identical to SEQ ID NO: 487068

SEQ ID NO: 648491 - RNA, 64 nt, hsa; identical to SEQ ID NO: 487069

SEQ ID NO: 648492 - RNA, 64 nt, hsa; identical to SEQ ID NO: 487070

SEQ ID NO: 648493 - RNA, 64 nt, hsa; identical to SEQ ID NO: 487071

SEQ ID NO: 648494 - RNA, 64 nt, hsa; identical to SEQ ID NO: 487072

SEQ ID NO: 648495 - RNA, 64 nt, hsa; identical to SEQ ID NO: 487073

SEQ ID NO: 648496 - RNA, 64 nt, hsa; identical to SEQ ID NO: 487074

SEQ ID NO: 648497 - RNA, 64 nt, hsa; identical to SEQ ID NO: 487075

SEQ ID NO: 648498 - RNA, 64 nt, hsa; identical to SEQ ID NO: 487076

SEQ ID NO: 648499 - RNA, 64 nt, hsa; identical to SEQ ID NO: 487077

SEQ ID NO: 648500 - RNA, 64 nt, hsa; identical to SEQ ID NO: 487078

SEQ ID NO: 648501 - RNA, 64 nt, hsa; identical to SEQ ID NO: 487079

SEQ ID NO: 648502 - RNA, 64 nt, hsa; identical to SEQ ID NO: 487080

SEQ ID NO: 648503 - RNA, 64 nt, hsa; identical to SEQ ID NO: 487081

SEQ ID NO: 648504 - RNA, 64 nt, hsa; identical to SEQ ID NO: 487082

SEQ ID NO: 648505 - RNA, 64 nt, hsa; identical to SEQ ID NO: 487083

SEQ ID NO: 648506 - RNA, 64 nt, hsa; identical to SEQ ID NO: 487084

SEQ ID NO: 648507 - RNA, 64 nt, hsa; identical to SEQ ID NO: 487085

SEQ ID NO: 648508 - RNA, 64 nt, hsa; identical to SEQ ID NO: 487086

SEQ ID NO: 648509 - RNA, 64 nt, hsa; identical to SEQ ID NO: 487087

SEQ ID NO: 648510 - RNA, 64 nt, hsa; identical to SEQ ID NO: 487088

SEQ ID NO: 648511 - RNA, 64 nt, hsa; identical to SEQ ID NO: 487089

SEQ ID NO: 648512 - RNA, 64 nt, hsa; identical to SEQ ID NO: 487090

SEQ ID NO: 648513 - RNA, 64 nt, hsa; identical to SEQ ID NO: 487091

SEQ ID NO: 648514 - RNA, 64 nt, hsa; identical to SEQ ID NO: 487092

SEQ ID NO: 648515 - RNA, 64 nt, hsa; identical to SEQ ID NO: 487093

SEQ ID NO: 648516 - RNA, 64 nt, hsa; identical to SEQ ID NO: 487094

SEQ ID NO: 648517 - RNA, 64 nt, hsa; identical to SEQ ID NO: 487095

SEQ ID NO: 648518 - RNA, 64 nt, hsa; identical to SEQ ID NO: 487096

SEQ ID NO: 648519 - RNA, 64 nt, hsa; identical to SEQ ID NO: 487097

SEQ ID NO: 648520 - RNA, 64 nt, hsa; identical to SEQ ID NO: 487098

SEQ ID NO: 648521 - RNA, 64 nt, hsa; identical to SEQ ID NO: 487099

SEQ ID NO: 648522 - RNA, 64 nt, hsa; identical to SEQ ID NO: 487100

SEQ ID NO: 648523 - RNA, 64 nt, hsa; identical to SEQ ID NO: 487101

SEQ ID NO: 648524 - RNA, 64 nt, hsa; identical to SEQ ID NO: 487102

SEQ ID NO: 648525 - RNA, 64 nt, hsa; identical to SEQ ID NO: 487103

SEQ ID NO: 648526 - RNA, 64 nt, hsa; identical to SEQ ID NO: 487104

SEQ ID NO: 648527 - RNA, 64 nt, hsa; identical to SEQ ID NO: 487105

SEQ ID NO: 648528 - RNA, 64 nt, hsa; identical to SEQ ID NO: 487106

SEQ ID NO: 648529 - RNA, 64 nt, hsa; identical to SEQ ID NO: 487107

SEQ ID NO: 648530 - RNA, 64 nt, hsa; identical to SEQ ID NO: 487108

SEQ ID NO: 648531 - RNA, 64 nt, hsa; identical to SEQ ID NO: 487109

SEQ ID NO: 648532 - RNA, 64 nt, hsa; identical to SEQ ID NO: 487110

SEQ ID NO: 648533 - RNA, 64 nt, hsa; identical to SEQ ID NO: 487111

SEQ ID NO: 648534 - RNA, 64 nt, hsa; identical to SEQ ID NO: 487112

SEQ ID NO: 648535 - RNA, 64 nt, hsa; identical to SEQ ID NO: 487113

SEQ ID NO: 648536 - RNA, 64 nt, hsa; identical to SEQ ID NO: 487114

SEQ ID NO: 648537 - RNA, 64 nt, hsa; identical to SEQ ID NO: 487115

SEQ ID NO: 648538 - RNA, 64 nt, hsa; identical to SEQ ID NO: 487116

SEQ ID NO: 648539 - RNA, 64 nt, hsa; identical to SEQ ID NO: 487117

SEQ ID NO: 648540 - RNA, 64 nt, hsa; identical to SEQ ID NO: 487118

SEQ ID NO: 648541 - RNA, 64 nt, hsa
augcuauccacacccaccuaucccugcagcuaauuuagcugaucucuaauuuaacugagcucua

SEQ ID NO: 648542 - RNA, 64 nt, hsa
auuuagcugaucucuaauuuaacugagcucuaauuuagcugaucagauuuugcuuggguaaagu

SEQ ID NO: 648543 - RNA, 64 nt, hsa
gcuauuuacuaucuuauaguaauucaggcucuaauuagcugagggaaugaaacacacaaaaauc

SEQ ID NO: 648544 - RNA, 64 nt, hsa
aaccuggggggaguguggaaaagggaaaacuguuuuagcugaauaaaggugaauuauauaauuu

SEQ ID NO: 648545 - RNA, 64 nt, hsa
ggugccuacugcugucuaaacucugcucuccuaauuagcugacucuugaaaaugaaauccuaac

SEQ ID NO: 648546 - RNA, 64 nt, hsa
aggagacaccagugguggugauuggcugguugccuuagcugauugaaacugaaaucgacauagg

SEQ ID NO: 648547 - RNA, 64 nt, hsa
uucugauccccuuugguuuuacuacccaaaucuaaauagauacuuuugauaauagauaacugcu

SEQ ID NO: 648548 - RNA, 64 nt, hsa
uuuuacuacccaaaucuaaauagauacuuuugauaauagauaacugcucuuuuacuaagacaua

SEQ ID NO: 648549 - RNA, 64 nt, hsa
uaaauuauggaacugcuaaauagauauuucuauaaauagauaauuuuuauuuauguagcuuuuu

SEQ ID NO: 648550 - RNA, 64 nt, hsa
uuugauuugaauauuuuaaauuauggaacugcuaaauagauauuucuauaaauagauaauuuuu

SEQ ID NO: 648551 - RNA, 64 nt, hsa
ugaugaaagaaaauccaaauaaagcccaccuagaaauagauauuuuauuauauaugugcuauag

SEQ ID NO: 648552 - RNA, 64 nt, hsa
aauuaaaccucuuaucuaucagaaauuguaagagaauagauacauguuuugaauguaaaguuga

SEQ ID NO: 648553 - RNA, 64 nt, hsa
aaagauaccuuuuguaaaguugucaucucucuguaauagauaauggcugacuggaccauaguug

SEQ ID NO: 648554 - RNA, 64 nt, hsa
auuuuuuagauacuaucauuagguuggauaugguaauagauauauuucagaauagcaaguggug

SEQ ID NO: 648555 - RNA, 64 nt, hsa
gaggcugguguguaugauugucuuaaaauuuuuuaauagauauggccgagcgugauggcucacc

SEQ ID NO: 648556 - RNA, 64 nt, hsa
ugacagugagacugucaaaaaaaaaaaaaaaauuaauagauaaaacaggccacuagagggugca

SEQ ID NO: 648557 - RNA, 64 nt, hsa
ugaguggaugaguggaucgauggauguauugauaaauagauagaaccagucaucugaagcaacu

SEQ ID NO: 648558 - RNA, 64 nt, hsa
aaaaauaaaaaguaccaaaauucauucaagaagaaauagauaccagccugagcaacauggcaaa

SEQ ID NO: 648559 - RNA, 64 nt, hsa
ucacuuuuaaaauguuaaugucauucugagcagaaauagauauauuuucagauuuuuuuacacu

SEQ ID NO: 648560 - RNA, 64 nt, hsa
gguaauugaaguccuauuggauauuucauguuuaaauagauauucuauauuaaacacuaauuua

SEQ ID NO: 648561 - RNA, 64 nt, hsa; identical to SEQ ID NO: 155629

SEQ ID NO: 648562 - RNA, 64 nt, hsa; identical to SEQ ID NO: 155630

SEQ ID NO: 648563 - RNA, 64 nt, hsa; identical to SEQ ID NO: 155631

SEQ ID NO: 648564 - RNA, 64 nt, hsa; identical to SEQ ID NO: 155632

SEQ ID NO: 648565 - RNA, 64 nt, hsa; identical to SEQ ID NO: 155633

SEQ ID NO: 648566 - RNA, 64 nt, hsa; identical to SEQ ID NO: 155634

SEQ ID NO: 648567 - RNA, 64 nt, hsa; identical to SEQ ID NO: 155635

SEQ ID NO: 648568 - RNA, 64 nt, hsa; identical to SEQ ID NO: 155636

SEQ ID NO: 648569 - RNA, 64 nt, hsa; identical to SEQ ID NO: 155637

SEQ ID NO: 648570 - RNA, 64 nt, hsa; identical to SEQ ID NO: 155638

SEQ ID NO: 648571 - RNA, 64 nt, hsa; identical to SEQ ID NO: 155639

SEQ ID NO: 648572 - RNA, 64 nt, hsa; identical to SEQ ID NO: 155640

SEQ ID NO: 648573 - RNA, 64 nt, hsa; identical to SEQ ID NO: 155641

SEQ ID NO: 648574 - RNA, 64 nt, hsa; identical to SEQ ID NO: 155642

SEQ ID NO: 648575 - RNA, 64 nt, hsa; identical to SEQ ID NO: 155643

SEQ ID NO: 648576 - RNA, 64 nt, hsa; identical to SEQ ID NO: 155644

SEQ ID NO: 648577 - RNA, 64 nt, hsa; identical to SEQ ID NO: 155645

SEQ ID NO: 648578 - RNA, 64 nt, hsa; identical to SEQ ID NO: 155646

SEQ ID NO: 648579 - RNA, 64 nt, hsa; identical to SEQ ID NO: 155647

SEQ ID NO: 648580 - RNA, 64 nt, hsa; identical to SEQ ID NO: 155648

SEQ ID NO: 648581 - RNA, 64 nt, hsa; identical to SEQ ID NO: 155649

SEQ ID NO: 648582 - RNA, 64 nt, hsa; identical to SEQ ID NO: 155650

SEQ ID NO: 648583 - RNA, 64 nt, hsa; identical to SEQ ID NO: 155651

SEQ ID NO: 648584 - RNA, 64 nt, hsa; identical to SEQ ID NO: 155652

SEQ ID NO: 648585 - RNA, 64 nt, hsa; identical to SEQ ID NO: 155653

SEQ ID NO: 648586 - RNA, 64 nt, hsa; identical to SEQ ID NO: 155654

SEQ ID NO: 648587 - RNA, 64 nt, hsa; identical to SEQ ID NO: 155655

SEQ ID NO: 648588 - RNA, 64 nt, hsa; identical to SEQ ID NO: 155656

SEQ ID NO: 648589 - RNA, 64 nt, hsa; identical to SEQ ID NO: 155657

SEQ ID NO: 648590 - RNA, 64 nt, hsa; identical to SEQ ID NO: 155658

SEQ ID NO: 648591 - RNA, 64 nt, hsa; identical to SEQ ID NO: 155659

SEQ ID NO: 648592 - RNA, 64 nt, hsa; identical to SEQ ID NO: 155660

SEQ ID NO: 648593 - RNA, 64 nt, hsa; identical to SEQ ID NO: 155661

SEQ ID NO: 648594 - RNA, 64 nt, hsa; identical to SEQ ID NO: 155662

SEQ ID NO: 648595 - RNA, 64 nt, hsa; identical to SEQ ID NO: 155663

SEQ ID NO: 648596 - RNA, 64 nt, hsa; identical to SEQ ID NO: 155664

SEQ ID NO: 648597 - RNA, 64 nt, hsa; identical to SEQ ID NO: 155665

SEQ ID NO: 648598 - RNA, 64 nt, hsa; identical to SEQ ID NO: 155666

SEQ ID NO: 648599 - RNA, 64 nt, hsa; identical to SEQ ID NO: 155667

SEQ ID NO: 648600 - RNA, 64 nt, hsa; identical to SEQ ID NO: 155668

SEQ ID NO: 648601 - RNA, 64 nt, hsa; identical to SEQ ID NO: 155669

SEQ ID NO: 648602 - RNA, 64 nt, hsa; identical to SEQ ID NO: 155670

SEQ ID NO: 648603 - RNA, 64 nt, hsa; identical to SEQ ID NO: 155671

SEQ ID NO: 648604 - RNA, 64 nt, hsa; identical to SEQ ID NO: 155672

SEQ ID NO: 648605 - RNA, 64 nt, hsa; identical to SEQ ID NO: 155673

SEQ ID NO: 648606 - RNA, 64 nt, hsa; identical to SEQ ID NO: 155674

SEQ ID NO: 648607 - RNA, 64 nt, hsa; identical to SEQ ID NO: 155675

SEQ ID NO: 648608 - RNA, 64 nt, hsa; identical to SEQ ID NO: 155676

SEQ ID NO: 648609 - RNA, 64 nt, hsa; identical to SEQ ID NO: 155677

SEQ ID NO: 648610 - RNA, 64 nt, hsa; identical to SEQ ID NO: 155678

SEQ ID NO: 648611 - RNA, 64 nt, hsa; identical to SEQ ID NO: 155679

SEQ ID NO: 648612 - RNA, 64 nt, hsa; identical to SEQ ID NO: 155680

SEQ ID NO: 648613 - RNA, 64 nt, hsa; identical to SEQ ID NO: 155681

SEQ ID NO: 648614 - RNA, 64 nt, hsa; identical to SEQ ID NO: 155682

SEQ ID NO: 648615 - RNA, 64 nt, hsa; identical to SEQ ID NO: 155683

SEQ ID NO: 648616 - RNA, 64 nt, hsa; identical to SEQ ID NO: 155684

SEQ ID NO: 648617 - RNA, 64 nt, hsa; identical to SEQ ID NO: 155685

SEQ ID NO: 648618 - RNA, 64 nt, hsa; identical to SEQ ID NO: 155686

SEQ ID NO: 648619 - RNA, 64 nt, hsa; identical to SEQ ID NO: 155687

SEQ ID NO: 648620 - RNA, 64 nt, hsa; identical to SEQ ID NO: 155688

SEQ ID NO: 648621 - RNA, 64 nt, hsa; identical to SEQ ID NO: 155689

SEQ ID NO: 648622 - RNA, 64 nt, hsa; identical to SEQ ID NO: 155690

SEQ ID NO: 648623 - RNA, 64 nt, hsa; identical to SEQ ID NO: 155691

SEQ ID NO: 648624 - RNA, 64 nt, hsa; identical to SEQ ID NO: 155692

SEQ ID NO: 648625 - RNA, 64 nt, hsa; identical to SEQ ID NO: 155693

SEQ ID NO: 648626 - RNA, 64 nt, hsa; identical to SEQ ID NO: 155694

SEQ ID NO: 648627 - RNA, 64 nt, hsa; identical to SEQ ID NO: 155695

SEQ ID NO: 648628 - RNA, 64 nt, hsa; identical to SEQ ID NO: 155696

SEQ ID NO: 648629 - RNA, 64 nt, hsa; identical to SEQ ID NO: 155697

SEQ ID NO: 648630 - RNA, 64 nt, hsa; identical to SEQ ID NO: 155698

SEQ ID NO: 648631 - RNA, 64 nt, hsa; identical to SEQ ID NO: 155699

SEQ ID NO: 648632 - RNA, 64 nt, hsa; identical to SEQ ID NO: 155700

SEQ ID NO: 648633 - RNA, 64 nt, hsa; identical to SEQ ID NO: 155701

SEQ ID NO: 648634 - RNA, 64 nt, hsa; identical to SEQ ID NO: 155702

SEQ ID NO: 648635 - RNA, 64 nt, hsa; identical to SEQ ID NO: 155703

SEQ ID NO: 648636 - RNA, 64 nt, hsa; identical to SEQ ID NO: 155704

SEQ ID NO: 648637 - RNA, 64 nt, hsa; identical to SEQ ID NO: 155705

SEQ ID NO: 648638 - RNA, 64 nt, hsa; identical to SEQ ID NO: 155706

SEQ ID NO: 648639 - RNA, 64 nt, hsa; identical to SEQ ID NO: 155707

SEQ ID NO: 648640 - RNA, 64 nt, hsa; identical to SEQ ID NO: 155708

SEQ ID NO: 648641 - RNA, 64 nt, hsa; identical to SEQ ID NO: 155709

SEQ ID NO: 648642 - RNA, 64 nt, hsa; identical to SEQ ID NO: 155710

SEQ ID NO: 648643 - RNA, 64 nt, hsa; identical to SEQ ID NO: 155711

SEQ ID NO: 648644 - RNA, 64 nt, hsa; identical to SEQ ID NO: 155712

SEQ ID NO: 648645 - RNA, 64 nt, hsa; identical to SEQ ID NO: 155713

SEQ ID NO: 648646 - RNA, 64 nt, hsa; identical to SEQ ID NO: 155714

SEQ ID NO: 648647 - RNA, 64 nt, hsa; identical to SEQ ID NO: 155715

SEQ ID NO: 648648 - RNA, 64 nt, hsa; identical to SEQ ID NO: 155716

SEQ ID NO: 648649 - RNA, 64 nt, hsa; identical to SEQ ID NO: 155717

SEQ ID NO: 648650 - RNA, 64 nt, hsa; identical to SEQ ID NO: 155718

SEQ ID NO: 648651 - RNA, 64 nt, hsa; identical to SEQ ID NO: 155719

SEQ ID NO: 648652 - RNA, 64 nt, hsa; identical to SEQ ID NO: 155720

SEQ ID NO: 648653 - RNA, 64 nt, hsa; identical to SEQ ID NO: 155721

SEQ ID NO: 648654 - RNA, 64 nt, hsa; identical to SEQ ID NO: 155722

SEQ ID NO: 648655 - RNA, 64 nt, hsa; identical to SEQ ID NO: 155723

SEQ ID NO: 648656 - RNA, 64 nt, hsa; identical to SEQ ID NO: 155724

SEQ ID NO: 648657 - RNA, 64 nt, hsa; identical to SEQ ID NO: 155725

SEQ ID NO: 648658 - RNA, 64 nt, hsa; identical to SEQ ID NO: 155726

SEQ ID NO: 648659 - RNA, 64 nt, hsa; identical to SEQ ID NO: 155727

SEQ ID NO: 648660 - RNA, 64 nt, hsa; identical to SEQ ID NO: 155728

SEQ ID NO: 648661 - RNA, 64 nt, hsa; identical to SEQ ID NO: 155729

SEQ ID NO: 648662 - RNA, 58 nt, hsa; identical to SEQ ID NO: 155730

SEQ ID NO: 648663 - RNA, 64 nt, hsa; identical to SEQ ID NO: 155731

SEQ ID NO: 648664 - RNA, 64 nt, hsa; identical to SEQ ID NO: 155732

SEQ ID NO: 648665 - RNA, 64 nt, hsa; identical to SEQ ID NO: 155733

SEQ ID NO: 648666 - RNA, 64 nt, hsa; identical to SEQ ID NO: 155734

SEQ ID NO: 648667 - RNA, 64 nt, hsa; identical to SEQ ID NO: 155735

SEQ ID NO: 648668 - RNA, 64 nt, hsa; identical to SEQ ID NO: 155736

SEQ ID NO: 648669 - RNA, 64 nt, hsa; identical to SEQ ID NO: 155737

SEQ ID NO: 648670 - RNA, 64 nt, hsa; identical to SEQ ID NO: 155738

SEQ ID NO: 648671 - RNA, 64 nt, hsa; identical to SEQ ID NO: 155739

SEQ ID NO: 648672 - RNA, 64 nt, hsa; identical to SEQ ID NO: 155740

SEQ ID NO: 648673 - RNA, 64 nt, hsa; identical to SEQ ID NO: 155741

SEQ ID NO: 648674 - RNA, 64 nt, hsa; identical to SEQ ID NO: 155742

SEQ ID NO: 648675 - RNA, 64 nt, hsa; identical to SEQ ID NO: 155743

SEQ ID NO: 648676 - RNA, 64 nt, hsa; identical to SEQ ID NO: 155744

SEQ ID NO: 648677 - RNA, 64 nt, hsa; identical to SEQ ID NO: 155745

SEQ ID NO: 648678 - RNA, 64 nt, hsa; identical to SEQ ID NO: 155746

SEQ ID NO: 648679 - RNA, 64 nt, hsa; identical to SEQ ID NO: 155747

SEQ ID NO: 648680 - RNA, 64 nt, hsa; identical to SEQ ID NO: 155748

SEQ ID NO: 648681 - RNA, 64 nt, hsa; identical to SEQ ID NO: 155749

SEQ ID NO: 648682 - RNA, 64 nt, hsa; identical to SEQ ID NO: 155750

SEQ ID NO: 648683 - RNA, 64 nt, hsa; identical to SEQ ID NO: 155751

SEQ ID NO: 648684 - RNA, 64 nt, hsa; identical to SEQ ID NO: 155752

SEQ ID NO: 648685 - RNA, 64 nt, hsa; identical to SEQ ID NO: 155753

SEQ ID NO: 648686 - RNA, 63 nt, hsa; identical to SEQ ID NO: 155754

SEQ ID NO: 648687 - RNA, 64 nt, hsa; identical to SEQ ID NO: 155755

SEQ ID NO: 648688 - RNA, 64 nt, hsa; identical to SEQ ID NO: 155756

SEQ ID NO: 648689 - RNA, 64 nt, hsa; identical to SEQ ID NO: 155757

SEQ ID NO: 648690 - RNA, 64 nt, hsa; identical to SEQ ID NO: 155758

SEQ ID NO: 648691 - RNA, 64 nt, hsa; identical to SEQ ID NO: 155759

SEQ ID NO: 648692 - RNA, 64 nt, hsa; identical to SEQ ID NO: 155760

SEQ ID NO: 648693 - RNA, 64 nt, hsa; identical to SEQ ID NO: 155761

SEQ ID NO: 648694 - RNA, 64 nt, hsa; identical to SEQ ID NO: 155762

SEQ ID NO: 648695 - RNA, 64 nt, hsa; identical to SEQ ID NO: 155763

SEQ ID NO: 648696 - RNA, 64 nt, hsa; identical to SEQ ID NO: 155764

SEQ ID NO: 648697 - RNA, 64 nt, hsa; identical to SEQ ID NO: 155765

SEQ ID NO: 648698 - RNA, 64 nt, hsa; identical to SEQ ID NO: 155766

SEQ ID NO: 648699 - RNA, 64 nt, hsa; identical to SEQ ID NO: 155767

SEQ ID NO: 648700 - RNA, 64 nt, hsa; identical to SEQ ID NO: 155768

SEQ ID NO: 648701 - RNA, 64 nt, hsa; identical to SEQ ID NO: 155769

SEQ ID NO: 648702 - RNA, 64 nt, hsa; identical to SEQ ID NO: 155770

SEQ ID NO: 648703 - RNA, 64 nt, hsa; identical to SEQ ID NO: 155771

SEQ ID NO: 648704 - RNA, 64 nt, hsa; identical to SEQ ID NO: 155772

SEQ ID NO: 648705 - RNA, 64 nt, hsa; identical to SEQ ID NO: 155773

SEQ ID NO: 648706 - RNA, 64 nt, hsa; identical to SEQ ID NO: 155774

SEQ ID NO: 648707 - RNA, 64 nt, hsa; identical to SEQ ID NO: 155775

SEQ ID NO: 648708 - RNA, 64 nt, hsa; identical to SEQ ID NO: 155776

SEQ ID NO: 648709 - RNA, 64 nt, hsa; identical to SEQ ID NO: 155777

SEQ ID NO: 648710 - RNA, 64 nt, hsa; identical to SEQ ID NO: 155778

SEQ ID NO: 648711 - RNA, 64 nt, hsa; identical to SEQ ID NO: 155779

SEQ ID NO: 648712 - RNA, 64 nt, hsa; identical to SEQ ID NO: 155780

SEQ ID NO: 648713 - RNA, 64 nt, hsa; identical to SEQ ID NO: 155781

SEQ ID NO: 648714 - RNA, 64 nt, hsa; identical to SEQ ID NO: 155782

SEQ ID NO: 648715 - RNA, 64 nt, hsa; identical to SEQ ID NO: 155783

SEQ ID NO: 648716 - RNA, 64 nt, hsa; identical to SEQ ID NO: 155784

SEQ ID NO: 648717 - RNA, 64 nt, hsa; identical to SEQ ID NO: 155785

SEQ ID NO: 648718 - RNA, 64 nt, hsa; identical to SEQ ID NO: 155786

SEQ ID NO: 648719 - RNA, 53 nt, hsa; identical to SEQ ID NO: 155787

SEQ ID NO: 648720 - RNA, 64 nt, hsa; identical to SEQ ID NO: 155788

SEQ ID NO: 648721 - RNA, 64 nt, hsa; identical to SEQ ID NO: 155789

SEQ ID NO: 648722 - RNA, 64 nt, hsa; identical to SEQ ID NO: 155790

SEQ ID NO: 648723 - RNA, 64 nt, hsa; identical to SEQ ID NO: 155791

SEQ ID NO: 648724 - RNA, 64 nt, hsa; identical to SEQ ID NO: 155792

SEQ ID NO: 648725 - RNA, 64 nt, hsa; identical to SEQ ID NO: 155793

SEQ ID NO: 648726 - RNA, 64 nt, hsa; identical to SEQ ID NO: 155794

SEQ ID NO: 648727 - RNA, 64 nt, hsa; identical to SEQ ID NO: 155795

SEQ ID NO: 648728 - RNA, 64 nt, hsa; identical to SEQ ID NO: 155796

SEQ ID NO: 648729 - RNA, 64 nt, hsa; identical to SEQ ID NO: 155797

SEQ ID NO: 648730 - RNA, 64 nt, hsa; identical to SEQ ID NO: 155798

SEQ ID NO: 648731 - RNA, 64 nt, hsa; identical to SEQ ID NO: 155799

SEQ ID NO: 648732 - RNA, 64 nt, hsa; identical to SEQ ID NO: 155800

SEQ ID NO: 648733 - RNA, 64 nt, hsa; identical to SEQ ID NO: 155801

SEQ ID NO: 648734 - RNA, 64 nt, hsa; identical to SEQ ID NO: 155802

SEQ ID NO: 648735 - RNA, 64 nt, hsa; identical to SEQ ID NO: 155803

SEQ ID NO: 648736 - RNA, 64 nt, hsa; identical to SEQ ID NO: 155804

SEQ ID NO: 648737 - RNA, 64 nt, hsa; identical to SEQ ID NO: 155805

SEQ ID NO: 648738 - RNA, 64 nt, hsa; identical to SEQ ID NO: 155806

SEQ ID NO: 648739 - RNA, 64 nt, hsa; identical to SEQ ID NO: 155807

SEQ ID NO: 648740 - RNA, 64 nt, hsa; identical to SEQ ID NO: 155808

SEQ ID NO: 648741 - RNA, 64 nt, hsa; identical to SEQ ID NO: 360747

SEQ ID NO: 648742 - RNA, 64 nt, hsa; identical to SEQ ID NO: 360748

SEQ ID NO: 648743 - RNA, 64 nt, hsa; identical to SEQ ID NO: 360749

SEQ ID NO: 648744 - RNA, 64 nt, hsa; identical to SEQ ID NO: 360750

SEQ ID NO: 648745 - RNA, 64 nt, hsa; identical to SEQ ID NO: 360751

SEQ ID NO: 648746 - RNA, 64 nt, hsa; identical to SEQ ID NO: 360752

SEQ ID NO: 648747 - RNA, 64 nt, hsa; identical to SEQ ID NO: 360753

SEQ ID NO: 648748 - RNA, 64 nt, hsa; identical to SEQ ID NO: 360754

SEQ ID NO: 648749 - RNA, 64 nt, hsa; identical to SEQ ID NO: 360755

SEQ ID NO: 648750 - RNA, 64 nt, hsa; identical to SEQ ID NO: 360756

SEQ ID NO: 648751 - RNA, 64 nt, hsa; identical to SEQ ID NO: 360757

SEQ ID NO: 648752 - RNA, 64 nt, hsa; identical to SEQ ID NO: 360758

SEQ ID NO: 648753 - RNA, 64 nt, hsa; identical to SEQ ID NO: 360759

SEQ ID NO: 648754 - RNA, 64 nt, hsa; identical to SEQ ID NO: 360760

SEQ ID NO: 648755 - RNA, 64 nt, hsa; identical to SEQ ID NO: 360761

SEQ ID NO: 648756 - RNA, 64 nt, hsa; identical to SEQ ID NO: 360762

SEQ ID NO: 648757 - RNA, 64 nt, hsa; identical to SEQ ID NO: 360763

SEQ ID NO: 648758 - RNA, 64 nt, hsa; identical to SEQ ID NO: 360764

SEQ ID NO: 648759 - RNA, 64 nt, hsa; identical to SEQ ID NO: 360765

SEQ ID NO: 648760 - RNA, 59 nt, hsa; identical to SEQ ID NO: 76155

SEQ ID NO: 648761 - RNA, 64 nt, hsa; identical to SEQ ID NO: 76156

SEQ ID NO: 648762 - RNA, 64 nt, hsa; identical to SEQ ID NO: 76157

SEQ ID NO: 648763 - RNA, 64 nt, hsa; identical to SEQ ID NO: 76158

SEQ ID NO: 648764 - RNA, 64 nt, hsa; identical to SEQ ID NO: 76159

SEQ ID NO: 648765 - RNA, 64 nt, hsa; identical to SEQ ID NO: 76160

SEQ ID NO: 648766 - RNA, 64 nt, hsa; identical to SEQ ID NO: 76161

SEQ ID NO: 648767 - RNA, 64 nt, hsa; identical to SEQ ID NO: 76162

SEQ ID NO: 648768 - RNA, 64 nt, hsa; identical to SEQ ID NO: 76163

SEQ ID NO: 648769 - RNA, 64 nt, hsa; identical to SEQ ID NO: 76164

SEQ ID NO: 648770 - RNA, 64 nt, hsa; identical to SEQ ID NO: 76165

SEQ ID NO: 648771 - RNA, 64 nt, hsa; identical to SEQ ID NO: 76166

SEQ ID NO: 648772 - RNA, 64 nt, hsa; identical to SEQ ID NO: 76167

SEQ ID NO: 648773 - RNA, 64 nt, hsa; identical to SEQ ID NO: 76168

SEQ ID NO: 648774 - RNA, 64 nt, hsa; identical to SEQ ID NO: 76169

SEQ ID NO: 648775 - RNA, 58 nt, hsa; identical to SEQ ID NO: 76170

SEQ ID NO: 648776 - RNA, 64 nt, hsa; identical to SEQ ID NO: 76171

SEQ ID NO: 648777 - RNA, 64 nt, hsa; identical to SEQ ID NO: 76172

SEQ ID NO: 648778 - RNA, 64 nt, hsa; identical to SEQ ID NO: 76173

SEQ ID NO: 648779 - RNA, 64 nt, hsa; identical to SEQ ID NO: 76174

SEQ ID NO: 648780 - RNA, 64 nt, hsa; identical to SEQ ID NO: 76175

SEQ ID NO: 648781 - RNA, 52 nt, hsa; identical to SEQ ID NO: 76176

SEQ ID NO: 648782 - RNA, 64 nt, hsa; identical to SEQ ID NO: 76177

SEQ ID NO: 648783 - RNA, 64 nt, hsa; identical to SEQ ID NO: 76178

SEQ ID NO: 648784 - RNA, 64 nt, hsa; identical to SEQ ID NO: 76179

SEQ ID NO: 648785 - RNA, 64 nt, hsa; identical to SEQ ID NO: 76180

SEQ ID NO: 648786 - RNA, 64 nt, hsa; identical to SEQ ID NO: 76181

SEQ ID NO: 648787 - RNA, 64 nt, hsa; identical to SEQ ID NO: 76182

SEQ ID NO: 648788 - RNA, 64 nt, hsa; identical to SEQ ID NO: 76183

SEQ ID NO: 648789 - RNA, 64 nt, hsa; identical to SEQ ID NO: 76184

SEQ ID NO: 648790 - RNA, 64 nt, hsa; identical to SEQ ID NO: 76185

SEQ ID NO: 648791 - RNA, 64 nt, hsa; identical to SEQ ID NO: 76186

SEQ ID NO: 648792 - RNA, 64 nt, hsa; identical to SEQ ID NO: 76187

SEQ ID NO: 648793 - RNA, 64 nt, hsa; identical to SEQ ID NO: 76188

SEQ ID NO: 648794 - RNA, 64 nt, hsa; identical to SEQ ID NO: 76189

SEQ ID NO: 648795 - RNA, 64 nt, hsa; identical to SEQ ID NO: 76190

SEQ ID NO: 648796 - RNA, 64 nt, hsa; identical to SEQ ID NO: 76191

SEQ ID NO: 648797 - RNA, 64 nt, hsa; identical to SEQ ID NO: 76192

SEQ ID NO: 648798 - RNA, 64 nt, hsa; identical to SEQ ID NO: 76193

SEQ ID NO: 648799 - RNA, 64 nt, hsa; identical to SEQ ID NO: 76194

SEQ ID NO: 648800 - RNA, 64 nt, hsa; identical to SEQ ID NO: 76195

SEQ ID NO: 648801 - RNA, 64 nt, hsa; identical to SEQ ID NO: 76196

SEQ ID NO: 648802 - RNA, 64 nt, hsa; identical to SEQ ID NO: 76197

SEQ ID NO: 648803 - RNA, 64 nt, hsa; identical to SEQ ID NO: 76198

SEQ ID NO: 648804 - RNA, 64 nt, hsa; identical to SEQ ID NO: 76199

SEQ ID NO: 648805 - RNA, 64 nt, hsa; identical to SEQ ID NO: 76200

SEQ ID NO: 648806 - RNA, 64 nt, hsa; identical to SEQ ID NO: 76201

SEQ ID NO: 648807 - RNA, 64 nt, hsa; identical to SEQ ID NO: 76202

SEQ ID NO: 648808 - RNA, 64 nt, hsa; identical to SEQ ID NO: 76203

SEQ ID NO: 648809 - RNA, 64 nt, hsa; identical to SEQ ID NO: 76204

SEQ ID NO: 648810 - RNA, 64 nt, hsa; identical to SEQ ID NO: 76205

SEQ ID NO: 648811 - RNA, 64 nt, hsa; identical to SEQ ID NO: 76206

SEQ ID NO: 648812 - RNA, 64 nt, hsa; identical to SEQ ID NO: 76207

SEQ ID NO: 648813 - RNA, 64 nt, hsa; identical to SEQ ID NO: 76208

SEQ ID NO: 648814 - RNA, 64 nt, hsa; identical to SEQ ID NO: 76209

SEQ ID NO: 648815 - RNA, 64 nt, hsa; identical to SEQ ID NO: 76210

SEQ ID NO: 648816 - RNA, 64 nt, hsa; identical to SEQ ID NO: 76211

SEQ ID NO: 648817 - RNA, 64 nt, hsa; identical to SEQ ID NO: 76212

SEQ ID NO: 648818 - RNA, 64 nt, hsa; identical to SEQ ID NO: 76213

SEQ ID NO: 648819 - RNA, 64 nt, hsa; identical to SEQ ID NO: 76214

SEQ ID NO: 648820 - RNA, 64 nt, hsa; identical to SEQ ID NO: 76215

SEQ ID NO: 648821 - RNA, 64 nt, hsa; identical to SEQ ID NO: 76216

SEQ ID NO: 648822 - RNA, 64 nt, hsa; identical to SEQ ID NO: 76217

SEQ ID NO: 648823 - RNA, 64 nt, hsa; identical to SEQ ID NO: 76218

SEQ ID NO: 648824 - RNA, 64 nt, hsa; identical to SEQ ID NO: 76219

SEQ ID NO: 648825 - RNA, 64 nt, hsa; identical to SEQ ID NO: 76456

SEQ ID NO: 648826 - RNA, 64 nt, hsa; identical to SEQ ID NO: 76457

SEQ ID NO: 648827 - RNA, 64 nt, hsa; identical to SEQ ID NO: 76458

SEQ ID NO: 648828 - RNA, 64 nt, hsa; identical to SEQ ID NO: 76459

SEQ ID NO: 648829 - RNA, 64 nt, hsa; identical to SEQ ID NO: 76460

SEQ ID NO: 648830 - RNA, 64 nt, hsa; identical to SEQ ID NO: 76461

SEQ ID NO: 648831 - RNA, 64 nt, hsa; identical to SEQ ID NO: 76462

SEQ ID NO: 648832 - RNA, 64 nt, hsa; identical to SEQ ID NO: 76463

SEQ ID NO: 648833 - RNA, 64 nt, hsa; identical to SEQ ID NO: 76464

SEQ ID NO: 648834 - RNA, 64 nt, hsa; identical to SEQ ID NO: 76465

SEQ ID NO: 648835 - RNA, 64 nt, hsa; identical to SEQ ID NO: 76466

SEQ ID NO: 648836 - RNA, 64 nt, hsa; identical to SEQ ID NO: 76467

SEQ ID NO: 648837 - RNA, 64 nt, hsa; identical to SEQ ID NO: 545907

SEQ ID NO: 648838 - RNA, 64 nt, hsa; identical to SEQ ID NO: 545908

SEQ ID NO: 648839 - RNA, 64 nt, hsa; identical to SEQ ID NO: 545909

SEQ ID NO: 648840 - RNA, 64 nt, hsa; identical to SEQ ID NO: 545910

SEQ ID NO: 648841 - RNA, 64 nt, hsa; identical to SEQ ID NO: 545911

SEQ ID NO: 648842 - RNA, 64 nt, hsa; identical to SEQ ID NO: 545912

SEQ ID NO: 648843 - RNA, 64 nt, hsa; identical to SEQ ID NO: 545913

SEQ ID NO: 648844 - RNA, 64 nt, hsa; identical to SEQ ID NO: 545914

SEQ ID NO: 648845 - RNA, 64 nt, hsa; identical to SEQ ID NO: 545915

SEQ ID NO: 648846 - RNA, 64 nt, hsa; identical to SEQ ID NO: 545916

SEQ ID NO: 648847 - RNA, 64 nt, hsa; identical to SEQ ID NO: 545917

SEQ ID NO: 648848 - RNA, 64 nt, hsa; identical to SEQ ID NO: 545918

SEQ ID NO: 648849 - RNA, 64 nt, hsa; identical to SEQ ID NO: 545919

SEQ ID NO: 648850 - RNA, 64 nt, hsa; identical to SEQ ID NO: 545920

SEQ ID NO: 648851 - RNA, 64 nt, hsa; identical to SEQ ID NO: 545921

SEQ ID NO: 648852 - RNA, 64 nt, hsa; identical to SEQ ID NO: 545922

SEQ ID NO: 648853 - RNA, 64 nt, hsa; identical to SEQ ID NO: 545923

SEQ ID NO: 648854 - RNA, 64 nt, hsa; identical to SEQ ID NO: 545924

SEQ ID NO: 648855 - RNA, 64 nt, hsa; identical to SEQ ID NO: 545925

SEQ ID NO: 648856 - RNA, 64 nt, hsa; identical to SEQ ID NO: 545926

SEQ ID NO: 648857 - RNA, 64 nt, hsa; identical to SEQ ID NO: 545927

SEQ ID NO: 648858 - RNA, 64 nt, hsa; identical to SEQ ID NO: 545928

SEQ ID NO: 648859 - RNA, 64 nt, hsa; identical to SEQ ID NO: 545929

SEQ ID NO: 648860 - RNA, 64 nt, hsa; identical to SEQ ID NO: 545930

SEQ ID NO: 648861 - RNA, 64 nt, hsa; identical to SEQ ID NO: 545931

SEQ ID NO: 648862 - RNA, 64 nt, hsa; identical to SEQ ID NO: 545932

SEQ ID NO: 648863 - RNA, 64 nt, hsa; identical to SEQ ID NO: 545933

SEQ ID NO: 648864 - RNA, 64 nt, hsa; identical to SEQ ID NO: 545934

SEQ ID NO: 648865 - RNA, 64 nt, hsa; identical to SEQ ID NO: 545935

SEQ ID NO: 648866 - RNA, 64 nt, hsa; identical to SEQ ID NO: 545936

SEQ ID NO: 648867 - RNA, 64 nt, hsa; identical to SEQ ID NO: 545937

SEQ ID NO: 648868 - RNA, 64 nt, hsa; identical to SEQ ID NO: 545938

SEQ ID NO: 648869 - RNA, 64 nt, hsa; identical to SEQ ID NO: 545939

SEQ ID NO: 648870 - RNA, 64 nt, hsa; identical to SEQ ID NO: 545940

SEQ ID NO: 648871 - RNA, 64 nt, hsa; identical to SEQ ID NO: 545941

SEQ ID NO: 648872 - RNA, 64 nt, hsa; identical to SEQ ID NO: 545942

SEQ ID NO: 648873 - RNA, 64 nt, hsa; identical to SEQ ID NO: 545943

SEQ ID NO: 648874 - RNA, 62 nt, hsa; identical to SEQ ID NO: 545944

SEQ ID NO: 648875 - RNA, 64 nt, hsa; identical to SEQ ID NO: 545945

SEQ ID NO: 648876 - RNA, 64 nt, hsa; identical to SEQ ID NO: 545946

SEQ ID NO: 648877 - RNA, 64 nt, hsa; identical to SEQ ID NO: 545947

SEQ ID NO: 648878 - RNA, 64 nt, hsa; identical to SEQ ID NO: 545948

SEQ ID NO: 648879 - RNA, 64 nt, hsa; identical to SEQ ID NO: 545949

SEQ ID NO: 648880 - RNA, 64 nt, hsa; identical to SEQ ID NO: 545950

SEQ ID NO: 648881 - RNA, 64 nt, hsa; identical to SEQ ID NO: 545951

SEQ ID NO: 648882 - RNA, 64 nt, hsa; identical to SEQ ID NO: 545952

SEQ ID NO: 648883 - RNA, 64 nt, hsa; identical to SEQ ID NO: 545953

SEQ ID NO: 648884 - RNA, 64 nt, hsa; identical to SEQ ID NO: 545954

SEQ ID NO: 648885 - RNA, 64 nt, hsa; identical to SEQ ID NO: 545955

SEQ ID NO: 648886 - RNA, 64 nt, hsa; identical to SEQ ID NO: 545956

SEQ ID NO: 648887 - RNA, 64 nt, hsa; identical to SEQ ID NO: 545957

SEQ ID NO: 648888 - RNA, 64 nt, hsa; identical to SEQ ID NO: 545958

SEQ ID NO: 648889 - RNA, 64 nt, hsa; identical to SEQ ID NO: 545959

SEQ ID NO: 648890 - RNA, 64 nt, hsa; identical to SEQ ID NO: 545960

SEQ ID NO: 648891 - RNA, 64 nt, hsa; identical to SEQ ID NO: 545961

SEQ ID NO: 648892 - RNA, 64 nt, hsa; identical to SEQ ID NO: 545962

SEQ ID NO: 648893 - RNA, 64 nt, hsa; identical to SEQ ID NO: 545963

SEQ ID NO: 648894 - RNA, 64 nt, hsa; identical to SEQ ID NO: 232514

SEQ ID NO: 648895 - RNA, 64 nt, hsa; identical to SEQ ID NO: 232515

SEQ ID NO: 648896 - RNA, 64 nt, hsa; identical to SEQ ID NO: 232516

SEQ ID NO: 648897 - RNA, 64 nt, hsa; identical to SEQ ID NO: 232517

SEQ ID NO: 648898 - RNA, 64 nt, hsa; identical to SEQ ID NO: 232518

SEQ ID NO: 648899 - RNA, 64 nt, hsa; identical to SEQ ID NO: 232519

SEQ ID NO: 648900 - RNA, 64 nt, hsa; identical to SEQ ID NO: 302252

SEQ ID NO: 648901 - RNA, 64 nt, hsa; identical to SEQ ID NO: 302253

SEQ ID NO: 648902 - RNA, 64 nt, hsa; identical to SEQ ID NO: 302254

SEQ ID NO: 648903 - RNA, 64 nt, hsa; identical to SEQ ID NO: 302255

SEQ ID NO: 648904 - RNA, 64 nt, hsa; identical to SEQ ID NO: 302256

SEQ ID NO: 648905 - RNA, 64 nt, hsa; identical to SEQ ID NO: 302257

SEQ ID NO: 648906 - RNA, 64 nt, hsa; identical to SEQ ID NO: 302258

SEQ ID NO: 648907 - RNA, 64 nt, hsa; identical to SEQ ID NO: 302259

SEQ ID NO: 648908 - RNA, 64 nt, hsa; identical to SEQ ID NO: 302260

SEQ ID NO: 648909 - RNA, 64 nt, hsa; identical to SEQ ID NO: 302261

SEQ ID NO: 648910 - RNA, 64 nt, hsa; identical to SEQ ID NO: 302262

SEQ ID NO: 648911 - RNA, 64 nt, hsa; identical to SEQ ID NO: 302263

SEQ ID NO: 648912 - RNA, 64 nt, hsa; identical to SEQ ID NO: 302264

SEQ ID NO: 648913 - RNA, 64 nt, hsa; identical to SEQ ID NO: 302265

SEQ ID NO: 648914 - RNA, 64 nt, hsa; identical to SEQ ID NO: 302266

SEQ ID NO: 648915 - RNA, 64 nt, hsa; identical to SEQ ID NO: 302267

SEQ ID NO: 648916 - RNA, 64 nt, hsa; identical to SEQ ID NO: 302268

SEQ ID NO: 648917 - RNA, 64 nt, hsa; identical to SEQ ID NO: 302269

SEQ ID NO: 648918 - RNA, 64 nt, hsa; identical to SEQ ID NO: 302270

SEQ ID NO: 648919 - RNA, 64 nt, hsa; identical to SEQ ID NO: 302271

SEQ ID NO: 648920 - RNA, 64 nt, hsa; identical to SEQ ID NO: 302272

SEQ ID NO: 648921 - RNA, 64 nt, hsa; identical to SEQ ID NO: 302273

SEQ ID NO: 648922 - RNA, 64 nt, hsa; identical to SEQ ID NO: 38711

SEQ ID NO: 648923 - RNA, 64 nt, hsa; identical to SEQ ID NO: 38712

SEQ ID NO: 648924 - RNA, 64 nt, hsa; identical to SEQ ID NO: 38713

SEQ ID NO: 648925 - RNA, 64 nt, hsa; identical to SEQ ID NO: 38714

SEQ ID NO: 648926 - RNA, 64 nt, hsa; identical to SEQ ID NO: 38715

SEQ ID NO: 648927 - RNA, 64 nt, hsa; identical to SEQ ID NO: 38716

SEQ ID NO: 648928 - RNA, 64 nt, hsa; identical to SEQ ID NO: 38717

SEQ ID NO: 648929 - RNA, 64 nt, hsa; identical to SEQ ID NO: 38718

SEQ ID NO: 648930 - RNA, 64 nt, hsa; identical to SEQ ID NO: 38719

SEQ ID NO: 648931 - RNA, 64 nt, hsa; identical to SEQ ID NO: 38720

SEQ ID NO: 648932 - RNA, 64 nt, hsa; identical to SEQ ID NO: 38721

SEQ ID NO: 648933 - RNA, 64 nt, hsa; identical to SEQ ID NO: 38722

SEQ ID NO: 648934 - RNA, 64 nt, hsa; identical to SEQ ID NO: 38723

SEQ ID NO: 648935 - RNA, 64 nt, hsa; identical to SEQ ID NO: 38724

SEQ ID NO: 648936 - RNA, 64 nt, hsa; identical to SEQ ID NO: 38725

SEQ ID NO: 648937 - RNA, 64 nt, hsa; identical to SEQ ID NO: 38726

SEQ ID NO: 648938 - RNA, 64 nt, hsa; identical to SEQ ID NO: 38727

SEQ ID NO: 648939 - RNA, 64 nt, hsa; identical to SEQ ID NO: 38728

SEQ ID NO: 648940 - RNA, 64 nt, hsa; identical to SEQ ID NO: 38729

SEQ ID NO: 648941 - RNA, 64 nt, hsa; identical to SEQ ID NO: 38730

SEQ ID NO: 648942 - RNA, 64 nt, hsa; identical to SEQ ID NO: 38731

SEQ ID NO: 648943 - RNA, 64 nt, hsa; identical to SEQ ID NO: 38732

SEQ ID NO: 648944 - RNA, 64 nt, hsa; identical to SEQ ID NO: 38733

SEQ ID NO: 648945 - RNA, 64 nt, hsa; identical to SEQ ID NO: 38734

SEQ ID NO: 648946 - RNA, 64 nt, hsa; identical to SEQ ID NO: 38735

SEQ ID NO: 648947 - RNA, 64 nt, hsa; identical to SEQ ID NO: 38736

SEQ ID NO: 648948 - RNA, 64 nt, hsa; identical to SEQ ID NO: 38737

SEQ ID NO: 648949 - RNA, 64 nt, hsa; identical to SEQ ID NO: 38738

SEQ ID NO: 648950 - RNA, 64 nt, hsa; identical to SEQ ID NO: 38739

SEQ ID NO: 648951 - RNA, 64 nt, hsa; identical to SEQ ID NO: 38740

SEQ ID NO: 648952 - RNA, 64 nt, hsa; identical to SEQ ID NO: 38741

SEQ ID NO: 648953 - RNA, 64 nt, hsa; identical to SEQ ID NO: 38742

SEQ ID NO: 648954 - RNA, 64 nt, hsa; identical to SEQ ID NO: 38743

SEQ ID NO: 648955 - RNA, 64 nt, hsa; identical to SEQ ID NO: 38744

SEQ ID NO: 648956 - RNA, 64 nt, hsa; identical to SEQ ID NO: 38745

SEQ ID NO: 648957 - RNA, 64 nt, hsa; identical to SEQ ID NO: 38746

SEQ ID NO: 648958 - RNA, 64 nt, hsa; identical to SEQ ID NO: 38747

SEQ ID NO: 648959 - RNA, 64 nt, hsa; identical to SEQ ID NO: 38748

SEQ ID NO: 648960 - RNA, 64 nt, hsa; identical to SEQ ID NO: 38749

SEQ ID NO: 648961 - RNA, 64 nt, hsa; identical to SEQ ID NO: 38750

SEQ ID NO: 648962 - RNA, 64 nt, hsa; identical to SEQ ID NO: 38751

SEQ ID NO: 648963 - RNA, 64 nt, hsa; identical to SEQ ID NO: 38752

SEQ ID NO: 648964 - RNA, 64 nt, hsa; identical to SEQ ID NO: 38753

SEQ ID NO: 648965 - RNA, 64 nt, hsa; identical to SEQ ID NO: 38754

SEQ ID NO: 648966 - RNA, 64 nt, hsa; identical to SEQ ID NO: 38755

SEQ ID NO: 648967 - RNA, 64 nt, hsa; identical to SEQ ID NO: 38756

SEQ ID NO: 648968 - RNA, 64 nt, hsa; identical to SEQ ID NO: 38757

SEQ ID NO: 648969 - RNA, 64 nt, hsa; identical to SEQ ID NO: 38758

SEQ ID NO: 648970 - RNA, 64 nt, hsa; identical to SEQ ID NO: 38759

SEQ ID NO: 648971 - RNA, 64 nt, hsa; identical to SEQ ID NO: 38760

SEQ ID NO: 648972 - RNA, 64 nt, hsa; identical to SEQ ID NO: 38761

SEQ ID NO: 648973 - RNA, 64 nt, hsa; identical to SEQ ID NO: 38762

SEQ ID NO: 648974 - RNA, 64 nt, hsa; identical to SEQ ID NO: 38763

SEQ ID NO: 648975 - RNA, 64 nt, hsa; identical to SEQ ID NO: 38764

SEQ ID NO: 648976 - RNA, 64 nt, hsa; identical to SEQ ID NO: 38765

SEQ ID NO: 648977 - RNA, 64 nt, hsa; identical to SEQ ID NO: 38766

SEQ ID NO: 648978 - RNA, 64 nt, hsa; identical to SEQ ID NO: 38767

SEQ ID NO: 648979 - RNA, 64 nt, hsa; identical to SEQ ID NO: 38768

SEQ ID NO: 648980 - RNA, 64 nt, hsa; identical to SEQ ID NO: 38769

SEQ ID NO: 648981 - RNA, 64 nt, hsa; identical to SEQ ID NO: 38770

SEQ ID NO: 648982 - RNA, 64 nt, hsa; identical to SEQ ID NO: 38771

SEQ ID NO: 648983 - RNA, 64 nt, hsa; identical to SEQ ID NO: 38772

SEQ ID NO: 648984 - RNA, 64 nt, hsa; identical to SEQ ID NO: 38773

SEQ ID NO: 648985 - RNA, 64 nt, hsa; identical to SEQ ID NO: 38774

SEQ ID NO: 648986 - RNA, 64 nt, hsa; identical to SEQ ID NO: 38775

SEQ ID NO: 648987 - RNA, 64 nt, hsa; identical to SEQ ID NO: 38776

SEQ ID NO: 648988 - RNA, 64 nt, hsa; identical to SEQ ID NO: 38777

SEQ ID NO: 648989 - RNA, 64 nt, hsa; identical to SEQ ID NO: 38778

SEQ ID NO: 648990 - RNA, 64 nt, hsa; identical to SEQ ID NO: 38779

SEQ ID NO: 648991 - RNA, 64 nt, hsa; identical to SEQ ID NO: 38780

SEQ ID NO: 648992 - RNA, 64 nt, hsa; identical to SEQ ID NO: 38781

SEQ ID NO: 648993 - RNA, 64 nt, hsa; identical to SEQ ID NO: 38782

SEQ ID NO: 648994 - RNA, 64 nt, hsa; identical to SEQ ID NO: 38783

SEQ ID NO: 648995 - RNA, 64 nt, hsa; identical to SEQ ID NO: 38784

SEQ ID NO: 648996 - RNA, 64 nt, hsa; identical to SEQ ID NO: 38785

SEQ ID NO: 648997 - RNA, 64 nt, hsa; identical to SEQ ID NO: 38786

SEQ ID NO: 648998 - RNA, 64 nt, hsa; identical to SEQ ID NO: 38787

SEQ ID NO: 648999 - RNA, 64 nt, hsa; identical to SEQ ID NO: 38788

SEQ ID NO: 649000 - RNA, 64 nt, hsa; identical to SEQ ID NO: 38789

SEQ ID NO: 649001 - RNA, 64 nt, hsa; identical to SEQ ID NO: 38790

SEQ ID NO: 649002 - RNA, 64 nt, hsa; identical to SEQ ID NO: 38791

SEQ ID NO: 649003 - RNA, 64 nt, hsa
auguugccacuccuuuuuaaggacaaacucaggcaaggagcauguuuuuuuguuauuuacaaaa

SEQ ID NO: 649004 - RNA, 64 nt, hsa
agaaaagauaggaccaucagugacaguuaaguguaaggagcaaguggaauugaguccuucaggg

SEQ ID NO: 649005 - RNA, 64 nt, hsa
uucaggcagcacugacaauaguuaugccuguacuaaggagcaugauuuuaagaggcuuuggccc

SEQ ID NO: 649006 - RNA, 64 nt, hsa
gcugacaauacugcugccuuacccgccauacauuaaggagcaggguccugguccuaaagaguua

SEQ ID NO: 649007 - RNA, 64 nt, hsa
gaaaggagcaguggcccgcgugauuguggcauuuaaggagcaguggcccaugugacuguggcau

SEQ ID NO: 649008 - RNA, 64 nt, hsa
acagugugagacucagguugucuguagagaaugaaaggagcaguggcccgcgugauuguggcau

SEQ ID NO: 649009 - RNA, 64 nt, hsa
caaggggauggagacaggaccacaggaaugggccaaggagcaacgugccugccauucagccagc

SEQ ID NO: 649010 - RNA, 62 nt, hsa
ccagacugagccuggaaugaugcagcucagucaaggagcagcagaccuggcacuggaacagg

SEQ ID NO: 649011 - RNA, 64 nt, hsa
ugaaagcuucuguuugaagagacaugaguucuggaaggagcaaggccaccagguccagagaacc

SEQ ID NO: 649012 - RNA, 64 nt, hsa
auauaagucucgccaucgucaaagagaaacuuugaaggagcaggagacugaaaucgauauuaau

SEQ ID NO: 649013 - RNA, 64 nt, hsa
uccccaagccuccugaggacacaggaagagacggaaggagcaccuugacagacuugugugaguc

SEQ ID NO: 649014 - RNA, 64 nt, hsa
uaaccgucuucacaauguauuuucaucacaguuuaaggagcaucagccgcuucucaagugggua

SEQ ID NO: 649015 - RNA, 64 nt, hsa
gacuuuaucagaaacucaaagcuugggggauaaaaaggagcaagagaauacuguaacaaacuuc

SEQ ID NO: 649016 - RNA, 64 nt, hsa
cccaugauugaccagucaaaucgagcagugagccaaggagcagcauauaguccagagggucagc

SEQ ID NO: 649017 - RNA, 64 nt, hsa
cagacucaccgaccgggaccucagacgcgagggaaaggagcacuaaguggggcucgccgccugc

SEQ ID NO: 649018 - RNA, 64 nt, hsa
gaugauuuaaaagaugcuuucuaucucugggaaaaaggagcagcauuuggccauguucuuuugu

SEQ ID NO: 649019 - RNA, 64 nt, hsa
cccuccgggccaaaugggccccagguuuccaaggaaggagcaaucugugacuccuaaaaugggu

SEQ ID NO: 649020 - RNA, 64 nt, hsa
accgccucaguguagggaaggguccaggccagggaaggagcacccucuaguggaggcgggggug

SEQ ID NO: 649021 - RNA, 64 nt, hsa
gugggcugggagacagggacaauggggaaaaguuaaggagcaaaauggggguuggaagcaaaaa

SEQ ID NO: 649022 - RNA, 64 nt, hsa
cucuuggcccagggccaggcagucgugguugcagaaggagcaauuaggcugccugccugugggc

SEQ ID NO: 649023 - RNA, 64 nt, hsa
gugcaggaaggccuucaagcgcgccacgcaccucaaggagcacaugcagacacaccaggccggc

SEQ ID NO: 649024 - RNA, 64 nt, hsa
uacaucgcagguaggaaaccacagaaccgucugcaaggagcaagcaacgguggcccuguccacc

SEQ ID NO: 649025 - RNA, 64 nt, hsa
cuaggcccugccucugucaccucauugguccaugaaggagcagccaggggugguggaaggagca

SEQ ID NO: 649026 - RNA, 64 nt, hsa
cauugguccaugaaggagcagccaggggugguggaaggagcacugggcuaggggucagggguca

SEQ ID NO: 649027 - RNA, 64 nt, hsa; identical to SEQ ID NO: 74916

SEQ ID NO: 649028 - RNA, 64 nt, hsa; identical to SEQ ID NO: 74917

SEQ ID NO: 649029 - RNA, 64 nt, hsa; identical to SEQ ID NO: 74918

SEQ ID NO: 649030 - RNA, 64 nt, hsa; identical to SEQ ID NO: 74919

SEQ ID NO: 649031 - RNA, 64 nt, hsa; identical to SEQ ID NO: 74920

SEQ ID NO: 649032 - RNA, 64 nt, hsa; identical to SEQ ID NO: 74921

SEQ ID NO: 649033 - RNA, 64 nt, hsa; identical to SEQ ID NO: 74922

SEQ ID NO: 649034 - RNA, 64 nt, hsa; identical to SEQ ID NO: 74923

SEQ ID NO: 649035 - RNA, 64 nt, hsa; identical to SEQ ID NO: 74924

SEQ ID NO: 649036 - RNA, 64 nt, hsa; identical to SEQ ID NO: 74925

SEQ ID NO: 649037 - RNA, 64 nt, hsa; identical to SEQ ID NO: 74926

SEQ ID NO: 649038 - RNA, 64 nt, hsa; identical to SEQ ID NO: 74927

SEQ ID NO: 649039 - RNA, 64 nt, hsa; identical to SEQ ID NO: 74928

SEQ ID NO: 649040 - RNA, 64 nt, hsa; identical to SEQ ID NO: 74929

SEQ ID NO: 649041 - RNA, 64 nt, hsa; identical to SEQ ID NO: 74930

SEQ ID NO: 649042 - RNA, 64 nt, hsa; identical to SEQ ID NO: 74931

SEQ ID NO: 649043 - RNA, 64 nt, hsa; identical to SEQ ID NO: 74932

SEQ ID NO: 649044 - RNA, 64 nt, hsa; identical to SEQ ID NO: 74933

SEQ ID NO: 649045 - RNA, 64 nt, hsa; identical to SEQ ID NO: 74934

SEQ ID NO: 649046 - RNA, 64 nt, hsa; identical to SEQ ID NO: 74935

SEQ ID NO: 649047 - RNA, 64 nt, hsa; identical to SEQ ID NO: 74936

SEQ ID NO: 649048 - RNA, 64 nt, hsa; identical to SEQ ID NO: 74937

SEQ ID NO: 649049 - RNA, 64 nt, hsa; identical to SEQ ID NO: 74938

SEQ ID NO: 649050 - RNA, 64 nt, hsa; identical to SEQ ID NO: 74939

SEQ ID NO: 649051 - RNA, 64 nt, hsa; identical to SEQ ID NO: 74940

SEQ ID NO: 649052 - RNA, 64 nt, hsa; identical to SEQ ID NO: 74941

SEQ ID NO: 649053 - RNA, 64 nt, hsa; identical to SEQ ID NO: 74942

SEQ ID NO: 649054 - RNA, 64 nt, hsa; identical to SEQ ID NO: 74943

SEQ ID NO: 649055 - RNA, 64 nt, hsa; identical to SEQ ID NO: 74944

SEQ ID NO: 649056 - RNA, 64 nt, hsa; identical to SEQ ID NO: 74945

SEQ ID NO: 649057 - RNA, 64 nt, hsa; identical to SEQ ID NO: 74946

SEQ ID NO: 649058 - RNA, 64 nt, hsa; identical to SEQ ID NO: 74947

SEQ ID NO: 649059 - RNA, 64 nt, hsa; identical to SEQ ID NO: 74948

SEQ ID NO: 649060 - RNA, 64 nt, hsa; identical to SEQ ID NO: 74949

SEQ ID NO: 649061 - RNA, 64 nt, hsa; identical to SEQ ID NO: 74950

SEQ ID NO: 649062 - RNA, 64 nt, hsa; identical to SEQ ID NO: 74951

SEQ ID NO: 649063 - RNA, 64 nt, hsa; identical to SEQ ID NO: 74952

SEQ ID NO: 649064 - RNA, 64 nt, hsa; identical to SEQ ID NO: 74953

SEQ ID NO: 649065 - RNA, 64 nt, hsa; identical to SEQ ID NO: 74954

SEQ ID NO: 649066 - RNA, 64 nt, hsa; identical to SEQ ID NO: 74955

SEQ ID NO: 649067 - RNA, 64 nt, hsa; identical to SEQ ID NO: 74956

SEQ ID NO: 649068 - RNA, 64 nt, hsa; identical to SEQ ID NO: 74957

SEQ ID NO: 649069 - RNA, 64 nt, hsa; identical to SEQ ID NO: 74958

SEQ ID NO: 649070 - RNA, 64 nt, hsa; identical to SEQ ID NO: 74959

SEQ ID NO: 649071 - RNA, 64 nt, hsa; identical to SEQ ID NO: 74960

SEQ ID NO: 649072 - RNA, 64 nt, hsa; identical to SEQ ID NO: 74961

SEQ ID NO: 649073 - RNA, 64 nt, hsa; identical to SEQ ID NO: 74962

SEQ ID NO: 649074 - RNA, 64 nt, hsa; identical to SEQ ID NO: 74963

SEQ ID NO: 649075 - RNA, 64 nt, hsa; identical to SEQ ID NO: 74964

SEQ ID NO: 649076 - RNA, 64 nt, hsa; identical to SEQ ID NO: 74965

SEQ ID NO: 649077 - RNA, 64 nt, hsa; identical to SEQ ID NO: 74966

SEQ ID NO: 649078 - RNA, 64 nt, hsa; identical to SEQ ID NO: 74967

SEQ ID NO: 649079 - RNA, 64 nt, hsa; identical to SEQ ID NO: 74968

SEQ ID NO: 649080 - RNA, 64 nt, hsa; identical to SEQ ID NO: 74969

SEQ ID NO: 649081 - RNA, 64 nt, hsa; identical to SEQ ID NO: 74970

SEQ ID NO: 649082 - RNA, 64 nt, hsa; identical to SEQ ID NO: 74971

SEQ ID NO: 649083 - RNA, 64 nt, hsa; identical to SEQ ID NO: 74972

SEQ ID NO: 649084 - RNA, 64 nt, hsa; identical to SEQ ID NO: 74973

SEQ ID NO: 649085 - RNA, 64 nt, hsa; identical to SEQ ID NO: 74974

SEQ ID NO: 649086 - RNA, 64 nt, hsa; identical to SEQ ID NO: 74975

SEQ ID NO: 649087 - RNA, 64 nt, hsa; identical to SEQ ID NO: 74976

SEQ ID NO: 649088 - RNA, 64 nt, hsa; identical to SEQ ID NO: 74977

SEQ ID NO: 649089 - RNA, 64 nt, hsa; identical to SEQ ID NO: 74978

SEQ ID NO: 649090 - RNA, 64 nt, hsa; identical to SEQ ID NO: 74979

SEQ ID NO: 649091 - RNA, 64 nt, hsa; identical to SEQ ID NO: 74980

SEQ ID NO: 649092 - RNA, 64 nt, hsa; identical to SEQ ID NO: 74981

SEQ ID NO: 649093 - RNA, 64 nt, hsa; identical to SEQ ID NO: 74982

SEQ ID NO: 649094 - RNA, 64 nt, hsa; identical to SEQ ID NO: 74983

SEQ ID NO: 649095 - RNA, 64 nt, hsa; identical to SEQ ID NO: 74984

SEQ ID NO: 649096 - RNA, 64 nt, hsa; identical to SEQ ID NO: 74985

SEQ ID NO: 649097 - RNA, 64 nt, hsa; identical to SEQ ID NO: 74986

SEQ ID NO: 649098 - RNA, 64 nt, hsa; identical to SEQ ID NO: 74987

SEQ ID NO: 649099 - RNA, 64 nt, hsa; identical to SEQ ID NO: 74988

SEQ ID NO: 649100 - RNA, 64 nt, hsa; identical to SEQ ID NO: 74989

SEQ ID NO: 649101 - RNA, 64 nt, hsa; identical to SEQ ID NO: 74990

SEQ ID NO: 649102 - RNA, 64 nt, hsa; identical to SEQ ID NO: 74991

SEQ ID NO: 649103 - RNA, 64 nt, hsa; identical to SEQ ID NO: 74992

SEQ ID NO: 649104 - RNA, 64 nt, hsa; identical to SEQ ID NO: 74993

SEQ ID NO: 649105 - RNA, 64 nt, hsa; identical to SEQ ID NO: 74994

SEQ ID NO: 649106 - RNA, 64 nt, hsa; identical to SEQ ID NO: 74995

SEQ ID NO: 649107 - RNA, 64 nt, hsa
uucacugaaauguugggguugcuuguuauaguagucgguccaucaugaccaguaaaacauaaau

SEQ ID NO: 649108 - RNA, 64 nt, hsa
ugguggagggaaagggagacaaguggggcugcacucgguccagaggccagcuaggagggaaacc

SEQ ID NO: 649109 - RNA, 64 nt, hsa
ucuugaaggaagcauuucuaaaauguauccccuuucgguccaacaacaggaaaccugacugggg

SEQ ID NO: 649110 - RNA, 64 nt, hsa
ugugaagggccagggcccugggcaggccuccagcucgguccaggugauucuggccucuguggua

SEQ ID NO: 649111 - RNA, 64 nt, hsa
gauaaugugaacuucuacuaggcaaagcaauacaucgguccaaggauuuucugcuuucauuucu

SEQ ID NO: 649112 - RNA, 64 nt, hsa
gcauuuuuuauaauuuucuaagucgugcacuuucucgguccacucuuguugaagugcuguuuua

SEQ ID NO: 649113 - RNA, 64 nt, hsa
guguguguggcucagcuuccacggcguguuugguucgguccaugugugugcguguguauacuug

SEQ ID NO: 649114 - RNA, 64 nt, hsa
ccccacccucuugcugcucgcccugcucccugcuucgguccagagaacuggcagauacuggugg

SEQ ID NO: 649115 - RNA, 64 nt, hsa
uccacaggaggaaucggacgagaggaugugacauucgguccaggagagaaagagcaguuucugu

SEQ ID NO: 649116 - RNA, 64 nt, hsa
aguagcggggcuggagcaguucauuacucauaccucgguccaaaccaaaaagguucuuuucaga

SEQ ID NO: 649117 - RNA, 64 nt, hsa
acccacuuuauucaguucuguacauauggggacaucgguccaagcccaacccaccuuagcaugu

SEQ ID NO: 649118 - RNA, 64 nt, hsa
caaacaauguuggaagugguauuuagguucuagaucgguccacgaaaguuagcccauauguaua

SEQ ID NO: 649119 - RNA, 64 nt, hsa
augcaguggggccccuggggugcccucggcagcuucgguccagccugcaucugccccucggccu

SEQ ID NO: 649120 - RNA, 64 nt, hsa
ugccccuugccccacacagaccaggccuuaaaugucgguccaggcccugugcaccuuaccccag

SEQ ID NO: 649121 - RNA, 64 nt, hsa
gcugacugagggcauucaggaguaaaugcacaggucgguccaggcccgucuggguuugggaugc

SEQ ID NO: 649122 - RNA, 64 nt, hsa
uaaaauucccagugugcauacauuuucugguuccucgguccaguugcuaaaguucuuaguauuu

SEQ ID NO: 649123 - RNA, 64 nt, hsa
uccccucacagaggugcugugagcgaggccuccuucgguccaggcagaaccucaggcagucucu

SEQ ID NO: 649124 - RNA, 64 nt, hsa
uuuuaccaaagcaucaauacaaccagcccaaccaucgguccacaccugggcauuuggugagagu

SEQ ID NO: 649125 - RNA, 64 nt, hsa
guuucgcagcugucuccccuccgcagcagauaccucgguccagaucuccggauugucgggggac

SEQ ID NO: 649126 - RNA, 64 nt, hsa
aauguaaauggggacuucuguaaaguucucaguuucgguccaugugguuuaucuuuacauuuua

SEQ ID NO: 649127 - RNA, 64 nt, hsa
gcagguuggcagcuaggguuuguguuggaggcuuucgguccagugucuugcaguccuacaacaa

SEQ ID NO: 649128 - RNA, 64 nt, hsa
uucccucagcaaucuguccugucugugcucccauucgguccacauagcuuucuuugccucucug

SEQ ID NO: 649129 - RNA, 64 nt, hsa
ggagaaugcccauggcccuuuauuccuucuucccucgguccacgaacaggaagaggcugaggcc

SEQ ID NO: 649130 - RNA, 64 nt, hsa
ggcgugcugcggggcccugaugcccccacccaccucgguccagcgcggcccugcccaggaggcg

SEQ ID NO: 649131 - RNA, 64 nt, hsa
ccuggcucccuccacccaacugcacccaugagacucgguccaagaguccauuccccagguggga

SEQ ID NO: 649132 - RNA, 64 nt, hsa
cacaacugcuuguucagguaucgugaugggccacucgguccaaaaucagccaggccaucuuuuc

SEQ ID NO: 649133 - RNA, 64 nt, hsa
guucucugccccucccugcccgcguuucagggccucgguccauagagaacaccaccaccauggc

SEQ ID NO: 649134 - RNA, 64 nt, hsa
gguacauuuuccucuauugucuagcuaagggcuuucgguccaccaguaaauaagaucaaaugcu

SEQ ID NO: 649135 - RNA, 64 nt, hsa
augcugcuggagcugaaucggaugccaccaaggcucgguccagcccaguaccgcuggaagugaa

SEQ ID NO: 649136 - RNA, 64 nt, hsa
cagcacucggacguccccggaccagcccucagucucgguccacgcugcuuucuucccaaaggac

SEQ ID NO: 649137 - RNA, 64 nt, hsa
uccccaacagagcccaccagcagugguggagaugucgguccaugagcgcacacacaagacugag

SEQ ID NO: 649138 - RNA, 64 nt, hsa
gccugaugaccaaacucucccuuuccccauccaaucgguccacacuccccgcccuggccucugg

SEQ ID NO: 649139 - RNA, 64 nt, hsa
ugucugucucauuucugcauucgucguccuucguucgguccagaagcaaccgcgacaguccugc

SEQ ID NO: 649140 - RNA, 64 nt, hsa
ccggaccuggcaguggagccaccgagcgagcagcucgguccagugacccagaucccagggaccu

SEQ ID NO: 649141 - RNA, 64 nt, hsa
gccugaugaccaaacucucccuuucuccauccaaucgguccacacuccccgcccccggccucug

SEQ ID NO: 649142 - RNA, 64 nt, hsa
caugugggacccugauggaccugaaagaccaggaucgguccagcucagauauugagggcucuga

SEQ ID NO: 649143 - RNA, 64 nt, hsa
cuauuacuaagagaaaauuuucuccugguagaccucgguccaaacagguagggugauuuuaaug

SEQ ID NO: 649144 - RNA, 64 nt, hsa
ccucccugggggcagguagaccuguggggauggcucgguccaagcccaacacugcccgcuccag

SEQ ID NO: 649145 - RNA, 64 nt, hsa
ugcucucugcuugacaacaaaagucagggugcagucgguccacccuugacugcucuuggcuugg

SEQ ID NO: 649146 - RNA, 64 nt, hsa
cugccuggcaagguccuucccugggaaucaccacucgguccaaccuagacaaccaagaccgcua

SEQ ID NO: 649147 - RNA, 64 nt, hsa
ccgugccagcguucacgcucccucccggggcccugccucggagcucugugguggaaggacggga

SEQ ID NO: 649148 - RNA, 58 nt, hsa
accaggaggccuucguguaguggcugccgccucggaacugcggucuccugccugugcu

SEQ ID NO: 649149 - RNA, 64 nt, hsa
cagucggcgggacccucauggaagcaucgcccucgccucggaccuugccuggcgcuauuuuugc

SEQ ID NO: 649150 - RNA, 64 nt, hsa
gcgcuauuuuugcagggagcuggggagcaggaacgccucggaccugagugcucuccauauugug

SEQ ID NO: 649151 - RNA, 57 nt, hsa; identical to SEQ ID NO: 130560

SEQ ID NO: 649152 - RNA, 64 nt, hsa; identical to SEQ ID NO: 130561

SEQ ID NO: 649153 - RNA, 64 nt, hsa; identical to SEQ ID NO: 130562

SEQ ID NO: 649154 - RNA, 64 nt, hsa; identical to SEQ ID NO: 130563

SEQ ID NO: 649155 - RNA, 64 nt, hsa; identical to SEQ ID NO: 130564

SEQ ID NO: 649156 - RNA, 64 nt, hsa; identical to SEQ ID NO: 130565

SEQ ID NO: 649157 - RNA, 64 nt, hsa; identical to SEQ ID NO: 130566

SEQ ID NO: 649158 - RNA, 64 nt, hsa; identical to SEQ ID NO: 130567

SEQ ID NO: 649159 - RNA, 64 nt, hsa; identical to SEQ ID NO: 130568

SEQ ID NO: 649160 - RNA, 64 nt, hsa; identical to SEQ ID NO: 130569

SEQ ID NO: 649161 - RNA, 64 nt, hsa; identical to SEQ ID NO: 130570

SEQ ID NO: 649162 - RNA, 64 nt, hsa; identical to SEQ ID NO: 130571

SEQ ID NO: 649163 - RNA, 64 nt, hsa; identical to SEQ ID NO: 130572

SEQ ID NO: 649164 - RNA, 64 nt, hsa; identical to SEQ ID NO: 130573

SEQ ID NO: 649165 - RNA, 64 nt, hsa; identical to SEQ ID NO: 130574

SEQ ID NO: 649166 - RNA, 64 nt, hsa; identical to SEQ ID NO: 130575

SEQ ID NO: 649167 - RNA, 64 nt, hsa; identical to SEQ ID NO: 130576

SEQ ID NO: 649168 - RNA, 64 nt, hsa; identical to SEQ ID NO: 130577

SEQ ID NO: 649169 - RNA, 64 nt, hsa; identical to SEQ ID NO: 130578

SEQ ID NO: 649170 - RNA, 64 nt, hsa; identical to SEQ ID NO: 130579

SEQ ID NO: 649171 - RNA, 64 nt, hsa; identical to SEQ ID NO: 130580

SEQ ID NO: 649172 - RNA, 64 nt, hsa; identical to SEQ ID NO: 130581

SEQ ID NO: 649173 - RNA, 64 nt, hsa; identical to SEQ ID NO: 130582

SEQ ID NO: 649174 - RNA, 64 nt, hsa; identical to SEQ ID NO: 130583

SEQ ID NO: 649175 - RNA, 64 nt, hsa; identical to SEQ ID NO: 130584

SEQ ID NO: 649176 - RNA, 64 nt, hsa; identical to SEQ ID NO: 130585

SEQ ID NO: 649177 - RNA, 64 nt, hsa; identical to SEQ ID NO: 130586

SEQ ID NO: 649178 - RNA, 64 nt, hsa; identical to SEQ ID NO: 130587

SEQ ID NO: 649179 - RNA, 64 nt, hsa; identical to SEQ ID NO: 130588

SEQ ID NO: 649180 - RNA, 64 nt, hsa; identical to SEQ ID NO: 130589

SEQ ID NO: 649181 - RNA, 64 nt, hsa; identical to SEQ ID NO: 130590

SEQ ID NO: 649182 - RNA, 64 nt, hsa; identical to SEQ ID NO: 130591

SEQ ID NO: 649183 - RNA, 64 nt, hsa; identical to SEQ ID NO: 130592

SEQ ID NO: 649184 - RNA, 64 nt, hsa; identical to SEQ ID NO: 130593

SEQ ID NO: 649185 - RNA, 64 nt, hsa; identical to SEQ ID NO: 130594

SEQ ID NO: 649186 - RNA, 64 nt, hsa; identical to SEQ ID NO: 130595

SEQ ID NO: 649187 - RNA, 64 nt, hsa; identical to SEQ ID NO: 130596

SEQ ID NO: 649188 - RNA, 64 nt, hsa; identical to SEQ ID NO: 130597

SEQ ID NO: 649189 - RNA, 64 nt, hsa; identical to SEQ ID NO: 130598

SEQ ID NO: 649190 - RNA, 64 nt, hsa; identical to SEQ ID NO: 130599

SEQ ID NO: 649191 - RNA, 64 nt, hsa; identical to SEQ ID NO: 130600

SEQ ID NO: 649192 - RNA, 64 nt, hsa; identical to SEQ ID NO: 130601

SEQ ID NO: 649193 - RNA, 64 nt, hsa; identical to SEQ ID NO: 130602

SEQ ID NO: 649194 - RNA, 64 nt, hsa; identical to SEQ ID NO: 130603

SEQ ID NO: 649195 - RNA, 64 nt, hsa; identical to SEQ ID NO: 130604

SEQ ID NO: 649196 - RNA, 64 nt, hsa; identical to SEQ ID NO: 130605

SEQ ID NO: 649197 - RNA, 64 nt, hsa; identical to SEQ ID NO: 130606

SEQ ID NO: 649198 - RNA, 64 nt, hsa; identical to SEQ ID NO: 130607

SEQ ID NO: 649199 - RNA, 64 nt, hsa; identical to SEQ ID NO: 130608

SEQ ID NO: 649200 - RNA, 64 nt, hsa; identical to SEQ ID NO: 130609

SEQ ID NO: 649201 - RNA, 64 nt, hsa; identical to SEQ ID NO: 130610

SEQ ID NO: 649202 - RNA, 64 nt, hsa; identical to SEQ ID NO: 130611

SEQ ID NO: 649203 - RNA, 64 nt, hsa; identical to SEQ ID NO: 72506

SEQ ID NO: 649204 - RNA, 64 nt, hsa; identical to SEQ ID NO: 72507

SEQ ID NO: 649205 - RNA, 64 nt, hsa; identical to SEQ ID NO: 72508

SEQ ID NO: 649206 - RNA, 64 nt, hsa; identical to SEQ ID NO: 72509

SEQ ID NO: 649207 - RNA, 64 nt, hsa; identical to SEQ ID NO: 72510

SEQ ID NO: 649208 - RNA, 64 nt, hsa; identical to SEQ ID NO: 72511

SEQ ID NO: 649209 - RNA, 64 nt, hsa; identical to SEQ ID NO: 72512

SEQ ID NO: 649210 - RNA, 64 nt, hsa; identical to SEQ ID NO: 72513

SEQ ID NO: 649211 - RNA, 64 nt, hsa; identical to SEQ ID NO: 72514

SEQ ID NO: 649212 - RNA, 64 nt, hsa; identical to SEQ ID NO: 72515

SEQ ID NO: 649213 - RNA, 64 nt, hsa; identical to SEQ ID NO: 72516

SEQ ID NO: 649214 - RNA, 64 nt, hsa; identical to SEQ ID NO: 72517

SEQ ID NO: 649215 - RNA, 64 nt, hsa; identical to SEQ ID NO: 72518

SEQ ID NO: 649216 - RNA, 64 nt, hsa; identical to SEQ ID NO: 72519

SEQ ID NO: 649217 - RNA, 64 nt, hsa; identical to SEQ ID NO: 72520

SEQ ID NO: 649218 - RNA, 64 nt, hsa; identical to SEQ ID NO: 72521

SEQ ID NO: 649219 - RNA, 64 nt, hsa; identical to SEQ ID NO: 72522

SEQ ID NO: 649220 - RNA, 64 nt, hsa; identical to SEQ ID NO: 72523

SEQ ID NO: 649221 - RNA, 64 nt, hsa; identical to SEQ ID NO: 72524

SEQ ID NO: 649222 - RNA, 64 nt, hsa; identical to SEQ ID NO: 72525

SEQ ID NO: 649223 - RNA, 64 nt, hsa; identical to SEQ ID NO: 72526

SEQ ID NO: 649224 - RNA, 64 nt, hsa; identical to SEQ ID NO: 72527

SEQ ID NO: 649225 - RNA, 64 nt, hsa; identical to SEQ ID NO: 72528

SEQ ID NO: 649226 - RNA, 64 nt, hsa; identical to SEQ ID NO: 72529

SEQ ID NO: 649227 - RNA, 64 nt, hsa; identical to SEQ ID NO: 72530

SEQ ID NO: 649228 - RNA, 64 nt, hsa; identical to SEQ ID NO: 72531

SEQ ID NO: 649229 - RNA, 64 nt, hsa; identical to SEQ ID NO: 72532

SEQ ID NO: 649230 - RNA, 64 nt, hsa; identical to SEQ ID NO: 72533

SEQ ID NO: 649231 - RNA, 64 nt, hsa; identical to SEQ ID NO: 72534

SEQ ID NO: 649232 - RNA, 64 nt, hsa; identical to SEQ ID NO: 72535

SEQ ID NO: 649233 - RNA, 64 nt, hsa; identical to SEQ ID NO: 72536

SEQ ID NO: 649234 - RNA, 64 nt, hsa; identical to SEQ ID NO: 72537

SEQ ID NO: 649235 - RNA, 64 nt, hsa; identical to SEQ ID NO: 72538

SEQ ID NO: 649236 - RNA, 64 nt, hsa; identical to SEQ ID NO: 72539

SEQ ID NO: 649237 - RNA, 64 nt, hsa; identical to SEQ ID NO: 72540

SEQ ID NO: 649238 - RNA, 64 nt, hsa; identical to SEQ ID NO: 72541

SEQ ID NO: 649239 - RNA, 64 nt, hsa; identical to SEQ ID NO: 72542

SEQ ID NO: 649240 - RNA, 64 nt, hsa; identical to SEQ ID NO: 72543

SEQ ID NO: 649241 - RNA, 64 nt, hsa; identical to SEQ ID NO: 72544

SEQ ID NO: 649242 - RNA, 64 nt, hsa; identical to SEQ ID NO: 72545

SEQ ID NO: 649243 - RNA, 64 nt, hsa; identical to SEQ ID NO: 72546

SEQ ID NO: 649244 - RNA, 64 nt, hsa; identical to SEQ ID NO: 72547

SEQ ID NO: 649245 - RNA, 64 nt, hsa; identical to SEQ ID NO: 72548

SEQ ID NO: 649246 - RNA, 64 nt, hsa; identical to SEQ ID NO: 72549

SEQ ID NO: 649247 - RNA, 64 nt, hsa; identical to SEQ ID NO: 72550

SEQ ID NO: 649248 - RNA, 64 nt, hsa; identical to SEQ ID NO: 72551

SEQ ID NO: 649249 - RNA, 64 nt, hsa; identical to SEQ ID NO: 72552

SEQ ID NO: 649250 - RNA, 64 nt, hsa; identical to SEQ ID NO: 72553

SEQ ID NO: 649251 - RNA, 64 nt, hsa; identical to SEQ ID NO: 72554

SEQ ID NO: 649252 - RNA, 64 nt, hsa; identical to SEQ ID NO: 72555

SEQ ID NO: 649253 - RNA, 64 nt, hsa; identical to SEQ ID NO: 72556

SEQ ID NO: 649254 - RNA, 64 nt, hsa; identical to SEQ ID NO: 72557

SEQ ID NO: 649255 - RNA, 64 nt, hsa; identical to SEQ ID NO: 72558

SEQ ID NO: 649256 - RNA, 64 nt, hsa; identical to SEQ ID NO: 72559

SEQ ID NO: 649257 - RNA, 64 nt, hsa; identical to SEQ ID NO: 72560

SEQ ID NO: 649258 - RNA, 64 nt, hsa; identical to SEQ ID NO: 72561

SEQ ID NO: 649259 - RNA, 64 nt, hsa; identical to SEQ ID NO: 72562

SEQ ID NO: 649260 - RNA, 64 nt, hsa; identical to SEQ ID NO: 72563

SEQ ID NO: 649261 - RNA, 64 nt, hsa; identical to SEQ ID NO: 72564

SEQ ID NO: 649262 - RNA, 64 nt, hsa; identical to SEQ ID NO: 72565

SEQ ID NO: 649263 - RNA, 64 nt, hsa; identical to SEQ ID NO: 72566

SEQ ID NO: 649264 - RNA, 64 nt, hsa; identical to SEQ ID NO: 72567

SEQ ID NO: 649265 - RNA, 64 nt, hsa; identical to SEQ ID NO: 72568

SEQ ID NO: 649266 - RNA, 64 nt, hsa; identical to SEQ ID NO: 72569

SEQ ID NO: 649267 - RNA, 64 nt, hsa; identical to SEQ ID NO: 72570

SEQ ID NO: 649268 - RNA, 64 nt, hsa; identical to SEQ ID NO: 72571

SEQ ID NO: 649269 - RNA, 64 nt, hsa; identical to SEQ ID NO: 72572

SEQ ID NO: 649270 - RNA, 64 nt, hsa; identical to SEQ ID NO: 72573

SEQ ID NO: 649271 - RNA, 64 nt, hsa; identical to SEQ ID NO: 72574

SEQ ID NO: 649272 - RNA, 64 nt, hsa; identical to SEQ ID NO: 72575

SEQ ID NO: 649273 - RNA, 64 nt, hsa; identical to SEQ ID NO: 72576

SEQ ID NO: 649274 - RNA, 64 nt, hsa; identical to SEQ ID NO: 72577

SEQ ID NO: 649275 - RNA, 64 nt, hsa; identical to SEQ ID NO: 72578

SEQ ID NO: 649276 - RNA, 64 nt, hsa; identical to SEQ ID NO: 72579

SEQ ID NO: 649277 - RNA, 64 nt, hsa; identical to SEQ ID NO: 72580

SEQ ID NO: 649278 - RNA, 64 nt, hsa; identical to SEQ ID NO: 72581

SEQ ID NO: 649279 - RNA, 64 nt, hsa; identical to SEQ ID NO: 72582

SEQ ID NO: 649280 - RNA, 64 nt, hsa; identical to SEQ ID NO: 72583

SEQ ID NO: 649281 - RNA, 64 nt, hsa; identical to SEQ ID NO: 72584

SEQ ID NO: 649282 - RNA, 64 nt, hsa; identical to SEQ ID NO: 72585

SEQ ID NO: 649283 - RNA, 64 nt, hsa; identical to SEQ ID NO: 72586

SEQ ID NO: 649284 - RNA, 64 nt, hsa; identical to SEQ ID NO: 72587

SEQ ID NO: 649285 - RNA, 64 nt, hsa; identical to SEQ ID NO: 72588

SEQ ID NO: 649286 - RNA, 64 nt, hsa; identical to SEQ ID NO: 72589

SEQ ID NO: 649287 - RNA, 64 nt, hsa; identical to SEQ ID NO: 72590

SEQ ID NO: 649288 - RNA, 64 nt, hsa; identical to SEQ ID NO: 72591

SEQ ID NO: 649289 - RNA, 64 nt, hsa; identical to SEQ ID NO: 72592

SEQ ID NO: 649290 - RNA, 64 nt, hsa; identical to SEQ ID NO: 72593

SEQ ID NO: 649291 - RNA, 64 nt, hsa; identical to SEQ ID NO: 72594

SEQ ID NO: 649292 - RNA, 64 nt, hsa; identical to SEQ ID NO: 72595

SEQ ID NO: 649293 - RNA, 64 nt, hsa; identical to SEQ ID NO: 72596

SEQ ID NO: 649294 - RNA, 64 nt, hsa; identical to SEQ ID NO: 72597

SEQ ID NO: 649295 - RNA, 64 nt, hsa; identical to SEQ ID NO: 72598

SEQ ID NO: 649296 - RNA, 64 nt, hsa; identical to SEQ ID NO: 72599

SEQ ID NO: 649297 - RNA, 64 nt, hsa; identical to SEQ ID NO: 72600

SEQ ID NO: 649298 - RNA, 64 nt, hsa; identical to SEQ ID NO: 72601

SEQ ID NO: 649299 - RNA, 64 nt, hsa; identical to SEQ ID NO: 198753

SEQ ID NO: 649300 - RNA, 64 nt, hsa; identical to SEQ ID NO: 198754

SEQ ID NO: 649301 - RNA, 64 nt, hsa; identical to SEQ ID NO: 198755

SEQ ID NO: 649302 - RNA, 64 nt, hsa; identical to SEQ ID NO: 198756

SEQ ID NO: 649303 - RNA, 64 nt, hsa; identical to SEQ ID NO: 198757

SEQ ID NO: 649304 - RNA, 64 nt, hsa; identical to SEQ ID NO: 198758

SEQ ID NO: 649305 - RNA, 64 nt, hsa; identical to SEQ ID NO: 198759

SEQ ID NO: 649306 - RNA, 64 nt, hsa; identical to SEQ ID NO: 198760

SEQ ID NO: 649307 - RNA, 64 nt, hsa; identical to SEQ ID NO: 198761

SEQ ID NO: 649308 - RNA, 64 nt, hsa; identical to SEQ ID NO: 198762

SEQ ID NO: 649309 - RNA, 64 nt, hsa; identical to SEQ ID NO: 198763

SEQ ID NO: 649310 - RNA, 64 nt, hsa; identical to SEQ ID NO: 198764

SEQ ID NO: 649311 - RNA, 64 nt, hsa; identical to SEQ ID NO: 198765

SEQ ID NO: 649312 - RNA, 64 nt, hsa; identical to SEQ ID NO: 198766

SEQ ID NO: 649313 - RNA, 64 nt, hsa; identical to SEQ ID NO: 198767

SEQ ID NO: 649314 - RNA, 64 nt, hsa; identical to SEQ ID NO: 198768

SEQ ID NO: 649315 - RNA, 64 nt, hsa; identical to SEQ ID NO: 198769

SEQ ID NO: 649316 - RNA, 64 nt, hsa; identical to SEQ ID NO: 198770

SEQ ID NO: 649317 - RNA, 64 nt, hsa; identical to SEQ ID NO: 198771

SEQ ID NO: 649318 - RNA, 64 nt, hsa; identical to SEQ ID NO: 198772

SEQ ID NO: 649319 - RNA, 64 nt, hsa; identical to SEQ ID NO: 198773

SEQ ID NO: 649320 - RNA, 64 nt, hsa; identical to SEQ ID NO: 198774

SEQ ID NO: 649321 - RNA, 64 nt, hsa; identical to SEQ ID NO: 198775

SEQ ID NO: 649322 - RNA, 64 nt, hsa; identical to SEQ ID NO: 198776

SEQ ID NO: 649323 - RNA, 64 nt, hsa; identical to SEQ ID NO: 198777

SEQ ID NO: 649324 - RNA, 64 nt, hsa; identical to SEQ ID NO: 198778

SEQ ID NO: 649325 - RNA, 64 nt, hsa; identical to SEQ ID NO: 198779

SEQ ID NO: 649326 - RNA, 64 nt, hsa; identical to SEQ ID NO: 198780

SEQ ID NO: 649327 - RNA, 64 nt, hsa; identical to SEQ ID NO: 198781

SEQ ID NO: 649328 - RNA, 64 nt, hsa; identical to SEQ ID NO: 198782

SEQ ID NO: 649329 - RNA, 64 nt, hsa; identical to SEQ ID NO: 198783

SEQ ID NO: 649330 - RNA, 64 nt, hsa; identical to SEQ ID NO: 198784

SEQ ID NO: 649331 - RNA, 64 nt, hsa; identical to SEQ ID NO: 198785

SEQ ID NO: 649332 - RNA, 64 nt, hsa; identical to SEQ ID NO: 198786

SEQ ID NO: 649333 - RNA, 64 nt, hsa; identical to SEQ ID NO: 198787

SEQ ID NO: 649334 - RNA, 64 nt, hsa; identical to SEQ ID NO: 198788

SEQ ID NO: 649335 - RNA, 64 nt, hsa; identical to SEQ ID NO: 198789

SEQ ID NO: 649336 - RNA, 64 nt, hsa; identical to SEQ ID NO: 198790

SEQ ID NO: 649337 - RNA, 64 nt, hsa; identical to SEQ ID NO: 198791

SEQ ID NO: 649338 - RNA, 64 nt, hsa; identical to SEQ ID NO: 198792

SEQ ID NO: 649339 - RNA, 64 nt, hsa; identical to SEQ ID NO: 198793

SEQ ID NO: 649340 - RNA, 64 nt, hsa; identical to SEQ ID NO: 198794

SEQ ID NO: 649341 - RNA, 64 nt, hsa; identical to SEQ ID NO: 198795

SEQ ID NO: 649342 - RNA, 64 nt, hsa; identical to SEQ ID NO: 198796

SEQ ID NO: 649343 - RNA, 64 nt, hsa; identical to SEQ ID NO: 198797

SEQ ID NO: 649344 - RNA, 64 nt, hsa; identical to SEQ ID NO: 198798

SEQ ID NO: 649345 - RNA, 64 nt, hsa; identical to SEQ ID NO: 198799

SEQ ID NO: 649346 - RNA, 64 nt, hsa
uagagugacucagacacaccacaguaacaacucucgcugcaauuuuauuuuaauuugagaaaua

SEQ ID NO: 649347 - RNA, 64 nt, hsa
agccaggcuggagugcaguggcaugaucucagcucgcugcaacccccaccucccagguucaagc

SEQ ID NO: 649348 - RNA, 64 nt, hsa
ccugccugugucuauuauuauauucauaucucuacgcugcaaauuuugggucucaauuuuuacu

SEQ ID NO: 649349 - RNA, 64 nt, hsa
aaagcaaagcuuguugauaguguaguuuucuaaacgcugcaaauuugcagccuuuaccacuaca

SEQ ID NO: 649350 - RNA, 64 nt, hsa
acccagugaacugacuuucuaguucuagaaguuccgcugcaaggccaggaaagcuugagaaagg

SEQ ID NO: 649351 - RNA, 64 nt, hsa
cgccaggcuggagugcaguggcgcagucucggcucgcugcaaccucugacucccugguucaaac

SEQ ID NO: 649352 - RNA, 64 nt, hsa
guuucuagggaaaugaaagaaaggccagcaaauucgcugcaaccuguugauagcaagugaauuu

SEQ ID NO: 649353 - RNA, 64 nt, hsa
ggagccacaggguguuuugcacugaaacgcagaacgcugcaaccaauacuguuguucuccucgc

SEQ ID NO: 649354 - RNA, 64 nt, hsa
cgugcaagugagccccgugugcacaccacccucccgcugcaagucagauugcugggaggacugg

SEQ ID NO: 649355 - RNA, 64 nt, hsa
cuuccccucaguuguuucuaagagcagagucucccgcugcaaucugggugguaacugccagccu

SEQ ID NO: 649356 - RNA, 64 nt, hsa
ugaacaggggaugucaaaucgauucuugaauucccgcugcaagcuagagccgcaggcacccucu

SEQ ID NO: 649357 - RNA, 64 nt, hsa
gcucuucccacccuccacccaccagaguggaacccgcugcaaaauccccagccuuaauucuugc

SEQ ID NO: 649358 - RNA, 64 nt, hsa
uuuaucuauuauauauuaaacauucuugcugcugcgcugcaaaaccauagcagauuugaggcac

SEQ ID NO: 649359 - RNA, 64 nt, hsa
cacccaagucacagaaauaaaaaacugacuuuaccgcugcaauuuuucuguuuuccuccuuacu

SEQ ID NO: 649360 - RNA, 64 nt, hsa
acccucccggaggcauacuugguuuccugacagccgcugcaauacacagucuugacggugccau

SEQ ID NO: 649361 - RNA, 64 nt, hsa
uuccccaauggacuccagaagaaacuugauucaucgcugcaaaggaaagaacaaccuuaaaacu

SEQ ID NO: 649362 - RNA, 64 nt, hsa
gggcgaguagaugccugggcagggaccaggccagcgcugcaaccuccuucggcuuugcccccuu

SEQ ID NO: 649363 - RNA, 64 nt, hsa
gcaccccgaggccgccaauuguccgccccgccagcgcugcaaauaaaccuucugagucagcccu

SEQ ID NO: 649364 - RNA, 64 nt, hsa
ucugcugugucucgcccacccugugcccuggcgccgcugcaacagccccucauggccaggagcc

SEQ ID NO: 649365 - RNA, 64 nt, hsa
ugaugcuugagaugguuuuugcaaaagcagaaaucgcugcaagguaaucacaauagauaaaagu

SEQ ID NO: 649366 - RNA, 64 nt, hsa
gaaucccgcuggagagcaaacacgaacuucuguucgcugcaaaaugguuagaaagaaacagcug

SEQ ID NO: 649367 - RNA, 64 nt, hsa
aaagaggcagaaaaguugguuugguuugcaguaacgcugcaacuagaaaauauaugcacuucag

SEQ ID NO: 649368 - RNA, 64 nt, hsa
caccuuugaccccaaggccuggagggcccaaugucgcugcaaacacagccacgaagaacaugca

SEQ ID NO: 649369 - RNA, 64 nt, hsa
guccuacacaaucagaauuugccuuuuuaagucacgcugcaacuauuccggcuuuuuauauggc

SEQ ID NO: 649370 - RNA, 64 nt, hsa
ugaagccucgugccacacuggcuuugagguagcacgcugcaaguuagugaguggaguugcccaa

SEQ ID NO: 649371 - RNA, 64 nt, hsa
gagguuaucaucauuauuuguauuuugugaauuacgcugcaaaaaaaaaaaaaauguuggcuac

SEQ ID NO: 649372 - RNA, 64 nt, hsa
uccuccaccgagggaggccucacaaaccacaggacgcugcaacgggucaggcuggcgggcccgg

SEQ ID NO: 649373 - RNA, 64 nt, hsa
gccucggcagcuugggauuagcuugggagcgcagcgcugcaaaguggaaaauaugaaaagacca

SEQ ID NO: 649374 - RNA, 64 nt, hsa
gacaugcauuuacucucugccgugggucugcagucgcugcaaccuacccucucucugccucagc

SEQ ID NO: 649375 - RNA, 64 nt, hsa
ucuggguugucucgaucuguguuucaauaaaugccgcugcaaugcaagagcguguggucuugug

SEQ ID NO: 649376 - RNA, 64 nt, hsa
aacuuguccccagugucaccagaccuucugugugcgcugcaagcgccaggugaggcacauucau

SEQ ID NO: 649377 - RNA, 64 nt, hsa
uacuuucugacguaauguaauucaggaagacagacgcugcaaucacagauuuuaaaaaauuguu

SEQ ID NO: 649378 - RNA, 64 nt, hsa
gcccaggcuggagugcaauggcacuaucucagcucgcugcaaccuucaccuccuggguucaagc

SEQ ID NO: 649379 - RNA, 64 nt, hsa
caucucagccuuccugaccucugccccaaacacacgcugcaauuuugucuccuccuuuucuguu

SEQ ID NO: 649380 - RNA, 64 nt, hsa
auguucuguguuguuuccuuagaccugugguguccgcugcaacagcuacuagccacguguagcu

SEQ ID NO: 649381 - RNA, 64 nt, hsa
cuuggugaccauugauugcugcuucugcccaggccgcugcaaagguuaggacuuuguccacuca

SEQ ID NO: 649382 - RNA, 64 nt, hsa
cgggaaggaggcaacugccucacuuaacauccuccgcugcaaggugguggcgccgagaggcgug

SEQ ID NO: 649383 - RNA, 64 nt, hsa
gccugcagggcccucccuuuucccauuguuccugcgcugcaaauugcaggccccagcaaucgug

SEQ ID NO: 649384 - RNA, 64 nt, hsa
cucggagggcugguguucaccaaguuucccuccucgcugcaacccaaugacaccuguauuguuc

SEQ ID NO: 649385 - RNA, 64 nt, hsa
acccaggcuggagugcaguggcaugaucucaggucgcugcaaccucugccuccaggguucaagc

SEQ ID NO: 649386 - RNA, 64 nt, hsa
gcacuaaacauggaaaggaacaacugauaccagccgcugcaaaaucaugccaaaauguaaagac

SEQ ID NO: 649387 - RNA, 64 nt, hsa
guccaggcuggagugcaguggcacaaucucagcucgcugcaaccucugccuccuggguucaagc

SEQ ID NO: 649388 - RNA, 64 nt, hsa
guguaaccagcgggguaaguuaagccaggaccuucgcugcaaaccugguuuuauugcuccuuca

SEQ ID NO: 649389 - RNA, 64 nt, hsa
uuuucuaagcccggccucgucucgccggaggagacgcugcaauaaagguugggagaaggcgcgg

SEQ ID NO: 649390 - RNA, 64 nt, hsa
ccugugugacucaguucuuuccaucuguuugucccgcugcaagccucuuucugcgcugacugug

SEQ ID NO: 649391 - RNA, 64 nt, hsa
uuuaucuauuauauauuaaacauucuugcugcugcgcugcaaagccauagcagauuugaggcgc

SEQ ID NO: 649392 - RNA, 64 nt, hsa
cccuggacaccccugcucuacccaugagccugcccgcugcaaugccuagacuucccaacagccu

SEQ ID NO: 649393 - RNA, 64 nt, hsa; identical to SEQ ID NO: 649351

SEQ ID NO: 649394 - RNA, 64 nt, hsa
agcuauucauaaccuauauucuagaguagacaaucuggacuauguaauaaauagucugcugauu

SEQ ID NO: 649395 - RNA, 64 nt, hsa
aaguaugaauaaagguguggcagaauauaauaaucuggacuauuuucuauaggauaauugcugg

SEQ ID NO: 649396 - RNA, 64 nt, hsa
uagcuacgugaggccugcacagcuaaguguggagcuggacuacggcggcaguauggaauuccag

SEQ ID NO: 649397 - RNA, 64 nt, hsa
ucuaccugaugaaccugagcgggugccgaagcuacuggacuaugcugauggguauguccuaccc

SEQ ID NO: 649398 - RNA, 64 nt, hsa
gcuuacuuuuauuacagucaauuuugaggauauucuggacuaaauauuuaagugcagucauuuc

SEQ ID NO: 649399 - RNA, 64 nt, hsa
ucauuucuuuuugguuugcaaaaagagcacagcccuggacuacaaguuuggagauuuaaauucu

SEQ ID NO: 649400 - RNA, 64 nt, hsa
ucauuucuuuuugguuugcaaaaagagcacagcccuggacuaugaguuuggagaucuaaauucu

SEQ ID NO: 649401 - RNA, 64 nt, hsa
gcuaacuuuuauuacagucaauuuugaggauauucuggacuaaauauuuaagugcagucauuuc

SEQ ID NO: 649402 - RNA, 64 nt, hsa; identical to SEQ ID NO: 110824

SEQ ID NO: 649403 - RNA, 64 nt, hsa; identical to SEQ ID NO: 110825

SEQ ID NO: 649404 - RNA, 64 nt, hsa; identical to SEQ ID NO: 110826

SEQ ID NO: 649405 - RNA, 64 nt, hsa; identical to SEQ ID NO: 110827

SEQ ID NO: 649406 - RNA, 64 nt, hsa; identical to SEQ ID NO: 110828

SEQ ID NO: 649407 - RNA, 64 nt, hsa; identical to SEQ ID NO: 110829

SEQ ID NO: 649408 - RNA, 64 nt, hsa; identical to SEQ ID NO: 110830

SEQ ID NO: 649409 - RNA, 64 nt, hsa; identical to SEQ ID NO: 110831

SEQ ID NO: 649410 - RNA, 64 nt, hsa; identical to SEQ ID NO: 110832

SEQ ID NO: 649411 - RNA, 64 nt, hsa; identical to SEQ ID NO: 110833

SEQ ID NO: 649412 - RNA, 64 nt, hsa; identical to SEQ ID NO: 608457

SEQ ID NO: 649413 - RNA, 64 nt, hsa; identical to SEQ ID NO: 608458

SEQ ID NO: 649414 - RNA, 64 nt, hsa; identical to SEQ ID NO: 608459

SEQ ID NO: 649415 - RNA, 64 nt, hsa; identical to SEQ ID NO: 608460

SEQ ID NO: 649416 - RNA, 64 nt, hsa; identical to SEQ ID NO: 608461

SEQ ID NO: 649417 - RNA, 64 nt, hsa; identical to SEQ ID NO: 608462

SEQ ID NO: 649418 - RNA, 64 nt, hsa; identical to SEQ ID NO: 608463

SEQ ID NO: 649419 - RNA, 64 nt, hsa; identical to SEQ ID NO: 608464

SEQ ID NO: 649420 - RNA, 64 nt, hsa; identical to SEQ ID NO: 608465

SEQ ID NO: 649421 - RNA, 64 nt, hsa; identical to SEQ ID NO: 608466

SEQ ID NO: 649422 - RNA, 64 nt, hsa; identical to SEQ ID NO: 257640

SEQ ID NO: 649423 - RNA, 64 nt, hsa; identical to SEQ ID NO: 257641

SEQ ID NO: 649424 - RNA, 64 nt, hsa; identical to SEQ ID NO: 257642

SEQ ID NO: 649425 - RNA, 64 nt, hsa; identical to SEQ ID NO: 257642

SEQ ID NO: 649426 - RNA, 64 nt, hsa; identical to SEQ ID NO: 257644

SEQ ID NO: 649427 - RNA, 64 nt, hsa; identical to SEQ ID NO: 257645

SEQ ID NO: 649428 - RNA, 64 nt, hsa; identical to SEQ ID NO: 257646

SEQ ID NO: 649429 - RNA, 64 nt, hsa; identical to SEQ ID NO: 257647

SEQ ID NO: 649430 - RNA, 64 nt, hsa; identical to SEQ ID NO: 300937

SEQ ID NO: 649431 - RNA, 64 nt, hsa; identical to SEQ ID NO: 300938

SEQ ID NO: 649432 - RNA, 64 nt, hsa; identical to SEQ ID NO: 300939

SEQ ID NO: 649433 - RNA, 64 nt, hsa; identical to SEQ ID NO: 300940

SEQ ID NO: 649434 - RNA, 64 nt, hsa; identical to SEQ ID NO: 300941

SEQ ID NO: 649435 - RNA, 64 nt, hsa; identical to SEQ ID NO: 300942

SEQ ID NO: 649436 - RNA, 64 nt, hsa; identical to SEQ ID NO: 300943

SEQ ID NO: 649437 - RNA, 64 nt, hsa; identical to SEQ ID NO: 300944

SEQ ID NO: 649438 - RNA, 64 nt, hsa; identical to SEQ ID NO: 300945

SEQ ID NO: 649439 - RNA, 64 nt, hsa; identical to SEQ ID NO: 300946

SEQ ID NO: 649440 - RNA, 64 nt, hsa; identical to SEQ ID NO: 300947

SEQ ID NO: 649441 - RNA, 64 nt, hsa; identical to SEQ ID NO: 300948

SEQ ID NO: 649442 - RNA, 64 nt, hsa; identical to SEQ ID NO: 300949

SEQ ID NO: 649443 - RNA, 64 nt, hsa; identical to SEQ ID NO: 300950

SEQ ID NO: 649444 - RNA, 64 nt, hsa; identical to SEQ ID NO: 300951

SEQ ID NO: 649445 - RNA, 64 nt, hsa; identical to SEQ ID NO: 300952

SEQ ID NO: 649446 - RNA, 64 nt, hsa; identical to SEQ ID NO: 300953

SEQ ID NO: 649447 - RNA, 64 nt, hsa; identical to SEQ ID NO: 300954

SEQ ID NO: 649448 - RNA, 64 nt, hsa; identical to SEQ ID NO: 300955

SEQ ID NO: 649449 - RNA, 64 nt, hsa; identical to SEQ ID NO: 300956

SEQ ID NO: 649450 - RNA, 64 nt, hsa; identical to SEQ ID NO: 300957

SEQ ID NO: 649451 - RNA, 64 nt, hsa; identical to SEQ ID NO: 300958

SEQ ID NO: 649452 - RNA, 64 nt, hsa; identical to SEQ ID NO: 300959

SEQ ID NO: 649453 - RNA, 64 nt, hsa; identical to SEQ ID NO: 300960

SEQ ID NO: 649454 - RNA, 64 nt, hsa; identical to SEQ ID NO: 300961

SEQ ID NO: 649455 - RNA, 64 nt, hsa; identical to SEQ ID NO: 300962

SEQ ID NO: 649456 - RNA, 64 nt, hsa; identical to SEQ ID NO: 300963

SEQ ID NO: 649457 - RNA, 64 nt, hsa; identical to SEQ ID NO: 300964

SEQ ID NO: 649458 - RNA, 54 nt, hsa; identical to SEQ ID NO: 300965

SEQ ID NO: 649459 - RNA, 64 nt, hsa; identical to SEQ ID NO: 300966

SEQ ID NO: 649460 - RNA, 64 nt, hsa; identical to SEQ ID NO: 300967

SEQ ID NO: 649461 - RNA, 64 nt, hsa; identical to SEQ ID NO: 300968

SEQ ID NO: 649462 - RNA, 64 nt, hsa; identical to SEQ ID NO: 300969

SEQ ID NO: 649463 - RNA, 64 nt, hsa; identical to SEQ ID NO: 300970

SEQ ID NO: 649464 - RNA, 64 nt, hsa; identical to SEQ ID NO: 300971

SEQ ID NO: 649465 - RNA, 64 nt, hsa; identical to SEQ ID NO: 300972

SEQ ID NO: 649466 - RNA, 59 nt, hsa; identical to SEQ ID NO: 300973

SEQ ID NO: 649467 - RNA, 64 nt, hsa; identical to SEQ ID NO: 300974

SEQ ID NO: 649468 - RNA, 64 nt, hsa; identical to SEQ ID NO: 300975

SEQ ID NO: 649469 - RNA, 64 nt, hsa; identical to SEQ ID NO: 300976

SEQ ID NO: 649470 - RNA, 64 nt, hsa; identical to SEQ ID NO: 300977

SEQ ID NO: 649471 - RNA, 64 nt, hsa; identical to SEQ ID NO: 300978

SEQ ID NO: 649472 - RNA, 64 nt, hsa; identical to SEQ ID NO: 300979

SEQ ID NO: 649473 - RNA, 64 nt, hsa; identical to SEQ ID NO: 300980

SEQ ID NO: 649474 - RNA, 64 nt, hsa; identical to SEQ ID NO: 300981

SEQ ID NO: 649475 - RNA, 64 nt, hsa; identical to SEQ ID NO: 300982

SEQ ID NO: 649476 - RNA, 64 nt, hsa; identical to SEQ ID NO: 300983

SEQ ID NO: 649477 - RNA, 64 nt, hsa; identical to SEQ ID NO: 300984

SEQ ID NO: 649478 - RNA, 64 nt, hsa; identical to SEQ ID NO: 300985

SEQ ID NO: 649479 - RNA, 64 nt, hsa; identical to SEQ ID NO: 300986

SEQ ID NO: 649480 - RNA, 64 nt, hsa; identical to SEQ ID NO: 300987

SEQ ID NO: 649481 - RNA, 64 nt, hsa; identical to SEQ ID NO: 300988

SEQ ID NO: 649482 - RNA, 64 nt, hsa; identical to SEQ ID NO: 300989

SEQ ID NO: 649483 - RNA, 64 nt, hsa; identical to SEQ ID NO: 300990

SEQ ID NO: 649484 - RNA, 64 nt, hsa; identical to SEQ ID NO: 300991

SEQ ID NO: 649485 - RNA, 64 nt, hsa; identical to SEQ ID NO: 300992

SEQ ID NO: 649486 - RNA, 64 nt, hsa; identical to SEQ ID NO: 300993

SEQ ID NO: 649487 - RNA, 64 nt, hsa; identical to SEQ ID NO: 300994

SEQ ID NO: 649488 - RNA, 64 nt, hsa
ugcuguaauuaggugaacucuaaaacugcaacaucugacaaauagcuuuaaaaauacaaugauu

SEQ ID NO: 649489 - RNA, 64 nt, hsa
aauggauauacuuuuaauaaaguuuuauaacucacugacaaaacauauuucaauaguauaugag

SEQ ID NO: 649490 - RNA, 64 nt, hsa
aauagguucugccagucuacaauagcagugaagacugacaaaucagauauucccaaugacugac

SEQ ID NO: 649491 - RNA, 64 nt, hsa
cgugauccuucugccaaaaugucgaaaucagacccugacaaacuggccaccguccgaauaacag

SEQ ID NO: 649492 - RNA, 64 nt, hsa
ggcuuuacauaagccuucauuccuucaaaagguccugacaaaauacuuggguuuuuuucucuuu

SEQ ID NO: 649493 - RNA, 64 nt, hsa
ugugggaaugggaaaggaaggagacagccaaacucugacaaaggcuuuuccuuauagaauaacc

SEQ ID NO: 649494 - RNA, 64 nt, hsa
aaaacaacuguuacaguuuuauugcucugaguaacugacaaagcagaaacuauucaguuuuugu

SEQ ID NO: 649495 - RNA, 64 nt, hsa
ggcuguggugaauggaugaacguacaucguaaaacugacaaaauauuuuaaaaauauauaaaac

SEQ ID NO: 649496 - RNA, 64 nt, hsa
ggaugacuguacauuuuagugauuugaaaaauaacugacaaaccauugaaacaguuuauuuuau

SEQ ID NO: 649497 - RNA, 64 nt, hsa
acuuaaauauauauaaauaaaggaaccuuuuauacugacaaaccagagaaaaauggaccuuuuu

SEQ ID NO: 649498 - RNA, 64 nt, hsa
aaguguaaacauuucaaagcaggccguacuccuucugacaaauuucuuguaaaccaggauugcc

SEQ ID NO: 649499 - RNA, 64 nt, hsa
uauauagauuucacuauaaauaagcauuuuaagacugacaaauguugaacuguacauacauuua

SEQ ID NO: 649500 - RNA, 64 nt, hsa
augaaugaccaguguuuuuggucgccaaauguugcugacaaacuuaucccaaaacuuuaguggc

SEQ ID NO: 649501 - RNA, 64 nt, hsa
uugagacuuugggguaguuuggcugccauucucacugacaaaauguauaucagcccccaccucc

SEQ ID NO: 649502 - RNA, 64 nt, hsa
ccacauaucuacaacuaucugaccuuugacaaaccugacaaaaacaagcaauggggaaaggauu

SEQ ID NO: 649503 - RNA, 64 nt, hsa
acaaaaugggagaaaauuuucgcaaccuacucaucugacaaagggcuaauauccagaaucuaca

SEQ ID NO: 649504 - RNA, 64 nt, hsa; identical to SEQ ID NO: 45285

SEQ ID NO: 649505 - RNA, 64 nt, hsa; identical to SEQ ID NO: 45286

SEQ ID NO: 649506 - RNA, 64 nt, hsa; identical to SEQ ID NO: 45287

SEQ ID NO: 649507 - RNA, 64 nt, hsa; identical to SEQ ID NO: 45288

SEQ ID NO: 649508 - RNA, 64 nt, hsa; identical to SEQ ID NO: 45289

SEQ ID NO: 649509 - RNA, 64 nt, hsa; identical to SEQ ID NO: 45290

SEQ ID NO: 649510 - RNA, 64 nt, hsa; identical to SEQ ID NO: 45291

SEQ ID NO: 649511 - RNA, 64 nt, hsa; identical to SEQ ID NO: 45292

SEQ ID NO: 649512 - RNA, 64 nt, hsa; identical to SEQ ID NO: 45293

SEQ ID NO: 649513 - RNA, 64 nt, hsa; identical to SEQ ID NO: 45294

SEQ ID NO: 649514 - RNA, 64 nt, hsa; identical to SEQ ID NO: 45295

SEQ ID NO: 649515 - RNA, 64 nt, hsa; identical to SEQ ID NO: 45296

SEQ ID NO: 649516 - RNA, 64 nt, hsa; identical to SEQ ID NO: 45297

SEQ ID NO: 649517 - RNA, 64 nt, hsa; identical to SEQ ID NO: 45298

SEQ ID NO: 649518 - RNA, 64 nt, hsa; identical to SEQ ID NO: 45299

SEQ ID NO: 649519 - RNA, 64 nt, hsa; identical to SEQ ID NO: 45300

SEQ ID NO: 649520 - RNA, 64 nt, hsa; identical to SEQ ID NO: 45301

SEQ ID NO: 649521 - RNA, 64 nt, hsa; identical to SEQ ID NO: 45302

SEQ ID NO: 649522 - RNA, 64 nt, hsa; identical to SEQ ID NO: 45303

SEQ ID NO: 649523 - RNA, 64 nt, hsa; identical to SEQ ID NO: 45304

SEQ ID NO: 649524 - RNA, 64 nt, hsa; identical to SEQ ID NO: 45305

SEQ ID NO: 649525 - RNA, 64 nt, hsa; identical to SEQ ID NO: 45306

SEQ ID NO: 649526 - RNA, 64 nt, hsa; identical to SEQ ID NO: 45307

SEQ ID NO: 649527 - RNA, 64 nt, hsa; identical to SEQ ID NO: 45308

SEQ ID NO: 649528 - RNA, 64 nt, hsa; identical to SEQ ID NO: 45309

SEQ ID NO: 649529 - RNA, 64 nt, hsa; identical to SEQ ID NO: 45310

SEQ ID NO: 649530 - RNA, 64 nt, hsa; identical to SEQ ID NO: 45311

SEQ ID NO: 649531 - RNA, 64 nt, hsa; identical to SEQ ID NO: 45312

SEQ ID NO: 649532 - RNA, 64 nt, hsa; identical to SEQ ID NO: 45312

SEQ ID NO: 649533 - RNA, 64 nt, hsa; identical to SEQ ID NO: 45314

SEQ ID NO: 649534 - RNA, 64 nt, hsa; identical to SEQ ID NO: 45315

SEQ ID NO: 649535 - RNA, 64 nt, hsa; identical to SEQ ID NO: 45316

SEQ ID NO: 649536 - RNA, 64 nt, hsa; identical to SEQ ID NO: 45317

SEQ ID NO: 649537 - RNA, 64 nt, hsa; identical to SEQ ID NO: 45318

SEQ ID NO: 649538 - RNA, 64 nt, hsa; identical to SEQ ID NO: 45319

SEQ ID NO: 649539 - RNA, 57 nt, hsa
uuucuaguugaaauggugaacugauaggaaaacaaaugaguagaaagaguucaugaa

SEQ ID NO: 649540 - RNA, 57 nt, hsa
cugaguauaacagcuuuaugauuaugagaaaacaaauucuuuauuuuuuuuuucugu

SEQ ID NO: 649541 - RNA, 57 nt, hsa
gaaccaaaggaaauaacauugaagaaggaaaacaauauguagaaaguauuuuagaaa

SEQ ID NO: 649542 - RNA, 57 nt, hsa
gauggucagagccagcacuggaauuuugaaaacaaauaaggugauuaucuauuuuag

SEQ ID NO: 649543 - RNA, 57 nt, hsa
uaauuauggaaguugggacauguuaaggaaaacaaauauguucaucaccaacaauca

SEQ ID NO: 649544 - RNA, 57 nt, hsa
uccuauuugaauuucuuuggugcuguagaaaacaaaaaaagaaaaauauauauucau

SEQ ID NO: 649545 - RNA, 57 nt, hsa
augcaaguuuugaauaaggaugguauagaaaacaacgcugcauauacagguaccauu

SEQ ID NO: 649546 - RNA, 57 nt, hsa
ccuggcugaagagucugcuuuaaaugggaaaacaacguaggagcagggguuuuuagg

SEQ ID NO: 649547 - RNA, 57 nt, hsa
cauugaggauggugagauaaauagguugaaaacaaucaucugugaguuuaggagucu

SEQ ID NO: 649548 - RNA, 57 nt, hsa
uaagggauagucuuacuuauucugccugaaaacaauguauuaccccagggcccaaca

SEQ ID NO: 649549 - RNA, 57 nt, hsa
aaacagcuuauuuauacauuuugaggagaaaacaaaguguuucacuaggaacaccuc

SEQ ID NO: 649550 - RNA, 57 nt, hsa
auuuauaaaguaaaaagauuuuauaaggaaaacaaauauaauaaccagugcugugaa

SEQ ID NO: 649551 - RNA, 57 nt, hsa
uuccaacaccaaauaaccuaacugcuggaaaacaagggaaauuuaaaucuccaaaua

SEQ ID NO: 649552 - RNA, 57 nt, hsa
aaagcaagcaaggaacauuugggguaagaaaacaaacaugaggcaaaagaaaaaaua

SEQ ID NO: 649553 - RNA, 57 nt, hsa
acauucacucuggcugcugggacaucagaaaacaaagucuucaucucucucuccagu

SEQ ID NO: 649554 - RNA, 57 nt, hsa
gaagguucuguuuugaguauagccagagaaaacaaggauggagaaaaaucuaggaca

SEQ ID NO: 649555 - RNA, 57 nt, hsa
gaagauucuguuuuggguauagccagagaaaacaaggauggagaaaaaucuaggaca

SEQ ID NO: 649556 - RNA, 57 nt, hsa
uagugacuugacugagaaguuaggguagaaaacaaaaagggaguggauucugggagc

SEQ ID NO: 649557 - RNA, 57 nt, hsa
cauaguuucagauaugguaguuaugaagaaaacaaugucauuugcugcuauuauugu

SEQ ID NO: 649558 - RNA, 57 nt, hsa
cgggugggggacagagggaccuuuaaagaaaacaaaacuggacagaaacaggaaugu

SEQ ID NO: 649559 - RNA, 57 nt, hsa
ugccgaauucaguugacacgaggcacagaaaacaaauaucaaagaucuaauaauaca

SEQ ID NO: 649560 - RNA, 57 nt, hsa
gacucugagggguccuguuccaauucggaaaacaauaggggaaagccacaaaagcac

SEQ ID NO: 649561 - RNA, 57 nt, hsa
caggaaucaaaagagaaaaaaguuucugaaaacaaugaaaccauaaaagauaauauu

SEQ ID NO: 649562 - RNA, 57 nt, hsa
caucuuauguccugauuucauauaguagaaaacaaacauuggguccgacuucaaaau

SEQ ID NO: 649563 - RNA, 57 nt, hsa
acuggaaucgucauaucucugaauauugaaaacaacaacuaaaaaaguggaccuucu

SEQ ID NO: 649564 - RNA, 57 nt, hsa
acagcuccuucuguaaggcuggucuuagaaaacaaguacuuuaguaucaggacagga

SEQ ID NO: 649565 - RNA, 57 nt, hsa
guggcaauaucacaagggaggagagaggaaaacaauuaucuucucuacuuggauuau

SEQ ID NO: 649566 - RNA, 57 nt, hsa
guuauguaacaaccugacaugauggaggaaaacaaccuuuaaagggauugugucuau

SEQ ID NO: 649567 - RNA, 57 nt, hsa
ucagucuuaguguuuuacaguauuugggaaaacaacuguuacaguuuuauugcucug

SEQ ID NO: 649568 - RNA, 57 nt, hsa
aagagucaacucuuaagauuaucauuagaaaacaaauacgucaacaccuaugaaaag

SEQ ID NO: 649569 - RNA, 57 nt, hsa
acgucaacaccuaugaaaagaagcggggaaaacaacaacaaggacaacaacaaaaaa

SEQ ID NO: 649570 - RNA, 57 nt, hsa
aaggcaauuggaugauaucuguaggaggaaaacaaugacuaauuucuuccuuuugaa

SEQ ID NO: 649571 - RNA, 57 nt, hsa
uuuuagaacuuuuuguuuaauucugaagaaaacaauauauaugguuuacuucucgaa

SEQ ID NO: 649572 - RNA, 57 nt, hsa
aagagaccuugucucgaaaaggaaucugaaaacaauggaaccaugccuucauaauuc

SEQ ID NO: 649573 - RNA, 57 nt, hsa
ccaccuuguuuguaacagugaaaaauugaaaacaaccuggaaguccagugaugggaa

SEQ ID NO: 649574 - RNA, 57 nt, hsa
uuucuaauaaauuuauauauuuguaaagaaaacaacagaaaucuuuaugcaauuugu

SEQ ID NO: 649575 - RNA, 57 nt, hsa
ggcucuaggaaacauuuacuuguuugugaaaacaauaccccaagguaauaggaaaag

SEQ ID NO: 649576 - RNA, 57 nt, hsa
ugaggaccuucucauggaagccauuaggaaaacaaacuagagguaaauaucacauua

SEQ ID NO: 649577 - RNA, 57 nt, hsa
agaaccugcagccauuucuuguuacaugaaaacaaaaugcuacuuguuaccucuauu

SEQ ID NO: 649578 - RNA, 57 nt, hsa
cuauuccuuucugagcuauguuuuagagaaaacaauuugauaugcuucaauuuugua

SEQ ID NO: 649579 - RNA, 57 nt, hsa
uauuuguuucuucugcaucuugcuacugaaaacaaaaacaaugaaaauauucauauu

SEQ ID NO: 649580 - RNA, 57 nt, hsa
uaaaggccuuuuauggaaaccaacuuggaaaacaaccuuaaauguggauguaucaga

SEQ ID NO: 649581 - RNA, 57 nt, hsa
agauuugguuuauccagccaugggagagaaaacaaaccuaaguuuacuuuacuugua

SEQ ID NO: 649582 - RNA, 57 nt, hsa
gacuggcucaaaaaagaaagaagcaacgaaaacaaaaugcacagccugaauggacgu

SEQ ID NO: 649583 - RNA, 57 nt, hsa
ggcuguagauuuaagggcacucaaggggaaaacaaauguaguuuccacagugugagg

SEQ ID NO: 649584 - RNA, 57 nt, hsa
auaauggugaauguucaaucuguguaagaaaacaaacuaaauguaguugucacacua

SEQ ID NO: 649585 - RNA, 57 nt, hsa
aaggugcuuguuaugucuagaaaguaagaaaacaauaugaggagacauucugucuuu

SEQ ID NO: 649586 - RNA, 57 nt, hsa
auucuaauugucagugauuuuguauaugaaaacaaguuccaaauccacagcuuuuac

SEQ ID NO: 649587 - RNA, 57 nt, hsa
uuuucuuucccuuaagaaucaaaagcagaaaacaaaaacaacaguccuacuccgaug

SEQ ID NO: 649588 - RNA, 57 nt, hsa
uugccaucuuuauuaugagccuuuaaggaaaacaaacccuaaacacaaagcaucagu

SEQ ID NO: 649589 - RNA, 57 nt, hsa
uuaaaaaaaauuuuaaugaagaaaguggaaaacaaggaagucaaagcaaggaaacua

SEQ ID NO: 649590 - RNA, 57 nt, hsa
cuagggccaagcccagcacugcuugaggaaaacaagcauucacaacuuguuuuuggu

SEQ ID NO: 649591 - RNA, 57 nt, hsa
acaugcgaucaguuugggaaaugugaugaaaacaaagacuagauggguauguguguu

SEQ ID NO: 649592 - RNA, 57 nt, hsa
uguaaacaagauucuaaauuuaaaaaggaaaacaaaacaaacuuguucuuugcagcu

SEQ ID NO: 649593 - RNA, 57 nt, hsa
gaguuaguguuaauggcuuucugguuugaaaacaaaaaugcaucuaugugguugaaa

SEQ ID NO: 649594 - RNA, 57 nt, hsa
uccuaacugaaauauuuacuuaaucuggaaaacaauguaacuauuuuuaaagugguu

SEQ ID NO: 649595 - RNA, 57 nt, hsa
ucucccuccacgauugugaaaacaaaugaaaacaaaauuagagcaaagcugaccugg

SEQ ID NO: 649596 - RNA, 57 nt, hsa
uccagagaguucucccuccacgauugugaaaacaaaugaaaacaaaauuagagcaaa

SEQ ID NO: 649597 - RNA, 57 nt, hsa
uucugaagaauaucugucaaaauuuaagaaaacaaauguauaaaauuccauuuuuuc

SEQ ID NO: 649598 - RNA, 57 nt, hsa
ggucuuuauuaaaaaucacaauauuccgaaaacaaaaaaaccuaggagauaaaugua

SEQ ID NO: 649599 - RNA, 57 nt, hsa
auauugaaguggaucaugagauguaaagaaaacaauaauggcaaugacuuauauuca

SEQ ID NO: 649600 - RNA, 57 nt, hsa
uuaaaaucccagauacucugaauuuuagaaaacaaacuaauucugauugugucgugc

SEQ ID NO: 649601 - RNA, 57 nt, hsa
agguguauguuggggagaacugaaagggaaaacaaaauacuugacauagucuuaagu

SEQ ID NO: 649602 - RNA, 57 nt, hsa
agucuuaaguagaagaaggcaguuagagaaaacaaaguaucuacuggccuugucaac

SEQ ID NO: 649603 - RNA, 57 nt, hsa
uugaaacuuucauaauuguauuaaucagaaaacaagcacauugccauucuuugaaac

SEQ ID NO: 649604 - RNA, 57 nt, hsa
uagacaugacagcaguaauaaaaggaugaaaacaagugucuucacuaagcguauggc

SEQ ID NO: 649605 - RNA, 57 nt, hsa
gaaauuuuuagcuguaacaaaaagaaagaaaacaacuuuuuuuaaagccucauucuc

SEQ ID NO: 649606 - RNA, 57 nt, hsa
uauuuucucccugcucuguauugaccagaaaacaaugauuuuauaauauuuaaccca

SEQ ID NO: 649607 - RNA, 57 nt, hsa
augagucuucaucacagcaucguuuaugaaaacaacuaaauauucacuaauggugcc

SEQ ID NO: 649608 - RNA, 57 nt, hsa
ucauuucuuuuucuguaaaugcaggaugaaaacaauauguaucuccuaggauggcug

SEQ ID NO: 649609 - RNA, 57 nt, hsa
aguauaaauugucauagcugguuuacugaaaacaaacacauuuaaaauugguuuacc

SEQ ID NO: 649610 - RNA, 57 nt, hsa
ccaaccucugagcccaagaccuugccugaaaacaagcagauaccgauugcuucaucc

SEQ ID NO: 649611 - RNA, 57 nt, hsa
uguuuaguggaaacuuucugagagauggaaaacaagcuucuggugggugcauuuucu

SEQ ID NO: 649612 - RNA, 57 nt, hsa
uuuucauguaggagcugaaagaucuccgaaaacaaagugaaaucauaccucagcuca

SEQ ID NO: 649613 - RNA, 57 nt, hsa
gugucaguuucaaaucaaauuaucuaagaaaacaagaaaacaaaggcagcagacuau

SEQ ID NO: 649614 - RNA, 57 nt, hsa
uucaaaucaaauuaucuaagaaaacaagaaaacaaaggcagcagacuauugguacac

SEQ ID NO: 649615 - RNA, 57 nt, hsa
guagcuccaaaugcaauuuuuaaaauggaaaacaaaaaucugaaagaaacgucuuua

SEQ ID NO: 649616 - RNA, 57 nt, hsa
uuccaugacucgaauaucugaaaugaagaaaacaaaccgacucacaaaccuccaagu

SEQ ID NO: 649617 - RNA, 57 nt, hsa
gacgcugugugugcugcaagugaccccgaaaacaaccacagccgucacaugguccuc

SEQ ID NO: 649618 - RNA, 57 nt, hsa
cuguuuacaucgauaaaugcacuuaaggaaaacaaacaaauuaaagcucaucuuaaa

SEQ ID NO: 649619 - RNA, 64 nt, hsa; identical to SEQ ID NO: 585264

SEQ ID NO: 649620 - RNA, 64 nt, hsa; identical to SEQ ID NO: 585265

SEQ ID NO: 649621 - RNA, 64 nt, hsa; identical to SEQ ID NO: 585266

SEQ ID NO: 649622 - RNA, 64 nt, hsa; identical to SEQ ID NO: 585267

SEQ ID NO: 649623 - RNA, 64 nt, hsa; identical to SEQ ID NO: 585268

SEQ ID NO: 649624 - RNA, 64 nt, hsa; identical to SEQ ID NO: 585269

SEQ ID NO: 649625 - RNA, 64 nt, hsa; identical to SEQ ID NO: 585270

SEQ ID NO: 649626 - RNA, 64 nt, hsa; identical to SEQ ID NO: 585270

SEQ ID NO: 649627 - RNA, 64 nt, hsa; identical to SEQ ID NO: 585272

SEQ ID NO: 649628 - RNA, 64 nt, hsa; identical to SEQ ID NO: 585273

SEQ ID NO: 649629 - RNA, 64 nt, hsa; identical to SEQ ID NO: 585274

SEQ ID NO: 649630 - RNA, 64 nt, hsa; identical to SEQ ID NO: 585275

SEQ ID NO: 649631 - RNA, 64 nt, hsa; identical to SEQ ID NO: 585276

SEQ ID NO: 649632 - RNA, 64 nt, hsa; identical to SEQ ID NO: 585277

SEQ ID NO: 649633 - RNA, 64 nt, hsa; identical to SEQ ID NO: 585278

SEQ ID NO: 649634 - RNA, 64 nt, hsa; identical to SEQ ID NO: 585279

SEQ ID NO: 649635 - RNA, 64 nt, hsa; identical to SEQ ID NO: 585280

SEQ ID NO: 649636 - RNA, 64 nt, hsa; identical to SEQ ID NO: 585281

SEQ ID NO: 649637 - RNA, 64 nt, hsa; identical to SEQ ID NO: 585282

SEQ ID NO: 649638 - RNA, 64 nt, hsa; identical to SEQ ID NO: 585283

SEQ ID NO: 649639 - RNA, 64 nt, hsa; identical to SEQ ID NO: 585284

SEQ ID NO: 649640 - RNA, 64 nt, hsa; identical to SEQ ID NO: 585285

SEQ ID NO: 649641 - RNA, 64 nt, hsa; identical to SEQ ID NO: 585286

SEQ ID NO: 649642 - RNA, 64 nt, hsa; identical to SEQ ID NO: 585287

SEQ ID NO: 649643 - RNA, 64 nt, hsa; identical to SEQ ID NO: 585288

SEQ ID NO: 649644 - RNA, 64 nt, hsa; identical to SEQ ID NO: 585289

SEQ ID NO: 649645 - RNA, 64 nt, hsa; identical to SEQ ID NO: 585290

SEQ ID NO: 649646 - RNA, 64 nt, hsa; identical to SEQ ID NO: 585291

SEQ ID NO: 649647 - RNA, 64 nt, hsa; identical to SEQ ID NO: 585292

SEQ ID NO: 649648 - RNA, 64 nt, hsa; identical to SEQ ID NO: 585293

SEQ ID NO: 649649 - RNA, 64 nt, hsa; identical to SEQ ID NO: 585294

SEQ ID NO: 649650 - RNA, 64 nt, hsa; identical to SEQ ID NO: 585295

SEQ ID NO: 649651 - RNA, 64 nt, hsa; identical to SEQ ID NO: 585296

SEQ ID NO: 649652 - RNA, 64 nt, hsa; identical to SEQ ID NO: 585297

SEQ ID NO: 649653 - RNA, 64 nt, hsa; identical to SEQ ID NO: 585298

SEQ ID NO: 649654 - RNA, 64 nt, hsa; identical to SEQ ID NO: 585299

SEQ ID NO: 649655 - RNA, 62 nt, hsa
uggccuggcugccuggccguggcuucucuuuggcucccaaagagaaggacaguguugggagu

SEQ ID NO: 649656 - RNA, 62 nt, hsa
guguugggaguaucugccguggcuucucuuuggcucccaaagagaaggacaguguugggagu

SEQ ID NO: 649657 - RNA, 62 nt, hsa
acggcccuccuucuuuuccuaacaugcaccuugcucccaauggugcuuggagggggaagaga

SEQ ID NO: 649658 - RNA, 62 nt, hsa
agggggcaagcuuugcuccuucaguucugcuugcucccaagccccugacccgcucggacuua

SEQ ID NO: 649659 - RNA, 62 nt, hsa
cagcagaauguuauaacgcaaguucauguguugcucccaacuccauucucuuuucucucgug

SEQ ID NO: 649660 - RNA, 62 nt, hsa
uuuaaaauguauguuuccccucacuguuugcagcucccaauguugucauuuuuaaauguuau

SEQ ID NO: 649661 - RNA, 62 nt, hsa
ucucugcuguauccuuucggcuucccaguugagcucccaagaccaggacccacuggggcaua

SEQ ID NO: 649662 - RNA, 62 nt, hsa
ucucugcuguguccuuucggcuucccaguugagcucccaagaccaggacccacuggggcaua

SEQ ID NO: 649663 - RNA, 64 nt, hsa; identical to SEQ ID NO: 603786

SEQ ID NO: 649664 - RNA, 64 nt, hsa; identical to SEQ ID NO: 603787

SEQ ID NO: 649665 - RNA, 64 nt, hsa; identical to SEQ ID NO: 603788

SEQ ID NO: 649666 - RNA, 64 nt, hsa; identical to SEQ ID NO: 603789

SEQ ID NO: 649667 - RNA, 64 nt, hsa
uaguuuauuacagauauuaaguaugcaauuacuuguauuauaggaugcaaggucaucauaugua

SEQ ID NO: 649668 - RNA, 64 nt, hsa
acaguuuuguaaaauuaguauugaguucuauugaguauuauaagauagcuuacauuuucaaaau

SEQ ID NO: 649669 - RNA, 64 nt, hsa
auacucugcacuguguaaaggaaaagggagaaauguauuauacuugagacauugcaccuacccc

SEQ ID NO: 649670 - RNA, 64 nt, hsa
aaugaaaaagucuucgauacaauauuguuaagcuguauuauaaguauuguuacacaggguuaug

SEQ ID NO: 649671 - RNA, 64 nt, hsa
ccaaauggacugaaagaaacuuuucaaggacaguguauuauaacaaucccuuucccagaauuag

SEQ ID NO: 649672 - RNA, 64 nt, hsa
uucaacaacauuuuaaauguauuuuguuauguuuguauuauauaggauaaagcaaaugucaagu

SEQ ID NO: 649673 - RNA, 64 nt, hsa
aaccuuaacuucauugucugcacauuacauugaaguauuauaaaugcaacagauguuauaugca

SEQ ID NO: 649674 - RNA, 64 nt, hsa
acauaaaguugcguaagaaacuuuaccaagaggaguauuauagccaaguuuucuuugaaaguau

SEQ ID NO: 649675 - RNA, 64 nt, hsa
uuuacuauaagguuaauauuuauuuucauuuucuguauuauauaugaaaaguaaauuaauguga

SEQ ID NO: 649676 - RNA, 64 nt, hsa
uaugcaagcacaacuugaagcugaauucauuucuguauuauauucucaacucguuaucuaaagc

SEQ ID NO: 649677 - RNA, 64 nt, hsa
cccuuuuuuaauguuucaugaccacccauugauuguauuauaaccacuuacaguugcuuauauu

SEQ ID NO: 649678 - RNA, 64 nt, hsa
cuuuuguuuuuuaacauuuagaauauuacauuuuguauuauacaguaccuuucucagacauuuu

SEQ ID NO: 649679 - RNA, 64 nt, hsa
auaauuucuaaaccauguauauguacguuuauauguauuauaauugcauacacaugccuccaug

SEQ ID NO: 649680 - RNA, 64 nt, hsa
auugugcccaaguaauaauaaaacuauuucagauguauuauaugauugagcaaaugagaaaaca

SEQ ID NO: 649681 - RNA, 64 nt, hsa
cuaccccuuuuugccuuacaagugauauuugcagguauuauaccauuuuucuauucuugguggc

SEQ ID NO: 649682 - RNA, 64 nt, hsa
agaaacaagccugccauaauccuuuggaaaagauguauuauaccagugaaaagguguuauaucu

SEQ ID NO: 649683 - RNA, 64 nt, hsa
caugaacuuagauuuuacaugaaguauuuuuucaguauuauauguacccucugaaauacauagg

SEQ ID NO: 649684 - RNA, 64 nt, hsa
uuauauguacccucugaaauacauagggauaugcguauuauaccaaaauguugcugaaaaaugg

SEQ ID NO: 649685 - RNA, 64 nt, hsa
agcauacuuaacagugaaaagaaucuuuaauuauguauuauaucuguaauauauuuauuuuguu

SEQ ID NO: 649686 - RNA, 64 nt, hsa
cuuuguaauauguuuuuaguucccuuuuuuuguuguauuauaggcagaugaacaaauuaaauuu

SEQ ID NO: 649687 - RNA, 64 nt, hsa
acgggcugcaugcugaggacgaccagcugaggguguauuauaugcagaauuacauaaacgaagc

SEQ ID NO: 649688 - RNA, 64 nt, hsa
acuguaaagagaaguaauuuugcuccuugauaaaguauuauauuaauaauaaaucugccugcaa

SEQ ID NO: 649689 - RNA, 64 nt, hsa
gaacacuuagaagacugauagaugucacacagugguauuauagaaggauaauacagagccaaga

SEQ ID NO: 649690 - RNA, 64 nt, hsa
ugcaugaugaauagcaccuuaauuucaagcaaauguauuauaauuaaaguuuuauuugcuguag

SEQ ID NO: 649691 - RNA, 64 nt, hsa
cucaaaugagcuuguauauuuauaauacaauauaguauuauaguaacaguuaucauacacugag

SEQ ID NO: 649692 - RNA, 64 nt, hsa
gagucacuaguauagacuaucuaucuagugaguuguauuauaagcgaugaaauacuuuaaaagc

SEQ ID NO: 649693 - RNA, 64 nt, hsa
auaucagacuucaccaaauauaugccuuacuauuguauuauaguacugcuuuacuguguaucuc

SEQ ID NO: 649694 - RNA, 64 nt, hsa
aagaaauaaaucuauauuuuugugaaggguagugguauuauacuguagauuucaguaguuucua

SEQ ID NO: 649695 - RNA, 64 nt, hsa; identical to SEQ ID NO: 346411

SEQ ID NO: 649696 - RNA, 64 nt, hsa; identical to SEQ ID NO: 346412

SEQ ID NO: 649697 - RNA, 64 nt, hsa; identical to SEQ ID NO: 346413

SEQ ID NO: 649698 - RNA, 64 nt, hsa; identical to SEQ ID NO: 346414

SEQ ID NO: 649699 - RNA, 64 nt, hsa; identical to SEQ ID NO: 346415

SEQ ID NO: 649700 - RNA, 64 nt, hsa; identical to SEQ ID NO: 346416

SEQ ID NO: 649701 - RNA, 64 nt, hsa; identical to SEQ ID NO: 346417

SEQ ID NO: 649702 - RNA, 64 nt, hsa; identical to SEQ ID NO: 346418

SEQ ID NO: 649703 - RNA, 64 nt, hsa; identical to SEQ ID NO: 346419

SEQ ID NO: 649704 - RNA, 64 nt, hsa; identical to SEQ ID NO: 346420

SEQ ID NO: 649705 - RNA, 64 nt, hsa; identical to SEQ ID NO: 346421

SEQ ID NO: 649706 - RNA, 64 nt, hsa; identical to SEQ ID NO: 346422

SEQ ID NO: 649707 - RNA, 64 nt, hsa; identical to SEQ ID NO: 346423

SEQ ID NO: 649708 - RNA, 64 nt, hsa; identical to SEQ ID NO: 346424

SEQ ID NO: 649709 - RNA, 64 nt, hsa; identical to SEQ ID NO: 346425

SEQ ID NO: 649710 - RNA, 64 nt, hsa; identical to SEQ ID NO: 346426

SEQ ID NO: 649711 - RNA, 64 nt, hsa; identical to SEQ ID NO: 346427

SEQ ID NO: 649712 - RNA, 64 nt, hsa; identical to SEQ ID NO: 346428

SEQ ID NO: 649713 - RNA, 64 nt, hsa; identical to SEQ ID NO: 553542

SEQ ID NO: 649714 - RNA, 64 nt, hsa; identical to SEQ ID NO: 553543

SEQ ID NO: 649715 - RNA, 64 nt, hsa; identical to SEQ ID NO: 553544

SEQ ID NO: 649716 - RNA, 64 nt, hsa; identical to SEQ ID NO: 553545

SEQ ID NO: 649717 - RNA, 64 nt, hsa; identical to SEQ ID NO: 553546

SEQ ID NO: 649718 - RNA, 64 nt, hsa; identical to SEQ ID NO: 553547

SEQ ID NO: 649719 - RNA, 64 nt, hsa; identical to SEQ ID NO: 553548

SEQ ID NO: 649720 - RNA, 64 nt, hsa; identical to SEQ ID NO: 553549

SEQ ID NO: 649721 - RNA, 64 nt, hsa; identical to SEQ ID NO: 553550

SEQ ID NO: 649722 - RNA, 64 nt, hsa; identical to SEQ ID NO: 553551

SEQ ID NO: 649723 - RNA, 64 nt, hsa; identical to SEQ ID NO: 97332

SEQ ID NO: 649724 - RNA, 64 nt, hsa; identical to SEQ ID NO: 97333

SEQ ID NO: 649725 - RNA, 64 nt, hsa; identical to SEQ ID NO: 97334

SEQ ID NO: 649726 - RNA, 64 nt, hsa; identical to SEQ ID NO: 97335

SEQ ID NO: 649727 - RNA, 64 nt, hsa; identical to SEQ ID NO: 97336

SEQ ID NO: 649728 - RNA, 64 nt, hsa; identical to SEQ ID NO: 97337

SEQ ID NO: 649729 - RNA, 64 nt, hsa; identical to SEQ ID NO: 97338

SEQ ID NO: 649730 - RNA, 64 nt, hsa; identical to SEQ ID NO: 97339

SEQ ID NO: 649731 - RNA, 64 nt, hsa; identical to SEQ ID NO: 97340

SEQ ID NO: 649732 - RNA, 64 nt, hsa; identical to SEQ ID NO: 97341

SEQ ID NO: 649733 - RNA, 64 nt, hsa; identical to SEQ ID NO: 97342

SEQ ID NO: 649734 - RNA, 64 nt, hsa; identical to SEQ ID NO: 97343

SEQ ID NO: 649735 - RNA, 64 nt, hsa; identical to SEQ ID NO: 97344

SEQ ID NO: 649736 - RNA, 64 nt, hsa; identical to SEQ ID NO: 97345

SEQ ID NO: 649737 - RNA, 64 nt, hsa; identical to SEQ ID NO: 97346

SEQ ID NO: 649738 - RNA, 64 nt, hsa; identical to SEQ ID NO: 97347

SEQ ID NO: 649739 - RNA, 64 nt, hsa; identical to SEQ ID NO: 97348

SEQ ID NO: 649740 - RNA, 64 nt, hsa; identical to SEQ ID NO: 97349

SEQ ID NO: 649741 - RNA, 64 nt, hsa; identical to SEQ ID NO: 97350

SEQ ID NO: 649742 - RNA, 64 nt, hsa; identical to SEQ ID NO: 97351

SEQ ID NO: 649743 - RNA, 64 nt, hsa; identical to SEQ ID NO: 97352

SEQ ID NO: 649744 - RNA, 64 nt, hsa; identical to SEQ ID NO: 97353

SEQ ID NO: 649745 - RNA, 64 nt, hsa; identical to SEQ ID NO: 97354

SEQ ID NO: 649746 - RNA, 64 nt, hsa; identical to SEQ ID NO: 97355

SEQ ID NO: 649747 - RNA, 64 nt, hsa; identical to SEQ ID NO: 97356

SEQ ID NO: 649748 - RNA, 64 nt, hsa; identical to SEQ ID NO: 97357

SEQ ID NO: 649749 - RNA, 64 nt, hsa; identical to SEQ ID NO: 97358

SEQ ID NO: 649750 - RNA, 64 nt, hsa; identical to SEQ ID NO: 97359

SEQ ID NO: 649751 - RNA, 64 nt, hsa; identical to SEQ ID NO: 97360

SEQ ID NO: 649752 - RNA, 64 nt, hsa; identical to SEQ ID NO: 97361

SEQ ID NO: 649753 - RNA, 64 nt, hsa; identical to SEQ ID NO: 97362

SEQ ID NO: 649754 - RNA, 64 nt, hsa; identical to SEQ ID NO: 97363

SEQ ID NO: 649755 - RNA, 64 nt, hsa; identical to SEQ ID NO: 97364

SEQ ID NO: 649756 - RNA, 64 nt, hsa; identical to SEQ ID NO: 97365

SEQ ID NO: 649757 - RNA, 64 nt, hsa; identical to SEQ ID NO: 97366

SEQ ID NO: 649758 - RNA, 64 nt, hsa; identical to SEQ ID NO: 97367

SEQ ID NO: 649759 - RNA, 64 nt, hsa; identical to SEQ ID NO: 97368

SEQ ID NO: 649760 - RNA, 64 nt, hsa; identical to SEQ ID NO: 97369

SEQ ID NO: 649761 - RNA, 64 nt, hsa; identical to SEQ ID NO: 97370

SEQ ID NO: 649762 - RNA, 64 nt, hsa; identical to SEQ ID NO: 97371

SEQ ID NO: 649763 - RNA, 64 nt, hsa; identical to SEQ ID NO: 97372

SEQ ID NO: 649764 - RNA, 64 nt, hsa; identical to SEQ ID NO: 97373

SEQ ID NO: 649765 - RNA, 64 nt, hsa; identical to SEQ ID NO: 97374

SEQ ID NO: 649766 - RNA, 64 nt, hsa; identical to SEQ ID NO: 97375

SEQ ID NO: 649767 - RNA, 64 nt, hsa; identical to SEQ ID NO: 97376

SEQ ID NO: 649768 - RNA, 64 nt, hsa; identical to SEQ ID NO: 97377

SEQ ID NO: 649769 - RNA, 64 nt, hsa; identical to SEQ ID NO: 97378

SEQ ID NO: 649770 - RNA, 64 nt, hsa; identical to SEQ ID NO: 97379

SEQ ID NO: 649771 - RNA, 64 nt, hsa; identical to SEQ ID NO: 97380

SEQ ID NO: 649772 - RNA, 64 nt, hsa; identical to SEQ ID NO: 97381

SEQ ID NO: 649773 - RNA, 64 nt, hsa; identical to SEQ ID NO: 97382

SEQ ID NO: 649774 - RNA, 64 nt, hsa; identical to SEQ ID NO: 97383

SEQ ID NO: 649775 - RNA, 64 nt, hsa; identical to SEQ ID NO: 97384

SEQ ID NO: 649776 - RNA, 64 nt, hsa; identical to SEQ ID NO: 97385

SEQ ID NO: 649777 - RNA, 64 nt, hsa; identical to SEQ ID NO: 97386

SEQ ID NO: 649778 - RNA, 64 nt, hsa; identical to SEQ ID NO: 97387

SEQ ID NO: 649779 - RNA, 64 nt, hsa; identical to SEQ ID NO: 97388

SEQ ID NO: 649780 - RNA, 64 nt, hsa; identical to SEQ ID NO: 97389

SEQ ID NO: 649781 - RNA, 64 nt, hsa; identical to SEQ ID NO: 97390

SEQ ID NO: 649782 - RNA, 64 nt, hsa; identical to SEQ ID NO: 97391

SEQ ID NO: 649783 - RNA, 64 nt, hsa; identical to SEQ ID NO: 97392

SEQ ID NO: 649784 - RNA, 64 nt, hsa; identical to SEQ ID NO: 97393

SEQ ID NO: 649785 - RNA, 64 nt, hsa; identical to SEQ ID NO: 97394

SEQ ID NO: 649786 - RNA, 64 nt, hsa; identical to SEQ ID NO: 294474

SEQ ID NO: 649787 - RNA, 64 nt, hsa; identical to SEQ ID NO: 294475

SEQ ID NO: 649788 - RNA, 64 nt, hsa; identical to SEQ ID NO: 294476

SEQ ID NO: 649789 - RNA, 64 nt, hsa; identical to SEQ ID NO: 294477

SEQ ID NO: 649790 - RNA, 64 nt, hsa; identical to SEQ ID NO: 294478

SEQ ID NO: 649791 - RNA, 64 nt, hsa; identical to SEQ ID NO: 294479

SEQ ID NO: 649792 - RNA, 64 nt, hsa; identical to SEQ ID NO: 151446

SEQ ID NO: 649793 - RNA, 64 nt, hsa; identical to SEQ ID NO: 151447

SEQ ID NO: 649794 - RNA, 64 nt, hsa; identical to SEQ ID NO: 151448

SEQ ID NO: 649795 - RNA, 64 nt, hsa; identical to SEQ ID NO: 151449

SEQ ID NO: 649796 - RNA, 64 nt, hsa; identical to SEQ ID NO: 151450

SEQ ID NO: 649797 - RNA, 64 nt, hsa; identical to SEQ ID NO: 151451

SEQ ID NO: 649798 - RNA, 64 nt, hsa; identical to SEQ ID NO: 151452

SEQ ID NO: 649799 - RNA, 64 nt, hsa; identical to SEQ ID NO: 151453

SEQ ID NO: 649800 - RNA, 64 nt, hsa; identical to SEQ ID NO: 151454

SEQ ID NO: 649801 - RNA, 64 nt, hsa; identical to SEQ ID NO: 151455

SEQ ID NO: 649802 - RNA, 64 nt, hsa; identical to SEQ ID NO: 151456

SEQ ID NO: 649803 - RNA, 64 nt, hsa; identical to SEQ ID NO: 151457

SEQ ID NO: 649804 - RNA, 64 nt, hsa; identical to SEQ ID NO: 151458

SEQ ID NO: 649805 - RNA, 64 nt, hsa; identical to SEQ ID NO: 151459

SEQ ID NO: 649806 - RNA, 64 nt, hsa; identical to SEQ ID NO: 151460

SEQ ID NO: 649807 - RNA, 64 nt, hsa; identical to SEQ ID NO: 151461

SEQ ID NO: 649808 - RNA, 64 nt, hsa; identical to SEQ ID NO: 151462

SEQ ID NO: 649809 - RNA, 64 nt, hsa; identical to SEQ ID NO: 151463

SEQ ID NO: 649810 - RNA, 64 nt, hsa; identical to SEQ ID NO: 151464

SEQ ID NO: 649811 - RNA, 64 nt, hsa; identical to SEQ ID NO: 151465

SEQ ID NO: 649812 - RNA, 64 nt, hsa; identical to SEQ ID NO: 151466

SEQ ID NO: 649813 - RNA, 64 nt, hsa; identical to SEQ ID NO: 151467

SEQ ID NO: 649814 - RNA, 64 nt, hsa; identical to SEQ ID NO: 151468

SEQ ID NO: 649815 - RNA, 64 nt, hsa; identical to SEQ ID NO: 151448

SEQ ID NO: 649816 - RNA, 64 nt, hsa; identical to SEQ ID NO: 151470

SEQ ID NO: 649817 - RNA, 64 nt, hsa; identical to SEQ ID NO: 151471

SEQ ID NO: 649818 - RNA, 64 nt, hsa
uacauuguagguggcccgcauuuccagaaauaacguuaugcaucuagauggaagcugcauguaa

SEQ ID NO: 649819 - RNA, 64 nt, hsa
aaauuguaaacaaauguaaaacuaaauaaacauuguuaugcaacauuaauaauguggaauuuuu

SEQ ID NO: 649820 - RNA, 64 nt, hsa
uuccagaggaagacacagcuuaguagcuuaagcaguuaugcauaucaggauacugugagcaaca

SEQ ID NO: 649821 - RNA, 64 nt, hsa
guuaucaccuuuuuuauccguccaccgugacaugguuaugcauccuuuagauuaaccucaccaa

SEQ ID NO: 649822 - RNA, 64 nt, hsa
aggaggcauuuucaucuuuauuauuguacuuuugguuaugcaaacacuuugauaauauaaacag

SEQ ID NO: 649823 - RNA, 64 nt, hsa
aauggaagagaaucauuuaagaguuccuguaacaguuaugcagaaaauacuaaaacccaucagg

SEQ ID NO: 649824 - RNA, 64 nt, hsa
uuuuuauaaauuggaauaauaccucaguuuugagguuaugcacacuaaauuaaaugugacauaa

SEQ ID NO: 649825 - RNA, 64 nt, hsa
gagaaaacuuuguauuuuuaaaacuugcauaaaaguuaugcaagugguuuuuauaaauuggaau

SEQ ID NO: 649826 - RNA, 64 nt, hsa
cugggugcagcaggagcugggucccgagagccuggcaggugaaacucugcaggccuuccgccug

SEQ ID NO: 649827 - RNA, 64 nt, hsa
gggagaccuuugcaaagggcauccaaauggguaggcaggugacagccgccguauuuauuuugca

SEQ ID NO: 649828 - RNA, 64 nt, hsa
ugcaggcuccaugcaccucccuucccucccugaggcaggugagaacccagagagaggggccugc

SEQ ID NO: 649829 - RNA, 64 nt, hsa
ccugaggcaggugagaacccagagagaggggccugcaggugagcaggcagggcugggccagguc

SEQ ID NO: 649830 - RNA, 64 nt, hsa
gaagcagagagcacagccccugcugugugggucugcaggugagcagacaggacaggugugccgc

SEQ ID NO: 649831 - RNA, 64 nt, hsa
cagauccccuaggaaagaggaggcaaauggcacugcaggugagaaccccgcccauccgugcuau

SEQ ID NO: 649832 - RNA, 64 nt, hsa
ugaccccagaaaccgccuucaucuccauucggaagcaggugacacaccccuucagaaggugccc

SEQ ID NO: 649833 - RNA, 64 nt, hsa
uaaguugccuuuccucuuuguaguuagcguucaggcaggugacguguggaaagucuaggggguu

SEQ ID NO: 649834 - RNA, 64 nt, hsa
ugcugaagguaccauauuuuaaauguuauuuaaugcaggugauuuauucaaacauuuguucuag

SEQ ID NO: 649835 - RNA, 64 nt, hsa
ucacaacucuuaauugggccuagugaaaaugggggcaggugagaaguccauuuugagaaucagc

SEQ ID NO: 649836 - RNA, 64 nt, hsa
caccagaugaauuuccaaguuuaaacucuuuccugcaggugauuacuuugaaaaagguuggucc

SEQ ID NO: 649837 - RNA, 64 nt, hsa
augccagaacaugguaaauuugcagccauuucaagcaggugauggucuuuuuuuauaacaucgu

SEQ ID NO: 649838 - RNA, 64 nt, hsa
uugaguugugggcccaggagcccugcggcugccggcaggugaacugagugcccgacagcugaga

SEQ ID NO: 649839 - RNA, 64 nt, hsa
augaggacgacggcuacugaaguguggccuccaggcaggugauguccuggcagggggccucgcg

SEQ ID NO: 649840 - RNA, 64 nt, hsa
gccucaggcccagcacccaguuccuccucacauggcaggugagcacagacuucuaguuggcagg

SEQ ID NO: 649841 - RNA, 64 nt, hsa
cuaagggcaagcaggauacagggcgagggauguggcaggugagggggcucccgccugugccccu

SEQ ID NO: 649842 - RNA, 64 nt, hsa
uaccccggaggcaccuggguccaucagagaaggugcaggugacagaggcgaaggcagauggggc

SEQ ID NO: 649843 - RNA, 64 nt, hsa
cggggcuggugggccuuucuguguccuacuccuugcaggugacauuugcucugaacuggaugau

SEQ ID NO: 649844 - RNA, 64 nt, hsa
cuggagccagcccggggacuguccuggguggagggcaggugaacacaagcugcugccggggacu

SEQ ID NO: 649845 - RNA, 64 nt, hsa
acaagcugcugccggggacuguccuggguggacggcaggugaacacaagcggcugccgcaugua

SEQ ID NO: 649846 - RNA, 64 nt, hsa
ggggaggaggauuaggcuggacugaucgcgggucgcaggugaccccgggaccagaugucccucc

SEQ ID NO: 649847 - RNA, 64 nt, hsa
ugccugccgcaguggcccagccccuucucucccugcaggugacccgcgccgcccccgcccgccc

SEQ ID NO: 649848 - RNA, 64 nt, hsa
ccaagucccgaguggccuucuuugaagagcucuagcaggugacccagccaccccaggaccugcc

SEQ ID NO: 649849 - RNA, 64 nt, hsa
ccuugagauccuuccaguuuggcuguuaugcaaagcaggugauuugucuuaaucagauaaaaga

SEQ ID NO: 649850 - RNA, 64 nt, hsa; identical to SEQ ID NO: 73323

SEQ ID NO: 649851 - RNA, 64 nt, hsa; identical to SEQ ID NO: 73324

SEQ ID NO: 649852 - RNA, 64 nt, hsa; identical to SEQ ID NO: 73325

SEQ ID NO: 649853 - RNA, 64 nt, hsa; identical to SEQ ID NO: 73326

SEQ ID NO: 649854 - RNA, 64 nt, hsa; identical to SEQ ID NO: 73327

SEQ ID NO: 649855 - RNA, 64 nt, hsa; identical to SEQ ID NO: 73328

SEQ ID NO: 649856 - RNA, 64 nt, hsa; identical to SEQ ID NO: 73329

SEQ ID NO: 649857 - RNA, 64 nt, hsa; identical to SEQ ID NO: 73330

SEQ ID NO: 649858 - RNA, 64 nt, hsa; identical to SEQ ID NO: 73331

SEQ ID NO: 649859 - RNA, 64 nt, hsa; identical to SEQ ID NO: 73332

SEQ ID NO: 649860 - RNA, 64 nt, hsa; identical to SEQ ID NO: 73333

SEQ ID NO: 649861 - RNA, 64 nt, hsa; identical to SEQ ID NO: 73334

SEQ ID NO: 649862 - RNA, 64 nt, hsa; identical to SEQ ID NO: 73335

SEQ ID NO: 649863 - RNA, 64 nt, hsa; identical to SEQ ID NO: 73336

SEQ ID NO: 649864 - RNA, 64 nt, hsa; identical to SEQ ID NO: 73337

SEQ ID NO: 649865 - RNA, 64 nt, hsa; identical to SEQ ID NO: 73338

SEQ ID NO: 649866 - RNA, 64 nt, hsa; identical to SEQ ID NO: 73339

SEQ ID NO: 649867 - RNA, 64 nt, hsa; identical to SEQ ID NO: 73340

SEQ ID NO: 649868 - RNA, 64 nt, hsa; identical to SEQ ID NO: 73341

SEQ ID NO: 649869 - RNA, 64 nt, hsa; identical to SEQ ID NO: 73342

SEQ ID NO: 649870 - RNA, 64 nt, hsa; identical to SEQ ID NO: 73343

SEQ ID NO: 649871 - RNA, 64 nt, hsa; identical to SEQ ID NO: 73344

SEQ ID NO: 649872 - RNA, 64 nt, hsa; identical to SEQ ID NO: 117299

SEQ ID NO: 649873 - RNA, 64 nt, hsa; identical to SEQ ID NO: 117300

SEQ ID NO: 649874 - RNA, 64 nt, hsa; identical to SEQ ID NO: 117301

SEQ ID NO: 649875 - RNA, 64 nt, hsa; identical to SEQ ID NO: 117302

SEQ ID NO: 649876 - RNA, 64 nt, hsa; identical to SEQ ID NO: 117303

SEQ ID NO: 649877 - RNA, 64 nt, hsa; identical to SEQ ID NO: 117304

SEQ ID NO: 649878 - RNA, 64 nt, hsa; identical to SEQ ID NO: 117305

SEQ ID NO: 649879 - RNA, 64 nt, hsa; identical to SEQ ID NO: 117306

SEQ ID NO: 649880 - RNA, 64 nt, hsa; identical to SEQ ID NO: 117307

SEQ ID NO: 649881 - RNA, 64 nt, hsa; identical to SEQ ID NO: 117308

SEQ ID NO: 649882 - RNA, 64 nt, hsa; identical to SEQ ID NO: 117309

SEQ ID NO: 649883 - RNA, 64 nt, hsa; identical to SEQ ID NO: 117310

SEQ ID NO: 649884 - RNA, 64 nt, hsa; identical to SEQ ID NO: 117311

SEQ ID NO: 649885 - RNA, 64 nt, hsa; identical to SEQ ID NO: 117312

SEQ ID NO: 649886 - RNA, 64 nt, hsa; identical to SEQ ID NO: 117313

SEQ ID NO: 649887 - RNA, 64 nt, hsa; identical to SEQ ID NO: 117314

SEQ ID NO: 649888 - RNA, 64 nt, hsa; identical to SEQ ID NO: 117315

SEQ ID NO: 649889 - RNA, 64 nt, hsa; identical to SEQ ID NO: 117316

SEQ ID NO: 649890 - RNA, 64 nt, hsa; identical to SEQ ID NO: 117317

SEQ ID NO: 649891 - RNA, 64 nt, hsa; identical to SEQ ID NO: 117318

SEQ ID NO: 649892 - RNA, 64 nt, hsa; identical to SEQ ID NO: 117319

SEQ ID NO: 649893 - RNA, 64 nt, hsa; identical to SEQ ID NO: 117320

SEQ ID NO: 649894 - RNA, 64 nt, hsa; identical to SEQ ID NO: 117321

SEQ ID NO: 649895 - RNA, 64 nt, hsa; identical to SEQ ID NO: 117322

SEQ ID NO: 649896 - RNA, 64 nt, hsa; identical to SEQ ID NO: 117323

SEQ ID NO: 649897 - RNA, 64 nt, hsa; identical to SEQ ID NO: 117324

SEQ ID NO: 649898 - RNA, 64 nt, hsa; identical to SEQ ID NO: 117325

SEQ ID NO: 649899 - RNA, 64 nt, hsa; identical to SEQ ID NO: 117326

SEQ ID NO: 649900 - RNA, 64 nt, hsa; identical to SEQ ID NO: 117327

SEQ ID NO: 649901 - RNA, 64 nt, hsa; identical to SEQ ID NO: 117328

SEQ ID NO: 649902 - RNA, 64 nt, hsa; identical to SEQ ID NO: 174092

SEQ ID NO: 649903 - RNA, 64 nt, hsa; identical to SEQ ID NO: 174093

SEQ ID NO: 649904 - RNA, 64 nt, hsa; identical to SEQ ID NO: 174095

SEQ ID NO: 649905 - RNA, 64 nt, hsa; identical to SEQ ID NO: 174096

SEQ ID NO: 649906 - RNA, 64 nt, hsa; identical to SEQ ID NO: 174127

SEQ ID NO: 649907 - RNA, 64 nt, hsa; identical to SEQ ID NO: 174128

SEQ ID NO: 649908 - RNA, 64 nt, hsa; identical to SEQ ID NO: 174147

SEQ ID NO: 649909 - RNA, 64 nt, hsa; identical to SEQ ID NO: 174148

SEQ ID NO: 649910 - RNA, 64 nt, hsa; identical to SEQ ID NO: 174171

SEQ ID NO: 649911 - RNA, 64 nt, hsa; identical to SEQ ID NO: 174172

SEQ ID NO: 649912 - RNA, 64 nt, hsa; identical to SEQ ID NO: 174194

SEQ ID NO: 649913 - RNA, 64 nt, hsa; identical to SEQ ID NO: 174195

SEQ ID NO: 649914 - RNA, 64 nt, hsa; identical to SEQ ID NO: 174204

SEQ ID NO: 649915 - RNA, 64 nt, hsa; identical to SEQ ID NO: 174205

SEQ ID NO: 649916 - RNA, 64 nt, hsa; identical to SEQ ID NO: 174212

SEQ ID NO: 649917 - RNA, 64 nt, hsa; identical to SEQ ID NO: 174213

SEQ ID NO: 649918 - RNA, 64 nt, hsa; identical to SEQ ID NO: 174220

SEQ ID NO: 649919 - RNA, 64 nt, hsa; identical to SEQ ID NO: 174221

SEQ ID NO: 649920 - RNA, 64 nt, hsa; identical to SEQ ID NO: 174227

SEQ ID NO: 649921 - RNA, 64 nt, hsa; identical to SEQ ID NO: 174228

SEQ ID NO: 649922 - RNA, 64 nt, hsa; identical to SEQ ID NO: 174230

SEQ ID NO: 649923 - RNA, 64 nt, hsa; identical to SEQ ID NO: 174231

SEQ ID NO: 649924 - RNA, 64 nt, hsa; identical to SEQ ID NO: 174233

SEQ ID NO: 649925 - RNA, 51 nt, hsa; identical to SEQ ID NO: 173793

SEQ ID NO: 649926 - RNA, 64 nt, hsa; identical to SEQ ID NO: 174312

SEQ ID NO: 649927 - RNA, 64 nt, hsa; identical to SEQ ID NO: 174313

SEQ ID NO: 649928 - RNA, 57 nt, hsa; identical to SEQ ID NO: 173883

SEQ ID NO: 649929 - RNA, 64 nt, hsa; identical to SEQ ID NO: 174325

SEQ ID NO: 649930 - RNA, 64 nt, hsa; identical to SEQ ID NO: 174358

SEQ ID NO: 649931 - RNA, 64 nt, hsa; identical to SEQ ID NO: 174359

SEQ ID NO: 649932 - RNA, 64 nt, hsa; identical to SEQ ID NO: 174369

SEQ ID NO: 649933 - RNA, 64 nt, hsa; identical to SEQ ID NO: 174370

SEQ ID NO: 649934 - RNA, 64 nt, hsa; identical to SEQ ID NO: 174388

SEQ ID NO: 649935 - RNA, 64 nt, hsa; identical to SEQ ID NO: 174389

SEQ ID NO: 649936 - RNA, 64 nt, hsa; identical to SEQ ID NO: 174405

SEQ ID NO: 649937 - RNA, 64 nt, hsa; identical to SEQ ID NO: 174406

SEQ ID NO: 649938 - RNA, 64 nt, hsa; identical to SEQ ID NO: 174416

SEQ ID NO: 649939 - RNA, 64 nt, hsa; identical to SEQ ID NO: 174417

SEQ ID NO: 649940 - RNA, 64 nt, hsa; identical to SEQ ID NO: 174427

SEQ ID NO: 649941 - RNA, 64 nt, hsa; identical to SEQ ID NO: 174428

SEQ ID NO: 649942 - RNA, 64 nt, hsa; identical to SEQ ID NO: 174434

SEQ ID NO: 649943 - RNA, 64 nt, hsa; identical to SEQ ID NO: 174435

SEQ ID NO: 649944 - RNA, 64 nt, hsa; identical to SEQ ID NO: 174516

SEQ ID NO: 649945 - RNA, 64 nt, hsa; identical to SEQ ID NO: 174517

SEQ ID NO: 649946 - RNA, 62 nt, hsa; identical to SEQ ID NO: 350237

SEQ ID NO: 649947 - RNA, 62 nt, hsa; identical to SEQ ID NO: 350238

SEQ ID NO: 649948 - RNA, 62 nt, hsa; identical to SEQ ID NO: 350239

SEQ ID NO: 649949 - RNA, 62 nt, hsa; identical to SEQ ID NO: 350240

SEQ ID NO: 649950 - RNA, 62 nt, hsa; identical to SEQ ID NO: 350241

SEQ ID NO: 649951 - RNA, 62 nt, hsa; identical to SEQ ID NO: 350242

SEQ ID NO: 649952 - RNA, 62 nt, hsa; identical to SEQ ID NO: 350243

SEQ ID NO: 649953 - RNA, 62 nt, hsa; identical to SEQ ID NO: 350244

SEQ ID NO: 649954 - RNA, 62 nt, hsa; identical to SEQ ID NO: 350245

SEQ ID NO: 649955 - RNA, 62 nt, hsa; identical to SEQ ID NO: 350246

SEQ ID NO: 649956 - RNA, 62 nt, hsa; identical to SEQ ID NO: 350247

SEQ ID NO: 649957 - RNA, 62 nt, hsa; identical to SEQ ID NO: 350248

SEQ ID NO: 649958 - RNA, 62 nt, hsa; identical to SEQ ID NO: 350249

SEQ ID NO: 649959 - RNA, 62 nt, hsa; identical to SEQ ID NO: 350250

SEQ ID NO: 649960 - RNA, 62 nt, hsa; identical to SEQ ID NO: 350251

SEQ ID NO: 649961 - RNA, 62 nt, hsa; identical to SEQ ID NO: 350252

SEQ ID NO: 649962 - RNA, 55 nt, hsa; identical to SEQ ID NO: 174536

SEQ ID NO: 649963 - RNA, 62 nt, hsa; identical to SEQ ID NO: 350254

SEQ ID NO: 649964 - RNA, 62 nt, hsa; identical to SEQ ID NO: 350255

SEQ ID NO: 649965 - RNA, 62 nt, hsa; identical to SEQ ID NO: 350256

SEQ ID NO: 649966 - RNA, 62 nt, hsa; identical to SEQ ID NO: 350257

SEQ ID NO: 649967 - RNA, 62 nt, hsa; identical to SEQ ID NO: 350258

SEQ ID NO: 649968 - RNA, 62 nt, hsa; identical to SEQ ID NO: 350259

SEQ ID NO: 649969 - RNA, 62 nt, hsa; identical to SEQ ID NO: 350260

SEQ ID NO: 649970 - RNA, 62 nt, hsa; identical to SEQ ID NO: 350261

SEQ ID NO: 649971 - RNA, 62 nt, hsa; identical to SEQ ID NO: 350262

SEQ ID NO: 649972 - RNA, 62 nt, hsa; identical to SEQ ID NO: 350263

SEQ ID NO: 649973 - RNA, 62 nt, hsa; identical to SEQ ID NO: 350264

SEQ ID NO: 649974 - RNA, 62 nt, hsa; identical to SEQ ID NO: 350265

SEQ ID NO: 649975 - RNA, 62 nt, hsa; identical to SEQ ID NO: 350266

SEQ ID NO: 649976 - RNA, 62 nt, hsa; identical to SEQ ID NO: 350267

SEQ ID NO: 649977 - RNA, 62 nt, hsa; identical to SEQ ID NO: 350268

SEQ ID NO: 649978 - RNA, 58 nt, hsa; identical to SEQ ID NO: 174552

SEQ ID NO: 649979 - RNA, 62 nt, hsa; identical to SEQ ID NO: 350270

SEQ ID NO: 649980 - RNA, 62 nt, hsa; identical to SEQ ID NO: 350271

SEQ ID NO: 649981 - RNA, 62 nt, hsa; identical to SEQ ID NO: 350272

SEQ ID NO: 649982 - RNA, 62 nt, hsa; identical to SEQ ID NO: 350273

SEQ ID NO: 649983 - RNA, 62 nt, hsa; identical to SEQ ID NO: 350274

SEQ ID NO: 649984 - RNA, 62 nt, hsa; identical to SEQ ID NO: 350275

SEQ ID NO: 649985 - RNA, 62 nt, hsa; identical to SEQ ID NO: 350276

SEQ ID NO: 649986 - RNA, 62 nt, hsa; identical to SEQ ID NO: 350277

SEQ ID NO: 649987 - RNA, 62 nt, hsa; identical to SEQ ID NO: 350278

SEQ ID NO: 649988 - RNA, 62 nt, hsa; identical to SEQ ID NO: 350279

SEQ ID NO: 649989 - RNA, 62 nt, hsa; identical to SEQ ID NO: 350280

SEQ ID NO: 649990 - RNA, 62 nt, hsa; identical to SEQ ID NO: 350281

SEQ ID NO: 649991 - RNA, 62 nt, hsa; identical to SEQ ID NO: 350282

SEQ ID NO: 649992 - RNA, 62 nt, hsa; identical to SEQ ID NO: 350283

SEQ ID NO: 649993 - RNA, 62 nt, hsa; identical to SEQ ID NO: 350284

SEQ ID NO: 649994 - RNA, 62 nt, hsa; identical to SEQ ID NO: 350285

SEQ ID NO: 649995 - RNA, 62 nt, hsa; identical to SEQ ID NO: 350286

SEQ ID NO: 649996 - RNA, 62 nt, hsa; identical to SEQ ID NO: 350287

SEQ ID NO: 649997 - RNA, 62 nt, hsa; identical to SEQ ID NO: 350288

SEQ ID NO: 649998 - RNA, 62 nt, hsa; identical to SEQ ID NO: 350289

SEQ ID NO: 649999 - RNA, 62 nt, hsa; identical to SEQ ID NO: 350290

SEQ ID NO: 650000 - RNA, 62 nt, hsa; identical to SEQ ID NO: 350291

SEQ ID NO: 650001 - RNA, 62 nt, hsa; identical to SEQ ID NO: 350292

SEQ ID NO: 650002 - RNA, 62 nt, hsa; identical to SEQ ID NO: 350293

SEQ ID NO: 650003 - RNA, 62 nt, hsa; identical to SEQ ID NO: 350294

SEQ ID NO: 650004 - RNA, 62 nt, hsa; identical to SEQ ID NO: 350295

SEQ ID NO: 650005 - RNA, 62 nt, hsa; identical to SEQ ID NO: 350296

SEQ ID NO: 650006 - RNA, 62 nt, hsa; identical to SEQ ID NO: 350297

SEQ ID NO: 650007 - RNA, 62 nt, hsa; identical to SEQ ID NO: 350298

SEQ ID NO: 650008 - RNA, 62 nt, hsa; identical to SEQ ID NO: 350299

SEQ ID NO: 650009 - RNA, 62 nt, hsa; identical to SEQ ID NO: 350300

SEQ ID NO: 650010 - RNA, 62 nt, hsa; identical to SEQ ID NO: 350301

SEQ ID NO: 650011 - RNA, 62 nt, hsa; identical to SEQ ID NO: 350302

SEQ ID NO: 650012 - RNA, 62 nt, hsa; identical to SEQ ID NO: 350303

SEQ ID NO: 650013 - RNA, 62 nt, hsa; identical to SEQ ID NO: 350304

SEQ ID NO: 650014 - RNA, 62 nt, hsa; identical to SEQ ID NO: 350305

SEQ ID NO: 650015 - RNA, 62 nt, hsa; identical to SEQ ID NO: 350306

SEQ ID NO: 650016 - RNA, 62 nt, hsa; identical to SEQ ID NO: 350307

SEQ ID NO: 650017 - RNA, 62 nt, hsa; identical to SEQ ID NO: 350308

SEQ ID NO: 650018 - RNA, 62 nt, hsa; identical to SEQ ID NO: 350309

SEQ ID NO: 650019 - RNA, 62 nt, hsa; identical to SEQ ID NO: 350310

SEQ ID NO: 650020 - RNA, 62 nt, hsa; identical to SEQ ID NO: 350311

SEQ ID NO: 650021 - RNA, 62 nt, hsa; identical to SEQ ID NO: 350312

SEQ ID NO: 650022 - RNA, 62 nt, hsa; identical to SEQ ID NO: 350313

SEQ ID NO: 650023 - RNA, 62 nt, hsa; identical to SEQ ID NO: 350314

SEQ ID NO: 650024 - RNA, 62 nt, hsa; identical to SEQ ID NO: 350315

SEQ ID NO: 650025 - RNA, 62 nt, hsa; identical to SEQ ID NO: 350316

SEQ ID NO: 650026 - RNA, 62 nt, hsa; identical to SEQ ID NO: 350317

SEQ ID NO: 650027 - RNA, 62 nt, hsa; identical to SEQ ID NO: 350318

SEQ ID NO: 650028 - RNA, 62 nt, hsa; identical to SEQ ID NO: 350319

SEQ ID NO: 650029 - RNA, 62 nt, hsa; identical to SEQ ID NO: 350320

SEQ ID NO: 650030 - RNA, 62 nt, hsa; identical to SEQ ID NO: 350321

SEQ ID NO: 650031 - RNA, 62 nt, hsa; identical to SEQ ID NO: 350322

SEQ ID NO: 650032 - RNA, 62 nt, hsa; identical to SEQ ID NO: 350323

SEQ ID NO: 650033 - RNA, 62 nt, hsa; identical to SEQ ID NO: 350324

SEQ ID NO: 650034 - RNA, 62 nt, hsa; identical to SEQ ID NO: 350325

SEQ ID NO: 650035 - RNA, 62 nt, hsa; identical to SEQ ID NO: 350326

SEQ ID NO: 650036 - RNA, 62 nt, hsa; identical to SEQ ID NO: 350327

SEQ ID NO: 650037 - RNA, 62 nt, hsa; identical to SEQ ID NO: 350328

SEQ ID NO: 650038 - RNA, 62 nt, hsa; identical to SEQ ID NO: 350329

SEQ ID NO: 650039 - RNA, 62 nt, hsa; identical to SEQ ID NO: 350330

SEQ ID NO: 650040 - RNA, 62 nt, hsa; identical to SEQ ID NO: 350331

SEQ ID NO: 650041 - RNA, 62 nt, hsa; identical to SEQ ID NO: 350332

SEQ ID NO: 650042 - RNA, 62 nt, hsa; identical to SEQ ID NO: 350333

SEQ ID NO: 650043 - RNA, 62 nt, hsa; identical to SEQ ID NO: 350334

SEQ ID NO: 650044 - RNA, 62 nt, hsa; identical to SEQ ID NO: 350335

SEQ ID NO: 650045 - RNA, 62 nt, hsa; identical to SEQ ID NO: 350336

SEQ ID NO: 650046 - RNA, 62 nt, hsa; identical to SEQ ID NO: 350337

SEQ ID NO: 650047 - RNA, 62 nt, hsa; identical to SEQ ID NO: 350338

SEQ ID NO: 650048 - RNA, 62 nt, hsa; identical to SEQ ID NO: 350339

SEQ ID NO: 650049 - RNA, 62 nt, hsa; identical to SEQ ID NO: 350340

SEQ ID NO: 650050 - RNA, 62 nt, hsa; identical to SEQ ID NO: 350341

SEQ ID NO: 650051 - RNA, 62 nt, hsa; identical to SEQ ID NO: 350342

SEQ ID NO: 650052 - RNA, 62 nt, hsa; identical to SEQ ID NO: 350343

SEQ ID NO: 650053 - RNA, 62 nt, hsa; identical to SEQ ID NO: 350344

SEQ ID NO: 650054 - RNA, 62 nt, hsa; identical to SEQ ID NO: 350345

SEQ ID NO: 650055 - RNA, 62 nt, hsa; identical to SEQ ID NO: 350346

SEQ ID NO: 650056 - RNA, 62 nt, hsa; identical to SEQ ID NO: 350347

SEQ ID NO: 650057 - RNA, 62 nt, hsa; identical to SEQ ID NO: 350348

SEQ ID NO: 650058 - RNA, 62 nt, hsa; identical to SEQ ID NO: 350349

SEQ ID NO: 650059 - RNA, 62 nt, hsa; identical to SEQ ID NO: 350350

SEQ ID NO: 650060 - RNA, 62 nt, hsa; identical to SEQ ID NO: 350351

SEQ ID NO: 650061 - RNA, 62 nt, hsa; identical to SEQ ID NO: 350352

SEQ ID NO: 650062 - RNA, 62 nt, hsa; identical to SEQ ID NO: 350353

SEQ ID NO: 650063 - RNA, 62 nt, hsa; identical to SEQ ID NO: 350354

SEQ ID NO: 650064 - RNA, 62 nt, hsa; identical to SEQ ID NO: 350355

SEQ ID NO: 650065 - RNA, 62 nt, hsa; identical to SEQ ID NO: 350356

SEQ ID NO: 650066 - RNA, 62 nt, hsa; identical to SEQ ID NO: 350357

SEQ ID NO: 650067 - RNA, 62 nt, hsa; identical to SEQ ID NO: 350358

SEQ ID NO: 650068 - RNA, 62 nt, hsa; identical to SEQ ID NO: 350359

SEQ ID NO: 650069 - RNA, 62 nt, hsa; identical to SEQ ID NO: 350360

SEQ ID NO: 650070 - RNA, 62 nt, hsa; identical to SEQ ID NO: 350361

SEQ ID NO: 650071 - RNA, 62 nt, hsa; identical to SEQ ID NO: 350362

SEQ ID NO: 650072 - RNA, 62 nt, hsa; identical to SEQ ID NO: 350363

SEQ ID NO: 650073 - RNA, 62 nt, hsa; identical to SEQ ID NO: 350364

SEQ ID NO: 650074 - RNA, 62 nt, hsa; identical to SEQ ID NO: 350365

SEQ ID NO: 650075 - RNA, 62 nt, hsa; identical to SEQ ID NO: 350366

SEQ ID NO: 650076 - RNA, 62 nt, hsa; identical to SEQ ID NO: 350367

SEQ ID NO: 650077 - RNA, 62 nt, hsa; identical to SEQ ID NO: 350368

SEQ ID NO: 650078 - RNA, 62 nt, hsa; identical to SEQ ID NO: 350369

SEQ ID NO: 650079 - RNA, 62 nt, hsa; identical to SEQ ID NO: 350370

SEQ ID NO: 650080 - RNA, 62 nt, hsa; identical to SEQ ID NO: 350371

SEQ ID NO: 650081 - RNA, 62 nt, hsa; identical to SEQ ID NO: 350372

SEQ ID NO: 650082 - RNA, 62 nt, hsa; identical to SEQ ID NO: 350373

SEQ ID NO: 650083 - RNA, 62 nt, hsa; identical to SEQ ID NO: 350374

SEQ ID NO: 650084 - RNA, 62 nt, hsa; identical to SEQ ID NO: 350375

SEQ ID NO: 650085 - RNA, 62 nt, hsa; identical to SEQ ID NO: 350376

SEQ ID NO: 650086 - RNA, 62 nt, hsa; identical to SEQ ID NO: 350377

SEQ ID NO: 650087 - RNA, 62 nt, hsa; identical to SEQ ID NO: 350378

SEQ ID NO: 650088 - RNA, 62 nt, hsa; identical to SEQ ID NO: 350379

SEQ ID NO: 650089 - RNA, 62 nt, hsa; identical to SEQ ID NO: 350380

SEQ ID NO: 650090 - RNA, 62 nt, hsa; identical to SEQ ID NO: 350381

SEQ ID NO: 650091 - RNA, 62 nt, hsa; identical to SEQ ID NO: 350382

SEQ ID NO: 650092 - RNA, 62 nt, hsa; identical to SEQ ID NO: 350383

SEQ ID NO: 650093 - RNA, 62 nt, hsa; identical to SEQ ID NO: 350384

SEQ ID NO: 650094 - RNA, 62 nt, hsa; identical to SEQ ID NO: 350385

SEQ ID NO: 650095 - RNA, 62 nt, hsa; identical to SEQ ID NO: 350386

SEQ ID NO: 650096 - RNA, 62 nt, hsa; identical to SEQ ID NO: 350387

SEQ ID NO: 650097 - RNA, 62 nt, hsa; identical to SEQ ID NO: 350388

SEQ ID NO: 650098 - RNA, 62 nt, hsa; identical to SEQ ID NO: 350389

SEQ ID NO: 650099 - RNA, 62 nt, hsa; identical to SEQ ID NO: 350390

SEQ ID NO: 650100 - RNA, 62 nt, hsa; identical to SEQ ID NO: 350391

SEQ ID NO: 650101 - RNA, 62 nt, hsa; identical to SEQ ID NO: 350392

SEQ ID NO: 650102 - RNA, 62 nt, hsa; identical to SEQ ID NO: 350393

SEQ ID NO: 650103 - RNA, 62 nt, hsa; identical to SEQ ID NO: 350394

SEQ ID NO: 650104 - RNA, 62 nt, hsa; identical to SEQ ID NO: 350395

SEQ ID NO: 650105 - RNA, 62 nt, hsa; identical to SEQ ID NO: 350396

SEQ ID NO: 650106 - RNA, 62 nt, hsa; identical to SEQ ID NO: 350397

SEQ ID NO: 650107 - RNA, 62 nt, hsa; identical to SEQ ID NO: 350398

SEQ ID NO: 650108 - RNA, 62 nt, hsa; identical to SEQ ID NO: 350399

SEQ ID NO: 650109 - RNA, 62 nt, hsa; identical to SEQ ID NO: 350400

SEQ ID NO: 650110 - RNA, 62 nt, hsa; identical to SEQ ID NO: 350401

SEQ ID NO: 650111 - RNA, 62 nt, hsa; identical to SEQ ID NO: 350402

SEQ ID NO: 650112 - RNA, 62 nt, hsa; identical to SEQ ID NO: 350403

SEQ ID NO: 650113 - RNA, 62 nt, hsa; identical to SEQ ID NO: 350404

SEQ ID NO: 650114 - RNA, 62 nt, hsa; identical to SEQ ID NO: 350405

SEQ ID NO: 650115 - RNA, 62 nt, hsa; identical to SEQ ID NO: 350406

SEQ ID NO: 650116 - RNA, 62 nt, hsa; identical to SEQ ID NO: 350407

SEQ ID NO: 650117 - RNA, 62 nt, hsa; identical to SEQ ID NO: 350408

SEQ ID NO: 650118 - RNA, 62 nt, hsa; identical to SEQ ID NO: 350409

SEQ ID NO: 650119 - RNA, 62 nt, hsa; identical to SEQ ID NO: 350410

SEQ ID NO: 650120 - RNA, 62 nt, hsa; identical to SEQ ID NO: 350411

SEQ ID NO: 650121 - RNA, 62 nt, hsa; identical to SEQ ID NO: 350412

SEQ ID NO: 650122 - RNA, 62 nt, hsa; identical to SEQ ID NO: 350413

SEQ ID NO: 650123 - RNA, 62 nt, hsa; identical to SEQ ID NO: 350414

SEQ ID NO: 650124 - RNA, 62 nt, hsa; identical to SEQ ID NO: 350415

SEQ ID NO: 650125 - RNA, 62 nt, hsa; identical to SEQ ID NO: 350416

SEQ ID NO: 650126 - RNA, 62 nt, hsa; identical to SEQ ID NO: 350417

SEQ ID NO: 650127 - RNA, 62 nt, hsa; identical to SEQ ID NO: 350418

SEQ ID NO: 650128 - RNA, 62 nt, hsa; identical to SEQ ID NO: 350419

SEQ ID NO: 650129 - RNA, 62 nt, hsa; identical to SEQ ID NO: 350420

SEQ ID NO: 650130 - RNA, 62 nt, hsa; identical to SEQ ID NO: 350421

SEQ ID NO: 650131 - RNA, 62 nt, hsa; identical to SEQ ID NO: 350422

SEQ ID NO: 650132 - RNA, 62 nt, hsa; identical to SEQ ID NO: 350423

SEQ ID NO: 650133 - RNA, 62 nt, hsa; identical to SEQ ID NO: 350424

SEQ ID NO: 650134 - RNA, 62 nt, hsa; identical to SEQ ID NO: 350425

SEQ ID NO: 650135 - RNA, 62 nt, hsa; identical to SEQ ID NO: 350426

SEQ ID NO: 650136 - RNA, 62 nt, hsa; identical to SEQ ID NO: 350427

SEQ ID NO: 650137 - RNA, 62 nt, hsa; identical to SEQ ID NO: 350428

SEQ ID NO: 650138 - RNA, 62 nt, hsa; identical to SEQ ID NO: 350429

SEQ ID NO: 650139 - RNA, 62 nt, hsa; identical to SEQ ID NO: 350430

SEQ ID NO: 650140 - RNA, 62 nt, hsa; identical to SEQ ID NO: 350431

SEQ ID NO: 650141 - RNA, 62 nt, hsa; identical to SEQ ID NO: 350432

SEQ ID NO: 650142 - RNA, 62 nt, hsa; identical to SEQ ID NO: 350433

SEQ ID NO: 650143 - RNA, 62 nt, hsa; identical to SEQ ID NO: 350434

SEQ ID NO: 650144 - RNA, 62 nt, hsa; identical to SEQ ID NO: 350435

SEQ ID NO: 650145 - RNA, 62 nt, hsa; identical to SEQ ID NO: 350436

SEQ ID NO: 650146 - RNA, 62 nt, hsa; identical to SEQ ID NO: 350437

SEQ ID NO: 650147 - RNA, 62 nt, hsa; identical to SEQ ID NO: 350438

SEQ ID NO: 650148 - RNA, 62 nt, hsa; identical to SEQ ID NO: 350439

SEQ ID NO: 650149 - RNA, 62 nt, hsa; identical to SEQ ID NO: 350440

SEQ ID NO: 650150 - RNA, 62 nt, hsa; identical to SEQ ID NO: 350441

SEQ ID NO: 650151 - RNA, 62 nt, hsa; identical to SEQ ID NO: 350442

SEQ ID NO: 650152 - RNA, 62 nt, hsa; identical to SEQ ID NO: 350443

SEQ ID NO: 650153 - RNA, 62 nt, hsa; identical to SEQ ID NO: 350444

SEQ ID NO: 650154 - RNA, 62 nt, hsa; identical to SEQ ID NO: 350445

SEQ ID NO: 650155 - RNA, 62 nt, hsa; identical to SEQ ID NO: 350446

SEQ ID NO: 650156 - RNA, 62 nt, hsa; identical to SEQ ID NO: 350447

SEQ ID NO: 650157 - RNA, 62 nt, hsa; identical to SEQ ID NO: 350448

SEQ ID NO: 650158 - RNA, 62 nt, hsa; identical to SEQ ID NO: 350449

SEQ ID NO: 650159 - RNA, 62 nt, hsa; identical to SEQ ID NO: 350450

SEQ ID NO: 650160 - RNA, 62 nt, hsa; identical to SEQ ID NO: 350451

SEQ ID NO: 650161 - RNA, 62 nt, hsa; identical to SEQ ID NO: 350452

SEQ ID NO: 650162 - RNA, 62 nt, hsa; identical to SEQ ID NO: 350453

SEQ ID NO: 650163 - RNA, 62 nt, hsa; identical to SEQ ID NO: 350454

SEQ ID NO: 650164 - RNA, 62 nt, hsa; identical to SEQ ID NO: 350455

SEQ ID NO: 650165 - RNA, 62 nt, hsa; identical to SEQ ID NO: 350456

SEQ ID NO: 650166 - RNA, 62 nt, hsa; identical to SEQ ID NO: 350457

SEQ ID NO: 650167 - RNA, 62 nt, hsa; identical to SEQ ID NO: 350458

SEQ ID NO: 650168 - RNA, 62 nt, hsa; identical to SEQ ID NO: 350459

SEQ ID NO: 650169 - RNA, 62 nt, hsa; identical to SEQ ID NO: 350460

SEQ ID NO: 650170 - RNA, 62 nt, hsa; identical to SEQ ID NO: 350461

SEQ ID NO: 650171 - RNA, 62 nt, hsa; identical to SEQ ID NO: 350462

SEQ ID NO: 650172 - RNA, 62 nt, hsa; identical to SEQ ID NO: 350463

SEQ ID NO: 650173 - RNA, 62 nt, hsa; identical to SEQ ID NO: 350464

SEQ ID NO: 650174 - RNA, 62 nt, hsa; identical to SEQ ID NO: 350465

SEQ ID NO: 650175 - RNA, 62 nt, hsa; identical to SEQ ID NO: 350466

SEQ ID NO: 650176 - RNA, 62 nt, hsa; identical to SEQ ID NO: 350467

SEQ ID NO: 650177 - RNA, 62 nt, hsa; identical to SEQ ID NO: 350468

SEQ ID NO: 650178 - RNA, 62 nt, hsa; identical to SEQ ID NO: 350469

SEQ ID NO: 650179 - RNA, 62 nt, hsa; identical to SEQ ID NO: 350470

SEQ ID NO: 650180 - RNA, 62 nt, hsa; identical to SEQ ID NO: 350471

SEQ ID NO: 650181 - RNA, 62 nt, hsa; identical to SEQ ID NO: 350472

SEQ ID NO: 650182 - RNA, 62 nt, hsa; identical to SEQ ID NO: 350473

SEQ ID NO: 650183 - RNA, 62 nt, hsa; identical to SEQ ID NO: 350474

SEQ ID NO: 650184 - RNA, 62 nt, hsa; identical to SEQ ID NO: 350475

SEQ ID NO: 650185 - RNA, 62 nt, hsa; identical to SEQ ID NO: 350476

SEQ ID NO: 650186 - RNA, 62 nt, hsa; identical to SEQ ID NO: 350477

SEQ ID NO: 650187 - RNA, 62 nt, hsa; identical to SEQ ID NO: 350478

SEQ ID NO: 650188 - RNA, 62 nt, hsa; identical to SEQ ID NO: 350479

SEQ ID NO: 650189 - RNA, 62 nt, hsa; identical to SEQ ID NO: 350480

SEQ ID NO: 650190 - RNA, 62 nt, hsa; identical to SEQ ID NO: 350481

SEQ ID NO: 650191 - RNA, 62 nt, hsa; identical to SEQ ID NO: 350482

SEQ ID NO: 650192 - RNA, 62 nt, hsa; identical to SEQ ID NO: 350483

SEQ ID NO: 650193 - RNA, 62 nt, hsa; identical to SEQ ID NO: 350484

SEQ ID NO: 650194 - RNA, 62 nt, hsa; identical to SEQ ID NO: 350485

SEQ ID NO: 650195 - RNA, 62 nt, hsa; identical to SEQ ID NO: 350486

SEQ ID NO: 650196 - RNA, 62 nt, hsa; identical to SEQ ID NO: 350487

SEQ ID NO: 650197 - RNA, 62 nt, hsa; identical to SEQ ID NO: 350488

SEQ ID NO: 650198 - RNA, 62 nt, hsa; identical to SEQ ID NO: 350489

SEQ ID NO: 650199 - RNA, 62 nt, hsa; identical to SEQ ID NO: 350490

SEQ ID NO: 650200 - RNA, 62 nt, hsa; identical to SEQ ID NO: 350491

SEQ ID NO: 650201 - RNA, 62 nt, hsa; identical to SEQ ID NO: 350492

SEQ ID NO: 650202 - RNA, 62 nt, hsa; identical to SEQ ID NO: 350493

SEQ ID NO: 650203 - RNA, 62 nt, hsa; identical to SEQ ID NO: 350494

SEQ ID NO: 650204 - RNA, 62 nt, hsa; identical to SEQ ID NO: 350495

SEQ ID NO: 650205 - RNA, 62 nt, hsa; identical to SEQ ID NO: 350496

SEQ ID NO: 650206 - RNA, 62 nt, hsa; identical to SEQ ID NO: 350497

SEQ ID NO: 650207 - RNA, 62 nt, hsa; identical to SEQ ID NO: 350498

SEQ ID NO: 650208 - RNA, 62 nt, hsa; identical to SEQ ID NO: 350499

SEQ ID NO: 650209 - RNA, 62 nt, hsa; identical to SEQ ID NO: 350500

SEQ ID NO: 650210 - RNA, 62 nt, hsa; identical to SEQ ID NO: 350501

SEQ ID NO: 650211 - RNA, 62 nt, hsa; identical to SEQ ID NO: 350502

SEQ ID NO: 650212 - RNA, 62 nt, hsa; identical to SEQ ID NO: 350503

SEQ ID NO: 650213 - RNA, 62 nt, hsa; identical to SEQ ID NO: 350504

SEQ ID NO: 650214 - RNA, 62 nt, hsa; identical to SEQ ID NO: 350505

SEQ ID NO: 650215 - RNA, 62 nt, hsa; identical to SEQ ID NO: 350506

SEQ ID NO: 650216 - RNA, 62 nt, hsa; identical to SEQ ID NO: 350507

SEQ ID NO: 650217 - RNA, 62 nt, hsa; identical to SEQ ID NO: 350508

SEQ ID NO: 650218 - RNA, 62 nt, hsa; identical to SEQ ID NO: 350509

SEQ ID NO: 650219 - RNA, 62 nt, hsa; identical to SEQ ID NO: 350510

SEQ ID NO: 650220 - RNA, 62 nt, hsa; identical to SEQ ID NO: 350511

SEQ ID NO: 650221 - RNA, 62 nt, hsa; identical to SEQ ID NO: 350512

SEQ ID NO: 650222 - RNA, 64 nt, hsa
ugguuggaaagucucuuuuuuguaauuuguuuuugcaaaucauugugaggccacuuuuucuuuc

SEQ ID NO: 650223 - RNA, 64 nt, hsa
uccuucuuucaucucuuuuuuguaauuuguuguugcaaaucauugugaggccacuuuucuuucc

SEQ ID NO: 650224 - RNA, 64 nt, hsa
cauguaccucguggaauucagccagcuucauguugcaaaucagaaagcugaccccaagacugca

SEQ ID NO: 650225 - RNA, 64 nt, hsa
ucauguugcaaaucagaaagcugaccccaagacugcaaaucaaugaagguauuggcauuguuaa

SEQ ID NO: 650226 - RNA, 64 nt, hsa
aaggcaucgucaugcacaguauuuguaauuaaaagcaaaucauuuguuuaaaaaggcaguuugc

SEQ ID NO: 650227 - RNA, 64 nt, hsa
aagguuagagaauaaauugauuuuuauaaauacugcaaaucaggcuuuuguuuccuuuuucaga

SEQ ID NO: 650228 - RNA, 64 nt, hsa
uagccuuugcacuuuuaaaauaaaaaccaaguaugcaaaucaaagauauuugguagucaaaaua

SEQ ID NO: 650229 - RNA, 64 nt, hsa
uuugccuaaaaaggaaauuggaugggauacuguggcaaaucauaaaaaaccagauaauugaacu

SEQ ID NO: 650230 - RNA, 64 nt, hsa
uugucacaaaguuuucaguaaugcuacaaccauugcaaaucauuggagaauccauaaugagaga

SEQ ID NO: 650231 - RNA, 64 nt, hsa
uacaaauaggaagaaugugacaaaguuuucgguugcaaaucaaaccuugaaacacauaagaaaa

SEQ ID NO: 650232 - RNA, 64 nt, hsa
auaaauaugaucuaugauuuugcuucauaaaacagcaaaucaauguuuuauguaaaauauuaaa

SEQ ID NO: 650233 - RNA, 64 nt, hsa
uaagucauuauuauauuuuucagcccuucauccagcaaaucagaaggacucaguacaaacuccg

SEQ ID NO: 650234 - RNA, 64 nt, hsa; identical to SEQ ID NO: 315044

SEQ ID NO: 650235 - RNA, 64 nt, hsa; identical to SEQ ID NO: 315045

SEQ ID NO: 650236 - RNA, 64 nt, hsa; identical to SEQ ID NO: 315046

SEQ ID NO: 650237 - RNA, 64 nt, hsa; identical to SEQ ID NO: 315047

SEQ ID NO: 650238 - RNA, 64 nt, hsa; identical to SEQ ID NO: 315048

SEQ ID NO: 650239 - RNA, 64 nt, hsa; identical to SEQ ID NO: 315049

SEQ ID NO: 650240 - RNA, 64 nt, hsa; identical to SEQ ID NO: 315050

SEQ ID NO: 650241 - RNA, 64 nt, hsa; identical to SEQ ID NO: 315051

SEQ ID NO: 650242 - RNA, 64 nt, hsa; identical to SEQ ID NO: 315052

SEQ ID NO: 650243 - RNA, 64 nt, hsa; identical to SEQ ID NO: 315053

SEQ ID NO: 650244 - RNA, 64 nt, hsa; identical to SEQ ID NO: 315054

SEQ ID NO: 650245 - RNA, 64 nt, hsa; identical to SEQ ID NO: 315055

SEQ ID NO: 650246 - RNA, 64 nt, hsa; identical to SEQ ID NO: 315056

SEQ ID NO: 650247 - RNA, 64 nt, hsa; identical to SEQ ID NO: 315057

SEQ ID NO: 650248 - RNA, 64 nt, hsa; identical to SEQ ID NO: 315058

SEQ ID NO: 650249 - RNA, 64 nt, hsa; identical to SEQ ID NO: 315059

SEQ ID NO: 650250 - RNA, 64 nt, hsa; identical to SEQ ID NO: 315060

SEQ ID NO: 650251 - RNA, 64 nt, hsa; identical to SEQ ID NO: 315061

SEQ ID NO: 650252 - RNA, 64 nt, hsa; identical to SEQ ID NO: 315062

SEQ ID NO: 650253 - RNA, 64 nt, hsa; identical to SEQ ID NO: 315063

SEQ ID NO: 650254 - RNA, 64 nt, hsa; identical to SEQ ID NO: 315064

SEQ ID NO: 650255 - RNA, 64 nt, hsa; identical to SEQ ID NO: 315065

SEQ ID NO: 650256 - RNA, 64 nt, hsa; identical to SEQ ID NO: 315066

SEQ ID NO: 650257 - RNA, 64 nt, hsa; identical to SEQ ID NO: 315067

SEQ ID NO: 650258 - RNA, 57 nt, hsa; identical to SEQ ID NO: 315068

SEQ ID NO: 650259 - RNA, 64 nt, hsa; identical to SEQ ID NO: 315069

SEQ ID NO: 650260 - RNA, 64 nt, hsa; identical to SEQ ID NO: 315070

SEQ ID NO: 650261 - RNA, 64 nt, hsa; identical to SEQ ID NO: 315071

SEQ ID NO: 650262 - RNA, 64 nt, hsa; identical to SEQ ID NO: 315072

SEQ ID NO: 650263 - RNA, 64 nt, hsa; identical to SEQ ID NO: 315073

SEQ ID NO: 650264 - RNA, 64 nt, hsa; identical to SEQ ID NO: 315074

SEQ ID NO: 650265 - RNA, 64 nt, hsa; identical to SEQ ID NO: 315075

SEQ ID NO: 650266 - RNA, 64 nt, hsa; identical to SEQ ID NO: 125298

SEQ ID NO: 650267 - RNA, 64 nt, hsa; identical to SEQ ID NO: 125299

SEQ ID NO: 650268 - RNA, 64 nt, hsa; identical to SEQ ID NO: 125300

SEQ ID NO: 650269 - RNA, 64 nt, hsa; identical to SEQ ID NO: 125301

SEQ ID NO: 650270 - RNA, 64 nt, hsa; identical to SEQ ID NO: 125302

SEQ ID NO: 650271 - RNA, 64 nt, hsa; identical to SEQ ID NO: 125303

SEQ ID NO: 650272 - RNA, 64 nt, hsa; identical to SEQ ID NO: 125304

SEQ ID NO: 650273 - RNA, 64 nt, hsa; identical to SEQ ID NO: 125305

SEQ ID NO: 650274 - RNA, 64 nt, hsa; identical to SEQ ID NO: 125306

SEQ ID NO: 650275 - RNA, 64 nt, hsa; identical to SEQ ID NO: 125307

SEQ ID NO: 650276 - RNA, 64 nt, hsa; identical to SEQ ID NO: 125308

SEQ ID NO: 650277 - RNA, 64 nt, hsa; identical to SEQ ID NO: 125309

SEQ ID NO: 650278 - RNA, 64 nt, hsa; identical to SEQ ID NO: 125310

SEQ ID NO: 650279 - RNA, 64 nt, hsa; identical to SEQ ID NO: 125311

SEQ ID NO: 650280 - RNA, 64 nt, hsa; identical to SEQ ID NO: 125312

SEQ ID NO: 650281 - RNA, 64 nt, hsa; identical to SEQ ID NO: 125313

SEQ ID NO: 650282 - RNA, 64 nt, hsa; identical to SEQ ID NO: 376189

SEQ ID NO: 650283 - RNA, 64 nt, hsa; identical to SEQ ID NO: 376190

SEQ ID NO: 650284 - RNA, 64 nt, hsa; identical to SEQ ID NO: 376191

SEQ ID NO: 650285 - RNA, 64 nt, hsa; identical to SEQ ID NO: 376192

SEQ ID NO: 650286 - RNA, 64 nt, hsa; identical to SEQ ID NO: 376193

SEQ ID NO: 650287 - RNA, 64 nt, hsa; identical to SEQ ID NO: 376194

SEQ ID NO: 650288 - RNA, 64 nt, hsa; identical to SEQ ID NO: 376195

SEQ ID NO: 650289 - RNA, 64 nt, hsa; identical to SEQ ID NO: 376196

SEQ ID NO: 650290 - RNA, 64 nt, hsa; identical to SEQ ID NO: 376197

SEQ ID NO: 650291 - RNA, 64 nt, hsa; identical to SEQ ID NO: 376198

SEQ ID NO: 650292 - RNA, 64 nt, hsa; identical to SEQ ID NO: 376199

SEQ ID NO: 650293 - RNA, 64 nt, hsa; identical to SEQ ID NO: 376200

SEQ ID NO: 650294 - RNA, 64 nt, hsa; identical to SEQ ID NO: 376201

SEQ ID NO: 650295 - RNA, 64 nt, hsa; identical to SEQ ID NO: 376202

SEQ ID NO: 650296 - RNA, 64 nt, hsa; identical to SEQ ID NO: 376203

SEQ ID NO: 650297 - RNA, 64 nt, hsa; identical to SEQ ID NO: 376204

SEQ ID NO: 650298 - RNA, 64 nt, hsa; identical to SEQ ID NO: 376205

SEQ ID NO: 650299 - RNA, 64 nt, hsa; identical to SEQ ID NO: 376206

SEQ ID NO: 650300 - RNA, 64 nt, hsa; identical to SEQ ID NO: 376207

SEQ ID NO: 650301 - RNA, 64 nt, hsa; identical to SEQ ID NO: 376208

SEQ ID NO: 650302 - RNA, 64 nt, hsa; identical to SEQ ID NO: 376209

SEQ ID NO: 650303 - RNA, 64 nt, hsa; identical to SEQ ID NO: 376210

SEQ ID NO: 650304 - RNA, 64 nt, hsa; identical to SEQ ID NO: 376211

SEQ ID NO: 650305 - RNA, 64 nt, hsa; identical to SEQ ID NO: 376212

SEQ ID NO: 650306 - RNA, 64 nt, hsa; identical to SEQ ID NO: 376213

SEQ ID NO: 650307 - RNA, 64 nt, hsa; identical to SEQ ID NO: 376214

SEQ ID NO: 650308 - RNA, 64 nt, hsa; identical to SEQ ID NO: 376215

SEQ ID NO: 650309 - RNA, 64 nt, hsa; identical to SEQ ID NO: 376216

SEQ ID NO: 650310 - RNA, 64 nt, hsa; identical to SEQ ID NO: 376217

SEQ ID NO: 650311 - RNA, 64 nt, hsa; identical to SEQ ID NO: 376218

SEQ ID NO: 650312 - RNA, 64 nt, hsa; identical to SEQ ID NO: 376219

SEQ ID NO: 650313 - RNA, 64 nt, hsa; identical to SEQ ID NO: 282942

SEQ ID NO: 650314 - RNA, 64 nt, hsa; identical to SEQ ID NO: 282943

SEQ ID NO: 650315 - RNA, 64 nt, hsa; identical to SEQ ID NO: 282944

SEQ ID NO: 650316 - RNA, 64 nt, hsa; identical to SEQ ID NO: 282945

SEQ ID NO: 650317 - RNA, 64 nt, hsa; identical to SEQ ID NO: 647031

SEQ ID NO: 650318 - RNA, 64 nt, hsa; identical to SEQ ID NO: 647032

SEQ ID NO: 650319 - RNA, 64 nt, hsa; identical to SEQ ID NO: 647033

SEQ ID NO: 650320 - RNA, 64 nt, hsa; identical to SEQ ID NO: 647034

SEQ ID NO: 650321 - RNA, 64 nt, hsa; identical to SEQ ID NO: 647035

SEQ ID NO: 650322 - RNA, 64 nt, hsa; identical to SEQ ID NO: 647036

SEQ ID NO: 650323 - RNA, 64 nt, hsa
cuguggccaccugaugacccuuucccuuuuuauuaaaccggacacaccuguuucccauuucgcu

SEQ ID NO: 650324 - RNA, 64 nt, hsa
cucggcuuccgcucagcccgguuuugacugguugaaaccggacauugguuuuuaaauuuuuugu

SEQ ID NO: 650325 - RNA, 64 nt, hsa
caacagagugagacuccgucucaaaaaaaaaaaaaaaccggaugucuaggccaaugauaauuau

SEQ ID NO: 650326 - RNA, 64 nt, hsa
aacugauccagcaauuacaacggagucaaaaauuaaaccggaccaucucuccaacucaacucaa

SEQ ID NO: 650327 - RNA, 64 nt, hsa
ugaggucaaauugaagacggaagacggaagacggaaaccggaaaccguuuucuuguaagccccu

SEQ ID NO: 650328 - RNA, 64 nt, hsa
uuugaaauugccuauacagucuuagugaccauuuaaaccggacgaacuagguguuuaauuuuca

SEQ ID NO: 650329 - RNA, 64 nt, hsa
caacuccugaauggccucgagccugcaacaguccaaaccggaagggagaauuuauuuuuugaaa

SEQ ID NO: 650330 - RNA, 64 nt, hsa
uucagcugugguuauuuaaagcagacuuacauguaaaccggaauccucucuauacaaguuuauu

SEQ ID NO: 650331 - RNA, 64 nt, hsa
cagauggcuucucacagaugcccuccugccagccaaaccggacuuguucuuccugccucugugc

SEQ ID NO: 650332 - RNA, 64 nt, hsa
cacccaguggguaggccaaguguguugcuucagcaaaccggaccaggagggccagggccggaug

SEQ ID NO: 650333 - RNA, 64 nt, hsa
cugugugaugggauaugaaaugguccauagaaaaaaaccggaaaaauacgccaagguuagguuc

SEQ ID NO: 650334 - RNA, 64 nt, hsa
acagaaacucaacucuaaauucaacaagaugugcaaaccggacaugcaggugaauauuuuaaua

SEQ ID NO: 650335 - RNA, 64 nt, hsa
cuggauccagucauuauguuuuuauagaauaauuaaaccggaugcuaacgguguuuuaaaaaau

SEQ ID NO: 650336 - RNA, 64 nt, hsa
ccucuacagcaccccugcccccuaauuuauacagaaaccggacccacuaauccucugggauugg

SEQ ID NO: 650337 - RNA, 64 nt, hsa
uugaucacgcacacacaauaagucuuucucuccgaaaccggaaguaaaucuauaucuguuagaa

SEQ ID NO: 650338 - RNA, 64 nt, hsa
ccccaucaagucccucuggggacguccccgucggaaaccggaaaaagcaguuccaguuaauugu

SEQ ID NO: 650339 - RNA, 64 nt, hsa
gcccccaccagcucaaauuccgagugcagaaaagaaaccggaccccccagugaggccugccagg

SEQ ID NO: 650340 - RNA, 64 nt, hsa
gcuagcucggcuuaagggaacucuccccauuggcaaaccggacccggccgccgccaggacugug

SEQ ID NO: 650341 - RNA, 64 nt, hsa
gacuucgcuaaaauucugauacuguuuacaaagaaaaccggauuuucaguagcugaagaaaaua

SEQ ID NO: 650342 - RNA, 64 nt, hsa
auuccaucucagguccagauguuaaacguuuauaaaaccggaaauguccuaacaacucuguaau

SEQ ID NO: 650343 - RNA, 64 nt, hsa
uugcacuggugccuccccucgaaccgccaagcagaaaccggaccucacagcugacugggaacug

SEQ ID NO: 650344 - RNA, 64 nt, hsa
uugcucaggacauuugaggucaaauugaagacggaaaccggaaaccguuuucuuguaagccccu

SEQ ID NO: 650345 - RNA, 64 nt, hsa
ugcauuucguaguucuuuauaugaaggguuagaaaaaccggaaucaagaaguucgauucacaac

SEQ ID NO: 650346 - RNA, 64 nt, hsa
gagggaguagggggcuagauguggcuccuagugcaaaccggaaaccauggcaccuuccagagcc

SEQ ID NO: 650347 - RNA, 64 nt, hsa
augacauacacuuaaccaaaacuauucaaaaugaaaaccggauuucaaauaaccagacaccaag

SEQ ID NO: 650348 - RNA, 64 nt, hsa
uuaccauugggauuguguuucuauucagcaagggaaaccggaccaagcgucugcauguguguga

SEQ ID NO: 650349 - RNA, 54 nt, hsa
cagugcccaaaauccacuaguccuaaaccggaagaggaugacaccggccauggg

SEQ ID NO: 650350 - RNA, 64 nt, hsa
cagcuguaaaaacacauuucuggaacaacuggagaaaccggaguaugcccuggacuggauauua

SEQ ID NO: 650351 - RNA, 64 nt, hsa
uggagugggggguggggguggggccacaaaaggaaaaccggaggagcaauuggggauccaggug

SEQ ID NO: 650352 - RNA, 64 nt, hsa
agaaauuccugauuccuguuacuaaucacuaaagaaaccggaugcugccaccguaggauuuaag

SEQ ID NO: 650353 - RNA, 64 nt, hsa
uagaaaggagauggggcuucaaccagggacauccaaaccggaagcacaaauccaggaggcucuc

SEQ ID NO: 650354 - RNA, 64 nt, hsa
ccucuccccgccgcccccaacaggcugucaaacaaaaccggagagggggugggggagccagccu

SEQ ID NO: 650355 - RNA, 64 nt, hsa
cuucaacgacaguauugaguggucagguuacaauaaaccggagagaaaagguccgcuugcacuu

SEQ ID NO: 650356 - RNA, 64 nt, hsa
uauggaaggcgugcuaggcauucaauuccugcagaaaccggaaaucuuccaugcccugcaaugu

SEQ ID NO: 650357 - RNA, 64 nt, hsa
uaacgugcaugcuuaagcuuuuacccaggcaucaaaaccggaacaucacaggguuuauacugga

SEQ ID NO: 650358 - RNA, 64 nt, hsa
uguuuccaaacaacaacaaaacaaaacaaaaaaaaaaccggauagaauaaugaccaaaaaaugg

SEQ ID NO: 650359 - RNA, 64 nt, hsa
ggggaucuuuguggcuucagcaaauucucuuguuaaaccggagugaaaacuucaggggaagggu

SEQ ID NO: 650360 - RNA, 64 nt, hsa
caccacucucaggaccacccugccaaggcagaauaaaccggauccuguugcagccuccuguccu

SEQ ID NO: 650361 - RNA, 64 nt, hsa
aaagguuuguguccaggauguacaaagaacucucaaaccggauaguaagaaaacaaacagccca

SEQ ID NO: 650362 - RNA, 64 nt, hsa
cugaacuugaacacugacauuuuguuaguaaagaaaaccggauggugccuuguuaaagggcaag

SEQ ID NO: 650363 - RNA, 64 nt, hsa
acugauacaacucagaaacugcucaaugucaggaaaaccggaacuuguugaugaacuuguuuuc

SEQ ID NO: 650364 - RNA, 64 nt, hsa
aauuuaaaagcugugaaauuaguuuucacgcaucaaaccggauuguuuauauguuuaaacauuu

SEQ ID NO: 650365 - RNA, 64 nt, hsa
ccccacaccgccgcccgguaauuauuugcauuacaaaccggaggcgcccucauuugcauuugug

SEQ ID NO: 650366 - RNA, 60 nt, hsa
cuucuuuuuuuuuuucugaaaaaaggaaaaagcacacagcacacaauuucaagccauuuu

SEQ ID NO: 650367 - RNA, 60 nt, hsa
uuuuuuuucugaaaaaaggaaaaagcacacagcacacaauuucaagccauuuucagauca

SEQ ID NO: 650368 - RNA, 60 nt, hsa
gcagagaaucagacuggccugaggugaaggagcacacagcccugagggcuuggaacccug

SEQ ID NO: 650369 - RNA, 60 nt, hsa
caucugugcuuaaccagaauccagcaagucagcacacaagugauuuuauuguuauuuugu

SEQ ID NO: 650370 - RNA, 60 nt, hsa
ggauggcggggcuagggaagcagagagcagagcacacacuggcucaagcagcagagguaa

SEQ ID NO: 650371 - RNA, 60 nt, hsa
gaugcugcuccaagccugugaggggcgaacagcacacaaggcugcccgucuugggaucac

SEQ ID NO: 650372 - RNA, 60 nt, hsa
gcuguccagccacugcccuuuaacaugcccagcacacaugggaggccuguggcccugugu

SEQ ID NO: 650373 - RNA, 60 nt, hsa
uaugaacccugcuugauguaaaauggaaauagcacacaggcagauggcccuggguuugga

SEQ ID NO: 650374 - RNA, 60 nt, hsa
caaggaacccagggccagcuggaaguguggagcacacaugcuguggagcacacaugcugu

SEQ ID NO: 650375 - RNA, 60 nt, hsa
agcuggaaguguggagcacacaugcuguggagcacacaugcuguggagauugcagugugu

SEQ ID NO: 650376 - RNA, 60 nt, hsa
aagccucaaaacacagcacacacacacacgagcacacacacacacacacacacgaacaca

SEQ ID NO: 650377 - RNA, 60 nt, hsa
cuucaaagcccacguaaagccucaaaacacagcacacacacacacgagcacacacacaca

SEQ ID NO: 650378 - RNA, 60 nt, hsa
guuuuucuccucuugguuuucauuugcucaagcacacaaaagggacuuuuguuuacucua

SEQ ID NO: 650379 - RNA, 60 nt, hsa
accugggaggagucuccaagccaugugcacagcacacacgugcagugcacacaaagaaau

SEQ ID NO: 650380 - RNA, 60 nt, hsa
acagcuuggucacaacacaacuguguccugagcacacaagauuccaucagcccugaagga

SEQ ID NO: 650381 - RNA, 60 nt, hsa
acaauccugacaugcucccuccaauuuaaaagcacacacacacacacacacacacacaca

SEQ ID NO: 650382 - RNA, 60 nt, hsa
ccccuguauucucaugauuuucucucaggaagcacacacugugaauggcagacuuuucau

SEQ ID NO: 650383 - RNA, 60 nt, hsa
augaguaggaucuuguuuuguuuuaucaccagcacacagauugcuauaaacuguuacuuu

SEQ ID NO: 650384 - RNA, 60 nt, hsa
cugauaauuagcugauauucaugguuguuuagcacacaguucaggaccuuugagaucaug

SEQ ID NO: 650385 - RNA, 60 nt, hsa
ccuccuuuguuacacacucaagaauuugucagcacacaauuaauugcagccauaguaccu

SEQ ID NO: 650386 - RNA, 60 nt, hsa
gaagggccugcucuuuccauuguggaucacagcacacacauacauacacccuccaccucc

SEQ ID NO: 650387 - RNA, 60 nt, hsa
gggccccuuagcagggugagcuguuaaaacagcacacaucucucauccccucuuccuuua

SEQ ID NO: 650388 - RNA, 60 nt, hsa
auuucauuuuuuggcacuaggucauuaaguagcacacagucugaaugcccuuuucuggag

SEQ ID NO: 650389 - RNA, 60 nt, hsa
ggcaagcuggcuguguacaggaaaauuggaagcacacaguggacugugccucuuaaagau

SEQ ID NO: 650390 - RNA, 60 nt, hsa
auauauauauauauauauauaugguaaacaagcacacacaauuuuauccaaugcaaacaa

SEQ ID NO: 650391 - RNA, 60 nt, hsa
uguuccucuacgacccgaccucucuauguaagcacacaugcgcacacacacuugcauuca

SEQ ID NO: 650392 - RNA, 60 nt, hsa
aaggcaaaaacuguacuguguuucgcauuaagcacacacaucuggcccugacuucuggag

SEQ ID NO: 650393 - RNA, 60 nt, hsa
caaaggugccucauagcauagccagcauucagcacacacaaaccuacugcccacauuugg

SEQ ID NO: 650394 - RNA, 60 nt, hsa
agcacaugcacacaggugcacagaccacacagcacacacaagugcacagagcacacugca

SEQ ID NO: 650395 - RNA, 60 nt, hsa
cacgcuugcacacaugcacacagaccacauagcacacaugugcacugaccacaccuguau

SEQ ID NO: 650396 - RNA, 60 nt, hsa
ggaacuguguguuuccaacaucaugguagcagcacacacuuccaaagcucagccagggac

SEQ ID NO: 650397 - RNA, 60 nt, hsa
uaaauaugugaaauauuaugaucugaacuuagcacacaugaagcaacauuucuuugcuac

SEQ ID NO: 650398 - RNA, 64 nt, hsa; identical to SEQ ID NO: 379229

SEQ ID NO: 650399 - RNA, 64 nt, hsa; identical to SEQ ID NO: 379230

SEQ ID NO: 650400 - RNA, 64 nt, hsa; identical to SEQ ID NO: 379231

SEQ ID NO: 650401 - RNA, 64 nt, hsa; identical to SEQ ID NO: 379232

SEQ ID NO: 650402 - RNA, 64 nt, hsa; identical to SEQ ID NO: 379233

SEQ ID NO: 650403 - RNA, 64 nt, hsa; identical to SEQ ID NO: 379234

SEQ ID NO: 650404 - RNA, 64 nt, hsa; identical to SEQ ID NO: 379235

SEQ ID NO: 650405 - RNA, 64 nt, hsa; identical to SEQ ID NO: 379236

SEQ ID NO: 650406 - RNA, 64 nt, hsa; identical to SEQ ID NO: 379237

SEQ ID NO: 650407 - RNA, 64 nt, hsa; identical to SEQ ID NO: 379238

SEQ ID NO: 650408 - RNA, 64 nt, hsa; identical to SEQ ID NO: 379239

SEQ ID NO: 650409 - RNA, 64 nt, hsa; identical to SEQ ID NO: 379240

SEQ ID NO: 650410 - RNA, 64 nt, hsa; identical to SEQ ID NO: 379241

SEQ ID NO: 650411 - RNA, 64 nt, hsa; identical to SEQ ID NO: 379242

SEQ ID NO: 650412 - RNA, 64 nt, hsa; identical to SEQ ID NO: 379243

SEQ ID NO: 650413 - RNA, 64 nt, hsa; identical to SEQ ID NO: 379244

SEQ ID NO: 650414 - RNA, 64 nt, hsa; identical to SEQ ID NO: 379245

SEQ ID NO: 650415 - RNA, 64 nt, hsa; identical to SEQ ID NO: 379246

SEQ ID NO: 650416 - RNA, 64 nt, hsa; identical to SEQ ID NO: 379247

SEQ ID NO: 650417 - RNA, 64 nt, hsa; identical to SEQ ID NO: 379248

SEQ ID NO: 650418 - RNA, 64 nt, hsa; identical to SEQ ID NO: 379249

SEQ ID NO: 650419 - RNA, 64 nt, hsa; identical to SEQ ID NO: 379250

SEQ ID NO: 650420 - RNA, 64 nt, hsa; identical to SEQ ID NO: 379251

SEQ ID NO: 650421 - RNA, 64 nt, hsa; identical to SEQ ID NO: 379252

SEQ ID NO: 650422 - RNA, 64 nt, hsa; identical to SEQ ID NO: 379253

SEQ ID NO: 650423 - RNA, 64 nt, hsa; identical to SEQ ID NO: 379254

SEQ ID NO: 650424 - RNA, 64 nt, hsa; identical to SEQ ID NO: 379255

SEQ ID NO: 650425 - RNA, 64 nt, hsa; identical to SEQ ID NO: 379256

SEQ ID NO: 650426 - RNA, 64 nt, hsa; identical to SEQ ID NO: 379257

SEQ ID NO: 650427 - RNA, 64 nt, hsa; identical to SEQ ID NO: 379258

SEQ ID NO: 650428 - RNA, 64 nt, hsa; identical to SEQ ID NO: 379259

SEQ ID NO: 650429 - RNA, 64 nt, hsa; identical to SEQ ID NO: 524911

SEQ ID NO: 650430 - RNA, 64 nt, hsa; identical to SEQ ID NO: 524912

SEQ ID NO: 650431 - RNA, 64 nt, hsa; identical to SEQ ID NO: 524913

SEQ ID NO: 650432 - RNA, 64 nt, hsa; identical to SEQ ID NO: 524914

SEQ ID NO: 650433 - RNA, 64 nt, hsa; identical to SEQ ID NO: 524915

SEQ ID NO: 650434 - RNA, 64 nt, hsa; identical to SEQ ID NO: 524916

SEQ ID NO: 650435 - RNA, 64 nt, hsa; identical to SEQ ID NO: 524917

SEQ ID NO: 650436 - RNA, 64 nt, hsa; identical to SEQ ID NO: 524918

SEQ ID NO: 650437 - RNA, 64 nt, hsa; identical to SEQ ID NO: 524919

SEQ ID NO: 650438 - RNA, 64 nt, hsa; identical to SEQ ID NO: 524920

SEQ ID NO: 650439 - RNA, 64 nt, hsa; identical to SEQ ID NO: 524921

SEQ ID NO: 650440 - RNA, 64 nt, hsa; identical to SEQ ID NO: 524922

SEQ ID NO: 650441 - RNA, 64 nt, hsa; identical to SEQ ID NO: 524923

SEQ ID NO: 650442 - RNA, 64 nt, hsa; identical to SEQ ID NO: 524924

SEQ ID NO: 650443 - RNA, 64 nt, hsa; identical to SEQ ID NO: 524925

SEQ ID NO: 650444 - RNA, 64 nt, hsa; identical to SEQ ID NO: 524926

SEQ ID NO: 650445 - RNA, 64 nt, hsa; identical to SEQ ID NO: 524927

SEQ ID NO: 650446 - RNA, 64 nt, hsa; identical to SEQ ID NO: 524928

SEQ ID NO: 650447 - RNA, 64 nt, hsa; identical to SEQ ID NO: 524929

SEQ ID NO: 650448 - RNA, 64 nt, hsa; identical to SEQ ID NO: 524930

SEQ ID NO: 650449 - RNA, 64 nt, hsa; identical to SEQ ID NO: 524931

SEQ ID NO: 650450 - RNA, 64 nt, hsa; identical to SEQ ID NO: 524932

SEQ ID NO: 650451 - RNA, 64 nt, hsa; identical to SEQ ID NO: 524933

SEQ ID NO: 650452 - RNA, 64 nt, hsa; identical to SEQ ID NO: 524934

SEQ ID NO: 650453 - RNA, 64 nt, hsa; identical to SEQ ID NO: 524935

SEQ ID NO: 650454 - RNA, 64 nt, hsa; identical to SEQ ID NO: 56439

SEQ ID NO: 650455 - RNA, 64 nt, hsa; identical to SEQ ID NO: 56440

SEQ ID NO: 650456 - RNA, 64 nt, hsa; identical to SEQ ID NO: 56441

SEQ ID NO: 650457 - RNA, 64 nt, hsa; identical to SEQ ID NO: 56442

SEQ ID NO: 650458 - RNA, 64 nt, hsa; identical to SEQ ID NO: 56443

SEQ ID NO: 650459 - RNA, 64 nt, hsa; identical to SEQ ID NO: 56444

SEQ ID NO: 650460 - RNA, 64 nt, hsa; identical to SEQ ID NO: 56445

SEQ ID NO: 650461 - RNA, 64 nt, hsa; identical to SEQ ID NO: 56446

SEQ ID NO: 650462 - RNA, 64 nt, hsa; identical to SEQ ID NO: 56447

SEQ ID NO: 650463 - RNA, 64 nt, hsa; identical to SEQ ID NO: 56448

SEQ ID NO: 650464 - RNA, 64 nt, hsa; identical to SEQ ID NO: 56449

SEQ ID NO: 650465 - RNA, 64 nt, hsa; identical to SEQ ID NO: 56450

SEQ ID NO: 650466 - RNA, 64 nt, hsa; identical to SEQ ID NO: 56451

SEQ ID NO: 650467 - RNA, 64 nt, hsa; identical to SEQ ID NO: 56452

SEQ ID NO: 650468 - RNA, 64 nt, hsa; identical to SEQ ID NO: 56453

SEQ ID NO: 650469 - RNA, 64 nt, hsa; identical to SEQ ID NO: 56454

SEQ ID NO: 650470 - RNA, 64 nt, hsa; identical to SEQ ID NO: 56455

SEQ ID NO: 650471 - RNA, 64 nt, hsa; identical to SEQ ID NO: 56456

SEQ ID NO: 650472 - RNA, 64 nt, hsa; identical to SEQ ID NO: 56457

SEQ ID NO: 650473 - RNA, 64 nt, hsa; identical to SEQ ID NO: 56458

SEQ ID NO: 650474 - RNA, 64 nt, hsa; identical to SEQ ID NO: 56459

SEQ ID NO: 650475 - RNA, 64 nt, hsa; identical to SEQ ID NO: 56460

SEQ ID NO: 650476 - RNA, 64 nt, hsa; identical to SEQ ID NO: 56461

SEQ ID NO: 650477 - RNA, 64 nt, hsa; identical to SEQ ID NO: 56462

SEQ ID NO: 650478 - RNA, 64 nt, hsa; identical to SEQ ID NO: 56463

SEQ ID NO: 650479 - RNA, 64 nt, hsa; identical to SEQ ID NO: 56464

SEQ ID NO: 650480 - RNA, 64 nt, hsa; identical to SEQ ID NO: 56465

SEQ ID NO: 650481 - RNA, 64 nt, hsa; identical to SEQ ID NO: 56466

SEQ ID NO: 650482 - RNA, 64 nt, hsa; identical to SEQ ID NO: 56467

SEQ ID NO: 650483 - RNA, 50 nt, hsa; identical to SEQ ID NO: 56468

SEQ ID NO: 650484 - RNA, 64 nt, hsa; identical to SEQ ID NO: 56469

SEQ ID NO: 650485 - RNA, 64 nt, hsa; identical to SEQ ID NO: 56470

SEQ ID NO: 650486 - RNA, 64 nt, hsa; identical to SEQ ID NO: 56471

SEQ ID NO: 650487 - RNA, 64 nt, hsa; identical to SEQ ID NO: 56472

SEQ ID NO: 650488 - RNA, 64 nt, hsa; identical to SEQ ID NO: 56473

SEQ ID NO: 650489 - RNA, 64 nt, hsa; identical to SEQ ID NO: 56474

SEQ ID NO: 650490 - RNA, 64 nt, hsa; identical to SEQ ID NO: 56475

SEQ ID NO: 650491 - RNA, 64 nt, hsa; identical to SEQ ID NO: 56476

SEQ ID NO: 650492 - RNA, 64 nt, hsa; identical to SEQ ID NO: 56477

SEQ ID NO: 650493 - RNA, 64 nt, hsa; identical to SEQ ID NO: 56478

SEQ ID NO: 650494 - RNA, 64 nt, hsa; identical to SEQ ID NO: 56479

SEQ ID NO: 650495 - RNA, 64 nt, hsa; identical to SEQ ID NO: 56480

SEQ ID NO: 650496 - RNA, 64 nt, hsa; identical to SEQ ID NO: 56481

SEQ ID NO: 650497 - RNA, 64 nt, hsa; identical to SEQ ID NO: 56482

SEQ ID NO: 650498 - RNA, 64 nt, hsa; identical to SEQ ID NO: 56483

SEQ ID NO: 650499 - RNA, 64 nt, hsa; identical to SEQ ID NO: 56484

SEQ ID NO: 650500 - RNA, 64 nt, hsa; identical to SEQ ID NO: 56485

SEQ ID NO: 650501 - RNA, 64 nt, hsa; identical to SEQ ID NO: 56486

SEQ ID NO: 650502 - RNA, 64 nt, hsa; identical to SEQ ID NO: 56487

SEQ ID NO: 650503 - RNA, 64 nt, hsa; identical to SEQ ID NO: 56488

SEQ ID NO: 650504 - RNA, 64 nt, hsa; identical to SEQ ID NO: 56489

SEQ ID NO: 650505 - RNA, 64 nt, hsa; identical to SEQ ID NO: 56490

SEQ ID NO: 650506 - RNA, 64 nt, hsa; identical to SEQ ID NO: 56491

SEQ ID NO: 650507 - RNA, 64 nt, hsa; identical to SEQ ID NO: 56492

SEQ ID NO: 650508 - RNA, 64 nt, hsa; identical to SEQ ID NO: 56493

SEQ ID NO: 650509 - RNA, 64 nt, hsa; identical to SEQ ID NO: 56494

SEQ ID NO: 650510 - RNA, 64 nt, hsa; identical to SEQ ID NO: 56495

SEQ ID NO: 650511 - RNA, 64 nt, hsa; identical to SEQ ID NO: 56496

SEQ ID NO: 650512 - RNA, 64 nt, hsa; identical to SEQ ID NO: 56497

SEQ ID NO: 650513 - RNA, 64 nt, hsa; identical to SEQ ID NO: 56498

SEQ ID NO: 650514 - RNA, 64 nt, hsa; identical to SEQ ID NO: 56499

SEQ ID NO: 650515 - RNA, 64 nt, hsa; identical to SEQ ID NO: 56500

SEQ ID NO: 650516 - RNA, 64 nt, hsa; identical to SEQ ID NO: 56501

SEQ ID NO: 650517 - RNA, 64 nt, hsa; identical to SEQ ID NO: 56502

SEQ ID NO: 650518 - RNA, 64 nt, hsa; identical to SEQ ID NO: 56503

SEQ ID NO: 650519 - RNA, 64 nt, hsa; identical to SEQ ID NO: 56504

SEQ ID NO: 650520 - RNA, 64 nt, hsa; identical to SEQ ID NO: 56505

SEQ ID NO: 650521 - RNA, 64 nt, hsa; identical to SEQ ID NO: 56506

SEQ ID NO: 650522 - RNA, 64 nt, hsa; identical to SEQ ID NO: 56507

SEQ ID NO: 650523 - RNA, 64 nt, hsa; identical to SEQ ID NO: 56508

SEQ ID NO: 650524 - RNA, 64 nt, hsa; identical to SEQ ID NO: 56509

SEQ ID NO: 650525 - RNA, 64 nt, hsa; identical to SEQ ID NO: 56510

SEQ ID NO: 650526 - RNA, 64 nt, hsa; identical to SEQ ID NO: 56511

SEQ ID NO: 650527 - RNA, 64 nt, hsa; identical to SEQ ID NO: 56512

SEQ ID NO: 650528 - RNA, 64 nt, hsa; identical to SEQ ID NO: 56513

SEQ ID NO: 650529 - RNA, 64 nt, hsa; identical to SEQ ID NO: 56514

SEQ ID NO: 650530 - RNA, 64 nt, hsa; identical to SEQ ID NO: 56515

SEQ ID NO: 650531 - RNA, 64 nt, hsa; identical to SEQ ID NO: 56516

SEQ ID NO: 650532 - RNA, 64 nt, hsa; identical to SEQ ID NO: 56517

SEQ ID NO: 650533 - RNA, 64 nt, hsa; identical to SEQ ID NO: 56518

SEQ ID NO: 650534 - RNA, 64 nt, hsa; identical to SEQ ID NO: 56519

SEQ ID NO: 650535 - RNA, 64 nt, hsa; identical to SEQ ID NO: 56520

SEQ ID NO: 650536 - RNA, 64 nt, hsa; identical to SEQ ID NO: 56521

SEQ ID NO: 650537 - RNA, 64 nt, hsa; identical to SEQ ID NO: 56522

SEQ ID NO: 650538 - RNA, 64 nt, hsa; identical to SEQ ID NO: 56523

SEQ ID NO: 650539 - RNA, 64 nt, hsa; identical to SEQ ID NO: 56524

SEQ ID NO: 650540 - RNA, 64 nt, hsa; identical to SEQ ID NO: 56525

SEQ ID NO: 650541 - RNA, 64 nt, hsa; identical to SEQ ID NO: 56526

SEQ ID NO: 650542 - RNA, 64 nt, hsa; identical to SEQ ID NO: 56527

SEQ ID NO: 650543 - RNA, 64 nt, hsa; identical to SEQ ID NO: 56528

SEQ ID NO: 650544 - RNA, 64 nt, hsa; identical to SEQ ID NO: 56529

SEQ ID NO: 650545 - RNA, 64 nt, hsa; identical to SEQ ID NO: 56530

SEQ ID NO: 650546 - RNA, 64 nt, hsa; identical to SEQ ID NO: 56531

SEQ ID NO: 650547 - RNA, 64 nt, hsa; identical to SEQ ID NO: 56532

SEQ ID NO: 650548 - RNA, 64 nt, hsa; identical to SEQ ID NO: 56533

SEQ ID NO: 650549 - RNA, 64 nt, hsa; identical to SEQ ID NO: 56534

SEQ ID NO: 650550 - RNA, 59 nt, hsa; identical to SEQ ID NO: 56535

SEQ ID NO: 650551 - RNA, 64 nt, hsa; identical to SEQ ID NO: 56536

SEQ ID NO: 650552 - RNA, 64 nt, hsa; identical to SEQ ID NO: 56537

SEQ ID NO: 650553 - RNA, 64 nt, hsa; identical to SEQ ID NO: 56538

SEQ ID NO: 650554 - RNA, 64 nt, hsa; identical to SEQ ID NO: 56539

SEQ ID NO: 650555 - RNA, 64 nt, hsa; identical to SEQ ID NO: 56540

SEQ ID NO: 650556 - RNA, 64 nt, hsa; identical to SEQ ID NO: 56541

SEQ ID NO: 650557 - RNA, 64 nt, hsa; identical to SEQ ID NO: 56542

SEQ ID NO: 650558 - RNA, 64 nt, hsa; identical to SEQ ID NO: 56543

SEQ ID NO: 650559 - RNA, 64 nt, hsa; identical to SEQ ID NO: 56544

SEQ ID NO: 650560 - RNA, 64 nt, hsa; identical to SEQ ID NO: 56545

SEQ ID NO: 650561 - RNA, 64 nt, hsa; identical to SEQ ID NO: 56546

SEQ ID NO: 650562 - RNA, 64 nt, hsa; identical to SEQ ID NO: 56547

SEQ ID NO: 650563 - RNA, 64 nt, hsa; identical to SEQ ID NO: 56548

SEQ ID NO: 650564 - RNA, 64 nt, hsa; identical to SEQ ID NO: 56549

SEQ ID NO: 650565 - RNA, 64 nt, hsa; identical to SEQ ID NO: 56550

SEQ ID NO: 650566 - RNA, 64 nt, hsa; identical to SEQ ID NO: 56551

SEQ ID NO: 650567 - RNA, 64 nt, hsa; identical to SEQ ID NO: 56552

SEQ ID NO: 650568 - RNA, 64 nt, hsa; identical to SEQ ID NO: 56553

SEQ ID NO: 650569 - RNA, 64 nt, hsa; identical to SEQ ID NO: 56554

SEQ ID NO: 650570 - RNA, 64 nt, hsa; identical to SEQ ID NO: 56555

SEQ ID NO: 650571 - RNA, 64 nt, hsa; identical to SEQ ID NO: 56556

SEQ ID NO: 650572 - RNA, 62 nt, hsa; identical to SEQ ID NO: 56557

SEQ ID NO: 650573 - RNA, 58 nt, hsa; identical to SEQ ID NO: 56558

SEQ ID NO: 650574 - RNA, 64 nt, hsa; identical to SEQ ID NO: 56559

SEQ ID NO: 650575 - RNA, 64 nt, hsa; identical to SEQ ID NO: 56560

SEQ ID NO: 650576 - RNA, 64 nt, hsa; identical to SEQ ID NO: 56561

SEQ ID NO: 650577 - RNA, 64 nt, hsa; identical to SEQ ID NO: 56562

SEQ ID NO: 650578 - RNA, 64 nt, hsa; identical to SEQ ID NO: 56563

SEQ ID NO: 650579 - RNA, 64 nt, hsa; identical to SEQ ID NO: 56564

SEQ ID NO: 650580 - RNA, 64 nt, hsa; identical to SEQ ID NO: 56565

SEQ ID NO: 650581 - RNA, 64 nt, hsa; identical to SEQ ID NO: 56566

SEQ ID NO: 650582 - RNA, 64 nt, hsa; identical to SEQ ID NO: 56567

SEQ ID NO: 650583 - RNA, 64 nt, hsa; identical to SEQ ID NO: 56568

SEQ ID NO: 650584 - RNA, 64 nt, hsa; identical to SEQ ID NO: 56569

SEQ ID NO: 650585 - RNA, 64 nt, hsa; identical to SEQ ID NO: 56570

SEQ ID NO: 650586 - RNA, 64 nt, hsa; identical to SEQ ID NO: 56571

SEQ ID NO: 650587 - RNA, 64 nt, hsa; identical to SEQ ID NO: 56572

SEQ ID NO: 650588 - RNA, 64 nt, hsa; identical to SEQ ID NO: 56573

SEQ ID NO: 650589 - RNA, 64 nt, hsa; identical to SEQ ID NO: 56574

SEQ ID NO: 650590 - RNA, 64 nt, hsa; identical to SEQ ID NO: 56575

SEQ ID NO: 650591 - RNA, 64 nt, hsa; identical to SEQ ID NO: 56576

SEQ ID NO: 650592 - RNA, 64 nt, hsa; identical to SEQ ID NO: 56577

SEQ ID NO: 650593 - RNA, 64 nt, hsa; identical to SEQ ID NO: 56578

SEQ ID NO: 650594 - RNA, 64 nt, hsa; identical to SEQ ID NO: 56579

SEQ ID NO: 650595 - RNA, 64 nt, hsa; identical to SEQ ID NO: 56580

SEQ ID NO: 650596 - RNA, 64 nt, hsa; identical to SEQ ID NO: 56581

SEQ ID NO: 650597 - RNA, 64 nt, hsa; identical to SEQ ID NO: 56582

SEQ ID NO: 650598 - RNA, 60 nt, hsa
aacuacaauucacuguugugagaauauuccucgucacagcaaaaacacuuuccuuucuac

SEQ ID NO: 650599 - RNA, 60 nt, hsa
auuuuagacaccuuagagguccgugcuacaucgucacaguuccuccgaauaaccuuaggu

SEQ ID NO: 650600 - RNA, 60 nt, hsa
ccagaaaggaccagagaaagccaggcuggaucgucacaugccggggagcaauguggaugg

SEQ ID NO: 650601 - RNA, 60 nt, hsa
gauugugcauguuuuguaugucauaguaugucgucacauaaaagggagggagcgaaaaac

SEQ ID NO: 650602 - RNA, 60 nt, hsa
gcacauguccaccugggaaaugagaugccaucgucacauucauuuggucacccucagucc

SEQ ID NO: 650603 - RNA, 60 nt, hsa
uagaugcugggcccagggcccuagguuugcucgucacaguguggggaagcccauuccucu

SEQ ID NO: 650604 - RNA, 60 nt, hsa
aguuucuuuucuuuuucuuuuuucuuuuucucgucacacagguaaccuuaaagacagacc

SEQ ID NO: 650605 - RNA, 60 nt, hsa
cugaugugcacuuuguucuguuucccagauucgucacaaugccuauuguccuguccuucu

SEQ ID NO: 650606 - RNA, 60 nt, hsa
aguagcuauuccgauuggauauuccguucgucgucacauagcuggcuuuucucuccucau

SEQ ID NO: 650607 - RNA, 60 nt, hsa
cuuuccugcauuucucccucccuccuucccucgucacaucucuuauaugagcacaguaau

SEQ ID NO: 650608 - RNA, 60 nt, hsa
guuuuaugacuuguagucaggcuuugcuguucgucacagugucauuuuccauucagguac

SEQ ID NO: 650609 - RNA, 60 nt, hsa
ucacauuggcgccuagaacaguuaggucgcucgucacauaggcaguuaaguggagaacca

SEQ ID NO: 650610 - RNA, 60 nt, hsa
uugagguggugccuucugccucugcccugaucgucacaacccucaggaaccaccgacaga

SEQ ID NO: 650611 - RNA, 60 nt, hsa
ucagcugcuguuggaaaacgcuauggagguucgucacaaaauucaacauagaauuacccu

SEQ ID NO: 650612 - RNA, 60 nt, hsa
gcagugauuugucggacugugguuacucugucgucacauuuuguagaauuaguucuauaa

SEQ ID NO: 650613 - RNA, 60 nt, hsa
ccugcucagcccggaggcugugcacggcccucgucacaaggugacccuugcagcacaggc

SEQ ID NO: 650614 - RNA, 60 nt, hsa
cacuguggaaagcuuugaacaauuguguuuucgucacaggagucuuuguaaugcuuguac

SEQ ID NO: 650615 - RNA, 60 nt, hsa
cgcccccgccugugucagguguggaugaggucgucacacucagaaggacaggcuugucug

SEQ ID NO: 650616 - RNA, 60 nt, hsa
cccauucuuagccuaacguucgucauugccucgucacaucaaugcaaaagguccugauuu

SEQ ID NO: 650617 - RNA, 60 nt, hsa
cggggccuccccucccugcuaggaggcaacucgucacacccaagcugcuggccuccaguc

SEQ ID NO: 650618 - RNA, 60 nt, hsa
ugcuuccgcugcuugaagguuuguccacauucgucacagauauaguuccgcaccucugag

SEQ ID NO: 650619 - RNA, 60 nt, hsa
gacuuggcaacuggcuuuucuccuguggagucgucacacgccauccagcagcgcuaaggu

SEQ ID NO: 650620 - RNA, 60 nt, hsa
auauuugcaaauugccaucuauugaaauucucgucacacuacauagacauaauuguuauc

SEQ ID NO: 650621 - RNA, 60 nt, hsa
auguuucacaggccuuccuacauuuagaaaucgucacacagcugugauaagaguagauua

SEQ ID NO: 650622 - RNA, 60 nt, hsa
ggcauacuugcccuuacagguggaguaucuucgucacacaucuaaaugagaaaucaguga

SEQ ID NO: 650623 - RNA, 60 nt, hsa
gaaagagugaugugugagauucccagagagucgucacaccaguguuaugccugggagugc

SEQ ID NO: 650624 - RNA, 60 nt, hsa
agggaccuuugucagugagcaagacugagaucgucacaggagaaggugcccuugcuggcu

SEQ ID NO: 650625 - RNA, 60 nt, hsa
ugcacuguggugcuucaguggccaccagccucgucacauacaccagcaucuuucuguacc

SEQ ID NO: 650626 - RNA, 60 nt, hsa
cuggacuuccucgaguggccacugugagccucgucacagcagaaaccaacuuuucuaacg

SEQ ID NO: 650627 - RNA, 60 nt, hsa
uggaaaagacaccagcccaggggcccugacucgucacacuucccuuuccuaagccucuga

SEQ ID NO: 650628 - RNA, 60 nt, hsa
gccacucuaagaauugaaaagauggggcauucgucacagagagaguacaucugugaacaa

SEQ ID NO: 650629 - RNA, 60 nt, hsa
cccccgaagcggggagggccgcuguggccuucgucacagccgcgcagugcccauggaggc

SEQ ID NO: 650630 - RNA, 60 nt, hsa
cuccaauguuuugauucucuaaucauguuuucgucacaugcugaguaaaagugccuuaca

SEQ ID NO: 650631 - RNA, 60 nt, hsa
cugagaaaacgagccuguuucagaggaacaucgucacaacgaauacuucuggaagcuuaa

SEQ ID NO: 650632 - RNA, 52 nt, hsa
ucuauguccacucaguuugacaucgucacaccuaaaugcugucugguccccu

SEQ ID NO: 650633 - RNA, 60 nt, hsa
ccaguuuuauaaacagcagauagcaacuugucgucacagcuggcaugggcuggacaguug

SEQ ID NO: 650634 - RNA, 64 nt, hsa; identical to SEQ ID NO: 214928

SEQ ID NO: 650635 - RNA, 64 nt, hsa; identical to SEQ ID NO: 214929

SEQ ID NO: 650636 - RNA, 64 nt, hsa; identical to SEQ ID NO: 214930

SEQ ID NO: 650637 - RNA, 64 nt, hsa; identical to SEQ ID NO: 214931

SEQ ID NO: 650638 - RNA, 64 nt, hsa; identical to SEQ ID NO: 214932

SEQ ID NO: 650639 - RNA, 64 nt, hsa; identical to SEQ ID NO: 214933

SEQ ID NO: 650640 - RNA, 64 nt, hsa; identical to SEQ ID NO: 214934

SEQ ID NO: 650641 - RNA, 64 nt, hsa; identical to SEQ ID NO: 214935

SEQ ID NO: 650642 - RNA, 64 nt, hsa; identical to SEQ ID NO: 214936

SEQ ID NO: 650643 - RNA, 64 nt, hsa; identical to SEQ ID NO: 214937

SEQ ID NO: 650644 - RNA, 54 nt, hsa; identical to SEQ ID NO: 214938

SEQ ID NO: 650645 - RNA, 64 nt, hsa; identical to SEQ ID NO: 214939

SEQ ID NO: 650646 - RNA, 64 nt, hsa; identical to SEQ ID NO: 214940

SEQ ID NO: 650647 - RNA, 64 nt, hsa; identical to SEQ ID NO: 214941

SEQ ID NO: 650648 - RNA, 64 nt, hsa; identical to SEQ ID NO: 214942

SEQ ID NO: 650649 - RNA, 64 nt, hsa; identical to SEQ ID NO: 214943

SEQ ID NO: 650650 - RNA, 64 nt, hsa; identical to SEQ ID NO: 214944

SEQ ID NO: 650651 - RNA, 64 nt, hsa; identical to SEQ ID NO: 214945

SEQ ID NO: 650652 - RNA, 64 nt, hsa; identical to SEQ ID NO: 214946

SEQ ID NO: 650653 - RNA, 64 nt, hsa; identical to SEQ ID NO: 214947

SEQ ID NO: 650654 - RNA, 64 nt, hsa; identical to SEQ ID NO: 214948

SEQ ID NO: 650655 - RNA, 64 nt, hsa; identical to SEQ ID NO: 214949

SEQ ID NO: 650656 - RNA, 64 nt, hsa; identical to SEQ ID NO: 214950

SEQ ID NO: 650657 - RNA, 64 nt, hsa; identical to SEQ ID NO: 214951

SEQ ID NO: 650658 - RNA, 64 nt, hsa; identical to SEQ ID NO: 214952

SEQ ID NO: 650659 - RNA, 64 nt, hsa; identical to SEQ ID NO: 214953

SEQ ID NO: 650660 - RNA, 64 nt, hsa; identical to SEQ ID NO: 214954

SEQ ID NO: 650661 - RNA, 64 nt, hsa; identical to SEQ ID NO: 214955

SEQ ID NO: 650662 - RNA, 64 nt, hsa; identical to SEQ ID NO: 214956

SEQ ID NO: 650663 - RNA, 64 nt, hsa; identical to SEQ ID NO: 214957

SEQ ID NO: 650664 - RNA, 64 nt, hsa; identical to SEQ ID NO: 214958

SEQ ID NO: 650665 - RNA, 64 nt, hsa; identical to SEQ ID NO: 214959

SEQ ID NO: 650666 - RNA, 64 nt, hsa; identical to SEQ ID NO: 214960

SEQ ID NO: 650667 - RNA, 64 nt, hsa; identical to SEQ ID NO: 214961

SEQ ID NO: 650668 - RNA, 64 nt, hsa; identical to SEQ ID NO: 214962

SEQ ID NO: 650669 - RNA, 64 nt, hsa; identical to SEQ ID NO: 214963

SEQ ID NO: 650670 - RNA, 64 nt, hsa; identical to SEQ ID NO: 214964

SEQ ID NO: 650671 - RNA, 64 nt, hsa; identical to SEQ ID NO: 214965

SEQ ID NO: 650672 - RNA, 64 nt, hsa; identical to SEQ ID NO: 214966

SEQ ID NO: 650673 - RNA, 64 nt, hsa; identical to SEQ ID NO: 214967

SEQ ID NO: 650674 - RNA, 64 nt, hsa; identical to SEQ ID NO: 214968

SEQ ID NO: 650675 - RNA, 64 nt, hsa; identical to SEQ ID NO: 214969

SEQ ID NO: 650676 - RNA, 64 nt, hsa; identical to SEQ ID NO: 214970

SEQ ID NO: 650677 - RNA, 64 nt, hsa; identical to SEQ ID NO: 214971

SEQ ID NO: 650678 - RNA, 64 nt, hsa; identical to SEQ ID NO: 214972

SEQ ID NO: 650679 - RNA, 64 nt, hsa; identical to SEQ ID NO: 214973

SEQ ID NO: 650680 - RNA, 64 nt, hsa; identical to SEQ ID NO: 214974

SEQ ID NO: 650681 - RNA, 64 nt, hsa; identical to SEQ ID NO: 214975

SEQ ID NO: 650682 - RNA, 64 nt, hsa; identical to SEQ ID NO: 214976

SEQ ID NO: 650683 - RNA, 64 nt, hsa; identical to SEQ ID NO: 214977

SEQ ID NO: 650684 - RNA, 64 nt, hsa; identical to SEQ ID NO: 214978

SEQ ID NO: 650685 - RNA, 63 nt, hsa; identical to SEQ ID NO: 588819

SEQ ID NO: 650686 - RNA, 63 nt, hsa; identical to SEQ ID NO: 588820

SEQ ID NO: 650687 - RNA, 63 nt, hsa; identical to SEQ ID NO: 588821

SEQ ID NO: 650688 - RNA, 63 nt, hsa; identical to SEQ ID NO: 588822

SEQ ID NO: 650689 - RNA, 63 nt, hsa; identical to SEQ ID NO: 588823

SEQ ID NO: 650690 - RNA, 63 nt, hsa; identical to SEQ ID NO: 588824

SEQ ID NO: 650691 - RNA, 63 nt, hsa; identical to SEQ ID NO: 588825

SEQ ID NO: 650692 - RNA, 63 nt, hsa; identical to SEQ ID NO: 588826

SEQ ID NO: 650693 - RNA, 63 nt, hsa; identical to SEQ ID NO: 588827

SEQ ID NO: 650694 - RNA, 63 nt, hsa; identical to SEQ ID NO: 588828

SEQ ID NO: 650695 - RNA, 63 nt, hsa; identical to SEQ ID NO: 588829

SEQ ID NO: 650696 - RNA, 63 nt, hsa; identical to SEQ ID NO: 588830

SEQ ID NO: 650697 - RNA, 63 nt, hsa; identical to SEQ ID NO: 588831

SEQ ID NO: 650698 - RNA, 63 nt, hsa; identical to SEQ ID NO: 588832

SEQ ID NO: 650699 - RNA, 63 nt, hsa; identical to SEQ ID NO: 588833

SEQ ID NO: 650700 - RNA, 63 nt, hsa; identical to SEQ ID NO: 588834

SEQ ID NO: 650701 - RNA, 63 nt, hsa; identical to SEQ ID NO: 588835

SEQ ID NO: 650702 - RNA, 63 nt, hsa; identical to SEQ ID NO: 588836

SEQ ID NO: 650703 - RNA, 63 nt, hsa; identical to SEQ ID NO: 588837

SEQ ID NO: 650704 - RNA, 63 nt, hsa; identical to SEQ ID NO: 588838

SEQ ID NO: 650705 - RNA, 63 nt, hsa; identical to SEQ ID NO: 588839

SEQ ID NO: 650706 - RNA, 63 nt, hsa; identical to SEQ ID NO: 588840

SEQ ID NO: 650707 - RNA, 63 nt, hsa; identical to SEQ ID NO: 588841

SEQ ID NO: 650708 - RNA, 63 nt, hsa; identical to SEQ ID NO: 588842

SEQ ID NO: 650709 - RNA, 63 nt, hsa; identical to SEQ ID NO: 588843

SEQ ID NO: 650710 - RNA, 63 nt, hsa; identical to SEQ ID NO: 588844

SEQ ID NO: 650711 - RNA, 63 nt, hsa; identical to SEQ ID NO: 588845

SEQ ID NO: 650712 - RNA, 63 nt, hsa; identical to SEQ ID NO: 588846

SEQ ID NO: 650713 - RNA, 63 nt, hsa; identical to SEQ ID NO: 588847

SEQ ID NO: 650714 - RNA, 63 nt, hsa; identical to SEQ ID NO: 588848

SEQ ID NO: 650715 - RNA, 63 nt, hsa; identical to SEQ ID NO: 588849

SEQ ID NO: 650716 - RNA, 63 nt, hsa; identical to SEQ ID NO: 588850

SEQ ID NO: 650717 - RNA, 63 nt, hsa; identical to SEQ ID NO: 588851

SEQ ID NO: 650718 - RNA, 63 nt, hsa; identical to SEQ ID NO: 588852

SEQ ID NO: 650719 - RNA, 63 nt, hsa; identical to SEQ ID NO: 588853

SEQ ID NO: 650720 - RNA, 63 nt, hsa; identical to SEQ ID NO: 588854

SEQ ID NO: 650721 - RNA, 63 nt, hsa; identical to SEQ ID NO: 588855

SEQ ID NO: 650722 - RNA, 63 nt, hsa; identical to SEQ ID NO: 588856

SEQ ID NO: 650723 - RNA, 63 nt, hsa; identical to SEQ ID NO: 588857

SEQ ID NO: 650724 - RNA, 63 nt, hsa; identical to SEQ ID NO: 588858

SEQ ID NO: 650725 - RNA, 63 nt, hsa; identical to SEQ ID NO: 588859

SEQ ID NO: 650726 - RNA, 63 nt, hsa; identical to SEQ ID NO: 588860

SEQ ID NO: 650727 - RNA, 63 nt, hsa; identical to SEQ ID NO: 588861

SEQ ID NO: 650728 - RNA, 63 nt, hsa; identical to SEQ ID NO: 588862

SEQ ID NO: 650729 - RNA, 63 nt, hsa; identical to SEQ ID NO: 588863

SEQ ID NO: 650730 - RNA, 63 nt, hsa; identical to SEQ ID NO: 588864

SEQ ID NO: 650731 - RNA, 63 nt, hsa; identical to SEQ ID NO: 588865

SEQ ID NO: 650732 - RNA, 63 nt, hsa; identical to SEQ ID NO: 588866

SEQ ID NO: 650733 - RNA, 63 nt, hsa; identical to SEQ ID NO: 588867

SEQ ID NO: 650734 - RNA, 63 nt, hsa; identical to SEQ ID NO: 588868

SEQ ID NO: 650735 - RNA, 63 nt, hsa; identical to SEQ ID NO: 588869

SEQ ID NO: 650736 - RNA, 63 nt, hsa; identical to SEQ ID NO: 588870

SEQ ID NO: 650737 - RNA, 63 nt, hsa; identical to SEQ ID NO: 588871

SEQ ID NO: 650738 - RNA, 63 nt, hsa; identical to SEQ ID NO: 588872

SEQ ID NO: 650739 - RNA, 63 nt, hsa; identical to SEQ ID NO: 588873

SEQ ID NO: 650740 - RNA, 63 nt, hsa; identical to SEQ ID NO: 588874

SEQ ID NO: 650741 - RNA, 63 nt, hsa; identical to SEQ ID NO: 588875

SEQ ID NO: 650742 - RNA, 63 nt, hsa; identical to SEQ ID NO: 588876

SEQ ID NO: 650743 - RNA, 63 nt, hsa; identical to SEQ ID NO: 588877

SEQ ID NO: 650744 - RNA, 63 nt, hsa; identical to SEQ ID NO: 588878

SEQ ID NO: 650745 - RNA, 63 nt, hsa; identical to SEQ ID NO: 588879

SEQ ID NO: 650746 - RNA, 63 nt, hsa; identical to SEQ ID NO: 588880

SEQ ID NO: 650747 - RNA, 63 nt, hsa; identical to SEQ ID NO: 588881

SEQ ID NO: 650748 - RNA, 63 nt, hsa; identical to SEQ ID NO: 588882

SEQ ID NO: 650749 - RNA, 63 nt, hsa; identical to SEQ ID NO: 588883

SEQ ID NO: 650750 - RNA, 63 nt, hsa; identical to SEQ ID NO: 588884

SEQ ID NO: 650751 - RNA, 63 nt, hsa; identical to SEQ ID NO: 588885

SEQ ID NO: 650752 - RNA, 63 nt, hsa; identical to SEQ ID NO: 588886

SEQ ID NO: 650753 - RNA, 63 nt, hsa; identical to SEQ ID NO: 588887

SEQ ID NO: 650754 - RNA, 63 nt, hsa; identical to SEQ ID NO: 588888

SEQ ID NO: 650755 - RNA, 52 nt, hsa; identical to SEQ ID NO: 588889

SEQ ID NO: 650756 - RNA, 63 nt, hsa; identical to SEQ ID NO: 588890

SEQ ID NO: 650757 - RNA, 63 nt, hsa; identical to SEQ ID NO: 588891

SEQ ID NO: 650758 - RNA, 63 nt, hsa; identical to SEQ ID NO: 588892

SEQ ID NO: 650759 - RNA, 63 nt, hsa; identical to SEQ ID NO: 588893

SEQ ID NO: 650760 - RNA, 63 nt, hsa; identical to SEQ ID NO: 588894

SEQ ID NO: 650761 - RNA, 63 nt, hsa; identical to SEQ ID NO: 588895

SEQ ID NO: 650762 - RNA, 63 nt, hsa; identical to SEQ ID NO: 588896

SEQ ID NO: 650763 - RNA, 63 nt, hsa; identical to SEQ ID NO: 588897

SEQ ID NO: 650764 - RNA, 63 nt, hsa; identical to SEQ ID NO: 588898

SEQ ID NO: 650765 - RNA, 63 nt, hsa; identical to SEQ ID NO: 588899

SEQ ID NO: 650766 - RNA, 63 nt, hsa; identical to SEQ ID NO: 588900

SEQ ID NO: 650767 - RNA, 63 nt, hsa; identical to SEQ ID NO: 588901

SEQ ID NO: 650768 - RNA, 63 nt, hsa; identical to SEQ ID NO: 588902

SEQ ID NO: 650769 - RNA, 63 nt, hsa; identical to SEQ ID NO: 588903

SEQ ID NO: 650770 - RNA, 63 nt, hsa; identical to SEQ ID NO: 588904

SEQ ID NO: 650771 - RNA, 63 nt, hsa; identical to SEQ ID NO: 588905

SEQ ID NO: 650772 - RNA, 63 nt, hsa; identical to SEQ ID NO: 588906

SEQ ID NO: 650773 - RNA, 63 nt, hsa; identical to SEQ ID NO: 588907

SEQ ID NO: 650774 - RNA, 63 nt, hsa; identical to SEQ ID NO: 588908

SEQ ID NO: 650775 - RNA, 63 nt, hsa; identical to SEQ ID NO: 588909

SEQ ID NO: 650776 - RNA, 63 nt, hsa; identical to SEQ ID NO: 588910

SEQ ID NO: 650777 - RNA, 63 nt, hsa; identical to SEQ ID NO: 588911

SEQ ID NO: 650778 - RNA, 63 nt, hsa; identical to SEQ ID NO: 588912

SEQ ID NO: 650779 - RNA, 63 nt, hsa; identical to SEQ ID NO: 588913

SEQ ID NO: 650780 - RNA, 63 nt, hsa; identical to SEQ ID NO: 588914

SEQ ID NO: 650781 - RNA, 63 nt, hsa; identical to SEQ ID NO: 588915

SEQ ID NO: 650782 - RNA, 63 nt, hsa; identical to SEQ ID NO: 588916

SEQ ID NO: 650783 - RNA, 63 nt, hsa; identical to SEQ ID NO: 588917

SEQ ID NO: 650784 - RNA, 63 nt, hsa; identical to SEQ ID NO: 588918

SEQ ID NO: 650785 - RNA, 63 nt, hsa; identical to SEQ ID NO: 588919

SEQ ID NO: 650786 - RNA, 63 nt, hsa; identical to SEQ ID NO: 588920

SEQ ID NO: 650787 - RNA, 63 nt, hsa; identical to SEQ ID NO: 588921

SEQ ID NO: 650788 - RNA, 63 nt, hsa; identical to SEQ ID NO: 588922

SEQ ID NO: 650789 - RNA, 63 nt, hsa; identical to SEQ ID NO: 588923

SEQ ID NO: 650790 - RNA, 63 nt, hsa; identical to SEQ ID NO: 588924

SEQ ID NO: 650791 - RNA, 63 nt, hsa; identical to SEQ ID NO: 588925

SEQ ID NO: 650792 - RNA, 63 nt, hsa; identical to SEQ ID NO: 588926

SEQ ID NO: 650793 - RNA, 63 nt, hsa; identical to SEQ ID NO: 588927

SEQ ID NO: 650794 - RNA, 63 nt, hsa; identical to SEQ ID NO: 588928

SEQ ID NO: 650795 - RNA, 63 nt, hsa; identical to SEQ ID NO: 588929

SEQ ID NO: 650796 - RNA, 63 nt, hsa; identical to SEQ ID NO: 588930

SEQ ID NO: 650797 - RNA, 63 nt, hsa; identical to SEQ ID NO: 588931

SEQ ID NO: 650798 - RNA, 63 nt, hsa; identical to SEQ ID NO: 588932

SEQ ID NO: 650799 - RNA, 63 nt, hsa; identical to SEQ ID NO: 588933

SEQ ID NO: 650800 - RNA, 63 nt, hsa; identical to SEQ ID NO: 588934

SEQ ID NO: 650801 - RNA, 63 nt, hsa; identical to SEQ ID NO: 588935

SEQ ID NO: 650802 - RNA, 63 nt, hsa; identical to SEQ ID NO: 588936

SEQ ID NO: 650803 - RNA, 63 nt, hsa; identical to SEQ ID NO: 588937

SEQ ID NO: 650804 - RNA, 63 nt, hsa; identical to SEQ ID NO: 588938

SEQ ID NO: 650805 - RNA, 63 nt, hsa; identical to SEQ ID NO: 588939

SEQ ID NO: 650806 - RNA, 63 nt, hsa; identical to SEQ ID NO: 588940

SEQ ID NO: 650807 - RNA, 63 nt, hsa; identical to SEQ ID NO: 588941

SEQ ID NO: 650808 - RNA, 63 nt, hsa; identical to SEQ ID NO: 588942

SEQ ID NO: 650809 - RNA, 63 nt, hsa; identical to SEQ ID NO: 588943

SEQ ID NO: 650810 - RNA, 63 nt, hsa; identical to SEQ ID NO: 588944

SEQ ID NO: 650811 - RNA, 63 nt, hsa; identical to SEQ ID NO: 588945

SEQ ID NO: 650812 - RNA, 63 nt, hsa; identical to SEQ ID NO: 588946

SEQ ID NO: 650813 - RNA, 63 nt, hsa; identical to SEQ ID NO: 588947

SEQ ID NO: 650814 - RNA, 63 nt, hsa; identical to SEQ ID NO: 588948

SEQ ID NO: 650815 - RNA, 63 nt, hsa; identical to SEQ ID NO: 588949

SEQ ID NO: 650816 - RNA, 63 nt, hsa; identical to SEQ ID NO: 588950

SEQ ID NO: 650817 - RNA, 63 nt, hsa; identical to SEQ ID NO: 588951

SEQ ID NO: 650818 - RNA, 63 nt, hsa; identical to SEQ ID NO: 588952

SEQ ID NO: 650819 - RNA, 63 nt, hsa; identical to SEQ ID NO: 588953

SEQ ID NO: 650820 - RNA, 63 nt, hsa; identical to SEQ ID NO: 588954

SEQ ID NO: 650821 - RNA, 63 nt, hsa; identical to SEQ ID NO: 588955

SEQ ID NO: 650822 - RNA, 63 nt, hsa; identical to SEQ ID NO: 588956

SEQ ID NO: 650823 - RNA, 63 nt, hsa; identical to SEQ ID NO: 588957

SEQ ID NO: 650824 - RNA, 63 nt, hsa; identical to SEQ ID NO: 588958

SEQ ID NO: 650825 - RNA, 63 nt, hsa; identical to SEQ ID NO: 588959

SEQ ID NO: 650826 - RNA, 64 nt, hsa
ugccaccuaaacgaucaguguggugcugcguucuggccaguaaauuccauguuuuuggcuauau

SEQ ID NO: 650827 - RNA, 64 nt, hsa
uucuagaccuuagacacucaagauuacggucccgggccaguaacagcaccugggagcuugguag

SEQ ID NO: 650828 - RNA, 64 nt, hsa
ggagaacuaaguaagaaacacaaugccaacagcuggccaguaauuaguguugugcacuucaugu

SEQ ID NO: 650829 - RNA, 64 nt, hsa
uauuuauuuauugagaguuuuuuagugcaaucugggccaguauuuuuauagauuaugauuaugu

SEQ ID NO: 650830 - RNA, 64 nt, hsa
ggaaaaguuuggcuacuaacaguagcauugugauggccaguauauccaguccauggauaaagaa

SEQ ID NO: 650831 - RNA, 64 nt, hsa
aaugucagaacagagugcaacccagucacacuguggccaguaaaauacuauugccucauauugu

SEQ ID NO: 650832 - RNA, 64 nt, hsa
agccacaaacaaguacuuuaccccacagcuuaguggccaguaaacacccuggggacuaggaaaa

SEQ ID NO: 650833 - RNA, 64 nt, hsa
cagcugucuugguaaaggagagagagagacauggggccaguaauuccggggugcucagaaguuu

SEQ ID NO: 650834 - RNA, 64 nt, hsa
agucccaaggguccacgauguacaaagucauuucggccaguaggugugcagaccccuccccgcc

SEQ ID NO: 650835 - RNA, 64 nt, hsa
ccuuccucacuguaucuuugcccagacccaccugggccaguaggccccuguccccagccacaca

SEQ ID NO: 650836 - RNA, 64 nt, hsa
agcccagcccugaccucaggaagugucagagcauggccaguaguuggcagcccgaaagacacac

SEQ ID NO: 650837 - RNA, 64 nt, hsa
uugccacccccugugagcagggauuagguguucaggccaguaucuugggcaugggggagccuuu

SEQ ID NO: 650838 - RNA, 64 nt, hsa
aaagacuuaauuuccuuguugagaacaggaaaguggccaguagccaggcaagucauagaauuga

SEQ ID NO: 650839 - RNA, 64 nt, hsa
ccagcuuuuuuuuuuuuuuuuuuaaauuggcuuuggccaguagcuaaagugcaagacugaauua

SEQ ID NO: 650840 - RNA, 64 nt, hsa
acaaaguuugccaaccauaagugucaaaagcacaggccaguauuaagcagaaguucuaccaccu

SEQ ID NO: 650841 - RNA, 64 nt, hsa
guauacauccuggguaaugagagguggcuuuugcggccaguauuagacuggaaguucauaccua

SEQ ID NO: 650842 - RNA, 64 nt, hsa
ugcaggggcagagaaggaagggaccaggggacugggccaguauguggaggauggggccugcgug

SEQ ID NO: 650843 - RNA, 64 nt, hsa
aauaucuguuuuuaauguuuuguuucucccuccaggccaguauaaagggacuugaaguauuuuu

SEQ ID NO: 650844 - RNA, 64 nt, hsa
uguauaauuuuuaugcucuuugauuaucuaauaaggccaguauuucaaaagcuguucugaauuu

SEQ ID NO: 650845 - RNA, 64 nt, hsa
uauagagcuagcuaaucucuacaaacccucuguaggccaguaguucucaaaguguggucucugg

SEQ ID NO: 650846 - RNA, 64 nt, hsa
uugcuagccucucuuacuaauggaauuauauacuggccaguaaaaugggccucccaauugcugu

SEQ ID NO: 650847 - RNA, 64 nt, hsa
caugaagugcucucguucucaguagcggcaucauggccaguagugucuuugaggaguucaccac

SEQ ID NO: 650848 - RNA, 64 nt, hsa
gauuauugauugugagauagguuagguuuuggggggccaguaguucagugagaauguuuauguu

SEQ ID NO: 650849 - RNA, 64 nt, hsa
cuuucucucucccucuuucucucucucuuucguaggccaguagcaauguuguguucacagucua

SEQ ID NO: 650850 - RNA, 64 nt, hsa
gccuucccuuggagagggccuggcuucaacauugggccaguaggcaucuuagcuuggcaggugu

SEQ ID NO: 650851 - RNA, 64 nt, hsa
ucucugcacgcuugaccaaagcagugaugagggcggccaguaccugcggugugcgugguagguu

SEQ ID NO: 650852 - RNA, 64 nt, hsa
ccguacuaacgucugcaaaccccaagacguuugaggccaguaggaaguugagaaagaaagccac

SEQ ID NO: 650853 - RNA, 64 nt, hsa
cucucuuucucugguggucuuccuucuaccccaaggccaguaguuuugacacuucccaguggaa

SEQ ID NO: 650854 - RNA, 64 nt, hsa
ccccuaaacccaacucacguuucuguaugucuuaggccaguaucccaaaccucuuccacgucac

SEQ ID NO: 650855 - RNA, 64 nt, hsa
auguggcucaguggagggagacccagcauagccaggccaguauggagcaccucacgcacagcuc

SEQ ID NO: 650856 - RNA, 64 nt, hsa
uuggugaaauugcuguggggguaucgggggauauggccaguaaaguauugagagacuaacaaau

SEQ ID NO: 650857 - RNA, 64 nt, hsa
gguugguugccccucaccucagagcucccccaaaggccaguaauggauccccggccucaguccc

SEQ ID NO: 650858 - RNA, 64 nt, hsa
cggugcaggcauagcugccugcugcucuggcagaggccaguaaauacaguuccuagaagcagcc

SEQ ID NO: 650859 - RNA, 64 nt, hsa
uccauaugaccucaugcaucuccaccugcucccaggccaguaagggaaauagaaaaacccugcc

SEQ ID NO: 650860 - RNA, 64 nt, hsa
aggucucauacaaggauauuuggagugaaaugcuggccaguacuuguucucccuugccccaacc

SEQ ID NO: 650861 - RNA, 64 nt, hsa
uucuuucaauccucauuaucuuuagcccucagcuggccaguacuuauugcuaaagaaagggaga

SEQ ID NO: 650862 - RNA, 64 nt, hsa
uuuagccuccuucgcaggcauguccuggacaccgggccaguaucuauauauguguauguacguu

SEQ ID NO: 650863 - RNA, 64 nt, hsa
agugcugggauuacaggugugagccaccacacuuggccaguauauccucaguaugaagauauuu

SEQ ID NO: 650864 - RNA, 64 nt, hsa
augucugcaucugugcuguguguguagugugguuggccaguaggugaguaucccugugugugug

SEQ ID NO: 650865 - RNA, 64 nt, hsa
gugugaguguuuauauagaaaugaacauagaccuggccaguaaaaggcucugaggaggcuuaaa

SEQ ID NO: 650866 - RNA, 64 nt, hsa
ggagugcagggaggggcaggaaaggagacaaggaggccaguauggacacuguguccaguauggc

SEQ ID NO: 650867 - RNA, 64 nt, hsa
acaguuccccacccagcgauuagggagcugggcuggccaguacagccaguggggaguggguggg

SEQ ID NO: 650868 - RNA, 64 nt, hsa
cuucacacagaaaucuguagcacugcuuuuuugaggccaguagcaacauccagagaucauucuu

SEQ ID NO: 650869 - RNA, 64 nt, hsa
uauuuggggcaucucuauagaaagugaccaccaaggccaguaaguacgggaaaaaauguuuacu

SEQ ID NO: 650870 - RNA, 64 nt, hsa
acucucucaugacugcacaccccauucaggcagaggccaguacagaggaggagccauuguggca

SEQ ID NO: 650871 - RNA, 64 nt, hsa
gccuuacccucuguaagauacugauucuuccuggggccaguauuaccuuguaugcaaauauuac

SEQ ID NO: 650872 - RNA, 64 nt, hsa
agaaagucacauuuaggguuuauuuuuuacacuuggccaguaaaauaggguaaauccuauuaga

SEQ ID NO: 650873 - RNA, 64 nt, hsa
cauuauguacagaauaggaccuauccaguagccaggccaguaggcaguuggggaaggugggaag

SEQ ID NO: 650874 - RNA, 64 nt, hsa
ugcuuuauaagugaggguagggugagggaggacaggccaguagggggagggaaagggagagggg

SEQ ID NO: 650875 - RNA, 64 nt, hsa
ggccccaggggguuagaggaggggugaagauuggggccaguaucgaucuuaugaagcuggagga

SEQ ID NO: 650876 - RNA, 64 nt, hsa
aaguuucugaagucuucacagcucuuaaaagccaggccaguacugacuguguggugguaaaugc

SEQ ID NO: 650877 - RNA, 64 nt, hsa
ugugcuuuggguugaaaagaaguuuuuaguccuaggccaguagauggcagcagcuuuucauugc

SEQ ID NO: 650878 - RNA, 64 nt, hsa
uaacuguaucuugaggugguaguaaaacacagagggccaguaacgggucguaaugacuuauugu

SEQ ID NO: 650879 - RNA, 64 nt, hsa
gcuuuauucuuccaaguucauucauacucaaagaggccaguacuuugccauccuugcacuucug

SEQ ID NO: 650880 - RNA, 64 nt, hsa
ugaauuuauagagcauuuuuuuucuuaccaagauggccaguaucauuuuacccccaccucccaa

SEQ ID NO: 650881 - RNA, 64 nt, hsa
cugauauuuaauccuuaaaaccccuuuaaaugagggccaguauuaucucugcuuucagaaguag

SEQ ID NO: 650882 - RNA, 64 nt, hsa
acaaauuuaauaacuuuaugggugagguacuuugggccaguagaguauacuacaguuauguuua

SEQ ID NO: 650883 - RNA, 64 nt, hsa
uuuuauuuaauacaaucggauuuaauaauuuuguggccaguaaaauuauaccauuggcaugaag

SEQ ID NO: 650884 - RNA, 64 nt, hsa
ggggaacgucaggucucucugaggucaggucugaggccaguauccuccagcccucccaaugcca

SEQ ID NO: 650885 - RNA, 64 nt, hsa
aagcagagauaacacuucccaacucauuuugugaggccaguauuacccuaauagcaaaaccagg

SEQ ID NO: 650886 - RNA, 64 nt, hsa
aaaaaagauggaacuuuuccaauucaguuuuugaggccaguacaaccuugauaacaaaaccuaa

SEQ ID NO: 650887 - RNA, 64 nt, hsa
ccaggccucuuggcagucacaucucuuccuccgaggccaguaccuuuccauuuauucuuugauc

SEQ ID NO: 650888 - RNA, 64 nt, hsa
uguccuggcaggaagccaccauuggagaaggugaggccaguaaccaucucaugggauucgcuau

SEQ ID NO: 650889 - RNA, 64 nt, hsa
ugggguacaaaggggcccaugcaggagaugcccuggccaguaggaccuccaacagguuguuucc

SEQ ID NO: 650890 - RNA, 64 nt, hsa
uacucuaaauacuaccggagucucuuuguagguuggccaguauauguuuuuagugaaauauuau

SEQ ID NO: 650891 - RNA, 64 nt, hsa
uaaaaaguauauuuauugcagaggauguucauaaggccaguaugauuuauaaaugcaaucuccc

SEQ ID NO: 650892 - RNA, 64 nt, hsa
ggcuaucauuagccacagguacugcugauuauaaggccaguaaaauuuuaguaccuggagguuu

SEQ ID NO: 650893 - RNA, 64 nt, hsa
gugcugugggcuggucccacacauccaggaaagaggccaguagagaauucugcccacuuuuuau

SEQ ID NO: 650894 - RNA, 64 nt, hsa
ccucuaccugaacaaagagaugaauaauuccaugggccaguaugccaguuugaauucucagucu

SEQ ID NO: 650895 - RNA, 64 nt, hsa
uggcuaauaggaauucccuccuggugccaccacuggccaguaccuuuccuaagucuuugcucaa

SEQ ID NO: 650896 - RNA, 52 nt, hsa; identical to SEQ ID NO: 588889

SEQ ID NO: 650897 - RNA, 64 nt, hsa
uaugacauaauuuaugucuccauuuuguuguauuggccaguacuuuuacaaaucaaaacaucuc

SEQ ID NO: 650898 - RNA, 64 nt, hsa
aucugagucuagaacccaggcuucuaaauuucuaggccaguacuacugcucucaaaagagauua

SEQ ID NO: 650899 - RNA, 64 nt, hsa
uguaccaagugaauuuaaauaauugguguggauuggccaguagcuaagaagugggcuuuuaaag

SEQ ID NO: 650900 - RNA, 64 nt, hsa
uccccccaaccacaggaauggaggcgggacacagggccaguaggagcaauaggauuuuaauaaa

SEQ ID NO: 650901 - RNA, 64 nt, hsa
aaucauauuuguauuucagguucuuuuuuaucuuggccaguauauuaugacuaaacgauuauau

SEQ ID NO: 650902 - RNA, 64 nt, hsa
gucauugucugaccaaaauuccuucugcacaugaggccaguauaggcaacgucacauuuguuug

SEQ ID NO: 650903 - RNA, 64 nt, hsa
ugcccacugccuaccgcgugagccgcagcccuggggccaguaggaagcggacccgcuccaggua

SEQ ID NO: 650904 - RNA, 64 nt, hsa
uguucuuccuacauaaaaugcaagaaaacagcauggccaguaaacugagcaagggccuuggaau

SEQ ID NO: 650905 - RNA, 64 nt, hsa
aaacacucuguacugugugcggacccgcagugacggccaguaaaguggacuuaacucccaagug

SEQ ID NO: 650906 - RNA, 64 nt, hsa
aaugcauuacaacucuguagauuguuaguuacuaggccaguagcuaggaauugguauaaauuua

SEQ ID NO: 650907 - RNA, 64 nt, hsa
guucagagggagccagcucuuuauguuggccccaggccaguacuaagcaaauuaaaaagaccga

SEQ ID NO: 650908 - RNA, 64 nt, hsa
aauuauggauaacucgaaagacagcucaggugaaggccaguaaugauuuuuuugaaguuucaau

SEQ ID NO: 650909 - RNA, 64 nt, hsa
uagcacagcacuuugguuuugcugagaucgaagaggccaguaggagacacgacagcacacacag

SEQ ID NO: 650910 - RNA, 64 nt, hsa
cccguucuuauagaugauuuuguagaauaugcacggccaguagucacagguggaaaacgcagcc

SEQ ID NO: 650911 - RNA, 64 nt, hsa
auccaggccugaggcugcugacguuugacaccagggccaguagagagugcccuuuuguaucuua

SEQ ID NO: 650912 - RNA, 64 nt, hsa
ggauguuuaaucuucauuaauaaauaccucaaauggccaguaacucaauauuacuuuucuuccu

SEQ ID NO: 650913 - RNA, 64 nt, hsa
uagugcuuugucuauucuuuauuucucucaggguggccaguauuuugacuuauuuauccugcuu

SEQ ID NO: 650914 - RNA, 64 nt, hsa
uuuggucuaacuucuacauuccuacuguuaaaaaggccaguauaucuuaaacaaaugaauaggc

SEQ ID NO: 650915 - RNA, 64 nt, hsa
uuaagcacugaauucacuacugaucccaucgccuggccaguagaacagucauuacuccauuaac

SEQ ID NO: 650916 - RNA, 64 nt, hsa
gcacugggcccauuugaaggugucucagacauuuggccaguaugucuuucucagggguuugguc

SEQ ID NO: 650917 - RNA, 64 nt, hsa
caguuuuauaagguauuugcauuuuagaagcucuggccaguaguuguuaagauguuggcauuaa

SEQ ID NO: 650918 - RNA, 64 nt, hsa
caagcauucccuuggugaauugucacgugaguggggccaguaagagugaagucugcuccuugaa

SEQ ID NO: 650919 - RNA, 64 nt, hsa
gcuagauaaauguggugaaauugccacuagaaagggccaguagcaauguguucuuaauuccuag

SEQ ID NO: 650920 - RNA, 64 nt, hsa
ugcuuggcaccuuagcagacugcuggaaccuuuuggccaguaggucgugcccgccuggugccuu

SEQ ID NO: 650921 - RNA, 64 nt, hsa
cuauugggacaguccucuucuauauguuuuaaguggccaguaauuuaaugaauuucugguuugu

SEQ ID NO: 650922 - RNA, 64 nt, hsa
uccagguucguauagaaaaagcacagcucucacuggccaguagcugccaaaaagaacacccauc

SEQ ID NO: 650923 - RNA, 64 nt, hsa
cugagaggcaguggccucuugagugaacaggggaggccaguagaugccccagauccagagccgu

SEQ ID NO: 650924 - RNA, 64 nt, hsa
ucugguuacccaacuacagaaccuccuuugaucaggccaguagguugugaugcaggcuggagcc

SEQ ID NO: 650925 - RNA, 64 nt, hsa
ccucccauagggcuuuuccaagcugccacuggucggccaguacagccuccggaagcagcccuac

SEQ ID NO: 650926 - RNA, 64 nt, hsa
cggaucaugaagucaagaguucgagaccagcaauggccaguauggugaaacccugucucuccua

SEQ ID NO: 650927 - RNA, 64 nt, hsa
cagccucuagcuacccuguaucgaggcaaggggaggccaguaaaguuugccaagccugauccug

SEQ ID NO: 650928 - RNA, 64 nt, hsa
caauguaacuaagcauuuguguucugauaucugaggccaguaacuauuaauaucuaguucucag

SEQ ID NO: 650929 - RNA, 64 nt, hsa
uuaauaauguuuauaagcugggcauggucgcucaggccaguaaucccagugacuuaggaggcug

SEQ ID NO: 650930 - RNA, 64 nt, hsa
acggccuggcagaggagcccaagggacugaagauggccaguagcuggguccugaggccccugaa

SEQ ID NO: 650931 - RNA, 64 nt, hsa
ucugaccucagggcucccagcucggggccuguggggccaguaugcuggucugggagucccuccu

SEQ ID NO: 650932 - RNA, 64 nt, hsa
cugagaaaccuggcagccugcuguuaacaacacaggccaguauuggguuuuauugaauuuggua

SEQ ID NO: 650933 - RNA, 64 nt, hsa
guggauuguauugugagauccugugauuccugguggccaguauccuggauuccucuaagaucuu

SEQ ID NO: 650934 - RNA, 64 nt, hsa
aauagaagcagaaaaacauuuagggauaacaucaggccaguagaauuaagccucuccaccuguc

SEQ ID NO: 650935 - RNA, 64 nt, hsa
ccacccccaaaguaagaagaaacauguuuccaguggccaguaugucuuucauugcuuugcaccc

SEQ ID NO: 650936 - RNA, 64 nt, hsa
uauuaacugccaaaacaagagccugauuuuuugaggccaguaauucguuugcuagaauugauuu

SEQ ID NO: 650937 - RNA, 64 nt, hsa
acuaaugggauccagcagggccauuucuccagagggccaguauccuauuaggagacucuuggaa

SEQ ID NO: 650938 - RNA, 64 nt, hsa
ccagaagcgaugggguaccguguaggggagccaaggccaguaguuuggggguaggaguccccua

SEQ ID NO: 650939 - RNA, 64 nt, hsa
aagacaccaccuuccugccagcuguuugcccuuaggccaguacacagaauuaaagugggggaga

SEQ ID NO: 650940 - RNA, 64 nt, hsa
caguguaacuaagcauuuguguucugauaucugaggccaguaacuauuaauaucuaguucucag

SEQ ID NO: 650941 - RNA, 64 nt, hsa
cauccacuuucuucuaaaauaaagagaagaaaauggccaguauucauccuguccuucucuuucc

SEQ ID NO: 650942 - RNA, 64 nt, hsa
caauguaacuaaguauuuguguucugauaucugaggccaguaacuauuaauaucuaguucucag

SEQ ID NO: 650943 - RNA, 64 nt, hsa
aaagcugcggucuccuguuugauaaaagaauauuggccaguauugcagauuuuaacugauuugg

SEQ ID NO: 650944 - RNA, 64 nt, hsa
gccuuucacguauuccgucugcacaggcaaccaaggccaguagaaagcuauggcugcaaaaccc

SEQ ID NO: 650945 - RNA, 64 nt, hsa
aaaaaauuggauaaaguauaggaggguuacuuggggccaguaaaucaguagacugaacauucaa

SEQ ID NO: 650946 - RNA, 64 nt, hsa
cccccugcuggucgcuguuucggggacucggggcggccaguaccaccgccugaggcggggcuca

SEQ ID NO: 650947 - RNA, 64 nt, hsa
gggcugcaaugcagcauguugcccuggcaccuguggccaguacucgggacagacuaagggcgcu

SEQ ID NO: 650948 - RNA, 64 nt, hsa
ucuguguuggccccugugccucagucccgcggauggccaguagggggcgcuggaggacugcggg

SEQ ID NO: 650949 - RNA, 64 nt, hsa
cuuaauccuauuuauccccuggaaugugcgugcuggccaguaggagggcuggcuuuggcagcuc

SEQ ID NO: 650950 - RNA, 64 nt, hsa
caaagagccccccgggucacccccgccccacugaggccaguagggggccaggccucccacuccu

SEQ ID NO: 650951 - RNA, 64 nt, hsa
aacuacuaguuauuugugauagcaacauacacauggccaguaaugcucuuguccaggaagaucu

SEQ ID NO: 650952 - RNA, 64 nt, hsa
ugauugaguucaucaugagccguugcuaaugccaggccaguaaaaguauaacagcaaauaacca

SEQ ID NO: 650953 - RNA, 64 nt, hsa
cucgccagaggagcacuuggcaaggucagugaggggccaguagacccccggagaagcaguaccg

SEQ ID NO: 650954 - RNA, 64 nt, hsa
accaucagggaagcuuguuguaacggcuuuugaaggccaguaaccauuguugugguuguguuuu

SEQ ID NO: 650955 - RNA, 64 nt, hsa
cuuuugcuuguacagaaucuguagugauuuugguggccaguaaaugccagccauuucucaaacc

SEQ ID NO: 650956 - RNA, 64 nt, hsa
aaaaaaugaagucugacuagaauucuauugcagaggccaguacauuuaguauggcauugaguug

SEQ ID NO: 650957 - RNA, 64 nt, hsa
ucaguuuacuucuaaguaaucacagauaauacauggccaguaaucccaggcuggccauucauuc

SEQ ID NO: 650958 - RNA, 64 nt, hsa
ccuugcagcuagcaagguugugugacuaagcccuggccaguaggcauggaagugaagacuguaa

SEQ ID NO: 650959 - RNA, 64 nt, hsa
aucacuguguccacaugagcgaaccccagcacguggccaguaucaucagcuccuucuuacagug

SEQ ID NO: 650960 - RNA, 64 nt, hsa
uuuaguggggaaagggacggggugcagacggcagggccaguauggggcccccucccucuccucu

SEQ ID NO: 650961 - RNA, 64 nt, hsa
acuacuuaaguacuugucauguacucuuagaggaggccaguaaugaucagaaccauuuuacuuu

SEQ ID NO: 650962 - RNA, 64 nt, hsa
gacagugaccuccacccccgcagcccucuuaaaaggccaguacucuuggggguggggggagggu

SEQ ID NO: 650963 - RNA, 64 nt, hsa
ucacccacauucgcugaagcgauggagagucgggggccaguagccagccaaccccguggggacc

SEQ ID NO: 650964 - RNA, 64 nt, hsa
uacaguacaggaucuuuggucuacucuaucacaaggccaguaccacacucaugaagaaagaaca

SEQ ID NO: 650965 - RNA, 64 nt, hsa
aaaauaugcucacaguuuguagucauguagaaaaggccaguauaaaaauguaguagacuuaaag

SEQ ID NO: 650966 - RNA, 64 nt, hsa
uccggaagggcuccauacugucccaauaaggugaggccaguagcaggaauaauaaaucccacuu

SEQ ID NO: 650967 - RNA, 66 nt, hsa
uuugccaccuaaacgaucaguguggugcugcguucuggccaguaaauuccauguuuuuggcuauau

SEQ ID NO: 650968 - RNA, 66 nt, hsa
cuuucuagaccuuagacacucaagauuacggucccgggccaguaacagcaccugggagcuugguag

SEQ ID NO: 650969 - RNA, 66 nt, hsa
ugggagaacuaaguaagaaacacaaugccaacagcuggccaguaauuaguguugugcacuucaugu

SEQ ID NO: 650970 - RNA, 66 nt, hsa
aauauuuauuuauugagaguuuuuuagugcaaucugggccaguauuuuuauagauuaugauuaugu

SEQ ID NO: 650971 - RNA, 66 nt, hsa
aaggaaaaguuuggcuacuaacaguagcauugugauggccaguauauccaguccauggauaaagaa

SEQ ID NO: 650972 - RNA, 66 nt, hsa
cuaaugucagaacagagugcaacccagucacacuguggccaguaaaauacuauugccucauauugu

SEQ ID NO: 650973 - RNA, 66 nt, hsa
acagccacaaacaaguacuuuaccccacagcuuaguggccaguaaacacccuggggacuaggaaaa

SEQ ID NO: 650974 - RNA, 66 nt, hsa
agcagcugucuugguaaaggagagagagagacauggggccaguaauuccggggugcucagaaguuu

SEQ ID NO: 650975 - RNA, 66 nt, hsa
ccagucccaaggguccacgauguacaaagucauuucggccaguaggugugcagaccccuccccgcc

SEQ ID NO: 650976 - RNA, 66 nt, hsa
uaccuuccucacuguaucuuugcccagacccaccugggccaguaggccccuguccccagccacaca

SEQ ID NO: 650977 - RNA, 66 nt, hsa
ccagcccagcccugaccucaggaagugucagagcauggccaguaguuggcagcccgaaagacacac

SEQ ID NO: 650978 - RNA, 66 nt, hsa
uuuugccacccccugugagcagggauuagguguucaggccaguaucuugggcaugggggagccuuu

SEQ ID NO: 650979 - RNA, 66 nt, hsa
ggaaagacuuaauuuccuuguugagaacaggaaaguggccaguagccaggcaagucauagaauuga

SEQ ID NO: 650980 - RNA, 66 nt, hsa
uaccagcuuuuuuuuuuuuuuuuuuaaauuggcuuuggccaguagcuaaagugcaagacugaauua

SEQ ID NO: 650981 - RNA, 66 nt, hsa
agacaaaguuugccaaccauaagugucaaaagcacaggccaguauuaagcagaaguucuaccaccu

SEQ ID NO: 650982 - RNA, 66 nt, hsa
uuguauacauccuggguaaugagagguggcuuuugcggccaguauuagacuggaaguucauaccua

SEQ ID NO: 650983 - RNA, 66 nt, hsa
ugugcaggggcagagaaggaagggaccaggggacugggccaguauguggaggauggggccugcgug

SEQ ID NO: 650984 - RNA, 66 nt, hsa
aaaauaucuguuuuuaauguuuuguuucucccuccaggccaguauaaagggacuugaaguauuuuu

SEQ ID NO: 650985 - RNA, 66 nt, hsa
uuuguauaauuuuuaugcucuuugauuaucuaauaaggccaguauuucaaaagcuguucugaauuu

SEQ ID NO: 650986 - RNA, 66 nt, hsa
cauauagagcuagcuaaucucuacaaacccucuguaggccaguaguucucaaaguguggucucugg

SEQ ID NO: 650987 - RNA, 66 nt, hsa
cuuugcuagccucucuuacuaauggaauuauauacuggccaguaaaaugggccucccaauugcugu

SEQ ID NO: 650988 - RNA, 66 nt, hsa
uccaugaagugcucucguucucaguagcggcaucauggccaguagugucuuugaggaguucaccac

SEQ ID NO: 650989 - RNA, 66 nt, hsa
augauuauugauugugagauagguuagguuuuggggggccaguaguucagugagaauguuuauguu

SEQ ID NO: 650990 - RNA, 66 nt, hsa
cucuuucucucucccucuuucucucucucuuucguaggccaguagcaauguuguguucacagucua

SEQ ID NO: 650991 - RNA, 66 nt, hsa
cggccuucccuuggagagggccuggcuucaacauugggccaguaggcaucuuagcuuggcaggugu

SEQ ID NO: 650992 - RNA, 66 nt, hsa
cuucucugcacgcuugaccaaagcagugaugagggcggccaguaccugcggugugcgugguagguu

SEQ ID NO: 650993 - RNA, 66 nt, hsa
cuccguacuaacgucugcaaaccccaagacguuugaggccaguaggaaguugagaaagaaagccac

SEQ ID NO: 650994 - RNA, 66 nt, hsa
cccucucuuucucugguggucuuccuucuaccccaaggccaguaguuuugacacuucccaguggaa

SEQ ID NO: 650995 - RNA, 66 nt, hsa
guccccuaaacccaacucacguuucuguaugucuuaggccaguaucccaaaccucuuccacgucac

SEQ ID NO: 650996 - RNA, 66 nt, hsa
aaauguggcucaguggagggagacccagcauagccaggccaguauggagcaccucacgcacagcuc

SEQ ID NO: 650997 - RNA, 66 nt, hsa
uguuggugaaauugcuguggggguaucgggggauauggccaguaaaguauugagagacuaacaaau

SEQ ID NO: 650998 - RNA, 66 nt, hsa
aggguugguugccccucaccucagagcucccccaaaggccaguaauggauccccggccucaguccc

SEQ ID NO: 650999 - RNA, 66 nt, hsa
cacggugcaggcauagcugccugcugcucuggcagaggccaguaaauacaguuccuagaagcagcc

SEQ ID NO: 651000 - RNA, 66 nt, hsa
cuuccauaugaccucaugcaucuccaccugcucccaggccaguaagggaaauagaaaaacccugcc

SEQ ID NO: 651001 - RNA, 66 nt, hsa
ugaggucucauacaaggauauuuggagugaaaugcuggccaguacuuguucucccuugccccaacc

SEQ ID NO: 651002 - RNA, 66 nt, hsa
uuuucuuucaauccucauuaucuuuagcccucagcuggccaguacuuauugcuaaagaaagggaga

SEQ ID NO: 651003 - RNA, 66 nt, hsa
gguuuagccuccuucgcaggcauguccuggacaccgggccaguaucuauauauguguauguacguu

SEQ ID NO: 651004 - RNA, 66 nt, hsa
aaagugcugggauuacaggugugagccaccacacuuggccaguauauccucaguaugaagauauuu

SEQ ID NO: 651005 - RNA, 66 nt, hsa
caaugucugcaucugugcuguguguguagugugguuggccaguaggugaguaucccugugugugug

SEQ ID NO: 651006 - RNA, 66 nt, hsa
uugugugaguguuuauauagaaaugaacauagaccuggccaguaaaaggcucugaggaggcuuaaa

SEQ ID NO: 651007 - RNA, 66 nt, hsa
aaggagugcagggaggggcaggaaaggagacaaggaggccaguauggacacuguguccaguauggc

SEQ ID NO: 651008 - RNA, 66 nt, hsa
gaacaguuccccacccagcgauuagggagcugggcuggccaguacagccaguggggaguggguggg

SEQ ID NO: 651009 - RNA, 66 nt, hsa
cucuucacacagaaaucuguagcacugcuuuuuugaggccaguagcaacauccagagaucauucuu

SEQ ID NO: 651010 - RNA, 66 nt, hsa
uauauuuggggcaucucuauagaaagugaccaccaaggccaguaaguacgggaaaaaauguuuacu

SEQ ID NO: 651011 - RNA, 66 nt, hsa
ugacucucucaugacugcacaccccauucaggcagaggccaguacagaggaggagccauuguggca

SEQ ID NO: 651012 - RNA, 66 nt, hsa
gugccuuacccucuguaagauacugauucuuccuggggccaguauuaccuuguaugcaaauauuac

SEQ ID NO: 651013 - RNA, 66 nt, hsa
agagaaagucacauuuaggguuuauuuuuuacacuuggccaguaaaauaggguaaauccuauuaga

SEQ ID NO: 651014 - RNA, 66 nt, hsa
cccauuauguacagaauaggaccuauccaguagccaggccaguaggcaguuggggaaggugggaag

SEQ ID NO: 651015 - RNA, 66 nt, hsa
uuugcuuuauaagugaggguagggugagggaggacaggccaguagggggagggaaagggagagggg

SEQ ID NO: 651016 - RNA, 66 nt, hsa
guggccccaggggguuagaggaggggugaagauuggggccaguaucgaucuuaugaagcuggagga

SEQ ID NO: 651017 - RNA, 66 nt, hsa
agaaguuucugaagucuucacagcucuuaaaagccaggccaguacugacuguguggugguaaaugc

SEQ ID NO: 651018 - RNA, 66 nt, hsa
uuugugcuuuggguugaaaagaaguuuuuaguccuaggccaguagauggcagcagcuuuucauugc

SEQ ID NO: 651019 - RNA, 66 nt, hsa
ccuaacuguaucuugaggugguaguaaaacacagagggccaguaacgggucguaaugacuuauugu

SEQ ID NO: 651020 - RNA, 66 nt, hsa
aggcuuuauucuuccaaguucauucauacucaaagaggccaguacuuugccauccuugcacuucug

SEQ ID NO: 651021 - RNA, 66 nt, hsa
guugaauuuauagagcauuuuuuuucuuaccaagauggccaguaucauuuuacccccaccucccaa

SEQ ID NO: 651022 - RNA, 66 nt, hsa
cacugauauuuaauccuuaaaaccccuuuaaaugagggccaguauuaucucugcuuucagaaguag

SEQ ID NO: 651023 - RNA, 66 nt, hsa
aaacaaauuuaauaacuuuaugggugagguacuuugggccaguagaguauacuacaguuauguuua

SEQ ID NO: 651024 - RNA, 66 nt, hsa
gauuuuauuuaauacaaucggauuuaauaauuuuguggccaguaaaauuauaccauuggcaugaag

SEQ ID NO: 651025 - RNA, 66 nt, hsa
guggggaacgucaggucucucugaggucaggucugaggccaguauccuccagcccucccaaugcca

SEQ ID NO: 651026 - RNA, 66 nt, hsa
aaaagcagagauaacacuucccaacucauuuugugaggccaguauuacccuaauagcaaaaccagg

SEQ ID NO: 651027 - RNA, 66 nt, hsa
agaaaaaagauggaacuuuuccaauucaguuuuugaggccaguacaaccuugauaacaaaaccuaa

SEQ ID NO: 651028 - RNA, 66 nt, hsa
ggccaggccucuuggcagucacaucucuuccuccgaggccaguaccuuuccauuuauucuuugauc

SEQ ID NO: 651029 - RNA, 66 nt, hsa
uguguccuggcaggaagccaccauuggagaaggugaggccaguaaccaucucaugggauucgcuau

SEQ ID NO: 651030 - RNA, 66 nt, hsa
ggugggguacaaaggggcccaugcaggagaugcccuggccaguaggaccuccaacagguuguuucc

SEQ ID NO: 651031 - RNA, 66 nt, hsa
ccuacucuaaauacuaccggagucucuuuguagguuggccaguauauguuuuuagugaaauauuau

SEQ ID NO: 651032 - RNA, 66 nt, hsa
gcuaaaaaguauauuuauugcagaggauguucauaaggccaguaugauuuauaaaugcaaucuccc

SEQ ID NO: 651033 - RNA, 66 nt, hsa
auggcuaucauuagccacagguacugcugauuauaaggccaguaaaauuuuaguaccuggagguuu

SEQ ID NO: 651034 - RNA, 66 nt, hsa
aggugcugugggcuggucccacacauccaggaaagaggccaguagagaauucugcccacuuuuuau

SEQ ID NO: 651035 - RNA, 66 nt, hsa
uuccucuaccugaacaaagagaugaauaauuccaugggccaguaugccaguuugaauucucagucu

SEQ ID NO: 651036 - RNA, 66 nt, hsa
acuggcuaauaggaauucccuccuggugccaccacuggccaguaccuuuccuaagucuuugcucaa

SEQ ID NO: 651037 - RNA, 52 nt, hsa; identical to SEQ ID NO: 588889

SEQ ID NO: 651038 - RNA, 66 nt, hsa
guuaugacauaauuuaugucuccauuuuguuguauuggccaguacuuuuacaaaucaaaacaucuc

SEQ ID NO: 651039 - RNA, 66 nt, hsa
agaucugagucuagaacccaggcuucuaaauuucuaggccaguacuacugcucucaaaagagauua

SEQ ID NO: 651040 - RNA, 66 nt, hsa
uguguaccaagugaauuuaaauaauugguguggauuggccaguagcuaagaagugggcuuuuaaag

SEQ ID NO: 651041 - RNA, 66 nt, hsa
cuuccccccaaccacaggaauggaggcgggacacagggccaguaggagcaauaggauuuuaauaaa

SEQ ID NO: 651042 - RNA, 66 nt, hsa
acugaucuuucugggauagagguucuuuuuuaucuuggccaguauauuaugacuaaacgauuauau

SEQ ID NO: 651043 - RNA, 66 nt, hsa
uugucauugucugaccaaaauuccuucugcacaugaggccaguauaggcaacgucacauuuguuug

SEQ ID NO: 651044 - RNA, 66 nt, hsa
ugugcccacugccuaccgcgugagccgcagcccuggggccaguaggaagcggacccgcuccaggua

SEQ ID NO: 651045 - RNA, 66 nt, hsa
ccuguucuuccuacauaaaaugcaagaaaacagcauggccaguaaacugagcaagggccuuggaau

SEQ ID NO: 651046 - RNA, 66 nt, hsa
agaaacacucuguacugugugcggacccgcagugacggccaguaaaguggacuuaacucccaagug

SEQ ID NO: 651047 - RNA, 66 nt, hsa
uuaaugcauuacaacucuguagauuguuaguuacuaggccaguagcuaggaauugguauaaauuua

SEQ ID NO: 651048 - RNA, 66 nt, hsa
auguucagagggagccagcucuuuauguuggccccaggccaguacuaagcaaauuaaaaagaccga

SEQ ID NO: 651049 - RNA, 66 nt, hsa
uaaauuauggauaacucgaaagacagcucaggugaaggccaguaaugauuuuuuugaaguuucaau

SEQ ID NO: 651050 - RNA, 66 nt, hsa
gguagcacagcacuuugguuuugcugagaucgaagaggccaguaggagacacgacagcacacacag

SEQ ID NO: 651051 - RNA, 66 nt, hsa
ggcccguucuuauagaugauuuuguagaauaugcacggccaguagucacagguggaaaacgcagcc

SEQ ID NO: 651052 - RNA, 66 nt, hsa
gcauccaggccugaggcugcugacguuugacaccagggccaguagagagugcccuuuuguaucuua

SEQ ID NO: 651053 - RNA, 66 nt, hsa
uuggauguuuaaucuucauuaauaaauaccucaaauggccaguaacucaauauuacuuuucuuccu

SEQ ID NO: 651054 - RNA, 66 nt, hsa
cuuagugcuuugucuauucuuuauuucucucaggguggccaguauuuugacuuauuuauccugcuu

SEQ ID NO: 651055 - RNA, 66 nt, hsa
gcuuuggucuaacuucuacauuccuacuguuaaaaaggccaguauaucuuaaacaaaugaauaggc

SEQ ID NO: 651056 - RNA, 66 nt, hsa
uuuuaagcacugaauucacuacugaucccaucgccuggccaguagaacagucauuacuccauuaac

SEQ ID NO: 651057 - RNA, 66 nt, hsa
uggcacugggcccauuugaaggugucucagacauuuggccaguaugucuuucucagggguuugguc

SEQ ID NO: 651058 - RNA, 66 nt, hsa
aacaguuuuauaagguauuugcauuuuagaagcucuggccaguaguuguuaagauguuggcauuaa

SEQ ID NO: 651059 - RNA, 66 nt, hsa
cccaagcauucccuuggugaauugucacgugaguggggccaguaagagugaagucugcuccuugaa

SEQ ID NO: 651060 - RNA, 66 nt, hsa
uggcuagauaaauguggugaaauugccacuagaaagggccaguagcaauguguucuuaauuccuag

SEQ ID NO: 651061 - RNA, 66 nt, hsa
gcugcuuggcaccuuagcagacugcuggaaccuuuuggccaguaggucgugcccgccuggugccuu

SEQ ID NO: 651062 - RNA, 66 nt, hsa
uucuauugggacaguccucuucuauauguuuuaaguggccaguaauuuaaugaauuucugguuugu

SEQ ID NO: 651063 - RNA, 66 nt, hsa
acuccagguucguauagaaaaagcacagcucucacuggccaguagcugccaaaaagaacacccauc

SEQ ID NO: 651064 - RNA, 66 nt, hsa
uccugagaggcaguggccucuugagugaacaggggaggccaguagaugccccagauccagagccgu

SEQ ID NO: 651065 - RNA, 66 nt, hsa
acucugguuacccaacuacagaaccuccuuugaucaggccaguagguugugaugcaggcuggagcc

SEQ ID NO: 651066 - RNA, 66 nt, hsa
ugccucccauagggcuuuuccaagcugccacuggucggccaguacagccuccggaagcagcccuac

SEQ ID NO: 651067 - RNA, 66 nt, hsa
ggcggaucaugaagucaagaguucgagaccagcaauggccaguauggugaaacccugucucuccua

SEQ ID NO: 651068 - RNA, 66 nt, hsa
cccagccucuagcuacccuguaucgaggcaaggggaggccaguaaaguuugccaagccugauccug

SEQ ID NO: 651069 - RNA, 66 nt, hsa
accaauguaacuaagcauuuguguucugauaucugaggccaguaacuauuaauaucuaguucucag

SEQ ID NO: 651070 - RNA, 66 nt, hsa
aauuaauaauguuuauaagcugggcauggucgcucaggccaguaaucccagugacuuaggaggcug

SEQ ID NO: 651071 - RNA, 66 nt, hsa
caacggccuggcagaggagcccaagggacugaagauggccaguagcuggguccugaggccccugaa

SEQ ID NO: 651072 - RNA, 66 nt, hsa
gcucugaccucagggcucccagcucggggccuguggggccaguaugcuggucugggagucccuccu

SEQ ID NO: 651073 - RNA, 66 nt, hsa
uucugagaaaccuggcagccugcuguuaacaacacaggccaguauuggguuuuauugaauuuggua

SEQ ID NO: 651074 - RNA, 66 nt, hsa
aaguggauuguauugugagauccugugauuccugguggccaguauccuggauuccucuaagaucuu

SEQ ID NO: 651075 - RNA, 66 nt, hsa
ugaauagaagcagaaaaacauuuagggauaacaucaggccaguagaauuaagccucuccaccuguc

SEQ ID NO: 651076 - RNA, 66 nt, hsa
ccccacccccaaaguaagaagaaacauguuuccaguggccaguaugucuuucauugcuuugcaccc

SEQ ID NO: 651077 - RNA, 66 nt, hsa
gcuauuaacugccaaaacaagagccugauuuuuugaggccaguaauucguuugcuagaauugauuu

SEQ ID NO: 651078 - RNA, 66 nt, hsa
uaacuaaugggauccagcagggccauuucuccagagggccaguauccuauuaggagacucuuggaa

SEQ ID NO: 651079 - RNA, 66 nt, hsa
ugccagaagcgaugggguaccguguaggggagccaaggccaguaguuuggggguaggaguccccua

SEQ ID NO: 651080 - RNA, 66 nt, hsa
uaaagacaccaccuuccugccagcuguuugcccuuaggccaguacacagaauuaaagugggggaga

SEQ ID NO: 651081 - RNA, 66 nt, hsa
accaguguaacuaagcauuuguguucugauaucugaggccaguaacuauuaauaucuaguucucag

SEQ ID NO: 651082 - RNA, 66 nt, hsa
aucauccacuuucuucuaaaauaaagagaagaaaauggccaguauucauccuguccuucucuuucc

SEQ ID NO: 651083 - RNA, 66 nt, hsa
accaauguaacuaaguauuuguguucugauaucugaggccaguaacuauuaauaucuaguucucag

SEQ ID NO: 651084 - RNA, 66 nt, hsa
uuaaagcugcggucuccuguuugauaaaagaauauuggccaguauugcagauuuuaacugauuugg

SEQ ID NO: 651085 - RNA, 66 nt, hsa
aggccuuucacguauuccgucugcacaggcaaccaaggccaguagaaagcuauggcugcaaaaccc

SEQ ID NO: 651086 - RNA, 66 nt, hsa
ugaaaaaauuggauaaaguauaggaggguuacuuggggccaguaaaucaguagacugaacauucaa

SEQ ID NO: 651087 - RNA, 66 nt, hsa
ggcccccugcuggucgcuguuucggggacucggggcggccaguaccaccgccugaggcggggcuca

SEQ ID NO: 651088 - RNA, 66 nt, hsa
cagggcugcaaugcagcauguugcccuggcaccuguggccaguacucgggacagacuaagggcgcu

SEQ ID NO: 651089 - RNA, 66 nt, hsa
aaucuguguuggccccugugccucagucccgcggauggccaguagggggcgcuggaggacugcggg

SEQ ID NO: 651090 - RNA, 66 nt, hsa
cacuuaauccuauuuauccccuggaaugugcgugcuggccaguaggagggcuggcuuuggcagcuc

SEQ ID NO: 651091 - RNA, 66 nt, hsa
accaaagagccccccgggucacccccgccccacugaggccaguagggggccaggccucccacuccu

SEQ ID NO: 651092 - RNA, 66 nt, hsa
uuaacuacuaguuauuugugauagcaacauacacauggccaguaaugcucuuguccaggaagaucu

SEQ ID NO: 651093 - RNA, 66 nt, hsa
uuugauugaguucaucaugagccguugcuaaugccaggccaguaaaaguauaacagcaaauaacca

SEQ ID NO: 651094 - RNA, 66 nt, hsa
cccucgccagaggagcacuuggcaaggucagugaggggccaguagacccccggagaagcaguaccg

SEQ ID NO: 651095 - RNA, 66 nt, hsa
acaccaucagggaagcuuguuguaacggcuuuugaaggccaguaaccauuguugugguuguguuuu

SEQ ID NO: 651096 - RNA, 66 nt, hsa
gucuuuugcuuguacagaaucuguagugauuuugguggccaguaaaugccagccauuucucaaacc

SEQ ID NO: 651097 - RNA, 66 nt, hsa
guaaaaaaugaagucugacuagaauucuauugcagaggccaguacauuuaguauggcauugaguug

SEQ ID NO: 651098 - RNA, 66 nt, hsa
ucucaguuuacuucuaaguaaucacagauaauacauggccaguaaucccaggcuggccauucauuc

SEQ ID NO: 651099 - RNA, 66 nt, hsa
ucccuugcagcuagcaagguugugugacuaagcccuggccaguaggcauggaagugaagacuguaa

SEQ ID NO: 651100 - RNA, 66 nt, hsa
caaucacuguguccacaugagcgaaccccagcacguggccaguaucaucagcuccuucuuacagug

SEQ ID NO: 651101 - RNA, 66 nt, hsa
uguuuaguggggaaagggacggggugcagacggcagggccaguauggggcccccucccucuccucu

SEQ ID NO: 651102 - RNA, 66 nt, hsa
ccacuacuuaaguacuugucauguacucuuagaggaggccaguaaugaucagaaccauuuuacuuu

SEQ ID NO: 651103 - RNA, 66 nt, hsa
cagacagugaccuccacccccgcagcccucuuaaaaggccaguacucuuggggguggggggagggu

SEQ ID NO: 651104 - RNA, 66 nt, hsa
ucucacccacauucgcugaagcgauggagagucgggggccaguagccagccaaccccguggggacc

SEQ ID NO: 651105 - RNA, 66 nt, hsa
uauacaguacaggaucuuuggucuacucuaucacaaggccaguaccacacucaugaagaaagaaca

SEQ ID NO: 651106 - RNA, 66 nt, hsa
uuaaaauaugcucacaguuuguagucauguagaaaaggccaguauaaaaauguaguagacuuaaag

SEQ ID NO: 651107 - RNA, 66 nt, hsa
uuuccggaagggcuccauacugucccaauaaggugaggccaguagcaggaauaauaaaucccacuu

SEQ ID NO: 651108 - RNA, 65 nt, hsa
cuguggcagcagcaggcuccccagcggcccagggugggccagaccagcagcccaggaagcagcac

SEQ ID NO: 651109 - RNA, 65 nt, hsa
ucccacagcagagccaggugagggggcgccugccagggccagacccagguggggcagccugaacc

SEQ ID NO: 651110 - RNA, 65 nt, hsa
uggugaguggcaucaaaugugugacuuacuaucuugggccagaacuaagaaugccaagguuuuau

SEQ ID NO: 651111 - RNA, 65 nt, hsa
cggucagcacgugugcucgggacacagcggagucagggccagagcccuucccuccaggaacugau

SEQ ID NO: 651112 - RNA, 65 nt, hsa
cuccacuucucagcucuccccugcccugcagcccugggccagacaaggccagaagguuucagggg

SEQ ID NO: 651113 - RNA, 65 nt, hsa
agcaugcuucccagagggagcaggccggaaccacagggccagagggagcuggaacccgaggggcc

SEQ ID NO: 651114 - RNA, 65 nt, hsa
gaggugggggauugagggagggacagaguguuggagggccagagacuaguccugagauggaaaca

SEQ ID NO: 651115 - RNA, 65 nt, hsa
cggggcccuggccuggggcacccacugcacacucagggccagacccaccauccuggacuggcgag

SEQ ID NO: 651116 - RNA, 65 nt, hsa
gcucugcuucugcuuuccaaaguagcccagguccugggccagaugcaggggaggugccuauccau

SEQ ID NO: 651117 - RNA, 65 nt, hsa
cuuagcuuccacucccuuguguguauucuggcugggggccagauuggggaagcccuucuccccgg

SEQ ID NO: 651118 - RNA, 65 nt, hsa
cuauacugaauucccauucauguuagguaacuuaggggccagaaucuccaugcacuuuguagacc

SEQ ID NO: 651119 - RNA, 65 nt, hsa
gugggccugguagcacaugucuguccucagagcaggggccagaugauuuuccucccugguuugca

SEQ ID NO: 651120 - RNA, 65 nt, hsa
acggcuaagggcacgaagacgauaucugguagagagggccagagaugcccgcgugguagggcugc

SEQ ID NO: 651121 - RNA, 65 nt, hsa
agaccaggguuucucaaacucguacuugacauuuggggccagauaauucuuuguuguggggcugu

SEQ ID NO: 651122 - RNA, 65 nt, hsa
auugggggaggggacaggaucuaacaaugucacuugggccagaauggaccugcccuuucugcucc

SEQ ID NO: 651123 - RNA, 65 nt, hsa
aacuagaucaggaggucaguaaacuuucuguggaagggccagagaguaaauauuuuaggcuuugc

SEQ ID NO: 651124 - RNA, 65 nt, hsa
ucaauugaaucagguaacacuaacggaucaaggcagggccagagggugguguggucucuauuuga

SEQ ID NO: 651125 - RNA, 65 nt, hsa
agcuugcaaaggaggagaguuuaggauuagggccagggccagaaagucgguaucuugguugugcu

SEQ ID NO: 651126 - RNA, 65 nt, hsa
ccagcuacucugaucccucugggggcucuggccaagggccagacagaccuucacagaugccuacu

SEQ ID NO: 651127 - RNA, 60 nt, hsa
gugccauggaguccucuuaaagagggacgagggccagacugaagcagcacaaggccgggg

SEQ ID NO: 651128 - RNA, 50 nt, hsa
gcaugcagacucacguguaggggccagagccuggcuggggcaucucugcg

SEQ ID NO: 651129 - RNA, 65 nt, hsa
ccaggcccucacuccccuuccccauguugucgauggggccagagaugaagggaaguggacuaaag

SEQ ID NO: 651130 - RNA, 65 nt, hsa
ugaccagcuuccuccagaccccuguggcagaccgggggccagacacagauacauggggaacugca

SEQ ID NO: 651131 - RNA, 65 nt, hsa
ucaugugacacagggguguugugagagcugggauggggccagagauuauaaguuugacacaacau

SEQ ID NO: 651132 - RNA, 65 nt, hsa
uugagaaccaagacagggccuggcuccaacucugugggccagaggugggggacugcuaggucgag

SEQ ID NO: 651133 - RNA, 65 nt, hsa
uacaccuuuugcuaacaccccuacuaggucccagagggccagaaacaccugacuuaccucugagu

SEQ ID NO: 651134 - RNA, 65 nt, hsa
gcccuuggaucaguaugggaaccccaaaucccacagggccagauguggagucugugucugccccc

SEQ ID NO: 651135 - RNA, 65 nt, hsa
gauuugagccucuccggcugccagccagggggccugggccagaccagggcucuguccuuccguga

SEQ ID NO: 651136 - RNA, 65 nt, hsa
gggaugggagggucccuagccuucgggcaccuccagggccagagagcaggcucagagcagcuagu

SEQ ID NO: 651137 - RNA, 65 nt, hsa
gggucucuguuuccauuacaaacuuuguucugucugggccagagaaccuagccuuugaaaucucu

SEQ ID NO: 651138 - RNA, 65 nt, hsa
ucggccaacuuggaguccuuucuguuuugaagcaugggccagacccggcacugcgcucggagagc

SEQ ID NO: 651139 - RNA, 65 nt, hsa
uucauagcuucucugcuuggcaaagagaugggagggggccagauacugacuaccugggguaggca

SEQ ID NO: 651140 - RNA, 65 nt, hsa
uagucacuguuauggggugauaagaggacuucuuggggccagaacuguggaggagagcacauuug

SEQ ID NO: 651141 - RNA, 65 nt, hsa
ccucucucugcuccuccauucgcaagugucuuccugggccagacuccccuccaccucauguacuu

SEQ ID NO: 651142 - RNA, 65 nt, hsa
uuccccacaaagccguucgcagcuuccgggagaaggggccagagcccgguggggccaguuucuca

SEQ ID NO: 651143 - RNA, 65 nt, hsa
ugcagagccuuuucucugaauuccuuauguccggugggccagaagcccguccuccuaugcuggug

SEQ ID NO: 651144 - RNA, 65 nt, hsa
augccaucacauggaggacgaggcccagcucagcugggccagagcccagaagugccaccucauca

SEQ ID NO: 651145 - RNA, 65 nt, hsa
ugaagaagugugaaugugaaggcggcgucggcgcggggccagagcaccacucugcugccccacca

SEQ ID NO: 651146 - RNA, 65 nt, hsa
uuccuccugauggccaagagcaucgugacccuucagggccagaaggagggcagagccaugggccu

SEQ ID NO: 651147 - RNA, 65 nt, hsa
guggucucauaauuccauuuguggagagaacaggagggccagauagauagguccuagcagaaggc

SEQ ID NO: 651148 - RNA, 65 nt, hsa
cgcacugaaagggcagaguaggccgaaggguccaagggccagacugccucacccucugcccuaau

SEQ ID NO: 651149 - RNA, 65 nt, hsa
cccuccaccuggcuggagagauggcacaucauucagggccagaagguuguccagcaguguuucug

SEQ ID NO: 651150 - RNA, 65 nt, hsa
agcagagucugaauagucuucagagauaggccugugggccagauugccauccccuauggaccaga

SEQ ID NO: 651151 - RNA, 65 nt, hsa
gcguggacauagcccugugauacugcaucucacuggggccagaggaagggagggagggugggggg

SEQ ID NO: 651152 - RNA, 64 nt, hsa; identical to SEQ ID NO: 533523

SEQ ID NO: 651153 - RNA, 65 nt, hsa
uuguuuuuuuuuuuuuaagguuugcaaauuaaaaagggccagaaaaauuuggcaccaggcaaacg

SEQ ID NO: 651154 - RNA, 65 nt, hsa
agaauuaaagacaccagaaguagcagagaagcagggggccagagcuacaacaguauucuucucug

SEQ ID NO: 651155 - RNA, 65 nt, hsa
uggaccaaggcuaaccuuucuaagcucccuaacuugggccagaaaccaaagcugagcuuuuaacu

SEQ ID NO: 651156 - RNA, 65 nt, hsa
gggguggggggaacaacuggcuauucaguaccaaggggccagaguggaggguaggagugccacuc

SEQ ID NO: 651157 - RNA, 65 nt, hsa
ugugccgcaccauugaacuguaccaugugcuacaggggccagaagaugaacagacugaccuugau

SEQ ID NO: 651158 - RNA, 65 nt, hsa
uauuaagaaacguaaugacauaaaagguuagcucugggccagacuucucuuacucuguggguaau

SEQ ID NO: 651159 - RNA, 65 nt, hsa
acuaggacuacuuuuuaccaaaagagaagcagucugggccagaugcccugccaggaaagggacau

SEQ ID NO: 651160 - RNA, 65 nt, hsa
gacagcuccuucccuacucauucccugcccaaguggggccagaccucuuuacacacacauucccg

SEQ ID NO: 651161 - RNA, 65 nt, hsa
aaggguggugaugggugagcgcucuggcccaggcugggccagacucccgcccaagcaugaacagg

SEQ ID NO: 651162 - RNA, 65 nt, hsa
guacauagcagggagugaucggggugaaauaacuugggccagaauauuauuaaacaaucaucagg

SEQ ID NO: 651163 - RNA, 65 nt, hsa
uaggcuucuucuuucauguaguuccucauaagcaggggccagaauaucucagccaccugcaguga

SEQ ID NO: 651164 - RNA, 65 nt, hsa
uuaguaucuguucucucugagccuggaugggcuuggggccagaccuuugccugauuccugauucc

SEQ ID NO: 651165 - RNA, 65 nt, hsa
gacaggccuccuuguugggagcacagaagugcuaugggccagaagccccucccuucaaggaucuc

SEQ ID NO: 651166 - RNA, 65 nt, hsa
ugcugcuagucuccaauugccaagggaauuuaacugggccagacuaccuuuuuauacuaggucug

SEQ ID NO: 651167 - RNA, 65 nt, hsa
gcaucaccaccacaccccugccggccuuggccuuggggccagacuggcugcacagcccaaccagg

SEQ ID NO: 651168 - RNA, 65 nt, hsa
agacucuggucauagaaacaauaaaugaguuagaagggccagauuucauucucagucccagagca

SEQ ID NO: 651169 - RNA, 50 nt, hsa
uugaguauauugaugauuaagggccagaggaucucacuugcuuaucugaa

SEQ ID NO: 651170 - RNA, 65 nt, hsa
ccaguguccaagccccuccaggaggguccuggggugggccagaugccugcccaccucugucuccu

SEQ ID NO: 651171 - RNA, 65 nt, hsa
cccugggagauccgggcuggacuguggaccccgaugggccagaguccuuguggcccacagcauag

SEQ ID NO: 651172 - RNA, 65 nt, hsa
cccugcagauagcaccggucuuugauccgcagcaggggccagacccugcccacaagucccagcgc

SEQ ID NO: 651173 - RNA, 65 nt, hsa
uaaauuacuaaaauaaguucaaguuuacaucccuugggccagauauguggguugaggcuugacug

SEQ ID NO: 651174 - RNA, 53 nt, hsa
cuguccacucagaguucugaagggggccagauguugggugcagauguagaagc

SEQ ID NO: 651175 - RNA, 65 nt, hsa
aguaggcaucuuagcuuggcaggugucgggggaaugggccagauggaccugcuagauuuggaagg

SEQ ID NO: 651176 - RNA, 65 nt, hsa
aaauccuccuccuucccuuuuuucuggagucuugagggccagaguuuuuguuuuuguuuuuguuu

SEQ ID NO: 651177 - RNA, 65 nt, hsa
ugcuccgacucucagggcugccucccugagcuccagggccagaaugccuggaugccuggguagcc

SEQ ID NO: 651178 - RNA, 63 nt, hsa
acagcgcccaccugucauagggaccucacccuggggccagagugggcucuggucuccacagau

SEQ ID NO: 651179 - RNA, 65 nt, hsa
aguuuccaggaaacaucaggaaguaggaaacuguagggccagagaguaguacaacguuaaauugu

SEQ ID NO: 651180 - RNA, 65 nt, hsa
uccugaguggagccuuaaaguggcuucaccuggaggggccagagggucaccuggagcuggggaga

SEQ ID NO: 651181 - RNA, 65 nt, hsa
gaaauauacugggguccccagauucugcucuaagggggccagacccucugccaggcuggauugua

SEQ ID NO: 651182 - RNA, 65 nt, hsa
cggaaagacaaaagcgauuucuucccacuccugcagggccagaaguucaggcugccccgccucca

SEQ ID NO: 651183 - RNA, 65 nt, hsa
ucaagaaaauugcauauuuccauucuggucuuucugggccagauuuuuauauugguuuucaguaa

SEQ ID NO: 651184 - RNA, 65 nt, hsa
gguggggcaacagcgguggcagggcaggggguggugggccagacugguccccgggggacuucuuc

SEQ ID NO: 651185 - RNA, 65 nt, hsa
auaguuguaaccuacagcugauugguaagaacuaugggccagacauuuaaucucuccaucuauga

SEQ ID NO: 651186 - RNA, 65 nt, hsa
ucaauuuuggacucugcacucccucuccucuucaggggccagacuuggcagcaugugcaccaggu

SEQ ID NO: 651187 - RNA, 65 nt, hsa
cugagauuucuacagcaauaaaggagacacacacugggccagagaggccugccuucugccugcuc

SEQ ID NO: 651188 - RNA, 65 nt, hsa
aaagugcugggauuacaggcgugagccacugcacagggccagauucaucauuucaaaguuacuuu

SEQ ID NO: 651189 - RNA, 65 nt, hsa
auuugcuugaaauucuugagcagggaucuuauaaagggccagaaauaagaugugugguucacaua

SEQ ID NO: 651190 - RNA, 65 nt, hsa
gcuaagccuucuccucacugcccuuuaggcucccagggccagaggagccagggacuauuuucugc

SEQ ID NO: 651191 - RNA, 65 nt, hsa
accuuuaaggaccagcugggcuguagugauuccuggggccagaguggcauuauguuuuuacaaaa

SEQ ID NO: 651192 - RNA, 65 nt, hsa
ugagggguuucauuauaggccuugguucucuccaggggccagaugaguuuauuguggaaucuuug

SEQ ID NO: 651193 - RNA, 65 nt, hsa
ugcuauacagcugggaacagcagacuuucucugaagggccagaugguaacuacauuaggguuugc

SEQ ID NO: 651194 - RNA, 65 nt, hsa
cugagggggugggcuuacucccugggcagucuugggggccagagcugaggccaguccauauuaca

SEQ ID NO: 651195 - RNA, 65 nt, hsa
cuugaugagguauaggucauuuguuuugaguaugugggccagaaauuuaaaauuagaaauuuguu

SEQ ID NO: 651196 - RNA, 65 nt, hsa
aucuaaaauaaagguuggcaaacuuuuucuguaaagggccagauuguaaauauuucagacugugu

SEQ ID NO: 651197 - RNA, 65 nt, hsa
gucaggaauucaagcgugaacccauauugauaagugggccagaauuauuuaggggccuggcuugc

SEQ ID NO: 651198 - RNA, 65 nt, hsa
ugggaaccacagcuccacaagggggagaggcagcugggccagaccgaggucacagccacuccaag

SEQ ID NO: 651199 - RNA, 65 nt, hsa
guugauuacccuugccugcuggggggccuagccaugggccagagauggaggagccccaguggcug

SEQ ID NO: 651200 - RNA, 65 nt, hsa
gucccaaaacuggcacuagaaguggcugggcaggggggccagagucauaggaagggucuuggagu

SEQ ID NO: 651201 - RNA, 65 nt, hsa
accccgcuucccuuggaaucccugagggguagaaggggccagaaaaaacgcuuauaaaaccagag

SEQ ID NO: 651202 - RNA, 65 nt, hsa
acagccuccucuuggucugaguaggcaucaugugggggccagaucugccugcuguuuccaugggu

SEQ ID NO: 651203 - RNA, 65 nt, hsa
uguacagaacuggacagguugggccggcagugguggggccagagggcucugugcucuaggagcua

SEQ ID NO: 651204 - RNA, 65 nt, hsa
auaaauugccaaagagugggaacagguggggucaggggccagagugcaggggagggggcaauggu

SEQ ID NO: 651205 - RNA, 65 nt, hsa
caguuccuaagggccacuguguacccgggcugugugggccagaacuggggggcugagucuucccu

SEQ ID NO: 651206 - RNA, 65 nt, hsa
cgugugcccaccagcggccuugaagaggcaggucugggccagaugcugggcaggaaaccccagcg

SEQ ID NO: 651207 - RNA, 65 nt, hsa
cugguuguugccagguugcagcugcucuugcaucugggccagaaguccucccuccugcaggcugg

SEQ ID NO: 651208 - RNA, 65 nt, hsa
uaaaagcacacagggucugcuauuccugaggcugggggccagagaagcuuuuacgcauggaaaaa

SEQ ID NO: 651209 - RNA, 65 nt, hsa
aaauccccuaccccucaaaaacagguugaguuuaugggccagaauauuuuguauaccagacauug

SEQ ID NO: 651210 - RNA, 65 nt, hsa
ucugauuuggaaaaagagagggagguauggacugggggccagaguccuuuccaaggcuucuccaa

SEQ ID NO: 651211 - RNA, 65 nt, hsa
uucugaaguauuuuauuuaccuaacuauaauuauugggccagauacuuguuaauaaaugggcuua

SEQ ID NO: 651212 - RNA, 65 nt, hsa
caaucccucacauccaggaaaugaauuuugcaauugggccagaugcuaauuugcacguugauuca

SEQ ID NO: 651213 - RNA, 65 nt, hsa
aagguaucaaaccacaucagccucugauuggccaugggccagaccugcacucuggccaaugauug

SEQ ID NO: 651214 - RNA, 65 nt, hsa
uagaaaaccagaacggauuucauuucuaauggagggggccagagaugggaaaauuucuuguucag

SEQ ID NO: 651215 - RNA, 65 nt, hsa
gagaacuacaguuaugucagcuacccagacuuaaugggccagagccaugacccucacaggucuug

SEQ ID NO: 651216 - RNA, 65 nt, hsa
gaauauagcugcauuaacuuggaaagaagccuguugggccagaagacagaaacuccaacuggcaa

SEQ ID NO: 651217 - RNA, 65 nt, hsa
ugccacugaauugaagaccacccaucuuccaggcagggccagaauuacagaaaacaauucuggua

SEQ ID NO: 651218 - RNA, 65 nt, hsa
uuauugaauccaaacaauguguuaaguaauauuuagggccagaaaaaucuuguacagaauaauga

SEQ ID NO: 651219 - RNA, 65 nt, hsa
cuaucauuuuauuaaguaugauugacacagcccaugggccagaacacacucuacaaaaugacuag

SEQ ID NO: 651220 - RNA, 65 nt, hsa
aaaucaacuuguguacugauaaaauacucuagccugggccagagaagauaauguucuuuaauguu

SEQ ID NO: 651221 - RNA, 65 nt, hsa
cacuguauuuaccacuucuaagagugacugacgacgggccagaugacccuugaaguagucauuau

SEQ ID NO: 651222 - RNA, 65 nt, hsa
uguguuucauucuccaaaggacagcugagacuuaugggccagaagauacuggaagaugguguggc

SEQ ID NO: 651223 - RNA, 65 nt, hsa
gagaggaagaagagggcaggguggggaggagcucugggccagaggaugcugagcugccugggcag

SEQ ID NO: 651224 - RNA, 65 nt, hsa
gaguggucucagugagaagguagaugccaacuggagggccagaccuguguccugcccauguccuc

SEQ ID NO: 651225 - RNA, 65 nt, hsa
gccaguucugcagggugucagcuccaggacccacagggccagaaccagcugggagaauugguuau

SEQ ID NO: 651226 - RNA, 65 nt, hsa
ggcaggauggucauucucaaaaacccugggguccugggccagagacaggcagggcccaguccagg

SEQ ID NO: 651227 - RNA, 65 nt, hsa
gucacugaagcauccaaauaaagaauuucccucaugggccagacuacaacuuaacagaccuaggg

SEQ ID NO: 651228 - RNA, 65 nt, hsa
gugagacaggacgcagcgggccccugguggccugggggccagacccgugggcagguggggcaugg

SEQ ID NO: 651229 - RNA, 65 nt, hsa
ggggcaguugcgugacccugcugggaggccagaccgggccagacugagggucaggggaccaggcu

SEQ ID NO: 651230 - RNA, 65 nt, hsa
ggccaggcagccuccccagcugaggcaucauuccugggccagagucguguccaccaagggacagu

SEQ ID NO: 651231 - RNA, 65 nt, hsa
ucuggaguagggggucagcaaacauugucugcaaagggccagauacugaauccaguacuuucagu

SEQ ID NO: 651232 - RNA, 65 nt, hsa
gagaugucuagacuggugcguuguggucuccgguggggccagauccccagaacagggagagacug

SEQ ID NO: 651233 - RNA, 65 nt, hsa
ccucucuuuuugacagaggacaagggcguggaucugggccagaagccaaaccccuacuucuacag

SEQ ID NO: 651234 - RNA, 65 nt, hsa
acauuucugggggugucgucacugccguccccggagggccagauacggccccgcccaaaggguuc

SEQ ID NO: 651235 - RNA, 65 nt, hsa
aaaccacugugugguggggggcacugggcuuguuggggccagaaauguccacguccugagcuuuc

SEQ ID NO: 651236 - RNA, 65 nt, hsa
gaggagcccugugcucccagcucagaggacagucugggccagaacuggaaggagacaucuguccc

SEQ ID NO: 651237 - RNA, 65 nt, hsa
gcacgacagcagaaggauguugcuuuuuuaagggagggccagaaagaaaguuaguggauugcaaa

SEQ ID NO: 651238 - RNA, 65 nt, hsa
uaaggacaggguggaagagggugguauauagggaagggccagauaggcaacuucauuuggcuugu

SEQ ID NO: 651239 - RNA, 65 nt, hsa
acuggcguuggggaguugguuccugagaggucugagggccagagcugcccucuacauuaacaugc

SEQ ID NO: 651240 - RNA, 65 nt, hsa
uggguggcuuucaaggcuggggcauggcaaaucaggggccagagagcaggggagcuugggacuca

SEQ ID NO: 651241 - RNA, 65 nt, hsa
uugcucuucugucugucaucuugcaggaugcccgagggccagaugggcuuagcuaggccaaagua

SEQ ID NO: 651242 - RNA, 65 nt, hsa
cagagaagcccuccuguggcucaggggcagcugcagggccagauggaguuggccugcagggaguc

SEQ ID NO: 651243 - RNA, 65 nt, hsa
agugugugacuuacagaaacugcaugaaaaaucaugggccagagccucggcccuagcauugcacu

SEQ ID NO: 651244 - RNA, 65 nt, hsa
cccaggcaggcuuuggaguuguuuccauggugauggggccagauguauaguauucaguauauauu

SEQ ID NO: 651245 - RNA, 65 nt, hsa
gcacauccuuggaggcgagaugagcuccuugcagagggccagaguaagugcaagucauggagugc

SEQ ID NO: 651246 - RNA, 65 nt, hsa
uaccucgcagauuugcugagucugucuugugcagagggccagagaauggcuuaugggggcccagg

SEQ ID NO: 651247 - RNA, 65 nt, hsa
cucucugccuucugccccacuacuguggggcaguggggccagagcccaccuccccaacaugugaa

SEQ ID NO: 651248 - RNA, 65 nt, hsa
gggaggccauuuuugccuaaauuugaaaugagggugggccagaugaguauguuuaaguggagagu

SEQ ID NO: 651249 - RNA, 65 nt, hsa
ucacuacuucugacacucugguuauugggcacuaagggccagacuggaaagucacuugagacaca

SEQ ID NO: 651250 - RNA, 65 nt, hsa
guucuggauauuuacagcuucuuuuguuuuuaauugggccagaagauucugcaaaucccaaaucu

SEQ ID NO: 651251 - RNA, 65 nt, hsa
cuacucagugauugggaaauucccugucuugcccugggccagagcugguguaccgcugguggauc

SEQ ID NO: 651252 - RNA, 65 nt, hsa
acuuaaaaguaagaaguagugguucauccaucagggggccagaagcagcaacuguuuuucauauu

SEQ ID NO: 651253 - RNA, 65 nt, hsa
ccagccccagcccugggccugggcugccgacaccugggccagagccccugcugugauuggugcuc

SEQ ID NO: 651254 - RNA, 65 nt, hsa
ggauucuaucuacauaaguccuuucaauuccaccagggccagagcagcuccaccacugugcacuu

SEQ ID NO: 651255 - RNA, 65 nt, hsa
gugcuguaaacagguuugggcaguggugggggagggggccagagaggcggcucagguugcccagc

SEQ ID NO: 651256 - RNA, 65 nt, hsa
gugcuggugggaaaugggcuugagucacucaccuggggccagaagaggcccccagggaguuguga

SEQ ID NO: 651257 - RNA, 65 nt, hsa
gugccuguccauaacugugaaguauuaagcacuuagggccagaugcacuguaaacauugcagguu

SEQ ID NO: 651258 - RNA, 65 nt, hsa
cagcagggugguggggacuccugagcccagccugggggccagagcaccccaggaccccgggggga

SEQ ID NO: 651259 - RNA, 65 nt, hsa
ccauggacacuccagugccagcaaugacaucucaggggccagaggaacuguccagagagcaacuc

SEQ ID NO: 651260 - RNA, 65 nt, hsa
ccuagccuccuauaaggcccaggaagagggcagaggggccagaaggacuccauggcccaaagacc

SEQ ID NO: 651261 - RNA, 65 nt, hsa
gcuguaaguggcuagguugguagaaucaaaaacaagggccagauguauuuaagggguauucagau

SEQ ID NO: 651262 - RNA, 65 nt, hsa
gagaggccaggagggccugaucccaggagacaccagggccagagugaccacagcagggcaggcau

SEQ ID NO: 651263 - RNA, 65 nt, hsa
ugaagagccucaccugggggcauuuuguggguggagggccagaguguguauacccaggcuugucu

SEQ ID NO: 651264 - RNA, 50 nt, hsa
agcaggaaggaauugaguaggggccagagggggcucugcucggccuguga

SEQ ID NO: 651265 - RNA, 65 nt, hsa
acuucuguagugcugcagggucccucgggugcugugggccagauccgggcggggaccuacugucc

SEQ ID NO: 651266 - RNA, 65 nt, hsa
ggacccuuuaaauuaaaaagugaagauagucaccagggccagaaagcucauggaguggccguaau

SEQ ID NO: 651267 - RNA, 65 nt, hsa
guguaaaccaggaauuggcacacuuuuuuuagaaugggccagaugguaaauauuuaugcuucacg

SEQ ID NO: 651268 - RNA, 65 nt, hsa
agauccuggcucggaccacugcaagggccgaggcagggccagaccagagcauccuggguacaggc

SEQ ID NO: 651269 - RNA, 65 nt, hsa
gcuuggaaagugaacuugcagccuuggauggggaagggccagaugcugggugggugccugucacc

SEQ ID NO: 651270 - RNA, 65 nt, hsa
acucaccugcccuucccgugcccacagcuggagcagggccagagccuugggccgguggagccccu

SEQ ID NO: 651271 - RNA, 65 nt, hsa
ugggaaggccuuacagaagaggugacauuucagcugggccagagaucaguagagagcagcugaag

SEQ ID NO: 651272 - RNA, 65 nt, hsa
ggcacccucagggagccuccccaucuguccagcuggggccagaggcugggagucccuaccugcuu

SEQ ID NO: 651273 - RNA, 57 nt, hsa
cugggcagaagaagauuuaaauccauugggccagaaggaaugaccauuacuaacaug

SEQ ID NO: 651274 - RNA, 65 nt, hsa
guggcaucauacucagaaaggaagaccaugccauggggccagaaauucagaaacguaauucuuac

SEQ ID NO: 651275 - RNA, 65 nt, hsa
guauugaucaggguagcaaacucaaaugcugacaggggccagaggagauauggggaaggagcauc

SEQ ID NO: 651276 - RNA, 65 nt, hsa
uuacuuauuuuaauuuucugacuuuacuauuuuaagggccagaggguuaaucacaaagagcaauu

SEQ ID NO: 651277 - RNA, 65 nt, hsa
ggguggaagucaguuggccucccugguucugcagagggccagaagaaugagagagaggaagacug

SEQ ID NO: 651278 - RNA, 65 nt, hsa
cgggaaggcgccgggcccgggacuguccguucucggggccagagcugcugggggaccgaguuugu

SEQ ID NO: 651279 - RNA, 65 nt, hsa
ccaggccgaacuccgcacucgcucucccggcagaggggccagaaucgcccggcccagcccuggag

SEQ ID NO: 651280 - RNA, 65 nt, hsa
gucgagaugacuuugaucauugguaacuugggccugggccagacaaaguauaaaacuuacaaaag

SEQ ID NO: 651281 - RNA, 65 nt, hsa
uaguugcugagaggggcuggggagauggggcgggagggccagacucagugcugcuguggagcuag

SEQ ID NO: 651282 - RNA, 65 nt, hsa
aggccagguggagaugaggauggguaacaguauuggggccagaucccuaagccccccagcuguaa

SEQ ID NO: 651283 - RNA, 65 nt, hsa
uuuuuuuucuguaccacaggcauuaucuauaccuggggccagauuuucugcacuuugaaauguug

SEQ ID NO: 651284 - RNA, 65 nt, hsa
cgucaugacuacgcagcagcagcaguuuccaagacgggccagaaacgcauccacagcaguggcac

SEQ ID NO: 651285 - RNA, 65 nt, hsa
agaccuuugaucugcaguguaaaucuaccagucaugggccagaagggcaaaagcccagcuuucuc

SEQ ID NO: 651286 - RNA, 65 nt, hsa
ucugaaaggucccucugacccaggucaccaaauuugggccagaacuggcacuuccgagugcccac

SEQ ID NO: 651287 - RNA, 65 nt, hsa
agcgccggacggcgcagcuggccaagaggcgggcggggccagaaauaccucaugccccugcacca

SEQ ID NO: 651288 - RNA, 65 nt, hsa
uccugggcuccacucaggggaggugcuuggccaaugggccagaaaccgcuucugagcggggcacu

SEQ ID NO: 651289 - RNA, 65 nt, hsa
uucucagaagaggcccagcguccaccucucucccagggccagacagcccuuccuggcucccccau

SEQ ID NO: 651290 - RNA, 65 nt, hsa
ccgaugcuaccccugucagacagaggcugcggccugggccagagucagggaguagcugcugcuuc

SEQ ID NO: 651291 - RNA, 65 nt, hsa
gauuuuagaacccuaaugcacccuggaggguagcugggccagacuucucauuucacaggugagga

SEQ ID NO: 651292 - RNA, 65 nt, hsa
uccccauggaacagcccugcacgcccaggaugaaggggccagaccacgccccugccugagaccac

SEQ ID NO: 651293 - RNA, 65 nt, hsa
agagcugcguaaaguuaccccggggugauauaggggggccagacgugugccccguucacccaccc

SEQ ID NO: 651294 - RNA, 65 nt, hsa
uuuucaaacugugguccagagaauaggggaagacugggccagacgcaguggcucaugccuguaau

SEQ ID NO: 651295 - RNA, 65 nt, hsa
aaaaaugcauaccaugcuuucagaacaaaagcucugggccagaaaggcaauuuggcuaaaaaaug

SEQ ID NO: 651296 - RNA, 65 nt, hsa
cuggggaguuuuccugaucuuggguccucuuuagggggccagacaagaaaggccuacgguuucug

SEQ ID NO: 651297 - RNA, 65 nt, hsa
ccuugcuccguuguucccuugcccugguggugggggggccagaccaccuccggaauccugccacc

SEQ ID NO: 651298 - RNA, 65 nt, hsa
guggcugcugugggcaaggaccggcccuucauggggggccagaagccgaaucucgcugauuuggu

SEQ ID NO: 651299 - RNA, 65 nt, hsa
ccgagggcacagggacccggggccccgcggggcuggggccagacaaagacucggcaaaggggcga

SEQ ID NO: 651300 - RNA, 65 nt, hsa
aggaauggagaagcugacccugcuggccaggcaaggggccagaccccccccaacccccagcugcc

SEQ ID NO: 651301 - RNA, 65 nt, hsa
auauuacugguuaacauuguggagcuauuacugaugggccagacucugugcuaggcacagacuuu

SEQ ID NO: 651302 - RNA, 65 nt, hsa
gaugcucuuggacuccccacugcaucugggcugcagggccagagcuagucugaccauuaggucag

SEQ ID NO: 651303 - RNA, 65 nt, hsa
auggucacccagagccauagagcacccuuccuccugggccagagcuggguuaucaugguuggcuu

SEQ ID NO: 651304 - RNA, 65 nt, hsa
acaguacuggagagagacacacagaucuaagucgggggccagagggagcucccucaacuaggcag

SEQ ID NO: 651305 - RNA, 65 nt, hsa
aaaauauuuuaauggcagacugauuacaguggugugggccagaaacaagggacagugaaacaccc

SEQ ID NO: 651306 - RNA, 65 nt, hsa
cucgcugccagcucuguaucaggacccagaggaaggggccagaggcucguugacuggcugugugu

SEQ ID NO: 651307 - RNA, 65 nt, hsa
cagcacgaacugcccgucagagaagugcacagccugggccagauacucccacaggugggugagug

SEQ ID NO: 651308 - RNA, 51 nt, hsa; identical to SEQ ID NO: 533529

SEQ ID NO: 651309 - RNA, 65 nt, hsa
caaacucacuccuuuuuagaaaaaacaaaaaaaaagggccagaaagucauuccuuccaucuuccu

SEQ ID NO: 651310 - RNA, 65 nt, hsa
cuaccagcagcaaccaggacgucuguucuuugugggggccagaucagaagagagaggccccugug

SEQ ID NO: 651311 - RNA, 65 nt, hsa
uugucagaagggacacaggugguaauuuggagauggggccagagcuucuggcuuuuggauuuggu

SEQ ID NO: 651312 - RNA, 65 nt, hsa
agugucugcuccucugaggccaggaggccggugcugggccagagaggacggcguggcgaaaguca

SEQ ID NO: 651313 - RNA, 65 nt, hsa
uuuccacacccuccucgguauccauggagagccuggggccagauaucuggcucaucucuggcauu

SEQ ID NO: 651314 - RNA, 65 nt, hsa
uggggauucaguaguccagaucucuggagcugaaggggccagagagugggcagagugcaucucgg

SEQ ID NO: 651315 - RNA, 65 nt, hsa
ucuugaccuuggaccugcuugguuaaggagggagugggccagaccagagugccaggagcuaaugg

SEQ ID NO: 651316 - RNA, 65 nt, hsa
agcugcucagaacccaagauuguaagcucccccuagggccagaggccucuuucuuucaguuuuuu

SEQ ID NO: 651317 - RNA, 65 nt, hsa
gcaagcuaaaucauuuaaauguuuaaauugaaaaugggccagauucucaaugaauaagugguucc

SEQ ID NO: 651318 - RNA, 65 nt, hsa
agguagggagagccagaggugccagccuuccugaagggccagaaaauuuagccuggaucuccucu

SEQ ID NO: 651319 - RNA, 65 nt, hsa
agacccauugcgauggccgcuccguguuccucggugggccagagcugaaccuugaggggcuaggu

SEQ ID NO: 651320 - RNA, 65 nt, hsa
ugaucugccuuacuucacuuuauccucugguuuuagggccagacgccagaagccaugugucaauu

SEQ ID NO: 651321 - RNA, 65 nt, hsa
uaagugucaagugggaggauacugcccccuugugggggccagacgggucggacacggcugugccc

SEQ ID NO: 651322 - RNA, 65 nt, hsa
ggagaacagccaguagccuugguaauaugaagggugggccagaagaugauuucacuugcaaaaac

SEQ ID NO: 651323 - RNA, 65 nt, hsa
caggacacggaagugagagacacuaaagaaggugugggccagacaaggccuuggagcccacacau

SEQ ID NO: 651324 - RNA, 65 nt, hsa
ucugagcagggcccaaggcagccaggggccuggaggggccagaggaggguggggucagggccgcc

SEQ ID NO: 651325 - RNA, 65 nt, hsa
cugucacugacuuugugcaggccaaggaccuggcagggccagacgcuguaccaucacccaggcca

SEQ ID NO: 651326 - RNA, 56 nt, hsa
auaucaucucacagcucugaggcccugggccagauuacuuccuccaccccucccua

SEQ ID NO: 651327 - RNA, 65 nt, hsa
ccaugaccccaugucccagcuccccacacagcgcugggccagagaggcauuggugcgagggauug

SEQ ID NO: 651328 - RNA, 65 nt, hsa
aggagggagcgugagccucccagagccccaggacugggccagagcacuuagguuucuuuuuccau

SEQ ID NO: 651329 - RNA, 65 nt, hsa
cccagggcucagcccugcuguccugagcgucuccugggccagagagaggagaugggggugggagg

SEQ ID NO: 651330 - RNA, 65 nt, hsa
ucuccacccccccgggacuguuggggggauucugagggccagagggggauauauaugauucccca

SEQ ID NO: 651331 - RNA, 65 nt, hsa
uguccuccagggcgagcacuuuccacuuccagagggggccagagggacuuugccugcccagucuu

SEQ ID NO: 651332 - RNA, 65 nt, hsa
cucgugcugggcucugcccugggcagacaggcagagggccagagcagaggacacauggccuugcg

SEQ ID NO: 651333 - RNA, 65 nt, hsa
cuccuuucccuuauacuuuuuauuaccuugcucaagggccagagaucucaagugucaaccuugag

SEQ ID NO: 651334 - RNA, 65 nt, hsa
caccccugucagucugcuccccaucccccagccuggggccagaacagccuaccccaggacaggag

SEQ ID NO: 651335 - RNA, 65 nt, hsa
uggggugauuggacaagagggucuggcugggaggugggccagaccuggcagcacugaaugugggc

SEQ ID NO: 651336 - RNA, 65 nt, hsa
augaaguccaguggaguucuuagggccuaaauugggggccagaguuucaaaggcaucacuaugga

SEQ ID NO: 651337 - RNA, 65 nt, hsa
cccaggaaucucaaacucccuuuggcccugaaccagggccagauaaggaacagcucgggccacuc

SEQ ID NO: 651338 - RNA, 65 nt, hsa
aaacaaccccccaucacaaacuuaaaggauugcaagggccagaucuguuaagugguuucauagga

SEQ ID NO: 651339 - RNA, 65 nt, hsa
aaaugccuauguuuucuuuuaguuacaugaauuaagggccagaaaaaaguguuuauaaugcaaug

SEQ ID NO: 651340 - RNA, 65 nt, hsa
aguugcccgcugggccuggggcccugcccaugccugggccagaguggcgcuggggccucggcuuc

SEQ ID NO: 651341 - RNA, 55 nt, hsa
gggccucggagcuacugugagccccgggccagagaagagcccgggagggccaggg

SEQ ID NO: 651342 - RNA, 65 nt, hsa
cagagaagggcucuccccacugcuucgugauuccagggccagagccaugcagucccagaaacccc

SEQ ID NO: 651343 - RNA, 65 nt, hsa
cuccucauugugccuucaucagagcuggugccuucgggccagaaagacucucguucuuucuagau

SEQ ID NO: 651344 - RNA, 65 nt, hsa
agaugugugugugacguguuuagaaaugcggugaagggccagacggugcugggaaggcaguuguu

SEQ ID NO: 651345 - RNA, 65 nt, hsa
cuucgguuuguugaacuuuggcagccaguuggugagggccagauguuauucccuuucuuaaagau

SEQ ID NO: 651346 - RNA, 65 nt, hsa
ucagaagaacauccuucucugcuugaccugaagaagggccagaccugggcagaaagacuccagca

SEQ ID NO: 651347 - RNA, 65 nt, hsa
caguuucauagaugggucaggagguggacaaguuggggccagagaugauggcaguccagcagcaa

SEQ ID NO: 651348 - RNA, 65 nt, hsa
acauccaagacuggagcagcaggcuggccacgcucgggccagagagagcucacagcugaagcucu

SEQ ID NO: 651349 - RNA, 63 nt, hsa
ucaguggcaauggcuucugagaucaggcacccggggccagagacauaugggccauaccccuua

SEQ ID NO: 651350 - RNA, 65 nt, hsa
ggaggauaugugggugggugggagggcuggggcaggggccagauagaaauuauugguuuuguuuu

SEQ ID NO: 651351 - RNA, 65 nt, hsa
guccccguuacucuuagagaaaggaguuggggugagggccagagcuggcaguggaaacuuguucu

SEQ ID NO: 651352 - RNA, 65 nt, hsa
ccguaggaaaaaggaauagcaaucauuaaaaucuugggccagagaacacuauuuuuacauaacag

SEQ ID NO: 651353 - RNA, 65 nt, hsa
caaagaggugguuucugaggaagucagagcgcccagggccagagcagucaguaaugggugaauga

SEQ ID NO: 651354 - RNA, 65 nt, hsa
uuuccaucucacuggacugcagacccggccugguggggccagagaguccccagcuagggaccugc

SEQ ID NO: 651355 - RNA, 65 nt, hsa
acuuuuucaaguucacauggggacccccuucuugggggccagagauaugacuaaaaccuuaucuc

SEQ ID NO: 651356 - RNA, 65 nt, hsa
uugaagggggcaagggcugagaugugguccccaaggggccagaaauucccaaguuggucacaggu

SEQ ID NO: 651357 - RNA, 65 nt, hsa
cuuucacccaaccugcucccucugauccuccaucagggccagaucuuccacgucuccaucucagu

SEQ ID NO: 651358 - RNA, 65 nt, hsa
guuugcccuugaacuaaaaauguuguuuggggcaagggccagaaauguggagacaugguuuuugu

SEQ ID NO: 651359 - RNA, 65 nt, hsa
agagcccagcuccaaggggaaucagaacucaaauggggccagauccagccuggggucuggaguug

SEQ ID NO: 651360 - RNA, 65 nt, hsa
ggaaagauaacuaggaaauccauucacaguucuuugggccagacaugccacaaggacuuccuguc

SEQ ID NO: 651361 - RNA, 65 nt, hsa
gaagcuccucuccccagcccagagacauacuugaagggccagagccaggggggugaggagcuggg

SEQ ID NO: 651362 - RNA, 65 nt, hsa
ugcgucaaagcacagaggcuccccggacucggagggggccagagacugagcucuggucaccuguu

SEQ ID NO: 651363 - RNA, 65 nt, hsa
aacacucacauggcaagaguugcucuggagagguagggccagaggaaugcugcugcacugccaac

SEQ ID NO: 651364 - RNA, 65 nt, hsa
uagauauugacagcuauucaccuuucacggugcuggggccagauuagggaucacucccgugagga

SEQ ID NO: 651365 - RNA, 65 nt, hsa
cagcuccugaugaaaucaucccuguggggagugcagggccagauggggacuccauggagacagcc

SEQ ID NO: 651366 - RNA, 65 nt, hsa
gggacaguggcccugagcccaccccuuccugggaugggccagacaagcaggugcugggaggaggc

SEQ ID NO: 651367 - RNA, 65 nt, hsa
aucauggcagugggaccaagcguggucccgaggaagggccagagccugguagagacuagggaagg

SEQ ID NO: 651368 - RNA, 65 nt, hsa
uuggcccagggccuccuuccacauuaguagccccagggccagauggagccaaaggucagcucucu

SEQ ID NO: 651369 - RNA, 65 nt, hsa
aagaaaacauuuguucccuguucauuuuauuuuaggggccagaucuaacauuguagugucuuuca

SEQ ID NO: 651370 - RNA, 65 nt, hsa
uugcacagaauugcaaaugucuuuugccauaccaagggccagacucagaacccuuggagucaugu

SEQ ID NO: 651371 - RNA, 65 nt, hsa
aaagggagaaggaagggcagagaauggcugggucagggccagacuggaagacacuucagaucuga

SEQ ID NO: 651372 - RNA, 65 nt, hsa
aggcuucugagcuucuccuguacugugcaucgugagggccagagacaggaauguaaggauuggca

SEQ ID NO: 651373 - RNA, 65 nt, hsa
aaagcucaaagguuuggaaggagcagaaaacccuugggccagaaguaccagacuagauggaccug

SEQ ID NO: 651374 - RNA, 65 nt, hsa
ccacgcucuucuaauugggagauaauauggaagaagggccagagcaguuacagcccuccuucuuu

SEQ ID NO: 651375 - RNA, 65 nt, hsa
aagagaggcuccauuuguggcuauuauguagaacugggccagagccaguccauugccuguuuuuu

SEQ ID NO: 651376 - RNA, 65 nt, hsa
guguccccaaccaucccaauagggugggggccugugggccagaggacuccaugacaguagccaug

SEQ ID NO: 651377 - RNA, 58 nt, hsa
acaggagaagugcacccuagggccuucugggccagaggcaccaucccuucuggccauc

SEQ ID NO: 651378 - RNA, 65 nt, hsa
cuggagcaagucucccagaugauucuaauacaggagggccagaggccaaacuugaagaacugcug

SEQ ID NO: 651379 - RNA, 65 nt, hsa
gcaucagcaacaaccagcaucccuugaccaggccugggccagaguauuggucuccucucagcccc

SEQ ID NO: 651380 - RNA, 65 nt, hsa
aacaaaguuuuccaggaggccuugcggaacaucgggggccagauucaggagaagguaugugagug

SEQ ID NO: 651381 - RNA, 65 nt, hsa
ccagcaccccaccaucccuuugcaggggagucaaagggccagaacuccuugggggaccagaacau

SEQ ID NO: 651382 - RNA, 65 nt, hsa
ccuugcaacucagugugaguugauuccuccaauaugggccagaugcuuuugaaugauagggaaau

SEQ ID NO: 651383 - RNA, 65 nt, hsa
gggaagggcccagccacuuccagcuuuugaucuuggggccagaggccgccuuacacacaccccag

SEQ ID NO: 651384 - RNA, 65 nt, hsa
uggaaauagcaaaaacaaggcccaggcuggggccagggccagaggggaaggcccuggauucucac

SEQ ID NO: 651385 - RNA, 65 nt, hsa
ugcccuggggcugaucucagggaagcccagcuccagggccagaugagcagaagcucucgauggac

SEQ ID NO: 651386 - RNA, 65 nt, hsa
augaacccuucaagaaaacgugaaguagaacgggugggccagaaaugaaaacaggcaaguaaagu

SEQ ID NO: 651387 - RNA, 65 nt, hsa
aggaacagcaaggacguugauugguuggggcaggggggccagaguagcugauguaggaguacugg

SEQ ID NO: 651388 - RNA, 55 nt, hsa
cuuugguuauggacacauaacuccugggccagaggcuaaaaccccaggaccccug

SEQ ID NO: 651389 - RNA, 65 nt, hsa
aaaagaacaaagucuccccaccuuucucggaugcagggccagagugacacagccgaaaaauugca

SEQ ID NO: 651390 - RNA, 65 nt, hsa
cagcauagcuacaggaaaagucagcccuugacugagggccagaucaucccuggagugcaccucua

SEQ ID NO: 651391 - RNA, 65 nt, hsa
agcaucucagcgccagcucuaccaguucucguuuugggccagaggcagccucugcacucccacgc

SEQ ID NO: 651392 - RNA, 65 nt, hsa
cugacuuagccgagguaaggucagugcagcagacagggccagacugggguguggggggcugagcu

SEQ ID NO: 651393 - RNA, 65 nt, hsa
gacagcugcauuccagagcaggaggcagggcucuggggccagaauggcuguccuugucguagagc

SEQ ID NO: 651394 - RNA, 65 nt, hsa
aaaaagcuccaaaugcagcuuuaaaaaauuaaucugggccagaauuucaaacggccucacuaggc

SEQ ID NO: 651395 - RNA, 65 nt, hsa
ccaaucgggagggagagacagagacagagccgauggggccagagcaggcagaacaggcggagcgc

SEQ ID NO: 651396 - RNA, 65 nt, hsa
gcaccugcuuggcccugccaccuuccuccaggggagggccagauggcauccuggcuuggggcggg

SEQ ID NO: 651397 - RNA, 65 nt, hsa
cacccagggcgaauggggcccagggcagaccuucagggccagagcccuggcggaggagaggcccu

SEQ ID NO: 651398 - RNA, 65 nt, hsa
ggcgggcaggaaccggggcugcgcgcagcgcuugcgggccagagugaguuccgggugggcguggg

SEQ ID NO: 651399 - RNA, 65 nt, hsa
cugggugauggguagagcccucgaaacuugacauggggccagaagggccuggguugaaguaguaa

SEQ ID NO: 651400 - RNA, 65 nt, hsa
ugauuaugagugguucacagcagcccuuauaagcugggccagaaaauuucacuaggucaguaauu

SEQ ID NO: 651401 - RNA, 65 nt, hsa
cgggacugucugauugaggacagugacgacgaggcgggccagagcugagcgugaggacgugcuug

SEQ ID NO: 651402 - RNA, 65 nt, hsa
auacacuuuggccuuccuuuccccagcgccccugagggccagaggcagaugugggcugcaggcug

SEQ ID NO: 651403 - RNA, 65 nt, hsa
gcuacgccccaugucaucacagggccuucaugacagggccagagccagccagcuuugaagacgcg

SEQ ID NO: 651404 - RNA, 65 nt, hsa
caccgcaacaagcgggccgccccagccaccuccgagggccagagcaagcgcuguaaacccugacg

SEQ ID NO: 651405 - RNA, 65 nt, hsa
ccuggggugcggcccuggcccccuccaccccugcugggccagagcgggugggcagugucaaggcc

SEQ ID NO: 651406 - RNA, 65 nt, hsa
ccgccccugccagccaccaagcgcaggugcagcgggggccagacuccugccggccucagaggaca

SEQ ID NO: 651407 - RNA, 58 nt, hsa
aggcccuggagcgacacugacagccagggggccagaaggacugacaccacagaugaca

SEQ ID NO: 651408 - RNA, 65 nt, hsa
ucuggggguagaacagaaccaaauucacagcuggugggccagacugguguugguuggaggugggg

SEQ ID NO: 651409 - RNA, 65 nt, hsa
ggaaucagagaccuuccagaaauacuacuguguaagggccagaaauaucuucacuugucauuguu

SEQ ID NO: 651410 - RNA, 65 nt, hsa
cccuucggugugaccggcagccuggcugaccgugagggccagagagagccuucacggacggcgcu

SEQ ID NO: 651411 - RNA, 65 nt, hsa
cagcccugcccccgggcacugcacagccugucugggggccagaccaccccauuguccauccuugu

SEQ ID NO: 651412 - RNA, 65 nt, hsa
cuccagccaguucaagcucagagccagagcuggacgggccagaacugcgcugcacacuuccugga

SEQ ID NO: 651413 - RNA, 65 nt, hsa
ucagugugcggacagaggagaccacucugcuccuggggccagaggccauucaauagccugccuuc

SEQ ID NO: 651414 - RNA, 65 nt, hsa
ucacugaaccucucaggaucaaugaccccuguaaggggccagagccuuggaggacacuaagagga

SEQ ID NO: 651415 - RNA, 65 nt, hsa
uccucacauacgguaaagccaaagagcugucacaugggccagaaacaugagccacggcaggaaga

SEQ ID NO: 651416 - RNA, 65 nt, hsa
auccuccuuuccucaugcagcacaagugcucaccggggccagagccagggcauggauaugacaag

SEQ ID NO: 651417 - RNA, 65 nt, hsa
aguggccuggcuccgcuguguggauggggagaucggggccagaggcagaacccuggugaggaagc

SEQ ID NO: 651418 - RNA, 63 nt, hsa
cucaucaggcccucgacugaaaaguucucaguggggccagacuggcuccuggagcugacaagc

SEQ ID NO: 651419 - RNA, 65 nt, hsa
cccugggcagaguaccaggcugcugacccucagcagggccagacaaggcucaguggaucuggucu

SEQ ID NO: 651420 - RNA, 65 nt, hsa
ggcuggggcugacccugggcagggacuuuccugcagggccagaccugccugcauucugagacaaa

SEQ ID NO: 651421 - RNA, 65 nt, hsa
ucuacaugcaaaucuggcuuaguaaaucgaggugugggccagagauccucugacagcuguccuga

SEQ ID NO: 651422 - RNA, 65 nt, hsa
gugagccaguuccagcuggcuccagccauccugcagggccagaccaaagagaagaugguuaccau

SEQ ID NO: 651423 - RNA, 65 nt, hsa
gcccuugaguguauuuguucucaguccuaacccuggggccagagauugguccgagguugagaauu

SEQ ID NO: 651424 - RNA, 65 nt, hsa
agggcuuccuaggagccagucagcagggugggguggggccagaggagcucuccagcccugccuag

SEQ ID NO: 651425 - RNA, 65 nt, hsa
cucauguggccaagcacaucuuugaccacgucaucgggccagaaggcgugcuggcaggcaaggug

SEQ ID NO: 651426 - RNA, 65 nt, hsa
uuccagugcucagagggcggggagaaucucagcgugggccagaggcagcucgugugccuggcccg

SEQ ID NO: 651427 - RNA, 65 nt, hsa
cauugugaccgaccccacuuccucagaauguaacggggccagagggaaacuucucacaaacuucg

SEQ ID NO: 651428 - RNA, 65 nt, hsa
ugcugacaccagaacagcccaaaucagaguucccagggccagacaggcucuuccugggccacaga

SEQ ID NO: 651429 - RNA, 65 nt, hsa
ggauucagagguugccugcggaguaccuugucccagggccagacacacccacaccacccacuguc

SEQ ID NO: 651430 - RNA, 65 nt, hsa
ggugaagucaggccagggccuuccagcugcucuuggggccagagccaagagccucucaguagagg

SEQ ID NO: 651431 - RNA, 65 nt, hsa
gugggccaggccgggccacagcaauaggaaagccagggccagagcgagccaugccagcccuacug

SEQ ID NO: 651432 - RNA, 65 nt, hsa
cgccucccucucuacgucucuguaccgagccucuggggccagauauaagagugccucucugaguc

SEQ ID NO: 651433 - RNA, 65 nt, hsa
aggcuuccuuaccaagaaugaguuccugaaacccagggccagagacaaggacaacuuaggggaag

SEQ ID NO: 651434 - RNA, 65 nt, hsa
uccccagaccaacccugggaccuauacagaacagagggccagagcuagggcugcugcuucugcuc

SEQ ID NO: 651435 - RNA, 65 nt, hsa
ggguucugggaaagcaacagcuaucagagagagaagggccagaccccauagccucuuagauuccu

SEQ ID NO: 651436 - RNA, 65 nt, hsa
gaggcugagaaaccuccagggcagacagaaaguuggggccagagcuagguuuuagagauccuaca

SEQ ID NO: 651437 - RNA, 65 nt, hsa
uaaugcugaguucugucucacacugaucaggcucagggccagagaggcaacaagagagcaagacc

SEQ ID NO: 651438 - RNA, 65 nt, hsa
uguucaauugccuuguguaaccacuugucgccuuagggccagauuccccucucuaguccccuuuu

SEQ ID NO: 651439 - RNA, 65 nt, hsa
cggucauucuacacugaggaggcugccuuaugggugggccagauccaaaccgcaggcaaacgggu

SEQ ID NO: 651440 - RNA, 65 nt, hsa
gcccagcaacccugccccuccccagcaucccagcugggccagagagagccgagugugccaacaag

SEQ ID NO: 651441 - RNA, 65 nt, hsa
uugggaauuaggaaccuuauuuccuaaaagaaacagggccagaggaaaaaaaacuauugauaagu

SEQ ID NO: 651442 - RNA, 65 nt, hsa
cacacucucccucaucuuucgugcccauucacugagggccagaaugacugcucacccacuuccac

SEQ ID NO: 651443 - RNA, 65 nt, hsa
gugugugugugugcacaucuacaugccaugccuaugggccagaguugucuuuauuguccaccaug

SEQ ID NO: 651444 - RNA, 65 nt, hsa
uguuggacuuagaccuccuucaguguggcucugcugggccagaggcauccugcugucccgggugg

SEQ ID NO: 651445 - RNA, 65 nt, hsa
agaggggauggcugaggacacuggcccuuaccccagggccagacagcauccaucccugcuguuug

SEQ ID NO: 651446 - RNA, 65 nt, hsa
cauucagggagaaaccucuccuucccgugugagaagggccagaggguccaggcaucccaagucca

SEQ ID NO: 651447 - RNA, 65 nt, hsa
ggugagagauuuuggccuuuuuuauuggauaaauugggccagaaaggcaggguagauuucgaagc

SEQ ID NO: 651448 - RNA, 65 nt, hsa
gagagacaccagcucucagggcagagauuggcuuggggccagaaggacccuccccaacccuggag

SEQ ID NO: 651449 - RNA, 65 nt, hsa
gcucuccaguaauugucuuuucauuuugaugguaggggccagacugaaugaauaaugcauucuuu

SEQ ID NO: 651450 - RNA, 65 nt, hsa
cuagcagaauagcaagcagaguaucauucaugcuggggccagaaugauggccgguugccagauau

SEQ ID NO: 651451 - RNA, 65 nt, hsa
uuuacuuuguuuuaaaacugaucaguuuugccaaggggccagaauuauuccuuguuagaauugcu

SEQ ID NO: 651452 - RNA, 65 nt, hsa
cuguggcagcgggaguucccggcccuccacacccggggccagacccucggggccaugccuuggug

SEQ ID NO: 651453 - RNA, 65 nt, hsa
gaccgcagcgcgcagccacaugcccuggcugccaugggccagaccgccuccaccucccccgcccg

SEQ ID NO: 651454 - RNA, 65 nt, hsa
gugcgaggcccucggggcccacccacagcggcccagggccagacccuggcuggaagccagaacgc

SEQ ID NO: 651455 - RNA, 65 nt, hsa
ugagagcugggccuccucuccagaaucauguggaggggccagaggccugccagacccccagcugg

SEQ ID NO: 651456 - RNA, 65 nt, hsa
cccucaugcuuccugucccccgcuuacacgacaacgggccagaccacaggaaggacgguguuugu

SEQ ID NO: 651457 - RNA, 65 nt, hsa
cuguccuccuaaaguggccccuguucccaucucccgggccagacagcuguccccccguccuccuc

SEQ ID NO: 651458 - RNA, 65 nt, hsa
uuaccugagaucugggaugcugaguggcuguuugggggccagagaaacacacacucaacugccca

SEQ ID NO: 651459 - RNA, 65 nt, hsa
uucccccucuucaggugucagugcggagaggcucugggccagaccucacccccagugacuuccga

SEQ ID NO: 651460 - RNA, 65 nt, hsa
ccgggacugcaggcggcggaugucaggcccugucugggccagaacugagcgcuguggggagcgcg

SEQ ID NO: 651461 - RNA, 65 nt, hsa
aucugccccagccuccaacuuggagagacagauuugggccagacuccuguguccuugcuuggcug

SEQ ID NO: 651462 - RNA, 65 nt, hsa
aggaagggugaaagagaaagccugugaaauaggcagggccagaucacccaaaacuccucaggacu

SEQ ID NO: 651463 - RNA, 65 nt, hsa
ggcggccagcggcgcccggaggggaggaaggggccgggccagacguucccacaguaaaucucccc

SEQ ID NO: 651464 - RNA, 65 nt, hsa
ugaauauauuuuacaugugaugacauggauuuugggggccagagguguaauguuuuggcugagug

SEQ ID NO: 651465 - RNA, 65 nt, hsa
auucacccccauccacaguugucaguugugaagaggggccagaugacacccuaaagcaggcugau

SEQ ID NO: 651466 - RNA, 65 nt, hsa
aaccagacuuccaguucucaggaacuucucauugugggccagaaguccugggugccuccuacuag

SEQ ID NO: 651467 - RNA, 65 nt, hsa
ucuagucacuggccucaaaggaccccacagcaccugggccagaccaacagcucgagggagaaccu

SEQ ID NO: 651468 - RNA, 65 nt, hsa
cgagggugggcugaggcugaaguugcccacacugggggccagagcuaggguggggggcgagggug

SEQ ID NO: 651469 - RNA, 65 nt, hsa
agggauggggguguuggaugccuggaucucuguaagggccagaagugagggcccagaggucuggg

SEQ ID NO: 651470 - RNA, 65 nt, hsa
cgagccaagcagggggacguugccagaggggaccagggccagagacgggaccaggaaggaacuga

SEQ ID NO: 651471 - RNA, 65 nt, hsa
aagagauucuccuuccaggccuaagccugggauuugggccagagauaagaauccaaacuaugagg

SEQ ID NO: 651472 - RNA, 65 nt, hsa
cggccagacguggcuucuccugaguucuagggcucgggccagaguggcacuacugcccggccagu

SEQ ID NO: 651473 - RNA, 65 nt, hsa
gagauuuugcguuugacauugugucugggaaggaagggccagaccuuggaaccuuuggaaccugc

SEQ ID NO: 651474 - RNA, 65 nt, hsa
ccgcucucugcagcguggauuuccuuugcccauuugggccagaaggucaccaggaguucaucacu

SEQ ID NO: 651475 - RNA, 65 nt, hsa
aagaauagccagcggagcauggacuguuccagcacgggccagauggccagcugucgagagcagcc

SEQ ID NO: 651476 - RNA, 65 nt, hsa
ugcuucuuugaaggaguaaauguguuuuguuccuagggccagaggagcuugucuuccuuguccuc

SEQ ID NO: 651477 - RNA, 65 nt, hsa
ccuugcuagccaaaaucucuuaaauacacguaggugggccagagaacauuggaagaaucaagaga

SEQ ID NO: 651478 - RNA, 65 nt, hsa
ucacccaugcuaggguccccaaagcacuggggcaggggccagagcagcagcacccagugcucccu

SEQ ID NO: 651479 - RNA, 65 nt, hsa
uaaguggggaggagggucagcuaagagaagugggagggccagagcuuuuugguucugauuuacaa

SEQ ID NO: 651480 - RNA, 65 nt, hsa
uauuuauggcuuauaaauguguauucuggcugcaagggccagaguuccacaaaucuauauuaaag

SEQ ID NO: 651481 - RNA, 65 nt, hsa
gaaagaacagagaagugacagcuagggguugagaggggccagaaaaacaugaaugcaggcagauu

SEQ ID NO: 651482 - RNA, 65 nt, hsa
cuggcacagggcugcauggaccucagggggcuguggggccagaagcugggccaagcccuccagcc

SEQ ID NO: 651483 - RNA, 65 nt, hsa
ggucucagggggaccccagggaugccccagaucaggggccagaggggaugcuuagcaaacccaau

SEQ ID NO: 651484 - RNA, 65 nt, hsa
acuccaggugcagggcgggccuccaggugcagggcgggccagaagcccccucaucggcccgcagc

SEQ ID NO: 651485 - RNA, 65 nt, hsa
uccccagagccuccgccuguggcugugaugaccuugggccagaaggucaaacuccgaagacugaa

SEQ ID NO: 651486 - RNA, 65 nt, hsa
gcauggguggucccugcuucgauggccccaaagcugggccagaguuaagggaaagaggaggaagu

SEQ ID NO: 651487 - RNA, 65 nt, hsa
ccgugggugaaguccuggggucagggggugggguggggccagaaggccugauagaagggucaggg

SEQ ID NO: 651488 - RNA, 65 nt, hsa
uuucaggcaucugagucggcguuuacccaggggccgggccagagacgggggucggccgcucgcuc

SEQ ID NO: 651489 - RNA, 65 nt, hsa
aacugucuuucuguagguugguuccuguauaccuugggccagagagcaaacauagguggccugag

SEQ ID NO: 651490 - RNA, 65 nt, hsa
cauaccaggagucacuggagaaaggggcugugcuggggccagacuggcacaaggcacucgugccc

SEQ ID NO: 651491 - RNA, 65 nt, hsa
agcagaggacuccagccuucucggggcccaggccugggccagaagcuguugaccauaccaggagu

SEQ ID NO: 651492 - RNA, 65 nt, hsa
uccccagggccuuuguggacuagccaaggcugugagggccagaauaaacaacugcucaacaaagg

SEQ ID NO: 651493 - RNA, 65 nt, hsa
cccggacacccauagacggugcggggggccuggcugggccagaccccaggaaggugggguagacu

SEQ ID NO: 651494 - RNA, 65 nt, hsa
ugugccuuugcugccccuuagguugggacuuaggugggccagaggggcuaggaucccaaaggacu

SEQ ID NO: 651495 - RNA, 65 nt, hsa
aacgcaggccuggggagcccccaguggcggggacagggccagauuucauguugacccuggggaug

SEQ ID NO: 651496 - RNA, 65 nt, hsa
agauguugaggcgagcagggcaggcccccggggaggggccagaguuuucuaugaaucuauuuuuc

SEQ ID NO: 651497 - RNA, 65 nt, hsa
ugcaucccaagccccucaugcuccugccuuccugagggccagaggggagccccaggacccauuaa

SEQ ID NO: 651498 - RNA, 65 nt, hsa
cucagcugcuucagggaaugugucccucccaccaugggccagagcuucagcccuucuuuagcuca

SEQ ID NO: 651499 - RNA, 65 nt, hsa
uggcccaggacgccugcugcaagcccacccagauggggccagagucuguguggacaaccgucccc

SEQ ID NO: 651500 - RNA, 65 nt, hsa
gggaaaugaguugagaccauggacuugggaguugggggccagaguugagccuggacuugaccaau

SEQ ID NO: 651501 - RNA, 65 nt, hsa
ggggagcagcuaugcaaaucccuaccuacccagcugggccagaggcacgaggcagccaggcaggg

SEQ ID NO: 651502 - RNA, 65 nt, hsa
acauguggaauaaaguaauagaguaacaaguggcagggccagaaccaggguccccaaaguccugg

SEQ ID NO: 651503 - RNA, 65 nt, hsa
agagagagcggaaggagcagcugaugcccagagcggggccagagcggcgggucuauguucacguc

SEQ ID NO: 651504 - RNA, 65 nt, hsa
uuggacugauucuccauuuuaucaccugaaggcuugggccagagcucaacagcuacucaacugga

SEQ ID NO: 651505 - RNA, 65 nt, hsa
agcauacuccaguuuacuaauacagcaggguaacugggccagauguucuuucuacagaagaauau

SEQ ID NO: 651506 - RNA, 58 nt, hsa
gccugacaggguaugugugaagaaccaggggccagagcugggggguggcugggucugu

SEQ ID NO: 651507 - RNA, 65 nt, hsa
acuuaaaucaggggucagcaaacuuuuucuguaaagggccagacgggaaauauuuugggcuuugc

SEQ ID NO: 651508 - RNA, 65 nt, hsa
gccuaaggacacacaaauuugguugggaguugauggggccagaugagccagcauuccagcucuuu

SEQ ID NO: 651509 - RNA, 65 nt, hsa
uucaaugaaauaaaaaugaacuuauuccccacucagggccagagaaagucagaacaaagaaaaug

SEQ ID NO: 651510 - RNA, 65 nt, hsa
gaccagcuauauccaggaucauuucucuuucuucagggccagacagcuuuuaauugaaauuguua

SEQ ID NO: 651511 - RNA, 65 nt, hsa
uaucaaaggaaaugagaaugacagccuuuuuuccugggccagaaguagaggggugggugcguaag

SEQ ID NO: 651512 - RNA, 65 nt, hsa
ucucuagccuggagaagagcaaaauggagggggaggggccagaaauaggaggagguuuugaagaa

SEQ ID NO: 651513 - RNA, 65 nt, hsa
gagugguugguaaaaucaauagauuucaggcaagagggccagauaccuaacagguuuuucuccgu

SEQ ID NO: 651514 - RNA, 65 nt, hsa
auggcaauguuuugcuuuugcucgaugcagacagggggccagaacaccacacauuucacugucug

SEQ ID NO: 651515 - RNA, 65 nt, hsa
uaccgacaagcacagucagguugaagaccuaaccagggccagaaguagcuuugcacuuuucuaaa

SEQ ID NO: 651516 - RNA, 67 nt, hsa
auucaccaagcauuuuaggauuugacuuuuucacuaaccaguugacgagcagugcauuuacaaggca

SEQ ID NO: 651517 - RNA, 67 nt, hsa
aauauuuguauagaauagaauuuauguaaacuaguaaccaguugaucucugugccaaauacauuaua

SEQ ID NO: 651518 - RNA, 67 nt, hsa
uguccuaauuccuuucucacucaccgaugcugaauacccaguugaaucaaacugucaaccuaccaaa

SEQ ID NO: 651519 - RNA, 67 nt, hsa
cgaaggucaacacacaauuccugcccuuaaggaauguccaguugaauuggagaguugaugacagaca

SEQ ID NO: 651520 - RNA, 67 nt, hsa
caaaccaggagcuacuacuguguaaauagguuacaccccaguugaaaucuuugcaaaggucgguucu

SEQ ID NO: 651521 - RNA, 67 nt, hsa
ucaggagcgagacuucaaggacucaguuugguuccacccaguugaaagacacccagugcacacccaa

SEQ ID NO: 651522 - RNA, 67 nt, hsa
uauugaguguuauggaggacacagagguagcagaaucccaguugaaaauguuuugauauuuuauugu

SEQ ID NO: 651523 - RNA, 67 nt, hsa
uuugcaaauucaaaauauaguuugguaauuuuuuuuuccaguugauuuuuaaaaagaacugcuguac

SEQ ID NO: 651524 - RNA, 67 nt, hsa
acccaugccagcucagaguuuagguguacacauuuacccaguugagcguucuuagaauaacuacugc

SEQ ID NO: 651525 - RNA, 67 nt, hsa
ccugccgcccgccaccggccgaccgaccgcggcugccccaguugaugagcggcguguccccucugca

SEQ ID NO: 651526 - RNA, 67 nt, hsa
caaugccuucugaccuucugaagcuuuccgaauccucccaguugaggcaguagcuguguccucugag

SEQ ID NO: 651527 - RNA, 67 nt, hsa
ggauucucccaucagccaucugguucuccucuuaaggccaguugaagauggucccuuacagcuuccc

SEQ ID NO: 651528 - RNA, 67 nt, hsa
gccuggacugacacccagugggaccaguguugccacaccaguugauaaaaugcagaaacccuucugu

SEQ ID NO: 651529 - RNA, 67 nt, hsa
accuuucugugcagugaagggaaagguuuaagagaauccaguugagaaaacaaacuugcuaaucacu

SEQ ID NO: 651530 - RNA, 67 nt, hsa
ucauucuuauaucuucauuaguucaucauaaaucuguccaguugaggccucaggaccacggcaugau

SEQ ID NO: 651531 - RNA, 67 nt, hsa
uccuaacaacauuuucgggggaucugaccuuuuuuuuccaguugaaauguauuaacacaccuuccac

SEQ ID NO: 651532 - RNA, 67 nt, hsa
auuugcauucggaaauccauguuguuucuaauauuguccaguugaaaacuguaugccaaaauuaguu

SEQ ID NO: 651533 - RNA, 67 nt, hsa
gaaaagugcccuuuccccuuaagagacaguuggaauaccaguugacuaauauuacaagcucuuguag

SEQ ID NO: 651534 - RNA, 59 nt, hsa
uugggcuggauucccucugauaagccuucccaguugacugaaagaugaggcuaggcucu

SEQ ID NO: 651535 - RNA, 67 nt, hsa
ccuggucaacaucaacaaccccucccucugaucauuuccaguugauugucauauccaggaaaaaaug

SEQ ID NO: 651536 - RNA, 67 nt, hsa
gauuggggccaaacauuuacaccuugcuucauaguaaccaguugagaugaagcacgucguuagaacg

SEQ ID NO: 651537 - RNA, 67 nt, hsa
acaaggaauuucugggauuacccagucccccuucaacccaguugauguaaccaccucauuuuuuaca

SEQ ID NO: 651538 - RNA, 67 nt, hsa
cuuuagaaagggagauuccaaacucccauuugguaaaccaguugauuauuuggaaauguucacugcc

SEQ ID NO: 651539 - RNA, 67 nt, hsa
gggaaaggaaagaauucacuagaaauuuguuuaggguccaguugauuuguguauuuuuguuaucauu

SEQ ID NO: 651540 - RNA, 67 nt, hsa
ucaggaagaaggcuuccuaggggacuggcgauuuaaaccaguugagaaacacugccaucagcaggca

SEQ ID NO: 651541 - RNA, 67 nt, hsa
accaguguuacccugagccccgcaggccaacccauccccaguugagccuuauagggucaguagcucu

SEQ ID NO: 651542 - RNA, 67 nt, hsa
aagaguuaucuuacguucugcuauauuuguauuugggccaguugauuguagguuguccaacauuuuu

SEQ ID NO: 651543 - RNA, 67 nt, hsa
uaguacauacucaguacucuccuucaauugcugaaccccaguugaccauuuuaccaagacuuuagau

SEQ ID NO: 651544 - RNA, 67 nt, hsa
guuuaauaguaagggagauaacacagcauguguagcaccaguugauaauuggucucuaguagcuuac

SEQ ID NO: 651545 - RNA, 67 nt, hsa
aauauauuugaauuucuguuuuagauuguaucgggucccaguugauucauguguacaaaguuaugcu

SEQ ID NO: 651546 - RNA, 67 nt, hsa
uagcgauuaccauaauuuugcucauugaaggcuaucuccaguugaucauugggaugagcaucuuugu

SEQ ID NO: 651547 - RNA, 67 nt, hsa
aacuaccuuguucgguugauacuuaguaacuccguggccaguugaagcgcuggauguuuccuagaac

SEQ ID NO: 651548 - RNA, 67 nt, hsa
cuuaccacgacguuucuguucuacacuuggguggagaccaguugaccauagagcauuugcagagccu

SEQ ID NO: 651549 - RNA, 67 nt, hsa
gaagucuggaaguauucugaaagcauccauuuaccguccaguugacagguuugagucuccugcuugu

SEQ ID NO: 651550 - RNA, 67 nt, hsa
uaaccaccuaccuuacagugagggcuauacaugguagccaguugaauuuauggaaucuaccaacugu

SEQ ID NO: 651551 - RNA, 67 nt, hsa
uuuaacuaaauuuuaaagccauucugauuauugaguuccaguugaaguuaguggaaaucugaacauu

SEQ ID NO: 651552 - RNA, 67 nt, hsa
uucacuaagaguaaacugggaaauuguaggccaaaguccaguugaacuuucuaagucugugaucccc

SEQ ID NO: 651553 - RNA, 67 nt, hsa
uuccucaaacacaaaucaguguucccacgaacaaguuccaguugagaaacacuaagguuauggugaa

SEQ ID NO: 651554 - RNA, 67 nt, hsa
cuucaguucuccagguccaccuggaaaguauaguuggccaguugagucucucaaaugaggggcuacu

SEQ ID NO: 651555 - RNA, 67 nt, hsa
agacucuuucaaaaaaaaaaaaaaaagccuacauucuccaguugauuauuucaacuaauguguauua

SEQ ID NO: 651556 - RNA, 67 nt, hsa
gggcaaccucuggcuacaggggccauugggugcccucccaguugagaggggccgcuguuucgccuug

SEQ ID NO: 651557 - RNA, 67 nt, hsa
uaccaauuuauuuuggccguggguuuuugcuuuuuuuccaguugaugacuuugugaacauucccagg

SEQ ID NO: 651558 - RNA, 67 nt, hsa
guuugcauguuuguuugcuuguugaauuuuugaacagccaguugaccaaucauagaaaguauuacuu

SEQ ID NO: 651559 - RNA, 67 nt, hsa
uuuguuuuuuauaguuuaaaauugauccuuugggaauccaguugaaguucccaaauacuuuauaaga

SEQ ID NO: 651560 - RNA, 67 nt, hsa
ucuuggauagauucuuuaaggcauuccacuuagcuugccaguugagacaaucaccacaguuauuacc

SEQ ID NO: 651561 - RNA, 67 nt, hsa
cauggcaucccagagcaaggacacaggagcccacaggccaguugagguugggcaaggagacuuccag

SEQ ID NO: 651562 - RNA, 67 nt, hsa
auguggccucaagugcacagacuagccuuagucaucuccaguugaggcuggguaugagggguacaga

SEQ ID NO: 651563 - RNA, 67 nt, hsa
uuccuaauuuuuucaaacuaauugcuuaaaucuagaaccaguugagauuaguacuguacaaugguau

SEQ ID NO: 651564 - RNA, 67 nt, hsa
cuacugcaacuaacuguugccccccaaccccgaacccccaguugaggaguugagagagugcaggcug

SEQ ID NO: 651565 - RNA, 67 nt, hsa
ggguggcuauccgccaggccuuccaccuuugcagggcccaguugauggccuuguuagcaugggcagc

SEQ ID NO: 651566 - RNA, 67 nt, hsa
uuuucucaaauaugccaucauaugggauggguagguuccaguugaaagagggugguagaaaucuauu

SEQ ID NO: 651567 - RNA, 67 nt, hsa
gccucacagaucuuugcaacacuccaaccagccaggaccaguugaucagaacugaucuuauuggucu

SEQ ID NO: 651568 - RNA, 67 nt, hsa
cccaaguagcugggauuacaggcgugcaccaccacgcccaguugauuuuuguauuuuugauagagac

SEQ ID NO: 651569 - RNA, 67 nt, hsa
aaugcagucaucccuuuucaggugggaagagagcaaaccaguugauuuuuuaauucauccuuaguac

SEQ ID NO: 651570 - RNA, 67 nt, hsa
augaguuaauuguuuuauuuuuaaacucuuuuuggguccaguugauuguacguagccacaggagccc

SEQ ID NO: 651571 - RNA, 67 nt, hsa
auuuccaaaugagggaaaaguccuuggcucguuugauccaguugaguugaaaggguugccuuggcag

SEQ ID NO: 651572 - RNA, 67 nt, hsa
caaaagaaaccauuagaaauuaauaacuguggcucuuccaguugaaauaggaauuggagagaaagga

SEQ ID NO: 651573 - RNA, 67 nt, hsa
gggagaggacauuaagugaaacaguugacagacaucaccaguugacuucugcauuaaccugcaugau

SEQ ID NO: 651574 - RNA, 67 nt, hsa
auuuuuuauauauauguuuuuauuuuuaaaaaacauaccaguugaaugggguuaaagcuuucaauau

SEQ ID NO: 651575 - RNA, 67 nt, hsa
ugaaugaagaauguuuguuuauauaucacuauaaaauccaguugaccuggacaguauuauauguaca

SEQ ID NO: 651576 - RNA, 67 nt, hsa
auucaggggugcacacaugggaccauguuagcugaugccaguugaaggccaggguauuugggaaggg

SEQ ID NO: 651577 - RNA, 67 nt, hsa
uauuacuaucccauuguaauuauuuauaacccucaagccaguugauuuuuaauauauuugauuggaa

SEQ ID NO: 651578 - RNA, 67 nt, hsa
uuaaaggcuaugauugucuuuguucuucuaccacccaccaguugaauuucaucaugcuuaaggccau

SEQ ID NO: 651579 - RNA, 67 nt, hsa
aauucaauuacgggaacuaccauaauuuaucuguucuccaguugaaggcaugaaguuguugccaguu

SEQ ID NO: 651580 - RNA, 67 nt, hsa
uggugaucagugcaauugaccuucucccucacuccugccaguugaaaauggauuuuuaaauuauacu

SEQ ID NO: 651581 - RNA, 67 nt, hsa
ucauccugcaacagaagcauucucuaggucccaguuuccaguugauugcauauccuugaucagcccu

SEQ ID NO: 651582 - RNA, 67 nt, hsa
ccuguuaaauuuuuaauggcuaauagcccagugccauccaguugaaaaaacaacagcaaucacaaag

SEQ ID NO: 651583 - RNA, 67 nt, hsa
cuauuaucugaccagcggaggcagaaaagagaggaacccaguugaauaggauccaaucccugguuag

SEQ ID NO: 651584 - RNA, 67 nt, hsa
cauucagaaaacuucaagacaucaccaucagcaggcuccaguugaacacuagucuguguaacuuuaa

SEQ ID NO: 651585 - RNA, 67 nt, hsa
cuauucuucugaccaucuagugacucaggauauuaggccaguugaaguggaguuauaggauuuucac

SEQ ID NO: 651586 - RNA, 67 nt, hsa
cuguggcaagcuauguccgcaguucccaggaauuuguccaguugauauuacccuaagccccuguguu

SEQ ID NO: 651587 - RNA, 67 nt, hsa
uuguauugucuuauuguauugucuuuucaaagugcugccaguugaaaagggaagcauuauguuuaca

SEQ ID NO: 651588 - RNA, 67 nt, hsa
cuaaauuugggaaacagaucuauucuaacucauuaacccaguugaaauuuaggucugucaucuuaau

SEQ ID NO: 651589 - RNA, 67 nt, hsa
gaggaacagcauagccaaggcuagcgaggcauacuuuccaguugaaaaaaaucaaaauuuuuugccu

SEQ ID NO: 651590 - RNA, 67 nt, hsa
gaggaucagagaccauguggaacauaaaugaaucaucccaguugagcccuguccgcagaucaaccag

SEQ ID NO: 651591 - RNA, 67 nt, hsa
ggagccccuccugcauccaccuaugccuccuauaaguccaguugaaaucucagccuccuucaacauu

SEQ ID NO: 651592 - RNA, 67 nt, hsa
auuuagauagaacuuuuuuuuggauacagcacaaacuccaguugacaguaaaaugaagcuucuaggu

SEQ ID NO: 651593 - RNA, 67 nt, hsa
acucccauucccccguccccaauguguuugugaguuuccaguugauuuguagcaaaugccuacuuag

SEQ ID NO: 651594 - RNA, 67 nt, hsa
aaccaaccauagaauguuucaguucuaggaaauaaaaccaguugauuaaagcaaauuuucuccggcc

SEQ ID NO: 651595 - RNA, 67 nt, hsa
acaaaacaugugcugacugcacucuggcgacccuuuuccaguugauguuuuuugucaugugacuguu

SEQ ID NO: 651596 - RNA, 67 nt, hsa
aaaaauaaguaacccaaugguagauaaaugaauucaaccaguugaucaaauggcagaaaagcaguua

SEQ ID NO: 651597 - RNA, 67 nt, hsa
aaagaacaaaacacaugcaucuaaacugcugggcaauccaguugacuuuuaaauguaagaauggaau

SEQ ID NO: 651598 - RNA, 67 nt, hsa
ccguuaagugaacuauuauaauauuuuugcugacuacccaguugaagaaaaguuuguuaauuggaug

SEQ ID NO: 651599 - RNA, 67 nt, hsa
aauaaaauaaauaacauaaaucguugaacauaauguuccaguugaaugcaaaacaaaaaaaauaugg

SEQ ID NO: 651600 - RNA, 67 nt, hsa
aauauuuauauuguauauaaaugguuggcagcuuauuccaguugaucucuucacaucugccuuaaaa

SEQ ID NO: 651601 - RNA, 67 nt, hsa
ggaggcagccagggcuuaccuguacacugacuugagaccaguugaauaaaagugcacaccuuaaaaa

SEQ ID NO: 651602 - RNA, 67 nt, hsa
acuguuucuuuugugagagacuaaacuuauuuuuaagccaguugauuuaggaugcucuauuacuaau

SEQ ID NO: 651603 - RNA, 67 nt, hsa
cuucaguccauccauguuagauggacagaaauuauggccaguugaaaauaccagcuuugguuggaca

SEQ ID NO: 651604 - RNA, 67 nt, hsa
aauuugagcacaguccagaaauggagacaucccacccccaguugaauaauggcccauucaugccaac

SEQ ID NO: 651605 - RNA, 67 nt, hsa
uucccagaguuuacucauucuuguuauuaaacucuagccaguugacaucuucgcaauuucaaggacu

SEQ ID NO: 651606 - RNA, 67 nt, hsa
uguucugacaguugugugguaacaagcuaauaugcuuccaguugacuuccagucuacccugguguua

SEQ ID NO: 651607 - RNA, 67 nt, hsa
cacaugugaauuuccacaccaaacagagcaugaggaaccaguugacaugcuggguugugacuggcag

SEQ ID NO: 651608 - RNA, 67 nt, hsa
aagagauucuguuuaggaagaaacucacucucuuuugccaguugaauuuauagagcauuuuuuuucu

SEQ ID NO: 651609 - RNA, 67 nt, hsa
cuuacugaugcacugggccuaucuuuuuguuuuccagccaguugaauagauuaguuuuucucaguaa

SEQ ID NO: 651610 - RNA, 67 nt, hsa
uccuguuccaccucagguuuucacaggugcucccaccccaguugaggcucccacccacagggcuguc

SEQ ID NO: 651611 - RNA, 67 nt, hsa
acuucaaaucucaaccugagccauccccaguucuuagccaguugagccagcgacaacagcaccagag

SEQ ID NO: 651612 - RNA, 67 nt, hsa
caaaaauggcaaacaucaccagcucccagauuuuggaccaguugaaagcuccgaguuugggccaguu

SEQ ID NO: 651613 - RNA, 67 nt, hsa
aauacacgcagcaaaauucuccucuucugugucuuucccaguugaacauuaugugagcaaaauuuaa

SEQ ID NO: 651614 - RNA, 67 nt, hsa
ucuugaaacugaccaaacgcuuauuguguaagauaaaccaguugaaucauugaggauccaaguugag

SEQ ID NO: 651615 - RNA, 67 nt, hsa
cuguacuuuguuuuucagguaaagaaggaaaauucagccaguugauuuuguuuuuagcuuacugcug

SEQ ID NO: 651616 - RNA, 67 nt, hsa
agaauccacaaauuaaacugaguccuucacuggcaugccaguugacuauuauuagcugucauaagua

SEQ ID NO: 651617 - RNA, 67 nt, hsa
uuacccuauacauccacaggguuuugacacuuguuguccaguugaaaaaagguuguguagcuguguc

SEQ ID NO: 651618 - RNA, 67 nt, hsa
caaugcuugaagaguuuuuggcaaguaaauuuuuuuuccaguugaacucugucacuuguuagagauu

SEQ ID NO: 651619 - RNA, 67 nt, hsa
agaucggggcgaccccugcagauguggagccauuagcccaguugaggauauucuccaaguuguccuc

SEQ ID NO: 651620 - RNA, 67 nt, hsa
ccaaaaugacguucuaaccugaagcugcuggcuguuuccaguugaacaacucaugaaaucugcucug

SEQ ID NO: 651621 - RNA, 67 nt, hsa
ggggcauauaaaaucucugcuguauccuuucggcuucccaguugagcucccaagaccaggacccacu

SEQ ID NO: 651622 - RNA, 67 nt, hsa
gggggccugcccuucucugcuguguccuuucggcuucccaguugagcucccaagaccaggacccacu

SEQ ID NO: 651623 - RNA, 67 nt, hsa
cuggacuuucacuaacccucugacauacuccccacacccaguugauggcuuuccguaauaaaaagau

SEQ ID NO: 651624 - RNA, 67 nt, hsa
aguuuuuuuggucuguucucccacuugauugaccucaccaguugagacaccuaguguauggcucaug

SEQ ID NO: 651625 - RNA, 67 nt, hsa
ucuaccuguuuuaguugugaagguaguuuuguguaauccaguugauugcuccucuggcagagagaag

SEQ ID NO: 651626 - RNA, 67 nt, hsa
aagacauaggaagacuuaauuuuuaaacggucaguguccaguugaaggcagaacacuaaucagauuu

SEQ ID NO: 651627 - RNA, 67 nt, hsa
aaauuuuuuucucaguuauugaacaagcaagcauuauccaguugaucuggcaaugacuuuuugugug

SEQ ID NO: 651628 - RNA, 67 nt, hsa
gaggugccuucucuguauuagacucacacacaucaguccaguugaagaauugguuuaaacuuuuaaa

SEQ ID NO: 651629 - RNA, 67 nt, hsa
uacuugugccagugacagaugcaguggucuccuuuccccaguugaagcagugcauacgcaguagcua

SEQ ID NO: 651630 - RNA, 67 nt, hsa
ccuaauacaauuagaaucucccucacucuauaguugcccaguugaaaggauaaggaggagggguggc

SEQ ID NO: 651631 - RNA, 67 nt, hsa
gacuuguuuguaaauuauccguuguuuuugcauaugcccaguugaugugauaaaauuuucauugucu

SEQ ID NO: 651632 - RNA, 67 nt, hsa
caggaaucagaggcagcuguuaccagguuucggccuuccaguugaucccuccacuguccaggcuguc

SEQ ID NO: 651633 - RNA, 67 nt, hsa
gcccugggccaucccugucuuccugucccuugucugcccaguugacaccuacuggugacuucuaggg

SEQ ID NO: 651634 - RNA, 67 nt, hsa
cuguccaugccagcauaguaguuguauggacuucuaaccaguugaguuuuuuaaagcauugaggauu

SEQ ID NO: 651635 - RNA, 67 nt, hsa
gucaucaucauuaucuuuuaacauuuugggggacuuuccaguugaaaagaaaacaugcuaugucauu

SEQ ID NO: 651636 - RNA, 67 nt, hsa
ggagcauuagagaaaagccuagacuuuuaguugauagccaguugaaauaucauugauagaauuuuag

SEQ ID NO: 651637 - RNA, 67 nt, hsa
cagggauuagagaaaagagcaggaguccugggucuucccaguugagacugcuggagcugagacacag

SEQ ID NO: 651638 - RNA, 67 nt, hsa
uuuuuuuuuuuuuaaauuugcuucaacaagcucuccaccaguugacuuucuuuggcuaauuuuacuu

SEQ ID NO: 651639 - RNA, 67 nt, hsa
uuuuaaaaguuuguuaaaauaugcuugacuagaguuuccaguugaaaggcaaaaacuuccaucacaa

SEQ ID NO: 651640 - RNA, 67 nt, hsa
aauaacuuguaaauggauaauuuuguucucuguaccaccaguugaaggggggguugacuuucgcaau

SEQ ID NO: 651641 - RNA, 67 nt, hsa
ucaacuguguguucgacagugaauauucaaucugguaccaguugaaauuuuugguuauaaauguaau

SEQ ID NO: 651642 - RNA, 67 nt, hsa
aaaugaaauucacacaacuauaccuuuuggggagguuccaguugauugaagugaguuggcugcauuu

SEQ ID NO: 651643 - RNA, 67 nt, hsa
ucuuuuuugaaaauaauuuaauauaccauguaauuuaccaguugaagauguucgcuuucagaauaua

SEQ ID NO: 651644 - RNA, 67 nt, hsa
aacucagaguuuuaauaaaggugugaggaggcuggggccaguugacaccagcaugcugccuuuuucu

SEQ ID NO: 651645 - RNA, 67 nt, hsa
uauugcugagcucaaauugaugugaaaugccaugguuccaguugaauuuuaagcauauuuucauuua

SEQ ID NO: 651646 - RNA, 67 nt, hsa
aacuucuaggccccugcccggggguucugcccacugcccaguugagcagagguuugagcccacaccu

SEQ ID NO: 651647 - RNA, 67 nt, hsa
ggaugugaucugguccccuuggaugccaggagagaauccaguugaacuugcuccuaaaugcucuuaa

SEQ ID NO: 651648 - RNA, 67 nt, hsa
cagcucacacagagucauccacacaaacccacggcucccaguugacagucaguggaaugcucgucuc

SEQ ID NO: 651649 - RNA, 67 nt, hsa
ucuacccagcaccaguagugccgaugugccacacugcccaguugaggccccucacgcucugugcccc

SEQ ID NO: 651650 - RNA, 67 nt, hsa
agaaagaaacugguggguuagggccuugguccaggagccaguugagccagggcagccacauccaggc

SEQ ID NO: 651651 - RNA, 67 nt, hsa
cugguucucuucugucuuguuugguaauaaacacauuccaguugaugccuugcagggcauucuucaa

SEQ ID NO: 651652 - RNA, 66 nt, hsa
uggaggugaugcugaagugagcagccccuccccacaccaguugaacugcaggaagagaggacccau

SEQ ID NO: 651653 - RNA, 67 nt, hsa
guuagugucacagccauuacagcacaagucaaagucgccaguugaauuuucauuaugcacgugugug

SEQ ID NO: 651654 - RNA, 67 nt, hsa
cauucuugaucuucagccuucguuugcaaggagaguuccaguugacgugguguuugguuccauggcg

SEQ ID NO: 651655 - RNA, 67 nt, hsa
aagaaacaauacaaagaauauauuuuuuuguuaaaaaccaguugauuuaaauaucuggucucucucu

SEQ ID NO: 651656 - RNA, 67 nt, hsa
cauucuugaucuucagccuucguuugcaagaagaguuccaguugaugugguguuugguuccauggcg

SEQ ID NO: 651657 - RNA, 67 nt, hsa
uccuugaagacuggaggguugagacccaggcccccugccaguugaagugagaguuuggugauacugu

SEQ ID NO: 651658 - RNA, 67 nt, hsa
auuuugcugaacacuuggguagugagugggauccuauccaguugaggaaugcuugcaaugcucauug

SEQ ID NO: 651659 - RNA, 67 nt, hsa
gcgguuucacgccccacacuuuguacagaccgagaggccaguugaucugcucuguuuuauacuagug

SEQ ID NO: 651660 - RNA, 67 nt, hsa
ccauggacaccuagccacccuguuguguguccuuaugccaguugagcugaaucuuuuccccaguaua

SEQ ID NO: 651661 - RNA, 67 nt, hsa
caccauuacucagacuucuaaagagacuauuugaaguccaguugagucacaagagaagccugucuug

SEQ ID NO: 651662 - RNA, 67 nt, hsa
guggagccggcaccucuggucuggauuccacuuaaaaccaguugaguggucucaagcccuuaaccuc

SEQ ID NO: 651663 - RNA, 67 nt, hsa
gcccuaacaagggcuccucccaccuccaccuguugccccaguugaaaagcauccauuaugagcugag

SEQ ID NO: 651664 - RNA, 67 nt, hsa
cacugcaggcuuuccugugguuggucagaaagauaagccaguugauaaugccaaauguaguaucaaa

SEQ ID NO: 651665 - RNA, 67 nt, hsa
aaaggccaagccaagccaugcuuggcagggugaggggccaguugaguucugggagcugggcacuacu

SEQ ID NO: 651666 - RNA, 67 nt, hsa
cuucccaaaccuuguuuugcaacaucccaaauugucuccaguugaaggaaggccuuuaucagauuca

SEQ ID NO: 651667 - RNA, 67 nt, hsa
ccaaaguuguaucacuguuaaacuucugaagacauaaccaguugagucuuauuucaagauauguucu

SEQ ID NO: 651668 - RNA, 67 nt, hsa
cauugcauggaaaagaccuauuuuauuucuagguucaccaguugagggacauuuggauuguucccac

SEQ ID NO: 651669 - RNA, 67 nt, hsa
aggcuuaaaauuacuuauacuuaugaaauaaacuuuaccaguugacuaaaauaaugcauguuaacag

SEQ ID NO: 651670 - RNA, 67 nt, hsa
aaucgcugaacucucaauauuguggggcauuuuccccccaguugauuaauuuugcguuaaagacuga

SEQ ID NO: 651671 - RNA, 67 nt, hsa
acuuugcaguugcagacgucugugccuagcaauauuuccaguugaccaaauauucuaaucuuuuuuc

SEQ ID NO: 651672 - RNA, 67 nt, hsa
uaugcaauaacugagcuugaugggggugggcagggggccaguugagccaagcccccagccccgaucu

SEQ ID NO: 651673 - RNA, 67 nt, hsa
ccacagguuuaagggcucauuccccaagucugcuccuccaguugagacacaagucacaaauccaggc

SEQ ID NO: 651674 - RNA, 58 nt, hsa
agaaacagccuaccucauagcucucaagccaguugaagaaaccuugccuuuucagcuu

SEQ ID NO: 651675 - RNA, 67 nt, hsa
ucugccagaauuggccuuucccagaugcugcaaacuuccaguugaaccccuuuuucuguguggcccc

SEQ ID NO: 651676 - RNA, 67 nt, hsa
ccacuugggaagcuaaggcucucaaaacgggcaucacccaguugacccaucucucagccucucugag

SEQ ID NO: 651677 - RNA, 67 nt, hsa
accagcuuuggggaggaggccgggaaucaaagcgaguccaguugaucuccccugacaaucuggaagg

SEQ ID NO: 651678 - RNA, 67 nt, hsa
uucacaagggaaagacacuuuugauauguagggauguccaguugauauaacagcucugaaggagauc

SEQ ID NO: 651679 - RNA, 67 nt, hsa
auggguaaggaccugaaagauccauggaaaaguuaacccaguugagauuuuuaaaaaguuuuacaaa

SEQ ID NO: 651680 - RNA, 67 nt, hsa
gugccugugucccuggcaguguccaguguguucacuuccaguugaaguauccauguguuucugggca

SEQ ID NO: 651681 - RNA, 67 nt, hsa
uuguaugaugcugaauuauuaugcagacuaauuccacccaguugagacacaccaugcuuguucacuu

SEQ ID NO: 651682 - RNA, 67 nt, hsa
gcaccugcugaccucagggucacaguugagucauuugccaguugacggagcaaguuugaccuugguu

SEQ ID NO: 651683 - RNA, 67 nt, hsa
agaaaagaggaacccaguggauguaacagaaccgacuccaguugaauguuuagauuuuugcuaaacu

SEQ ID NO: 651684 - RNA, 67 nt, hsa
ggaccgucauugagggguaacuccucccacaggaaccccaguugacaguuuaaaagcacuuucacac

SEQ ID NO: 651685 - RNA, 67 nt, hsa
aggcaaaaaugccccuucaucuuucucuauauauuuuccaguugaaaacaaacuaagaaguccuuua

SEQ ID NO: 651686 - RNA, 67 nt, hsa
uguggaauuuuacaccuggccugcguggcagccucuuccaguugagguguuuuaugucacgcacacu

SEQ ID NO: 651687 - RNA, 67 nt, hsa
cucaaccccugggguaucuaaucuugccaggucuuggccaguugagauucuguuccaccugccugcc

SEQ ID NO: 651688 - RNA, 67 nt, hsa
ucagagaaaagaggucaauguuuagggaacagagaugccaguugaggggagggcauuaccugggcua

SEQ ID NO: 651689 - RNA, 67 nt, hsa
cuuguuacaccuaguggaugcucuagauugguauagaccaguugacuucagcaucaguccaccucua

SEQ ID NO: 651690 - RNA, 67 nt, hsa
gggaaaggcuuggcacacagcaggcuuucaagaagugccaguugaucaaugaauaaauaaacgagcc

SEQ ID NO: 651691 - RNA, 67 nt, hsa
ucauaaugcccagugauuagugaguauuucccuuuugccaguugacaagauuuuuccacccucgagc

SEQ ID NO: 651692 - RNA, 67 nt, hsa
ucauuuaugcaugacauagguaaugugacuaauuucuccaguugauucaagaaacucauuacuuugc

SEQ ID NO: 651693 - RNA, 67 nt, hsa
gaaggcauaggcuuauucugacauaaaauuccacuggccaguugaauauauucuauuccauguccau

SEQ ID NO: 651694 - RNA, 67 nt, hsa
auguagccagggacuccccauagcaaagggucuguggccaguugacauccaggauggcugcaagcgc

SEQ ID NO: 651695 - RNA, 67 nt, hsa
gaauuauaaaugugguguuuggccugccucagcagcaccaguugacugcucgugugccagcggugug

SEQ ID NO: 651696 - RNA, 67 nt, hsa
uagucugaaauguaauaggaaagauaacgggaagaugccaguugacugaaaauucaaagccuuucaa

SEQ ID NO: 651697 - RNA, 67 nt, hsa
augggugacucagccuuaguuucuauucuuggaugucccaguugaaucagaaggggaccucuggagu

SEQ ID NO: 651698 - RNA, 67 nt, hsa
cauuuccugccccuuucgccacucacggaccuugaggccaguugacggcccuucuccccacgccugu

SEQ ID NO: 651699 - RNA, 67 nt, hsa
uggguaaccaucagaggaaaaagccaugcucagccuuccaguugaguggguaacgacugagucucca

SEQ ID NO: 651700 - RNA, 67 nt, hsa
gucugggguggucacucccgggguccacgucugggcuccaguugauccccugggugucugggaacug

SEQ ID NO: 651701 - RNA, 67 nt, hsa
ugguuaaguauagggucaccagagaaaguuccuuuccccaguugaugucuugaggcuguugagaaac

SEQ ID NO: 651702 - RNA, 67 nt, hsa
uguugaaacugacuugcugugacuuaugugcagcuuuccaguugagcagaggaaaauaguggcagga

SEQ ID NO: 651703 - RNA, 67 nt, hsa
aucacauggagcaguaauggagcaaagaccagccaucccaguugagauacccuacaccaaccagauu

SEQ ID NO: 651704 - RNA, 67 nt, hsa
agucacuccauuguguggauuuacuacuguuuguuccccaguugaaggauguuuaggaucuuugcag

SEQ ID NO: 651705 - RNA, 67 nt, hsa
aagccauuuuggaaauucacgaaaguacugcuccaccccaguugaguuauuuagaauuuuaucucaa

SEQ ID NO: 651706 - RNA, 67 nt, hsa
cuuugguucauaaauauggcucuugaacccauagaccccaguugaagauggaauuuucaggaaaggg

SEQ ID NO: 651707 - RNA, 67 nt, hsa
agauagcuuaugucuaaaacaguggugaugaguaaggccaguugagcauugcuuacuuaugguuaaa

SEQ ID NO: 651708 - RNA, 67 nt, hsa
uaccugaacugagucuugagggacggguaggaauuagccaguugaggaaguagaaggaauuuccaga

SEQ ID NO: 651709 - RNA, 67 nt, hsa
uucauccugcacagggaaauggcuaccuauuaaagucccaguugaaauuuuuugaaaaaauacaccu

SEQ ID NO: 651710 - RNA, 64 nt, hsa
auggacauuuagaagaaagauguuuggcguagcagaguuaaaucucaaauaggcuauuaaaaaa

SEQ ID NO: 651711 - RNA, 64 nt, hsa
gcaucuugguuauuucugaagguagcauucuuuggaguuaaaaugcacauauagacacauacac

SEQ ID NO: 651712 - RNA, 64 nt, hsa
uguuuuuaaagcaauuauuguaguaauuucauuugaguuaaauuuacaugcucggucacucauu

SEQ ID NO: 651713 - RNA, 64 nt, hsa
ugggaaacacuuuauguagggugggaggacaggggaguuaaauggcugggcaggugccacagga

SEQ ID NO: 651714 - RNA, 64 nt, hsa
uuaaauauuuucuuugccuaaauacaugugagaggaguuaaauauaaauguacagagaggaaag

SEQ ID NO: 651715 - RNA, 64 nt, hsa
cauagugguagguuugcccuuugguacagaaggugaguuaaagcugguggaaaaggcuuauugc

SEQ ID NO: 651716 - RNA, 64 nt, hsa
uauggcuucgucaagggaggugaacauuguugcugaguuaaauuccagggucucagaugguuag

SEQ ID NO: 651717 - RNA, 64 nt, hsa
cagaaaacucagcucaggcacaauugucaccaaggaguuaaaagcuucuucuucaauagaggaa

SEQ ID NO: 651718 - RNA, 64 nt, hsa
gcaaugauuacuguguugcuaacucauuuucuuugaguuaaagcuguguauacauuuuaaaagg

SEQ ID NO: 651719 - RNA, 64 nt, hsa
guuuguuuuccuaccuuaugcugaguaguccagagaguuaaaaaaauucucugcauguuggucu

SEQ ID NO: 651720 - RNA, 64 nt, hsa
ggaagugaguuaaaaacaauaaaagcccuuucuugaguuaaaaagaaaaaaaaaagguuugugc

SEQ ID NO: 651721 - RNA, 64 nt, hsa
uaagaguguuuuaaaaauuaacuucccaggaagugaguuaaaaacaauaaaagcccuuucuuga

SEQ ID NO: 651722 - RNA, 64 nt, hsa; identical to SEQ ID NO: 196427

SEQ ID NO: 651723 - RNA, 64 nt, hsa; identical to SEQ ID NO: 196428

SEQ ID NO: 651724 - RNA, 64 nt, hsa; identical to SEQ ID NO: 196429

SEQ ID NO: 651725 - RNA, 64 nt, hsa; identical to SEQ ID NO: 196430

SEQ ID NO: 651726 - RNA, 64 nt, hsa; identical to SEQ ID NO: 196431

SEQ ID NO: 651727 - RNA, 64 nt, hsa; identical to SEQ ID NO: 196432

SEQ ID NO: 651728 - RNA, 64 nt, hsa; identical to SEQ ID NO: 196433

SEQ ID NO: 651729 - RNA, 64 nt, hsa; identical to SEQ ID NO: 196434

SEQ ID NO: 651730 - RNA, 64 nt, hsa; identical to SEQ ID NO: 196435

SEQ ID NO: 651731 - RNA, 64 nt, hsa; identical to SEQ ID NO: 196436

SEQ ID NO: 651732 - RNA, 64 nt, hsa; identical to SEQ ID NO: 196437

SEQ ID NO: 651733 - RNA, 64 nt, hsa; identical to SEQ ID NO: 196438

SEQ ID NO: 651734 - RNA, 64 nt, hsa; identical to SEQ ID NO: 196439

SEQ ID NO: 651735 - RNA, 64 nt, hsa; identical to SEQ ID NO: 196440

SEQ ID NO: 651736 - RNA, 64 nt, hsa; identical to SEQ ID NO: 196441

SEQ ID NO: 651737 - RNA, 57 nt, hsa; identical to SEQ ID NO: 196442

SEQ ID NO: 651738 - RNA, 64 nt, hsa; identical to SEQ ID NO: 196443

SEQ ID NO: 651739 - RNA, 64 nt, hsa; identical to SEQ ID NO: 196444

SEQ ID NO: 651740 - RNA, 64 nt, hsa; identical to SEQ ID NO: 196445

SEQ ID NO: 651741 - RNA, 64 nt, hsa; identical to SEQ ID NO: 196446

SEQ ID NO: 651742 - RNA, 64 nt, hsa; identical to SEQ ID NO: 196447

SEQ ID NO: 651743 - RNA, 64 nt, hsa; identical to SEQ ID NO: 651710

SEQ ID NO: 651744 - RNA, 64 nt, hsa; identical to SEQ ID NO: 651711

SEQ ID NO: 651745 - RNA, 64 nt, hsa; identical to SEQ ID NO: 651712

SEQ ID NO: 651746 - RNA, 64 nt, hsa; identical to SEQ ID NO: 651713

SEQ ID NO: 651747 - RNA, 64 nt, hsa; identical to SEQ ID NO: 651714

SEQ ID NO: 651748 - RNA, 64 nt, hsa; identical to SEQ ID NO: 651715

SEQ ID NO: 651749 - RNA, 64 nt, hsa; identical to SEQ ID NO: 651716

SEQ ID NO: 651750 - RNA, 64 nt, hsa; identical to SEQ ID NO: 651717

SEQ ID NO: 651751 - RNA, 64 nt, hsa; identical to SEQ ID NO: 651718

SEQ ID NO: 651752 - RNA, 64 nt, hsa; identical to SEQ ID NO: 651719

SEQ ID NO: 651753 - RNA, 64 nt, hsa; identical to SEQ ID NO: 651720

SEQ ID NO: 651754 - RNA, 64 nt, hsa; identical to SEQ ID NO: 651721

SEQ ID NO: 651755 - RNA, 64 nt, hsa; identical to SEQ ID NO: 196427

SEQ ID NO: 651756 - RNA, 64 nt, hsa; identical to SEQ ID NO: 196428

SEQ ID NO: 651757 - RNA, 64 nt, hsa; identical to SEQ ID NO: 196429

SEQ ID NO: 651758 - RNA, 64 nt, hsa; identical to SEQ ID NO: 196430

SEQ ID NO: 651759 - RNA, 64 nt, hsa; identical to SEQ ID NO: 196431

SEQ ID NO: 651760 - RNA, 64 nt, hsa; identical to SEQ ID NO: 196432

SEQ ID NO: 651761 - RNA, 64 nt, hsa; identical to SEQ ID NO: 196433

SEQ ID NO: 651762 - RNA, 64 nt, hsa; identical to SEQ ID NO: 196434

SEQ ID NO: 651763 - RNA, 64 nt, hsa; identical to SEQ ID NO: 196435

SEQ ID NO: 651764 - RNA, 64 nt, hsa; identical to SEQ ID NO: 196436

SEQ ID NO: 651765 - RNA, 64 nt, hsa; identical to SEQ ID NO: 196437

SEQ ID NO: 651766 - RNA, 64 nt, hsa; identical to SEQ ID NO: 196438

SEQ ID NO: 651767 - RNA, 64 nt, hsa; identical to SEQ ID NO: 196439

SEQ ID NO: 651768 - RNA, 64 nt, hsa; identical to SEQ ID NO: 196440

SEQ ID NO: 651769 - RNA, 64 nt, hsa; identical to SEQ ID NO: 196441

SEQ ID NO: 651770 - RNA, 57 nt, hsa; identical to SEQ ID NO: 196442

SEQ ID NO: 651771 - RNA, 64 nt, hsa; identical to SEQ ID NO: 196443

SEQ ID NO: 651772 - RNA, 64 nt, hsa; identical to SEQ ID NO: 196444

SEQ ID NO: 651773 - RNA, 64 nt, hsa; identical to SEQ ID NO: 196445

SEQ ID NO: 651774 - RNA, 64 nt, hsa; identical to SEQ ID NO: 196446

SEQ ID NO: 651775 - RNA, 64 nt, hsa; identical to SEQ ID NO: 196447

SEQ ID NO: 651776 - RNA, 64 nt, hsa; identical to SEQ ID NO: 57592

SEQ ID NO: 651777 - RNA, 64 nt, hsa; identical to SEQ ID NO: 57593

SEQ ID NO: 651778 - RNA, 64 nt, hsa; identical to SEQ ID NO: 57594

SEQ ID NO: 651779 - RNA, 64 nt, hsa; identical to SEQ ID NO: 57595

SEQ ID NO: 651780 - RNA, 64 nt, hsa; identical to SEQ ID NO: 57596

SEQ ID NO: 651781 - RNA, 64 nt, hsa; identical to SEQ ID NO: 57597

SEQ ID NO: 651782 - RNA, 64 nt, hsa; identical to SEQ ID NO: 57598

SEQ ID NO: 651783 - RNA, 64 nt, hsa; identical to SEQ ID NO: 57599

SEQ ID NO: 651784 - RNA, 64 nt, hsa; identical to SEQ ID NO: 57600

SEQ ID NO: 651785 - RNA, 64 nt, hsa; identical to SEQ ID NO: 57601

SEQ ID NO: 651786 - RNA, 64 nt, hsa; identical to SEQ ID NO: 57602

SEQ ID NO: 651787 - RNA, 64 nt, hsa; identical to SEQ ID NO: 108382

SEQ ID NO: 651788 - RNA, 64 nt, hsa; identical to SEQ ID NO: 108383

SEQ ID NO: 651789 - RNA, 64 nt, hsa; identical to SEQ ID NO: 108384

SEQ ID NO: 651790 - RNA, 64 nt, hsa; identical to SEQ ID NO: 108385

SEQ ID NO: 651791 - RNA, 64 nt, hsa; identical to SEQ ID NO: 108386

SEQ ID NO: 651792 - RNA, 64 nt, hsa; identical to SEQ ID NO: 108387

SEQ ID NO: 651793 - RNA, 64 nt, hsa; identical to SEQ ID NO: 108388

SEQ ID NO: 651794 - RNA, 64 nt, hsa; identical to SEQ ID NO: 108389

SEQ ID NO: 651795 - RNA, 64 nt, hsa; identical to SEQ ID NO: 108390

SEQ ID NO: 651796 - RNA, 64 nt, hsa; identical to SEQ ID NO: 108391

SEQ ID NO: 651797 - RNA, 64 nt, hsa; identical to SEQ ID NO: 108392

SEQ ID NO: 651798 - RNA, 64 nt, hsa; identical to SEQ ID NO: 108393

SEQ ID NO: 651799 - RNA, 64 nt, hsa; identical to SEQ ID NO: 108394

SEQ ID NO: 651800 - RNA, 64 nt, hsa; identical to SEQ ID NO: 108395

SEQ ID NO: 651801 - RNA, 64 nt, hsa; identical to SEQ ID NO: 370058

SEQ ID NO: 651802 - RNA, 64 nt, hsa; identical to SEQ ID NO: 370059

SEQ ID NO: 651803 - RNA, 64 nt, hsa; identical to SEQ ID NO: 370060

SEQ ID NO: 651804 - RNA, 64 nt, hsa; identical to SEQ ID NO: 370061

SEQ ID NO: 651805 - RNA, 64 nt, hsa; identical to SEQ ID NO: 370062

SEQ ID NO: 651806 - RNA, 64 nt, hsa; identical to SEQ ID NO: 370063

SEQ ID NO: 651807 - RNA, 64 nt, hsa; identical to SEQ ID NO: 78101

SEQ ID NO: 651808 - RNA, 62 nt, hsa; identical to SEQ ID NO: 78102

SEQ ID NO: 651809 - RNA, 64 nt, hsa; identical to SEQ ID NO: 78103

SEQ ID NO: 651810 - RNA, 55 nt, hsa; identical to SEQ ID NO: 78104

SEQ ID NO: 651811 - RNA, 64 nt, hsa; identical to SEQ ID NO: 78105

SEQ ID NO: 651812 - RNA, 64 nt, hsa; identical to SEQ ID NO: 78106

SEQ ID NO: 651813 - RNA, 64 nt, hsa; identical to SEQ ID NO: 78107

SEQ ID NO: 651814 - RNA, 64 nt, hsa; identical to SEQ ID NO: 78108

SEQ ID NO: 651815 - RNA, 64 nt, hsa; identical to SEQ ID NO: 78109

SEQ ID NO: 651816 - RNA, 64 nt, hsa; identical to SEQ ID NO: 78110

SEQ ID NO: 651817 - RNA, 64 nt, hsa; identical to SEQ ID NO: 78111

SEQ ID NO: 651818 - RNA, 64 nt, hsa; identical to SEQ ID NO: 78112

SEQ ID NO: 651819 - RNA, 64 nt, hsa; identical to SEQ ID NO: 78113

SEQ ID NO: 651820 - RNA, 64 nt, hsa; identical to SEQ ID NO: 78114

SEQ ID NO: 651821 - RNA, 64 nt, hsa; identical to SEQ ID NO: 78115

SEQ ID NO: 651822 - RNA, 64 nt, hsa; identical to SEQ ID NO: 78116

SEQ ID NO: 651823 - RNA, 64 nt, hsa; identical to SEQ ID NO: 78117

SEQ ID NO: 651824 - RNA, 64 nt, hsa; identical to SEQ ID NO: 78118

SEQ ID NO: 651825 - RNA, 64 nt, hsa; identical to SEQ ID NO: 78119

SEQ ID NO: 651826 - RNA, 64 nt, hsa; identical to SEQ ID NO: 78120

SEQ ID NO: 651827 - RNA, 64 nt, hsa; identical to SEQ ID NO: 78121

SEQ ID NO: 651828 - RNA, 64 nt, hsa; identical to SEQ ID NO: 78122

SEQ ID NO: 651829 - RNA, 64 nt, hsa; identical to SEQ ID NO: 78123

SEQ ID NO: 651830 - RNA, 64 nt, hsa; identical to SEQ ID NO: 78124

SEQ ID NO: 651831 - RNA, 64 nt, hsa; identical to SEQ ID NO: 78125

SEQ ID NO: 651832 - RNA, 64 nt, hsa; identical to SEQ ID NO: 78126

SEQ ID NO: 651833 - RNA, 64 nt, hsa; identical to SEQ ID NO: 78127

SEQ ID NO: 651834 - RNA, 64 nt, hsa; identical to SEQ ID NO: 78128

SEQ ID NO: 651835 - RNA, 64 nt, hsa; identical to SEQ ID NO: 78129

SEQ ID NO: 651836 - RNA, 64 nt, hsa; identical to SEQ ID NO: 78130

SEQ ID NO: 651837 - RNA, 64 nt, hsa; identical to SEQ ID NO: 78131

SEQ ID NO: 651838 - RNA, 64 nt, hsa; identical to SEQ ID NO: 78132

SEQ ID NO: 651839 - RNA, 64 nt, hsa; identical to SEQ ID NO: 78133

SEQ ID NO: 651840 - RNA, 64 nt, hsa; identical to SEQ ID NO: 78134

SEQ ID NO: 651841 - RNA, 64 nt, hsa; identical to SEQ ID NO: 78135

SEQ ID NO: 651842 - RNA, 64 nt, hsa; identical to SEQ ID NO: 78136

SEQ ID NO: 651843 - RNA, 64 nt, hsa; identical to SEQ ID NO: 78137

SEQ ID NO: 651844 - RNA, 64 nt, hsa; identical to SEQ ID NO: 78138

SEQ ID NO: 651845 - RNA, 64 nt, hsa; identical to SEQ ID NO: 78139

SEQ ID NO: 651846 - RNA, 64 nt, hsa; identical to SEQ ID NO: 78140

SEQ ID NO: 651847 - RNA, 64 nt, hsa; identical to SEQ ID NO: 78141

SEQ ID NO: 651848 - RNA, 64 nt, hsa; identical to SEQ ID NO: 78142

SEQ ID NO: 651849 - RNA, 64 nt, hsa; identical to SEQ ID NO: 78143

SEQ ID NO: 651850 - RNA, 64 nt, hsa; identical to SEQ ID NO: 78144

SEQ ID NO: 651851 - RNA, 64 nt, hsa; identical to SEQ ID NO: 78145

SEQ ID NO: 651852 - RNA, 64 nt, hsa; identical to SEQ ID NO: 78146

SEQ ID NO: 651853 - RNA, 64 nt, hsa; identical to SEQ ID NO: 78147

SEQ ID NO: 651854 - RNA, 64 nt, hsa; identical to SEQ ID NO: 78148

SEQ ID NO: 651855 - RNA, 64 nt, hsa; identical to SEQ ID NO: 78149

SEQ ID NO: 651856 - RNA, 64 nt, hsa; identical to SEQ ID NO: 78150

SEQ ID NO: 651857 - RNA, 64 nt, hsa; identical to SEQ ID NO: 78151

SEQ ID NO: 651858 - RNA, 64 nt, hsa; identical to SEQ ID NO: 78152

SEQ ID NO: 651859 - RNA, 64 nt, hsa; identical to SEQ ID NO: 78153

SEQ ID NO: 651860 - RNA, 64 nt, hsa; identical to SEQ ID NO: 78154

SEQ ID NO: 651861 - RNA, 64 nt, hsa; identical to SEQ ID NO: 78155

SEQ ID NO: 651862 - RNA, 64 nt, hsa; identical to SEQ ID NO: 78156

SEQ ID NO: 651863 - RNA, 64 nt, hsa; identical to SEQ ID NO: 78157

SEQ ID NO: 651864 - RNA, 64 nt, hsa; identical to SEQ ID NO: 78158

SEQ ID NO: 651865 - RNA, 64 nt, hsa; identical to SEQ ID NO: 78159

SEQ ID NO: 651866 - RNA, 64 nt, hsa; identical to SEQ ID NO: 78160

SEQ ID NO: 651867 - RNA, 64 nt, hsa; identical to SEQ ID NO: 78161

SEQ ID NO: 651868 - RNA, 64 nt, hsa; identical to SEQ ID NO: 78162

SEQ ID NO: 651869 - RNA, 64 nt, hsa; identical to SEQ ID NO: 78163

SEQ ID NO: 651870 - RNA, 64 nt, hsa; identical to SEQ ID NO: 78164

SEQ ID NO: 651871 - RNA, 64 nt, hsa; identical to SEQ ID NO: 78165

SEQ ID NO: 651872 - RNA, 64 nt, hsa; identical to SEQ ID NO: 78166

SEQ ID NO: 651873 - RNA, 64 nt, hsa; identical to SEQ ID NO: 78167

SEQ ID NO: 651874 - RNA, 64 nt, hsa; identical to SEQ ID NO: 78168

SEQ ID NO: 651875 - RNA, 64 nt, hsa; identical to SEQ ID NO: 78169

SEQ ID NO: 651876 - RNA, 64 nt, hsa; identical to SEQ ID NO: 78170

SEQ ID NO: 651877 - RNA, 64 nt, hsa; identical to SEQ ID NO: 78171

SEQ ID NO: 651878 - RNA, 64 nt, hsa; identical to SEQ ID NO: 78172

SEQ ID NO: 651879 - RNA, 64 nt, hsa; identical to SEQ ID NO: 78173

SEQ ID NO: 651880 - RNA, 64 nt, hsa; identical to SEQ ID NO: 78174

SEQ ID NO: 651881 - RNA, 64 nt, hsa; identical to SEQ ID NO: 78175

SEQ ID NO: 651882 - RNA, 64 nt, hsa; identical to SEQ ID NO: 78176

SEQ ID NO: 651883 - RNA, 64 nt, hsa; identical to SEQ ID NO: 78177

SEQ ID NO: 651884 - RNA, 64 nt, hsa; identical to SEQ ID NO: 78178

SEQ ID NO: 651885 - RNA, 64 nt, hsa; identical to SEQ ID NO: 78179

SEQ ID NO: 651886 - RNA, 64 nt, hsa; identical to SEQ ID NO: 78180

SEQ ID NO: 651887 - RNA, 64 nt, hsa; identical to SEQ ID NO: 78181

SEQ ID NO: 651888 - RNA, 64 nt, hsa; identical to SEQ ID NO: 78182

SEQ ID NO: 651889 - RNA, 64 nt, hsa; identical to SEQ ID NO: 78183

SEQ ID NO: 651890 - RNA, 64 nt, hsa; identical to SEQ ID NO: 78184

SEQ ID NO: 651891 - RNA, 64 nt, hsa; identical to SEQ ID NO: 78185

SEQ ID NO: 651892 - RNA, 64 nt, hsa; identical to SEQ ID NO: 78186

SEQ ID NO: 651893 - RNA, 64 nt, hsa; identical to SEQ ID NO: 78187

SEQ ID NO: 651894 - RNA, 64 nt, hsa; identical to SEQ ID NO: 78188

SEQ ID NO: 651895 - RNA, 64 nt, hsa; identical to SEQ ID NO: 78189

SEQ ID NO: 651896 - RNA, 64 nt, hsa; identical to SEQ ID NO: 78190

SEQ ID NO: 651897 - RNA, 64 nt, hsa; identical to SEQ ID NO: 78191

SEQ ID NO: 651898 - RNA, 64 nt, hsa; identical to SEQ ID NO: 78192

SEQ ID NO: 651899 - RNA, 64 nt, hsa; identical to SEQ ID NO: 78193

SEQ ID NO: 651900 - RNA, 64 nt, hsa; identical to SEQ ID NO: 78194

SEQ ID NO: 651901 - RNA, 64 nt, hsa; identical to SEQ ID NO: 78195

SEQ ID NO: 651902 - RNA, 64 nt, hsa; identical to SEQ ID NO: 78196

SEQ ID NO: 651903 - RNA, 64 nt, hsa; identical to SEQ ID NO: 78197

SEQ ID NO: 651904 - RNA, 64 nt, hsa; identical to SEQ ID NO: 78198

SEQ ID NO: 651905 - RNA, 64 nt, hsa; identical to SEQ ID NO: 78199

SEQ ID NO: 651906 - RNA, 64 nt, hsa; identical to SEQ ID NO: 78200

SEQ ID NO: 651907 - RNA, 64 nt, hsa; identical to SEQ ID NO: 78201

SEQ ID NO: 651908 - RNA, 64 nt, hsa; identical to SEQ ID NO: 78202

SEQ ID NO: 651909 - RNA, 64 nt, hsa; identical to SEQ ID NO: 78203

SEQ ID NO: 651910 - RNA, 64 nt, hsa; identical to SEQ ID NO: 78204

SEQ ID NO: 651911 - RNA, 64 nt, hsa; identical to SEQ ID NO: 78205

SEQ ID NO: 651912 - RNA, 64 nt, hsa; identical to SEQ ID NO: 78206

SEQ ID NO: 651913 - RNA, 64 nt, hsa; identical to SEQ ID NO: 78207

SEQ ID NO: 651914 - RNA, 64 nt, hsa; identical to SEQ ID NO: 78208

SEQ ID NO: 651915 - RNA, 64 nt, hsa; identical to SEQ ID NO: 78209

SEQ ID NO: 651916 - RNA, 64 nt, hsa; identical to SEQ ID NO: 78210

SEQ ID NO: 651917 - RNA, 64 nt, hsa; identical to SEQ ID NO: 78211

SEQ ID NO: 651918 - RNA, 64 nt, hsa; identical to SEQ ID NO: 78212

SEQ ID NO: 651919 - RNA, 64 nt, hsa; identical to SEQ ID NO: 78213

SEQ ID NO: 651920 - RNA, 64 nt, hsa; identical to SEQ ID NO: 78214

SEQ ID NO: 651921 - RNA, 64 nt, hsa; identical to SEQ ID NO: 78215

SEQ ID NO: 651922 - RNA, 64 nt, hsa; identical to SEQ ID NO: 78216

SEQ ID NO: 651923 - RNA, 64 nt, hsa; identical to SEQ ID NO: 78217

SEQ ID NO: 651924 - RNA, 64 nt, hsa; identical to SEQ ID NO: 78218

SEQ ID NO: 651925 - RNA, 64 nt, hsa; identical to SEQ ID NO: 465655

SEQ ID NO: 651926 - RNA, 64 nt, hsa; identical to SEQ ID NO: 465656

SEQ ID NO: 651927 - RNA, 64 nt, hsa; identical to SEQ ID NO: 465657

SEQ ID NO: 651928 - RNA, 64 nt, hsa; identical to SEQ ID NO: 465658

SEQ ID NO: 651929 - RNA, 64 nt, hsa; identical to SEQ ID NO: 61300

SEQ ID NO: 651930 - RNA, 64 nt, hsa; identical to SEQ ID NO: 61301

SEQ ID NO: 651931 - RNA, 64 nt, hsa; identical to SEQ ID NO: 61302

SEQ ID NO: 651932 - RNA, 64 nt, hsa; identical to SEQ ID NO: 61303

SEQ ID NO: 651933 - RNA, 64 nt, hsa; identical to SEQ ID NO: 61304

SEQ ID NO: 651934 - RNA, 64 nt, hsa; identical to SEQ ID NO: 61305

SEQ ID NO: 651935 - RNA, 64 nt, hsa; identical to SEQ ID NO: 61306

SEQ ID NO: 651936 - RNA, 64 nt, hsa; identical to SEQ ID NO: 61307

SEQ ID NO: 651937 - RNA, 64 nt, hsa; identical to SEQ ID NO: 61308

SEQ ID NO: 651938 - RNA, 64 nt, hsa; identical to SEQ ID NO: 61309

SEQ ID NO: 651939 - RNA, 64 nt, hsa; identical to SEQ ID NO: 61310

SEQ ID NO: 651940 - RNA, 56 nt, hsa; identical to SEQ ID NO: 61311

SEQ ID NO: 651941 - RNA, 64 nt, hsa; identical to SEQ ID NO: 61312

SEQ ID NO: 651942 - RNA, 64 nt, hsa; identical to SEQ ID NO: 61313

SEQ ID NO: 651943 - RNA, 64 nt, hsa; identical to SEQ ID NO: 61314

SEQ ID NO: 651944 - RNA, 64 nt, hsa; identical to SEQ ID NO: 61315

SEQ ID NO: 651945 - RNA, 64 nt, hsa; identical to SEQ ID NO: 61316

SEQ ID NO: 651946 - RNA, 64 nt, hsa; identical to SEQ ID NO: 61317

SEQ ID NO: 651947 - RNA, 64 nt, hsa; identical to SEQ ID NO: 380102

SEQ ID NO: 651948 - RNA, 64 nt, hsa; identical to SEQ ID NO: 380103

SEQ ID NO: 651949 - RNA, 64 nt, hsa; identical to SEQ ID NO: 380104

SEQ ID NO: 651950 - RNA, 64 nt, hsa; identical to SEQ ID NO: 380105

SEQ ID NO: 651951 - RNA, 64 nt, hsa; identical to SEQ ID NO: 380106

SEQ ID NO: 651952 - RNA, 64 nt, hsa; identical to SEQ ID NO: 380107

SEQ ID NO: 651953 - RNA, 64 nt, hsa; identical to SEQ ID NO: 380108

SEQ ID NO: 651954 - RNA, 64 nt, hsa; identical to SEQ ID NO: 380109

SEQ ID NO: 651955 - RNA, 64 nt, hsa; identical to SEQ ID NO: 380110

SEQ ID NO: 651956 - RNA, 64 nt, hsa; identical to SEQ ID NO: 380111

SEQ ID NO: 651957 - RNA, 64 nt, hsa; identical to SEQ ID NO: 380112

SEQ ID NO: 651958 - RNA, 64 nt, hsa; identical to SEQ ID NO: 380113

SEQ ID NO: 651959 - RNA, 64 nt, hsa; identical to SEQ ID NO: 380114

SEQ ID NO: 651960 - RNA, 64 nt, hsa; identical to SEQ ID NO: 380115

SEQ ID NO: 651961 - RNA, 58 nt, hsa; identical to SEQ ID NO: 380116

SEQ ID NO: 651962 - RNA, 64 nt, hsa; identical to SEQ ID NO: 380117

SEQ ID NO: 651963 - RNA, 64 nt, hsa; identical to SEQ ID NO: 380118

SEQ ID NO: 651964 - RNA, 64 nt, hsa; identical to SEQ ID NO: 380119

SEQ ID NO: 651965 - RNA, 64 nt, hsa; identical to SEQ ID NO: 380120

SEQ ID NO: 651966 - RNA, 64 nt, hsa; identical to SEQ ID NO: 380121

SEQ ID NO: 651967 - RNA, 64 nt, hsa; identical to SEQ ID NO: 380122

SEQ ID NO: 651968 - RNA, 64 nt, hsa; identical to SEQ ID NO: 380123

SEQ ID NO: 651969 - RNA, 64 nt, hsa; identical to SEQ ID NO: 380124

SEQ ID NO: 651970 - RNA, 64 nt, hsa; identical to SEQ ID NO: 380125

SEQ ID NO: 651971 - RNA, 64 nt, hsa; identical to SEQ ID NO: 380126

SEQ ID NO: 651972 - RNA, 64 nt, hsa; identical to SEQ ID NO: 380127

SEQ ID NO: 651973 - RNA, 64 nt, hsa; identical to SEQ ID NO: 380128

SEQ ID NO: 651974 - RNA, 64 nt, hsa; identical to SEQ ID NO: 380129

SEQ ID NO: 651975 - RNA, 64 nt, hsa; identical to SEQ ID NO: 380130

SEQ ID NO: 651976 - RNA, 64 nt, hsa; identical to SEQ ID NO: 380131

SEQ ID NO: 651977 - RNA, 64 nt, hsa; identical to SEQ ID NO: 380132

SEQ ID NO: 651978 - RNA, 64 nt, hsa; identical to SEQ ID NO: 380133

SEQ ID NO: 651979 - RNA, 64 nt, hsa; identical to SEQ ID NO: 380134

SEQ ID NO: 651980 - RNA, 64 nt, hsa; identical to SEQ ID NO: 380135

SEQ ID NO: 651981 - RNA, 64 nt, hsa; identical to SEQ ID NO: 380136

SEQ ID NO: 651982 - RNA, 64 nt, hsa; identical to SEQ ID NO: 380137

SEQ ID NO: 651983 - RNA, 64 nt, hsa; identical to SEQ ID NO: 380138

SEQ ID NO: 651984 - RNA, 64 nt, hsa; identical to SEQ ID NO: 380139

SEQ ID NO: 651985 - RNA, 64 nt, hsa; identical to SEQ ID NO: 380140

SEQ ID NO: 651986 - RNA, 64 nt, hsa; identical to SEQ ID NO: 380141

SEQ ID NO: 651987 - RNA, 64 nt, hsa; identical to SEQ ID NO: 380142

SEQ ID NO: 651988 - RNA, 64 nt, hsa; identical to SEQ ID NO: 380143

SEQ ID NO: 651989 - RNA, 64 nt, hsa; identical to SEQ ID NO: 380144

SEQ ID NO: 651990 - RNA, 64 nt, hsa; identical to SEQ ID NO: 380145

SEQ ID NO: 651991 - RNA, 64 nt, hsa; identical to SEQ ID NO: 380146

SEQ ID NO: 651992 - RNA, 64 nt, hsa; identical to SEQ ID NO: 380147

SEQ ID NO: 651993 - RNA, 59 nt, hsa; identical to SEQ ID NO: 380148

SEQ ID NO: 651994 - RNA, 64 nt, hsa; identical to SEQ ID NO: 380149

SEQ ID NO: 651995 - RNA, 64 nt, hsa; identical to SEQ ID NO: 380150

SEQ ID NO: 651996 - RNA, 64 nt, hsa; identical to SEQ ID NO: 380151

SEQ ID NO: 651997 - RNA, 64 nt, hsa; identical to SEQ ID NO: 380152

SEQ ID NO: 651998 - RNA, 64 nt, hsa; identical to SEQ ID NO: 380153

SEQ ID NO: 651999 - RNA, 64 nt, hsa; identical to SEQ ID NO: 380154

SEQ ID NO: 652000 - RNA, 64 nt, hsa; identical to SEQ ID NO: 380155

SEQ ID NO: 652001 - RNA, 64 nt, hsa; identical to SEQ ID NO: 380156

SEQ ID NO: 652002 - RNA, 64 nt, hsa; identical to SEQ ID NO: 380157

SEQ ID NO: 652003 - RNA, 64 nt, hsa; identical to SEQ ID NO: 380158

SEQ ID NO: 652004 - RNA, 64 nt, hsa; identical to SEQ ID NO: 380159

SEQ ID NO: 652005 - RNA, 64 nt, hsa; identical to SEQ ID NO: 380160

SEQ ID NO: 652006 - RNA, 64 nt, hsa; identical to SEQ ID NO: 380161

SEQ ID NO: 652007 - RNA, 54 nt, hsa; identical to SEQ ID NO: 380162

SEQ ID NO: 652008 - RNA, 64 nt, hsa; identical to SEQ ID NO: 380163

SEQ ID NO: 652009 - RNA, 64 nt, hsa; identical to SEQ ID NO: 380164

SEQ ID NO: 652010 - RNA, 64 nt, hsa; identical to SEQ ID NO: 380165

SEQ ID NO: 652011 - RNA, 64 nt, hsa; identical to SEQ ID NO: 380166

SEQ ID NO: 652012 - RNA, 64 nt, hsa; identical to SEQ ID NO: 380167

SEQ ID NO: 652013 - RNA, 64 nt, hsa; identical to SEQ ID NO: 380168

SEQ ID NO: 652014 - RNA, 64 nt, hsa; identical to SEQ ID NO: 380169

SEQ ID NO: 652015 - RNA, 64 nt, hsa; identical to SEQ ID NO: 380170

SEQ ID NO: 652016 - RNA, 64 nt, hsa; identical to SEQ ID NO: 380171

SEQ ID NO: 652017 - RNA, 64 nt, hsa; identical to SEQ ID NO: 380172

SEQ ID NO: 652018 - RNA, 64 nt, hsa; identical to SEQ ID NO: 380173

SEQ ID NO: 652019 - RNA, 64 nt, hsa; identical to SEQ ID NO: 380174

SEQ ID NO: 652020 - RNA, 64 nt, hsa; identical to SEQ ID NO: 380175

SEQ ID NO: 652021 - RNA, 64 nt, hsa; identical to SEQ ID NO: 380176

SEQ ID NO: 652022 - RNA, 64 nt, hsa; identical to SEQ ID NO: 380177

SEQ ID NO: 652023 - RNA, 64 nt, hsa; identical to SEQ ID NO: 380178

SEQ ID NO: 652024 - RNA, 64 nt, hsa; identical to SEQ ID NO: 380179

SEQ ID NO: 652025 - RNA, 64 nt, hsa; identical to SEQ ID NO: 380180

SEQ ID NO: 652026 - RNA, 64 nt, hsa; identical to SEQ ID NO: 380181

SEQ ID NO: 652027 - RNA, 64 nt, hsa; identical to SEQ ID NO: 380182

SEQ ID NO: 652028 - RNA, 64 nt, hsa; identical to SEQ ID NO: 380183

SEQ ID NO: 652029 - RNA, 64 nt, hsa; identical to SEQ ID NO: 380184

SEQ ID NO: 652030 - RNA, 64 nt, hsa; identical to SEQ ID NO: 380185

SEQ ID NO: 652031 - RNA, 64 nt, hsa; identical to SEQ ID NO: 380186

SEQ ID NO: 652032 - RNA, 64 nt, hsa; identical to SEQ ID NO: 380187

SEQ ID NO: 652033 - RNA, 64 nt, hsa; identical to SEQ ID NO: 380188

SEQ ID NO: 652034 - RNA, 64 nt, hsa; identical to SEQ ID NO: 380189

SEQ ID NO: 652035 - RNA, 64 nt, hsa; identical to SEQ ID NO: 380190

SEQ ID NO: 652036 - RNA, 64 nt, hsa; identical to SEQ ID NO: 380191

SEQ ID NO: 652037 - RNA, 64 nt, hsa; identical to SEQ ID NO: 380192

SEQ ID NO: 652038 - RNA, 64 nt, hsa; identical to SEQ ID NO: 380193

SEQ ID NO: 652039 - RNA, 64 nt, hsa; identical to SEQ ID NO: 380194

SEQ ID NO: 652040 - RNA, 64 nt, hsa; identical to SEQ ID NO: 380195

SEQ ID NO: 652041 - RNA, 58 nt, hsa; identical to SEQ ID NO: 380196

SEQ ID NO: 652042 - RNA, 64 nt, hsa; identical to SEQ ID NO: 380197

SEQ ID NO: 652043 - RNA, 64 nt, hsa; identical to SEQ ID NO: 380198

SEQ ID NO: 652044 - RNA, 64 nt, hsa; identical to SEQ ID NO: 380199

SEQ ID NO: 652045 - RNA, 64 nt, hsa; identical to SEQ ID NO: 380200

SEQ ID NO: 652046 - RNA, 64 nt, hsa; identical to SEQ ID NO: 380201

SEQ ID NO: 652047 - RNA, 64 nt, hsa; identical to SEQ ID NO: 380202

SEQ ID NO: 652048 - RNA, 64 nt, hsa; identical to SEQ ID NO: 380203

SEQ ID NO: 652049 - RNA, 64 nt, hsa; identical to SEQ ID NO: 380204

SEQ ID NO: 652050 - RNA, 64 nt, hsa; identical to SEQ ID NO: 380205

SEQ ID NO: 652051 - RNA, 64 nt, hsa; identical to SEQ ID NO: 380206

SEQ ID NO: 652052 - RNA, 64 nt, hsa; identical to SEQ ID NO: 380207

SEQ ID NO: 652053 - RNA, 64 nt, hsa; identical to SEQ ID NO: 380208

SEQ ID NO: 652054 - RNA, 64 nt, hsa; identical to SEQ ID NO: 380209

SEQ ID NO: 652055 - RNA, 63 nt, hsa; identical to SEQ ID NO: 380210

SEQ ID NO: 652056 - RNA, 64 nt, hsa; identical to SEQ ID NO: 380211

SEQ ID NO: 652057 - RNA, 64 nt, hsa; identical to SEQ ID NO: 380212

SEQ ID NO: 652058 - RNA, 64 nt, hsa; identical to SEQ ID NO: 380213

SEQ ID NO: 652059 - RNA, 64 nt, hsa; identical to SEQ ID NO: 380214

SEQ ID NO: 652060 - RNA, 64 nt, hsa; identical to SEQ ID NO: 380215

SEQ ID NO: 652061 - RNA, 64 nt, hsa; identical to SEQ ID NO: 380216

SEQ ID NO: 652062 - RNA, 64 nt, hsa; identical to SEQ ID NO: 380217

SEQ ID NO: 652063 - RNA, 64 nt, hsa; identical to SEQ ID NO: 380218

SEQ ID NO: 652064 - RNA, 64 nt, hsa; identical to SEQ ID NO: 380219

SEQ ID NO: 652065 - RNA, 64 nt, hsa; identical to SEQ ID NO: 380220

SEQ ID NO: 652066 - RNA, 64 nt, hsa; identical to SEQ ID NO: 380221

SEQ ID NO: 652067 - RNA, 64 nt, hsa; identical to SEQ ID NO: 380222

SEQ ID NO: 652068 - RNA, 64 nt, hsa; identical to SEQ ID NO: 380223

SEQ ID NO: 652069 - RNA, 64 nt, hsa; identical to SEQ ID NO: 380224

SEQ ID NO: 652070 - RNA, 64 nt, hsa; identical to SEQ ID NO: 380225

SEQ ID NO: 652071 - RNA, 64 nt, hsa; identical to SEQ ID NO: 380226

SEQ ID NO: 652072 - RNA, 64 nt, hsa; identical to SEQ ID NO: 380227

SEQ ID NO: 652073 - RNA, 64 nt, hsa; identical to SEQ ID NO: 380228

SEQ ID NO: 652074 - RNA, 64 nt, hsa; identical to SEQ ID NO: 380229

SEQ ID NO: 652075 - RNA, 64 nt, hsa; identical to SEQ ID NO: 380230

SEQ ID NO: 652076 - RNA, 64 nt, hsa; identical to SEQ ID NO: 380231

SEQ ID NO: 652077 - RNA, 64 nt, hsa; identical to SEQ ID NO: 380232

SEQ ID NO: 652078 - RNA, 64 nt, hsa; identical to SEQ ID NO: 380233

SEQ ID NO: 652079 - RNA, 64 nt, hsa; identical to SEQ ID NO: 380234

SEQ ID NO: 652080 - RNA, 64 nt, hsa; identical to SEQ ID NO: 380235

SEQ ID NO: 652081 - RNA, 51 nt, hsa; identical to SEQ ID NO: 380236

SEQ ID NO: 652082 - RNA, 64 nt, hsa; identical to SEQ ID NO: 380237

SEQ ID NO: 652083 - RNA, 64 nt, hsa; identical to SEQ ID NO: 380238

SEQ ID NO: 652084 - RNA, 64 nt, hsa; identical to SEQ ID NO: 380239

SEQ ID NO: 652085 - RNA, 64 nt, hsa; identical to SEQ ID NO: 380240

SEQ ID NO: 652086 - RNA, 64 nt, hsa; identical to SEQ ID NO: 380241

SEQ ID NO: 652087 - RNA, 64 nt, hsa; identical to SEQ ID NO: 380242

SEQ ID NO: 652088 - RNA, 64 nt, hsa; identical to SEQ ID NO: 380243

SEQ ID NO: 652089 - RNA, 64 nt, hsa; identical to SEQ ID NO: 380244

SEQ ID NO: 652090 - RNA, 64 nt, hsa; identical to SEQ ID NO: 380245

SEQ ID NO: 652091 - RNA, 64 nt, hsa; identical to SEQ ID NO: 380246

SEQ ID NO: 652092 - RNA, 64 nt, hsa; identical to SEQ ID NO: 380247

SEQ ID NO: 652093 - RNA, 64 nt, hsa; identical to SEQ ID NO: 380248

SEQ ID NO: 652094 - RNA, 64 nt, hsa; identical to SEQ ID NO: 380249

SEQ ID NO: 652095 - RNA, 64 nt, hsa; identical to SEQ ID NO: 380250

SEQ ID NO: 652096 - RNA, 64 nt, hsa; identical to SEQ ID NO: 380251

SEQ ID NO: 652097 - RNA, 64 nt, hsa; identical to SEQ ID NO: 380252

SEQ ID NO: 652098 - RNA, 64 nt, hsa; identical to SEQ ID NO: 380253

SEQ ID NO: 652099 - RNA, 64 nt, hsa; identical to SEQ ID NO: 380254

SEQ ID NO: 652100 - RNA, 64 nt, hsa; identical to SEQ ID NO: 380255

SEQ ID NO: 652101 - RNA, 64 nt, hsa; identical to SEQ ID NO: 380256

SEQ ID NO: 652102 - RNA, 64 nt, hsa; identical to SEQ ID NO: 380257

SEQ ID NO: 652103 - RNA, 64 nt, hsa; identical to SEQ ID NO: 380258

SEQ ID NO: 652104 - RNA, 64 nt, hsa; identical to SEQ ID NO: 380259

SEQ ID NO: 652105 - RNA, 64 nt, hsa; identical to SEQ ID NO: 380260

SEQ ID NO: 652106 - RNA, 64 nt, hsa; identical to SEQ ID NO: 380261

SEQ ID NO: 652107 - RNA, 64 nt, hsa; identical to SEQ ID NO: 380262

SEQ ID NO: 652108 - RNA, 64 nt, hsa; identical to SEQ ID NO: 380263

SEQ ID NO: 652109 - RNA, 64 nt, hsa; identical to SEQ ID NO: 380264

SEQ ID NO: 652110 - RNA, 64 nt, hsa; identical to SEQ ID NO: 380265

SEQ ID NO: 652111 - RNA, 64 nt, hsa; identical to SEQ ID NO: 380266

SEQ ID NO: 652112 - RNA, 64 nt, hsa; identical to SEQ ID NO: 380267

SEQ ID NO: 652113 - RNA, 64 nt, hsa; identical to SEQ ID NO: 380268

SEQ ID NO: 652114 - RNA, 64 nt, hsa; identical to SEQ ID NO: 380269

SEQ ID NO: 652115 - RNA, 64 nt, hsa; identical to SEQ ID NO: 380270

SEQ ID NO: 652116 - RNA, 64 nt, hsa; identical to SEQ ID NO: 380271

SEQ ID NO: 652117 - RNA, 64 nt, hsa; identical to SEQ ID NO: 380272

SEQ ID NO: 652118 - RNA, 64 nt, hsa; identical to SEQ ID NO: 380273

SEQ ID NO: 652119 - RNA, 64 nt, hsa; identical to SEQ ID NO: 380274

SEQ ID NO: 652120 - RNA, 64 nt, hsa; identical to SEQ ID NO: 380275

SEQ ID NO: 652121 - RNA, 64 nt, hsa; identical to SEQ ID NO: 380276

SEQ ID NO: 652122 - RNA, 64 nt, hsa; identical to SEQ ID NO: 380277

SEQ ID NO: 652123 - RNA, 64 nt, hsa; identical to SEQ ID NO: 380278

SEQ ID NO: 652124 - RNA, 64 nt, hsa; identical to SEQ ID NO: 380279

SEQ ID NO: 652125 - RNA, 50 nt, hsa; identical to SEQ ID NO: 380280

SEQ ID NO: 652126 - RNA, 64 nt, hsa; identical to SEQ ID NO: 380281

SEQ ID NO: 652127 - RNA, 63 nt, hsa; identical to SEQ ID NO: 380282

SEQ ID NO: 652128 - RNA, 64 nt, hsa; identical to SEQ ID NO: 380283

SEQ ID NO: 652129 - RNA, 64 nt, hsa; identical to SEQ ID NO: 380284

SEQ ID NO: 652130 - RNA, 64 nt, hsa; identical to SEQ ID NO: 380285

SEQ ID NO: 652131 - RNA, 64 nt, hsa; identical to SEQ ID NO: 380286

SEQ ID NO: 652132 - RNA, 64 nt, hsa; identical to SEQ ID NO: 380287

SEQ ID NO: 652133 - RNA, 64 nt, hsa; identical to SEQ ID NO: 380288

SEQ ID NO: 652134 - RNA, 64 nt, hsa; identical to SEQ ID NO: 380289

SEQ ID NO: 652135 - RNA, 64 nt, hsa; identical to SEQ ID NO: 380290

SEQ ID NO: 652136 - RNA, 64 nt, hsa; identical to SEQ ID NO: 380291

SEQ ID NO: 652137 - RNA, 64 nt, hsa; identical to SEQ ID NO: 380292

SEQ ID NO: 652138 - RNA, 64 nt, hsa; identical to SEQ ID NO: 380293

SEQ ID NO: 652139 - RNA, 64 nt, hsa; identical to SEQ ID NO: 380294

SEQ ID NO: 652140 - RNA, 64 nt, hsa; identical to SEQ ID NO: 380295

SEQ ID NO: 652141 - RNA, 64 nt, hsa; identical to SEQ ID NO: 380296

SEQ ID NO: 652142 - RNA, 64 nt, hsa; identical to SEQ ID NO: 380297

SEQ ID NO: 652143 - RNA, 64 nt, hsa; identical to SEQ ID NO: 380298

SEQ ID NO: 652144 - RNA, 64 nt, hsa; identical to SEQ ID NO: 380299

SEQ ID NO: 652145 - RNA, 64 nt, hsa; identical to SEQ ID NO: 380300

SEQ ID NO: 652146 - RNA, 64 nt, hsa; identical to SEQ ID NO: 380301

SEQ ID NO: 652147 - RNA, 64 nt, hsa; identical to SEQ ID NO: 380302

SEQ ID NO: 652148 - RNA, 64 nt, hsa; identical to SEQ ID NO: 380303

SEQ ID NO: 652149 - RNA, 64 nt, hsa; identical to SEQ ID NO: 380304

SEQ ID NO: 652150 - RNA, 64 nt, hsa; identical to SEQ ID NO: 380304

SEQ ID NO: 652151 - RNA, 64 nt, hsa; identical to SEQ ID NO: 380306

SEQ ID NO: 652152 - RNA, 64 nt, hsa; identical to SEQ ID NO: 380307

SEQ ID NO: 652153 - RNA, 64 nt, hsa; identical to SEQ ID NO: 380308

SEQ ID NO: 652154 - RNA, 64 nt, hsa; identical to SEQ ID NO: 380309

SEQ ID NO: 652155 - RNA, 64 nt, hsa; identical to SEQ ID NO: 380310

SEQ ID NO: 652156 - RNA, 64 nt, hsa; identical to SEQ ID NO: 380311

SEQ ID NO: 652157 - RNA, 64 nt, hsa
uguauauguugucaugcaggguuugggccaagaaagcaugcagaaaaaaaugccaugugauugu

SEQ ID NO: 652158 - RNA, 64 nt, hsa
aaaugauucucucacaggcuugggaaauccuguuagcaugcagaauaaugugguaacuuuguca

SEQ ID NO: 652159 - RNA, 64 nt, hsa
agauuauuuuagucugucauccagaaaaugugucagcaugcauagugcuaagaaagcaagccaa

SEQ ID NO: 652160 - RNA, 64 nt, hsa
auuuuuuguauauuaaagcaccaaauucauguacagcaugcaucacggaucaauagacuguacu

SEQ ID NO: 652161 - RNA, 64 nt, hsa
gcugccaggugagucaccgccuguccugcaguggagcaugcacagcucgcagccucuuugcacg

SEQ ID NO: 652162 - RNA, 64 nt, hsa
aacagacacaucuccaaaugggcaaggagucucuagcaugcagcccaggccuucuccauacccc

SEQ ID NO: 652163 - RNA, 64 nt, hsa
ggcaggccacaguccugagcuuguaagauggugcagcaugcagaccagacuuguccccaagguc

SEQ ID NO: 652164 - RNA, 64 nt, hsa
gcuggcuacuaacuaacugggagaccuuaggcaaagcaugcaaucgcucugaauggcaguuucc

SEQ ID NO: 652165 - RNA, 64 nt, hsa
gaucuguuugcaucuucuuuaaaacuaaguggugagcaugcauugugguguagaggcaggcauu

SEQ ID NO: 652166 - RNA, 64 nt, hsa
uuggcugggccaugagagucuguauacucuaaaaagcaugcagcauggugccccucuucugacc

SEQ ID NO: 652167 - RNA, 64 nt, hsa
gaccguguucacgauucccuacucugcaacucucagcaugcaucaugaugauucucuaacacug

SEQ ID NO: 652168 - RNA, 64 nt, hsa
uaacacugucugucaccuuccuguauuuccacagagcaugcaagaacuucuacaaaacuucuau

SEQ ID NO: 652169 - RNA, 64 nt, hsa; identical to SEQ ID NO: 102259

SEQ ID NO: 652170 - RNA, 64 nt, hsa; identical to SEQ ID NO: 102260

SEQ ID NO: 652171 - RNA, 64 nt, hsa; identical to SEQ ID NO: 102261

SEQ ID NO: 652172 - RNA, 64 nt, hsa; identical to SEQ ID NO: 102262

SEQ ID NO: 652173 - RNA, 64 nt, hsa; identical to SEQ ID NO: 102263

SEQ ID NO: 652174 - RNA, 64 nt, hsa; identical to SEQ ID NO: 102264

SEQ ID NO: 652175 - RNA, 64 nt, hsa; identical to SEQ ID NO: 102265

SEQ ID NO: 652176 - RNA, 64 nt, hsa; identical to SEQ ID NO: 102266

SEQ ID NO: 652177 - RNA, 64 nt, hsa; identical to SEQ ID NO: 102267

SEQ ID NO: 652178 - RNA, 64 nt, hsa; identical to SEQ ID NO: 102268

SEQ ID NO: 652179 - RNA, 64 nt, hsa
uuuguaacuguuuagugcuguaaagaaauauuccaagugucauuaggauuguugcugccagaac

SEQ ID NO: 652180 - RNA, 64 nt, hsa
auagauuuugaauugauucuuuagaccccccaaaaagugucaguucuaauggggaaauauauuc

SEQ ID NO: 652181 - RNA, 64 nt, hsa
ugcuuccacauucaccuauguauuuauuauucaaaagugucauuuuaauauuuauugcuaccuu

SEQ ID NO: 652182 - RNA, 64 nt, hsa
gaaagugcuuuccagaauaauaugaaguaucuaaaagugucaccuuuucuugccugaucaacaa

SEQ ID NO: 652183 - RNA, 64 nt, hsa
cacucuggucuuggaauuccauuugaggauuuagaagugucauguuuauaacuauucaguugug

SEQ ID NO: 652184 - RNA, 64 nt, hsa
auuauuuacaguagccaaaagguagaagcagcccaagugucaucccauucacccaugaauggau

SEQ ID NO: 652185 - RNA, 64 nt, hsa
acuagagcuuuagugucuacaugaguaucuugugaagugucauaacaggcauaacauauuuuua

SEQ ID NO: 652186 - RNA, 64 nt, hsa
gccuuuauuuauuacuuuuuggaggaaaucagagaagugucaauggaccgucacucagacugag

SEQ ID NO: 652187 - RNA, 64 nt, hsa
auuaauaauagguuacaggaaagccagccagaggaagugucagcacuuuaaaauucuagacccc

SEQ ID NO: 652188 - RNA, 64 nt, hsa
cccgaugugcaccuccccgaggugcagcugccgaaagugucagagauucggcugccggaaaugc

SEQ ID NO: 652189 - RNA, 64 nt, hsa
ccggaggugcggcuuccagagguacagcugccgaaagugucagagaugaaacucccagaggugu

SEQ ID NO: 652190 - RNA, 64 nt, hsa
ccggaggugcggcuuccagagguagagcugcccaaagugucagagaugaaacucccaaaggugc

SEQ ID NO: 652191 - RNA, 64 nt, hsa
guugcucuuuggcaaugucccuuaaccaugauuauuaacuaaguuuguggcuugaguuuacaaa

SEQ ID NO: 652192 - RNA, 64 nt, hsa
uggggaaucgauuguaaaagucccagguucuaaauuaacuaaauguguacagaaaugaacgugu

SEQ ID NO: 652193 - RNA, 64 nt, hsa
uuucaauauacaaauuuuaaaaauacuacaauauuuaacuaaggcccaaccgauuuccauaaug

SEQ ID NO: 652194 - RNA, 64 nt, hsa
uuccuccuccauagggacacauuuucucuaacccuuaacuaaaguguaggauuuuaaaauuaaa

SEQ ID NO: 652195 - RNA, 64 nt, hsa
aaagacaugcacuuuccauauuuucaagucaauuuuaacuaaaaacuaagauaauguuuccuag

SEQ ID NO: 652196 - RNA, 64 nt, hsa
cuuuggacuuuugauauacucaaagccagaaagcuuaacuaauguaagauuagcuauuauuugu

SEQ ID NO: 652197 - RNA, 64 nt, hsa
guacuuguuucccuuuuugaaacaagugucuugguuaacuaauucuguuuuaugguugugcuaa

SEQ ID NO: 652198 - RNA, 64 nt, hsa
ggaaugaaucaacugaccuugggccagcagguuuuuaacuaaauuguuacuugccuuucucacc

SEQ ID NO: 652199 - RNA, 64 nt, hsa
ucuuuuagcaauucaguuuaguacaggagugacauuaacuaaugacaauaaauuaaacaaagcc

SEQ ID NO: 652200 - RNA, 64 nt, hsa
aggaauugccucaggcauuuuuuuuuuuuacacauuaacuaaagggcuauucgaaaucuugacu

SEQ ID NO: 652201 - RNA, 64 nt, hsa
gauuuauagucauaauuauuuuauuguaaagauuuuaacuaaaguuuuuccuuuucucucaaac

SEQ ID NO: 652202 - RNA, 64 nt, hsa
uucuuuauacaaauaccauguaauguguacauauuuaacuaaagagauuuauagucauaauuau

SEQ ID NO: 652203 - RNA, 64 nt, hsa
ccuuaccuuggaaacuaucaaauauaaauauacuuuaacuaagccagugaccugguccuaaguu

SEQ ID NO: 652204 - RNA, 64 nt, hsa
uaaagguaggaugcucagguuuucugcauaguucuuaacuaaucuugucugcaguuugguauug

SEQ ID NO: 652205 - RNA, 64 nt, hsa
guuuaguauuuuagaaauauaccagcacuacuaauuaacuaaugucuuuuauuuauuauauuau

SEQ ID NO: 652206 - RNA, 64 nt, hsa
ucuuucuuggaauaugugaaauaaauuuagcaguuuaacuaaauacaaauauaugcauugugua

SEQ ID NO: 652207 - RNA, 64 nt, hsa
acagacaugguguacugaucagaaauguucaguuuuaacuaaaacuaaauuuauguuauuuggc

SEQ ID NO: 652208 - RNA, 64 nt, hsa
agcugcaaaauaauuguagacaaaauaauggcauuuaacuaaagauggagcaugaucuaaguac

SEQ ID NO: 652209 - RNA, 64 nt, hsa
gcuaugagccuaaaaccucuuuaaaaacggucaguuaacuaaaaaauaaaaaucaagucuuuag

SEQ ID NO: 652210 - RNA, 64 nt, hsa
aaaaaucaagucuuuaggagaguagaaaacacaauuaacuaaaaagcagggacaucugaaagag

SEQ ID NO: 652211 - RNA, 64 nt, hsa
auaaaccauuuuguauguuuggauuuugaauggguuaacuaauuacaggcuaaaauaaugccuu

SEQ ID NO: 652212 - RNA, 64 nt, hsa
gauuuauauagucagguuuuugucauguaauuuauuaacuaacuauuacagaaacacagcuaag

SEQ ID NO: 652213 - RNA, 64 nt, hsa
aaagguguuuuauugauaaaucuauuguacuauuuggauacauuuguguauuccuugcagccaa

SEQ ID NO: 652214 - RNA, 64 nt, hsa
uuuaaaauuacauaacuaaaaauaaaccacacuguggauacaucuuauaaaacuaauggaaaca

SEQ ID NO: 652215 - RNA, 64 nt, hsa
uauaauuuuuguuaauaagacaaagguaauauauuggauacaaagacacaaauguauugugugu

SEQ ID NO: 652216 - RNA, 64 nt, hsa
uuaaugaagcagagagcuaguacuucauuuucacuggauacauuuucagcaucaugaguuguca

SEQ ID NO: 652217 - RNA, 64 nt, hsa; identical to SEQ ID NO: 354645

SEQ ID NO: 652218 - RNA, 64 nt, hsa; identical to SEQ ID NO: 354646

SEQ ID NO: 652219 - RNA, 64 nt, hsa; identical to SEQ ID NO: 354647

SEQ ID NO: 652220 - RNA, 64 nt, hsa; identical to SEQ ID NO: 354648

SEQ ID NO: 652221 - RNA, 64 nt, hsa; identical to SEQ ID NO: 354649

SEQ ID NO: 652222 - RNA, 64 nt, hsa; identical to SEQ ID NO: 354650

SEQ ID NO: 652223 - RNA, 64 nt, hsa; identical to SEQ ID NO: 354651

SEQ ID NO: 652224 - RNA, 64 nt, hsa; identical to SEQ ID NO: 354652

SEQ ID NO: 652225 - RNA, 64 nt, hsa; identical to SEQ ID NO: 354653

SEQ ID NO: 652226 - RNA, 64 nt, hsa; identical to SEQ ID NO: 354654

SEQ ID NO: 652227 - RNA, 64 nt, hsa; identical to SEQ ID NO: 354655

SEQ ID NO: 652228 - RNA, 64 nt, hsa; identical to SEQ ID NO: 354656

SEQ ID NO: 652229 - RNA, 64 nt, hsa; identical to SEQ ID NO: 354657

SEQ ID NO: 652230 - RNA, 64 nt, hsa; identical to SEQ ID NO: 354658

SEQ ID NO: 652231 - RNA, 64 nt, hsa; identical to SEQ ID NO: 354659

SEQ ID NO: 652232 - RNA, 64 nt, hsa; identical to SEQ ID NO: 354660

SEQ ID NO: 652233 - RNA, 64 nt, hsa; identical to SEQ ID NO: 354661

SEQ ID NO: 652234 - RNA, 64 nt, hsa; identical to SEQ ID NO: 354662

SEQ ID NO: 652235 - RNA, 64 nt, hsa; identical to SEQ ID NO: 354663

SEQ ID NO: 652236 - RNA, 64 nt, hsa; identical to SEQ ID NO: 354664

SEQ ID NO: 652237 - RNA, 64 nt, hsa; identical to SEQ ID NO: 354665

SEQ ID NO: 652238 - RNA, 64 nt, hsa; identical to SEQ ID NO: 354666

SEQ ID NO: 652239 - RNA, 64 nt, hsa; identical to SEQ ID NO: 151446

SEQ ID NO: 652240 - RNA, 64 nt, hsa; identical to SEQ ID NO: 151447

SEQ ID NO: 652241 - RNA, 64 nt, hsa; identical to SEQ ID NO: 151448

SEQ ID NO: 652242 - RNA, 64 nt, hsa; identical to SEQ ID NO: 151449

SEQ ID NO: 652243 - RNA, 64 nt, hsa; identical to SEQ ID NO: 151450

SEQ ID NO: 652244 - RNA, 64 nt, hsa; identical to SEQ ID NO: 151451

SEQ ID NO: 652245 - RNA, 64 nt, hsa; identical to SEQ ID NO: 151452

SEQ ID NO: 652246 - RNA, 64 nt, hsa; identical to SEQ ID NO: 151453

SEQ ID NO: 652247 - RNA, 64 nt, hsa; identical to SEQ ID NO: 151454

SEQ ID NO: 652248 - RNA, 64 nt, hsa; identical to SEQ ID NO: 151455

SEQ ID NO: 652249 - RNA, 64 nt, hsa; identical to SEQ ID NO: 151456

SEQ ID NO: 652250 - RNA, 64 nt, hsa; identical to SEQ ID NO: 151457

SEQ ID NO: 652251 - RNA, 64 nt, hsa; identical to SEQ ID NO: 151458

SEQ ID NO: 652252 - RNA, 64 nt, hsa; identical to SEQ ID NO: 151459

SEQ ID NO: 652253 - RNA, 64 nt, hsa; identical to SEQ ID NO: 151460

SEQ ID NO: 652254 - RNA, 64 nt, hsa; identical to SEQ ID NO: 151461

SEQ ID NO: 652255 - RNA, 64 nt, hsa; identical to SEQ ID NO: 151462

SEQ ID NO: 652256 - RNA, 64 nt, hsa; identical to SEQ ID NO: 151463

SEQ ID NO: 652257 - RNA, 64 nt, hsa; identical to SEQ ID NO: 151464

SEQ ID NO: 652258 - RNA, 64 nt, hsa; identical to SEQ ID NO: 151465

SEQ ID NO: 652259 - RNA, 64 nt, hsa; identical to SEQ ID NO: 151466

SEQ ID NO: 652260 - RNA, 64 nt, hsa; identical to SEQ ID NO: 151467

SEQ ID NO: 652261 - RNA, 64 nt, hsa; identical to SEQ ID NO: 151468

SEQ ID NO: 652262 - RNA, 64 nt, hsa; identical to SEQ ID NO: 151448

SEQ ID NO: 652263 - RNA, 64 nt, hsa; identical to SEQ ID NO: 151470

SEQ ID NO: 652264 - RNA, 64 nt, hsa; identical to SEQ ID NO: 151471

SEQ ID NO: 652265 - RNA, 64 nt, hsa
aggaaacuuugaaggguuaaauagagauuuaaaaaaauaaaauaaaaaggcugggcuagggugc

SEQ ID NO: 652266 - RNA, 64 nt, hsa
acuuugaaggguuaaauagagauuuaaaaaaauaaaauaaaaaggcugggcuagggugcuuuuu

SEQ ID NO: 652267 - RNA, 64 nt, hsa
cuuuuuauaagaguugucauuguuggaaauucuuaaauaaaacugauuuaaauaauaugugucu

SEQ ID NO: 652268 - RNA, 64 nt, hsa
augcauucauucuaaaaaauuuuuugaaccagauaaauaaaauuuuuuuuugacaccacaguuu

SEQ ID NO: 652269 - RNA, 64 nt, hsa
cagaaagaaauccugugugagccucugguaugagaaauaaaaucugccaguuuuauaacauuca

SEQ ID NO: 652270 - RNA, 64 nt, hsa
guguuggugcucaaugcaguguagacauguuuucaaauaaaacaaaugauuguguacaacaaug

SEQ ID NO: 652271 - RNA, 64 nt, hsa
aguuacuguuguuuacagugaguuuggggaaaaaaaauaaaauaaaaauggcuuucccaguccu

SEQ ID NO: 652272 - RNA, 64 nt, hsa
cuguuguuuacagugaguuuggggaaaaaaaauaaaauaaaaauggcuuucccaguccuugcau

SEQ ID NO: 652273 - RNA, 64 nt, hsa
augcuaucagaaacaguauuuucuucccaaaucaaaauaaaagaaauaugaucagagcuugaac

SEQ ID NO: 652274 - RNA, 64 nt, hsa
auaugaucagagcuugaacacaggcuuauuuuuaaaauaaaaauauuuuuaacauggguuuccu

SEQ ID NO: 652275 - RNA, 64 nt, hsa
cuagugaacaaaaggugccuauucuuuuuuaaaaaaauaaaauaaaacauaaauauuacucuuc

SEQ ID NO: 652276 - RNA, 64 nt, hsa
gaacaaaaggugccuauucuuuuuuaaaaaaauaaaauaaaacauaaauauuacucuuccauau

SEQ ID NO: 652277 - RNA, 64 nt, hsa
cugucaauagccuagggcugaauuuuugucagauaaauaaaauaaaucauucauccuuuuuuuu

SEQ ID NO: 652278 - RNA, 64 nt, hsa
uaaauguauuuuagacuuccuguagggggcgauaaaauaaaaugcuaaacaacuggguauacau

SEQ ID NO: 652279 - RNA, 64 nt, hsa
aaaaucaugucaucuucuauuuguacagaaaugaaaauaaaauaugaaaauaaugaaagaaaug

SEQ ID NO: 652280 - RNA, 64 nt, hsa
gggcaaaugucauuguuaccucuguguguuaagaaaauaaaaauauuuucuaaaggucuguauu

SEQ ID NO: 652281 - RNA, 64 nt, hsa
gaacauuuuucuuuuauuguuuuaucuucacagaaaauaaaagguguuaauuugcuuuuuaaaa

SEQ ID NO: 652282 - RNA, 64 nt, hsa
cugaguugauuuucuagguucuuacguauuugaaaaauaaaauugcaauucgagauaagugcuu

SEQ ID NO: 652283 - RNA, 64 nt, hsa
aaaugaccuuuucuugaaauguaacuugaaaacaaaauaaaauguggaacauaauguuuaauua

SEQ ID NO: 652284 - RNA, 64 nt, hsa
auuauuuguggagaacucuaagguuaagaucaggaaauaaaagacugugugugugugugugugu

SEQ ID NO: 652285 - RNA, 64 nt, hsa
cuaucacuuuaaaaaaauaauugaaguguaagcuaaauaaaaugcuuggaguuuugccugggcu

SEQ ID NO: 652286 - RNA, 64 nt, hsa
gcuucccucaguucaccaaaguuaccaaaauguaaaauaaaauaagacuggcucagguaaguag

SEQ ID NO: 652287 - RNA, 64 nt, hsa
ugugggccaaaucuagcucacuaucuguuuuuguaaauaaaauuuuauaauaguacacagccac

SEQ ID NO: 652288 - RNA, 64 nt, hsa
uaaaucuagaaaccauuaguuugagaucucucaaaaauaaaaauaaaaauugcuuucagagagu

SEQ ID NO: 652289 - RNA, 64 nt, hsa
uagaaaccauuaguuugagaucucucaaaaauaaaaauaaaaauugcuuucagagaguagccca

SEQ ID NO: 652290 - RNA, 64 nt, hsa
augaauucuccauuuccuacuggaggauuuauuuaaauaaaauaugcuuauuaaacacuccugc

SEQ ID NO: 652291 - RNA, 64 nt, hsa
cgacauuauaugugacuuaaaaccuagaagaaauaaauaaaacuauugaucaauuuuaacuaca

SEQ ID NO: 652292 - RNA, 64 nt, hsa
ucuggccaacauggugaaacccugucucuacugaaaauaaaaaaaacuagcugggcaugguggc

SEQ ID NO: 652293 - RNA, 64 nt, hsa
uugauucauuuuagaucucuggggaagaaaaaggaaauaaaaaccaucucaauaauuaagguaa

SEQ ID NO: 652294 - RNA, 64 nt, hsa
gacuuaugguccaaaaaagugacccaauggcaacaaauaaaaauugaaaugcaguuguucuccu

SEQ ID NO: 652295 - RNA, 64 nt, hsa
agccuaggagacaaaacgagacuucauuuaaaaaaaauaaaaauaaaaauaaaaauaaagucau

SEQ ID NO: 652296 - RNA, 64 nt, hsa
ggagacaaaacgagacuucauuuaaaaaaaauaaaaauaaaaauaaaaauaaagucaucuugcc

SEQ ID NO: 652297 - RNA, 64 nt, hsa
aaaacgagacuucauuuaaaaaaaauaaaaauaaaaauaaaaauaaagucaucuugccacccac

SEQ ID NO: 652298 - RNA, 64 nt, hsa
acaagaucuguaauguuauuuccacuuauaaaggaaauaaaaaaugaaaaacauuauuuggaua

SEQ ID NO: 652299 - RNA, 64 nt, hsa
aaaaaaugaaaaacauuauuuggauaucaaaagcaaauaaaaacccaauucagucucuucuaag

SEQ ID NO: 652300 - RNA, 64 nt, hsa
accuuaguuacauccuaggaaaaaauacuuccuaaaauaaaacuaagguaucauccuuacccuu

SEQ ID NO: 652301 - RNA, 64 nt, hsa
cuuaaaucuccaggcuuuuuaaagcacaaaauauaaauaaaagcugggaaaguaaaccaaaauu

SEQ ID NO: 652302 - RNA, 64 nt, hsa
caaguuggagcaauugucuguguuugaaaagaugaaauaaaaauaauaaucaagggcaaagcuu

SEQ ID NO: 652303 - RNA, 64 nt, hsa
uccccauuccaagaaauauaagugagugaaguugaaauaaaaucuuuaaaauuuacuauauugc

SEQ ID NO: 652304 - RNA, 64 nt, hsa
aacaguucucuuguauuuauuuaucaauuaaaucaaauaaaaaugauuaugucaaugcguuuuc

SEQ ID NO: 652305 - RNA, 64 nt, hsa
auacauuuuuuaggacaucuuaaaucuaaacaaaaaauaaaaugaacaucucuugaaaccuguu

SEQ ID NO: 652306 - RNA, 64 nt, hsa
cuuuagguuagggguucuauuuauuccuguuaguaaauaaaauuaacaaauuucuuuguuuaac

SEQ ID NO: 652307 - RNA, 64 nt, hsa
aguuauuaggaaacagaaggcaaaaagauugucaaaauaaaaacaauaauucaaguaacaaugc

SEQ ID NO: 652308 - RNA, 64 nt, hsa
acuguuuuugacaauuuuuuuaucaagaaagagcaaauaaaaagcagugguaaugauccaaagu

SEQ ID NO: 652309 - RNA, 64 nt, hsa
uaauuaugaagaugaaacacuagagucauauaagaaauaaaaauugggcaauaaaauaaaauga

SEQ ID NO: 652310 - RNA, 64 nt, hsa
cuagagucauauaagaaauaaaaauugggcaauaaaauaaaaugauucaguguuucuuuucuau

SEQ ID NO: 652311 - RNA, 64 nt, hsa
cauauugucaccuguaccugucacacaucuugaaaaauaaaacgauaauagaacuagugacuaa

SEQ ID NO: 652312 - RNA, 64 nt, hsa
gauugaagugcagagaaaaaucccuuagauugcaaaauaaaauaguugaacucucugucuucau

SEQ ID NO: 652313 - RNA, 63 nt, hsa; identical to SEQ ID NO: 628887

SEQ ID NO: 652314 - RNA, 64 nt, hsa
ugucucaaaaaauaaaauaaaauaaaauaaaauaaaauaaaauaaaauaaaauaaaauaaaaua

SEQ ID NO: 652315 - RNA, 64 nt, hsa
cacucugucucaaaaaauaaaauaaaauaaaauaaaauaaaauaaaauaaaauaaaauaaaaua

SEQ ID NO: 652316 - RNA, 64 nt, hsa
agugacacucugucucaaaaaauaaaauaaaauaaaauaaaauaaaauaaaauaaaauaaaaua

SEQ ID NO: 652317 - RNA, 64 nt, hsa
aacagagugacacucugucucaaaaaauaaaauaaaauaaaauaaaauaaaauaaaauaaaaua

SEQ ID NO: 652318 - RNA, 64 nt, hsa
ugggcaacagagugacacucugucucaaaaaauaaaauaaaauaaaauaaaauaaaauaaaaua

SEQ ID NO: 652319 - RNA, 64 nt, hsa
cagccugggcaacagagugacacucugucucaaaaaauaaaauaaaauaaaauaaaauaaaaua

SEQ ID NO: 652320 - RNA, 64 nt, hsa
gccagagacugguguuugauggauguuuuauacuaaauaaaacccaucagcaugggguuaugua

SEQ ID NO: 652321 - RNA, 64 nt, hsa
cuaaguaaaggccccagugaaaaacauacuggggaaauaaaaccucugagaaaagguucaagca

SEQ ID NO: 652322 - RNA, 64 nt, hsa
auccacuuagagcaauaaccacuuuuuaaauguaaaauaaaaagacaaaugaaaaggcacaucc

SEQ ID NO: 652323 - RNA, 64 nt, hsa
aggaggcugcacuacaaacccaaauucugcaaaaaaauaaaaauaagccacaaaacuaaaaggc

SEQ ID NO: 652324 - RNA, 64 nt, hsa
uauauauaugugaggauguaucgggaagauuucuaaauaaaaguuuuacaaaggggccuuagga

SEQ ID NO: 652325 - RNA, 64 nt, hsa
gaugacaagaugguacaaccuuuauucuuuuccaaaauaaaacaaagggcacagcaucuguagu

SEQ ID NO: 652326 - RNA, 64 nt, hsa
uagugccaaaaacuuuuuaaaagguaaaaaaauaaaauaaaauuacaacaugaagauucagauu

SEQ ID NO: 652327 - RNA, 64 nt, hsa
ccuuguagugccaaaaacuuuuuaaaagguaaaaaaauaaaauaaaauuacaacaugaagauuc

SEQ ID NO: 652328 - RNA, 64 nt, hsa
cugcgaaacuauacuuguauuaaaugugcuuuuuaaauaaaagcucguaacacaacuaauuaag

SEQ ID NO: 652329 - RNA, 64 nt, hsa
ugacuuuaguucaggaaguuuuguuuuguguuuuaaauaaaaggaaagagcaaguuugcucagu

SEQ ID NO: 652330 - RNA, 64 nt, hsa
uguuuuuuuuccguaacauugucugcugcaauuuaaauaaaaauuacgacauuuuaagauauuu

SEQ ID NO: 652331 - RNA, 64 nt, hsa
gucacaugagcuuuaguuuguuuucugguuuaaaaaauaaaaagguuucucuuaacaguauuuc

SEQ ID NO: 652332 - RNA, 64 nt, hsa
aaaauauugggauaaagugaaaguuccauuuccuaaauaaaaacuaauaaaauauaguacuuuc

SEQ ID NO: 652333 - RNA, 64 nt, hsa
gaaaguguucuagcucgaguggaagaacucauugaaauaaaaacaaagucuaccucugaagaaa

SEQ ID NO: 652334 - RNA, 64 nt, hsa
cucuuguaucucaauauuuuuaaaccacaggccuaaauaaaacuaauuuugcucaaguuuucuc

SEQ ID NO: 652335 - RNA, 64 nt, hsa
aguaacuggaguagcugggauuuacuaguaguguaaauaaaauucacucuucaauacaugaaug

SEQ ID NO: 652336 - RNA, 64 nt, hsa
auuugccacaaaaccuguauuacugaauaauaucaaauaaaauaucauaaagcauuuuaaauau

SEQ ID NO: 652337 - RNA, 64 nt, hsa
uggcuuauuucuaugacaaauucaagagcuagaaaaauaaaauguuucauuaugcacuuuuaga

SEQ ID NO: 652338 - RNA, 64 nt, hsa
gcucuuuccaaauuaaaacaaauauacauuuucuaaauaaaaauauguaauuucaaaauacauu

SEQ ID NO: 652339 - RNA, 64 nt, hsa
aggaaauaauucucugcuguguauuguauuuuucaaauaaaaauuuaaaaauucaauugaaaac

SEQ ID NO: 652340 - RNA, 64 nt, hsa
acaaaaaugugaugaccaaaugaacaaaauucuuaaauaaaacauucacuuuaguuucucacag

SEQ ID NO: 652341 - RNA, 64 nt, hsa
auuuucauaucauuugcauugaguugaaaacugcaaauaaaaguuugucacuugagcuuaugua

SEQ ID NO: 652342 - RNA, 64 nt, hsa
gauuuauaauaauaugggcugcaaguacaccugcaaauaaaacuacuagaauacugcuaguuaa

SEQ ID NO: 652343 - RNA, 64 nt, hsa
aaaauaauguucuuuuuaugcaaauccccugugaaaauaaaauuuucaauguuuuuuuggucuu

SEQ ID NO: 652344 - RNA, 64 nt, hsa
caauuugaauaagucaugcuuuccuagaauuuaaaaauaaaaaagucuuccucuggaaagagaa

SEQ ID NO: 652345 - RNA, 64 nt, hsa
cucuguuucuaagugccaagcacagaaagccgcuaaauaaaaucuuugcaauuguuuucugcau

SEQ ID NO: 652346 - RNA, 64 nt, hsa
ugauuccacagcaugcagccugguaggggaaggaaaauaaaagggugugaagaaggaauaguuu

SEQ ID NO: 652347 - RNA, 64 nt, hsa
agaaggaaacauauguucuccccuacauuaguaaaaauaaaaauggaauuuuuuacccauacaa

SEQ ID NO: 652348 - RNA, 64 nt, hsa
gccuggacaacauagugagaccuugucuccacaaaaauaaaaaagaaacuauccaggaguggug

SEQ ID NO: 652349 - RNA, 64 nt, hsa
uuuuuaaaaauuaaaagauuaaauaaaaaauauuaaauaaaacauggcaauaagugucagacua

SEQ ID NO: 652350 - RNA, 64 nt, hsa
cuguuaauggguuuuuuuuaaaaauuaaaagauuaaauaaaaaauauuaaauaaaacauggcaa

SEQ ID NO: 652351 - RNA, 64 nt, hsa
aacguuuucuggaacaaggcagguacaaauaaaaaaauaaaacuuuggaaagcacuuucuagaa

SEQ ID NO: 652352 - RNA, 64 nt, hsa
ccaccuucaacguuuucuggaacaaggcagguacaaauaaaaaaauaaaacuuuggaaagcacu

SEQ ID NO: 652353 - RNA, 64 nt, hsa
gggucuuguuuggauccugacucaaauuaagaaaaaauaaaacuaccuacgaaauacuaagaaa

SEQ ID NO: 652354 - RNA, 64 nt, hsa
cuggcuucuauaacaaauaaaugggaaaaaaaugaaauaaaaagaagagagggaggaagaaagg

SEQ ID NO: 652355 - RNA, 64 nt, hsa
guccugccacuguagcgccuuuuuaaaauaaauaaaauaaaauaaagcaccauuuuguuucccu

SEQ ID NO: 652356 - RNA, 64 nt, hsa
gcagcguccugccacuguagcgccuuuuuaaaauaaauaaaauaaaauaaagcaccauuuuguu

SEQ ID NO: 652357 - RNA, 64 nt, hsa
agagugagacucugucucaaaaaauaaauaaauaaaauaaaaugaaauagaucuuauuauucug

SEQ ID NO: 652358 - RNA, 64 nt, hsa
gugacagagugagacucugucucaaaaaauaaauaaauaaaauaaaaugaaauagaucuuauua

SEQ ID NO: 652359 - RNA, 64 nt, hsa
uaguuaauaguaauauugcuauuuacauggaaacaaauaaaagaucucagaauucacuacuggu

SEQ ID NO: 652360 - RNA, 64 nt, hsa
caucccucuauuuuaaucuguuaugaaggaagguaaauaaaaaugcuaaauagaagaaauugua

SEQ ID NO: 652361 - RNA, 64 nt, hsa
aacaugaccaauguuuuucaucugccacaucucaaaauaaaacuucuggugaaacaaauuaaac

SEQ ID NO: 652362 - RNA, 64 nt, hsa
augacccauaguauuaaauacauaucauuuuuaaaaauaaaaaaaaacccaaaaauaaugcaug

SEQ ID NO: 652363 - RNA, 64 nt, hsa
guugccuuuuuaaaauaauuauacuugcacaugaaaauaaaauauaaagucaauaauaguccuu

SEQ ID NO: 652364 - RNA, 64 nt, hsa
aagauauucuaauguacucucaauaauucuacagaaauaaaacuguaaagugcaaugugaaauc

SEQ ID NO: 652365 - RNA, 53 nt, hsa
gggaggaaacucaacuuugauaaaaauaaaaugagaaacuuuuuuccuacaaa

SEQ ID NO: 652366 - RNA, 64 nt, hsa
gggugacagagcaagacucugucucaaaaaauaaaaauaaaaauaaauuugguucuaauagaac

SEQ ID NO: 652367 - RNA, 64 nt, hsa
cagccugggugacagagcaagacucugucucaaaaaauaaaaauaaaaauaaauuugguucuaa

SEQ ID NO: 652368 - RNA, 64 nt, hsa
augauaacuauuauuugugcaacauuacucuuugaaauaaaaauuggcauguagccaauguuuc

SEQ ID NO: 652369 - RNA, 64 nt, hsa
uaauauuguauuuccuuacuguuuuaucuauuguaaauaaaaagcauuuuaaaaaguauugaca

SEQ ID NO: 652370 - RNA, 64 nt, hsa
agcauuacaaaagaguaaguaucucacaaauaggaaauaaaacuaaaacguggauuuaaaaaga

SEQ ID NO: 652371 - RNA, 64 nt, hsa
guuuaaguugcuacuauucaacuacacuauauauaaauaaaauauauacaauauauacauuguu

SEQ ID NO: 652372 - RNA, 64 nt, hsa
augguuuauuauagaauaccaauguauagcuuagaaauaaaacuuugaauauuucaagaauaua

SEQ ID NO: 652373 - RNA, 64 nt, hsa
aaacugcugaaauaaaaugacuguuacauuuuucaaauaaaacuuuuacuuugaacuauuuuga

SEQ ID NO: 652374 - RNA, 64 nt, hsa
cucuuuaagaaaaaggacaauuuuuaaacugcugaaauaaaaugacuguuacauuuuucaaaua

SEQ ID NO: 652375 - RNA, 64 nt, hsa
auuuggcaaauuuuauaaugaaguuuuaaguugaaaauaaaauguagcaacauuuugaucacuu

SEQ ID NO: 652376 - RNA, 64 nt, hsa
aacugucuuuuuaacaaaacauuuucaguauuuuaaauaaaauuuuguaaaguaaugugaauua

SEQ ID NO: 652377 - RNA, 64 nt, hsa
aguuuccuacacgcuaacuucguuugugcgauugaaauaaaauugcaguauauauauguugcuu

SEQ ID NO: 652378 - RNA, 64 nt, hsa
ggguacaagugguccaaacuaagauaagagacuaaaauaaaaugcuaaaucuuaaaagaaacug

SEQ ID NO: 652379 - RNA, 64 nt, hsa
ugaauuuucuuuucuguccaaacaaguaaaauaaaaauaaaagucuauuuagauguugauucuc

SEQ ID NO: 652380 - RNA, 64 nt, hsa
agcugaugaauuuucuuuucuguccaaacaaguaaaauaaaaauaaaagucuauuuagauguug

SEQ ID NO: 652381 - RNA, 64 nt, hsa
ggauuaaacaaguauaaaauaaaauacauuuauaaaauaaaaaggaaaacagacuuaaauuuuc

SEQ ID NO: 652382 - RNA, 64 nt, hsa
augugcuaggucuaagauggauuaaacaaguauaaaauaaaauacauuuauaaaauaaaaagga

SEQ ID NO: 652383 - RNA, 64 nt, hsa
agaaggauuuuauucucaacagaugcaaaaugcaaaauaaaauauuggcaaacaauacagcaac

SEQ ID NO: 652384 - RNA, 64 nt, hsa
aauaguaauuaaaaugagaaauacauaagaugauaaauaaaaugaaggugaagguauuccagau

SEQ ID NO: 652385 - RNA, 64 nt, hsa
gcuuggcgacagagcaagacccccucucaaaaauaaauaaaauaaaguaaaauaaauauaaaua

SEQ ID NO: 652386 - RNA, 64 nt, hsa
ugagaccccugucuauauauuuuuuuaauuuaaaaaauaaaagaauaaaauuguguagcucagu

SEQ ID NO: 652387 - RNA, 64 nt, hsa
uauuguagauacaauuuucugauuaaaucuggaaaaauaaaaggcagccuguuuuuucugcuuu

SEQ ID NO: 652388 - RNA, 64 nt, hsa
uuguauuaacagcugagguagcuaaaguuauuuaaaauaaaauuaaauuuaugauccaaguagc

SEQ ID NO: 652389 - RNA, 64 nt, hsa
auguacagauuaaaauuauugcuacauuugaggaaaauaaaauugcuugcuucuauguaauucc

SEQ ID NO: 652390 - RNA, 64 nt, hsa
auacacuggugguguccuucuuacaaaacuuuugaaauaaaaaaaaaacucaaaucuucacugu

SEQ ID NO: 652391 - RNA, 64 nt, hsa
uuucaguguguaaauuuccuuuuagcuuauacaaaaauaaaauaauuuaaaagaaauuuagccu

SEQ ID NO: 652392 - RNA, 64 nt, hsa
auaguaccauacaugaguuauuucuaaguuugaaaaauaaaaagaaauugcaucacacuaauua

SEQ ID NO: 652393 - RNA, 64 nt, hsa
uaaauuaacaugaaauacuucauuuugauugagaaaauaaaaucagauuuuuucaaagucaauu

SEQ ID NO: 652394 - RNA, 64 nt, hsa
gggagcaucuguauuuuuauguuaaaagcccacaaaauaaaaauaaaaaguaacugagaugaau

SEQ ID NO: 652395 - RNA, 64 nt, hsa
aucuguauuuuuauguuaaaagcccacaaaauaaaaauaaaaaguaacugagaugaauuuaccu

SEQ ID NO: 652396 - RNA, 64 nt, hsa
aagcauucauuguuuuauuaauacuuuuuuucuaaaauaaaacuuguacaccaguuuauuacuc

SEQ ID NO: 652397 - RNA, 64 nt, hsa
aauagaacauuuauuaauauguaggaauguuaagaaauaaaacauuuaauaagaucucagaaga

SEQ ID NO: 652398 - RNA, 64 nt, hsa
cacauguuugacucaaauuguggagcaaaauaguaaauaaaauauaaaaaugaaaaugaagaua

SEQ ID NO: 652399 - RNA, 64 nt, hsa
ggggguuacccaaauagguucacagaagaaccagaaauaaaaccugccuuucuagacuguaagu

SEQ ID NO: 652400 - RNA, 64 nt, hsa
gcugguaaagcuucugaauauugaguuugcugagaaauaaaaaucaaaacuucuuuaagcuggu

SEQ ID NO: 652401 - RNA, 64 nt, hsa
gaaguccuuaccucuuuauauuguuugcagguuuaaauaaaacaguguggugccauuuugacuc

SEQ ID NO: 652402 - RNA, 64 nt, hsa
cccaggccaugcugguggugauuuuuuagccccuaaauaaaacacuggacuauuuccuguuuac

SEQ ID NO: 652403 - RNA, 64 nt, hsa
uacagcuguuguaauaaugaccuauuucuauauaaaauaaaauuguauggcuuauguguaaauu

SEQ ID NO: 652404 - RNA, 58 nt, hsa
cugaagauaauuuacagugaccccaucuaaauaaaauacugcuuuugcaaacagaaca

SEQ ID NO: 652405 - RNA, 64 nt, hsa
acauagugaauuuuaaaauguagaagaaagcaaaaaauaaaauaaguccuaaagugaagaagcc

SEQ ID NO: 652406 - RNA, 64 nt, hsa
aacaaaaugaaguuaacuuaguguuuagcauuaaaaauaaaaguuguaccuugacccuagaauu

SEQ ID NO: 652407 - RNA, 64 nt, hsa
guagaccugauuuucaaaaucugcccucagaugaaaauaaaauaaacgaaacauuuagacaaug

SEQ ID NO: 652408 - RNA, 59 nt, hsa
acuucugcauggaacucugagcaagauguaaauaaaauuaaaagguggauggcaagagu

SEQ ID NO: 652409 - RNA, 64 nt, hsa
gagcuucaaauaagcaccuuuuuauuauguaaauaaauaaaaguuaucuguauccccacugcau

SEQ ID NO: 652410 - RNA, 64 nt, hsa
gagcgagaccuugucucuaaaaauaauaguaauaaaauaaaaauaacguuuuaugacuauuuau

SEQ ID NO: 652411 - RNA, 64 nt, hsa
augaaucuguuuugagaauccucuccauuuucccaaauaaaaaccuaucacaacagugacuaua

SEQ ID NO: 652412 - RNA, 64 nt, hsa
uuuuaauguguuauaauugaccuugcauggugugaaauaaaaguuuaaacacugguguauuuca

SEQ ID NO: 652413 - RNA, 64 nt, hsa
uugcaguaccuuuuucugguaaauuuuguagcagaaauaaaaugacaauuccuaagagccacug

SEQ ID NO: 652414 - RNA, 64 nt, hsa
uacaugugggugaaaaaccaaucuaauuuuguauaaauaaaaacaggcuccuggaaggugaaaa

SEQ ID NO: 652415 - RNA, 64 nt, hsa
ggagauuguaaaaucuguaaaguuuguuuugugaaaauaaaauguucacaguagaauuuuucuc

SEQ ID NO: 652416 - RNA, 64 nt, hsa
cagaauacagauuuaaaaguuugccuguagagcaaaauaaaacagucaguuguagucauuaauc

SEQ ID NO: 652417 - RNA, 64 nt, hsa
ucaaauaaauuuaaauaaauuuuaaauaaauuuuaaauaaaauuuuacagagacguggucucac

SEQ ID NO: 652418 - RNA, 64 nt, hsa
uggaugucucgcuucacaauaaaacacagcuuaaaaauaaaauaacugaaagaaauagaauuca

SEQ ID NO: 652419 - RNA, 64 nt, hsa
ccugcuguuuuggaaaugcacaguugacauguugaaauaaaaaugaauaccauuuuuaaauguu

SEQ ID NO: 652420 - RNA, 64 nt, hsa
uauagauuagaaaaauuccuaagaaucagaguagaaauaaaagugaaugaaagauuaaacagau

SEQ ID NO: 652421 - RNA, 64 nt, hsa
uucuucagucagaaaacuuuaaaaaauauuuauuaaauaaaaucaauuuuuaggaaguuuucug

SEQ ID NO: 652422 - RNA, 64 nt, hsa
uuacgucuccccuguaaaaggggcaaaaagaaaaaaauaaaaagcauuuuaaaaucauggaauu

SEQ ID NO: 652423 - RNA, 64 nt, hsa
aaaaaauaaaaagcauuuuaaaaucauggaauugaaauaaaauaauguauuuuguuuuaaaacu

SEQ ID NO: 652424 - RNA, 54 nt, hsa
cugaaagagauugcuaauaaaaucaaauaaaacuguaugaacucuaauggagaa

SEQ ID NO: 652425 - RNA, 64 nt, hsa
cauaagauaugagauacaugaaccugaacuauuaaaauaaaauauuauauuuaacccuuaguuu

SEQ ID NO: 652426 - RNA, 64 nt, hsa
ccuggccaacauggcaaaaccacaucucuacuaaaaauaaaaaaauuagcugggugugguggug

SEQ ID NO: 652427 - RNA, 64 nt, hsa
cacaacauucacuauguuugcaaggaauuaacacaaauaaaagaugccuuuuuacuuaaacacc

SEQ ID NO: 652428 - RNA, 64 nt, hsa
uaaauaguuuccuaugcaacgugucuuguagcacaaauaaaauucuacaaaaguugcaguaaau

SEQ ID NO: 652429 - RNA, 64 nt, hsa
guguguguguguuuucuguacccaaccagacuuuaaauaaaacaaacaugaaaccuaauguacg

SEQ ID NO: 652430 - RNA, 64 nt, hsa
uuguuaugaaauaaaaaaaagauggguuuuguaaaaauaaaaaaaaaauauuuuuagcagaaca

SEQ ID NO: 652431 - RNA, 64 nt, hsa
aggaaguacagacguacuuuaaauuuuuguuaugaaauaaaaaaaagauggguuuuguaaaaau

SEQ ID NO: 652432 - RNA, 64 nt, hsa
gaaauuguucuuuuaaaauauguguaacuucuaaaaauaaaacuuaaaauuuauauguauuaag

SEQ ID NO: 652433 - RNA, 64 nt, hsa
uaguuuggguucauuucuauaacauuuuguaagaaaauaaaaguuugagcaccugauuauauuu

SEQ ID NO: 652434 - RNA, 64 nt, hsa
uccagaggucauggaacagaaagccuuauaaaccaaauaaaaauucucaaaauacauugguuua

SEQ ID NO: 652435 - RNA, 64 nt, hsa
augagcuuaggauagagagugggcucauuggccuaaauaaaaagagaagaccagaagucuuuga

SEQ ID NO: 652436 - RNA, 64 nt, hsa
gcuacagagcacccagugauuuuacugaggauuaaaauaaaaaaccguaggaaugggcucaaca

SEQ ID NO: 652437 - RNA, 64 nt, hsa
aaaauauguuuacauuggauaaaggauuaggcaaaaauaaaauguuucaaggauuccugaccau

SEQ ID NO: 652438 - RNA, 64 nt, hsa
cucucugagagaaaaggguguuuuaaauuuaaaaaaauaaaaacaaaaaaguuugauugagaca

SEQ ID NO: 652439 - RNA, 64 nt, hsa
cagagcaagacuccaucucaguaaauaaauaaauaaauaaaaagcgcugcaguagcuguggccu

SEQ ID NO: 652440 - RNA, 64 nt, hsa
agauucugagcaaucauagagucaucuaaguuguaaauaaaaccuugcauagcacaauuuaucu

SEQ ID NO: 652441 - RNA, 64 nt, hsa
aauauucuaaauaaaacugacauuuacucuugacaaauaaaacauauauuuacuaaaauguguu

SEQ ID NO: 652442 - RNA, 64 nt, hsa
auauacauuuucauuuuuuguacuugaauauucuaaauaaaacugacauuuacucuugacaaau

SEQ ID NO: 652443 - RNA, 64 nt, hsa
uaaaaugggaacauggacaccauuucugaccuucaaauaaaacuuauuauguauugguuuucag

SEQ ID NO: 652444 - RNA, 64 nt, hsa
uaagauuuguucauaaaauggucugauccaggaaaaauaaaaugggaacauggacaccauuucu

SEQ ID NO: 652445 - RNA, 64 nt, hsa
gcaguauuuauuaaaacauacuuuuuuuuucuucaaauaaaaaaguaaccaugucuuugucuaa

SEQ ID NO: 652446 - RNA, 64 nt, hsa
gauuuuuugccaucguugauaaaaaugcaaagucaaauaaaaggugucuugguuugaugucaua

SEQ ID NO: 652447 - RNA, 64 nt, hsa
uaucaccacagauaaagauuuuguuuugcccugcaaauaaaaagacaauuccuuauugucugaa

SEQ ID NO: 652448 - RNA, 64 nt, hsa
auaaaaucuugucuagcacaguuaaagucauuaaaaauaaaaaugacagcuuuagcacaauuuu

SEQ ID NO: 652449 - RNA, 64 nt, hsa
gaguuauguuggauaguuuuauuucuguggcugaaaauaaaaucuugucuagcacaguuaaagu

SEQ ID NO: 652450 - RNA, 64 nt, hsa
uuauuuuaagcuuguaaaauacacuguggugauaaaauaaaagagcuggguuugacuuuugagu

SEQ ID NO: 652451 - RNA, 64 nt, hsa
uaaugaaggguuuuuuaaaagaacuaaauaaaacaaauaaaacuaggcuacagguauagcugac

SEQ ID NO: 652452 - RNA, 64 nt, hsa
gaauaaaacuaaugaaggguuuuuuaaaagaacuaaauaaaacaaauaaaacuaggcuacaggu

SEQ ID NO: 652453 - RNA, 64 nt, hsa
gagcaagacucuaucucaaaaauaaaauaaaauaaaauaaaauaauuaauaaaaugguguagua

SEQ ID NO: 652454 - RNA, 64 nt, hsa
caacagagcaagacucuaucucaaaaauaaaauaaaauaaaauaaaauaauuaauaaaauggug

SEQ ID NO: 652455 - RNA, 64 nt, hsa
cugagcaacagagcaagacucuaucucaaaaauaaaauaaaauaaaauaaaauaauuaauaaaa

SEQ ID NO: 652456 - RNA, 64 nt, hsa
ccagccugagcaacagagcaagacucuaucucaaaaauaaaauaaaauaaaauaaaauaauuaa

SEQ ID NO: 652457 - RNA, 64 nt, hsa
cauaucucuaauuuacuuugaaauucaaaggugaaaauaaaaaaugauggccuaaguaaaauuu

SEQ ID NO: 652458 - RNA, 64 nt, hsa
agagaaagaaacugcauguuuguuguugaugaugaaauaaaaaugcuagcgacagucuuucuua

SEQ ID NO: 652459 - RNA, 64 nt, hsa
auucauuucacuuuaaagucuuuccgucucccuaaaauaaaaaccagaaucauaauuuucaaga

SEQ ID NO: 652460 - RNA, 64 nt, hsa
uuauguauuauuuucuauagcucuucuauuuaaaaaauaaaaaaauacaguaaaguuuaaaaaa

SEQ ID NO: 652461 - RNA, 64 nt, hsa
auuacauuuuaguaauuguuuucaagacaacaaaaaauaaaacauuucauuauucuuguauauu

SEQ ID NO: 652462 - RNA, 64 nt, hsa
accuucaugauaccagugagaagccaggcuagagaaauaaaauccugaauuacauuuuaguaau

SEQ ID NO: 652463 - RNA, 64 nt, hsa
ugagauugugguuuuuucuuccuaauguaaaauaaaauaaaacacaucugccuucuugauauuu

SEQ ID NO: 652464 - RNA, 64 nt, hsa
ugcuuugagauugugguuuuuucuuccuaauguaaaauaaaauaaaacacaucugccuucuuga

SEQ ID NO: 652465 - RNA, 64 nt, hsa
gguugugaaugugaaagggggaauggaggaauggaaauaaaauugggaugagcccuaauggagg

SEQ ID NO: 652466 - RNA, 64 nt, hsa
augugaaauuaugaaaguauuuuauuguucauagaaauaaaaaacacaguuacuuugcauuugg

SEQ ID NO: 652467 - RNA, 64 nt, hsa
auguuuuuguaacauuuaagcauauuucagauguaaauaaaagauuguaaaauauacgguuuuu

SEQ ID NO: 652468 - RNA, 64 nt, hsa
gucucguuagaguauuugaugucaugcaccaaaaaaauaaaaccccaccuuguugcaaaagcug

SEQ ID NO: 652469 - RNA, 64 nt, hsa
cauuaucacacaaagagaccaauaaaaauaaaaaaaauaaaaaaaaaaaaagacgaacuauugg

SEQ ID NO: 652470 - RNA, 64 nt, hsa
uguguaggucauuaucacacaaagagaccaauaaaaauaaaaaaaauaaaaaaaaaaaaagacg

SEQ ID NO: 652471 - RNA, 64 nt, hsa
uucugaugagcacugacaaaggauaugguacuaaaaauaaaaugugaaaugucaaagacauguc

SEQ ID NO: 652472 - RNA, 64 nt, hsa
ucaggaaucacuauguauuuccuucuugugauaaaaauaaaauuacgagaaggcaaugugaggu

SEQ ID NO: 652473 - RNA, 64 nt, hsa
uuuguucuuguauugcuuucuuucaacaguuucaaaauaaaauaucauauaaauauugagggaa

SEQ ID NO: 652474 - RNA, 64 nt, hsa
ugauucauauauuuuaugaaucagaauaaccuucaaauaaaauaaaucuaagucgguuaaaaug

SEQ ID NO: 652475 - RNA, 64 nt, hsa
aaauauuuucauuauacaugaaauucaacuuuccaaauaaaaguucuacuucauguaauccaaa

SEQ ID NO: 652476 - RNA, 64 nt, hsa
gcacagagucagaagcugccaccuuagagaacugaaauaaaaauagaaguucuuacgcuuuuuu

SEQ ID NO: 652477 - RNA, 64 nt, hsa
ugguacagaugcuuucgacaauuuaaagaaagcuaaauaaaaauguagacauggcuggcgcagu

SEQ ID NO: 652478 - RNA, 64 nt, hsa
ccucaacugugucugauguuucuucucauguaagaaauaaaaaauaaaaauaaaauaaaauaua

SEQ ID NO: 652479 - RNA, 64 nt, hsa
ugugucugauguuucuucucauguaagaaauaaaaaauaaaaauaaaauaaaauauauugguau

SEQ ID NO: 652480 - RNA, 64 nt, hsa
ugauguuucuucucauguaagaaauaaaaaauaaaaauaaaauaaaauauauugguauguaacu

SEQ ID NO: 652481 - RNA, 64 nt, hsa
uuucuucucauguaagaaauaaaaaauaaaaauaaaauaaaauauauugguauguaacuacagg

SEQ ID NO: 652482 - RNA, 64 nt, hsa
aaauaaaauauauugguauguaacuacaggaaaaaaauaaaaaauauauaguggacaguaaccu

SEQ ID NO: 652483 - RNA, 64 nt, hsa
aaaaaaagauguuauacaaccaucaaaguggcaaaaauaaaaaaaaucaaguauuggcaaagau

SEQ ID NO: 652484 - RNA, 64 nt, hsa
aauagaaugagugaaucaccugugguauauuuauaaauaaaaauauuaaauagaagguaaaaca

SEQ ID NO: 652485 - RNA, 64 nt, hsa
auaaaaaugacaacaaaguaaaaggguaucccaaaaauaaaacuauccuuuuggaaaaaaaaag

SEQ ID NO: 652486 - RNA, 64 nt, hsa
agaaacuacugaauucucuguuugucuguuguggaaauaaaaccuucuggggaugaaucaaaac

SEQ ID NO: 652487 - RNA, 64 nt, hsa
aauucagauauacuuuaucuuuuuaaaaaaguguaaauaaaaucaaagaauguaaagucuaucu

SEQ ID NO: 652488 - RNA, 64 nt, hsa
uuucuaaauucauguacuguauguccauaagugaaaauaaaaugucauauucuuuucuauuauu

SEQ ID NO: 652489 - RNA, 64 nt, hsa
auggaucacacgauuucuuuaagggaauuaaaaaaaauaaaagaauuacggcuuuuacagcaac

SEQ ID NO: 652490 - RNA, 64 nt, hsa
ucuggacggacuuauuaaaauacaaacagacaaaaaauaaaacaaaacuugaguucuauuuacc

SEQ ID NO: 652491 - RNA, 64 nt, hsa
guagucauuaggugcccuucucugaaguuauguaaaauaaaagcaucugauccuucaaggauaa

SEQ ID NO: 652492 - RNA, 64 nt, hsa
aucccuugaaaaggaaauauuuucuguuucuuauaaauaaaagaguaaucuuacuuucagaagg

SEQ ID NO: 652493 - RNA, 64 nt, hsa
cuuagugaaacauguguaacauugaaugcauguuaaauaaaaauggaauuucuaacuuuuuuuc

SEQ ID NO: 652494 - RNA, 64 nt, hsa
augaauauauccacccaccuagauuuuaagcaguaaauaaaacauuucgcaaaagauuaaaguu

SEQ ID NO: 652495 - RNA, 64 nt, hsa
ucuaaauaaacaaagaugauuucuuugacacuugaaauaaaauacaaauucaacaaaaaguaga

SEQ ID NO: 652496 - RNA, 64 nt, hsa
acauaauaagagguguaaaaacuaucacaggaagaaauaaaaacagauuuuugaaggugagaug

SEQ ID NO: 652497 - RNA, 64 nt, hsa
cuggacaacagagcaagacucugucucaaaaaaaaaauaaaaaauaaaaaauaaaaaauaaaag

SEQ ID NO: 652498 - RNA, 64 nt, hsa
acagagcaagacucugucucaaaaaaaaaauaaaaaauaaaaaauaaaaaauaaaagaaacaua

SEQ ID NO: 652499 - RNA, 64 nt, hsa
aagacucugucucaaaaaaaaaauaaaaaauaaaaaauaaaaaauaaaagaaacauaagauaag

SEQ ID NO: 652500 - RNA, 64 nt, hsa
ugucucaaaaaaaaaauaaaaaauaaaaaauaaaaaauaaaagaaacauaagauaaguaccucu

SEQ ID NO: 652501 - RNA, 64 nt, hsa
ucugagcaacauggcaaaacccugugucuacaaaaaauaaaaaauuagcugggcaugacggcca

SEQ ID NO: 652502 - RNA, 64 nt, hsa
aacaaaagucaagauuuuauuaccaaacuuauagaaauaaaaauuauuagaaagaaauacuaug

SEQ ID NO: 652503 - RNA, 64 nt, hsa
uuuuuaguucuuaaaaauuuauuuuuaaguucuaaaauaaaauaaaaauaaguucuuaaaauuu

SEQ ID NO: 652504 - RNA, 64 nt, hsa
aguucuuaaaaauuuauuuuuaaguucuaaaauaaaauaaaaauaaguucuuaaaauuuauuuu

SEQ ID NO: 652505 - RNA, 64 nt, hsa
uugcuuggauacauaugaaugaugcuuuccccucaaauaaaacaucugcauuauucugaaacuc

SEQ ID NO: 652506 - RNA, 64 nt, hsa
cuuauaauaaagaauggguugggggaagggggagaaauaaaagccaagaagaggaaacaagaua

SEQ ID NO: 652507 - RNA, 64 nt, hsa
cuuuguaacuuccugugaauuuauaauaauuucaaaauaaaacaaguuaaaaaaaaacccacua

SEQ ID NO: 652508 - RNA, 64 nt, hsa
uauugauugguuuuauaguucauugaaaauccucaaauaaaauauaauuauuacugaaauaugu

SEQ ID NO: 652509 - RNA, 64 nt, hsa
auggauccuaguccuuuucauuaccugaugguagaaauaaaauaauugauuuuaaauuccuuug

SEQ ID NO: 652510 - RNA, 64 nt, hsa
gcguaacguaaaguguauucuguacauaauuuacaaauaaaacauuuuauuuuaauuguuacuu

SEQ ID NO: 652511 - RNA, 64 nt, hsa
accuauuuugggguauaaacaugguguuuuucagaaauaaaaauuauuucauuaaccuuuacua

SEQ ID NO: 652512 - RNA, 64 nt, hsa
auucuguguuaaaucauuucaggguuuaauuuugaaauaaaagauuaauauaaaaugcaacaac

SEQ ID NO: 652513 - RNA, 64 nt, hsa
uaccuuuuuuuuuuuuuuuuacuuugaagucuuuaaauaaaauguauaauacccauugagagug

SEQ ID NO: 652514 - RNA, 64 nt, hsa
uaccucucugugccucaguuuucccaugcaugaaaaauaaaauaaaauaaaacggggauucuaa

SEQ ID NO: 652515 - RNA, 64 nt, hsa
cucugugccucaguuuucccaugcaugaaaaauaaaauaaaauaaaacggggauucuaauguuu

SEQ ID NO: 652516 - RNA, 64 nt, hsa
ugccucaguuuucccaugcaugaaaaauaaaauaaaauaaaacggggauucuaauguuuguaag

SEQ ID NO: 652517 - RNA, 64 nt, hsa
accaaacaggaaagaacuaugucugaaauauaaaaaauaaaaauaaaaaaacaacuaugaauau

SEQ ID NO: 652518 - RNA, 64 nt, hsa
caggaaagaacuaugucugaaauauaaaaaauaaaaauaaaaaaacaacuaugaauaugcacaa

SEQ ID NO: 652519 - RNA, 64 nt, hsa
cauuuugccugacaauugcaaaucagagcauacaaaauaaaacugugcaguuuuguuugguuua

SEQ ID NO: 652520 - RNA, 64 nt, hsa
uuuuuucuaguuuuuaauuuuaacaucagaacugaaauaaaaaauuauggauacguguuuugaa

SEQ ID NO: 652521 - RNA, 64 nt, hsa
ccugggcaacauagugagaccuugucucuacaaaaaauaaaauaaaauaaaaaccaaauuagcc

SEQ ID NO: 652522 - RNA, 64 nt, hsa
gcaacauagugagaccuugucucuacaaaaaauaaaauaaaauaaaaaccaaauuagccagaca

SEQ ID NO: 652523 - RNA, 64 nt, hsa
auagugagaccuugucucuacaaaaaauaaaauaaaauaaaaaccaaauuagccagacauggug

SEQ ID NO: 652524 - RNA, 64 nt, hsa
uuucuuuuccagaaauacaaugcuagguguuuugaaauaaaacuuauauagcaauuguuuaaag

SEQ ID NO: 652525 - RNA, 64 nt, hsa
uagguauuuaucaacugcagauguuauugaaagaaaauaaaauucagucucaagaguaaacccu

SEQ ID NO: 652526 - RNA, 64 nt, hsa
uuugagaauguacuaaaaaccaaugaacuuuaaaaaauaaaaauaaacaaaaaaaauucaacag

SEQ ID NO: 652527 - RNA, 64 nt, hsa
aaacaacccaaaugucuaccaacugaugaaugggaaauaaaauguggucuguccacgcaaugga

SEQ ID NO: 652528 - RNA, 64 nt, hsa
ugcaauuuuuacuaucaugcaaauaagcuuagguaaauaaaacuaauagaucaccuuagaaaau

SEQ ID NO: 652529 - RNA, 64 nt, hsa
gcacugccguaauucaaauuuguuuuuauuuuggaaauaaaaguucacuguacuuuuuuuucau

SEQ ID NO: 652530 - RNA, 64 nt, hsa
cucuuaaaauaaaauccauuuccuauuucucuuaaaauaaaauccauuauucuuaauauggccu

SEQ ID NO: 652531 - RNA, 64 nt, hsa
gauuaugcuuaacagcuguuuccuguuucucuuaaaauaaaauccauuuccuauuucucuuaaa

SEQ ID NO: 652532 - RNA, 64 nt, hsa
uguuauaaugcguaaagauauugaaaauauaaugaaauaaaagcaucuuagguuauaccaucuu

SEQ ID NO: 652533 - RNA, 64 nt, hsa
acaaaaugugaaaugucuaaauaucuguucauaaaaauaaaaggaaaacauguuucuucaaauu

SEQ ID NO: 652534 - RNA, 64 nt, hsa
acuaaucgagcacuucucaccaaacuucauguauaaauaaaauacauauuuuuaaaacaaacca

SEQ ID NO: 652535 - RNA, 64 nt, hsa
uguuuucacgcaggucauauugucaguccuacaaaaauaaaaggcuuccagaggagaguggccu

SEQ ID NO: 652536 - RNA, 64 nt, hsa
aauguauauaugucuugcucagauuauuugguuuaaauaaaacaaccuugagguuuguagcuuu

SEQ ID NO: 652537 - RNA, 64 nt, hsa
aguggaaacaaacauguauugaaauacauauuggaaauaaaaaugguuugagcgucagugauau

SEQ ID NO: 652538 - RNA, 64 nt, hsa
uuacuuuuauacuuaaguauuguuuauguuugaaaaauaaaaagcauuuauuguuuuugcaaua

SEQ ID NO: 652539 - RNA, 64 nt, hsa
agauacaguauuuaguaaaagagaaaguuucaggaaauaaaacuacaucuagaaguauaagcau

SEQ ID NO: 652540 - RNA, 64 nt, hsa
acccugucucaaaaaauauauauuuaaaaaauaaaaauaaaagcugaccccaaagacaaauaag

SEQ ID NO: 652541 - RNA, 64 nt, hsa
agagagacccugucucaaaaaauauauauuuaaaaaauaaaaauaaaagcugaccccaaagaca

SEQ ID NO: 652542 - RNA, 64 nt, hsa
uuuuauuauuuucaucuuuauugaucaaauuugaaaauaaaauucacaauguaauacuacuacu

SEQ ID NO: 652543 - RNA, 64 nt, hsa
aaaaauaauaauaauaauaauaaaguaaaaauaaaaauaaaaaaguaaucagaagcuaaaguaa

SEQ ID NO: 652544 - RNA, 64 nt, hsa
caucucaaaaauaauaauaauaauaauaaaguaaaaauaaaaauaaaaaaguaaucagaagcua

SEQ ID NO: 652545 - RNA, 64 nt, hsa
agcccucauauaauagguuugaaaguacuccuuaaaauaaaacacuguuucccuuuggaacuau

SEQ ID NO: 652546 - RNA, 64 nt, hsa
aauaaagugagacccugucacuaacaaaauuaaaaaauaaaauaaauauaaaauauaggcuuua

SEQ ID NO: 652547 - RNA, 64 nt, hsa
uauguuauguauauuuuaccacaauaaaugcaaaaaauaaaaagucuguguucuaaacaauucu

SEQ ID NO: 652548 - RNA, 64 nt, hsa
aacccccauuuuaauuacuaugucuagguuuuuuaaauaaaaaucuuuucuuuuuaacauguuu

SEQ ID NO: 652549 - RNA, 64 nt, hsa
caggcuuacuaauuuuugugauauuuucauguucaaauaaaauguuuuuuuguauuuucuccaa

SEQ ID NO: 652550 - RNA, 64 nt, hsa
aaugggguguuaaagccguuuuuuauuuuuuucuaaauaaaaagagaacccaugcuuuuaugga

SEQ ID NO: 652551 - RNA, 64 nt, hsa
uguuuguuaguaugaaaaguuaacuuuuuuuccaaaauaaaagagugaauuuuucauguuaagu

SEQ ID NO: 652552 - RNA, 64 nt, hsa
uuaaguuaaaaaucuuugucuuguacuauuucaaaaauaaaaagacagcaaugacuuuauaucc

SEQ ID NO: 652553 - RNA, 64 nt, hsa
acaauagaacagaaauuugggacauuuuucuaggaaauaaaauuccucgguguauuaaucuaag

SEQ ID NO: 652554 - RNA, 64 nt, hsa
aauaccauauggaaaucuuuuaauaaauauauguaaauaaaauaaaaaauauuugucuccaccu

SEQ ID NO: 652555 - RNA, 64 nt, hsa
cauauggaaaucuuuuaauaaauauauguaaauaaaauaaaaaauauuugucuccaccuuuucc

SEQ ID NO: 652556 - RNA, 64 nt, hsa
agaauuugcaguggcaucuaaagagaucuuuuuuaaauaaaaauuauguauuguggcauaaucc

SEQ ID NO: 652557 - RNA, 64 nt, hsa
guauggauacauccauucacugugguacauuuuaaaauaaaauauuuuagcagugaauauggau

SEQ ID NO: 652558 - RNA, 64 nt, hsa
gaauucaccacagcuggaauagcuguggaaaacaaaauaaaacaacaaaauuaauaaugaaaug

SEQ ID NO: 652559 - RNA, 64 nt, hsa
ugcaaacaaauuauuuuuuacaaaaaaacaaaauaaauaaaauuagacuuccuucccucacuau

SEQ ID NO: 652560 - RNA, 64 nt, hsa
aagaaaaaaaaaucuuuucaaaauuuacuuugucaaauaaaaauuuguuuuucagagauuuacc

SEQ ID NO: 652561 - RNA, 64 nt, hsa
aaauauuuuguggcaaugaagaaaacacuacggaaaauaaaaaauaagauaaagccuuaugagc

SEQ ID NO: 652562 - RNA, 64 nt, hsa
ugacaaaacccuuuagauaauuaucuuccauuuuaaauaaaauuuuauuucacaaauaugagcc

SEQ ID NO: 652563 - RNA, 64 nt, hsa
ugcuuuaaugucaaguuugcagaauugucucugaaaauaaaaacccugacuuuaguuguaaaac

SEQ ID NO: 652564 - RNA, 64 nt, hsa
gaucuguagaagacauuuugggaaacacugucuuaaauaaaaacucaauguuuaguuguuuuuu

SEQ ID NO: 652565 - RNA, 64 nt, hsa
uguauaaaacugucuuuuaagaauuauccuuucaaaauaaaaauguuauuguuucacuaguuua

SEQ ID NO: 652566 - RNA, 64 nt, hsa
gaaauauugaaaauauugaaaauauuauuauugaaaauaaaaucuugaucucaacuauccccca

SEQ ID NO: 652567 - RNA, 64 nt, hsa
auuugguuaguaccuucacugagcaauaguggaaaaauaaaaaaauaaguaaacagaaaaaacu

SEQ ID NO: 652568 - RNA, 64 nt, hsa
uuauuauuuuaaguaacuagaaccaccaaauaucaaauaaaauuauuugguuaugguuauguuc

SEQ ID NO: 652569 - RNA, 64 nt, hsa
cuguuauuuuuaagcuuuuauuucuuguagcuaaaaauaaaacaucauaaaucugguagguaaa

SEQ ID NO: 652570 - RNA, 64 nt, hsa
guucuccucuaucuuagagggguauucuucuugaaaauaaaaaauauugaaaugcuguauuuuu

SEQ ID NO: 652571 - RNA, 64 nt, hsa
gcaucaucuguuuguaaucauuaucucacuuuguaaauaaaaacacaccuuaaaacaugaacaa

SEQ ID NO: 652572 - RNA, 64 nt, hsa
uuaaagaaaaguauauucaaugaagaugaaauuuaaauaaaaaaggacagagucuauccuccag

SEQ ID NO: 652573 - RNA, 64 nt, hsa
cauagcugcaauguguacaauggcugauuuaauuaaauaaaauguacaaguguuaaauguggca

SEQ ID NO: 652574 - RNA, 64 nt, hsa
augacuuuagugacauuauaaaacugaaacuggaaaauaaaauggcuuaucugcugauguuuau

SEQ ID NO: 652575 - RNA, 64 nt, hsa
aaauggcuuaucugcugauguuuaucuuuaaaauaaauaaaaucuugcuagugugaauauaucu

SEQ ID NO: 652576 - RNA, 64 nt, hsa
uauauauuuaugauaaaucuuuuccauuuguacaaaauaaaauuccauuucauugugaccuacu

SEQ ID NO: 652577 - RNA, 64 nt, hsa
cuauauuuauguaacuguauacugaauucugacaaaauaaaaaaagauaccuuauugacgaaau

SEQ ID NO: 652578 - RNA, 64 nt, hsa
acauucuaguaacuggccacuggaaaauaaauaaaaauaaaaacuaggguuuuaaaaguaucuu

SEQ ID NO: 652579 - RNA, 64 nt, hsa
auaaaaacauucuaguaacuggccacuggaaaauaaauaaaaauaaaaacuaggguuuuaaaag

SEQ ID NO: 652580 - RNA, 64 nt, hsa
ucaaaccacagagaaaauauuuauaacaugcaaaaaauaaaaacauucuaguaacuggccacug

SEQ ID NO: 652581 - RNA, 64 nt, hsa
aggacagaagcaucucuacagaugaaaauuacauaaauaaaacauucuccaucaacaacuauau

SEQ ID NO: 652582 - RNA, 64 nt, hsa
aaucauguugguuuuaauagugucaauuuuuguaaaauaaaaauuaaacuucaaacucuuuacu

SEQ ID NO: 652583 - RNA, 64 nt, hsa
ccuaccauaaaaugcuaaaaauaugcacuguuucaaauaaaaccaagaaaugcagcauuauaua

SEQ ID NO: 652584 - RNA, 64 nt, hsa
caguuuacuagauuaccaaguguuacaucauauuaaauaaaauguagcagaaccaucugcauca

SEQ ID NO: 652585 - RNA, 64 nt, hsa
cuugguuuuaaauguugacaauauuuacaaguggaaauaaaauuuguaaauauaugaaagaugc

SEQ ID NO: 652586 - RNA, 64 nt, hsa
uggauguuuugaaagugagcauucauuuaaggauaaauaaaaaauaaaguaguaauaaagaaua

SEQ ID NO: 652587 - RNA, 64 nt, hsa
uucuuuauguuuuaugaaaguguugcagucccuaaaauaaaaauauugaggaacauugcuugua

SEQ ID NO: 652588 - RNA, 64 nt, hsa
cucccaaauauguucaauucuuaugucgcucaaaaaauaaaauuuaauuuaaaaaguaucugau

SEQ ID NO: 652589 - RNA, 64 nt, hsa
uggaagcuaaaaaaauugauaucauagaaguaaaaaauaaaacagaggauacuacaggcuggga

SEQ ID NO: 652590 - RNA, 64 nt, hsa
agccugggugacagagugagacugucucaaaauaaaauaaaaauaacauauuggugaagaugcg

SEQ ID NO: 652591 - RNA, 64 nt, hsa
acuccagccugggugacagagugagacugucucaaaauaaaauaaaaauaacauauuggugaag

SEQ ID NO: 652592 - RNA, 64 nt, hsa
uaauacccacaaaacuuaaaauauaaaauguuuuaaauaaaaauaaagaaaagauuucccacaa

SEQ ID NO: 652593 - RNA, 64 nt, hsa
cugggaaguugaaaguggggaaugaagagauaauaaauaaaacuagauuggccauauguuuaua

SEQ ID NO: 652594 - RNA, 64 nt, hsa
aauguugaaaccaacugaacugccaacaaaauaaaaauaaaaagucuucacuauguagcauacc

SEQ ID NO: 652595 - RNA, 64 nt, hsa
ucaauaaauguugaaaccaacugaacugccaacaaaauaaaaauaaaaagucuucacuauguag

SEQ ID NO: 652596 - RNA, 64 nt, hsa
ccagcauuuguauuuugcaucauuaaauaaaaagaaauaaaaauacuucuguauucuucagaua

SEQ ID NO: 652597 - RNA, 64 nt, hsa
auauaucaagccagcauuuguauuuugcaucauuaaauaaaaagaaauaaaaauacuucuguau

SEQ ID NO: 652598 - RNA, 64 nt, hsa
aguaguguuaaccucaaauaggcuaaaugugaacaaauaaaauacagcaaauacucagauacag

SEQ ID NO: 652599 - RNA, 64 nt, hsa
uaaggcagcagucauuuguguauucaggcuuuuuaaauaaaauuagagcuguaaggaaaaugaa

SEQ ID NO: 652600 - RNA, 64 nt, hsa
gugacuauuugaaucaaaaauguauugaaucaucaaauaaaagaauguggcuauuuuggggaga

SEQ ID NO: 652601 - RNA, 64 nt, hsa
uuaucauaucuuccauuccuguuauuggagaugaaaauaaaaagcaacuuaugaaaguagacau

SEQ ID NO: 652602 - RNA, 64 nt, hsa
uuuuuucucuguccuuuugguaugauuaaacaagaaauaaaagguguuguggaaacuuaaaauu

SEQ ID NO: 652603 - RNA, 64 nt, hsa
uauccuagucaaacaaaauuuacuugguugguccaaauaaaauaaauuguuuuugacuaaguga

SEQ ID NO: 652604 - RNA, 64 nt, hsa
augcaguaagaaaacuguaaaauucgagccauauaaauaaaaccuguacuguucuaguuguuuu

SEQ ID NO: 652605 - RNA, 64 nt, hsa
uaaggauuacuuugucugcccaccaccuaguguaaaauaaaaucaaguaauacaaucuuaacug

SEQ ID NO: 652606 - RNA, 64 nt, hsa
ccuaacuuuaguagcaaaucuugauuaauugaagaaauaaaauauuucggauaagguuucauaa

SEQ ID NO: 652607 - RNA, 64 nt, hsa
uaaaaccacuaauuguuccguuaagcuucacagaaaauaaaaccucuauuacuagacauuuaug

SEQ ID NO: 652608 - RNA, 64 nt, hsa
gagauugcaccacugcacuccagcuugggugauaaaauaaaauaaaauagucgugaaucuuguu

SEQ ID NO: 652609 - RNA, 64 nt, hsa
ugcaccacugcacuccagcuugggugauaaaauaaaauaaaauagucgugaaucuuguucaaaa

SEQ ID NO: 652610 - RNA, 64 nt, hsa
ugucuucgagauguagaaauaaggaauauucugaaaauaaaaauuauacaguaguaaagauaau

SEQ ID NO: 652611 - RNA, 64 nt, hsa
gcaggagugcccugcauuguuuucuuuuaauuagaaauaaaaaguauuagucuaaaugugguuc

SEQ ID NO: 652612 - RNA, 64 nt, hsa
aucacagaaaugauauucugcaagaauuucuuuuaaauaaaaaguuugggggugcaauauaaga

SEQ ID NO: 652613 - RNA, 64 nt, hsa
uuguauauuuauuguauuaacacagagugucauaaaauaaaaugcuguuuacuggauguuuguu

SEQ ID NO: 652614 - RNA, 64 nt, hsa
ucagauaaaauauauuuugggaaauuaacugaacaaauaaaaaguuuuugauauaacuucaauu

SEQ ID NO: 652615 - RNA, 64 nt, hsa
aaauguuuuagauaagacacaauaaaauuauuauaaauaaaagcuuaauguuuguaaaaaaucu

SEQ ID NO: 652616 - RNA, 64 nt, hsa
caucaguauaaaagugccaaaccugcccucuuuuaaauaaaaauguaaaaaggccacucccagg

SEQ ID NO: 652617 - RNA, 64 nt, hsa
uaauuuuuuuuacaacccucugacucaacaaaguaaauaaaaguauauuuuaucacuauuaagc

SEQ ID NO: 652618 - RNA, 64 nt, hsa
uuaaauauuauugacuuacaguuuaaaaauaaauaaauaaaagcauacuauaguuguaaaaaca

SEQ ID NO: 652619 - RNA, 64 nt, hsa
ugaauauuugcucauguuuucuaaauuccuuauaaaauaaaauuaauucgaauucaaucugcac

SEQ ID NO: 652620 - RNA, 64 nt, hsa
acacgauccucuuucugggcauuccuaggggagaaaauaaaauuuguaauguucuagagaucau

SEQ ID NO: 652621 - RNA, 64 nt, hsa
uaauaugagacauacuguuacuaaacauaaguucaaauaaaaaguuguucuguuaaaaaaaaaa

SEQ ID NO: 652622 - RNA, 64 nt, hsa
ggagccuacuucuagcuguauuuuuuguaugcuuaaauaaaaauaaaaauucauaaccaaagag

SEQ ID NO: 652623 - RNA, 64 nt, hsa
uacuucuagcuguauuuuuuguaugcuuaaauaaaaauaaaaauucauaaccaaagagaauccc

SEQ ID NO: 652624 - RNA, 64 nt, hsa
aaaaguucuauuuucccuguauugguaucuccuuaaauaaaauaaaauauuccuauuguaagug

SEQ ID NO: 652625 - RNA, 64 nt, hsa
uucuauuuucccuguauugguaucuccuuaaauaaaauaaaauauuccuauuguaagugauaug

SEQ ID NO: 652626 - RNA, 64 nt, hsa
gugauaugagaaaucuuuaaccagccuuaucuaaaaauaaaaagagaagccauuguaagacauu

SEQ ID NO: 652627 - RNA, 64 nt, hsa
cuccagccugggcaauaagagcaaaacuccaucaaaauaaaauaaaauaaaauauaaaauaacu

SEQ ID NO: 652628 - RNA, 64 nt, hsa
gccugggcaauaagagcaaaacuccaucaaaauaaaauaaaauaaaauauaaaauaacuuaaaa

SEQ ID NO: 652629 - RNA, 64 nt, hsa
ggcaauaagagcaaaacuccaucaaaauaaaauaaaauaaaauauaaaauaacuuaaaaagaac

SEQ ID NO: 652630 - RNA, 64 nt, hsa
gcugauguauaaaacagacuaugccuuauaauugaaauaaaauuauaaucugccugaaaaugaa

SEQ ID NO: 652631 - RNA, 64 nt, hsa
gaaauaaaauuauaaucugccugaaaaugaauaaaaauaaaacauuuugaaaugugugguugag

SEQ ID NO: 652632 - RNA, 64 nt, hsa
uauguaacuuaaaucuagacaccaucaaagcauaaaauaaaaauaaaaagcguugcugaaucug

SEQ ID NO: 652633 - RNA, 64 nt, hsa
acuuaaaucuagacaccaucaaagcauaaaauaaaaauaaaaagcguugcugaaucugggucga

SEQ ID NO: 652634 - RNA, 64 nt, hsa
ugucuagauuauauagguuuagguugaaguuauaaaauaaaauaaaauucauuuuccacuggaa

SEQ ID NO: 652635 - RNA, 64 nt, hsa
agauuauauagguuuagguugaaguuauaaaauaaaauaaaauucauuuuccacuggaacucua

SEQ ID NO: 652636 - RNA, 64 nt, hsa
auuuggugcucucauucauggcaaaggauuugauaaauaaaaguucuuuaaacacuaaagcaaa

SEQ ID NO: 652637 - RNA, 64 nt, hsa
caauauauuuguagguauacuauguaagggcuuuaaauaaaagagguccauuaauacuuccuua

SEQ ID NO: 652638 - RNA, 64 nt, hsa
uccaccaauaucauguguagauauuauguauagaaaauaaaauaaauuauggcucuaacuucug

SEQ ID NO: 652639 - RNA, 64 nt, hsa
auuaucccucaaaaaguuaccaccacaucagaaaaaauaaaaaaaaaauaguaaaguaggcaga

SEQ ID NO: 652640 - RNA, 64 nt, hsa
ugccaacuucaucaaguaaugcaugcuuuauuauaaauaaaauucuagcuuugaaaggcguuau

SEQ ID NO: 652641 - RNA, 64 nt, hsa
auacuucuccauacacagaccucugcagaaugcaaaauaaaacuugcagugaaugaauuuagca

SEQ ID NO: 652642 - RNA, 64 nt, hsa
uauuuuugaagacuauuuuucuaugacuuagguaaaauaaaagacuauuuucuauuuucccagu

SEQ ID NO: 652643 - RNA, 64 nt, hsa
uucuacucuaaagcuucuauaaaauauaguuuggaaauaaaaauguucuuacacaaggggcaaa

SEQ ID NO: 652644 - RNA, 64 nt, hsa
uuuugcuguuaguuauaaaacuauguguucaaugaaauaaaagcacacugcuuaguauucuuga

SEQ ID NO: 652645 - RNA, 64 nt, hsa
gaccaccaguaaauaauccuccuucaaaaaauaaaaauaaaagaaaaaggaaaaucauucagga

SEQ ID NO: 652646 - RNA, 64 nt, hsa
cuuuuagaccaccaguaaauaauccuccuucaaaaaauaaaaauaaaagaaaaaggaaaaucau

SEQ ID NO: 652647 - RNA, 64 nt, hsa
gauaauacaguccaugcaaaguagggucauagagaaauaaaagcaugcccucagcuuuuaauga

SEQ ID NO: 652648 - RNA, 64 nt, hsa
ccuucgugucauugugauauuugacaacucuaaaaaauaaaaaaaaaaaacuuagagcacaaua

SEQ ID NO: 652649 - RNA, 64 nt, hsa
cuuuuuuuuuuuuuuuuggcuuugggaaaagucaaaauaaaacaaccagaaaaccccugaagga

SEQ ID NO: 652650 - RNA, 64 nt, hsa
gagcaggagaagauggggagggggugggagugggaaauaaaauauuuagcccuuccuugguagg

SEQ ID NO: 652651 - RNA, 64 nt, hsa
ccccacagagugccuagaaucuuaauaaugaauaaaauaaaaagcagcaauaugucauuaacaa

SEQ ID NO: 652652 - RNA, 64 nt, hsa
uccccugagaucuagcugaugcuuagauccuuugaaauaaaaauuaugucuuuauaacucugau

SEQ ID NO: 652653 - RNA, 64 nt, hsa
uaaaauauuuauuauauugguaaaaauucugguuaaauaaaaaauuagagaucacucuuggcug

SEQ ID NO: 652654 - RNA, 64 nt, hsa
ggcacagaauuuuuuugacauagauaauuuaguaaaauaaaaauucagcuuauaauaaugauac

SEQ ID NO: 652655 - RNA, 64 nt, hsa
caguuaacuuggugcuaaugugcccuggugaaauaaauaaaagaugggcaguuucuguggcauu

SEQ ID NO: 652656 - RNA, 64 nt, hsa
uauuuaauauuugacugauuucaauaacugugaaaaauaaaaaagguguuguauugcuugugag

SEQ ID NO: 652657 - RNA, 64 nt, hsa
aaaaaguuuacauuaauuauucaguguugugaguaaauaaaaaugugugcucuuuacuguuuuu

SEQ ID NO: 652658 - RNA, 64 nt, hsa
agaugugauacacugaauggaaauaaauagauguaaauaaaauugaguucucauuuaacuguua

SEQ ID NO: 652659 - RNA, 64 nt, hsa
uaaguaucuaggaguauuuaaauccuuuucccauaaauaaaaguacaguuuucuugguggcaga

SEQ ID NO: 652660 - RNA, 64 nt, hsa
uguauguugcuauccugcaggaaauauaaacuuaaaauaaaauuauauaccccacaggcugugu

SEQ ID NO: 652661 - RNA, 64 nt, hsa
aaggaauauauuuaauuauauucauauauuuaacaaauaaaaauauguugaauuuucguauugu

SEQ ID NO: 652662 - RNA, 64 nt, hsa
ugguuagcaaggcaagauccccaacucuacaaaaaaauaaaaauuaaaaaaaaauuauuaggcu

SEQ ID NO: 652663 - RNA, 64 nt, hsa
cugccucuccccucccccaguuucuccuccccuaaaauaaaaauaguggucaacuuuaguaaua

SEQ ID NO: 652664 - RNA, 64 nt, hsa
cauuuguaagcagaacucuagcuauaugggguagaaauaaaaucucugagaugaaacaaaggaa

SEQ ID NO: 652665 - RNA, 64 nt, hsa
uucuguuugcagauaugauugauguauuucaccaaaauaaaauauuuuuauguuuauaaagugu

SEQ ID NO: 652666 - RNA, 64 nt, hsa
uuauagaauaaauauucagcugugaaaacugguuaaauaaaacuaauauuucuuaacacauuug

SEQ ID NO: 652667 - RNA, 64 nt, hsa
aggcacugauaaaaccgcaacaaaaacauguaagaaauaaaauagaaaugcuuuauauaauuua

SEQ ID NO: 652668 - RNA, 64 nt, hsa
uuuuuguguuuggaguguaguccauuugcaauagaaauaaaaaaauccgucaccaaauuguaac

SEQ ID NO: 652669 - RNA, 64 nt, hsa
caagugugcaaauuaugacugcgugagccuuagaaaauaaaauguauaaagggcaacacaugag

SEQ ID NO: 652670 - RNA, 64 nt, hsa
cuuguuuucauuuuuguuguacguguagaucuguaaauaaaauugcaguauuuaaagcuuaagc

SEQ ID NO: 652671 - RNA, 64 nt, hsa
uacccucuugagguaggaaaugcucugugaugguaaauaaaauuggagcagacagaaaagauau

SEQ ID NO: 652672 - RNA, 64 nt, hsa
ggucauaaguuaacuguauuaagaacaguaaaauaaauaaaaaccaauaguacuaauuuugcuu

SEQ ID NO: 652673 - RNA, 64 nt, hsa
uguguauuuauuguuaauucuuaaaauaguguguaaauaaaauaacaucagugugcuuuaaaga

SEQ ID NO: 652674 - RNA, 64 nt, hsa
gagccuuaagucaaucucagaagguagcauaaacaaauaaaaauuaacuguauggcaugaucag

SEQ ID NO: 652675 - RNA, 64 nt, hsa
aggaauuguauuauuguguguauauauaauuuguaaauaaaaaguauggagaugauacgguguu

SEQ ID NO: 652676 - RNA, 64 nt, hsa
acuuguguacgaaaaauaaaucuccuuaaaaacuaaauaaaaugcacuguauucuuacaguuaa

SEQ ID NO: 652677 - RNA, 64 nt, hsa
auuaauacaguaguaguaaucauuuucuaggggaaaauaaaagaauaaaucacuauacugauau

SEQ ID NO: 652678 - RNA, 64 nt, hsa
gggugacaaagcaagacugugucucaaaauaaauaaauaaaauaaaauaaaaugacguacagag

SEQ ID NO: 652679 - RNA, 64 nt, hsa
acaaagcaagacugugucucaaaauaaauaaauaaaauaaaauaaaaugacguacagagauucu

SEQ ID NO: 652680 - RNA, 64 nt, hsa
gcaagacugugucucaaaauaaauaaauaaaauaaaauaaaaugacguacagagauucuauauu

SEQ ID NO: 652681 - RNA, 64 nt, hsa
aaauaucauuauucacucagacuuccauaagaguaaauaaaaaugaauaugcaguggcugacau

SEQ ID NO: 652682 - RNA, 64 nt, hsa
ugagcucauuauuaaucauaguuucaaaauuaucaaauaaaaccagugaagaucugaagaugca

SEQ ID NO: 652683 - RNA, 64 nt, hsa
accaaaaacauguauauaaaagaaugaaauugaaaaauaaaauauauaaacauaaauaaauuag

SEQ ID NO: 652684 - RNA, 64 nt, hsa
auucaaguuguacuuguuauaucugacaugaaugaaauaaaaucuuaauuacagaugcuuuuua

SEQ ID NO: 652685 - RNA, 64 nt, hsa
ugaaaauauuacauucaugauuauuuuauuuaguaaauaaaauaauagagagcccagaaaucaa

SEQ ID NO: 652686 - RNA, 64 nt, hsa
ccuuguauuauauagguugaaauuaaagaugaauaaauaaaauaaaaugacacaaggccaaaaa

SEQ ID NO: 652687 - RNA, 64 nt, hsa
uauuauauagguugaaauuaaagaugaauaaauaaaauaaaaugacacaaggccaaaaacaaau

SEQ ID NO: 652688 - RNA, 64 nt, hsa
gaagauuuuuuugaagauuaauuuauacccuauaaaauaaaacuuguuagcuucgaugaaguca

SEQ ID NO: 652689 - RNA, 64 nt, hsa
aaacguggagcauuguuucucacagagagucuccaaauaaaaaggguuuuguucagauuaaaau

SEQ ID NO: 652690 - RNA, 64 nt, hsa
agugcuuuaaacaaauagcaauacuuauagacugaaauaaaaugaaacuucaaauaagacuaug

SEQ ID NO: 652691 - RNA, 64 nt, hsa
ucaaagugauuuugaaaaucucuaauggcucagaaaauaaaaacauccaguuuguggaugacua

SEQ ID NO: 652692 - RNA, 64 nt, hsa
gucaguuuagcauuacauugucuugagcaccagaaaauaaaauccauauauuaauaaaaaccua

SEQ ID NO: 652693 - RNA, 64 nt, hsa
augcuauaaguauguacauacaguuucacuucaaaaauaaaaaaaaaaucccuaaaaacucucu

SEQ ID NO: 652694 - RNA, 64 nt, hsa
ccaauucacccagaaaaaagaccaauaggugcaaaaauaaaaggaaaaccagugaagugccaca

SEQ ID NO: 652695 - RNA, 64 nt, hsa
acaacauauuugggguuugcuuguaaaaccaacuaaauaaaaaauucaaaccaauucacccaga

SEQ ID NO: 652696 - RNA, 64 nt, hsa
guucuaugaauauggaaaggccagaggcagagugaaauaaaaugcuaucucaaaguuuaacaca

SEQ ID NO: 652697 - RNA, 64 nt, hsa
aaauguguauuuagaauauuuguauaacuguguaaaauaaaaaaggaauuauguggucagugca

SEQ ID NO: 652698 - RNA, 64 nt, hsa
guuacaaaccugugggccuguugcaauacuuuaaaaauaaaaaauuuuauuccauuugcuuguu

SEQ ID NO: 652699 - RNA, 64 nt, hsa
aaauguuaaauauuuuaugaguuuagaauauaguaaauaaaaggugauguaaaugaaugcugca

SEQ ID NO: 652700 - RNA, 64 nt, hsa
uuacugaaccauuaaauacuuauauacuaagaauaaauaaaauauacccaugugaaauaauaau

SEQ ID NO: 652701 - RNA, 64 nt, hsa
acuucugucauaauucuugcugagucaagaguguaaauaaaagaaauggcaggacucauauuau

SEQ ID NO: 652702 - RNA, 64 nt, hsa
gauuauuaucuagguuagacuuaaagugaaucucaaauaaaagaaucaggaauacaacuuaagu

SEQ ID NO: 652703 - RNA, 64 nt, hsa
uaaaguugggagaggagcaucuauuuucuuaaagaaauaaaacacccaaaacaauauaaaguug

SEQ ID NO: 652704 - RNA, 64 nt, hsa
uuuggauuaaauuaguuugugaaggauuauggaaaaauaaaacugucacuguuggacgucagca

SEQ ID NO: 652705 - RNA, 64 nt, hsa
auauucucuauuugaauuauuucugucacaguaaaaauaaaauacuuugaguuuugagcuacug

SEQ ID NO: 652706 - RNA, 64 nt, hsa
ugaauugcaauuuauuaaauauucuuauccucuuaaauaaaacugcucaacaguuaaucagcag

SEQ ID NO: 652707 - RNA, 64 nt, hsa
auguuuagcaggcuguaaacuuaagaaaaggguaaaauaaaauuuucuggagaggaacuuggaa

SEQ ID NO: 652708 - RNA, 64 nt, hsa
acucucugguaagacuugaaugugauuauuuuauaaauaaaagaaccacuaugaaacuuucaug

SEQ ID NO: 652709 - RNA, 64 nt, hsa
aaguucgaauuacaguugugagauugauuuauuuaaauaaaaauaugccuuugccaguuuugga

SEQ ID NO: 652710 - RNA, 64 nt, hsa
aaacaucaacaaaaacaaaacccacugugucuuaaaauaaaauguucugcauuguagucaauaa

SEQ ID NO: 652711 - RNA, 64 nt, hsa
cuucaacuaagcucuugcagagugagaugacuugaaauaaaaauguucuaugaauauugaauuu

SEQ ID NO: 652712 - RNA, 64 nt, hsa
aaaaaaaaaacaaaaaaaaaaaaacaaaagaaaaaaauaaaaauacgguggcaauauuauguaa

SEQ ID NO: 652713 - RNA, 64 nt, hsa
acauuauguguaacagauugauuuucucagcacaaaauaaaaagcaucuguauuaauguaaaga

SEQ ID NO: 652714 - RNA, 64 nt, hsa
guuauggaaaaugucaaccuuuguaagaaaaccaaaauaaaaauugaaaaauaaaaaccauaaa

SEQ ID NO: 652715 - RNA, 64 nt, hsa
caaccuuuguaagaaaaccaaaauaaaaauugaaaaauaaaaaccauaaacauuugcaccacuu

SEQ ID NO: 652716 - RNA, 64 nt, hsa
agccuggauaacagagcgagacccugucucaaaaaaauaaaauaaaaaauaaaaacacccuugc

SEQ ID NO: 652717 - RNA, 64 nt, hsa
ggauaacagagcgagacccugucucaaaaaaauaaaauaaaaaauaaaaacacccuugccugcg

SEQ ID NO: 652718 - RNA, 64 nt, hsa
agagcgagacccugucucaaaaaaauaaaauaaaaaauaaaaacacccuugccugcgcuccauu

SEQ ID NO: 652719 - RNA, 64 nt, hsa
ggaauuuuuuccuaaucauguuuuuaacauuuuaaaauaaaauuuaauacuaagaaauuauggc

SEQ ID NO: 652720 - RNA, 64 nt, hsa
ggcaugcacugcaagaauuaaguaucucagacugaaauaaaaccguucauaauuaaaguauuau

SEQ ID NO: 652721 - RNA, 64 nt, hsa
gaggaaacuguguuaggcauguauuaaaacauuuaaauaaaauaaaaauacauuucagcuacaa

SEQ ID NO: 652722 - RNA, 64 nt, hsa
aacuguguuaggcauguauuaaaacauuuaaauaaaauaaaaauacauuucagcuacaaaguga

SEQ ID NO: 652723 - RNA, 64 nt, hsa
cauucugccuugcuguagugaagagacccacuccaaauaaaaaaggggccacacggggcuucua

SEQ ID NO: 652724 - RNA, 64 nt, hsa
gaucagcaauaaugacuauguaaucucaaaaaacaaauaaaauauucuuaacauggacucuuaa

SEQ ID NO: 652725 - RNA, 64 nt, hsa
uccuuccccuuagcuuuauuaagguaucauugauaaauaaaaauaaaauauguuuaauguauau

SEQ ID NO: 652726 - RNA, 64 nt, hsa
cccuuagcuuuauuaagguaucauugauaaauaaaaauaaaauauguuuaauguauauaaugug

SEQ ID NO: 652727 - RNA, 64 nt, hsa
ggcgcaaacccuuuuccucccagccuauuuuuguaaauaaaauguuuaaacuugaaauacaaau

SEQ ID NO: 652728 - RNA, 64 nt, hsa
ugugaggcauguucugauauguuuauaggcaaacaaauaaaacagcaaacuuuuuugccacaug

SEQ ID NO: 652729 - RNA, 64 nt, hsa
accuuuaaacccauaaauuaauuuuauaucaauaaaauaaaauacuuucucuaguuuuggagcu

SEQ ID NO: 652730 - RNA, 64 nt, hsa
uacaguuuugugauauaaaauaaagcugaguauaaaauaaaaccaaucaaacacagaauuugau

SEQ ID NO: 652731 - RNA, 64 nt, hsa
guaacaaucagaggaacuauaagaacaccuuuagaaauaaaaauacugggaucaaacuggccug

SEQ ID NO: 652732 - RNA, 64 nt, hsa
ggacagucuagagacucuggagcuggauaacuaaaaauaaaaauauaugccaaagauuuucuug

SEQ ID NO: 652733 - RNA, 64 nt, hsa
uaaugaaagcaucaacagauaauuuuaaauugauaaauaaaaagcacaguuucaaaugguauca

SEQ ID NO: 652734 - RNA, 64 nt, hsa
uuggugaaaucaauaugucuugguauaguggcuuaaauaaaacaauuuuagccuuucucaguuu

SEQ ID NO: 652735 - RNA, 64 nt, hsa
gaaagccaguauuguuaaaauaccauuuuauacaaaauaaaaagcugcucucacugucagcucu

SEQ ID NO: 652736 - RNA, 64 nt, hsa
auuguuguguugagaugauauuuaacuuuuugccaaauaaaauauauugauucuuuucuauuuu

SEQ ID NO: 652737 - RNA, 64 nt, hsa
augauuguaaaguagcuguaagaauuucccagugaaauaaaaaaaaauuuuaaguguucucggg

SEQ ID NO: 652738 - RNA, 64 nt, hsa
gguguuucuuaugcacuuauaaaaugauuugaacaaauaaaacuaggaaccugcuauacaugug

SEQ ID NO: 652739 - RNA, 64 nt, hsa
auaaggcauucaauaaaugcacaacgcccaaaggaaauaaaauccuaucuaauccuacucucca

SEQ ID NO: 652740 - RNA, 64 nt, hsa
aacucuaaaaacaaaaauaauaauaaagaaaaauaaauaaaaaggagaggcagacaaugucugg

SEQ ID NO: 652741 - RNA, 64 nt, hsa
cucuucaucacagcuaucugucuuuuagugccacaaauaaaagaaaaucaaaucuuagcuguug

SEQ ID NO: 652742 - RNA, 64 nt, hsa
ugaaaaaaguaauagaaaucaagauguguugaugaaauaaaauguguaucugagugagaaaaca

SEQ ID NO: 652743 - RNA, 64 nt, hsa
uuaauuggauauugaugaaaucauuggccuggcaaaauaaaacauguugaauuccccaguuaug

SEQ ID NO: 652744 - RNA, 64 nt, hsa
auuagaauaauuucauacugaaauuauuuucuccaaauaaaaauuagauggaaaaaugugaaaa

SEQ ID NO: 652745 - RNA, 64 nt, hsa
cuaaaauaugaaauuuuguaagauguuuucaccuaaauaaaaauugaaagcaaguggauuacac

SEQ ID NO: 652746 - RNA, 64 nt, hsa
auacaucaaguucauuugcagaaacaaauaacugaaauaaaaaacauguuaauccuuguaucau

SEQ ID NO: 652747 - RNA, 64 nt, hsa
uuauaacacagucuuuaauuuucacucacuguggaaauaaaaacuaagguaacuucucagaaag

SEQ ID NO: 652748 - RNA, 64 nt, hsa
acaauuuuaaauaauucaucuuacaagucagguaaaauaaaaucgauucccagauuccauacau

SEQ ID NO: 652749 - RNA, 64 nt, hsa
aauuaguuaaaauauauuaaaaauauuauuaguaaaauaaaauuucacacaauaaaaaacaaca

SEQ ID NO: 652750 - RNA, 64 nt, hsa
ccauucaacugaacaacuaguugucaacuaaugaaaauaaaacauuuucucuaagcaucuuuag

SEQ ID NO: 652751 - RNA, 64 nt, hsa
aaacuuagguaaaugacauagacgcacuugggugaaauaaaacaacaaaaaagguaauccagua

SEQ ID NO: 652752 - RNA, 64 nt, hsa
uuuauccauuuauaggcuucaaaaguaaauuuuuaaauaaaauauauuagucgacuguguuacu

SEQ ID NO: 652753 - RNA, 64 nt, hsa
ccucauuucuuucugcccaaagaccucauucuuuaaauaaaacuuguuauuuuggcauauuucu

SEQ ID NO: 652754 - RNA, 64 nt, hsa
cucaucuccugaaccuguuauucugagaacucauaaauaaaauucagccaagauuaaucaauca

SEQ ID NO: 652755 - RNA, 64 nt, hsa
gcuguuuaaccguguaacaaaaaugccacgugaaaaauaaaaauuuuuauuguauagcaauucu

SEQ ID NO: 652756 - RNA, 64 nt, hsa
aaaauuaaauaaaacuaauaugaacauaaagaggaaauaaaagguaccuaacuugggcacagcu

SEQ ID NO: 652757 - RNA, 64 nt, hsa
accuacacacaauuuuagaaauaaauuaaaaauuaaauaaaacuaauaugaacauaaagaggaa

SEQ ID NO: 652758 - RNA, 64 nt, hsa
uagccugggcaacggugagacccugccucaaaaaaaauaaaaauaaaaauaaaacacuuuaauu

SEQ ID NO: 652759 - RNA, 64 nt, hsa
gggcaacggugagacccugccucaaaaaaaauaaaaauaaaaauaaaacacuuuaauuagaauc

SEQ ID NO: 652760 - RNA, 64 nt, hsa
cggugagacccugccucaaaaaaaauaaaaauaaaaauaaaacacuuuaauuagaaucuauuuu

SEQ ID NO: 652761 - RNA, 64 nt, hsa
aaaccaaaguuuauuaauaauuuuuauauaacuaaaauaaaauagauguggagggaucugugau

SEQ ID NO: 652762 - RNA, 64 nt, hsa
gugaaauuuagcaauaguuaauauuaggugacauaaauaaaacaucccagacuagugaguuaag

SEQ ID NO: 652763 - RNA, 64 nt, hsa
agaaaaacuugaaauguugacuuaagugagggggaaauaaaacccagagagagagagagagcga

SEQ ID NO: 652764 - RNA, 64 nt, hsa
cuauggugugaaauccuuuguuauuuuucuaaaaaaauaaaauuuaaaaagaaagaaaacuaag

SEQ ID NO: 652765 - RNA, 64 nt, hsa
guauuucaaagcucuuuuccuaacugguuaaguaaaauaaaaaauugagcuuucuagaauauuu

SEQ ID NO: 652766 - RNA, 64 nt, hsa
aaaaaagagagaguaacuacagaagaacuuuaaaaaauaaaaaauaagcuuaccuuggauucuu

SEQ ID NO: 652767 - RNA, 64 nt, hsa
guuuuguuuuucacaaagcucuuauuaugaagcaaaauaaaaauucuaguuucuuguaugauuu

SEQ ID NO: 652768 - RNA, 64 nt, hsa
gaguauuugcacugcugaagagucacuaugagcaaaauaaaacaaauaagacucaaacugcuca

SEQ ID NO: 652769 - RNA, 64 nt, hsa
uggcuucaggaaagucuagaagcaauauuucuucaaauaaaagguguuuaaacuuuuuucuguu

SEQ ID NO: 652770 - RNA, 64 nt, hsa
uuuuaaccagacuuucucuuaaaaacauuagauaaaauaaaagauucaccggauggauucugau

SEQ ID NO: 652771 - RNA, 64 nt, hsa
acugugaugcuauguuuguuucacuaaacuuucuaaauaaaaacugagaaaaaaaaaaucacug

SEQ ID NO: 652772 - RNA, 64 nt, hsa
guguaggagugaagacaggaucccgugcuuaaaaaaauaaaaaauaaaaaaauaaaaaaaaaau

SEQ ID NO: 652773 - RNA, 64 nt, hsa
agugaagacaggaucccgugcuuaaaaaaauaaaaaauaaaaaaauaaaaaaaaaauaagacuu

SEQ ID NO: 652774 - RNA, 64 nt, hsa
caggaucccgugcuuaaaaaaauaaaaaauaaaaaaauaaaaaaaaaauaagacuuuaacugca

SEQ ID NO: 652775 - RNA, 64 nt, hsa
uugcuucucgggaaagcaaagaagcugcuuuaaaaaauaaaaaggggacuaaaaauuuguuuug

SEQ ID NO: 652776 - RNA, 64 nt, hsa
aaaauuauaaauguuaaaaggaaguuauugaagaaaauaaaagaaauuauguuauauuaucuag

SEQ ID NO: 652777 - RNA, 64 nt, hsa
uuuguuaauaaauuugcuuuucacaccuuucuuuaaauaaaagguauaucucucuuucuugugg

SEQ ID NO: 652778 - RNA, 64 nt, hsa
uuugcauguaaacaaugauuucaaaauacuugaaaaauaaaauuuuaacccaaaugaauaacua

SEQ ID NO: 652779 - RNA, 64 nt, hsa
auaccuuuguauacucucaguucucauucaguauaaauaaaauuuuaaaauccuuucauaguuc

SEQ ID NO: 652780 - RNA, 64 nt, hsa
uuaaaaccccauuuuccuaaagaacaaaguaguaaaauaaaaaaaaauuuaaaaaauuaaaaaa

SEQ ID NO: 652781 - RNA, 64 nt, hsa
aguaguaaaauaaaaaaaaauuuaaaaaauuaaaaaauaaaaaaaagaggucacuaaaagacca

SEQ ID NO: 652782 - RNA, 64 nt, hsa
ugucaauuauuuucaaaugucuaaauuccuuuggaaauaaaaauaucaguuuuacuuugaaauu

SEQ ID NO: 652783 - RNA, 64 nt, hsa
ggaauguuuucauaaucgaaagaaacggguauccaaauaaaaccaaguucuugacauuggucug

SEQ ID NO: 652784 - RNA, 64 nt, hsa
augacaaacuacuucuauaaugcuuauuaugguaaaauaaaauuggaaaaaauuaaaacugacc

SEQ ID NO: 652785 - RNA, 64 nt, hsa
gaaauucaauaccaaauacaguaaaaacaaauguaaauaaaagaaaacacaucaucaauaaaac

SEQ ID NO: 652786 - RNA, 64 nt, hsa
cugacugauaguucuauauuuucaaaauauuugaaaauaaaaaguauucccaagugauuuuaau

SEQ ID NO: 652787 - RNA, 64 nt, hsa
gguaaacaaagaaaugacaaaaauaaaauaaauaaaauaaaaauggauagguggugacccacug

SEQ ID NO: 652788 - RNA, 64 nt, hsa
ggauagguaaacaaagaaaugacaaaaauaaaauaaauaaaauaaaaauggauagguggugacc

SEQ ID NO: 652789 - RNA, 64 nt, hsa
uuuaaaaaaggauagguaaacaaagaaaugacaaaaauaaaauaaauaaaauaaaaauggauag

SEQ ID NO: 652790 - RNA, 64 nt, hsa
caugaaaaaaggacaauuucaaaaaaauaaaauaaaauaaaaauaaauucaccuagucuaagga

SEQ ID NO: 652791 - RNA, 64 nt, hsa
uuugacaugaaaaaaggacaauuucaaaaaaauaaaauaaaauaaaaauaaauucaccuagucu

SEQ ID NO: 652792 - RNA, 64 nt, hsa
aauguuuugacaugaaaaaaggacaauuucaaaaaaauaaaauaaaauaaaaauaaauucaccu

SEQ ID NO: 652793 - RNA, 64 nt, hsa
gauucuaaauaaauaggggcuuauacaaaaaagaaaauaaaaagccauauauacugcaaaguuc

SEQ ID NO: 652794 - RNA, 64 nt, hsa
guugaguuuuuaauguuuacauguuuacaucucuaaauaaaauuugcuuauuugaaauguuaau

SEQ ID NO: 652795 - RNA, 64 nt, hsa
uacguaacuugcgaaucuguuuacccucacuugcaaauaaaauaagugcaaauaaagcaaugau

SEQ ID NO: 652796 - RNA, 64 nt, hsa
gucuauacacuucacacuuuauauaauaccucaaaaauaaaaauaugaaaacaguacacuguug

SEQ ID NO: 652797 - RNA, 64 nt, hsa
cagggaccuuuggaaauaaaaccuguucugucccaaauaaaaccagccugugauguucaaggga

SEQ ID NO: 652798 - RNA, 64 nt, hsa
guucauugucauugcuguguucagggaccuuuggaaauaaaaccuguucugucccaaauaaaac

SEQ ID NO: 652799 - RNA, 64 nt, hsa
caaaaccagacccaucuuguugccuauugugauaaaauaaaaagacggcuguauauaacauauu

SEQ ID NO: 652800 - RNA, 64 nt, hsa
agcugauuuuuaaugauaaagcugcagaugggcuaaauaaaagccaaauuaauccuacaaucag

SEQ ID NO: 652801 - RNA, 64 nt, hsa
agagugugaccuaaaugcuuuugucuugucacugaaauaaaagauggcauuaugugguuaagag

SEQ ID NO: 652802 - RNA, 64 nt, hsa
cacgagugcuguugcacuaccaucuauuuguuguaaauaaaaguguuguuuucaaagccaucuu

SEQ ID NO: 652803 - RNA, 64 nt, hsa
gcuauuuuuuuuccccagagacuuccauaauuuaaaauaaaauccuagauccaguucuuguuuu

SEQ ID NO: 652804 - RNA, 64 nt, hsa
aaguucuucauaucaucacaacauuauuugauuuaaauaaaauugaaaguaauauuugugcaac

SEQ ID NO: 652805 - RNA, 64 nt, hsa
agaauacuauuuccaaacucauauuacaaaaacaaaauaaaauaauaaaaaaagaaagcaugau

SEQ ID NO: 652806 - RNA, 64 nt, hsa
gugucuauaaaagaaacacuuugaagucuauaaaaaauaaaauaauuauaaauaucauuguaca

SEQ ID NO: 652807 - RNA, 64 nt, hsa
aaguaugauguaaauuuucagugcaauguaaacaaaauaaaaauggauaauugcuuuuguaaaa

SEQ ID NO: 652808 - RNA, 64 nt, hsa
accauccuuuauuuuacaauauuuuugaucgaccaaauaaaauguccuaauaaucuacucuauu

SEQ ID NO: 652809 - RNA, 64 nt, hsa
uuuuaagccauuuccucuucacuaugucuuauuaaaauaaaaccugucaaguucuuuucaaaag

SEQ ID NO: 652810 - RNA, 64 nt, hsa
ucauuuccuucaaaaugaagggcagugcuuaguuaaauaaaagauugaugauaucuuuuaagcc

SEQ ID NO: 652811 - RNA, 64 nt, hsa
uuuuuaaugacacugguuucauguaguuuucaagaaauaaaagaauucauucaagugaagccau

SEQ ID NO: 652812 - RNA, 64 nt, hsa
aauucauuguucuacuuaguugcagcuguaccugaaauaaaaauguuauugaugacugaauuuu

SEQ ID NO: 652813 - RNA, 64 nt, hsa
gccugggugacagagugagacucugucucaaaaaaaauaaaauaaaaagucaauuuagaaugug

SEQ ID NO: 652814 - RNA, 64 nt, hsa
ggugacagagugagacucugucucaaaaaaaauaaaauaaaaagucaauuuagaaugugaaauu

SEQ ID NO: 652815 - RNA, 64 nt, hsa
gaauugaugguuguauaagaacuagcucauguaaaaauaaaauaacauuauuacauugccucaa

SEQ ID NO: 652816 - RNA, 64 nt, hsa
gucuuguuuauuaacucuccuuuauucuauauggaaauaaaaaggaggcagucauguuagcaaa

SEQ ID NO: 652817 - RNA, 64 nt, hsa
guuuuugucgugucuauaaaggaagaacaaaacaaaauaaaaacagagcccuagagaaaugcug

SEQ ID NO: 652818 - RNA, 64 nt, hsa
uuuguguuuuuuucuggaacuacuucaagugagaaaauaaaaaaaaauggugacaaagcuguac

SEQ ID NO: 652819 - RNA, 64 nt, hsa
gauagagauaauagaagacaaagagauuaaaaggaaauaaaaaugcaugauuaaaaacuaagaa

SEQ ID NO: 652820 - RNA, 64 nt, hsa
aucuaccuucaggauugcugacagacagaauuugaaauaaaauaugcaaguuagcuaauacaaa

SEQ ID NO: 652821 - RNA, 64 nt, hsa
ugcagccuuuccucuguacuuuucuccaugguugaaauaaaacagggugacugggaguuacuua

SEQ ID NO: 652822 - RNA, 64 nt, hsa
cugcuagcaaauggcagaaccaaagcucaaauaaaaauaaaauaauuuucauucauucacucau

SEQ ID NO: 652823 - RNA, 64 nt, hsa
gucacacugcuagcaaauggcagaaccaaagcucaaauaaaaauaaaauaauuuucauucauuc

SEQ ID NO: 652824 - RNA, 64 nt, hsa
auguacuugacaauuccuuagaaaaaagaggcuaaaauaaaauagaucuaugucauaaucuaua

SEQ ID NO: 652825 - RNA, 64 nt, hsa
guauuaaguuauacuaauguuucaaucaguaaagaaauaaaaguuuaggauuuauuaauauaug

SEQ ID NO: 652826 - RNA, 64 nt, hsa
caguaaaacaaauguguauucaacaaaagaaaaaaaauaaaacaguaacacuuuaaaacaagaa

SEQ ID NO: 652827 - RNA, 64 nt, hsa
aggcauuuuaaucugcacaguuuaucuucugccaaaauaaaaauuuacuauuuccuuuauauac

SEQ ID NO: 652828 - RNA, 64 nt, hsa
aacauauucugcaucccucacugaauucaguaauaaauaaaaauguguacaugugauuaaaaga

SEQ ID NO: 652829 - RNA, 64 nt, hsa
cuauaucggcuuagaaacaugccucauuucuaggaaauaaaagauagaggugagagaugauuua

SEQ ID NO: 652830 - RNA, 64 nt, hsa
agaguuguaggaugcagggcuaaauugcaaaauaaaauaaaauagccagcguacacaaugagau

SEQ ID NO: 652831 - RNA, 64 nt, hsa
uaucaagaguuguaggaugcagggcuaaauugcaaaauaaaauaaaauagccagcguacacaau

SEQ ID NO: 652832 - RNA, 64 nt, hsa
cucauguuuaauuuguacgcauagaauugcugagaaauaaaauguucuguucaacuuauaaaac

SEQ ID NO: 652833 - RNA, 64 nt, hsa
gagggacugaauacugaaaacugugaaauguacuaaauaaaauguacaucugaagaugauuauu

SEQ ID NO: 652834 - RNA, 64 nt, hsa
gucagaacuaugccucgguuuauuuaucauuuugaaauaaaaucagaauuucaaccuguaauuu

SEQ ID NO: 652835 - RNA, 64 nt, hsa
guccuguuugccacuaaaaacauuuucaaaggaaaaauaaaaugaaaguacuuuuuacuuuuua

SEQ ID NO: 652836 - RNA, 64 nt, hsa
ugaauugauauucugagugaaaacuaccuaauauaaauaaaauuagugaaaagaaaacauggga

SEQ ID NO: 652837 - RNA, 64 nt, hsa
auauugauuguaugucuacugugcugcauuaagaaaauaaaauuucuauauaccaaaaauguga

SEQ ID NO: 652838 - RNA, 64 nt, hsa
guacauuugaauugaauauauaauaaauauugcaaaauaaaauccaucuaaauagaaggguucu

SEQ ID NO: 652839 - RNA, 64 nt, hsa
auagcagauagucucauauuuaggaaaacuuuccaaauaaaauaaauguuauucucugauaaag

SEQ ID NO: 652840 - RNA, 64 nt, hsa
uuuuuuucuccuacaaggagauauggcuggaccaaaauaaaaugacaugaaacugcaaaaauga

SEQ ID NO: 652841 - RNA, 64 nt, hsa
uauguaauauauguaacaucuuccaauucuuuuaaaauaaaauuaauauuuauaauggauauuu

SEQ ID NO: 652842 - RNA, 64 nt, hsa
gccucuuaaaaaaaaaaaaccugcuaggauuuaaaaauaaaaaucagaggccuaucuccacuuu

SEQ ID NO: 652843 - RNA, 64 nt, hsa
uuccguaagacccaauaguuacuguacaucccauaaauaaaaaauacuuuaguuugcuaaccaa

SEQ ID NO: 652844 - RNA, 64 nt, hsa
aaucuguauuaaaaauaaaauuaauaaaaguaaaaaauaaaaauagaaacacaacucuacuagu

SEQ ID NO: 652845 - RNA, 64 nt, hsa
guugaaaaugccccuuacugaaaaucuguauuaaaaauaaaauuaauaaaaguaaaaaauaaaa

SEQ ID NO: 652846 - RNA, 64 nt, hsa
ucuuuaaaagguauccagcccugauauuuuguguaaauaaaauguuuuuaaaaccuguuaguua

SEQ ID NO: 652847 - RNA, 64 nt, hsa
ccaguuccucuuugauaaauauauaguuaauucgaaauaaaauccauugcaauucauuuaugag

SEQ ID NO: 652848 - RNA, 64 nt, hsa
accaugcauaacucuugggaaguugagcuuugcuaaauaaaagauauuucugcugaucaaagau

SEQ ID NO: 652849 - RNA, 64 nt, hsa
aaugagccaggagaacaaacuaauuccuuuaaauaaauaaaaaaaaaaaaugcaaauguccuuc

SEQ ID NO: 652850 - RNA, 64 nt, hsa
auauaaauguuuuauauguauauguuuuauacauaaauaaaacauuucaucuaauauauauaug

SEQ ID NO: 652851 - RNA, 64 nt, hsa
aauuuaagaaaucuaaagugaaaauuuugcuuagaaauaaaauacgacaaguuauguuuugagu

SEQ ID NO: 652852 - RNA, 64 nt, hsa
gaaaugauaccaagucucuaccaucucuuucagaaaauaaaagcagagauaacacuucccaacu

SEQ ID NO: 652853 - RNA, 64 nt, hsa
gcuuuuugacagcuuuuugagaccucuuaagaaaaaauaaaaaguaaaaaaugaaaggaaucuu

SEQ ID NO: 652854 - RNA, 64 nt, hsa
cgguuucugcuguauuaaugacaauuauucaugaaaauaaaaaaugaaauauuuuguauacuac

SEQ ID NO: 652855 - RNA, 64 nt, hsa
ggaguggggagggauuaaaacccauccaaaaaauaaauaaaaacuauauaggugcuauguauau

SEQ ID NO: 652856 - RNA, 64 nt, hsa
caacaaacaaacaaaaaacaagaaugaaaaacagaaauaaaagaaguagaaaagacaaagaaag

SEQ ID NO: 652857 - RNA, 64 nt, hsa
aaaacaggaaccugauuuuuuuaaaauaaauuuuaaauaaaauagaauuacuacaauucugcaa

SEQ ID NO: 652858 - RNA, 64 nt, hsa
ccuuuuacagaucuuacuguagcuuuuuccauauaaauaaaaugcuuuuucuacuauuugucuu

SEQ ID NO: 652859 - RNA, 64 nt, hsa
ugcuuuuucuacuauuugucuugauuacuuaaaaaaauaaaaauauaaguaaggaucaaaacuc

SEQ ID NO: 652860 - RNA, 64 nt, hsa
guauaaaaaagcaaauacuuggugagugauuuaaaaauaaaaccaaaacaaaacacaaaaagau

SEQ ID NO: 652861 - RNA, 64 nt, hsa
aguuugaagcaguucuucaugccacuuaguuugaaaauaaaauucuagauaugcaaaugauuuu

SEQ ID NO: 652862 - RNA, 64 nt, hsa
agauaugcaaaugauuuucuuagaaaacuucacaaaauaaaagaucuuguuuuuuuuuccauag

SEQ ID NO: 652863 - RNA, 64 nt, hsa
guauuuuuugacuuaaacagaguaugacccugaaaaauaaaagaaucuuuuuuuuucaaaacuc

SEQ ID NO: 652864 - RNA, 64 nt, hsa
ugugauacaguuaaaaggugcagcugccagugacaaauaaaaacuuuuguuacaucucauuauu

SEQ ID NO: 652865 - RNA, 64 nt, hsa
acaggugcauucuaguuacaugaacaugcuaguuaaauaaaagucacaauuaagucauuaugac

SEQ ID NO: 652866 - RNA, 64 nt, hsa
gaaaagacuauugcuuugccaugccuguuuuccuaaauaaaacaguugcuggcauuugcacauc

SEQ ID NO: 652867 - RNA, 64 nt, hsa
augaugccauaagggagaagaguuuauuuggggaaaauaaaagaaauuuccacaccuuuguucu

SEQ ID NO: 652868 - RNA, 64 nt, hsa
cuucuucccuuuuauaguucaucagccacaacaaaaauaaaaccuuugugugauuuacuguuuu

SEQ ID NO: 652869 - RNA, 64 nt, hsa
agcuuuauaaccucaccaaugaauacaaauguuuaaauaaaauauugauuaaaaaaacauuaaa

SEQ ID NO: 652870 - RNA, 64 nt, hsa
aacacuugugucaaaaugauauagcuuaguauaaaaauaaaauucaacguuuuggccaaaaugu

SEQ ID NO: 652871 - RNA, 64 nt, hsa
uuguuucauuuugcucuguuuuaaauccauaugcaaauaaaacugcuucucucuuacacugcuu

SEQ ID NO: 652872 - RNA, 64 nt, hsa
gaaacauguauaagaaaccagauuuaaguguuuuaaauaaaauguaaacaguuuuuauuuggua

SEQ ID NO: 652873 - RNA, 64 nt, hsa
uuuugguuuacaguguaauaauaccucauuuaaaaaauaaaaaccacuacuguuacauuuuauu

SEQ ID NO: 652874 - RNA, 64 nt, hsa
cuauaaauuccccuugaauuuauagugugaugccaaauaaaauuuucucaggaucuuauuaggu

SEQ ID NO: 652875 - RNA, 64 nt, hsa
cauguuugauugacuuucauaguuuccugcauugaaauaaaaucacuaugaauucuaguuuauc

SEQ ID NO: 652876 - RNA, 64 nt, hsa
agcaaauaauaauaauauuaauaauaauaaagagaaauaaaauaauaaaauaaaaaacaauagc

SEQ ID NO: 652877 - RNA, 64 nt, hsa
aauauuaauaauaauaaagagaaauaaaauaauaaaauaaaaaacaauagcacagcccuuguug

SEQ ID NO: 652878 - RNA, 64 nt, hsa
ugaacccuuccugagcuuuaugguccuaaaagcaaaauaaaaacuauucgaaugaaaagacaag

SEQ ID NO: 652879 - RNA, 64 nt, hsa
aaucaacuuugaagacacaaaaguuaauuggaagaaauaaaaacugugaacgaagaauaccuuu

SEQ ID NO: 652880 - RNA, 64 nt, hsa
gugacucaaaauucugaauuauggcagaaaggaaaaauaaaacauacuucacauuagaacacag

SEQ ID NO: 652881 - RNA, 64 nt, hsa
uauguuauaauaugcuguuaaucaggacuuuauuaaauaaaaacauuggcucuuccaaccccca

SEQ ID NO: 652882 - RNA, 64 nt, hsa
cacuuuuucguaugcacuacuguauuuccuuucuaaauaaaauugauuugauuguaugcaguac

SEQ ID NO: 652883 - RNA, 64 nt, hsa
auuuguuuuuaaaaaaacaagaaaugcauguuucaaauaaaauucucuauuguaaauaaaauuu

SEQ ID NO: 652884 - RNA, 64 nt, hsa
agaaaugcauguuucaaauaaaauucucuauuguaaauaaaauuuuuucuuuggaucuuggcaa

SEQ ID NO: 652885 - RNA, 64 nt, hsa
uuauuauucuuaaaugcuguaugauaaugaagaaaaauaaaaauuuauuucuugcaaaguuaaa

SEQ ID NO: 652886 - RNA, 64 nt, hsa
auuugugagagauuauuguaaaaugagagcgagcaaauaaaacuuaauuuaaucuuugcagaua

SEQ ID NO: 652887 - RNA, 64 nt, hsa
uauuuguauuuugacauuguaccuuguauaaacaaaauaaaacaucuauuuucaauauuuuuaa

SEQ ID NO: 652888 - RNA, 64 nt, hsa
acagugugagcugccuggaauacaugugguaaugaaauaaaaacccugccccgaaucuuccguc

SEQ ID NO: 652889 - RNA, 64 nt, hsa
uucauguagguucuguucacugcugaaauauucuaaauaaaaugguuuagaguuuuacuguaac

SEQ ID NO: 652890 - RNA, 64 nt, hsa
cuguacauccacaaaaauaugcaauggauguagaaaauaaaauucaagaaaagaacguugaacc

SEQ ID NO: 652891 - RNA, 64 nt, hsa
uccauuaccuggcacuagcaacauuagaauuuuaaaauaaaauaauugggaaagaagguggguc

SEQ ID NO: 652892 - RNA, 64 nt, hsa
uuuuguccuuuccuucacugauuugcuuuaaaaaaaauaaaagauaaugauuuauugcagaauu

SEQ ID NO: 652893 - RNA, 64 nt, hsa
caguacacaugucauuuugugauauaggacucccaaauaaaaguaucagaauaaacacaacaau

SEQ ID NO: 652894 - RNA, 64 nt, hsa
gaacauuaucuacaauuuuacucucaaauagucaaaauaaaaacaucucaauuucuaauaccgg

SEQ ID NO: 652895 - RNA, 64 nt, hsa
gugcuaucuaaugcagugauaccaaaaaaaaaggaaauaaaaugcacauaaauuuggaaggagg

SEQ ID NO: 652896 - RNA, 64 nt, hsa
gaaaugauaccaagucuguacugucucuuucagaaaauaaaagcagggauaacacuucccaaau

SEQ ID NO: 652897 - RNA, 64 nt, hsa
aauuuaagaaaucuaaagugaaaauuuugcuuagaaauaaaauaugacaaguucuguuuugagu

SEQ ID NO: 652898 - RNA, 64 nt, hsa
uuuauuagagggagcauggccauaaaauaaaauaaaauaaaauuuagauuuaagucgagcucag

SEQ ID NO: 652899 - RNA, 64 nt, hsa
uuagauuuauuagagggagcauggccauaaaauaaaauaaaauaaaauuuagauuuaagucgag

SEQ ID NO: 652900 - RNA, 64 nt, hsa
aaaauuuagauuuauuagagggagcauggccauaaaauaaaauaaaauaaaauuuagauuuaag

SEQ ID NO: 652901 - RNA, 64 nt, hsa
aacugcaguggcugagcaauuggacaagauaaagaaauaaaagugauccagaucauaaagaaag

SEQ ID NO: 652902 - RNA, 64 nt, hsa
ugauauuuguauuguaaaacaauaauggugaaggaaauaaaaaggcuuuuaaaauuuuguuugu

SEQ ID NO: 652903 - RNA, 64 nt, hsa
uucugaaaucuuucuaccuguugcaccgauauucaaauaaaaaugauagacacagaaagguuug

SEQ ID NO: 652904 - RNA, 64 nt, hsa
ucuauaugauuguaaauauuuuauacaacaauacaaauaaaauauuuuucuauuauauuuauua

SEQ ID NO: 652905 - RNA, 64 nt, hsa
uaucuuugucuauaacugacagauguuuauauuaaaauaaaauauuguauuaaaaauuuaaaau

SEQ ID NO: 652906 - RNA, 64 nt, hsa
uaauuuuuauuugagcuguuucaauagcauaaugaaauaaaauuuugaauuggccaauaacaug

SEQ ID NO: 652907 - RNA, 64 nt, hsa
aguauuuuguaauuagacuccucgugggcuugagaaauaaaaagccuguccaaagucuagcuuu

SEQ ID NO: 652908 - RNA, 64 nt, hsa
ucaaaucacacugaacccuaaaugucauugcaagaaauaaaaauuuaagaauuaaauugcugcc

SEQ ID NO: 652909 - RNA, 64 nt, hsa
gcagaacaguuuuaaaaaucuaauuagaauuuccaaauaaaacaguuuccauaaggugucagca

SEQ ID NO: 652910 - RNA, 64 nt, hsa
uguuuuaaaaugucaguguguuucccagaggcagaaauaaaaauacugaauaucuuugcucuua

SEQ ID NO: 652911 - RNA, 64 nt, hsa
auaauaggaaaaacacuucuuuccuucauuuuuuaaauaaaauuaauguuguauuuaaaaggua

SEQ ID NO: 652912 - RNA, 64 nt, hsa
cauucuauuguguucuacuucaccuaaaaaaauaaaauaaaaauguugaucaagacauggaguu

SEQ ID NO: 652913 - RNA, 64 nt, hsa
ugagccauucuauuguguucuacuucaccuaaaaaaauaaaauaaaaauguugaucaagacaug

SEQ ID NO: 652914 - RNA, 64 nt, hsa
uguugaaaugcuaccuuuuuuaaaauaagaaacuaaauaaaauuauuuuacuaucagugauuug

SEQ ID NO: 652915 - RNA, 64 nt, hsa
uuuaguucuccuuaaaagaacuuuugaauuauaaaaauaaaaucuuuaccugucgaauuguugc

SEQ ID NO: 652916 - RNA, 64 nt, hsa
cuuuuaccaaguggugaguuaguuagguuuuuuaaaauaaaauguucauuguauuugaaguuuu

SEQ ID NO: 652917 - RNA, 64 nt, hsa
uccaguccaaggcaggccugaaucaacugucuuuaaauaaaauuuuaagugaugcuguauuaua

SEQ ID NO: 652918 - RNA, 64 nt, hsa
auaggaauacaguuuucuuuuccacauuaugaucaaauaaaaaucuugugagauuguuuauguu

SEQ ID NO: 652919 - RNA, 64 nt, hsa
aauuuugaccuugaaagaugaauuccuucaagaaaaauaaaauaaugcuuaagauaauguguac

SEQ ID NO: 652920 - RNA, 64 nt, hsa
uuguuuuaaauguaaauugagaaucuuuuauaagaaauaaaagcauuauugggugccuuuguuu

SEQ ID NO: 652921 - RNA, 64 nt, hsa
cugggcuacagagagcaagacucugucucaaaaaaaauaaaauaaaauaaauaaaaaaagauau

SEQ ID NO: 652922 - RNA, 64 nt, hsa
cuacagagagcaagacucugucucaaaaaaaauaaaauaaaauaaauaaaaaaagauauaguau

SEQ ID NO: 652923 - RNA, 64 nt, hsa
gcaagacucugucucaaaaaaaauaaaauaaaauaaauaaaaaaagauauaguauuaaugccug

SEQ ID NO: 652924 - RNA, 64 nt, hsa
ccagccugggcgacagagcaagacuccaucucaaaaauaaaauaaaaaaagaaagaaagaaaag

SEQ ID NO: 652925 - RNA, 64 nt, hsa
cugggcgacagagcaagacuccaucucaaaaauaaaauaaaaaaagaaagaaagaaaagaagaa

SEQ ID NO: 652926 - RNA, 64 nt, hsa
acaguaguuucaguucugaugguauaagcaaaacaaauaaaacguuuauaaaaguuguaucuug

SEQ ID NO: 652927 - RNA, 64 nt, hsa
ggugggaaaugggggaucuucaauguuuauuuuaaaauaaaauaaaauaaguucuugacuuuuc

SEQ ID NO: 652928 - RNA, 64 nt, hsa
gaaaugggggaucuucaauguuuauuuuaaaauaaaauaaaauaaguucuugacuuuucucaug

SEQ ID NO: 652929 - RNA, 64 nt, hsa
aacacuggccauggccgugggaguacugggaguaaaauaaaaauaucgagguauagacuagcau

SEQ ID NO: 652930 - RNA, 64 nt, hsa
uaaggcauauuaaaaauaaauauguaaagaagaaaaauaaaaguugucuucauggaagcaacuu

SEQ ID NO: 652931 - RNA, 64 nt, hsa
uguacacauaagugugugugucucaggaaguaggaaauaaaaauggaagcuauuaugaccucaa

SEQ ID NO: 652932 - RNA, 64 nt, hsa
agauguaaacuugauuauuuuauugcuaauuuaaaaauaaaaaugacuuuguauugauugugaa

SEQ ID NO: 652933 - RNA, 64 nt, hsa
ucuugacuuuaacaucagcauuauaaaaagugucaaauaaaaaauuaccaucauuaucauuaaa

SEQ ID NO: 652934 - RNA, 64 nt, hsa
aacuacuuugucgguugcucugaggguuaaaugaaaauaaaaagaaaaugugaaacagcaccac

SEQ ID NO: 652935 - RNA, 64 nt, hsa
cccggccuacaagaacaaaacuccaucucaaaauaaauaaaaaaauaaauaaaaauaaaaauag

SEQ ID NO: 652936 - RNA, 64 nt, hsa
gaacaaaacuccaucucaaaauaaauaaaaaaauaaauaaaaauaaaaauagacuauauauagu

SEQ ID NO: 652937 - RNA, 64 nt, hsa
aacuccaucucaaaauaaauaaaaaaauaaauaaaaauaaaaauagacuauauauagucuuuga

SEQ ID NO: 652938 - RNA, 64 nt, hsa
gucuuugaauucauuuauuuuaaauaaaugaauaaaauaaaauaaaaaagaauauucagucguu

SEQ ID NO: 652939 - RNA, 64 nt, hsa
ugaauucauuuauuuuaaauaaaugaauaaaauaaaauaaaaaagaauauucagucguuggcac

SEQ ID NO: 652940 - RNA, 64 nt, hsa
ggaaucuauuuuaugucaccaguugguccucaucaaauaaaauuuccuuaggagugcagagggc

SEQ ID NO: 652941 - RNA, 64 nt, hsa
aaauuuccuuaggagugcagagggcucauugggaaaauaaaaauaauaaaaauaaauaaaacuu

SEQ ID NO: 652942 - RNA, 64 nt, hsa
gagggcucauugggaaaauaaaaauaauaaaaauaaauaaaacuuccuaaaagaaaagauugaa

SEQ ID NO: 652943 - RNA, 64 nt, hsa
ugcaauuuauagauuucauguugaaauauauguuaaauaaaauuucuguuuauugaaccucuuu

SEQ ID NO: 652944 - RNA, 64 nt, hsa
caacagagcaagacuccgucucacaaaaaugaauaaauaaaauaaaaauaaaaauguuacuuuu

SEQ ID NO: 652945 - RNA, 64 nt, hsa
gagcaagacuccgucucacaaaaaugaauaaauaaaauaaaaauaaaaauguuacuuuuuaaaa

SEQ ID NO: 652946 - RNA, 64 nt, hsa
gacuccgucucacaaaaaugaauaaauaaaauaaaaauaaaaauguuacuuuuuaaaaaguaac

SEQ ID NO: 652947 - RNA, 64 nt, hsa
auguaacaagccugcacauguaccccagaaucuaaaauaaaaauaaaaagaaaaacaaagaaug

SEQ ID NO: 652948 - RNA, 64 nt, hsa
caagccugcacauguaccccagaaucuaaaauaaaaauaaaaagaaaaacaaagaauguacucu

SEQ ID NO: 652949 - RNA, 64 nt, hsa
agcaugaugggugaagagaaccgagcaaagaucaaaauaaaaagugacacagcagcuucaccag

SEQ ID NO: 652950 - RNA, 64 nt, hsa
uauuaccccacacauccccuuuguguagaaagccaaauaaaaucuauacauaccauuuccuuuu

SEQ ID NO: 652951 - RNA, 64 nt, hsa
gccugggugacagagcaagacccugucucaaaaaaaauaaaauaaaaggcuuucugccuucauu

SEQ ID NO: 652952 - RNA, 64 nt, hsa
ggugacagagcaagacccugucucaaaaaaaauaaaauaaaaggcuuucugccuucauugccuc

SEQ ID NO: 652953 - RNA, 64 nt, hsa
agaaaggccaucagagcaaauuuggggguuucucaaauaaaauaaaaauaaaaacaaauacugu

SEQ ID NO: 652954 - RNA, 64 nt, hsa
ggccaucagagcaaauuuggggguuucucaaauaaaauaaaaauaaaaacaaauacuguguuuc

SEQ ID NO: 652955 - RNA, 64 nt, hsa
cagagcaaauuuggggguuucucaaauaaaauaaaaauaaaaacaaauacuguguuucagaagc

SEQ ID NO: 652956 - RNA, 64 nt, hsa
uaaacaacaacaaaaacaaaaaaagaagaaaacuaaauaaaaauaaaaauaaaaauaagaucca

SEQ ID NO: 652957 - RNA, 64 nt, hsa
acaacaaaaacaaaaaaagaagaaaacuaaauaaaaauaaaaauaaaaauaagauccacuucuc

SEQ ID NO: 652958 - RNA, 64 nt, hsa
aaaacaaaaaaagaagaaaacuaaauaaaaauaaaaauaaaaauaagauccacuucucucugcc

SEQ ID NO: 652959 - RNA, 64 nt, hsa
aaguaaccuuauauuuaaaagaugauuuugcaaaaaauaaaaaauaaaaaauaugccuucugga

SEQ ID NO: 652960 - RNA, 64 nt, hsa
cuuauauuuaaaagaugauuuugcaaaaaauaaaaaauaaaaaauaugccuucuggagugaugu

SEQ ID NO: 652961 - RNA, 64 nt, hsa
uguaugguuugcaaaagggcuuccuaaaaauaaaaaauaaaauuuaaaaaacugugccuccguc

SEQ ID NO: 652962 - RNA, 64 nt, hsa
uauaucuuguaugguuugcaaaagggcuuccuaaaaauaaaaaauaaaauuuaaaaaacugugc

SEQ ID NO: 652963 - RNA, 64 nt, hsa
gugacagagaaagacccugucucaaaaacaaauuaaauaaaauaucuucauauauaaauuaagc

SEQ ID NO: 652964 - RNA, 64 nt, hsa
ccugggcaacauagugagaaugcaucucuacaaaaaauaaaaaaaauuagcuaggcauaguacc

SEQ ID NO: 652965 - RNA, 64 nt, hsa
cauaaaaucauuguaaauauuauuuagucaucacaaauaaaauauugucccuugcuacuugaua

SEQ ID NO: 652966 - RNA, 64 nt, hsa
gaaacucuuuguuuucuucuuuuguguucuaaaaaaauaaaauuucaaaagaaaagguugucuu

SEQ ID NO: 652967 - RNA, 64 nt, hsa
gugugacacuuuggagcaaaaaccuugcagugguaaauaaaaaauuuccaacagggucagcugc

SEQ ID NO: 652968 - RNA, 64 nt, hsa
ugaauuuuaaauuauccagagaugucaaacugccaaauaaaaauauuucaguagucuuugcauc

SEQ ID NO: 652969 - RNA, 64 nt, hsa
cugcuaccacagagauuguacuauacaaauaaaaaaauaaaaacccaaccucaagcugucaccc

SEQ ID NO: 652970 - RNA, 64 nt, hsa
auauauuucugcuaccacagagauuguacuauacaaauaaaaaaauaaaaacccaaccucaagc

SEQ ID NO: 652971 - RNA, 64 nt, hsa
aaaaucuauucacuuuaacuuauaauaguuuaugaaauaaaaacaugagucacagcuuuuguuc

SEQ ID NO: 652972 - RNA, 64 nt, hsa
ggucuuaacuugaccugggauaacuacuuuaaagaaauaaaaaauuccagucaauuauuccuca

SEQ ID NO: 652973 - RNA, 64 nt, hsa
uuuaauaaacacaauuuugcugccaaaaauauauaaauaaaacacgaaagaaaacaauuauuga

SEQ ID NO: 652974 - RNA, 64 nt, hsa
aaagcauacauaguagagggaaaggagagaauggaaauaaaacucaauauuaugcagauuuaug

SEQ ID NO: 652975 - RNA, 64 nt, hsa
auaggacuuuagacaccacccagcccaaacuuccaaauaaaauauggaacgcaauuggguguaa

SEQ ID NO: 652976 - RNA, 64 nt, hsa
aaggaaaaaagguacuucuauuuugaaaaaauaaaaauaaaagccuuuggguucuugaauggag

SEQ ID NO: 652977 - RNA, 64 nt, hsa
uaauaaaaggaaaaaagguacuucuauuuugaaaaaauaaaaauaaaagccuuuggguucuuga

SEQ ID NO: 652978 - RNA, 64 nt, hsa
gcauaacuaaaauuaaguauauauauuuuggcucaaauaaaauugaaaaaaaaaucauuugguu

SEQ ID NO: 652979 - RNA, 64 nt, hsa
ucaguguaccacuacuuagagauauguaucauaaaaauaaaaucuguaaaccauagguaaugau

SEQ ID NO: 652980 - RNA, 64 nt, hsa
uauaucuugggacuuauguauauauauaccuuuuaaauaaaauaaauuuucuaaauaaaaaguu

SEQ ID NO: 652981 - RNA, 64 nt, hsa
cagagugagacuccaucucaaaaacugaaaauaaaaauaaaaauauguauucuccuaacugaaa

SEQ ID NO: 652982 - RNA, 64 nt, hsa
gggugacagagugagacuccaucucaaaaacugaaaauaaaaauaaaaauauguauucuccuaa

SEQ ID NO: 652983 - RNA, 64 nt, hsa
acuccaucucaaaaaauaaaauaaauaaauaaacaaauaaaaaauucauaaugugaacugucug

SEQ ID NO: 652984 - RNA, 64 nt, hsa
agccugggcaacaacagcaaaacuccaucucaaaaaauaaaauaaauaaauaaacaaauaaaaa

SEQ ID NO: 652985 - RNA, 64 nt, hsa
ccucauuuugcauccuucuguauccccaaaucugaaauaaaagcuggaaaaaaauucuugugaa

SEQ ID NO: 652986 - RNA, 64 nt, hsa
gcuguggauguauuuuauuuaauuucucaaauuaaaauaaaagguaacgguacacuuaagagug

SEQ ID NO: 652987 - RNA, 64 nt, hsa
ucagcagaaauuuaaauaagauuuaauucacaucaaauaaaauuuagaaaauaaaauuuaacuc

SEQ ID NO: 652988 - RNA, 64 nt, hsa
aauaagauuuaauucacaucaaauaaaauuuagaaaauaaaauuuaacucacacugcccaggcu

SEQ ID NO: 652989 - RNA, 64 nt, hsa
gcauucccaggaaaauacgaaaaucccaugagauaaauaaaaauauaggugaugggcagaucuu

SEQ ID NO: 652990 - RNA, 64 nt, hsa
uaaaaauauaggugaugggcagaucuuuucuuuaaaauaaaaaagcaaaaacucuugugguacc

SEQ ID NO: 652991 - RNA, 64 nt, hsa
aucuuuuaugcaccaaaguuggucuugaaaaggaaaauaaaaucacuuucuugcuugguaagca

SEQ ID NO: 652992 - RNA, 64 nt, hsa
augaaaaugagucuuauaaaauuaagugaagugcaaauaaaagcacugcuacuauaagacauuc

SEQ ID NO: 652993 - RNA, 64 nt, hsa
guuuuuacauacuuuugcaaaauaaguaaauaauaaauaaaauaaaagccaaccuucaaagaaa

SEQ ID NO: 652994 - RNA, 64 nt, hsa
uacauacuuuugcaaaauaaguaaauaauaaauaaaauaaaagccaaccuucaaagaaacuuga

SEQ ID NO: 652995 - RNA, 64 nt, hsa
ugcguuaaauaagcaaauaaacaguggcucauaaaaauaaaagucgcauuccauaucuuuggau

SEQ ID NO: 652996 - RNA, 64 nt, hsa
ucuaagcugagaaguagauuguuacccaguaaugaaauaaaaaauaaaaauaaaaggauuuuuu

SEQ ID NO: 652997 - RNA, 64 nt, hsa
ugagaaguagauuguuacccaguaaugaaauaaaaaauaaaaauaaaaggauuuuuuucucuau

SEQ ID NO: 652998 - RNA, 64 nt, hsa
guagauuguuacccaguaaugaaauaaaaaauaaaaauaaaaggauuuuuuucucuauuguuua

SEQ ID NO: 652999 - RNA, 64 nt, hsa
ucuuuucucuuuaauccuuuaguuauauuguauuaaauaaaaauauaauacugccuaauguaua

SEQ ID NO: 653000 - RNA, 64 nt, hsa
uucaagauauaagaaauuuuggaaauuccaccauaaauaaaauuuuuuacuacaagaaauauuu

SEQ ID NO: 653001 - RNA, 64 nt, hsa
gggcagcuaaauuuuucaguuccaugugccucccaaauaaaaaacagaaaauaaguaguuuuug

SEQ ID NO: 653002 - RNA, 64 nt, hsa
uaagaauccugacuuuuuuauauuuggaaacaucaaauaaaaauggaaaaaaugaucauggcuu

SEQ ID NO: 653003 - RNA, 64 nt, hsa
ggcugaccaagaccuguugauccuuuuagauuaaaaauaaaaugucgcauguaaaggcugaagu

SEQ ID NO: 653004 - RNA, 64 nt, hsa
auuuacugcuguuacuauuugauuagaauguauuaaauaaaaaaaaccugauuucuacaaguug

SEQ ID NO: 653005 - RNA, 64 nt, hsa
agcaacccacugccuacuaacaucaagaggggcuaaauaaaacugcauuuuccuugcaaggaca

SEQ ID NO: 653006 - RNA, 64 nt, hsa
uugguggugaggaggaagaacaaauaauagaagaaaauaaaaaugagauagaagaaaaguaaga

SEQ ID NO: 653007 - RNA, 64 nt, hsa
aaauuuuaacauuggcaucuaaaguguuauuugaaaauaaaauuauuuuccuguucauugauuu

SEQ ID NO: 653008 - RNA, 64 nt, hsa
aacuuauugugaaaguugugcuguuuucuaaguaaaauaaaaaauaaaaaauuagcaauuuaug

SEQ ID NO: 653009 - RNA, 64 nt, hsa
ugugaaaguugugcuguuuucuaaguaaaauaaaaaauaaaaaauuagcaauuuaugauagcca

SEQ ID NO: 653010 - RNA, 64 nt, hsa
gccuuugagccuauacuauacuguguauguguggaaauaaaaauguauuguacuuuuggagaau

SEQ ID NO: 653011 - RNA, 64 nt, hsa
aauaugacaucggauguuucagcaacuguucuguaaauaaaaucuuugaucacaccacucagug

SEQ ID NO: 653012 - RNA, 64 nt, hsa
uacaguugugcaagauaugaaugguuucacacucaaauaaaaaauauugaaacgaccugcuuuc

SEQ ID NO: 653013 - RNA, 64 nt, hsa
uuuucgacacuggacuggaagaacaagucuauaaaaauaaaaauggacaauuaacaguggugag

SEQ ID NO: 653014 - RNA, 64 nt, hsa
gguuggagaacgaaugaauacaaauuuuauuguaaaauaaaaauguauauaaagcauaugagca

SEQ ID NO: 653015 - RNA, 64 nt, hsa
acgaugugcaauacauuuuuuucucuuuccuugaaaauaaaaagagaaacaaguauuuugcuau

SEQ ID NO: 653016 - RNA, 64 nt, hsa
auaugauauuuuucaugcuccacuauuuuauuaaaaauaaaauauguucuuuaguuugcugcua

SEQ ID NO: 653017 - RNA, 64 nt, hsa
guaaccccuuuuuccuuucuucuguuuaaaauaaaaauaaaauuuaucucagcuucuguuagcu

SEQ ID NO: 653018 - RNA, 64 nt, hsa
aaaaauguaaccccuuuuuccuuucuucuguuuaaaauaaaaauaaaauuuaucucagcuucug

SEQ ID NO: 653019 - RNA, 64 nt, hsa
auaaaauaauauaaaagugauuuauaugaaguuaaaauaaaaaaucaguaugauggaauaaacu

SEQ ID NO: 653020 - RNA, 64 nt, hsa
uaaauaauuuuggaagcugugaagauaaaauaccaaauaaaauaauauaaaagugauuuauaug

SEQ ID NO: 653021 - RNA, 64 nt, hsa
agucugauccauauuuaauaaugcuuuaaaauaaaaauaaaaacaauccuuuugauaaauuuaa

SEQ ID NO: 653022 - RNA, 64 nt, hsa
uuuucaagucugauccauauuuaauaaugcuuuaaaauaaaaauaaaaacaauccuuuugauaa

SEQ ID NO: 653023 - RNA, 62 nt, hsa; identical to SEQ ID NO: 629600

SEQ ID NO: 653024 - RNA, 64 nt, hsa
aacacacucgauuaaaaauguuaagcuaucugaaaaauaaaaugugcaagucuucaggauggca

SEQ ID NO: 653025 - RNA, 64 nt, hsa
ccagaacuuaaaguaaaauaaaaaauaaauaaauaaauaaaaucuuuuccacagagaaaggcaa

SEQ ID NO: 653026 - RNA, 64 nt, hsa
uuaaagaagucuuuuccucccagaacuuaaaguaaaauaaaaaauaaauaaauaaauaaaaucu

SEQ ID NO: 653027 - RNA, 64 nt, hsa
guguaaaaaaaaauaaaaauaaaaauaaauaaauaaauaaaauuaaaaaaaauaaaaaccauga

SEQ ID NO: 653028 - RNA, 64 nt, hsa
agggaauaaagugcuaaaguguaaaaaaaaauaaaaauaaaaauaaauaaauaaauaaaauuaa

SEQ ID NO: 653029 - RNA, 64 nt, hsa
aacuucagggaauaaagugcuaaaguguaaaaaaaaauaaaaauaaaaauaaauaaauaaauaa

SEQ ID NO: 653030 - RNA, 64 nt, hsa
aaaugcaguaaucaaaaugugaucuaguguaaugaaauaaaaugugaucuaguguaauggaaga

SEQ ID NO: 653031 - RNA, 64 nt, hsa
uuagaauggaagauaaugcagauauuucugugggaaauaaaauaacuaauuuugagguaccaaa

SEQ ID NO: 653032 - RNA, 64 nt, hsa
uauuuacauuuucacucaucuaaaaaguauacaaaaauaaaaaguggaaaaagguaucuucuga

SEQ ID NO: 653033 - RNA, 64 nt, hsa
cuguuuuugucaaggaugguuguguauguguuuaaaauaaaaccuguggugcacauuucuaccc

SEQ ID NO: 653034 - RNA, 64 nt, hsa
aaauuuguuguaaacugcauguuuuauaaaauaaaaauaaaauaucguuuguuauuuaucucau

SEQ ID NO: 653035 - RNA, 64 nt, hsa
uuuuaaaaauuuguuguaaacugcauguuuuauaaaauaaaaauaaaauaucguuuguuauuua

SEQ ID NO: 653036 - RNA, 64 nt, hsa
gggugacagagcgagaccaugucucaaaaaauaaaaauaaaaaaaaauuguuuucauuaccuca

SEQ ID NO: 653037 - RNA, 64 nt, hsa
cagccugggugacagagcgagaccaugucucaaaaaauaaaaauaaaaaaaaauuguuuucauu

SEQ ID NO: 653038 - RNA, 64 nt, hsa
ugcuugccauaauuugucugagaaggaaucuguuaaauaaaagcuuuuauccucuaaccuuuac

SEQ ID NO: 653039 - RNA, 64 nt, hsa
uacacaucauaccuagcagguaauaaaauuuaaaaaauaaaaauuaaauauuagaaugugagaa

SEQ ID NO: 653040 - RNA, 64 nt, hsa
ccauuaacuagucuugaaaugccuuuguuuguaaaaauaaaauaaugguacuuucauuuuauaa

SEQ ID NO: 653041 - RNA, 64 nt, hsa
ucuuugaaacaauauuauuuugaaauuggcuuuaaaauaaaaccauucagauugaaauucuaau

SEQ ID NO: 653042 - RNA, 64 nt, hsa
uuccuuuuguauuuguaauguugauuaagauguaaaauaaaaagugugccugauuauuuuugca

SEQ ID NO: 653043 - RNA, 64 nt, hsa
auuuaaggaaauucuuuaggauaaccauuucaaaaaauaaaauugcuaugcaaucuugaauauu

SEQ ID NO: 653044 - RNA, 64 nt, hsa
uucuuuauauuugauuguguuuuuuggauuuucuaaauaaaaauauugaaugcuuucuaacaaa

SEQ ID NO: 653045 - RNA, 64 nt, hsa
caaacaggaggauaacgaccugaagaaaaugagaaaauaaaauauuucuuaauuguaaucauaa

SEQ ID NO: 653046 - RNA, 64 nt, hsa
uuaguaaagcuuuucuuuuuuaauuuccaggaaaaaauaaaaagaguaugagucuucuguaauu

SEQ ID NO: 653047 - RNA, 64 nt, hsa
uggcaaaaucuuguuaaugucauugcuaaaaaauaaauaaaagcuagauacuggaaaccuaacu

SEQ ID NO: 653048 - RNA, 64 nt, hsa
caaagugagacucugucucaauaaauaaauaaauaaauaaaaauaagccuguggccuguuuuga

SEQ ID NO: 653049 - RNA, 64 nt, hsa
auccacacaaccaaguucaugggaauuuuguguaaaauaaaagauaacaugccugagggagagc

SEQ ID NO: 653050 - RNA, 64 nt, hsa
aguuagaccucaucucuacaaaaauaaaaaauaaaaauaaaaaaaacuuagcuaggcauguugc

SEQ ID NO: 653051 - RNA, 64 nt, hsa
aaacauaguuagaccucaucucuacaaaaauaaaaaauaaaaauaaaaaaaacuuagcuaggca

SEQ ID NO: 653052 - RNA, 64 nt, hsa
agccuggaaacauaguuagaccucaucucuacaaaaauaaaaaauaaaaauaaaaaaaacuuag

SEQ ID NO: 653053 - RNA, 64 nt, hsa
auaauauaaaauaaaaacuuaaaaaaaauuuaaaaaauaaaaaaaguuuuaaaaacugaucaag

SEQ ID NO: 653054 - RNA, 64 nt, hsa
uuaagggaaaaacuuuuacuuuguagauaauauaaaauaaaaacuuaaaaaaaauuuaaaaaau

SEQ ID NO: 653055 - RNA, 64 nt, hsa
cgcagugaacuuaaagcaaagaccucuuaguaaaaaauaaaaaaaaauaaaaaauaaaaauaaa

SEQ ID NO: 653056 - RNA, 64 nt, hsa
uuaaagcaaagaccucuuaguaaaaaauaaaaaaaaauaaaaaauaaaaauaaaaaaaguuaaa

SEQ ID NO: 653057 - RNA, 64 nt, hsa
aaagaccucuuaguaaaaaauaaaaaaaaauaaaaaauaaaaauaaaaaaaguuaaauuuauuu

SEQ ID NO: 653058 - RNA, 64 nt, hsa
cucuuaguaaaaaauaaaaaaaaauaaaaaauaaaaauaaaaaaaguuaaauuuauuuauagaa

SEQ ID NO: 653059 - RNA, 64 nt, hsa
cgagaaacuaugggaaaaaaaauugcaaaaucuaaaauaaaaaaugcaaaaucuaaaauaaaaa

SEQ ID NO: 653060 - RNA, 64 nt, hsa
auugcaaaaucuaaaauaaaaaaugcaaaaucuaaaauaaaaaauggaaaggaaacuuugaacc

SEQ ID NO: 653061 - RNA, 64 nt, hsa
caacaagagcaaaacuccgucucaaaaaagaugaaaauaaaauaaaauauauauuuacaggccu

SEQ ID NO: 653062 - RNA, 64 nt, hsa
agagcaaaacuccgucucaaaaaagaugaaaauaaaauaaaauauauauuuacaggccuacaac

SEQ ID NO: 653063 - RNA, 64 nt, hsa
uuguuagugggaagaauaugguaaauuuuuuguuaaauaaaauagacccuuauguuuagcauuu

SEQ ID NO: 653064 - RNA, 64 nt, hsa
cuccaaucaaggucuuguugauauuauauaguaaaaauaaaaccaaaaauaaauauuauucaag

SEQ ID NO: 653065 - RNA, 64 nt, hsa
augguaucuaauuaauaacuagucugacaucagaaaauaaaauugaggcugauuuuuaaaaauu

SEQ ID NO: 653066 - RNA, 64 nt, hsa
gaaacccacuguuaaaauuuaaaaaggugcuuuaaaauaaaacgccuauaaagauugugcagua

SEQ ID NO: 653067 - RNA, 64 nt, hsa
auaauuuuuuagaguuuaauuuguaaagcuuagcaaauaaaaucuuguacuaugaauagcuucu

SEQ ID NO: 653068 - RNA, 64 nt, hsa
ucuaacuauucagggacauuuuuccauuuccaaaaaauaaaauuuauuaugcuuuauaaccucu

SEQ ID NO: 653069 - RNA, 64 nt, hsa
uucuguauuuucuaauuuuuucauugucuuugauaaauaaaacaguuuuguuuugcuaauauag

SEQ ID NO: 653070 - RNA, 64 nt, hsa
ccuuccggagucuuugaagcugaaaauauaaaacaaauaaaaaauaaaaaaauaaaaacccaca

SEQ ID NO: 653071 - RNA, 64 nt, hsa
gagucuuugaagcugaaaauauaaaacaaauaaaaaauaaaaaaauaaaaacccacaaaaaugu

SEQ ID NO: 653072 - RNA, 64 nt, hsa
gaagcugaaaauauaaaacaaauaaaaaauaaaaaaauaaaaacccacaaaaauguugaaccaa

SEQ ID NO: 653073 - RNA, 64 nt, hsa
agagugaugauucugugaauauugcugagaauucaaauaaaaagaggacugagaacugacuguu

SEQ ID NO: 653074 - RNA, 64 nt, hsa
aguuguaaguauuauuuuuauuaaauauaauguaaaauaaaauguuaagauacuuaguuuuguu

SEQ ID NO: 653075 - RNA, 64 nt, hsa
gugacuacagucaacaauaacuuuauacauuuaaaaauaaaagaguguaauugggacguuugua

SEQ ID NO: 653076 - RNA, 64 nt, hsa
aaggccaaggauaauguacuaguuguuaaaauggaaauaaaagugaagugguaaauagcuuaca

SEQ ID NO: 653077 - RNA, 64 nt, hsa
guuaggaaauggaauggucucuuugauuuaaaauaaauaaaaauagauuauuacgucuuuugua

SEQ ID NO: 653078 - RNA, 64 nt, hsa
uuuguagaaaagugauuuguaugugguuaauuauaaauaaaacugguaccagaacuuaugcuuc

SEQ ID NO: 653079 - RNA, 64 nt, hsa
uacaagacauucacguuuaacaucacuuuuagugaaauaaaaugugccauacuaguaugugcuu

SEQ ID NO: 653080 - RNA, 64 nt, hsa
gccugggcaacauagcaaaaccccaucucuacaaaaauaaaaaauaugucugggcaugguggcc

SEQ ID NO: 653081 - RNA, 64 nt, hsa
gaagaccuuugagaaugcuuuaguguuugauuugaaauaaaaggaaauuuuagcaaggauuaaa

SEQ ID NO: 653082 - RNA, 64 nt, hsa
ccaaaagcuuucacugaagguuuuuuuuucuuaaaaauaaaaaaaaauauauaaguguaacaug

SEQ ID NO: 653083 - RNA, 64 nt, hsa
ccaaucuggcaacagagcgagaccuugucuuuaaaaauaaaaauaaaaacaucuuuacaacauu

SEQ ID NO: 653084 - RNA, 64 nt, hsa
uggcaacagagcgagaccuugucuuuaaaaauaaaaauaaaaacaucuuuacaacauuccuguu

SEQ ID NO: 653085 - RNA, 64 nt, hsa
aauucauacaacaucagugguuacagcuauacuaaaauaaaacuuuauaugcuaauuaucuuca

SEQ ID NO: 653086 - RNA, 64 nt, hsa
cuuuauaugcuaauuaucuucaagggucuuucuaaaauaaaagggguuguuaggcuacugcaaa

SEQ ID NO: 653087 - RNA, 64 nt, hsa
guucaaauacaugugaauucuacugcuuuaagagaaauaaaacaaauaagccuagggaaauauu

SEQ ID NO: 653088 - RNA, 64 nt, hsa
acugcagaccucuaaacauaaguaggaaaaagaaaaauaaaagaauauuaccaauaauuaaagg

SEQ ID NO: 653089 - RNA, 64 nt, hsa
uaauuuuugauugacugguggaauuagauuuacuaaauaaaaauggcuuaaauuuugacuguac

SEQ ID NO: 653090 - RNA, 64 nt, hsa
auuuagucaucagagauacuuuccuaaaaaggaaaaauaaaaaacaaaauggugccacuuuggg

SEQ ID NO: 653091 - RNA, 64 nt, hsa
auuuugagaugucauacuguacacuguauuguaaaaauaaaaaguaaaauuauauuucaaauuu

SEQ ID NO: 653092 - RNA, 64 nt, hsa
aauaacuggugucuuguaaauguucuguuuuuuuaaauaaaacuucucuacuuuagucuuuacu

SEQ ID NO: 653093 - RNA, 64 nt, hsa
gaaaaacuuucuggaaaggaaauaaaugggagaaaaauaaaauuaauugaaggcagcaaaaggc

SEQ ID NO: 653094 - RNA, 64 nt, hsa
ccugccuuuuguagaaaagaaaaacaaaaaaaguaaauaaaaauuuuaaacaguaaaauaaaag

SEQ ID NO: 653095 - RNA, 64 nt, hsa
aaacaaaaaaaguaaauaaaaauuuuaaacaguaaaauaaaaguuuaacugcuaaaaugugaau

SEQ ID NO: 653096 - RNA, 64 nt, hsa
uauaaucagggaaacuaauuguauuuagugacaaaaauaaaaaguuuuuuuuuauaauucaguc

SEQ ID NO: 653097 - RNA, 64 nt, hsa
ggcuugauugguguaaaucuuuuuauaaauacauaaauaaaagaaaaauaugcauuuuucuuuu

SEQ ID NO: 653098 - RNA, 64 nt, hsa
cccuaaaaugcuagaauaauaauaaaaaggccaaaaauaaaauuguuucucucucaaccacuuu

SEQ ID NO: 653099 - RNA, 64 nt, hsa
gcaaauagguaucaucaaugaguuaaccaucuaaaaauaaaagaguggaagcccuaaaaugcua

SEQ ID NO: 653100 - RNA, 64 nt, hsa
uuccaaaucucuucuaacacaaguaggaaacaugaaauaaaauuuacuuuccuccacauaguuc

SEQ ID NO: 653101 - RNA, 64 nt, hsa
uauaggcaacuugagauuauaguuuuggcuguauaaauaaaacugugagaagaaaaaaauaaua

SEQ ID NO: 653102 - RNA, 64 nt, hsa
guauauugguucgaaaucccagggaaaaaaauaaaaauaaaaaauuaaaggauuguugauaacc

SEQ ID NO: 653103 - RNA, 64 nt, hsa
cuaggaguauauugguucgaaaucccagggaaaaaaauaaaaauaaaaaauuaaaggauuguug

SEQ ID NO: 653104 - RNA, 64 nt, hsa
aguagaucaaaauagaacacaauagagaacuucaaaauaaaacaggugugagaauugugugugu

SEQ ID NO: 653105 - RNA, 64 nt, hsa
gauugacuauaccaaacauuauauuaaaaacacaaaauaaaaacuauaaaaauguacuuuagga

SEQ ID NO: 653106 - RNA, 64 nt, hsa
agccagaccuugucucaaaaaauaaaaaauaaaaaaauaaaaacaaaauaaggaauccuuuuaa

SEQ ID NO: 653107 - RNA, 64 nt, hsa
agagagagagccagaccuugucucaaaaaauaaaaaauaaaaaaauaaaaacaaaauaaggaau

SEQ ID NO: 653108 - RNA, 64 nt, hsa
gccugagagagagagagccagaccuugucucaaaaaauaaaaaauaaaaaaauaaaaacaaaau

SEQ ID NO: 653109 - RNA, 64 nt, hsa
auauauuuauucucauaauacuuucacuaauacuaaauaaaauuuggggaacacuuuuuauuuu

SEQ ID NO: 653110 - RNA, 64 nt, hsa
auuuuucaguacauuuaggguugcuggauuuagcaaauaaaaauaaagauugcccaguuagauu

SEQ ID NO: 653111 - RNA, 64 nt, hsa
ucaaacuagcguuuuauguaauaauauguaauauaaauaaaacuaugguaaaugugacaagcau

SEQ ID NO: 653112 - RNA, 64 nt, hsa
agucuuuuguuaagcauggugcuuguacugguuuaaauaaaauguuaacauuaaaagacuucca

SEQ ID NO: 653113 - RNA, 64 nt, hsa
cauuuggugaaauuaauacuuuuuuaaaggguccaaauaaaauaauuuucuaauguguauaucu

SEQ ID NO: 653114 - RNA, 64 nt, hsa
caaguuaaggcuucccccuuuacuauaagacuauaaauaaaaacuuauuuuauccuucuuggug

SEQ ID NO: 653115 - RNA, 64 nt, hsa
guagucucaguucguguuugauuccauuccauggaaauaaaaaguauguuguacauacugccga

SEQ ID NO: 653116 - RNA, 64 nt, hsa
uuuugccugaguguauuuuacuauuugggcucugaaauaaaaauuaugaaauauggugagguca

SEQ ID NO: 653117 - RNA, 64 nt, hsa
gguguugagauuuacguggaacccuaaagcaguaaaauaaaaaaccugguugcagcacauucac

SEQ ID NO: 653118 - RNA, 64 nt, hsa
uuuuguccauuccauuaauaacugaauaaaaaauaaauaaaauggauagaaaaaaacuaaaguu

SEQ ID NO: 653119 - RNA, 64 nt, hsa
cugguuauuuccuugaagcuuuauguggaccuauaaauaaaaauccaaucuccugcuaauaggu

SEQ ID NO: 653120 - RNA, 64 nt, hsa
agcuaugacuucucaguuucuuagaauccuagguaaauaaaacaauaaaaagaaaacccuuaca

SEQ ID NO: 653121 - RNA, 64 nt, hsa
gguggucuuuuggaugagggaauaaugcauuuuuaaauaaaauaccaauaucaggaagccauuu

SEQ ID NO: 653122 - RNA, 64 nt, hsa
gggauuuaauguaccuuuuuguuagugaauuuggaaauaaaaagaaaaaaaaaacaaaaacaaa

SEQ ID NO: 653123 - RNA, 64 nt, hsa
cguggcauucacaauacuggcacuauaaagaacaaaauaaaauaauaauuuauaggacaguuuu

SEQ ID NO: 653124 - RNA, 64 nt, hsa
uuuacuuuuucauuccuuccuuuuuuuuguccugaaauaaaaaguggcaugcaguuuuuuuuuu

SEQ ID NO: 653125 - RNA, 64 nt, hsa
uugucucuuuuuuuugguauuaaaaaaaucauaaaaauaaaagaaauaaugcaauuuaaccuuc

SEQ ID NO: 653126 - RNA, 64 nt, hsa
ucaucagaaaaauacauuaggaaaauguguuuagaaauaaaagcacaaggcagggcagugcuca

SEQ ID NO: 653127 - RNA, 64 nt, hsa
uguaauugccaucugucacucacuauauucacaaaaauaaaacucuacaacucauucuaacauu

SEQ ID NO: 653128 - RNA, 64 nt, hsa
agcuucugaguuuuauacugcucaagaucgucauaaauaaaauuuuuucucauugucauagauu

SEQ ID NO: 653129 - RNA, 64 nt, hsa
uuagaauuuguguuuauauuuccuguaagugaauaaauaaaacaaaacaaaacaaaaaaaacuu

SEQ ID NO: 653130 - RNA, 64 nt, hsa
aagcuaaggcucauuuauuuuuaaaaggcauauuaaauaaaauacuguaauuuaggaagaaagu

SEQ ID NO: 653131 - RNA, 64 nt, hsa
cucaggaccagccuagagagaucccaucucuaaaaaauaaaauauaagaaaauaaaacuuaggg

SEQ ID NO: 653132 - RNA, 64 nt, hsa
gagagaucccaucucuaaaaaauaaaauauaagaaaauaaaacuuaggggauauacagauuuaa

SEQ ID NO: 653133 - RNA, 64 nt, hsa
gaugaaugucuuuuugguuguaauuuaacaagucaaauaaaauaaucauugcugagcacaauca

SEQ ID NO: 653134 - RNA, 64 nt, hsa
ccauauuuuacuuuuuuaggauuuuucccccuuuaaauaaaaauauuagaucaaauacuauaug

SEQ ID NO: 653135 - RNA, 64 nt, hsa
aaugggcagugucugcuauagggcuucaggcauuaaauaaaaccgaggguuguugauuuugcug

SEQ ID NO: 653136 - RNA, 64 nt, hsa
aaaagagagcuuaaugauaauauuguggugccacaaauaaaauggauuuauuagaauuucauau

SEQ ID NO: 653137 - RNA, 64 nt, hsa
cgacagaaggaaccagcguguauaugaggguaucaaauaaaauugcuacuacuuaccuaccaca

SEQ ID NO: 653138 - RNA, 64 nt, hsa
cgaagugucuuccaccugcccugcggaccguggaaaauaaaaggcucugcccccagugugagug

SEQ ID NO: 653139 - RNA, 64 nt, hsa
cuuggcuacacucauguugcucagacuauauuucaaauaaaaaaucuucucaccaugcagguag

SEQ ID NO: 653140 - RNA, 64 nt, hsa
ugagacagaacuguuuguuauguaccauaaugcuaaauaaaacuguggcacuuuucaccauaau

SEQ ID NO: 653141 - RNA, 64 nt, hsa
augugauguuguuaauuucuuuuauugcauuauaaaauaaaaggauuauguauuuuuaacuaag

SEQ ID NO: 653142 - RNA, 64 nt, hsa
aaggauuuggcaugcuguaaaacaaaacaaaacaaaauaaaacaaaaaaaaggaaggaaaaaaa

SEQ ID NO: 653143 - RNA, 64 nt, hsa
aucaggucuccuaacuaccccaguuuguaaggaaaaauaaaaguuuuuauaaaauuaaaaaaaa

SEQ ID NO: 653144 - RNA, 64 nt, hsa
aggaacacauaaguaaguugcuuuggugccaagaaaauaaaaaagcuauuaucaggucuccuaa

SEQ ID NO: 653145 - RNA, 64 nt, hsa
agaucaaaaauauuagaaaaaauaaaaauaauacaaauaaaaauacaguauaacaguuauuuaa

SEQ ID NO: 653146 - RNA, 64 nt, hsa
gauuaaaccaauugcagaucaaaaauauuagaaaaaauaaaaauaauacaaauaaaaauacagu

SEQ ID NO: 653147 - RNA, 64 nt, hsa
ucacacaacaaggagauuuuuagcaugauacuggaaauaaaauguccaagcugacaaguauuaa

SEQ ID NO: 653148 - RNA, 64 nt, hsa
auacuuuuugauccauauaugugugcaugucaagaaauaaaagaaucacacaacaaggagauuu

SEQ ID NO: 653149 - RNA, 64 nt, hsa
auguauugaggaucugugaaaugcuaagugcccaaaauaaaauauugcugauugucuuuuuauu

SEQ ID NO: 653150 - RNA, 64 nt, hsa
auccuuuauuauuacuaauauucuacaauuguuuaaauaaaaggaacuuuauaaugaaacgguu

SEQ ID NO: 653151 - RNA, 64 nt, hsa
uauggguacaacguauguucauuauuuguacauaaaauaaaaccauuuaaaaaguaaugcugau

SEQ ID NO: 653152 - RNA, 64 nt, hsa
acuaauggcaaaaauucauggcuagugauguauaaaauaaaauauucuuugcaguaaaauauuc

SEQ ID NO: 653153 - RNA, 64 nt, hsa
cgcuauuuaaguuaaauuuaaaugaaauaaaauaaaauaaaaucaguuccugagucacacaauc

SEQ ID NO: 653154 - RNA, 64 nt, hsa
agugucgcuauuuaaguuaaauuuaaaugaaauaaaauaaaauaaaaucaguuccugagucaca

SEQ ID NO: 653155 - RNA, 64 nt, hsa
auccaagugucgcuauuuaaguuaaauuuaaaugaaauaaaauaaaauaaaaucaguuccugag

SEQ ID NO: 653156 - RNA, 64 nt, hsa
uuugccaauuauuuuguuauauuuccaaaaaacuaaauaaaaaucauuuuuauuuuuuaguuug

SEQ ID NO: 653157 - RNA, 64 nt, hsa
aacuauccauguagucaaaucuaggggaaaaagcaaauaaaaauaguaaaauuuggccgggcac

SEQ ID NO: 653158 - RNA, 64 nt, hsa
auagagggucaguguuauaaauaauugucuuuugaaauaaaaucaaauauucaugcauugaaca

SEQ ID NO: 653159 - RNA, 64 nt, hsa
gggcaauagcaagacuccaucucaaaauaaaauaaaauaaaacuuagagcaaaguuuaaaacug

SEQ ID NO: 653160 - RNA, 64 nt, hsa
agcuugggcaauagcaagacuccaucucaaaauaaaauaaaauaaaacuuagagcaaaguuuaa

SEQ ID NO: 653161 - RNA, 64 nt, hsa
acuccagcuugggcaauagcaagacuccaucucaaaauaaaauaaaauaaaacuuagagcaaag

SEQ ID NO: 653162 - RNA, 64 nt, hsa
guuucacaaguuuugggccaccuauuucaauaaaaaauaaaauauaaauuaaaaaaguugccgg

SEQ ID NO: 653163 - RNA, 64 nt, hsa
ggucuuucugggccuuacugugcugguauaauuaaaauaaaauauauuuuguucuauugguagg

SEQ ID NO: 653164 - RNA, 64 nt, hsa
caaauguaauuuuaugucugcuuuaaggaaaauaaaauaaaauauuaauaggaguugugagccu

SEQ ID NO: 653165 - RNA, 64 nt, hsa
ucuuccaaauguaauuuuaugucugcuuuaaggaaaauaaaauaaaauauuaauaggaguugug

SEQ ID NO: 653166 - RNA, 64 nt, hsa
gauuaauuuagauuagaaucauuaacaucaugaaaaauaaaaguacuacauuucuaacguauuc

SEQ ID NO: 653167 - RNA, 64 nt, hsa
cagccuggaccacagagcaagacccuguguaaaaaaauaaaauaaaaaacagauuggaugucuu

SEQ ID NO: 653168 - RNA, 64 nt, hsa
uggaccacagagcaagacccuguguaaaaaaauaaaauaaaaaacagauuggaugucuuucuuc

SEQ ID NO: 653169 - RNA, 64 nt, hsa
aucauuuuagcaacucuaaaaaaaaaaaaaauacaaauaaaaaggaaaaaaaauuacauuuuuu

SEQ ID NO: 653170 - RNA, 64 nt, hsa
ggguauccgucacgggucuuccuguuuuguauuuaaauaaaaacaacagcagcaggcugucccu

SEQ ID NO: 653171 - RNA, 64 nt, hsa
gugagccacugugcccagccuaagccauuucuuaaaauaaaaaugcuaaaggacuaguaaguaa

SEQ ID NO: 653172 - RNA, 64 nt, hsa
cuuaaaauaaaaaugcuaaaggacuaguaaguaaaaauaaaacuuccuaugggauuucccagug

SEQ ID NO: 653173 - RNA, 64 nt, hsa
uuuuacuuuuuauuacauaaaaauauuaaaaaauaaauaaaaaaaauaaaauuuuaaacuaacu

SEQ ID NO: 653174 - RNA, 64 nt, hsa
uuauuacauaaaaauauuaaaaaauaaauaaaaaaaauaaaauuuuaaacuaacuuaaccugcc

SEQ ID NO: 653175 - RNA, 64 nt, hsa
cugggcaacacagcgagacuccgucucaaggaaaaaauaaaaauaaaaagcgggcacgggcccg

SEQ ID NO: 653176 - RNA, 64 nt, hsa
aacacagcgagacuccgucucaaggaaaaaauaaaaauaaaaagcgggcacgggcccgugacau

SEQ ID NO: 653177 - RNA, 64 nt, hsa
gaguuuuauuucugaaaauaaauuaauuuuuuguaaauaaaauguuuaaaaauaaaaaagaaac

SEQ ID NO: 653178 - RNA, 64 nt, hsa
aaauaaauuaauuuuuuguaaauaaaauguuuaaaaauaaaaaagaaacuaaaguuacuuguau

SEQ ID NO: 653179 - RNA, 64 nt, hsa
aaagaaaacaaaauauaagggaaaaauaugagaaaaauaaaaauaaaaagagaauaauaggcca

SEQ ID NO: 653180 - RNA, 64 nt, hsa
aacaaaauauaagggaaaaauaugagaaaaauaaaaauaaaaagagaauaauaggccaggcacu

SEQ ID NO: 653181 - RNA, 64 nt, hsa
agcacucuggugcgggaagaagcagaagcaaaaaaaauaaaaauaaaaaaauaaauaaaaauaa

SEQ ID NO: 653182 - RNA, 64 nt, hsa
cuggugcgggaagaagcagaagcaaaaaaaauaaaaauaaaaaaauaaauaaaaauaaaaaaaa

SEQ ID NO: 653183 - RNA, 64 nt, hsa
gaagcagaagcaaaaaaaauaaaaauaaaaaaauaaauaaaaauaaaaaaaauaaaaaaggaaa

SEQ ID NO: 653184 - RNA, 64 nt, hsa
gaagcaaaaaaaauaaaaauaaaaaaauaaauaaaaauaaaaaaaauaaaaaaggaaaaaaaaa

SEQ ID NO: 653185 - RNA, 64 nt, hsa
aaaauaaaaauaaaaaaauaaauaaaaauaaaaaaaauaaaaaaggaaaaaaaaaaaagaagaa

SEQ ID NO: 653186 - RNA, 64 nt, hsa
ugugugaauugacuaccguuguuugcaaacccgaaaauaaaagacguucauuauguaugaaaag

SEQ ID NO: 653187 - RNA, 64 nt, hsa
ugaaucaucaaagcucacaccaaauuuuucuaucaaauaaaacuagugacagcuuguggcuuuu

SEQ ID NO: 653188 - RNA, 64 nt, hsa
aguuucaggaaugaaguagaagguaguuauuuaaaaauaaaaaacacaguccgucccuaccaau

SEQ ID NO: 653189 - RNA, 64 nt, hsa
cauaucuuuuaugaacaaaucugaacaauuugugaaauaaaacauugaaaaccaucuuucaggc

SEQ ID NO: 653190 - RNA, 64 nt, hsa
uaguggugggucugaucugacugcagccaucgguaaauaaaaguuuuugauccuguugaacccg

SEQ ID NO: 653191 - RNA, 64 nt, hsa
gccuuuuguguauuuuuuccuaaaaaaagaacaaaaauaaaaauguauaacauuuguacauggc

SEQ ID NO: 653192 - RNA, 64 nt, hsa
guaacaaacagccauauuuaagacaugccuggauaaauaaaauugguaggaauguuuucuugcc

SEQ ID NO: 653193 - RNA, 64 nt, hsa
cugcacagucugcagcuuccugaguccuguucugaaauaaaacaugaggcuuuuaagaaucaug

SEQ ID NO: 653194 - RNA, 64 nt, hsa
caacauagugagauucuguuaaaaaaauaaaauaaaauaaaaccaauuuuuaaaaagagaauaa

SEQ ID NO: 653195 - RNA, 64 nt, hsa
cugggcaacauagugagauucuguuaaaaaaauaaaauaaaauaaaaccaauuuuuaaaaagag

SEQ ID NO: 653196 - RNA, 64 nt, hsa
ccaaccugggcaacauagugagauucuguuaaaaaaauaaaauaaaauaaaaccaauuuuuaaa

SEQ ID NO: 653197 - RNA, 64 nt, hsa; identical to SEQ ID NO: 653192

SEQ ID NO: 653198 - RNA, 64 nt, hsa
cugcacagucugcaacuuccugaggccuguucugaaauaaaacaugaggcuuuuaagaaucaug

SEQ ID NO: 653199 - RNA, 64 nt, hsa
uugugaaauaaaaacuuaaauuguauauuuugaaaaauaaaacacugaaaagaaaccaacaaaa

SEQ ID NO: 653200 - RNA, 64 nt, hsa
gauuuuggaauaaauauacaaaacuacgguugugaaauaaaaacuuaaauuguauauuuugaaa

SEQ ID NO: 653201 - RNA, 64 nt, hsa
uacuuuuaaaaauuuguccuuaaaugaauaaauaaaauaaaaguugguccugugagaggauaau

SEQ ID NO: 653202 - RNA, 64 nt, hsa
cacuuuacuuuuaaaaauuuguccuuaaaugaauaaauaaaauaaaaguugguccugugagagg

SEQ ID NO: 653203 - RNA, 64 nt, hsa
aaaaugcacacuuuauaguuucaagauuuucaguaaauaaaaucuguccauuccuaccuggaca

SEQ ID NO: 653204 - RNA, 64 nt, hsa
uuuagaaagauguuaauguacauaaauagaguguaaauaaaauaguguugauguacugaaauau

SEQ ID NO: 653205 - RNA, 64 nt, hsa
guaaaagggaaauuugaacaacaaaaaccaaaaaaaauaaaaauaaaaaacuucaaaaguugac

SEQ ID NO: 653206 - RNA, 64 nt, hsa
gggaaauuugaacaacaaaaaccaaaaaaaauaaaaauaaaaaacuucaaaaguugacaagaag

SEQ ID NO: 653207 - RNA, 64 nt, hsa
aaguugcuugagccaagugcuuaaaaaguuaauaaaauaaaaugaucuguaugauaccugcaau

SEQ ID NO: 653208 - RNA, 64 nt, hsa
aaaacuuuguguuuuggcaaucguuuuauaacuaaaauaaaaugaaagcuaaaucuacacgcug

SEQ ID NO: 653209 - RNA, 64 nt, hsa
cuggacaacacagugagaccucaucucuaucaaaaaauaaaaauuagcuagaugugguggcaug

SEQ ID NO: 653210 - RNA, 64 nt, hsa
cuugggcaacagagcaagacccugucuccgaaacaaauaaaaaauacuguaauaaaaguacuua

SEQ ID NO: 653211 - RNA, 64 nt, hsa
uugaaaaaggaaaaucagcaauucagcaaaaaauaaauaaaaaauaaaaauguaaauaugauag

SEQ ID NO: 653212 - RNA, 64 nt, hsa
aggaaaaucagcaauucagcaaaaaauaaauaaaaaauaaaaauguaaauaugauaguaauaaa

SEQ ID NO: 653213 - RNA, 64 nt, hsa
aagaacccugaaauuuauauaggugagacaauagaaauaaaaagaucuucagccaggccuuucu

SEQ ID NO: 653214 - RNA, 64 nt, hsa
ggagagagagagagaugcuguugagcacaugacaaaauaaaauaaaauggaugauucauucuua

SEQ ID NO: 653215 - RNA, 64 nt, hsa
gagagagagaugcuguugagcacaugacaaaauaaaauaaaauggaugauucauucuuaagugc

SEQ ID NO: 653216 - RNA, 64 nt, hsa
aaaaucaaaaacuuuugcaaucuuaagcagagauaaauaaaagauagcaauaugagacacaggu

SEQ ID NO: 653217 - RNA, 64 nt, hsa
ucaaaugagcaucucaaauguuuucugcagaaaaaaauaaaaagauucuaauaaaauguauucu

SEQ ID NO: 653218 - RNA, 64 nt, hsa
cuccugaagaaauggcucagauauugagucagagaaauaaaaaguaggaucaguuagcaauucu

SEQ ID NO: 653219 - RNA, 64 nt, hsa
uuuucuugcaucaguauuggcuagaaaagaaaauaaauaaaaccaaguuaauuuaguaguaaca

SEQ ID NO: 653220 - RNA, 64 nt, hsa
uagugagagacccuguaucugaaaguaauaauaaaaauaaaaaauauaaaugaggucucguuga

SEQ ID NO: 653221 - RNA, 64 nt, hsa
agccugggcaacaaagcaagacucugucucaaaaaaauaaaaauaaaaaaaaaaucuuaguucc

SEQ ID NO: 653222 - RNA, 64 nt, hsa
ggcaacaaagcaagacucugucucaaaaaaauaaaaauaaaaaaaaaaucuuaguuccauggaa

SEQ ID NO: 653223 - RNA, 64 nt, hsa
aaacggggaaugaaggcaggaaggaggcuggaauaaauaaaaauaaaaauagacaaguaagaca

SEQ ID NO: 653224 - RNA, 64 nt, hsa
ggaaugaaggcaggaaggaggcuggaauaaauaaaaauaaaaauagacaaguaagacagcauaa

SEQ ID NO: 653225 - RNA, 64 nt, hsa
uaaccaaaagccaucugcuccccaaaaacuauugaaauaaaauaaaauauaaaaagaaagagaa

SEQ ID NO: 653226 - RNA, 64 nt, hsa
aaaagccaucugcuccccaaaaacuauugaaauaaaauaaaauauaaaaagaaagagaaagaaa

SEQ ID NO: 653227 - RNA, 64 nt, hsa
aggcaaucuggucacuaggucuuugugaugccaaaaauaaaagaggguggggugggugcuuucu

SEQ ID NO: 653228 - RNA, 64 nt, hsa
gaugcucagacuugguugucuuauguuuaccaauaaauaaaaguagacuuuuucuauuuuuauu

SEQ ID NO: 653229 - RNA, 64 nt, hsa
auuuuauguauguuuacacugucaaacaucuggaaaauaaaaggucuaugcucauaacuguguc

SEQ ID NO: 653230 - RNA, 64 nt, hsa
uucuaacucugauguaaaugaaguaacuugucuuaaauaaaagaaaugcacaaugucuugguac

SEQ ID NO: 653231 - RNA, 64 nt, hsa
ucuuuaacuuccagaauagugauuuuaaaaguaaaaauaaaaauaaaccuuacuuacaagcaua

SEQ ID NO: 653232 - RNA, 64 nt, hsa
uaagaaacucuaaagguuauaaaaugaaaacaaaaaauaaaauauuuguuuucugcuagaugca

SEQ ID NO: 653233 - RNA, 64 nt, hsa
aaacaguucuaggggguugaacuacauaguaaaaaaauaaaauaaauaguacuuaguguaaaau

SEQ ID NO: 653234 - RNA, 64 nt, hsa
gaauuaaaaccaaucauaaguagaacccacuucaaaauaaaaaaacagcauuacuauuucuaau

SEQ ID NO: 653235 - RNA, 64 nt, hsa
acaugcaaugugcuguaaaaauucaauacaguuuaaauaaaaucucuauauuagugcugcuuug

SEQ ID NO: 653236 - RNA, 64 nt, hsa
acaggagcuacaccuugauccucuccuggcaugaaaauaaaacaaagguuuucguuguuguugu

SEQ ID NO: 653237 - RNA, 64 nt, hsa
uuuagaaagauguuaauguacauaaauagaguguaaauaaaauaguguugauguaccgaaauau

SEQ ID NO: 653238 - RNA, 64 nt, hsa
auguaguuauuuuauccuguggcccugaagcacaaaauaaaaauucuaauuaaaauaguuaacu

SEQ ID NO: 653239 - RNA, 64 nt, hsa
uuacguucggguuauaugcaaguuuauuucuuagaaauaaaacuuugauggacuuuucuuaugu

SEQ ID NO: 653240 - RNA, 64 nt, hsa
auuaucaauaaagcuaacacugagaacauuuuacaaauaaaaauaugagguuuuuagccugaac

SEQ ID NO: 653241 - RNA, 64 nt, hsa
caucuucuuaaauaaguacguaauguuccaaucuaaauaaaaaacuaauucauaacuaaugcau

SEQ ID NO: 653242 - RNA, 64 nt, hsa
ugaaaugcugugguuguguguuuugcuuuucuuuaaauaaaacguauguauaauuaagugaagc

SEQ ID NO: 653243 - RNA, 64 nt, hsa
uaauguuuuaagcuuaauagccuuugcacuuuuaaaauaaaaaccaaguaugcaaaucaaagau

SEQ ID NO: 653244 - RNA, 64 nt, hsa
gaugcaaaacauaauuugcaaaauuuuauaauugaaauaaaacuugguaugcuguuuuauaaua

SEQ ID NO: 653245 - RNA, 64 nt, hsa
gaacugguagccaguauauuaaauauugauauaaaaauaaaagaacuggaaccagauucagaau

SEQ ID NO: 653246 - RNA, 64 nt, hsa
uauugaauuguaauguuuaucugcugcuuuuuuuaaauaaaauuugacugaaaauguuuaauug

SEQ ID NO: 653247 - RNA, 64 nt, hsa
cucuugcuuaaaugauagucuauuuaguaguuuaaaauaaaaauaaucacucccuaugaucuag

SEQ ID NO: 653248 - RNA, 64 nt, hsa
gugugcugaauguuccuguguacauauguguguuaaauaaaacaauuguauugaagacuguuuu

SEQ ID NO: 653249 - RNA, 64 nt, hsa
uucugguauuuugacauguuauaauacgcaaguaaaauaaaacaauaguuuacucagcucaugu

SEQ ID NO: 653250 - RNA, 64 nt, hsa
gcaaaacauaaauuaaaacucaaaugccaggacaaaauaaaacaauauaccagauggagaggau

SEQ ID NO: 653251 - RNA, 64 nt, hsa
uguaaaugaagcuugcuuggaaggggaaaacuuuaaauaaaaacuuuauguacuaauucaacug

SEQ ID NO: 653252 - RNA, 64 nt, hsa
acuuguucugcauuuuauuuuuuauuucucaccaaaauaaaagcauuuaugagaauuauaagua

SEQ ID NO: 653253 - RNA, 64 nt, hsa
agcccuccagagcuugaacaacaacuuuaggaguaaauaaaagccuaaaauauauuuuaaccau

SEQ ID NO: 653254 - RNA, 64 nt, hsa
cuauguaaaaauaaaauucaaacgcccaggauuaaaauaaaauauaaucugaaaaccucauguu

SEQ ID NO: 653255 - RNA, 64 nt, hsa
guuuugagggaauauacuaaaugcagcuauguaaaaauaaaauucaaacgcccaggauuaaaau

SEQ ID NO: 653256 - RNA, 64 nt, hsa
gccugggcgacagagcaagacucugucucaaaaaaaauaaaaaauaaucagggcacaguggcuc

SEQ ID NO: 653257 - RNA, 64 nt, hsa
ccagccugggcaacaagagcaaaacuccgucucaaaauaaaaagaaaagaaaagaauggacagu

SEQ ID NO: 653258 - RNA, 64 nt, hsa
cagccugggggacagagcacgacccugucuccaaaaauaaaauaaaaauaaaaauaaauauugg

SEQ ID NO: 653259 - RNA, 64 nt, hsa
ugggggacagagcacgacccugucuccaaaaauaaaauaaaaauaaaaauaaauauuggcgggg

SEQ ID NO: 653260 - RNA, 64 nt, hsa
acagagcacgacccugucuccaaaaauaaaauaaaaauaaaaauaaauauuggcgggggaaccc

SEQ ID NO: 653261 - RNA, 64 nt, hsa
uauccagccaaacuaagcuucauaagugaaggagaaauaaaauacuuuacagacaagcaaaugc

SEQ ID NO: 653262 - RNA, 64 nt, hsa
acccaucucacgugcagagacacacauaggcucaaaauaaaaggauggaggaagaucuacgaag

SEQ ID NO: 653263 - RNA, 64 nt, hsa
cucuucaaggagaacuacaaaccacugcuuaacgaaauaaaagaggaugcaaagaaauggaaga

SEQ ID NO: 653264 - RNA, 64 nt, hsa
uuuauacgaaaauauauuuucaaagguguaguaaaaauaaaaaaaauuuuaauccaaauuuguc

SEQ ID NO: 653265 - RNA, 64 nt, hsa
gaauauucuacuaaaugagaguucugaguauagaaaauaaaacuaaaguugguagaaaaauuau

SEQ ID NO: 653266 - RNA, 64 nt, hsa
aauaacauuuaggaagcaaauagauuaaacacaaaaauaaaacuaaagcauaggaauuauguuu

SEQ ID NO: 653267 - RNA, 64 nt, hsa
uuuaaauauaauuuuauuucuuucaacaaauauaaaauaaaaaacaacuuuggaacaaugacuu

SEQ ID NO: 653268 - RNA, 64 nt, hsa
uggugacagagugagauccugucucuaaauaaauaaauaaaaugcgggccaggcacaguggcuc

SEQ ID NO: 653269 - RNA, 64 nt, hsa
accagaaaaaugaaaagaaaaaaacagacauacaaaauaaaagccccaguuuuuuauuauggua

SEQ ID NO: 653270 - RNA, 64 nt, hsa
ccugggcgacagagugagacucccucucaaaagaaaauaaaaauaaaaauaaacuggccaggug

SEQ ID NO: 653271 - RNA, 64 nt, hsa
cgacagagugagacucccucucaaaagaaaauaaaaauaaaaauaaacuggccaggugcggugg

SEQ ID NO: 653272 - RNA, 64 nt, hsa
ccugggcaagagagagagacuuugucucuauuaaaaauaaaaaugauuggccgagcaugguggu

SEQ ID NO: 653273 - RNA, 64 nt, hsa
acaggcugcaccauaagacccacucacaauaaaaaaauaaaaggccgagccgggcaugguugcu

SEQ ID NO: 653274 - RNA, 64 nt, hsa
gagccgggcaugguugcucacucccguaauaaaaaaauaaaagaacaggcugagccgggcaugg

SEQ ID NO: 653275 - RNA, 64 nt, hsa
aacaagagcgaaacucugucucaaaauaaauaaaaaauaaaagacagaaagcaaggggugccua

SEQ ID NO: 653276 - RNA, 64 nt, hsa
ccugggcaacaagagcgaaacucugucucaaaauaaauaaaaaauaaaagacagaaagcaaggg

SEQ ID NO: 653277 - RNA, 64 nt, hsa
gugacagaaugagacucugugucaaaaaaauaaaaaauaaaaaaucuaagggcucaggaaccag

SEQ ID NO: 653278 - RNA, 64 nt, hsa
agccugggugacagaaugagacucugugucaaaaaaauaaaaaauaaaaaaucuaagggcucag

SEQ ID NO: 653279 - RNA, 64 nt, hsa
uucgcuuccucucuuguguuauggaaauaaaaacaaauaaaacuacacacugcacauccacugu

SEQ ID NO: 653280 - RNA, 64 nt, hsa
gcccuggcccuucgcuuccucucuuguguuauggaaauaaaaacaaauaaaacuacacacugca

SEQ ID NO: 653281 - RNA, 64 nt, hsa
ugaagcacuuuugcauuaauuugguuaaaaaauaaaauaaaauaauaauaauguaugaagcucu

SEQ ID NO: 653282 - RNA, 64 nt, hsa
uacuuugaagcacuuuugcauuaauuugguuaaaaaauaaaauaaaauaauaauaauguaugaa

SEQ ID NO: 653283 - RNA, 64 nt, hsa
aauaaguauuuccgucaagaaaaaggaaacaacaaaauaaaaccaacccaaguaaagaacagcc

SEQ ID NO: 653284 - RNA, 64 nt, hsa
auuugguuagggauuaugucagugugauuauaaaaaauaaaagaucguaugauaugagauacau

SEQ ID NO: 653285 - RNA, 64 nt, hsa
ugauuuuuuuuucucugucuuugcugcaauuuugaaauaaaaugccaaagaacacacauugucg

SEQ ID NO: 653286 - RNA, 64 nt, hsa
cucccuaccaaugacucaccugaagugcaauacgaaauaaaaggccagcgggcggcgucugggu

SEQ ID NO: 653287 - RNA, 64 nt, hsa
cauuaguuuuguucccgguuuuucuuacuguuacaaauaaaaauccuaugaacauuuguacaca

SEQ ID NO: 653288 - RNA, 64 nt, hsa
gaaauguaauaauuauaggaacgucuuugcccaaaaauaaaacuucaacagauugagagaguuc

SEQ ID NO: 653289 - RNA, 64 nt, hsa
gcuuguagaaacaauuuugaaagccccuugaggaaaauaaaaaucaagaagaacacuuuucucc

SEQ ID NO: 653290 - RNA, 64 nt, hsa
uuaucagaaccugcagugaaauuaaacuuauguuaaauaaaaccaguuugcaggugcacaaacu

SEQ ID NO: 653291 - RNA, 64 nt, hsa
gucuuuuuuuugggcagcguggugggggauaaauaaauaaaaggaaaaaaaacuuagccuagaa

SEQ ID NO: 653292 - RNA, 64 nt, hsa
uuuuuuuuuuuuuuuuuuacugcauguuacauugaaauaaaaacaaaguaaaaugagcaauugc

SEQ ID NO: 653293 - RNA, 64 nt, hsa
uggcuuuuuauaaagcuugaguuauguaagauuuaaauaaaaguuugcuaccaagaugauugcc

SEQ ID NO: 653294 - RNA, 64 nt, hsa
aagucuuuaucugccccuuuaacaaguugaguaaaaauaaaagguauuuuuuagucaauguguu

SEQ ID NO: 653295 - RNA, 64 nt, hsa
gaaagcccauuuucucccuuccuaagcuagauccaaauaaaagaaaguucaguuuucccccaua

SEQ ID NO: 653296 - RNA, 64 nt, hsa
uaacaacuucaacaucauaaacaaauuccuugaaaaauaaaaaguaccaaaauucauucaagaa

SEQ ID NO: 653297 - RNA, 64 nt, hsa
gauagauuuuaaugggaaaauuauaauucagauuaaauaaaaaacaauucccuuuucccuguug

SEQ ID NO: 653298 - RNA, 64 nt, hsa
uucccacugcugggccucuaucuccaugacaacaaaauaaaaacagagguugcuugacucauua

SEQ ID NO: 653299 - RNA, 64 nt, hsa
gccacaaaaguucccucucacuuucaguaaaaauaaauaaaacagcagcagcaaacaaauaaaa

SEQ ID NO: 653300 - RNA, 64 nt, hsa
uucaguaaaaauaaauaaaacagcagcagcaaacaaauaaaaugaaauaaaagaaacaaaugaa

SEQ ID NO: 653301 - RNA, 64 nt, hsa
auaaauaaaacagcagcagcaaacaaauaaaaugaaauaaaagaaacaaaugaaauaaauauug

SEQ ID NO: 653302 - RNA, 64 nt, hsa
uaaauauuguguugugcagcauuaaaaaaaaucaaaauaaaaauuaaaugugagcaaagaauga

SEQ ID NO: 653303 - RNA, 64 nt, hsa
gagaauuggugaguuuaaaauaaaagcuauuuuuaaauaaaagacgucguucugagcugaggag

SEQ ID NO: 653304 - RNA, 64 nt, hsa
ugugagugugugugagagagaauuggugaguuuaaaauaaaagcuauuuuuaaauaaaagacgu

SEQ ID NO: 653305 - RNA, 64 nt, hsa
aggcuuguguaauuuccugcuccuccaguacaauaaauaaaagaaagaugcugaugacuuggug

SEQ ID NO: 653306 - RNA, 64 nt, hsa
auccccauaaugcuucuuuccucuuaaugucucaaaauaaaaccagaaagaggaauaaaaugau

SEQ ID NO: 653307 - RNA, 64 nt, hsa
gugagcacuaacuauuggcagaaacugcauuugcaaauaaaaauaaauguuugccuuuucccca

SEQ ID NO: 653308 - RNA, 64 nt, hsa
ugugcacguuucauuaauccaaccaaaaauaaugaaauaaaauuugagccacaguauaccacuc

SEQ ID NO: 653309 - RNA, 64 nt, hsa
uugacugucacuguuccuugucacugguagaccaaaauaaaaccagcucuacuggucuugugga

SEQ ID NO: 653310 - RNA, 64 nt, hsa
gaaccccuacaugaaacagaaacaaaaacacuaaaaauaaaaauggccauuugcuuuuucacca

SEQ ID NO: 653311 - RNA, 64 nt, hsa
aauccccucaaaaaaauaaaaauaaaaaaaauaaaaauaaaaaaacauuuuuuucaagcaggga

SEQ ID NO: 653312 - RNA, 64 nt, hsa
cugugcaauccccucaaaaaaauaaaaauaaaaaaaauaaaaauaaaaaaacauuuuuuucaag

SEQ ID NO: 653313 - RNA, 64 nt, hsa
ggaaauaaacugugcaauccccucaaaaaaauaaaaauaaaaaaaauaaaaauaaaaaaacauu

SEQ ID NO: 653314 - RNA, 64 nt, hsa
guguuuggaaauaaacugugcaauccccucaaaaaaauaaaaauaaaaaaaauaaaaauaaaaa

SEQ ID NO: 653315 - RNA, 64 nt, hsa
uuucauauugcaacaaucuuuguaagaaccacucaaauaaaagucucuuaaaaaggccacagga

SEQ ID NO: 653316 - RNA, 64 nt, hsa
ugucauuuguaugcaauuuccuguuaccuugaaaaaauaaaaauguuaacaggaaugcagugug

SEQ ID NO: 653317 - RNA, 64 nt, hsa
uucaucuguauaccuucaaauucucugaaaguaaaaauaaaaguuuuuaaauauuugagagacu

SEQ ID NO: 653318 - RNA, 64 nt, hsa
aggccucccaugaaauugcguucuuccugcauugaaauaaaaacauuauugggaaacuagagaa

SEQ ID NO: 653319 - RNA, 64 nt, hsa
uagaaauccaauuaagacucacuuggguaaaaaaaaauaaaaaaauaaacaaaauaaacugcuc

SEQ ID NO: 653320 - RNA, 64 nt, hsa
cagcccagccaacauugugagacauaaucucuacaaauaaaauaaauuaguuggacaugauggu

SEQ ID NO: 653321 - RNA, 64 nt, hsa
agccugagugacagagugagacuuugcaaccaaaaaauaaaauaauaauaauaaugaaauaaau

SEQ ID NO: 653322 - RNA, 64 nt, hsa
uccuguauaguucacguuucauguaauccucaagaaauaaaaggaagccaaagaguguauuuuu

SEQ ID NO: 653323 - RNA, 64 nt, hsa
aauugugugugaugugaagccaauucagacaggcaaauaaaagugaccuuuuacacugacucuu

SEQ ID NO: 653324 - RNA, 64 nt, hsa
acuauuuugccauauuugcuucugauuuuuaaauaaauaaaauguuacucuuuuguacuucucc

SEQ ID NO: 653325 - RNA, 64 nt, hsa
gcacauguuuaauuggcaaaaagcaauucaugauaaauaaaauuacugcuuuccaucuacuggg

SEQ ID NO: 653326 - RNA, 64 nt, hsa
uaggcaauuuucuucagugguauggcauuuucucaaauaaaacucugcaagaguuaucaauaga

SEQ ID NO: 653327 - RNA, 64 nt, hsa
uauuuaugcccuuauaucccaaaaaugucuuagaaaauaaaaauucugggccuuacuuguuuuu

SEQ ID NO: 653328 - RNA, 64 nt, hsa
uaaucaauggauauccuucaguagugaaugcagaaaauaaaaauacacagguaauuuaguaucu

SEQ ID NO: 653329 - RNA, 64 nt, hsa
cuggaccacagagcaggccccugucucaaaaauaaaauaaaaaagugaaagaagcaagcugugu

SEQ ID NO: 653330 - RNA, 64 nt, hsa
auagccuggaccacagagcaggccccugucucaaaaauaaaauaaaaaagugaaagaagcaagc

SEQ ID NO: 653331 - RNA, 64 nt, hsa
ucuuaugaaauagagaguguccuaaauaucacugaaauaaaaaguaggaaaaagaagcuugaau

SEQ ID NO: 653332 - RNA, 64 nt, hsa
uuaaaugugcuuucuuuuugaaauuuauguuuucaaauaaaaucucccuaaagcaauauuuaaa

SEQ ID NO: 653333 - RNA, 64 nt, hsa
uaggguuucuguuguguuuuuuuuuuuuuuuuugaaauaaaacuauaauauaaauucuccuauu

SEQ ID NO: 653334 - RNA, 64 nt, hsa
uuugaaauaaaacuauaauauaaauucuccuauuaaauaaaauuauuuuaaguuuuagugucaa

SEQ ID NO: 653335 - RNA, 64 nt, hsa
agccugggugacagagugagacccuauuucaaaaaaauaaaaauuggaagaagagcuuaaaaaa

SEQ ID NO: 653336 - RNA, 64 nt, hsa
agagaccugcuguccuuuuucuccuugagggaggaaauaaaacugcggaauacaauguccuucc

SEQ ID NO: 653337 - RNA, 64 nt, hsa
cucuuuuuaaaaauaaaaccagacucuguucugaaaauaaaaaacuugagacuugugacaagcu

SEQ ID NO: 653338 - RNA, 64 nt, hsa
cuagcauuuaucacuuuuuuccuucucuuuuuaaaaauaaaaccagacucuguucugaaaauaa

SEQ ID NO: 653339 - RNA, 64 nt, hsa
ugaacaguaauucauuuaauugcaaagcauuuugaaauaaaaaaaaucaaacuuaaaacugugu

SEQ ID NO: 653340 - RNA, 64 nt, hsa
augccccucaaccuaucccguuccuucugccuacaaauaaaaagugcaggcuggaaugaucuca

SEQ ID NO: 653341 - RNA, 64 nt, hsa
auacuagaguaucuagaagggugaaaacaaaaaaaaauaaaaagaaacacagacgcccaggugu

SEQ ID NO: 653342 - RNA, 64 nt, hsa
aaugauauaacaguuccuucaaaauuggccuaggaaauaaaaccuuaaaaggacacuggugugc

SEQ ID NO: 653343 - RNA, 64 nt, hsa
ucuacugcacaccaacuguuuauagaauacacaaaaauaaaauguaauaacuguauucugugaa

SEQ ID NO: 653344 - RNA, 64 nt, hsa
uuuagaaauuagcuccagguucuuaaacuaacaaaaauaaaaccuaagcaugccacagagcuau

SEQ ID NO: 653345 - RNA, 64 nt, hsa
ccacagaauuuucaagcccuuaagaguuuaguuaaaauaaaauuuuugaaauuauugucuuaau

SEQ ID NO: 653346 - RNA, 64 nt, hsa
gcuguaaauggguugccaacauaagcuggcugagaaauaaaagaaaacaagacaguuguucaua

SEQ ID NO: 653347 - RNA, 64 nt, hsa
ggaguaacugaauugaaucaaccaguuugcauuuaaauaaaagaacaggcucaguggucuuccu

SEQ ID NO: 653348 - RNA, 64 nt, hsa
uuuugagaccaugaugguuacacuuuugguuccuaaauaaaauuuaaaaaauuaacagccaagu

SEQ ID NO: 653349 - RNA, 64 nt, hsa
uucaaacacuacuccuauuacauuuucuauguguaaauaaaacugcuuagcauuguacagaaac

SEQ ID NO: 653350 - RNA, 64 nt, hsa
aauacuacaaaaucaacaugauuucauaaggugcaaauaaaaguuggugacagauuuaauauaa

SEQ ID NO: 653351 - RNA, 64 nt, hsa
auuucaaauaauaacaauacuuuuuguuuuucaaaaauaaaaugcaauguuauauaaagcuaua

SEQ ID NO: 653352 - RNA, 64 nt, hsa
acacagaacaaaaaccaucaaaaucucauauaugaaauaaaauauauucuucuaagcaaagaaa

SEQ ID NO: 653353 - RNA, 64 nt, hsa
acaaaaaaaucugcucagaaaaauguaugugcacaaauaaaaaaaauuaauggcaauuguuuag

SEQ ID NO: 653354 - RNA, 64 nt, hsa
uguaauuuagguuuuucaacaaagcccuugucuaaaauaaaaggcauuauuggaaauauuugaa

SEQ ID NO: 653355 - RNA, 64 nt, hsa
gaaagccuacaaugaaucauuguucaaccuugaaaaauaaaauuuuguaaaacaucgguugaug

SEQ ID NO: 653356 - RNA, 64 nt, hsa
gaauuuuguucaaauuauagcagaauuuaggcaaaaauaaaacagacauguauuuuuguuugcu

SEQ ID NO: 653357 - RNA, 64 nt, hsa
caauuuguauugauucucuuuaaauauaaaauguaaauaaaauauuccaauaaaaguuuguguc

SEQ ID NO: 653358 - RNA, 64 nt, hsa
uccacaguguccagacuaauuugugcaugaacugaaauaaaaccauccuacgguauccagggaa

SEQ ID NO: 653359 - RNA, 64 nt, hsa
gggaggacaggaaggcagccugggacauuuaaaaaaauaaaaaugaaaaaaaaacccagaaccc

SEQ ID NO: 653360 - RNA, 64 nt, hsa
cuaacauacucacugugaacccagccuauugcaaaaauaaaaucuuuuuauaauauuaucuaug

SEQ ID NO: 653361 - RNA, 64 nt, hsa
auuuuugacaugcuccuauuuuuguaacuugaaaaaauaaaauuuugccuugugacagauuuuc

SEQ ID NO: 653362 - RNA, 64 nt, hsa
auuccuuccaguaaugccacuguauuuugucuccaaauaaaagaagcuuauuguaguauguuug

SEQ ID NO: 653363 - RNA, 64 nt, hsa
cuuauuagagugugggaauagggaucuaaauuuuaaauaaaauuauauauauauauaaauuggu

SEQ ID NO: 653364 - RNA, 54 nt, hsa
ucugccugaaagccccaugaagaaaaauaaaacaccuuguacuuuauuuucuau

SEQ ID NO: 653365 - RNA, 64 nt, hsa
uuauaaaggauuaaugucaauucuugccaaauauaaauaaaaauaauccucaguuuuugugaaa

SEQ ID NO: 653366 - RNA, 64 nt, hsa
gccuaauuauguaaaaagaauauaauaccuguggaaauaaaaaugaauuccaaguguauacuug

SEQ ID NO: 653367 - RNA, 64 nt, hsa
uccaccaaaaccuauggaaauuuaaaaaaaacaaaaauaaaaagcaaaacaaaaaucccaaaau

SEQ ID NO: 653368 - RNA, 64 nt, hsa
gguggaaauaguuguggauguacuaagaguaaugaaauaaaauuauagcuucauucacuugccu

SEQ ID NO: 653369 - RNA, 64 nt, hsa
uaugccaucuguccucaaguguuaucuacauaggaaauaaaauggaauugauguaaaguuccau

SEQ ID NO: 653370 - RNA, 64 nt, hsa
guaaagaaaucagauacaaacuacugcaauuagaaaauaaaauaugaacaacuuucaacaaugu

SEQ ID NO: 653371 - RNA, 64 nt, hsa
uuccuauaauacagugcuauaagcuaugcacagaaaauaaaauguuugaaauccaagaauaaug

SEQ ID NO: 653372 - RNA, 64 nt, hsa
aguuucugaaugaaaaagcuacagcugagaaauaaaauaaaaugucaugcugcagaauauguua

SEQ ID NO: 653373 - RNA, 64 nt, hsa
ucuccaguuucugaaugaaaaagcuacagcugagaaauaaaauaaaaugucaugcugcagaaua

SEQ ID NO: 653374 - RNA, 64 nt, hsa
auauauaaauuuuaauuucauagcaacuuguaaaaaauaaaauacuuguugaaaagccuuuuuc

SEQ ID NO: 653375 - RNA, 64 nt, hsa
guugacaugaagucaucuauguggaaaaaaauaaaaauaaaagugauuucacggaugugguuug

SEQ ID NO: 653376 - RNA, 64 nt, hsa
uuuguaguugacaugaagucaucuauguggaaaaaaauaaaaauaaaagugauuucacggaugu

SEQ ID NO: 653377 - RNA, 64 nt, hsa
gugaauguaagaggugucaacaaacugggaaauaaaauaaaaaaaaauaauaauaaauguguca

SEQ ID NO: 653378 - RNA, 64 nt, hsa
ugccugugaauguaagaggugucaacaaacugggaaauaaaauaaaaaaaaauaauaauaaaug

SEQ ID NO: 653379 - RNA, 64 nt, hsa
aaguugauauuuuaggaauuguauuucagaucuuaaauaaaauuuguuucuaaauuucaaagca

SEQ ID NO: 653380 - RNA, 64 nt, hsa
guuucaguuuguuuuccguucuguuuuaaacagaaaauaaaaggaguguaagcuccuuuucuca

SEQ ID NO: 653381 - RNA, 64 nt, hsa
aaaauguauuuugauuuguauuucagaaacuaaaaaauaaaauguugaaagaaucuuccaauuu

SEQ ID NO: 653382 - RNA, 64 nt, hsa
cuauguauuuguuuuugauggguuguuuacucugaaauaaaauguaugguuuucuuaaaaggaa

SEQ ID NO: 653383 - RNA, 64 nt, hsa
aggaguuguucaaaucacugcaguagggcucugcaaauaaaauaauguaaccuauuaucaugga

SEQ ID NO: 653384 - RNA, 64 nt, hsa
cccagcuuuagucauuugaacaugcuucuaaauaaaauaaaacaaaaccaaaacuauacuuuug

SEQ ID NO: 653385 - RNA, 64 nt, hsa
aggagcccagcuuuagucauuugaacaugcuucuaaauaaaauaaaacaaaaccaaaacuauac

SEQ ID NO: 653386 - RNA, 64 nt, hsa
ucuaguagacuucugcacauguaaaauugaauucaaauaaaaucauacacacuuucuaguucuu

SEQ ID NO: 653387 - RNA, 64 nt, hsa
cuauauuuuuauauucauguguaaacaaaaaauaaaauaaaauucugaucgcauaaaaauaugu

SEQ ID NO: 653388 - RNA, 64 nt, hsa
uuuuucuauauuuuuauauucauguguaaacaaaaaauaaaauaaaauucugaucgcauaaaaa

SEQ ID NO: 653389 - RNA, 64 nt, hsa
aaaaaauaaaagguauucccagguauguuuggcaaaauaaaauaaagguaauuaaaaaccuaag

SEQ ID NO: 653390 - RNA, 64 nt, hsa
uaugguuuggaaccaucaccccaagguaaaaaaaaaauaaaagguauucccagguauguuuggc

SEQ ID NO: 653391 - RNA, 64 nt, hsa
uuuauuuuccugcugguuucuucaguaaugaguuaaauaaaacauugacacauacaaacaaaug

SEQ ID NO: 653392 - RNA, 64 nt, hsa
auaagucaggaggaugcaauuguugaaagcuuugaaauaaaauaacaaugucuucuugaaauuu

SEQ ID NO: 653393 - RNA, 64 nt, hsa
auguuaacauuucagguuaagccucauacguuuaaaauaaaacucucaguuguuuauuauccug

SEQ ID NO: 653394 - RNA, 64 nt, hsa
caacugaaucuuuuauucauagaaaugaaaaggaaaauaaaaacuguggcugaccaaaaggucu

SEQ ID NO: 653395 - RNA, 64 nt, hsa
gauuauauuauuuuuaaaugaagaagcacucauuaaauaaaacauaauuuuaaaaaacaauaua

SEQ ID NO: 653396 - RNA, 64 nt, hsa
uuuuacuuuaauaguuuaguguaaaguacaucagaaauaaaacuguaucugacauuuuaagccu

SEQ ID NO: 653397 - RNA, 64 nt, hsa; identical to SEQ ID NO: 653352

SEQ ID NO: 653398 - RNA, 64 nt, hsa; identical to SEQ ID NO: 653353

SEQ ID NO: 653399 - RNA, 64 nt, hsa
caacacagugagaacucaucucuguaaaaaauaaaaauaaaacauuaaaaaaaaacaugagcuu

SEQ ID NO: 653400 - RNA, 64 nt, hsa
ccuaggcaacacagugagaacucaucucuguaaaaaauaaaaauaaaacauuaaaaaaaaacau

SEQ ID NO: 653401 - RNA, 62 nt, hsa
aaggcagcucaccauuugcugguaacuuaaugugagagaauccauaucugcgugaaaacacc

SEQ ID NO: 653402 - RNA, 62 nt, hsa
aacuuggcauuuccaacuucuuccuuuccgggugagagaagaagcggagaaggguucagugu

SEQ ID NO: 653403 - RNA, 62 nt, hsa
cuggauuuuuagagcuuuagaaauuuguaagcugagagaacaauguuucacuuaauaggagg

SEQ ID NO: 653404 - RNA, 62 nt, hsa
gaucacguggcaaaagagcauguacaugggagugagagaaaaagagagagagagacagagug

SEQ ID NO: 653405 - RNA, 62 nt, hsa
cucggcugaaccaggacuccucacugucuaccugagagaaugagcaccccucauccaucuca

SEQ ID NO: 653406 - RNA, 62 nt, hsa
auaagugcuuagcugccaugagggaaaaguaaugagagaaguuucuagaagccacuccagcc

SEQ ID NO: 653407 - RNA, 62 nt, hsa
uaugcuuuuuucugugaauuuuccuugguacaugagagaaauaaguacucucaucaacuuau

SEQ ID NO: 653408 - RNA, 62 nt, hsa
uuugagcauugcucuauagaagggaagggugaugagagaacagaacuggccccuguacaggu

SEQ ID NO: 653409 - RNA, 62 nt, hsa
ucuuguaaaaaccugucaguuauuuucaucuaugagagaagaggagcccaaacucucgccca

SEQ ID NO: 653410 - RNA, 62 nt, hsa
cucugaagggggaagguagugggaauagguggugagagaacucacauuuuucucuuguccug

SEQ ID NO: 653411 - RNA, 62 nt, hsa
aguuguuucauagcucccagucaaaaagaaagugagagaagcuguugggcagcgaaccuacu

SEQ ID NO: 653412 - RNA, 62 nt, hsa
uguuagcucaaaaaaacuuuacugcacacuacugagagaaugagaugaaaaacgauuaaugu

SEQ ID NO: 653413 - RNA, 62 nt, hsa
gaaagucugugucagccaaagccaugucacucugagagaacugauucugaggacaaguuagc

SEQ ID NO: 653414 - RNA, 62 nt, hsa
ggaacauaaccaaaguucacaaacauaacgagugagagaaacacauucaagcccaggucuag

SEQ ID NO: 653415 - RNA, 62 nt, hsa
acuguuaacugucuugagagaaaagaaaaauaugagagaacuauuguuuggggaaguucaag

SEQ ID NO: 653416 - RNA, 62 nt, hsa
acuguuucacuaauacuuacuguuaacugucuugagagaaaagaaaaauaugagagaacuau

SEQ ID NO: 653417 - RNA, 62 nt, hsa
uuaugaagaccagugaauuacgauauuuaaagugagagaacuuaauuauuugcaaagguaag

SEQ ID NO: 653418 - RNA, 62 nt, hsa
uuauuugcaaagguaaguuacagcuuguuuuuugagagaaucaaaugaguuuacuuuuguuc

SEQ ID NO: 653419 - RNA, 62 nt, hsa
agccuggaaagauguggccucaggaaaagggaugagagaaaggaggugguauggaagacuca

SEQ ID NO: 653420 - RNA, 62 nt, hsa
ucuagggguuuggcuacuguuggccugggagcugagagaaggcacugagagggacaguaggc

SEQ ID NO: 653421 - RNA, 62 nt, hsa
aaauauguuucucaagcaaccugcaucuuuuaugagagaagaaagagugagagaagaauugc

SEQ ID NO: 653422 - RNA, 62 nt, hsa
gcaaccugcaucuuuuaugagagaagaaagagugagagaagaauugccucuggacuaucauc

SEQ ID NO: 653423 - RNA, 62 nt, hsa
uguggguaaagacagggaugaaggauagaggcugagagaagaaggaagaaucagcccagcag

SEQ ID NO: 653424 - RNA, 62 nt, hsa
cugccccaucacagccagcaugacugcuucucugagagaacuugcccaucaggggcugggac

SEQ ID NO: 653425 - RNA, 62 nt, hsa
cccauugguucccacuggcagcaugguagagcugagagaaacaggcucucaggguaccugac

SEQ ID NO: 653426 - RNA, 62 nt, hsa
gugaaaauuccuuauaaauccaggauuggcucugagagaacuggcuaagauucaggaagaaa

SEQ ID NO: 653427 - RNA, 62 nt, hsa
auuuuuguccaaaaaccuacagacaaguacuuugagagaauuuccaauauaauauuagacau

SEQ ID NO: 653428 - RNA, 62 nt, hsa
uuuuuguacaaauuuagcuaauagcuacaggcugagagaauuguaacauagcaugacaaauu

SEQ ID NO: 653429 - RNA, 62 nt, hsa
aauuuuucagugauucuucucuuucuuguauaugagagaacuuauauggagaaaccccuagg

SEQ ID NO: 653430 - RNA, 62 nt, hsa
ucucaccuucaugggcccagaagauuauguacugagagaauccugaagaauggaacagcugu

SEQ ID NO: 653431 - RNA, 62 nt, hsa
cacucugagcgagucucuagagggugagaauuugagagaaauaguaauuugauuauuucauu

SEQ ID NO: 653432 - RNA, 62 nt, hsa
aaacuuucuuuuacaaaagaauauuacauauuugagagaaaauauuucuauuaaugguuuaa

SEQ ID NO: 653433 - RNA, 64 nt, hsa; identical to SEQ ID NO: 155522

SEQ ID NO: 653434 - RNA, 64 nt, hsa; identical to SEQ ID NO: 155523

SEQ ID NO: 653435 - RNA, 64 nt, hsa; identical to SEQ ID NO: 155524

SEQ ID NO: 653436 - RNA, 64 nt, hsa; identical to SEQ ID NO: 155525

SEQ ID NO: 653437 - RNA, 64 nt, hsa; identical to SEQ ID NO: 155526

SEQ ID NO: 653438 - RNA, 64 nt, hsa; identical to SEQ ID NO: 155527

SEQ ID NO: 653439 - RNA, 64 nt, hsa; identical to SEQ ID NO: 155528

SEQ ID NO: 653440 - RNA, 64 nt, hsa; identical to SEQ ID NO: 155529

SEQ ID NO: 653441 - RNA, 64 nt, hsa; identical to SEQ ID NO: 155530

SEQ ID NO: 653442 - RNA, 64 nt, hsa; identical to SEQ ID NO: 155531

SEQ ID NO: 653443 - RNA, 64 nt, hsa; identical to SEQ ID NO: 155532

SEQ ID NO: 653444 - RNA, 64 nt, hsa; identical to SEQ ID NO: 155533

SEQ ID NO: 653445 - RNA, 64 nt, hsa; identical to SEQ ID NO: 155534

SEQ ID NO: 653446 - RNA, 64 nt, hsa; identical to SEQ ID NO: 155535

SEQ ID NO: 653447 - RNA, 64 nt, hsa; identical to SEQ ID NO: 155536

SEQ ID NO: 653448 - RNA, 64 nt, hsa; identical to SEQ ID NO: 155537

SEQ ID NO: 653449 - RNA, 64 nt, hsa; identical to SEQ ID NO: 155538

SEQ ID NO: 653450 - RNA, 64 nt, hsa; identical to SEQ ID NO: 155539

SEQ ID NO: 653451 - RNA, 64 nt, hsa; identical to SEQ ID NO: 155540

SEQ ID NO: 653452 - RNA, 64 nt, hsa; identical to SEQ ID NO: 155541

SEQ ID NO: 653453 - RNA, 64 nt, hsa; identical to SEQ ID NO: 155542

SEQ ID NO: 653454 - RNA, 64 nt, hsa; identical to SEQ ID NO: 155543

SEQ ID NO: 653455 - RNA, 64 nt, hsa; identical to SEQ ID NO: 155544

SEQ ID NO: 653456 - RNA, 64 nt, hsa; identical to SEQ ID NO: 155545

SEQ ID NO: 653457 - RNA, 64 nt, hsa; identical to SEQ ID NO: 155546

SEQ ID NO: 653458 - RNA, 59 nt, hsa
agcagugugugcacagcuuucuuuugguuggcagagauucaggaucauggaguacugcu

SEQ ID NO: 653459 - RNA, 59 nt, hsa
cucucauaauugaagacguguuuguuauuggcagagaaccuuaaaaaaggccuuuaccu

SEQ ID NO: 653460 - RNA, 59 nt, hsa
aagcugguccaucacuggccucuguccuuggcagagaccuugcugcccaggcccagggg

SEQ ID NO: 653461 - RNA, 59 nt, hsa
ccagcacugacucaggaacagcaagucagggcagagaggaggagggaggcugucaggau

SEQ ID NO: 653462 - RNA, 59 nt, hsa
ggcuggcucaggcaucgucucccgcaaugggcagagagagcagagacagguggaccaac

SEQ ID NO: 653463 - RNA, 59 nt, hsa
uacccccagcuucacucagcacuggagcuggcagagacgcaaaacccagucugcccuug

SEQ ID NO: 653464 - RNA, 59 nt, hsa
gcggggcauccuaugaggcaggcacccugggcagagagaugcagugggugcggggggau

SEQ ID NO: 653465 - RNA, 59 nt, hsa
cgaggaccagcugugaggcgggcgcccugggcagagagacucuguggcgcggggcaucc

SEQ ID NO: 653466 - RNA, 59 nt, hsa
auucaugccaaccuugccaacacggagagggcagagaugcacuagaagaccuucauccu

SEQ ID NO: 653467 - RNA, 59 nt, hsa
acggaaucuauguagacaaugggacguuaggcagagagcucagauggcccuuuuaaggg

SEQ ID NO: 653468 - RNA, 59 nt, hsa
uguaugucaccaggauggcagagagccagggcagagagagacuggacuugggaucagca

SEQ ID NO: 653469 - RNA, 59 nt, hsa
ugucccccauaucuguaugucaccaggauggcagagagccagggcagagagagacugga

SEQ ID NO: 653470 - RNA, 59 nt, hsa
aagcuguuguucccugaggcugaggcugaggcagagaaucuuccagaugauaaacccca

SEQ ID NO: 653471 - RNA, 59 nt, hsa
cuccucuuacugagauacagggcagcacuggcagagagcagacuuaaggaaaccuguaa

SEQ ID NO: 653472 - RNA, 59 nt, hsa
ugccaaaucuaaauaguuuauauagggauggcagagaguucccaucucaucugucagcc

SEQ ID NO: 653473 - RNA, 59 nt, hsa
gauacaaggagagguugucaucuggguagggcagagaggagggcuugcucaucugaaca

SEQ ID NO: 653474 - RNA, 59 nt, hsa
aaagaggguugcauuucuugcagccagaaggcagagaaagugaagaccaaguccagaac

SEQ ID NO: 653475 - RNA, 59 nt, hsa
acaccgccaugagcacagggcagggcuggggcagagaaaggaagggaacuggagcuggc

SEQ ID NO: 653476 - RNA, 59 nt, hsa
ccaggagccauggccucacacagacccgaggcagagaacagcucauugggucacuggug

SEQ ID NO: 653477 - RNA, 59 nt, hsa
acuguggcagagaaaguccuccacucagaggcagagacugaguuaagucauagguggcc

SEQ ID NO: 653478 - RNA, 59 nt, hsa
uuugucaggaaacucagccaguggacuguggcagagaaaguccuccacucagaggcaga

SEQ ID NO: 653479 - RNA, 59 nt, hsa
aggucccucccaaaguuguuuucgugugaggcagagaaagccacacucugaauacauuu

SEQ ID NO: 653480 - RNA, 59 nt, hsa
uugggacuucaguucucgugguccauaggggcagagaugucaaagugaagguugccuga

SEQ ID NO: 653481 - RNA, 59 nt, hsa
ccuguccugcaggaugcugcauaggaaugggcagagauguccuggaugggaacaugguc

SEQ ID NO: 653482 - RNA, 59 nt, hsa
cagugaggggugauucagagguggggaugggcagagagggcuggccacucugccucagg

SEQ ID NO: 653483 - RNA, 59 nt, hsa
auuguaaccgaggucagagcucugggguuggcagagaugaguggccauaucugggggua

SEQ ID NO: 653484 - RNA, 59 nt, hsa
cucgggcuucauuuucucuauuuagagauggcagagagugagguaguggcgagaaagcu

SEQ ID NO: 653485 - RNA, 59 nt, hsa
ccuucugacugucagcaccaccggcacagggcagagaugcggguggcccaaggaccacg

SEQ ID NO: 653486 - RNA, 59 nt, hsa
gggacagcaaggucccuuguuauaagaggggcagagaggacaacuccgcuuuggccaac

SEQ ID NO: 653487 - RNA, 59 nt, hsa
aacccacagugagaggggagggcuccuggggcagagaaguuccuuagguuuucuuugga

SEQ ID NO: 653488 - RNA, 59 nt, hsa
uuauauugggcgauuugggggcucggggaggcagagaaucucuugggagucuugggugg

SEQ ID NO: 653489 - RNA, 59 nt, hsa; identical to SEQ ID NO: 52361

SEQ ID NO: 653490 - RNA, 59 nt, hsa
gauauggagaugggagggggaggacaaggggcagagaguagggucuagcuggcuaucuc

SEQ ID NO: 653491 - RNA, 59 nt, hsa
agagagggagagaggcagagagggagagaggcagagagacagagagggagagagggaca

SEQ ID NO: 653492 - RNA, 59 nt, hsa
agagaaggagagaggcagagagggagagaggcagagagggagagaggcagagagacaga

SEQ ID NO: 653493 - RNA, 59 nt, hsa
aaggaaagagacaggcagagaaggagagaggcagagagggagagaggcagagagggaga

SEQ ID NO: 653494 - RNA, 59 nt, hsa
agggaaagaggcagagaaggaaagagacaggcagagaaggagagaggcagagagggaga

SEQ ID NO: 653495 - RNA, 59 nt, hsa
agaggggaagagaggcagagagggaaagaggcagagaaggaaagagacaggcagagaag

SEQ ID NO: 653496 - RNA, 59 nt, hsa
agagggagagagagacagaggggaagagaggcagagagggaaagaggcagagaaggaaa

SEQ ID NO: 653497 - RNA, 59 nt, hsa
gagagauaugaggagagagagacagaggaggcagagagggagagaaacagaggagacag

SEQ ID NO: 653498 - RNA, 59 nt, hsa
uaugucuucauuaugagagcaggagagacggcagagauauguugcuaggugaauauaua

SEQ ID NO: 653499 - RNA, 59 nt, hsa
gacccggaggagcaucagcaaggggcccgggcagagaaucggcuaugucuucauuauga

SEQ ID NO: 653500 - RNA, 59 nt, hsa
uuugcugggagcugggagcaggcuugccuggcagagaaccuguucagauacaggccagu

SEQ ID NO: 653501 - RNA, 59 nt, hsa
uauuucccuggcaggcagccuugccagaaggcagagaggcaguucugaaucauucucuc

SEQ ID NO: 653502 - RNA, 59 nt, hsa
gucgcuugugcgggcgggagggcaaugguggcagagacaugcugguggccccggcggag

SEQ ID NO: 653503 - RNA, 59 nt, hsa
uuuugaaagcaaguguagacaccuucgagggcagagaucgggagauuuaagauguuaca

SEQ ID NO: 653504 - RNA, 64 nt, hsa; identical to SEQ ID NO: 97332

SEQ ID NO: 653505 - RNA, 64 nt, hsa; identical to SEQ ID NO: 97333

SEQ ID NO: 653506 - RNA, 64 nt, hsa; identical to SEQ ID NO: 97334

SEQ ID NO: 653507 - RNA, 64 nt, hsa; identical to SEQ ID NO: 97335

SEQ ID NO: 653508 - RNA, 64 nt, hsa; identical to SEQ ID NO: 97336

SEQ ID NO: 653509 - RNA, 64 nt, hsa; identical to SEQ ID NO: 97337

SEQ ID NO: 653510 - RNA, 64 nt, hsa; identical to SEQ ID NO: 97338

SEQ ID NO: 653511 - RNA, 64 nt, hsa; identical to SEQ ID NO: 97339

SEQ ID NO: 653512 - RNA, 64 nt, hsa; identical to SEQ ID NO: 97340

SEQ ID NO: 653513 - RNA, 64 nt, hsa; identical to SEQ ID NO: 97341

SEQ ID NO: 653514 - RNA, 64 nt, hsa; identical to SEQ ID NO: 97342

SEQ ID NO: 653515 - RNA, 64 nt, hsa; identical to SEQ ID NO: 97343

SEQ ID NO: 653516 - RNA, 64 nt, hsa; identical to SEQ ID NO: 97344

SEQ ID NO: 653517 - RNA, 64 nt, hsa; identical to SEQ ID NO: 97345

SEQ ID NO: 653518 - RNA, 64 nt, hsa; identical to SEQ ID NO: 97346

SEQ ID NO: 653519 - RNA, 64 nt, hsa; identical to SEQ ID NO: 97347

SEQ ID NO: 653520 - RNA, 64 nt, hsa; identical to SEQ ID NO: 97348

SEQ ID NO: 653521 - RNA, 64 nt, hsa; identical to SEQ ID NO: 97349

SEQ ID NO: 653522 - RNA, 64 nt, hsa; identical to SEQ ID NO: 97350

SEQ ID NO: 653523 - RNA, 64 nt, hsa; identical to SEQ ID NO: 97351

SEQ ID NO: 653524 - RNA, 64 nt, hsa; identical to SEQ ID NO: 97352

SEQ ID NO: 653525 - RNA, 64 nt, hsa; identical to SEQ ID NO: 97353

SEQ ID NO: 653526 - RNA, 64 nt, hsa; identical to SEQ ID NO: 97354

SEQ ID NO: 653527 - RNA, 64 nt, hsa; identical to SEQ ID NO: 97355

SEQ ID NO: 653528 - RNA, 64 nt, hsa; identical to SEQ ID NO: 97356

SEQ ID NO: 653529 - RNA, 64 nt, hsa; identical to SEQ ID NO: 97357

SEQ ID NO: 653530 - RNA, 64 nt, hsa; identical to SEQ ID NO: 97358

SEQ ID NO: 653531 - RNA, 64 nt, hsa; identical to SEQ ID NO: 97359

SEQ ID NO: 653532 - RNA, 64 nt, hsa; identical to SEQ ID NO: 97360

SEQ ID NO: 653533 - RNA, 64 nt, hsa; identical to SEQ ID NO: 97361

SEQ ID NO: 653534 - RNA, 64 nt, hsa; identical to SEQ ID NO: 97362

SEQ ID NO: 653535 - RNA, 64 nt, hsa; identical to SEQ ID NO: 97363

SEQ ID NO: 653536 - RNA, 64 nt, hsa; identical to SEQ ID NO: 97364

SEQ ID NO: 653537 - RNA, 64 nt, hsa; identical to SEQ ID NO: 97365

SEQ ID NO: 653538 - RNA, 64 nt, hsa; identical to SEQ ID NO: 97366

SEQ ID NO: 653539 - RNA, 64 nt, hsa; identical to SEQ ID NO: 97367

SEQ ID NO: 653540 - RNA, 64 nt, hsa; identical to SEQ ID NO: 97368

SEQ ID NO: 653541 - RNA, 64 nt, hsa; identical to SEQ ID NO: 97369

SEQ ID NO: 653542 - RNA, 64 nt, hsa; identical to SEQ ID NO: 97370

SEQ ID NO: 653543 - RNA, 64 nt, hsa; identical to SEQ ID NO: 97371

SEQ ID NO: 653544 - RNA, 64 nt, hsa; identical to SEQ ID NO: 97372

SEQ ID NO: 653545 - RNA, 64 nt, hsa; identical to SEQ ID NO: 97373

SEQ ID NO: 653546 - RNA, 64 nt, hsa; identical to SEQ ID NO: 97374

SEQ ID NO: 653547 - RNA, 64 nt, hsa; identical to SEQ ID NO: 97375

SEQ ID NO: 653548 - RNA, 64 nt, hsa; identical to SEQ ID NO: 97376

SEQ ID NO: 653549 - RNA, 64 nt, hsa; identical to SEQ ID NO: 97377

SEQ ID NO: 653550 - RNA, 64 nt, hsa; identical to SEQ ID NO: 97378

SEQ ID NO: 653551 - RNA, 64 nt, hsa; identical to SEQ ID NO: 97379

SEQ ID NO: 653552 - RNA, 64 nt, hsa; identical to SEQ ID NO: 97380

SEQ ID NO: 653553 - RNA, 64 nt, hsa; identical to SEQ ID NO: 97381

SEQ ID NO: 653554 - RNA, 64 nt, hsa; identical to SEQ ID NO: 97382

SEQ ID NO: 653555 - RNA, 64 nt, hsa; identical to SEQ ID NO: 97383

SEQ ID NO: 653556 - RNA, 64 nt, hsa; identical to SEQ ID NO: 97384

SEQ ID NO: 653557 - RNA, 64 nt, hsa; identical to SEQ ID NO: 97385

SEQ ID NO: 653558 - RNA, 64 nt, hsa; identical to SEQ ID NO: 97386

SEQ ID NO: 653559 - RNA, 64 nt, hsa; identical to SEQ ID NO: 97387

SEQ ID NO: 653560 - RNA, 64 nt, hsa; identical to SEQ ID NO: 97388

SEQ ID NO: 653561 - RNA, 64 nt, hsa; identical to SEQ ID NO: 97389

SEQ ID NO: 653562 - RNA, 64 nt, hsa; identical to SEQ ID NO: 97390

SEQ ID NO: 653563 - RNA, 64 nt, hsa; identical to SEQ ID NO: 97391

SEQ ID NO: 653564 - RNA, 64 nt, hsa; identical to SEQ ID NO: 97392

SEQ ID NO: 653565 - RNA, 64 nt, hsa; identical to SEQ ID NO: 97393

SEQ ID NO: 653566 - RNA, 64 nt, hsa; identical to SEQ ID NO: 97394

SEQ ID NO: 653567 - RNA, 64 nt, hsa
ccgauuuugugcauaguaaugacacagcaccauuccugagaaauaggaaauauauguguguggu

SEQ ID NO: 653568 - RNA, 64 nt, hsa
ggguucugugcguguaccauguugccugacacguccugagaaaucuucuuaaacucugaguuua

SEQ ID NO: 653569 - RNA, 64 nt, hsa
uaucuuaauauuucaaguuuacaucaagauaaacccugagaagaacuacggagaaaucaaauaa

SEQ ID NO: 653570 - RNA, 64 nt, hsa
agagcugcuguaacagcucuuccuguucugcuccccugagaacagugugguggggagaggcagg

SEQ ID NO: 653571 - RNA, 64 nt, hsa
acgugaagguuucaguuaccugcucuagacuuugccugagaacuuguaaauuaaucagugagac

SEQ ID NO: 653572 - RNA, 64 nt, hsa
uccauuuuugauucauuccugagaauggcuuaguccugagaaucugcaaagucucugaagagaa

SEQ ID NO: 653573 - RNA, 64 nt, hsa
cccagagagccaucucuuccauuuuugauucauuccugagaauggcuuaguccugagaaucugc

SEQ ID NO: 653574 - RNA, 64 nt, hsa
cuggggagcagaauucuugucaucuaugagggguccugagaaagacuugucauuuuuuuuccug

SEQ ID NO: 653575 - RNA, 64 nt, hsa
uccaucagcucagcagagcucgacagccacaaguccugagaagcuuugaccuugaagggcuucu

SEQ ID NO: 653576 - RNA, 64 nt, hsa
gucccuccgucccagggggcugugcuagcacagaccugagaauggggacacaggucauucagag

SEQ ID NO: 653577 - RNA, 64 nt, hsa
uguaggaagccauaggagagugaccacgggauucccugagaaacagggccggccccccaacuuc

SEQ ID NO: 653578 - RNA, 64 nt, hsa
gcucucucucuguuuuguucuagccaugaauuugccugagaaacuuguaaccuaugugccucaa

SEQ ID NO: 653579 - RNA, 64 nt, hsa
aaaucaaccaacauaucugaaaaggaucaugaaaccugagaaaugcuaauggagauuugcuggu

SEQ ID NO: 653580 - RNA, 64 nt, hsa
ugggggagaagucccaccaggaugcccccccuccccugagaagcccgccuucucccucguggac

SEQ ID NO: 653581 - RNA, 64 nt, hsa
ccagagcagcagagauuugcagcccucgccccucccugagaagaagcuggauuugaaaaucccu

SEQ ID NO: 653582 - RNA, 64 nt, hsa
agaagagaagacaaccuccaucuauuuauugcuuccugagaacugaccuggaugcggcccucug

SEQ ID NO: 653583 - RNA, 64 nt, hsa
ggccuuguuuuuagugcugagagccaguugcugcccugagaagagaagacaaccuccaucuauu

SEQ ID NO: 653584 - RNA, 64 nt, hsa
ugagaacuuuucuuguaaugcagcuuuuucucuuccugagaaacaguguguucuaaugggauuc

SEQ ID NO: 653585 - RNA, 64 nt, hsa
gcucugaaauaacaguccuaagaacuccuaaaguccugagaacuuuucuuguaaugcagcuuuu

SEQ ID NO: 653586 - RNA, 64 nt, hsa
ggggaguggauccaggacaggggagguuguaaccccugagaaaugaacauugguaggagcauuu

SEQ ID NO: 653587 - RNA, 64 nt, hsa
aggcagccuacucuuggaaacuggaggaaacugcccugagaauuauuagaaugcuaauaauagu

SEQ ID NO: 653588 - RNA, 64 nt, hsa
cugcagacaccagcucuccuuccugccuuuagauccugagaaggagggaaaugaggggugcuga

SEQ ID NO: 653589 - RNA, 64 nt, hsa
ccugucuucucugauucuuuucccucaaaauaguccugagaacuaauugucacacuggcucauc

SEQ ID NO: 653590 - RNA, 64 nt, hsa
auagcgauuuugcuuugccaccaaaaggcuuuucccugagaacagugaaggauguaugucauuu

SEQ ID NO: 653591 - RNA, 64 nt, hsa
aggccaaugcugaagacacagcuccgcuugggagccugagaacccaggcuucccaggccagagu

SEQ ID NO: 653592 - RNA, 64 nt, hsa
auggcguccugcccuugcuccagccugacaacagccugagaaauccccccguaacuuauuauca

SEQ ID NO: 653593 - RNA, 64 nt, hsa
gugucccccgaacgcucugcaccuucugacgcagccugagaaugaccugcccuggccccagccc

SEQ ID NO: 653594 - RNA, 64 nt, hsa
aacugggccuccgcuucccagcaacgcagccaggccugagaauucugugcgcccggcgggcuuu

SEQ ID NO: 653595 - RNA, 64 nt, hsa
auucuguuccggugccuuuccuauccaggcaccaccugagaaaguugucauuugaggucgcacu

SEQ ID NO: 653596 - RNA, 64 nt, hsa
ugcuucccugcaguuuagaucccgggauggcauuccugagaaagcaacccgaaccagcuguccu

SEQ ID NO: 653597 - RNA, 64 nt, hsa
cagguggggacagaaggaagaagccaggagccucccugagaaggugucaccuuaucuguccucc

SEQ ID NO: 653598 - RNA, 64 nt, hsa
accagucaccuuucacuucuuggccaaauuuuauccugagaaugcugaagaggagcugguucag

SEQ ID NO: 653599 - RNA, 64 nt, hsa
uggaguggaugcccuggggcuucacauuuaugacccugagaacagacugacccccaagaucucc

SEQ ID NO: 653600 - RNA, 64 nt, hsa
ugggaagucauuguagggagugagacacugaagcccugagaagccagugccaucauccccaccc

SEQ ID NO: 653601 - RNA, 64 nt, hsa
agaagagccaaggaauaaacaugcaaugaacccaaaaggucacucugagaggagugauaccaau

SEQ ID NO: 653602 - RNA, 64 nt, hsa
cuaagucacucugagaggagugauaccaaugaaaaaaggucaguugauuccagugcuaaaaggg

SEQ ID NO: 653603 - RNA, 64 nt, hsa
cccgggaccucacagucccuucuuagaagccugcaaaggucagcugugcccucugggauucuga

SEQ ID NO: 653604 - RNA, 64 nt, hsa
cagaggcucuugaggcuccgaggcccuggggaucaaaggucaaugaguuagguggggagaaaga

SEQ ID NO: 653605 - RNA, 64 nt, hsa
aaauucaguccucaguuaacggaucauguuugcaaaaggucacugugaggcugcauauuucaga

SEQ ID NO: 653606 - RNA, 64 nt, hsa
uauuuuaagcaucaaaugcaaucaucuaaaauauaaaggucaaucauuuauaauagaaacaccu

SEQ ID NO: 653607 - RNA, 64 nt, hsa
acauaguaaaguuugcuuucauaacugcagcaaaaaaggucaacuugccaagucacugcugcca

SEQ ID NO: 653608 - RNA, 64 nt, hsa
gauugcugggagcaaaaacuagaaugauacaaagaaaggucagagaaaugcaugggaauauuuu

SEQ ID NO: 653609 - RNA, 64 nt, hsa
uaccauucuccuugucccuugcuccuauguggcaaaaggucagccuugggguuggccguuccuc

SEQ ID NO: 653610 - RNA, 64 nt, hsa
uaacauucuugguaaaccagguaauugaaugaagaaaggucacuaaagggagaaaugacauguu

SEQ ID NO: 653611 - RNA, 64 nt, hsa
aaugaaauuuucauuaauauuaaaauugugaagcaaaggucaauaggcuuauauuuaauuaaag

SEQ ID NO: 653612 - RNA, 64 nt, hsa; identical to SEQ ID NO: 147964

SEQ ID NO: 653613 - RNA, 64 nt, hsa; identical to SEQ ID NO: 147965

SEQ ID NO: 653614 - RNA, 64 nt, hsa; identical to SEQ ID NO: 147966

SEQ ID NO: 653615 - RNA, 64 nt, hsa; identical to SEQ ID NO: 147967

SEQ ID NO: 653616 - RNA, 64 nt, hsa; identical to SEQ ID NO: 147968

SEQ ID NO: 653617 - RNA, 64 nt, hsa; identical to SEQ ID NO: 147969

SEQ ID NO: 653618 - RNA, 64 nt, hsa; identical to SEQ ID NO: 147970

SEQ ID NO: 653619 - RNA, 64 nt, hsa; identical to SEQ ID NO: 147971

SEQ ID NO: 653620 - RNA, 64 nt, hsa; identical to SEQ ID NO: 147972

SEQ ID NO: 653621 - RNA, 64 nt, hsa
uuaguaacagucaccaaaauguucuaagcaacuacuuuccuagaguaucauuugccaaccaaaa

SEQ ID NO: 653622 - RNA, 64 nt, hsa
auuuuaaaaaccuguuaaucuuuuuauuuguauacuuuccuaaaaauauucauauggggaaucc

SEQ ID NO: 653623 - RNA, 64 nt, hsa
ccuucccuuuaauccugccacugucauaugcuaccuuuccuaucucuucccucaucaucuuguu

SEQ ID NO: 653624 - RNA, 64 nt, hsa
aaggaacuuaaagaacaaaaaucaucugguaauucuuuccuagaaggaucacagccccugggau

SEQ ID NO: 653625 - RNA, 64 nt, hsa
uaaucauuguauagugauuaugccucugguauagcuuuccuaauaaaaaguuuuugaaaaacau

SEQ ID NO: 653626 - RNA, 64 nt, hsa
uuuacacuugucccaguaacuccauccucacgaucuuuccuacccugaacaaaacuaaaaccgc

SEQ ID NO: 653627 - RNA, 64 nt, hsa
auuagggguaugucuauacaacaaaagggggggucuuuccuaaaaaagaaaacauaugaugcuu

SEQ ID NO: 653628 - RNA, 64 nt, hsa
uucuaucuuuguguuaacaguggacacagcaaggcuuuccuacauaaguauaauaaugugggaa

SEQ ID NO: 653629 - RNA, 64 nt, hsa
cacugcaaggagaccucuacugucaccguuuacucuuuccuacccugacauccagaaacaaugg

SEQ ID NO: 653630 - RNA, 52 nt, hsa
agacucuacucaaccccugacccuuuccuaucaggagagauggcuugucccc

SEQ ID NO: 653631 - RNA, 64 nt, hsa
aaaagacuccaggccgacucaugauacucugcaucuuuccuacaugagaagcuucucugccaca

SEQ ID NO: 653632 - RNA, 64 nt, hsa
uuaacuuuuaaacugaauauuaaaauguaucugucuuuccuaguauguuuuuaucuucucaugu

SEQ ID NO: 653633 - RNA, 64 nt, hsa
cucuccugaauuuaugagguuuauuuauuuuucucuuuccuacuccuauuaaagaaccucgucc

SEQ ID NO: 653634 - RNA, 64 nt, hsa
gaaggcagaaagugggauccuggccccacucugccuuuccuauugagcaaccagcucugggcuc

SEQ ID NO: 653635 - RNA, 64 nt, hsa
aaggccuugcccuaagcuaccugaggguuuaggaggucugaacacacacaguggagagguuaau

SEQ ID NO: 653636 - RNA, 64 nt, hsa
ugcccuuauuccuccaccccacuucuuuuagcaaggucugaaaguuucaaagggagaccuauag

SEQ ID NO: 653637 - RNA, 64 nt, hsa
ucuccugcugauggaaaugggaaugaaguuaaguggucugaaaaacuugaaucguucacauuuc

SEQ ID NO: 653638 - RNA, 64 nt, hsa
augcacucuucccuugccggcuccugguaccauuggucugaacagcuguaguuggucuacuccu

SEQ ID NO: 653639 - RNA, 64 nt, hsa
uucugaagaggcgaauuuguugaaaagucccaagggucugaaugaaagcaucuuuaaucaacac

SEQ ID NO: 653640 - RNA, 64 nt, hsa
aggcucacacgucaauuccagggcagcuacacguggucugaaucgagaaccgagcuuggaguuc

SEQ ID NO: 653641 - RNA, 64 nt, hsa
gaaguuccagagcaaggagccauguuccucuaagggaauucaggaauucagacgugcuaguccc

SEQ ID NO: 653642 - RNA, 64 nt, hsa
agagcaaggagccauguuccucuaagggaauucaggaauucagacgugcuagucccacaccagu

SEQ ID NO: 653643 - RNA, 64 nt, hsa
accucaugggacuuuuaaaagaagggcuauuuaaggaauucacuugguaguacuuugcuuuagc

SEQ ID NO: 653644 - RNA, 64 nt, hsa
uauguuuuaugucuuugagagagauacaggucuuggaauucacuuuuuaaauguuacguuccaa

SEQ ID NO: 653645 - RNA, 64 nt, hsa
ggcuuuaguaauuuguauguaaugucaaauaaaaggaauucaaaucugaguaaauaacagccuc

SEQ ID NO: 653646 - RNA, 64 nt, hsa
ugauugaagaauguaucacucuuauucaagcaaaggaauucagacuuaaaugccuaccucugug

SEQ ID NO: 653647 - RNA, 64 nt, hsa
aagaaguuaccugcaauuauucuuaacacuacauggaauucacuggguaauugugggucauuua

SEQ ID NO: 653648 - RNA, 64 nt, hsa
cuuucuaaaaagucuugagaucccaccauucugaggaauucaauaugaucacuuuuuccuucuu

SEQ ID NO: 653649 - RNA, 64 nt, hsa
uuugacaaacaagcauccuuuacuaacaagagcaggaauucagaggcacaagaaaaagcauugg

SEQ ID NO: 653650 - RNA, 64 nt, hsa
uguggcagacauugccgagugacuuucuaacauaggaauucacuguguuuucauuugaugucgu

SEQ ID NO: 653651 - RNA, 64 nt, hsa
cauaacagugcagagcacaaugcuguguaacauaggaauucacuguguuuucauuugaugucgu

SEQ ID NO: 653652 - RNA, 64 nt, hsa
ucuuaagguguguuuucuagaaaaguucccuaauggaauucaugaguuugggggucucagucac

SEQ ID NO: 653653 - RNA, 64 nt, hsa
gguggccauuuccugacaucugcauguaccucguggaauucagccagcuucauguugcaaauca

SEQ ID NO: 653654 - RNA, 64 nt, hsa
gagaggccugaggucggcggacugccugaggucaggaauucaagaccagccuggccaacauggc

SEQ ID NO: 653655 - RNA, 64 nt, hsa
gcuaucccagcaucucuuaaaacuuuguagucuuggaauucaugacagaggcaaaugacuccug

SEQ ID NO: 653656 - RNA, 64 nt, hsa
gauucuauaucaugaccaaguggaauuuaucccaggaauucaagguugguucaacaucuaaaaa

SEQ ID NO: 653657 - RNA, 64 nt, hsa
uguacuugaaguucuagccacagcaguuagguuaggaauucaagguuuguucaacaucuaaaaa

SEQ ID NO: 653658 - RNA, 64 nt, hsa
agcgagcaauugcuaguugucuugaggagcaugaggaauucaggagcagaaggucaggauagca

SEQ ID NO: 653659 - RNA, 64 nt, hsa
auccauaauaaaaaaaaaugggagauuguuuucaggaauucagggaugaaaagaaagaauaauu

SEQ ID NO: 653660 - RNA, 64 nt, hsa
ggaauguagcuuaaugauuuucuguuucccauaccauuucuaaucuuuuguguaauuuucucuu

SEQ ID NO: 653661 - RNA, 64 nt, hsa
auugaaauaguauugauuuagaaaaaguauauugcauuucuaaaaaacaucuaccaagguuacu

SEQ ID NO: 653662 - RNA, 64 nt, hsa
gacuaauuaguuuaauucuuucgggcuugcuaagcauuucuaaagcauuagacuaacagauucc

SEQ ID NO: 653663 - RNA, 64 nt, hsa
uuaacauuguaaacaacagacuuacguuaaacuucauuucuaguacacgcccuauuuaaaaaag

SEQ ID NO: 653664 - RNA, 64 nt, hsa
uuauuucuagugaaacuuuuauauacguaucggucauuucuauuuccuuuuuugagaacugcca

SEQ ID NO: 653665 - RNA, 64 nt, hsa
uuuaagccuucaacuugauuuccaauuauuccaucauuucuauucugaaaugacucacugucgu

SEQ ID NO: 653666 - RNA, 64 nt, hsa
agcucccauuucuacucuuaaguuucucagcucccauuucuacucucccauggcuuaaugcuuc

SEQ ID NO: 653667 - RNA, 64 nt, hsa
ugaggauaggaguucacuucaucuucucagcucccauuucuacucuuaaguuucucagcuccca

SEQ ID NO: 653668 - RNA, 64 nt, hsa
caagaaaccaacccaaagaaaauucugaaaaauacauuucuauuuauagaauaaauguuucauu

SEQ ID NO: 653669 - RNA, 64 nt, hsa
agaaauauaaugugagccccauauacaauuuuuacauuucuaauauauuuuaaacaagugaagu

SEQ ID NO: 653670 - RNA, 64 nt, hsa
cuuagaaaugguauagucaaagacauuuuauccacauuucuaauaguggacuugauuaaguaga

SEQ ID NO: 653671 - RNA, 64 nt, hsa
gaaacaaaauuaauaguucauaugucacucauagcauuucuauauuugaaaguagcccaauaua

SEQ ID NO: 653672 - RNA, 64 nt, hsa
auuauuuuaaaagguauuuuaggugacaccacugcauuucuauuucaucuuuugagucauaugu

SEQ ID NO: 653673 - RNA, 64 nt, hsa
aggcaugagccaccacacccagccccuuuccaaccauuucuaaguagauuuuuugacauuaaug

SEQ ID NO: 653674 - RNA, 54 nt, hsa
cuggcaaggaacauaguugaaugacauuucuaguaaucucuaauuccagugucu

SEQ ID NO: 653675 - RNA, 64 nt, hsa
uauaauaaguauaugaguauaauuauaauucacacauuucuaagucaugaaugcuuuuaaaaaa

SEQ ID NO: 653676 - RNA, 64 nt, hsa
gaaaccuccugcccucccugcacgucugugucuucauuucuaaaaugggggugaugcuuucaua

SEQ ID NO: 653677 - RNA, 64 nt, hsa
gguugaccaugccuggugccacagccaugguuuccauuucuagaugaaaggauggccuaggaca

SEQ ID NO: 653678 - RNA, 64 nt, hsa
uccaccuguucauuuguucauccauguauucuaacauuucuauguagugugcaacucuaauguc

SEQ ID NO: 653679 - RNA, 64 nt, hsa
uaugauuacauaucaaaauugauuaaaacacuuccauuucuaaaaguucaaauauacuuguuaa

SEQ ID NO: 653680 - RNA, 64 nt, hsa
gccuccugaauuuuagauguuccacuguuuugaucauuucuauaaaagaaauggucauuuuacu

SEQ ID NO: 653681 - RNA, 64 nt, hsa
uguuauugacuggaguuaauguguaaguuauuaacauuucuaugaaaaugcccuuuuggggccu

SEQ ID NO: 653682 - RNA, 64 nt, hsa
uccccccuguuucuacuuuauuguuuguccuaaccauuucuacuacaguuuuuuccuuauggac

SEQ ID NO: 653683 - RNA, 64 nt, hsa
ugcuuuguuuucuccucagaagucggguagauagcauuucuaucccaucccucacguuauugga

SEQ ID NO: 653684 - RNA, 64 nt, hsa
ucagagcucuuggcgaggguggagggaggagugucauuucuauguguaauuucugagccauugu

SEQ ID NO: 653685 - RNA, 64 nt, hsa
uuugggaugauuugauuucuguuguuguugaucccauuucuaacuuggaauugugagccucuau

SEQ ID NO: 653686 - RNA, 64 nt, hsa
ugaauguggaguguggagaggaaggaggcagauucauuucuaagacgcacucuggagccaugua

SEQ ID NO: 653687 - RNA, 64 nt, hsa
caaucuuaaggaugugaauaaaaccaccaaauggcauuucuagacaguuugaccuguuauacag

SEQ ID NO: 653688 - RNA, 64 nt, hsa
ccauuuucuaguaaagccagaaauucuugcuucccauuucuagaauaguuucuagaacagugcu

SEQ ID NO: 653689 - RNA, 64 nt, hsa
ggggaaaaaaagagcacuauaaaccacauguuuucauuucuagugcuucgcuguaaguggcuag

SEQ ID NO: 653690 - RNA, 64 nt, hsa
acgccuggccaauuauguaauuuuuuaaaaaggacauuucuaucagggauauauaccuucagaa

SEQ ID NO: 653691 - RNA, 64 nt, hsa
caggugugagccaccacguccggccaauuuuucucauuucuaugccuccuauauuaaggucugu

SEQ ID NO: 653692 - RNA, 64 nt, hsa
auuuucaucacugaaagucagaggccaaggaaaucauuucuacuucuuuaaaaacuccuucuaa

SEQ ID NO: 653693 - RNA, 64 nt, hsa
cauuuuugaauagggucaaggagcccaagcaaaucauuucuacuuuuuccuuuaagcauaauaa

SEQ ID NO: 653694 - RNA, 64 nt, hsa
aaaauaaauccaguauuuguaaagugaauaacuucauuucuaauuguuuaauuuuuaaaauucu

SEQ ID NO: 653695 - RNA, 64 nt, hsa
gaaauaugaccuuuucugaaaauacauacuuuuacauuucuacuuuauugagaccuauuagaug

SEQ ID NO: 653696 - RNA, 64 nt, hsa
uuuuccuugcuuuuuauaugcagaauaucaaagucauuucuaauuuaguugucaaaaacauaua

SEQ ID NO: 653697 - RNA, 64 nt, hsa
aagcauggucaugcugguuuauagauuuuuuacccauuucuacucuuuuucucuauugguggca

SEQ ID NO: 653698 - RNA, 64 nt, hsa
gagaacgcuagauauuaagaauuuugaaauggaucauuucuacuugcugugcauuuuaaccaau

SEQ ID NO: 653699 - RNA, 64 nt, hsa
aagagguauguagucacaguaaauacuaagauggcauuucuaucucagagggccaaagugaauc

SEQ ID NO: 653700 - RNA, 64 nt, hsa
agauaguuauaggccacuguuuuguaauguaguacauuucuaaucuauuauuccuaaccuauua

SEQ ID NO: 653701 - RNA, 64 nt, hsa
aaauguauaaaauuccauuuuuuccaguguuuagcauuucuaguaagcagugagguuguuugac

SEQ ID NO: 653702 - RNA, 64 nt, hsa
auuauuaaagugagcuauguguuaagugccaggacauuucuagcuuuugugagaaugugucuac

SEQ ID NO: 653703 - RNA, 64 nt, hsa
gggucaccaagaagguuuacuuaauuaaauaccgcauuucuaagagaagauacuuuguguaaga

SEQ ID NO: 653704 - RNA, 64 nt, hsa
ucauacugaacaaaugucauucuaguuuagauagcauuucuaagauaacugauacuaauacuug

SEQ ID NO: 653705 - RNA, 64 nt, hsa
cuccugcugaaaaauacgcuuucugccaccuacacauuucuauuuaggaaguaaaauuugcuuc

SEQ ID NO: 653706 - RNA, 64 nt, hsa
auccuucacagcaagaaaccgaauaaaauacuaacauuucuaacaacugcucugacauuguaaa

SEQ ID NO: 653707 - RNA, 64 nt, hsa
aaaaauaccacuaucagaguagaaacaagguagacauuucuaaaacauaugugcuucauuauga

SEQ ID NO: 653708 - RNA, 64 nt, hsa
gagucaaaauaccauuuacaaagaaaaucaaaagcauuucuauauuuugucuuuuuuuaguuca

SEQ ID NO: 653709 - RNA, 64 nt, hsa
aaaauaauggggucuugggcauuucacaucacuccauuucuacugagacuuucagaaucacaca

SEQ ID NO: 653710 - RNA, 64 nt, hsa
uccuaaguauuguguauguuuaaaacgacagaaccauuucuacuucauuuggaaaaagauucag

SEQ ID NO: 653711 - RNA, 64 nt, hsa
cugcucuuagcauucuaccaccaugugucucacccauuucuaauuucauugucuuucuucccac

SEQ ID NO: 653712 - RNA, 64 nt, hsa
ccauuucuaauuucauugucuuucuucccacgcucauuucuaucauucucccccaugacccguc

SEQ ID NO: 653713 - RNA, 64 nt, hsa
aagguuuuauauagagaaacuugaguaauuuuuacauuucuaagacauuaaaucccauuuaaau

SEQ ID NO: 653714 - RNA, 64 nt, hsa
uuuuccauuuccauuuaaacauuuuuagccacuucauuucuauuuauugaacaggucaaauuug

SEQ ID NO: 653715 - RNA, 64 nt, hsa
cgaagaugauuggaaaaaagucugaaagauacaucauuucuauauuccuugcuuaauuuuuaua

SEQ ID NO: 653716 - RNA, 64 nt, hsa
aggaaauucuaaaggcuuaacaugaaacugucugcauuucuaccuguuagacaaugguugcucu

SEQ ID NO: 653717 - RNA, 64 nt, hsa
cacugucugcgugcaguuauuacaugcauuugugcauuucuacuacaauggcaucuuuaugucu

SEQ ID NO: 653718 - RNA, 64 nt, hsa
gcuguauguacaauccugggcauugacucugugacauuucuagcauauccaaggcaccaccagu

SEQ ID NO: 653719 - RNA, 64 nt, hsa
gcccuuucuuaugccguggguuuucaaguuuacucauuucuaugguugcaaauaacucuaaaac

SEQ ID NO: 653720 - RNA, 64 nt, hsa
aaugcuaaauuuuguuuucauguauggugucgcucauuucuauugaauuacaacagaacucagu

SEQ ID NO: 653721 - RNA, 64 nt, hsa; identical to SEQ ID NO: 427206

SEQ ID NO: 653722 - RNA, 64 nt, hsa; identical to SEQ ID NO: 427207

SEQ ID NO: 653723 - RNA, 64 nt, hsa; identical to SEQ ID NO: 76468

SEQ ID NO: 653724 - RNA, 64 nt, hsa; identical to SEQ ID NO: 76469

SEQ ID NO: 653725 - RNA, 64 nt, hsa; identical to SEQ ID NO: 76470

SEQ ID NO: 653726 - RNA, 64 nt, hsa; identical to SEQ ID NO: 76471

SEQ ID NO: 653727 - RNA, 64 nt, hsa; identical to SEQ ID NO: 76472

SEQ ID NO: 653728 - RNA, 64 nt, hsa; identical to SEQ ID NO: 76473

SEQ ID NO: 653729 - RNA, 64 nt, hsa; identical to SEQ ID NO: 653621

SEQ ID NO: 653730 - RNA, 64 nt, hsa; identical to SEQ ID NO: 653622

SEQ ID NO: 653731 - RNA, 64 nt, hsa; identical to SEQ ID NO: 653623

SEQ ID NO: 653732 - RNA, 64 nt, hsa; identical to SEQ ID NO: 653624

SEQ ID NO: 653733 - RNA, 64 nt, hsa; identical to SEQ ID NO: 653625

SEQ ID NO: 653734 - RNA, 64 nt, hsa; identical to SEQ ID NO: 653626

SEQ ID NO: 653735 - RNA, 64 nt, hsa; identical to SEQ ID NO: 653627

SEQ ID NO: 653736 - RNA, 64 nt, hsa; identical to SEQ ID NO: 653628

SEQ ID NO: 653737 - RNA, 64 nt, hsa; identical to SEQ ID NO: 653629

SEQ ID NO: 653738 - RNA, 52 nt, hsa; identical to SEQ ID NO: 653630

SEQ ID NO: 653739 - RNA, 64 nt, hsa; identical to SEQ ID NO: 653631

SEQ ID NO: 653740 - RNA, 64 nt, hsa; identical to SEQ ID NO: 653632

SEQ ID NO: 653741 - RNA, 64 nt, hsa; identical to SEQ ID NO: 653633

SEQ ID NO: 653742 - RNA, 64 nt, hsa; identical to SEQ ID NO: 653634

SEQ ID NO: 653743 - RNA, 64 nt, hsa; identical to SEQ ID NO: 189185

SEQ ID NO: 653744 - RNA, 64 nt, hsa; identical to SEQ ID NO: 189186

SEQ ID NO: 653745 - RNA, 64 nt, hsa; identical to SEQ ID NO: 189187

SEQ ID NO: 653746 - RNA, 64 nt, hsa; identical to SEQ ID NO: 189188

SEQ ID NO: 653747 - RNA, 64 nt, hsa; identical to SEQ ID NO: 189189

SEQ ID NO: 653748 - RNA, 64 nt, hsa; identical to SEQ ID NO: 189190

SEQ ID NO: 653749 - RNA, 64 nt, hsa; identical to SEQ ID NO: 189191

SEQ ID NO: 653750 - RNA, 64 nt, hsa; identical to SEQ ID NO: 189192

SEQ ID NO: 653751 - RNA, 64 nt, hsa; identical to SEQ ID NO: 189193

SEQ ID NO: 653752 - RNA, 64 nt, hsa; identical to SEQ ID NO: 189194

SEQ ID NO: 653753 - RNA, 64 nt, hsa; identical to SEQ ID NO: 189195

SEQ ID NO: 653754 - RNA, 64 nt, hsa; identical to SEQ ID NO: 189196

SEQ ID NO: 653755 - RNA, 64 nt, hsa; identical to SEQ ID NO: 189197

SEQ ID NO: 653756 - RNA, 64 nt, hsa; identical to SEQ ID NO: 189198

SEQ ID NO: 653757 - RNA, 64 nt, hsa; identical to SEQ ID NO: 189199

SEQ ID NO: 653758 - RNA, 64 nt, hsa; identical to SEQ ID NO: 189200

SEQ ID NO: 653759 - RNA, 64 nt, hsa; identical to SEQ ID NO: 189201

SEQ ID NO: 653760 - RNA, 64 nt, hsa; identical to SEQ ID NO: 189202

SEQ ID NO: 653761 - RNA, 64 nt, hsa; identical to SEQ ID NO: 189203

SEQ ID NO: 653762 - RNA, 64 nt, hsa; identical to SEQ ID NO: 189204

SEQ ID NO: 653763 - RNA, 64 nt, hsa; identical to SEQ ID NO: 189205

SEQ ID NO: 653764 - RNA, 64 nt, hsa; identical to SEQ ID NO: 189206

SEQ ID NO: 653765 - RNA, 64 nt, hsa; identical to SEQ ID NO: 189207

SEQ ID NO: 653766 - RNA, 64 nt, hsa; identical to SEQ ID NO: 189208

SEQ ID NO: 653767 - RNA, 64 nt, hsa; identical to SEQ ID NO: 189209

SEQ ID NO: 653768 - RNA, 64 nt, hsa; identical to SEQ ID NO: 189210

SEQ ID NO: 653769 - RNA, 64 nt, hsa; identical to SEQ ID NO: 189211

SEQ ID NO: 653770 - RNA, 64 nt, hsa; identical to SEQ ID NO: 189212

SEQ ID NO: 653771 - RNA, 64 nt, hsa; identical to SEQ ID NO: 189213

SEQ ID NO: 653772 - RNA, 50 nt, hsa; identical to SEQ ID NO: 189214

SEQ ID NO: 653773 - RNA, 64 nt, hsa; identical to SEQ ID NO: 189215

SEQ ID NO: 653774 - RNA, 64 nt, hsa; identical to SEQ ID NO: 189216

SEQ ID NO: 653775 - RNA, 64 nt, hsa; identical to SEQ ID NO: 189217

SEQ ID NO: 653776 - RNA, 64 nt, hsa; identical to SEQ ID NO: 189218

SEQ ID NO: 653777 - RNA, 64 nt, hsa; identical to SEQ ID NO: 189219

SEQ ID NO: 653778 - RNA, 64 nt, hsa; identical to SEQ ID NO: 189220

SEQ ID NO: 653779 - RNA, 64 nt, hsa; identical to SEQ ID NO: 189221

SEQ ID NO: 653780 - RNA, 64 nt, hsa; identical to SEQ ID NO: 189222

SEQ ID NO: 653781 - RNA, 64 nt, hsa; identical to SEQ ID NO: 189223

SEQ ID NO: 653782 - RNA, 64 nt, hsa; identical to SEQ ID NO: 189224

SEQ ID NO: 653783 - RNA, 64 nt, hsa; identical to SEQ ID NO: 189225

SEQ ID NO: 653784 - RNA, 64 nt, hsa; identical to SEQ ID NO: 189226

SEQ ID NO: 653785 - RNA, 64 nt, hsa; identical to SEQ ID NO: 189227

SEQ ID NO: 653786 - RNA, 64 nt, hsa; identical to SEQ ID NO: 189228

SEQ ID NO: 653787 - RNA, 64 nt, hsa; identical to SEQ ID NO: 189229

SEQ ID NO: 653788 - RNA, 64 nt, hsa; identical to SEQ ID NO: 189230

SEQ ID NO: 653789 - RNA, 64 nt, hsa; identical to SEQ ID NO: 189231

SEQ ID NO: 653790 - RNA, 64 nt, hsa; identical to SEQ ID NO: 189232

SEQ ID NO: 653791 - RNA, 64 nt, hsa; identical to SEQ ID NO: 189233

SEQ ID NO: 653792 - RNA, 64 nt, hsa; identical to SEQ ID NO: 189234

SEQ ID NO: 653793 - RNA, 64 nt, hsa; identical to SEQ ID NO: 189235

SEQ ID NO: 653794 - RNA, 64 nt, hsa; identical to SEQ ID NO: 189236

SEQ ID NO: 653795 - RNA, 64 nt, hsa; identical to SEQ ID NO: 189237

SEQ ID NO: 653796 - RNA, 64 nt, hsa; identical to SEQ ID NO: 189238

SEQ ID NO: 653797 - RNA, 64 nt, hsa; identical to SEQ ID NO: 189239

SEQ ID NO: 653798 - RNA, 64 nt, hsa; identical to SEQ ID NO: 189240

SEQ ID NO: 653799 - RNA, 64 nt, hsa; identical to SEQ ID NO: 189241

SEQ ID NO: 653800 - RNA, 64 nt, hsa; identical to SEQ ID NO: 189242

SEQ ID NO: 653801 - RNA, 64 nt, hsa; identical to SEQ ID NO: 189243

SEQ ID NO: 653802 - RNA, 64 nt, hsa; identical to SEQ ID NO: 189244

SEQ ID NO: 653803 - RNA, 64 nt, hsa; identical to SEQ ID NO: 189245

SEQ ID NO: 653804 - RNA, 64 nt, hsa; identical to SEQ ID NO: 189246

SEQ ID NO: 653805 - RNA, 64 nt, hsa; identical to SEQ ID NO: 189247

SEQ ID NO: 653806 - RNA, 64 nt, hsa; identical to SEQ ID NO: 189248

SEQ ID NO: 653807 - RNA, 64 nt, hsa; identical to SEQ ID NO: 189249

SEQ ID NO: 653808 - RNA, 64 nt, hsa; identical to SEQ ID NO: 189250

SEQ ID NO: 653809 - RNA, 64 nt, hsa; identical to SEQ ID NO: 189251

SEQ ID NO: 653810 - RNA, 64 nt, hsa; identical to SEQ ID NO: 189252

SEQ ID NO: 653811 - RNA, 64 nt, hsa; identical to SEQ ID NO: 189253

SEQ ID NO: 653812 - RNA, 64 nt, hsa; identical to SEQ ID NO: 189254

SEQ ID NO: 653813 - RNA, 64 nt, hsa; identical to SEQ ID NO: 189255

SEQ ID NO: 653814 - RNA, 64 nt, hsa; identical to SEQ ID NO: 189256

SEQ ID NO: 653815 - RNA, 64 nt, hsa; identical to SEQ ID NO: 189257

SEQ ID NO: 653816 - RNA, 64 nt, hsa; identical to SEQ ID NO: 189258

SEQ ID NO: 653817 - RNA, 60 nt, hsa
acacucucccuuuucaguaagcgcaaagccucagaagaccuggaacaagauucugccauc

SEQ ID NO: 653818 - RNA, 64 nt, hsa
aaguguugacaagaugccuauucguagaguucccucagaagagccaugguguuuaugaagagaa

SEQ ID NO: 653819 - RNA, 64 nt, hsa
gaagacacuaauauuauuacccauauacaugauuucagaagaugacauaagauuccucuuaaag

SEQ ID NO: 653820 - RNA, 64 nt, hsa
gggaagagaacauggcauuaaaagaaucacaucuucagaagagaagacacuaauauuauuaccc

SEQ ID NO: 653821 - RNA, 64 nt, hsa
aucaucuuguugugggcaugaggaggugcugaugucagaagaaauggcucgagcucagaagaua

SEQ ID NO: 653822 - RNA, 64 nt, hsa
aggaggugcugaugucagaagaaauggcucgagcucagaagauaaaagauaaguaggguaugcu

SEQ ID NO: 653823 - RNA, 64 nt, hsa
uucugauguagagcgacuggaaagauucuucgacucagaagaugaagacuuugaaauccugucc

SEQ ID NO: 653824 - RNA, 64 nt, hsa
acaugaauuucugggcgcucccugagucagagucucagaagaccugugcaggcuggcgugagag

SEQ ID NO: 653825 - RNA, 64 nt, hsa
ggugaugguguggcuuuccgaaaugggcaaauauucagaagaucuuuugcauuuucuucuguca

SEQ ID NO: 653826 - RNA, 64 nt, hsa
ggcuccuccaugacuagugggaauuacuguggguucagaagacccuugucugguauuugccaca

SEQ ID NO: 653827 - RNA, 64 nt, hsa
cagguuuucuaguucagaagacuaaccagcuuagucagaagaugguuccauggaagaaaaaggc

SEQ ID NO: 653828 - RNA, 64 nt, hsa
uuuuggauucuaucccagacccagguuuucuaguucagaagacuaaccagcuuagucagaagau

SEQ ID NO: 653829 - RNA, 64 nt, hsa
uuucacugauugagauuacuuuguaaguagcuguucagaagaauaaaauaugacuguuuuaggg

SEQ ID NO: 653830 - RNA, 64 nt, hsa
uuuuuuaaagcagacuaaaagcaugaaauugcuuucagaagaauguauaucaucgggaaaaguu

SEQ ID NO: 653831 - RNA, 64 nt, hsa
aucucuaaagcaaaagccucaccucaagggcugcucagaagagagcaccuucagcaugaguugu

SEQ ID NO: 653832 - RNA, 64 nt, hsa
uguuuuccccucuaaugagagggcauggccugagucagaagagcuaccccaggugaaacuggaa

SEQ ID NO: 653833 - RNA, 64 nt, hsa
ggcagggugugguuuggggggaaauuuuucuuuuucagaagacagaacacagauguggacacau

SEQ ID NO: 653834 - RNA, 64 nt, hsa
cauuggaaaaagccacuuggacuucacagagcugucagaagacuuaggaagcuuugccaguagu

SEQ ID NO: 653835 - RNA, 64 nt, hsa
cucuggagauagcuaccuggacuuuacagagcugucagaagacuugggaagguuugccagcauu

SEQ ID NO: 653836 - RNA, 64 nt, hsa
gugaugccacuucuucaguauuagggauucucagucagaagagacccccuguguggccugaguc

SEQ ID NO: 653837 - RNA, 64 nt, hsa
cauuguuaauuugaggacugggcugucuuggggcucagaagauaaagaacuauuugagcagaug

SEQ ID NO: 653838 - RNA, 64 nt, hsa
gggagacuguugcucaaccaucaggaaacaguugucagaagacaucauugguucuguguuuccu

SEQ ID NO: 653839 - RNA, 64 nt, hsa
aaagucgcauaggguuuuuuaaugcagaauuuugucagaagacaauggcgcugcauguuuuucu

SEQ ID NO: 653840 - RNA, 64 nt, hsa
uagguagggggcuuucacuaggaaaaucaugugcucagaagaggaaaugacucguagucagguu

SEQ ID NO: 653841 - RNA, 64 nt, hsa
ggagaaaucauccuguuuucucugugaccugauuucagaagagacugauccaaaaauuauaacg

SEQ ID NO: 653842 - RNA, 64 nt, hsa
aacaagaaaaccauggcccuccuuuguucaaguaucagaagaaauaaacccacagcuccagaga

SEQ ID NO: 653843 - RNA, 64 nt, hsa
aaaacauuugaaaccaaguacuguuuaauuucaaucagaagaugcaaauacauacuuugaucua

SEQ ID NO: 653844 - RNA, 64 nt, hsa
ccuuagaacaccugagcugcugcaugaguggacgucagaagaaucucuaugcccuguuaaaugg

SEQ ID NO: 653845 - RNA, 64 nt, hsa
gagucacccccaggacuuauccaugcaucacuauucagaagacacagagggccccucucuccac

SEQ ID NO: 653846 - RNA, 64 nt, hsa
auuauauagcccagaaacuauaauaacauaaaguucagaagaguguaaauagaauuuauauuac

SEQ ID NO: 653847 - RNA, 63 nt, hsa
guuucagaccacccugcugaggcuggccccaucucagaagaugagcaggagcuccacuacgcu

SEQ ID NO: 653848 - RNA, 64 nt, hsa
ucuuuccuuuuuuuaaauuuaaaccauugagacuucagaagagcaggacacaaugcuguggaca

SEQ ID NO: 653849 - RNA, 64 nt, hsa
cucggcuguuagggaucugaacuugguuuucccgucagaagaaucagcaggacagaucguagug

SEQ ID NO: 653850 - RNA, 64 nt, hsa; identical to SEQ ID NO: 379260

SEQ ID NO: 653851 - RNA, 64 nt, hsa; identical to SEQ ID NO: 379261

SEQ ID NO: 653852 - RNA, 64 nt, hsa; identical to SEQ ID NO: 379262

SEQ ID NO: 653853 - RNA, 64 nt, hsa; identical to SEQ ID NO: 379263

SEQ ID NO: 653854 - RNA, 64 nt, hsa; identical to SEQ ID NO: 379264

SEQ ID NO: 653855 - RNA, 64 nt, hsa; identical to SEQ ID NO: 379265

SEQ ID NO: 653856 - RNA, 64 nt, hsa; identical to SEQ ID NO: 379266

SEQ ID NO: 653857 - RNA, 64 nt, hsa; identical to SEQ ID NO: 379267

SEQ ID NO: 653858 - RNA, 64 nt, hsa; identical to SEQ ID NO: 379268

SEQ ID NO: 653859 - RNA, 64 nt, hsa; identical to SEQ ID NO: 379269

SEQ ID NO: 653860 - RNA, 64 nt, hsa; identical to SEQ ID NO: 379270

SEQ ID NO: 653861 - RNA, 64 nt, hsa; identical to SEQ ID NO: 379271

SEQ ID NO: 653862 - RNA, 64 nt, hsa; identical to SEQ ID NO: 379272

SEQ ID NO: 653863 - RNA, 64 nt, hsa; identical to SEQ ID NO: 379273

SEQ ID NO: 653864 - RNA, 64 nt, hsa; identical to SEQ ID NO: 530346

SEQ ID NO: 653865 - RNA, 64 nt, hsa; identical to SEQ ID NO: 530347

SEQ ID NO: 653866 - RNA, 64 nt, hsa; identical to SEQ ID NO: 530348

SEQ ID NO: 653867 - RNA, 64 nt, hsa; identical to SEQ ID NO: 530349

SEQ ID NO: 653868 - RNA, 64 nt, hsa; identical to SEQ ID NO: 530350

SEQ ID NO: 653869 - RNA, 64 nt, hsa; identical to SEQ ID NO: 530351

SEQ ID NO: 653870 - RNA, 64 nt, hsa; identical to SEQ ID NO: 530352

SEQ ID NO: 653871 - RNA, 64 nt, hsa; identical to SEQ ID NO: 530353

SEQ ID NO: 653872 - RNA, 64 nt, hsa; identical to SEQ ID NO: 530354

SEQ ID NO: 653873 - RNA, 64 nt, hsa; identical to SEQ ID NO: 530355

SEQ ID NO: 653874 - RNA, 64 nt, hsa; identical to SEQ ID NO: 530356

SEQ ID NO: 653875 - RNA, 64 nt, hsa; identical to SEQ ID NO: 530357

SEQ ID NO: 653876 - RNA, 64 nt, hsa; identical to SEQ ID NO: 530358

SEQ ID NO: 653877 - RNA, 64 nt, hsa; identical to SEQ ID NO: 530359

SEQ ID NO: 653878 - RNA, 64 nt, hsa; identical to SEQ ID NO: 530360

SEQ ID NO: 653879 - RNA, 64 nt, hsa; identical to SEQ ID NO: 530361

SEQ ID NO: 653880 - RNA, 64 nt, hsa; identical to SEQ ID NO: 530362

SEQ ID NO: 653881 - RNA, 64 nt, hsa; identical to SEQ ID NO: 530363

SEQ ID NO: 653882 - RNA, 64 nt, hsa; identical to SEQ ID NO: 530364

SEQ ID NO: 653883 - RNA, 64 nt, hsa; identical to SEQ ID NO: 530365

SEQ ID NO: 653884 - RNA, 64 nt, hsa; identical to SEQ ID NO: 530366

SEQ ID NO: 653885 - RNA, 64 nt, hsa; identical to SEQ ID NO: 530367

SEQ ID NO: 653886 - RNA, 64 nt, hsa; identical to SEQ ID NO: 530368

SEQ ID NO: 653887 - RNA, 64 nt, hsa; identical to SEQ ID NO: 530369

SEQ ID NO: 653888 - RNA, 64 nt, hsa; identical to SEQ ID NO: 530370

SEQ ID NO: 653889 - RNA, 64 nt, hsa; identical to SEQ ID NO: 530371

SEQ ID NO: 653890 - RNA, 64 nt, hsa; identical to SEQ ID NO: 530372

SEQ ID NO: 653891 - RNA, 64 nt, hsa; identical to SEQ ID NO: 530373

SEQ ID NO: 653892 - RNA, 64 nt, hsa; identical to SEQ ID NO: 530374

SEQ ID NO: 653893 - RNA, 64 nt, hsa; identical to SEQ ID NO: 530375

SEQ ID NO: 653894 - RNA, 64 nt, hsa; identical to SEQ ID NO: 530376

SEQ ID NO: 653895 - RNA, 60 nt, hsa; identical to SEQ ID NO: 530377

SEQ ID NO: 653896 - RNA, 64 nt, hsa; identical to SEQ ID NO: 530378

SEQ ID NO: 653897 - RNA, 64 nt, hsa; identical to SEQ ID NO: 530379

SEQ ID NO: 653898 - RNA, 64 nt, hsa; identical to SEQ ID NO: 530380

SEQ ID NO: 653899 - RNA, 64 nt, hsa; identical to SEQ ID NO: 530381

SEQ ID NO: 653900 - RNA, 64 nt, hsa; identical to SEQ ID NO: 530382

SEQ ID NO: 653901 - RNA, 64 nt, hsa; identical to SEQ ID NO: 530383

SEQ ID NO: 653902 - RNA, 64 nt, hsa; identical to SEQ ID NO: 530384

SEQ ID NO: 653903 - RNA, 64 nt, hsa; identical to SEQ ID NO: 530385

SEQ ID NO: 653904 - RNA, 64 nt, hsa; identical to SEQ ID NO: 530386

SEQ ID NO: 653905 - RNA, 64 nt, hsa; identical to SEQ ID NO: 530387

SEQ ID NO: 653906 - RNA, 64 nt, hsa; identical to SEQ ID NO: 530388

SEQ ID NO: 653907 - RNA, 64 nt, hsa; identical to SEQ ID NO: 530389

SEQ ID NO: 653908 - RNA, 64 nt, hsa; identical to SEQ ID NO: 530390

SEQ ID NO: 653909 - RNA, 64 nt, hsa; identical to SEQ ID NO: 530391

SEQ ID NO: 653910 - RNA, 64 nt, hsa; identical to SEQ ID NO: 530392

SEQ ID NO: 653911 - RNA, 64 nt, hsa; identical to SEQ ID NO: 530393

SEQ ID NO: 653912 - RNA, 64 nt, hsa; identical to SEQ ID NO: 530394

SEQ ID NO: 653913 - RNA, 64 nt, hsa; identical to SEQ ID NO: 530395

SEQ ID NO: 653914 - RNA, 64 nt, hsa; identical to SEQ ID NO: 530396

SEQ ID NO: 653915 - RNA, 64 nt, hsa; identical to SEQ ID NO: 530397

SEQ ID NO: 653916 - RNA, 64 nt, hsa; identical to SEQ ID NO: 530398

SEQ ID NO: 653917 - RNA, 64 nt, hsa; identical to SEQ ID NO: 530399

SEQ ID NO: 653918 - RNA, 64 nt, hsa; identical to SEQ ID NO: 530400

SEQ ID NO: 653919 - RNA, 64 nt, hsa; identical to SEQ ID NO: 530401

SEQ ID NO: 653920 - RNA, 64 nt, hsa; identical to SEQ ID NO: 530402

SEQ ID NO: 653921 - RNA, 64 nt, hsa; identical to SEQ ID NO: 530403

SEQ ID NO: 653922 - RNA, 64 nt, hsa; identical to SEQ ID NO: 530404

SEQ ID NO: 653923 - RNA, 64 nt, hsa; identical to SEQ ID NO: 530405

SEQ ID NO: 653924 - RNA, 64 nt, hsa; identical to SEQ ID NO: 530406

SEQ ID NO: 653925 - RNA, 64 nt, hsa; identical to SEQ ID NO: 530407

SEQ ID NO: 653926 - RNA, 64 nt, hsa; identical to SEQ ID NO: 530408

SEQ ID NO: 653927 - RNA, 64 nt, hsa; identical to SEQ ID NO: 530409

SEQ ID NO: 653928 - RNA, 64 nt, hsa; identical to SEQ ID NO: 530410

SEQ ID NO: 653929 - RNA, 64 nt, hsa; identical to SEQ ID NO: 530411

SEQ ID NO: 653930 - RNA, 64 nt, hsa; identical to SEQ ID NO: 530412

SEQ ID NO: 653931 - RNA, 64 nt, hsa; identical to SEQ ID NO: 530413

SEQ ID NO: 653932 - RNA, 64 nt, hsa; identical to SEQ ID NO: 530414

SEQ ID NO: 653933 - RNA, 64 nt, hsa; identical to SEQ ID NO: 530415

SEQ ID NO: 653934 - RNA, 64 nt, hsa; identical to SEQ ID NO: 530416

SEQ ID NO: 653935 - RNA, 64 nt, hsa; identical to SEQ ID NO: 530417

SEQ ID NO: 653936 - RNA, 64 nt, hsa; identical to SEQ ID NO: 530418

SEQ ID NO: 653937 - RNA, 64 nt, hsa; identical to SEQ ID NO: 530419

SEQ ID NO: 653938 - RNA, 64 nt, hsa; identical to SEQ ID NO: 530420

SEQ ID NO: 653939 - RNA, 64 nt, hsa; identical to SEQ ID NO: 530421

SEQ ID NO: 653940 - RNA, 64 nt, hsa; identical to SEQ ID NO: 530422

SEQ ID NO: 653941 - RNA, 64 nt, hsa; identical to SEQ ID NO: 530423

SEQ ID NO: 653942 - RNA, 64 nt, hsa; identical to SEQ ID NO: 530424

SEQ ID NO: 653943 - RNA, 64 nt, hsa; identical to SEQ ID NO: 530425

SEQ ID NO: 653944 - RNA, 64 nt, hsa; identical to SEQ ID NO: 530426

SEQ ID NO: 653945 - RNA, 64 nt, hsa; identical to SEQ ID NO: 530427

SEQ ID NO: 653946 - RNA, 64 nt, hsa; identical to SEQ ID NO: 530428

SEQ ID NO: 653947 - RNA, 64 nt, hsa; identical to SEQ ID NO: 530429

SEQ ID NO: 653948 - RNA, 64 nt, hsa; identical to SEQ ID NO: 530430

SEQ ID NO: 653949 - RNA, 64 nt, hsa; identical to SEQ ID NO: 530431

SEQ ID NO: 653950 - RNA, 64 nt, hsa; identical to SEQ ID NO: 530432

SEQ ID NO: 653951 - RNA, 64 nt, hsa; identical to SEQ ID NO: 530433

SEQ ID NO: 653952 - RNA, 64 nt, hsa; identical to SEQ ID NO: 530434

SEQ ID NO: 653953 - RNA, 64 nt, hsa; identical to SEQ ID NO: 530435

SEQ ID NO: 653954 - RNA, 64 nt, hsa; identical to SEQ ID NO: 530436

SEQ ID NO: 653955 - RNA, 64 nt, hsa; identical to SEQ ID NO: 530437

SEQ ID NO: 653956 - RNA, 51 nt, hsa; identical to SEQ ID NO: 530438

SEQ ID NO: 653957 - RNA, 59 nt, hsa; identical to SEQ ID NO: 530439

SEQ ID NO: 653958 - RNA, 64 nt, hsa; identical to SEQ ID NO: 530440

SEQ ID NO: 653959 - RNA, 64 nt, hsa; identical to SEQ ID NO: 530441

SEQ ID NO: 653960 - RNA, 64 nt, hsa; identical to SEQ ID NO: 530442

SEQ ID NO: 653961 - RNA, 64 nt, hsa; identical to SEQ ID NO: 530443

SEQ ID NO: 653962 - RNA, 64 nt, hsa; identical to SEQ ID NO: 530444

SEQ ID NO: 653963 - RNA, 64 nt, hsa; identical to SEQ ID NO: 530445

SEQ ID NO: 653964 - RNA, 64 nt, hsa; identical to SEQ ID NO: 530446

SEQ ID NO: 653965 - RNA, 64 nt, hsa; identical to SEQ ID NO: 530447

SEQ ID NO: 653966 - RNA, 64 nt, hsa; identical to SEQ ID NO: 530448

SEQ ID NO: 653967 - RNA, 64 nt, hsa; identical to SEQ ID NO: 530449

SEQ ID NO: 653968 - RNA, 64 nt, hsa; identical to SEQ ID NO: 530450

SEQ ID NO: 653969 - RNA, 64 nt, hsa; identical to SEQ ID NO: 530451

SEQ ID NO: 653970 - RNA, 64 nt, hsa; identical to SEQ ID NO: 530452

SEQ ID NO: 653971 - RNA, 64 nt, hsa; identical to SEQ ID NO: 530453

SEQ ID NO: 653972 - RNA, 64 nt, hsa; identical to SEQ ID NO: 530454

SEQ ID NO: 653973 - RNA, 64 nt, hsa; identical to SEQ ID NO: 530455

SEQ ID NO: 653974 - RNA, 64 nt, hsa; identical to SEQ ID NO: 530456

SEQ ID NO: 653975 - RNA, 64 nt, hsa; identical to SEQ ID NO: 530457

SEQ ID NO: 653976 - RNA, 64 nt, hsa; identical to SEQ ID NO: 530458

SEQ ID NO: 653977 - RNA, 64 nt, hsa; identical to SEQ ID NO: 530459

SEQ ID NO: 653978 - RNA, 64 nt, hsa; identical to SEQ ID NO: 530460

SEQ ID NO: 653979 - RNA, 64 nt, hsa; identical to SEQ ID NO: 530461

SEQ ID NO: 653980 - RNA, 64 nt, hsa; identical to SEQ ID NO: 530462

SEQ ID NO: 653981 - RNA, 64 nt, hsa; identical to SEQ ID NO: 530463

SEQ ID NO: 653982 - RNA, 64 nt, hsa; identical to SEQ ID NO: 530464

SEQ ID NO: 653983 - RNA, 64 nt, hsa; identical to SEQ ID NO: 530465

SEQ ID NO: 653984 - RNA, 64 nt, hsa; identical to SEQ ID NO: 530466

SEQ ID NO: 653985 - RNA, 64 nt, hsa; identical to SEQ ID NO: 530467

SEQ ID NO: 653986 - RNA, 64 nt, hsa; identical to SEQ ID NO: 530468

SEQ ID NO: 653987 - RNA, 64 nt, hsa; identical to SEQ ID NO: 530469

SEQ ID NO: 653988 - RNA, 64 nt, hsa; identical to SEQ ID NO: 530470

SEQ ID NO: 653989 - RNA, 64 nt, hsa; identical to SEQ ID NO: 530471

SEQ ID NO: 653990 - RNA, 64 nt, hsa; identical to SEQ ID NO: 530472

SEQ ID NO: 653991 - RNA, 64 nt, hsa; identical to SEQ ID NO: 530473

SEQ ID NO: 653992 - RNA, 64 nt, hsa; identical to SEQ ID NO: 530474

SEQ ID NO: 653993 - RNA, 64 nt, hsa; identical to SEQ ID NO: 530475

SEQ ID NO: 653994 - RNA, 64 nt, hsa; identical to SEQ ID NO: 530476

SEQ ID NO: 653995 - RNA, 64 nt, hsa; identical to SEQ ID NO: 530477

SEQ ID NO: 653996 - RNA, 64 nt, hsa; identical to SEQ ID NO: 530478

SEQ ID NO: 653997 - RNA, 64 nt, hsa; identical to SEQ ID NO: 530479

SEQ ID NO: 653998 - RNA, 64 nt, hsa; identical to SEQ ID NO: 530480

SEQ ID NO: 653999 - RNA, 64 nt, hsa; identical to SEQ ID NO: 530481

SEQ ID NO: 654000 - RNA, 64 nt, hsa; identical to SEQ ID NO: 530482

SEQ ID NO: 654001 - RNA, 64 nt, hsa; identical to SEQ ID NO: 530483

SEQ ID NO: 654002 - RNA, 64 nt, hsa; identical to SEQ ID NO: 530484

SEQ ID NO: 654003 - RNA, 64 nt, hsa; identical to SEQ ID NO: 530485

SEQ ID NO: 654004 - RNA, 64 nt, hsa; identical to SEQ ID NO: 530486

SEQ ID NO: 654005 - RNA, 64 nt, hsa; identical to SEQ ID NO: 530487

SEQ ID NO: 654006 - RNA, 64 nt, hsa; identical to SEQ ID NO: 530488

SEQ ID NO: 654007 - RNA, 64 nt, hsa; identical to SEQ ID NO: 530489

SEQ ID NO: 654008 - RNA, 64 nt, hsa; identical to SEQ ID NO: 530490

SEQ ID NO: 654009 - RNA, 64 nt, hsa; identical to SEQ ID NO: 530491

SEQ ID NO: 654010 - RNA, 64 nt, hsa; identical to SEQ ID NO: 530492

SEQ ID NO: 654011 - RNA, 64 nt, hsa; identical to SEQ ID NO: 530493

SEQ ID NO: 654012 - RNA, 64 nt, hsa; identical to SEQ ID NO: 530494

SEQ ID NO: 654013 - RNA, 64 nt, hsa; identical to SEQ ID NO: 530495

SEQ ID NO: 654014 - RNA, 64 nt, hsa; identical to SEQ ID NO: 530496

SEQ ID NO: 654015 - RNA, 64 nt, hsa; identical to SEQ ID NO: 530497

SEQ ID NO: 654016 - RNA, 64 nt, hsa; identical to SEQ ID NO: 530498

SEQ ID NO: 654017 - RNA, 64 nt, hsa; identical to SEQ ID NO: 530499

SEQ ID NO: 654018 - RNA, 64 nt, hsa; identical to SEQ ID NO: 530500

SEQ ID NO: 654019 - RNA, 64 nt, hsa; identical to SEQ ID NO: 530501

SEQ ID NO: 654020 - RNA, 64 nt, hsa; identical to SEQ ID NO: 530502

SEQ ID NO: 654021 - RNA, 64 nt, hsa; identical to SEQ ID NO: 530503

SEQ ID NO: 654022 - RNA, 64 nt, hsa; identical to SEQ ID NO: 530504

SEQ ID NO: 654023 - RNA, 64 nt, hsa; identical to SEQ ID NO: 530505

SEQ ID NO: 654024 - RNA, 64 nt, hsa; identical to SEQ ID NO: 530506

SEQ ID NO: 654025 - RNA, 64 nt, hsa; identical to SEQ ID NO: 530507

SEQ ID NO: 654026 - RNA, 64 nt, hsa; identical to SEQ ID NO: 530508

SEQ ID NO: 654027 - RNA, 64 nt, hsa; identical to SEQ ID NO: 530509

SEQ ID NO: 654028 - RNA, 64 nt, hsa; identical to SEQ ID NO: 530510

SEQ ID NO: 654029 - RNA, 64 nt, hsa; identical to SEQ ID NO: 530511

SEQ ID NO: 654030 - RNA, 64 nt, hsa; identical to SEQ ID NO: 530512

SEQ ID NO: 654031 - RNA, 64 nt, hsa; identical to SEQ ID NO: 530513

SEQ ID NO: 654032 - RNA, 64 nt, hsa; identical to SEQ ID NO: 530514

SEQ ID NO: 654033 - RNA, 64 nt, hsa; identical to SEQ ID NO: 530515

SEQ ID NO: 654034 - RNA, 64 nt, hsa; identical to SEQ ID NO: 530516

SEQ ID NO: 654035 - RNA, 64 nt, hsa; identical to SEQ ID NO: 530517

SEQ ID NO: 654036 - RNA, 64 nt, hsa; identical to SEQ ID NO: 530518

SEQ ID NO: 654037 - RNA, 64 nt, hsa; identical to SEQ ID NO: 530519

SEQ ID NO: 654038 - RNA, 64 nt, hsa; identical to SEQ ID NO: 530520

SEQ ID NO: 654039 - RNA, 64 nt, hsa; identical to SEQ ID NO: 530521

SEQ ID NO: 654040 - RNA, 64 nt, hsa; identical to SEQ ID NO: 530522

SEQ ID NO: 654041 - RNA, 64 nt, hsa; identical to SEQ ID NO: 530523

SEQ ID NO: 654042 - RNA, 64 nt, hsa; identical to SEQ ID NO: 530524

SEQ ID NO: 654043 - RNA, 64 nt, hsa; identical to SEQ ID NO: 530525

SEQ ID NO: 654044 - RNA, 64 nt, hsa; identical to SEQ ID NO: 530526

SEQ ID NO: 654045 - RNA, 64 nt, hsa; identical to SEQ ID NO: 530527

SEQ ID NO: 654046 - RNA, 64 nt, hsa; identical to SEQ ID NO: 530528

SEQ ID NO: 654047 - RNA, 64 nt, hsa; identical to SEQ ID NO: 530529

SEQ ID NO: 654048 - RNA, 64 nt, hsa; identical to SEQ ID NO: 530530

SEQ ID NO: 654049 - RNA, 64 nt, hsa; identical to SEQ ID NO: 530531

SEQ ID NO: 654050 - RNA, 64 nt, hsa; identical to SEQ ID NO: 530532

SEQ ID NO: 654051 - RNA, 64 nt, hsa; identical to SEQ ID NO: 530533

SEQ ID NO: 654052 - RNA, 64 nt, hsa; identical to SEQ ID NO: 530534

SEQ ID NO: 654053 - RNA, 64 nt, hsa; identical to SEQ ID NO: 530535

SEQ ID NO: 654054 - RNA, 64 nt, hsa; identical to SEQ ID NO: 530536

SEQ ID NO: 654055 - RNA, 64 nt, hsa; identical to SEQ ID NO: 530537

SEQ ID NO: 654056 - RNA, 64 nt, hsa; identical to SEQ ID NO: 530538

SEQ ID NO: 654057 - RNA, 64 nt, hsa; identical to SEQ ID NO: 530539

SEQ ID NO: 654058 - RNA, 64 nt, hsa; identical to SEQ ID NO: 530540

SEQ ID NO: 654059 - RNA, 64 nt, hsa; identical to SEQ ID NO: 530541

SEQ ID NO: 654060 - RNA, 64 nt, hsa; identical to SEQ ID NO: 530542

SEQ ID NO: 654061 - RNA, 64 nt, hsa; identical to SEQ ID NO: 530543

SEQ ID NO: 654062 - RNA, 64 nt, hsa; identical to SEQ ID NO: 530544

SEQ ID NO: 654063 - RNA, 64 nt, hsa; identical to SEQ ID NO: 530545

SEQ ID NO: 654064 - RNA, 64 nt, hsa; identical to SEQ ID NO: 530546

SEQ ID NO: 654065 - RNA, 64 nt, hsa; identical to SEQ ID NO: 530547

SEQ ID NO: 654066 - RNA, 64 nt, hsa; identical to SEQ ID NO: 530548

SEQ ID NO: 654067 - RNA, 64 nt, hsa; identical to SEQ ID NO: 530549

SEQ ID NO: 654068 - RNA, 64 nt, hsa; identical to SEQ ID NO: 530550

SEQ ID NO: 654069 - RNA, 64 nt, hsa; identical to SEQ ID NO: 530551

SEQ ID NO: 654070 - RNA, 64 nt, hsa; identical to SEQ ID NO: 530552

SEQ ID NO: 654071 - RNA, 64 nt, hsa; identical to SEQ ID NO: 530553

SEQ ID NO: 654072 - RNA, 64 nt, hsa; identical to SEQ ID NO: 530554

SEQ ID NO: 654073 - RNA, 64 nt, hsa; identical to SEQ ID NO: 530555

SEQ ID NO: 654074 - RNA, 64 nt, hsa; identical to SEQ ID NO: 530556

SEQ ID NO: 654075 - RNA, 64 nt, hsa; identical to SEQ ID NO: 530557

SEQ ID NO: 654076 - RNA, 64 nt, hsa; identical to SEQ ID NO: 530558

SEQ ID NO: 654077 - RNA, 64 nt, hsa; identical to SEQ ID NO: 530559

SEQ ID NO: 654078 - RNA, 64 nt, hsa; identical to SEQ ID NO: 530560

SEQ ID NO: 654079 - RNA, 64 nt, hsa; identical to SEQ ID NO: 530561

SEQ ID NO: 654080 - RNA, 62 nt, hsa; identical to SEQ ID NO: 530562

SEQ ID NO: 654081 - RNA, 64 nt, hsa; identical to SEQ ID NO: 530563

SEQ ID NO: 654082 - RNA, 64 nt, hsa; identical to SEQ ID NO: 530564

SEQ ID NO: 654083 - RNA, 64 nt, hsa; identical to SEQ ID NO: 530565

SEQ ID NO: 654084 - RNA, 64 nt, hsa; identical to SEQ ID NO: 530566

SEQ ID NO: 654085 - RNA, 64 nt, hsa; identical to SEQ ID NO: 530567

SEQ ID NO: 654086 - RNA, 64 nt, hsa; identical to SEQ ID NO: 530568

SEQ ID NO: 654087 - RNA, 64 nt, hsa; identical to SEQ ID NO: 530569

SEQ ID NO: 654088 - RNA, 64 nt, hsa; identical to SEQ ID NO: 530570

SEQ ID NO: 654089 - RNA, 64 nt, hsa; identical to SEQ ID NO: 530571

SEQ ID NO: 654090 - RNA, 64 nt, hsa; identical to SEQ ID NO: 530572

SEQ ID NO: 654091 - RNA, 64 nt, hsa; identical to SEQ ID NO: 530573

SEQ ID NO: 654092 - RNA, 64 nt, hsa; identical to SEQ ID NO: 530574

SEQ ID NO: 654093 - RNA, 64 nt, hsa; identical to SEQ ID NO: 530575

SEQ ID NO: 654094 - RNA, 64 nt, hsa; identical to SEQ ID NO: 530576

SEQ ID NO: 654095 - RNA, 64 nt, hsa; identical to SEQ ID NO: 530577

SEQ ID NO: 654096 - RNA, 64 nt, hsa; identical to SEQ ID NO: 530578

SEQ ID NO: 654097 - RNA, 64 nt, hsa; identical to SEQ ID NO: 530579

SEQ ID NO: 654098 - RNA, 64 nt, hsa; identical to SEQ ID NO: 530580

SEQ ID NO: 654099 - RNA, 64 nt, hsa; identical to SEQ ID NO: 530581

SEQ ID NO: 654100 - RNA, 64 nt, hsa; identical to SEQ ID NO: 530582

SEQ ID NO: 654101 - RNA, 64 nt, hsa; identical to SEQ ID NO: 530583

SEQ ID NO: 654102 - RNA, 64 nt, hsa; identical to SEQ ID NO: 530584

SEQ ID NO: 654103 - RNA, 64 nt, hsa; identical to SEQ ID NO: 530585

SEQ ID NO: 654104 - RNA, 64 nt, hsa; identical to SEQ ID NO: 530586

SEQ ID NO: 654105 - RNA, 64 nt, hsa; identical to SEQ ID NO: 530587

SEQ ID NO: 654106 - RNA, 64 nt, hsa; identical to SEQ ID NO: 530588

SEQ ID NO: 654107 - RNA, 64 nt, hsa; identical to SEQ ID NO: 530589

SEQ ID NO: 654108 - RNA, 64 nt, hsa; identical to SEQ ID NO: 530590

SEQ ID NO: 654109 - RNA, 64 nt, hsa; identical to SEQ ID NO: 530591

SEQ ID NO: 654110 - RNA, 64 nt, hsa; identical to SEQ ID NO: 530592

SEQ ID NO: 654111 - RNA, 64 nt, hsa; identical to SEQ ID NO: 530593

SEQ ID NO: 654112 - RNA, 64 nt, hsa; identical to SEQ ID NO: 530594

SEQ ID NO: 654113 - RNA, 64 nt, hsa; identical to SEQ ID NO: 530595

SEQ ID NO: 654114 - RNA, 64 nt, hsa; identical to SEQ ID NO: 530596

SEQ ID NO: 654115 - RNA, 64 nt, hsa; identical to SEQ ID NO: 530597

SEQ ID NO: 654116 - RNA, 64 nt, hsa; identical to SEQ ID NO: 530598

SEQ ID NO: 654117 - RNA, 64 nt, hsa; identical to SEQ ID NO: 530599

SEQ ID NO: 654118 - RNA, 64 nt, hsa; identical to SEQ ID NO: 530600

SEQ ID NO: 654119 - RNA, 64 nt, hsa; identical to SEQ ID NO: 530601

SEQ ID NO: 654120 - RNA, 64 nt, hsa; identical to SEQ ID NO: 530602

SEQ ID NO: 654121 - RNA, 64 nt, hsa; identical to SEQ ID NO: 530603

SEQ ID NO: 654122 - RNA, 64 nt, hsa; identical to SEQ ID NO: 530604

SEQ ID NO: 654123 - RNA, 64 nt, hsa; identical to SEQ ID NO: 530605

SEQ ID NO: 654124 - RNA, 64 nt, hsa; identical to SEQ ID NO: 530606

SEQ ID NO: 654125 - RNA, 64 nt, hsa; identical to SEQ ID NO: 530607

SEQ ID NO: 654126 - RNA, 64 nt, hsa; identical to SEQ ID NO: 530608

SEQ ID NO: 654127 - RNA, 64 nt, hsa; identical to SEQ ID NO: 530609

SEQ ID NO: 654128 - RNA, 64 nt, hsa; identical to SEQ ID NO: 530610

SEQ ID NO: 654129 - RNA, 64 nt, hsa; identical to SEQ ID NO: 530611

SEQ ID NO: 654130 - RNA, 64 nt, hsa; identical to SEQ ID NO: 530612

SEQ ID NO: 654131 - RNA, 64 nt, hsa; identical to SEQ ID NO: 530613

SEQ ID NO: 654132 - RNA, 64 nt, hsa; identical to SEQ ID NO: 530614

SEQ ID NO: 654133 - RNA, 64 nt, hsa; identical to SEQ ID NO: 530615

SEQ ID NO: 654134 - RNA, 64 nt, hsa; identical to SEQ ID NO: 530616

SEQ ID NO: 654135 - RNA, 64 nt, hsa; identical to SEQ ID NO: 530617

SEQ ID NO: 654136 - RNA, 64 nt, hsa; identical to SEQ ID NO: 530618

SEQ ID NO: 654137 - RNA, 64 nt, hsa; identical to SEQ ID NO: 530619

SEQ ID NO: 654138 - RNA, 64 nt, hsa; identical to SEQ ID NO: 530620

SEQ ID NO: 654139 - RNA, 64 nt, hsa; identical to SEQ ID NO: 530621

SEQ ID NO: 654140 - RNA, 64 nt, hsa; identical to SEQ ID NO: 530622

SEQ ID NO: 654141 - RNA, 64 nt, hsa; identical to SEQ ID NO: 530623

SEQ ID NO: 654142 - RNA, 64 nt, hsa; identical to SEQ ID NO: 530624

SEQ ID NO: 654143 - RNA, 64 nt, hsa; identical to SEQ ID NO: 530625

SEQ ID NO: 654144 - RNA, 64 nt, hsa; identical to SEQ ID NO: 530626

SEQ ID NO: 654145 - RNA, 64 nt, hsa; identical to SEQ ID NO: 530627

SEQ ID NO: 654146 - RNA, 64 nt, hsa; identical to SEQ ID NO: 530628

SEQ ID NO: 654147 - RNA, 64 nt, hsa; identical to SEQ ID NO: 530629

SEQ ID NO: 654148 - RNA, 64 nt, hsa; identical to SEQ ID NO: 530630

SEQ ID NO: 654149 - RNA, 64 nt, hsa; identical to SEQ ID NO: 530631

SEQ ID NO: 654150 - RNA, 64 nt, hsa; identical to SEQ ID NO: 530632

SEQ ID NO: 654151 - RNA, 64 nt, hsa; identical to SEQ ID NO: 530633

SEQ ID NO: 654152 - RNA, 64 nt, hsa; identical to SEQ ID NO: 530634

SEQ ID NO: 654153 - RNA, 64 nt, hsa; identical to SEQ ID NO: 530635

SEQ ID NO: 654154 - RNA, 64 nt, hsa; identical to SEQ ID NO: 530636

SEQ ID NO: 654155 - RNA, 64 nt, hsa; identical to SEQ ID NO: 530637

SEQ ID NO: 654156 - RNA, 64 nt, hsa; identical to SEQ ID NO: 530638

SEQ ID NO: 654157 - RNA, 64 nt, hsa; identical to SEQ ID NO: 530639

SEQ ID NO: 654158 - RNA, 64 nt, hsa; identical to SEQ ID NO: 530640

SEQ ID NO: 654159 - RNA, 64 nt, hsa; identical to SEQ ID NO: 530641

SEQ ID NO: 654160 - RNA, 64 nt, hsa; identical to SEQ ID NO: 530642

SEQ ID NO: 654161 - RNA, 64 nt, hsa; identical to SEQ ID NO: 530643

SEQ ID NO: 654162 - RNA, 64 nt, hsa; identical to SEQ ID NO: 530644

SEQ ID NO: 654163 - RNA, 64 nt, hsa; identical to SEQ ID NO: 530645

SEQ ID NO: 654164 - RNA, 64 nt, hsa; identical to SEQ ID NO: 530646

SEQ ID NO: 654165 - RNA, 64 nt, hsa; identical to SEQ ID NO: 530647

SEQ ID NO: 654166 - RNA, 64 nt, hsa; identical to SEQ ID NO: 530648

SEQ ID NO: 654167 - RNA, 64 nt, hsa; identical to SEQ ID NO: 530649

SEQ ID NO: 654168 - RNA, 64 nt, hsa; identical to SEQ ID NO: 530650

SEQ ID NO: 654169 - RNA, 64 nt, hsa; identical to SEQ ID NO: 530651

SEQ ID NO: 654170 - RNA, 64 nt, hsa; identical to SEQ ID NO: 530652

SEQ ID NO: 654171 - RNA, 64 nt, hsa; identical to SEQ ID NO: 530653

SEQ ID NO: 654172 - RNA, 64 nt, hsa; identical to SEQ ID NO: 530654

SEQ ID NO: 654173 - RNA, 64 nt, hsa; identical to SEQ ID NO: 530655

SEQ ID NO: 654174 - RNA, 64 nt, hsa; identical to SEQ ID NO: 530656

SEQ ID NO: 654175 - RNA, 64 nt, hsa; identical to SEQ ID NO: 530657

SEQ ID NO: 654176 - RNA, 64 nt, hsa; identical to SEQ ID NO: 530658

SEQ ID NO: 654177 - RNA, 64 nt, hsa; identical to SEQ ID NO: 530659

SEQ ID NO: 654178 - RNA, 64 nt, hsa; identical to SEQ ID NO: 530660

SEQ ID NO: 654179 - RNA, 64 nt, hsa; identical to SEQ ID NO: 530661

SEQ ID NO: 654180 - RNA, 64 nt, hsa; identical to SEQ ID NO: 530662

SEQ ID NO: 654181 - RNA, 64 nt, hsa; identical to SEQ ID NO: 530663

SEQ ID NO: 654182 - RNA, 64 nt, hsa; identical to SEQ ID NO: 530664

SEQ ID NO: 654183 - RNA, 64 nt, hsa; identical to SEQ ID NO: 530665

SEQ ID NO: 654184 - RNA, 64 nt, hsa; identical to SEQ ID NO: 530666

SEQ ID NO: 654185 - RNA, 64 nt, hsa; identical to SEQ ID NO: 530667

SEQ ID NO: 654186 - RNA, 64 nt, hsa; identical to SEQ ID NO: 530668

SEQ ID NO: 654187 - RNA, 64 nt, hsa; identical to SEQ ID NO: 530669

SEQ ID NO: 654188 - RNA, 64 nt, hsa; identical to SEQ ID NO: 530670

SEQ ID NO: 654189 - RNA, 64 nt, hsa; identical to SEQ ID NO: 530671

SEQ ID NO: 654190 - RNA, 64 nt, hsa; identical to SEQ ID NO: 530672

SEQ ID NO: 654191 - RNA, 64 nt, hsa; identical to SEQ ID NO: 530673

SEQ ID NO: 654192 - RNA, 64 nt, hsa; identical to SEQ ID NO: 530674

SEQ ID NO: 654193 - RNA, 64 nt, hsa; identical to SEQ ID NO: 530675

SEQ ID NO: 654194 - RNA, 64 nt, hsa; identical to SEQ ID NO: 530676

SEQ ID NO: 654195 - RNA, 64 nt, hsa; identical to SEQ ID NO: 530677

SEQ ID NO: 654196 - RNA, 64 nt, hsa; identical to SEQ ID NO: 530678

SEQ ID NO: 654197 - RNA, 64 nt, hsa; identical to SEQ ID NO: 530679

SEQ ID NO: 654198 - RNA, 64 nt, hsa; identical to SEQ ID NO: 530680

SEQ ID NO: 654199 - RNA, 64 nt, hsa; identical to SEQ ID NO: 530681

SEQ ID NO: 654200 - RNA, 64 nt, hsa; identical to SEQ ID NO: 530682

SEQ ID NO: 654201 - RNA, 64 nt, hsa; identical to SEQ ID NO: 530683

SEQ ID NO: 654202 - RNA, 64 nt, hsa; identical to SEQ ID NO: 530684

SEQ ID NO: 654203 - RNA, 64 nt, hsa; identical to SEQ ID NO: 530685

SEQ ID NO: 654204 - RNA, 64 nt, hsa; identical to SEQ ID NO: 530686

SEQ ID NO: 654205 - RNA, 64 nt, hsa; identical to SEQ ID NO: 530687

SEQ ID NO: 654206 - RNA, 64 nt, hsa; identical to SEQ ID NO: 530688

SEQ ID NO: 654207 - RNA, 64 nt, hsa; identical to SEQ ID NO: 530689

SEQ ID NO: 654208 - RNA, 64 nt, hsa; identical to SEQ ID NO: 530690

SEQ ID NO: 654209 - RNA, 64 nt, hsa; identical to SEQ ID NO: 530691

SEQ ID NO: 654210 - RNA, 64 nt, hsa; identical to SEQ ID NO: 530692

SEQ ID NO: 654211 - RNA, 64 nt, hsa; identical to SEQ ID NO: 530693

SEQ ID NO: 654212 - RNA, 64 nt, hsa; identical to SEQ ID NO: 530694

SEQ ID NO: 654213 - RNA, 64 nt, hsa; identical to SEQ ID NO: 530695

SEQ ID NO: 654214 - RNA, 64 nt, hsa; identical to SEQ ID NO: 530696

SEQ ID NO: 654215 - RNA, 64 nt, hsa; identical to SEQ ID NO: 530697

SEQ ID NO: 654216 - RNA, 64 nt, hsa; identical to SEQ ID NO: 530698

SEQ ID NO: 654217 - RNA, 64 nt, hsa; identical to SEQ ID NO: 530699

SEQ ID NO: 654218 - RNA, 64 nt, hsa; identical to SEQ ID NO: 530700

SEQ ID NO: 654219 - RNA, 64 nt, hsa; identical to SEQ ID NO: 530701

SEQ ID NO: 654220 - RNA, 64 nt, hsa; identical to SEQ ID NO: 530702

SEQ ID NO: 654221 - RNA, 64 nt, hsa; identical to SEQ ID NO: 530703

SEQ ID NO: 654222 - RNA, 64 nt, hsa; identical to SEQ ID NO: 530704

SEQ ID NO: 654223 - RNA, 64 nt, hsa; identical to SEQ ID NO: 530705

SEQ ID NO: 654224 - RNA, 64 nt, hsa; identical to SEQ ID NO: 530706

SEQ ID NO: 654225 - RNA, 64 nt, hsa; identical to SEQ ID NO: 530707

SEQ ID NO: 654226 - RNA, 64 nt, hsa; identical to SEQ ID NO: 530708

SEQ ID NO: 654227 - RNA, 64 nt, hsa; identical to SEQ ID NO: 530709

SEQ ID NO: 654228 - RNA, 64 nt, hsa; identical to SEQ ID NO: 530710

SEQ ID NO: 654229 - RNA, 64 nt, hsa; identical to SEQ ID NO: 530711

SEQ ID NO: 654230 - RNA, 64 nt, hsa; identical to SEQ ID NO: 530712

SEQ ID NO: 654231 - RNA, 64 nt, hsa; identical to SEQ ID NO: 530713

SEQ ID NO: 654232 - RNA, 64 nt, hsa; identical to SEQ ID NO: 530714

SEQ ID NO: 654233 - RNA, 64 nt, hsa; identical to SEQ ID NO: 530715

SEQ ID NO: 654234 - RNA, 64 nt, hsa; identical to SEQ ID NO: 530716

SEQ ID NO: 654235 - RNA, 64 nt, hsa; identical to SEQ ID NO: 530717

SEQ ID NO: 654236 - RNA, 64 nt, hsa; identical to SEQ ID NO: 530718

SEQ ID NO: 654237 - RNA, 64 nt, hsa; identical to SEQ ID NO: 530719

SEQ ID NO: 654238 - RNA, 64 nt, hsa; identical to SEQ ID NO: 530720

SEQ ID NO: 654239 - RNA, 64 nt, hsa; identical to SEQ ID NO: 530721

SEQ ID NO: 654240 - RNA, 64 nt, hsa; identical to SEQ ID NO: 530722

SEQ ID NO: 654241 - RNA, 64 nt, hsa; identical to SEQ ID NO: 530723

SEQ ID NO: 654242 - RNA, 64 nt, hsa; identical to SEQ ID NO: 530724

SEQ ID NO: 654243 - RNA, 64 nt, hsa; identical to SEQ ID NO: 530725

SEQ ID NO: 654244 - RNA, 64 nt, hsa; identical to SEQ ID NO: 530726

SEQ ID NO: 654245 - RNA, 64 nt, hsa; identical to SEQ ID NO: 530727

SEQ ID NO: 654246 - RNA, 64 nt, hsa; identical to SEQ ID NO: 530728

SEQ ID NO: 654247 - RNA, 64 nt, hsa; identical to SEQ ID NO: 530729

SEQ ID NO: 654248 - RNA, 64 nt, hsa; identical to SEQ ID NO: 530718

SEQ ID NO: 654249 - RNA, 64 nt, hsa; identical to SEQ ID NO: 530717

SEQ ID NO: 654250 - RNA, 64 nt, hsa; identical to SEQ ID NO: 530720

SEQ ID NO: 654251 - RNA, 64 nt, hsa; identical to SEQ ID NO: 530719

SEQ ID NO: 654252 - RNA, 64 nt, hsa; identical to SEQ ID NO: 530734

SEQ ID NO: 654253 - RNA, 64 nt, hsa; identical to SEQ ID NO: 530735

SEQ ID NO: 654254 - RNA, 64 nt, hsa; identical to SEQ ID NO: 530736

SEQ ID NO: 654255 - RNA, 64 nt, hsa; identical to SEQ ID NO: 530737

SEQ ID NO: 654256 - RNA, 64 nt, hsa; identical to SEQ ID NO: 530738

SEQ ID NO: 654257 - RNA, 64 nt, hsa; identical to SEQ ID NO: 530739

SEQ ID NO: 654258 - RNA, 64 nt, hsa; identical to SEQ ID NO: 530740

SEQ ID NO: 654259 - RNA, 64 nt, hsa; identical to SEQ ID NO: 530741

SEQ ID NO: 654260 - RNA, 64 nt, hsa; identical to SEQ ID NO: 530742

SEQ ID NO: 654261 - RNA, 64 nt, hsa; identical to SEQ ID NO: 530743

SEQ ID NO: 654262 - RNA, 62 nt, hsa; identical to SEQ ID NO: 530744

SEQ ID NO: 654263 - RNA, 64 nt, hsa; identical to SEQ ID NO: 530745

SEQ ID NO: 654264 - RNA, 64 nt, hsa; identical to SEQ ID NO: 530746

SEQ ID NO: 654265 - RNA, 64 nt, hsa; identical to SEQ ID NO: 530747

SEQ ID NO: 654266 - RNA, 64 nt, hsa; identical to SEQ ID NO: 530748

SEQ ID NO: 654267 - RNA, 64 nt, hsa; identical to SEQ ID NO: 530749

SEQ ID NO: 654268 - RNA, 64 nt, hsa; identical to SEQ ID NO: 530750

SEQ ID NO: 654269 - RNA, 64 nt, hsa; identical to SEQ ID NO: 530751

SEQ ID NO: 654270 - RNA, 64 nt, hsa; identical to SEQ ID NO: 530752

SEQ ID NO: 654271 - RNA, 64 nt, hsa; identical to SEQ ID NO: 530753

SEQ ID NO: 654272 - RNA, 64 nt, hsa; identical to SEQ ID NO: 530754

SEQ ID NO: 654273 - RNA, 64 nt, hsa; identical to SEQ ID NO: 530755

SEQ ID NO: 654274 - RNA, 64 nt, hsa; identical to SEQ ID NO: 530756

SEQ ID NO: 654275 - RNA, 64 nt, hsa; identical to SEQ ID NO: 530757

SEQ ID NO: 654276 - RNA, 64 nt, hsa; identical to SEQ ID NO: 530758

SEQ ID NO: 654277 - RNA, 64 nt, hsa; identical to SEQ ID NO: 530759

SEQ ID NO: 654278 - RNA, 64 nt, hsa; identical to SEQ ID NO: 530760

SEQ ID NO: 654279 - RNA, 64 nt, hsa; identical to SEQ ID NO: 530761

SEQ ID NO: 654280 - RNA, 64 nt, hsa; identical to SEQ ID NO: 530762

SEQ ID NO: 654281 - RNA, 64 nt, hsa; identical to SEQ ID NO: 530763

SEQ ID NO: 654282 - RNA, 64 nt, hsa; identical to SEQ ID NO: 530764

SEQ ID NO: 654283 - RNA, 64 nt, hsa; identical to SEQ ID NO: 530765

SEQ ID NO: 654284 - RNA, 64 nt, hsa; identical to SEQ ID NO: 530766

SEQ ID NO: 654285 - RNA, 64 nt, hsa; identical to SEQ ID NO: 530767

SEQ ID NO: 654286 - RNA, 64 nt, hsa; identical to SEQ ID NO: 530768

SEQ ID NO: 654287 - RNA, 64 nt, hsa; identical to SEQ ID NO: 530769

SEQ ID NO: 654288 - RNA, 64 nt, hsa; identical to SEQ ID NO: 530770

SEQ ID NO: 654289 - RNA, 64 nt, hsa; identical to SEQ ID NO: 530771

SEQ ID NO: 654290 - RNA, 64 nt, hsa; identical to SEQ ID NO: 530772

SEQ ID NO: 654291 - RNA, 64 nt, hsa; identical to SEQ ID NO: 530773

SEQ ID NO: 654292 - RNA, 64 nt, hsa; identical to SEQ ID NO: 530774

SEQ ID NO: 654293 - RNA, 64 nt, hsa; identical to SEQ ID NO: 530775

SEQ ID NO: 654294 - RNA, 64 nt, hsa; identical to SEQ ID NO: 530776

SEQ ID NO: 654295 - RNA, 64 nt, hsa; identical to SEQ ID NO: 530777

SEQ ID NO: 654296 - RNA, 64 nt, hsa; identical to SEQ ID NO: 530778

SEQ ID NO: 654297 - RNA, 64 nt, hsa; identical to SEQ ID NO: 530779

SEQ ID NO: 654298 - RNA, 64 nt, hsa; identical to SEQ ID NO: 530780

SEQ ID NO: 654299 - RNA, 64 nt, hsa; identical to SEQ ID NO: 530781

SEQ ID NO: 654300 - RNA, 64 nt, hsa; identical to SEQ ID NO: 530782

SEQ ID NO: 654301 - RNA, 64 nt, hsa; identical to SEQ ID NO: 530783

SEQ ID NO: 654302 - RNA, 64 nt, hsa; identical to SEQ ID NO: 530784

SEQ ID NO: 654303 - RNA, 64 nt, hsa; identical to SEQ ID NO: 530785

SEQ ID NO: 654304 - RNA, 64 nt, hsa; identical to SEQ ID NO: 530786

SEQ ID NO: 654305 - RNA, 64 nt, hsa; identical to SEQ ID NO: 530787

SEQ ID NO: 654306 - RNA, 64 nt, hsa; identical to SEQ ID NO: 530788

SEQ ID NO: 654307 - RNA, 64 nt, hsa; identical to SEQ ID NO: 530789

SEQ ID NO: 654308 - RNA, 64 nt, hsa; identical to SEQ ID NO: 530790

SEQ ID NO: 654309 - RNA, 64 nt, hsa; identical to SEQ ID NO: 530791

SEQ ID NO: 654310 - RNA, 64 nt, hsa; identical to SEQ ID NO: 530792

SEQ ID NO: 654311 - RNA, 64 nt, hsa; identical to SEQ ID NO: 530793

SEQ ID NO: 654312 - RNA, 64 nt, hsa; identical to SEQ ID NO: 530794

SEQ ID NO: 654313 - RNA, 64 nt, hsa; identical to SEQ ID NO: 530795

SEQ ID NO: 654314 - RNA, 64 nt, hsa; identical to SEQ ID NO: 530796

SEQ ID NO: 654315 - RNA, 64 nt, hsa; identical to SEQ ID NO: 530797

SEQ ID NO: 654316 - RNA, 64 nt, hsa; identical to SEQ ID NO: 530798

SEQ ID NO: 654317 - RNA, 64 nt, hsa; identical to SEQ ID NO: 530799

SEQ ID NO: 654318 - RNA, 64 nt, hsa; identical to SEQ ID NO: 530800

SEQ ID NO: 654319 - RNA, 64 nt, hsa; identical to SEQ ID NO: 530801

SEQ ID NO: 654320 - RNA, 64 nt, hsa; identical to SEQ ID NO: 530802

SEQ ID NO: 654321 - RNA, 64 nt, hsa; identical to SEQ ID NO: 530803

SEQ ID NO: 654322 - RNA, 64 nt, hsa; identical to SEQ ID NO: 530804

SEQ ID NO: 654323 - RNA, 64 nt, hsa; identical to SEQ ID NO: 530805

SEQ ID NO: 654324 - RNA, 64 nt, hsa; identical to SEQ ID NO: 530806

SEQ ID NO: 654325 - RNA, 64 nt, hsa; identical to SEQ ID NO: 530807

SEQ ID NO: 654326 - RNA, 64 nt, hsa; identical to SEQ ID NO: 530808

SEQ ID NO: 654327 - RNA, 64 nt, hsa; identical to SEQ ID NO: 530809

SEQ ID NO: 654328 - RNA, 64 nt, hsa; identical to SEQ ID NO: 530810

SEQ ID NO: 654329 - RNA, 64 nt, hsa; identical to SEQ ID NO: 530811

SEQ ID NO: 654330 - RNA, 64 nt, hsa; identical to SEQ ID NO: 530812

SEQ ID NO: 654331 - RNA, 64 nt, hsa; identical to SEQ ID NO: 530813

SEQ ID NO: 654332 - RNA, 64 nt, hsa; identical to SEQ ID NO: 530814

SEQ ID NO: 654333 - RNA, 64 nt, hsa; identical to SEQ ID NO: 530815

SEQ ID NO: 654334 - RNA, 64 nt, hsa; identical to SEQ ID NO: 530816

SEQ ID NO: 654335 - RNA, 64 nt, hsa; identical to SEQ ID NO: 530817

SEQ ID NO: 654336 - RNA, 64 nt, hsa; identical to SEQ ID NO: 530818

SEQ ID NO: 654337 - RNA, 64 nt, hsa; identical to SEQ ID NO: 530819

SEQ ID NO: 654338 - RNA, 64 nt, hsa; identical to SEQ ID NO: 530820

SEQ ID NO: 654339 - RNA, 64 nt, hsa; identical to SEQ ID NO: 530821

SEQ ID NO: 654340 - RNA, 64 nt, hsa; identical to SEQ ID NO: 530822

SEQ ID NO: 654341 - RNA, 64 nt, hsa; identical to SEQ ID NO: 530823

SEQ ID NO: 654342 - RNA, 64 nt, hsa; identical to SEQ ID NO: 530824

SEQ ID NO: 654343 - RNA, 64 nt, hsa; identical to SEQ ID NO: 530825

SEQ ID NO: 654344 - RNA, 64 nt, hsa; identical to SEQ ID NO: 530826

SEQ ID NO: 654345 - RNA, 64 nt, hsa; identical to SEQ ID NO: 530827

SEQ ID NO: 654346 - RNA, 64 nt, hsa; identical to SEQ ID NO: 530828

SEQ ID NO: 654347 - RNA, 64 nt, hsa; identical to SEQ ID NO: 530829

SEQ ID NO: 654348 - RNA, 64 nt, hsa; identical to SEQ ID NO: 530830

SEQ ID NO: 654349 - RNA, 64 nt, hsa; identical to SEQ ID NO: 530831

SEQ ID NO: 654350 - RNA, 64 nt, hsa; identical to SEQ ID NO: 530832

SEQ ID NO: 654351 - RNA, 64 nt, hsa; identical to SEQ ID NO: 530833

SEQ ID NO: 654352 - RNA, 64 nt, hsa; identical to SEQ ID NO: 530834

SEQ ID NO: 654353 - RNA, 64 nt, hsa; identical to SEQ ID NO: 530835

SEQ ID NO: 654354 - RNA, 64 nt, hsa; identical to SEQ ID NO: 530836

SEQ ID NO: 654355 - RNA, 64 nt, hsa; identical to SEQ ID NO: 530837

SEQ ID NO: 654356 - RNA, 64 nt, hsa; identical to SEQ ID NO: 530838

SEQ ID NO: 654357 - RNA, 64 nt, hsa; identical to SEQ ID NO: 530839

SEQ ID NO: 654358 - RNA, 64 nt, hsa; identical to SEQ ID NO: 530840

SEQ ID NO: 654359 - RNA, 64 nt, hsa; identical to SEQ ID NO: 530841

SEQ ID NO: 654360 - RNA, 64 nt, hsa; identical to SEQ ID NO: 530842

SEQ ID NO: 654361 - RNA, 64 nt, hsa; identical to SEQ ID NO: 530819

SEQ ID NO: 654362 - RNA, 64 nt, hsa; identical to SEQ ID NO: 530844

SEQ ID NO: 654363 - RNA, 64 nt, hsa; identical to SEQ ID NO: 530845

SEQ ID NO: 654364 - RNA, 64 nt, hsa
gaaauguuuuaaaauagaaguacaccuaauuguuauugguuaaaaaaaaagccauaugugaaug

SEQ ID NO: 654365 - RNA, 64 nt, hsa
uugugauuauccauuaaauccagugucugaugcuauugguuaguaaugaugucccagcauuuga

SEQ ID NO: 654366 - RNA, 64 nt, hsa
caaucugcuuaagauccugucauaguuuuagaucauugguuauccugauuugcaaagugaucaa

SEQ ID NO: 654367 - RNA, 64 nt, hsa
uauacugggcuggacauuccaguuuuagccaggcauugguuaaaagaguuagaugggaugaugc

SEQ ID NO: 654368 - RNA, 64 nt, hsa
gauuuuuuuaaaagauguaaacugugcuuaguuaauugguuauauuuuguucuguuuuuuuuuu

SEQ ID NO: 654369 - RNA, 64 nt, hsa
ugauaguggcugagaaauucagaugagaagacaaauugguuaugaauuuugaaauaucuauuau

SEQ ID NO: 654370 - RNA, 64 nt, hsa; identical to SEQ ID NO: 530346

SEQ ID NO: 654371 - RNA, 64 nt, hsa; identical to SEQ ID NO: 530347

SEQ ID NO: 654372 - RNA, 64 nt, hsa; identical to SEQ ID NO: 530348

SEQ ID NO: 654373 - RNA, 64 nt, hsa; identical to SEQ ID NO: 530349

SEQ ID NO: 654374 - RNA, 64 nt, hsa; identical to SEQ ID NO: 530350

SEQ ID NO: 654375 - RNA, 64 nt, hsa; identical to SEQ ID NO: 530351

SEQ ID NO: 654376 - RNA, 64 nt, hsa; identical to SEQ ID NO: 530352

SEQ ID NO: 654377 - RNA, 64 nt, hsa; identical to SEQ ID NO: 530353

SEQ ID NO: 654378 - RNA, 64 nt, hsa; identical to SEQ ID NO: 530354

SEQ ID NO: 654379 - RNA, 64 nt, hsa; identical to SEQ ID NO: 530355

SEQ ID NO: 654380 - RNA, 64 nt, hsa; identical to SEQ ID NO: 530356

SEQ ID NO: 654381 - RNA, 64 nt, hsa; identical to SEQ ID NO: 530357

SEQ ID NO: 654382 - RNA, 64 nt, hsa; identical to SEQ ID NO: 530358

SEQ ID NO: 654383 - RNA, 64 nt, hsa; identical to SEQ ID NO: 530359

SEQ ID NO: 654384 - RNA, 64 nt, hsa; identical to SEQ ID NO: 530360

SEQ ID NO: 654385 - RNA, 64 nt, hsa; identical to SEQ ID NO: 530361

SEQ ID NO: 654386 - RNA, 64 nt, hsa; identical to SEQ ID NO: 530362

SEQ ID NO: 654387 - RNA, 64 nt, hsa; identical to SEQ ID NO: 530363

SEQ ID NO: 654388 - RNA, 64 nt, hsa; identical to SEQ ID NO: 530364

SEQ ID NO: 654389 - RNA, 64 nt, hsa; identical to SEQ ID NO: 530365

SEQ ID NO: 654390 - RNA, 64 nt, hsa; identical to SEQ ID NO: 530366

SEQ ID NO: 654391 - RNA, 64 nt, hsa; identical to SEQ ID NO: 530367

SEQ ID NO: 654392 - RNA, 64 nt, hsa; identical to SEQ ID NO: 530368

SEQ ID NO: 654393 - RNA, 64 nt, hsa; identical to SEQ ID NO: 530369

SEQ ID NO: 654394 - RNA, 64 nt, hsa; identical to SEQ ID NO: 530370

SEQ ID NO: 654395 - RNA, 64 nt, hsa; identical to SEQ ID NO: 530371

SEQ ID NO: 654396 - RNA, 64 nt, hsa; identical to SEQ ID NO: 530372

SEQ ID NO: 654397 - RNA, 64 nt, hsa; identical to SEQ ID NO: 530373

SEQ ID NO: 654398 - RNA, 64 nt, hsa; identical to SEQ ID NO: 530374

SEQ ID NO: 654399 - RNA, 64 nt, hsa; identical to SEQ ID NO: 530375

SEQ ID NO: 654400 - RNA, 64 nt, hsa; identical to SEQ ID NO: 530376

SEQ ID NO: 654401 - RNA, 60 nt, hsa; identical to SEQ ID NO: 530377

SEQ ID NO: 654402 - RNA, 64 nt, hsa; identical to SEQ ID NO: 530378

SEQ ID NO: 654403 - RNA, 64 nt, hsa; identical to SEQ ID NO: 530379

SEQ ID NO: 654404 - RNA, 64 nt, hsa; identical to SEQ ID NO: 530380

SEQ ID NO: 654405 - RNA, 64 nt, hsa; identical to SEQ ID NO: 530381

SEQ ID NO: 654406 - RNA, 64 nt, hsa; identical to SEQ ID NO: 530382

SEQ ID NO: 654407 - RNA, 64 nt, hsa; identical to SEQ ID NO: 530383

SEQ ID NO: 654408 - RNA, 64 nt, hsa; identical to SEQ ID NO: 530384

SEQ ID NO: 654409 - RNA, 64 nt, hsa; identical to SEQ ID NO: 530385

SEQ ID NO: 654410 - RNA, 64 nt, hsa; identical to SEQ ID NO: 530386

SEQ ID NO: 654411 - RNA, 64 nt, hsa; identical to SEQ ID NO: 530387

SEQ ID NO: 654412 - RNA, 64 nt, hsa; identical to SEQ ID NO: 530388

SEQ ID NO: 654413 - RNA, 64 nt, hsa; identical to SEQ ID NO: 530389

SEQ ID NO: 654414 - RNA, 64 nt, hsa; identical to SEQ ID NO: 530390

SEQ ID NO: 654415 - RNA, 64 nt, hsa; identical to SEQ ID NO: 530391

SEQ ID NO: 654416 - RNA, 64 nt, hsa; identical to SEQ ID NO: 530392

SEQ ID NO: 654417 - RNA, 64 nt, hsa; identical to SEQ ID NO: 530393

SEQ ID NO: 654418 - RNA, 64 nt, hsa; identical to SEQ ID NO: 530394

SEQ ID NO: 654419 - RNA, 64 nt, hsa; identical to SEQ ID NO: 530395

SEQ ID NO: 654420 - RNA, 64 nt, hsa; identical to SEQ ID NO: 530396

SEQ ID NO: 654421 - RNA, 64 nt, hsa; identical to SEQ ID NO: 530397

SEQ ID NO: 654422 - RNA, 64 nt, hsa; identical to SEQ ID NO: 530398

SEQ ID NO: 654423 - RNA, 64 nt, hsa; identical to SEQ ID NO: 530399

SEQ ID NO: 654424 - RNA, 64 nt, hsa; identical to SEQ ID NO: 530400

SEQ ID NO: 654425 - RNA, 64 nt, hsa; identical to SEQ ID NO: 530401

SEQ ID NO: 654426 - RNA, 64 nt, hsa; identical to SEQ ID NO: 530402

SEQ ID NO: 654427 - RNA, 64 nt, hsa; identical to SEQ ID NO: 530403

SEQ ID NO: 654428 - RNA, 64 nt, hsa; identical to SEQ ID NO: 530404

SEQ ID NO: 654429 - RNA, 64 nt, hsa; identical to SEQ ID NO: 530405

SEQ ID NO: 654430 - RNA, 64 nt, hsa; identical to SEQ ID NO: 530406

SEQ ID NO: 654431 - RNA, 64 nt, hsa; identical to SEQ ID NO: 530407

SEQ ID NO: 654432 - RNA, 64 nt, hsa; identical to SEQ ID NO: 530408

SEQ ID NO: 654433 - RNA, 64 nt, hsa; identical to SEQ ID NO: 530409

SEQ ID NO: 654434 - RNA, 64 nt, hsa; identical to SEQ ID NO: 530410

SEQ ID NO: 654435 - RNA, 64 nt, hsa; identical to SEQ ID NO: 530411

SEQ ID NO: 654436 - RNA, 64 nt, hsa; identical to SEQ ID NO: 530412

SEQ ID NO: 654437 - RNA, 64 nt, hsa; identical to SEQ ID NO: 530413

SEQ ID NO: 654438 - RNA, 64 nt, hsa; identical to SEQ ID NO: 530414

SEQ ID NO: 654439 - RNA, 64 nt, hsa; identical to SEQ ID NO: 530415

SEQ ID NO: 654440 - RNA, 64 nt, hsa; identical to SEQ ID NO: 530416

SEQ ID NO: 654441 - RNA, 64 nt, hsa; identical to SEQ ID NO: 530417

SEQ ID NO: 654442 - RNA, 64 nt, hsa; identical to SEQ ID NO: 530418

SEQ ID NO: 654443 - RNA, 64 nt, hsa; identical to SEQ ID NO: 530419

SEQ ID NO: 654444 - RNA, 64 nt, hsa; identical to SEQ ID NO: 530420

SEQ ID NO: 654445 - RNA, 64 nt, hsa; identical to SEQ ID NO: 530421

SEQ ID NO: 654446 - RNA, 64 nt, hsa; identical to SEQ ID NO: 530422

SEQ ID NO: 654447 - RNA, 64 nt, hsa; identical to SEQ ID NO: 530423

SEQ ID NO: 654448 - RNA, 64 nt, hsa; identical to SEQ ID NO: 530424

SEQ ID NO: 654449 - RNA, 64 nt, hsa; identical to SEQ ID NO: 530425

SEQ ID NO: 654450 - RNA, 64 nt, hsa; identical to SEQ ID NO: 530426

SEQ ID NO: 654451 - RNA, 64 nt, hsa; identical to SEQ ID NO: 530427

SEQ ID NO: 654452 - RNA, 64 nt, hsa; identical to SEQ ID NO: 530428

SEQ ID NO: 654453 - RNA, 64 nt, hsa; identical to SEQ ID NO: 530429

SEQ ID NO: 654454 - RNA, 64 nt, hsa; identical to SEQ ID NO: 530430

SEQ ID NO: 654455 - RNA, 64 nt, hsa; identical to SEQ ID NO: 530431

SEQ ID NO: 654456 - RNA, 64 nt, hsa; identical to SEQ ID NO: 530432

SEQ ID NO: 654457 - RNA, 64 nt, hsa; identical to SEQ ID NO: 530433

SEQ ID NO: 654458 - RNA, 64 nt, hsa; identical to SEQ ID NO: 530434

SEQ ID NO: 654459 - RNA, 64 nt, hsa; identical to SEQ ID NO: 530435

SEQ ID NO: 654460 - RNA, 64 nt, hsa; identical to SEQ ID NO: 530436

SEQ ID NO: 654461 - RNA, 64 nt, hsa; identical to SEQ ID NO: 530437

SEQ ID NO: 654462 - RNA, 51 nt, hsa; identical to SEQ ID NO: 530438

SEQ ID NO: 654463 - RNA, 59 nt, hsa; identical to SEQ ID NO: 530439

SEQ ID NO: 654464 - RNA, 64 nt, hsa; identical to SEQ ID NO: 530440

SEQ ID NO: 654465 - RNA, 64 nt, hsa; identical to SEQ ID NO: 530441

SEQ ID NO: 654466 - RNA, 64 nt, hsa; identical to SEQ ID NO: 530442

SEQ ID NO: 654467 - RNA, 64 nt, hsa; identical to SEQ ID NO: 530443

SEQ ID NO: 654468 - RNA, 64 nt, hsa; identical to SEQ ID NO: 530444

SEQ ID NO: 654469 - RNA, 64 nt, hsa; identical to SEQ ID NO: 530445

SEQ ID NO: 654470 - RNA, 64 nt, hsa; identical to SEQ ID NO: 530446

SEQ ID NO: 654471 - RNA, 64 nt, hsa; identical to SEQ ID NO: 530447

SEQ ID NO: 654472 - RNA, 64 nt, hsa; identical to SEQ ID NO: 530448

SEQ ID NO: 654473 - RNA, 64 nt, hsa; identical to SEQ ID NO: 530449

SEQ ID NO: 654474 - RNA, 64 nt, hsa; identical to SEQ ID NO: 530450

SEQ ID NO: 654475 - RNA, 64 nt, hsa; identical to SEQ ID NO: 530451

SEQ ID NO: 654476 - RNA, 64 nt, hsa; identical to SEQ ID NO: 530452

SEQ ID NO: 654477 - RNA, 64 nt, hsa; identical to SEQ ID NO: 530453

SEQ ID NO: 654478 - RNA, 64 nt, hsa; identical to SEQ ID NO: 530454

SEQ ID NO: 654479 - RNA, 64 nt, hsa; identical to SEQ ID NO: 530455

SEQ ID NO: 654480 - RNA, 64 nt, hsa; identical to SEQ ID NO: 530456

SEQ ID NO: 654481 - RNA, 64 nt, hsa; identical to SEQ ID NO: 530457

SEQ ID NO: 654482 - RNA, 64 nt, hsa; identical to SEQ ID NO: 530458

SEQ ID NO: 654483 - RNA, 64 nt, hsa; identical to SEQ ID NO: 530459

SEQ ID NO: 654484 - RNA, 64 nt, hsa; identical to SEQ ID NO: 530460

SEQ ID NO: 654485 - RNA, 64 nt, hsa; identical to SEQ ID NO: 530461

SEQ ID NO: 654486 - RNA, 64 nt, hsa; identical to SEQ ID NO: 530462

SEQ ID NO: 654487 - RNA, 64 nt, hsa; identical to SEQ ID NO: 530463

SEQ ID NO: 654488 - RNA, 64 nt, hsa; identical to SEQ ID NO: 530464

SEQ ID NO: 654489 - RNA, 64 nt, hsa; identical to SEQ ID NO: 530465

SEQ ID NO: 654490 - RNA, 64 nt, hsa; identical to SEQ ID NO: 530466

SEQ ID NO: 654491 - RNA, 64 nt, hsa; identical to SEQ ID NO: 530467

SEQ ID NO: 654492 - RNA, 64 nt, hsa; identical to SEQ ID NO: 530468

SEQ ID NO: 654493 - RNA, 64 nt, hsa; identical to SEQ ID NO: 530469

SEQ ID NO: 654494 - RNA, 64 nt, hsa; identical to SEQ ID NO: 530470

SEQ ID NO: 654495 - RNA, 64 nt, hsa; identical to SEQ ID NO: 530471

SEQ ID NO: 654496 - RNA, 64 nt, hsa; identical to SEQ ID NO: 530472

SEQ ID NO: 654497 - RNA, 64 nt, hsa; identical to SEQ ID NO: 530473

SEQ ID NO: 654498 - RNA, 64 nt, hsa; identical to SEQ ID NO: 530474

SEQ ID NO: 654499 - RNA, 64 nt, hsa; identical to SEQ ID NO: 530475

SEQ ID NO: 654500 - RNA, 64 nt, hsa; identical to SEQ ID NO: 530476

SEQ ID NO: 654501 - RNA, 64 nt, hsa; identical to SEQ ID NO: 530477

SEQ ID NO: 654502 - RNA, 64 nt, hsa; identical to SEQ ID NO: 530478

SEQ ID NO: 654503 - RNA, 64 nt, hsa; identical to SEQ ID NO: 530479

SEQ ID NO: 654504 - RNA, 64 nt, hsa; identical to SEQ ID NO: 530480

SEQ ID NO: 654505 - RNA, 64 nt, hsa; identical to SEQ ID NO: 530481

SEQ ID NO: 654506 - RNA, 64 nt, hsa; identical to SEQ ID NO: 530482

SEQ ID NO: 654507 - RNA, 64 nt, hsa; identical to SEQ ID NO: 530483

SEQ ID NO: 654508 - RNA, 64 nt, hsa; identical to SEQ ID NO: 530484

SEQ ID NO: 654509 - RNA, 64 nt, hsa; identical to SEQ ID NO: 530485

SEQ ID NO: 654510 - RNA, 64 nt, hsa; identical to SEQ ID NO: 530486

SEQ ID NO: 654511 - RNA, 64 nt, hsa; identical to SEQ ID NO: 530487

SEQ ID NO: 654512 - RNA, 64 nt, hsa; identical to SEQ ID NO: 530488

SEQ ID NO: 654513 - RNA, 64 nt, hsa; identical to SEQ ID NO: 530489

SEQ ID NO: 654514 - RNA, 64 nt, hsa; identical to SEQ ID NO: 530490

SEQ ID NO: 654515 - RNA, 64 nt, hsa; identical to SEQ ID NO: 530491

SEQ ID NO: 654516 - RNA, 64 nt, hsa; identical to SEQ ID NO: 530492

SEQ ID NO: 654517 - RNA, 64 nt, hsa; identical to SEQ ID NO: 530493

SEQ ID NO: 654518 - RNA, 64 nt, hsa; identical to SEQ ID NO: 530494

SEQ ID NO: 654519 - RNA, 64 nt, hsa; identical to SEQ ID NO: 530495

SEQ ID NO: 654520 - RNA, 64 nt, hsa; identical to SEQ ID NO: 530496

SEQ ID NO: 654521 - RNA, 64 nt, hsa; identical to SEQ ID NO: 530497

SEQ ID NO: 654522 - RNA, 64 nt, hsa; identical to SEQ ID NO: 530498

SEQ ID NO: 654523 - RNA, 64 nt, hsa; identical to SEQ ID NO: 530499

SEQ ID NO: 654524 - RNA, 64 nt, hsa; identical to SEQ ID NO: 530500

SEQ ID NO: 654525 - RNA, 64 nt, hsa; identical to SEQ ID NO: 530501

SEQ ID NO: 654526 - RNA, 64 nt, hsa; identical to SEQ ID NO: 530502

SEQ ID NO: 654527 - RNA, 64 nt, hsa; identical to SEQ ID NO: 530503

SEQ ID NO: 654528 - RNA, 64 nt, hsa; identical to SEQ ID NO: 530504

SEQ ID NO: 654529 - RNA, 64 nt, hsa; identical to SEQ ID NO: 530505

SEQ ID NO: 654530 - RNA, 64 nt, hsa; identical to SEQ ID NO: 530506

SEQ ID NO: 654531 - RNA, 64 nt, hsa; identical to SEQ ID NO: 530507

SEQ ID NO: 654532 - RNA, 64 nt, hsa; identical to SEQ ID NO: 530508

SEQ ID NO: 654533 - RNA, 64 nt, hsa; identical to SEQ ID NO: 530509

SEQ ID NO: 654534 - RNA, 64 nt, hsa; identical to SEQ ID NO: 530510

SEQ ID NO: 654535 - RNA, 64 nt, hsa; identical to SEQ ID NO: 530511

SEQ ID NO: 654536 - RNA, 64 nt, hsa; identical to SEQ ID NO: 530512

SEQ ID NO: 654537 - RNA, 64 nt, hsa; identical to SEQ ID NO: 530513

SEQ ID NO: 654538 - RNA, 64 nt, hsa; identical to SEQ ID NO: 530514

SEQ ID NO: 654539 - RNA, 64 nt, hsa; identical to SEQ ID NO: 530515

SEQ ID NO: 654540 - RNA, 64 nt, hsa; identical to SEQ ID NO: 530516

SEQ ID NO: 654541 - RNA, 64 nt, hsa; identical to SEQ ID NO: 530517

SEQ ID NO: 654542 - RNA, 64 nt, hsa; identical to SEQ ID NO: 530518

SEQ ID NO: 654543 - RNA, 64 nt, hsa; identical to SEQ ID NO: 530519

SEQ ID NO: 654544 - RNA, 64 nt, hsa; identical to SEQ ID NO: 530520

SEQ ID NO: 654545 - RNA, 64 nt, hsa; identical to SEQ ID NO: 530521

SEQ ID NO: 654546 - RNA, 64 nt, hsa; identical to SEQ ID NO: 530522

SEQ ID NO: 654547 - RNA, 64 nt, hsa; identical to SEQ ID NO: 530523

SEQ ID NO: 654548 - RNA, 64 nt, hsa; identical to SEQ ID NO: 530524

SEQ ID NO: 654549 - RNA, 64 nt, hsa; identical to SEQ ID NO: 530525

SEQ ID NO: 654550 - RNA, 64 nt, hsa; identical to SEQ ID NO: 530526

SEQ ID NO: 654551 - RNA, 64 nt, hsa; identical to SEQ ID NO: 530527

SEQ ID NO: 654552 - RNA, 64 nt, hsa; identical to SEQ ID NO: 530528

SEQ ID NO: 654553 - RNA, 64 nt, hsa; identical to SEQ ID NO: 530529

SEQ ID NO: 654554 - RNA, 64 nt, hsa; identical to SEQ ID NO: 530530

SEQ ID NO: 654555 - RNA, 64 nt, hsa; identical to SEQ ID NO: 530531

SEQ ID NO: 654556 - RNA, 64 nt, hsa; identical to SEQ ID NO: 530532

SEQ ID NO: 654557 - RNA, 64 nt, hsa; identical to SEQ ID NO: 530533

SEQ ID NO: 654558 - RNA, 64 nt, hsa; identical to SEQ ID NO: 530534

SEQ ID NO: 654559 - RNA, 64 nt, hsa; identical to SEQ ID NO: 530535

SEQ ID NO: 654560 - RNA, 64 nt, hsa; identical to SEQ ID NO: 530536

SEQ ID NO: 654561 - RNA, 64 nt, hsa; identical to SEQ ID NO: 530537

SEQ ID NO: 654562 - RNA, 64 nt, hsa; identical to SEQ ID NO: 530538

SEQ ID NO: 654563 - RNA, 64 nt, hsa; identical to SEQ ID NO: 530539

SEQ ID NO: 654564 - RNA, 64 nt, hsa; identical to SEQ ID NO: 530540

SEQ ID NO: 654565 - RNA, 64 nt, hsa; identical to SEQ ID NO: 530541

SEQ ID NO: 654566 - RNA, 64 nt, hsa; identical to SEQ ID NO: 530542

SEQ ID NO: 654567 - RNA, 64 nt, hsa; identical to SEQ ID NO: 530543

SEQ ID NO: 654568 - RNA, 64 nt, hsa; identical to SEQ ID NO: 530544

SEQ ID NO: 654569 - RNA, 64 nt, hsa; identical to SEQ ID NO: 530545

SEQ ID NO: 654570 - RNA, 64 nt, hsa; identical to SEQ ID NO: 530546

SEQ ID NO: 654571 - RNA, 64 nt, hsa; identical to SEQ ID NO: 530547

SEQ ID NO: 654572 - RNA, 64 nt, hsa; identical to SEQ ID NO: 530548

SEQ ID NO: 654573 - RNA, 64 nt, hsa; identical to SEQ ID NO: 530549

SEQ ID NO: 654574 - RNA, 64 nt, hsa; identical to SEQ ID NO: 530550

SEQ ID NO: 654575 - RNA, 64 nt, hsa; identical to SEQ ID NO: 530551

SEQ ID NO: 654576 - RNA, 64 nt, hsa; identical to SEQ ID NO: 530552

SEQ ID NO: 654577 - RNA, 64 nt, hsa; identical to SEQ ID NO: 530553

SEQ ID NO: 654578 - RNA, 64 nt, hsa; identical to SEQ ID NO: 530554

SEQ ID NO: 654579 - RNA, 64 nt, hsa; identical to SEQ ID NO: 530555

SEQ ID NO: 654580 - RNA, 64 nt, hsa; identical to SEQ ID NO: 530556

SEQ ID NO: 654581 - RNA, 64 nt, hsa; identical to SEQ ID NO: 530557

SEQ ID NO: 654582 - RNA, 64 nt, hsa; identical to SEQ ID NO: 530558

SEQ ID NO: 654583 - RNA, 64 nt, hsa; identical to SEQ ID NO: 530559

SEQ ID NO: 654584 - RNA, 64 nt, hsa; identical to SEQ ID NO: 530560

SEQ ID NO: 654585 - RNA, 64 nt, hsa; identical to SEQ ID NO: 530561

SEQ ID NO: 654586 - RNA, 62 nt, hsa; identical to SEQ ID NO: 530562

SEQ ID NO: 654587 - RNA, 64 nt, hsa; identical to SEQ ID NO: 530563

SEQ ID NO: 654588 - RNA, 64 nt, hsa; identical to SEQ ID NO: 530564

SEQ ID NO: 654589 - RNA, 64 nt, hsa; identical to SEQ ID NO: 530565

SEQ ID NO: 654590 - RNA, 64 nt, hsa; identical to SEQ ID NO: 530566

SEQ ID NO: 654591 - RNA, 64 nt, hsa; identical to SEQ ID NO: 530567

SEQ ID NO: 654592 - RNA, 64 nt, hsa; identical to SEQ ID NO: 530568

SEQ ID NO: 654593 - RNA, 64 nt, hsa; identical to SEQ ID NO: 530569

SEQ ID NO: 654594 - RNA, 64 nt, hsa; identical to SEQ ID NO: 530570

SEQ ID NO: 654595 - RNA, 64 nt, hsa; identical to SEQ ID NO: 530571

SEQ ID NO: 654596 - RNA, 64 nt, hsa; identical to SEQ ID NO: 530572

SEQ ID NO: 654597 - RNA, 64 nt, hsa; identical to SEQ ID NO: 530573

SEQ ID NO: 654598 - RNA, 64 nt, hsa; identical to SEQ ID NO: 530574

SEQ ID NO: 654599 - RNA, 64 nt, hsa; identical to SEQ ID NO: 530575

SEQ ID NO: 654600 - RNA, 64 nt, hsa; identical to SEQ ID NO: 530576

SEQ ID NO: 654601 - RNA, 64 nt, hsa; identical to SEQ ID NO: 530577

SEQ ID NO: 654602 - RNA, 64 nt, hsa; identical to SEQ ID NO: 530578

SEQ ID NO: 654603 - RNA, 64 nt, hsa; identical to SEQ ID NO: 530579

SEQ ID NO: 654604 - RNA, 64 nt, hsa; identical to SEQ ID NO: 530580

SEQ ID NO: 654605 - RNA, 64 nt, hsa; identical to SEQ ID NO: 530581

SEQ ID NO: 654606 - RNA, 64 nt, hsa; identical to SEQ ID NO: 530582

SEQ ID NO: 654607 - RNA, 64 nt, hsa; identical to SEQ ID NO: 530583

SEQ ID NO: 654608 - RNA, 64 nt, hsa; identical to SEQ ID NO: 530584

SEQ ID NO: 654609 - RNA, 64 nt, hsa; identical to SEQ ID NO: 530585

SEQ ID NO: 654610 - RNA, 64 nt, hsa; identical to SEQ ID NO: 530586

SEQ ID NO: 654611 - RNA, 64 nt, hsa; identical to SEQ ID NO: 530587

SEQ ID NO: 654612 - RNA, 64 nt, hsa; identical to SEQ ID NO: 530588

SEQ ID NO: 654613 - RNA, 64 nt, hsa; identical to SEQ ID NO: 530589

SEQ ID NO: 654614 - RNA, 64 nt, hsa; identical to SEQ ID NO: 530590

SEQ ID NO: 654615 - RNA, 64 nt, hsa; identical to SEQ ID NO: 530591

SEQ ID NO: 654616 - RNA, 64 nt, hsa; identical to SEQ ID NO: 530592

SEQ ID NO: 654617 - RNA, 64 nt, hsa; identical to SEQ ID NO: 530593

SEQ ID NO: 654618 - RNA, 64 nt, hsa; identical to SEQ ID NO: 530594

SEQ ID NO: 654619 - RNA, 64 nt, hsa; identical to SEQ ID NO: 530595

SEQ ID NO: 654620 - RNA, 64 nt, hsa; identical to SEQ ID NO: 530596

SEQ ID NO: 654621 - RNA, 64 nt, hsa; identical to SEQ ID NO: 530597

SEQ ID NO: 654622 - RNA, 64 nt, hsa; identical to SEQ ID NO: 530598

SEQ ID NO: 654623 - RNA, 64 nt, hsa; identical to SEQ ID NO: 530599

SEQ ID NO: 654624 - RNA, 64 nt, hsa; identical to SEQ ID NO: 530600

SEQ ID NO: 654625 - RNA, 64 nt, hsa; identical to SEQ ID NO: 530601

SEQ ID NO: 654626 - RNA, 64 nt, hsa; identical to SEQ ID NO: 530602

SEQ ID NO: 654627 - RNA, 64 nt, hsa; identical to SEQ ID NO: 530603

SEQ ID NO: 654628 - RNA, 64 nt, hsa; identical to SEQ ID NO: 530604

SEQ ID NO: 654629 - RNA, 64 nt, hsa; identical to SEQ ID NO: 530605

SEQ ID NO: 654630 - RNA, 64 nt, hsa; identical to SEQ ID NO: 530606

SEQ ID NO: 654631 - RNA, 64 nt, hsa; identical to SEQ ID NO: 530607

SEQ ID NO: 654632 - RNA, 64 nt, hsa; identical to SEQ ID NO: 530608

SEQ ID NO: 654633 - RNA, 64 nt, hsa; identical to SEQ ID NO: 530609

SEQ ID NO: 654634 - RNA, 64 nt, hsa; identical to SEQ ID NO: 530610

SEQ ID NO: 654635 - RNA, 64 nt, hsa; identical to SEQ ID NO: 530611

SEQ ID NO: 654636 - RNA, 64 nt, hsa; identical to SEQ ID NO: 530612

SEQ ID NO: 654637 - RNA, 64 nt, hsa; identical to SEQ ID NO: 530613

SEQ ID NO: 654638 - RNA, 64 nt, hsa; identical to SEQ ID NO: 530614

SEQ ID NO: 654639 - RNA, 64 nt, hsa; identical to SEQ ID NO: 530615

SEQ ID NO: 654640 - RNA, 64 nt, hsa; identical to SEQ ID NO: 530616

SEQ ID NO: 654641 - RNA, 64 nt, hsa; identical to SEQ ID NO: 530617

SEQ ID NO: 654642 - RNA, 64 nt, hsa; identical to SEQ ID NO: 530618

SEQ ID NO: 654643 - RNA, 64 nt, hsa; identical to SEQ ID NO: 530619

SEQ ID NO: 654644 - RNA, 64 nt, hsa; identical to SEQ ID NO: 530620

SEQ ID NO: 654645 - RNA, 64 nt, hsa; identical to SEQ ID NO: 530621

SEQ ID NO: 654646 - RNA, 64 nt, hsa; identical to SEQ ID NO: 530622

SEQ ID NO: 654647 - RNA, 64 nt, hsa; identical to SEQ ID NO: 530623

SEQ ID NO: 654648 - RNA, 64 nt, hsa; identical to SEQ ID NO: 530624

SEQ ID NO: 654649 - RNA, 64 nt, hsa; identical to SEQ ID NO: 530625

SEQ ID NO: 654650 - RNA, 64 nt, hsa; identical to SEQ ID NO: 530626

SEQ ID NO: 654651 - RNA, 64 nt, hsa; identical to SEQ ID NO: 530627

SEQ ID NO: 654652 - RNA, 64 nt, hsa; identical to SEQ ID NO: 530628

SEQ ID NO: 654653 - RNA, 64 nt, hsa; identical to SEQ ID NO: 530629

SEQ ID NO: 654654 - RNA, 64 nt, hsa; identical to SEQ ID NO: 530630

SEQ ID NO: 654655 - RNA, 64 nt, hsa; identical to SEQ ID NO: 530631

SEQ ID NO: 654656 - RNA, 64 nt, hsa; identical to SEQ ID NO: 530632

SEQ ID NO: 654657 - RNA, 64 nt, hsa; identical to SEQ ID NO: 530633

SEQ ID NO: 654658 - RNA, 64 nt, hsa; identical to SEQ ID NO: 530634

SEQ ID NO: 654659 - RNA, 64 nt, hsa; identical to SEQ ID NO: 530635

SEQ ID NO: 654660 - RNA, 64 nt, hsa; identical to SEQ ID NO: 530636

SEQ ID NO: 654661 - RNA, 64 nt, hsa; identical to SEQ ID NO: 530637

SEQ ID NO: 654662 - RNA, 64 nt, hsa; identical to SEQ ID NO: 530638

SEQ ID NO: 654663 - RNA, 64 nt, hsa; identical to SEQ ID NO: 530639

SEQ ID NO: 654664 - RNA, 64 nt, hsa; identical to SEQ ID NO: 530640

SEQ ID NO: 654665 - RNA, 64 nt, hsa; identical to SEQ ID NO: 530641

SEQ ID NO: 654666 - RNA, 64 nt, hsa; identical to SEQ ID NO: 530642

SEQ ID NO: 654667 - RNA, 64 nt, hsa; identical to SEQ ID NO: 530643

SEQ ID NO: 654668 - RNA, 64 nt, hsa; identical to SEQ ID NO: 530644

SEQ ID NO: 654669 - RNA, 64 nt, hsa; identical to SEQ ID NO: 530645

SEQ ID NO: 654670 - RNA, 64 nt, hsa; identical to SEQ ID NO: 530646

SEQ ID NO: 654671 - RNA, 64 nt, hsa; identical to SEQ ID NO: 530647

SEQ ID NO: 654672 - RNA, 64 nt, hsa; identical to SEQ ID NO: 530648

SEQ ID NO: 654673 - RNA, 64 nt, hsa; identical to SEQ ID NO: 530649

SEQ ID NO: 654674 - RNA, 64 nt, hsa; identical to SEQ ID NO: 530650

SEQ ID NO: 654675 - RNA, 64 nt, hsa; identical to SEQ ID NO: 530651

SEQ ID NO: 654676 - RNA, 64 nt, hsa; identical to SEQ ID NO: 530652

SEQ ID NO: 654677 - RNA, 64 nt, hsa; identical to SEQ ID NO: 530653

SEQ ID NO: 654678 - RNA, 64 nt, hsa; identical to SEQ ID NO: 530654

SEQ ID NO: 654679 - RNA, 64 nt, hsa; identical to SEQ ID NO: 530655

SEQ ID NO: 654680 - RNA, 64 nt, hsa; identical to SEQ ID NO: 530656

SEQ ID NO: 654681 - RNA, 64 nt, hsa; identical to SEQ ID NO: 530657

SEQ ID NO: 654682 - RNA, 64 nt, hsa; identical to SEQ ID NO: 530658

SEQ ID NO: 654683 - RNA, 64 nt, hsa; identical to SEQ ID NO: 530659

SEQ ID NO: 654684 - RNA, 64 nt, hsa; identical to SEQ ID NO: 530660

SEQ ID NO: 654685 - RNA, 64 nt, hsa; identical to SEQ ID NO: 530661

SEQ ID NO: 654686 - RNA, 64 nt, hsa; identical to SEQ ID NO: 530662

SEQ ID NO: 654687 - RNA, 64 nt, hsa; identical to SEQ ID NO: 530663

SEQ ID NO: 654688 - RNA, 64 nt, hsa; identical to SEQ ID NO: 530664

SEQ ID NO: 654689 - RNA, 64 nt, hsa; identical to SEQ ID NO: 530665

SEQ ID NO: 654690 - RNA, 64 nt, hsa; identical to SEQ ID NO: 530666

SEQ ID NO: 654691 - RNA, 64 nt, hsa; identical to SEQ ID NO: 530667

SEQ ID NO: 654692 - RNA, 64 nt, hsa; identical to SEQ ID NO: 530668

SEQ ID NO: 654693 - RNA, 64 nt, hsa; identical to SEQ ID NO: 530669

SEQ ID NO: 654694 - RNA, 64 nt, hsa; identical to SEQ ID NO: 530670

SEQ ID NO: 654695 - RNA, 64 nt, hsa; identical to SEQ ID NO: 530671

SEQ ID NO: 654696 - RNA, 64 nt, hsa; identical to SEQ ID NO: 530672

SEQ ID NO: 654697 - RNA, 64 nt, hsa; identical to SEQ ID NO: 530673

SEQ ID NO: 654698 - RNA, 64 nt, hsa; identical to SEQ ID NO: 530674

SEQ ID NO: 654699 - RNA, 64 nt, hsa; identical to SEQ ID NO: 530675

SEQ ID NO: 654700 - RNA, 64 nt, hsa; identical to SEQ ID NO: 530676

SEQ ID NO: 654701 - RNA, 64 nt, hsa; identical to SEQ ID NO: 530677

SEQ ID NO: 654702 - RNA, 64 nt, hsa; identical to SEQ ID NO: 530678

SEQ ID NO: 654703 - RNA, 64 nt, hsa; identical to SEQ ID NO: 530679

SEQ ID NO: 654704 - RNA, 64 nt, hsa; identical to SEQ ID NO: 530680

SEQ ID NO: 654705 - RNA, 64 nt, hsa; identical to SEQ ID NO: 530681

SEQ ID NO: 654706 - RNA, 64 nt, hsa; identical to SEQ ID NO: 530682

SEQ ID NO: 654707 - RNA, 64 nt, hsa; identical to SEQ ID NO: 530683

SEQ ID NO: 654708 - RNA, 64 nt, hsa; identical to SEQ ID NO: 530684

SEQ ID NO: 654709 - RNA, 64 nt, hsa; identical to SEQ ID NO: 530685

SEQ ID NO: 654710 - RNA, 64 nt, hsa; identical to SEQ ID NO: 530686

SEQ ID NO: 654711 - RNA, 64 nt, hsa; identical to SEQ ID NO: 530687

SEQ ID NO: 654712 - RNA, 64 nt, hsa; identical to SEQ ID NO: 530688

SEQ ID NO: 654713 - RNA, 64 nt, hsa; identical to SEQ ID NO: 530689

SEQ ID NO: 654714 - RNA, 64 nt, hsa; identical to SEQ ID NO: 530690

SEQ ID NO: 654715 - RNA, 64 nt, hsa; identical to SEQ ID NO: 530691

SEQ ID NO: 654716 - RNA, 64 nt, hsa; identical to SEQ ID NO: 530692

SEQ ID NO: 654717 - RNA, 64 nt, hsa; identical to SEQ ID NO: 530693

SEQ ID NO: 654718 - RNA, 64 nt, hsa; identical to SEQ ID NO: 530694

SEQ ID NO: 654719 - RNA, 64 nt, hsa; identical to SEQ ID NO: 530695

SEQ ID NO: 654720 - RNA, 64 nt, hsa; identical to SEQ ID NO: 530696

SEQ ID NO: 654721 - RNA, 64 nt, hsa; identical to SEQ ID NO: 530697

SEQ ID NO: 654722 - RNA, 64 nt, hsa; identical to SEQ ID NO: 530698

SEQ ID NO: 654723 - RNA, 64 nt, hsa; identical to SEQ ID NO: 530699

SEQ ID NO: 654724 - RNA, 64 nt, hsa; identical to SEQ ID NO: 530700

SEQ ID NO: 654725 - RNA, 64 nt, hsa; identical to SEQ ID NO: 530701

SEQ ID NO: 654726 - RNA, 64 nt, hsa; identical to SEQ ID NO: 530702

SEQ ID NO: 654727 - RNA, 64 nt, hsa; identical to SEQ ID NO: 530703

SEQ ID NO: 654728 - RNA, 64 nt, hsa; identical to SEQ ID NO: 530704

SEQ ID NO: 654729 - RNA, 64 nt, hsa; identical to SEQ ID NO: 530705

SEQ ID NO: 654730 - RNA, 64 nt, hsa; identical to SEQ ID NO: 530706

SEQ ID NO: 654731 - RNA, 64 nt, hsa; identical to SEQ ID NO: 530707

SEQ ID NO: 654732 - RNA, 64 nt, hsa; identical to SEQ ID NO: 530708

SEQ ID NO: 654733 - RNA, 64 nt, hsa; identical to SEQ ID NO: 530709

SEQ ID NO: 654734 - RNA, 64 nt, hsa; identical to SEQ ID NO: 530710

SEQ ID NO: 654735 - RNA, 64 nt, hsa; identical to SEQ ID NO: 530711

SEQ ID NO: 654736 - RNA, 64 nt, hsa; identical to SEQ ID NO: 530712

SEQ ID NO: 654737 - RNA, 64 nt, hsa; identical to SEQ ID NO: 530713

SEQ ID NO: 654738 - RNA, 64 nt, hsa; identical to SEQ ID NO: 530714

SEQ ID NO: 654739 - RNA, 64 nt, hsa; identical to SEQ ID NO: 530715

SEQ ID NO: 654740 - RNA, 64 nt, hsa; identical to SEQ ID NO: 530716

SEQ ID NO: 654741 - RNA, 64 nt, hsa; identical to SEQ ID NO: 530717

SEQ ID NO: 654742 - RNA, 64 nt, hsa; identical to SEQ ID NO: 530718

SEQ ID NO: 654743 - RNA, 64 nt, hsa; identical to SEQ ID NO: 530719

SEQ ID NO: 654744 - RNA, 64 nt, hsa; identical to SEQ ID NO: 530720

SEQ ID NO: 654745 - RNA, 64 nt, hsa; identical to SEQ ID NO: 530721

SEQ ID NO: 654746 - RNA, 64 nt, hsa; identical to SEQ ID NO: 530722

SEQ ID NO: 654747 - RNA, 64 nt, hsa; identical to SEQ ID NO: 530723

SEQ ID NO: 654748 - RNA, 64 nt, hsa; identical to SEQ ID NO: 530724

SEQ ID NO: 654749 - RNA, 64 nt, hsa; identical to SEQ ID NO: 530725

SEQ ID NO: 654750 - RNA, 64 nt, hsa; identical to SEQ ID NO: 530726

SEQ ID NO: 654751 - RNA, 64 nt, hsa; identical to SEQ ID NO: 530727

SEQ ID NO: 654752 - RNA, 64 nt, hsa; identical to SEQ ID NO: 530728

SEQ ID NO: 654753 - RNA, 64 nt, hsa; identical to SEQ ID NO: 530729

SEQ ID NO: 654754 - RNA, 64 nt, hsa; identical to SEQ ID NO: 530718

SEQ ID NO: 654755 - RNA, 64 nt, hsa; identical to SEQ ID NO: 530717

SEQ ID NO: 654756 - RNA, 64 nt, hsa; identical to SEQ ID NO: 530720

SEQ ID NO: 654757 - RNA, 64 nt, hsa; identical to SEQ ID NO: 530719

SEQ ID NO: 654758 - RNA, 64 nt, hsa; identical to SEQ ID NO: 530734

SEQ ID NO: 654759 - RNA, 64 nt, hsa; identical to SEQ ID NO: 530735

SEQ ID NO: 654760 - RNA, 64 nt, hsa; identical to SEQ ID NO: 530736

SEQ ID NO: 654761 - RNA, 64 nt, hsa; identical to SEQ ID NO: 530737

SEQ ID NO: 654762 - RNA, 64 nt, hsa; identical to SEQ ID NO: 530738

SEQ ID NO: 654763 - RNA, 64 nt, hsa; identical to SEQ ID NO: 530739

SEQ ID NO: 654764 - RNA, 64 nt, hsa; identical to SEQ ID NO: 530740

SEQ ID NO: 654765 - RNA, 64 nt, hsa; identical to SEQ ID NO: 530741

SEQ ID NO: 654766 - RNA, 64 nt, hsa; identical to SEQ ID NO: 530742

SEQ ID NO: 654767 - RNA, 64 nt, hsa; identical to SEQ ID NO: 530743

SEQ ID NO: 654768 - RNA, 62 nt, hsa; identical to SEQ ID NO: 530744

SEQ ID NO: 654769 - RNA, 64 nt, hsa; identical to SEQ ID NO: 530745

SEQ ID NO: 654770 - RNA, 64 nt, hsa; identical to SEQ ID NO: 530746

SEQ ID NO: 654771 - RNA, 64 nt, hsa; identical to SEQ ID NO: 530747

SEQ ID NO: 654772 - RNA, 64 nt, hsa; identical to SEQ ID NO: 530748

SEQ ID NO: 654773 - RNA, 64 nt, hsa; identical to SEQ ID NO: 530749

SEQ ID NO: 654774 - RNA, 64 nt, hsa; identical to SEQ ID NO: 530750

SEQ ID NO: 654775 - RNA, 64 nt, hsa; identical to SEQ ID NO: 530751

SEQ ID NO: 654776 - RNA, 64 nt, hsa; identical to SEQ ID NO: 530752

SEQ ID NO: 654777 - RNA, 64 nt, hsa; identical to SEQ ID NO: 530753

SEQ ID NO: 654778 - RNA, 64 nt, hsa; identical to SEQ ID NO: 530754

SEQ ID NO: 654779 - RNA, 64 nt, hsa; identical to SEQ ID NO: 530755

SEQ ID NO: 654780 - RNA, 64 nt, hsa; identical to SEQ ID NO: 530756

SEQ ID NO: 654781 - RNA, 64 nt, hsa; identical to SEQ ID NO: 530757

SEQ ID NO: 654782 - RNA, 64 nt, hsa; identical to SEQ ID NO: 530758

SEQ ID NO: 654783 - RNA, 64 nt, hsa; identical to SEQ ID NO: 530759

SEQ ID NO: 654784 - RNA, 64 nt, hsa; identical to SEQ ID NO: 530760

SEQ ID NO: 654785 - RNA, 64 nt, hsa; identical to SEQ ID NO: 530761

SEQ ID NO: 654786 - RNA, 64 nt, hsa; identical to SEQ ID NO: 530762

SEQ ID NO: 654787 - RNA, 64 nt, hsa; identical to SEQ ID NO: 530763

SEQ ID NO: 654788 - RNA, 64 nt, hsa; identical to SEQ ID NO: 530764

SEQ ID NO: 654789 - RNA, 64 nt, hsa; identical to SEQ ID NO: 530765

SEQ ID NO: 654790 - RNA, 64 nt, hsa; identical to SEQ ID NO: 530766

SEQ ID NO: 654791 - RNA, 64 nt, hsa; identical to SEQ ID NO: 530767

SEQ ID NO: 654792 - RNA, 64 nt, hsa; identical to SEQ ID NO: 530768

SEQ ID NO: 654793 - RNA, 64 nt, hsa; identical to SEQ ID NO: 530769

SEQ ID NO: 654794 - RNA, 64 nt, hsa; identical to SEQ ID NO: 530770

SEQ ID NO: 654795 - RNA, 64 nt, hsa; identical to SEQ ID NO: 530771

SEQ ID NO: 654796 - RNA, 64 nt, hsa; identical to SEQ ID NO: 530772

SEQ ID NO: 654797 - RNA, 64 nt, hsa; identical to SEQ ID NO: 530773

SEQ ID NO: 654798 - RNA, 64 nt, hsa; identical to SEQ ID NO: 530774

SEQ ID NO: 654799 - RNA, 64 nt, hsa; identical to SEQ ID NO: 530775

SEQ ID NO: 654800 - RNA, 64 nt, hsa; identical to SEQ ID NO: 530776

SEQ ID NO: 654801 - RNA, 64 nt, hsa; identical to SEQ ID NO: 530777

SEQ ID NO: 654802 - RNA, 64 nt, hsa; identical to SEQ ID NO: 530778

SEQ ID NO: 654803 - RNA, 64 nt, hsa; identical to SEQ ID NO: 530779

SEQ ID NO: 654804 - RNA, 64 nt, hsa; identical to SEQ ID NO: 530780

SEQ ID NO: 654805 - RNA, 64 nt, hsa; identical to SEQ ID NO: 530781

SEQ ID NO: 654806 - RNA, 64 nt, hsa; identical to SEQ ID NO: 530782

SEQ ID NO: 654807 - RNA, 64 nt, hsa; identical to SEQ ID NO: 530783

SEQ ID NO: 654808 - RNA, 64 nt, hsa; identical to SEQ ID NO: 530784

SEQ ID NO: 654809 - RNA, 64 nt, hsa; identical to SEQ ID NO: 530785

SEQ ID NO: 654810 - RNA, 64 nt, hsa; identical to SEQ ID NO: 530786

SEQ ID NO: 654811 - RNA, 64 nt, hsa; identical to SEQ ID NO: 530787

SEQ ID NO: 654812 - RNA, 64 nt, hsa; identical to SEQ ID NO: 530788

SEQ ID NO: 654813 - RNA, 64 nt, hsa; identical to SEQ ID NO: 530789

SEQ ID NO: 654814 - RNA, 64 nt, hsa; identical to SEQ ID NO: 530790

SEQ ID NO: 654815 - RNA, 64 nt, hsa; identical to SEQ ID NO: 530791

SEQ ID NO: 654816 - RNA, 64 nt, hsa; identical to SEQ ID NO: 530792

SEQ ID NO: 654817 - RNA, 64 nt, hsa; identical to SEQ ID NO: 530793

SEQ ID NO: 654818 - RNA, 64 nt, hsa; identical to SEQ ID NO: 530794

SEQ ID NO: 654819 - RNA, 64 nt, hsa; identical to SEQ ID NO: 530795

SEQ ID NO: 654820 - RNA, 64 nt, hsa; identical to SEQ ID NO: 530796

SEQ ID NO: 654821 - RNA, 64 nt, hsa; identical to SEQ ID NO: 530797

SEQ ID NO: 654822 - RNA, 64 nt, hsa; identical to SEQ ID NO: 530798

SEQ ID NO: 654823 - RNA, 64 nt, hsa; identical to SEQ ID NO: 530799

SEQ ID NO: 654824 - RNA, 64 nt, hsa; identical to SEQ ID NO: 530800

SEQ ID NO: 654825 - RNA, 64 nt, hsa; identical to SEQ ID NO: 530801

SEQ ID NO: 654826 - RNA, 64 nt, hsa; identical to SEQ ID NO: 530802

SEQ ID NO: 654827 - RNA, 64 nt, hsa; identical to SEQ ID NO: 530803

SEQ ID NO: 654828 - RNA, 64 nt, hsa; identical to SEQ ID NO: 530804

SEQ ID NO: 654829 - RNA, 64 nt, hsa; identical to SEQ ID NO: 530805

SEQ ID NO: 654830 - RNA, 64 nt, hsa; identical to SEQ ID NO: 530806

SEQ ID NO: 654831 - RNA, 64 nt, hsa; identical to SEQ ID NO: 530807

SEQ ID NO: 654832 - RNA, 64 nt, hsa; identical to SEQ ID NO: 530808

SEQ ID NO: 654833 - RNA, 64 nt, hsa; identical to SEQ ID NO: 530809

SEQ ID NO: 654834 - RNA, 64 nt, hsa; identical to SEQ ID NO: 530810

SEQ ID NO: 654835 - RNA, 64 nt, hsa; identical to SEQ ID NO: 530811

SEQ ID NO: 654836 - RNA, 64 nt, hsa; identical to SEQ ID NO: 530812

SEQ ID NO: 654837 - RNA, 64 nt, hsa; identical to SEQ ID NO: 530813

SEQ ID NO: 654838 - RNA, 64 nt, hsa; identical to SEQ ID NO: 530814

SEQ ID NO: 654839 - RNA, 64 nt, hsa; identical to SEQ ID NO: 530815

SEQ ID NO: 654840 - RNA, 64 nt, hsa; identical to SEQ ID NO: 530816

SEQ ID NO: 654841 - RNA, 64 nt, hsa; identical to SEQ ID NO: 530817

SEQ ID NO: 654842 - RNA, 64 nt, hsa; identical to SEQ ID NO: 530818

SEQ ID NO: 654843 - RNA, 64 nt, hsa; identical to SEQ ID NO: 530819

SEQ ID NO: 654844 - RNA, 64 nt, hsa; identical to SEQ ID NO: 530820

SEQ ID NO: 654845 - RNA, 64 nt, hsa; identical to SEQ ID NO: 530821

SEQ ID NO: 654846 - RNA, 64 nt, hsa; identical to SEQ ID NO: 530822

SEQ ID NO: 654847 - RNA, 64 nt, hsa; identical to SEQ ID NO: 530823

SEQ ID NO: 654848 - RNA, 64 nt, hsa; identical to SEQ ID NO: 530824

SEQ ID NO: 654849 - RNA, 64 nt, hsa; identical to SEQ ID NO: 530825

SEQ ID NO: 654850 - RNA, 64 nt, hsa; identical to SEQ ID NO: 530826

SEQ ID NO: 654851 - RNA, 64 nt, hsa; identical to SEQ ID NO: 530827

SEQ ID NO: 654852 - RNA, 64 nt, hsa; identical to SEQ ID NO: 530828

SEQ ID NO: 654853 - RNA, 64 nt, hsa; identical to SEQ ID NO: 530829

SEQ ID NO: 654854 - RNA, 64 nt, hsa; identical to SEQ ID NO: 530830

SEQ ID NO: 654855 - RNA, 64 nt, hsa; identical to SEQ ID NO: 530831

SEQ ID NO: 654856 - RNA, 64 nt, hsa; identical to SEQ ID NO: 530832

SEQ ID NO: 654857 - RNA, 64 nt, hsa; identical to SEQ ID NO: 530833

SEQ ID NO: 654858 - RNA, 64 nt, hsa; identical to SEQ ID NO: 530834

SEQ ID NO: 654859 - RNA, 64 nt, hsa; identical to SEQ ID NO: 530835

SEQ ID NO: 654860 - RNA, 64 nt, hsa; identical to SEQ ID NO: 530836

SEQ ID NO: 654861 - RNA, 64 nt, hsa; identical to SEQ ID NO: 530837

SEQ ID NO: 654862 - RNA, 64 nt, hsa; identical to SEQ ID NO: 530838

SEQ ID NO: 654863 - RNA, 64 nt, hsa; identical to SEQ ID NO: 530839

SEQ ID NO: 654864 - RNA, 64 nt, hsa; identical to SEQ ID NO: 530840

SEQ ID NO: 654865 - RNA, 64 nt, hsa; identical to SEQ ID NO: 530841

SEQ ID NO: 654866 - RNA, 64 nt, hsa; identical to SEQ ID NO: 530842

SEQ ID NO: 654867 - RNA, 64 nt, hsa; identical to SEQ ID NO: 530819

SEQ ID NO: 654868 - RNA, 64 nt, hsa; identical to SEQ ID NO: 530844

SEQ ID NO: 654869 - RNA, 64 nt, hsa; identical to SEQ ID NO: 530845

SEQ ID NO: 654870 - RNA, 64 nt, hsa; identical to SEQ ID NO: 654364

SEQ ID NO: 654871 - RNA, 64 nt, hsa; identical to SEQ ID NO: 654365

SEQ ID NO: 654872 - RNA, 64 nt, hsa; identical to SEQ ID NO: 654366

SEQ ID NO: 654873 - RNA, 64 nt, hsa; identical to SEQ ID NO: 654367

SEQ ID NO: 654874 - RNA, 64 nt, hsa; identical to SEQ ID NO: 654368

SEQ ID NO: 654875 - RNA, 64 nt, hsa; identical to SEQ ID NO: 654369

SEQ ID NO: 654876 - RNA, 64 nt, hsa; identical to SEQ ID NO: 193370

SEQ ID NO: 654877 - RNA, 64 nt, hsa; identical to SEQ ID NO: 193371

SEQ ID NO: 654878 - RNA, 64 nt, hsa; identical to SEQ ID NO: 193372

SEQ ID NO: 654879 - RNA, 64 nt, hsa; identical to SEQ ID NO: 193373

SEQ ID NO: 654880 - RNA, 64 nt, hsa; identical to SEQ ID NO: 193374

SEQ ID NO: 654881 - RNA, 64 nt, hsa; identical to SEQ ID NO: 193375

SEQ ID NO: 654882 - RNA, 64 nt, hsa; identical to SEQ ID NO: 193376

SEQ ID NO: 654883 - RNA, 64 nt, hsa; identical to SEQ ID NO: 193377

SEQ ID NO: 654884 - RNA, 64 nt, hsa; identical to SEQ ID NO: 193378

SEQ ID NO: 654885 - RNA, 64 nt, hsa; identical to SEQ ID NO: 193379

SEQ ID NO: 654886 - RNA, 64 nt, hsa; identical to SEQ ID NO: 193380

SEQ ID NO: 654887 - RNA, 64 nt, hsa; identical to SEQ ID NO: 193381

SEQ ID NO: 654888 - RNA, 64 nt, hsa; identical to SEQ ID NO: 193382

SEQ ID NO: 654889 - RNA, 64 nt, hsa; identical to SEQ ID NO: 193383

SEQ ID NO: 654890 - RNA, 64 nt, hsa; identical to SEQ ID NO: 193384

SEQ ID NO: 654891 - RNA, 64 nt, hsa; identical to SEQ ID NO: 193385

SEQ ID NO: 654892 - RNA, 64 nt, hsa; identical to SEQ ID NO: 193386

SEQ ID NO: 654893 - RNA, 64 nt, hsa; identical to SEQ ID NO: 193387

SEQ ID NO: 654894 - RNA, 64 nt, hsa; identical to SEQ ID NO: 193388

SEQ ID NO: 654895 - RNA, 64 nt, hsa; identical to SEQ ID NO: 193389

SEQ ID NO: 654896 - RNA, 64 nt, hsa; identical to SEQ ID NO: 193390

SEQ ID NO: 654897 - RNA, 64 nt, hsa; identical to SEQ ID NO: 193391

SEQ ID NO: 654898 - RNA, 64 nt, hsa; identical to SEQ ID NO: 193392

SEQ ID NO: 654899 - RNA, 64 nt, hsa; identical to SEQ ID NO: 193393

SEQ ID NO: 654900 - RNA, 64 nt, hsa; identical to SEQ ID NO: 263253

SEQ ID NO: 654901 - RNA, 64 nt, hsa; identical to SEQ ID NO: 263254

SEQ ID NO: 654902 - RNA, 64 nt, hsa; identical to SEQ ID NO: 263255

SEQ ID NO: 654903 - RNA, 64 nt, hsa; identical to SEQ ID NO: 263256

SEQ ID NO: 654904 - RNA, 64 nt, hsa; identical to SEQ ID NO: 263257

SEQ ID NO: 654905 - RNA, 64 nt, hsa; identical to SEQ ID NO: 263258

SEQ ID NO: 654906 - RNA, 64 nt, hsa; identical to SEQ ID NO: 263259

SEQ ID NO: 654907 - RNA, 64 nt, hsa; identical to SEQ ID NO: 263260

SEQ ID NO: 654908 - RNA, 64 nt, hsa; identical to SEQ ID NO: 263261

SEQ ID NO: 654909 - RNA, 64 nt, hsa; identical to SEQ ID NO: 263262

SEQ ID NO: 654910 - RNA, 64 nt, hsa; identical to SEQ ID NO: 263263

SEQ ID NO: 654911 - RNA, 64 nt, hsa; identical to SEQ ID NO: 263264

SEQ ID NO: 654912 - RNA, 64 nt, hsa; identical to SEQ ID NO: 263265

SEQ ID NO: 654913 - RNA, 64 nt, hsa; identical to SEQ ID NO: 263266

SEQ ID NO: 654914 - RNA, 64 nt, hsa; identical to SEQ ID NO: 263267

SEQ ID NO: 654915 - RNA, 64 nt, hsa; identical to SEQ ID NO: 263268

SEQ ID NO: 654916 - RNA, 64 nt, hsa; identical to SEQ ID NO: 263269

SEQ ID NO: 654917 - RNA, 64 nt, hsa; identical to SEQ ID NO: 263270

SEQ ID NO: 654918 - RNA, 64 nt, hsa; identical to SEQ ID NO: 263271

SEQ ID NO: 654919 - RNA, 64 nt, hsa; identical to SEQ ID NO: 263272

SEQ ID NO: 654920 - RNA, 59 nt, hsa; identical to SEQ ID NO: 263273

SEQ ID NO: 654921 - RNA, 64 nt, hsa; identical to SEQ ID NO: 164108

SEQ ID NO: 654922 - RNA, 64 nt, hsa; identical to SEQ ID NO: 164109

SEQ ID NO: 654923 - RNA, 64 nt, hsa; identical to SEQ ID NO: 164110

SEQ ID NO: 654924 - RNA, 64 nt, hsa; identical to SEQ ID NO: 164111

SEQ ID NO: 654925 - RNA, 64 nt, hsa; identical to SEQ ID NO: 164112

SEQ ID NO: 654926 - RNA, 64 nt, hsa; identical to SEQ ID NO: 164113

SEQ ID NO: 654927 - RNA, 64 nt, hsa; identical to SEQ ID NO: 164114

SEQ ID NO: 654928 - RNA, 64 nt, hsa; identical to SEQ ID NO: 164115

SEQ ID NO: 654929 - RNA, 64 nt, hsa; identical to SEQ ID NO: 164116

SEQ ID NO: 654930 - RNA, 64 nt, hsa; identical to SEQ ID NO: 164117

SEQ ID NO: 654931 - RNA, 64 nt, hsa; identical to SEQ ID NO: 164118

SEQ ID NO: 654932 - RNA, 64 nt, hsa; identical to SEQ ID NO: 164119

SEQ ID NO: 654933 - RNA, 64 nt, hsa; identical to SEQ ID NO: 164120

SEQ ID NO: 654934 - RNA, 64 nt, hsa; identical to SEQ ID NO: 164121

SEQ ID NO: 654935 - RNA, 64 nt, hsa; identical to SEQ ID NO: 164122

SEQ ID NO: 654936 - RNA, 64 nt, hsa; identical to SEQ ID NO: 164123

SEQ ID NO: 654937 - RNA, 64 nt, hsa; identical to SEQ ID NO: 164124

SEQ ID NO: 654938 - RNA, 64 nt, hsa; identical to SEQ ID NO: 164125

SEQ ID NO: 654939 - RNA, 64 nt, hsa; identical to SEQ ID NO: 164126

SEQ ID NO: 654940 - RNA, 64 nt, hsa; identical to SEQ ID NO: 164127

SEQ ID NO: 654941 - RNA, 64 nt, hsa; identical to SEQ ID NO: 164128

SEQ ID NO: 654942 - RNA, 64 nt, hsa; identical to SEQ ID NO: 164129

SEQ ID NO: 654943 - RNA, 64 nt, hsa; identical to SEQ ID NO: 164130

SEQ ID NO: 654944 - RNA, 64 nt, hsa
gagagggaaaagcacaaugcaagaaccuaacuaacgugaugauaugaagaguuuucuuaagacc

SEQ ID NO: 654945 - RNA, 64 nt, hsa
gcagcccaagggcuccagacacaccugaacacaucgugaugaugacguccucucaacucucuuu

SEQ ID NO: 654946 - RNA, 64 nt, hsa
cuugaacucaggaguucgagacuagccugggcaacgugaugagacuccgucucuaccaaaaaau

SEQ ID NO: 654947 - RNA, 64 nt, hsa
aggauugaagaauucaccauuagaggacauuuagcgugaugaaauaaagcaucuacgucagcag

SEQ ID NO: 654948 - RNA, 64 nt, hsa
ccuguuucuaaggaaaugcaugugugcccugagccgugaugauccucccauccguguugugagc

SEQ ID NO: 654949 - RNA, 64 nt, hsa
ucuugcuaagugucacacacacucuucccaaagacgugaugaguuaaaguuguauucugaaauc

SEQ ID NO: 654950 - RNA, 64 nt, hsa
uauagauucuguagucuggugaaggugugggugacgugaugagagguuugagaaaugggugaaa

SEQ ID NO: 654951 - RNA, 64 nt, hsa
gacuggcuucccugugggacgcuuuugucugacacgugaugaugugguccugccugccacugug

SEQ ID NO: 654952 - RNA, 64 nt, hsa
uagaacucucccuacuagcuggaaacucuggugacgugaugaaugugggaagggcuuuggugga

SEQ ID NO: 654953 - RNA, 64 nt, hsa
gggcugcuauaacagaauaccacagacuggguaacgugaugaacaaaaauuuauuuggcucaca

SEQ ID NO: 654954 - RNA, 64 nt, hsa
ugugcugcugcugaccgacggggacgugcacauccgugaugacgggcgccgggccaccaucuca

SEQ ID NO: 654955 - RNA, 64 nt, hsa
auaaacaaauaugauguucuuugacguaaaucaacgugaugauucuuucacauguaaacacauu

SEQ ID NO: 654956 - RNA, 64 nt, hsa
aauuccuuaugagacucuugccuccuguggcuuacgugaugaauuguuaauauggcaguaauua

SEQ ID NO: 654957 - RNA, 64 nt, hsa
guucgaagcuccgugagugaaccaucauuauaaacgugaugaucagcuguuugucauagggcag

SEQ ID NO: 654958 - RNA, 64 nt, hsa
ccugucucuacuaaaaauacaaaaaguagccagccgugaugacaggcaccuguaaucccagcua

SEQ ID NO: 654959 - RNA, 64 nt, hsa
gcagauauucucuagucauuuguuaauauuucuucgugaugacauaucacaugucagccacugu

SEQ ID NO: 654960 - RNA, 64 nt, hsa
guaaaaguggaagagaggcagaucaggaugucagcgugaugaggugugagacagacuugacuug

SEQ ID NO: 654961 - RNA, 56 nt, hsa
auagcuuuggauuaaauuagagaucucgugaugacgcguuguuuucugccauuuau

SEQ ID NO: 654962 - RNA, 64 nt, hsa
uugacuuucccacuguugcuggagacaaagacaucgugaugagagaaaguucgcacaaucuagu

SEQ ID NO: 654963 - RNA, 64 nt, hsa
acccagcgcaccccucccccccuuuuuuuaaacgcgugaugaagacagaaggcuccggggugac

SEQ ID NO: 654964 - RNA, 64 nt, hsa
cuggcccuuucuuauucuuuggcuccucauccaccgugaugagaagcgcugcuguggccacggc

SEQ ID NO: 654965 - RNA, 64 nt, hsa
gcugugaauacuucucucagugugagagguuagccgugaugaaagcagcguuacuucugaccgu

SEQ ID NO: 654966 - RNA, 64 nt, hsa
auuaggcaccguauugcauaaaauagaaggcuuccgugaugaaaauaccagugaaaagauuuuu

SEQ ID NO: 654967 - RNA, 64 nt, hsa
uauuaauguaaaaaggggggggcucuacagcagucgugaugaaacuuaaauauauauucuuugu

SEQ ID NO: 654968 - RNA, 64 nt, hsa
agacagaaaaugaauuccgucgguauguuccaaucgugaugaauuugagaaacauugcaagagg

SEQ ID NO: 654969 - RNA, 64 nt, hsa
guugaauugcaccaucgugaaagaugggaaaaaucgugaugauggguaaggggaaaacuucccg

SEQ ID NO: 654970 - RNA, 64 nt, hsa
ggugacagagaugauggaugagcagcuggauuuucgugaugaaggacggaagcagcagcgggcc

SEQ ID NO: 654971 - RNA, 64 nt, hsa
ugugcggcggcuaccugagcugaccccugcugagcgugaugaucuagccuccaucaugaagaag

SEQ ID NO: 654972 - RNA, 55 nt, hsa
auacuaagaagaaugaauaaauuuacgugaugagcucuacaaggccaaaaauuuu

SEQ ID NO: 654973 - RNA, 64 nt, hsa
ggugcuuauuuuuucaaaaauuugcugugaacaacgugaugacaacaagcaacauuuaucuaau

SEQ ID NO: 654974 - RNA, 64 nt, hsa
gaugaccacuaauugauagaacguuucuuugugucgugaugaaaacuuucuaaauuucaguagu

SEQ ID NO: 654975 - RNA, 64 nt, hsa
gaugaccucuaacugauagaacguuacuuugugucgugaugaaaacuuucuaaauuucaguagu

SEQ ID NO: 654976 - RNA, 64 nt, hsa
ugugucauugaucagcaccauuugugguauguuccgugaugagcguuuagugagccugcuggcu

SEQ ID NO: 654977 - RNA, 58 nt, hsa
ucuaucagucucgggacugagagggaaccgugaugaagagacacuuucugccucauuu

SEQ ID NO: 654978 - RNA, 64 nt, hsa
ggcaccacacauuugccccauagauaacaauacacgugaugaugucacuaguacuaccuuucua

SEQ ID NO: 654979 - RNA, 64 nt, hsa
auccuuucuaaauugcaugaauaggcucugcuaacgugaugagacaaacugaaaauuauugcaa

SEQ ID NO: 654980 - RNA, 64 nt, hsa
cuccugagcgcccguucuuggucuaauccccagucgugaugauuccacacuuccucagccgcau

SEQ ID NO: 654981 - RNA, 62 nt, hsa
aagacuucgcgcauaucacuaauaaaccugaagucgugaugaaaagccgugugugugacugg

SEQ ID NO: 654982 - RNA, 64 nt, hsa
uuauugcuaauuggaaauuuucccaauaccccaccgugaugacuugaaauauaaucagcgcugg

SEQ ID NO: 654983 - RNA, 64 nt, hsa
caggcuccccuaaagaauagcaaaucaguguguucgugaugacugugcuaccuucauuauaguu

SEQ ID NO: 654984 - RNA, 64 nt, hsa
ggacucauuucaagcaguuugcuuuuguucaaaucgugaugagaaaccuaauacuguaauuuga

SEQ ID NO: 654985 - RNA, 64 nt, hsa
auugauaaauuagguauggaauccaucaguguuacgugaugagaauaggugaacacaccuuguc

SEQ ID NO: 654986 - RNA, 64 nt, hsa
caggcggcuugcugggggaugugagcgcucaggacgugaugagguacucgugguucuggagcuc

SEQ ID NO: 654987 - RNA, 64 nt, hsa
cugagaaaacgaaacugcucuaagcacacggagacgugaugaagggaggaggugaacuguuucc

SEQ ID NO: 654988 - RNA, 64 nt, hsa
ugugcagccccccugcccugguguccuggguuuucgugaugaucuuugcucuguuuccaguggg

SEQ ID NO: 654989 - RNA, 64 nt, hsa
uaaaagcauaauuuaauagcauugucuuaaaauacgugaugaguuauuuggugcacugaugcca

SEQ ID NO: 654990 - RNA, 64 nt, hsa
gcagggcgcgggggggaggcuggggucccgccgccgugaugaauguacugacgagccgaggcag

SEQ ID NO: 654991 - RNA, 64 nt, hsa
agaggcugauucuuguagaauuaacagcccucaacgugaugagcuaugauaacacuaugaauua

SEQ ID NO: 654992 - RNA, 64 nt, hsa
uuuuaagucucaaauggugugcccuucugaguagcgugaugaaaucucucgcuguccggcucca

SEQ ID NO: 654993 - RNA, 64 nt, hsa
auaagaugcaaaaucuuccaacuuuucaacccaacgugaugaauauuugauuuuguucuagauu

SEQ ID NO: 654994 - RNA, 64 nt, hsa
uguucucagugauucaacuuuaaaacaaauuucucgugaugauucauuucaaaauccugaguga

SEQ ID NO: 654995 - RNA, 64 nt, hsa
uaccccagcuccauccuugcaucacuggggaggacgugaugagugaggacuuggguccucgguc

SEQ ID NO: 654996 - RNA, 62 nt, hsa
acuccaaggcuggugagugaggagaugcuugccgugaugacgcugggcacagagggucaggu

SEQ ID NO: 654997 - RNA, 64 nt, hsa
ucucuacgcgcuuucuugucccacagggagccgccgugaugagcacagccaacccaguucccgg

SEQ ID NO: 654998 - RNA, 64 nt, hsa
aacaggauggcuuucuguagccacaccugugaggcgugaugauuguuguauuauuagauuacug

SEQ ID NO: 654999 - RNA, 64 nt, hsa
cugugcauucuagaccagccaauuggugggacagcgugaugaccggcaggguucaacagaccag

SEQ ID NO: 655000 - RNA, 64 nt, hsa
gaagcaccccaccacacacacccuuccccacucccgugaugaaacagcuagguuaauaggagga

SEQ ID NO: 655001 - RNA, 64 nt, hsa
caauugcuucaggcacagguggaauagaagaaaucgugaugaaauaauuucuggguagauccug

SEQ ID NO: 655002 - RNA, 64 nt, hsa; identical to SEQ ID NO: 382042

SEQ ID NO: 655003 - RNA, 64 nt, hsa; identical to SEQ ID NO: 382043

SEQ ID NO: 655004 - RNA, 64 nt, hsa; identical to SEQ ID NO: 382044

SEQ ID NO: 655005 - RNA, 64 nt, hsa; identical to SEQ ID NO: 382045

SEQ ID NO: 655006 - RNA, 64 nt, hsa; identical to SEQ ID NO: 382046

SEQ ID NO: 655007 - RNA, 64 nt, hsa; identical to SEQ ID NO: 382047

SEQ ID NO: 655008 - RNA, 64 nt, hsa; identical to SEQ ID NO: 382048

SEQ ID NO: 655009 - RNA, 64 nt, hsa; identical to SEQ ID NO: 382049

SEQ ID NO: 655010 - RNA, 64 nt, hsa; identical to SEQ ID NO: 382050

SEQ ID NO: 655011 - RNA, 64 nt, hsa; identical to SEQ ID NO: 382051

SEQ ID NO: 655012 - RNA, 64 nt, hsa; identical to SEQ ID NO: 382052

SEQ ID NO: 655013 - RNA, 64 nt, hsa; identical to SEQ ID NO: 382053

SEQ ID NO: 655014 - RNA, 64 nt, hsa; identical to SEQ ID NO: 382054

SEQ ID NO: 655015 - RNA, 64 nt, hsa; identical to SEQ ID NO: 382055

SEQ ID NO: 655016 - RNA, 64 nt, hsa; identical to SEQ ID NO: 382056

SEQ ID NO: 655017 - RNA, 64 nt, hsa; identical to SEQ ID NO: 382057

SEQ ID NO: 655018 - RNA, 64 nt, hsa; identical to SEQ ID NO: 382058

SEQ ID NO: 655019 - RNA, 64 nt, hsa; identical to SEQ ID NO: 382059

SEQ ID NO: 655020 - RNA, 64 nt, hsa; identical to SEQ ID NO: 382060

SEQ ID NO: 655021 - RNA, 64 nt, hsa; identical to SEQ ID NO: 382061

SEQ ID NO: 655022 - RNA, 64 nt, hsa
aaagaaagggaaaaagcagaaacacugcagaagacacaaacaaacaaagaagagaaggauucuu

SEQ ID NO: 655023 - RNA, 64 nt, hsa
caauucggaaaacaauaggggaaagccacaaaagcacaaacaugggucaaaggaaaaucuuaaa

SEQ ID NO: 655024 - RNA, 64 nt, hsa
uuuuuuuuuuuuuuuuuuuuuaaugucaaaauugcacaaacauggugcucuaccaggaaggauu

SEQ ID NO: 655025 - RNA, 64 nt, hsa
uagauaggcucaggccacacuuuaaaaacaaacacacaaacaacaaaaaacggguauucuaguc

SEQ ID NO: 655026 - RNA, 64 nt, hsa
uauauuugugugcauuugcaugugcaacaguacacacaaacauacauaaagagagcaauugaua

SEQ ID NO: 655027 - RNA, 64 nt, hsa
ucauuauuacaucaaagcauauauauuggccagacacaaacaguugaugaugucauucaauuaa

SEQ ID NO: 655028 - RNA, 64 nt, hsa
caugcuucagcugugacucagcaguuccuuaaaucacaaacaaugguaggucuauuauuuucuc

SEQ ID NO: 655029 - RNA, 64 nt, hsa
aauaauaaugacaaaaagcacaugcagaguaauacacaaacaaaaaaagugacaguuacuuuuu

SEQ ID NO: 655030 - RNA, 64 nt, hsa
gagcucccacacguacacaugcacauguacgcaccacaaacacaugcgcaggcuccugcaggcg

SEQ ID NO: 655031 - RNA, 64 nt, hsa
auacacacaugcacacacauauacacacaugugccacaaacaagugcacacuguccuggugucc

SEQ ID NO: 655032 - RNA, 64 nt, hsa
agaucugccucacaccuucaaauucaugaaaggacacaaacacacauaagaauacacucuggag

SEQ ID NO: 655033 - RNA, 64 nt, hsa
agaucugccaagaaccuucgaauucaugaaaggacacaaacacacguaagaaugcacucuguag

SEQ ID NO: 655034 - RNA, 64 nt, hsa
aaaaaagaaaaaaaucaaaaaagcgacaaaaaaacacaaacagaagaggaaaaaaaagcaacaa

SEQ ID NO: 655035 - RNA, 64 nt, hsa
ggacaucaaauuuggacaccaggucacggagaaacacaaacaccacccaggaacacgcagacau

SEQ ID NO: 655036 - RNA, 64 nt, hsa
aaaagacaaaaaauuagcugggcaugguggcauauaccuguaaccccaacuacuuggguggcug

SEQ ID NO: 655037 - RNA, 64 nt, hsa
agugauccuguguaaaacugccaaggaaaguaauuaccuguaggaguuugcugagcuugaagag

SEQ ID NO: 655038 - RNA, 64 nt, hsa
aacugaaaggucgauuguaauggauugccguuuguaccuguaucaguauugcuguguaaaaauu

SEQ ID NO: 655039 - RNA, 64 nt, hsa
cuggaguagaaaccaaaugugaauagccacaucuuaccuguaaagucuuacuugugauugugcc

SEQ ID NO: 655040 - RNA, 64 nt, hsa
aaccgaauguucauucauauucauuuauaaaaaguaccuguaucaaaggaauuuuaacaaagag

SEQ ID NO: 655041 - RNA, 64 nt, hsa
agcuuugcuugcagccuuccaaucuauguugguuuaccuguaguguuuuauaaaguguggucag

SEQ ID NO: 655042 - RNA, 64 nt, hsa
agugaagaacuuauuuaagaauuauuucaguauuuaccuguauuuuauucuugaaguuggccaa

SEQ ID NO: 655043 - RNA, 64 nt, hsa
caauuucaaaaggcugcugauguaguucccggguuaccuguaucugaaggacgguucuggggca

SEQ ID NO: 655044 - RNA, 64 nt, hsa
gaaaauuuccucaugcugaauuguaauuuucucuuaccuguaaaguaaaauuuagaucaauucc

SEQ ID NO: 655045 - RNA, 64 nt, hsa
uugaauuauuuucuaaaauuaagagccguauaccuaccuguaagucuuuucacauaucauuuaa

SEQ ID NO: 655046 - RNA, 64 nt, hsa
ggaaaagucuuugcuauccgacauguacugcuaguaccuguaagcauuuuaggucccagaaugg

SEQ ID NO: 655047 - RNA, 64 nt, hsa
aggaaaaggcuggcaagguggguuccagggacuguaccuguaggaaacagaaaagagaagaaag

SEQ ID NO: 655048 - RNA, 64 nt, hsa
ugauaguauuaagcaagucauguuuugaauggauuaccuguagugacucauuggaaugauauaa

SEQ ID NO: 655049 - RNA, 64 nt, hsa
gauuggccuaggcuaaggacaaaaauaaacuaaguaccuguaguguauuuaugugauauguguc

SEQ ID NO: 655050 - RNA, 64 nt, hsa
uggucaauaacuguuacuuuuaaguauccuuuaauaccuguaccuuuuguuuuagaagauuguu

SEQ ID NO: 655051 - RNA, 64 nt, hsa
cauaauguagauaaaaagaaaaaaaggauaugguuaccuguaaucuuaccaaucauagauaauc

SEQ ID NO: 655052 - RNA, 64 nt, hsa
ucugcaaauacagaccauuuuuuaucuuucaucuuaccuguaauccuagcacuuugagaccacu

SEQ ID NO: 655053 - RNA, 64 nt, hsa
caugguuaauauuucuucauuuuauuuuaaagcuuaccuguaucauuacuuaugaagucaguuu

SEQ ID NO: 655054 - RNA, 64 nt, hsa
gacaguucacuaauuguugaauuuuacuguauauucauauaaaaaugcaaacguacuagaccag

SEQ ID NO: 655055 - RNA, 64 nt, hsa
uugugaaagaaaauggucauuuuuuuuacugaagucauauaaugacuugggucagcucguaaug

SEQ ID NO: 655056 - RNA, 64 nt, hsa
uaaaaauauaaacaauguucaggagaguaaaaauucauauaaagugcaauugcacaaauacaag

SEQ ID NO: 655057 - RNA, 64 nt, hsa
accaugugcaucaggaaacaccucacucauacugucauauaaugcaacagggaggcauagucuc

SEQ ID NO: 655058 - RNA, 64 nt, hsa
cuugguuugguacaguucauaauucaccaaaaguucauauaauuuaaagaaacacuaaauuagu

SEQ ID NO: 655059 - RNA, 64 nt, hsa
uuauacauaaacaguuuuggagaaaaauuacagaucauauaagcaagacaguggcacuaaaaug

SEQ ID NO: 655060 - RNA, 64 nt, hsa
uaagaaaagauauaauuucuuuacugcaguuaaaucauauaauguuuguaugauuaaaaauaaa

SEQ ID NO: 655061 - RNA, 64 nt, hsa
aguugagaugcauuuuacauaauuaugaguuuguucauauaaagaaaagcuguggaaaagaguc

SEQ ID NO: 655062 - RNA, 64 nt, hsa
ucucugcuuucagaaguagacauaauaggaugaaucauauaacagaaaaaaaaaagugaagcca

SEQ ID NO: 655063 - RNA, 64 nt, hsa
uuaccuuagccacuaagaagacaagggcuguuacucauauaacuugcuuuuauuacuuaaugua

SEQ ID NO: 655064 - RNA, 64 nt, hsa
uauaacaugcuucgugccaucaugauccuugccuucauauaacaaacaugcuucgucagaggug

SEQ ID NO: 655065 - RNA, 64 nt, hsa
cauauaacaugcuucgugcucauggucauugccuucauauaacaugcuucgugccaucaugauc

SEQ ID NO: 655066 - RNA, 64 nt, hsa
auuuugguggcagcugccaucauggucauugccuucauauaacaugcuucgugcucauggucau

SEQ ID NO: 655067 - RNA, 64 nt, hsa
ucuccgucacuauuauuuugccuuuucuggacugucauauaaacagaaucuuauaguacguucc

SEQ ID NO: 655068 - RNA, 64 nt, hsa
gucucuagguaauugauuuaaguauaaaauccaaucauauaaaaacuuuaaugaauuaggauaa

SEQ ID NO: 655069 - RNA, 64 nt, hsa
uuuguugcagcugucagcuaacauuugguugagcucauauaauccaaaccuaauuguccaacua

SEQ ID NO: 655070 - RNA, 64 nt, hsa
uaugggagauagcacuguaauuagagaauuuauuucauauaaaauaauaauauaaaguuugaac

SEQ ID NO: 655071 - RNA, 64 nt, hsa
uauagaauaaaguaccaccuaaaacugaauuuuaucauauaagcaaguaauaccuauuagucau

SEQ ID NO: 655072 - RNA, 64 nt, hsa
ccuaaguguauaauuaugugcaauguucaauaccucauauaauacuugcucaacaguauagugg

SEQ ID NO: 655073 - RNA, 64 nt, hsa
uauaagugaaaucauacacucucguguauauacuucauauaagugaauauauacucucgugaga

SEQ ID NO: 655074 - RNA, 64 nt, hsa
uauuggccuugccucuucuagagcuucuagaacuucauauaagugaaaucauacacucucgugu

SEQ ID NO: 655075 - RNA, 64 nt, hsa; identical to SEQ ID NO: 312121

SEQ ID NO: 655076 - RNA, 64 nt, hsa; identical to SEQ ID NO: 312122

SEQ ID NO: 655077 - RNA, 64 nt, hsa; identical to SEQ ID NO: 312123

SEQ ID NO: 655078 - RNA, 64 nt, hsa; identical to SEQ ID NO: 312124

SEQ ID NO: 655079 - RNA, 64 nt, hsa; identical to SEQ ID NO: 312125

SEQ ID NO: 655080 - RNA, 64 nt, hsa; identical to SEQ ID NO: 312126

SEQ ID NO: 655081 - RNA, 64 nt, hsa; identical to SEQ ID NO: 312127

SEQ ID NO: 655082 - RNA, 64 nt, hsa; identical to SEQ ID NO: 312128

SEQ ID NO: 655083 - RNA, 64 nt, hsa; identical to SEQ ID NO: 312129

SEQ ID NO: 655084 - RNA, 64 nt, hsa; identical to SEQ ID NO: 312130

SEQ ID NO: 655085 - RNA, 64 nt, hsa; identical to SEQ ID NO: 312131

SEQ ID NO: 655086 - RNA, 64 nt, hsa; identical to SEQ ID NO: 312132

SEQ ID NO: 655087 - RNA, 64 nt, hsa
cgggguuucaccauguuggucaggcuggucucaaacuccugaccucaggugauccgcccaccuc

SEQ ID NO: 655088 - RNA, 64 nt, hsa
cgggguuucaccauguuggccaggcuguucucgaacuccugaccucaggugaucugcccgccuc

SEQ ID NO: 655089 - RNA, 64 nt, hsa
caggguuucaccauguuggccaggcugcucuugaacuccugaccucagguaaucgaccugccuc

SEQ ID NO: 655090 - RNA, 64 nt, hsa
cgggguuucaccauguuggccaggcuggucucgaacuccugaccuuaggugauccacucgccuu

SEQ ID NO: 655091 - RNA, 64 nt, hsa
auggagucucaccacauaggccaggcagucucgaacuccugaccucaggugauccacccaccuu

SEQ ID NO: 655092 - RNA, 64 nt, hsa
caggguucaaccauguuggucaggcuggucucgaacuccugaccgcaagugauccacacgccuu

SEQ ID NO: 655093 - RNA, 64 nt, hsa
cgggguuucaccacguugcccaggcuggucuugaacuccugaccuccagugauccgccugccuu

SEQ ID NO: 655094 - RNA, 64 nt, hsa
acagguuuugccauguugcccaggcuggccucaaacuccugagcucaagugauccucccgucuc

SEQ ID NO: 655095 - RNA, 64 nt, hsa
caggguuucaccauauuggccaggcuggucucgaacuccugaccuugugaucugcccgccucca

SEQ ID NO: 655096 - RNA, 64 nt, hsa
cgggguuucaccacauucgucagguugguuucaaacuccugacuuugugauccacccgccucgg

SEQ ID NO: 655097 - RNA, 64 nt, hsa
guauucucucucuggcucugcugcaggucucugcacuccugauuuugcuccauacuuuuaaaua

SEQ ID NO: 655098 - RNA, 64 nt, hsa
ccuccucucuauuuguuuuuuuaaggaaaagucaacuccugaaaugucccuuagcuauaaucag

SEQ ID NO: 655099 - RNA, 64 nt, hsa
cgggauuuuaucauguuggccaggcuggucucgaacuccugaccucaggugaucugcccaccuu

SEQ ID NO: 655100 - RNA, 64 nt, hsa
cgggguuucaccauguuggccaggcuggucuugaacuccugaccucaacugauccgcccaccuu

SEQ ID NO: 655101 - RNA, 64 nt, hsa
gauaacuuccccacuccacccuacaagcagugggacuccugagaacacgguucucuccuagccu

SEQ ID NO: 655102 - RNA, 64 nt, hsa
agacauggagccccucccuuggucagacucugggacuccugagaugggagaggcagggaucaga

SEQ ID NO: 655103 - RNA, 64 nt, hsa
ugguguuucaccauguuggccagacuggucuuggacuccugaccucgugauccacccaccuugg

SEQ ID NO: 655104 - RNA, 64 nt, hsa
ggaguuuugccauguggucccaggcuggucucaaacuccugagcucaagcaauccguccacuug

SEQ ID NO: 655105 - RNA, 64 nt, hsa
agggguuucaccacguuggccaggcuggucucgaacuccugaccuuaggugauccgcccgccuc

SEQ ID NO: 655106 - RNA, 64 nt, hsa
caggauuucaccauguuggccaggccagucucaaacuccugaccucaggugauccaccugccuc

SEQ ID NO: 655107 - RNA, 64 nt, hsa
gcacaacucagacaccccugaggccuagcagucaacuccugauucagacaugauccaguccagc

SEQ ID NO: 655108 - RNA, 64 nt, hsa
caggguuucaccauguuggccaggcuggucucgaacuccugaccucaagugaucugccugccuu

SEQ ID NO: 655109 - RNA, 64 nt, hsa
gacggguucaccguguuggccaggcuggucuugaacuccugaccucaggugauacccgcccccc

SEQ ID NO: 655110 - RNA, 64 nt, hsa
gacacuuuccucuguuccauuccccaucucagggacuccugaauauucagccucuccaggcugg

SEQ ID NO: 655111 - RNA, 64 nt, hsa
ugggguuucaccauguuagccaggcuggucucaaacuccugacccugugauccgcccgccucgg

SEQ ID NO: 655112 - RNA, 64 nt, hsa
ggacucccgcguugauggaccguucuuggugcagacuccugacugcgugcaugaaaccugagac

SEQ ID NO: 655113 - RNA, 64 nt, hsa
uuggccuguuagauuguuccagagucugcauggcacuccugaagaagggagugugaccugcagu

SEQ ID NO: 655114 - RNA, 64 nt, hsa
ugggaaguccugagugcuccgucccucuagcaucacuccugagcugcgggagagguggcccaga

SEQ ID NO: 655115 - RNA, 64 nt, hsa
cauuaucaaacccgaguggauccgaauguucucaacuccugaacugcagcgucucaucucuggc

SEQ ID NO: 655116 - RNA, 64 nt, hsa
ccuaagguacacaucccaucugggcgguggcuucacuccugagucugcaaaaucccaggaaacu

SEQ ID NO: 655117 - RNA, 64 nt, hsa
agacgggguuucaccauguuggccaggcugauuaacuccugaccucaggugauccaccuuucuc

SEQ ID NO: 655118 - RNA, 64 nt, hsa
cagaguuucaccauguuggccaggcuggucuugaacuccugaccuugugauccacccaccucgg

SEQ ID NO: 655119 - RNA, 64 nt, hsa
cugucucuggucucuuccuuuagcugacaaggacacuccugaggucuuuguucucacuguauuc

SEQ ID NO: 655120 - RNA, 64 nt, hsa
gccacccuaucgcccccuacgcgccuugucuccuacuccugacuccuaccugcccuggaacauc

SEQ ID NO: 655121 - RNA, 64 nt, hsa
gcaauaacuucugaccuuuuggugaaagcugagaacuccugacuguaacauauucuguaugaac

SEQ ID NO: 655122 - RNA, 64 nt, hsa
caggguuucaccauguuggccaggcuggucucgaacuccugaccucgugauccgccugccucag

SEQ ID NO: 655123 - RNA, 64 nt, hsa
gggaguuucaccauguuggccagguuggucuugaacuccugaccucaggugauccuccugccuc

SEQ ID NO: 655124 - RNA, 64 nt, hsa
ugggguuucaccauguuggccaggcuugucucgaacuccugaccccaaguuauccaccugccuu

SEQ ID NO: 655125 - RNA, 64 nt, hsa
acggguuucaccauguuggcuagacuagucucaaacuccugaccucaagugaucugcccgccuc

SEQ ID NO: 655126 - RNA, 64 nt, hsa
ugagguuucuccauguuggucaggcuggucucgaacuccugaccucaggugauccacccaccuu

SEQ ID NO: 655127 - RNA, 64 nt, hsa
aauuugaacaucaaaagagauacuuacugacuccacuccugacuucugcuucugaaaaaaugaa

SEQ ID NO: 655128 - RNA, 64 nt, hsa
ugagguuucaucauguuggccaggccggucucaaacuccugaccucaggugaugcacccaccuc

SEQ ID NO: 655129 - RNA, 64 nt, hsa
ggggguuucaccauguuagccaggcuggucucgaacuccugaccucaggugauccacccgccuc

SEQ ID NO: 655130 - RNA, 64 nt, hsa
cgggguuucaccauguugaccaggcuggucucgaacuccugaccuggugaucugcccacccagg

SEQ ID NO: 655131 - RNA, 64 nt, hsa
gagacggacucuauguugcccaggcuguuauggaacuccugagucaagugauccucccaccuug

SEQ ID NO: 655132 - RNA, 64 nt, hsa
uggcaucuugcuaugucguccaggcuggucuugaacuccugaguucaagcaguccuccugcuuc

SEQ ID NO: 655133 - RNA, 64 nt, hsa
cgggguuucaccguguuggccgggcuggucucaaacuccugaccucaggugauccacccaccuc

SEQ ID NO: 655134 - RNA, 64 nt, hsa
cacuggagggcacacacguaccccgcacccagcaacuccugacagaaagcuccucccacccaaa

SEQ ID NO: 655135 - RNA, 64 nt, hsa
ggccuaaggucucuagggucccugccuaaaucccacuccugagggagggggaagaagagagggu

SEQ ID NO: 655136 - RNA, 64 nt, hsa
uggaguuucaccauguuggccaggcuggucucgaacuccugaccucaggugauccaccugccuc

SEQ ID NO: 655137 - RNA, 64 nt, hsa
cagcguuuugccaugcuggccaggcucgucucgaacuccugaccucaggugauccgcccaccuu

SEQ ID NO: 655138 - RNA, 64 nt, hsa
ugggguuucacuguguaggccaggcuggucucgaacuccugaacucaagugauucacccaccuu

SEQ ID NO: 655139 - RNA, 64 nt, hsa
ccuggcuaaauuuuguauuuuuagguggucuugaacuccugaugucaggugauucuccuagcuc

SEQ ID NO: 655140 - RNA, 64 nt, hsa
acaguguuuaccauguuggccaggcaggucuccaacuccugaccucaagugauauguucaccuc

SEQ ID NO: 655141 - RNA, 64 nt, hsa
ugggguuucaccacguuggccacacuggucucaaacuccugaccucaggcgauccaucugccuc

SEQ ID NO: 655142 - RNA, 64 nt, hsa
cgggguuucaccauguuggccaggcuggucuugaacuccugaccucagguaauccaccugccuu

SEQ ID NO: 655143 - RNA, 64 nt, hsa
ugggguuucuccauguuggucaggcuggucucaaacuccugaccucaggugaucugccugccuc

SEQ ID NO: 655144 - RNA, 64 nt, hsa
cgaaguuucaccauguuggccaggcugguuucaaacuccugaccucauaugauccaccugccuc

SEQ ID NO: 655145 - RNA, 64 nt, hsa
caggguuucauaauguaagucaagcuggucucgaacuccugaccuuaaaugauuugccugccuc

SEQ ID NO: 655146 - RNA, 64 nt, hsa
caggguuucaccauguuggccaggcuggucuugaacuccugaccucaggugauccacccaccug

SEQ ID NO: 655147 - RNA, 64 nt, hsa
caguguuuugccauguuggccaggcuggucucgaacuccugacaucaggugauccaccugccuc

SEQ ID NO: 655148 - RNA, 64 nt, hsa
cgggguuucaccaugucagucaggcuggucuugaacuccugaccucaggugauccacccgccuc

SEQ ID NO: 655149 - RNA, 64 nt, hsa
caggguuucaccauauuagccaggugggucuugaacuccugaccuugugauccacccgccucgg

SEQ ID NO: 655150 - RNA, 64 nt, hsa
cuggguuucaccauguuggccaggcuggucuugaacuccugaccucaggugauccgccuaucuc

SEQ ID NO: 655151 - RNA, 64 nt, hsa
cauugcucccaaaauggacuucucugcaagccugacuccugaaacugugcauuguacccugaaa

SEQ ID NO: 655152 - RNA, 64 nt, hsa
cgggguuucgcuauuuuggccgggcugguuucaaacuccugaccucaguugauccacccgccuc

SEQ ID NO: 655153 - RNA, 64 nt, hsa
caggguuucaccauauuggucaggcuggucuugaacuccugaccucgugauccacccaccucag

SEQ ID NO: 655154 - RNA, 64 nt, hsa
caggguuucaccauauuggucaggcuggucuugaacuccugaccucgugaucugcccgccuugg

SEQ ID NO: 655155 - RNA, 64 nt, hsa; identical to SEQ ID NO: 229362

SEQ ID NO: 655156 - RNA, 64 nt, hsa; identical to SEQ ID NO: 229363

SEQ ID NO: 655157 - RNA, 64 nt, hsa; identical to SEQ ID NO: 229364

SEQ ID NO: 655158 - RNA, 64 nt, hsa; identical to SEQ ID NO: 229365

SEQ ID NO: 655159 - RNA, 64 nt, hsa; identical to SEQ ID NO: 229366

SEQ ID NO: 655160 - RNA, 64 nt, hsa; identical to SEQ ID NO: 229367

SEQ ID NO: 655161 - RNA, 64 nt, hsa; identical to SEQ ID NO: 229368

SEQ ID NO: 655162 - RNA, 64 nt, hsa; identical to SEQ ID NO: 229369

SEQ ID NO: 655163 - RNA, 64 nt, hsa
cacacagccuggaugacgccuuggcuguucuaaggggcuguaaggugggcucugggccuuccag

SEQ ID NO: 655164 - RNA, 64 nt, hsa
aucaccacccugagcagauacaggaguggggagggggcuguaacucagugaguggcuuccaggg

SEQ ID NO: 655165 - RNA, 64 nt, hsa; identical to SEQ ID NO: 385392

SEQ ID NO: 655166 - RNA, 64 nt, hsa; identical to SEQ ID NO: 385393

SEQ ID NO: 655167 - RNA, 64 nt, hsa; identical to SEQ ID NO: 385394

SEQ ID NO: 655168 - RNA, 64 nt, hsa; identical to SEQ ID NO: 385395

SEQ ID NO: 655169 - RNA, 64 nt, hsa; identical to SEQ ID NO: 385396

SEQ ID NO: 655170 - RNA, 64 nt, hsa; identical to SEQ ID NO: 385397

SEQ ID NO: 655171 - RNA, 64 nt, hsa; identical to SEQ ID NO: 385398

SEQ ID NO: 655172 - RNA, 64 nt, hsa; identical to SEQ ID NO: 385399

SEQ ID NO: 655173 - RNA, 64 nt, hsa; identical to SEQ ID NO: 385400

SEQ ID NO: 655174 - RNA, 64 nt, hsa; identical to SEQ ID NO: 385401

SEQ ID NO: 655175 - RNA, 64 nt, hsa; identical to SEQ ID NO: 385402

SEQ ID NO: 655176 - RNA, 64 nt, hsa; identical to SEQ ID NO: 385403

SEQ ID NO: 655177 - RNA, 64 nt, hsa; identical to SEQ ID NO: 385404

SEQ ID NO: 655178 - RNA, 64 nt, hsa; identical to SEQ ID NO: 385405

SEQ ID NO: 655179 - RNA, 64 nt, hsa; identical to SEQ ID NO: 385406

SEQ ID NO: 655180 - RNA, 64 nt, hsa; identical to SEQ ID NO: 385407

SEQ ID NO: 655181 - RNA, 64 nt, hsa; identical to SEQ ID NO: 385408

SEQ ID NO: 655182 - RNA, 64 nt, hsa; identical to SEQ ID NO: 385409

SEQ ID NO: 655183 - RNA, 64 nt, hsa; identical to SEQ ID NO: 385410

SEQ ID NO: 655184 - RNA, 64 nt, hsa; identical to SEQ ID NO: 385411

SEQ ID NO: 655185 - RNA, 64 nt, hsa; identical to SEQ ID NO: 385412

SEQ ID NO: 655186 - RNA, 64 nt, hsa; identical to SEQ ID NO: 385413

SEQ ID NO: 655187 - RNA, 62 nt, hsa; identical to SEQ ID NO: 385414

SEQ ID NO: 655188 - RNA, 64 nt, hsa; identical to SEQ ID NO: 385415

SEQ ID NO: 655189 - RNA, 64 nt, hsa; identical to SEQ ID NO: 385416

SEQ ID NO: 655190 - RNA, 64 nt, hsa; identical to SEQ ID NO: 385417

SEQ ID NO: 655191 - RNA, 64 nt, hsa; identical to SEQ ID NO: 385418

SEQ ID NO: 655192 - RNA, 64 nt, hsa; identical to SEQ ID NO: 385419

SEQ ID NO: 655193 - RNA, 64 nt, hsa; identical to SEQ ID NO: 385420

SEQ ID NO: 655194 - RNA, 64 nt, hsa; identical to SEQ ID NO: 385421

SEQ ID NO: 655195 - RNA, 64 nt, hsa; identical to SEQ ID NO: 385422

SEQ ID NO: 655196 - RNA, 64 nt, hsa; identical to SEQ ID NO: 385423

SEQ ID NO: 655197 - RNA, 64 nt, hsa; identical to SEQ ID NO: 385424

SEQ ID NO: 655198 - RNA, 64 nt, hsa; identical to SEQ ID NO: 385425

SEQ ID NO: 655199 - RNA, 59 nt, hsa
aaacucagucauauauagugaacaguucaaaugggaaaguguucuaaaacauauuauuu

SEQ ID NO: 655200 - RNA, 59 nt, hsa
aauugugugaaaucaccuuaucaaauuaaaaugggaagaaaguaauuuuaauaauuuuu

SEQ ID NO: 655201 - RNA, 59 nt, hsa
aaaaagcaaaugggauuaaggacucauggaaugggaaggggaaggggagucuuacuaua

SEQ ID NO: 655202 - RNA, 59 nt, hsa
caagcucccugccaaccucuggauacaucaaugggaaggaaaccagggaagcauagacc

SEQ ID NO: 655203 - RNA, 59 nt, hsa
ggauggaugcaggaaggaauggaggaaugaaugggaagggagaacauaucuauccucuc

SEQ ID NO: 655204 - RNA, 59 nt, hsa
gggcuagagguggaggaggcaguccugggaaugggaaaaaccccaacuuuggggucaua

SEQ ID NO: 655205 - RNA, 59 nt, hsa
gcauugcuguauacaccucaugcuuaugcaaugggaagaauaugggggccagggggugu

SEQ ID NO: 655206 - RNA, 59 nt, hsa
guauguauagaggagcugaggugcugucuaaugggaaaugugauuugauugauuuauuu

SEQ ID NO: 655207 - RNA, 59 nt, hsa
agcaccuuccuuagguuucauggacaaauaaugggaacuucuaauuuugaucaauccca

SEQ ID NO: 655208 - RNA, 59 nt, hsa
uaaucucccguuagccaaaauaugccagaaaugggaaagagaggagaaaaagucauuaa

SEQ ID NO: 655209 - RNA, 59 nt, hsa
ucauaagaaacaucugaauaacaacgaugaaugggaaacuaguguugaaauaggauuca

SEQ ID NO: 655210 - RNA, 59 nt, hsa
ccuuuuuaauaugaguaaugcuuuauaaaaaugggaaaaaaaguauacuuaaggaucug

SEQ ID NO: 655211 - RNA, 59 nt, hsa
uaaaaucauuccuguccauuccacuuguaaaugggaauucaugaaauuaaauauuacuu

SEQ ID NO: 655212 - RNA, 59 nt, hsa
agacauuugaggggaggaggauuauuaugaaugggaaaaaaagauuuugguugagacua

SEQ ID NO: 655213 - RNA, 59 nt, hsa
agcuuuuaguucagacuuaguuuuuauaaaaugggaauucugacuuacuuaaccagguu

SEQ ID NO: 655214 - RNA, 59 nt, hsa
aaaaaaaaucuuuaaugguuaauaggaugaaugggaaaguauuuuugaaagaauucuau

SEQ ID NO: 655215 - RNA, 59 nt, hsa
auauuucggauaagguuucauaauuuacaaaugggaauuucauuuauaauaauaaauau

SEQ ID NO: 655216 - RNA, 59 nt, hsa
aaugguguaaaagagaccaguagauuuucaaugggaaauguaccuagcaagcugguucu

SEQ ID NO: 655217 - RNA, 59 nt, hsa
uccacagugcuacagacaauaagugauaaaaugggaaaaaauagugaagaucuucuuuu

SEQ ID NO: 655218 - RNA, 59 nt, hsa
uagggacuucuaaugaaaaggguauaugaaaugggaacaauaaauucuguacauguaua

SEQ ID NO: 655219 - RNA, 59 nt, hsa
accuguuacccauuaggggugauaacauuaaugggaagaaaugauggcaacuuugaaug

SEQ ID NO: 655220 - RNA, 59 nt, hsa
agaacucugccuuccaucaacugcaguguaaugggaaagaggguggugagguuuugaaa

SEQ ID NO: 655221 - RNA, 59 nt, hsa
uaaaacagaaaugggaauuauugcacagaaaugggaaauaacuaauuuuaaaucaguca

SEQ ID NO: 655222 - RNA, 59 nt, hsa
cauagaaguaugaaucuaauuaaaacagaaaugggaauuauugcacagaaaugggaaau

SEQ ID NO: 655223 - RNA, 59 nt, hsa
acauuagcuuaugcuucuuuagauggaauaaugggaaaggagggaaaugggaaauggau

SEQ ID NO: 655224 - RNA, 59 nt, hsa
cuuuagauggaauaaugggaaaggagggaaaugggaaauggauggaaaugggaaaggag

SEQ ID NO: 655225 - RNA, 59 nt, hsa
ggaaaggagggaaaugggaaauggauggaaaugggaaaggagggaaaauaauagcccag

SEQ ID NO: 655226 - RNA, 59 nt, hsa
cuugagacaauaagguggagcaacagaacaaugggaaagaggacugggagaggaaucua

SEQ ID NO: 655227 - RNA, 59 nt, hsa
cucucuguauagaauuuucacaucuuuaaaaugggaauaauaguaccuaccucauaggg

SEQ ID NO: 655228 - RNA, 59 nt, hsa
uuagacucuaaaaagucuuuucaaaaagaaaugggaaauaggcagacuguuuauguuaa

SEQ ID NO: 655229 - RNA, 59 nt, hsa
gcugauuuugcuaaacuccuguucccuacaaugggaaaugucacaagaaugugcaaaaa

SEQ ID NO: 655230 - RNA, 59 nt, hsa
cacaggcucaacgggacaugcaacauaaaaaugggaagguuauuuaaacaacaaaaaac

SEQ ID NO: 655231 - RNA, 59 nt, hsa
caagaccaugaccuucuuugauccuugaaaaugggaacuuugacagccaugaccaugaa

SEQ ID NO: 655232 - RNA, 59 nt, hsa
aggugccugcccucaguauagacguauccaaugggaaaacagcggaccugcccagagca

SEQ ID NO: 655233 - RNA, 59 nt, hsa
gucucgucccagaggcauuggaucaggagaaugggaauuuuuuuccucccaccuggaca

SEQ ID NO: 655234 - RNA, 59 nt, hsa
ccugggaucucaaggagcuuuaaagucuuaaugggaacuuggcauuuuccugaugaucu

SEQ ID NO: 655235 - RNA, 59 nt, hsa
gucaaggggaguuuuuacauggaaaugacaaugggaaaauucagauauuuucuuaguag

SEQ ID NO: 655236 - RNA, 59 nt, hsa
aggaacauuggagccugcaauaagggaaaaaugggaacuggagaguguggggaauggga

SEQ ID NO: 655237 - RNA, 59 nt, hsa
gggaaaaaugggaacuggagaguguggggaaugggaagaagcaguuuacuuuagacuaa

SEQ ID NO: 655238 - RNA, 64 nt, hsa; identical to SEQ ID NO: 306996

SEQ ID NO: 655239 - RNA, 64 nt, hsa; identical to SEQ ID NO: 306997

SEQ ID NO: 655240 - RNA, 64 nt, hsa; identical to SEQ ID NO: 306998

SEQ ID NO: 655241 - RNA, 64 nt, hsa; identical to SEQ ID NO: 306999

SEQ ID NO: 655242 - RNA, 64 nt, hsa; identical to SEQ ID NO: 307000

SEQ ID NO: 655243 - RNA, 64 nt, hsa; identical to SEQ ID NO: 307001

SEQ ID NO: 655244 - RNA, 64 nt, hsa; identical to SEQ ID NO: 307002

SEQ ID NO: 655245 - RNA, 64 nt, hsa; identical to SEQ ID NO: 307003

SEQ ID NO: 655246 - RNA, 64 nt, hsa; identical to SEQ ID NO: 307004

SEQ ID NO: 655247 - RNA, 64 nt, hsa; identical to SEQ ID NO: 307005

SEQ ID NO: 655248 - RNA, 64 nt, hsa; identical to SEQ ID NO: 307006

SEQ ID NO: 655249 - RNA, 64 nt, hsa; identical to SEQ ID NO: 307007

SEQ ID NO: 655250 - RNA, 64 nt, hsa; identical to SEQ ID NO: 113569

SEQ ID NO: 655251 - RNA, 64 nt, hsa; identical to SEQ ID NO: 113570

SEQ ID NO: 655252 - RNA, 64 nt, hsa; identical to SEQ ID NO: 113571

SEQ ID NO: 655253 - RNA, 64 nt, hsa; identical to SEQ ID NO: 113572

SEQ ID NO: 655254 - RNA, 64 nt, hsa; identical to SEQ ID NO: 113573

SEQ ID NO: 655255 - RNA, 64 nt, hsa; identical to SEQ ID NO: 113574

SEQ ID NO: 655256 - RNA, 64 nt, hsa; identical to SEQ ID NO: 113575

SEQ ID NO: 655257 - RNA, 64 nt, hsa; identical to SEQ ID NO: 113576

SEQ ID NO: 655258 - RNA, 64 nt, hsa; identical to SEQ ID NO: 113577

SEQ ID NO: 655259 - RNA, 64 nt, hsa; identical to SEQ ID NO: 113578

SEQ ID NO: 655260 - RNA, 64 nt, hsa; identical to SEQ ID NO: 113579

SEQ ID NO: 655261 - RNA, 64 nt, hsa; identical to SEQ ID NO: 113580

SEQ ID NO: 655262 - RNA, 64 nt, hsa; identical to SEQ ID NO: 113581

SEQ ID NO: 655263 - RNA, 64 nt, hsa; identical to SEQ ID NO: 113582

SEQ ID NO: 655264 - RNA, 64 nt, hsa
cuucuaguucccaaaggcgauguccagacacagacuuuaugauuauuauauuuuucaaugccag

SEQ ID NO: 655265 - RNA, 64 nt, hsa
uuuggaugcacuaaggaguuaucaauacuucuggcuuuaugagagcucuuaaauuuugucuaaa

SEQ ID NO: 655266 - RNA, 64 nt, hsa
aaguuagccccaagacuucccuaggguugauguacuuuaugauccagaugcuaaacuucuuaga

SEQ ID NO: 655267 - RNA, 64 nt, hsa
aaucuuacagauauuauaggaauuucuuuucuaucuuuaugaaaacaacguauauaaaauauau

SEQ ID NO: 655268 - RNA, 64 nt, hsa
uacaguugacaggaaccuggaccccuuaccccaacuuuaugaguaaugcuuggaauaaaaacuc

SEQ ID NO: 655269 - RNA, 64 nt, hsa
guaauuuagaaauuaacaugauaucuuaaauuaccuuuaugaaauauaguuuuguauaauagca

SEQ ID NO: 655270 - RNA, 64 nt, hsa
cacuugaccauccagaaauacaugacuacaaguccuuuaugacuguuugccauuuuuuuuaaug

SEQ ID NO: 655271 - RNA, 64 nt, hsa
ugaaagcaacacagccuuaaacucaaugcuuuugcuuuaugacaugggaauguucugucaucaa

SEQ ID NO: 655272 - RNA, 64 nt, hsa
uucuuuuggacuauggagcgcauaucuguuccuucuuuaugaugccuuuuuaugguucugaagu

SEQ ID NO: 655273 - RNA, 64 nt, hsa
uuucaguuuuuuaauuuuauagucacaucaacaucuuuaugaucuauugccuauauaucuguga

SEQ ID NO: 655274 - RNA, 64 nt, hsa
caaguccuaguuguucagcauggcauccaagacucuuuaugaucuggcccuugcuuaccucuca

SEQ ID NO: 655275 - RNA, 64 nt, hsa
uuaaaguucuucuaagcugaguuaggugucuguccuuuaugaucccgcaguauuccaugaauac

SEQ ID NO: 655276 - RNA, 64 nt, hsa
aagcaccugaugaaaauauuuguaagcagaucaucuuuaugauuagaacaauuugcucaaagcc

SEQ ID NO: 655277 - RNA, 64 nt, hsa
gcccugaugucuuaaauucugaaggcuccccugacuuuaugaagggaagauugucuagguugca

SEQ ID NO: 655278 - RNA, 64 nt, hsa
auaaccuagugaaccuggaaauacaacuuugcuucuuuaugaaaguacccugggucuuucaucc

SEQ ID NO: 655279 - RNA, 64 nt, hsa
uuucuacaaaagucuccuagggucuuugagucagcuuuaugaaaaaauguuuguuuauuucagc

SEQ ID NO: 655280 - RNA, 64 nt, hsa
auuuucuuuuuaauauauuuagccaagugaugcacuuuaugauaauuaaacucuuuugugccaa

SEQ ID NO: 655281 - RNA, 64 nt, hsa
aaaaacugguucuauaaauuaaguagaguagcuucuuuaugauaaagacaauuuucugaaaagu

SEQ ID NO: 655282 - RNA, 64 nt, hsa
cagguaguuauaagggaucuggaagaaauccagucuuuaugaauauacuauuaguugggcauua

SEQ ID NO: 655283 - RNA, 64 nt, hsa
acaggcaugagccaccgugcucagccgcaaaauucuuuaugaauuuuacacuuggcaaauguua

SEQ ID NO: 655284 - RNA, 64 nt, hsa
gcuggauggcucaaauauaaaugaaugaggaauucuuuaugaaguaucagucagauuuuaugau

SEQ ID NO: 655285 - RNA, 64 nt, hsa
gagucccacauucccugaggcaggucacacgucucuuuaugaugaggauaagguauaauguccc

SEQ ID NO: 655286 - RNA, 64 nt, hsa
cuacauugaaccggaaaucugaacgggaagucuucuuuaugaauacucagagcauuguucagcu

SEQ ID NO: 655287 - RNA, 64 nt, hsa
ucaucacuagcagaugucaguugcacauugaguccuuuaugaaauucauaaauaaagaauuguu

SEQ ID NO: 655288 - RNA, 64 nt, hsa
aguuugguaauacugagcaagccuguggaauuuucuuuaugaaaaaugauuuuagccuuugcaa

SEQ ID NO: 655289 - RNA, 64 nt, hsa
ucugaauacugucaacacucuuaucuaaguuugccuuuaugaugcaguggcagcauuuugaauu

SEQ ID NO: 655290 - RNA, 64 nt, hsa
gauauuuuguaaaacuuuuuuuuccaaguaaaaacuuuaugaaacuuggucucaaaaauguugu

SEQ ID NO: 655291 - RNA, 64 nt, hsa; identical to SEQ ID NO: 100684

SEQ ID NO: 655292 - RNA, 64 nt, hsa; identical to SEQ ID NO: 100685

SEQ ID NO: 655293 - RNA, 64 nt, hsa; identical to SEQ ID NO: 100686

SEQ ID NO: 655294 - RNA, 64 nt, hsa; identical to SEQ ID NO: 100687

SEQ ID NO: 655295 - RNA, 64 nt, hsa; identical to SEQ ID NO: 100688

SEQ ID NO: 655296 - RNA, 64 nt, hsa; identical to SEQ ID NO: 100689

SEQ ID NO: 655297 - RNA, 64 nt, hsa; identical to SEQ ID NO: 100690

SEQ ID NO: 655298 - RNA, 64 nt, hsa; identical to SEQ ID NO: 100691

SEQ ID NO: 655299 - RNA, 64 nt, hsa; identical to SEQ ID NO: 100692

SEQ ID NO: 655300 - RNA, 64 nt, hsa; identical to SEQ ID NO: 100693

SEQ ID NO: 655301 - RNA, 64 nt, hsa; identical to SEQ ID NO: 100694

SEQ ID NO: 655302 - RNA, 64 nt, hsa; identical to SEQ ID NO: 100695

SEQ ID NO: 655303 - RNA, 64 nt, hsa; identical to SEQ ID NO: 100696

SEQ ID NO: 655304 - RNA, 64 nt, hsa; identical to SEQ ID NO: 100697

SEQ ID NO: 655305 - RNA, 64 nt, hsa; identical to SEQ ID NO: 100698

SEQ ID NO: 655306 - RNA, 64 nt, hsa; identical to SEQ ID NO: 100699

SEQ ID NO: 655307 - RNA, 64 nt, hsa; identical to SEQ ID NO: 100700

SEQ ID NO: 655308 - RNA, 64 nt, hsa; identical to SEQ ID NO: 130118

SEQ ID NO: 655309 - RNA, 64 nt, hsa; identical to SEQ ID NO: 130119

SEQ ID NO: 655310 - RNA, 64 nt, hsa; identical to SEQ ID NO: 130120

SEQ ID NO: 655311 - RNA, 64 nt, hsa; identical to SEQ ID NO: 130121

SEQ ID NO: 655312 - RNA, 64 nt, hsa; identical to SEQ ID NO: 130122

SEQ ID NO: 655313 - RNA, 64 nt, hsa; identical to SEQ ID NO: 130123

SEQ ID NO: 655314 - RNA, 64 nt, hsa; identical to SEQ ID NO: 130124

SEQ ID NO: 655315 - RNA, 64 nt, hsa; identical to SEQ ID NO: 130125

SEQ ID NO: 655316 - RNA, 64 nt, hsa; identical to SEQ ID NO: 130126

SEQ ID NO: 655317 - RNA, 64 nt, hsa; identical to SEQ ID NO: 130127

SEQ ID NO: 655318 - RNA, 64 nt, hsa; identical to SEQ ID NO: 130128

SEQ ID NO: 655319 - RNA, 64 nt, hsa; identical to SEQ ID NO: 130129

SEQ ID NO: 655320 - RNA, 64 nt, hsa; identical to SEQ ID NO: 130130

SEQ ID NO: 655321 - RNA, 64 nt, hsa; identical to SEQ ID NO: 130131

SEQ ID NO: 655322 - RNA, 64 nt, hsa; identical to SEQ ID NO: 130132

SEQ ID NO: 655323 - RNA, 64 nt, hsa; identical to SEQ ID NO: 130133

SEQ ID NO: 655324 - RNA, 64 nt, hsa; identical to SEQ ID NO: 130134

SEQ ID NO: 655325 - RNA, 64 nt, hsa; identical to SEQ ID NO: 130135

SEQ ID NO: 655326 - RNA, 64 nt, hsa; identical to SEQ ID NO: 130136

SEQ ID NO: 655327 - RNA, 64 nt, hsa; identical to SEQ ID NO: 130137

SEQ ID NO: 655328 - RNA, 64 nt, hsa; identical to SEQ ID NO: 130138

SEQ ID NO: 655329 - RNA, 64 nt, hsa; identical to SEQ ID NO: 130139

SEQ ID NO: 655330 - RNA, 64 nt, hsa; identical to SEQ ID NO: 130140

SEQ ID NO: 655331 - RNA, 64 nt, hsa; identical to SEQ ID NO: 130141

SEQ ID NO: 655332 - RNA, 64 nt, hsa; identical to SEQ ID NO: 130142

SEQ ID NO: 655333 - RNA, 64 nt, hsa; identical to SEQ ID NO: 130143

SEQ ID NO: 655334 - RNA, 64 nt, hsa; identical to SEQ ID NO: 130144

SEQ ID NO: 655335 - RNA, 64 nt, hsa; identical to SEQ ID NO: 130145

SEQ ID NO: 655336 - RNA, 64 nt, hsa; identical to SEQ ID NO: 130146

SEQ ID NO: 655337 - RNA, 64 nt, hsa; identical to SEQ ID NO: 130147

SEQ ID NO: 655338 - RNA, 64 nt, hsa; identical to SEQ ID NO: 130148

SEQ ID NO: 655339 - RNA, 64 nt, hsa; identical to SEQ ID NO: 130149

SEQ ID NO: 655340 - RNA, 64 nt, hsa; identical to SEQ ID NO: 130150

SEQ ID NO: 655341 - RNA, 64 nt, hsa; identical to SEQ ID NO: 130151

SEQ ID NO: 655342 - RNA, 64 nt, hsa; identical to SEQ ID NO: 130152

SEQ ID NO: 655343 - RNA, 64 nt, hsa; identical to SEQ ID NO: 130153

SEQ ID NO: 655344 - RNA, 64 nt, hsa; identical to SEQ ID NO: 130154

SEQ ID NO: 655345 - RNA, 64 nt, hsa; identical to SEQ ID NO: 130155

SEQ ID NO: 655346 - RNA, 64 nt, hsa; identical to SEQ ID NO: 130156

SEQ ID NO: 655347 - RNA, 64 nt, hsa; identical to SEQ ID NO: 130157

SEQ ID NO: 655348 - RNA, 64 nt, hsa; identical to SEQ ID NO: 130158

SEQ ID NO: 655349 - RNA, 64 nt, hsa; identical to SEQ ID NO: 130159

SEQ ID NO: 655350 - RNA, 64 nt, hsa; identical to SEQ ID NO: 130160

SEQ ID NO: 655351 - RNA, 64 nt, hsa; identical to SEQ ID NO: 130161

SEQ ID NO: 655352 - RNA, 64 nt, hsa; identical to SEQ ID NO: 130162

SEQ ID NO: 655353 - RNA, 64 nt, hsa; identical to SEQ ID NO: 130163

SEQ ID NO: 655354 - RNA, 64 nt, hsa; identical to SEQ ID NO: 130164

SEQ ID NO: 655355 - RNA, 64 nt, hsa; identical to SEQ ID NO: 130165

SEQ ID NO: 655356 - RNA, 64 nt, hsa; identical to SEQ ID NO: 130166

SEQ ID NO: 655357 - RNA, 64 nt, hsa; identical to SEQ ID NO: 130167

SEQ ID NO: 655358 - RNA, 64 nt, hsa; identical to SEQ ID NO: 130168

SEQ ID NO: 655359 - RNA, 64 nt, hsa; identical to SEQ ID NO: 130169

SEQ ID NO: 655360 - RNA, 64 nt, hsa; identical to SEQ ID NO: 130170

SEQ ID NO: 655361 - RNA, 64 nt, hsa; identical to SEQ ID NO: 130171

SEQ ID NO: 655362 - RNA, 64 nt, hsa; identical to SEQ ID NO: 130172

SEQ ID NO: 655363 - RNA, 64 nt, hsa; identical to SEQ ID NO: 130173

SEQ ID NO: 655364 - RNA, 64 nt, hsa; identical to SEQ ID NO: 130174

SEQ ID NO: 655365 - RNA, 64 nt, hsa; identical to SEQ ID NO: 130175

SEQ ID NO: 655366 - RNA, 64 nt, hsa; identical to SEQ ID NO: 130176

SEQ ID NO: 655367 - RNA, 64 nt, hsa; identical to SEQ ID NO: 130177

SEQ ID NO: 655368 - RNA, 64 nt, hsa; identical to SEQ ID NO: 130178

SEQ ID NO: 655369 - RNA, 64 nt, hsa; identical to SEQ ID NO: 130179

SEQ ID NO: 655370 - RNA, 64 nt, hsa; identical to SEQ ID NO: 130180

SEQ ID NO: 655371 - RNA, 64 nt, hsa; identical to SEQ ID NO: 130181

SEQ ID NO: 655372 - RNA, 64 nt, hsa; identical to SEQ ID NO: 130182

SEQ ID NO: 655373 - RNA, 64 nt, hsa; identical to SEQ ID NO: 130183

SEQ ID NO: 655374 - RNA, 64 nt, hsa; identical to SEQ ID NO: 130184

SEQ ID NO: 655375 - RNA, 64 nt, hsa; identical to SEQ ID NO: 130185

SEQ ID NO: 655376 - RNA, 64 nt, hsa; identical to SEQ ID NO: 130186

SEQ ID NO: 655377 - RNA, 64 nt, hsa; identical to SEQ ID NO: 130187

SEQ ID NO: 655378 - RNA, 64 nt, hsa; identical to SEQ ID NO: 130188

SEQ ID NO: 655379 - RNA, 64 nt, hsa; identical to SEQ ID NO: 130189

SEQ ID NO: 655380 - RNA, 64 nt, hsa; identical to SEQ ID NO: 130190

SEQ ID NO: 655381 - RNA, 64 nt, hsa; identical to SEQ ID NO: 130191

SEQ ID NO: 655382 - RNA, 64 nt, hsa; identical to SEQ ID NO: 130192

SEQ ID NO: 655383 - RNA, 64 nt, hsa; identical to SEQ ID NO: 130193

SEQ ID NO: 655384 - RNA, 64 nt, hsa; identical to SEQ ID NO: 130194

SEQ ID NO: 655385 - RNA, 64 nt, hsa; identical to SEQ ID NO: 130195

SEQ ID NO: 655386 - RNA, 64 nt, hsa; identical to SEQ ID NO: 130196

SEQ ID NO: 655387 - RNA, 64 nt, hsa; identical to SEQ ID NO: 437317

SEQ ID NO: 655388 - RNA, 64 nt, hsa; identical to SEQ ID NO: 437318

SEQ ID NO: 655389 - RNA, 64 nt, hsa; identical to SEQ ID NO: 437319

SEQ ID NO: 655390 - RNA, 64 nt, hsa; identical to SEQ ID NO: 437320

SEQ ID NO: 655391 - RNA, 64 nt, hsa; identical to SEQ ID NO: 437321

SEQ ID NO: 655392 - RNA, 64 nt, hsa; identical to SEQ ID NO: 437322

SEQ ID NO: 655393 - RNA, 64 nt, hsa; identical to SEQ ID NO: 437323

SEQ ID NO: 655394 - RNA, 64 nt, hsa; identical to SEQ ID NO: 437324

SEQ ID NO: 655395 - RNA, 64 nt, hsa; identical to SEQ ID NO: 437325

SEQ ID NO: 655396 - RNA, 64 nt, hsa; identical to SEQ ID NO: 437326

SEQ ID NO: 655397 - RNA, 64 nt, hsa; identical to SEQ ID NO: 437327

SEQ ID NO: 655398 - RNA, 64 nt, hsa; identical to SEQ ID NO: 437328

SEQ ID NO: 655399 - RNA, 64 nt, hsa; identical to SEQ ID NO: 437329

SEQ ID NO: 655400 - RNA, 64 nt, hsa; identical to SEQ ID NO: 437330

SEQ ID NO: 655401 - RNA, 64 nt, hsa; identical to SEQ ID NO: 437331

SEQ ID NO: 655402 - RNA, 64 nt, hsa; identical to SEQ ID NO: 437332

SEQ ID NO: 655403 - RNA, 64 nt, hsa; identical to SEQ ID NO: 437333

SEQ ID NO: 655404 - RNA, 64 nt, hsa; identical to SEQ ID NO: 437334

SEQ ID NO: 655405 - RNA, 64 nt, hsa; identical to SEQ ID NO: 437335

SEQ ID NO: 655406 - RNA, 64 nt, hsa; identical to SEQ ID NO: 437336

SEQ ID NO: 655407 - RNA, 64 nt, hsa; identical to SEQ ID NO: 437337

SEQ ID NO: 655408 - RNA, 64 nt, hsa; identical to SEQ ID NO: 437338

SEQ ID NO: 655409 - RNA, 64 nt, hsa; identical to SEQ ID NO: 437339

SEQ ID NO: 655410 - RNA, 64 nt, hsa; identical to SEQ ID NO: 437340

SEQ ID NO: 655411 - RNA, 64 nt, hsa; identical to SEQ ID NO: 437341

SEQ ID NO: 655412 - RNA, 64 nt, hsa; identical to SEQ ID NO: 437342

SEQ ID NO: 655413 - RNA, 64 nt, hsa; identical to SEQ ID NO: 437343

SEQ ID NO: 655414 - RNA, 64 nt, hsa; identical to SEQ ID NO: 437344

SEQ ID NO: 655415 - RNA, 64 nt, hsa; identical to SEQ ID NO: 437345

SEQ ID NO: 655416 - RNA, 64 nt, hsa; identical to SEQ ID NO: 437346

SEQ ID NO: 655417 - RNA, 64 nt, hsa; identical to SEQ ID NO: 437347

SEQ ID NO: 655418 - RNA, 64 nt, hsa; identical to SEQ ID NO: 437348

SEQ ID NO: 655419 - RNA, 64 nt, hsa; identical to SEQ ID NO: 437349

SEQ ID NO: 655420 - RNA, 64 nt, hsa; identical to SEQ ID NO: 437350

SEQ ID NO: 655421 - RNA, 64 nt, hsa; identical to SEQ ID NO: 437351

SEQ ID NO: 655422 - RNA, 64 nt, hsa; identical to SEQ ID NO: 437352

SEQ ID NO: 655423 - RNA, 64 nt, hsa; identical to SEQ ID NO: 437353

SEQ ID NO: 655424 - RNA, 64 nt, hsa; identical to SEQ ID NO: 437354

SEQ ID NO: 655425 - RNA, 64 nt, hsa; identical to SEQ ID NO: 437355

SEQ ID NO: 655426 - RNA, 64 nt, hsa; identical to SEQ ID NO: 284541

SEQ ID NO: 655427 - RNA, 64 nt, hsa; identical to SEQ ID NO: 284542

SEQ ID NO: 655428 - RNA, 64 nt, hsa; identical to SEQ ID NO: 284543

SEQ ID NO: 655429 - RNA, 64 nt, hsa; identical to SEQ ID NO: 284544

SEQ ID NO: 655430 - RNA, 64 nt, hsa; identical to SEQ ID NO: 284545

SEQ ID NO: 655431 - RNA, 64 nt, hsa; identical to SEQ ID NO: 284546

SEQ ID NO: 655432 - RNA, 64 nt, hsa; identical to SEQ ID NO: 284547

SEQ ID NO: 655433 - RNA, 64 nt, hsa; identical to SEQ ID NO: 284548

SEQ ID NO: 655434 - RNA, 64 nt, hsa; identical to SEQ ID NO: 284549

SEQ ID NO: 655435 - RNA, 64 nt, hsa; identical to SEQ ID NO: 284550

SEQ ID NO: 655436 - RNA, 64 nt, hsa; identical to SEQ ID NO: 284551

SEQ ID NO: 655437 - RNA, 64 nt, hsa; identical to SEQ ID NO: 284552

SEQ ID NO: 655438 - RNA, 64 nt, hsa; identical to SEQ ID NO: 284553

SEQ ID NO: 655439 - RNA, 64 nt, hsa; identical to SEQ ID NO: 284554

SEQ ID NO: 655440 - RNA, 64 nt, hsa; identical to SEQ ID NO: 284555

SEQ ID NO: 655441 - RNA, 64 nt, hsa; identical to SEQ ID NO: 284556

SEQ ID NO: 655442 - RNA, 64 nt, hsa; identical to SEQ ID NO: 284557

SEQ ID NO: 655443 - RNA, 64 nt, hsa; identical to SEQ ID NO: 284558

SEQ ID NO: 655444 - RNA, 64 nt, hsa; identical to SEQ ID NO: 284559

SEQ ID NO: 655445 - RNA, 64 nt, hsa; identical to SEQ ID NO: 284560

SEQ ID NO: 655446 - RNA, 64 nt, hsa; identical to SEQ ID NO: 284561

SEQ ID NO: 655447 - RNA, 64 nt, hsa; identical to SEQ ID NO: 284562

SEQ ID NO: 655448 - RNA, 64 nt, hsa; identical to SEQ ID NO: 284563

SEQ ID NO: 655449 - RNA, 64 nt, hsa; identical to SEQ ID NO: 284564

SEQ ID NO: 655450 - RNA, 64 nt, hsa; identical to SEQ ID NO: 284565

SEQ ID NO: 655451 - RNA, 64 nt, hsa; identical to SEQ ID NO: 284566

SEQ ID NO: 655452 - RNA, 64 nt, hsa; identical to SEQ ID NO: 284567

SEQ ID NO: 655453 - RNA, 64 nt, hsa; identical to SEQ ID NO: 284568

SEQ ID NO: 655454 - RNA, 64 nt, hsa; identical to SEQ ID NO: 284569

SEQ ID NO: 655455 - RNA, 64 nt, hsa; identical to SEQ ID NO: 284570

SEQ ID NO: 655456 - RNA, 59 nt, hsa; identical to SEQ ID NO: 284571

SEQ ID NO: 655457 - RNA, 64 nt, hsa; identical to SEQ ID NO: 284572

SEQ ID NO: 655458 - RNA, 64 nt, hsa; identical to SEQ ID NO: 284573

SEQ ID NO: 655459 - RNA, 64 nt, hsa; identical to SEQ ID NO: 284574

SEQ ID NO: 655460 - RNA, 64 nt, hsa; identical to SEQ ID NO: 284575

SEQ ID NO: 655461 - RNA, 64 nt, hsa; identical to SEQ ID NO: 284576

SEQ ID NO: 655462 - RNA, 64 nt, hsa; identical to SEQ ID NO: 284577

SEQ ID NO: 655463 - RNA, 64 nt, hsa; identical to SEQ ID NO: 284578

SEQ ID NO: 655464 - RNA, 64 nt, hsa; identical to SEQ ID NO: 284579

SEQ ID NO: 655465 - RNA, 64 nt, hsa; identical to SEQ ID NO: 284580

SEQ ID NO: 655466 - RNA, 64 nt, hsa; identical to SEQ ID NO: 284581

SEQ ID NO: 655467 - RNA, 64 nt, hsa; identical to SEQ ID NO: 284582

SEQ ID NO: 655468 - RNA, 64 nt, hsa; identical to SEQ ID NO: 284583

SEQ ID NO: 655469 - RNA, 56 nt, hsa; identical to SEQ ID NO: 284584

SEQ ID NO: 655470 - RNA, 64 nt, hsa; identical to SEQ ID NO: 284585

SEQ ID NO: 655471 - RNA, 64 nt, hsa; identical to SEQ ID NO: 284586

SEQ ID NO: 655472 - RNA, 64 nt, hsa; identical to SEQ ID NO: 284587

SEQ ID NO: 655473 - RNA, 64 nt, hsa; identical to SEQ ID NO: 284588

SEQ ID NO: 655474 - RNA, 64 nt, hsa; identical to SEQ ID NO: 284589

SEQ ID NO: 655475 - RNA, 64 nt, hsa; identical to SEQ ID NO: 284590

SEQ ID NO: 655476 - RNA, 64 nt, hsa; identical to SEQ ID NO: 284591

SEQ ID NO: 655477 - RNA, 64 nt, hsa; identical to SEQ ID NO: 284592

SEQ ID NO: 655478 - RNA, 64 nt, hsa; identical to SEQ ID NO: 284593

SEQ ID NO: 655479 - RNA, 64 nt, hsa; identical to SEQ ID NO: 284594

SEQ ID NO: 655480 - RNA, 64 nt, hsa; identical to SEQ ID NO: 284595

SEQ ID NO: 655481 - RNA, 64 nt, hsa; identical to SEQ ID NO: 284596

SEQ ID NO: 655482 - RNA, 64 nt, hsa; identical to SEQ ID NO: 284597

SEQ ID NO: 655483 - RNA, 64 nt, hsa; identical to SEQ ID NO: 284598

SEQ ID NO: 655484 - RNA, 64 nt, hsa; identical to SEQ ID NO: 284599

SEQ ID NO: 655485 - RNA, 64 nt, hsa; identical to SEQ ID NO: 284600

SEQ ID NO: 655486 - RNA, 64 nt, hsa; identical to SEQ ID NO: 284601

SEQ ID NO: 655487 - RNA, 64 nt, hsa; identical to SEQ ID NO: 284602

SEQ ID NO: 655488 - RNA, 64 nt, hsa; identical to SEQ ID NO: 284603

SEQ ID NO: 655489 - RNA, 64 nt, hsa; identical to SEQ ID NO: 284604

SEQ ID NO: 655490 - RNA, 64 nt, hsa; identical to SEQ ID NO: 284605

SEQ ID NO: 655491 - RNA, 64 nt, hsa; identical to SEQ ID NO: 130376

SEQ ID NO: 655492 - RNA, 64 nt, hsa; identical to SEQ ID NO: 130377

SEQ ID NO: 655493 - RNA, 64 nt, hsa; identical to SEQ ID NO: 130378

SEQ ID NO: 655494 - RNA, 64 nt, hsa; identical to SEQ ID NO: 130379

SEQ ID NO: 655495 - RNA, 64 nt, hsa; identical to SEQ ID NO: 359890

SEQ ID NO: 655496 - RNA, 64 nt, hsa; identical to SEQ ID NO: 359891

SEQ ID NO: 655497 - RNA, 64 nt, hsa; identical to SEQ ID NO: 359892

SEQ ID NO: 655498 - RNA, 64 nt, hsa; identical to SEQ ID NO: 359893

SEQ ID NO: 655499 - RNA, 64 nt, hsa; identical to SEQ ID NO: 359894

SEQ ID NO: 655500 - RNA, 64 nt, hsa; identical to SEQ ID NO: 359895

SEQ ID NO: 655501 - RNA, 64 nt, hsa; identical to SEQ ID NO: 359896

SEQ ID NO: 655502 - RNA, 64 nt, hsa; identical to SEQ ID NO: 359897

SEQ ID NO: 655503 - RNA, 64 nt, hsa; identical to SEQ ID NO: 359898

SEQ ID NO: 655504 - RNA, 64 nt, hsa; identical to SEQ ID NO: 359899

SEQ ID NO: 655505 - RNA, 64 nt, hsa; identical to SEQ ID NO: 359900

SEQ ID NO: 655506 - RNA, 64 nt, hsa; identical to SEQ ID NO: 359901

SEQ ID NO: 655507 - RNA, 64 nt, hsa; identical to SEQ ID NO: 359902

SEQ ID NO: 655508 - RNA, 64 nt, hsa; identical to SEQ ID NO: 359903

SEQ ID NO: 655509 - RNA, 64 nt, hsa; identical to SEQ ID NO: 359904

SEQ ID NO: 655510 - RNA, 64 nt, hsa; identical to SEQ ID NO: 359905

SEQ ID NO: 655511 - RNA, 64 nt, hsa; identical to SEQ ID NO: 359906

SEQ ID NO: 655512 - RNA, 64 nt, hsa; identical to SEQ ID NO: 359907

SEQ ID NO: 655513 - RNA, 64 nt, hsa; identical to SEQ ID NO: 359908

SEQ ID NO: 655514 - RNA, 64 nt, hsa; identical to SEQ ID NO: 359909

SEQ ID NO: 655515 - RNA, 64 nt, hsa; identical to SEQ ID NO: 359910

SEQ ID NO: 655516 - RNA, 64 nt, hsa; identical to SEQ ID NO: 359911

SEQ ID NO: 655517 - RNA, 64 nt, hsa; identical to SEQ ID NO: 359912

SEQ ID NO: 655518 - RNA, 64 nt, hsa; identical to SEQ ID NO: 359913

SEQ ID NO: 655519 - RNA, 64 nt, hsa; identical to SEQ ID NO: 359914

SEQ ID NO: 655520 - RNA, 64 nt, hsa; identical to SEQ ID NO: 359915

SEQ ID NO: 655521 - RNA, 64 nt, hsa; identical to SEQ ID NO: 359916

SEQ ID NO: 655522 - RNA, 64 nt, hsa; identical to SEQ ID NO: 359917

SEQ ID NO: 655523 - RNA, 64 nt, hsa; identical to SEQ ID NO: 359918

SEQ ID NO: 655524 - RNA, 64 nt, hsa; identical to SEQ ID NO: 359919

SEQ ID NO: 655525 - RNA, 64 nt, hsa; identical to SEQ ID NO: 359920

SEQ ID NO: 655526 - RNA, 64 nt, hsa; identical to SEQ ID NO: 359921

SEQ ID NO: 655527 - RNA, 64 nt, hsa; identical to SEQ ID NO: 359922

SEQ ID NO: 655528 - RNA, 64 nt, hsa; identical to SEQ ID NO: 359923

SEQ ID NO: 655529 - RNA, 64 nt, hsa; identical to SEQ ID NO: 359924

SEQ ID NO: 655530 - RNA, 64 nt, hsa; identical to SEQ ID NO: 359925

SEQ ID NO: 655531 - RNA, 64 nt, hsa; identical to SEQ ID NO: 359926

SEQ ID NO: 655532 - RNA, 64 nt, hsa; identical to SEQ ID NO: 359927

SEQ ID NO: 655533 - RNA, 64 nt, hsa
uuggaugggaagaugguagcagauaaagacagcugacagauacauagauggaccaguagacaac

SEQ ID NO: 655534 - RNA, 64 nt, hsa
ugugcaaauuuuaaaaaggaacccuuuuccuccagacagauacagccccaaaccagggugcaug

SEQ ID NO: 655535 - RNA, 64 nt, hsa
cucccugcuccaggagggaaaaacagauguuguugacagauagagugauaggcaaauucugugu

SEQ ID NO: 655536 - RNA, 64 nt, hsa
caccauuaauuuugaguauaauuuguuacauagcgacagauaacuauacagcucaacaacuaga

SEQ ID NO: 655537 - RNA, 64 nt, hsa
uccauugagacauuccauuucaaagcaccgugcugacagauaucaaaguacucuagcagggaaa

SEQ ID NO: 655538 - RNA, 64 nt, hsa
aauuuguuugcuguguaaggaagaauguagacaagacagauaaaucugaaggucauguggcauc

SEQ ID NO: 655539 - RNA, 64 nt, hsa; identical to SEQ ID NO: 537060

SEQ ID NO: 655540 - RNA, 64 nt, hsa; identical to SEQ ID NO: 537061

SEQ ID NO: 655541 - RNA, 64 nt, hsa; identical to SEQ ID NO: 537062

SEQ ID NO: 655542 - RNA, 64 nt, hsa; identical to SEQ ID NO: 537063

SEQ ID NO: 655543 - RNA, 64 nt, hsa; identical to SEQ ID NO: 537064

SEQ ID NO: 655544 - RNA, 64 nt, hsa; identical to SEQ ID NO: 537065

SEQ ID NO: 655545 - RNA, 64 nt, hsa; identical to SEQ ID NO: 537066

SEQ ID NO: 655546 - RNA, 64 nt, hsa; identical to SEQ ID NO: 537067

SEQ ID NO: 655547 - RNA, 64 nt, hsa; identical to SEQ ID NO: 300702

SEQ ID NO: 655548 - RNA, 64 nt, hsa; identical to SEQ ID NO: 300703

SEQ ID NO: 655549 - RNA, 64 nt, hsa; identical to SEQ ID NO: 300704

SEQ ID NO: 655550 - RNA, 64 nt, hsa; identical to SEQ ID NO: 300705

SEQ ID NO: 655551 - RNA, 64 nt, hsa; identical to SEQ ID NO: 300706

SEQ ID NO: 655552 - RNA, 64 nt, hsa; identical to SEQ ID NO: 300707

SEQ ID NO: 655553 - RNA, 64 nt, hsa; identical to SEQ ID NO: 300708

SEQ ID NO: 655554 - RNA, 64 nt, hsa; identical to SEQ ID NO: 300709

SEQ ID NO: 655555 - RNA, 64 nt, hsa; identical to SEQ ID NO: 300710

SEQ ID NO: 655556 - RNA, 65 nt, hsa
cugggggaagagccucccauaaaaucacaccuacucugugguaagaauaaaaucccacccaccug

SEQ ID NO: 655557 - RNA, 65 nt, hsa
cagugaccgaaagaacccggugugccgggagauggcugugguacugcuggccaaccuggcucagg

SEQ ID NO: 655558 - RNA, 65 nt, hsa
ugugggcccuuauugcagcugucucacagccugagcugugguacagagaaauggggguucuccuu

SEQ ID NO: 655559 - RNA, 65 nt, hsa
gcuugaaggcacauggcuuucucauguagggcucucugugguauuuguuauuauuuugcaacaag

SEQ ID NO: 655560 - RNA, 65 nt, hsa
uaacuucagcuccagcugguuuuugacagcuguugcugugguaauauuuuugacaugugauggug

SEQ ID NO: 655561 - RNA, 65 nt, hsa
uaucggugacuccguauuaugacuccauuagugagcugugguauggguaggauuuuccuacuucu

SEQ ID NO: 655562 - RNA, 65 nt, hsa
uagcaagauagucuucaguuucauuuuccugugcccugugguaguuggaaacaaaucauaaugua

SEQ ID NO: 655563 - RNA, 65 nt, hsa
uuuaacaugauaaaugaauuuaccaguuuaguaugcugugguauuuuaauaaguuuucaaagaua

SEQ ID NO: 655564 - RNA, 65 nt, hsa
acuuucugaagcuaaagaccacaccugaaucagggcugugguaaucaucuuaccauagcuguaaa

SEQ ID NO: 655565 - RNA, 65 nt, hsa
gggaacauacuucuaaguucccugcagucucuguccugugguagaccaucuuuuuguaaacugcg

SEQ ID NO: 655566 - RNA, 65 nt, hsa
gacaaaaacagagagaccgcagaaggaggaagauacugugguacugucauaaaaaacaguggagc

SEQ ID NO: 655567 - RNA, 65 nt, hsa
uacugauuguguuuggauaauuugggaauuuucgacugugguaaaauauacauaaaauaauacuu

SEQ ID NO: 655568 - RNA, 65 nt, hsa
ugucuuauuccgcuugaaaauagccaaaaagucuacugugguauuuguaauaaacucuaucugcu

SEQ ID NO: 655569 - RNA, 65 nt, hsa
guuaaccaggcaagacacaagccuuggcuggaaaacugugguagagccgggcuguggcucaggua

SEQ ID NO: 655570 - RNA, 65 nt, hsa
guuauugauucacucuucucaacuugacagucuaccugugguauaacugucagguaaaaacauac

SEQ ID NO: 655571 - RNA, 65 nt, hsa
guacauuugaaggauuuggcauauuuugccuauuucugugguaguguaauuugaggaauacagug

SEQ ID NO: 655572 - RNA, 65 nt, hsa
ggcagggagugcuccggagggaggcagaggggagacugugguagaaggaagacagaacucacaca

SEQ ID NO: 655573 - RNA, 65 nt, hsa
uccugggugucccagggacugugugcucaggagcacugugguagagcacuggcccugccuugaga

SEQ ID NO: 655574 - RNA, 65 nt, hsa
uaauuuuuuuaaauaucaacuaaaauaucauaguucugugguagacauuguuuuauaaugaaaua

SEQ ID NO: 655575 - RNA, 65 nt, hsa
uaauuugaaaccugaaaugccucuuuagcaaaagccugugguaugggguaaagccauguaagaag

SEQ ID NO: 655576 - RNA, 65 nt, hsa
ccugugaagacugggugaggauaacacaaguaaaacugugguacugauggacuuaaccggaguuc

SEQ ID NO: 655577 - RNA, 65 nt, hsa
uuuaaguguuuagaaaucauagaagguguaggcugcugugguaauucuauuuguauaucucaaca

SEQ ID NO: 655578 - RNA, 65 nt, hsa
ucaaacucagccuauuccuuguucccugguggggucugugguaagggucagggaagggcauauag

SEQ ID NO: 655579 - RNA, 65 nt, hsa
ccaugguucuuuauguuuguagucuugaugugcuccugugguauuacuuccccucugauaggaca

SEQ ID NO: 655580 - RNA, 65 nt, hsa
gcaggccuccagcucgguccaggugauucuggccucugugguaggaggcagggagaguaagacau

SEQ ID NO: 655581 - RNA, 65 nt, hsa
guguaaugagcuagagauaauauuuuaagugucuucugugguauaugugggagggccauuaagga

SEQ ID NO: 655582 - RNA, 65 nt, hsa
aggugcugugagaagugcaccaggcagcuuucucucugugguagacuaggcaugucuggggaugg

SEQ ID NO: 655583 - RNA, 65 nt, hsa
gugacuauuugaggauuuugaaaacaucagauuugcugugguaugggagaaaaggcuauguacuu

SEQ ID NO: 655584 - RNA, 65 nt, hsa
caccccauucuacuccauggccucucugcucccagcugugguaggcucacauagccagugugauc

SEQ ID NO: 655585 - RNA, 65 nt, hsa
uuugccuauuucgcuaacaguuugguuuuuaauggcugugguauuugagugaggcaacucugggg

SEQ ID NO: 655586 - RNA, 65 nt, hsa
gaggggaacuuaacuauuaacuacaaguuguaugucugugguaucuugauuuucccauuucuaaa

SEQ ID NO: 655587 - RNA, 65 nt, hsa
cagcagugugugagaagagcagccuuccuuugucccugugguauucauaaaguacccgcuccacc

SEQ ID NO: 655588 - RNA, 65 nt, hsa
ugagcccugcuugguugucuccacacacagcugggcugugguagggggugucucaggccacaccg

SEQ ID NO: 655589 - RNA, 65 nt, hsa
guaucagaaccacaugaaguuauagccucuaaagccugugguauuuuauauaauauuuuuauaac

SEQ ID NO: 655590 - RNA, 65 nt, hsa
gcuuuuugguugcuguugaguuuuuguuuugucuucugugguaagaacacuuaacucaagaccua

SEQ ID NO: 655591 - RNA, 65 nt, hsa
auggcucuuguuuaucagcuaaucuugaauuuauucugugguaaaucuuuugaguuguugaguau

SEQ ID NO: 655592 - RNA, 65 nt, hsa
aucccugaaaaucauuuacagauaaccacaauuugcugugguauauaaacuaauucuuggucuau

SEQ ID NO: 655593 - RNA, 65 nt, hsa
aaauagcuucauugaucaacauuucauaaaugcaucugugguagagguagaaagcagcaccuuuc

SEQ ID NO: 655594 - RNA, 65 nt, hsa
auuugagagaaauuauucagauuuuauuuuuguaucugugguaacaaaacauuaaccaaaagauu

SEQ ID NO: 655595 - RNA, 65 nt, hsa
ugcggacgccggcuguucuucccgccacgaucuuucugugguagcggccagcagaagacauggcc

SEQ ID NO: 655596 - RNA, 65 nt, hsa
auggccuaacuaucgggaaauuugagugucaguaacugugguagacucagaaauucgucuuuguc

SEQ ID NO: 655597 - RNA, 65 nt, hsa
ucccuuuuugcuuaaccuggagugaagagguagaacugugguauuauggaugagguuucuaugag

SEQ ID NO: 655598 - RNA, 65 nt, hsa
ugacucuguuuugauuggguacagauuuggugacucugugguaaagacuauaauuauuucuauaa

SEQ ID NO: 655599 - RNA, 65 nt, hsa
ugcaaccuaauugcaucuaaaacuaugaauaaguucugugguaaaaucuuaaacuauggaaaauu

SEQ ID NO: 655600 - RNA, 65 nt, hsa
uuaacuuaauuuuuuuuccuuuaccucauaugcagcugugguagaaauaugaauaauguuaaguc

SEQ ID NO: 655601 - RNA, 65 nt, hsa
ggucccucaccuggcuagggagauaccgaagccuacugugguacugaagacuucuggguucuuuc

SEQ ID NO: 655602 - RNA, 65 nt, hsa
uccuuugacuucuguaaaaugugaccguuugacaucugugguagauugaacggaauaucacagcu

SEQ ID NO: 655603 - RNA, 65 nt, hsa
ggggcugggcagucgccccccacuucccagcagcucugugguaguggggcgggagcagcagggac

SEQ ID NO: 655604 - RNA, 65 nt, hsa
uguuaaauuaauuauaaugggauuggguuuguuaucugugguaguauauauccuaguguuccuau

SEQ ID NO: 655605 - RNA, 65 nt, hsa
ugcugcccuugugcaguuuggucagucugugggcucugugguauaugacugcuucgaggcugccc

SEQ ID NO: 655606 - RNA, 65 nt, hsa
ugaccuuguucaaucacuaugaagcagagugaaagcugugguagagugguuaacagauacaagug

SEQ ID NO: 655607 - RNA, 65 nt, hsa
uaccaaaauguccaccaauagaaugagugaaucaccugugguauauuuauaaauaaaaauauuaa

SEQ ID NO: 655608 - RNA, 65 nt, hsa
aaauauuuauauugaauucugaauacaaaaugucccugugguagaaaacuuacucuuuaugccug

SEQ ID NO: 655609 - RNA, 65 nt, hsa
accuggaugugugacacacaguuuuggaaaaaggucugugguagucuggaguugaugaggaaggg

SEQ ID NO: 655610 - RNA, 65 nt, hsa
caucuuaagaaguaaagaucaggacuuuuuaauuacugugguaauuaaauguguucaguauguac

SEQ ID NO: 655611 - RNA, 65 nt, hsa
auacuccaaaaccuagaaaugcuguaggaauaaaucugugguaacuauagagguuuaacuuauau

SEQ ID NO: 655612 - RNA, 65 nt, hsa
cagaaagcuaggugcucugucacccccaggaggcgcugugguacuggggcugcugcuauuuaagc

SEQ ID NO: 655613 - RNA, 65 nt, hsa
cuuuucaguguuuggagacauuucucaauccccugcugugguaggaacuccaguggugaacggcu

SEQ ID NO: 655614 - RNA, 65 nt, hsa
aaggugcauaugcaugucucaauuucuaccuuuuucugugguaucggcuauacuagggaaccauu

SEQ ID NO: 655615 - RNA, 65 nt, hsa
aauauauacauugauuuuucauaauuuaucaaagccugugguacgcacugaauuuucuuugucac

SEQ ID NO: 655616 - RNA, 65 nt, hsa
cagcuucacccccuggcuuugugucuauggguggccugugguauauggaaaaguagcaggguggu

SEQ ID NO: 655617 - RNA, 65 nt, hsa
uaucaguaaucucuuggacuuuguuaaauauuuuacugugguaauauagagaagaauuaaagcaa

SEQ ID NO: 655618 - RNA, 65 nt, hsa
uuaaaggaguuagagagcuauauuaaacaguuuuucugugguauaauaaugugucucuuacuaga

SEQ ID NO: 655619 - RNA, 65 nt, hsa
ucccuaaaaaaguaaaacagacaagguucugaguccugugguauguccccuagcaaauguaacua

SEQ ID NO: 655620 - RNA, 65 nt, hsa
uugugaccaaguuauaaaucaaugucacuuaaaggcugugguaguacuccugcaaaauuuuauag

SEQ ID NO: 655621 - RNA, 65 nt, hsa
cagaagaugaugaauugugaucaggaccaagaucccugugguaaacacucugauugaaucugggg

SEQ ID NO: 655622 - RNA, 65 nt, hsa
ucuaucuugcugaaauauugcuucauauuuauagccugugguagugcacaugguuaacauaaaag

SEQ ID NO: 655623 - RNA, 65 nt, hsa
acauuuauaagaaccaguauggauacauccauucacugugguacauuuuaaaauaaaauauuuua

SEQ ID NO: 655624 - RNA, 63 nt, hsa
uuagggcugagaauucauaaaaaaauucauucucugugguauccaagaaucagugaagaugcc

SEQ ID NO: 655625 - RNA, 65 nt, hsa
aucaguaguaccaaaggaucuuuuuacaaggcuuccugugguauugacucugagaauaacacaua

SEQ ID NO: 655626 - RNA, 65 nt, hsa
ugaaauuaguagaaucagggaggacgggacuuaugcugugguaggcaacagaaaaaaacuucuau

SEQ ID NO: 655627 - RNA, 65 nt, hsa
auauaaguuauuuaauauaauaaugaagcucaacacugugguaggaaaauagccacuagaaagaa

SEQ ID NO: 655628 - RNA, 65 nt, hsa
aauuagauugguaaauacauguauucauacauacucugugguaauagagacuugagcuggaucug

SEQ ID NO: 655629 - RNA, 65 nt, hsa
uugugcuucagcucauuuuccauauuuuuaaaacccugugguaaaagccucaaugaaaucauuua

SEQ ID NO: 655630 - RNA, 65 nt, hsa
uuaaaggaaacaaguagaaaucagcaguggagugucugugguaagaaaacaugaacuuuaugcuu

SEQ ID NO: 655631 - RNA, 65 nt, hsa
gacagcuugacugcuuuuaaaugaccaaagaugaccugugguaagcaaccugggcaucuuaggaa

SEQ ID NO: 655632 - RNA, 65 nt, hsa
acuugccaagcccuuaacucuacuuccucuucagucugugguacuccuccuaacccuaaacccuc

SEQ ID NO: 655633 - RNA, 65 nt, hsa
cuuucuucccccugggauaugaugugugguguuuccugugguaaaagacugaggcaggccagggg

SEQ ID NO: 655634 - RNA, 65 nt, hsa
agcagggggacaugugucccucagcucagcagaggcugugguacaacaugguccuuggugaagac

SEQ ID NO: 655635 - RNA, 65 nt, hsa
uuugacuucuguggcauggugcuagugcauguacccugugguauugccccucuguccguagugug

SEQ ID NO: 655636 - RNA, 65 nt, hsa
cuaacgaggcugccuccagcauuuccugauuuccucugugguaauaaaagcuuucugugcuuagg

SEQ ID NO: 655637 - RNA, 65 nt, hsa
augcgggaagcagccgcggggagguaaugaauugucugugguaucaugucagcagagucuccaag

SEQ ID NO: 655638 - RNA, 65 nt, hsa
acugaagagaauguuuaugaggaguguguauguaccugugguauaccaaauagcauacauguaca

SEQ ID NO: 655639 - RNA, 65 nt, hsa
aagaaauggaauaauuuaaaugugaggaaagauaucugugguagacauguccuuccaugacuaau

SEQ ID NO: 655640 - RNA, 65 nt, hsa
uccucuauuaauuacugugugugagccagagggagcugugguaaggguugggcccccagccugua

SEQ ID NO: 655641 - RNA, 65 nt, hsa
uaccuuccuacuggagcuugauguuauauuagggacugugguauaauuauuuuaauaauguugcc

SEQ ID NO: 655642 - RNA, 65 nt, hsa
gcucaggcagacucaccucacauacucccugcucccugugguagagacaccugagagaaagggga

SEQ ID NO: 655643 - RNA, 65 nt, hsa
gccuucagucaccugaucagcagagagacucucagcugugguacugcccuguaagaaccugcccc

SEQ ID NO: 655644 - RNA, 65 nt, hsa
ggcacuugcagggccugggaugagcagucuucaagcugugguaguuagcgggcaggagagcgaca

SEQ ID NO: 655645 - RNA, 65 nt, hsa
gacuucugacucuccuuccaccuccccacuguacacugugguacagauaguuggcacuauccuag

SEQ ID NO: 655646 - RNA, 65 nt, hsa
cgggugccagcaugcuaugggcuccugcgugaggccugugguacacagagauuagguugugauac

SEQ ID NO: 655647 - RNA, 65 nt, hsa
ucucuaugccaccacuggccaccuagagcccuuggcugugguaauccaggguaauugcgcagagg

SEQ ID NO: 655648 - RNA, 65 nt, hsa
ggaaacaauaaauuccugagauacauucuuccaaucugugguaauaauaagaauuccucucugcc

SEQ ID NO: 655649 - RNA, 65 nt, hsa
ccaagcugugauaaguggaaugguuacuguuuauacugugguauguuuuugauuacagcagauaa

SEQ ID NO: 655650 - RNA, 65 nt, hsa
cagauuuuaaauuguauguguacuugcaucuaagacugugguagagaaguaaagagaagucaauu

SEQ ID NO: 655651 - RNA, 65 nt, hsa
guucuguuuucuugagacauuuaaucuggugguaacugugguaacauugcagcccuaagcagcau

SEQ ID NO: 655652 - RNA, 65 nt, hsa
cauagugccauuggauagggaagaacuucagaaaucugugguacucuuggccuugucuuugucuu

SEQ ID NO: 655653 - RNA, 65 nt, hsa
acaugguuaacauucauaaauggugggggcccuuacugugguagaaaccauugucacugcaaggc

SEQ ID NO: 655654 - RNA, 65 nt, hsa
cuaggcaccugcuguucuuucaggaaacagcuuggcugugguaaugcucuacugggcccuucaga

SEQ ID NO: 655655 - RNA, 65 nt, hsa
gagaaggugagagacaaaaauggaaagauccuggccugugguagugguagcaguuuucucaaaua

SEQ ID NO: 655656 - RNA, 65 nt, hsa
uuuuuuuaacaaaacuaaaaaugaaacacaugugucugugguaucuauaagugcuucgucccuuu

SEQ ID NO: 655657 - RNA, 65 nt, hsa
caugaacuccugauggaacaauaacaggcccaagccugugguaugaugugcacacuugcuagacu

SEQ ID NO: 655658 - RNA, 65 nt, hsa
cccaagaccaggagggggcaaugggcccagccuuucugugguaucugaugcaggaaggacugcag

SEQ ID NO: 655659 - RNA, 65 nt, hsa
uaucuacauagauaugcuuugcugagaaguuaggucugugguagaccagaaaccacaaauugacu

SEQ ID NO: 655660 - RNA, 65 nt, hsa
cuugaaaagcuuucuuguuaaaauaaaaggugucacugugguaggcauuuggcauauuuugugga

SEQ ID NO: 655661 - RNA, 65 nt, hsa
gaauucuuucugacagccuaggaguuaucuucccacugugguaaccccccauguggcacccaggg

SEQ ID NO: 655662 - RNA, 65 nt, hsa
cacaccccuggggcugagucuccagggccccccaacugugguagcuccagcgauggugcugccca

SEQ ID NO: 655663 - RNA, 65 nt, hsa
uuguugcaucccucaauugaaugagggccauaucccugugguauuccuuuccugcuuuggggcuu

SEQ ID NO: 655664 - RNA, 65 nt, hsa
guuuacaaacauggaaaacagaguauuucuggcagcugugguacaaaugugauaauauauugcua

SEQ ID NO: 655665 - RNA, 65 nt, hsa
ggccccccagaccauaccucugacccacccagccccugugguagccccagcaguucucagggugc

SEQ ID NO: 655666 - RNA, 65 nt, hsa
gacaggagcagggccccugucccucucuucuggcccugugguacccaggccacacguugugcccg

SEQ ID NO: 655667 - RNA, 65 nt, hsa
ccacaggaauaucuucuguuguacagucuaauaagcugugguaggaaguaucauguaaucacagu

SEQ ID NO: 655668 - RNA, 65 nt, hsa
agugaagggauacugcaggccuguguuugcagcgccugugguaacuguggaaugagcucuguuag

SEQ ID NO: 655669 - RNA, 65 nt, hsa
agaaaugguuuucuuaaauaccuacaaaaaaguuacugugguaucuaugaguuaucaucuuagcu

SEQ ID NO: 655670 - RNA, 65 nt, hsa
uguaucuuuuucaagaagaaucucuuauggacagucugugguaaagaagcaacucuuugcuuuag

SEQ ID NO: 655671 - RNA, 65 nt, hsa
ccugcccaagcuucucccccagccacccucugccccugugguagagcccacuauaggcccaggcg

SEQ ID NO: 655672 - RNA, 65 nt, hsa
aguggauuuauccugcagcucaagcagcuucuugccugugguaauaccaaguuugaggcauugac

SEQ ID NO: 655673 - RNA, 65 nt, hsa
uuguggguacuuuaagguuuggagcacuuacaaggcugugguagaaucauaccccauggauacca

SEQ ID NO: 655674 - RNA, 65 nt, hsa
ggaaaaaaguaucuuuaacagcucuuuguugaagccugugguagcacauuauguuuauaauugca

SEQ ID NO: 655675 - RNA, 65 nt, hsa
cgagguuuuuauuuguucgguauuguuuuuuuacacugugguacauauaagcaacuuuaauaggu

SEQ ID NO: 655676 - RNA, 65 nt, hsa
cacagaaagggucaugaagcccuggcccaacaggacugugguacuaggggcugggaugugggguu

SEQ ID NO: 655677 - RNA, 65 nt, hsa
ccccccuaauaaauuaauuuaaaaagccccccaaucugugguauuuuauuauggcagcccuagca

SEQ ID NO: 655678 - RNA, 65 nt, hsa
gggagggaugguuugggcaggugcagauccaagggcugugguaaacgggagagcuuguguuuuug

SEQ ID NO: 655679 - RNA, 65 nt, hsa
aguaagcagagacaguguuaaggacgaguuggugucugugguagcuuuuaggcugcuccuaaccc

SEQ ID NO: 655680 - RNA, 65 nt, hsa
ucaggugugaccguuggugaaaacuugugccccuucugugguaugcccuugcccuguucuauaaa

SEQ ID NO: 655681 - RNA, 65 nt, hsa
ugucuuuuugugauguuauauaaaauuguagaugacugugguaaauguguaauuauguccauuau

SEQ ID NO: 655682 - RNA, 65 nt, hsa
guaauuuaagaaccuucaccaagauacaauguauacugugguacaaugacagccauuguuucaua

SEQ ID NO: 655683 - RNA, 65 nt, hsa
cuguuuaaaauauuuuaaauuugcauaucacaacccugugguaguaugaaauguuacuguuaacu

SEQ ID NO: 655684 - RNA, 65 nt, hsa
cuucugaauccuuagaauggccucuuuguagaacccugugguauagaggaguauggccacugccc

SEQ ID NO: 655685 - RNA, 65 nt, hsa
gaaaccauuauauuuuacuaucugcaugcuguuaacugugguacacugugaaauauguugauuac

SEQ ID NO: 655686 - RNA, 65 nt, hsa
ugaaauauuugccauuguuguuuaaauaccuaucacugugguagagcuugcauugaucuuuucca

SEQ ID NO: 655687 - RNA, 65 nt, hsa
uggacagacuucaauuugccauuuugagauuugaccugugguagcaucugggccuaauguuggcu

SEQ ID NO: 655688 - RNA, 65 nt, hsa
ggauagagaucccaacuugaaacaacagccagugccugugguaacuuaaugucuugucaaauacu

SEQ ID NO: 655689 - RNA, 65 nt, hsa
caugaagucuuuucuugcaagacguuuuucuucugcugugguaucuugcccuuaaaaauuaguuu

SEQ ID NO: 655690 - RNA, 65 nt, hsa
uagaggauacuuucuggguuuggaaggugugcuugcugugguacugggugagcggcucaugugug

SEQ ID NO: 655691 - RNA, 65 nt, hsa
cagaaccccggccuugcaguuguggcagguuuccacugugguaagcuagguucauuccucaucaa

SEQ ID NO: 655692 - RNA, 65 nt, hsa
augauaucuaguccauuaacucuuugggccaugaccugugguaccuaguuaugguagugcaaauc

SEQ ID NO: 655693 - RNA, 65 nt, hsa
ucauuaaggcaucuaugggcauuaugagcuaaaagcugugguauguuagcuuuaaaagaguauuu

SEQ ID NO: 655694 - RNA, 65 nt, hsa
ugucccuaguccuaagcuuugguucuuuagggugacugugguaagaaggauauuuaaucaugaca

SEQ ID NO: 655695 - RNA, 65 nt, hsa
ucacauuacuacaaaauggggagaaaacuguuugccugugguagacaccugcacgcauaggauug

SEQ ID NO: 655696 - RNA, 65 nt, hsa
auaacuaaaauuguucacaacuugaaaugcuuuaacugugguauugagacaugaugagaagccgu

SEQ ID NO: 655697 - RNA, 65 nt, hsa
auggaccugguggcuucuccaucccacuguggccucugugguauggaccugguggcuucuccauc

SEQ ID NO: 655698 - RNA, 65 nt, hsa
aaccccaaauguccauccacagacgaauguauaaacugugguauccauuacacaauagacuacuu

SEQ ID NO: 655699 - RNA, 65 nt, hsa
uuaggaaggaaucuuuuuuuaaagacuuccaucuacugugguauuauacccaagccuagugugua

SEQ ID NO: 655700 - RNA, 65 nt, hsa
agggcugaccuccguuucuggggaauguggcugagcugugguaaccagcuacaccccaggugcuc

SEQ ID NO: 655701 - RNA, 65 nt, hsa
aaaaagaguuguauaaucuuguagaauuucucauucugugguacaacccagggguaaacuauuau

SEQ ID NO: 655702 - RNA, 65 nt, hsa
uccaguuucagaagcaggcagggcaaaggucaagacugugguauuggggucuuuuggcucugaag

SEQ ID NO: 655703 - RNA, 65 nt, hsa
gcggguggugauaauaggggcuggaaagccagcagcugugguacuccagacaaaaggugagugac

SEQ ID NO: 655704 - RNA, 65 nt, hsa
uuuaugaaauaaaaacaugagucacagcuuuuguucugugguaaccuauaaaaaaaguuugucuu

SEQ ID NO: 655705 - RNA, 65 nt, hsa
agaccaugcccgggccucuucacugcugccaggggcugugguaccugcagcgugggggacgugcu

SEQ ID NO: 655706 - RNA, 65 nt, hsa
cuggcaucacacgcagguuaccuuggcgugugucccugugguacccuggcagagaagagaccaag

SEQ ID NO: 655707 - RNA, 65 nt, hsa
caaagcuuuuuaaugcauaaaaguauaauugaaaucugugguauuuauuuacaaacaugucuaca

SEQ ID NO: 655708 - RNA, 65 nt, hsa
acuccccacacuccggggcagaucuuuccucuugucugugguaaggaaggagucuugaccauaga

SEQ ID NO: 655709 - RNA, 65 nt, hsa
agucuuuugugcaauuguuucucacccugcugauucugugguaucuguguugaauaaagaaaaag

SEQ ID NO: 655710 - RNA, 65 nt, hsa
cucuuacuuuaaaaacuggucuuuuuauuuacccucugugguagaagagucaccagcagguucca

SEQ ID NO: 655711 - RNA, 65 nt, hsa
cucuggagaaauaccuccccucucuggggugcuuccugugguagugucuuucagguauccguucc

SEQ ID NO: 655712 - RNA, 65 nt, hsa
uaugggaugaaauauuucaaaagaggauaaauccucugugguaagccauuuggaaaauccuacca

SEQ ID NO: 655713 - RNA, 65 nt, hsa
uccagagauucaguauuaaaaaaaaaaaaauuacacugugguaguggcauuuaaacaauauaaua

SEQ ID NO: 655714 - RNA, 65 nt, hsa
ugacaauguuggaagucaucuggaaaagagaaccucugugguaauguggucucauuaaagucaag

SEQ ID NO: 655715 - RNA, 65 nt, hsa
cccccaaacuccuucuccacuggaguuaggagggccugugguagacagcgugaaucaugaaaaua

SEQ ID NO: 655716 - RNA, 65 nt, hsa
uaaaagaugaacucuuugagaugauuucucaccugcugugguaucuugcaggaacugugugcuaa

SEQ ID NO: 655717 - RNA, 65 nt, hsa
gucaugagcaaguuuucuguggacuguuccccccacugugguaggacaggacuggcccacuuagu

SEQ ID NO: 655718 - RNA, 65 nt, hsa
gugauauucugcugugcaaauccaugcaaaacugacugugguagugaaaagucuguagaaaagua

SEQ ID NO: 655719 - RNA, 65 nt, hsa
uuuugacucaaauugcuacaguugccaucaccuuucugugguaauacuacugauauuugcuuuuc

SEQ ID NO: 655720 - RNA, 65 nt, hsa
gacaggccuguccaacacaucucccuuuuccaugacugugguagccagcaucggaaagaacgcug

SEQ ID NO: 655721 - RNA, 65 nt, hsa
auaucuugagcuuuacugaggaauauucucacgcucugugguauuugaaucauuuugccagguca

SEQ ID NO: 655722 - RNA, 65 nt, hsa
augagaaacaugagggaaauuguggaguuagccuccugugguaaaggaauugaagaaaauauaac

SEQ ID NO: 655723 - RNA, 65 nt, hsa
uuaguaauuaugcaguauguacucuauuuaaggaucugugguaguauaacaugagugaaugucau

SEQ ID NO: 655724 - RNA, 65 nt, hsa
cuccaggcauuuagcccucacauuagaucuaguuacugugguauggcuaauaccugucaacauuu

SEQ ID NO: 655725 - RNA, 65 nt, hsa
uuugccuugccaaguauaacuuguauaucuugacucugugguagauuucaaguucaauguuauuu

SEQ ID NO: 655726 - RNA, 65 nt, hsa
cugcugucaugucugggucuuuaggguaggacaggcugugguaugagaggcaggagucuccacaa

SEQ ID NO: 655727 - RNA, 64 nt, hsa
acauggaauccagucugugacaguguuuuucacucugugguaagcugaggaauaugucacauuu

SEQ ID NO: 655728 - RNA, 65 nt, hsa
gcaggaaugaagccaauaauuuauugcuuuccauucugugguaugaugugcgugugcgugagugu

SEQ ID NO: 655729 - RNA, 65 nt, hsa
uucucuuguguguaccuaaagccauauuuccaagucugugguacuccaggauuccaggaguaagc

SEQ ID NO: 655730 - RNA, 65 nt, hsa
uacuccauuaacauccucacuguuuagacacauaacugugguacaguguauuggaaauuuuauaa

SEQ ID NO: 655731 - RNA, 65 nt, hsa
cugcuagauuguaauauuuaaggucgaauuucgaccugugguacacagcugugcuguggcucagu

SEQ ID NO: 655732 - RNA, 65 nt, hsa
cugucaugggagccauucugccaauuuaaaugcgacugugguauaaacaguaaaaugauuuaaaa

SEQ ID NO: 655733 - RNA, 65 nt, hsa
cuuccacuuccuccccaaaagggaugaagaaaacccugugguagaaccaaaccacccaaggccag

SEQ ID NO: 655734 - RNA, 65 nt, hsa
cugaccccagcccagacagcaagguguggaggcuccugugguaguccucccaagcugugcuggga

SEQ ID NO: 655735 - RNA, 65 nt, hsa
gaagguaaacuuccuugaggagaagugaaguuucacugugguauggccauugaaaaacaaaaacu

SEQ ID NO: 655736 - RNA, 65 nt, hsa
gucgcguagcccaggguggaggcagaacgaugcugcugugguagcccuuugccuuucaugcccau

SEQ ID NO: 655737 - RNA, 65 nt, hsa
caacucuagguuucaaguacuccuuuucuccgauccugugguacuugaauauccaaaaacccugc

SEQ ID NO: 655738 - RNA, 65 nt, hsa
gggaggaaagagcugcguggauagauucaaacuuccugugguagugcucccagucugaccucugu

SEQ ID NO: 655739 - RNA, 65 nt, hsa
uuugguucaucagugaauucaccauccaggagagacugugguauauauuuuaaaccuguugggcc

SEQ ID NO: 655740 - RNA, 65 nt, hsa
uuaauccuuaucuuagggauacuugaacacaaacacugugguaggauaacaguauaucugauuaa

SEQ ID NO: 655741 - RNA, 65 nt, hsa
uaauaugcaaauucccaccacuuacuuccaugaagcugugguacccaauugccgccuugugucuu

SEQ ID NO: 655742 - RNA, 65 nt, hsa
gaugaguucuuggcaagggccagcguuagaaaucacugugguacuagagccguucuucaccacgc

SEQ ID NO: 655743 - RNA, 65 nt, hsa
agcaauaaauguuugauguuuauaagccacccagacugugguauuuuguuauagcagccugaaca

SEQ ID NO: 655744 - RNA, 65 nt, hsa
cuagaaaccacaagaugauggagaggucauaaaaacugugguaguaugcuuagaaacuguugauu

SEQ ID NO: 655745 - RNA, 65 nt, hsa
aaugaaaaaaaaaauccaaaacagaacaagcccuucugugguauuugcuuuuuaucagaaagaac

SEQ ID NO: 655746 - RNA, 65 nt, hsa
aagguggagcuuuccuggcccugggaggaagcuggcugugguagcguagcgcucucucucucugu

SEQ ID NO: 655747 - RNA, 65 nt, hsa
uacccaaaacugagucccuuugggcucagaaaugucugugguauugggucagacucugaccacag

SEQ ID NO: 655748 - RNA, 65 nt, hsa
uugcccuuggccuggcucccugcccggggcuggugcugugguaccuacaucuucaggaagcugug

SEQ ID NO: 655749 - RNA, 65 nt, hsa
ccuugccagcugacgucacagucuaagaugggaaacugugguacagauagacaugaagagagcuu

SEQ ID NO: 655750 - RNA, 65 nt, hsa
auugaguugcuggaaugaaguagaggugacucucucugugguacacauugaauguacuauguaug

SEQ ID NO: 655751 - RNA, 65 nt, hsa
ggguugccuagcgacucuucuggcacagggugugucugugguauaccugugaggugguugacaau

SEQ ID NO: 655752 - RNA, 65 nt, hsa
acaucuacacugcugcucuucaccauuggaauucacugugguauuuauaguauuggcuucagucc

SEQ ID NO: 655753 - RNA, 65 nt, hsa
aaagaccaaccggcaaacuuucagaugaaugcuuacugugguauuuggaauguauguaucuucug

SEQ ID NO: 655754 - RNA, 65 nt, hsa
gguugugacuuccccuuaaguauaacuaauuugcucugugguaagagauaugcucauuauuacca

SEQ ID NO: 655755 - RNA, 65 nt, hsa
cguccugagaaggacgguguaaugcaaggaaauggcugugguaacacugauccuucagaagaagc

SEQ ID NO: 655756 - RNA, 65 nt, hsa
gcagagccggacccaguggcuacacccacagcggucugugguagagaacucucuuccuucuuucc

SEQ ID NO: 655757 - RNA, 65 nt, hsa
agauaugcuucgagcacuuuucuaacuaaugagcucugugguaagaaaaaaugaacucuuucaau

SEQ ID NO: 655758 - RNA, 65 nt, hsa
uuugucagaucacacauauauuguguuauugggcgcugugguaucuuuuauaaaaccucuugcuu

SEQ ID NO: 655759 - RNA, 65 nt, hsa
accaggcccuaauaauagaaguuguaccaaaaugccugugguacuugauggccuguuggucaaau

SEQ ID NO: 655760 - RNA, 65 nt, hsa
ccuaccuaagucagucacuuugcuaaauucuucaccugugguaacucauuuugauuguuauaaca

SEQ ID NO: 655761 - RNA, 65 nt, hsa
ucccauaucaaaaagccuuuggaguguggagcuuucugugguauggcagaaauggguggauggca

SEQ ID NO: 655762 - RNA, 65 nt, hsa
uaccaguccauaccagcugcgauuugugaguggaccugugguaagaagaauagaaaaggcucuca

SEQ ID NO: 655763 - RNA, 65 nt, hsa
uuuugugucauuuauucaaguauugagaaccuggccugugguaggcacuguacuuaauacuagga

SEQ ID NO: 655764 - RNA, 65 nt, hsa
aguggugcuuacgcuccaccaagaaagcaggaaaccugugguaugaagccagaccuccccggcgg

SEQ ID NO: 655765 - RNA, 65 nt, hsa
gcugguuuugcugugagcugcaguguucugugggucugugguaucugacacuguggacauuaaug

SEQ ID NO: 655766 - RNA, 65 nt, hsa
gaugacauggucaucuacaacuaauauuaagacuccugugguauugauugagcagagcagaagag

SEQ ID NO: 655767 - RNA, 65 nt, hsa
agcaggggcuggaugccuuucaucccaacuauucucugugguaucaaaaagaaaaaaaaaaaaaa

SEQ ID NO: 655768 - RNA, 65 nt, hsa
aaacugucuggggugauuccuagaagaucauuaaacugugguacauuuuuuugucuaugaauguu

SEQ ID NO: 655769 - RNA, 65 nt, hsa
uauuucuuuauucaguauaauagcacuggaggagacugugguagccaucuucguaaauuuaaacu

SEQ ID NO: 655770 - RNA, 65 nt, hsa
gugagccagguauuuacagcaacucaauucuaccacugugguaugaaaacagcuauagacaauca

SEQ ID NO: 655771 - RNA, 65 nt, hsa
ccacgcggcugguagugcagccuucugugaccccgcugugguaaguccagccugcccagggcugc

SEQ ID NO: 655772 - RNA, 65 nt, hsa
aaaugauaaaacagaauauugacaagcuaggacaccugugguaucuuuaauuguaucuccuucag

SEQ ID NO: 655773 - RNA, 65 nt, hsa
gcuuuugacaucagauuuucauuugagagggagagcugugguacuggcuaaaaagaaaggaagau

SEQ ID NO: 655774 - RNA, 65 nt, hsa
accugcccuucagaauucgguucacuugggggcuucugugguagagacuaacuggccuucugaug

SEQ ID NO: 655775 - RNA, 65 nt, hsa
uuuugugauuucuguauaggacucuuuaucuugagcugugguauuuuuguuuuguuuuugucuuu

SEQ ID NO: 655776 - RNA, 65 nt, hsa
ugggucauuuaaaguccuguaugaaccauaaccugcugugguaccuuuguacauguuugauucug

SEQ ID NO: 655777 - RNA, 65 nt, hsa
aaguguuuuuauuuguuaaccaguuuaaguggauccugugguaacuuaaacuguuguucucaucc

SEQ ID NO: 655778 - RNA, 65 nt, hsa
acuuggcagcacagcaugcccccgugaccugccugcugugguaugagcuaugaccaagagcaggc

SEQ ID NO: 655779 - RNA, 65 nt, hsa
gccagaggguuauauaccauccugucucuggcccacugugguaauuccacauccagguaccaccg

SEQ ID NO: 655780 - RNA, 65 nt, hsa
guaaauggguacuugugaucacacuacgggaaucucugugguauauaccuggggccauucuaggc

SEQ ID NO: 655781 - RNA, 65 nt, hsa
gcaaugaaaaaccaugugggugauuuccagcagaccugugguauuggccaggaggccugagaaag

SEQ ID NO: 655782 - RNA, 65 nt, hsa
ucaccaucucuuguaaaaguuaauucucaccauuccugugguaccugcgaguguuaugaccagga

SEQ ID NO: 655783 - RNA, 63 nt, hsa
uucagaaugugaaccagugacucucgggcgccccugugguaacuuugcaggcggcccucagug

SEQ ID NO: 655784 - RNA, 65 nt, hsa
ucgaggggacccuggcaccccgggcacacaaaccucugugguauaggugaggggugugaggcccc

SEQ ID NO: 655785 - RNA, 65 nt, hsa
acagacuuuucauacuuaccucccguauucuguuucugugguaaaaauaugaaguguuuuaguug

SEQ ID NO: 655786 - RNA, 65 nt, hsa
caaagauugugcauuuuuuucuuuuuuuuuuuaaacugugguaaaaaaaaaaaaaauaaugcauu

SEQ ID NO: 655787 - RNA, 65 nt, hsa
agccuguggcuuggaguggccaaauaggagggagacugugguaggggcagggaggcaacacugcu

SEQ ID NO: 655788 - RNA, 65 nt, hsa
ugcauguagugugggaggcuccuguuagcuccucacugugguaaaugccacacaccuuuaaguag

SEQ ID NO: 655789 - RNA, 65 nt, hsa
uucuagagugaauuauaguauugacgugaaucccacugugguauagauuccauaauaugcuugaa

SEQ ID NO: 655790 - RNA, 59 nt, hsa
augccuggaccuggggcuagaggagggugcugugguacauggcagccaggggcuucauu

SEQ ID NO: 655791 - RNA, 65 nt, hsa
uguuccaaaaacccaaguagucagucccuuauguacugugguaaaccuguuuauguucaccccaa

SEQ ID NO: 655792 - RNA, 65 nt, hsa
uaugauuaaacuguguguaaauuuuguaacauaaacugugguaauugcauaauuucauuggugag

SEQ ID NO: 655793 - RNA, 65 nt, hsa
ggcuuucaguuuuuagucagaaaucaagcauugggcugugguagccaaaaaccauagguuagcua

SEQ ID NO: 655794 - RNA, 65 nt, hsa
aagaugacccucugagcuuuucauuuauucaagcucugugguacagccuuuuuuuaaaauaaauu

SEQ ID NO: 655795 - RNA, 65 nt, hsa
gguugauuugcuguuuuguuucuugucuuuguguucugugguacuugcugagagaaaagaaaagu

SEQ ID NO: 655796 - RNA, 65 nt, hsa
uuaugcauagacccacucuagaguaaugauggucccugugguauauacuuucuccuacucuagca

SEQ ID NO: 655797 - RNA, 65 nt, hsa
uccuaagaggagacagcugugaaguugggcgugcucugugguaccagcugugacuuuucuauuuc

SEQ ID NO: 655798 - RNA, 65 nt, hsa
ccacucuuagcccaugcuguuuucccuuugccacacugugguagguguuugaacagaggccacau

SEQ ID NO: 655799 - RNA, 65 nt, hsa
aguuuuaguaguagaauguuuucaagaaauguacacugugguaaaugauuuaaaacacuaguaua

SEQ ID NO: 655800 - RNA, 65 nt, hsa
gguuuggaugugcagcacauccaaggcaaccacagcugugguagagcuugguaaaagacugaaga

SEQ ID NO: 655801 - RNA, 65 nt, hsa
uguuccaaaaacccaaguagucagucccuuguguacugugguaaaccuguuuauguucaccccaa

SEQ ID NO: 655802 - RNA, 65 nt, hsa
uaauuuaugauuaaacuguaauuuuguaacauaaacugugguaauugcauaauuucauuggugag

SEQ ID NO: 655803 - RNA, 65 nt, hsa
cauugugcauaccuguagucccagcuauucaggagcugugguaggaggauggcuugagcucaaga

SEQ ID NO: 655804 - RNA, 64 nt, hsa; identical to SEQ ID NO: 332833

SEQ ID NO: 655805 - RNA, 64 nt, hsa; identical to SEQ ID NO: 332834

SEQ ID NO: 655806 - RNA, 64 nt, hsa; identical to SEQ ID NO: 332835

SEQ ID NO: 655807 - RNA, 64 nt, hsa; identical to SEQ ID NO: 332836

SEQ ID NO: 655808 - RNA, 64 nt, hsa; identical to SEQ ID NO: 332837

SEQ ID NO: 655809 - RNA, 64 nt, hsa; identical to SEQ ID NO: 332838

SEQ ID NO: 655810 - RNA, 64 nt, hsa; identical to SEQ ID NO: 332839

SEQ ID NO: 655811 - RNA, 64 nt, hsa; identical to SEQ ID NO: 332840

SEQ ID NO: 655812 - RNA, 64 nt, hsa; identical to SEQ ID NO: 332841

SEQ ID NO: 655813 - RNA, 64 nt, hsa; identical to SEQ ID NO: 332842

SEQ ID NO: 655814 - RNA, 64 nt, hsa; identical to SEQ ID NO: 332843

SEQ ID NO: 655815 - RNA, 64 nt, hsa; identical to SEQ ID NO: 332844

SEQ ID NO: 655816 - RNA, 64 nt, hsa; identical to SEQ ID NO: 332845

SEQ ID NO: 655817 - RNA, 64 nt, hsa; identical to SEQ ID NO: 332846

SEQ ID NO: 655818 - RNA, 64 nt, hsa; identical to SEQ ID NO: 332847

SEQ ID NO: 655819 - RNA, 64 nt, hsa; identical to SEQ ID NO: 332848

SEQ ID NO: 655820 - RNA, 64 nt, hsa; identical to SEQ ID NO: 332849

SEQ ID NO: 655821 - RNA, 64 nt, hsa; identical to SEQ ID NO: 332850

SEQ ID NO: 655822 - RNA, 64 nt, hsa; identical to SEQ ID NO: 332851

SEQ ID NO: 655823 - RNA, 64 nt, hsa; identical to SEQ ID NO: 332852

SEQ ID NO: 655824 - RNA, 64 nt, hsa; identical to SEQ ID NO: 332853

SEQ ID NO: 655825 - RNA, 64 nt, hsa; identical to SEQ ID NO: 332854

SEQ ID NO: 655826 - RNA, 64 nt, hsa; identical to SEQ ID NO: 332855

SEQ ID NO: 655827 - RNA, 64 nt, hsa; identical to SEQ ID NO: 332856

SEQ ID NO: 655828 - RNA, 64 nt, hsa; identical to SEQ ID NO: 332857

SEQ ID NO: 655829 - RNA, 64 nt, hsa; identical to SEQ ID NO: 332858

SEQ ID NO: 655830 - RNA, 64 nt, hsa; identical to SEQ ID NO: 332859

SEQ ID NO: 655831 - RNA, 64 nt, hsa; identical to SEQ ID NO: 332860

SEQ ID NO: 655832 - RNA, 64 nt, hsa; identical to SEQ ID NO: 332861

SEQ ID NO: 655833 - RNA, 64 nt, hsa; identical to SEQ ID NO: 332862

SEQ ID NO: 655834 - RNA, 64 nt, hsa; identical to SEQ ID NO: 332863

SEQ ID NO: 655835 - RNA, 64 nt, hsa; identical to SEQ ID NO: 332864

SEQ ID NO: 655836 - RNA, 64 nt, hsa; identical to SEQ ID NO: 332865

SEQ ID NO: 655837 - RNA, 64 nt, hsa; identical to SEQ ID NO: 332866

SEQ ID NO: 655838 - RNA, 64 nt, hsa; identical to SEQ ID NO: 332867

SEQ ID NO: 655839 - RNA, 64 nt, hsa; identical to SEQ ID NO: 332868

SEQ ID NO: 655840 - RNA, 61 nt, hsa
uauucauaaccuauauucuagaguagacaaucuggacuauguaauaaauagucugcugauu

SEQ ID NO: 655841 - RNA, 61 nt, hsa
uaugaauaaagguguggcagaauauaauaaucuggacuauuuucuauaggauaauugcugg

SEQ ID NO: 655842 - RNA, 61 nt, hsa
augccuauugcugggcaggcuaaguguggagcuggacuacggcggcaguauggaauuccag

SEQ ID NO: 655843 - RNA, 61 nt, hsa
accugaugaaccugagcgggugccgaagcuacuggacuaugcugauggguauguccuaccc

SEQ ID NO: 655844 - RNA, 61 nt, hsa
uacuuuuauuacagucaauuuugaggauauucuggacuaaauauuuaagugcagucauuuc

SEQ ID NO: 655845 - RNA, 61 nt, hsa
uuucuuuuugguuugcaaaaagagcacagcccuggacuacaaguuuggagauuuaaauucu

SEQ ID NO: 655846 - RNA, 61 nt, hsa
uuucuuuuugguuugcaaaaagagcacagcccuggacuaugaguuuggagaucuaaauucu

SEQ ID NO: 655847 - RNA, 61 nt, hsa
aacuuuuauuacagucaauuuugaggauauucuggacuaaauauuuaagugcagucauuuc

SEQ ID NO: 655848 - RNA, 64 nt, hsa; identical to SEQ ID NO: 88616

SEQ ID NO: 655849 - RNA, 64 nt, hsa; identical to SEQ ID NO: 88617

SEQ ID NO: 655850 - RNA, 64 nt, hsa; identical to SEQ ID NO: 88618

SEQ ID NO: 655851 - RNA, 64 nt, hsa; identical to SEQ ID NO: 88619

SEQ ID NO: 655852 - RNA, 64 nt, hsa; identical to SEQ ID NO: 88620

SEQ ID NO: 655853 - RNA, 64 nt, hsa; identical to SEQ ID NO: 88621

SEQ ID NO: 655854 - RNA, 64 nt, hsa; identical to SEQ ID NO: 88622

SEQ ID NO: 655855 - RNA, 64 nt, hsa; identical to SEQ ID NO: 88623

SEQ ID NO: 655856 - RNA, 64 nt, hsa; identical to SEQ ID NO: 162369

SEQ ID NO: 655857 - RNA, 64 nt, hsa; identical to SEQ ID NO: 162370

SEQ ID NO: 655858 - RNA, 64 nt, hsa; identical to SEQ ID NO: 162371

SEQ ID NO: 655859 - RNA, 64 nt, hsa; identical to SEQ ID NO: 162372

SEQ ID NO: 655860 - RNA, 64 nt, hsa; identical to SEQ ID NO: 162373

SEQ ID NO: 655861 - RNA, 64 nt, hsa; identical to SEQ ID NO: 162374

SEQ ID NO: 655862 - RNA, 64 nt, hsa; identical to SEQ ID NO: 162375

SEQ ID NO: 655863 - RNA, 64 nt, hsa; identical to SEQ ID NO: 162376

SEQ ID NO: 655864 - RNA, 64 nt, hsa; identical to SEQ ID NO: 162377

SEQ ID NO: 655865 - RNA, 64 nt, hsa; identical to SEQ ID NO: 162378

SEQ ID NO: 655866 - RNA, 64 nt, hsa; identical to SEQ ID NO: 162379

SEQ ID NO: 655867 - RNA, 64 nt, hsa; identical to SEQ ID NO: 162380

SEQ ID NO: 655868 - RNA, 64 nt, hsa; identical to SEQ ID NO: 162381

SEQ ID NO: 655869 - RNA, 64 nt, hsa; identical to SEQ ID NO: 162382

SEQ ID NO: 655870 - RNA, 64 nt, hsa; identical to SEQ ID NO: 162383

SEQ ID NO: 655871 - RNA, 64 nt, hsa; identical to SEQ ID NO: 162384

SEQ ID NO: 655872 - RNA, 64 nt, hsa; identical to SEQ ID NO: 162385

SEQ ID NO: 655873 - RNA, 64 nt, hsa; identical to SEQ ID NO: 162386

SEQ ID NO: 655874 - RNA, 64 nt, hsa; identical to SEQ ID NO: 162387

SEQ ID NO: 655875 - RNA, 64 nt, hsa; identical to SEQ ID NO: 162388

SEQ ID NO: 655876 - RNA, 64 nt, hsa; identical to SEQ ID NO: 162389

SEQ ID NO: 655877 - RNA, 64 nt, hsa; identical to SEQ ID NO: 162390

SEQ ID NO: 655878 - RNA, 64 nt, hsa; identical to SEQ ID NO: 362237

SEQ ID NO: 655879 - RNA, 64 nt, hsa; identical to SEQ ID NO: 362238

SEQ ID NO: 655880 - RNA, 64 nt, hsa
gaagugaggagcgucuccgcccggcagccacccaguccgggagggaggugggggggucaguccc

SEQ ID NO: 655881 - RNA, 64 nt, hsa
gggggggucagucccccguccggccagccgccccguccgggaggugaggggcgccucugcccag

SEQ ID NO: 655882 - RNA, 64 nt, hsa
aagugaggagccccucugccccgccagccaccccguccgggagggaggugggggggucagcccc

SEQ ID NO: 655883 - RNA, 64 nt, hsa
gggggggucagccccccgcccggccagccgccccguccgggagggaggugggggaucagccccc

SEQ ID NO: 655884 - RNA, 64 nt, hsa
ugggggaucagccccccgcccggcuagccgccccguccgggaggcgaggggcgccucugcccgg

SEQ ID NO: 655885 - RNA, 64 nt, hsa
gggggggucagccccccgcccggccagccgcccgguccgggagggaggugggggggucagcccc

SEQ ID NO: 655886 - RNA, 64 nt, hsa
gggggggucagccccccgcccggccagccgccccguccgggagguuaggggcgccucugcccgg

SEQ ID NO: 655887 - RNA, 64 nt, hsa
aagugaggagcgucuacgcccgggcagcugccccguccgggagggaggugggggggucagcccc

SEQ ID NO: 655888 - RNA, 64 nt, hsa
gggggggucagccccccgcccggccagccgccccguccgggagggaggugggggggaucagccc

SEQ ID NO: 655889 - RNA, 64 nt, hsa
ggggggaucagccccccgcccggccagccgccccguccgggagggagguggggggcgccucugc

SEQ ID NO: 655890 - RNA, 64 nt, hsa
ggggugcugggcucuggccuucucaugcagagagguccgggacagggucaguaucgugggcaug

SEQ ID NO: 655891 - RNA, 64 nt, hsa
cugggugcaucugcuaaugggagaccaaaucuuuguccgggaagcaagaagugggugggagaau

SEQ ID NO: 655892 - RNA, 64 nt, hsa; identical to SEQ ID NO: 85822

SEQ ID NO: 655893 - RNA, 64 nt, hsa; identical to SEQ ID NO: 85823

SEQ ID NO: 655894 - RNA, 64 nt, hsa; identical to SEQ ID NO: 85824

SEQ ID NO: 655895 - RNA, 64 nt, hsa; identical to SEQ ID NO: 85825

SEQ ID NO: 655896 - RNA, 64 nt, hsa; identical to SEQ ID NO: 85826

SEQ ID NO: 655897 - RNA, 64 nt, hsa; identical to SEQ ID NO: 85827

SEQ ID NO: 655898 - RNA, 64 nt, hsa; identical to SEQ ID NO: 85828

SEQ ID NO: 655899 - RNA, 64 nt, hsa; identical to SEQ ID NO: 85829

SEQ ID NO: 655900 - RNA, 64 nt, hsa; identical to SEQ ID NO: 85830

SEQ ID NO: 655901 - RNA, 64 nt, hsa; identical to SEQ ID NO: 85831

SEQ ID NO: 655902 - RNA, 64 nt, hsa; identical to SEQ ID NO: 85832

SEQ ID NO: 655903 - RNA, 64 nt, hsa; identical to SEQ ID NO: 85833

SEQ ID NO: 655904 - RNA, 64 nt, hsa; identical to SEQ ID NO: 85834

SEQ ID NO: 655905 - RNA, 64 nt, hsa; identical to SEQ ID NO: 85835

SEQ ID NO: 655906 - RNA, 64 nt, hsa; identical to SEQ ID NO: 85836

SEQ ID NO: 655907 - RNA, 64 nt, hsa; identical to SEQ ID NO: 85837

SEQ ID NO: 655908 - RNA, 64 nt, hsa; identical to SEQ ID NO: 85838

SEQ ID NO: 655909 - RNA, 64 nt, hsa; identical to SEQ ID NO: 85839

SEQ ID NO: 655910 - RNA, 64 nt, hsa; identical to SEQ ID NO: 85840

SEQ ID NO: 655911 - RNA, 64 nt, hsa; identical to SEQ ID NO: 85841

SEQ ID NO: 655912 - RNA, 64 nt, hsa; identical to SEQ ID NO: 85842

SEQ ID NO: 655913 - RNA, 64 nt, hsa; identical to SEQ ID NO: 85843

SEQ ID NO: 655914 - RNA, 64 nt, hsa; identical to SEQ ID NO: 85844

SEQ ID NO: 655915 - RNA, 64 nt, hsa; identical to SEQ ID NO: 85845

SEQ ID NO: 655916 - RNA, 64 nt, hsa; identical to SEQ ID NO: 85846

SEQ ID NO: 655917 - RNA, 64 nt, hsa; identical to SEQ ID NO: 85847

SEQ ID NO: 655918 - RNA, 64 nt, hsa; identical to SEQ ID NO: 85848

SEQ ID NO: 655919 - RNA, 64 nt, hsa; identical to SEQ ID NO: 85849

SEQ ID NO: 655920 - RNA, 64 nt, hsa; identical to SEQ ID NO: 85850

SEQ ID NO: 655921 - RNA, 64 nt, hsa; identical to SEQ ID NO: 85851

SEQ ID NO: 655922 - RNA, 64 nt, hsa; identical to SEQ ID NO: 85852

SEQ ID NO: 655923 - RNA, 64 nt, hsa; identical to SEQ ID NO: 85853

SEQ ID NO: 655924 - RNA, 64 nt, hsa; identical to SEQ ID NO: 85854

SEQ ID NO: 655925 - RNA, 64 nt, hsa; identical to SEQ ID NO: 85855

SEQ ID NO: 655926 - RNA, 64 nt, hsa; identical to SEQ ID NO: 85856

SEQ ID NO: 655927 - RNA, 64 nt, hsa; identical to SEQ ID NO: 85857

SEQ ID NO: 655928 - RNA, 64 nt, hsa; identical to SEQ ID NO: 85858

SEQ ID NO: 655929 - RNA, 64 nt, hsa
acccagcacucaaucuguucaagacaaccaguggggaugagaggcuguaccccucacccacauc

SEQ ID NO: 655930 - RNA, 64 nt, hsa
ggcucugggauauucuggccuccgacuucacaccggaugagagagcuauguuucugaagguauu

SEQ ID NO: 655931 - RNA, 64 nt, hsa
uucaagugaaauaguaaauccaaaugugccuguuggaugagaguaaaaaaauuauaugcugcau

SEQ ID NO: 655932 - RNA, 64 nt, hsa
ucaauaaccagugccaaauucugaaugccagaugggaugagaugggauguuaaaccacuucuua

SEQ ID NO: 655933 - RNA, 64 nt, hsa; identical to SEQ ID NO: 80199

SEQ ID NO: 655934 - RNA, 64 nt, hsa; identical to SEQ ID NO: 80200

SEQ ID NO: 655935 - RNA, 64 nt, hsa; identical to SEQ ID NO: 80201

SEQ ID NO: 655936 - RNA, 64 nt, hsa; identical to SEQ ID NO: 80202

SEQ ID NO: 655937 - RNA, 64 nt, hsa; identical to SEQ ID NO: 80203

SEQ ID NO: 655938 - RNA, 64 nt, hsa; identical to SEQ ID NO: 80204

SEQ ID NO: 655939 - RNA, 64 nt, hsa; identical to SEQ ID NO: 80205

SEQ ID NO: 655940 - RNA, 64 nt, hsa; identical to SEQ ID NO: 80206

SEQ ID NO: 655941 - RNA, 64 nt, hsa; identical to SEQ ID NO: 80207

SEQ ID NO: 655942 - RNA, 64 nt, hsa; identical to SEQ ID NO: 80208

SEQ ID NO: 655943 - RNA, 64 nt, hsa; identical to SEQ ID NO: 80209

SEQ ID NO: 655944 - RNA, 64 nt, hsa; identical to SEQ ID NO: 80210

SEQ ID NO: 655945 - RNA, 64 nt, hsa; identical to SEQ ID NO: 80211

SEQ ID NO: 655946 - RNA, 64 nt, hsa; identical to SEQ ID NO: 80212

SEQ ID NO: 655947 - RNA, 64 nt, hsa; identical to SEQ ID NO: 80213

SEQ ID NO: 655948 - RNA, 64 nt, hsa; identical to SEQ ID NO: 80214

SEQ ID NO: 655949 - RNA, 64 nt, hsa; identical to SEQ ID NO: 80215

SEQ ID NO: 655950 - RNA, 64 nt, hsa; identical to SEQ ID NO: 80216

SEQ ID NO: 655951 - RNA, 64 nt, hsa; identical to SEQ ID NO: 80217

SEQ ID NO: 655952 - RNA, 64 nt, hsa; identical to SEQ ID NO: 80218

SEQ ID NO: 655953 - RNA, 64 nt, hsa; identical to SEQ ID NO: 80219

SEQ ID NO: 655954 - RNA, 64 nt, hsa; identical to SEQ ID NO: 80220

SEQ ID NO: 655955 - RNA, 64 nt, hsa; identical to SEQ ID NO: 80221

SEQ ID NO: 655956 - RNA, 64 nt, hsa; identical to SEQ ID NO: 80222

SEQ ID NO: 655957 - RNA, 64 nt, hsa; identical to SEQ ID NO: 80223

SEQ ID NO: 655958 - RNA, 64 nt, hsa; identical to SEQ ID NO: 80224

SEQ ID NO: 655959 - RNA, 64 nt, hsa; identical to SEQ ID NO: 80225

SEQ ID NO: 655960 - RNA, 64 nt, hsa; identical to SEQ ID NO: 80226

SEQ ID NO: 655961 - RNA, 64 nt, hsa; identical to SEQ ID NO: 80227

SEQ ID NO: 655962 - RNA, 64 nt, hsa; identical to SEQ ID NO: 80228

SEQ ID NO: 655963 - RNA, 64 nt, hsa; identical to SEQ ID NO: 80229

SEQ ID NO: 655964 - RNA, 64 nt, hsa; identical to SEQ ID NO: 80230

SEQ ID NO: 655965 - RNA, 64 nt, hsa; identical to SEQ ID NO: 80231

SEQ ID NO: 655966 - RNA, 52 nt, hsa; identical to SEQ ID NO: 80232

SEQ ID NO: 655967 - RNA, 64 nt, hsa; identical to SEQ ID NO: 80233

SEQ ID NO: 655968 - RNA, 64 nt, hsa; identical to SEQ ID NO: 80234

SEQ ID NO: 655969 - RNA, 64 nt, hsa; identical to SEQ ID NO: 80235

SEQ ID NO: 655970 - RNA, 64 nt, hsa; identical to SEQ ID NO: 80236

SEQ ID NO: 655971 - RNA, 64 nt, hsa; identical to SEQ ID NO: 80237

SEQ ID NO: 655972 - RNA, 64 nt, hsa; identical to SEQ ID NO: 80238

SEQ ID NO: 655973 - RNA, 64 nt, hsa; identical to SEQ ID NO: 80239

SEQ ID NO: 655974 - RNA, 64 nt, hsa; identical to SEQ ID NO: 80240

SEQ ID NO: 655975 - RNA, 64 nt, hsa; identical to SEQ ID NO: 80241

SEQ ID NO: 655976 - RNA, 64 nt, hsa; identical to SEQ ID NO: 80242

SEQ ID NO: 655977 - RNA, 64 nt, hsa; identical to SEQ ID NO: 80243

SEQ ID NO: 655978 - RNA, 64 nt, hsa; identical to SEQ ID NO: 80244

SEQ ID NO: 655979 - RNA, 64 nt, hsa; identical to SEQ ID NO: 80245

SEQ ID NO: 655980 - RNA, 64 nt, hsa; identical to SEQ ID NO: 80246

SEQ ID NO: 655981 - RNA, 64 nt, hsa; identical to SEQ ID NO: 80247

SEQ ID NO: 655982 - RNA, 64 nt, hsa; identical to SEQ ID NO: 80248

SEQ ID NO: 655983 - RNA, 64 nt, hsa; identical to SEQ ID NO: 80249

SEQ ID NO: 655984 - RNA, 64 nt, hsa; identical to SEQ ID NO: 80250

SEQ ID NO: 655985 - RNA, 64 nt, hsa; identical to SEQ ID NO: 80251

SEQ ID NO: 655986 - RNA, 64 nt, hsa; identical to SEQ ID NO: 80252

SEQ ID NO: 655987 - RNA, 64 nt, hsa; identical to SEQ ID NO: 80253

SEQ ID NO: 655988 - RNA, 64 nt, hsa; identical to SEQ ID NO: 80254

SEQ ID NO: 655989 - RNA, 64 nt, hsa; identical to SEQ ID NO: 80255

SEQ ID NO: 655990 - RNA, 64 nt, hsa; identical to SEQ ID NO: 80256

SEQ ID NO: 655991 - RNA, 64 nt, hsa; identical to SEQ ID NO: 80257

SEQ ID NO: 655992 - RNA, 64 nt, hsa; identical to SEQ ID NO: 80258

SEQ ID NO: 655993 - RNA, 64 nt, hsa; identical to SEQ ID NO: 80259

SEQ ID NO: 655994 - RNA, 64 nt, hsa; identical to SEQ ID NO: 80260

SEQ ID NO: 655995 - RNA, 64 nt, hsa; identical to SEQ ID NO: 80261

SEQ ID NO: 655996 - RNA, 64 nt, hsa; identical to SEQ ID NO: 80262

SEQ ID NO: 655997 - RNA, 64 nt, hsa; identical to SEQ ID NO: 80263

SEQ ID NO: 655998 - RNA, 64 nt, hsa; identical to SEQ ID NO: 80264

SEQ ID NO: 655999 - RNA, 64 nt, hsa; identical to SEQ ID NO: 80265

SEQ ID NO: 656000 - RNA, 64 nt, hsa; identical to SEQ ID NO: 80266

SEQ ID NO: 656001 - RNA, 64 nt, hsa; identical to SEQ ID NO: 80267

SEQ ID NO: 656002 - RNA, 64 nt, hsa; identical to SEQ ID NO: 80268

SEQ ID NO: 656003 - RNA, 64 nt, hsa; identical to SEQ ID NO: 80269

SEQ ID NO: 656004 - RNA, 64 nt, hsa; identical to SEQ ID NO: 80270

SEQ ID NO: 656005 - RNA, 64 nt, hsa; identical to SEQ ID NO: 80271

SEQ ID NO: 656006 - RNA, 64 nt, hsa; identical to SEQ ID NO: 80272

SEQ ID NO: 656007 - RNA, 64 nt, hsa; identical to SEQ ID NO: 80273

SEQ ID NO: 656008 - RNA, 64 nt, hsa; identical to SEQ ID NO: 80274

SEQ ID NO: 656009 - RNA, 64 nt, hsa; identical to SEQ ID NO: 80275

SEQ ID NO: 656010 - RNA, 64 nt, hsa; identical to SEQ ID NO: 80276

SEQ ID NO: 656011 - RNA, 64 nt, hsa; identical to SEQ ID NO: 80277

SEQ ID NO: 656012 - RNA, 64 nt, hsa; identical to SEQ ID NO: 80278

SEQ ID NO: 656013 - RNA, 64 nt, hsa; identical to SEQ ID NO: 80279

SEQ ID NO: 656014 - RNA, 64 nt, hsa; identical to SEQ ID NO: 80280

SEQ ID NO: 656015 - RNA, 64 nt, hsa; identical to SEQ ID NO: 80281

SEQ ID NO: 656016 - RNA, 64 nt, hsa; identical to SEQ ID NO: 80282

SEQ ID NO: 656017 - RNA, 64 nt, hsa; identical to SEQ ID NO: 80283

SEQ ID NO: 656018 - RNA, 64 nt, hsa; identical to SEQ ID NO: 80284

SEQ ID NO: 656019 - RNA, 64 nt, hsa; identical to SEQ ID NO: 80285

SEQ ID NO: 656020 - RNA, 64 nt, hsa; identical to SEQ ID NO: 80286

SEQ ID NO: 656021 - RNA, 64 nt, hsa; identical to SEQ ID NO: 80287

SEQ ID NO: 656022 - RNA, 64 nt, hsa; identical to SEQ ID NO: 80288

SEQ ID NO: 656023 - RNA, 64 nt, hsa; identical to SEQ ID NO: 80289

SEQ ID NO: 656024 - RNA, 64 nt, hsa; identical to SEQ ID NO: 80290

SEQ ID NO: 656025 - RNA, 64 nt, hsa; identical to SEQ ID NO: 80291

SEQ ID NO: 656026 - RNA, 64 nt, hsa; identical to SEQ ID NO: 80292

SEQ ID NO: 656027 - RNA, 64 nt, hsa; identical to SEQ ID NO: 80293

SEQ ID NO: 656028 - RNA, 64 nt, hsa; identical to SEQ ID NO: 80294

SEQ ID NO: 656029 - RNA, 64 nt, hsa; identical to SEQ ID NO: 80295

SEQ ID NO: 656030 - RNA, 64 nt, hsa; identical to SEQ ID NO: 80296

SEQ ID NO: 656031 - RNA, 64 nt, hsa; identical to SEQ ID NO: 80297

SEQ ID NO: 656032 - RNA, 64 nt, hsa; identical to SEQ ID NO: 80298

SEQ ID NO: 656033 - RNA, 64 nt, hsa; identical to SEQ ID NO: 80299

SEQ ID NO: 656034 - RNA, 64 nt, hsa; identical to SEQ ID NO: 80300

SEQ ID NO: 656035 - RNA, 64 nt, hsa; identical to SEQ ID NO: 80301

SEQ ID NO: 656036 - RNA, 64 nt, hsa; identical to SEQ ID NO: 80302

SEQ ID NO: 656037 - RNA, 64 nt, hsa; identical to SEQ ID NO: 80303

SEQ ID NO: 656038 - RNA, 64 nt, hsa; identical to SEQ ID NO: 80304

SEQ ID NO: 656039 - RNA, 64 nt, hsa; identical to SEQ ID NO: 80305

SEQ ID NO: 656040 - RNA, 64 nt, hsa; identical to SEQ ID NO: 80306

SEQ ID NO: 656041 - RNA, 64 nt, hsa; identical to SEQ ID NO: 80307

SEQ ID NO: 656042 - RNA, 64 nt, hsa; identical to SEQ ID NO: 80308

SEQ ID NO: 656043 - RNA, 64 nt, hsa; identical to SEQ ID NO: 80309

SEQ ID NO: 656044 - RNA, 64 nt, hsa; identical to SEQ ID NO: 80310

SEQ ID NO: 656045 - RNA, 64 nt, hsa; identical to SEQ ID NO: 80311

SEQ ID NO: 656046 - RNA, 64 nt, hsa; identical to SEQ ID NO: 80312

SEQ ID NO: 656047 - RNA, 64 nt, hsa; identical to SEQ ID NO: 80313

SEQ ID NO: 656048 - RNA, 64 nt, hsa; identical to SEQ ID NO: 80314

SEQ ID NO: 656049 - RNA, 64 nt, hsa; identical to SEQ ID NO: 80315

SEQ ID NO: 656050 - RNA, 64 nt, hsa; identical to SEQ ID NO: 80316

SEQ ID NO: 656051 - RNA, 64 nt, hsa; identical to SEQ ID NO: 80317

SEQ ID NO: 656052 - RNA, 64 nt, hsa; identical to SEQ ID NO: 80318

SEQ ID NO: 656053 - RNA, 64 nt, hsa; identical to SEQ ID NO: 80319

SEQ ID NO: 656054 - RNA, 64 nt, hsa; identical to SEQ ID NO: 80320

SEQ ID NO: 656055 - RNA, 64 nt, hsa; identical to SEQ ID NO: 80321

SEQ ID NO: 656056 - RNA, 64 nt, hsa; identical to SEQ ID NO: 80322

SEQ ID NO: 656057 - RNA, 64 nt, hsa; identical to SEQ ID NO: 80323

SEQ ID NO: 656058 - RNA, 64 nt, hsa; identical to SEQ ID NO: 80324

SEQ ID NO: 656059 - RNA, 51 nt, hsa; identical to SEQ ID NO: 80325

SEQ ID NO: 656060 - RNA, 64 nt, hsa; identical to SEQ ID NO: 80326

SEQ ID NO: 656061 - RNA, 64 nt, hsa; identical to SEQ ID NO: 80327

SEQ ID NO: 656062 - RNA, 64 nt, hsa; identical to SEQ ID NO: 80328

SEQ ID NO: 656063 - RNA, 64 nt, hsa; identical to SEQ ID NO: 80329

SEQ ID NO: 656064 - RNA, 64 nt, hsa; identical to SEQ ID NO: 80330

SEQ ID NO: 656065 - RNA, 62 nt, hsa; identical to SEQ ID NO: 80331

SEQ ID NO: 656066 - RNA, 64 nt, hsa; identical to SEQ ID NO: 80332

SEQ ID NO: 656067 - RNA, 64 nt, hsa; identical to SEQ ID NO: 80333

SEQ ID NO: 656068 - RNA, 64 nt, hsa; identical to SEQ ID NO: 80334

SEQ ID NO: 656069 - RNA, 54 nt, hsa; identical to SEQ ID NO: 80335

SEQ ID NO: 656070 - RNA, 64 nt, hsa; identical to SEQ ID NO: 80336

SEQ ID NO: 656071 - RNA, 64 nt, hsa; identical to SEQ ID NO: 80337

SEQ ID NO: 656072 - RNA, 64 nt, hsa; identical to SEQ ID NO: 80338

SEQ ID NO: 656073 - RNA, 64 nt, hsa; identical to SEQ ID NO: 80339

SEQ ID NO: 656074 - RNA, 64 nt, hsa; identical to SEQ ID NO: 80340

SEQ ID NO: 656075 - RNA, 64 nt, hsa; identical to SEQ ID NO: 80341

SEQ ID NO: 656076 - RNA, 64 nt, hsa; identical to SEQ ID NO: 80342

SEQ ID NO: 656077 - RNA, 64 nt, hsa; identical to SEQ ID NO: 80343

SEQ ID NO: 656078 - RNA, 64 nt, hsa; identical to SEQ ID NO: 80344

SEQ ID NO: 656079 - RNA, 64 nt, hsa; identical to SEQ ID NO: 80345

SEQ ID NO: 656080 - RNA, 64 nt, hsa; identical to SEQ ID NO: 80346

SEQ ID NO: 656081 - RNA, 64 nt, hsa; identical to SEQ ID NO: 80347

SEQ ID NO: 656082 - RNA, 64 nt, hsa; identical to SEQ ID NO: 80348

SEQ ID NO: 656083 - RNA, 64 nt, hsa; identical to SEQ ID NO: 80349

SEQ ID NO: 656084 - RNA, 64 nt, hsa; identical to SEQ ID NO: 80350

SEQ ID NO: 656085 - RNA, 64 nt, hsa; identical to SEQ ID NO: 80351

SEQ ID NO: 656086 - RNA, 59 nt, hsa; identical to SEQ ID NO: 80352

SEQ ID NO: 656087 - RNA, 64 nt, hsa; identical to SEQ ID NO: 80353

SEQ ID NO: 656088 - RNA, 64 nt, hsa; identical to SEQ ID NO: 80354

SEQ ID NO: 656089 - RNA, 64 nt, hsa; identical to SEQ ID NO: 80355

SEQ ID NO: 656090 - RNA, 64 nt, hsa; identical to SEQ ID NO: 80356

SEQ ID NO: 656091 - RNA, 64 nt, hsa; identical to SEQ ID NO: 80357

SEQ ID NO: 656092 - RNA, 64 nt, hsa; identical to SEQ ID NO: 80358

SEQ ID NO: 656093 - RNA, 64 nt, hsa; identical to SEQ ID NO: 80359

SEQ ID NO: 656094 - RNA, 64 nt, hsa; identical to SEQ ID NO: 80360

SEQ ID NO: 656095 - RNA, 64 nt, hsa; identical to SEQ ID NO: 80361

SEQ ID NO: 656096 - RNA, 64 nt, hsa; identical to SEQ ID NO: 80362

SEQ ID NO: 656097 - RNA, 64 nt, hsa; identical to SEQ ID NO: 80363

SEQ ID NO: 656098 - RNA, 64 nt, hsa; identical to SEQ ID NO: 80364

SEQ ID NO: 656099 - RNA, 64 nt, hsa; identical to SEQ ID NO: 80365

SEQ ID NO: 656100 - RNA, 64 nt, hsa; identical to SEQ ID NO: 80366

SEQ ID NO: 656101 - RNA, 64 nt, hsa; identical to SEQ ID NO: 80367

SEQ ID NO: 656102 - RNA, 64 nt, hsa; identical to SEQ ID NO: 80368

SEQ ID NO: 656103 - RNA, 64 nt, hsa; identical to SEQ ID NO: 80369

SEQ ID NO: 656104 - RNA, 64 nt, hsa; identical to SEQ ID NO: 80370

SEQ ID NO: 656105 - RNA, 64 nt, hsa; identical to SEQ ID NO: 80371

SEQ ID NO: 656106 - RNA, 64 nt, hsa; identical to SEQ ID NO: 80372

SEQ ID NO: 656107 - RNA, 64 nt, hsa; identical to SEQ ID NO: 80373

SEQ ID NO: 656108 - RNA, 64 nt, hsa; identical to SEQ ID NO: 80374

SEQ ID NO: 656109 - RNA, 64 nt, hsa; identical to SEQ ID NO: 80375

SEQ ID NO: 656110 - RNA, 64 nt, hsa; identical to SEQ ID NO: 80376

SEQ ID NO: 656111 - RNA, 64 nt, hsa; identical to SEQ ID NO: 80377

SEQ ID NO: 656112 - RNA, 64 nt, hsa; identical to SEQ ID NO: 80378

SEQ ID NO: 656113 - RNA, 64 nt, hsa; identical to SEQ ID NO: 80379

SEQ ID NO: 656114 - RNA, 64 nt, hsa; identical to SEQ ID NO: 80380

SEQ ID NO: 656115 - RNA, 64 nt, hsa; identical to SEQ ID NO: 80381

SEQ ID NO: 656116 - RNA, 64 nt, hsa; identical to SEQ ID NO: 80382

SEQ ID NO: 656117 - RNA, 64 nt, hsa; identical to SEQ ID NO: 80383

SEQ ID NO: 656118 - RNA, 64 nt, hsa; identical to SEQ ID NO: 80384

SEQ ID NO: 656119 - RNA, 64 nt, hsa; identical to SEQ ID NO: 80385

SEQ ID NO: 656120 - RNA, 64 nt, hsa; identical to SEQ ID NO: 80386

SEQ ID NO: 656121 - RNA, 64 nt, hsa; identical to SEQ ID NO: 80387

SEQ ID NO: 656122 - RNA, 64 nt, hsa; identical to SEQ ID NO: 80388

SEQ ID NO: 656123 - RNA, 64 nt, hsa; identical to SEQ ID NO: 80389

SEQ ID NO: 656124 - RNA, 64 nt, hsa; identical to SEQ ID NO: 80390

SEQ ID NO: 656125 - RNA, 64 nt, hsa; identical to SEQ ID NO: 80391

SEQ ID NO: 656126 - RNA, 53 nt, hsa; identical to SEQ ID NO: 80392

SEQ ID NO: 656127 - RNA, 64 nt, hsa; identical to SEQ ID NO: 80393

SEQ ID NO: 656128 - RNA, 64 nt, hsa; identical to SEQ ID NO: 80394

SEQ ID NO: 656129 - RNA, 64 nt, hsa; identical to SEQ ID NO: 80395

SEQ ID NO: 656130 - RNA, 64 nt, hsa; identical to SEQ ID NO: 80396

SEQ ID NO: 656131 - RNA, 64 nt, hsa; identical to SEQ ID NO: 80397

SEQ ID NO: 656132 - RNA, 64 nt, hsa; identical to SEQ ID NO: 80398

SEQ ID NO: 656133 - RNA, 64 nt, hsa; identical to SEQ ID NO: 80399

SEQ ID NO: 656134 - RNA, 64 nt, hsa; identical to SEQ ID NO: 80400

SEQ ID NO: 656135 - RNA, 64 nt, hsa; identical to SEQ ID NO: 80401

SEQ ID NO: 656136 - RNA, 64 nt, hsa; identical to SEQ ID NO: 80402

SEQ ID NO: 656137 - RNA, 64 nt, hsa; identical to SEQ ID NO: 80403

SEQ ID NO: 656138 - RNA, 64 nt, hsa; identical to SEQ ID NO: 80404

SEQ ID NO: 656139 - RNA, 64 nt, hsa; identical to SEQ ID NO: 80405

SEQ ID NO: 656140 - RNA, 64 nt, hsa; identical to SEQ ID NO: 80406

SEQ ID NO: 656141 - RNA, 64 nt, hsa; identical to SEQ ID NO: 80407

SEQ ID NO: 656142 - RNA, 64 nt, hsa; identical to SEQ ID NO: 80408

SEQ ID NO: 656143 - RNA, 64 nt, hsa; identical to SEQ ID NO: 80409

SEQ ID NO: 656144 - RNA, 64 nt, hsa; identical to SEQ ID NO: 80410

SEQ ID NO: 656145 - RNA, 64 nt, hsa; identical to SEQ ID NO: 80411

SEQ ID NO: 656146 - RNA, 64 nt, hsa; identical to SEQ ID NO: 80412

SEQ ID NO: 656147 - RNA, 64 nt, hsa; identical to SEQ ID NO: 80413

SEQ ID NO: 656148 - RNA, 64 nt, hsa; identical to SEQ ID NO: 80414

SEQ ID NO: 656149 - RNA, 64 nt, hsa; identical to SEQ ID NO: 80415

SEQ ID NO: 656150 - RNA, 64 nt, hsa; identical to SEQ ID NO: 80416

SEQ ID NO: 656151 - RNA, 64 nt, hsa; identical to SEQ ID NO: 80417

SEQ ID NO: 656152 - RNA, 64 nt, hsa; identical to SEQ ID NO: 80418

SEQ ID NO: 656153 - RNA, 64 nt, hsa; identical to SEQ ID NO: 247680

SEQ ID NO: 656154 - RNA, 64 nt, hsa; identical to SEQ ID NO: 247681

SEQ ID NO: 656155 - RNA, 64 nt, hsa; identical to SEQ ID NO: 247682

SEQ ID NO: 656156 - RNA, 64 nt, hsa; identical to SEQ ID NO: 247683

SEQ ID NO: 656157 - RNA, 64 nt, hsa; identical to SEQ ID NO: 247684

SEQ ID NO: 656158 - RNA, 64 nt, hsa; identical to SEQ ID NO: 247685

SEQ ID NO: 656159 - RNA, 64 nt, hsa; identical to SEQ ID NO: 247686

SEQ ID NO: 656160 - RNA, 64 nt, hsa; identical to SEQ ID NO: 247687

SEQ ID NO: 656161 - RNA, 64 nt, hsa; identical to SEQ ID NO: 247688

SEQ ID NO: 656162 - RNA, 64 nt, hsa; identical to SEQ ID NO: 247689

SEQ ID NO: 656163 - RNA, 64 nt, hsa; identical to SEQ ID NO: 247690

SEQ ID NO: 656164 - RNA, 64 nt, hsa; identical to SEQ ID NO: 247691

SEQ ID NO: 656165 - RNA, 64 nt, hsa; identical to SEQ ID NO: 247692

SEQ ID NO: 656166 - RNA, 64 nt, hsa; identical to SEQ ID NO: 247693

SEQ ID NO: 656167 - RNA, 64 nt, hsa; identical to SEQ ID NO: 247694

SEQ ID NO: 656168 - RNA, 64 nt, hsa; identical to SEQ ID NO: 247695

SEQ ID NO: 656169 - RNA, 64 nt, hsa; identical to SEQ ID NO: 247696

SEQ ID NO: 656170 - RNA, 64 nt, hsa; identical to SEQ ID NO: 247697

SEQ ID NO: 656171 - RNA, 64 nt, hsa; identical to SEQ ID NO: 217395

SEQ ID NO: 656172 - RNA, 64 nt, hsa; identical to SEQ ID NO: 217396

SEQ ID NO: 656173 - RNA, 64 nt, hsa; identical to SEQ ID NO: 217397

SEQ ID NO: 656174 - RNA, 64 nt, hsa; identical to SEQ ID NO: 217398

SEQ ID NO: 656175 - RNA, 64 nt, hsa; identical to SEQ ID NO: 217399

SEQ ID NO: 656176 - RNA, 64 nt, hsa; identical to SEQ ID NO: 217400

SEQ ID NO: 656177 - RNA, 64 nt, hsa; identical to SEQ ID NO: 217401

SEQ ID NO: 656178 - RNA, 64 nt, hsa; identical to SEQ ID NO: 217402

SEQ ID NO: 656179 - RNA, 64 nt, hsa; identical to SEQ ID NO: 217403

SEQ ID NO: 656180 - RNA, 64 nt, hsa; identical to SEQ ID NO: 217404

SEQ ID NO: 656181 - RNA, 64 nt, hsa; identical to SEQ ID NO: 217405

SEQ ID NO: 656182 - RNA, 64 nt, hsa; identical to SEQ ID NO: 217406

SEQ ID NO: 656183 - RNA, 64 nt, hsa; identical to SEQ ID NO: 217407

SEQ ID NO: 656184 - RNA, 64 nt, hsa; identical to SEQ ID NO: 217408

SEQ ID NO: 656185 - RNA, 64 nt, hsa; identical to SEQ ID NO: 217409

SEQ ID NO: 656186 - RNA, 64 nt, hsa; identical to SEQ ID NO: 217410

SEQ ID NO: 656187 - RNA, 64 nt, hsa; identical to SEQ ID NO: 217411

SEQ ID NO: 656188 - RNA, 64 nt, hsa; identical to SEQ ID NO: 217412

SEQ ID NO: 656189 - RNA, 64 nt, hsa; identical to SEQ ID NO: 217413

SEQ ID NO: 656190 - RNA, 64 nt, hsa; identical to SEQ ID NO: 217414

SEQ ID NO: 656191 - RNA, 64 nt, hsa; identical to SEQ ID NO: 217415

SEQ ID NO: 656192 - RNA, 64 nt, hsa; identical to SEQ ID NO: 217416

SEQ ID NO: 656193 - RNA, 64 nt, hsa; identical to SEQ ID NO: 209724

SEQ ID NO: 656194 - RNA, 64 nt, hsa; identical to SEQ ID NO: 209725

SEQ ID NO: 656195 - RNA, 64 nt, hsa; identical to SEQ ID NO: 209726

SEQ ID NO: 656196 - RNA, 64 nt, hsa; identical to SEQ ID NO: 209727

SEQ ID NO: 656197 - RNA, 64 nt, hsa; identical to SEQ ID NO: 209728

SEQ ID NO: 656198 - RNA, 64 nt, hsa; identical to SEQ ID NO: 209729

SEQ ID NO: 656199 - RNA, 64 nt, hsa; identical to SEQ ID NO: 209730

SEQ ID NO: 656200 - RNA, 64 nt, hsa; identical to SEQ ID NO: 209731

SEQ ID NO: 656201 - RNA, 64 nt, hsa; identical to SEQ ID NO: 209732

SEQ ID NO: 656202 - RNA, 64 nt, hsa; identical to SEQ ID NO: 209733

SEQ ID NO: 656203 - RNA, 63 nt, hsa; identical to SEQ ID NO: 209734

SEQ ID NO: 656204 - RNA, 64 nt, hsa; identical to SEQ ID NO: 209735

SEQ ID NO: 656205 - RNA, 64 nt, hsa; identical to SEQ ID NO: 209736

SEQ ID NO: 656206 - RNA, 64 nt, hsa; identical to SEQ ID NO: 209737

SEQ ID NO: 656207 - RNA, 64 nt, hsa; identical to SEQ ID NO: 209738

SEQ ID NO: 656208 - RNA, 64 nt, hsa; identical to SEQ ID NO: 209739

SEQ ID NO: 656209 - RNA, 64 nt, hsa; identical to SEQ ID NO: 209740

SEQ ID NO: 656210 - RNA, 64 nt, hsa; identical to SEQ ID NO: 209741

SEQ ID NO: 656211 - RNA, 64 nt, hsa; identical to SEQ ID NO: 209742

SEQ ID NO: 656212 - RNA, 64 nt, hsa; identical to SEQ ID NO: 209743

SEQ ID NO: 656213 - RNA, 64 nt, hsa; identical to SEQ ID NO: 209744

SEQ ID NO: 656214 - RNA, 64 nt, hsa; identical to SEQ ID NO: 209745

SEQ ID NO: 656215 - RNA, 64 nt, hsa; identical to SEQ ID NO: 209746

SEQ ID NO: 656216 - RNA, 64 nt, hsa; identical to SEQ ID NO: 209747

SEQ ID NO: 656217 - RNA, 64 nt, hsa; identical to SEQ ID NO: 209748

SEQ ID NO: 656218 - RNA, 64 nt, hsa; identical to SEQ ID NO: 209749

SEQ ID NO: 656219 - RNA, 64 nt, hsa; identical to SEQ ID NO: 209750

SEQ ID NO: 656220 - RNA, 64 nt, hsa; identical to SEQ ID NO: 209751

SEQ ID NO: 656221 - RNA, 64 nt, hsa; identical to SEQ ID NO: 209752

SEQ ID NO: 656222 - RNA, 64 nt, hsa; identical to SEQ ID NO: 209753

SEQ ID NO: 656223 - RNA, 64 nt, hsa; identical to SEQ ID NO: 209754

SEQ ID NO: 656224 - RNA, 64 nt, hsa; identical to SEQ ID NO: 209755

SEQ ID NO: 656225 - RNA, 64 nt, hsa; identical to SEQ ID NO: 209756

SEQ ID NO: 656226 - RNA, 64 nt, hsa; identical to SEQ ID NO: 209757

SEQ ID NO: 656227 - RNA, 64 nt, hsa; identical to SEQ ID NO: 209758

SEQ ID NO: 656228 - RNA, 64 nt, hsa; identical to SEQ ID NO: 209759

SEQ ID NO: 656229 - RNA, 64 nt, hsa; identical to SEQ ID NO: 209760

SEQ ID NO: 656230 - RNA, 64 nt, hsa; identical to SEQ ID NO: 209761

SEQ ID NO: 656231 - RNA, 64 nt, hsa; identical to SEQ ID NO: 209762

SEQ ID NO: 656232 - RNA, 64 nt, hsa; identical to SEQ ID NO: 209763

SEQ ID NO: 656233 - RNA, 64 nt, hsa; identical to SEQ ID NO: 209764

SEQ ID NO: 656234 - RNA, 64 nt, hsa; identical to SEQ ID NO: 209765

SEQ ID NO: 656235 - RNA, 64 nt, hsa; identical to SEQ ID NO: 209766

SEQ ID NO: 656236 - RNA, 64 nt, hsa; identical to SEQ ID NO: 209767

SEQ ID NO: 656237 - RNA, 64 nt, hsa; identical to SEQ ID NO: 209768

SEQ ID NO: 656238 - RNA, 64 nt, hsa; identical to SEQ ID NO: 209769

SEQ ID NO: 656239 - RNA, 64 nt, hsa; identical to SEQ ID NO: 209770

SEQ ID NO: 656240 - RNA, 64 nt, hsa; identical to SEQ ID NO: 209771

SEQ ID NO: 656241 - RNA, 64 nt, hsa; identical to SEQ ID NO: 209772

SEQ ID NO: 656242 - RNA, 64 nt, hsa; identical to SEQ ID NO: 209773

SEQ ID NO: 656243 - RNA, 64 nt, hsa; identical to SEQ ID NO: 209774

SEQ ID NO: 656244 - RNA, 64 nt, hsa; identical to SEQ ID NO: 209775

SEQ ID NO: 656245 - RNA, 64 nt, hsa; identical to SEQ ID NO: 209776

SEQ ID NO: 656246 - RNA, 64 nt, hsa; identical to SEQ ID NO: 209777

SEQ ID NO: 656247 - RNA, 64 nt, hsa; identical to SEQ ID NO: 209778

SEQ ID NO: 656248 - RNA, 64 nt, hsa; identical to SEQ ID NO: 209779

SEQ ID NO: 656249 - RNA, 64 nt, hsa; identical to SEQ ID NO: 209780

SEQ ID NO: 656250 - RNA, 64 nt, hsa; identical to SEQ ID NO: 209781

SEQ ID NO: 656251 - RNA, 64 nt, hsa; identical to SEQ ID NO: 209782

SEQ ID NO: 656252 - RNA, 64 nt, hsa; identical to SEQ ID NO: 209783

SEQ ID NO: 656253 - RNA, 64 nt, hsa; identical to SEQ ID NO: 209784

SEQ ID NO: 656254 - RNA, 64 nt, hsa; identical to SEQ ID NO: 209785

SEQ ID NO: 656255 - RNA, 64 nt, hsa; identical to SEQ ID NO: 209786

SEQ ID NO: 656256 - RNA, 64 nt, hsa; identical to SEQ ID NO: 209787

SEQ ID NO: 656257 - RNA, 64 nt, hsa; identical to SEQ ID NO: 209788

SEQ ID NO: 656258 - RNA, 64 nt, hsa; identical to SEQ ID NO: 209789

SEQ ID NO: 656259 - RNA, 64 nt, hsa; identical to SEQ ID NO: 209790

SEQ ID NO: 656260 - RNA, 64 nt, hsa; identical to SEQ ID NO: 209791

SEQ ID NO: 656261 - RNA, 64 nt, hsa; identical to SEQ ID NO: 209792

SEQ ID NO: 656262 - RNA, 64 nt, hsa; identical to SEQ ID NO: 209793

SEQ ID NO: 656263 - RNA, 64 nt, hsa; identical to SEQ ID NO: 209794

SEQ ID NO: 656264 - RNA, 64 nt, hsa; identical to SEQ ID NO: 209795

SEQ ID NO: 656265 - RNA, 64 nt, hsa; identical to SEQ ID NO: 209796

SEQ ID NO: 656266 - RNA, 64 nt, hsa; identical to SEQ ID NO: 209797

SEQ ID NO: 656267 - RNA, 64 nt, hsa; identical to SEQ ID NO: 209798

SEQ ID NO: 656268 - RNA, 64 nt, hsa; identical to SEQ ID NO: 209799

SEQ ID NO: 656269 - RNA, 64 nt, hsa; identical to SEQ ID NO: 209800

SEQ ID NO: 656270 - RNA, 64 nt, hsa; identical to SEQ ID NO: 209801

SEQ ID NO: 656271 - RNA, 64 nt, hsa; identical to SEQ ID NO: 209802

SEQ ID NO: 656272 - RNA, 64 nt, hsa; identical to SEQ ID NO: 209803

SEQ ID NO: 656273 - RNA, 64 nt, hsa; identical to SEQ ID NO: 209804

SEQ ID NO: 656274 - RNA, 64 nt, hsa; identical to SEQ ID NO: 209805

SEQ ID NO: 656275 - RNA, 64 nt, hsa; identical to SEQ ID NO: 209806

SEQ ID NO: 656276 - RNA, 64 nt, hsa; identical to SEQ ID NO: 209807

SEQ ID NO: 656277 - RNA, 64 nt, hsa; identical to SEQ ID NO: 209808

SEQ ID NO: 656278 - RNA, 64 nt, hsa; identical to SEQ ID NO: 209809

SEQ ID NO: 656279 - RNA, 64 nt, hsa; identical to SEQ ID NO: 209810

SEQ ID NO: 656280 - RNA, 64 nt, hsa; identical to SEQ ID NO: 209811

SEQ ID NO: 656281 - RNA, 64 nt, hsa; identical to SEQ ID NO: 209812

SEQ ID NO: 656282 - RNA, 64 nt, hsa; identical to SEQ ID NO: 209813

SEQ ID NO: 656283 - RNA, 64 nt, hsa; identical to SEQ ID NO: 209814

SEQ ID NO: 656284 - RNA, 64 nt, hsa; identical to SEQ ID NO: 217965

SEQ ID NO: 656285 - RNA, 64 nt, hsa; identical to SEQ ID NO: 217966

SEQ ID NO: 656286 - RNA, 64 nt, hsa; identical to SEQ ID NO: 217967

SEQ ID NO: 656287 - RNA, 64 nt, hsa; identical to SEQ ID NO: 217968

SEQ ID NO: 656288 - RNA, 64 nt, hsa; identical to SEQ ID NO: 217969

SEQ ID NO: 656289 - RNA, 64 nt, hsa; identical to SEQ ID NO: 217970

SEQ ID NO: 656290 - RNA, 64 nt, hsa; identical to SEQ ID NO: 217971

SEQ ID NO: 656291 - RNA, 64 nt, hsa; identical to SEQ ID NO: 217972

SEQ ID NO: 656292 - RNA, 64 nt, hsa; identical to SEQ ID NO: 217973

SEQ ID NO: 656293 - RNA, 64 nt, hsa; identical to SEQ ID NO: 217974

SEQ ID NO: 656294 - RNA, 64 nt, hsa; identical to SEQ ID NO: 217975

SEQ ID NO: 656295 - RNA, 64 nt, hsa; identical to SEQ ID NO: 217976

SEQ ID NO: 656296 - RNA, 64 nt, hsa; identical to SEQ ID NO: 217977

SEQ ID NO: 656297 - RNA, 64 nt, hsa; identical to SEQ ID NO: 217978

SEQ ID NO: 656298 - RNA, 64 nt, hsa; identical to SEQ ID NO: 217979

SEQ ID NO: 656299 - RNA, 64 nt, hsa; identical to SEQ ID NO: 217980

SEQ ID NO: 656300 - RNA, 64 nt, hsa; identical to SEQ ID NO: 217981

SEQ ID NO: 656301 - RNA, 64 nt, hsa; identical to SEQ ID NO: 217982

SEQ ID NO: 656302 - RNA, 64 nt, hsa; identical to SEQ ID NO: 217983

SEQ ID NO: 656303 - RNA, 64 nt, hsa; identical to SEQ ID NO: 217984

SEQ ID NO: 656304 - RNA, 64 nt, hsa; identical to SEQ ID NO: 217985

SEQ ID NO: 656305 - RNA, 64 nt, hsa; identical to SEQ ID NO: 217986

SEQ ID NO: 656306 - RNA, 64 nt, hsa; identical to SEQ ID NO: 217987

SEQ ID NO: 656307 - RNA, 56 nt, hsa; identical to SEQ ID NO: 217988

SEQ ID NO: 656308 - RNA, 64 nt, hsa; identical to SEQ ID NO: 217989

SEQ ID NO: 656309 - RNA, 64 nt, hsa; identical to SEQ ID NO: 217990

SEQ ID NO: 656310 - RNA, 64 nt, hsa; identical to SEQ ID NO: 217991

SEQ ID NO: 656311 - RNA, 64 nt, hsa; identical to SEQ ID NO: 217992

SEQ ID NO: 656312 - RNA, 64 nt, hsa; identical to SEQ ID NO: 217993

SEQ ID NO: 656313 - RNA, 64 nt, hsa; identical to SEQ ID NO: 217994

SEQ ID NO: 656314 - RNA, 64 nt, hsa; identical to SEQ ID NO: 217995

SEQ ID NO: 656315 - RNA, 64 nt, hsa; identical to SEQ ID NO: 217996

SEQ ID NO: 656316 - RNA, 64 nt, hsa; identical to SEQ ID NO: 217997

SEQ ID NO: 656317 - RNA, 64 nt, hsa; identical to SEQ ID NO: 217998

SEQ ID NO: 656318 - RNA, 64 nt, hsa; identical to SEQ ID NO: 217999

SEQ ID NO: 656319 - RNA, 64 nt, hsa; identical to SEQ ID NO: 218000

SEQ ID NO: 656320 - RNA, 64 nt, hsa; identical to SEQ ID NO: 218001

SEQ ID NO: 656321 - RNA, 64 nt, hsa; identical to SEQ ID NO: 218002

SEQ ID NO: 656322 - RNA, 64 nt, hsa; identical to SEQ ID NO: 218003

SEQ ID NO: 656323 - RNA, 64 nt, hsa; identical to SEQ ID NO: 218004

SEQ ID NO: 656324 - RNA, 64 nt, hsa; identical to SEQ ID NO: 218005

SEQ ID NO: 656325 - RNA, 64 nt, hsa; identical to SEQ ID NO: 218006

SEQ ID NO: 656326 - RNA, 64 nt, hsa; identical to SEQ ID NO: 218007

SEQ ID NO: 656327 - RNA, 64 nt, hsa; identical to SEQ ID NO: 218008

SEQ ID NO: 656328 - RNA, 64 nt, hsa; identical to SEQ ID NO: 218009

SEQ ID NO: 656329 - RNA, 64 nt, hsa; identical to SEQ ID NO: 218010

SEQ ID NO: 656330 - RNA, 64 nt, hsa; identical to SEQ ID NO: 218011

SEQ ID NO: 656331 - RNA, 64 nt, hsa; identical to SEQ ID NO: 218012

SEQ ID NO: 656332 - RNA, 64 nt, hsa; identical to SEQ ID NO: 218013

SEQ ID NO: 656333 - RNA, 64 nt, hsa; identical to SEQ ID NO: 218014

SEQ ID NO: 656334 - RNA, 64 nt, hsa; identical to SEQ ID NO: 218015

SEQ ID NO: 656335 - RNA, 64 nt, hsa; identical to SEQ ID NO: 218016

SEQ ID NO: 656336 - RNA, 64 nt, hsa; identical to SEQ ID NO: 218017

SEQ ID NO: 656337 - RNA, 64 nt, hsa; identical to SEQ ID NO: 218018

SEQ ID NO: 656338 - RNA, 64 nt, hsa; identical to SEQ ID NO: 218019

SEQ ID NO: 656339 - RNA, 64 nt, hsa; identical to SEQ ID NO: 218020

SEQ ID NO: 656340 - RNA, 64 nt, hsa
gguaaauaaugcaaaauaccugguaguaaaauaaaugcugaaaauuuuccuuuaaaauagaauc

SEQ ID NO: 656341 - RNA, 64 nt, hsa
cugaggucaggaguucgaguccagccuggccaauaugcugaaacccugucucuacuaaaauuac

SEQ ID NO: 656342 - RNA, 64 nt, hsa
uuggugucuguccuaauuccuuucucacucaccgaugcugaauacccaguugaaucaaacuguc

SEQ ID NO: 656343 - RNA, 64 nt, hsa
aauggaauuuccuaugcacuacuguagcuaggaaaugcugaaaacaacuguguuuuuuaauuaa

SEQ ID NO: 656344 - RNA, 64 nt, hsa
gcaugaacauguacuguucucuucuugaacacucaugcugaaagcccaaguagggggucuaaaa

SEQ ID NO: 656345 - RNA, 64 nt, hsa
auuuuuaaggacuuuccuuccuccaucuccaagaaugcugaaaccaagggggaugacaugugac

SEQ ID NO: 656346 - RNA, 64 nt, hsa
guccaccugccugcugaccacuggacgcugcuccaugcugaagaaaagugacagucuccagggg

SEQ ID NO: 656347 - RNA, 64 nt, hsa
agaaaagugacagucuccaggggacauuucagccaugcugaaagggaggcuggcaguggucauu

SEQ ID NO: 656348 - RNA, 64 nt, hsa
cuaaaguugaauaaaaugcaugaacaauagaaaaaugcugaacauuauuuuggaugcuagcugc

SEQ ID NO: 656349 - RNA, 64 nt, hsa
uauuacagagcuauguaaagggacuuaggagaaaaugcugaauguaagauggucccauuucaau

SEQ ID NO: 656350 - RNA, 64 nt, hsa
cauguaccauuugcauggcuccagaaaugucuaaaugcugaaaaaacaccuagcuuuauucuuc

SEQ ID NO: 656351 - RNA, 64 nt, hsa
aucccagcacaucacuguagaauuugagugaucuaugcugaauaaacaguggaaugugaccagu

SEQ ID NO: 656352 - RNA, 64 nt, hsa
cuugauuuuacugcagaucaagggguguuguuagaugcugaaauguccagaaaagaaggacauu

SEQ ID NO: 656353 - RNA, 64 nt, hsa
cuuauuuagcuuaucauaaucuacuuuguaaaacaugcugaaaccucacuguggagaaccagaa

SEQ ID NO: 656354 - RNA, 64 nt, hsa
augguccgaauaucugggccugcccccccaaauuaugcugaaaccuaaucaccagugugauggu

SEQ ID NO: 656355 - RNA, 64 nt, hsa
gaagagaaacuagaaacaguuaaagugucuaauaaugcugaagaccccaaagaucucauguuaa

SEQ ID NO: 656356 - RNA, 64 nt, hsa
accucagucucccaaguagcugggacuauuuugcaugcugaaacuucucaaccagaagaaaggg

SEQ ID NO: 656357 - RNA, 64 nt, hsa
aaugucagauuuauuuuuauguggaucccuguguaugcugaacuacagagcaugauguuuaauc

SEQ ID NO: 656358 - RNA, 64 nt, hsa
uauucuucuaacccuuccugaaguugugaugcucaugcugaaauuuaagaugccaaauauuuuu

SEQ ID NO: 656359 - RNA, 64 nt, hsa; identical to SEQ ID NO: 125003

SEQ ID NO: 656360 - RNA, 64 nt, hsa; identical to SEQ ID NO: 125004

SEQ ID NO: 656361 - RNA, 64 nt, hsa; identical to SEQ ID NO: 125005

SEQ ID NO: 656362 - RNA, 64 nt, hsa; identical to SEQ ID NO: 125006

SEQ ID NO: 656363 - RNA, 64 nt, hsa; identical to SEQ ID NO: 125007

SEQ ID NO: 656364 - RNA, 64 nt, hsa; identical to SEQ ID NO: 125008

SEQ ID NO: 656365 - RNA, 64 nt, hsa; identical to SEQ ID NO: 125009

SEQ ID NO: 656366 - RNA, 64 nt, hsa; identical to SEQ ID NO: 125010

SEQ ID NO: 656367 - RNA, 64 nt, hsa; identical to SEQ ID NO: 125011

SEQ ID NO: 656368 - RNA, 64 nt, hsa; identical to SEQ ID NO: 125012

SEQ ID NO: 656369 - RNA, 64 nt, hsa; identical to SEQ ID NO: 125013

SEQ ID NO: 656370 - RNA, 64 nt, hsa; identical to SEQ ID NO: 125014

SEQ ID NO: 656371 - RNA, 64 nt, hsa; identical to SEQ ID NO: 125015

SEQ ID NO: 656372 - RNA, 64 nt, hsa; identical to SEQ ID NO: 125016

SEQ ID NO: 656373 - RNA, 64 nt, hsa; identical to SEQ ID NO: 125017

SEQ ID NO: 656374 - RNA, 64 nt, hsa
cuuuuauaauaaaaaaaagaaguugaguaaaaaaaaaaaacacacaaaccuguuaguuucaaaa

SEQ ID NO: 656375 - RNA, 64 nt, hsa
uugaugcaauuuuuaacguuaauugauauaaaaaaaaaaacaacaaaauuaggcuuguaaaacu

SEQ ID NO: 656376 - RNA, 64 nt, hsa
aaacacuaacauuuuccccuucuguaguuguaugaaaaaacaaauauuguuagcauaguagaua

SEQ ID NO: 656377 - RNA, 64 nt, hsa
auuguguaaaauuacauuuuuuuuccaggggagaaaaaaacaucaaacaaaaacaucuaaauca

SEQ ID NO: 656378 - RNA, 64 nt, hsa
aaagguuaaaacaaaaacaaaaaaccacaaaaauaaaaaacaaaaaaaacaaaaaacccaagaa

SEQ ID NO: 656379 - RNA, 64 nt, hsa
aacaaaaacaaaaaaccacaaaaauaaaaaacaaaaaaaacaaaaaacccaagaaaaaaaaaaa

SEQ ID NO: 656380 - RNA, 64 nt, hsa
uuuuaaaaguuuugaaaugcugcacuuacauuuaaaaaaacaacaacaacauuuuuucaacaau

SEQ ID NO: 656381 - RNA, 64 nt, hsa
guccuuucaccccaggacucuaaauuauugggguaaaaaacagccuugcaagaaaaaggggagc

SEQ ID NO: 656382 - RNA, 64 nt, hsa
gcuggagaggcaggagcccuggggugagaaaagcaaaaaacaaacaaaaaacaaaacccuggag

SEQ ID NO: 656383 - RNA, 64 nt, hsa
aggagcccuggggugagaaaagcaaaaaacaaacaaaaaacaaaacccuggaguguuaggagga

SEQ ID NO: 656384 - RNA, 64 nt, hsa
acuaaccaccagaagacuugaaaaucuuaaaaaaaaaaaacaaaaaaacaagaaaaggcaacau

SEQ ID NO: 656385 - RNA, 64 nt, hsa
ccagaagacuugaaaaucuuaaaaaaaaaaaacaaaaaaacaagaaaaggcaacaucucauuuu

SEQ ID NO: 656386 - RNA, 64 nt, hsa
ugagcaaaaaaaaaaaaaaaacaaaaaaacaaaaaaaaaacaaaacaguuuuuaaaacugauuu

SEQ ID NO: 656387 - RNA, 64 nt, hsa
gcaaauaguccugagcaaaaaaaaaaaaaaaacaaaaaaacaaaaaaaaaacaaaacaguuuuu

SEQ ID NO: 656388 - RNA, 64 nt, hsa
cucugaaagcaaauaguccugagcaaaaaaaaaaaaaaaacaaaaaaacaaaaaaaaaacaaaa

SEQ ID NO: 656389 - RNA, 64 nt, hsa
gauaaaaaaaaaaaaaaaacaaaaaacaacaccaaaaaaacagcagugauauauauauauauau

SEQ ID NO: 656390 - RNA, 64 nt, hsa
ccugggcacuuuuagauaaaaaaaaaaaaaaaacaaaaaacaacaccaaaaaaacagcagugau

SEQ ID NO: 656391 - RNA, 64 nt, hsa
aagcccaccugggcacuuuuagauaaaaaaaaaaaaaaaacaaaaaacaacaccaaaaaaacag

SEQ ID NO: 656392 - RNA, 64 nt, hsa
aaaaacaacaacaacaaaaaacuaagcgauugggaaaaaacaggaauuuuaucugguuauugca

SEQ ID NO: 656393 - RNA, 64 nt, hsa
aaaguaguucugggucagaaugaucuacucaguuaaaaaacaacaacaacaaaaaacuaagcga

SEQ ID NO: 656394 - RNA, 64 nt, hsa
ggaauacaguguguuguuaauagucacuacaggcaaaaaacaguaagagcuugcuuuuaaauug

SEQ ID NO: 656395 - RNA, 64 nt, hsa
uugcuuuacaauaaugcuuagaugcagagagaggaaaaaacagcaacaaagucacauaaaucuu

SEQ ID NO: 656396 - RNA, 64 nt, hsa
aaggaacuauucuuuggaaaaaaacaaaaaacaaaaaaaacaacaaaaaaagcuaaguuauaag

SEQ ID NO: 656397 - RNA, 64 nt, hsa
auccauuuuaaggaacuauucuuuggaaaaaaacaaaaaacaaaaaaaacaacaaaaaaagcua

SEQ ID NO: 656398 - RNA, 64 nt, hsa
caggagcauccauuuuaaggaacuauucuuuggaaaaaaacaaaaaacaaaaaaaacaacaaaa

SEQ ID NO: 656399 - RNA, 64 nt, hsa
uuuauauuguuugauacucaguaccuguuuuaagaaaaaacaacaaggaaguaaaaccaaagac

SEQ ID NO: 656400 - RNA, 64 nt, hsa
ugauuaucaaagaauaucagggccugacauccacaaaaaacaaacuuaauuuugauugaacuaa

SEQ ID NO: 656401 - RNA, 64 nt, hsa
gaccagccugggcaacauagugagaucccaucucaaaaaacauuauuuuuaaaauuagccuggu

SEQ ID NO: 656402 - RNA, 64 nt, hsa
cugggcgacagagcaagacgccaucucaaaaacaaaaaaacaaaauucauguuacuaaaagaca

SEQ ID NO: 656403 - RNA, 64 nt, hsa
uacaucacuggcugcucuucaucaaaccuacuauaaaaaacauucaaguucaacuguuucuuug

SEQ ID NO: 656404 - RNA, 64 nt, hsa
ccagccuggaugacagaguggagacucuguuucaaaaaaacagaaaagaaaauauaguuugauu

SEQ ID NO: 656405 - RNA, 64 nt, hsa
cugcuucacuugccuagucuugaagaaaaaaaacaaaaaacaaaaaaaaaccuuguuccuuuau

SEQ ID NO: 656406 - RNA, 64 nt, hsa
auucccacugcuucacuugccuagucuugaagaaaaaaaacaaaaaacaaaaaaaaaccuuguu

SEQ ID NO: 656407 - RNA, 64 nt, hsa
gugcagucgugucauaaaaaaacaaaacaaaacaaaaaaacacuaggaguccacucaacccugg

SEQ ID NO: 656408 - RNA, 64 nt, hsa
caggaccagauccacaucgugcagucgugucauaaaaaaacaaaacaaaacaaaaaaacacuag

SEQ ID NO: 656409 - RNA, 64 nt, hsa
agacucuaucucaaaaaaaaacaaaaaaaaaaacaaaaaacaaagaugagucgcacaucugcug

SEQ ID NO: 656410 - RNA, 64 nt, hsa
cagagcgagacucuaucucaaaaaaaaacaaaaaaaaaaacaaaaaacaaagaugagucgcaca

SEQ ID NO: 656411 - RNA, 64 nt, hsa
cagccugggcaacagagcgagacucuaucucaaaaaaaaacaaaaaaaaaaacaaaaaacaaag

SEQ ID NO: 656412 - RNA, 64 nt, hsa
uuuauuucuuauuuccuaacauugaauucguuagaaaaaacagcgucaccucacucuucaccug

SEQ ID NO: 656413 - RNA, 64 nt, hsa
guauugcaaaaguuagaagucauuuuacaaauuaaaaaaacauuuuuuucuugguagucuuuaa

SEQ ID NO: 656414 - RNA, 64 nt, hsa
cucucucucaaagaaaaaaaaaaugggagugcaaaaaaaacaaagccaaaaaauauaugaagga

SEQ ID NO: 656415 - RNA, 64 nt, hsa
aaguagaaacauaauuuuuuuuccuccaaaggugaaaaaacaaugcauucuugcuuuaaaaaaa

SEQ ID NO: 656416 - RNA, 64 nt, hsa
aguggauuuuguauuuuguauuuaacuugcauucaaaaaacaggaucucaguucuccuuucuug

SEQ ID NO: 656417 - RNA, 64 nt, hsa
auguuuucuuccugaaugcucauuaggacuucuuaaaaaacaugaaaguaauuuggaaguaagu

SEQ ID NO: 656418 - RNA, 64 nt, hsa
uauccauuuguugacauguagacuguuuacaaaaaaaaaacacaugguuaaauguuaaauuuua

SEQ ID NO: 656419 - RNA, 64 nt, hsa
aaugaaaggagucaccuuuuacaugacucaggugaaaaaacaguauaaacauuaauuuacuuug

SEQ ID NO: 656420 - RNA, 64 nt, hsa
aagguagugaaaaaaugaaaauuugcuauuuauuaaaaaacauuaaauuucauuccaaaugaga

SEQ ID NO: 656421 - RNA, 64 nt, hsa
uaacaucuaagcaucaucugauuugauauucccuaaaaaacauuuggaauauaugcuaucuaua

SEQ ID NO: 656422 - RNA, 64 nt, hsa
cagcaucauuaaacaguuauguuguucuccuugcaaaaaacauguacugacuucccguugagua

SEQ ID NO: 656423 - RNA, 64 nt, hsa
gacuagggggacaaagaaaagcaaaacugaccauaaaaaacaauuaccuggugagaaguugcau

SEQ ID NO: 656424 - RNA, 64 nt, hsa
aaagugacagucaaaaccccaccuggagcaaauaaaaaaacauacaaaacguacuggugcuuuc

SEQ ID NO: 656425 - RNA, 64 nt, hsa
acugagguagcgacacaaaguuaaacaaacaaacaaaaaacacaaaacauaauaaaacaccaag

SEQ ID NO: 656426 - RNA, 64 nt, hsa
ugcucuuguuucucaaaaaagaaaaacaaaaaacaaaaaacaggggccaauaaauucccuaaca

SEQ ID NO: 656427 - RNA, 64 nt, hsa
uaucucaugcucuuguuucucaaaaaagaaaaacaaaaaacaaaaaacaggggccaauaaauuc

SEQ ID NO: 656428 - RNA, 64 nt, hsa
cuuggauacacaccgcucuucagguuguaaaaaaaaaaaacauacauuggggaaagguuuaaga

SEQ ID NO: 656429 - RNA, 64 nt, hsa
uuuuuaaauauaaauguuaagaaaaauuuuuuuuaaaaaacacuucauuauguuuaggggggaa

SEQ ID NO: 656430 - RNA, 64 nt, hsa
ccgaacagguuuauuuuaguaaaaaaaaaaaaacaaaaaacaaaaacaaaagauuuuuaucaaa

SEQ ID NO: 656431 - RNA, 64 nt, hsa
uguucccccgaacagguuuauuuuaguaaaaaaaaaaaaacaaaaaacaaaaacaaaagauuuu

SEQ ID NO: 656432 - RNA, 64 nt, hsa
uccaucucauuaaaaaaaacgaaaacaaaaacaaaaaaaacacaaaccaucaucacagaagaug

SEQ ID NO: 656433 - RNA, 64 nt, hsa
gguagggacaaaaccacaucagguuuucagaaggaaaaaacauuuaaaaacccaccaucacaug

SEQ ID NO: 656434 - RNA, 64 nt, hsa
agaaaaaauuuccagaagaggaaaaaaaaacuacaaaaaacaaaacauugaagguugauauuuu

SEQ ID NO: 656435 - RNA, 64 nt, hsa
guagauaggagcuuauggucaaaaagugcaaaaaaaaaaacaaaaaaaaagcaauagauagaga

SEQ ID NO: 656436 - RNA, 64 nt, hsa
auuucuauuucaaaggaaaccaaaccuuaaaaaaaaaaaacaaaaacugggcugggucuuccaa

SEQ ID NO: 656437 - RNA, 64 nt, hsa
ccauugguucagccucaagucuggcccgucuucgaaaaaacaaacacauuuguaagcuuugugg

SEQ ID NO: 656438 - RNA, 64 nt, hsa
ccgcucugggugucucccacaugucuacuauggcaaaaaacauuaccauccccacccauaccac

SEQ ID NO: 656439 - RNA, 64 nt, hsa
cgccccagcccucagccccaggccccagcuggagaaaaaacauugcccagggauuaggagcagc

SEQ ID NO: 656440 - RNA, 64 nt, hsa
ccaacaugaagucucuuuaugguuagagaagaccaaaaaacaaacaaacaaacuuagaaacaua

SEQ ID NO: 656441 - RNA, 64 nt, hsa
cccaauauggugaaaccccgucucuccugaaaaaaaaaaacacaaaaauuagccaggcauggug

SEQ ID NO: 656442 - RNA, 55 nt, hsa; identical to SEQ ID NO: 422370

SEQ ID NO: 656443 - RNA, 62 nt, hsa
auuuauuguaucccauguaaaaacaaaaaaacaaaaaacaaagaaaagaaagagauuuuaua

SEQ ID NO: 656444 - RNA, 64 nt, hsa
gauacaauuaaccauuuuauauuugccaccuacaaaaaaacacccaauaucuucucuuguagac

SEQ ID NO: 656445 - RNA, 64 nt, hsa
gaguaaugaaguuaucuuuuuuguuuaaaaaaaaaaaaaacacugcauuaaaaaaguaucuguu

SEQ ID NO: 656446 - RNA, 64 nt, hsa
auaugcuagaaaaggcauuuugggguuauguuuaaaaaaacauuauugucccacaauauuaccu

SEQ ID NO: 656447 - RNA, 64 nt, hsa
aaauuagccagacaugguggcaugcgcuuguuuaaaaaaacaaauaaauaaauaaucgacucaa

SEQ ID NO: 656448 - RNA, 64 nt, hsa
ggaguaauuguacugcaauaauuuuucaaaaaacaaaaaacaaaacaaacaaaagagaacuaug

SEQ ID NO: 656449 - RNA, 64 nt, hsa
ccaaauaggaguaauuguacugcaauaauuuuucaaaaaacaaaaaacaaaacaaacaaaagag

SEQ ID NO: 656450 - RNA, 64 nt, hsa
ccuuuuaaggaugccaagaaugcauuauuccacaaaaaaacagcagaccaacauauagaguguu

SEQ ID NO: 656451 - RNA, 64 nt, hsa
ucugucuugcgugauuuguauauuucacugguuuaaaaaacaaacaucgaaaggcuuaugccaa

SEQ ID NO: 656452 - RNA, 64 nt, hsa
gagcugcugagauuucaguggugcaaugucuuuaaaaaaacaggcuuuguugggaggguauuuc

SEQ ID NO: 656453 - RNA, 64 nt, hsa
aaaggaacauauucaauuuggcuuuuuguggcugaaaaaacauaacuguuagacccaaagcauu

SEQ ID NO: 656454 - RNA, 64 nt, hsa
guucaaaccuuuagggaaugauuaaaauuuaaaaaaaaaacauuucacucaguugcacuuaguc

SEQ ID NO: 656455 - RNA, 64 nt, hsa
accccgagaaugaagauuggaaaaaggaaaaaaaaaaaaacacgucaaaaguuagcagugaaau

SEQ ID NO: 656456 - RNA, 64 nt, hsa
uuacagauacugaaagugccuccuuuugugguguaaaaaacaaauuauggugcaaaaaguaauc

SEQ ID NO: 656457 - RNA, 64 nt, hsa
ccauuacauggcaaaauguuugcuaccuuaguuuaaaaaacaaucucaaacaaaagacuugcuu

SEQ ID NO: 656458 - RNA, 64 nt, hsa
ugugugggauugugcugauuuuuguugauaacacaaaaaacacuauguuuucuggagagcugug

SEQ ID NO: 656459 - RNA, 64 nt, hsa
uugguggguuguauaaggguagcuuuuguuguuaaaaaaacaguagagaguuaaguuccauaua

SEQ ID NO: 656460 - RNA, 64 nt, hsa
acuguacugaauagguuccccaauccaucguauuaaaaaacaauuaacugcccucugaaauaau

SEQ ID NO: 656461 - RNA, 64 nt, hsa
aagucucuguguaaccagcucaguguuuugguggaaaaaacauuuuaaguuuuacugauaauuu

SEQ ID NO: 656462 - RNA, 64 nt, hsa
ucuagccugggugacagagucagacuccgucccaaaaaaacaaacaaacaaaacaaaacaaaaa

SEQ ID NO: 656463 - RNA, 64 nt, hsa
gucccaaaaaaacaaacaaacaaaacaaaacaaaaaaaaacagaaguuacaaaugaauacucac

SEQ ID NO: 656464 - RNA, 64 nt, hsa
uucaagaccaaccuggugaaaccccgucucuacaaaaaaacacaaaaaauagccaggcauggug

SEQ ID NO: 656465 - RNA, 64 nt, hsa
gcauucuauuuucuauaugacccucuugauauuuaaaaaacacuauggauaacaauucuucauu

SEQ ID NO: 656466 - RNA, 64 nt, hsa
gcagaaacauaccuuugacuauaagaaauuaaaaaaaaaacaccaaaauaauauuuuucuuacu

SEQ ID NO: 656467 - RNA, 64 nt, hsa
aggcuuuucuuugguuuucuucaaacauaggugaaaaaaacacugccauucacaagucaaggaa

SEQ ID NO: 656468 - RNA, 64 nt, hsa
ucuuggagaauuuggaugccuaaggcauaaaggaaaaaaacagaguucauaguuugagcuggua

SEQ ID NO: 656469 - RNA, 64 nt, hsa
aaaaagauguaagacuuugguucccaacuuuguuaaaaaacaaaaaaagugauggaaagguguu

SEQ ID NO: 656470 - RNA, 64 nt, hsa
uaaaaaacaaaaagccaacaacccagaaagguuuaaaaaacauaaggaaaaaaaagacaaauua

SEQ ID NO: 656471 - RNA, 64 nt, hsa
auaaaaacaaaaaaguuggaaggcagaaaccauuaaaaaacaaaaagccaacaacccagaaagg

SEQ ID NO: 656472 - RNA, 64 nt, hsa
aaauauacuuauuugucuucuuuuugcauugugaaaaaaacaaaauaaauuuugugugauaauu

SEQ ID NO: 656473 - RNA, 64 nt, hsa
ucacuuugaauugugcacauaagaaaaccaauacaaaaaacaauuuguauucaauauugucaca

SEQ ID NO: 656474 - RNA, 64 nt, hsa
aaccaacaaacucucuuaagguucaauauguaauaaaaaacauaacacaaauaauuauucuaua

SEQ ID NO: 656475 - RNA, 64 nt, hsa
uauuucagcccuauuuguauuauuuugugcauuuaaaaaacacaaucuuaaggggauagacuag

SEQ ID NO: 656476 - RNA, 64 nt, hsa
uaaaauaccuucagccuaaggcacaaggaugccaaaaaaacaaaggugagaaaccacaacacag

SEQ ID NO: 656477 - RNA, 64 nt, hsa
gacaccaacacaccacucauuggaaaauggaaaaaaaaaacaaaaaaaaaacaaaaaaauguac

SEQ ID NO: 656478 - RNA, 64 nt, hsa
accacucauuggaaaauggaaaaaaaaaacaaaaaaaaaacaaaaaaauguacaauggaugcau

SEQ ID NO: 656479 - RNA, 64 nt, hsa
aaaccccuacccuccuugguuuaccuccaucauuaaaaaacaacaaugacaacgacaacaaaaa

SEQ ID NO: 656480 - RNA, 64 nt, hsa
uccaucauuaaaaaacaacaaugacaacgacaacaaaaaacaaaacuaaaacgacuuauuauuu

SEQ ID NO: 656481 - RNA, 64 nt, hsa
ucagaugucagccuuugcucuccauuuugacguuaaaaaacaacaacagaucuagagauaccuc

SEQ ID NO: 656482 - RNA, 64 nt, hsa
gguauccuguaauuuaguuguaacauagaaaaugaaaaaacaguuaaaaaaagugaaguaguug

SEQ ID NO: 656483 - RNA, 64 nt, hsa
gauaaaguauuacugauaaaaaauuaucuaaggaaaaaaacagaaaauuauuugguguggccau

SEQ ID NO: 656484 - RNA, 64 nt, hsa
acuuuuaaaaagugucuguaaaucuucaguguuaaaaaaacagaugcccauuuguuggcuguuu

SEQ ID NO: 656485 - RNA, 64 nt, hsa
uuucuuaagacuauuucacaaguccugugaggcaaaaaaacaaaacaaaacaaaacaaccaaac

SEQ ID NO: 656486 - RNA, 64 nt, hsa
uuaacuuuguccuauuugucaacuggguucuggaaaaaaacaaacaugaugaagcuuuugaaua

SEQ ID NO: 656487 - RNA, 64 nt, hsa
gggcaacagagcaagacccugucugucucaaaacaaaaaacaaaaccacuuauauugcuagcua

SEQ ID NO: 656488 - RNA, 64 nt, hsa
uauugcauacaaaagaaaauguguaaggcuugcuaaaaaacaaaacaaaacaaaacacaguccu

SEQ ID NO: 656489 - RNA, 64 nt, hsa
uguauuaauauaugcauucacuugaaaaacuaaaaaaaaacaauaauuuggaaaaacccaugaa

SEQ ID NO: 656490 - RNA, 64 nt, hsa
uauauaauaaugaaaugacuaaguuaugugaggaaaaaaacagaagacauugcuaaaagaguua

SEQ ID NO: 656491 - RNA, 64 nt, hsa
auugaagauaaagcaaaaguaaaaaaaaaaaaaaaaaaaacaaggggaaaggguugguuaggca

SEQ ID NO: 656492 - RNA, 64 nt, hsa
cagcuugggcaacauggcaaagccccaucucuacaaaaaacacaaaaauuagcugggcauugug

SEQ ID NO: 656493 - RNA, 64 nt, hsa
ucuacuauuguaagaguucuucuguuugugaagaaaaaaacaaguuaaaaacugaauguacuga

SEQ ID NO: 656494 - RNA, 64 nt, hsa
ggauguucuugaacauuucagaaggagugguagaaaaaaacacacauucagccaaccacuuaua

SEQ ID NO: 656495 - RNA, 64 nt, hsa
acagagcgagacucugucucaaaaaaacaaaacaaaaaaacaccaaaaaaacccccaaaccuga

SEQ ID NO: 656496 - RNA, 64 nt, hsa
uccagccugggugacagagcgagacucugucucaaaaaaacaaaacaaaaaaacaccaaaaaaa

SEQ ID NO: 656497 - RNA, 64 nt, hsa
uuuaauugaauugaaaauaucccuuaggaaaaaaaaaaaacacacaaaaaaccacaagagcccc

SEQ ID NO: 656498 - RNA, 64 nt, hsa
aguuuaaaaaagaaaauauguaauauaauguaaaaaaaaacaaaaaaaagcuuuuaugauggau

SEQ ID NO: 656499 - RNA, 64 nt, hsa
auucaaacgcaacucaaaucugugcuggacuuuaaaaaaacaauucaggaccaaauuuuuucuc

SEQ ID NO: 656500 - RNA, 64 nt, hsa
uuuuuauauuuaaauguagacuuuugacacuuuuaaaaaacaaaaaaagacaagagagaugaaa

SEQ ID NO: 656501 - RNA, 64 nt, hsa
agaguuuuuacagcucaucauucaaauaacgcacaaaaaacaaaagccgcuaugaccggcguug

SEQ ID NO: 656502 - RNA, 64 nt, hsa
aaauuagccacguaacaagagucuauuugccuugaaaaaacaauuauccuugaacuuccuccag

SEQ ID NO: 656503 - RNA, 64 nt, hsa
acaaauggaauccugugcugaacccgaaucuuccaaaaaacagccuacaaucugugaccaccac

SEQ ID NO: 656504 - RNA, 64 nt, hsa
uugcucuuguccugagaaauaacagugcuguuuuaaaaaacauuugaaauaaauaccgcacaca

SEQ ID NO: 656505 - RNA, 64 nt, hsa
agauuauuaaaccuuuguucugggauuuacuguuaaaaaacaaacaaaaaacaacaaaaaagcg

SEQ ID NO: 656506 - RNA, 64 nt, hsa
ccuuuguucugggauuuacuguuaaaaaacaaacaaaaaacaacaaaaaagcggugacaggaaa

SEQ ID NO: 656507 - RNA, 64 nt, hsa
aauugucuugguuucuugauucauuuauuugagaaaaaaacaauacaaagaaaugcauucauau

SEQ ID NO: 656508 - RNA, 64 nt, hsa
accaucugcaaccauaugcuauuaauaaaauggaaaaaaacaaaauggucauuuugcauauacu

SEQ ID NO: 656509 - RNA, 64 nt, hsa
ugugcuaaggguuuauuuuauguaaaaaaaaaaaaaaaaacaaaaaaaaacccugagaccauga

SEQ ID NO: 656510 - RNA, 64 nt, hsa
uccagccuggacaacaagagcgaaauucugucuaaaaaaacaaaagucccaauuaagaaccucc

SEQ ID NO: 656511 - RNA, 64 nt, hsa
aacaaaaaacaaacaacaaaaaaaaaauuaaaaaaaaaaacagaaauagagcucuaaguuaugu

SEQ ID NO: 656512 - RNA, 64 nt, hsa
ccaaagaaguccugcuauguuaaaaacaaacaacaaaaaacaaacaacaaaaaaaaaauuaaaa

SEQ ID NO: 656513 - RNA, 64 nt, hsa
acaaaaaacaaccuuagcauuaagaaauaaaaacaaaaaacaagaagcaaguuguacugcuaga

SEQ ID NO: 656514 - RNA, 64 nt, hsa
gaagccuuaauacucuguaaacaaacaaacaaacaaaaaacaaccuuagcauuaagaaauaaaa

SEQ ID NO: 656515 - RNA, 64 nt, hsa
cugaauuguuuuaauaucuuuacucaaaaaaacaaaaaaacaaaaacccauggaagcaacaaaa

SEQ ID NO: 656516 - RNA, 64 nt, hsa
uuuggcaucugaauuguuuuaauaucuuuacucaaaaaaacaaaaaaacaaaaacccauggaag

SEQ ID NO: 656517 - RNA, 64 nt, hsa
cugucccuuggaaccuuuguacgcuuugcucaaaaaaaaacaaaaaaaaaaaacaaaaaaaaaa

SEQ ID NO: 656518 - RNA, 64 nt, hsa
ccuuuguacgcuuugcucaaaaaaaaacaaaaaaaaaaaacaaaaaaaaaaaacaacgguggag

SEQ ID NO: 656519 - RNA, 64 nt, hsa
ugcucaaaaaaaaacaaaaaaaaaaaacaaaaaaaaaaaacaacgguggagccuucgcacucaa

SEQ ID NO: 656520 - RNA, 64 nt, hsa
cauuggugacagggucugacauggucagucuacuaaaaaacaaaaaaaaaaaacaaaaaaaaaa

SEQ ID NO: 656521 - RNA, 64 nt, hsa
gucugacauggucagucuacuaaaaaacaaaaaaaaaaaacaaaaaaaaaaaaacaaaagaaaa

SEQ ID NO: 656522 - RNA, 64 nt, hsa
gucuacuaaaaaacaaaaaaaaaaaacaaaaaaaaaaaaacaaaagaaaaaaauaaaaauacgg

SEQ ID NO: 656523 - RNA, 64 nt, hsa
ccaggauuaaguugucaucauucugggaagaaaaaaaaaacauuaaugaagaggccaauaauau

SEQ ID NO: 656524 - RNA, 64 nt, hsa
auagcaugacuguuuuuugaauagguuggaauugaaaaaacaauuaucaaacguuaagaacaaa

SEQ ID NO: 656525 - RNA, 64 nt, hsa
uacaacaaagcaccuuuaaaaaaaauacauuuuaaaaaaacauuccaagccaauuggaagacau

SEQ ID NO: 656526 - RNA, 64 nt, hsa
uccagccugggcgacagagcaggacucucucucaaaaaaacacaaaaaaacaaaaacaaaaaac

SEQ ID NO: 656527 - RNA, 64 nt, hsa
gcgacagagcaggacucucucucaaaaaaacacaaaaaaacaaaaacaaaaaaccauacacaca

SEQ ID NO: 656528 - RNA, 64 nt, hsa
agaguuauccacuguauuuauaaggaagagucggaaaaaacaaugaccuuaguuuuuuuuaagc

SEQ ID NO: 656529 - RNA, 64 nt, hsa
auuuuauuucagauaaaagucaggaguuacugcuaaaaaacagacauguaggagacauucaaca

SEQ ID NO: 656530 - RNA, 64 nt, hsa
cagacuuugugaaugguucagauauuuuuucauuaaaaaacaagguauggcagauggacuuuuc

SEQ ID NO: 656531 - RNA, 64 nt, hsa
guauauucuaaauaaagucaucuaacuauuaaaaaaaaaacacccuuccuaacccuucuuuucu

SEQ ID NO: 656532 - RNA, 64 nt, hsa
uagaaauuaaaaacaaaacaaaaaaaaaaacaaaaaaaaacaaaaguaaauuaaaaacaaaacc

SEQ ID NO: 656533 - RNA, 64 nt, hsa
accagaaaaauagaaauuaaaaacaaaacaaaaaaaaaaacaaaaaaaaacaaaaguaaauuaa

SEQ ID NO: 656534 - RNA, 64 nt, hsa
gugauuuguuaaaaaaaaacaaaaaaaaaaaaaaaaaaaacaagaugacgacgacaaccacaaa

SEQ ID NO: 656535 - RNA, 64 nt, hsa
ugcagaaaaacaagaccagaugugauuuguuaaaaaaaaacaaaaaaaaaaaaaaaaaaaacaa

SEQ ID NO: 656536 - RNA, 64 nt, hsa
acccccccaaaaaauaaaaaaaccacaaaaaacaaaaaaacaaaacuaaggcacuucacuuaga

SEQ ID NO: 656537 - RNA, 64 nt, hsa
cuccucccacccccccaaaaaauaaaaaaaccacaaaaaacaaaaaaacaaaacuaaggcacuu

SEQ ID NO: 656538 - RNA, 64 nt, hsa
ugagauuucuaagcuugcagguuacaaaaaacaaaaaaaacagagaagcugccugcguaaaaag

SEQ ID NO: 656539 - RNA, 64 nt, hsa
agcacaaccugagauuucuaagcuugcagguuacaaaaaacaaaaaaaacagagaagcugccug

SEQ ID NO: 656540 - RNA, 64 nt, hsa
uucagagcauuuuuaccucucucuuaaauguuauaaaaaacaauuguauuuuuaagaauguuua

SEQ ID NO: 656541 - RNA, 64 nt, hsa
aucaaguucauuugcagaaacaaauaacugaaauaaaaaacauguuaauccuuguaucauacuu

SEQ ID NO: 656542 - RNA, 64 nt, hsa
augcauugcuuaaugguuucucauuauguuuaucaaaaaacaacuguagcuguuauuuucagua

SEQ ID NO: 656543 - RNA, 64 nt, hsa
auggcugccaaaaccauuaaguggaaagcugauuaaaaaacaaaaauuucuaauggauuuauca

SEQ ID NO: 656544 - RNA, 64 nt, hsa
gcuuaucaacuccccuccaaacaaacaauuaaaaaaaaaacauacagacacucaaauuccacaa

SEQ ID NO: 656545 - RNA, 64 nt, hsa
aaaaauuaggaaaucaaaagaaaagcauacauauaaaaaacaguuuuuucuaagcauuucucau

SEQ ID NO: 656546 - RNA, 64 nt, hsa
gggcgacaaaucaagaccccgucuccaaaaaaaaaaaaaacaaaacuugauugggauccaaaau

SEQ ID NO: 656547 - RNA, 64 nt, hsa
augcucuguaugucacuacauaugaaaaaacaucaaaaaacaauuagcauuggacaucuuaaua

SEQ ID NO: 656548 - RNA, 64 nt, hsa
ucagugcuaaaugcucuguaugucacuacauaugaaaaaacaucaaaaaacaauuagcauugga

SEQ ID NO: 656549 - RNA, 64 nt, hsa
ccaucagugauuggggaaucaaacauuuugguuuaaaaaacaugauuauuuaaaacuggaaacu

SEQ ID NO: 656550 - RNA, 64 nt, hsa
cuuguaauggcaccucaaauuuuauacucuuaaaaaaaaacaauaauuugugaauuaccaccaa

SEQ ID NO: 656551 - RNA, 64 nt, hsa
gccugaguagcauagcaagacccugucucuacaaaaaaaacaaaaauuagcugggcaugguggc

SEQ ID NO: 656552 - RNA, 64 nt, hsa
caccugcacuuagaggaaauuugaacaaguuggaaaaaaacaauuuuuguuucaauucuaagaa

SEQ ID NO: 656553 - RNA, 64 nt, hsa
caugguaauuuuugguuguuuugguuguuuucuuaaaaaacaaguuaaaaccugacgauuucug

SEQ ID NO: 656554 - RNA, 64 nt, hsa
guaaccacugucuugauggcaaaauaauuaugguaaaaaacaagucucguguuuauuauuccuu

SEQ ID NO: 656555 - RNA, 64 nt, hsa
cuauguguaaauguagaacccuaauuuuucuauaaaaaaacaaacuaacuaacuaacuguguaa

SEQ ID NO: 656556 - RNA, 64 nt, hsa
guguaugaagcauucguccagcagcaccaggcugaaaaaacagaacgagagaaucggcuuaaag

SEQ ID NO: 656557 - RNA, 64 nt, hsa
cuaccaacaauaagcuagaaaagacaaaaaaaacaaaaaacaaaaaaacguguaauaaaguuag

SEQ ID NO: 656558 - RNA, 64 nt, hsa
uguuuuucuaccaacaauaagcuagaaaagacaaaaaaaacaaaaaacaaaaaaacguguaaua

SEQ ID NO: 656559 - RNA, 64 nt, hsa
auaguuaucccccccuuuuuuuuuuuuuuuaacaaaaaaacacuuuucuaaggacugaagauug

SEQ ID NO: 656560 - RNA, 64 nt, hsa
ugcuaguccuagauuacuuauugauuuaaaaacaaaaaaacacaaaaaaauaguaaaauauaaa

SEQ ID NO: 656561 - RNA, 64 nt, hsa
uaucuaaacaucgaaaaacuuaaauauuauggaaaaaaaacauugcaaaauauaaaauaaauaa

SEQ ID NO: 656562 - RNA, 64 nt, hsa
caaagcuaggccugauuagaguagagugacuauuaaaaaacauaacuuucuaggagcuauaaau

SEQ ID NO: 656563 - RNA, 64 nt, hsa
auuuaaaacuaugguguaagucuuugacaagaaaaaaaaacaaacaaacacuucuuuccaucag

SEQ ID NO: 656564 - RNA, 64 nt, hsa
uuuuuucaaaaaaaaaaaaaaaacaaaaacaaaaaaaaaacacaaaagcugcaugucuaaaauu

SEQ ID NO: 656565 - RNA, 64 nt, hsa
ucucaaaauaaacugguuuuuuucaaaaaaaaaaaaaaaacaaaaacaaaaaaaaaacacaaaa

SEQ ID NO: 656566 - RNA, 64 nt, hsa
gaaaugauuucaaguacccuguauucuggaugcuaaaaaacaaaaacaaacaaaaaaacaaaaa

SEQ ID NO: 656567 - RNA, 64 nt, hsa
cuguauucuggaugcuaaaaaacaaaaacaaacaaaaaaacaaaaacaaaaaaacaaaaccaga

SEQ ID NO: 656568 - RNA, 64 nt, hsa
cuaaaaaacaaaaacaaacaaaaaaacaaaaacaaaaaaacaaaaccagaaucagguaaaacag

SEQ ID NO: 656569 - RNA, 64 nt, hsa
uuuuucaagaccuaacugcagccgcuuugggaaaaaaaaacaaaaaacaaaaaacagaaaacaa

SEQ ID NO: 656570 - RNA, 64 nt, hsa
agaccuaacugcagccgcuuugggaaaaaaaaacaaaaaacaaaaaacagaaaacaaaaaaaaa

SEQ ID NO: 656571 - RNA, 63 nt, hsa
acugcagccgcuuugggaaaaaaaaacaaaaaacaaaaaacagaaaacaaaaaaaaaaaaacu

SEQ ID NO: 656572 - RNA, 64 nt, hsa
uuucucuguauauuuaugaccagagcaaaaauguaaaaaacaaaaaaaacaacaaaaaaaguuu

SEQ ID NO: 656573 - RNA, 64 nt, hsa
auauuuaugaccagagcaaaaauguaaaaaacaaaaaaaacaacaaaaaaaguuuguuacuuug

SEQ ID NO: 656574 - RNA, 64 nt, hsa
aaagggaccacauuuuucaaguauuucuaaguauaaaaaacaaaacaaaaaucucuuaggaaau

SEQ ID NO: 656575 - RNA, 64 nt, hsa
uuuccuugacaaaauuuaagcugagcuuaaaagcaaaaaacaaaaaguacacagaaauauuuau

SEQ ID NO: 656576 - RNA, 64 nt, hsa
gccaauuuguuggccaccagaaaaccgcuuuuuaaaaaaacacuuggugauucuuucaagugcc

SEQ ID NO: 656577 - RNA, 64 nt, hsa
uauguuagcauuaaugcacauuuuuaaaaaaagaaaaaaacauggucuuguuuuuacuaccugu

SEQ ID NO: 656578 - RNA, 64 nt, hsa
uauugcaaucgaaaugaaagaagaguugauguuaaaaaaacaaaagucaagugauuuauuauau

SEQ ID NO: 656579 - RNA, 64 nt, hsa
caugccaacacuucuguaauugaucauuauaaagaaaaaacaagguaacagucauaguucaccu

SEQ ID NO: 656580 - RNA, 64 nt, hsa
ggacagagcaagacucuugucucaaaaaaaacaaaaaaaacauauauacugcuguaucaugcca

SEQ ID NO: 656581 - RNA, 64 nt, hsa
ccagccuggggacagagcaagacucuugucucaaaaaaaacaaaaaaaacauauauacugcugu

SEQ ID NO: 656582 - RNA, 64 nt, hsa
ugggauuggaagaaacacguggucaugaauagaaaaaaaacaaacccaaagguaggaaggucaa

SEQ ID NO: 656583 - RNA, 64 nt, hsa
gaauuggaaaggaaaagaggcccaagugcaaaagaaaaaacauuuuagaaacggacagcuuaua

SEQ ID NO: 656584 - RNA, 64 nt, hsa
uauguguuuuguauaaaucccuaauauuuaaaaaaaaaaacaaaacaaaaaaagguuacaaagu

SEQ ID NO: 656585 - RNA, 64 nt, hsa
ccugggauggaaaggacuagccucuacugaugcaaaaaaacaaaaagcaacacaaacguuuccu

SEQ ID NO: 656586 - RNA, 64 nt, hsa
aguucucacaguauagaagagaacuuaaagagggaaaaaacaauaugaagauagggaaugcagg

SEQ ID NO: 656587 - RNA, 64 nt, hsa
acugcacuccagccugagugacagagagagauucaaaaaacaaaaaaaaagcaaaaauauacuu

SEQ ID NO: 656588 - RNA, 64 nt, hsa
gaggccaguacaaccuugauaacaaaaccuaaaaaaaaaacaacaaaaaaacccauaaagcuau

SEQ ID NO: 656589 - RNA, 64 nt, hsa
ucucauagauuuagaugcaaaauccuaaaauugaaaaaaacaucuagccauauccauaaacuau

SEQ ID NO: 656590 - RNA, 64 nt, hsa
uauuugaacuagcuucuugucuuaggccugaaccaaaaaacaacaaacaaacaaaaaacaagaa

SEQ ID NO: 656591 - RNA, 64 nt, hsa
gucuuaggccugaaccaaaaaacaacaaacaaacaaaaaacaagaaugaaaaacagaaauaaaa

SEQ ID NO: 656592 - RNA, 64 nt, hsa
cuguuuccucuuagcuuucuagacuucuuaacagaaaaaacaguuuggguucaauagcauuuua

SEQ ID NO: 656593 - RNA, 64 nt, hsa
cuucuauuauuuguuuugguuagaaagugaauuuaaaaaacaaaccaaacucuaaacuuucuca

SEQ ID NO: 656594 - RNA, 64 nt, hsa
gauggaacuucaggucuuaagugcaaaucaaagcaaaaaacaaacaaaacuuacauggaaaaac

SEQ ID NO: 656595 - RNA, 64 nt, hsa
accuacaaagaguuaaaacaaacagacaaacaaaaaaaaacacuacuauuuuaaauaguggaac

SEQ ID NO: 656596 - RNA, 64 nt, hsa
ccagcaguggccugaagaggaagagaaaaaaaacaaaaaacagaaaccaaucgguaaucugauc

SEQ ID NO: 656597 - RNA, 62 nt, hsa
caucuccagcaguggccugaagaggaagagaaaaaaaacaaaaaacagaaaccaaucgguaa

SEQ ID NO: 656598 - RNA, 64 nt, hsa
uucuucaggggaagacuguggucaaguuaaaaaaaaaaaacaauauuaaacaacaugaaacugc

SEQ ID NO: 656599 - RNA, 64 nt, hsa
acaacucauucuucagugccucaugacugaaaacaaaaaacaaaaaaacgaaagcaucuucaca

SEQ ID NO: 656600 - RNA, 64 nt, hsa
gggugcuuauucuuuaacaaagagaaucuaaaaaaaaaaacaaaaaacuguugucuaauauauc

SEQ ID NO: 656601 - RNA, 64 nt, hsa
gcuucaggaauacugcucguuauaaacacuacuaaaaaaacaguuuauauuuuauauacacaua

SEQ ID NO: 656602 - RNA, 64 nt, hsa
agaggcccccaucagggaccagacuguuccaaaaaaaaaacaaaaaacaaaaacaaacaaaaaa

SEQ ID NO: 656603 - RNA, 64 nt, hsa
cccaucagggaccagacuguuccaaaaaaaaaacaaaaaacaaaaacaaacaaaaaaacacuua

SEQ ID NO: 656604 - RNA, 64 nt, hsa
guuccaaaaaaaaaacaaaaaacaaaaacaaacaaaaaaacacuuaaaagcccaaggaguaagc

SEQ ID NO: 656605 - RNA, 64 nt, hsa
cauauuagugacuugaaucuucauaaguuaaaguaaaaaacagcaaaaaaccuagaucuuuguc

SEQ ID NO: 656606 - RNA, 64 nt, hsa
aggcuaaaaccacaaaguggcucaggcuuuaaaaaaaaaacacuguggauaaugacaaaaagca

SEQ ID NO: 656607 - RNA, 64 nt, hsa
cucuaugguaaagauauuauucaccauguaaaacaaaaaacaauauuuauuguauuuuaguaua

SEQ ID NO: 656608 - RNA, 64 nt, hsa
uugauaauaaacuguccucuuucagaaaacagaaaaaaaacacacacacacacaacaaaaauuu

SEQ ID NO: 656609 - RNA, 64 nt, hsa
gcuaaaucuacuguuucaaaaaagugucuuuacaaaaaaacaaaaaagaaaagaaauuuauuua

SEQ ID NO: 656610 - RNA, 64 nt, hsa
aagagacucaaaucuaaaacauuuacagaguuacaaaaaacaaacaaucaaaaaaaaagacagu

SEQ ID NO: 656611 - RNA, 64 nt, hsa
aaauauuuuuuggaagagcugcuaauuuuauuuuaaaaaacaaaguugugaaaacaugccuccu

SEQ ID NO: 656612 - RNA, 64 nt, hsa
gcaccuuugcaugaugaugacucuugaacagagcaaaaaacaaggaggauuaugugugacuggg

SEQ ID NO: 656613 - RNA, 64 nt, hsa
aucaggaggcaucuggaaagggggggaaaaaagcaaaaaacaaaauuaaaaaaaauugauuucc

SEQ ID NO: 656614 - RNA, 64 nt, hsa
ucccaaguaaaaauuucuucugggcugaguagauaaaaaacaucaucgcucccaaaggaaagag

SEQ ID NO: 656615 - RNA, 64 nt, hsa
ugcaguucauccgcacuguaaauacauguauuuaaaaaaacaaucccaaguaaaaauuucuucu

SEQ ID NO: 656616 - RNA, 64 nt, hsa
agcuaaauuuuucaguuccaugugccucccaaauaaaaaacagaaaauaaguaguuuuugugaa

SEQ ID NO: 656617 - RNA, 64 nt, hsa
aauaaaaauggaaaaaaugaucauggcuuuaaaaaaaaaacaaaaacacacacacaugaacuca

SEQ ID NO: 656618 - RNA, 64 nt, hsa
gccuggguggcaaagugagacucuggcucaaaaaaaaaaacaaaaaacaaaaccaucugcccuc

SEQ ID NO: 656619 - RNA, 64 nt, hsa
uggcaaagugagacucuggcucaaaaaaaaaaacaaaaaacaaaaccaucugcccuccuccccu

SEQ ID NO: 656620 - RNA, 64 nt, hsa
ucgaauccagagagcaguguggaaaaaaaaaaacaaaaaacaacugaccaguuguugauaacca

SEQ ID NO: 656621 - RNA, 64 nt, hsa
acuagguucgaauccagagagcaguguggaaaaaaaaaaacaaaaaacaacugaccaguuguug

SEQ ID NO: 656622 - RNA, 64 nt, hsa
ugaacuucaaaacaaaacaaaaaacaacaacaacaaaaaacaaguccaaacugauauauccuau

SEQ ID NO: 656623 - RNA, 64 nt, hsa
guaaaaaaaagugcacugaacuucaaaacaaaacaaaaaacaacaacaacaaaaaacaagucca

SEQ ID NO: 656624 - RNA, 64 nt, hsa
cuggccauguuauaaauauuguuauuuaaaaaacaaaaaacaaaacacacguacauuagguccu

SEQ ID NO: 656625 - RNA, 64 nt, hsa
agagucacuggccauguuauaaauauuguuauuuaaaaaacaaaaaacaaaacacacguacauu

SEQ ID NO: 656626 - RNA, 64 nt, hsa
ccuucuuaaaaucaaaaacaaaacaaaaaaacacaaaaaacacauucuaaauacuagagauaac

SEQ ID NO: 656627 - RNA, 64 nt, hsa
aaaagaauuccuucuuaaaaucaaaaacaaaacaaaaaaacacaaaaaacacauucuaaauacu

SEQ ID NO: 656628 - RNA, 64 nt, hsa
uaaaacagacuccuuuaaaaaaacaaacaaacaaaaaaaacauagacuucuuuauaucuuuuga

SEQ ID NO: 656629 - RNA, 64 nt, hsa
aggauaauaggcaauuuuaaaacagacuccuuuaaaaaaacaaacaaacaaaaaaaacauagac

SEQ ID NO: 656630 - RNA, 64 nt, hsa
ucucaaaaaaaaaaaaacaaaaacaaacaaacaaaaaaaacaccucaccaugagugcuacaugu

SEQ ID NO: 656631 - RNA, 64 nt, hsa
uugggcaacagaguaagacucugucucaaaaaaaaaaaaacaaaaacaaacaaacaaaaaaaac

SEQ ID NO: 656632 - RNA, 64 nt, hsa
uugaauuuaguuugucuaaaauagucucacagguaaaaaacauaacaacaaugaccaccauugu

SEQ ID NO: 656633 - RNA, 64 nt, hsa
uuguuuaaaaaaacgaaaaaaacaaaacaaaacaaaaaaacaugagcagugguguucuaaugaa

SEQ ID NO: 656634 - RNA, 64 nt, hsa
auagauaacacuaaugcuuuguuuaaaaaaacgaaaaaaacaaaacaaaacaaaaaaacaugag

SEQ ID NO: 656635 - RNA, 64 nt, hsa
aaauauucuuccugauuaaaaaaauuuuuuuugaaaaaaacaaggccagccccaaccuuccaaa

SEQ ID NO: 656636 - RNA, 64 nt, hsa
aaaaugugacuuucuuguuuugucucaaaacuuaaaaaaacaaacacaaaaagaugagucccac

SEQ ID NO: 656637 - RNA, 64 nt, hsa
aguagcugugguggauauuauuauuugaagaaagaaaaaacagauuuuaggguggaaaaaacag

SEQ ID NO: 656638 - RNA, 64 nt, hsa
uauuugaagaaagaaaaaacagauuuuaggguggaaaaaacagucaacucacacaaagaaugga

SEQ ID NO: 656639 - RNA, 64 nt, hsa
auacaguaccuacauaguuuuuaaauuauuguuuaaaaaacaaaacagcuguuauaaaugaaua

SEQ ID NO: 656640 - RNA, 64 nt, hsa
uaugaugaauaaaucuuaaaugcuuuguuuaauuaaaaaacaaaaaucaccaauauccaagaca

SEQ ID NO: 656641 - RNA, 64 nt, hsa
guucaccaucaauuuaaaaguaaaaaaaacaaaaaaaaaacaaaaaauuuaaaaaaaagguuug

SEQ ID NO: 656642 - RNA, 64 nt, hsa
uuaaugccacgguucaccaucaauuuaaaaguaaaaaaaacaaaaaaaaaacaaaaaauuuaaa

SEQ ID NO: 656643 - RNA, 64 nt, hsa
aaaaagguguagacaauggugguuaaaaaaaaaaaaaaaacagguaccagguucuguguguuug

SEQ ID NO: 656644 - RNA, 64 nt, hsa
gugaagaaaauucauuuuacauuggguagacaguaaaaaacaaguaaaauaacuugacaugagc

SEQ ID NO: 656645 - RNA, 64 nt, hsa
agucaucagagauacuuuccuaaaaaggaaaaauaaaaaacaaaauggugccacuuuggguuga

SEQ ID NO: 656646 - RNA, 64 nt, hsa
ggcuugaauucauuuauaugucuuuugauucuuaaaaaaacaaaaaacauuccauuagaagcac

SEQ ID NO: 656647 - RNA, 64 nt, hsa
auucauuuauaugucuuuugauucuuaaaaaaacaaaaaacauuccauuagaagcaccaguuuu

SEQ ID NO: 656648 - RNA, 64 nt, hsa
ugacuguaaccauguuuuuucuguuuaauuauguaaaaaacaaaacuacaacaacaaaaaaaga

SEQ ID NO: 656649 - RNA, 64 nt, hsa
uacaacaacaaaaaaagaaaaaaguuaaaaaagaaaaaaacaccaaaaaacaaaaacaaacaaa

SEQ ID NO: 656650 - RNA, 64 nt, hsa
aaaaaagaaaaaaguuaaaaaagaaaaaaacaccaaaaaacaaaaacaaacaaaaaaaaaaacc

SEQ ID NO: 656651 - RNA, 64 nt, hsa
uugcauuaacuauuucaaaaauuacugccuuuaaaaaaaacaaccucaagcuauauuuguauuc

SEQ ID NO: 656652 - RNA, 64 nt, hsa
gaugauguauuucuccauugaaaacacaauaaaaaaaaaacagcacaaucucacaguugccuga

SEQ ID NO: 656653 - RNA, 64 nt, hsa
gaaaaaacaaaacaaaaaaaaaaaaaaaagaaaaaaaaaacaugcaccuguuucacugugaaua

SEQ ID NO: 656654 - RNA, 64 nt, hsa
gugcuguggcucagucagcaaccucagaacucugaaaaaacaaaacaaaaaaaaaaaaaaaaga

SEQ ID NO: 656655 - RNA, 64 nt, hsa
caucgugaccaaauuguuuaagaaaaaaaaacaaaaaaaacaaaaucuagggcuguauuuuaua

SEQ ID NO: 656656 - RNA, 64 nt, hsa
ucaaaggugcaucgugaccaaauuguuuaagaaaaaaaaacaaaaaaaacaaaaucuagggcug

SEQ ID NO: 656657 - RNA, 64 nt, hsa
aaguauuccagcaaaagaggauguagccucugggaaaaaacaaacauguuacaguguuuuuugu

SEQ ID NO: 656658 - RNA, 64 nt, hsa
agcagcacuguauauaccugucucuaaguaaaggaaaaaacaaaauaaggacuucaauccaaag

SEQ ID NO: 656659 - RNA, 64 nt, hsa
aauugaaguucagagucacccguggcuccuaaggaaaaaacagcaucaugaaaggcaaaaagua

SEQ ID NO: 656660 - RNA, 64 nt, hsa
cuugcugccuuuaauugucuugcucucuaugggaaaaaaacaaaagggcuucagucucauggau

SEQ ID NO: 656661 - RNA, 64 nt, hsa
uauuuuuuuaauuuggcaggauaaaauauugcaaaaaaaacacauuuguauguuaaguccuauu

SEQ ID NO: 656662 - RNA, 64 nt, hsa
cuuuuuguuagugaauuuggaaauaaaaagaaaaaaaaaacaaaaacaaacaggcugccauaau

SEQ ID NO: 656663 - RNA, 64 nt, hsa
gaaagaagagagagaacuugaugcaaaguccacgaaaaaacaauuuuuuucaccucagguguca

SEQ ID NO: 656664 - RNA, 64 nt, hsa
uuuuuucaccucaggugucaaaguaaauuuguuaaaaaaacaaaaaaaacacaaaaauuucaaa

SEQ ID NO: 656665 - RNA, 64 nt, hsa
cucaggugucaaaguaaauuuguuaaaaaaacaaaaaaaacacaaaaauuucaaaaaacaccac

SEQ ID NO: 656666 - RNA, 64 nt, hsa
uuuguuaaaaaaacaaaaaaaacacaaaaauuucaaaaaacaccacccaccaaauugcacaaua

SEQ ID NO: 656667 - RNA, 64 nt, hsa
uaucugaagacacaaaccugacaggagggagaagaaaaaacaaaacacuugaaccaagaaacuc

SEQ ID NO: 656668 - RNA, 64 nt, hsa
augcccagaagcuuuccuucauaaaauagaaagaaaaaaacauuuggcuuauuuuucacuguag

SEQ ID NO: 656669 - RNA, 64 nt, hsa
gugaagcauuuuauuaaaagaauaauuauaauuaaaaaaacacgauacagaucagugcauauag

SEQ ID NO: 656670 - RNA, 64 nt, hsa
accuaaaacuguucuaaaauagaaagucugugaaaaaaaacaaaaguaaaguuauaaaaggaaa

SEQ ID NO: 656671 - RNA, 64 nt, hsa
ucaaucccugaccauguaaggcuuuuuuauuuuaaaaaaacagaguuaucccaauacauuaucc

SEQ ID NO: 656672 - RNA, 64 nt, hsa
ugaagugaauuugaauaucaucagaaugugucugaaaaaacauuguccucaaauaauguucuuu

SEQ ID NO: 656673 - RNA, 64 nt, hsa
guauagauaugaucagacaaaaugcagaaggaaaaaaaaacauauugaaugaagcacuuggaaa

SEQ ID NO: 656674 - RNA, 64 nt, hsa
ucuuccugcuaaaaagacaaaaaacaaaaaacaaaaaaaacaaaaaaaaccucaugagugcaug

SEQ ID NO: 656675 - RNA, 64 nt, hsa
uucucccccucuuccugcuaaaaagacaaaaaacaaaaaacaaaaaaaacaaaaaaaaccucau

SEQ ID NO: 656676 - RNA, 64 nt, hsa
cauuauauucucccccucuuccugcuaaaaagacaaaaaacaaaaaacaaaaaaaacaaaaaaa

SEQ ID NO: 656677 - RNA, 64 nt, hsa
guaccacucuauucacugguacaguccagccaguaaaaaacacuuccaaaaagauacacagaag

SEQ ID NO: 656678 - RNA, 64 nt, hsa
aucuauauagucuaaugcugacaacuucuauuuuaaaaaacaagacuuuacuuucuucugcccc

SEQ ID NO: 656679 - RNA, 64 nt, hsa
cagauuuaauuugcuaaauagacuaacaggaggaaaaaaacaaacagccuagcuuuaaaaaaca

SEQ ID NO: 656680 - RNA, 64 nt, hsa
cuaacaggaggaaaaaaacaaacagccuagcuuuaaaaaacagugaaauagcagugauuucaug

SEQ ID NO: 656681 - RNA, 64 nt, hsa
ucagagguaccuggcaccuuacucaagcaaaaacaaaaaacagcuuuacuucaaaagcaugugc

SEQ ID NO: 656682 - RNA, 64 nt, hsa
ccauuccaccugacccuguguguacaauccaggaaaaaaacaaaccccacucagaaacagagaa

SEQ ID NO: 656683 - RNA, 64 nt, hsa
gcucucuccucauccuaguucuuuaaaaaaaacaaaaaaacaaaaaaaacuuuuuuuaaucguu

SEQ ID NO: 656684 - RNA, 58 nt, hsa; identical to SEQ ID NO: 422612

SEQ ID NO: 656685 - RNA, 64 nt, hsa
uucaugaugguaauaaacgagauguuugccaaauaaaaaacagaaaccgcaggaguuugcgaag

SEQ ID NO: 656686 - RNA, 64 nt, hsa
cgcagcuacuccccuuucuuccaaacuuuugcagaaaaaacaaaaaaacuacaaacaaaagcag

SEQ ID NO: 656687 - RNA, 64 nt, hsa
agccugggcgauagagcuagacucugucucaaaaaaaaaacaaaaaacaaguaacucuuuauuc

SEQ ID NO: 656688 - RNA, 64 nt, hsa
gcgauagagcuagacucugucucaaaaaaaaaacaaaaaacaaguaacucuuuauuccuugugu

SEQ ID NO: 656689 - RNA, 64 nt, hsa
ccuucccuucugugugaccgaccccuuggccaaaaaaaaacaaaaagcaaaaaacaaaaaccua

SEQ ID NO: 656690 - RNA, 64 nt, hsa
ugaccgaccccuuggccaaaaaaaaacaaaaagcaaaaaacaaaaaccuacccuguucugguuu

SEQ ID NO: 656691 - RNA, 64 nt, hsa
cugcagggcuuaauacauuagugguaacugguuuaaaaaacaaagacuguaagccugugugugc

SEQ ID NO: 656692 - RNA, 64 nt, hsa
aacauuuuugugcuauuguuuuaaaaaaauaauuaaaaaacaguuggcguuaauaaaaauguca

SEQ ID NO: 656693 - RNA, 64 nt, hsa
augaaucauuaucagcaugaugaaaggugugucuaaaaaacaauucagaauaccagcagcauug

SEQ ID NO: 656694 - RNA, 64 nt, hsa
auagucuugaauauuuuauuuuuuuaaugaaaagaaaaaacaagaaaguuauguuucauaauuu

SEQ ID NO: 656695 - RNA, 64 nt, hsa
uccagccuggucaacaagaguaaaacuucaucucaaaaaacaaaacaaaacaaaaacaacaaca

SEQ ID NO: 656696 - RNA, 64 nt, hsa
ucaaagucagacacacccaugguaaaaaaaaaaaaaaaaacaaucccaaggguacagaagagcu

SEQ ID NO: 656697 - RNA, 64 nt, hsa
guugaauugaguauauauuugaaaaggaaaaaacaaaaaacaaacccagaccccaccugaauug

SEQ ID NO: 656698 - RNA, 64 nt, hsa
uacagagguugaauugaguauauauuugaaaaggaaaaaacaaaaaacaaacccagaccccacc

SEQ ID NO: 656699 - RNA, 64 nt, hsa
gaauagggaaguaaaaaaacaaaacaaaaaacaaaaaaaacaaaaaaaaaacccuauuuaaaug

SEQ ID NO: 656700 - RNA, 64 nt, hsa
acucaaaucgaauagggaaguaaaaaaacaaaacaaaaaacaaaaaaaacaaaaaaaaaacccu

SEQ ID NO: 656701 - RNA, 64 nt, hsa
cugaaucaggaaacucaaaucgaauagggaaguaaaaaaacaaaacaaaaaacaaaaaaaacaa

SEQ ID NO: 656702 - RNA, 64 nt, hsa
ucccccaccccuuuuucuaaaaaacaaacaaaaaaaaaaacacacaaaacaaaaacagaacaaa

SEQ ID NO: 656703 - RNA, 64 nt, hsa
cugauuuuauuucuucucccccaccccuuuuucuaaaaaacaaacaaaaaaaaaaacacacaaa

SEQ ID NO: 656704 - RNA, 64 nt, hsa
gcgauuucagcugauagaaaaacaaaaaugaaaaaaaaaacacaaaaaacaaaaaacauggcac

SEQ ID NO: 656705 - RNA, 64 nt, hsa
gcugauagaaaaacaaaaaugaaaaaaaaaacacaaaaaacaaaaaacauggcacguugcuagu

SEQ ID NO: 656706 - RNA, 64 nt, hsa
gaaaaacaaaaaugaaaaaaaaaacacaaaaaacaaaaaacauggcacguugcuaguuuacagg

SEQ ID NO: 656707 - RNA, 64 nt, hsa
uauuuuuuuaugaaaaaaaaaacacuucucagugaaaaaacaagauuacaagggggaauaauau

SEQ ID NO: 656708 - RNA, 64 nt, hsa
uaaaauuaucauuugaaauauuuuuuuaugaaaaaaaaaacacuucucagugaaaaaacaagau

SEQ ID NO: 656709 - RNA, 64 nt, hsa
ugcaaaucaaguggacaagaaaaaauaacaaaacaaaaaacaagaaaaaaaaaacacaaaaccc

SEQ ID NO: 656710 - RNA, 64 nt, hsa
acaagaaaaaauaacaaaacaaaaaacaagaaaaaaaaaacacaaaaccccguaaaaucacaaa

SEQ ID NO: 656711 - RNA, 64 nt, hsa
aggagauguggggacguguuaggagagaaaaaaaaaaaaacaaaaauauauaugggggaaauua

SEQ ID NO: 656712 - RNA, 64 nt, hsa
gggcugaaggaaacguucacauuuuagaguuuaaaaaaaacaccucgacauuuaaaaaaucaac

SEQ ID NO: 656713 - RNA, 64 nt, hsa
gggugacggugagacuuugucucaaaaaaaaaaaaaaaaacaauggaaggcagacagcaagucc

SEQ ID NO: 656714 - RNA, 64 nt, hsa
acaucacacaguguccuguagcuaagugucuaggaaaaaacaaaaacuccaaacccuucagugg

SEQ ID NO: 656715 - RNA, 64 nt, hsa
cuauaacuuuucagcuggugcuuuuacuuagggaaaaaaacaauuuguaaauacagaacauugu

SEQ ID NO: 656716 - RNA, 64 nt, hsa
auaaguuauggaagaaccgggacauuuuacagaaaaaaaacaaaaaacaacaaaaaauauacgu

SEQ ID NO: 656717 - RNA, 64 nt, hsa
auggaagaaccgggacauuuuacagaaaaaaaacaaaaaacaacaaaaaauauacgugggaaaa

SEQ ID NO: 656718 - RNA, 64 nt, hsa
auuuagcacugagaacuaguauuauaugguuuuuaaaaaacaauggugaaguacaugccacaua

SEQ ID NO: 656719 - RNA, 64 nt, hsa
uaucuuguaaaaugaaacucuauaaccaccauuaaaaaaacaacucauucccacauucuucagu

SEQ ID NO: 656720 - RNA, 64 nt, hsa
aggaacaaaaaagaaaaaaaucaaaaaagcgacaaaaaaacacaaacagaagaggaaaaaaaag

SEQ ID NO: 656721 - RNA, 64 nt, hsa
agaauuuuuacuggggauucuugaacuugaaaaaaaaaaacacaaaaaaagacaaaaaaaaaaa

SEQ ID NO: 656722 - RNA, 64 nt, hsa
uuugcccccuuuuucuuguuaaaaaacaaaaaacaaaaaacaaaaaaccacacacacauuuugu

SEQ ID NO: 656723 - RNA, 64 nt, hsa
ccuggcuuuugcccccuuuuucuuguuaaaaaacaaaaaacaaaaaacaaaaaaccacacacac

SEQ ID NO: 656724 - RNA, 64 nt, hsa
ccccauuccuggcuuuugcccccuuuuucuuguuaaaaaacaaaaaacaaaaaacaaaaaacca

SEQ ID NO: 656725 - RNA, 64 nt, hsa
cacagcuugaaagacaggagaauucauacuggagaaaaaacauacaaauguaagguuuguaaca

SEQ ID NO: 656726 - RNA, 64 nt, hsa
uacaaguguaaugaauguggcaagguuuuuaaucaaaaaacaacccuugcacgucaucauagaa

SEQ ID NO: 656727 - RNA, 64 nt, hsa
uuugugaugccuuaggacauguuugaacugcagcaaaaaacaaaaacaaaaaacagugcauuag

SEQ ID NO: 656728 - RNA, 64 nt, hsa
aggacauguuugaacugcagcaaaaaacaaaaacaaaaaacagugcauuagcaauuucauagca

SEQ ID NO: 656729 - RNA, 64 nt, hsa
acuaaaagagagagaggaagcgagagagagagagaaaaaacaaaaaacagaaaacacgaaugcc

SEQ ID NO: 656730 - RNA, 64 nt, hsa
gagagagaggaagcgagagagagagagaaaaaacaaaaaacagaaaacacgaaugccuuuucua

SEQ ID NO: 656731 - RNA, 64 nt, hsa
aacauagcgagaccucaucuccaaaaaagaaaacaaaaaacaaaaaaaggaaugauguucugua

SEQ ID NO: 656732 - RNA, 64 nt, hsa
uaugcacugauuuaaaacaaaccaaaaaaaaagaaaaaaacaaaaaaaaaaaucccuccuuucu

SEQ ID NO: 656733 - RNA, 64 nt, hsa
cuggcuggucugucuuuucuccauuuguuuaaaaaaaaaacaaaaacaaaaaacaacacuuugg

SEQ ID NO: 656734 - RNA, 64 nt, hsa
cuuuucuccauuuguuuaaaaaaaaaacaaaaacaaaaaacaacacuuugguguggugguaugg

SEQ ID NO: 656735 - RNA, 64 nt, hsa
gguacauuuuugcacugaaaucuaaagauguuuuaaaaaacacuuuucacaaaaauaguccuuu

SEQ ID NO: 656736 - RNA, 64 nt, hsa
ugcuguuaauagugugaaauugucauguuaaaaaaaaaaacaggaaccaaaugugaccuugugc

SEQ ID NO: 656737 - RNA, 64 nt, hsa
acuacagagaggacguuucccuguuuagggaaagaaaaaacaucuucagaucauagguccuaaa

SEQ ID NO: 656738 - RNA, 64 nt, hsa
aaggccagucugguuuaaguagucauuucugcugaaaaaacagaugauccugguggaagaaaag

SEQ ID NO: 656739 - RNA, 64 nt, hsa
aagcgcugagcaccagcagcagaaaacaacaacaaaaaaacaccucguuuuuaccuugucuucu

SEQ ID NO: 656740 - RNA, 64 nt, hsa
aucucagucuuuauuuguguaauucauuuugaggaaaaaacaacuccauguauuuauucaagug

SEQ ID NO: 656741 - RNA, 64 nt, hsa
auuauuucuuuuguuacaucuauuacaaguuuagaaaaaacaaagcaauugucaaaaaaaguua

SEQ ID NO: 656742 - RNA, 64 nt, hsa
aauuagaauuauuuuucucaaaaaacaaacaaacaaaaaacacaaaaaaaaccacucuucucca

SEQ ID NO: 656743 - RNA, 64 nt, hsa
uggaaaugaggcuucaauuagaauuauuuuucucaaaaaacaaacaaacaaaaaacacaaaaaa

SEQ ID NO: 656744 - RNA, 64 nt, hsa
ucuuaguagugcagaccuuuaccccuagucuaugaaaaaacaaaccaaaauaugcucuugcgcc

SEQ ID NO: 656745 - RNA, 64 nt, hsa
cauaaggggaauuuuuuuuaaaaaacaacaaaaaaaaaaacauacaaagauggguuucugaaua

SEQ ID NO: 656746 - RNA, 64 nt, hsa
uugaccaaaccaguucauaaggggaauuuuuuuuaaaaaacaacaaaaaaaaaaacauacaaag

SEQ ID NO: 656747 - RNA, 62 nt, hsa
auccuggggaggccaaauaagcccccacugcaaaaaaacaaaaaacagguuaagaaaauuac

SEQ ID NO: 656748 - RNA, 64 nt, hsa
ggggaggccaaauaagcccccacugcaaaaaaacaaaaaacagguuaagaaaauuacuugggug

SEQ ID NO: 656749 - RNA, 64 nt, hsa
aaggaaauguuaaaaaaaaaaaaacaaaaaaacaaaaaaacaacuguucuuugccuaauaaaga

SEQ ID NO: 656750 - RNA, 64 nt, hsa
cuuccuuaaaggaaauguuaaaaaaaaaaaaacaaaaaaacaaaaaaacaacuguucuuugccu

SEQ ID NO: 656751 - RNA, 64 nt, hsa
ugagccaccuuccuuaaaggaaauguuaaaaaaaaaaaaacaaaaaaacaaaaaaacaacuguu

SEQ ID NO: 656752 - RNA, 64 nt, hsa
ggggaggccaaauaagcccucacuccaaaaaaacaaaaaacaggguaagaaaauuacuugggug

SEQ ID NO: 656753 - RNA, 62 nt, hsa
guccuggggaggccaaauaagcccucacuccaaaaaaacaaaaaacaggguaagaaaauuac

SEQ ID NO: 656754 - RNA, 64 nt, hsa
aaaaacaaaaaaacacacacacacaaaaaaagagaaaaaacauaacaaguaaauuuuaaaaaaa

SEQ ID NO: 656755 - RNA, 64 nt, hsa
acaaaaaacaaaaaaaacaaaaaaacaaaaaacaaaaaaacacacacacacaaaaaaagagaaa

SEQ ID NO: 656756 - RNA, 64 nt, hsa
aagcaaaaacaaaaaacaaaaaaaacaaaaaaacaaaaaacaaaaaaacacacacacacaaaaa

SEQ ID NO: 656757 - RNA, 64 nt, hsa
cuuccaaaagcaaaaacaaaaaacaaaaaaaacaaaaaaacaaaaaacaaaaaaacacacacac

SEQ ID NO: 656758 - RNA, 64 nt, hsa
ugggagaccuuccaaaagcaaaaacaaaaaacaaaaaaaacaaaaaaacaaaaaacaaaaaaac

SEQ ID NO: 656759 - RNA, 64 nt, hsa
acccuccgcugggagaccuuccaaaagcaaaaacaaaaaacaaaaaaaacaaaaaaacaaaaaa

SEQ ID NO: 656760 - RNA, 64 nt, hsa
uagcuguuucacaaacaguuuuauuuaaaaaaacaaaaaacaaaaaaaaucaaaaaaucaaaaa

SEQ ID NO: 656761 - RNA, 64 nt, hsa
gauaaaauagcuguuucacaaacaguuuuauuuaaaaaaacaaaaaacaaaaaaaaucaaaaaa

SEQ ID NO: 656762 - RNA, 64 nt, hsa
caagaaaagaagaauaguuguuuaaauauuuuuuaaaaaacacuugaauaagaaucaguagggu

SEQ ID NO: 656763 - RNA, 64 nt, hsa
auccuggcuaacacggugaaaccccgucucuacuaaaaaacagaaaauuagccgggcguggugg

SEQ ID NO: 656764 - RNA, 64 nt, hsa
acuucaggagagcuacuuucuauccaaauaauuuaaaaaacacuuuucaccuacuccuuucaug

SEQ ID NO: 656765 - RNA, 64 nt, hsa
gacucuuucauacuacccuuuagucauaaggagaaaaaaacacucaaauaguagaagcagcaag

SEQ ID NO: 656766 - RNA, 64 nt, hsa
gauacuucucccugagguggggauaaaagaaaaaaaaaaacaacuucuuuuuuucuuccgcaua

SEQ ID NO: 656767 - RNA, 64 nt, hsa
cucuguuauugucggcaggcggugagggguagaaaaaaaacaaacaaacaaacagaaaaaaaaa

SEQ ID NO: 656768 - RNA, 64 nt, hsa
gggagcucaaagucacaagaagaaaaaugaaaggaaaaaacagcagcccuauucagaaauuggu

SEQ ID NO: 656769 - RNA, 64 nt, hsa
gaaaguuuaaagaaacuugaccaaaagacaguacaaaaaacacuggcacuugaauguugaaugu

SEQ ID NO: 656770 - RNA, 64 nt, hsa
cggauacucccauuaaugagaaauaacacuaggaagccacuauuacaggaagaaaagauuuggu

SEQ ID NO: 656771 - RNA, 64 nt, hsa
cauggcagucuguuuuuuuaaaaaaaaauuuuugagccacuaucuauuguugaauauuuuaaga

SEQ ID NO: 656772 - RNA, 64 nt, hsa
ugcacucgcucccucucuggcuaaggcaugcauuagccacuacacaagucauuagugaaagugg

SEQ ID NO: 656773 - RNA, 64 nt, hsa
guaaaaauaaacaguguucucuucucuaccccaaagccacuacugaccaaggucucuucagugc

SEQ ID NO: 656774 - RNA, 64 nt, hsa
uggagagauuauggagauaaucuccuugucuauuagccacuagcauggcuaauugaucauugau

SEQ ID NO: 656775 - RNA, 64 nt, hsa
aucaccguuaaacacugaucuuugcuaaugguggagccacuauggccaaugccuggcugcaggc

SEQ ID NO: 656776 - RNA, 62 nt, hsa
uucgaaguaguagauucucagaucuuuauucuaacaauuacaugauuugaaaacaguacuca

SEQ ID NO: 656777 - RNA, 62 nt, hsa
uaaaaaauguuuuguaaauccagguguauuuuaacaauuaaaugccuauuuuguuauauguu

SEQ ID NO: 656778 - RNA, 62 nt, hsa
uucauaagacuauuuuaaauagaaauuauuucaacaauuaaaguaauguugaccaucccccu

SEQ ID NO: 656779 - RNA, 62 nt, hsa
uguuaaugaauauuuuugcaguuguaaagcauaacaauuacaacuacacaucuauuucuaaa

SEQ ID NO: 656780 - RNA, 62 nt, hsa
gaucaguauuguaacguaugugaauagaugauaacaauuaauauuacuaaaagucccacaug

SEQ ID NO: 656781 - RNA, 62 nt, hsa
acugucuuggaaaaaaaauauaauaacaauuaaacaauuauuucucagagggcaacuuuauu

SEQ ID NO: 656782 - RNA, 62 nt, hsa
agaugaagacugucuuggaaaaaaaauauaauaacaauuaaacaauuauuucucagagggca

SEQ ID NO: 656783 - RNA, 62 nt, hsa
aaacaaguacuuuaguaucaggacaggaguugaacaauuagguuagcagauggagaugagag

SEQ ID NO: 656784 - RNA, 62 nt, hsa
ugguggcaauaucacaagggaggagagaggaaaacaauuaucuucucuacuuggauuaugag

SEQ ID NO: 656785 - RNA, 62 nt, hsa
cuaaaaagucaauucaucuaguuaagucgcugaacaauuaccugccaaaugcuauacugugu

SEQ ID NO: 656786 - RNA, 62 nt, hsa
agcagggugggguaaggaggagaaaauaaaccaacaauuaggucugcauuuucucaggcagu

SEQ ID NO: 656787 - RNA, 64 nt, hsa; identical to SEQ ID NO: 95053

SEQ ID NO: 656788 - RNA, 64 nt, hsa; identical to SEQ ID NO: 95054

SEQ ID NO: 656789 - RNA, 64 nt, hsa; identical to SEQ ID NO: 95055

SEQ ID NO: 656790 - RNA, 64 nt, hsa; identical to SEQ ID NO: 95056

SEQ ID NO: 656791 - RNA, 64 nt, hsa; identical to SEQ ID NO: 95057

SEQ ID NO: 656792 - RNA, 64 nt, hsa; identical to SEQ ID NO: 95058

SEQ ID NO: 656793 - RNA, 64 nt, hsa; identical to SEQ ID NO: 95059

SEQ ID NO: 656794 - RNA, 64 nt, hsa; identical to SEQ ID NO: 95060

SEQ ID NO: 656795 - RNA, 64 nt, hsa; identical to SEQ ID NO: 95061

SEQ ID NO: 656796 - RNA, 64 nt, hsa; identical to SEQ ID NO: 95062

SEQ ID NO: 656797 - RNA, 64 nt, hsa; identical to SEQ ID NO: 95063

SEQ ID NO: 656798 - RNA, 64 nt, hsa; identical to SEQ ID NO: 95064

SEQ ID NO: 656799 - RNA, 64 nt, hsa; identical to SEQ ID NO: 95065

SEQ ID NO: 656800 - RNA, 64 nt, hsa; identical to SEQ ID NO: 95066

SEQ ID NO: 656801 - RNA, 64 nt, hsa; identical to SEQ ID NO: 95067

SEQ ID NO: 656802 - RNA, 64 nt, hsa; identical to SEQ ID NO: 95068

SEQ ID NO: 656803 - RNA, 64 nt, hsa; identical to SEQ ID NO: 95069

SEQ ID NO: 656804 - RNA, 64 nt, hsa; identical to SEQ ID NO: 95070

SEQ ID NO: 656805 - RNA, 64 nt, hsa; identical to SEQ ID NO: 95071

SEQ ID NO: 656806 - RNA, 64 nt, hsa; identical to SEQ ID NO: 95072

SEQ ID NO: 656807 - RNA, 64 nt, hsa; identical to SEQ ID NO: 95073

SEQ ID NO: 656808 - RNA, 64 nt, hsa; identical to SEQ ID NO: 95074

SEQ ID NO: 656809 - RNA, 64 nt, hsa; identical to SEQ ID NO: 95075

SEQ ID NO: 656810 - RNA, 64 nt, hsa; identical to SEQ ID NO: 95076

SEQ ID NO: 656811 - RNA, 64 nt, hsa; identical to SEQ ID NO: 95077

SEQ ID NO: 656812 - RNA, 64 nt, hsa; identical to SEQ ID NO: 95078

SEQ ID NO: 656813 - RNA, 64 nt, hsa; identical to SEQ ID NO: 95079

SEQ ID NO: 656814 - RNA, 64 nt, hsa; identical to SEQ ID NO: 71812

SEQ ID NO: 656815 - RNA, 64 nt, hsa; identical to SEQ ID NO: 71813

SEQ ID NO: 656816 - RNA, 64 nt, hsa; identical to SEQ ID NO: 71814

SEQ ID NO: 656817 - RNA, 64 nt, hsa; identical to SEQ ID NO: 71815

SEQ ID NO: 656818 - RNA, 64 nt, hsa; identical to SEQ ID NO: 71816

SEQ ID NO: 656819 - RNA, 64 nt, hsa; identical to SEQ ID NO: 71817

SEQ ID NO: 656820 - RNA, 64 nt, hsa; identical to SEQ ID NO: 71818

SEQ ID NO: 656821 - RNA, 64 nt, hsa; identical to SEQ ID NO: 71819

SEQ ID NO: 656822 - RNA, 64 nt, hsa; identical to SEQ ID NO: 71820

SEQ ID NO: 656823 - RNA, 64 nt, hsa; identical to SEQ ID NO: 71821

SEQ ID NO: 656824 - RNA, 64 nt, hsa; identical to SEQ ID NO: 71822

SEQ ID NO: 656825 - RNA, 64 nt, hsa; identical to SEQ ID NO: 71823

SEQ ID NO: 656826 - RNA, 64 nt, hsa; identical to SEQ ID NO: 71824

SEQ ID NO: 656827 - RNA, 64 nt, hsa; identical to SEQ ID NO: 71825

SEQ ID NO: 656828 - RNA, 64 nt, hsa; identical to SEQ ID NO: 71826

SEQ ID NO: 656829 - RNA, 64 nt, hsa; identical to SEQ ID NO: 71827

SEQ ID NO: 656830 - RNA, 64 nt, hsa; identical to SEQ ID NO: 71828

SEQ ID NO: 656831 - RNA, 64 nt, hsa; identical to SEQ ID NO: 71829

SEQ ID NO: 656832 - RNA, 64 nt, hsa; identical to SEQ ID NO: 71830

SEQ ID NO: 656833 - RNA, 64 nt, hsa; identical to SEQ ID NO: 71831

SEQ ID NO: 656834 - RNA, 64 nt, hsa; identical to SEQ ID NO: 71832

SEQ ID NO: 656835 - RNA, 64 nt, hsa; identical to SEQ ID NO: 71833

SEQ ID NO: 656836 - RNA, 64 nt, hsa; identical to SEQ ID NO: 71834

SEQ ID NO: 656837 - RNA, 64 nt, hsa; identical to SEQ ID NO: 71835

SEQ ID NO: 656838 - RNA, 64 nt, hsa; identical to SEQ ID NO: 71836

SEQ ID NO: 656839 - RNA, 64 nt, hsa; identical to SEQ ID NO: 71837

SEQ ID NO: 656840 - RNA, 64 nt, hsa; identical to SEQ ID NO: 71838

SEQ ID NO: 656841 - RNA, 64 nt, hsa; identical to SEQ ID NO: 71839

SEQ ID NO: 656842 - RNA, 64 nt, hsa; identical to SEQ ID NO: 71840

SEQ ID NO: 656843 - RNA, 64 nt, hsa; identical to SEQ ID NO: 71841

SEQ ID NO: 656844 - RNA, 64 nt, hsa; identical to SEQ ID NO: 71842

SEQ ID NO: 656845 - RNA, 64 nt, hsa; identical to SEQ ID NO: 71843

SEQ ID NO: 656846 - RNA, 64 nt, hsa; identical to SEQ ID NO: 71844

SEQ ID NO: 656847 - RNA, 64 nt, hsa; identical to SEQ ID NO: 71845

SEQ ID NO: 656848 - RNA, 64 nt, hsa; identical to SEQ ID NO: 71846

SEQ ID NO: 656849 - RNA, 64 nt, hsa; identical to SEQ ID NO: 71847

SEQ ID NO: 656850 - RNA, 64 nt, hsa; identical to SEQ ID NO: 71847

SEQ ID NO: 656851 - RNA, 64 nt, hsa; identical to SEQ ID NO: 71849

SEQ ID NO: 656852 - RNA, 64 nt, hsa; identical to SEQ ID NO: 71850

SEQ ID NO: 656853 - RNA, 64 nt, hsa; identical to SEQ ID NO: 71851

SEQ ID NO: 656854 - RNA, 64 nt, hsa; identical to SEQ ID NO: 71852

SEQ ID NO: 656855 - RNA, 64 nt, hsa; identical to SEQ ID NO: 71853

SEQ ID NO: 656856 - RNA, 64 nt, hsa; identical to SEQ ID NO: 71854

SEQ ID NO: 656857 - RNA, 64 nt, hsa; identical to SEQ ID NO: 71855

SEQ ID NO: 656858 - RNA, 64 nt, hsa; identical to SEQ ID NO: 71856

SEQ ID NO: 656859 - RNA, 57 nt, hsa; identical to SEQ ID NO: 71857

SEQ ID NO: 656860 - RNA, 64 nt, hsa; identical to SEQ ID NO: 71858

SEQ ID NO: 656861 - RNA, 64 nt, hsa
uuaaaacauaggucacuaacugugauguuauuuguuuucuaagugguaugugagauuuucuaau

SEQ ID NO: 656862 - RNA, 64 nt, hsa
gugauguuauuuguuuucuaagugguaugugagauuuucuaauguaguuagaaguuucauuguc

SEQ ID NO: 656863 - RNA, 64 nt, hsa
ugguugguugguauagaauggugggaauucaaauuuuucuaaacucaugguaaguauauuguaa

SEQ ID NO: 656864 - RNA, 64 nt, hsa
uucuuauuugggggagugggcaaaauguugauuauuuucuaaugcuuuguagcaaagcauauca

SEQ ID NO: 656865 - RNA, 64 nt, hsa
gagucugucagcuuucauuuuauuuugcuaagguuuuucuaaugaauuuuuaaguguuugugua

SEQ ID NO: 656866 - RNA, 64 nt, hsa
gcaguagcuuuagcaagcagauggucacaaucuguuuucuaaaucauuuuuuauuaaaugaauc

SEQ ID NO: 656867 - RNA, 64 nt, hsa
gcgaaaauaugcaggaagauuaauuuuguggcaguuuucuaaaacugacaaccaggugggacca

SEQ ID NO: 656868 - RNA, 63 nt, hsa
aguauaguuugaaagcggcacaauuaaaaauuaauuuucuaacaaaguugggagguuugaugg

SEQ ID NO: 656869 - RNA, 64 nt, hsa
cuagaacuuuaaagaaaaaagaauguuauauuaguuuucuaaaacucaacuaucuuuagucaug

SEQ ID NO: 656870 - RNA, 64 nt, hsa
auuguuaccucuguguguuaagaaaauaaaaauauuuucuaaaggucuguauuuugcuuucauu

SEQ ID NO: 656871 - RNA, 64 nt, hsa
cucuauuaggagaacuagaccacuuucuucauucuuuucuaaacugcugcagauugccgugaac

SEQ ID NO: 656872 - RNA, 64 nt, hsa
uaucaauagucucuuuuccgcaggcaaaguggcauuuucuaaacauguuugcuuacugccaggu

SEQ ID NO: 656873 - RNA, 64 nt, hsa
auauaaauaugucagauguacauagagaucuauuuuuucuaaaacauuccccuccccacuccuc

SEQ ID NO: 656874 - RNA, 62 nt, hsa
aggcagagaccuccaauaaagugccuucugggcuuuuucuaaccuuugucuuagcuaccugu

SEQ ID NO: 656875 - RNA, 64 nt, hsa
gaugcuugggggaucauagaguauuuaugucugcuuuucuaaaucugcauuauaauagcucuaa

SEQ ID NO: 656876 - RNA, 64 nt, hsa
auauauguacaaaaauuacugaaaggcuucaguuuuuucuaauuggauuauuaugucuugaaag

SEQ ID NO: 656877 - RNA, 64 nt, hsa
uguauccuaguuuagugauacaaaugauugcaauuuuucuaaaucauuaaauuauuugguuugg

SEQ ID NO: 656878 - RNA, 64 nt, hsa
accuggguuuauuuacuauuacucuguguugcuauuuucuaagaaagaauacagcacuagacuu

SEQ ID NO: 656879 - RNA, 64 nt, hsa
gaucugaauuauaguucuaauuuauuauuacuuuuuuucuaauuuacugaucuuacuacuacaa

SEQ ID NO: 656880 - RNA, 64 nt, hsa
uuuuaaaaauuauguugacuaaauacaaaguuuguuuucuaaaauguaaauauuugccacaaug

SEQ ID NO: 656881 - RNA, 64 nt, hsa
aacaucaaagaugcagcaagcuuauuaaguauuauuuucuaaaagaaauaggaggcauuuucau

SEQ ID NO: 656882 - RNA, 64 nt, hsa
ucaguccauaaagcaaagcuuguugauaguguaguuuucuaaacgcugcaaauuugcagccuuu

SEQ ID NO: 656883 - RNA, 64 nt, hsa
uaacuuaaggagacggguaaaggaucuuaaauuuuuuucuaauagaaagaugugcuacacugua

SEQ ID NO: 656884 - RNA, 64 nt, hsa
cagugcaaaaguucuuuaaaaugcauaugucuuuuuuucuaauuccguuuuguuuuaaagcaca

SEQ ID NO: 656885 - RNA, 64 nt, hsa
uauuucaacagugugacuaauguuugaaauuauuuuuucuaagaguuuuucuauaaccuuccaa

SEQ ID NO: 656886 - RNA, 64 nt, hsa
cucuucugcaaaagguacuguuaaguaaaccagauuuucuaaauaggcauucuuaaaauuucag

SEQ ID NO: 656887 - RNA, 64 nt, hsa
uaagaaauacuuucauuuauguuugcuagaaacauuuucuaaaugauagugauuagcugguuag

SEQ ID NO: 656888 - RNA, 64 nt, hsa
ucucuguggaucuaugccaaaaucaugggccaucuuuucuaaguguacuucugauuaaugcaag

SEQ ID NO: 656889 - RNA, 64 nt, hsa
ggccuauugcacaagucuugacaaacaacauauauuuucuaaaacuauccagauuucauuauca

SEQ ID NO: 656890 - RNA, 64 nt, hsa
cggaggaggcuucuaauuagcuggaaaagaguauuuuucuaauacguugcaaggauuagccaaa

SEQ ID NO: 656891 - RNA, 64 nt, hsa
acaaacuuguaccacaaaacaauaucgcuuuaacuuuucuaaagccaaauuucccauguaagcu

SEQ ID NO: 656892 - RNA, 64 nt, hsa
cuaacucacuucggucucugucugucaacuaaacuuuucuaaagguuaccaguuauccaaucac

SEQ ID NO: 656893 - RNA, 64 nt, hsa
ugucuuggacaacacuauuguuugaagguuuaucuuuucuaaucaugcucuaccgcauuguaga

SEQ ID NO: 656894 - RNA, 64 nt, hsa
uagaguauuuacacuaugauaaaguuguaaauaauuuucuaagacaguuuuuauauagucuaca

SEQ ID NO: 656895 - RNA, 63 nt, hsa
uuccuucuuuccaugacuaaauucuucuaaaaguuuucuaauuugcacuaauguguuaugaga

SEQ ID NO: 656896 - RNA, 64 nt, hsa
uugugguuuguacagauuuguuaaaaugugaacguuuucuaacugccucguaggguagaaacca

SEQ ID NO: 656897 - RNA, 64 nt, hsa
cagcuuauucuuguacaaauguuuaaaauauggcuuuucuaauuggauauuguauuuuuuuuaa

SEQ ID NO: 656898 - RNA, 64 nt, hsa
ucagaaguauaauagaaauaaucuuuaguugcucuuuucuaaccauuguaauucuucccuucuu

SEQ ID NO: 656899 - RNA, 64 nt, hsa
augugcaagucuaauuguugauuucaguacaagauuuucuaaaucaguugcuacaaaaacugau

SEQ ID NO: 656900 - RNA, 64 nt, hsa
uaugaugucauuaauacuuuuucuaaauguuuaguuuucuaaauuguauaauaauucaaaauua

SEQ ID NO: 656901 - RNA, 64 nt, hsa
uugaauguaaaguauauaugaugucauuaauacuuuuucuaaauguuuaguuuucuaaauugua

SEQ ID NO: 656902 - RNA, 64 nt, hsa
agggaaucauuuuuguaggaagcauuuuuuauaauuuucuaagucgugcacuuucucgguccac

SEQ ID NO: 656903 - RNA, 64 nt, hsa
auggauucauggaguagccuggacuguuucauaguuuucuaaauguacaaauucuuauaggcua

SEQ ID NO: 656904 - RNA, 64 nt, hsa
auuauuuuacggagcugcaaccuccaauuuuguguuuucuaagugauuuacuuaagucaauaac

SEQ ID NO: 656905 - RNA, 64 nt, hsa
acagauggaauccuguggacuaaugugccaccaguuuucuaacaaggguguacauaaaauggau

SEQ ID NO: 656906 - RNA, 64 nt, hsa
aacauuuucagaccaugaaugaauguuuccauuuuuuucuaauggaaugugagaguuuacuuuu

SEQ ID NO: 656907 - RNA, 64 nt, hsa
agauugucucuucuauauugaaagcauuuuuauguuuucuaauuuaaaaauuaauauuuucuua

SEQ ID NO: 656908 - RNA, 64 nt, hsa
ugugcuaugacccacuaugaccacagcaucugcauuuucuaaaaaauuccaugcagguguuuug

SEQ ID NO: 656909 - RNA, 64 nt, hsa
ucugccuuguucuuaucaacuugaaauguuggcauuuucuaaccuuguuuuguuggcuacaaua

SEQ ID NO: 656910 - RNA, 64 nt, hsa
auuuuucaucaauaacugucagaggugaucuuuauuuucuaaauauuucaaacuugaaaacaga

SEQ ID NO: 656911 - RNA, 64 nt, hsa
uuaaauuucaaggaaauaugaaggcacuuccuuuuuuucuaagaaggaaguugcuagaugauuc

SEQ ID NO: 656912 - RNA, 64 nt, hsa
cuuccuuauguugcugugauauugauagcuuuuauuuucuaauuuuuaaaaaauggucauauua

SEQ ID NO: 656913 - RNA, 64 nt, hsa
uauucaacuucaucaaucacuuuauuuuauuuuuuuuucuaacuccuggagacuuauuuuacug

SEQ ID NO: 656914 - RNA, 64 nt, hsa
aaccucaaaucauaaagacauuuaaaagaauuguuuuucuaacuggaggggcucuagugcuaaa

SEQ ID NO: 656915 - RNA, 64 nt, hsa
gcguacuacauuuccugccuuuuucuuucaguguuuuucuaagacuaaauaaauagcaaacuuu

SEQ ID NO: 656916 - RNA, 64 nt, hsa
auauuuucuaaagaaaaaaauaaaaaaaguuguauuuucuaauuuuuauuaccaauauauaaga

SEQ ID NO: 656917 - RNA, 64 nt, hsa
gcuauuguagauggcaucuuuuuaaaaaguuauauuuucuaaagaaaaaaauaaaaaaaguugu

SEQ ID NO: 656918 - RNA, 64 nt, hsa
uuaaccaugauccuccagauuuuuuggaguauucuuuucuaaccuuaacccugccaaaccuuga

SEQ ID NO: 656919 - RNA, 64 nt, hsa
guuuuguuuuugcccuuuauguacuacauucuuauuuucuaacuuuuaaacacuguauuggagg

SEQ ID NO: 656920 - RNA, 64 nt, hsa
auuccuaaugggguguuaaagccguuuuuuauuuuuuucuaaauaaaaagagaacccaugcuuu

SEQ ID NO: 656921 - RNA, 64 nt, hsa
gcuuaacuggguaauuuguggucuaggccuuuuguuuucuaagcuuacuaucuuguguuuguuu

SEQ ID NO: 656922 - RNA, 64 nt, hsa
aacacuaguaauuaaaaugugccuuuugaagauguuuucuaagagaaaggaaauacguugcagu

SEQ ID NO: 656923 - RNA, 64 nt, hsa
aagaaugacuuuuccaagaguucuagauguuugauuuucuaauuaauacuuaucagaucuacaa

SEQ ID NO: 656924 - RNA, 64 nt, hsa
aaagaagggaaucuguuuaucgcuuuucaaaauauuuucuaaagugggggaagaaaguuuauag

SEQ ID NO: 656925 - RNA, 64 nt, hsa
ugugggcaguuuaauaaaccugaaccuuuguguguuuucuaauuguaccugaguugaccauccu

SEQ ID NO: 656926 - RNA, 64 nt, hsa
accacaaugaucugauuuucuuucuucuuucuuuuuuucuaauugagaggauuauucccaguaa

SEQ ID NO: 656927 - RNA, 64 nt, hsa
cagaacagggcaaacucuccauuuuacuuauggcuuuucuaauuuuuaauuaauuaauuuauuu

SEQ ID NO: 656928 - RNA, 64 nt, hsa
guuuaaagacguguuuuuaaaauuccacuaucccuuuucuaaagguuaaaggucugaagcagcu

SEQ ID NO: 656929 - RNA, 64 nt, hsa
acaacuuagaucaacuauuuuuagcuugguaaauuuuucuaaacacaauuguuauagccagagg

SEQ ID NO: 656930 - RNA, 64 nt, hsa
uuuauauucuccuuuugacauuauaacuguuggcuuuucuaaucuuguuaaauauaucuauuuu

SEQ ID NO: 656931 - RNA, 64 nt, hsa
uucaagaguuguaccuuaacauuggugaaacauuuuuucuaagauuuucaaaaggaauaugugu

SEQ ID NO: 656932 - RNA, 64 nt, hsa
auuaugaugaauuauuuucuuguaucaagcugaauuuucuaaaaguuaaccuugugggcuguug

SEQ ID NO: 656933 - RNA, 64 nt, hsa
auacaugugcaaucauccccccagacaaauuguguuuucuaaaggauguguaucacuuaccuuu

SEQ ID NO: 656934 - RNA, 64 nt, hsa
aauaagagcaguauccuuagcucuagccaagcauuuuucuaauuccugccuuuggucacaaaga

SEQ ID NO: 656935 - RNA, 64 nt, hsa
agacuuauaaaggauuucaucagaaguuuucauuuuuucuaaauccuccccuacaaaauuuuca

SEQ ID NO: 656936 - RNA, 64 nt, hsa
uuuguuuccagaaauucuucaauuugaaaucaccuuuucuaaaaagucaauucaucuaguuaag

SEQ ID NO: 656937 - RNA, 64 nt, hsa
uuuugucagucugagucaucaaaaagagucuuaauuuucuaaaacaaguuggcuagaagaaagu

SEQ ID NO: 656938 - RNA, 64 nt, hsa
ugaauucagaauauuaagaaaaugaaguaacugauuuucuaaaaaaaaaaaaaaaaaaaauuuc

SEQ ID NO: 656939 - RNA, 64 nt, hsa
ugauaauacuguaauauaccugucacacaaaugcuuuucuaauguuuuaaccuugaguauugca

SEQ ID NO: 656940 - RNA, 64 nt, hsa
uguacaguuuuacuaagguuuagcaccuuugaucuuuucuaaaucaggaaaaaaaucuaugcau

SEQ ID NO: 656941 - RNA, 64 nt, hsa
cauaaagugaagcugcaauguaacauagguaucuuuuucuaaaaacuucaaguguuugauuaaa

SEQ ID NO: 656942 - RNA, 64 nt, hsa
cuauguucagaacuucaucugccacugguuauuuuuuucuaaggaguaacuugcaaguuuucag

SEQ ID NO: 656943 - RNA, 64 nt, hsa
aguaggaggaggaugagccacagaaauugcauaauuuucuaauuucaagucuuccugauacaug

SEQ ID NO: 656944 - RNA, 64 nt, hsa
uuaucuauauauaaaccaugauuuaaaacuuuaauuuucuaaacauaguauucaacuuaguuga

SEQ ID NO: 656945 - RNA, 64 nt, hsa
uucucacuauaguccauaaugcuuccagaucaccuuuucuaagaugcaacaugugaguuuagug

SEQ ID NO: 656946 - RNA, 64 nt, hsa
gucgccacucgucuaauuugaccaguguuaagaauuuucuaauuuaauaauuuaauagugaucu

SEQ ID NO: 656947 - RNA, 64 nt, hsa
uuucuuccuucacaguuuuaucucacaaaaccauuuuucuaauaagagacaucauguuggaaag

SEQ ID NO: 656948 - RNA, 64 nt, hsa
acuucugguagaugucuuaugagauuguucugcuuuuucuaaguuacuuagauguuggauaugu

SEQ ID NO: 656949 - RNA, 64 nt, hsa
uacacuauucauaacucuuaaaauuauucucuuuuuuucuaagagucccucccuuccaaaagug

SEQ ID NO: 656950 - RNA, 64 nt, hsa
uggaguuggguugcuaaccuuaauuucuaugauguuuucuaaaaugaaacuugauaaaguagac

SEQ ID NO: 656951 - RNA, 64 nt, hsa
ugugaaguuguuaaggcacucucauuugcccucuuuuucuaagugaauacaggacacguauuag

SEQ ID NO: 656952 - RNA, 64 nt, hsa
caccucuaauaugaacauuaguuugagguaguuuuuuucuaaagcaaaaauuuuaacuguuuuc

SEQ ID NO: 656953 - RNA, 64 nt, hsa
agguaguuuuuuucuaaagcaaaaauuuuaacuguuuucuaauugucaagcacuauuuucauua

SEQ ID NO: 656954 - RNA, 64 nt, hsa
agaguuuauuuuauucucagaguuuggacuacaauuuucuaagauguuucugguucaagacugu

SEQ ID NO: 656955 - RNA, 64 nt, hsa
uuuucuuuacacuaaucgauacauuuagaaaaaauuuucuaaguuagagacaaguuuaaaagua

SEQ ID NO: 656956 - RNA, 64 nt, hsa
gaaccucucugggauguuuccagcaaaagugagcuuuucuaaucgucucauuguaacauggcuu

SEQ ID NO: 656957 - RNA, 64 nt, hsa
gauguccuuaauaagggaagucauguauaagauguuuucuaaaagacuuuucaguauuacaacu

SEQ ID NO: 656958 - RNA, 64 nt, hsa
ccugcuguuaauguuuuuuccccccuugugaauguuuucuaacuuugucuugguaauugcaauu

SEQ ID NO: 656959 - RNA, 64 nt, hsa
auguaauugcuuaccugcacacaguuuuuuuuccuuuucuaaauuuguuugugaucauugacag

SEQ ID NO: 656960 - RNA, 64 nt, hsa
ggaaugguauuuucgguuuauugacauugaauuguuuucuaaguuuuuccaucacaagauagga

SEQ ID NO: 656961 - RNA, 64 nt, hsa
uauuuugccuguuugugcagauaagaacagaaacuuuucuaagacccacauuugguuauugaag

SEQ ID NO: 656962 - RNA, 64 nt, hsa
uuauauucugauuaagcuuacuuuaccuuacauuuuuucuaaguaacaaugaauccugauuucu

SEQ ID NO: 656963 - RNA, 64 nt, hsa
uggauuaaaucugauauuuucuaauacugaaagauuuucuaaaugucacugcugacauaacucc

SEQ ID NO: 656964 - RNA, 64 nt, hsa
ggguuggggugguuccuuuggauuaaaucugauauuuucuaauacugaaagauuuucuaaaugu

SEQ ID NO: 656965 - RNA, 64 nt, hsa
caacugccuugucaguuugguaauucacuuaugauuuucuaauguucucuuggugaauuuuauu

SEQ ID NO: 656966 - RNA, 64 nt, hsa
aauauauuuacuauaauucuaaauguuuaaaugcuuuucuaaaaaugcaaaacuaugauguuua

SEQ ID NO: 656967 - RNA, 64 nt, hsa
gaaauguuuauugacaggucuuuucaaauaaugcuuuucuaauuaauagccaaagauuucauau

SEQ ID NO: 656968 - RNA, 64 nt, hsa
aauaaaagauaaaagagcgauacacaaagcuuucuuuucuaacuuuuccaagcaaaaucuaaaa

SEQ ID NO: 656969 - RNA, 64 nt, hsa
uaugaugagcagacuucucggaauucauaauaaauuuucuaaaagccuacaaauguguguauug

SEQ ID NO: 656970 - RNA, 64 nt, hsa
gaagagagauuagaacuguuagaaggaguugaaauuuucuaaaagacauaguauuuaguuuaua

SEQ ID NO: 656971 - RNA, 64 nt, hsa
aaugaaguucacaauaggucauaaggucucuuccuuuucuaaaauugaaagacaagaaauuuag

SEQ ID NO: 656972 - RNA, 64 nt, hsa
gucgacaguuucuacaaaaauguuacaaauuuuguuuucuaaacaauuuguugauuaagugauc

SEQ ID NO: 656973 - RNA, 64 nt, hsa
ucaaaugguacuaugaggaaaaaaagaaaaacauuuuucuaaauauucaacuauaacugcuguu

SEQ ID NO: 656974 - RNA, 64 nt, hsa
gaccaaugcuugaauaaguagaccccaagcauccuuuucuaaaaagugacuuaaaauaagccaa

SEQ ID NO: 656975 - RNA, 64 nt, hsa
auaaaacacuuuaauuagaaucuauuuuuaccuauuuucuaaauuuauuuaaaugcuuagcagg

SEQ ID NO: 656976 - RNA, 64 nt, hsa
ucaugauuuuguuaaaguagccuucuucagaugcuuuucuaagggcuaguuaccaacuuuauuu

SEQ ID NO: 656977 - RNA, 64 nt, hsa
aaguaauuacauuauuuaggucuuaauccaacuuuuuucuaauauaucuaaacaauugaaaggg

SEQ ID NO: 656978 - RNA, 64 nt, hsa
uuacaaauaugugccauugugcaacaucgguggauuuucuaaaaauaauguaaaugucuucuau

SEQ ID NO: 656979 - RNA, 64 nt, hsa
accugaaauaauaagauaauaagaaaagcaauaauuuucuaaagcugugcugucggugauacag

SEQ ID NO: 656980 - RNA, 64 nt, hsa
cuggauuaauucccagaacccucucccuccuuucuuuucuaagugaguuguugauuuuaggagu

SEQ ID NO: 656981 - RNA, 64 nt, hsa
ugucucagaccuuagguaacauaccugcagcugcuuuucuaacaaacuguugaucagcaaaaau

SEQ ID NO: 656982 - RNA, 64 nt, hsa
aagguagauuuuuauaaaacaagcauggggauucuuuucuaagguaauauuaaugagaagggaa

SEQ ID NO: 656983 - RNA, 64 nt, hsa
cuuucuugugugugaugaaccaguauggauuugcuuuucuaagccuccuguugguuacuaaucu

SEQ ID NO: 656984 - RNA, 64 nt, hsa
uuacacacaugagggcugguguucauuaauacuguuuucuaauuuuuccauaguuaaucuauaa

SEQ ID NO: 656985 - RNA, 64 nt, hsa
ugaauguguuuuuuaaauggaacuaucuccaaauuuuucuaagacuacuaugaacaguuuucuu

SEQ ID NO: 656986 - RNA, 64 nt, hsa
aaccuaaaagaguagucuuaacacauuacuaacuuuuucuaagagaaauugauuccuguuuugu

SEQ ID NO: 656987 - RNA, 64 nt, hsa
cagaguaacucaccuccaugggcugaccaaaggcuuuucuaauuuuuguuacugaugagaugaa

SEQ ID NO: 656988 - RNA, 64 nt, hsa
cacagaagcuuuaaaaauacauagucauccaagguuuucuaaaaauugaaaucauauguuggga

SEQ ID NO: 656989 - RNA, 64 nt, hsa
guucauguugucauuugaaacucuucacauaaaauuuucuaauauucauuuggaaaaccucucc

SEQ ID NO: 656990 - RNA, 64 nt, hsa
aggucauaucuguuuuucuuuaucauucauuucuuuuucuaaaaguuguuacugauaugcuuuu

SEQ ID NO: 656991 - RNA, 64 nt, hsa
cuggaaacacuaccauuauuuuugguguauugcuuuuucuaauugacuguuuuuaaugauuuug

SEQ ID NO: 656992 - RNA, 64 nt, hsa
ugacauuuaaguggaaaaccaaguuaucauugucuuuucuaagcucaguguggaugauugcauu

SEQ ID NO: 656993 - RNA, 64 nt, hsa
ucuacuuuauagaagguugcuuuucuuuuuaauuuuuucuaacaaagaaaagaauaaaguauuu

SEQ ID NO: 656994 - RNA, 64 nt, hsa
agcauagcaugguuuuguuuguuuuugcuuucaauuuucuaauuuggcauggauccauauguau

SEQ ID NO: 656995 - RNA, 64 nt, hsa
aauuuggcauggauccauauguauuuacuauccuuuuucuaauauauuaauauaugcuacauuu

SEQ ID NO: 656996 - RNA, 64 nt, hsa
uucugacuugauaaagcuuuaauaauguacaguguuuucuaaauauuuccuguuuuuucagcac

SEQ ID NO: 656997 - RNA, 64 nt, hsa
gaaggaaaugcugucccauaaaaugccauuccuauuuucuaauauaaaacucuuuuccaggaag

SEQ ID NO: 656998 - RNA, 64 nt, hsa
gcuugacaacacucugggaaugaggaacaagacuuuuucuaaaaagauaguggaaguucaaggg

SEQ ID NO: 656999 - RNA, 64 nt, hsa
aaaagacguccuuuuccauuuuuuuuugcuuuuauuuucuaaaucauuuuuaagggaaugaaac

SEQ ID NO: 657000 - RNA, 64 nt, hsa
aaccagacaggaguuaacuuguauuagaauuguuuuuucuaaaguuauguuaccugagaaauua

SEQ ID NO: 657001 - RNA, 64 nt, hsa
acaggauaagguuacacuuguauuagaauuguuuuuuucuaaaguuauguuaccugaaaaauca

SEQ ID NO: 657002 - RNA, 64 nt, hsa
uucuguacauuaaaagaacugauucaugaagacguuuucuaacuuuuucucuuuaagugcuccu

SEQ ID NO: 657003 - RNA, 64 nt, hsa
cacauguauggaaaccuuaaaaaguaaacuuauuuuuucuaacuagaaggcucucauaaguuuc

SEQ ID NO: 657004 - RNA, 64 nt, hsa
uauuaacucgcagacccucuggggguaggggcuguuuucuaaguuacaggcagagugggacuga

SEQ ID NO: 657005 - RNA, 64 nt, hsa
aaagagaaccuuucggaucacucguuuacaagccuuuucuaaguauuuggugguuuauguuuac

SEQ ID NO: 657006 - RNA, 64 nt, hsa
ugguuaauguaguaugguauaugcacaaaacuacuuuucuaaaaucuaaaauuucauaauucug

SEQ ID NO: 657007 - RNA, 64 nt, hsa
aauaggcauuuuaaguaaaagucuaccuguguuuuuuucuaaaaaggcugcucacaaguucuau

SEQ ID NO: 657008 - RNA, 64 nt, hsa
uaguuuuauguaagaaaccuuaggaugagcucccuuuucuaagguguuuuuguuuuuuguaugu

SEQ ID NO: 657009 - RNA, 64 nt, hsa
gcagggcuuuacauuuaccuuuuuauccuuauauuuuucuaaagguaaauuauuuguuagauga

SEQ ID NO: 657010 - RNA, 64 nt, hsa
cuugcuauauaagauucaaaagagcuuuuuaaauuuuucuaauaauaucuuacauuuguacagc

SEQ ID NO: 657011 - RNA, 64 nt, hsa
ugccagacuuucuccaaaugaaaccugaaucaauuuuucuaaaucuagguuucauagaguccuc

SEQ ID NO: 657012 - RNA, 64 nt, hsa
ggcacuguaaauacuuuccaguauuaaauuauccuuuucuaacacuguaggaacuauuuugaau

SEQ ID NO: 657013 - RNA, 64 nt, hsa
uauggaguuguuauuucauaggcauugaaaaugguuuucuaaacuccaaaauggucaucuuauc

SEQ ID NO: 657014 - RNA, 64 nt, hsa
uaauaauauugaccauuuccuaucugccaggcauuuuucuaagcacaugaagaaauuaguccua

SEQ ID NO: 657015 - RNA, 64 nt, hsa
uguauuuuuaaucauaaguuguucaaauuaaaacuuuucuaaaauauaguuagcauuuucauuu

SEQ ID NO: 657016 - RNA, 64 nt, hsa
uguccauuaaucaacagauguuggcuuaguuuaauuuucuaaagaguuguuuaauagagaaaau

SEQ ID NO: 657017 - RNA, 64 nt, hsa
cauccauuaauaguuauuaggcauuuagguaaaauuuucuaauaccuaaaaauugucaaaaaca

SEQ ID NO: 657018 - RNA, 64 nt, hsa
cugaaaugccuuguaccuacaacaaugcuuaggcuuuucuaagccucuugccacuuuuaaaauu

SEQ ID NO: 657019 - RNA, 64 nt, hsa
aacacauuuauuuauacuaaauaacugucaaccauuuucuaacaaaaaguaagacugaauugac

SEQ ID NO: 657020 - RNA, 64 nt, hsa
gggcacaaagaaaauuuagaucugacaaguauaauuuucuaaagacauuauuucaggauuaaca

SEQ ID NO: 657021 - RNA, 64 nt, hsa
aaacuggggauuucucaaugugacuaacucuaauuuuucuaauuauaacugccuuuaauuaaca

SEQ ID NO: 657022 - RNA, 64 nt, hsa
aaaagaguuuuauuauaaaccguguguuuuugguuuuucuaaguauauagaaagcuuguauaau

SEQ ID NO: 657023 - RNA, 64 nt, hsa
cuuguagcuuauuauuguaaaguguuuuuuuuuuuuuucuaauuucucccacauguauuucugg

SEQ ID NO: 657024 - RNA, 64 nt, hsa
auuaucccuggaacuuauugugaaaguugugcuguuuucuaaguaaaauaaaaaauaaaaaauu

SEQ ID NO: 657025 - RNA, 64 nt, hsa
uuaaaccugcugcaagagccauaacuuugaggcauuuucuaaaugaacuguggggauccaggau

SEQ ID NO: 657026 - RNA, 64 nt, hsa
caguuaauacuguauuucaaaacacauuuaacuguuuucuaaugcuuugcauuaucaguuacaa

SEQ ID NO: 657027 - RNA, 64 nt, hsa
acuuaaugaauauguuaaggaccaggcuagaguauuuucuaagcuggaaacuuagugugccuug

SEQ ID NO: 657028 - RNA, 64 nt, hsa
uacuacauguaaacugauuuuuuguucugauuuuuuuucuaauauuuuuaggaaaauauuaagc

SEQ ID NO: 657029 - RNA, 64 nt, hsa
ggaaguagaucugaauaggcuaccggagccuuguuuuucuaaaggggggcgcugucuagcacuu

SEQ ID NO: 657030 - RNA, 64 nt, hsa
caccuguguaaguugguauuugggcacuuuauauuuuucuaaaaacguguuuuggauccuguac

SEQ ID NO: 657031 - RNA, 64 nt, hsa
agcuaaugguaauuagaaucauuugaauuuauuuuuuucuaauaugugaaacacagauuucaag

SEQ ID NO: 657032 - RNA, 64 nt, hsa
auccauagcagcaccguucauucuaugagucuauuuuucuaaugaugcaguaauuaaauugcau

SEQ ID NO: 657033 - RNA, 64 nt, hsa
acaggccuacaacuuuugccucagacuguuccccuuuucuaaggguauucaaguuuucaccuuu

SEQ ID NO: 657034 - RNA, 64 nt, hsa
acuauuuucaaaaucauuuucaucaagacaccuuuuuucuaaaauaggcauugcauacacauau

SEQ ID NO: 657035 - RNA, 64 nt, hsa
uauuuauuucauuuaagauaauuuucaaaguuaauuuucuaaauaagauaauucucauuugugu

SEQ ID NO: 657036 - RNA, 64 nt, hsa
auaaaauuuauuaugcuuuauaaccucuucuguauuuucuaauuuuuucauugucuuugauaaa

SEQ ID NO: 657037 - RNA, 64 nt, hsa
gaaaacacugcauuuaagaauuuuuaaaaauugguuuucuaaaauuaaaauguccaaauuaggc

SEQ ID NO: 657038 - RNA, 64 nt, hsa
aaggaaccucgguacuucuuaagguuuguuuguguuuucuaaaaccagagaauaaggaacugau

SEQ ID NO: 657039 - RNA, 64 nt, hsa
acauaaauuauguuuaaauggcuuggugucuuucuuuucuaauuaugcagaauaagcucuuuau

SEQ ID NO: 657040 - RNA, 64 nt, hsa
guagauacagauuguauuuguguguguuuuugguuuuucuaaauauccaauugguccaaggaaa

SEQ ID NO: 657041 - RNA, 64 nt, hsa
ugaaaauugucuauuuuuaucuauauauuuaaaguuuucuaaaaaugauaaaagguuauuacga

SEQ ID NO: 657042 - RNA, 64 nt, hsa
aaguauugcuaguaaaugauuuguagaaacuugguuuucuaagcauaguucuuccauaaccacc

SEQ ID NO: 657043 - RNA, 64 nt, hsa
uaaaggcaggucugaauaagaccuagcuuuguuuuuuucuaauggaaugaaccauuuuccucuu

SEQ ID NO: 657044 - RNA, 64 nt, hsa
uugucuugagacguggcaaauucuccuuggugaguuuucuaaaaguauuuccccauggaaagga

SEQ ID NO: 657045 - RNA, 64 nt, hsa
guuuaaauuuagcacagaacuagaugaguugcacuuuucuaauaacauaggauggauuugggga

SEQ ID NO: 657046 - RNA, 64 nt, hsa
ugacucuccaauagguucuucuauaccgauuucauuuucuaaacuguaucaggacccagguguc

SEQ ID NO: 657047 - RNA, 64 nt, hsa
aaggggagaaguagaaccacaguguuuuauuuauuuuucuaaaacucuuacuaaauccagauuu

SEQ ID NO: 657048 - RNA, 64 nt, hsa
aacacaacuggaguuuccauuuaucauaauuaguuuuucuaaauagacccuuaugggaguuuga

SEQ ID NO: 657049 - RNA, 64 nt, hsa
uccuuaauauguuugaaauuauugauuuuggcauuuuucuaagcaauuuauguaauuuuauuug

SEQ ID NO: 657050 - RNA, 64 nt, hsa
uaccuauauuuaccauguuuacuuaccaggaauauuuucuaagugccauagucuuuuucauaau

SEQ ID NO: 657051 - RNA, 64 nt, hsa
cacagauccuaaguagaaccagguaauugucucuuuuucuaauaaggaauuuggguaauuuuua

SEQ ID NO: 657052 - RNA, 64 nt, hsa
acacagauccaaaauagaaucagauuaucucuuuuuuucuaaaggagagaaagacuuagaacau

SEQ ID NO: 657053 - RNA, 64 nt, hsa
cagugccauucugccuucucaaugagcaaaaccauuuucuaaguaugaggauauuagugaguag

SEQ ID NO: 657054 - RNA, 64 nt, hsa
aucaauuuaauauacaguacuucauuuuuaauuguuuucuaaaaaaaagguuuuuuuuuuccuu

SEQ ID NO: 657055 - RNA, 64 nt, hsa
auuugggaguuugggguuuuauguuuuguuuuucuuuucuaaaaugaagugagauuguucacac

SEQ ID NO: 657056 - RNA, 64 nt, hsa
uuuugauauuugagccauuccuaaagauuugggguuuucuaaaacuaaagaaucuaggaaccuu

SEQ ID NO: 657057 - RNA, 64 nt, hsa
gguugagcugaagccacaguuucucugugcuguguuuucuaacacauuuuucuguuuuuaauua

SEQ ID NO: 657058 - RNA, 64 nt, hsa
cauuugauauauuuuucuuaacuaugggguuuauuuuucuaaauguggguugauugacuguuaa

SEQ ID NO: 657059 - RNA, 64 nt, hsa
auuguuucagcagacuucuuucagcagcucguguuuuucuaaagugaaaggcaugguuuguccu

SEQ ID NO: 657060 - RNA, 64 nt, hsa
augguaugaaauuucucucccccugcuugaagaguuuucuaauucguuucuagugagcaaaaca

SEQ ID NO: 657061 - RNA, 64 nt, hsa
uuuaagggcuuuaugugaacuaugauauuguaauuuuucuaagcauauucaaaagggugacaaa

SEQ ID NO: 657062 - RNA, 64 nt, hsa
uuaaaguuucuugcauuuauuauucucaaaaguuuuuucuaaguuaaacagucaguaugcaauc

SEQ ID NO: 657063 - RNA, 64 nt, hsa
uuuuuucuauggguguuaucaccuagcugaauguuuuucuaaaggaguuuauguuccauuaaac

SEQ ID NO: 657064 - RNA, 64 nt, hsa
ucaaugagcauguuuagacuuuaacauaagcuauuuuucuaacuacaaagguuuaaaugaacaa

SEQ ID NO: 657065 - RNA, 64 nt, hsa
uuuuuuaaaauuuuuuuuucucuuaaugaacacauuuucuaaaugaauuuuuuuuguaguuacu

SEQ ID NO: 657066 - RNA, 64 nt, hsa
uuguauuuuuuuucuuuugaaaggguuuguuaauuuuucuaauuuuaccaaaguuugcagccua

SEQ ID NO: 657067 - RNA, 64 nt, hsa
uauuagggaagaaugagacaauuuuguguaggcuuuuucuaaaguccaguacuuuguccagauu

SEQ ID NO: 657068 - RNA, 64 nt, hsa
uuuuuuuuaacuuugacaacugacuucuguuuccuuuucuaaguuuuauuuuucaaaccacccc

SEQ ID NO: 657069 - RNA, 62 nt, hsa
cuacgcggacuccuaccugaagcggaagaggauuuucuaaguggcuggcaccagagauaacu

SEQ ID NO: 657070 - RNA, 64 nt, hsa
gggagaacagaaaugcaaaaauacagaugucuauuuuucuaaacugggggguggaggggugccu

SEQ ID NO: 657071 - RNA, 64 nt, hsa
agucuauuuuuguacaaaagagaagcaaaaucuuuuuucuaaaccugugccucccucuccucgg

SEQ ID NO: 657072 - RNA, 64 nt, hsa
agaaguggccugcagaaguuuaauaauuugacuuuuuucuaauauuuuaguuugaaagaaaauu

SEQ ID NO: 657073 - RNA, 64 nt, hsa
uaugccuauuuuaacauuaacuucuaaagaaguuuuuucuaagaaaauguuucaaggcaauauu

SEQ ID NO: 657074 - RNA, 64 nt, hsa
aaacauugauuuuuuuauaucuuucauaauauaauuuucuaacaaugcaauaaaaccacuaaac

SEQ ID NO: 657075 - RNA, 64 nt, hsa
uugcuuuauacauuuauauuaauaaauuguacauuuuucuaauuauuugacauucuuucacaag

SEQ ID NO: 657076 - RNA, 64 nt, hsa
augcuuugauuguucuagaaaguauaguaauuuguuuucuaaggugguucaagcaucuacucuu

SEQ ID NO: 657077 - RNA, 64 nt, hsa
gaggucaaaaauauaauuuauuccucagucaugguuuucuaaauaucuguacuccacauuccau

SEQ ID NO: 657078 - RNA, 64 nt, hsa
ggaagcacuuucagaacuauucacuugccagguauuuucuaaaauuccaccugaaagccaaaag

SEQ ID NO: 657079 - RNA, 64 nt, hsa
agggaaagugauuuaaacuuuauuuaaagagguauuuucuaauuaugcacagauaucuacuuua

SEQ ID NO: 657080 - RNA, 64 nt, hsa
aagacacacccuugggcuuaucuacagagcacacuuuucuaacagugaaucuccuaauuuuagc

SEQ ID NO: 657081 - RNA, 64 nt, hsa
auccuaauugcaguuuagugaaauuacuagauuuuuuucuaaucuucaguauguagugagcauu

SEQ ID NO: 657082 - RNA, 64 nt, hsa
aaagaacagaguggaguggauauauucacuuuuuuuuucuaaaacauacaaagugauaaaauaa

SEQ ID NO: 657083 - RNA, 64 nt, hsa
aaaggauuacgucugcaucuuuucuaacuuacuauuuucuaaaacacuuguggagcaucaagca

SEQ ID NO: 657084 - RNA, 64 nt, hsa
caccaccauccaacaaaaggauuacgucugcaucuuuucuaacuuacuauuuucuaaaacacuu

SEQ ID NO: 657085 - RNA, 64 nt, hsa; identical to SEQ ID NO: 618913

SEQ ID NO: 657086 - RNA, 64 nt, hsa; identical to SEQ ID NO: 618914

SEQ ID NO: 657087 - RNA, 64 nt, hsa; identical to SEQ ID NO: 618915

SEQ ID NO: 657088 - RNA, 64 nt, hsa; identical to SEQ ID NO: 618916

SEQ ID NO: 657089 - RNA, 55 nt, hsa; identical to SEQ ID NO: 618917

SEQ ID NO: 657090 - RNA, 64 nt, hsa; identical to SEQ ID NO: 618918

SEQ ID NO: 657091 - RNA, 64 nt, hsa; identical to SEQ ID NO: 618919

SEQ ID NO: 657092 - RNA, 64 nt, hsa; identical to SEQ ID NO: 618920

SEQ ID NO: 657093 - RNA, 64 nt, hsa; identical to SEQ ID NO: 618921

SEQ ID NO: 657094 - RNA, 64 nt, hsa; identical to SEQ ID NO: 618922

SEQ ID NO: 657095 - RNA, 64 nt, hsa; identical to SEQ ID NO: 618923

SEQ ID NO: 657096 - RNA, 64 nt, hsa; identical to SEQ ID NO: 618924

SEQ ID NO: 657097 - RNA, 64 nt, hsa; identical to SEQ ID NO: 605888

SEQ ID NO: 657098 - RNA, 64 nt, hsa; identical to SEQ ID NO: 605889

SEQ ID NO: 657099 - RNA, 64 nt, hsa; identical to SEQ ID NO: 605890

SEQ ID NO: 657100 - RNA, 64 nt, hsa; identical to SEQ ID NO: 605891

SEQ ID NO: 657101 - RNA, 64 nt, hsa; identical to SEQ ID NO: 605892

SEQ ID NO: 657102 - RNA, 64 nt, hsa; identical to SEQ ID NO: 605893

SEQ ID NO: 657103 - RNA, 64 nt, hsa; identical to SEQ ID NO: 605894

SEQ ID NO: 657104 - RNA, 64 nt, hsa; identical to SEQ ID NO: 605895

SEQ ID NO: 657105 - RNA, 64 nt, hsa; identical to SEQ ID NO: 605896

SEQ ID NO: 657106 - RNA, 64 nt, hsa; identical to SEQ ID NO: 605897

SEQ ID NO: 657107 - RNA, 64 nt, hsa; identical to SEQ ID NO: 605898

SEQ ID NO: 657108 - RNA, 64 nt, hsa; identical to SEQ ID NO: 605899

SEQ ID NO: 657109 - RNA, 64 nt, hsa; identical to SEQ ID NO: 605900

SEQ ID NO: 657110 - RNA, 64 nt, hsa; identical to SEQ ID NO: 605901

SEQ ID NO: 657111 - RNA, 64 nt, hsa; identical to SEQ ID NO: 605902

SEQ ID NO: 657112 - RNA, 64 nt, hsa; identical to SEQ ID NO: 605903

SEQ ID NO: 657113 - RNA, 64 nt, hsa; identical to SEQ ID NO: 605904

SEQ ID NO: 657114 - RNA, 52 nt, hsa; identical to SEQ ID NO: 605905

SEQ ID NO: 657115 - RNA, 64 nt, hsa; identical to SEQ ID NO: 605906

SEQ ID NO: 657116 - RNA, 64 nt, hsa; identical to SEQ ID NO: 605907

SEQ ID NO: 657117 - RNA, 64 nt, hsa; identical to SEQ ID NO: 605908

SEQ ID NO: 657118 - RNA, 64 nt, hsa; identical to SEQ ID NO: 605909

SEQ ID NO: 657119 - RNA, 64 nt, hsa; identical to SEQ ID NO: 605910

SEQ ID NO: 657120 - RNA, 64 nt, hsa; identical to SEQ ID NO: 605911

SEQ ID NO: 657121 - RNA, 64 nt, hsa; identical to SEQ ID NO: 605912

SEQ ID NO: 657122 - RNA, 64 nt, hsa; identical to SEQ ID NO: 605913

SEQ ID NO: 657123 - RNA, 64 nt, hsa; identical to SEQ ID NO: 605914

SEQ ID NO: 657124 - RNA, 64 nt, hsa; identical to SEQ ID NO: 605915

SEQ ID NO: 657125 - RNA, 64 nt, hsa; identical to SEQ ID NO: 605916

SEQ ID NO: 657126 - RNA, 64 nt, hsa; identical to SEQ ID NO: 605917

SEQ ID NO: 657127 - RNA, 64 nt, hsa; identical to SEQ ID NO: 605918

SEQ ID NO: 657128 - RNA, 64 nt, hsa; identical to SEQ ID NO: 605919

SEQ ID NO: 657129 - RNA, 64 nt, hsa; identical to SEQ ID NO: 605920

SEQ ID NO: 657130 - RNA, 64 nt, hsa; identical to SEQ ID NO: 605921

SEQ ID NO: 657131 - RNA, 64 nt, hsa; identical to SEQ ID NO: 605922

SEQ ID NO: 657132 - RNA, 64 nt, hsa; identical to SEQ ID NO: 605923

SEQ ID NO: 657133 - RNA, 64 nt, hsa; identical to SEQ ID NO: 605924

SEQ ID NO: 657134 - RNA, 64 nt, hsa; identical to SEQ ID NO: 605925

SEQ ID NO: 657135 - RNA, 64 nt, hsa; identical to SEQ ID NO: 605926

SEQ ID NO: 657136 - RNA, 64 nt, hsa; identical to SEQ ID NO: 605927

SEQ ID NO: 657137 - RNA, 64 nt, hsa; identical to SEQ ID NO: 605928

SEQ ID NO: 657138 - RNA, 64 nt, hsa; identical to SEQ ID NO: 605929

SEQ ID NO: 657139 - RNA, 64 nt, hsa; identical to SEQ ID NO: 605930

SEQ ID NO: 657140 - RNA, 64 nt, hsa; identical to SEQ ID NO: 605931

SEQ ID NO: 657141 - RNA, 64 nt, hsa; identical to SEQ ID NO: 605932

SEQ ID NO: 657142 - RNA, 64 nt, hsa; identical to SEQ ID NO: 605933

SEQ ID NO: 657143 - RNA, 64 nt, hsa; identical to SEQ ID NO: 605934

SEQ ID NO: 657144 - RNA, 64 nt, hsa; identical to SEQ ID NO: 605935

SEQ ID NO: 657145 - RNA, 64 nt, hsa; identical to SEQ ID NO: 605936

SEQ ID NO: 657146 - RNA, 64 nt, hsa; identical to SEQ ID NO: 605937

SEQ ID NO: 657147 - RNA, 64 nt, hsa; identical to SEQ ID NO: 605938

SEQ ID NO: 657148 - RNA, 64 nt, hsa; identical to SEQ ID NO: 605939

SEQ ID NO: 657149 - RNA, 64 nt, hsa; identical to SEQ ID NO: 605940

SEQ ID NO: 657150 - RNA, 64 nt, hsa; identical to SEQ ID NO: 605941

SEQ ID NO: 657151 - RNA, 64 nt, hsa; identical to SEQ ID NO: 605942

SEQ ID NO: 657152 - RNA, 64 nt, hsa; identical to SEQ ID NO: 605943

SEQ ID NO: 657153 - RNA, 64 nt, hsa; identical to SEQ ID NO: 605944

SEQ ID NO: 657154 - RNA, 64 nt, hsa; identical to SEQ ID NO: 605945

SEQ ID NO: 657155 - RNA, 64 nt, hsa; identical to SEQ ID NO: 605946

SEQ ID NO: 657156 - RNA, 64 nt, hsa; identical to SEQ ID NO: 605947

SEQ ID NO: 657157 - RNA, 64 nt, hsa; identical to SEQ ID NO: 605948

SEQ ID NO: 657158 - RNA, 64 nt, hsa; identical to SEQ ID NO: 605949

SEQ ID NO: 657159 - RNA, 64 nt, hsa; identical to SEQ ID NO: 605950

SEQ ID NO: 657160 - RNA, 64 nt, hsa; identical to SEQ ID NO: 605951

SEQ ID NO: 657161 - RNA, 64 nt, hsa; identical to SEQ ID NO: 605952

SEQ ID NO: 657162 - RNA, 64 nt, hsa; identical to SEQ ID NO: 605953

SEQ ID NO: 657163 - RNA, 64 nt, hsa; identical to SEQ ID NO: 605954

SEQ ID NO: 657164 - RNA, 64 nt, hsa; identical to SEQ ID NO: 605955

SEQ ID NO: 657165 - RNA, 64 nt, hsa; identical to SEQ ID NO: 605956

SEQ ID NO: 657166 - RNA, 64 nt, hsa; identical to SEQ ID NO: 605957

SEQ ID NO: 657167 - RNA, 64 nt, hsa; identical to SEQ ID NO: 605958

SEQ ID NO: 657168 - RNA, 64 nt, hsa; identical to SEQ ID NO: 605959

SEQ ID NO: 657169 - RNA, 64 nt, hsa; identical to SEQ ID NO: 605960

SEQ ID NO: 657170 - RNA, 64 nt, hsa; identical to SEQ ID NO: 605961

SEQ ID NO: 657171 - RNA, 64 nt, hsa; identical to SEQ ID NO: 605962

SEQ ID NO: 657172 - RNA, 64 nt, hsa; identical to SEQ ID NO: 605963

SEQ ID NO: 657173 - RNA, 64 nt, hsa; identical to SEQ ID NO: 605964

SEQ ID NO: 657174 - RNA, 64 nt, hsa; identical to SEQ ID NO: 605965

SEQ ID NO: 657175 - RNA, 64 nt, hsa; identical to SEQ ID NO: 605966

SEQ ID NO: 657176 - RNA, 64 nt, hsa; identical to SEQ ID NO: 605967

SEQ ID NO: 657177 - RNA, 64 nt, hsa; identical to SEQ ID NO: 605968

SEQ ID NO: 657178 - RNA, 64 nt, hsa; identical to SEQ ID NO: 605969

SEQ ID NO: 657179 - RNA, 64 nt, hsa; identical to SEQ ID NO: 605970

SEQ ID NO: 657180 - RNA, 64 nt, hsa; identical to SEQ ID NO: 605971

SEQ ID NO: 657181 - RNA, 64 nt, hsa; identical to SEQ ID NO: 605972

SEQ ID NO: 657182 - RNA, 64 nt, hsa; identical to SEQ ID NO: 605973

SEQ ID NO: 657183 - RNA, 64 nt, hsa; identical to SEQ ID NO: 605974

SEQ ID NO: 657184 - RNA, 64 nt, hsa; identical to SEQ ID NO: 605975

SEQ ID NO: 657185 - RNA, 64 nt, hsa; identical to SEQ ID NO: 605976

SEQ ID NO: 657186 - RNA, 64 nt, hsa; identical to SEQ ID NO: 605977

SEQ ID NO: 657187 - RNA, 64 nt, hsa; identical to SEQ ID NO: 605978

SEQ ID NO: 657188 - RNA, 64 nt, hsa; identical to SEQ ID NO: 605979

SEQ ID NO: 657189 - RNA, 64 nt, hsa; identical to SEQ ID NO: 605980

SEQ ID NO: 657190 - RNA, 64 nt, hsa; identical to SEQ ID NO: 605981

SEQ ID NO: 657191 - RNA, 64 nt, hsa; identical to SEQ ID NO: 605982

SEQ ID NO: 657192 - RNA, 64 nt, hsa; identical to SEQ ID NO: 605983

SEQ ID NO: 657193 - RNA, 64 nt, hsa; identical to SEQ ID NO: 605984

SEQ ID NO: 657194 - RNA, 64 nt, hsa; identical to SEQ ID NO: 605985

SEQ ID NO: 657195 - RNA, 64 nt, hsa; identical to SEQ ID NO: 605986

SEQ ID NO: 657196 - RNA, 64 nt, hsa; identical to SEQ ID NO: 605987

SEQ ID NO: 657197 - RNA, 64 nt, hsa; identical to SEQ ID NO: 605988

SEQ ID NO: 657198 - RNA, 64 nt, hsa; identical to SEQ ID NO: 605989

SEQ ID NO: 657199 - RNA, 64 nt, hsa; identical to SEQ ID NO: 605990

SEQ ID NO: 657200 - RNA, 64 nt, hsa; identical to SEQ ID NO: 605991

SEQ ID NO: 657201 - RNA, 64 nt, hsa; identical to SEQ ID NO: 605992

SEQ ID NO: 657202 - RNA, 64 nt, hsa; identical to SEQ ID NO: 605993

SEQ ID NO: 657203 - RNA, 64 nt, hsa; identical to SEQ ID NO: 605994

SEQ ID NO: 657204 - RNA, 64 nt, hsa; identical to SEQ ID NO: 605995

SEQ ID NO: 657205 - RNA, 64 nt, hsa; identical to SEQ ID NO: 605996

SEQ ID NO: 657206 - RNA, 64 nt, hsa; identical to SEQ ID NO: 605997

SEQ ID NO: 657207 - RNA, 64 nt, hsa; identical to SEQ ID NO: 605998

SEQ ID NO: 657208 - RNA, 64 nt, hsa; identical to SEQ ID NO: 605999

SEQ ID NO: 657209 - RNA, 64 nt, hsa; identical to SEQ ID NO: 606000

SEQ ID NO: 657210 - RNA, 64 nt, hsa; identical to SEQ ID NO: 606001

SEQ ID NO: 657211 - RNA, 64 nt, hsa; identical to SEQ ID NO: 606002

SEQ ID NO: 657212 - RNA, 64 nt, hsa; identical to SEQ ID NO: 606003

SEQ ID NO: 657213 - RNA, 64 nt, hsa; identical to SEQ ID NO: 606004

SEQ ID NO: 657214 - RNA, 64 nt, hsa; identical to SEQ ID NO: 606005

SEQ ID NO: 657215 - RNA, 64 nt, hsa; identical to SEQ ID NO: 606006

SEQ ID NO: 657216 - RNA, 64 nt, hsa; identical to SEQ ID NO: 606007

SEQ ID NO: 657217 - RNA, 64 nt, hsa; identical to SEQ ID NO: 606008

SEQ ID NO: 657218 - RNA, 64 nt, hsa; identical to SEQ ID NO: 606009

SEQ ID NO: 657219 - RNA, 64 nt, hsa; identical to SEQ ID NO: 606010

SEQ ID NO: 657220 - RNA, 64 nt, hsa; identical to SEQ ID NO: 606011

SEQ ID NO: 657221 - RNA, 64 nt, hsa; identical to SEQ ID NO: 606012

SEQ ID NO: 657222 - RNA, 64 nt, hsa; identical to SEQ ID NO: 606013

SEQ ID NO: 657223 - RNA, 64 nt, hsa; identical to SEQ ID NO: 606014

SEQ ID NO: 657224 - RNA, 56 nt, hsa; identical to SEQ ID NO: 606015

SEQ ID NO: 657225 - RNA, 64 nt, hsa; identical to SEQ ID NO: 606016

SEQ ID NO: 657226 - RNA, 64 nt, hsa; identical to SEQ ID NO: 606017

SEQ ID NO: 657227 - RNA, 64 nt, hsa; identical to SEQ ID NO: 606018

SEQ ID NO: 657228 - RNA, 64 nt, hsa; identical to SEQ ID NO: 606019

SEQ ID NO: 657229 - RNA, 64 nt, hsa; identical to SEQ ID NO: 606020

SEQ ID NO: 657230 - RNA, 64 nt, hsa; identical to SEQ ID NO: 606021

SEQ ID NO: 657231 - RNA, 64 nt, hsa; identical to SEQ ID NO: 606022

SEQ ID NO: 657232 - RNA, 64 nt, hsa; identical to SEQ ID NO: 606023

SEQ ID NO: 657233 - RNA, 64 nt, hsa; identical to SEQ ID NO: 606024

SEQ ID NO: 657234 - RNA, 64 nt, hsa; identical to SEQ ID NO: 606025

SEQ ID NO: 657235 - RNA, 64 nt, hsa; identical to SEQ ID NO: 52236

SEQ ID NO: 657236 - RNA, 64 nt, hsa; identical to SEQ ID NO: 52237

SEQ ID NO: 657237 - RNA, 64 nt, hsa; identical to SEQ ID NO: 52238

SEQ ID NO: 657238 - RNA, 64 nt, hsa; identical to SEQ ID NO: 52239

SEQ ID NO: 657239 - RNA, 64 nt, hsa; identical to SEQ ID NO: 52240

SEQ ID NO: 657240 - RNA, 64 nt, hsa; identical to SEQ ID NO: 52241

SEQ ID NO: 657241 - RNA, 64 nt, hsa; identical to SEQ ID NO: 52242

SEQ ID NO: 657242 - RNA, 64 nt, hsa; identical to SEQ ID NO: 52243

SEQ ID NO: 657243 - RNA, 64 nt, hsa; identical to SEQ ID NO: 52244

SEQ ID NO: 657244 - RNA, 64 nt, hsa; identical to SEQ ID NO: 52245

SEQ ID NO: 657245 - RNA, 64 nt, hsa; identical to SEQ ID NO: 52246

SEQ ID NO: 657246 - RNA, 64 nt, hsa; identical to SEQ ID NO: 52247

SEQ ID NO: 657247 - RNA, 64 nt, hsa; identical to SEQ ID NO: 52248

SEQ ID NO: 657248 - RNA, 64 nt, hsa; identical to SEQ ID NO: 52249

SEQ ID NO: 657249 - RNA, 64 nt, hsa; identical to SEQ ID NO: 52250

SEQ ID NO: 657250 - RNA, 64 nt, hsa; identical to SEQ ID NO: 52251

SEQ ID NO: 657251 - RNA, 64 nt, hsa; identical to SEQ ID NO: 52252

SEQ ID NO: 657252 - RNA, 64 nt, hsa; identical to SEQ ID NO: 52253

SEQ ID NO: 657253 - RNA, 64 nt, hsa; identical to SEQ ID NO: 52254

SEQ ID NO: 657254 - RNA, 64 nt, hsa; identical to SEQ ID NO: 52255

SEQ ID NO: 657255 - RNA, 64 nt, hsa; identical to SEQ ID NO: 60066

SEQ ID NO: 657256 - RNA, 64 nt, hsa; identical to SEQ ID NO: 60067

SEQ ID NO: 657257 - RNA, 64 nt, hsa; identical to SEQ ID NO: 60068

SEQ ID NO: 657258 - RNA, 64 nt, hsa; identical to SEQ ID NO: 60069

SEQ ID NO: 657259 - RNA, 64 nt, hsa; identical to SEQ ID NO: 60070

SEQ ID NO: 657260 - RNA, 64 nt, hsa; identical to SEQ ID NO: 60071

SEQ ID NO: 657261 - RNA, 64 nt, hsa; identical to SEQ ID NO: 60072

SEQ ID NO: 657262 - RNA, 64 nt, hsa; identical to SEQ ID NO: 60073

SEQ ID NO: 657263 - RNA, 64 nt, hsa; identical to SEQ ID NO: 60074

SEQ ID NO: 657264 - RNA, 64 nt, hsa; identical to SEQ ID NO: 60075

SEQ ID NO: 657265 - RNA, 64 nt, hsa; identical to SEQ ID NO: 60076

SEQ ID NO: 657266 - RNA, 64 nt, hsa; identical to SEQ ID NO: 115740

SEQ ID NO: 657267 - RNA, 64 nt, hsa; identical to SEQ ID NO: 115741

SEQ ID NO: 657268 - RNA, 64 nt, hsa; identical to SEQ ID NO: 115742

SEQ ID NO: 657269 - RNA, 64 nt, hsa; identical to SEQ ID NO: 115743

SEQ ID NO: 657270 - RNA, 64 nt, hsa; identical to SEQ ID NO: 115744

SEQ ID NO: 657271 - RNA, 64 nt, hsa; identical to SEQ ID NO: 115745

SEQ ID NO: 657272 - RNA, 64 nt, hsa; identical to SEQ ID NO: 115746

SEQ ID NO: 657273 - RNA, 64 nt, hsa; identical to SEQ ID NO: 115747

SEQ ID NO: 657274 - RNA, 64 nt, hsa; identical to SEQ ID NO: 115748

SEQ ID NO: 657275 - RNA, 64 nt, hsa; identical to SEQ ID NO: 115749

SEQ ID NO: 657276 - RNA, 64 nt, hsa; identical to SEQ ID NO: 115750

SEQ ID NO: 657277 - RNA, 64 nt, hsa; identical to SEQ ID NO: 115751

SEQ ID NO: 657278 - RNA, 64 nt, hsa; identical to SEQ ID NO: 115752

SEQ ID NO: 657279 - RNA, 64 nt, hsa; identical to SEQ ID NO: 115753

SEQ ID NO: 657280 - RNA, 64 nt, hsa; identical to SEQ ID NO: 115754

SEQ ID NO: 657281 - RNA, 64 nt, hsa; identical to SEQ ID NO: 115755

SEQ ID NO: 657282 - RNA, 64 nt, hsa; identical to SEQ ID NO: 115756

SEQ ID NO: 657283 - RNA, 64 nt, hsa; identical to SEQ ID NO: 115757

SEQ ID NO: 657284 - RNA, 64 nt, hsa; identical to SEQ ID NO: 115758

SEQ ID NO: 657285 - RNA, 64 nt, hsa; identical to SEQ ID NO: 115759

SEQ ID NO: 657286 - RNA, 64 nt, hsa; identical to SEQ ID NO: 115760

SEQ ID NO: 657287 - RNA, 64 nt, hsa; identical to SEQ ID NO: 115761

SEQ ID NO: 657288 - RNA, 64 nt, hsa; identical to SEQ ID NO: 115762

SEQ ID NO: 657289 - RNA, 64 nt, hsa; identical to SEQ ID NO: 115763

SEQ ID NO: 657290 - RNA, 64 nt, hsa; identical to SEQ ID NO: 115764

SEQ ID NO: 657291 - RNA, 64 nt, hsa; identical to SEQ ID NO: 115765

SEQ ID NO: 657292 - RNA, 64 nt, hsa; identical to SEQ ID NO: 115766

SEQ ID NO: 657293 - RNA, 64 nt, hsa; identical to SEQ ID NO: 115767

SEQ ID NO: 657294 - RNA, 64 nt, hsa; identical to SEQ ID NO: 115768

SEQ ID NO: 657295 - RNA, 64 nt, hsa; identical to SEQ ID NO: 115769

SEQ ID NO: 657296 - RNA, 64 nt, hsa; identical to SEQ ID NO: 115770

SEQ ID NO: 657297 - RNA, 64 nt, hsa; identical to SEQ ID NO: 115771

SEQ ID NO: 657298 - RNA, 64 nt, hsa; identical to SEQ ID NO: 115772

SEQ ID NO: 657299 - RNA, 64 nt, hsa; identical to SEQ ID NO: 115773

SEQ ID NO: 657300 - RNA, 64 nt, hsa; identical to SEQ ID NO: 115774

SEQ ID NO: 657301 - RNA, 64 nt, hsa; identical to SEQ ID NO: 115775

SEQ ID NO: 657302 - RNA, 64 nt, hsa; identical to SEQ ID NO: 115776

SEQ ID NO: 657303 - RNA, 64 nt, hsa; identical to SEQ ID NO: 115777

SEQ ID NO: 657304 - RNA, 64 nt, hsa; identical to SEQ ID NO: 336816

SEQ ID NO: 657305 - RNA, 64 nt, hsa; identical to SEQ ID NO: 336817

SEQ ID NO: 657306 - RNA, 64 nt, hsa; identical to SEQ ID NO: 336818

SEQ ID NO: 657307 - RNA, 64 nt, hsa; identical to SEQ ID NO: 336819

SEQ ID NO: 657308 - RNA, 64 nt, hsa; identical to SEQ ID NO: 336820

SEQ ID NO: 657309 - RNA, 64 nt, hsa; identical to SEQ ID NO: 336821

SEQ ID NO: 657310 - RNA, 64 nt, hsa; identical to SEQ ID NO: 336822

SEQ ID NO: 657311 - RNA, 64 nt, hsa; identical to SEQ ID NO: 336823

SEQ ID NO: 657312 - RNA, 64 nt, hsa; identical to SEQ ID NO: 336824

SEQ ID NO: 657313 - RNA, 64 nt, hsa; identical to SEQ ID NO: 336825

SEQ ID NO: 657314 - RNA, 64 nt, hsa; identical to SEQ ID NO: 336826

SEQ ID NO: 657315 - RNA, 64 nt, hsa; identical to SEQ ID NO: 336827

SEQ ID NO: 657316 - RNA, 64 nt, hsa; identical to SEQ ID NO: 336828

SEQ ID NO: 657317 - RNA, 64 nt, hsa; identical to SEQ ID NO: 336829

SEQ ID NO: 657318 - RNA, 61 nt, hsa; identical to SEQ ID NO: 336830

SEQ ID NO: 657319 - RNA, 64 nt, hsa; identical to SEQ ID NO: 336831

SEQ ID NO: 657320 - RNA, 64 nt, hsa; identical to SEQ ID NO: 336832

SEQ ID NO: 657321 - RNA, 64 nt, hsa; identical to SEQ ID NO: 336833

SEQ ID NO: 657322 - RNA, 64 nt, hsa; identical to SEQ ID NO: 336834

SEQ ID NO: 657323 - RNA, 62 nt, hsa
gggcccuggagcugcuggggccaagccaaggccuccccuaccucaaaccccagcugggcccg

SEQ ID NO: 657324 - RNA, 55 nt, hsa; identical to SEQ ID NO: 21545

SEQ ID NO: 657325 - RNA, 62 nt, hsa
aaacuucauuacuuuccuuaggcccucugccccuccccuagcauauggcucuuucuccuauu

SEQ ID NO: 657326 - RNA, 62 nt, hsa
uuuaucauuucagcuacacauaaaagguuucucuccccuauggauuuugcuaaugguugagu

SEQ ID NO: 657327 - RNA, 62 nt, hsa
gaggcccuacccgugucuaaacccuccucucacuccccuaagccuggugaaagagucagaag

SEQ ID NO: 657328 - RNA, 62 nt, hsa
acuucaucuucuuggugucucauguccucauucuccccuauaugacaugcaaaaacgaucuu

SEQ ID NO: 657329 - RNA, 62 nt, hsa
gguuggguguccauggugcccugggcuguguccuccccuagggaugagggucgggccuccac

SEQ ID NO: 657330 - RNA, 62 nt, hsa
gguuggauguccaagaugcccugggcuguguacuccccuaggaaugagggcuggguguccaa

SEQ ID NO: 657331 - RNA, 62 nt, hsa
uuugcacaaugaaguuucagcuucucaaccuucuccccuacccagggcuguggacccagacu

SEQ ID NO: 657332 - RNA, 62 nt, hsa
auagucugggaacauggucaagguggaaggggcuccccuagagaggguggggguguaguuac

SEQ ID NO: 657333 - RNA, 62 nt, hsa
aguccauccuguacaucucaagcaagggguuccuccccuagcaccugggcuuggcagaaggg

SEQ ID NO: 657334 - RNA, 62 nt, hsa
gcuuggcagaagggccauaguucauccagcuccuccccuagagcaaugcugaggagcggggg

SEQ ID NO: 657335 - RNA, 62 nt, hsa
caagugggucaggccuggcccagguccuuauacuccccuaucuuguccuagcccaggccucc

SEQ ID NO: 657336 - RNA, 62 nt, hsa
uggcauugccccagagcucuccagagaugagccuccccuauccccacccuguccccgucccc

SEQ ID NO: 657337 - RNA, 62 nt, hsa
gcccccaggagcugggagaggcaggaaggauccuccccuagagccuccagggggaacuggag

SEQ ID NO: 657338 - RNA, 62 nt, hsa
guccccaggagcugggagaggcaggaaggacccuccccuagagucucuggagggaacuggau

SEQ ID NO: 657339 - RNA, 64 nt, hsa
uaaacuaaacuaaugugaacaguagggaagcaagggcccaaaugcauaaguuucuuugcacugu

SEQ ID NO: 657340 - RNA, 64 nt, hsa
gaacaacaggauagagcuguugggguggcacaguggcccaaagagcagcuucagagauaauucc

SEQ ID NO: 657341 - RNA, 64 nt, hsa
gaugcguuaaaaugacaugagcaggcgacucaguggcccaaaacaggacccagaacauucaucc

SEQ ID NO: 657342 - RNA, 64 nt, hsa
aacauucauccguaaauggaaucugauaaucuggggcccaaauucuguuuacuuaacaugugag

SEQ ID NO: 657343 - RNA, 64 nt, hsa
gccccaagcugccuuccucgauguggcccaaaguggcccaaagcgucccaaaguaggccucgcc

SEQ ID NO: 657344 - RNA, 64 nt, hsa
gcgccucccggccccaagcugccuuccucgauguggcccaaaguggcccaaagcgucccaaagu

SEQ ID NO: 657345 - RNA, 64 nt, hsa
gauaagauguaguucauguuuuucuguagcacugggcccaaauauucuuuguaaagaaaaucgc

SEQ ID NO: 657346 - RNA, 64 nt, hsa
agugcugggauuacaggcgugagccaccaugcccggcccaaauauuuuuuauucaggaugguau

SEQ ID NO: 657347 - RNA, 64 nt, hsa; identical to SEQ ID NO: 553500

SEQ ID NO: 657348 - RNA, 64 nt, hsa; identical to SEQ ID NO: 553501

SEQ ID NO: 657349 - RNA, 64 nt, hsa; identical to SEQ ID NO: 553502

SEQ ID NO: 657350 - RNA, 64 nt, hsa; identical to SEQ ID NO: 553503

SEQ ID NO: 657351 - RNA, 64 nt, hsa; identical to SEQ ID NO: 553504

SEQ ID NO: 657352 - RNA, 64 nt, hsa; identical to SEQ ID NO: 553505

SEQ ID NO: 657353 - RNA, 64 nt, hsa; identical to SEQ ID NO: 553506

SEQ ID NO: 657354 - RNA, 64 nt, hsa; identical to SEQ ID NO: 553507

SEQ ID NO: 657355 - RNA, 64 nt, hsa; identical to SEQ ID NO: 553508

SEQ ID NO: 657356 - RNA, 64 nt, hsa; identical to SEQ ID NO: 553509

SEQ ID NO: 657357 - RNA, 64 nt, hsa; identical to SEQ ID NO: 553510

SEQ ID NO: 657358 - RNA, 64 nt, hsa; identical to SEQ ID NO: 553511

SEQ ID NO: 657359 - RNA, 64 nt, hsa; identical to SEQ ID NO: 553512

SEQ ID NO: 657360 - RNA, 64 nt, hsa; identical to SEQ ID NO: 553513

SEQ ID NO: 657361 - RNA, 64 nt, hsa; identical to SEQ ID NO: 553514

SEQ ID NO: 657362 - RNA, 64 nt, hsa; identical to SEQ ID NO: 553515

SEQ ID NO: 657363 - RNA, 64 nt, hsa; identical to SEQ ID NO: 553516

SEQ ID NO: 657364 - RNA, 64 nt, hsa; identical to SEQ ID NO: 553517

SEQ ID NO: 657365 - RNA, 64 nt, hsa; identical to SEQ ID NO: 553518

SEQ ID NO: 657366 - RNA, 64 nt, hsa; identical to SEQ ID NO: 553519

SEQ ID NO: 657367 - RNA, 64 nt, hsa; identical to SEQ ID NO: 553520

SEQ ID NO: 657368 - RNA, 64 nt, hsa; identical to SEQ ID NO: 553521

SEQ ID NO: 657369 - RNA, 64 nt, hsa; identical to SEQ ID NO: 553522

SEQ ID NO: 657370 - RNA, 64 nt, hsa; identical to SEQ ID NO: 553523

SEQ ID NO: 657371 - RNA, 64 nt, hsa; identical to SEQ ID NO: 553524

SEQ ID NO: 657372 - RNA, 64 nt, hsa; identical to SEQ ID NO: 553525

SEQ ID NO: 657373 - RNA, 64 nt, hsa; identical to SEQ ID NO: 553526

SEQ ID NO: 657374 - RNA, 64 nt, hsa; identical to SEQ ID NO: 553527

SEQ ID NO: 657375 - RNA, 64 nt, hsa; identical to SEQ ID NO: 553528

SEQ ID NO: 657376 - RNA, 64 nt, hsa; identical to SEQ ID NO: 553529

SEQ ID NO: 657377 - RNA, 64 nt, hsa; identical to SEQ ID NO: 553530

SEQ ID NO: 657378 - RNA, 64 nt, hsa; identical to SEQ ID NO: 553531

SEQ ID NO: 657379 - RNA, 64 nt, hsa; identical to SEQ ID NO: 553532

SEQ ID NO: 657380 - RNA, 64 nt, hsa; identical to SEQ ID NO: 553533

SEQ ID NO: 657381 - RNA, 64 nt, hsa; identical to SEQ ID NO: 553534

SEQ ID NO: 657382 - RNA, 64 nt, hsa; identical to SEQ ID NO: 553535

SEQ ID NO: 657383 - RNA, 64 nt, hsa; identical to SEQ ID NO: 553536

SEQ ID NO: 657384 - RNA, 64 nt, hsa; identical to SEQ ID NO: 553537

SEQ ID NO: 657385 - RNA, 64 nt, hsa; identical to SEQ ID NO: 553538

SEQ ID NO: 657386 - RNA, 64 nt, hsa; identical to SEQ ID NO: 553539

SEQ ID NO: 657387 - RNA, 64 nt, hsa; identical to SEQ ID NO: 553540

SEQ ID NO: 657388 - RNA, 64 nt, hsa; identical to SEQ ID NO: 553541

SEQ ID NO: 657389 - RNA, 64 nt, hsa; identical to SEQ ID NO: 236284

SEQ ID NO: 657390 - RNA, 64 nt, hsa; identical to SEQ ID NO: 236285

SEQ ID NO: 657391 - RNA, 64 nt, hsa; identical to SEQ ID NO: 236286

SEQ ID NO: 657392 - RNA, 64 nt, hsa; identical to SEQ ID NO: 236287

SEQ ID NO: 657393 - RNA, 64 nt, hsa; identical to SEQ ID NO: 236288

SEQ ID NO: 657394 - RNA, 64 nt, hsa; identical to SEQ ID NO: 236289

SEQ ID NO: 657395 - RNA, 64 nt, hsa; identical to SEQ ID NO: 184094

SEQ ID NO: 657396 - RNA, 64 nt, hsa; identical to SEQ ID NO: 184095

SEQ ID NO: 657397 - RNA, 64 nt, hsa; identical to SEQ ID NO: 184096

SEQ ID NO: 657398 - RNA, 64 nt, hsa; identical to SEQ ID NO: 184097

SEQ ID NO: 657399 - RNA, 64 nt, hsa; identical to SEQ ID NO: 184098

SEQ ID NO: 657400 - RNA, 64 nt, hsa; identical to SEQ ID NO: 184099

SEQ ID NO: 657401 - RNA, 64 nt, hsa; identical to SEQ ID NO: 184100

SEQ ID NO: 657402 - RNA, 64 nt, hsa; identical to SEQ ID NO: 184101

SEQ ID NO: 657403 - RNA, 64 nt, hsa; identical to SEQ ID NO: 184102

SEQ ID NO: 657404 - RNA, 64 nt, hsa; identical to SEQ ID NO: 184103

SEQ ID NO: 657405 - RNA, 64 nt, hsa; identical to SEQ ID NO: 184104

SEQ ID NO: 657406 - RNA, 64 nt, hsa; identical to SEQ ID NO: 184105

SEQ ID NO: 657407 - RNA, 64 nt, hsa; identical to SEQ ID NO: 184106

SEQ ID NO: 657408 - RNA, 64 nt, hsa; identical to SEQ ID NO: 184107

SEQ ID NO: 657409 - RNA, 64 nt, hsa; identical to SEQ ID NO: 184108

SEQ ID NO: 657410 - RNA, 64 nt, hsa; identical to SEQ ID NO: 184109

SEQ ID NO: 657411 - RNA, 64 nt, hsa; identical to SEQ ID NO: 184110

SEQ ID NO: 657412 - RNA, 64 nt, hsa; identical to SEQ ID NO: 184111

SEQ ID NO: 657413 - RNA, 64 nt, hsa; identical to SEQ ID NO: 184112

SEQ ID NO: 657414 - RNA, 64 nt, hsa; identical to SEQ ID NO: 184113

SEQ ID NO: 657415 - RNA, 64 nt, hsa; identical to SEQ ID NO: 184114

SEQ ID NO: 657416 - RNA, 64 nt, hsa; identical to SEQ ID NO: 184115

SEQ ID NO: 657417 - RNA, 64 nt, hsa; identical to SEQ ID NO: 184116

SEQ ID NO: 657418 - RNA, 64 nt, hsa; identical to SEQ ID NO: 184117

SEQ ID NO: 657419 - RNA, 64 nt, hsa; identical to SEQ ID NO: 184118

SEQ ID NO: 657420 - RNA, 64 nt, hsa; identical to SEQ ID NO: 184119

SEQ ID NO: 657421 - RNA, 64 nt, hsa; identical to SEQ ID NO: 184120

SEQ ID NO: 657422 - RNA, 64 nt, hsa; identical to SEQ ID NO: 184121

SEQ ID NO: 657423 - RNA, 64 nt, hsa; identical to SEQ ID NO: 140386

SEQ ID NO: 657424 - RNA, 64 nt, hsa; identical to SEQ ID NO: 140387

SEQ ID NO: 657425 - RNA, 64 nt, hsa; identical to SEQ ID NO: 140388

SEQ ID NO: 657426 - RNA, 64 nt, hsa; identical to SEQ ID NO: 140389

SEQ ID NO: 657427 - RNA, 64 nt, hsa; identical to SEQ ID NO: 140390

SEQ ID NO: 657428 - RNA, 64 nt, hsa; identical to SEQ ID NO: 140391

SEQ ID NO: 657429 - RNA, 64 nt, hsa; identical to SEQ ID NO: 140392

SEQ ID NO: 657430 - RNA, 64 nt, hsa; identical to SEQ ID NO: 140393

SEQ ID NO: 657431 - RNA, 64 nt, hsa; identical to SEQ ID NO: 140394

SEQ ID NO: 657432 - RNA, 64 nt, hsa; identical to SEQ ID NO: 140395

SEQ ID NO: 657433 - RNA, 64 nt, hsa; identical to SEQ ID NO: 140396

SEQ ID NO: 657434 - RNA, 64 nt, hsa; identical to SEQ ID NO: 140397

SEQ ID NO: 657435 - RNA, 64 nt, hsa; identical to SEQ ID NO: 140398

SEQ ID NO: 657436 - RNA, 64 nt, hsa; identical to SEQ ID NO: 140399

SEQ ID NO: 657437 - RNA, 64 nt, hsa; identical to SEQ ID NO: 140400

SEQ ID NO: 657438 - RNA, 64 nt, hsa; identical to SEQ ID NO: 140401

SEQ ID NO: 657439 - RNA, 64 nt, hsa; identical to SEQ ID NO: 140402

SEQ ID NO: 657440 - RNA, 64 nt, hsa; identical to SEQ ID NO: 140403

SEQ ID NO: 657441 - RNA, 64 nt, hsa; identical to SEQ ID NO: 140404

SEQ ID NO: 657442 - RNA, 64 nt, hsa; identical to SEQ ID NO: 140405

SEQ ID NO: 657443 - RNA, 64 nt, hsa; identical to SEQ ID NO: 140406

SEQ ID NO: 657444 - RNA, 64 nt, hsa; identical to SEQ ID NO: 140407

SEQ ID NO: 657445 - RNA, 64 nt, hsa; identical to SEQ ID NO: 140408

SEQ ID NO: 657446 - RNA, 64 nt, hsa; identical to SEQ ID NO: 140409

SEQ ID NO: 657447 - RNA, 64 nt, hsa; identical to SEQ ID NO: 140410

SEQ ID NO: 657448 - RNA, 64 nt, hsa; identical to SEQ ID NO: 140411

SEQ ID NO: 657449 - RNA, 64 nt, hsa; identical to SEQ ID NO: 140412

SEQ ID NO: 657450 - RNA, 64 nt, hsa; identical to SEQ ID NO: 140413

SEQ ID NO: 657451 - RNA, 64 nt, hsa; identical to SEQ ID NO: 140414

SEQ ID NO: 657452 - RNA, 64 nt, hsa; identical to SEQ ID NO: 140415

SEQ ID NO: 657453 - RNA, 64 nt, hsa; identical to SEQ ID NO: 140416

SEQ ID NO: 657454 - RNA, 64 nt, hsa; identical to SEQ ID NO: 140417

SEQ ID NO: 657455 - RNA, 64 nt, hsa; identical to SEQ ID NO: 140418

SEQ ID NO: 657456 - RNA, 64 nt, hsa; identical to SEQ ID NO: 140419

SEQ ID NO: 657457 - RNA, 64 nt, hsa; identical to SEQ ID NO: 140420

SEQ ID NO: 657458 - RNA, 64 nt, hsa; identical to SEQ ID NO: 140421

SEQ ID NO: 657459 - RNA, 64 nt, hsa; identical to SEQ ID NO: 140422

SEQ ID NO: 657460 - RNA, 64 nt, hsa; identical to SEQ ID NO: 140423

SEQ ID NO: 657461 - RNA, 64 nt, hsa; identical to SEQ ID NO: 140424

SEQ ID NO: 657462 - RNA, 64 nt, hsa; identical to SEQ ID NO: 140425

SEQ ID NO: 657463 - RNA, 64 nt, hsa; identical to SEQ ID NO: 140426

SEQ ID NO: 657464 - RNA, 64 nt, hsa; identical to SEQ ID NO: 140427

SEQ ID NO: 657465 - RNA, 64 nt, hsa; identical to SEQ ID NO: 140428

SEQ ID NO: 657466 - RNA, 64 nt, hsa; identical to SEQ ID NO: 140429

SEQ ID NO: 657467 - RNA, 63 nt, hsa; identical to SEQ ID NO: 140430

SEQ ID NO: 657468 - RNA, 64 nt, hsa; identical to SEQ ID NO: 140431

SEQ ID NO: 657469 - RNA, 64 nt, hsa; identical to SEQ ID NO: 140432

SEQ ID NO: 657470 - RNA, 64 nt, hsa; identical to SEQ ID NO: 140433

SEQ ID NO: 657471 - RNA, 64 nt, hsa; identical to SEQ ID NO: 140434

SEQ ID NO: 657472 - RNA, 52 nt, hsa; identical to SEQ ID NO: 140435

SEQ ID NO: 657473 - RNA, 64 nt, hsa; identical to SEQ ID NO: 140436

SEQ ID NO: 657474 - RNA, 64 nt, hsa; identical to SEQ ID NO: 140437

SEQ ID NO: 657475 - RNA, 64 nt, hsa; identical to SEQ ID NO: 140438

SEQ ID NO: 657476 - RNA, 64 nt, hsa; identical to SEQ ID NO: 140439

SEQ ID NO: 657477 - RNA, 64 nt, hsa; identical to SEQ ID NO: 140440

SEQ ID NO: 657478 - RNA, 64 nt, hsa; identical to SEQ ID NO: 140441

SEQ ID NO: 657479 - RNA, 64 nt, hsa; identical to SEQ ID NO: 140442

SEQ ID NO: 657480 - RNA, 64 nt, hsa; identical to SEQ ID NO: 140443

SEQ ID NO: 657481 - RNA, 64 nt, hsa; identical to SEQ ID NO: 140444

SEQ ID NO: 657482 - RNA, 64 nt, hsa; identical to SEQ ID NO: 140445

SEQ ID NO: 657483 - RNA, 64 nt, hsa; identical to SEQ ID NO: 140446

SEQ ID NO: 657484 - RNA, 64 nt, hsa; identical to SEQ ID NO: 140447

SEQ ID NO: 657485 - RNA, 64 nt, hsa; identical to SEQ ID NO: 140448

SEQ ID NO: 657486 - RNA, 64 nt, hsa; identical to SEQ ID NO: 140449

SEQ ID NO: 657487 - RNA, 64 nt, hsa; identical to SEQ ID NO: 140450

SEQ ID NO: 657488 - RNA, 64 nt, hsa; identical to SEQ ID NO: 140451

SEQ ID NO: 657489 - RNA, 64 nt, hsa; identical to SEQ ID NO: 140452

SEQ ID NO: 657490 - RNA, 64 nt, hsa; identical to SEQ ID NO: 140453

SEQ ID NO: 657491 - RNA, 64 nt, hsa; identical to SEQ ID NO: 140454

SEQ ID NO: 657492 - RNA, 64 nt, hsa; identical to SEQ ID NO: 140455

SEQ ID NO: 657493 - RNA, 64 nt, hsa; identical to SEQ ID NO: 140456

SEQ ID NO: 657494 - RNA, 64 nt, hsa; identical to SEQ ID NO: 140457

SEQ ID NO: 657495 - RNA, 64 nt, hsa; identical to SEQ ID NO: 140458

SEQ ID NO: 657496 - RNA, 64 nt, hsa; identical to SEQ ID NO: 140459

SEQ ID NO: 657497 - RNA, 64 nt, hsa; identical to SEQ ID NO: 140460

SEQ ID NO: 657498 - RNA, 64 nt, hsa; identical to SEQ ID NO: 140461

SEQ ID NO: 657499 - RNA, 64 nt, hsa; identical to SEQ ID NO: 140462

SEQ ID NO: 657500 - RNA, 64 nt, hsa; identical to SEQ ID NO: 140463

SEQ ID NO: 657501 - RNA, 64 nt, hsa; identical to SEQ ID NO: 140464

SEQ ID NO: 657502 - RNA, 64 nt, hsa; identical to SEQ ID NO: 140465

SEQ ID NO: 657503 - RNA, 64 nt, hsa; identical to SEQ ID NO: 140466

SEQ ID NO: 657504 - RNA, 64 nt, hsa; identical to SEQ ID NO: 140467

SEQ ID NO: 657505 - RNA, 64 nt, hsa; identical to SEQ ID NO: 140468

SEQ ID NO: 657506 - RNA, 64 nt, hsa; identical to SEQ ID NO: 140469

SEQ ID NO: 657507 - RNA, 64 nt, hsa; identical to SEQ ID NO: 140470

SEQ ID NO: 657508 - RNA, 64 nt, hsa; identical to SEQ ID NO: 140471

SEQ ID NO: 657509 - RNA, 64 nt, hsa; identical to SEQ ID NO: 140472

SEQ ID NO: 657510 - RNA, 64 nt, hsa; identical to SEQ ID NO: 140473

SEQ ID NO: 657511 - RNA, 64 nt, hsa; identical to SEQ ID NO: 140474

SEQ ID NO: 657512 - RNA, 64 nt, hsa; identical to SEQ ID NO: 140475

SEQ ID NO: 657513 - RNA, 64 nt, hsa; identical to SEQ ID NO: 140476

SEQ ID NO: 657514 - RNA, 64 nt, hsa; identical to SEQ ID NO: 140477

SEQ ID NO: 657515 - RNA, 64 nt, hsa; identical to SEQ ID NO: 140478

SEQ ID NO: 657516 - RNA, 64 nt, hsa; identical to SEQ ID NO: 140479

SEQ ID NO: 657517 - RNA, 64 nt, hsa; identical to SEQ ID NO: 140480

SEQ ID NO: 657518 - RNA, 64 nt, hsa; identical to SEQ ID NO: 140481

SEQ ID NO: 657519 - RNA, 64 nt, hsa; identical to SEQ ID NO: 140482

SEQ ID NO: 657520 - RNA, 64 nt, hsa; identical to SEQ ID NO: 140483

SEQ ID NO: 657521 - RNA, 64 nt, hsa; identical to SEQ ID NO: 140484

SEQ ID NO: 657522 - RNA, 64 nt, hsa; identical to SEQ ID NO: 140485

SEQ ID NO: 657523 - RNA, 64 nt, hsa; identical to SEQ ID NO: 140486

SEQ ID NO: 657524 - RNA, 64 nt, hsa; identical to SEQ ID NO: 140487

SEQ ID NO: 657525 - RNA, 64 nt, hsa; identical to SEQ ID NO: 140488

SEQ ID NO: 657526 - RNA, 64 nt, hsa; identical to SEQ ID NO: 140489

SEQ ID NO: 657527 - RNA, 64 nt, hsa; identical to SEQ ID NO: 140490

SEQ ID NO: 657528 - RNA, 64 nt, hsa; identical to SEQ ID NO: 140491

SEQ ID NO: 657529 - RNA, 64 nt, hsa; identical to SEQ ID NO: 140492

SEQ ID NO: 657530 - RNA, 64 nt, hsa; identical to SEQ ID NO: 140493

SEQ ID NO: 657531 - RNA, 64 nt, hsa; identical to SEQ ID NO: 140494

SEQ ID NO: 657532 - RNA, 64 nt, hsa; identical to SEQ ID NO: 140495

SEQ ID NO: 657533 - RNA, 64 nt, hsa; identical to SEQ ID NO: 140496

SEQ ID NO: 657534 - RNA, 64 nt, hsa; identical to SEQ ID NO: 140497

SEQ ID NO: 657535 - RNA, 64 nt, hsa; identical to SEQ ID NO: 140498

SEQ ID NO: 657536 - RNA, 64 nt, hsa; identical to SEQ ID NO: 140499

SEQ ID NO: 657537 - RNA, 64 nt, hsa; identical to SEQ ID NO: 140500

SEQ ID NO: 657538 - RNA, 64 nt, hsa; identical to SEQ ID NO: 140501

SEQ ID NO: 657539 - RNA, 64 nt, hsa; identical to SEQ ID NO: 140502

SEQ ID NO: 657540 - RNA, 64 nt, hsa; identical to SEQ ID NO: 140503

SEQ ID NO: 657541 - RNA, 64 nt, hsa; identical to SEQ ID NO: 140504

SEQ ID NO: 657542 - RNA, 64 nt, hsa; identical to SEQ ID NO: 140505

SEQ ID NO: 657543 - RNA, 64 nt, hsa; identical to SEQ ID NO: 140506

SEQ ID NO: 657544 - RNA, 64 nt, hsa; identical to SEQ ID NO: 140507

SEQ ID NO: 657545 - RNA, 64 nt, hsa; identical to SEQ ID NO: 140508

SEQ ID NO: 657546 - RNA, 64 nt, hsa; identical to SEQ ID NO: 140509

SEQ ID NO: 657547 - RNA, 64 nt, hsa; identical to SEQ ID NO: 140510

SEQ ID NO: 657548 - RNA, 64 nt, hsa; identical to SEQ ID NO: 140511

SEQ ID NO: 657549 - RNA, 64 nt, hsa; identical to SEQ ID NO: 140512

SEQ ID NO: 657550 - RNA, 64 nt, hsa; identical to SEQ ID NO: 140513

SEQ ID NO: 657551 - RNA, 64 nt, hsa; identical to SEQ ID NO: 140514

SEQ ID NO: 657552 - RNA, 64 nt, hsa; identical to SEQ ID NO: 140515

SEQ ID NO: 657553 - RNA, 64 nt, hsa; identical to SEQ ID NO: 140516

SEQ ID NO: 657554 - RNA, 64 nt, hsa; identical to SEQ ID NO: 140517

SEQ ID NO: 657555 - RNA, 64 nt, hsa; identical to SEQ ID NO: 140518

SEQ ID NO: 657556 - RNA, 64 nt, hsa; identical to SEQ ID NO: 140519

SEQ ID NO: 657557 - RNA, 64 nt, hsa; identical to SEQ ID NO: 140520

SEQ ID NO: 657558 - RNA, 64 nt, hsa; identical to SEQ ID NO: 140521

SEQ ID NO: 657559 - RNA, 64 nt, hsa; identical to SEQ ID NO: 140522

SEQ ID NO: 657560 - RNA, 64 nt, hsa; identical to SEQ ID NO: 140523

SEQ ID NO: 657561 - RNA, 64 nt, hsa; identical to SEQ ID NO: 140524

SEQ ID NO: 657562 - RNA, 64 nt, hsa; identical to SEQ ID NO: 140525

SEQ ID NO: 657563 - RNA, 64 nt, hsa; identical to SEQ ID NO: 140526

SEQ ID NO: 657564 - RNA, 64 nt, hsa; identical to SEQ ID NO: 140527

SEQ ID NO: 657565 - RNA, 64 nt, hsa; identical to SEQ ID NO: 140528

SEQ ID NO: 657566 - RNA, 64 nt, hsa; identical to SEQ ID NO: 140529

SEQ ID NO: 657567 - RNA, 64 nt, hsa; identical to SEQ ID NO: 140530

SEQ ID NO: 657568 - RNA, 64 nt, hsa; identical to SEQ ID NO: 140531

SEQ ID NO: 657569 - RNA, 64 nt, hsa; identical to SEQ ID NO: 140532

SEQ ID NO: 657570 - RNA, 64 nt, hsa; identical to SEQ ID NO: 140533

SEQ ID NO: 657571 - RNA, 64 nt, hsa; identical to SEQ ID NO: 140534

SEQ ID NO: 657572 - RNA, 64 nt, hsa; identical to SEQ ID NO: 140535

SEQ ID NO: 657573 - RNA, 64 nt, hsa; identical to SEQ ID NO: 140536

SEQ ID NO: 657574 - RNA, 64 nt, hsa; identical to SEQ ID NO: 140537

SEQ ID NO: 657575 - RNA, 64 nt, hsa; identical to SEQ ID NO: 140538

SEQ ID NO: 657576 - RNA, 62 nt, hsa; identical to SEQ ID NO: 140539

SEQ ID NO: 657577 - RNA, 64 nt, hsa; identical to SEQ ID NO: 140540

SEQ ID NO: 657578 - RNA, 64 nt, hsa; identical to SEQ ID NO: 140541

SEQ ID NO: 657579 - RNA, 64 nt, hsa; identical to SEQ ID NO: 140542

SEQ ID NO: 657580 - RNA, 64 nt, hsa; identical to SEQ ID NO: 140543

SEQ ID NO: 657581 - RNA, 64 nt, hsa; identical to SEQ ID NO: 140544

SEQ ID NO: 657582 - RNA, 64 nt, hsa; identical to SEQ ID NO: 140545

SEQ ID NO: 657583 - RNA, 64 nt, hsa; identical to SEQ ID NO: 140546

SEQ ID NO: 657584 - RNA, 64 nt, hsa; identical to SEQ ID NO: 140547

SEQ ID NO: 657585 - RNA, 64 nt, hsa; identical to SEQ ID NO: 140548

SEQ ID NO: 657586 - RNA, 64 nt, hsa; identical to SEQ ID NO: 140549

SEQ ID NO: 657587 - RNA, 64 nt, hsa; identical to SEQ ID NO: 140550

SEQ ID NO: 657588 - RNA, 64 nt, hsa; identical to SEQ ID NO: 140551

SEQ ID NO: 657589 - RNA, 64 nt, hsa; identical to SEQ ID NO: 140552

SEQ ID NO: 657590 - RNA, 64 nt, hsa; identical to SEQ ID NO: 140553

SEQ ID NO: 657591 - RNA, 64 nt, hsa; identical to SEQ ID NO: 140554

SEQ ID NO: 657592 - RNA, 64 nt, hsa; identical to SEQ ID NO: 140555

SEQ ID NO: 657593 - RNA, 64 nt, hsa; identical to SEQ ID NO: 140556

SEQ ID NO: 657594 - RNA, 64 nt, hsa; identical to SEQ ID NO: 140557

SEQ ID NO: 657595 - RNA, 64 nt, hsa; identical to SEQ ID NO: 140558

SEQ ID NO: 657596 - RNA, 64 nt, hsa; identical to SEQ ID NO: 140559

SEQ ID NO: 657597 - RNA, 64 nt, hsa; identical to SEQ ID NO: 140560

SEQ ID NO: 657598 - RNA, 64 nt, hsa; identical to SEQ ID NO: 140561

SEQ ID NO: 657599 - RNA, 64 nt, hsa; identical to SEQ ID NO: 140562

SEQ ID NO: 657600 - RNA, 64 nt, hsa; identical to SEQ ID NO: 140563

SEQ ID NO: 657601 - RNA, 64 nt, hsa; identical to SEQ ID NO: 140564

SEQ ID NO: 657602 - RNA, 64 nt, hsa; identical to SEQ ID NO: 140565

SEQ ID NO: 657603 - RNA, 64 nt, hsa; identical to SEQ ID NO: 140566

SEQ ID NO: 657604 - RNA, 64 nt, hsa; identical to SEQ ID NO: 140567

SEQ ID NO: 657605 - RNA, 64 nt, hsa; identical to SEQ ID NO: 140568

SEQ ID NO: 657606 - RNA, 64 nt, hsa; identical to SEQ ID NO: 140569

SEQ ID NO: 657607 - RNA, 64 nt, hsa; identical to SEQ ID NO: 140570

SEQ ID NO: 657608 - RNA, 64 nt, hsa; identical to SEQ ID NO: 140571

SEQ ID NO: 657609 - RNA, 64 nt, hsa; identical to SEQ ID NO: 140572

SEQ ID NO: 657610 - RNA, 64 nt, hsa; identical to SEQ ID NO: 140573

SEQ ID NO: 657611 - RNA, 64 nt, hsa; identical to SEQ ID NO: 140574

SEQ ID NO: 657612 - RNA, 64 nt, hsa; identical to SEQ ID NO: 140575

SEQ ID NO: 657613 - RNA, 64 nt, hsa; identical to SEQ ID NO: 140576

SEQ ID NO: 657614 - RNA, 64 nt, hsa; identical to SEQ ID NO: 140577

SEQ ID NO: 657615 - RNA, 64 nt, hsa; identical to SEQ ID NO: 140578

SEQ ID NO: 657616 - RNA, 64 nt, hsa; identical to SEQ ID NO: 140579

SEQ ID NO: 657617 - RNA, 64 nt, hsa; identical to SEQ ID NO: 140580

SEQ ID NO: 657618 - RNA, 64 nt, hsa; identical to SEQ ID NO: 140581

SEQ ID NO: 657619 - RNA, 64 nt, hsa; identical to SEQ ID NO: 140582

SEQ ID NO: 657620 - RNA, 64 nt, hsa; identical to SEQ ID NO: 140583

SEQ ID NO: 657621 - RNA, 64 nt, hsa; identical to SEQ ID NO: 140584

SEQ ID NO: 657622 - RNA, 64 nt, hsa; identical to SEQ ID NO: 140585

SEQ ID NO: 657623 - RNA, 64 nt, hsa; identical to SEQ ID NO: 140586

SEQ ID NO: 657624 - RNA, 64 nt, hsa; identical to SEQ ID NO: 140587

SEQ ID NO: 657625 - RNA, 64 nt, hsa; identical to SEQ ID NO: 140588

SEQ ID NO: 657626 - RNA, 64 nt, hsa; identical to SEQ ID NO: 140589

SEQ ID NO: 657627 - RNA, 64 nt, hsa; identical to SEQ ID NO: 140590

SEQ ID NO: 657628 - RNA, 64 nt, hsa; identical to SEQ ID NO: 140591

SEQ ID NO: 657629 - RNA, 64 nt, hsa; identical to SEQ ID NO: 140592

SEQ ID NO: 657630 - RNA, 64 nt, hsa; identical to SEQ ID NO: 140593

SEQ ID NO: 657631 - RNA, 64 nt, hsa; identical to SEQ ID NO: 140594

SEQ ID NO: 657632 - RNA, 64 nt, hsa; identical to SEQ ID NO: 140595

SEQ ID NO: 657633 - RNA, 64 nt, hsa; identical to SEQ ID NO: 140596

SEQ ID NO: 657634 - RNA, 64 nt, hsa; identical to SEQ ID NO: 481758

SEQ ID NO: 657635 - RNA, 64 nt, hsa; identical to SEQ ID NO: 481759

SEQ ID NO: 657636 - RNA, 64 nt, hsa; identical to SEQ ID NO: 481760

SEQ ID NO: 657637 - RNA, 64 nt, hsa; identical to SEQ ID NO: 481761

SEQ ID NO: 657638 - RNA, 50 nt, hsa; identical to SEQ ID NO: 481762

SEQ ID NO: 657639 - RNA, 64 nt, hsa; identical to SEQ ID NO: 481763

SEQ ID NO: 657640 - RNA, 64 nt, hsa; identical to SEQ ID NO: 481764

SEQ ID NO: 657641 - RNA, 64 nt, hsa; identical to SEQ ID NO: 481765

SEQ ID NO: 657642 - RNA, 64 nt, hsa; identical to SEQ ID NO: 481766

SEQ ID NO: 657643 - RNA, 64 nt, hsa; identical to SEQ ID NO: 481767

SEQ ID NO: 657644 - RNA, 64 nt, hsa; identical to SEQ ID NO: 481768

SEQ ID NO: 657645 - RNA, 64 nt, hsa; identical to SEQ ID NO: 481769

SEQ ID NO: 657646 - RNA, 64 nt, hsa; identical to SEQ ID NO: 481770

SEQ ID NO: 657647 - RNA, 64 nt, hsa; identical to SEQ ID NO: 481771

SEQ ID NO: 657648 - RNA, 64 nt, hsa; identical to SEQ ID NO: 481772

SEQ ID NO: 657649 - RNA, 64 nt, hsa; identical to SEQ ID NO: 481773

SEQ ID NO: 657650 - RNA, 64 nt, hsa; identical to SEQ ID NO: 78219

SEQ ID NO: 657651 - RNA, 64 nt, hsa; identical to SEQ ID NO: 78220

SEQ ID NO: 657652 - RNA, 64 nt, hsa; identical to SEQ ID NO: 78221

SEQ ID NO: 657653 - RNA, 64 nt, hsa; identical to SEQ ID NO: 78222

SEQ ID NO: 657654 - RNA, 64 nt, hsa; identical to SEQ ID NO: 78223

SEQ ID NO: 657655 - RNA, 64 nt, hsa; identical to SEQ ID NO: 78224

SEQ ID NO: 657656 - RNA, 64 nt, hsa; identical to SEQ ID NO: 78225

SEQ ID NO: 657657 - RNA, 64 nt, hsa; identical to SEQ ID NO: 78226

SEQ ID NO: 657658 - RNA, 64 nt, hsa; identical to SEQ ID NO: 78226

SEQ ID NO: 657659 - RNA, 64 nt, hsa; identical to SEQ ID NO: 78226

SEQ ID NO: 657660 - RNA, 64 nt, hsa; identical to SEQ ID NO: 78229

SEQ ID NO: 657661 - RNA, 62 nt, hsa; identical to SEQ ID NO: 292657

SEQ ID NO: 657662 - RNA, 62 nt, hsa; identical to SEQ ID NO: 292658

SEQ ID NO: 657663 - RNA, 62 nt, hsa; identical to SEQ ID NO: 292659

SEQ ID NO: 657664 - RNA, 62 nt, hsa; identical to SEQ ID NO: 292660

SEQ ID NO: 657665 - RNA, 62 nt, hsa; identical to SEQ ID NO: 292661

SEQ ID NO: 657666 - RNA, 62 nt, hsa; identical to SEQ ID NO: 292662

SEQ ID NO: 657667 - RNA, 62 nt, hsa; identical to SEQ ID NO: 292663

SEQ ID NO: 657668 - RNA, 62 nt, hsa; identical to SEQ ID NO: 292664

SEQ ID NO: 657669 - RNA, 62 nt, hsa; identical to SEQ ID NO: 292665

SEQ ID NO: 657670 - RNA, 62 nt, hsa; identical to SEQ ID NO: 292666

SEQ ID NO: 657671 - RNA, 62 nt, hsa; identical to SEQ ID NO: 292667

SEQ ID NO: 657672 - RNA, 62 nt, hsa; identical to SEQ ID NO: 292668

SEQ ID NO: 657673 - RNA, 62 nt, hsa; identical to SEQ ID NO: 292669

SEQ ID NO: 657674 - RNA, 62 nt, hsa; identical to SEQ ID NO: 292670

SEQ ID NO: 657675 - RNA, 64 nt, hsa
ucacccccauccucuuacuccuuucaugucccauuucagacagaguaaccauuaacaaaaaaga

SEQ ID NO: 657676 - RNA, 64 nt, hsa
aaacuggaacuaugaacuucauccauuugcacuguucagacauauauauguauguauguaaaaa

SEQ ID NO: 657677 - RNA, 64 nt, hsa
gcugggauuccaugcgacagcuugaaugcugaccuucagacaugagacauagggauuuggaggc

SEQ ID NO: 657678 - RNA, 64 nt, hsa
ccgaaucuggucccugggggacccccaguuucucuucagacacugaccuucugcugggaaagca

SEQ ID NO: 657679 - RNA, 64 nt, hsa
uggucccaagcgaaggcuccucugcuugggauucuucagacagaagcugggccagcacugugga

SEQ ID NO: 657680 - RNA, 64 nt, hsa
uacuucaguaaugucuauauuauauaaauaguauuucagacacuauguagucuguuagauuuua

SEQ ID NO: 657681 - RNA, 64 nt, hsa
augggaaauguuuggccaugcuugguuguugcaguucagacaaauguaacacacacacacauac

SEQ ID NO: 657682 - RNA, 64 nt, hsa
cuguauuaaaauagaaccaggaaaggcucaggauuucagacauuucaucagccuuuucacuuuc

SEQ ID NO: 657683 - RNA, 64 nt, hsa
guucuugguggugucucccauuccccuggcuaauuucagacagcuguggucaagggauuuuacu

SEQ ID NO: 657684 - RNA, 64 nt, hsa
aagcauuaucaaugaaauuacugucaaaagaucuuucagacaauauaagccugcaaagugcagc

SEQ ID NO: 657685 - RNA, 64 nt, hsa
gaauucacaauacagauaucuaagauacugacacuucagacauuacacaaaaucagagugcuga

SEQ ID NO: 657686 - RNA, 64 nt, hsa
cuugggcaaccacacauagagguuuccuucucacuucagacacauacaucacuuucacaccacu

SEQ ID NO: 657687 - RNA, 64 nt, hsa
cugcucaagguuccccucugcucaucccuccucauucagacauccuccaccauaccaguguuua

SEQ ID NO: 657688 - RNA, 64 nt, hsa
cucggacaaaucccugggagagaaagcaguggcuuucagacacaccaaagaagacucugcauca

SEQ ID NO: 657689 - RNA, 64 nt, hsa
aaacucgacugcugcgucuaccaaguacgaugucuucagacaacuuucucuggaagggucugga

SEQ ID NO: 657690 - RNA, 64 nt, hsa
gagggccaacccggccccucuguccccuuggcucuucagacagggccagcccugcucaggaagu

SEQ ID NO: 657691 - RNA, 64 nt, hsa
agggaucuugacucuugucuccuuuguccuuuuguucagacagaguuguaccugcagcagacaa

SEQ ID NO: 657692 - RNA, 64 nt, hsa
aaaaguaaccgggagacaaauugagccacauauuuucagacacuuguuaccauauuuuaaaauc

SEQ ID NO: 657693 - RNA, 64 nt, hsa
caauaugacuggaguccuuaucggaagagggaaauucagacacagaugcauagggaggacacca

SEQ ID NO: 657694 - RNA, 64 nt, hsa
acaauguuauuuauuagcccuaauuguguuugguuucagacaaaaccuuuucuccuguguaucu

SEQ ID NO: 657695 - RNA, 64 nt, hsa
uguaaguuauuuauuagcccuaauuguguuugauuucagacaaaauuaacccuuuucuccugug

SEQ ID NO: 657696 - RNA, 64 nt, hsa
gagugaggaaaacauguucagugaggaaaaaacauucagacaaauguucagugaggaaaaaaag

SEQ ID NO: 657697 - RNA, 64 nt, hsa
ugcaugcaucuugaagcaacaaagcagccacaguuucagacaaauguucagugugagugaggaa

SEQ ID NO: 657698 - RNA, 64 nt, hsa
acaaacaaaccucgucaccacggucaggaggagguucagacauucugcccagaggggcugggga

SEQ ID NO: 657699 - RNA, 64 nt, hsa
uggcucugggaggacucugaggggcagugcucaguucagacaagggggaacugaaggcugacaa

SEQ ID NO: 657700 - RNA, 64 nt, hsa
auuguucuuucagucagacaugauaugcgcaacauucagacaugauaugcgcaucauucagaca

SEQ ID NO: 657701 - RNA, 64 nt, hsa
auaugcgcaacauucagacaugauaugcgcaucauucagacaugauaugcggggucaaguucuu

SEQ ID NO: 657702 - RNA, 64 nt, hsa
uuacauucaaaauaauguuuauaaauuuauuugucuauacuaguagaagugaucagugacauac

SEQ ID NO: 657703 - RNA, 64 nt, hsa
guaaaacuuuugguucagaagcuugacucauaaacuauacuauauauucccaaaaaugucagua

SEQ ID NO: 657704 - RNA, 64 nt, hsa
acaauccugcuuucucaaguacuauucuaacauugcgcuuuauaagggaugauauuucuaccac

SEQ ID NO: 657705 - RNA, 64 nt, hsa
uauaaagcccaggaacuucuagaauaacccagaugcgcuuuaauuuuuuuuaauauguuuugau

SEQ ID NO: 657706 - RNA, 64 nt, hsa
ugccuuaauauaucuauggcagacauuuaagaaugcgcuuuaucuagcucaugguaacuuugca

SEQ ID NO: 657707 - RNA, 64 nt, hsa
uuacgguaguuaggaugcucaguugcuaaacacugcgcuuuauuuucuuaaccaguuguggugu

SEQ ID NO: 657708 - RNA, 64 nt, hsa
gucaugggauaaaaauaaucgauguauguuacgggcgcuuuaaccaucagcugccucucgaaug

SEQ ID NO: 657709 - RNA, 64 nt, hsa
cggguucaccuggguggcuggagccgccggcgcugcgcuuuauuucggagcgcaaugccaucua

SEQ ID NO: 657710 - RNA, 64 nt, hsa
ucuguuucccuuaaugauacaagucucuguaccagcgcuuuauguuaauuaccaaaacucuccu

SEQ ID NO: 657711 - RNA, 64 nt, hsa
cuagaaguggcagaacacuggauuuguguguguggcgcuuuagggugcuggacuguauggcuga

SEQ ID NO: 657712 - RNA, 64 nt, hsa
aaucccuccccuugcacuugugaaaacacuuugagcgcuuuaagagauuagccugagaaauaau

SEQ ID NO: 657713 - RNA, 64 nt, hsa
caaagugacuguuuggcuuauaaacacauugaaugcgcuuuauugcccaugggauauguggugu

SEQ ID NO: 657714 - RNA, 64 nt, hsa
cggaauaacaaguugucccuagcaaaaccgcugagcgcuuuauaauuuugugguguauuuuugu

SEQ ID NO: 657715 - RNA, 64 nt, hsa
uacucaguuuuauaaggugauacuuuuuaaauaagcgcuuuaaugaaaaugguuagacugaaaa

SEQ ID NO: 657716 - RNA, 64 nt, hsa
uguacauugucaugugacuggaucacauggggaagcgcuuuauacagacaucaguuccauggug

SEQ ID NO: 657717 - RNA, 64 nt, hsa
ccucucaccucacaggcacaucaggcugcagaaugcgcuuuagaaagcauuguuuuaguccagg

SEQ ID NO: 657718 - RNA, 64 nt, hsa
cucauugcaugagucaagucggccacagacuugagcgcuuuauuauuaguuaaucuuuugcagg

SEQ ID NO: 657719 - RNA, 64 nt, hsa
aaaauuuuuaaacuucuaagugaaaguagucugagcgcuuuauaaaauucauauuauugugugu

SEQ ID NO: 657720 - RNA, 64 nt, hsa
cuaccccagcacacacacucccugccacuguucugcgcuuuaauugugggagaagagaggagag

SEQ ID NO: 657721 - RNA, 64 nt, hsa
cuucaugaugacaacacugccucgcguuucaauagcgcuuuauacuuuuuuaaguguuuucuau

SEQ ID NO: 657722 - RNA, 64 nt, hsa
uuuuuugcuauuguaaauauuagugguuuacaaugcgcuuuagacauauuucuuuaaaaugcaa

SEQ ID NO: 657723 - RNA, 64 nt, hsa
gcuguagcuaucuucaccugcgccaauugugagggcgcuuuagcauuugagugauucaauaguu

SEQ ID NO: 657724 - RNA, 64 nt, hsa
gagggccgaggugggcuucaguaaguccccggcggcgcuuuaguuugagcgcauggcaagucac

SEQ ID NO: 657725 - RNA, 64 nt, hsa
caaaagauugaacuuaaaugccccccucccaacagcgcuuuaaaagcgaccucucuugagguag

SEQ ID NO: 657726 - RNA, 64 nt, hsa
gcuugccgccaucucuuaguuuucuuuuucacaagcgcuuuauuuuuuuaauagacaaaucaca

SEQ ID NO: 657727 - RNA, 64 nt, hsa
gaccuuggauuuaauuuaaagucuucaacacuaugcgcuuuaucauauuauucacagaugcauu

SEQ ID NO: 657728 - RNA, 64 nt, hsa
auccaauccaacuugaagucaauugaauauuaaggcgcuuuacuuccgugugcuuucaguuuuu

SEQ ID NO: 657729 - RNA, 64 nt, hsa
gcucugccucagaaagcucugcgcuuuccagaaagcgcuuuacccugcaggguuuugcuaaccu

SEQ ID NO: 657730 - RNA, 64 nt, hsa
cucuugagaaccuucacccuuucacuuaaaggaggcgcuuuauagcuucucuuuggcauaucca

SEQ ID NO: 657731 - RNA, 64 nt, hsa
uuuucauucucccccucucucccuccugugucuugcgcuuuauguuuucuuccguuugauaauu

SEQ ID NO: 657732 - RNA, 64 nt, hsa
gcuccuagagaagccaugugauucccagagccaggcgcuuuacaccuaaaguaguuugacuuuc

SEQ ID NO: 657733 - RNA, 64 nt, hsa
uugcuuguguguguagcuucuuguagcuuagaaagcgcuuuaugcccaugaugucauuucaggc

SEQ ID NO: 657734 - RNA, 64 nt, hsa
gcuugcucccuugggacaguuaccuuccuggugucauugccauccuggguugacaagcugagag

SEQ ID NO: 657735 - RNA, 64 nt, hsa
uuuuaucuuugccaaaucuuuaccacugauuuaccauugccauaaaguagacugguauaugguu

SEQ ID NO: 657736 - RNA, 64 nt, hsa
auaauguucucauuuauuuuugauguagaauuuacauugccauggguguuaaauaagcuuugag

SEQ ID NO: 657737 - RNA, 64 nt, hsa
gucgccccuuuguaacaaaacgaaagagucuaagcauugccacuuuagcugcugccucccucug

SEQ ID NO: 657738 - RNA, 64 nt, hsa
cguaucacagaauaaacacauuuagccuuauagacauugccaaauugcucuucaaaguaaaugu

SEQ ID NO: 657739 - RNA, 64 nt, hsa
ugucaaaucuuaacauuuugccacuucgagaucacauugccauuccuccccuccagagguaaca

SEQ ID NO: 657740 - RNA, 64 nt, hsa
auuuaguuaccucuugaaagcacaaaaauuaaaacauugccauauguugaauuuuuaaaaagca

SEQ ID NO: 657741 - RNA, 64 nt, hsa
aauuuucaccaacaguucacucacccuccugguacauugccauuccaaggaauucugagaguag

SEQ ID NO: 657742 - RNA, 64 nt, hsa
cacaagagaucucuuccugccaagguuuuuaguucauugccaguuuagucuuuuugacccaugu

SEQ ID NO: 657743 - RNA, 64 nt, hsa
agcugcaggagagcagggccaucugaagcgguagcauugccaccaucucccucucaucuagagc

SEQ ID NO: 657744 - RNA, 64 nt, hsa
ccacccacucaggacucuuccccaucaucccuuccauugccacacccuagauccagccucagga

SEQ ID NO: 657745 - RNA, 64 nt, hsa
ugaguuguguagggaugaagacuauugaagacuccauugccaaaccauggccuuuccucagugu

SEQ ID NO: 657746 - RNA, 64 nt, hsa
auauuccaccagcgauuugauuuauuggcucuuccauugccacugagcaaugcccaggaagcag

SEQ ID NO: 657747 - RNA, 64 nt, hsa
ccauugccacugagcaaugcccaggaagcaggcacauugccaaggacugggggcaucuugacua

SEQ ID NO: 657748 - RNA, 64 nt, hsa; identical to SEQ ID NO: 198342

SEQ ID NO: 657749 - RNA, 64 nt, hsa; identical to SEQ ID NO: 198343

SEQ ID NO: 657750 - RNA, 64 nt, hsa; identical to SEQ ID NO: 198344

SEQ ID NO: 657751 - RNA, 64 nt, hsa; identical to SEQ ID NO: 198345

SEQ ID NO: 657752 - RNA, 64 nt, hsa; identical to SEQ ID NO: 198346

SEQ ID NO: 657753 - RNA, 64 nt, hsa; identical to SEQ ID NO: 198347

SEQ ID NO: 657754 - RNA, 64 nt, hsa; identical to SEQ ID NO: 198348

SEQ ID NO: 657755 - RNA, 64 nt, hsa; identical to SEQ ID NO: 198349

SEQ ID NO: 657756 - RNA, 64 nt, hsa; identical to SEQ ID NO: 198350

SEQ ID NO: 657757 - RNA, 64 nt, hsa; identical to SEQ ID NO: 198351

SEQ ID NO: 657758 - RNA, 64 nt, hsa; identical to SEQ ID NO: 198352

SEQ ID NO: 657759 - RNA, 64 nt, hsa; identical to SEQ ID NO: 198353

SEQ ID NO: 657760 - RNA, 64 nt, hsa; identical to SEQ ID NO: 198354

SEQ ID NO: 657761 - RNA, 64 nt, hsa; identical to SEQ ID NO: 198355

SEQ ID NO: 657762 - RNA, 64 nt, hsa; identical to SEQ ID NO: 198356

SEQ ID NO: 657763 - RNA, 64 nt, hsa; identical to SEQ ID NO: 198357

SEQ ID NO: 657764 - RNA, 64 nt, hsa; identical to SEQ ID NO: 198358

SEQ ID NO: 657765 - RNA, 64 nt, hsa; identical to SEQ ID NO: 198359

SEQ ID NO: 657766 - RNA, 64 nt, hsa; identical to SEQ ID NO: 198360

SEQ ID NO: 657767 - RNA, 64 nt, hsa; identical to SEQ ID NO: 198361

SEQ ID NO: 657768 - RNA, 64 nt, hsa; identical to SEQ ID NO: 198362

SEQ ID NO: 657769 - RNA, 64 nt, hsa; identical to SEQ ID NO: 198363

SEQ ID NO: 657770 - RNA, 64 nt, hsa; identical to SEQ ID NO: 198364

SEQ ID NO: 657771 - RNA, 64 nt, hsa; identical to SEQ ID NO: 198365

SEQ ID NO: 657772 - RNA, 64 nt, hsa; identical to SEQ ID NO: 198366

SEQ ID NO: 657773 - RNA, 64 nt, hsa; identical to SEQ ID NO: 198367

SEQ ID NO: 657774 - RNA, 64 nt, hsa; identical to SEQ ID NO: 198368

SEQ ID NO: 657775 - RNA, 64 nt, hsa; identical to SEQ ID NO: 198369

SEQ ID NO: 657776 - RNA, 64 nt, hsa; identical to SEQ ID NO: 198370

SEQ ID NO: 657777 - RNA, 64 nt, hsa; identical to SEQ ID NO: 198371

SEQ ID NO: 657778 - RNA, 64 nt, hsa; identical to SEQ ID NO: 198372

SEQ ID NO: 657779 - RNA, 64 nt, hsa; identical to SEQ ID NO: 198373

SEQ ID NO: 657780 - RNA, 64 nt, hsa; identical to SEQ ID NO: 198374

SEQ ID NO: 657781 - RNA, 64 nt, hsa; identical to SEQ ID NO: 198375

SEQ ID NO: 657782 - RNA, 64 nt, hsa; identical to SEQ ID NO: 198376

SEQ ID NO: 657783 - RNA, 64 nt, hsa; identical to SEQ ID NO: 198377

SEQ ID NO: 657784 - RNA, 64 nt, hsa; identical to SEQ ID NO: 198378

SEQ ID NO: 657785 - RNA, 64 nt, hsa; identical to SEQ ID NO: 198379

SEQ ID NO: 657786 - RNA, 64 nt, hsa; identical to SEQ ID NO: 198380

SEQ ID NO: 657787 - RNA, 64 nt, hsa; identical to SEQ ID NO: 198381

SEQ ID NO: 657788 - RNA, 64 nt, hsa; identical to SEQ ID NO: 198382

SEQ ID NO: 657789 - RNA, 64 nt, hsa; identical to SEQ ID NO: 198383

SEQ ID NO: 657790 - RNA, 64 nt, hsa; identical to SEQ ID NO: 198384

SEQ ID NO: 657791 - RNA, 64 nt, hsa; identical to SEQ ID NO: 198385

SEQ ID NO: 657792 - RNA, 64 nt, hsa; identical to SEQ ID NO: 198386

SEQ ID NO: 657793 - RNA, 64 nt, hsa; identical to SEQ ID NO: 198387

SEQ ID NO: 657794 - RNA, 64 nt, hsa; identical to SEQ ID NO: 198388

SEQ ID NO: 657795 - RNA, 64 nt, hsa; identical to SEQ ID NO: 198389

SEQ ID NO: 657796 - RNA, 64 nt, hsa; identical to SEQ ID NO: 198390

SEQ ID NO: 657797 - RNA, 64 nt, hsa; identical to SEQ ID NO: 198391

SEQ ID NO: 657798 - RNA, 64 nt, hsa; identical to SEQ ID NO: 198392

SEQ ID NO: 657799 - RNA, 64 nt, hsa; identical to SEQ ID NO: 198393

SEQ ID NO: 657800 - RNA, 64 nt, hsa; identical to SEQ ID NO: 198394

SEQ ID NO: 657801 - RNA, 64 nt, hsa; identical to SEQ ID NO: 198395

SEQ ID NO: 657802 - RNA, 64 nt, hsa; identical to SEQ ID NO: 198396

SEQ ID NO: 657803 - RNA, 64 nt, hsa; identical to SEQ ID NO: 198397

SEQ ID NO: 657804 - RNA, 64 nt, hsa; identical to SEQ ID NO: 198398

SEQ ID NO: 657805 - RNA, 64 nt, hsa; identical to SEQ ID NO: 198399

SEQ ID NO: 657806 - RNA, 64 nt, hsa; identical to SEQ ID NO: 198400

SEQ ID NO: 657807 - RNA, 64 nt, hsa; identical to SEQ ID NO: 198401

SEQ ID NO: 657808 - RNA, 64 nt, hsa; identical to SEQ ID NO: 198402

SEQ ID NO: 657809 - RNA, 64 nt, hsa; identical to SEQ ID NO: 198403

SEQ ID NO: 657810 - RNA, 64 nt, hsa; identical to SEQ ID NO: 198404

SEQ ID NO: 657811 - RNA, 64 nt, hsa; identical to SEQ ID NO: 198405

SEQ ID NO: 657812 - RNA, 64 nt, hsa; identical to SEQ ID NO: 198406

SEQ ID NO: 657813 - RNA, 64 nt, hsa; identical to SEQ ID NO: 198407

SEQ ID NO: 657814 - RNA, 64 nt, hsa; identical to SEQ ID NO: 198408

SEQ ID NO: 657815 - RNA, 64 nt, hsa; identical to SEQ ID NO: 198409

SEQ ID NO: 657816 - RNA, 64 nt, hsa; identical to SEQ ID NO: 198410

SEQ ID NO: 657817 - RNA, 64 nt, hsa; identical to SEQ ID NO: 198411

SEQ ID NO: 657818 - RNA, 64 nt, hsa; identical to SEQ ID NO: 198412

SEQ ID NO: 657819 - RNA, 64 nt, hsa; identical to SEQ ID NO: 198413

SEQ ID NO: 657820 - RNA, 64 nt, hsa; identical to SEQ ID NO: 198414

SEQ ID NO: 657821 - RNA, 64 nt, hsa; identical to SEQ ID NO: 198415

SEQ ID NO: 657822 - RNA, 64 nt, hsa; identical to SEQ ID NO: 198416

SEQ ID NO: 657823 - RNA, 64 nt, hsa; identical to SEQ ID NO: 198417

SEQ ID NO: 657824 - RNA, 64 nt, hsa; identical to SEQ ID NO: 198418

SEQ ID NO: 657825 - RNA, 64 nt, hsa; identical to SEQ ID NO: 198419

SEQ ID NO: 657826 - RNA, 64 nt, hsa; identical to SEQ ID NO: 198420

SEQ ID NO: 657827 - RNA, 64 nt, hsa; identical to SEQ ID NO: 198421

SEQ ID NO: 657828 - RNA, 64 nt, hsa; identical to SEQ ID NO: 198422

SEQ ID NO: 657829 - RNA, 64 nt, hsa; identical to SEQ ID NO: 198423

SEQ ID NO: 657830 - RNA, 64 nt, hsa; identical to SEQ ID NO: 198424

SEQ ID NO: 657831 - RNA, 64 nt, hsa; identical to SEQ ID NO: 198425

SEQ ID NO: 657832 - RNA, 64 nt, hsa; identical to SEQ ID NO: 198426

SEQ ID NO: 657833 - RNA, 64 nt, hsa
agagucuuuguaaguaaacugcccugucuaggucaguacccaccugagcuuuggacgcacacag

SEQ ID NO: 657834 - RNA, 64 nt, hsa
guacccaccugagcuuuggacgcacacagcuuuuaguacccaccugagcuuuggacacacacag

SEQ ID NO: 657835 - RNA, 64 nt, hsa
auugaguacacgccggccagcccggccuacgcccaguacccaccggccaccuaugaccaguacc

SEQ ID NO: 657836 - RNA, 64 nt, hsa
gccuacgcccaguacccaccggccaccuaugaccaguacccauacgccgccucgccugccacgg

SEQ ID NO: 657837 - RNA, 64 nt, hsa
cuacagaaauguuuuaaauacauucucaggcauguuugcaaaaauauggcacauguauacauuu

SEQ ID NO: 657838 - RNA, 64 nt, hsa
cguauuuuguaguggaguucauaucacauuauguuuugcaaaauaaaacuuguuuugucacaau

SEQ ID NO: 657839 - RNA, 64 nt, hsa
gaugggcuuagagcucucaugaugcuacccgagguuugcaaauccuucaugucuuaaccuaccu

SEQ ID NO: 657840 - RNA, 64 nt, hsa
acuaccucccaaccccagugccucagucaauaaauuugcaaauucaugagaauuuuuaggucuc

SEQ ID NO: 657841 - RNA, 64 nt, hsa
agggccuagaaacucacccgugcauauguugaccuuugcaaaaugaccuggugacauggcaagu

SEQ ID NO: 657842 - RNA, 64 nt, hsa
gaccacaaugagauuccauuuuauauccauaagauuugcaaagguugggucugacaguaccagu

SEQ ID NO: 657843 - RNA, 64 nt, hsa
ccaaguggagucagguuuucuauuccuuucuguguuugcaaauucaguguuaacuaaauaaagg

SEQ ID NO: 657844 - RNA, 64 nt, hsa
cagugcguccagucuccuguccugccacgugucuuuugcaaagcuccuuggauguggagacaga

SEQ ID NO: 657845 - RNA, 64 nt, hsa
uucuuugauucuuuaacauguucucucucuucuguuugcaaaauauguuugaaagcauugguag

SEQ ID NO: 657846 - RNA, 64 nt, hsa
auuuuguaucagaggcauaucauaaauugauaauuuugcaaaaugcacuuuuuugagaugcaga

SEQ ID NO: 657847 - RNA, 64 nt, hsa
ugaaguccgcaugaaacacugcaccaggcagggcuuugcaaagugcaagguauccccaguccaa

SEQ ID NO: 657848 - RNA, 64 nt, hsa
gaguuuuagaagauuagaccauuaggaacguaucuuugcaaacugcccauucacccaugaagag

SEQ ID NO: 657849 - RNA, 64 nt, hsa
ugaagucuuaacauuuuaacauuuauagugcuuauuugcaaaauuguauaauuaggaauuauuu

SEQ ID NO: 657850 - RNA, 64 nt, hsa
aaugugccaaaaagaaaaaaagcuagagacccuuuuugcaaacauuuggugaccacacauuuga

SEQ ID NO: 657851 - RNA, 64 nt, hsa
uuuauuauugacuauaauaauuaguuuaauuagcuuugcaaacugauggcaucaagguaaauau

SEQ ID NO: 657852 - RNA, 64 nt, hsa
auuaaaacugccauaucaauuuuaauguauagauuuugcaaauauuaugcuauauguaauaccu

SEQ ID NO: 657853 - RNA, 64 nt, hsa
gaauaacauuuaaaggagauuguuucaaaauauuuuugcaaauugagauaaggacagaaagauu

SEQ ID NO: 657854 - RNA, 64 nt, hsa
gauaaggacagaaagauugagaaacauuguauauuuugcaaaaacaagauguuuguagcuguuu

SEQ ID NO: 657855 - RNA, 64 nt, hsa
aauaucuugcaucuuuauggaaguuuaaagcauguuugcaaauauugcagcccauugaaagaau

SEQ ID NO: 657856 - RNA, 64 nt, hsa
aagauaaguacggucuucauguuuauaguccaaauuugcaaacccuacaacucugggugucaua

SEQ ID NO: 657857 - RNA, 64 nt, hsa
aaugugauagcugugcaugcauuauauauuugcauuugcaaauuucccauuguuuuaacagcug

SEQ ID NO: 657858 - RNA, 64 nt, hsa
auaggacaauuaauggaaaaaaaaauucucauuauuugcaaagaaugaacaaguuaaugaacaa

SEQ ID NO: 657859 - RNA, 64 nt, hsa
gcaaaggccaucuacaagagguauaccacuguauuuugcaaauuagaauuaagguucacuaaac

SEQ ID NO: 657860 - RNA, 64 nt, hsa
uaccauuugcauucuuucuguuugguauuaaaaguuugcaaacaaaaauacauugcaugagcca

SEQ ID NO: 657861 - RNA, 64 nt, hsa
agccugcuauaaaguuaaagucacacauuucuauuuugcaaacacugugauuacucuuugcuuu

SEQ ID NO: 657862 - RNA, 64 nt, hsa
auuuaguggauuaaccaguccagacgcacugaucuuugcaaaggagacuuaauuucaaaucugu

SEQ ID NO: 657863 - RNA, 64 nt, hsa
uauuuaaauccaucugaacugucccaaaauguaauuugcaaagagcuucaaacaccaaaaauau

SEQ ID NO: 657864 - RNA, 64 nt, hsa
caaugcuauuugccuuaguucauucguuguuuacuuugcaaaauuugugacuuuuaaguacuaa

SEQ ID NO: 657865 - RNA, 64 nt, hsa
auccaaaugauuuuacaguuuuauuuuuucaucuuuugcaaaaaguauuuguuacauaaucaaa

SEQ ID NO: 657866 - RNA, 64 nt, hsa
auuaguaauagaguuaaauuugauacuuccugcuuuugcaaauaauggaguagggaagaagaua

SEQ ID NO: 657867 - RNA, 64 nt, hsa
uaacuaauuucaguuguacugugaaugcuaaauauuugcaaacaaguacaucuugaaaguaaag

SEQ ID NO: 657868 - RNA, 64 nt, hsa
uuuuuuaaaugucauauugugauaaugcucugcuuuugcaaauuguguuugcaugucauuaguu

SEQ ID NO: 657869 - RNA, 64 nt, hsa
caccaacuuaaaaaaaaaaaguacaauucauuguuuugcaaaaguguaugguaggggcuuaaaa

SEQ ID NO: 657870 - RNA, 64 nt, hsa
ucuuuuguaagacauuuccuuuuuuaaaaaaauuuuugcaaauaacugaucucaaguauauguc

SEQ ID NO: 657871 - RNA, 64 nt, hsa
uuuugcuuauuuucauauaaaagguaagacagaguuugcaaagcauuuguggcuuuuuguaguu

SEQ ID NO: 657872 - RNA, 64 nt, hsa
uuuuaaggcuaacuucuuuucacuguugugcuccuuugcaaaauguauguuacaauagauagug

SEQ ID NO: 657873 - RNA, 64 nt, hsa
gacacuucccugcauuaacugcacaaacaauauguuugcaaacuuguuagaucaaccuccaaca

SEQ ID NO: 657874 - RNA, 64 nt, hsa
gggaggaaaacucaguaagaauuauauuagucuguuugcaaaguagaaaaagauucucaucacu

SEQ ID NO: 657875 - RNA, 64 nt, hsa
ucccacuccucacacucuucuacagggauaggcuuuugcaaauauaucagauaaauuuuuuguu

SEQ ID NO: 657876 - RNA, 64 nt, hsa
aguauugucuauuucagugugaaacuaucuugaauuugcaaauauaguguuauauuuuauaaag

SEQ ID NO: 657877 - RNA, 64 nt, hsa
cccgccuaggacaggagcugucuggagcuccaccuuugcaaagaaaggaaaaacacaaauugcc

SEQ ID NO: 657878 - RNA, 64 nt, hsa
gaugucauauugaggcccaaacuugauuggagaauuugcaaacuaccgucgcucagcaacacca

SEQ ID NO: 657879 - RNA, 64 nt, hsa
ugaaguaaauguaugguagaaauuaagacguuucuuugcaaaacaaggaaaucacacauaugca

SEQ ID NO: 657880 - RNA, 64 nt, hsa
aacagaaaaagaaaaaauugucugaaauguuuauuuugcaaaacagugcaauagaaucuaguua

SEQ ID NO: 657881 - RNA, 64 nt, hsa
guuuaauggccaccuguucucuccugugaaaggcuuugcaaagucacauuaaguuugcaugacc

SEQ ID NO: 657882 - RNA, 64 nt, hsa
ucuuuauaaaaguaaaaggccaacauuuaauuauuuugcaaagcaaccuaagagcuaaagaugu

SEQ ID NO: 657883 - RNA, 64 nt, hsa
cuuucuuugccucugcagucucauuucucauaauuuugcaaauuauauuuuguugcuuucuuac

SEQ ID NO: 657884 - RNA, 64 nt, hsa
agcaagcuuuugcucaacagcauaugggugggauuuugcaaaaauccuauucugaugaaucuca

SEQ ID NO: 657885 - RNA, 64 nt, hsa
gggaccaggaugauacagucaucugagguuaugcuuugcaaaaggcugacgguauggaauaugu

SEQ ID NO: 657886 - RNA, 64 nt, hsa
gcacccuuaauucaggcacuguccauuagcuuccuuugcaaaggcuacuuauggccggucacaa

SEQ ID NO: 657887 - RNA, 64 nt, hsa
aggaauauuugacaauuaaguuaaucuucacguuuuugcaaacuuugauuuuuauuucaucuga

SEQ ID NO: 657888 - RNA, 64 nt, hsa
uuugugaagcaccuugauuccuugauuuugauuuuuugcaaaguuagacaauggcacaaaguca

SEQ ID NO: 657889 - RNA, 64 nt, hsa
cagcaagaaguucauucugugcaauauggacauguuugcaaaccauaccaagggucagguuguu

SEQ ID NO: 657890 - RNA, 64 nt, hsa
uuauuuuaaaguaaccuuauauuuaaaagaugauuuugcaaaaaauaaaaaauaaaaaauaugc

SEQ ID NO: 657891 - RNA, 64 nt, hsa
uuagguaauuguagggcgaggauuauaaaugaaauuugcaaaaucacuuagcagcaacugaaga

SEQ ID NO: 657892 - RNA, 64 nt, hsa
ugguuuuggggaaauguggagaagagugcccugcuuugcaaacaucaaccuggcaaaaaugcaa

SEQ ID NO: 657893 - RNA, 64 nt, hsa
ccuauggaaauauauaucuauuauauauauauuuuuugcaaaucucacaaagugcggcaagccc

SEQ ID NO: 657894 - RNA, 64 nt, hsa
aagucugaauacauuuuugaaauaggaacucccuuuugcaaaaaagaaaccugggugucaggga

SEQ ID NO: 657895 - RNA, 64 nt, hsa
caauuggcuuauuuuuuagaucaccugcaauucauuugcaaauugcaauaaaacacauuuuaga

SEQ ID NO: 657896 - RNA, 64 nt, hsa
gagaugaucacgguuucuuuuguuuaucacgccauuugcaaaucagagcaagagcucuuucuca

SEQ ID NO: 657897 - RNA, 64 nt, hsa
augggccuggcugggaguggaagaagggaagccuuuugcaaauaguagaguaucaguugcaggu

SEQ ID NO: 657898 - RNA, 63 nt, hsa
uuugaauucuauguuggcauuaacaauaaagcauuuugcaaacacugguuauaacugucuuua

SEQ ID NO: 657899 - RNA, 64 nt, hsa
gaacagucauuucaccuacuauuucugaauauauuuugcaaauugaauuggaauaggaauugau

SEQ ID NO: 657900 - RNA, 64 nt, hsa
uauuacagaacguugccuuguuuuccuuggaaauuuugcaaaauguuaugugaaacaacuucua

SEQ ID NO: 657901 - RNA, 64 nt, hsa
accccaaagaucucauguuaaguggagaaaggguuuugcaaacugaaagaucuguagagaguag

SEQ ID NO: 657902 - RNA, 64 nt, hsa
ucccuuguauuuuacagaugcaaacagcuauaauuuugcaaaaaaggaaaauaacucuccugaa

SEQ ID NO: 657903 - RNA, 64 nt, hsa
uauuuuuuuccuuguaucaagaugcaaaacauaauuugcaaaauuuuauaauugaaauaaaacu

SEQ ID NO: 657904 - RNA, 64 nt, hsa
agcguacaauuuaucauaaauauaugagguaaaauuugcaaaacuuuccacaguacuuucuuga

SEQ ID NO: 657905 - RNA, 64 nt, hsa
uacauccaauaugucaaguuaaaccauucugggauuugcaaaguuuaauacauccaauauguca

SEQ ID NO: 657906 - RNA, 64 nt, hsa; identical to SEQ ID NO: 657905

SEQ ID NO: 657907 - RNA, 64 nt, hsa
acauuuaauucaaggaucaaaaauuguggccaucuuugcaaaugacuaccuauagccugugaaa

SEQ ID NO: 657908 - RNA, 64 nt, hsa
aaagccaauauaaauucucauaagcacuauagaauuugcaaauucagaacauuuuauaccuaaa

SEQ ID NO: 657909 - RNA, 64 nt, hsa
aguguguugcucuuucaaguucuaucacuuuuuguuugcaaaguucaaagcuguauuguuuggu

SEQ ID NO: 657910 - RNA, 64 nt, hsa
cuugcccagcuuuuugaucuguaggauuaugccuuuugcaaaauuuggggaacuuucaacuauu

SEQ ID NO: 657911 - RNA, 64 nt, hsa
acucuuugagucccaggagaagccuggcacccucuuugcaaauuggccuuugcucuuucaaugc

SEQ ID NO: 657912 - RNA, 64 nt, hsa
aggcagguuucgggccugaagcagaucagagggcuuugcaaaagacagcauagagccaucuucc

SEQ ID NO: 657913 - RNA, 64 nt, hsa
uguguucuuuuccugucaauuuucauagaccuaauuugcaaacucaaucggggacuaaaauuuc

SEQ ID NO: 657914 - RNA, 64 nt, hsa
aucuugaauguuguguauauauuuuaaaaagcacuuugcaaaauaguuuguacauuuauuuccu

SEQ ID NO: 657915 - RNA, 64 nt, hsa
ccauuuaaauuauauccucauuuuaaaaguuacauuugcaaauauuucucccuaugauaaugua

SEQ ID NO: 657916 - RNA, 64 nt, hsa
uuuaguucuuacauuucuaauagccuuggguuuauuugcaaaggaagcuugaaaaauaugagaa

SEQ ID NO: 657917 - RNA, 64 nt, hsa
gcauucucuuuuguuugcaaauuggucaacaaaauuugcaaagugauuucaggagagagcagcu

SEQ ID NO: 657918 - RNA, 64 nt, hsa
uucuagguuggguaggccacugcauucucuuuuguuugcaaauuggucaacaaaauuugcaaag

SEQ ID NO: 657919 - RNA, 64 nt, hsa
ucauguccugaaguuggaauuuaaauaauuccuauuugcaaauuagaaugacaguguuggaauu

SEQ ID NO: 657920 - RNA, 64 nt, hsa
caugauugcuaucuuauuuuuguuauccgagaccuuugcaaacauuggcaaauagcaucaauua

SEQ ID NO: 657921 - RNA, 64 nt, hsa
aguugaaguauuuuucuugccaugccuauuuauuuuugcaaaaaaauuaucugcuauauagaac

SEQ ID NO: 657922 - RNA, 64 nt, hsa
uuauacagucauauggcuacacguuuauguaaaguuugcaaaaguuugguguuuugauuuauaa

SEQ ID NO: 657923 - RNA, 64 nt, hsa
ugcuguaaauacuauguuuacuucaugcugaauguuugcaaagacuugauauaaguauuaauag

SEQ ID NO: 657924 - RNA, 64 nt, hsa
caccuuuuaaacgacaaagcaugguuuguggcuuuuugcaaaauuacuaugaaccaaaaguuga

SEQ ID NO: 657925 - RNA, 64 nt, hsa
uccaggaagaagcccauuuguugaggcugaccuuccugaucauacacacacacagcccagcaaa

SEQ ID NO: 657926 - RNA, 64 nt, hsa
ugauugaugacggguucccgccugcuguccccucccugaucacacagcuaacgaggcugccucc

SEQ ID NO: 657927 - RNA, 64 nt, hsa; identical to SEQ ID NO: 101903

SEQ ID NO: 657928 - RNA, 64 nt, hsa; identical to SEQ ID NO: 101904

SEQ ID NO: 657929 - RNA, 64 nt, hsa; identical to SEQ ID NO: 101905

SEQ ID NO: 657930 - RNA, 64 nt, hsa; identical to SEQ ID NO: 101906

SEQ ID NO: 657931 - RNA, 64 nt, hsa; identical to SEQ ID NO: 101907

SEQ ID NO: 657932 - RNA, 64 nt, hsa; identical to SEQ ID NO: 101908

SEQ ID NO: 657933 - RNA, 64 nt, hsa; identical to SEQ ID NO: 101909

SEQ ID NO: 657934 - RNA, 64 nt, hsa; identical to SEQ ID NO: 101910

SEQ ID NO: 657935 - RNA, 64 nt, hsa; identical to SEQ ID NO: 101911

SEQ ID NO: 657936 - RNA, 64 nt, hsa; identical to SEQ ID NO: 101912

SEQ ID NO: 657937 - RNA, 64 nt, hsa; identical to SEQ ID NO: 101913

SEQ ID NO: 657938 - RNA, 64 nt, hsa; identical to SEQ ID NO: 101914

SEQ ID NO: 657939 - RNA, 64 nt, hsa; identical to SEQ ID NO: 478298

SEQ ID NO: 657940 - RNA, 64 nt, hsa; identical to SEQ ID NO: 478299

SEQ ID NO: 657941 - RNA, 64 nt, hsa; identical to SEQ ID NO: 478300

SEQ ID NO: 657942 - RNA, 64 nt, hsa; identical to SEQ ID NO: 478301

SEQ ID NO: 657943 - RNA, 64 nt, hsa; identical to SEQ ID NO: 478302

SEQ ID NO: 657944 - RNA, 64 nt, hsa; identical to SEQ ID NO: 478303

SEQ ID NO: 657945 - RNA, 64 nt, hsa
uccacuauuaauaaauugaaagcuugcuguacaaaggcaacagcaacuuaaaaaagaaaaucug

SEQ ID NO: 657946 - RNA, 64 nt, hsa
uuauauuuuuuaaaauaaugaauuuucuaucucuaggcaacaugucuuuauuauucaagcugaa

SEQ ID NO: 657947 - RNA, 64 nt, hsa
acacuacuuaacacuccuaaagacuacuuugaguaggcaacauaacuaaauuuuucuaguuucu

SEQ ID NO: 657948 - RNA, 64 nt, hsa
ggugagccaugaucgugucacugcacuccagccuaggcaacagagcaagacccugucucuuaaa

SEQ ID NO: 657949 - RNA, 64 nt, hsa
aauuugggagggaaaaaagaaauugggaggguacaggcaacaggagaaaggaaucaaaccacag

SEQ ID NO: 657950 - RNA, 64 nt, hsa
gcaaacaaauuugauuauuuuuucauuguuaaauaggcaacaugaccagaaaggauggaauggc

SEQ ID NO: 657951 - RNA, 64 nt, hsa
cuggcagcugucccaagcaauggguaaugaugauggcaaaaaggguguuugggggaacagcugc

SEQ ID NO: 657952 - RNA, 64 nt, hsa
agccaaagcaucuuugacagaagguucugcaccaggcaaaaagaucugaaacauuaguuugggg

SEQ ID NO: 657953 - RNA, 64 nt, hsa
aaauccagccaguguuuuuugugguaugagaacaggcaaaaagagaugccccgagauagaaggg

SEQ ID NO: 657954 - RNA, 64 nt, hsa
ggcuaaugaugaggguugguggggcucucuguggggcaaaaaggugguauggggguuagcacug

SEQ ID NO: 657955 - RNA, 64 nt, hsa
uuguuuggucaguacuguuagcucauuugaaguuggcaaaaacaaauacaaacaagcaaaaaac

SEQ ID NO: 657956 - RNA, 64 nt, hsa
cuaaugggcugcugucauuuuaugcuaaguaaggggcaaaaaaaaaaauuacauuaugcccuug

SEQ ID NO: 657957 - RNA, 64 nt, hsa
uguaacccuguuguuacuuuauauuucauaaucaggcaaaaauacuuacaguuaauaauauaga

SEQ ID NO: 657958 - RNA, 64 nt, hsa
guaggaauucaguugggcaaugauaacuuuuaugggcaaaaacauucuauuauagugaacuaau

SEQ ID NO: 657959 - RNA, 64 nt, hsa
cagaaagaagagaucacaaacauaugagucagauggcaaaaaucaagcaaacccuucuagacag

SEQ ID NO: 657960 - RNA, 64 nt, hsa
uuuuguuaauaaagaacagauuaguuuugaagaaggcaaaaauuucaguuuucugaagacagca

SEQ ID NO: 657961 - RNA, 64 nt, hsa
gaugugguuuacaguaagguggaugguaccuuauggcaaaaaucucucagaaauuuaugugugg

SEQ ID NO: 657962 - RNA, 64 nt, hsa
gcgaaagaaacuggagcagccggcggcaggagagggcaaaaagccaagaguaaccccaaccccc

SEQ ID NO: 657963 - RNA, 64 nt, hsa
uugauauagguggacuuuuuuacaggucaguugaggcaaaaaacuauggguuuuuucaggugaa

SEQ ID NO: 657964 - RNA, 64 nt, hsa
uaguauuuggaaugaauggaagaauauggguuaaggcaaaaaccauccagcagacuuuaauuuu

SEQ ID NO: 657965 - RNA, 64 nt, hsa
auauucaauauuaaaauaguuuuauauuugggaaggcaaaaaugaaucuauuguuuugcaauau

SEQ ID NO: 657966 - RNA, 64 nt, hsa
acaugacuggggaggccucagaaucauggugggaggcaaaaagcacuucuuacauggcggcagc

SEQ ID NO: 657967 - RNA, 64 nt, hsa
uucuaauaucacaauaggugcuuucuccuaaaagggcaaaaaacaaucucaaaaagauuagaaa

SEQ ID NO: 657968 - RNA, 64 nt, hsa
gagaucaggaguucgaggccagccuggccaagauggcaaaaaccccgacucuacuaaaaauaca

SEQ ID NO: 657969 - RNA, 64 nt, hsa
agacaaaugaggucauaaacacugcauaaagcaaggcaaaaauguaugccacaucucaguuauc

SEQ ID NO: 657970 - RNA, 64 nt, hsa
acagggaggauugaaaaaaagggcacucugauagggcaaaaacggaacaugggaggggacaaau

SEQ ID NO: 657971 - RNA, 64 nt, hsa
guuuauauaguuaguuuucagcucauuuaaaagaggcaaaaauuaaaagcuuggagagauaguu

SEQ ID NO: 657972 - RNA, 64 nt, hsa
gaccacuuuauaccuucgcaguguggucucugggggcaaaaaacuaaugaaaacaaucucugua

SEQ ID NO: 657973 - RNA, 64 nt, hsa
ccauggccugauauuaguucuuagagcuucuuguggcaaaaauaaaaugauuuaauucugaugu

SEQ ID NO: 657974 - RNA, 64 nt, hsa; identical to SEQ ID NO: 351954

SEQ ID NO: 657975 - RNA, 64 nt, hsa; identical to SEQ ID NO: 351955

SEQ ID NO: 657976 - RNA, 64 nt, hsa; identical to SEQ ID NO: 351956

SEQ ID NO: 657977 - RNA, 64 nt, hsa; identical to SEQ ID NO: 351957

SEQ ID NO: 657978 - RNA, 64 nt, hsa; identical to SEQ ID NO: 351958

SEQ ID NO: 657979 - RNA, 64 nt, hsa; identical to SEQ ID NO: 351959

SEQ ID NO: 657980 - RNA, 64 nt, hsa; identical to SEQ ID NO: 351960

SEQ ID NO: 657981 - RNA, 64 nt, hsa; identical to SEQ ID NO: 351961

SEQ ID NO: 657982 - RNA, 64 nt, hsa; identical to SEQ ID NO: 351962

SEQ ID NO: 657983 - RNA, 64 nt, hsa; identical to SEQ ID NO: 351963

SEQ ID NO: 657984 - RNA, 64 nt, hsa; identical to SEQ ID NO: 351964

SEQ ID NO: 657985 - RNA, 64 nt, hsa; identical to SEQ ID NO: 351965

SEQ ID NO: 657986 - RNA, 64 nt, hsa; identical to SEQ ID NO: 351966

SEQ ID NO: 657987 - RNA, 64 nt, hsa; identical to SEQ ID NO: 351967

SEQ ID NO: 657988 - RNA, 64 nt, hsa; identical to SEQ ID NO: 351968

SEQ ID NO: 657989 - RNA, 64 nt, hsa; identical to SEQ ID NO: 351969

SEQ ID NO: 657990 - RNA, 64 nt, hsa; identical to SEQ ID NO: 351970

SEQ ID NO: 657991 - RNA, 64 nt, hsa; identical to SEQ ID NO: 351971

SEQ ID NO: 657992 - RNA, 64 nt, hsa; identical to SEQ ID NO: 351972

SEQ ID NO: 657993 - RNA, 64 nt, hsa; identical to SEQ ID NO: 351973

SEQ ID NO: 657994 - RNA, 64 nt, hsa; identical to SEQ ID NO: 351974

SEQ ID NO: 657995 - RNA, 64 nt, hsa; identical to SEQ ID NO: 351975

SEQ ID NO: 657996 - RNA, 64 nt, hsa; identical to SEQ ID NO: 351976

SEQ ID NO: 657997 - RNA, 64 nt, hsa; identical to SEQ ID NO: 351977

SEQ ID NO: 657998 - RNA, 64 nt, hsa; identical to SEQ ID NO: 351978

SEQ ID NO: 657999 - RNA, 64 nt, hsa; identical to SEQ ID NO: 351979

SEQ ID NO: 658000 - RNA, 64 nt, hsa; identical to SEQ ID NO: 351980

SEQ ID NO: 658001 - RNA, 64 nt, hsa; identical to SEQ ID NO: 351981

SEQ ID NO: 658002 - RNA, 64 nt, hsa; identical to SEQ ID NO: 351982

SEQ ID NO: 658003 - RNA, 64 nt, hsa; identical to SEQ ID NO: 351983

SEQ ID NO: 658004 - RNA, 64 nt, hsa; identical to SEQ ID NO: 351984

SEQ ID NO: 658005 - RNA, 64 nt, hsa; identical to SEQ ID NO: 351985

SEQ ID NO: 658006 - RNA, 64 nt, hsa; identical to SEQ ID NO: 351986

SEQ ID NO: 658007 - RNA, 64 nt, hsa; identical to SEQ ID NO: 351987

SEQ ID NO: 658008 - RNA, 64 nt, hsa; identical to SEQ ID NO: 351988

SEQ ID NO: 658009 - RNA, 64 nt, hsa; identical to SEQ ID NO: 351989

SEQ ID NO: 658010 - RNA, 64 nt, hsa; identical to SEQ ID NO: 351990

SEQ ID NO: 658011 - RNA, 64 nt, hsa; identical to SEQ ID NO: 351991

SEQ ID NO: 658012 - RNA, 64 nt, hsa; identical to SEQ ID NO: 351992

SEQ ID NO: 658013 - RNA, 64 nt, hsa; identical to SEQ ID NO: 351993

SEQ ID NO: 658014 - RNA, 64 nt, hsa; identical to SEQ ID NO: 351994

SEQ ID NO: 658015 - RNA, 64 nt, hsa; identical to SEQ ID NO: 351995

SEQ ID NO: 658016 - RNA, 64 nt, hsa; identical to SEQ ID NO: 351996

SEQ ID NO: 658017 - RNA, 64 nt, hsa; identical to SEQ ID NO: 351997

SEQ ID NO: 658018 - RNA, 64 nt, hsa; identical to SEQ ID NO: 351998

SEQ ID NO: 658019 - RNA, 64 nt, hsa; identical to SEQ ID NO: 351999

SEQ ID NO: 658020 - RNA, 64 nt, hsa; identical to SEQ ID NO: 352000

SEQ ID NO: 658021 - RNA, 64 nt, hsa; identical to SEQ ID NO: 352001

SEQ ID NO: 658022 - RNA, 64 nt, hsa; identical to SEQ ID NO: 352002

SEQ ID NO: 658023 - RNA, 64 nt, hsa; identical to SEQ ID NO: 352003

SEQ ID NO: 658024 - RNA, 64 nt, hsa; identical to SEQ ID NO: 352004

SEQ ID NO: 658025 - RNA, 64 nt, hsa; identical to SEQ ID NO: 352005

SEQ ID NO: 658026 - RNA, 64 nt, hsa; identical to SEQ ID NO: 352006

SEQ ID NO: 658027 - RNA, 64 nt, hsa; identical to SEQ ID NO: 352007

SEQ ID NO: 658028 - RNA, 64 nt, hsa; identical to SEQ ID NO: 352008

SEQ ID NO: 658029 - RNA, 64 nt, hsa; identical to SEQ ID NO: 157890

SEQ ID NO: 658030 - RNA, 64 nt, hsa; identical to SEQ ID NO: 157891

SEQ ID NO: 658031 - RNA, 64 nt, hsa; identical to SEQ ID NO: 157892

SEQ ID NO: 658032 - RNA, 64 nt, hsa; identical to SEQ ID NO: 157893

SEQ ID NO: 658033 - RNA, 64 nt, hsa; identical to SEQ ID NO: 157894

SEQ ID NO: 658034 - RNA, 64 nt, hsa; identical to SEQ ID NO: 157895

SEQ ID NO: 658035 - RNA, 64 nt, hsa; identical to SEQ ID NO: 157896

SEQ ID NO: 658036 - RNA, 64 nt, hsa; identical to SEQ ID NO: 157897

SEQ ID NO: 658037 - RNA, 64 nt, hsa; identical to SEQ ID NO: 157898

SEQ ID NO: 658038 - RNA, 64 nt, hsa; identical to SEQ ID NO: 157899

SEQ ID NO: 658039 - RNA, 64 nt, hsa; identical to SEQ ID NO: 21544

SEQ ID NO: 658040 - RNA, 55 nt, hsa; identical to SEQ ID NO: 21545

SEQ ID NO: 658041 - RNA, 64 nt, hsa; identical to SEQ ID NO: 21546

SEQ ID NO: 658042 - RNA, 64 nt, hsa; identical to SEQ ID NO: 21547

SEQ ID NO: 658043 - RNA, 64 nt, hsa; identical to SEQ ID NO: 21548

SEQ ID NO: 658044 - RNA, 64 nt, hsa; identical to SEQ ID NO: 21549

SEQ ID NO: 658045 - RNA, 64 nt, hsa; identical to SEQ ID NO: 21550

SEQ ID NO: 658046 - RNA, 64 nt, hsa; identical to SEQ ID NO: 21551

SEQ ID NO: 658047 - RNA, 64 nt, hsa; identical to SEQ ID NO: 21552

SEQ ID NO: 658048 - RNA, 64 nt, hsa; identical to SEQ ID NO: 21553

SEQ ID NO: 658049 - RNA, 64 nt, hsa; identical to SEQ ID NO: 21554

SEQ ID NO: 658050 - RNA, 64 nt, hsa; identical to SEQ ID NO: 21555

SEQ ID NO: 658051 - RNA, 64 nt, hsa; identical to SEQ ID NO: 21556

SEQ ID NO: 658052 - RNA, 64 nt, hsa; identical to SEQ ID NO: 21557

SEQ ID NO: 658053 - RNA, 64 nt, hsa; identical to SEQ ID NO: 21558

SEQ ID NO: 658054 - RNA, 64 nt, hsa; identical to SEQ ID NO: 21559

SEQ ID NO: 658055 - RNA, 64 nt, hsa; identical to SEQ ID NO: 132617

SEQ ID NO: 658056 - RNA, 64 nt, hsa; identical to SEQ ID NO: 132618

SEQ ID NO: 658057 - RNA, 64 nt, hsa; identical to SEQ ID NO: 132619

SEQ ID NO: 658058 - RNA, 64 nt, hsa; identical to SEQ ID NO: 132620

SEQ ID NO: 658059 - RNA, 64 nt, hsa; identical to SEQ ID NO: 132621

SEQ ID NO: 658060 - RNA, 64 nt, hsa; identical to SEQ ID NO: 132622

SEQ ID NO: 658061 - RNA, 64 nt, hsa; identical to SEQ ID NO: 132623

SEQ ID NO: 658062 - RNA, 64 nt, hsa; identical to SEQ ID NO: 132624

SEQ ID NO: 658063 - RNA, 64 nt, hsa; identical to SEQ ID NO: 132625

SEQ ID NO: 658064 - RNA, 64 nt, hsa; identical to SEQ ID NO: 132626

SEQ ID NO: 658065 - RNA, 64 nt, hsa; identical to SEQ ID NO: 132627

SEQ ID NO: 658066 - RNA, 64 nt, hsa; identical to SEQ ID NO: 132628

SEQ ID NO: 658067 - RNA, 64 nt, hsa; identical to SEQ ID NO: 132629

SEQ ID NO: 658068 - RNA, 64 nt, hsa; identical to SEQ ID NO: 132630

SEQ ID NO: 658069 - RNA, 64 nt, hsa; identical to SEQ ID NO: 132631

SEQ ID NO: 658070 - RNA, 64 nt, hsa; identical to SEQ ID NO: 132632

SEQ ID NO: 658071 - RNA, 64 nt, hsa; identical to SEQ ID NO: 132633

SEQ ID NO: 658072 - RNA, 64 nt, hsa; identical to SEQ ID NO: 132634

SEQ ID NO: 658073 - RNA, 64 nt, hsa; identical to SEQ ID NO: 132635

SEQ ID NO: 658074 - RNA, 64 nt, hsa; identical to SEQ ID NO: 132636

SEQ ID NO: 658075 - RNA, 64 nt, hsa; identical to SEQ ID NO: 132637

SEQ ID NO: 658076 - RNA, 64 nt, hsa; identical to SEQ ID NO: 132638

SEQ ID NO: 658077 - RNA, 64 nt, hsa; identical to SEQ ID NO: 132639

SEQ ID NO: 658078 - RNA, 64 nt, hsa; identical to SEQ ID NO: 132640

SEQ ID NO: 658079 - RNA, 64 nt, hsa; identical to SEQ ID NO: 132641

SEQ ID NO: 658080 - RNA, 64 nt, hsa; identical to SEQ ID NO: 132642

SEQ ID NO: 658081 - RNA, 64 nt, hsa; identical to SEQ ID NO: 132643

SEQ ID NO: 658082 - RNA, 64 nt, hsa; identical to SEQ ID NO: 132644

SEQ ID NO: 658083 - RNA, 64 nt, hsa; identical to SEQ ID NO: 132645

SEQ ID NO: 658084 - RNA, 64 nt, hsa; identical to SEQ ID NO: 132646

SEQ ID NO: 658085 - RNA, 64 nt, hsa; identical to SEQ ID NO: 132647

SEQ ID NO: 658086 - RNA, 64 nt, hsa; identical to SEQ ID NO: 132648

SEQ ID NO: 658087 - RNA, 64 nt, hsa; identical to SEQ ID NO: 132649

SEQ ID NO: 658088 - RNA, 64 nt, hsa; identical to SEQ ID NO: 132650

SEQ ID NO: 658089 - RNA, 64 nt, hsa; identical to SEQ ID NO: 132651

SEQ ID NO: 658090 - RNA, 64 nt, hsa; identical to SEQ ID NO: 132652

SEQ ID NO: 658091 - RNA, 64 nt, hsa; identical to SEQ ID NO: 132653

SEQ ID NO: 658092 - RNA, 64 nt, hsa; identical to SEQ ID NO: 132654

SEQ ID NO: 658093 - RNA, 64 nt, hsa; identical to SEQ ID NO: 132655

SEQ ID NO: 658094 - RNA, 64 nt, hsa; identical to SEQ ID NO: 132656

SEQ ID NO: 658095 - RNA, 64 nt, hsa; identical to SEQ ID NO: 132657

SEQ ID NO: 658096 - RNA, 64 nt, hsa; identical to SEQ ID NO: 132658

SEQ ID NO: 658097 - RNA, 64 nt, hsa; identical to SEQ ID NO: 132659

SEQ ID NO: 658098 - RNA, 64 nt, hsa; identical to SEQ ID NO: 132660

SEQ ID NO: 658099 - RNA, 64 nt, hsa; identical to SEQ ID NO: 132661

SEQ ID NO: 658100 - RNA, 64 nt, hsa; identical to SEQ ID NO: 132662

SEQ ID NO: 658101 - RNA, 64 nt, hsa; identical to SEQ ID NO: 132663

SEQ ID NO: 658102 - RNA, 64 nt, hsa; identical to SEQ ID NO: 132664

SEQ ID NO: 658103 - RNA, 64 nt, hsa; identical to SEQ ID NO: 132665

SEQ ID NO: 658104 - RNA, 64 nt, hsa; identical to SEQ ID NO: 132666

SEQ ID NO: 658105 - RNA, 64 nt, hsa; identical to SEQ ID NO: 132667

SEQ ID NO: 658106 - RNA, 64 nt, hsa; identical to SEQ ID NO: 132668

SEQ ID NO: 658107 - RNA, 64 nt, hsa; identical to SEQ ID NO: 132669

SEQ ID NO: 658108 - RNA, 64 nt, hsa; identical to SEQ ID NO: 132670

SEQ ID NO: 658109 - RNA, 64 nt, hsa; identical to SEQ ID NO: 132671

SEQ ID NO: 658110 - RNA, 64 nt, hsa; identical to SEQ ID NO: 132672

SEQ ID NO: 658111 - RNA, 64 nt, hsa; identical to SEQ ID NO: 132673

SEQ ID NO: 658112 - RNA, 64 nt, hsa; identical to SEQ ID NO: 132674

SEQ ID NO: 658113 - RNA, 64 nt, hsa; identical to SEQ ID NO: 132675

SEQ ID NO: 658114 - RNA, 64 nt, hsa; identical to SEQ ID NO: 132676

SEQ ID NO: 658115 - RNA, 64 nt, hsa; identical to SEQ ID NO: 132677

SEQ ID NO: 658116 - RNA, 57 nt, hsa; identical to SEQ ID NO: 132678

SEQ ID NO: 658117 - RNA, 64 nt, hsa; identical to SEQ ID NO: 132679

SEQ ID NO: 658118 - RNA, 64 nt, hsa; identical to SEQ ID NO: 132680

SEQ ID NO: 658119 - RNA, 64 nt, hsa; identical to SEQ ID NO: 132681

SEQ ID NO: 658120 - RNA, 64 nt, hsa; identical to SEQ ID NO: 132682

SEQ ID NO: 658121 - RNA, 64 nt, hsa; identical to SEQ ID NO: 132683

SEQ ID NO: 658122 - RNA, 64 nt, hsa; identical to SEQ ID NO: 132684

SEQ ID NO: 658123 - RNA, 64 nt, hsa; identical to SEQ ID NO: 132685

SEQ ID NO: 658124 - RNA, 64 nt, hsa; identical to SEQ ID NO: 132686

SEQ ID NO: 658125 - RNA, 64 nt, hsa; identical to SEQ ID NO: 132687

SEQ ID NO: 658126 - RNA, 64 nt, hsa; identical to SEQ ID NO: 132688

SEQ ID NO: 658127 - RNA, 64 nt, hsa; identical to SEQ ID NO: 132689

SEQ ID NO: 658128 - RNA, 64 nt, hsa; identical to SEQ ID NO: 132690

SEQ ID NO: 658129 - RNA, 55 nt, hsa; identical to SEQ ID NO: 132691

SEQ ID NO: 658130 - RNA, 64 nt, hsa; identical to SEQ ID NO: 132692

SEQ ID NO: 658131 - RNA, 64 nt, hsa; identical to SEQ ID NO: 132693

SEQ ID NO: 658132 - RNA, 64 nt, hsa; identical to SEQ ID NO: 132694

SEQ ID NO: 658133 - RNA, 64 nt, hsa; identical to SEQ ID NO: 132695

SEQ ID NO: 658134 - RNA, 64 nt, hsa; identical to SEQ ID NO: 132696

SEQ ID NO: 658135 - RNA, 64 nt, hsa; identical to SEQ ID NO: 132697

SEQ ID NO: 658136 - RNA, 64 nt, hsa; identical to SEQ ID NO: 132698

SEQ ID NO: 658137 - RNA, 64 nt, hsa; identical to SEQ ID NO: 132699

SEQ ID NO: 658138 - RNA, 64 nt, hsa; identical to SEQ ID NO: 132700

SEQ ID NO: 658139 - RNA, 64 nt, hsa; identical to SEQ ID NO: 132701

SEQ ID NO: 658140 - RNA, 64 nt, hsa; identical to SEQ ID NO: 132702

SEQ ID NO: 658141 - RNA, 64 nt, hsa; identical to SEQ ID NO: 132703

SEQ ID NO: 658142 - RNA, 64 nt, hsa; identical to SEQ ID NO: 132704

SEQ ID NO: 658143 - RNA, 64 nt, hsa; identical to SEQ ID NO: 132705

SEQ ID NO: 658144 - RNA, 64 nt, hsa; identical to SEQ ID NO: 132706

SEQ ID NO: 658145 - RNA, 64 nt, hsa; identical to SEQ ID NO: 132707

SEQ ID NO: 658146 - RNA, 64 nt, hsa; identical to SEQ ID NO: 132708

SEQ ID NO: 658147 - RNA, 64 nt, hsa; identical to SEQ ID NO: 132709

SEQ ID NO: 658148 - RNA, 64 nt, hsa; identical to SEQ ID NO: 132710

SEQ ID NO: 658149 - RNA, 64 nt, hsa; identical to SEQ ID NO: 132711

SEQ ID NO: 658150 - RNA, 64 nt, hsa; identical to SEQ ID NO: 132712

SEQ ID NO: 658151 - RNA, 64 nt, hsa
uaugacaauauuuaaauacuaagugguacuagggaacuacaagaauacuguaaagcuuaagcca

SEQ ID NO: 658152 - RNA, 64 nt, hsa
guccaacuuaaaaccaacagucucaaacgucuacaacuacaauguccaaugagccacuagccac

SEQ ID NO: 658153 - RNA, 64 nt, hsa
acacacaaccuaauaauuucuuauaaaaauuuuaaacuacaaagcuacauuuuuacuugcuugu

SEQ ID NO: 658154 - RNA, 64 nt, hsa
uucuguauuaauauauuagcagauauuuggucuuaacuacaacauagcuuuguuuguaaacuua

SEQ ID NO: 658155 - RNA, 64 nt, hsa
gugcaacauugagaauaaugauuugguucagggcaacuacaaauaaucacuuacuaagccuuaa

SEQ ID NO: 658156 - RNA, 64 nt, hsa
aauuaugaaagugaaaugcaaaugucuguuaucuaacuacaaauugucagauuucuuaaaagga

SEQ ID NO: 658157 - RNA, 64 nt, hsa
aaccacagauugcaaagcauagcauuuuagcaucaacuacaaucaaaagagcgauuugcugaag

SEQ ID NO: 658158 - RNA, 64 nt, hsa
gaauggguucugugucuaauccugaaacaaagaaaacuacaagcuggaguguaggaauugacua

SEQ ID NO: 658159 - RNA, 64 nt, hsa
augucagauaaaguaagcauaguaauguagcaggaacuacaauagaagacauuuucacuggaau

SEQ ID NO: 658160 - RNA, 64 nt, hsa
cuuugcuaaggaguaagugaaugugaagaguaccaacuacaacaauucuacagauaauuagugg

SEQ ID NO: 658161 - RNA, 64 nt, hsa
caaauguaauaaauuugaaaaaaaaguuuuccaaaacuacaacuuagacaacaccagaggguuc

SEQ ID NO: 658162 - RNA, 64 nt, hsa
cuuacuaaacauaaaaaaacuuaaacuggagagaaacuacaaagcuggaagacaucacaguaau

SEQ ID NO: 658163 - RNA, 59 nt, hsa
ccgccagccgugagccguaagccggcguccccgcccagccgagagggccggcgccuacc

SEQ ID NO: 658164 - RNA, 64 nt, hsa
ccuggcgggaccccgcagcagccccggccccauccccgcccagagccgggcgucgugugggucc

SEQ ID NO: 658165 - RNA, 64 nt, hsa
ugggcauucaggaccuugaggacacgugaccccacccgcccaccgccacuaucaggccccggga

SEQ ID NO: 658166 - RNA, 64 nt, hsa
ccucccuccccagaccccagagggagaggcccaccccgcccagccccgccccagccccugcuca

SEQ ID NO: 658167 - RNA, 64 nt, hsa
cgucgcugugcuugguguguaggacccuaggcuccccgcccacccucugccuggucgcgcucuu

SEQ ID NO: 658168 - RNA, 64 nt, hsa
caacgaaggcgccaucuaggccgcgcuggcugcacccgcccaggcccgcacccgcccagucccg

SEQ ID NO: 658169 - RNA, 64 nt, hsa
uaggccgcgcuggcugcacccgcccaggcccgcacccgcccagucccgagggcccggcccuguc

SEQ ID NO: 658170 - RNA, 50 nt, hsa
gcagugccaacggccucugacccgcccacccgccuuuuauaaaccucuaa

SEQ ID NO: 658171 - RNA, 64 nt, hsa
cagugugccccccauccuggcccaucaguguacccccgcccaggcuggccagccccacagccca

SEQ ID NO: 658172 - RNA, 64 nt, hsa
cgcccaacuucccuacuggcugcuccccuugggucccgcccaccagcggacucggcccccaagg

SEQ ID NO: 658173 - RNA, 52 nt, hsa
ggguggugcccggcauguaagccccgcccaccccacggaggccacagccaca

SEQ ID NO: 658174 - RNA, 64 nt, hsa
cucugcccacccgagccccaccacucucagaacccccgcccagcgcacggcgaccucgcgccuc

SEQ ID NO: 658175 - RNA, 64 nt, hsa
cggguggggguguggccgagccccggcaggaagccccgcccagacgguguucagggaacccgga

SEQ ID NO: 658176 - RNA, 64 nt, hsa
cugcccagggcuccccaacuauaggccugggacccccgcccagcuuggggggcugcucguacga

SEQ ID NO: 658177 - RNA, 64 nt, hsa
ugcacaccaggcugcugcuuuguccgucuauccacccgcccacccgcccccaccccaccggcag

SEQ ID NO: 658178 - RNA, 64 nt, hsa
agaagcuccuggagauugccaccaagcccacguacccgcccaugaacccaauuccagcaccguu

SEQ ID NO: 658179 - RNA, 64 nt, hsa
ugaagcccugagaagccagugccaucauccccaccccgcccaggguuccggaacauucauuccc

SEQ ID NO: 658180 - RNA, 64 nt, hsa
ccagcacgccugccggcuucucaucgucagggagcccgcccagagcucgugacgagcaagugcu

SEQ ID NO: 658181 - RNA, 64 nt, hsa; identical to SEQ ID NO: 236284

SEQ ID NO: 658182 - RNA, 64 nt, hsa; identical to SEQ ID NO: 236285

SEQ ID NO: 658183 - RNA, 64 nt, hsa; identical to SEQ ID NO: 236286

SEQ ID NO: 658184 - RNA, 64 nt, hsa; identical to SEQ ID NO: 236287

SEQ ID NO: 658185 - RNA, 64 nt, hsa; identical to SEQ ID NO: 236288

SEQ ID NO: 658186 - RNA, 64 nt, hsa; identical to SEQ ID NO: 236289

SEQ ID NO: 658187 - RNA, 64 nt, hsa; identical to SEQ ID NO: 189516

SEQ ID NO: 658188 - RNA, 64 nt, hsa; identical to SEQ ID NO: 189517

SEQ ID NO: 658189 - RNA, 64 nt, hsa; identical to SEQ ID NO: 245345

SEQ ID NO: 658190 - RNA, 64 nt, hsa; identical to SEQ ID NO: 245346

SEQ ID NO: 658191 - RNA, 64 nt, hsa; identical to SEQ ID NO: 245347

SEQ ID NO: 658192 - RNA, 64 nt, hsa; identical to SEQ ID NO: 245348

SEQ ID NO: 658193 - RNA, 64 nt, hsa; identical to SEQ ID NO: 245349

SEQ ID NO: 658194 - RNA, 64 nt, hsa; identical to SEQ ID NO: 245350

SEQ ID NO: 658195 - RNA, 64 nt, hsa; identical to SEQ ID NO: 245351

SEQ ID NO: 658196 - RNA, 64 nt, hsa; identical to SEQ ID NO: 245352

SEQ ID NO: 658197 - RNA, 64 nt, hsa; identical to SEQ ID NO: 245353

SEQ ID NO: 658198 - RNA, 64 nt, hsa; identical to SEQ ID NO: 245354

SEQ ID NO: 658199 - RNA, 64 nt, hsa; identical to SEQ ID NO: 245355

SEQ ID NO: 658200 - RNA, 64 nt, hsa; identical to SEQ ID NO: 245356

SEQ ID NO: 658201 - RNA, 64 nt, hsa; identical to SEQ ID NO: 245357

SEQ ID NO: 658202 - RNA, 64 nt, hsa; identical to SEQ ID NO: 245358

SEQ ID NO: 658203 - RNA, 64 nt, hsa; identical to SEQ ID NO: 245359

SEQ ID NO: 658204 - RNA, 64 nt, hsa; identical to SEQ ID NO: 245360

SEQ ID NO: 658205 - RNA, 64 nt, hsa; identical to SEQ ID NO: 245361

SEQ ID NO: 658206 - RNA, 64 nt, hsa; identical to SEQ ID NO: 245362

SEQ ID NO: 658207 - RNA, 64 nt, hsa; identical to SEQ ID NO: 245363

SEQ ID NO: 658208 - RNA, 64 nt, hsa; identical to SEQ ID NO: 245364

SEQ ID NO: 658209 - RNA, 64 nt, hsa; identical to SEQ ID NO: 245365

SEQ ID NO: 658210 - RNA, 64 nt, hsa; identical to SEQ ID NO: 245366

SEQ ID NO: 658211 - RNA, 64 nt, hsa; identical to SEQ ID NO: 245367

SEQ ID NO: 658212 - RNA, 64 nt, hsa; identical to SEQ ID NO: 245368

SEQ ID NO: 658213 - RNA, 64 nt, hsa; identical to SEQ ID NO: 245369

SEQ ID NO: 658214 - RNA, 64 nt, hsa; identical to SEQ ID NO: 245370

SEQ ID NO: 658215 - RNA, 64 nt, hsa; identical to SEQ ID NO: 245371

SEQ ID NO: 658216 - RNA, 64 nt, hsa; identical to SEQ ID NO: 245372

SEQ ID NO: 658217 - RNA, 64 nt, hsa; identical to SEQ ID NO: 245373

SEQ ID NO: 658218 - RNA, 64 nt, hsa; identical to SEQ ID NO: 245374

SEQ ID NO: 658219 - RNA, 64 nt, hsa; identical to SEQ ID NO: 245375

SEQ ID NO: 658220 - RNA, 64 nt, hsa; identical to SEQ ID NO: 245376

SEQ ID NO: 658221 - RNA, 64 nt, hsa; identical to SEQ ID NO: 245377

SEQ ID NO: 658222 - RNA, 64 nt, hsa; identical to SEQ ID NO: 245378

SEQ ID NO: 658223 - RNA, 64 nt, hsa; identical to SEQ ID NO: 245379

SEQ ID NO: 658224 - RNA, 64 nt, hsa; identical to SEQ ID NO: 245380

SEQ ID NO: 658225 - RNA, 64 nt, hsa; identical to SEQ ID NO: 245381

SEQ ID NO: 658226 - RNA, 64 nt, hsa; identical to SEQ ID NO: 245382

SEQ ID NO: 658227 - RNA, 64 nt, hsa; identical to SEQ ID NO: 245383

SEQ ID NO: 658228 - RNA, 64 nt, hsa; identical to SEQ ID NO: 245384

SEQ ID NO: 658229 - RNA, 64 nt, hsa; identical to SEQ ID NO: 245385

SEQ ID NO: 658230 - RNA, 51 nt, hsa; identical to SEQ ID NO: 245386

SEQ ID NO: 658231 - RNA, 64 nt, hsa; identical to SEQ ID NO: 245387

SEQ ID NO: 658232 - RNA, 64 nt, hsa; identical to SEQ ID NO: 245388

SEQ ID NO: 658233 - RNA, 64 nt, hsa; identical to SEQ ID NO: 245389

SEQ ID NO: 658234 - RNA, 64 nt, hsa; identical to SEQ ID NO: 245390

SEQ ID NO: 658235 - RNA, 64 nt, hsa; identical to SEQ ID NO: 245391

SEQ ID NO: 658236 - RNA, 64 nt, hsa; identical to SEQ ID NO: 245392

SEQ ID NO: 658237 - RNA, 57 nt, hsa; identical to SEQ ID NO: 245393

SEQ ID NO: 658238 - RNA, 64 nt, hsa; identical to SEQ ID NO: 245394

SEQ ID NO: 658239 - RNA, 64 nt, hsa; identical to SEQ ID NO: 245395

SEQ ID NO: 658240 - RNA, 64 nt, hsa; identical to SEQ ID NO: 245396

SEQ ID NO: 658241 - RNA, 64 nt, hsa; identical to SEQ ID NO: 245397

SEQ ID NO: 658242 - RNA, 64 nt, hsa; identical to SEQ ID NO: 245398

SEQ ID NO: 658243 - RNA, 64 nt, hsa; identical to SEQ ID NO: 245399

SEQ ID NO: 658244 - RNA, 64 nt, hsa; identical to SEQ ID NO: 245400

SEQ ID NO: 658245 - RNA, 64 nt, hsa; identical to SEQ ID NO: 245401

SEQ ID NO: 658246 - RNA, 64 nt, hsa; identical to SEQ ID NO: 245402

SEQ ID NO: 658247 - RNA, 64 nt, hsa; identical to SEQ ID NO: 245403

SEQ ID NO: 658248 - RNA, 64 nt, hsa; identical to SEQ ID NO: 245404

SEQ ID NO: 658249 - RNA, 64 nt, hsa; identical to SEQ ID NO: 245405

SEQ ID NO: 658250 - RNA, 64 nt, hsa; identical to SEQ ID NO: 96836

SEQ ID NO: 658251 - RNA, 64 nt, hsa; identical to SEQ ID NO: 96837

SEQ ID NO: 658252 - RNA, 64 nt, hsa; identical to SEQ ID NO: 96838

SEQ ID NO: 658253 - RNA, 64 nt, hsa; identical to SEQ ID NO: 96839

SEQ ID NO: 658254 - RNA, 64 nt, hsa; identical to SEQ ID NO: 96840

SEQ ID NO: 658255 - RNA, 64 nt, hsa; identical to SEQ ID NO: 96841

SEQ ID NO: 658256 - RNA, 64 nt, hsa; identical to SEQ ID NO: 96842

SEQ ID NO: 658257 - RNA, 64 nt, hsa; identical to SEQ ID NO: 96843

SEQ ID NO: 658258 - RNA, 64 nt, hsa; identical to SEQ ID NO: 96844

SEQ ID NO: 658259 - RNA, 64 nt, hsa; identical to SEQ ID NO: 96845

SEQ ID NO: 658260 - RNA, 64 nt, hsa; identical to SEQ ID NO: 96846

SEQ ID NO: 658261 - RNA, 64 nt, hsa; identical to SEQ ID NO: 96847

SEQ ID NO: 658262 - RNA, 64 nt, hsa; identical to SEQ ID NO: 96848

SEQ ID NO: 658263 - RNA, 64 nt, hsa; identical to SEQ ID NO: 96849

SEQ ID NO: 658264 - RNA, 64 nt, hsa; identical to SEQ ID NO: 96850

SEQ ID NO: 658265 - RNA, 64 nt, hsa; identical to SEQ ID NO: 96851

SEQ ID NO: 658266 - RNA, 64 nt, hsa; identical to SEQ ID NO: 96852

SEQ ID NO: 658267 - RNA, 64 nt, hsa; identical to SEQ ID NO: 96853

SEQ ID NO: 658268 - RNA, 64 nt, hsa; identical to SEQ ID NO: 96854

SEQ ID NO: 658269 - RNA, 64 nt, hsa; identical to SEQ ID NO: 96855

SEQ ID NO: 658270 - RNA, 64 nt, hsa; identical to SEQ ID NO: 96856

SEQ ID NO: 658271 - RNA, 64 nt, hsa; identical to SEQ ID NO: 96857

SEQ ID NO: 658272 - RNA, 64 nt, hsa; identical to SEQ ID NO: 96858

SEQ ID NO: 658273 - RNA, 64 nt, hsa; identical to SEQ ID NO: 96859

SEQ ID NO: 658274 - RNA, 64 nt, hsa; identical to SEQ ID NO: 96860

SEQ ID NO: 658275 - RNA, 64 nt, hsa; identical to SEQ ID NO: 96861

SEQ ID NO: 658276 - RNA, 64 nt, hsa; identical to SEQ ID NO: 96862

SEQ ID NO: 658277 - RNA, 64 nt, hsa; identical to SEQ ID NO: 96863

SEQ ID NO: 658278 - RNA, 64 nt, hsa; identical to SEQ ID NO: 96864

SEQ ID NO: 658279 - RNA, 64 nt, hsa; identical to SEQ ID NO: 96865

SEQ ID NO: 658280 - RNA, 64 nt, hsa; identical to SEQ ID NO: 96866

SEQ ID NO: 658281 - RNA, 64 nt, hsa; identical to SEQ ID NO: 96867

SEQ ID NO: 658282 - RNA, 64 nt, hsa; identical to SEQ ID NO: 96868

SEQ ID NO: 658283 - RNA, 64 nt, hsa; identical to SEQ ID NO: 96869

SEQ ID NO: 658284 - RNA, 64 nt, hsa; identical to SEQ ID NO: 96870

SEQ ID NO: 658285 - RNA, 64 nt, hsa; identical to SEQ ID NO: 96871

SEQ ID NO: 658286 - RNA, 64 nt, hsa; identical to SEQ ID NO: 96872

SEQ ID NO: 658287 - RNA, 64 nt, hsa; identical to SEQ ID NO: 96873

SEQ ID NO: 658288 - RNA, 64 nt, hsa; identical to SEQ ID NO: 96874

SEQ ID NO: 658289 - RNA, 64 nt, hsa; identical to SEQ ID NO: 96875

SEQ ID NO: 658290 - RNA, 64 nt, hsa; identical to SEQ ID NO: 169676

SEQ ID NO: 658291 - RNA, 64 nt, hsa; identical to SEQ ID NO: 169677

SEQ ID NO: 658292 - RNA, 64 nt, hsa; identical to SEQ ID NO: 169678

SEQ ID NO: 658293 - RNA, 64 nt, hsa; identical to SEQ ID NO: 169679

SEQ ID NO: 658294 - RNA, 64 nt, hsa; identical to SEQ ID NO: 169680

SEQ ID NO: 658295 - RNA, 64 nt, hsa; identical to SEQ ID NO: 169681

SEQ ID NO: 658296 - RNA, 64 nt, hsa; identical to SEQ ID NO: 169682

SEQ ID NO: 658297 - RNA, 64 nt, hsa; identical to SEQ ID NO: 169683

SEQ ID NO: 658298 - RNA, 64 nt, hsa; identical to SEQ ID NO: 169684

SEQ ID NO: 658299 - RNA, 64 nt, hsa; identical to SEQ ID NO: 169685

SEQ ID NO: 658300 - RNA, 64 nt, hsa; identical to SEQ ID NO: 169686

SEQ ID NO: 658301 - RNA, 64 nt, hsa; identical to SEQ ID NO: 169687

SEQ ID NO: 658302 - RNA, 64 nt, hsa; identical to SEQ ID NO: 169688

SEQ ID NO: 658303 - RNA, 64 nt, hsa; identical to SEQ ID NO: 169689

SEQ ID NO: 658304 - RNA, 64 nt, hsa; identical to SEQ ID NO: 169690

SEQ ID NO: 658305 - RNA, 64 nt, hsa; identical to SEQ ID NO: 169691

SEQ ID NO: 658306 - RNA, 64 nt, hsa; identical to SEQ ID NO: 169692

SEQ ID NO: 658307 - RNA, 64 nt, hsa; identical to SEQ ID NO: 169693

SEQ ID NO: 658308 - RNA, 64 nt, hsa; identical to SEQ ID NO: 169694

SEQ ID NO: 658309 - RNA, 64 nt, hsa; identical to SEQ ID NO: 169695

SEQ ID NO: 658310 - RNA, 64 nt, hsa; identical to SEQ ID NO: 169696

SEQ ID NO: 658311 - RNA, 64 nt, hsa; identical to SEQ ID NO: 169697

SEQ ID NO: 658312 - RNA, 64 nt, hsa; identical to SEQ ID NO: 169698

SEQ ID NO: 658313 - RNA, 64 nt, hsa; identical to SEQ ID NO: 169699

SEQ ID NO: 658314 - RNA, 64 nt, hsa; identical to SEQ ID NO: 169700

SEQ ID NO: 658315 - RNA, 64 nt, hsa; identical to SEQ ID NO: 169701

SEQ ID NO: 658316 - RNA, 64 nt, hsa; identical to SEQ ID NO: 169702

SEQ ID NO: 658317 - RNA, 64 nt, hsa; identical to SEQ ID NO: 169703

SEQ ID NO: 658318 - RNA, 64 nt, hsa; identical to SEQ ID NO: 169704

SEQ ID NO: 658319 - RNA, 64 nt, hsa; identical to SEQ ID NO: 169705

SEQ ID NO: 658320 - RNA, 64 nt, hsa; identical to SEQ ID NO: 169706

SEQ ID NO: 658321 - RNA, 64 nt, hsa; identical to SEQ ID NO: 169707

SEQ ID NO: 658322 - RNA, 64 nt, hsa; identical to SEQ ID NO: 169708

SEQ ID NO: 658323 - RNA, 64 nt, hsa; identical to SEQ ID NO: 169709

SEQ ID NO: 658324 - RNA, 64 nt, hsa; identical to SEQ ID NO: 169710

SEQ ID NO: 658325 - RNA, 64 nt, hsa; identical to SEQ ID NO: 169711

SEQ ID NO: 658326 - RNA, 64 nt, hsa; identical to SEQ ID NO: 169712

SEQ ID NO: 658327 - RNA, 64 nt, hsa; identical to SEQ ID NO: 169713

SEQ ID NO: 658328 - RNA, 64 nt, hsa; identical to SEQ ID NO: 169714

SEQ ID NO: 658329 - RNA, 64 nt, hsa; identical to SEQ ID NO: 169715

SEQ ID NO: 658330 - RNA, 64 nt, hsa; identical to SEQ ID NO: 169716

SEQ ID NO: 658331 - RNA, 64 nt, hsa; identical to SEQ ID NO: 169717

SEQ ID NO: 658332 - RNA, 64 nt, hsa; identical to SEQ ID NO: 169718

SEQ ID NO: 658333 - RNA, 64 nt, hsa; identical to SEQ ID NO: 169719

SEQ ID NO: 658334 - RNA, 64 nt, hsa; identical to SEQ ID NO: 169720

SEQ ID NO: 658335 - RNA, 62 nt, hsa; identical to SEQ ID NO: 169721

SEQ ID NO: 658336 - RNA, 64 nt, hsa; identical to SEQ ID NO: 169722

SEQ ID NO: 658337 - RNA, 64 nt, hsa; identical to SEQ ID NO: 169723

SEQ ID NO: 658338 - RNA, 64 nt, hsa; identical to SEQ ID NO: 169724

SEQ ID NO: 658339 - RNA, 64 nt, hsa; identical to SEQ ID NO: 169725

SEQ ID NO: 658340 - RNA, 64 nt, hsa; identical to SEQ ID NO: 169726

SEQ ID NO: 658341 - RNA, 64 nt, hsa; identical to SEQ ID NO: 169727

SEQ ID NO: 658342 - RNA, 64 nt, hsa; identical to SEQ ID NO: 169728

SEQ ID NO: 658343 - RNA, 64 nt, hsa; identical to SEQ ID NO: 169729

SEQ ID NO: 658344 - RNA, 64 nt, hsa; identical to SEQ ID NO: 169730

SEQ ID NO: 658345 - RNA, 64 nt, hsa; identical to SEQ ID NO: 169731

SEQ ID NO: 658346 - RNA, 64 nt, hsa; identical to SEQ ID NO: 169732

SEQ ID NO: 658347 - RNA, 64 nt, hsa; identical to SEQ ID NO: 169733

SEQ ID NO: 658348 - RNA, 64 nt, hsa; identical to SEQ ID NO: 169734

SEQ ID NO: 658349 - RNA, 64 nt, hsa; identical to SEQ ID NO: 281104

SEQ ID NO: 658350 - RNA, 64 nt, hsa; identical to SEQ ID NO: 281105

SEQ ID NO: 658351 - RNA, 64 nt, hsa; identical to SEQ ID NO: 281106

SEQ ID NO: 658352 - RNA, 64 nt, hsa; identical to SEQ ID NO: 281107

SEQ ID NO: 658353 - RNA, 64 nt, hsa; identical to SEQ ID NO: 281108

SEQ ID NO: 658354 - RNA, 64 nt, hsa; identical to SEQ ID NO: 281109

SEQ ID NO: 658355 - RNA, 64 nt, hsa; identical to SEQ ID NO: 281110

SEQ ID NO: 658356 - RNA, 64 nt, hsa; identical to SEQ ID NO: 281111

SEQ ID NO: 658357 - RNA, 64 nt, hsa; identical to SEQ ID NO: 281112

SEQ ID NO: 658358 - RNA, 64 nt, hsa; identical to SEQ ID NO: 281113

SEQ ID NO: 658359 - RNA, 64 nt, hsa; identical to SEQ ID NO: 281114

SEQ ID NO: 658360 - RNA, 64 nt, hsa; identical to SEQ ID NO: 281115

SEQ ID NO: 658361 - RNA, 64 nt, hsa; identical to SEQ ID NO: 281116

SEQ ID NO: 658362 - RNA, 64 nt, hsa; identical to SEQ ID NO: 281117

SEQ ID NO: 658363 - RNA, 64 nt, hsa; identical to SEQ ID NO: 281118

SEQ ID NO: 658364 - RNA, 64 nt, hsa; identical to SEQ ID NO: 281119

SEQ ID NO: 658365 - RNA, 64 nt, hsa; identical to SEQ ID NO: 303055

SEQ ID NO: 658366 - RNA, 64 nt, hsa; identical to SEQ ID NO: 303056

SEQ ID NO: 658367 - RNA, 64 nt, hsa; identical to SEQ ID NO: 303057

SEQ ID NO: 658368 - RNA, 64 nt, hsa; identical to SEQ ID NO: 303058

SEQ ID NO: 658369 - RNA, 64 nt, hsa; identical to SEQ ID NO: 303059

SEQ ID NO: 658370 - RNA, 64 nt, hsa; identical to SEQ ID NO: 303060

SEQ ID NO: 658371 - RNA, 64 nt, hsa; identical to SEQ ID NO: 303061

SEQ ID NO: 658372 - RNA, 64 nt, hsa; identical to SEQ ID NO: 303062

SEQ ID NO: 658373 - RNA, 64 nt, hsa; identical to SEQ ID NO: 303063

SEQ ID NO: 658374 - RNA, 64 nt, hsa; identical to SEQ ID NO: 303064

SEQ ID NO: 658375 - RNA, 64 nt, hsa; identical to SEQ ID NO: 303065

SEQ ID NO: 658376 - RNA, 64 nt, hsa; identical to SEQ ID NO: 303066

SEQ ID NO: 658377 - RNA, 64 nt, hsa; identical to SEQ ID NO: 303067

SEQ ID NO: 658378 - RNA, 64 nt, hsa; identical to SEQ ID NO: 303068

SEQ ID NO: 658379 - RNA, 64 nt, hsa; identical to SEQ ID NO: 303069

SEQ ID NO: 658380 - RNA, 64 nt, hsa; identical to SEQ ID NO: 303070

SEQ ID NO: 658381 - RNA, 64 nt, hsa; identical to SEQ ID NO: 303071

SEQ ID NO: 658382 - RNA, 64 nt, hsa; identical to SEQ ID NO: 303072

SEQ ID NO: 658383 - RNA, 64 nt, hsa; identical to SEQ ID NO: 303073

SEQ ID NO: 658384 - RNA, 64 nt, hsa; identical to SEQ ID NO: 303074

SEQ ID NO: 658385 - RNA, 64 nt, hsa; identical to SEQ ID NO: 303075

SEQ ID NO: 658386 - RNA, 64 nt, hsa; identical to SEQ ID NO: 303076

SEQ ID NO: 658387 - RNA, 64 nt, hsa; identical to SEQ ID NO: 303077

SEQ ID NO: 658388 - RNA, 64 nt, hsa; identical to SEQ ID NO: 303078

SEQ ID NO: 658389 - RNA, 64 nt, hsa; identical to SEQ ID NO: 303079

SEQ ID NO: 658390 - RNA, 64 nt, hsa; identical to SEQ ID NO: 303080

SEQ ID NO: 658391 - RNA, 64 nt, hsa; identical to SEQ ID NO: 303081

SEQ ID NO: 658392 - RNA, 64 nt, hsa; identical to SEQ ID NO: 303082

SEQ ID NO: 658393 - RNA, 64 nt, hsa; identical to SEQ ID NO: 303083

SEQ ID NO: 658394 - RNA, 64 nt, hsa; identical to SEQ ID NO: 303084

SEQ ID NO: 658395 - RNA, 64 nt, hsa; identical to SEQ ID NO: 303085

SEQ ID NO: 658396 - RNA, 64 nt, hsa; identical to SEQ ID NO: 303086

SEQ ID NO: 658397 - RNA, 64 nt, hsa; identical to SEQ ID NO: 303087

SEQ ID NO: 658398 - RNA, 64 nt, hsa; identical to SEQ ID NO: 303088

SEQ ID NO: 658399 - RNA, 64 nt, hsa; identical to SEQ ID NO: 303089

SEQ ID NO: 658400 - RNA, 64 nt, hsa; identical to SEQ ID NO: 303090

SEQ ID NO: 658401 - RNA, 64 nt, hsa; identical to SEQ ID NO: 303091

SEQ ID NO: 658402 - RNA, 64 nt, hsa; identical to SEQ ID NO: 303092

SEQ ID NO: 658403 - RNA, 64 nt, hsa; identical to SEQ ID NO: 303093

SEQ ID NO: 658404 - RNA, 64 nt, hsa; identical to SEQ ID NO: 303094

SEQ ID NO: 658405 - RNA, 64 nt, hsa; identical to SEQ ID NO: 303095

SEQ ID NO: 658406 - RNA, 64 nt, hsa; identical to SEQ ID NO: 303096

SEQ ID NO: 658407 - RNA, 64 nt, hsa; identical to SEQ ID NO: 303097

SEQ ID NO: 658408 - RNA, 64 nt, hsa; identical to SEQ ID NO: 303098

SEQ ID NO: 658409 - RNA, 64 nt, hsa; identical to SEQ ID NO: 303099

SEQ ID NO: 658410 - RNA, 64 nt, hsa; identical to SEQ ID NO: 303100

SEQ ID NO: 658411 - RNA, 64 nt, hsa; identical to SEQ ID NO: 303101

SEQ ID NO: 658412 - RNA, 64 nt, hsa; identical to SEQ ID NO: 303102

SEQ ID NO: 658413 - RNA, 64 nt, hsa; identical to SEQ ID NO: 303103

SEQ ID NO: 658414 - RNA, 64 nt, hsa; identical to SEQ ID NO: 303104

SEQ ID NO: 658415 - RNA, 64 nt, hsa; identical to SEQ ID NO: 303105

SEQ ID NO: 658416 - RNA, 64 nt, hsa; identical to SEQ ID NO: 303106

SEQ ID NO: 658417 - RNA, 64 nt, hsa; identical to SEQ ID NO: 303107

SEQ ID NO: 658418 - RNA, 64 nt, hsa; identical to SEQ ID NO: 303108

SEQ ID NO: 658419 - RNA, 64 nt, hsa; identical to SEQ ID NO: 303109

SEQ ID NO: 658420 - RNA, 64 nt, hsa; identical to SEQ ID NO: 303110

SEQ ID NO: 658421 - RNA, 64 nt, hsa; identical to SEQ ID NO: 303111

SEQ ID NO: 658422 - RNA, 64 nt, hsa; identical to SEQ ID NO: 303112

SEQ ID NO: 658423 - RNA, 64 nt, hsa; identical to SEQ ID NO: 303113

SEQ ID NO: 658424 - RNA, 64 nt, hsa; identical to SEQ ID NO: 303114

SEQ ID NO: 658425 - RNA, 64 nt, hsa; identical to SEQ ID NO: 303115

SEQ ID NO: 658426 - RNA, 64 nt, hsa; identical to SEQ ID NO: 303116

SEQ ID NO: 658427 - RNA, 64 nt, hsa; identical to SEQ ID NO: 303117

SEQ ID NO: 658428 - RNA, 64 nt, hsa; identical to SEQ ID NO: 303118

SEQ ID NO: 658429 - RNA, 64 nt, hsa; identical to SEQ ID NO: 303119

SEQ ID NO: 658430 - RNA, 64 nt, hsa; identical to SEQ ID NO: 303120

SEQ ID NO: 658431 - RNA, 64 nt, hsa; identical to SEQ ID NO: 303121

SEQ ID NO: 658432 - RNA, 64 nt, hsa; identical to SEQ ID NO: 303122

SEQ ID NO: 658433 - RNA, 64 nt, hsa; identical to SEQ ID NO: 303123

SEQ ID NO: 658434 - RNA, 64 nt, hsa; identical to SEQ ID NO: 303124

SEQ ID NO: 658435 - RNA, 64 nt, hsa; identical to SEQ ID NO: 303125

SEQ ID NO: 658436 - RNA, 64 nt, hsa; identical to SEQ ID NO: 303126

SEQ ID NO: 658437 - RNA, 64 nt, hsa; identical to SEQ ID NO: 303127

SEQ ID NO: 658438 - RNA, 64 nt, hsa; identical to SEQ ID NO: 303128

SEQ ID NO: 658439 - RNA, 64 nt, hsa; identical to SEQ ID NO: 303129

SEQ ID NO: 658440 - RNA, 62 nt, hsa; identical to SEQ ID NO: 303130

SEQ ID NO: 658441 - RNA, 64 nt, hsa; identical to SEQ ID NO: 303131

SEQ ID NO: 658442 - RNA, 64 nt, hsa; identical to SEQ ID NO: 303132

SEQ ID NO: 658443 - RNA, 64 nt, hsa; identical to SEQ ID NO: 303133

SEQ ID NO: 658444 - RNA, 64 nt, hsa; identical to SEQ ID NO: 303134

SEQ ID NO: 658445 - RNA, 64 nt, hsa; identical to SEQ ID NO: 303135

SEQ ID NO: 658446 - RNA, 64 nt, hsa; identical to SEQ ID NO: 303136

SEQ ID NO: 658447 - RNA, 64 nt, hsa; identical to SEQ ID NO: 303137

SEQ ID NO: 658448 - RNA, 64 nt, hsa; identical to SEQ ID NO: 303138

SEQ ID NO: 658449 - RNA, 64 nt, hsa; identical to SEQ ID NO: 303139

SEQ ID NO: 658450 - RNA, 64 nt, hsa; identical to SEQ ID NO: 303140

SEQ ID NO: 658451 - RNA, 64 nt, hsa; identical to SEQ ID NO: 303141

SEQ ID NO: 658452 - RNA, 64 nt, hsa; identical to SEQ ID NO: 303142

SEQ ID NO: 658453 - RNA, 64 nt, hsa; identical to SEQ ID NO: 303143

SEQ ID NO: 658454 - RNA, 64 nt, hsa; identical to SEQ ID NO: 303144

SEQ ID NO: 658455 - RNA, 64 nt, hsa; identical to SEQ ID NO: 303145

SEQ ID NO: 658456 - RNA, 64 nt, hsa; identical to SEQ ID NO: 303146

SEQ ID NO: 658457 - RNA, 64 nt, hsa; identical to SEQ ID NO: 303147

SEQ ID NO: 658458 - RNA, 64 nt, hsa; identical to SEQ ID NO: 303148

SEQ ID NO: 658459 - RNA, 64 nt, hsa; identical to SEQ ID NO: 303149

SEQ ID NO: 658460 - RNA, 64 nt, hsa; identical to SEQ ID NO: 303150

SEQ ID NO: 658461 - RNA, 64 nt, hsa; identical to SEQ ID NO: 303151

SEQ ID NO: 658462 - RNA, 64 nt, hsa; identical to SEQ ID NO: 303152

SEQ ID NO: 658463 - RNA, 64 nt, hsa; identical to SEQ ID NO: 303153

SEQ ID NO: 658464 - RNA, 64 nt, hsa; identical to SEQ ID NO: 303154

SEQ ID NO: 658465 - RNA, 64 nt, hsa; identical to SEQ ID NO: 303155

SEQ ID NO: 658466 - RNA, 64 nt, hsa; identical to SEQ ID NO: 303156

SEQ ID NO: 658467 - RNA, 64 nt, hsa; identical to SEQ ID NO: 303157

SEQ ID NO: 658468 - RNA, 64 nt, hsa; identical to SEQ ID NO: 303158

SEQ ID NO: 658469 - RNA, 64 nt, hsa; identical to SEQ ID NO: 303159

SEQ ID NO: 658470 - RNA, 63 nt, hsa; identical to SEQ ID NO: 303160

SEQ ID NO: 658471 - RNA, 64 nt, hsa; identical to SEQ ID NO: 303161

SEQ ID NO: 658472 - RNA, 64 nt, hsa; identical to SEQ ID NO: 303162

SEQ ID NO: 658473 - RNA, 64 nt, hsa; identical to SEQ ID NO: 303163

SEQ ID NO: 658474 - RNA, 64 nt, hsa; identical to SEQ ID NO: 303164

SEQ ID NO: 658475 - RNA, 64 nt, hsa; identical to SEQ ID NO: 303165

SEQ ID NO: 658476 - RNA, 64 nt, hsa; identical to SEQ ID NO: 303166

SEQ ID NO: 658477 - RNA, 64 nt, hsa; identical to SEQ ID NO: 303167

SEQ ID NO: 658478 - RNA, 64 nt, hsa; identical to SEQ ID NO: 303168

SEQ ID NO: 658479 - RNA, 64 nt, hsa; identical to SEQ ID NO: 303169

SEQ ID NO: 658480 - RNA, 64 nt, hsa; identical to SEQ ID NO: 303170

SEQ ID NO: 658481 - RNA, 64 nt, hsa; identical to SEQ ID NO: 303171

SEQ ID NO: 658482 - RNA, 64 nt, hsa; identical to SEQ ID NO: 303172

SEQ ID NO: 658483 - RNA, 64 nt, hsa; identical to SEQ ID NO: 303173

SEQ ID NO: 658484 - RNA, 64 nt, hsa; identical to SEQ ID NO: 303174

SEQ ID NO: 658485 - RNA, 64 nt, hsa; identical to SEQ ID NO: 303175

SEQ ID NO: 658486 - RNA, 64 nt, hsa; identical to SEQ ID NO: 303176

SEQ ID NO: 658487 - RNA, 64 nt, hsa; identical to SEQ ID NO: 303177

SEQ ID NO: 658488 - RNA, 64 nt, hsa; identical to SEQ ID NO: 303178

SEQ ID NO: 658489 - RNA, 64 nt, hsa; identical to SEQ ID NO: 303179

SEQ ID NO: 658490 - RNA, 64 nt, hsa; identical to SEQ ID NO: 303180

SEQ ID NO: 658491 - RNA, 64 nt, hsa; identical to SEQ ID NO: 303181

SEQ ID NO: 658492 - RNA, 64 nt, hsa; identical to SEQ ID NO: 303182

SEQ ID NO: 658493 - RNA, 64 nt, hsa; identical to SEQ ID NO: 303183

SEQ ID NO: 658494 - RNA, 64 nt, hsa; identical to SEQ ID NO: 303184

SEQ ID NO: 658495 - RNA, 64 nt, hsa; identical to SEQ ID NO: 303185

SEQ ID NO: 658496 - RNA, 64 nt, hsa; identical to SEQ ID NO: 303186

SEQ ID NO: 658497 - RNA, 64 nt, hsa; identical to SEQ ID NO: 303187

SEQ ID NO: 658498 - RNA, 64 nt, hsa; identical to SEQ ID NO: 303188

SEQ ID NO: 658499 - RNA, 64 nt, hsa; identical to SEQ ID NO: 303189

SEQ ID NO: 658500 - RNA, 64 nt, hsa; identical to SEQ ID NO: 303190

SEQ ID NO: 658501 - RNA, 64 nt, hsa; identical to SEQ ID NO: 303191

SEQ ID NO: 658502 - RNA, 64 nt, hsa; identical to SEQ ID NO: 303192

SEQ ID NO: 658503 - RNA, 64 nt, hsa; identical to SEQ ID NO: 303193

SEQ ID NO: 658504 - RNA, 64 nt, hsa; identical to SEQ ID NO: 303194

SEQ ID NO: 658505 - RNA, 64 nt, hsa; identical to SEQ ID NO: 303195

SEQ ID NO: 658506 - RNA, 64 nt, hsa; identical to SEQ ID NO: 303196

SEQ ID NO: 658507 - RNA, 64 nt, hsa; identical to SEQ ID NO: 303197

SEQ ID NO: 658508 - RNA, 64 nt, hsa; identical to SEQ ID NO: 303198

SEQ ID NO: 658509 - RNA, 64 nt, hsa; identical to SEQ ID NO: 303199

SEQ ID NO: 658510 - RNA, 64 nt, hsa; identical to SEQ ID NO: 303200

SEQ ID NO: 658511 - RNA, 64 nt, hsa; identical to SEQ ID NO: 303201

SEQ ID NO: 658512 - RNA, 64 nt, hsa; identical to SEQ ID NO: 303202

SEQ ID NO: 658513 - RNA, 64 nt, hsa; identical to SEQ ID NO: 303203

SEQ ID NO: 658514 - RNA, 64 nt, hsa; identical to SEQ ID NO: 303204

SEQ ID NO: 658515 - RNA, 64 nt, hsa; identical to SEQ ID NO: 303205

SEQ ID NO: 658516 - RNA, 64 nt, hsa; identical to SEQ ID NO: 303206

SEQ ID NO: 658517 - RNA, 64 nt, hsa; identical to SEQ ID NO: 303207

SEQ ID NO: 658518 - RNA, 64 nt, hsa; identical to SEQ ID NO: 303208

SEQ ID NO: 658519 - RNA, 64 nt, hsa; identical to SEQ ID NO: 303209

SEQ ID NO: 658520 - RNA, 64 nt, hsa; identical to SEQ ID NO: 303210

SEQ ID NO: 658521 - RNA, 64 nt, hsa; identical to SEQ ID NO: 303211

SEQ ID NO: 658522 - RNA, 64 nt, hsa; identical to SEQ ID NO: 303212

SEQ ID NO: 658523 - RNA, 64 nt, hsa; identical to SEQ ID NO: 303213

SEQ ID NO: 658524 - RNA, 64 nt, hsa; identical to SEQ ID NO: 303214

SEQ ID NO: 658525 - RNA, 64 nt, hsa; identical to SEQ ID NO: 303215

SEQ ID NO: 658526 - RNA, 64 nt, hsa; identical to SEQ ID NO: 303216

SEQ ID NO: 658527 - RNA, 64 nt, hsa; identical to SEQ ID NO: 303217

SEQ ID NO: 658528 - RNA, 64 nt, hsa; identical to SEQ ID NO: 303218

SEQ ID NO: 658529 - RNA, 64 nt, hsa; identical to SEQ ID NO: 303219

SEQ ID NO: 658530 - RNA, 64 nt, hsa; identical to SEQ ID NO: 303220

SEQ ID NO: 658531 - RNA, 64 nt, hsa; identical to SEQ ID NO: 303221

SEQ ID NO: 658532 - RNA, 64 nt, hsa; identical to SEQ ID NO: 303222

SEQ ID NO: 658533 - RNA, 64 nt, hsa; identical to SEQ ID NO: 303223

SEQ ID NO: 658534 - RNA, 64 nt, hsa; identical to SEQ ID NO: 303224

SEQ ID NO: 658535 - RNA, 64 nt, hsa; identical to SEQ ID NO: 303225

SEQ ID NO: 658536 - RNA, 64 nt, hsa; identical to SEQ ID NO: 303226

SEQ ID NO: 658537 - RNA, 64 nt, hsa; identical to SEQ ID NO: 303227

SEQ ID NO: 658538 - RNA, 64 nt, hsa; identical to SEQ ID NO: 303228

SEQ ID NO: 658539 - RNA, 64 nt, hsa; identical to SEQ ID NO: 303229

SEQ ID NO: 658540 - RNA, 64 nt, hsa; identical to SEQ ID NO: 303230

SEQ ID NO: 658541 - RNA, 64 nt, hsa; identical to SEQ ID NO: 303231

SEQ ID NO: 658542 - RNA, 64 nt, hsa; identical to SEQ ID NO: 303232

SEQ ID NO: 658543 - RNA, 64 nt, hsa; identical to SEQ ID NO: 303233

SEQ ID NO: 658544 - RNA, 64 nt, hsa; identical to SEQ ID NO: 303234

SEQ ID NO: 658545 - RNA, 64 nt, hsa; identical to SEQ ID NO: 303235

SEQ ID NO: 658546 - RNA, 64 nt, hsa; identical to SEQ ID NO: 303236

SEQ ID NO: 658547 - RNA, 64 nt, hsa; identical to SEQ ID NO: 303237

SEQ ID NO: 658548 - RNA, 64 nt, hsa; identical to SEQ ID NO: 303238

SEQ ID NO: 658549 - RNA, 64 nt, hsa; identical to SEQ ID NO: 303239

SEQ ID NO: 658550 - RNA, 64 nt, hsa; identical to SEQ ID NO: 303240

SEQ ID NO: 658551 - RNA, 64 nt, hsa; identical to SEQ ID NO: 303241

SEQ ID NO: 658552 - RNA, 64 nt, hsa; identical to SEQ ID NO: 303242

SEQ ID NO: 658553 - RNA, 64 nt, hsa; identical to SEQ ID NO: 303243

SEQ ID NO: 658554 - RNA, 64 nt, hsa; identical to SEQ ID NO: 303244

SEQ ID NO: 658555 - RNA, 64 nt, hsa; identical to SEQ ID NO: 303245

SEQ ID NO: 658556 - RNA, 64 nt, hsa; identical to SEQ ID NO: 303246

SEQ ID NO: 658557 - RNA, 64 nt, hsa; identical to SEQ ID NO: 303247

SEQ ID NO: 658558 - RNA, 64 nt, hsa; identical to SEQ ID NO: 303248

SEQ ID NO: 658559 - RNA, 64 nt, hsa; identical to SEQ ID NO: 303249

SEQ ID NO: 658560 - RNA, 64 nt, hsa; identical to SEQ ID NO: 303250

SEQ ID NO: 658561 - RNA, 64 nt, hsa; identical to SEQ ID NO: 303251

SEQ ID NO: 658562 - RNA, 64 nt, hsa; identical to SEQ ID NO: 303252

SEQ ID NO: 658563 - RNA, 64 nt, hsa; identical to SEQ ID NO: 303253

SEQ ID NO: 658564 - RNA, 64 nt, hsa; identical to SEQ ID NO: 303254

SEQ ID NO: 658565 - RNA, 64 nt, hsa; identical to SEQ ID NO: 303255

SEQ ID NO: 658566 - RNA, 64 nt, hsa; identical to SEQ ID NO: 303256

SEQ ID NO: 658567 - RNA, 64 nt, hsa; identical to SEQ ID NO: 303257

SEQ ID NO: 658568 - RNA, 64 nt, hsa; identical to SEQ ID NO: 303258

SEQ ID NO: 658569 - RNA, 64 nt, hsa; identical to SEQ ID NO: 303259

SEQ ID NO: 658570 - RNA, 64 nt, hsa; identical to SEQ ID NO: 303260

SEQ ID NO: 658571 - RNA, 64 nt, hsa; identical to SEQ ID NO: 303261

SEQ ID NO: 658572 - RNA, 64 nt, hsa; identical to SEQ ID NO: 303262

SEQ ID NO: 658573 - RNA, 64 nt, hsa; identical to SEQ ID NO: 303263

SEQ ID NO: 658574 - RNA, 64 nt, hsa; identical to SEQ ID NO: 303264

SEQ ID NO: 658575 - RNA, 64 nt, hsa; identical to SEQ ID NO: 303265

SEQ ID NO: 658576 - RNA, 64 nt, hsa; identical to SEQ ID NO: 303266

SEQ ID NO: 658577 - RNA, 64 nt, hsa; identical to SEQ ID NO: 303267

SEQ ID NO: 658578 - RNA, 64 nt, hsa; identical to SEQ ID NO: 303268

SEQ ID NO: 658579 - RNA, 64 nt, hsa; identical to SEQ ID NO: 303269

SEQ ID NO: 658580 - RNA, 64 nt, hsa; identical to SEQ ID NO: 303270

SEQ ID NO: 658581 - RNA, 64 nt, hsa; identical to SEQ ID NO: 303271

SEQ ID NO: 658582 - RNA, 64 nt, hsa; identical to SEQ ID NO: 303272

SEQ ID NO: 658583 - RNA, 64 nt, hsa; identical to SEQ ID NO: 303273

SEQ ID NO: 658584 - RNA, 64 nt, hsa; identical to SEQ ID NO: 303274

SEQ ID NO: 658585 - RNA, 64 nt, hsa; identical to SEQ ID NO: 303275

SEQ ID NO: 658586 - RNA, 64 nt, hsa; identical to SEQ ID NO: 303276

SEQ ID NO: 658587 - RNA, 64 nt, hsa; identical to SEQ ID NO: 303277

SEQ ID NO: 658588 - RNA, 64 nt, hsa; identical to SEQ ID NO: 303278

SEQ ID NO: 658589 - RNA, 64 nt, hsa; identical to SEQ ID NO: 303279

SEQ ID NO: 658590 - RNA, 64 nt, hsa; identical to SEQ ID NO: 303280

SEQ ID NO: 658591 - RNA, 64 nt, hsa; identical to SEQ ID NO: 303281

SEQ ID NO: 658592 - RNA, 64 nt, hsa; identical to SEQ ID NO: 303282

SEQ ID NO: 658593 - RNA, 64 nt, hsa; identical to SEQ ID NO: 303283

SEQ ID NO: 658594 - RNA, 64 nt, hsa; identical to SEQ ID NO: 303284

SEQ ID NO: 658595 - RNA, 64 nt, hsa; identical to SEQ ID NO: 303285

SEQ ID NO: 658596 - RNA, 64 nt, hsa; identical to SEQ ID NO: 303286

SEQ ID NO: 658597 - RNA, 64 nt, hsa; identical to SEQ ID NO: 144190

SEQ ID NO: 658598 - RNA, 64 nt, hsa; identical to SEQ ID NO: 144191

SEQ ID NO: 658599 - RNA, 64 nt, hsa; identical to SEQ ID NO: 144192

SEQ ID NO: 658600 - RNA, 64 nt, hsa; identical to SEQ ID NO: 144193

SEQ ID NO: 658601 - RNA, 64 nt, hsa; identical to SEQ ID NO: 144194

SEQ ID NO: 658602 - RNA, 64 nt, hsa; identical to SEQ ID NO: 144195

SEQ ID NO: 658603 - RNA, 64 nt, hsa; identical to SEQ ID NO: 144196

SEQ ID NO: 658604 - RNA, 64 nt, hsa; identical to SEQ ID NO: 144197

SEQ ID NO: 658605 - RNA, 64 nt, hsa; identical to SEQ ID NO: 144198

SEQ ID NO: 658606 - RNA, 64 nt, hsa; identical to SEQ ID NO: 144199

SEQ ID NO: 658607 - RNA, 64 nt, hsa; identical to SEQ ID NO: 144200

SEQ ID NO: 658608 - RNA, 64 nt, hsa; identical to SEQ ID NO: 144201

SEQ ID NO: 658609 - RNA, 64 nt, hsa; identical to SEQ ID NO: 144202

SEQ ID NO: 658610 - RNA, 64 nt, hsa; identical to SEQ ID NO: 144203

SEQ ID NO: 658611 - RNA, 64 nt, hsa; identical to SEQ ID NO: 144204

SEQ ID NO: 658612 - RNA, 64 nt, hsa; identical to SEQ ID NO: 144205

SEQ ID NO: 658613 - RNA, 64 nt, hsa; identical to SEQ ID NO: 144206

SEQ ID NO: 658614 - RNA, 64 nt, hsa; identical to SEQ ID NO: 144207

SEQ ID NO: 658615 - RNA, 64 nt, hsa; identical to SEQ ID NO: 144208

SEQ ID NO: 658616 - RNA, 64 nt, hsa; identical to SEQ ID NO: 144209

SEQ ID NO: 658617 - RNA, 64 nt, hsa; identical to SEQ ID NO: 144210

SEQ ID NO: 658618 - RNA, 64 nt, hsa; identical to SEQ ID NO: 144211

SEQ ID NO: 658619 - RNA, 64 nt, hsa; identical to SEQ ID NO: 144212

SEQ ID NO: 658620 - RNA, 64 nt, hsa; identical to SEQ ID NO: 144213

SEQ ID NO: 658621 - RNA, 64 nt, hsa; identical to SEQ ID NO: 144214

SEQ ID NO: 658622 - RNA, 64 nt, hsa; identical to SEQ ID NO: 144215

SEQ ID NO: 658623 - RNA, 64 nt, hsa; identical to SEQ ID NO: 144216

SEQ ID NO: 658624 - RNA, 64 nt, hsa; identical to SEQ ID NO: 144217

SEQ ID NO: 658625 - RNA, 64 nt, hsa; identical to SEQ ID NO: 144218

SEQ ID NO: 658626 - RNA, 64 nt, hsa; identical to SEQ ID NO: 144219

SEQ ID NO: 658627 - RNA, 64 nt, hsa; identical to SEQ ID NO: 144220

SEQ ID NO: 658628 - RNA, 64 nt, hsa; identical to SEQ ID NO: 144221

SEQ ID NO: 658629 - RNA, 64 nt, hsa; identical to SEQ ID NO: 144222

SEQ ID NO: 658630 - RNA, 64 nt, hsa; identical to SEQ ID NO: 144223

SEQ ID NO: 658631 - RNA, 64 nt, hsa; identical to SEQ ID NO: 144224

SEQ ID NO: 658632 - RNA, 64 nt, hsa; identical to SEQ ID NO: 144225

SEQ ID NO: 658633 - RNA, 64 nt, hsa; identical to SEQ ID NO: 144226

SEQ ID NO: 658634 - RNA, 64 nt, hsa; identical to SEQ ID NO: 144227

SEQ ID NO: 658635 - RNA, 64 nt, hsa; identical to SEQ ID NO: 144228

SEQ ID NO: 658636 - RNA, 64 nt, hsa; identical to SEQ ID NO: 144229

SEQ ID NO: 658637 - RNA, 64 nt, hsa; identical to SEQ ID NO: 144230

SEQ ID NO: 658638 - RNA, 64 nt, hsa; identical to SEQ ID NO: 144231

SEQ ID NO: 658639 - RNA, 64 nt, hsa; identical to SEQ ID NO: 144232

SEQ ID NO: 658640 - RNA, 64 nt, hsa; identical to SEQ ID NO: 144233

SEQ ID NO: 658641 - RNA, 64 nt, hsa; identical to SEQ ID NO: 144234

SEQ ID NO: 658642 - RNA, 64 nt, hsa; identical to SEQ ID NO: 144235

SEQ ID NO: 658643 - RNA, 64 nt, hsa; identical to SEQ ID NO: 144236

SEQ ID NO: 658644 - RNA, 64 nt, hsa; identical to SEQ ID NO: 144237

SEQ ID NO: 658645 - RNA, 64 nt, hsa; identical to SEQ ID NO: 144238

SEQ ID NO: 658646 - RNA, 64 nt, hsa; identical to SEQ ID NO: 144239

SEQ ID NO: 658647 - RNA, 64 nt, hsa; identical to SEQ ID NO: 144240

SEQ ID NO: 658648 - RNA, 64 nt, hsa; identical to SEQ ID NO: 144241

SEQ ID NO: 658649 - RNA, 64 nt, hsa; identical to SEQ ID NO: 144242

SEQ ID NO: 658650 - RNA, 64 nt, hsa; identical to SEQ ID NO: 144243

SEQ ID NO: 658651 - RNA, 64 nt, hsa; identical to SEQ ID NO: 144244

SEQ ID NO: 658652 - RNA, 64 nt, hsa; identical to SEQ ID NO: 144245

SEQ ID NO: 658653 - RNA, 64 nt, hsa; identical to SEQ ID NO: 144246

SEQ ID NO: 658654 - RNA, 64 nt, hsa; identical to SEQ ID NO: 144247

SEQ ID NO: 658655 - RNA, 64 nt, hsa; identical to SEQ ID NO: 144248

SEQ ID NO: 658656 - RNA, 64 nt, hsa; identical to SEQ ID NO: 144249

SEQ ID NO: 658657 - RNA, 64 nt, hsa; identical to SEQ ID NO: 144250

SEQ ID NO: 658658 - RNA, 64 nt, hsa; identical to SEQ ID NO: 144251

SEQ ID NO: 658659 - RNA, 64 nt, hsa; identical to SEQ ID NO: 144252

SEQ ID NO: 658660 - RNA, 64 nt, hsa; identical to SEQ ID NO: 144253

SEQ ID NO: 658661 - RNA, 64 nt, hsa; identical to SEQ ID NO: 144254

SEQ ID NO: 658662 - RNA, 64 nt, hsa; identical to SEQ ID NO: 144255

SEQ ID NO: 658663 - RNA, 64 nt, hsa; identical to SEQ ID NO: 519046

SEQ ID NO: 658664 - RNA, 64 nt, hsa; identical to SEQ ID NO: 519047

SEQ ID NO: 658665 - RNA, 64 nt, hsa; identical to SEQ ID NO: 519048

SEQ ID NO: 658666 - RNA, 64 nt, hsa; identical to SEQ ID NO: 519049

SEQ ID NO: 658667 - RNA, 64 nt, hsa; identical to SEQ ID NO: 519050

SEQ ID NO: 658668 - RNA, 64 nt, hsa; identical to SEQ ID NO: 519051

SEQ ID NO: 658669 - RNA, 64 nt, hsa; identical to SEQ ID NO: 519052

SEQ ID NO: 658670 - RNA, 64 nt, hsa; identical to SEQ ID NO: 519053

SEQ ID NO: 658671 - RNA, 64 nt, hsa; identical to SEQ ID NO: 519054

SEQ ID NO: 658672 - RNA, 64 nt, hsa; identical to SEQ ID NO: 519055

SEQ ID NO: 658673 - RNA, 64 nt, hsa; identical to SEQ ID NO: 519056

SEQ ID NO: 658674 - RNA, 64 nt, hsa; identical to SEQ ID NO: 519057

SEQ ID NO: 658675 - RNA, 64 nt, hsa; identical to SEQ ID NO: 519058

SEQ ID NO: 658676 - RNA, 64 nt, hsa; identical to SEQ ID NO: 519059

SEQ ID NO: 658677 - RNA, 64 nt, hsa; identical to SEQ ID NO: 519060

SEQ ID NO: 658678 - RNA, 64 nt, hsa; identical to SEQ ID NO: 519061

SEQ ID NO: 658679 - RNA, 64 nt, hsa; identical to SEQ ID NO: 519062

SEQ ID NO: 658680 - RNA, 64 nt, hsa; identical to SEQ ID NO: 519063

SEQ ID NO: 658681 - RNA, 64 nt, hsa; identical to SEQ ID NO: 519064

SEQ ID NO: 658682 - RNA, 64 nt, hsa; identical to SEQ ID NO: 519065

SEQ ID NO: 658683 - RNA, 64 nt, hsa; identical to SEQ ID NO: 519066

SEQ ID NO: 658684 - RNA, 64 nt, hsa; identical to SEQ ID NO: 519067

SEQ ID NO: 658685 - RNA, 64 nt, hsa; identical to SEQ ID NO: 519068

SEQ ID NO: 658686 - RNA, 64 nt, hsa; identical to SEQ ID NO: 519069

SEQ ID NO: 658687 - RNA, 64 nt, hsa; identical to SEQ ID NO: 519070

SEQ ID NO: 658688 - RNA, 64 nt, hsa; identical to SEQ ID NO: 519071

SEQ ID NO: 658689 - RNA, 64 nt, hsa; identical to SEQ ID NO: 519072

SEQ ID NO: 658690 - RNA, 64 nt, hsa; identical to SEQ ID NO: 519073

SEQ ID NO: 658691 - RNA, 64 nt, hsa; identical to SEQ ID NO: 519074

SEQ ID NO: 658692 - RNA, 64 nt, hsa; identical to SEQ ID NO: 519075

SEQ ID NO: 658693 - RNA, 64 nt, hsa; identical to SEQ ID NO: 519076

SEQ ID NO: 658694 - RNA, 64 nt, hsa; identical to SEQ ID NO: 519077

SEQ ID NO: 658695 - RNA, 64 nt, hsa; identical to SEQ ID NO: 519078

SEQ ID NO: 658696 - RNA, 64 nt, hsa; identical to SEQ ID NO: 519079

SEQ ID NO: 658697 - RNA, 64 nt, hsa; identical to SEQ ID NO: 519080

SEQ ID NO: 658698 - RNA, 64 nt, hsa; identical to SEQ ID NO: 519081

SEQ ID NO: 658699 - RNA, 64 nt, hsa; identical to SEQ ID NO: 519082

SEQ ID NO: 658700 - RNA, 64 nt, hsa; identical to SEQ ID NO: 519083

SEQ ID NO: 658701 - RNA, 64 nt, hsa; identical to SEQ ID NO: 519084

SEQ ID NO: 658702 - RNA, 64 nt, hsa; identical to SEQ ID NO: 519085

SEQ ID NO: 658703 - RNA, 64 nt, hsa; identical to SEQ ID NO: 519086

SEQ ID NO: 658704 - RNA, 64 nt, hsa; identical to SEQ ID NO: 519087

SEQ ID NO: 658705 - RNA, 64 nt, hsa; identical to SEQ ID NO: 519088

SEQ ID NO: 658706 - RNA, 64 nt, hsa; identical to SEQ ID NO: 519089

SEQ ID NO: 658707 - RNA, 64 nt, hsa; identical to SEQ ID NO: 519090

SEQ ID NO: 658708 - RNA, 64 nt, hsa; identical to SEQ ID NO: 519091

SEQ ID NO: 658709 - RNA, 64 nt, hsa; identical to SEQ ID NO: 519092

SEQ ID NO: 658710 - RNA, 64 nt, hsa; identical to SEQ ID NO: 519093

SEQ ID NO: 658711 - RNA, 64 nt, hsa; identical to SEQ ID NO: 519094

SEQ ID NO: 658712 - RNA, 64 nt, hsa; identical to SEQ ID NO: 519095

SEQ ID NO: 658713 - RNA, 64 nt, hsa; identical to SEQ ID NO: 519096

SEQ ID NO: 658714 - RNA, 64 nt, hsa; identical to SEQ ID NO: 519097

SEQ ID NO: 658715 - RNA, 64 nt, hsa; identical to SEQ ID NO: 519098

SEQ ID NO: 658716 - RNA, 64 nt, hsa; identical to SEQ ID NO: 519099

SEQ ID NO: 658717 - RNA, 64 nt, hsa; identical to SEQ ID NO: 519100

SEQ ID NO: 658718 - RNA, 64 nt, hsa; identical to SEQ ID NO: 519101

SEQ ID NO: 658719 - RNA, 64 nt, hsa; identical to SEQ ID NO: 519102

SEQ ID NO: 658720 - RNA, 64 nt, hsa; identical to SEQ ID NO: 519103

SEQ ID NO: 658721 - RNA, 64 nt, hsa; identical to SEQ ID NO: 519104

SEQ ID NO: 658722 - RNA, 64 nt, hsa; identical to SEQ ID NO: 519105

SEQ ID NO: 658723 - RNA, 64 nt, hsa; identical to SEQ ID NO: 519106

SEQ ID NO: 658724 - RNA, 64 nt, hsa; identical to SEQ ID NO: 519107

SEQ ID NO: 658725 - RNA, 64 nt, hsa; identical to SEQ ID NO: 519108

SEQ ID NO: 658726 - RNA, 64 nt, hsa; identical to SEQ ID NO: 519109

SEQ ID NO: 658727 - RNA, 64 nt, hsa; identical to SEQ ID NO: 519110

SEQ ID NO: 658728 - RNA, 64 nt, hsa; identical to SEQ ID NO: 519111

SEQ ID NO: 658729 - RNA, 64 nt, hsa; identical to SEQ ID NO: 519112

SEQ ID NO: 658730 - RNA, 64 nt, hsa; identical to SEQ ID NO: 519113

SEQ ID NO: 658731 - RNA, 64 nt, hsa; identical to SEQ ID NO: 519114

SEQ ID NO: 658732 - RNA, 64 nt, hsa; identical to SEQ ID NO: 519115

SEQ ID NO: 658733 - RNA, 64 nt, hsa; identical to SEQ ID NO: 519116

SEQ ID NO: 658734 - RNA, 64 nt, hsa; identical to SEQ ID NO: 519117

SEQ ID NO: 658735 - RNA, 64 nt, hsa; identical to SEQ ID NO: 519118

SEQ ID NO: 658736 - RNA, 64 nt, hsa; identical to SEQ ID NO: 519119

SEQ ID NO: 658737 - RNA, 64 nt, hsa; identical to SEQ ID NO: 519120

SEQ ID NO: 658738 - RNA, 64 nt, hsa; identical to SEQ ID NO: 519121

SEQ ID NO: 658739 - RNA, 64 nt, hsa; identical to SEQ ID NO: 519122

SEQ ID NO: 658740 - RNA, 64 nt, hsa; identical to SEQ ID NO: 519123

SEQ ID NO: 658741 - RNA, 64 nt, hsa; identical to SEQ ID NO: 519124

SEQ ID NO: 658742 - RNA, 64 nt, hsa; identical to SEQ ID NO: 519125

SEQ ID NO: 658743 - RNA, 64 nt, hsa; identical to SEQ ID NO: 519126

SEQ ID NO: 658744 - RNA, 64 nt, hsa; identical to SEQ ID NO: 655264

SEQ ID NO: 658745 - RNA, 64 nt, hsa; identical to SEQ ID NO: 655265

SEQ ID NO: 658746 - RNA, 64 nt, hsa; identical to SEQ ID NO: 655266

SEQ ID NO: 658747 - RNA, 64 nt, hsa; identical to SEQ ID NO: 655267

SEQ ID NO: 658748 - RNA, 64 nt, hsa; identical to SEQ ID NO: 655268

SEQ ID NO: 658749 - RNA, 64 nt, hsa; identical to SEQ ID NO: 655269

SEQ ID NO: 658750 - RNA, 64 nt, hsa; identical to SEQ ID NO: 655270

SEQ ID NO: 658751 - RNA, 64 nt, hsa; identical to SEQ ID NO: 655271

SEQ ID NO: 658752 - RNA, 64 nt, hsa; identical to SEQ ID NO: 655272

SEQ ID NO: 658753 - RNA, 64 nt, hsa; identical to SEQ ID NO: 655273

SEQ ID NO: 658754 - RNA, 64 nt, hsa; identical to SEQ ID NO: 655274

SEQ ID NO: 658755 - RNA, 64 nt, hsa; identical to SEQ ID NO: 655275

SEQ ID NO: 658756 - RNA, 64 nt, hsa; identical to SEQ ID NO: 655276

SEQ ID NO: 658757 - RNA, 64 nt, hsa; identical to SEQ ID NO: 655277

SEQ ID NO: 658758 - RNA, 64 nt, hsa; identical to SEQ ID NO: 655278

SEQ ID NO: 658759 - RNA, 64 nt, hsa; identical to SEQ ID NO: 655279

SEQ ID NO: 658760 - RNA, 64 nt, hsa; identical to SEQ ID NO: 655280

SEQ ID NO: 658761 - RNA, 64 nt, hsa; identical to SEQ ID NO: 655281

SEQ ID NO: 658762 - RNA, 64 nt, hsa; identical to SEQ ID NO: 655282

SEQ ID NO: 658763 - RNA, 64 nt, hsa; identical to SEQ ID NO: 655283

SEQ ID NO: 658764 - RNA, 64 nt, hsa; identical to SEQ ID NO: 655284

SEQ ID NO: 658765 - RNA, 64 nt, hsa; identical to SEQ ID NO: 655285

SEQ ID NO: 658766 - RNA, 64 nt, hsa; identical to SEQ ID NO: 655286

SEQ ID NO: 658767 - RNA, 64 nt, hsa; identical to SEQ ID NO: 655287

SEQ ID NO: 658768 - RNA, 64 nt, hsa; identical to SEQ ID NO: 655288

SEQ ID NO: 658769 - RNA, 64 nt, hsa; identical to SEQ ID NO: 655289

SEQ ID NO: 658770 - RNA, 64 nt, hsa; identical to SEQ ID NO: 655290

SEQ ID NO: 658771 - RNA, 64 nt, hsa; identical to SEQ ID NO: 342652

SEQ ID NO: 658772 - RNA, 64 nt, hsa; identical to SEQ ID NO: 342653

SEQ ID NO: 658773 - RNA, 64 nt, hsa; identical to SEQ ID NO: 342654

SEQ ID NO: 658774 - RNA, 64 nt, hsa; identical to SEQ ID NO: 342655

SEQ ID NO: 658775 - RNA, 64 nt, hsa; identical to SEQ ID NO: 342656

SEQ ID NO: 658776 - RNA, 64 nt, hsa; identical to SEQ ID NO: 342657

SEQ ID NO: 658777 - RNA, 64 nt, hsa; identical to SEQ ID NO: 342658

SEQ ID NO: 658778 - RNA, 64 nt, hsa; identical to SEQ ID NO: 342659

SEQ ID NO: 658779 - RNA, 64 nt, hsa; identical to SEQ ID NO: 342660

SEQ ID NO: 658780 - RNA, 64 nt, hsa; identical to SEQ ID NO: 342661

SEQ ID NO: 658781 - RNA, 64 nt, hsa; identical to SEQ ID NO: 342662

SEQ ID NO: 658782 - RNA, 64 nt, hsa; identical to SEQ ID NO: 342663

SEQ ID NO: 658783 - RNA, 64 nt, hsa; identical to SEQ ID NO: 342664

SEQ ID NO: 658784 - RNA, 64 nt, hsa; identical to SEQ ID NO: 342665

SEQ ID NO: 658785 - RNA, 64 nt, hsa; identical to SEQ ID NO: 342666

SEQ ID NO: 658786 - RNA, 64 nt, hsa; identical to SEQ ID NO: 342667

SEQ ID NO: 658787 - RNA, 64 nt, hsa; identical to SEQ ID NO: 342668

SEQ ID NO: 658788 - RNA, 64 nt, hsa; identical to SEQ ID NO: 342669

SEQ ID NO: 658789 - RNA, 64 nt, hsa; identical to SEQ ID NO: 342670

SEQ ID NO: 658790 - RNA, 64 nt, hsa; identical to SEQ ID NO: 342671

SEQ ID NO: 658791 - RNA, 64 nt, hsa; identical to SEQ ID NO: 622464

SEQ ID NO: 658792 - RNA, 64 nt, hsa; identical to SEQ ID NO: 622465

SEQ ID NO: 658793 - RNA, 64 nt, hsa; identical to SEQ ID NO: 622466

SEQ ID NO: 658794 - RNA, 64 nt, hsa; identical to SEQ ID NO: 622467

SEQ ID NO: 658795 - RNA, 64 nt, hsa; identical to SEQ ID NO: 622468

SEQ ID NO: 658796 - RNA, 64 nt, hsa; identical to SEQ ID NO: 622469

SEQ ID NO: 658797 - RNA, 64 nt, hsa; identical to SEQ ID NO: 622470

SEQ ID NO: 658798 - RNA, 64 nt, hsa; identical to SEQ ID NO: 622471

SEQ ID NO: 658799 - RNA, 64 nt, hsa; identical to SEQ ID NO: 622472

SEQ ID NO: 658800 - RNA, 64 nt, hsa; identical to SEQ ID NO: 622473

SEQ ID NO: 658801 - RNA, 64 nt, hsa; identical to SEQ ID NO: 622474

SEQ ID NO: 658802 - RNA, 64 nt, hsa; identical to SEQ ID NO: 622475

SEQ ID NO: 658803 - RNA, 64 nt, hsa; identical to SEQ ID NO: 622476

SEQ ID NO: 658804 - RNA, 64 nt, hsa; identical to SEQ ID NO: 622477

SEQ ID NO: 658805 - RNA, 64 nt, hsa; identical to SEQ ID NO: 538220

SEQ ID NO: 658806 - RNA, 64 nt, hsa; identical to SEQ ID NO: 538221

SEQ ID NO: 658807 - RNA, 64 nt, hsa; identical to SEQ ID NO: 538222

SEQ ID NO: 658808 - RNA, 64 nt, hsa; identical to SEQ ID NO: 538223

SEQ ID NO: 658809 - RNA, 64 nt, hsa; identical to SEQ ID NO: 538224

SEQ ID NO: 658810 - RNA, 64 nt, hsa; identical to SEQ ID NO: 538225

SEQ ID NO: 658811 - RNA, 64 nt, hsa; identical to SEQ ID NO: 538226

SEQ ID NO: 658812 - RNA, 64 nt, hsa; identical to SEQ ID NO: 538227

SEQ ID NO: 658813 - RNA, 64 nt, hsa; identical to SEQ ID NO: 538228

SEQ ID NO: 658814 - RNA, 64 nt, hsa; identical to SEQ ID NO: 538229

SEQ ID NO: 658815 - RNA, 64 nt, hsa; identical to SEQ ID NO: 538230

SEQ ID NO: 658816 - RNA, 64 nt, hsa; identical to SEQ ID NO: 538231

SEQ ID NO: 658817 - RNA, 64 nt, hsa; identical to SEQ ID NO: 538232

SEQ ID NO: 658818 - RNA, 64 nt, hsa; identical to SEQ ID NO: 538233

SEQ ID NO: 658819 - RNA, 64 nt, hsa; identical to SEQ ID NO: 538234

SEQ ID NO: 658820 - RNA, 57 nt, hsa; identical to SEQ ID NO: 538235

SEQ ID NO: 658821 - RNA, 64 nt, hsa; identical to SEQ ID NO: 538236

SEQ ID NO: 658822 - RNA, 64 nt, hsa; identical to SEQ ID NO: 538237

SEQ ID NO: 658823 - RNA, 64 nt, hsa; identical to SEQ ID NO: 538238

SEQ ID NO: 658824 - RNA, 64 nt, hsa; identical to SEQ ID NO: 538239

SEQ ID NO: 658825 - RNA, 64 nt, hsa; identical to SEQ ID NO: 538240

SEQ ID NO: 658826 - RNA, 64 nt, hsa; identical to SEQ ID NO: 538241

SEQ ID NO: 658827 - RNA, 64 nt, hsa; identical to SEQ ID NO: 538242

SEQ ID NO: 658828 - RNA, 64 nt, hsa; identical to SEQ ID NO: 538243

SEQ ID NO: 658829 - RNA, 64 nt, hsa; identical to SEQ ID NO: 538243

SEQ ID NO: 658830 - RNA, 64 nt, hsa; identical to SEQ ID NO: 538245

SEQ ID NO: 658831 - RNA, 64 nt, hsa; identical to SEQ ID NO: 538246

SEQ ID NO: 658832 - RNA, 64 nt, hsa; identical to SEQ ID NO: 538247

SEQ ID NO: 658833 - RNA, 64 nt, hsa; identical to SEQ ID NO: 538248

SEQ ID NO: 658834 - RNA, 64 nt, hsa; identical to SEQ ID NO: 538249

SEQ ID NO: 658835 - RNA, 64 nt, hsa; identical to SEQ ID NO: 538250

SEQ ID NO: 658836 - RNA, 64 nt, hsa; identical to SEQ ID NO: 538251

SEQ ID NO: 658837 - RNA, 64 nt, hsa; identical to SEQ ID NO: 538252

SEQ ID NO: 658838 - RNA, 64 nt, hsa; identical to SEQ ID NO: 538253

SEQ ID NO: 658839 - RNA, 64 nt, hsa; identical to SEQ ID NO: 538254

SEQ ID NO: 658840 - RNA, 64 nt, hsa; identical to SEQ ID NO: 538255

SEQ ID NO: 658841 - RNA, 64 nt, hsa; identical to SEQ ID NO: 538256

SEQ ID NO: 658842 - RNA, 64 nt, hsa; identical to SEQ ID NO: 538257

SEQ ID NO: 658843 - RNA, 64 nt, hsa; identical to SEQ ID NO: 538258

SEQ ID NO: 658844 - RNA, 64 nt, hsa; identical to SEQ ID NO: 538259

SEQ ID NO: 658845 - RNA, 64 nt, hsa; identical to SEQ ID NO: 538257

SEQ ID NO: 658846 - RNA, 64 nt, hsa; identical to SEQ ID NO: 291360

SEQ ID NO: 658847 - RNA, 64 nt, hsa; identical to SEQ ID NO: 291361

SEQ ID NO: 658848 - RNA, 64 nt, hsa; identical to SEQ ID NO: 291362

SEQ ID NO: 658849 - RNA, 64 nt, hsa; identical to SEQ ID NO: 291363

SEQ ID NO: 658850 - RNA, 64 nt, hsa; identical to SEQ ID NO: 291364

SEQ ID NO: 658851 - RNA, 64 nt, hsa; identical to SEQ ID NO: 291365

SEQ ID NO: 658852 - RNA, 64 nt, hsa; identical to SEQ ID NO: 291366

SEQ ID NO: 658853 - RNA, 64 nt, hsa; identical to SEQ ID NO: 291367

SEQ ID NO: 658854 - RNA, 64 nt, hsa; identical to SEQ ID NO: 291368

SEQ ID NO: 658855 - RNA, 64 nt, hsa; identical to SEQ ID NO: 291369

SEQ ID NO: 658856 - RNA, 64 nt, hsa; identical to SEQ ID NO: 291370

SEQ ID NO: 658857 - RNA, 64 nt, hsa; identical to SEQ ID NO: 291371

SEQ ID NO: 658858 - RNA, 64 nt, hsa; identical to SEQ ID NO: 291372

SEQ ID NO: 658859 - RNA, 64 nt, hsa; identical to SEQ ID NO: 291373

SEQ ID NO: 658860 - RNA, 64 nt, hsa; identical to SEQ ID NO: 291374

SEQ ID NO: 658861 - RNA, 64 nt, hsa; identical to SEQ ID NO: 291375

SEQ ID NO: 658862 - RNA, 64 nt, hsa; identical to SEQ ID NO: 291376

SEQ ID NO: 658863 - RNA, 64 nt, hsa; identical to SEQ ID NO: 291377

SEQ ID NO: 658864 - RNA, 64 nt, hsa; identical to SEQ ID NO: 291378

SEQ ID NO: 658865 - RNA, 64 nt, hsa; identical to SEQ ID NO: 81945

SEQ ID NO: 658866 - RNA, 64 nt, hsa; identical to SEQ ID NO: 81946

SEQ ID NO: 658867 - RNA, 64 nt, hsa; identical to SEQ ID NO: 81947

SEQ ID NO: 658868 - RNA, 64 nt, hsa; identical to SEQ ID NO: 81948

SEQ ID NO: 658869 - RNA, 64 nt, hsa; identical to SEQ ID NO: 81949

SEQ ID NO: 658870 - RNA, 64 nt, hsa; identical to SEQ ID NO: 81950

SEQ ID NO: 658871 - RNA, 64 nt, hsa; identical to SEQ ID NO: 81951

SEQ ID NO: 658872 - RNA, 64 nt, hsa; identical to SEQ ID NO: 81952

SEQ ID NO: 658873 - RNA, 64 nt, hsa; identical to SEQ ID NO: 81953

SEQ ID NO: 658874 - RNA, 64 nt, hsa; identical to SEQ ID NO: 81954

SEQ ID NO: 658875 - RNA, 64 nt, hsa; identical to SEQ ID NO: 81955

SEQ ID NO: 658876 - RNA, 64 nt, hsa; identical to SEQ ID NO: 81956

SEQ ID NO: 658877 - RNA, 64 nt, hsa; identical to SEQ ID NO: 81957

SEQ ID NO: 658878 - RNA, 64 nt, hsa; identical to SEQ ID NO: 81958

SEQ ID NO: 658879 - RNA, 64 nt, hsa; identical to SEQ ID NO: 81959

SEQ ID NO: 658880 - RNA, 64 nt, hsa; identical to SEQ ID NO: 81960

SEQ ID NO: 658881 - RNA, 64 nt, hsa; identical to SEQ ID NO: 81961

SEQ ID NO: 658882 - RNA, 64 nt, hsa; identical to SEQ ID NO: 81962

SEQ ID NO: 658883 - RNA, 64 nt, hsa; identical to SEQ ID NO: 511663

SEQ ID NO: 658884 - RNA, 64 nt, hsa; identical to SEQ ID NO: 511664

SEQ ID NO: 658885 - RNA, 64 nt, hsa; identical to SEQ ID NO: 511665

SEQ ID NO: 658886 - RNA, 64 nt, hsa; identical to SEQ ID NO: 511666

SEQ ID NO: 658887 - RNA, 64 nt, hsa; identical to SEQ ID NO: 511667

SEQ ID NO: 658888 - RNA, 64 nt, hsa; identical to SEQ ID NO: 511668

SEQ ID NO: 658889 - RNA, 64 nt, hsa; identical to SEQ ID NO: 511669

SEQ ID NO: 658890 - RNA, 64 nt, hsa; identical to SEQ ID NO: 511670

SEQ ID NO: 658891 - RNA, 64 nt, hsa; identical to SEQ ID NO: 511671

SEQ ID NO: 658892 - RNA, 64 nt, hsa; identical to SEQ ID NO: 511672

SEQ ID NO: 658893 - RNA, 61 nt, hsa
ucacacuaggcaaugccauuucaaugcauuacuaaaugacauuuguaguuccuagcuccuc

SEQ ID NO: 658894 - RNA, 61 nt, hsa
gguuguuuuuggucucuguugucacuaaagacuaaaugaggguuugcaguugggaaagagg

SEQ ID NO: 658895 - RNA, 61 nt, hsa
uacuuucauuuauguuugcuagaaacauuuucuaaaugauagugauuagcugguuagccau

SEQ ID NO: 658896 - RNA, 61 nt, hsa
uuagaauccuuugaaucuaaguauuuguuuccuaaaugaaacauuuguacaacauuugaug

SEQ ID NO: 658897 - RNA, 61 nt, hsa
aaucaaacauucauauccacaaaauuuucugcuaaaugacuccacacucagccuucucuac

SEQ ID NO: 658898 - RNA, 61 nt, hsa
acugaagcuccagaguuaagguuucagauuucuaaaugaaacuaucuuuuucaauuacauc

SEQ ID NO: 658899 - RNA, 61 nt, hsa
uaagugagaauuucuaaaugauuuucacauucuaaaugacuuuggguuuugaacucuccau

SEQ ID NO: 658900 - RNA, 61 nt, hsa
cuaauucugugggugccuuaagugagaauuucuaaaugauuuucacauucuaaaugacuuu

SEQ ID NO: 658901 - RNA, 61 nt, hsa
ucauauguuaaaaauaaagagauguagaaaucuaaaugaauuaucacuguguauacagaca

SEQ ID NO: 658902 - RNA, 61 nt, hsa
ggucaucuggugaugaagagaaaaguuuaaucuaaaugauaugugcauuuccucauuuaaa

SEQ ID NO: 658903 - RNA, 61 nt, hsa
ccucuugggaaauuagcagauagucuuugcucuaaaugauaucugaguaaauagacuugag

SEQ ID NO: 658904 - RNA, 61 nt, hsa
cauuuuaaguauuuuuaaauagaugaaaauucuaaaugauuuucccucaaaucuaucuaga

SEQ ID NO: 658905 - RNA, 61 nt, hsa
auuuucugaauucccauuuucuuguucgcggcuaaaugacaguuucugucauuacuuagau

SEQ ID NO: 658906 - RNA, 61 nt, hsa
gguucuggcacuucaaugccaggcaggucuccuaaaugaacagaaugaucugugugagccg

SEQ ID NO: 658907 - RNA, 61 nt, hsa
guauuuuaaaguaauaaugauuaaagaauaacuaaaugacucugauuuuguuuuaucaauc

SEQ ID NO: 658908 - RNA, 61 nt, hsa
gcauucuguacuacauccugccuuuugaaaccuaaaugaguuuucguugaugaaauguugc

SEQ ID NO: 658909 - RNA, 61 nt, hsa
ugagagaagcuauaauuuaaucugugaggaacuaaaugacaggagauuggugcuaauacgg

SEQ ID NO: 658910 - RNA, 61 nt, hsa
uaguacaugauuuuaaagguuagaaccccuucuaaaugaauggucuguggaagauuuuagu

SEQ ID NO: 658911 - RNA, 61 nt, hsa
aacacuuccaaaaagauacacagaagaggaacuaaaugacugcgaagcuggaauacugcua

SEQ ID NO: 658912 - RNA, 61 nt, hsa
ugcuuaaaguacauuaugcuuuuuaauggaacuaaaugaucaaaaaaagaauggacuguaa

SEQ ID NO: 658913 - RNA, 61 nt, hsa
aaaguauguuuguguugguuuuuuaagaagucuaaaugaaguuauuaauaccugaagcuuu

SEQ ID NO: 658914 - RNA, 61 nt, hsa
aaauugacuaccuggaggaaugauuaggaaucuaaaugaagccagcccucgguaucugcag

SEQ ID NO: 658915 - RNA, 61 nt, hsa
ccaaguauagugcagauucuauguaaaacuacuaaaugacacuggaauauguuuaguagau

SEQ ID NO: 658916 - RNA, 61 nt, hsa
uauuuaucugagugaguccaaggugcaacuccuaaaugaauuguguugcagagaacuccca

SEQ ID NO: 658917 - RNA, 64 nt, hsa; identical to SEQ ID NO: 418746

SEQ ID NO: 658918 - RNA, 64 nt, hsa; identical to SEQ ID NO: 418747

SEQ ID NO: 658919 - RNA, 64 nt, hsa; identical to SEQ ID NO: 418748

SEQ ID NO: 658920 - RNA, 64 nt, hsa; identical to SEQ ID NO: 418749

SEQ ID NO: 658921 - RNA, 64 nt, hsa; identical to SEQ ID NO: 418750

SEQ ID NO: 658922 - RNA, 64 nt, hsa; identical to SEQ ID NO: 418751

SEQ ID NO: 658923 - RNA, 64 nt, hsa; identical to SEQ ID NO: 418752

SEQ ID NO: 658924 - RNA, 64 nt, hsa; identical to SEQ ID NO: 418753

SEQ ID NO: 658925 - RNA, 64 nt, hsa; identical to SEQ ID NO: 418754

SEQ ID NO: 658926 - RNA, 64 nt, hsa; identical to SEQ ID NO: 418755

SEQ ID NO: 658927 - RNA, 64 nt, hsa; identical to SEQ ID NO: 418756

SEQ ID NO: 658928 - RNA, 64 nt, hsa; identical to SEQ ID NO: 418757

SEQ ID NO: 658929 - RNA, 64 nt, hsa; identical to SEQ ID NO: 418758

SEQ ID NO: 658930 - RNA, 64 nt, hsa; identical to SEQ ID NO: 418759

SEQ ID NO: 658931 - RNA, 64 nt, hsa; identical to SEQ ID NO: 418760

SEQ ID NO: 658932 - RNA, 64 nt, hsa; identical to SEQ ID NO: 418761

SEQ ID NO: 658933 - RNA, 64 nt, hsa; identical to SEQ ID NO: 418762

SEQ ID NO: 658934 - RNA, 64 nt, hsa; identical to SEQ ID NO: 418763

SEQ ID NO: 658935 - RNA, 64 nt, hsa; identical to SEQ ID NO: 418764

SEQ ID NO: 658936 - RNA, 64 nt, hsa; identical to SEQ ID NO: 418765

SEQ ID NO: 658937 - RNA, 64 nt, hsa; identical to SEQ ID NO: 418766

SEQ ID NO: 658938 - RNA, 64 nt, hsa; identical to SEQ ID NO: 418767

SEQ ID NO: 658939 - RNA, 64 nt, hsa; identical to SEQ ID NO: 418768

SEQ ID NO: 658940 - RNA, 64 nt, hsa; identical to SEQ ID NO: 418769

SEQ ID NO: 658941 - RNA, 64 nt, hsa; identical to SEQ ID NO: 418770

SEQ ID NO: 658942 - RNA, 64 nt, hsa; identical to SEQ ID NO: 418771

SEQ ID NO: 658943 - RNA, 64 nt, hsa; identical to SEQ ID NO: 418772

SEQ ID NO: 658944 - RNA, 64 nt, hsa; identical to SEQ ID NO: 418773

SEQ ID NO: 658945 - RNA, 64 nt, hsa; identical to SEQ ID NO: 418774

SEQ ID NO: 658946 - RNA, 64 nt, hsa; identical to SEQ ID NO: 418775

SEQ ID NO: 658947 - RNA, 64 nt, hsa; identical to SEQ ID NO: 418776

SEQ ID NO: 658948 - RNA, 64 nt, hsa; identical to SEQ ID NO: 418777

SEQ ID NO: 658949 - RNA, 64 nt, hsa; identical to SEQ ID NO: 418778

SEQ ID NO: 658950 - RNA, 64 nt, hsa; identical to SEQ ID NO: 418779

SEQ ID NO: 658951 - RNA, 64 nt, hsa; identical to SEQ ID NO: 418780

SEQ ID NO: 658952 - RNA, 64 nt, hsa; identical to SEQ ID NO: 418781

SEQ ID NO: 658953 - RNA, 64 nt, hsa; identical to SEQ ID NO: 418782

SEQ ID NO: 658954 - RNA, 64 nt, hsa; identical to SEQ ID NO: 418783

SEQ ID NO: 658955 - RNA, 64 nt, hsa; identical to SEQ ID NO: 418784

SEQ ID NO: 658956 - RNA, 64 nt, hsa; identical to SEQ ID NO: 418785

SEQ ID NO: 658957 - RNA, 64 nt, hsa; identical to SEQ ID NO: 418786

SEQ ID NO: 658958 - RNA, 64 nt, hsa; identical to SEQ ID NO: 418787

SEQ ID NO: 658959 - RNA, 64 nt, hsa; identical to SEQ ID NO: 418788

SEQ ID NO: 658960 - RNA, 64 nt, hsa; identical to SEQ ID NO: 418789

SEQ ID NO: 658961 - RNA, 64 nt, hsa; identical to SEQ ID NO: 418790

SEQ ID NO: 658962 - RNA, 64 nt, hsa; identical to SEQ ID NO: 418791

SEQ ID NO: 658963 - RNA, 64 nt, hsa; identical to SEQ ID NO: 418792

SEQ ID NO: 658964 - RNA, 64 nt, hsa; identical to SEQ ID NO: 418793

SEQ ID NO: 658965 - RNA, 64 nt, hsa; identical to SEQ ID NO: 418794

SEQ ID NO: 658966 - RNA, 64 nt, hsa; identical to SEQ ID NO: 418795

SEQ ID NO: 658967 - RNA, 64 nt, hsa; identical to SEQ ID NO: 418796

SEQ ID NO: 658968 - RNA, 64 nt, hsa; identical to SEQ ID NO: 418797

SEQ ID NO: 658969 - RNA, 64 nt, hsa; identical to SEQ ID NO: 418798

SEQ ID NO: 658970 - RNA, 64 nt, hsa; identical to SEQ ID NO: 418799

SEQ ID NO: 658971 - RNA, 64 nt, hsa; identical to SEQ ID NO: 418800

SEQ ID NO: 658972 - RNA, 64 nt, hsa
ccaaucucauuagcaggugauagaaagguuuugugguagcaaaugcaugauuucucugugacca

SEQ ID NO: 658973 - RNA, 64 nt, hsa
agagaugccuuaagauaauuaugugaggccacuugguagcaagaauggcagcuauuuccugagc

SEQ ID NO: 658974 - RNA, 64 nt, hsa
agagcuuggucccaagcucuacugggcccuuggagguagcaaggccacuggguugcuauccucu

SEQ ID NO: 658975 - RNA, 64 nt, hsa
aaaauagcuguuuugaaacuguuuuaauugcuuggguagcaaugugcacuuuaaacaauuugga

SEQ ID NO: 658976 - RNA, 64 nt, hsa
cuacccacugggccugguguguagagggggagaggguagcaaggugcuucucuacgcccaugac

SEQ ID NO: 658977 - RNA, 64 nt, hsa
aaaucuugagcauacuccagcaagauauguuuuugguagcaaaacugagaaaaucagcuucagg

SEQ ID NO: 658978 - RNA, 64 nt, hsa
cuagcacugagacuugugccuggaaggaaaaagagguagcaaaggggcaccugagguucacgcu

SEQ ID NO: 658979 - RNA, 64 nt, hsa
uuaccaauagccugaauuugaggagggaaugauugguagcaaaggaugggggaaagaaguaggu

SEQ ID NO: 658980 - RNA, 64 nt, hsa
aaaaguaaucaaugaaauauaauagcuaucuuuugguagcaaaagauauaaauuguauauguuu

SEQ ID NO: 658981 - RNA, 64 nt, hsa
aaauagucccacaaaauaccuuuugugacuaauggguagcaaucguauuauuugcuggccugaa

SEQ ID NO: 658982 - RNA, 64 nt, hsa
gaaaguguuaacuaucguugcccaccgaauuugagguagcaaaaaaaaaaaagaauguucuggu

SEQ ID NO: 658983 - RNA, 64 nt, hsa
aaaagaagucauguaaauaaaauagacauaaaaagguagcaauguacagauaaagaguacuuua

SEQ ID NO: 658984 - RNA, 64 nt, hsa
gggugcugcagccaggaggagaggaaaggacauggguagcaauucuacccagagccuucuccug

SEQ ID NO: 658985 - RNA, 64 nt, hsa
cgugacaggcuagucuugucucucucauaugcuagguagcaaauggggugauauuuuuauagaa

SEQ ID NO: 658986 - RNA, 64 nt, hsa
caccaugccuggccaaaacaccugauuuuuaaaugguagcaauugugcuaaauaaaauguguaa

SEQ ID NO: 658987 - RNA, 64 nt, hsa
uuuuuuucaaguucucucaagugucccaaaucaggguagcaaucuuguugccacaugugcagca

SEQ ID NO: 658988 - RNA, 64 nt, hsa
uaggaggcagcuuuacuaagcuggugcuuugcaugguagcaagugcugcccuuuaucagcaccc

SEQ ID NO: 658989 - RNA, 64 nt, hsa
aagucuuaagacugaauaugcauuaaaguaugcagguagcaaagauguaauaaauuugcuuaaa

SEQ ID NO: 658990 - RNA, 64 nt, hsa
guuuggugaauaugcuguuuccucaguucagagagguagcaacuagguaaacuccuuauaaaaa

SEQ ID NO: 658991 - RNA, 64 nt, hsa
uuuguaaggaauauggaauugcuaagauaucauugguagcaaacaucucugguaaggugcauau

SEQ ID NO: 658992 - RNA, 64 nt, hsa
auauuuuuuuaggaaaccuccuacccaugucugagguagcaagugcagccucacgacagauacc

SEQ ID NO: 658993 - RNA, 64 nt, hsa
ugagcagagcaguucaagggccaaacccuggaacgguagcaaugggauauaauaccuuucuaag

SEQ ID NO: 658994 - RNA, 64 nt, hsa
gggaaguaacaguugcuaggcuucaaugccuaucgguagcaagccauggaaaaagaugugucag

SEQ ID NO: 658995 - RNA, 64 nt, hsa
cagccuugacuucuugcccaaggccugcuacugggguagcaacugacagcucagaaaggagcug

SEQ ID NO: 658996 - RNA, 64 nt, hsa
ucagcacucaaaaauguacacccauuuaguuugugguagcaaagugcaaugcgaaauugaauga

SEQ ID NO: 658997 - RNA, 64 nt, hsa
ccgcguucauagcagcauuacucaaaagucaaacgguagcaacaacccaaauguccauccacag

SEQ ID NO: 658998 - RNA, 64 nt, hsa
uuaacuucaagaucugccccaguaauuuaccaaagguagcaaaauaauagugaagauggaauau

SEQ ID NO: 658999 - RNA, 64 nt, hsa
uuuucaucugccaggcguuguuaugugcuaugaggguagcaaguacgucuuugucuuaaugauc

SEQ ID NO: 659000 - RNA, 64 nt, hsa
uguucauuuagauaaaaguagaaggcacaggagagguagcaaaggccaggcuuuucuuugguuu

SEQ ID NO: 659001 - RNA, 64 nt, hsa
acagauuucgguucccugcuaugaaaagugaugugguagcaauuuuauaaauguugcuuucuga

SEQ ID NO: 659002 - RNA, 64 nt, hsa
aagacagcaauaaaagaccagugucauccauuuagguagcaagacauauugaaugcaaaguucu

SEQ ID NO: 659003 - RNA, 64 nt, hsa
auugucuaguaauugggaaaaaagcaacugguuagguagcaacaacagaagggaaauuucaaua

SEQ ID NO: 659004 - RNA, 64 nt, hsa
augacaaaauguagacaagaugccucaagguauugguagcaagcaagauuuugcccuuuaguuu

SEQ ID NO: 659005 - RNA, 64 nt, hsa
gcuaaauaaauguaauagccaaacccacucuguugguagcaauuggcagcccuauuucaguuua

SEQ ID NO: 659006 - RNA, 64 nt, hsa
augcacgaagucuguuuuaaugacaaggugauaugguagcaacacugugaagacaaucauggga

SEQ ID NO: 659007 - RNA, 64 nt, hsa
aaaauugucuuuccuuaucauuggugggaggcuugguagcaaaguaacauuuuuuggaaaagag

SEQ ID NO: 659008 - RNA, 64 nt, hsa
cuugcuuaacuaaaaccuaaggaccacuguuuuugguagcaauuauaugguuacuauccacugc

SEQ ID NO: 659009 - RNA, 64 nt, hsa
acucggcucccaucucugucaccuagccaggagggguagcaaaaauaaagucacgaggacauag

SEQ ID NO: 659010 - RNA, 64 nt, hsa
aaaugucaguccuagcagauguugcauguaaauugguagcaaguaaugauuacaacccagagga

SEQ ID NO: 659011 - RNA, 64 nt, hsa
acauccagacucaucugaaggcuggggaggauuugguagcaauguguagagcagagcuggaaaa

SEQ ID NO: 659012 - RNA, 64 nt, hsa
uccuuucuccauguguuugauuucuccucaggcugguagcaaguucuggaucuuauacccaaca

SEQ ID NO: 659013 - RNA, 64 nt, hsa
gcgcuuccgcgagcacccugggaacugggucuuggguagcaaagcccucccagagaaaagauug

SEQ ID NO: 659014 - RNA, 64 nt, hsa
augguuggcuucuugucugcaagccagcugauaugguagcaaccaaagauuccaguguuugagc

SEQ ID NO: 659015 - RNA, 64 nt, hsa
acggcuuuuggugaauuuguuuaagguuaauuaugguagcaaauuuuggaccuaaacauuauuu

SEQ ID NO: 659016 - RNA, 64 nt, hsa
ucucuugcaacacccaugugccuuugaugagucagguagcaagcuguaguagauaaugagaaag

SEQ ID NO: 659017 - RNA, 64 nt, hsa
uaacccaguggagguuagaaagaaguuauauucugguagcaaauuaacuuuacauccuuuuucc

SEQ ID NO: 659018 - RNA, 64 nt, hsa
gcuaguuauacuccauucuuuggucgucguccucgguagcaagaccccugauuuuaagcuuugc

SEQ ID NO: 659019 - RNA, 64 nt, hsa
auggcuaacugauguuuauaaugcccuccauccagguagcaagauguguguaugucuugucuaa

SEQ ID NO: 659020 - RNA, 64 nt, hsa
ggaaaggaccaaaaucaaaccgcaauuucuaggugguagcaaagggggacucgaaccagauguc

SEQ ID NO: 659021 - RNA, 64 nt, hsa
gucuggggcccguuuuccccccagggggugucuagguagcaacagguaucgaggacucuccaaa

SEQ ID NO: 659022 - RNA, 64 nt, hsa
ucacaccugggccucuccucggagccgaccccuggguagcaaggcagccgagagcaucucccug

SEQ ID NO: 659023 - RNA, 64 nt, hsa
uugccucuuaaaggcaaggguugaagauaaauaagguagcaaugucuauaguuuuggccuuaac

SEQ ID NO: 659024 - RNA, 64 nt, hsa
aaaauucuaaaaauuugcaagucaaguaaguguggguagcaaaaacaauuaucuuuaaaaaaaa

SEQ ID NO: 659025 - RNA, 64 nt, hsa
ucuucuuucaacuauaaguaauccccaggugugggguagcaagugugcuuccgucaagauacca

SEQ ID NO: 659026 - RNA, 64 nt, hsa
auuacccugaugugacaauuacacauuguagacagguagcaaaauaucacauacacccccaaaa

SEQ ID NO: 659027 - RNA, 64 nt, hsa
gacuaaacagaaaccagaacugaaacauucaccugguagcaaaugacacaugcacgcacacaca

SEQ ID NO: 659028 - RNA, 64 nt, hsa
ccugaggugcauagcauauucccacauuccauuugguagcaauaugcggucugaaugcaugcau

SEQ ID NO: 659029 - RNA, 64 nt, hsa
augaaguuucgaaguuucauguuggcuuuggaaugguagcaaaagccuuuccuggcugagauga

SEQ ID NO: 659030 - RNA, 64 nt, hsa
aaugcauaaccugccauaucuuuacauauuuguugguagcaauuuguauuaaagaaaucacaag

SEQ ID NO: 659031 - RNA, 64 nt, hsa
uauauuuuuaaaaaguucccuuaaucuaugacaugguagcaaugauuucccuuuggugucuuaa

SEQ ID NO: 659032 - RNA, 64 nt, hsa
ucaauauguguugacaaccagcccugugguucuggguagcaaaggaaauacaguauaacuuaau

SEQ ID NO: 659033 - RNA, 64 nt, hsa
cuuuuacauauuguuuagggaaaugauauugaaagguagcaaugccuggauagugaagcaugag

SEQ ID NO: 659034 - RNA, 64 nt, hsa
uuucuuaguaaaaugaaaucaaaguauugaucaggguagcaaacucaaaugcugacaggggcca

SEQ ID NO: 659035 - RNA, 64 nt, hsa
ggccuccucucauaaaagagacaguuguuggcaagguagcaauaccaguuucaaacuuggugac

SEQ ID NO: 659036 - RNA, 64 nt, hsa
accuguugggaguucacaagugcugcauauacuggguagcaaaagaaaauggaaaaaaacccac

SEQ ID NO: 659037 - RNA, 64 nt, hsa
ugggaggaguaaagguagccuugaggccagagcagguagcaaggcauuguggaaagaggggacc

SEQ ID NO: 659038 - RNA, 64 nt, hsa
auuucugacccacuagguuuucuuuccagaaauagguagcaaggacaagaacuaaacaauccca

SEQ ID NO: 659039 - RNA, 64 nt, hsa
aaacaaaacaaacaaaccacccauugggauauaagguagcaaucacaaacuaaagacugcggcu

SEQ ID NO: 659040 - RNA, 64 nt, hsa
agggaaugcuuugcuugaggccacacagcagguugguagcaaagaucuugucuagccagggcag

SEQ ID NO: 659041 - RNA, 64 nt, hsa
gggcaggggccuuggugggcagauggcaauugaggguagcaaccuauuagggugggggagggac

SEQ ID NO: 659042 - RNA, 64 nt, hsa
guugauuggaccucaggggaaaaaagugaaaaaggguagcaaaggccaaugucuucuagcugcu

SEQ ID NO: 659043 - RNA, 64 nt, hsa
uuagguuacaugguuacacagugaggugaggugagguagcaagaaguuucugugagcccaaaau

SEQ ID NO: 659044 - RNA, 64 nt, hsa
auuagagucagagccuguucacauauugugaucagguagcaaugacauguaccacuuaaauuau

SEQ ID NO: 659045 - RNA, 64 nt, hsa
guguaauauuucuuuugcuuuuaaaaaaauuccugguagcaaaucaagauaaauaauugcuuca

SEQ ID NO: 659046 - RNA, 64 nt, hsa
auuaaauaaaggacuuuauuuacauacuacauaagguagcaaacuguugaaugaguuugaaggu

SEQ ID NO: 659047 - RNA, 64 nt, hsa
aguaaaagugauggcaucucucauugacuuaucugguagcaaacugguucuuucggagccaucc

SEQ ID NO: 659048 - RNA, 64 nt, hsa
uuggggagucggagaguuggggcccugagacugggguagcaacccccccuuuuaucuuuuaaga

SEQ ID NO: 659049 - RNA, 64 nt, hsa
ugaaucaaaaugauggcugguaauacggcaauaagguagcaaaggcaggugcuuugcagaaaga

SEQ ID NO: 659050 - RNA, 64 nt, hsa
aaauuggaauuuuguuuaaaauuuuacacuuuaagguagcaaaugucaauuauuagaccgagca

SEQ ID NO: 659051 - RNA, 64 nt, hsa
guuauggccgaaaaggauaugcaguaugcuuaaugguagcaacugaaagaagacauccugagca

SEQ ID NO: 659052 - RNA, 64 nt, hsa
gaccugggauuuuaucaugcagaugaaacauccagguagcaagcuucagagagaauagacugug

SEQ ID NO: 659053 - RNA, 64 nt, hsa
uucucaugaguuuuguucaaauauucugggauaagguagcaagaucuuguuuuuaaacaaucuc

SEQ ID NO: 659054 - RNA, 64 nt, hsa
aauucucuuacccugaggcugagggcgaacaguagguagcaagggaguguaaaggaauuuaucu

SEQ ID NO: 659055 - RNA, 64 nt, hsa
gcucccucuccccuucaucuucugcuccaaaggugguagcaagaggaguacccaguuagggguu

SEQ ID NO: 659056 - RNA, 64 nt, hsa
ccuugguagcugugcuucagcaaacgucaaccaugguagcaaauuggugaggcugugaccaaua

SEQ ID NO: 659057 - RNA, 64 nt, hsa
aaccagauaacuuccuaaguggagauggccuguagguagcaaaugcaggauuuuguuuacuuuc

SEQ ID NO: 659058 - RNA, 64 nt, hsa
caauaauggaaacguucuaugugcaguccaauaggguagcaacuggccaaaugaggccuacuga

SEQ ID NO: 659059 - RNA, 64 nt, hsa
gaugcccagguugcacaggagugggauggggugugguagcaaaaggagggagaggaguccuuuu

SEQ ID NO: 659060 - RNA, 64 nt, hsa
ugcugaguuugggugcacccuaagauggaggccagguagcaauggggccggccucagagagagc

SEQ ID NO: 659061 - RNA, 64 nt, hsa
cccuggucacuguccuaaccuuugucaggacaaagguagcaagaggauuuccuggcggguggga

SEQ ID NO: 659062 - RNA, 64 nt, hsa
ggcuucaggcccacuuguugaacagaacaaucuggguagcaacagcaucuuccacaguuuucca

SEQ ID NO: 659063 - RNA, 64 nt, hsa
gcaacagaggaaacagugaaggggaacagaaggggguagcaaaguguuacagaaaagcggacug

SEQ ID NO: 659064 - RNA, 64 nt, hsa
guuaauucugugguccuguuuaucacagacuuuggguagcaauaggaagagaguguuauucuga

SEQ ID NO: 659065 - RNA, 64 nt, hsa
caagcuccucauuuacggcucugugcuaccccuagguagcaagagagaggcugggaaaagugug

SEQ ID NO: 659066 - RNA, 64 nt, hsa
ugguuuguagaauuuguguucauaaguucagauggguagcaaauggaauagaacuuacuuaaaa

SEQ ID NO: 659067 - RNA, 64 nt, hsa
uucaagagucauuuauuacaggggauaaauguuggguagcaagaacuuuaauuugcacuaccag

SEQ ID NO: 659068 - RNA, 64 nt, hsa
uaaugucacucuagugcuuaggcugcgauccuaugguagcaauucugugcugguauaaaucuua

SEQ ID NO: 659069 - RNA, 64 nt, hsa
guugugguugaugcagugugggaugucccugagagguagcaagucuaggguggugaguuccugc

SEQ ID NO: 659070 - RNA, 64 nt, hsa
cgggacugggggguuugucuggcauagccaugcugguagcaagagagaaaaaaucaacagcaaa

SEQ ID NO: 659071 - RNA, 64 nt, hsa
agcaaaaaucugguauacccuguagaagcagggggguagcaaauuuaggcucucuucgaaauua

SEQ ID NO: 659072 - RNA, 64 nt, hsa
uaauaauaguacauacaauacuaauuguauauaagguagcaaccaaaagagguuguuaauuagc

SEQ ID NO: 659073 - RNA, 64 nt, hsa
uaacccacaaauguagcaucaagccagacucacagguagcaaaaugaauuacacaccuacuuuu

SEQ ID NO: 659074 - RNA, 64 nt, hsa
uucccacacuuacugaguacagaugaaggaaagugguagcaauuuaaucauaacuuucauuugc

SEQ ID NO: 659075 - RNA, 64 nt, hsa
agauugucauggccagagaucauaggucacuucagguagcaagaccccuggcaaacugggcacu

SEQ ID NO: 659076 - RNA, 64 nt, hsa
guggucucacucuagcugagcagaguauuaacuugguagcaagaguuccugauacaaauagaug

SEQ ID NO: 659077 - RNA, 61 nt, hsa
uuauuaacuuuuucaucugaugagaugucgcgguagcaaaaauagagaaaggguagaaaaa

SEQ ID NO: 659078 - RNA, 64 nt, hsa
cagaggccuugucauccucccuugccccaggccagguagcaagagagcagcgcccaggccugcu

SEQ ID NO: 659079 - RNA, 64 nt, hsa
gauggcuguauucugacuuugaagccuguuaagagguagcaagggggcuagaggagggagauuc

SEQ ID NO: 659080 - RNA, 64 nt, hsa
cagauucccaggugagcugaugcuggugguuaaggguagcaaaucucuaaagcacgaagcccuc

SEQ ID NO: 659081 - RNA, 64 nt, hsa
uguugugccccuuuccaagauacagccugcaagugguagcaagaagugauuagaggcagaucug

SEQ ID NO: 659082 - RNA, 64 nt, hsa
uguuugauaaugguuacuggguccuucucucaaggguagcaaggccaagcugauggcugcuugu

SEQ ID NO: 659083 - RNA, 64 nt, hsa
caugccuugaguacauaccauacagcaaauaaaugguagcaaaacauucuacuuugccugucug

SEQ ID NO: 659084 - RNA, 64 nt, hsa
uagaccgcauaaaaaauaaagugaacagugaggugguagcaagacuucuuuuuagaaaagaaag

SEQ ID NO: 659085 - RNA, 64 nt, hsa
gaggcagugauuugccaaagugacacagagcaaugguagcaaaacaaggacuagagcucaggcc

SEQ ID NO: 659086 - RNA, 64 nt, hsa
augggagcauuagauuuaguuuuagacuuagguggguagcaaugccaguaaacuuaaauuacgu

SEQ ID NO: 659087 - RNA, 64 nt, hsa
agccuacuccuucuuacauagcuucuccaacagggguagcaaugaccuguccacuucaaacaca

SEQ ID NO: 659088 - RNA, 64 nt, hsa
agcacuaggagcaccuuucucaaggacaagaaaugguagcaaccaaaagguugguugaaggaaa

SEQ ID NO: 659089 - RNA, 64 nt, hsa
ggcugaucugaagucagucggaauuuguaaacaggguagcaaacaagauauuuuucuuccaugu

SEQ ID NO: 659090 - RNA, 64 nt, hsa
gucuccgcuagaaauacaaaaauuagccaagcaugguagcaagugccuauaauaccagcugagg

SEQ ID NO: 659091 - RNA, 64 nt, hsa
gaauacucgcugcagcugggguucccugcuuuuugguagcaaggguccagagaugagguguuuu

SEQ ID NO: 659092 - RNA, 64 nt, hsa
agcauaaaaucuagcuggacaacuaagaagcuaugguagcaaacagugauguugauggaaugag

SEQ ID NO: 659093 - RNA, 64 nt, hsa
gaucugaucaagguaggaauuacaauugcaugcagguagcaagcaagaaagcagaaacuacugu

SEQ ID NO: 659094 - RNA, 64 nt, hsa
agcaaaguugggagcuggaccccaauugaguggggguagcaauuggaguccuugugucucuuuu

SEQ ID NO: 659095 - RNA, 64 nt, hsa
auguccccuuccccguguaugcccccuuccccaagguagcaagauggagggauggggcucucuc

SEQ ID NO: 659096 - RNA, 64 nt, hsa
uaacacgcguuucauucaaugucuccacagacuggguagcaaaaaaaucaccuuuuaguuuuag

SEQ ID NO: 659097 - RNA, 64 nt, hsa
cuguucucaaccacguagugcgccagucaucacugguagcaaagauuuacagaaugucaacauc

SEQ ID NO: 659098 - RNA, 64 nt, hsa
uuuuucuucuccuaaaacuuuaaaacuugaaguagguagcaacguggcuuuuuuuuuuucccuu

SEQ ID NO: 659099 - RNA, 64 nt, hsa
gggaggacacucugaucucgaagccugccauaaagguagcaaauagacucuugggauuccccuc

SEQ ID NO: 659100 - RNA, 64 nt, hsa
aggcuaaagugcuguauccuuuaguaaaauuggagguagcaaacacuaaggugaaaagauaaug

SEQ ID NO: 659101 - RNA, 64 nt, hsa
acauauauauucuuuccccucuuuuaaaacaaaugguagcaaaccaaccacacacuguucugua

SEQ ID NO: 659102 - RNA, 64 nt, hsa
ccccaaaaggugggaacuuguccaagacgucacagguagcaagagguacuuuuaccuggcucca

SEQ ID NO: 659103 - RNA, 64 nt, hsa
cuuuaccacugaugaggggccucugccggcugaggguagcaagcagggguugugagucaggcug

SEQ ID NO: 659104 - RNA, 64 nt, hsa
gcuuucuguaacuuguuuuaauuuagaacacuuugguagcaauagaaacuuuggauacauuuuu

SEQ ID NO: 659105 - RNA, 64 nt, hsa
uauguuacucuaacucugaaaagugauguaaucugguagcaauguaguaguucaaauaaaggca

SEQ ID NO: 659106 - RNA, 64 nt, hsa
gaggugcucacccuccacccugugucccuguuuugguagcaagagugaccgaugucaagaacga

SEQ ID NO: 659107 - RNA, 64 nt, hsa
cuguaugagcaguucaaaggccaagccguggaaugguagcaaugggauauaauaccuuucuaag

SEQ ID NO: 659108 - RNA, 64 nt, hsa; identical to SEQ ID NO: 659107

SEQ ID NO: 659109 - RNA, 64 nt, hsa
gaguucgacaccaucuugggcaacauggugaaacccugucuacuaaaauacaaaaaaauuagcu

SEQ ID NO: 659110 - RNA, 64 nt, hsa
uacuuagacauauuaauaaacaauaaagacuuuaccugucuaauggaaaaccuggagaagucgu

SEQ ID NO: 659111 - RNA, 64 nt, hsa
ucaucccuuuacucuuacaguagcaaauaagaccccugucuaauggggggagacaaauguguag

SEQ ID NO: 659112 - RNA, 64 nt, hsa
caacccuuuacccuuacaguagcaagcauagaccccugucuaacggggguagacaggugcagau

SEQ ID NO: 659113 - RNA, 64 nt, hsa
gucuaccuccugcaguggggccgcucgccucuucccugucuacugcucaggcucucccacuucg

SEQ ID NO: 659114 - RNA, 64 nt, hsa
agccucaguguggcugcugcauaaguaucuguagccugucuaccuccugcaguggggccgcucg

SEQ ID NO: 659115 - RNA, 64 nt, hsa
acaauuaaagaaacaaaugacuuuuuggaauagcccugucuagggcaaacuguggcccccagga

SEQ ID NO: 659116 - RNA, 64 nt, hsa
agugauggagagaaaccaacaagagaucucgaacccugucuagaaggaauguauuuguugcuaa

SEQ ID NO: 659117 - RNA, 64 nt, hsa
cuggggcagcuguugggauucugauuaaaagaggggaaacgaucauccuggacaggaagugaga

SEQ ID NO: 659118 - RNA, 64 nt, hsa
cagucacuaaucucugagacuccauuuucuccagggaaacgaggcuugcccagauagacuaaca

SEQ ID NO: 659119 - RNA, 64 nt, hsa
gcgagcuucuuauaaauguggugauuuuuaccaaggaaacgauugacuuaaugcuuaaaaguau

SEQ ID NO: 659120 - RNA, 64 nt, hsa
auguuagacaucuguugaaauaagcucauaugguggaaacgacaacuauauuaugaauuauuuu

SEQ ID NO: 659121 - RNA, 64 nt, hsa
ugaaauucuucuguaagccugucugaguguauguggaaacgauugucaaaucuaaaauaucuau

SEQ ID NO: 659122 - RNA, 64 nt, hsa
ugggcagucccugcagaucuuccggaaaugggccggaaacgaaaagaacauggugagggcaugg

SEQ ID NO: 659123 - RNA, 64 nt, hsa
uccguuuauccugccauugcuuugaaaagcagcaggaaacgaaauccuuugacuuguaucagcu

SEQ ID NO: 659124 - RNA, 64 nt, hsa
caaaguaugggcuuuuuuguuuuuguuuuuuaagggaaacgaaauggaauucgaagggaccuuu

SEQ ID NO: 659125 - RNA, 64 nt, hsa
agagcgaggcaucccugaauuccacgcaucugcuggaaacgagccgugucagaucgcacauccc

SEQ ID NO: 659126 - RNA, 64 nt, hsa
ugaccaagugauguacauccaagugauguauucuggaaacgauggaauuuuacaguuacaguuc

SEQ ID NO: 659127 - RNA, 64 nt, hsa
ccaugguuccaacaaauugcaaauaaaacuguauggaaacgaugagcaagcugccgcuuuuuua

SEQ ID NO: 659128 - RNA, 64 nt, hsa
aaacaacuucugccaaacaauaauaaagccaacuggaaacgaaucggagccauuuucauuuucc

SEQ ID NO: 659129 - RNA, 64 nt, hsa
cuuguuuccuuauuugucaaauuagauuacacuaggaaacgauucucgaacauguuuuaaccuu

SEQ ID NO: 659130 - RNA, 64 nt, hsa
caugauuagaggcacgccaguuucaccauuuccgggaaacgaacccacugugcuuacagugacu

SEQ ID NO: 659131 - RNA, 64 nt, hsa
agguaccuccaaggaccggccuuugcaccuccauggaaacgaagcaccaucauucccguugaac

SEQ ID NO: 659132 - RNA, 64 nt, hsa
ucguuaagucagaauauaauaugaaguuccccaaggaaacgaacaaaaugaacucuagaauauc

SEQ ID NO: 659133 - RNA, 64 nt, hsa
uauggaaaagaaaacagacaguuuaguucagaauggaaacgaacguucugaugacacuguuuca

SEQ ID NO: 659134 - RNA, 64 nt, hsa
guucuuucaaagaccaggaugugguaccaacuuuggaaacgaaaggucucuugccaacaguauc

SEQ ID NO: 659135 - RNA, 64 nt, hsa
aacaauagagauugcuuuggugaccaugauaggaggaaacgaaacuuguaagauuggaacaguu

SEQ ID NO: 659136 - RNA, 64 nt, hsa
gacccagacaagcaaacucaaaauaaagagaaaaggaaacgaagaagcucccucucaccacccu

SEQ ID NO: 659137 - RNA, 64 nt, hsa
uuggagaagccaccugcacagcagagcucauuguggaaacgauggaggaaggugaaggggaagg

SEQ ID NO: 659138 - RNA, 64 nt, hsa
acuuuagugcaaagagcugagcacauuccagcagggaaacgaacuccgaugugcgcccauugua

SEQ ID NO: 659139 - RNA, 64 nt, hsa
auucucuagacaaaauccaucagggaaugcugcaggaaacgauugccaacuauacgaauggcuu

SEQ ID NO: 659140 - RNA, 64 nt, hsa
ugcaguacacaucagccucacugagcuaauaaagggaaacgaauguuucaaaucuacuucugcu

SEQ ID NO: 659141 - RNA, 64 nt, hsa
gcaaauuacauccuugcugaauucaggagguuaaggaaacgauccaugcaagagaggcccaauc

SEQ ID NO: 659142 - RNA, 64 nt, hsa
uccaaacucguggugcagcaagucacaccagacaggaaacgaauauggacguaauugcagaagg

SEQ ID NO: 659143 - RNA, 64 nt, hsa
uuucuguuguuugaagcccccaacuucuagauugggaaacgaagcucugcugggcgugguggcu

SEQ ID NO: 659144 - RNA, 64 nt, hsa
gggucucuugcccaucucuccggccaccccgccaggaaacgacgagaaggccgaggaauccuca

SEQ ID NO: 659145 - RNA, 64 nt, hsa
guucugcaaaacauuuuauguauagauuuagaggggaaacgagaagguacugaaauaaugaucu

SEQ ID NO: 659146 - RNA, 64 nt, hsa
cuuacagaaccaauucacuuuagagugacuaaaaggaaacgauagccuagcuuucuaaagccac

SEQ ID NO: 659147 - RNA, 64 nt, hsa
agcacggagauucucuccaacaaagguccaguuaggaaacgacgcugagaggaugacgacaacg

SEQ ID NO: 659148 - RNA, 64 nt, hsa
auuuuaccaucugacguuuuuaguagggagcuggggaaacgacugcccgaggaaugcggucgga

SEQ ID NO: 659149 - RNA, 64 nt, hsa
auuguaccuaggauuguaacuuaaauuaacgaggggaaacgacaugcugggacccuugagaaac

SEQ ID NO: 659150 - RNA, 64 nt, hsa
acacuccaguggcagacaaacagaccauaaauaaggaaacgaugaaauaagauauauacaaggu

SEQ ID NO: 659151 - RNA, 64 nt, hsa
ugccgcggaaaccugauuuuguacucucuuuuauggaaacgaucuguggcuguuuagaggcagc

SEQ ID NO: 659152 - RNA, 64 nt, hsa
caggagccgcggaggaggacagugagggaggaauggaaacgagagaugugaaguuggcagccgg

SEQ ID NO: 659153 - RNA, 64 nt, hsa
ucacugaaaguuaccgaaagagucgguuuaggaaggaaacgaagggucagugaacagagucaaa

SEQ ID NO: 659154 - RNA, 64 nt, hsa
ugucaucagaagcugugagggacccacagauuuuggaaacgaccuggacacacuauugggaagg

SEQ ID NO: 659155 - RNA, 64 nt, hsa
uuuuacuaggcaaaucuucaaaagaugcacuuuaggaaacgaaauauuuccuaaauaaccaggc

SEQ ID NO: 659156 - RNA, 64 nt, hsa
cugagauccuggcccauaguagaaucuguguagaggaaacgagagcucacuauuugugaggcag

SEQ ID NO: 659157 - RNA, 64 nt, hsa
gacuacauuaaacccaaaacuccugcacaacaaaggaaacgaucaccaaaaugaaaagguggac

SEQ ID NO: 659158 - RNA, 64 nt, hsa
aaauuauaaguucauauauuugaaauaagauccuggaaacgaauuuaaauggugucaaacugca

SEQ ID NO: 659159 - RNA, 64 nt, hsa
agcgucccaggcauagaaaccucgaagcgcccgaggaaacgagggccugcuggcugagauaugg

SEQ ID NO: 659160 - RNA, 64 nt, hsa
ucuuaguuuucugcauacuuuucaucacgaugcaggaaacgauuucgagucaagaagacuuuua

SEQ ID NO: 659161 - RNA, 64 nt, hsa
agugcacugaggugucggaacgcugaaagcaugaggaaacgaggacguagggugugacugaaug

SEQ ID NO: 659162 - RNA, 64 nt, hsa
agcuacaagcaagcagcguggcuggaagcugaugggaaacgacccggcacgggcauccugugug

SEQ ID NO: 659163 - RNA, 64 nt, hsa
acagcugaacuuuucaucaucucauucacauuugggaaacgaacaggagaugagcaaagcugcu

SEQ ID NO: 659164 - RNA, 64 nt, hsa
gagagaaauugauaagcuuuugcaagacugccggggaaacgacccuguggcugugagaaaguga

SEQ ID NO: 659165 - RNA, 64 nt, hsa
gucuuuucccauuuaucuaaauauggacugcucaggaaacgagacuuuccauuacaaguauuuu

SEQ ID NO: 659166 - RNA, 64 nt, hsa
acaggagcagaagcugggugggcugaagaggccuggaaacgagagucuuaauugaggagauggg

SEQ ID NO: 659167 - RNA, 64 nt, hsa
cgaucuacacacauccacgcacaugcgaccccgaggaaacgaaacccacucuagaaaacgcgac

SEQ ID NO: 659168 - RNA, 64 nt, hsa
gguaugacuguguucuggacaauggaaugugaggggaaacgauuuuuuguguccuuaaaauggc

SEQ ID NO: 659169 - RNA, 64 nt, hsa
auuuuauuuacugucugugagagcauugggaguaggaaacgauggacuccaaaguacaagggag

SEQ ID NO: 659170 - RNA, 64 nt, hsa
auugugaaaccggccuaauuuuucugacugauauggaaacgauugccaacacauacuucuacuu

SEQ ID NO: 659171 - RNA, 64 nt, hsa
cuuuggucaguuaccugggaauucugggcugccaggaaacgauuugggccucugucaguuucuu

SEQ ID NO: 659172 - RNA, 64 nt, hsa
uaaaggaaaaugaaauacaauuagcagaauaaggggaaacgaguggucugcucugcucgggcaa

SEQ ID NO: 659173 - RNA, 64 nt, hsa
agcaaauacacacacacacacauacucucacacaggaaacgaccuggaagaauauuuggugcuu

SEQ ID NO: 659174 - RNA, 64 nt, hsa
auucaggcucuccuacuuggcagaaugaucuuggggaaacgacuucaucugaacuucagauauu

SEQ ID NO: 659175 - RNA, 64 nt, hsa
acgaugagcauuucuuaggcucagcucuugauacggaaacgagugucuucacuccagccagcau

SEQ ID NO: 659176 - RNA, 62 nt, hsa
cacaggaaacuucgcagugaugcaccaggcgaggaaacgagaccucuuucguuccuucuaga

SEQ ID NO: 659177 - RNA, 64 nt, hsa
gcagcacacagcgacuugcguugacaaaggaggaggaaacgauuacucuguaaacaaaguuauc

SEQ ID NO: 659178 - RNA, 64 nt, hsa
uugggaagacaaaauugagccauuaucuccucuuggaaacgaaucuugccagaaaaacgggauu

SEQ ID NO: 659179 - RNA, 64 nt, hsa
uggauauuccagcucaauuagugccacauaugggggaaacgacacaucccagugggauuuccaa

SEQ ID NO: 659180 - RNA, 64 nt, hsa
agcguggaagcaggagggcagaggcuacagcuguggaaacgaggccaugcugccuccuccuggu

SEQ ID NO: 659181 - RNA, 64 nt, hsa
cgguucaggggccugcggagcggguuggggcgggggaaacgauaguucugcagucugcgccuuu

SEQ ID NO: 659182 - RNA, 64 nt, hsa
ccaacaccaccucuccagaggccaaggaggccuuggaaacgauucccccagucauucugggaac

SEQ ID NO: 659183 - RNA, 64 nt, hsa
gggcgcaucccaagacagccagcagguugucucuggaaacgaccagaguuaagcucucggcuuc

SEQ ID NO: 659184 - RNA, 64 nt, hsa
ucagccaccuggugaagaagugaccugcgacacaggaaacgaugggaccucagucuucuucagc

SEQ ID NO: 659185 - RNA, 64 nt, hsa
uugugagugagcagagcagguuaugugcagacagggaaacgagaacuuuggaccuggcuuucug

SEQ ID NO: 659186 - RNA, 64 nt, hsa
cgucgugguugagaugauuaccucggacgucuacggaaacgagcgggcgcauuguuguccgcuu

SEQ ID NO: 659187 - RNA, 64 nt, hsa
gguaacuguuuacuacgacagagacguggcauuuggaaacgaaacuuagauguuucauggagcu

SEQ ID NO: 659188 - RNA, 64 nt, hsa
uugggauggaacucccuacugaccucugagaacuggaaacgaguuuguacagaagucagaacuu

SEQ ID NO: 659189 - RNA, 64 nt, hsa
aauuauggcacagauugaugcgcaccagucuugaggaaacgaucucccuauucccuuacccugu

SEQ ID NO: 659190 - RNA, 64 nt, hsa
cccgcuuuccuaaccuugcugcuuucacagggugggaaacgaaauucgagggaaauuccccgga

SEQ ID NO: 659191 - RNA, 64 nt, hsa; identical to SEQ ID NO: 482355

SEQ ID NO: 659192 - RNA, 64 nt, hsa; identical to SEQ ID NO: 482356

SEQ ID NO: 659193 - RNA, 64 nt, hsa; identical to SEQ ID NO: 482357

SEQ ID NO: 659194 - RNA, 64 nt, hsa; identical to SEQ ID NO: 482358

SEQ ID NO: 659195 - RNA, 64 nt, hsa; identical to SEQ ID NO: 482359

SEQ ID NO: 659196 - RNA, 64 nt, hsa; identical to SEQ ID NO: 482360

SEQ ID NO: 659197 - RNA, 64 nt, hsa; identical to SEQ ID NO: 482361

SEQ ID NO: 659198 - RNA, 64 nt, hsa; identical to SEQ ID NO: 482362

SEQ ID NO: 659199 - RNA, 64 nt, hsa; identical to SEQ ID NO: 482363

SEQ ID NO: 659200 - RNA, 64 nt, hsa; identical to SEQ ID NO: 482364

SEQ ID NO: 659201 - RNA, 64 nt, hsa; identical to SEQ ID NO: 482365

SEQ ID NO: 659202 - RNA, 64 nt, hsa; identical to SEQ ID NO: 482366

SEQ ID NO: 659203 - RNA, 64 nt, hsa; identical to SEQ ID NO: 482367

SEQ ID NO: 659204 - RNA, 64 nt, hsa; identical to SEQ ID NO: 482368

SEQ ID NO: 659205 - RNA, 64 nt, hsa; identical to SEQ ID NO: 482369

SEQ ID NO: 659206 - RNA, 64 nt, hsa; identical to SEQ ID NO: 482370

SEQ ID NO: 659207 - RNA, 64 nt, hsa; identical to SEQ ID NO: 482371

SEQ ID NO: 659208 - RNA, 64 nt, hsa; identical to SEQ ID NO: 482372

SEQ ID NO: 659209 - RNA, 64 nt, hsa; identical to SEQ ID NO: 482373

SEQ ID NO: 659210 - RNA, 64 nt, hsa; identical to SEQ ID NO: 482374

SEQ ID NO: 659211 - RNA, 64 nt, hsa; identical to SEQ ID NO: 482375

SEQ ID NO: 659212 - RNA, 64 nt, hsa; identical to SEQ ID NO: 482376

SEQ ID NO: 659213 - RNA, 64 nt, hsa; identical to SEQ ID NO: 482377

SEQ ID NO: 659214 - RNA, 64 nt, hsa; identical to SEQ ID NO: 482378

SEQ ID NO: 659215 - RNA, 64 nt, hsa; identical to SEQ ID NO: 482379

SEQ ID NO: 659216 - RNA, 64 nt, hsa; identical to SEQ ID NO: 482380

SEQ ID NO: 659217 - RNA, 64 nt, hsa; identical to SEQ ID NO: 482381

SEQ ID NO: 659218 - RNA, 64 nt, hsa; identical to SEQ ID NO: 482382

SEQ ID NO: 659219 - RNA, 64 nt, hsa; identical to SEQ ID NO: 482383

SEQ ID NO: 659220 - RNA, 64 nt, hsa; identical to SEQ ID NO: 482384

SEQ ID NO: 659221 - RNA, 64 nt, hsa; identical to SEQ ID NO: 482385

SEQ ID NO: 659222 - RNA, 64 nt, hsa; identical to SEQ ID NO: 482386

SEQ ID NO: 659223 - RNA, 64 nt, hsa; identical to SEQ ID NO: 482387

SEQ ID NO: 659224 - RNA, 64 nt, hsa; identical to SEQ ID NO: 482388

SEQ ID NO: 659225 - RNA, 64 nt, hsa; identical to SEQ ID NO: 482389

SEQ ID NO: 659226 - RNA, 64 nt, hsa; identical to SEQ ID NO: 482390

SEQ ID NO: 659227 - RNA, 64 nt, hsa; identical to SEQ ID NO: 482391

SEQ ID NO: 659228 - RNA, 64 nt, hsa; identical to SEQ ID NO: 482392

SEQ ID NO: 659229 - RNA, 64 nt, hsa; identical to SEQ ID NO: 482393

SEQ ID NO: 659230 - RNA, 64 nt, hsa; identical to SEQ ID NO: 482394

SEQ ID NO: 659231 - RNA, 64 nt, hsa; identical to SEQ ID NO: 482395

SEQ ID NO: 659232 - RNA, 64 nt, hsa; identical to SEQ ID NO: 482396

SEQ ID NO: 659233 - RNA, 64 nt, hsa; identical to SEQ ID NO: 482397

SEQ ID NO: 659234 - RNA, 64 nt, hsa; identical to SEQ ID NO: 482398

SEQ ID NO: 659235 - RNA, 64 nt, hsa; identical to SEQ ID NO: 482399

SEQ ID NO: 659236 - RNA, 64 nt, hsa; identical to SEQ ID NO: 482400

SEQ ID NO: 659237 - RNA, 64 nt, hsa; identical to SEQ ID NO: 482401

SEQ ID NO: 659238 - RNA, 64 nt, hsa; identical to SEQ ID NO: 482402

SEQ ID NO: 659239 - RNA, 64 nt, hsa; identical to SEQ ID NO: 482403

SEQ ID NO: 659240 - RNA, 64 nt, hsa; identical to SEQ ID NO: 482404

SEQ ID NO: 659241 - RNA, 64 nt, hsa; identical to SEQ ID NO: 482405

SEQ ID NO: 659242 - RNA, 64 nt, hsa; identical to SEQ ID NO: 482406

SEQ ID NO: 659243 - RNA, 62 nt, hsa
agagaugugcauguggguauuguuaggaaaugucaucaaacuccacccaccuggcuucauac

SEQ ID NO: 659244 - RNA, 62 nt, hsa
cacacaaugcccaacuuacugucuucuucaugucaucaaaaucugcacagucacuggcccaa

SEQ ID NO: 659245 - RNA, 62 nt, hsa
cccuaugacauuucuacaucacuggcugcucuucaucaaaccuacuauaaaaaacauucaag

SEQ ID NO: 659246 - RNA, 62 nt, hsa
aaaaacauaaauaauaccauaauacauggcuaucaucaaaaguguauagaauauuauaguuu

SEQ ID NO: 659247 - RNA, 62 nt, hsa
ugaauguuugaugcuaugaaaagcuuuccauaucaucaaaacuaauuuguguagauuuuugc

SEQ ID NO: 659248 - RNA, 62 nt, hsa
auucaccuucagggggcugauaaccuaguaaaucaucaaaaugagaucauaaguguuaaugu

SEQ ID NO: 659249 - RNA, 62 nt, hsa
ugguuaguuuguucagauguugugcacagacaucaucaaaauuagcuaacauggguauuuuu

SEQ ID NO: 659250 - RNA, 62 nt, hsa
guaguacuucaaagaagauagcuguauaaaugucaucaaacuauacuauauagagaaucuua

SEQ ID NO: 659251 - RNA, 62 nt, hsa
aaagcugugauuauaucaaaaauccagauaaaucaucaaauauaucagauuaagaccagggu

SEQ ID NO: 659252 - RNA, 62 nt, hsa
auucucacaauauagguuuuggggcuuccauaucaucaaaagacugaaaaauuauaauuuua

SEQ ID NO: 659253 - RNA, 62 nt, hsa
aacuccuagcaccacggggaagaauagagguaucaucaaacguggcaaauuuucuuucagga

SEQ ID NO: 659254 - RNA, 62 nt, hsa
cuugacaauuuacuuaacaaguaaccaguaguucaucaaaaccaacuuguacagacuaauaa

SEQ ID NO: 659255 - RNA, 62 nt, hsa
gcuaccaguaagacaagugggaagaggcacguucaucaaaccuguuacuaaaccagccuagu

SEQ ID NO: 659256 - RNA, 62 nt, hsa
uucccucucuccugccuuuaugaggaaacugaucaucaaaaguucccacucccuacuucugc

SEQ ID NO: 659257 - RNA, 62 nt, hsa
cccacucugaccccacuaaaaugaccccugauucaucaaaagugaggccuagaauuacccua

SEQ ID NO: 659258 - RNA, 62 nt, hsa
guaucauuaucaguuacaaauugaguuauucuucaucaaaugacuuuuggaguagagauuuu

SEQ ID NO: 659259 - RNA, 62 nt, hsa
gcaagugggguuuaaacagacccacagucuacucaucaaaccagguguccuuggcauugugu

SEQ ID NO: 659260 - RNA, 62 nt, hsa
ucucagaggauacauuuguaaccauuacacagucaucaaaggaauaauuuuuuuuaaucacc

SEQ ID NO: 659261 - RNA, 62 nt, hsa
aaaacacagcaaacauaaaaaguuguuacacuucaucaaaaguacaaaguucuguucaucaa

SEQ ID NO: 659262 - RNA, 62 nt, hsa
uguuacacuucaucaaaaguacaaaguucuguucaucaaaugaugcuguuaagauagggaaa

SEQ ID NO: 659263 - RNA, 62 nt, hsa
uguuuaaaaaauugagcucaucaaaaauauugucaucaaauacaggugguuaaucugacaua

SEQ ID NO: 659264 - RNA, 62 nt, hsa
aguaauaguauugacuguuuaaaaaauugagcucaucaaaaauauugucaucaaauacaggu

SEQ ID NO: 659265 - RNA, 64 nt, hsa; identical to SEQ ID NO: 86193

SEQ ID NO: 659266 - RNA, 64 nt, hsa; identical to SEQ ID NO: 86194

SEQ ID NO: 659267 - RNA, 64 nt, hsa; identical to SEQ ID NO: 86195

SEQ ID NO: 659268 - RNA, 64 nt, hsa; identical to SEQ ID NO: 86196

SEQ ID NO: 659269 - RNA, 64 nt, hsa; identical to SEQ ID NO: 86197

SEQ ID NO: 659270 - RNA, 64 nt, hsa; identical to SEQ ID NO: 86198

SEQ ID NO: 659271 - RNA, 64 nt, hsa; identical to SEQ ID NO: 86199

SEQ ID NO: 659272 - RNA, 64 nt, hsa; identical to SEQ ID NO: 86200

SEQ ID NO: 659273 - RNA, 61 nt, hsa
uacccaugugagacaugaacaacaggagggagggaaagagcccaggugggacgugggacag

SEQ ID NO: 659274 - RNA, 61 nt, hsa
agagcccaggugggacgugggacaggcuuaggggaaagagcuuguccuaucucaggaacaa

SEQ ID NO: 659275 - RNA, 61 nt, hsa
acacacacacacacacuuuugcaagagugaugggaaagacccuaggugcucauaacuagag

SEQ ID NO: 659276 - RNA, 61 nt, hsa
cuauaugccuauauuuauaaaccagcagcaggggaaagauuauauuuuauaagagggaaca

SEQ ID NO: 659277 - RNA, 61 nt, hsa
uggcaccaggcaaacgaauaaagauaggauugggaaagaaguugcuaagugugcuuaguuu

SEQ ID NO: 659278 - RNA, 61 nt, hsa
ugaggagggaaugauugguagcaaaggaugggggaaagaaguagguucuguuuuguuuugu

SEQ ID NO: 659279 - RNA, 61 nt, hsa
ccuuuaaaacuaucaugguuauaauucuauugggaaagacuuuuagauaacaaagauuuca

SEQ ID NO: 659280 - RNA, 61 nt, hsa
aaacuuacugauauauuggacuuugagccaagggaaagaaugaguacuaucuuuccagaua

SEQ ID NO: 659281 - RNA, 61 nt, hsa
acuggauugcucuuuauccagcccacagcaggggaaagaaaggcaacucgcaaagaugaga

SEQ ID NO: 659282 - RNA, 61 nt, hsa
auccugccugaauggggaagucuucuaaaaugggaaagaagugguuucaucuccacacagu

SEQ ID NO: 659283 - RNA, 61 nt, hsa
caccacuggacgggaaggagaacagaggagagggaaagagaagcccaaccucugugaucau

SEQ ID NO: 659284 - RNA, 61 nt, hsa
caaggaauaagcaugaaugacaagaaaacaagggaaagaguuaaccugucacauagcaggu

SEQ ID NO: 659285 - RNA, 61 nt, hsa
ugagacuuauucacugucacgagaauagcacgggaaagacuggcccccaugauucaauuac

SEQ ID NO: 659286 - RNA, 61 nt, hsa
ugaaacuuauucacuaucacaagaauagcaugggaaagacuggcccccaugauucaauuac

SEQ ID NO: 659287 - RNA, 61 nt, hsa
cccuuuagugcuuugugauaguucagucccagggaaagagaaaacucgcccuaggcccuag

SEQ ID NO: 659288 - RNA, 61 nt, hsa
agagagggacgacauccugugccccgacugugggaaagacaucugaauucaacacagagaa

SEQ ID NO: 659289 - RNA, 61 nt, hsa
cugcucagcagcucagcugauucagaucagagggaaagaaauaccaacccugcaauaagug

SEQ ID NO: 659290 - RNA, 61 nt, hsa
aaaaagcaaaauuggccugaauauucucuuggggaaagagggcaccaaagaaaaggguaag

SEQ ID NO: 659291 - RNA, 61 nt, hsa
ucuuccugccaucauuccuccuuuucccacagggaaagaaaaguuggaucacuaguggcca

SEQ ID NO: 659292 - RNA, 61 nt, hsa
ucuucaccugcucuaggugcaaaggcauguugggaaagagauggauguuggggaggaagag

SEQ ID NO: 659293 - RNA, 61 nt, hsa
guagacuucuuuauguggcucaguggagagagggaaagaauguugcaccugcucuaguacc

SEQ ID NO: 659294 - RNA, 61 nt, hsa
gcaggaggcagugaugucccuggucuauucagggaaagauuucagugugaaaugguaaaca

SEQ ID NO: 659295 - RNA, 61 nt, hsa
cacccaccccucuuuauucuggagcauaucagggaaagaaaaguugaugauagauugccuu

SEQ ID NO: 659296 - RNA, 61 nt, hsa
aggccuggagcugggaugcaauguaggcugagggaaagacgucagguuccuuuaaucacag

SEQ ID NO: 659297 - RNA, 55 nt, hsa; identical to SEQ ID NO: 235846

SEQ ID NO: 659298 - RNA, 61 nt, hsa
ccuucaucugggacaaaacuggagaugcaucgggaaagaagaaacuccgaagaaaagaauu

SEQ ID NO: 659299 - RNA, 61 nt, hsa
uaccucagcagaagacuagaauuagagaaaagggaaagaccuuuucuucuaguaaguguca

SEQ ID NO: 659300 - RNA, 61 nt, hsa
uuggacaaagaaucccucuguucacuguggugggaaagaucacacuacaugccuguugauu

SEQ ID NO: 659301 - RNA, 61 nt, hsa
aaggggacggggucugugagagucaauucaggggaaagauacaagauugauuuguaaaacc

SEQ ID NO: 659302 - RNA, 61 nt, hsa
ggaaauggcccaaugaacgugguugugggaggggaaagaggaaacagagcuagucagaugu

SEQ ID NO: 659303 - RNA, 61 nt, hsa
cauuuguaggauuauuucgagggcagggcaggggaaagaaacgcguuaaagggccaugaca

SEQ ID NO: 659304 - RNA, 61 nt, hsa
ggagggcaggauucucagguccccauagagagggaaagagaagaccagaugugcauagaag

SEQ ID NO: 659305 - RNA, 61 nt, hsa
aagaacccuugugaaguaaccaggaggaauggggaaagaagcaaguugggcaggauauggc

SEQ ID NO: 659306 - RNA, 61 nt, hsa
uccucccaaucccacaccuccuguuugccaggggaaagaaccuaaagacuucgugugauug

SEQ ID NO: 659307 - RNA, 61 nt, hsa
aggucccucagaccugggaccucccuuuauagggaaagaccauauuccauagguuuagggc

SEQ ID NO: 659308 - RNA, 61 nt, hsa
ugacauccuucagcacccagggacaagagaggggaaagaugcuuuauggaauguaagaaga

SEQ ID NO: 659309 - RNA, 61 nt, hsa
cugcuuuggaaauuauucuaaacacaaaaaagggaaagaaaauguuauuucucccuaaguc

SEQ ID NO: 659310 - RNA, 61 nt, hsa
ggaggagggacucuggaguagcagaggggcugggaaagagggggcaggggcugcugggaca

SEQ ID NO: 659311 - RNA, 61 nt, hsa
aaugacuauccugaacaggguggaggggugugggaaagaaaccagccauauugguuuuggu

SEQ ID NO: 659312 - RNA, 61 nt, hsa
cccuagaaauuggcucaccuugggaaacccagggaaagaaucagcagguucucugcccucc

SEQ ID NO: 659313 - RNA, 61 nt, hsa
caaguugcauauuugguuuccccuuaugauugggaaagaugaauuuucagcagaaaacauu

SEQ ID NO: 659314 - RNA, 61 nt, hsa
uuguuuucaaaagcacaaaggaaaagugaaagggaaagagaaacaagugacugagaagucu

SEQ ID NO: 659315 - RNA, 61 nt, hsa
ggauguuccuacagagggaaagaccuacagagggaaagacccucgggccgcuccccugcgc

SEQ ID NO: 659316 - RNA, 61 nt, hsa
gcuuccagaaucuucuggauguuccuacagagggaaagaccuacagagggaaagacccucg

SEQ ID NO: 659317 - RNA, 61 nt, hsa
agagcagaaaagaagcacauccuaagauucagggaaagacuaacugugaaaaggaaggcug

SEQ ID NO: 659318 - RNA, 61 nt, hsa
gugccucugaggauuaggguugagcacucaagggaaagauggaguagagggcaaauagcaa

SEQ ID NO: 659319 - RNA, 61 nt, hsa
ugcuguaaagaacaacacuuguuugucuguggggaaagaaaagcagaauacuugagaugaa

SEQ ID NO: 659320 - RNA, 61 nt, hsa
aguuaugcgaguggauagauugguauguagagggaaagaggucugcuguaaagaacaacac

SEQ ID NO: 659321 - RNA, 61 nt, hsa
cagaugaugggaaggcaaggaagaagggacagggaaagauaauuacugauaaaugaagggg

SEQ ID NO: 659322 - RNA, 61 nt, hsa
caagucagcucugccaacugcuaggggaguugggaaagaguggguguguguccgcaucccc

SEQ ID NO: 659323 - RNA, 61 nt, hsa
aucuuucccguggagcaacuuccugcuccacgggaaagaggucgauggauuuaccccugga

SEQ ID NO: 659324 - RNA, 61 nt, hsa
aauuguacauuuauuuuuuaaaacucaaagagggaaagagccuuguaucauaugugaacau

SEQ ID NO: 659325 - RNA, 61 nt, hsa
cagcacagcggccugcuggacucugagaacugggaaagaucagagcaagccuugccucuua

SEQ ID NO: 659326 - RNA, 61 nt, hsa
uggaguugaccagagaaaggggagagaauucgggaaagacccaaaguguuuguaauucuuc

SEQ ID NO: 659327 - RNA, 61 nt, hsa
ugccugcagguugccuggccagguggagagggggaaagaggaagggcaccguggguguaag

SEQ ID NO: 659328 - RNA, 61 nt, hsa
agaagcccagcagaagcugagccaggcagaggggaaagaagcugauaugaggaagggucug

SEQ ID NO: 659329 - RNA, 61 nt, hsa
agacccagucuguuggagccaugaaggaagagggaaagagggcugccauuccugacagccu

SEQ ID NO: 659330 - RNA, 61 nt, hsa
caccucauucggcaccaaaaaguucacacuagggaaagaacuuacaaaugcagcaaaugug

SEQ ID NO: 659331 - RNA, 61 nt, hsa
ccagauaaagaauguauauauaaagcagauggggaaagacuucacacagaaaucuacucug

SEQ ID NO: 659332 - RNA, 61 nt, hsa
aagcccuggugguaccagaggccagaauggugggaaagacagauccagauaaugcugggaa

SEQ ID NO: 659333 - RNA, 61 nt, hsa
uucgauggccccaaagcugggccagaguuaagggaaagaggaggaaguccuaagcagagaa

SEQ ID NO: 659334 - RNA, 61 nt, hsa
agagccacagaaaaagaagaauuccaggagagggaaagaucguaaggaugagagaggagac

SEQ ID NO: 659335 - RNA, 61 nt, hsa
guccucucccaaguggcugaggcaggcuuaggggaaagaaccagaggggcaggggaggacu

SEQ ID NO: 659336 - RNA, 61 nt, hsa
ucuucucuagaauaaaucaggagacaaaauggggaaagaugaaaauauccaguguaaaguu

SEQ ID NO: 659337 - RNA, 61 nt, hsa
ugacaggaauguaaaaugguacagccacucugggaaagaguuuaugaauuucuuaucaagu

SEQ ID NO: 659338 - RNA, 64 nt, hsa; identical to SEQ ID NO: 118878

SEQ ID NO: 659339 - RNA, 64 nt, hsa; identical to SEQ ID NO: 118879

SEQ ID NO: 659340 - RNA, 64 nt, hsa; identical to SEQ ID NO: 118880

SEQ ID NO: 659341 - RNA, 64 nt, hsa; identical to SEQ ID NO: 118881

SEQ ID NO: 659342 - RNA, 64 nt, hsa; identical to SEQ ID NO: 118882

SEQ ID NO: 659343 - RNA, 64 nt, hsa; identical to SEQ ID NO: 118883

SEQ ID NO: 659344 - RNA, 64 nt, hsa; identical to SEQ ID NO: 118884

SEQ ID NO: 659345 - RNA, 64 nt, hsa; identical to SEQ ID NO: 118885

SEQ ID NO: 659346 - RNA, 64 nt, hsa; identical to SEQ ID NO: 118886

SEQ ID NO: 659347 - RNA, 64 nt, hsa; identical to SEQ ID NO: 118887

SEQ ID NO: 659348 - RNA, 64 nt, hsa; identical to SEQ ID NO: 118888

SEQ ID NO: 659349 - RNA, 64 nt, hsa; identical to SEQ ID NO: 118889

SEQ ID NO: 659350 - RNA, 64 nt, hsa; identical to SEQ ID NO: 118890

SEQ ID NO: 659351 - RNA, 56 nt, hsa; identical to SEQ ID NO: 118891

SEQ ID NO: 659352 - RNA, 64 nt, hsa; identical to SEQ ID NO: 302004

SEQ ID NO: 659353 - RNA, 64 nt, hsa; identical to SEQ ID NO: 302005

SEQ ID NO: 659354 - RNA, 64 nt, hsa; identical to SEQ ID NO: 302006

SEQ ID NO: 659355 - RNA, 64 nt, hsa; identical to SEQ ID NO: 302007

SEQ ID NO: 659356 - RNA, 64 nt, hsa; identical to SEQ ID NO: 302008

SEQ ID NO: 659357 - RNA, 64 nt, hsa; identical to SEQ ID NO: 302009

SEQ ID NO: 659358 - RNA, 64 nt, hsa; identical to SEQ ID NO: 302010

SEQ ID NO: 659359 - RNA, 64 nt, hsa; identical to SEQ ID NO: 302011

SEQ ID NO: 659360 - RNA, 64 nt, hsa; identical to SEQ ID NO: 196466

SEQ ID NO: 659361 - RNA, 64 nt, hsa; identical to SEQ ID NO: 196467

SEQ ID NO: 659362 - RNA, 64 nt, hsa; identical to SEQ ID NO: 196468

SEQ ID NO: 659363 - RNA, 64 nt, hsa; identical to SEQ ID NO: 196469

SEQ ID NO: 659364 - RNA, 64 nt, hsa; identical to SEQ ID NO: 196470

SEQ ID NO: 659365 - RNA, 64 nt, hsa; identical to SEQ ID NO: 196471

SEQ ID NO: 659366 - RNA, 64 nt, hsa; identical to SEQ ID NO: 196472

SEQ ID NO: 659367 - RNA, 64 nt, hsa; identical to SEQ ID NO: 196473

SEQ ID NO: 659368 - RNA, 64 nt, hsa; identical to SEQ ID NO: 196474

SEQ ID NO: 659369 - RNA, 64 nt, hsa; identical to SEQ ID NO: 196475

SEQ ID NO: 659370 - RNA, 64 nt, hsa; identical to SEQ ID NO: 196476

SEQ ID NO: 659371 - RNA, 64 nt, hsa; identical to SEQ ID NO: 196477

SEQ ID NO: 659372 - RNA, 64 nt, hsa; identical to SEQ ID NO: 196478

SEQ ID NO: 659373 - RNA, 64 nt, hsa; identical to SEQ ID NO: 196479

SEQ ID NO: 659374 - RNA, 64 nt, hsa; identical to SEQ ID NO: 196480

SEQ ID NO: 659375 - RNA, 64 nt, hsa; identical to SEQ ID NO: 196481

SEQ ID NO: 659376 - RNA, 64 nt, hsa; identical to SEQ ID NO: 196482

SEQ ID NO: 659377 - RNA, 64 nt, hsa; identical to SEQ ID NO: 196483

SEQ ID NO: 659378 - RNA, 64 nt, hsa; identical to SEQ ID NO: 196484

SEQ ID NO: 659379 - RNA, 64 nt, hsa; identical to SEQ ID NO: 302562

SEQ ID NO: 659380 - RNA, 64 nt, hsa; identical to SEQ ID NO: 302563

SEQ ID NO: 659381 - RNA, 64 nt, hsa; identical to SEQ ID NO: 302564

SEQ ID NO: 659382 - RNA, 64 nt, hsa; identical to SEQ ID NO: 302565

SEQ ID NO: 659383 - RNA, 64 nt, hsa; identical to SEQ ID NO: 302566

SEQ ID NO: 659384 - RNA, 64 nt, hsa; identical to SEQ ID NO: 302567

SEQ ID NO: 659385 - RNA, 64 nt, hsa; identical to SEQ ID NO: 302568

SEQ ID NO: 659386 - RNA, 64 nt, hsa; identical to SEQ ID NO: 302569

SEQ ID NO: 659387 - RNA, 64 nt, hsa; identical to SEQ ID NO: 302570

SEQ ID NO: 659388 - RNA, 64 nt, hsa; identical to SEQ ID NO: 302571

SEQ ID NO: 659389 - RNA, 64 nt, hsa; identical to SEQ ID NO: 302572

SEQ ID NO: 659390 - RNA, 64 nt, hsa; identical to SEQ ID NO: 302573

SEQ ID NO: 659391 - RNA, 64 nt, hsa; identical to SEQ ID NO: 302574

SEQ ID NO: 659392 - RNA, 64 nt, hsa; identical to SEQ ID NO: 302575

SEQ ID NO: 659393 - RNA, 64 nt, hsa; identical to SEQ ID NO: 302576

SEQ ID NO: 659394 - RNA, 64 nt, hsa; identical to SEQ ID NO: 302577

SEQ ID NO: 659395 - RNA, 64 nt, hsa; identical to SEQ ID NO: 302578

SEQ ID NO: 659396 - RNA, 64 nt, hsa; identical to SEQ ID NO: 302579

SEQ ID NO: 659397 - RNA, 64 nt, hsa; identical to SEQ ID NO: 302580

SEQ ID NO: 659398 - RNA, 64 nt, hsa; identical to SEQ ID NO: 302581

SEQ ID NO: 659399 - RNA, 64 nt, hsa; identical to SEQ ID NO: 196466

SEQ ID NO: 659400 - RNA, 64 nt, hsa; identical to SEQ ID NO: 196467

SEQ ID NO: 659401 - RNA, 64 nt, hsa; identical to SEQ ID NO: 196468

SEQ ID NO: 659402 - RNA, 64 nt, hsa; identical to SEQ ID NO: 196469

SEQ ID NO: 659403 - RNA, 64 nt, hsa; identical to SEQ ID NO: 196470

SEQ ID NO: 659404 - RNA, 64 nt, hsa; identical to SEQ ID NO: 196471

SEQ ID NO: 659405 - RNA, 64 nt, hsa; identical to SEQ ID NO: 196472

SEQ ID NO: 659406 - RNA, 64 nt, hsa; identical to SEQ ID NO: 196473

SEQ ID NO: 659407 - RNA, 64 nt, hsa; identical to SEQ ID NO: 196474

SEQ ID NO: 659408 - RNA, 64 nt, hsa; identical to SEQ ID NO: 196475

SEQ ID NO: 659409 - RNA, 64 nt, hsa; identical to SEQ ID NO: 196476

SEQ ID NO: 659410 - RNA, 64 nt, hsa; identical to SEQ ID NO: 196477

SEQ ID NO: 659411 - RNA, 64 nt, hsa; identical to SEQ ID NO: 196478

SEQ ID NO: 659412 - RNA, 64 nt, hsa; identical to SEQ ID NO: 196479

SEQ ID NO: 659413 - RNA, 64 nt, hsa; identical to SEQ ID NO: 196480

SEQ ID NO: 659414 - RNA, 64 nt, hsa; identical to SEQ ID NO: 196481

SEQ ID NO: 659415 - RNA, 64 nt, hsa; identical to SEQ ID NO: 196482

SEQ ID NO: 659416 - RNA, 64 nt, hsa; identical to SEQ ID NO: 196483

SEQ ID NO: 659417 - RNA, 64 nt, hsa; identical to SEQ ID NO: 196484

SEQ ID NO: 659418 - RNA, 64 nt, hsa; identical to SEQ ID NO: 302562

SEQ ID NO: 659419 - RNA, 64 nt, hsa; identical to SEQ ID NO: 302563

SEQ ID NO: 659420 - RNA, 64 nt, hsa; identical to SEQ ID NO: 302564

SEQ ID NO: 659421 - RNA, 64 nt, hsa; identical to SEQ ID NO: 302565

SEQ ID NO: 659422 - RNA, 64 nt, hsa; identical to SEQ ID NO: 302566

SEQ ID NO: 659423 - RNA, 64 nt, hsa; identical to SEQ ID NO: 302567

SEQ ID NO: 659424 - RNA, 64 nt, hsa; identical to SEQ ID NO: 302568

SEQ ID NO: 659425 - RNA, 64 nt, hsa; identical to SEQ ID NO: 302569

SEQ ID NO: 659426 - RNA, 64 nt, hsa; identical to SEQ ID NO: 302570

SEQ ID NO: 659427 - RNA, 64 nt, hsa; identical to SEQ ID NO: 302571

SEQ ID NO: 659428 - RNA, 64 nt, hsa; identical to SEQ ID NO: 302572

SEQ ID NO: 659429 - RNA, 64 nt, hsa; identical to SEQ ID NO: 302573

SEQ ID NO: 659430 - RNA, 64 nt, hsa; identical to SEQ ID NO: 302574

SEQ ID NO: 659431 - RNA, 64 nt, hsa; identical to SEQ ID NO: 302575

SEQ ID NO: 659432 - RNA, 64 nt, hsa; identical to SEQ ID NO: 302576

SEQ ID NO: 659433 - RNA, 64 nt, hsa; identical to SEQ ID NO: 302577

SEQ ID NO: 659434 - RNA, 64 nt, hsa; identical to SEQ ID NO: 302578

SEQ ID NO: 659435 - RNA, 64 nt, hsa; identical to SEQ ID NO: 302579

SEQ ID NO: 659436 - RNA, 64 nt, hsa; identical to SEQ ID NO: 302580

SEQ ID NO: 659437 - RNA, 64 nt, hsa; identical to SEQ ID NO: 302581

SEQ ID NO: 659438 - RNA, 64 nt, hsa; identical to SEQ ID NO: 196466

SEQ ID NO: 659439 - RNA, 64 nt, hsa; identical to SEQ ID NO: 196467

SEQ ID NO: 659440 - RNA, 64 nt, hsa; identical to SEQ ID NO: 196468

SEQ ID NO: 659441 - RNA, 64 nt, hsa; identical to SEQ ID NO: 196469

SEQ ID NO: 659442 - RNA, 64 nt, hsa; identical to SEQ ID NO: 196470

SEQ ID NO: 659443 - RNA, 64 nt, hsa; identical to SEQ ID NO: 196471

SEQ ID NO: 659444 - RNA, 64 nt, hsa; identical to SEQ ID NO: 196472

SEQ ID NO: 659445 - RNA, 64 nt, hsa; identical to SEQ ID NO: 196473

SEQ ID NO: 659446 - RNA, 64 nt, hsa; identical to SEQ ID NO: 196474

SEQ ID NO: 659447 - RNA, 64 nt, hsa; identical to SEQ ID NO: 196475

SEQ ID NO: 659448 - RNA, 64 nt, hsa; identical to SEQ ID NO: 196476

SEQ ID NO: 659449 - RNA, 64 nt, hsa; identical to SEQ ID NO: 196477

SEQ ID NO: 659450 - RNA, 64 nt, hsa; identical to SEQ ID NO: 196478

SEQ ID NO: 659451 - RNA, 64 nt, hsa; identical to SEQ ID NO: 196479

SEQ ID NO: 659452 - RNA, 64 nt, hsa; identical to SEQ ID NO: 196480

SEQ ID NO: 659453 - RNA, 64 nt, hsa; identical to SEQ ID NO: 196481

SEQ ID NO: 659454 - RNA, 64 nt, hsa; identical to SEQ ID NO: 196482

SEQ ID NO: 659455 - RNA, 64 nt, hsa; identical to SEQ ID NO: 196483

SEQ ID NO: 659456 - RNA, 64 nt, hsa; identical to SEQ ID NO: 196484

SEQ ID NO: 659457 - RNA, 64 nt, hsa; identical to SEQ ID NO: 302562

SEQ ID NO: 659458 - RNA, 64 nt, hsa; identical to SEQ ID NO: 302563

SEQ ID NO: 659459 - RNA, 64 nt, hsa; identical to SEQ ID NO: 302564

SEQ ID NO: 659460 - RNA, 64 nt, hsa; identical to SEQ ID NO: 302565

SEQ ID NO: 659461 - RNA, 64 nt, hsa; identical to SEQ ID NO: 302566

SEQ ID NO: 659462 - RNA, 64 nt, hsa; identical to SEQ ID NO: 302567

SEQ ID NO: 659463 - RNA, 64 nt, hsa; identical to SEQ ID NO: 302568

SEQ ID NO: 659464 - RNA, 64 nt, hsa; identical to SEQ ID NO: 302569

SEQ ID NO: 659465 - RNA, 64 nt, hsa; identical to SEQ ID NO: 302570

SEQ ID NO: 659466 - RNA, 64 nt, hsa; identical to SEQ ID NO: 302571

SEQ ID NO: 659467 - RNA, 64 nt, hsa; identical to SEQ ID NO: 302572

SEQ ID NO: 659468 - RNA, 64 nt, hsa; identical to SEQ ID NO: 302573

SEQ ID NO: 659469 - RNA, 64 nt, hsa; identical to SEQ ID NO: 302574

SEQ ID NO: 659470 - RNA, 64 nt, hsa; identical to SEQ ID NO: 302575

SEQ ID NO: 659471 - RNA, 64 nt, hsa; identical to SEQ ID NO: 302576

SEQ ID NO: 659472 - RNA, 64 nt, hsa; identical to SEQ ID NO: 302577

SEQ ID NO: 659473 - RNA, 64 nt, hsa; identical to SEQ ID NO: 302578

SEQ ID NO: 659474 - RNA, 64 nt, hsa; identical to SEQ ID NO: 302579

SEQ ID NO: 659475 - RNA, 64 nt, hsa; identical to SEQ ID NO: 302580

SEQ ID NO: 659476 - RNA, 64 nt, hsa; identical to SEQ ID NO: 302581

SEQ ID NO: 659477 - RNA, 64 nt, hsa; identical to SEQ ID NO: 196466

SEQ ID NO: 659478 - RNA, 64 nt, hsa; identical to SEQ ID NO: 196467

SEQ ID NO: 659479 - RNA, 64 nt, hsa; identical to SEQ ID NO: 196468

SEQ ID NO: 659480 - RNA, 64 nt, hsa; identical to SEQ ID NO: 196469

SEQ ID NO: 659481 - RNA, 64 nt, hsa; identical to SEQ ID NO: 196470

SEQ ID NO: 659482 - RNA, 64 nt, hsa; identical to SEQ ID NO: 196471

SEQ ID NO: 659483 - RNA, 64 nt, hsa; identical to SEQ ID NO: 196472

SEQ ID NO: 659484 - RNA, 64 nt, hsa; identical to SEQ ID NO: 196473

SEQ ID NO: 659485 - RNA, 64 nt, hsa; identical to SEQ ID NO: 196474

SEQ ID NO: 659486 - RNA, 64 nt, hsa; identical to SEQ ID NO: 196475

SEQ ID NO: 659487 - RNA, 64 nt, hsa; identical to SEQ ID NO: 196476

SEQ ID NO: 659488 - RNA, 64 nt, hsa; identical to SEQ ID NO: 196477

SEQ ID NO: 659489 - RNA, 64 nt, hsa; identical to SEQ ID NO: 196478

SEQ ID NO: 659490 - RNA, 64 nt, hsa; identical to SEQ ID NO: 196479

SEQ ID NO: 659491 - RNA, 64 nt, hsa; identical to SEQ ID NO: 196480

SEQ ID NO: 659492 - RNA, 64 nt, hsa; identical to SEQ ID NO: 196481

SEQ ID NO: 659493 - RNA, 64 nt, hsa; identical to SEQ ID NO: 196482

SEQ ID NO: 659494 - RNA, 64 nt, hsa; identical to SEQ ID NO: 196483

SEQ ID NO: 659495 - RNA, 64 nt, hsa; identical to SEQ ID NO: 196484

SEQ ID NO: 659496 - RNA, 64 nt, hsa; identical to SEQ ID NO: 302562

SEQ ID NO: 659497 - RNA, 64 nt, hsa; identical to SEQ ID NO: 302563

SEQ ID NO: 659498 - RNA, 64 nt, hsa; identical to SEQ ID NO: 302564

SEQ ID NO: 659499 - RNA, 64 nt, hsa; identical to SEQ ID NO: 302565

SEQ ID NO: 659500 - RNA, 64 nt, hsa; identical to SEQ ID NO: 302566

SEQ ID NO: 659501 - RNA, 64 nt, hsa; identical to SEQ ID NO: 302567

SEQ ID NO: 659502 - RNA, 64 nt, hsa; identical to SEQ ID NO: 302568

SEQ ID NO: 659503 - RNA, 64 nt, hsa; identical to SEQ ID NO: 302569

SEQ ID NO: 659504 - RNA, 64 nt, hsa; identical to SEQ ID NO: 302570

SEQ ID NO: 659505 - RNA, 64 nt, hsa; identical to SEQ ID NO: 302571

SEQ ID NO: 659506 - RNA, 64 nt, hsa; identical to SEQ ID NO: 302572

SEQ ID NO: 659507 - RNA, 64 nt, hsa; identical to SEQ ID NO: 302573

SEQ ID NO: 659508 - RNA, 64 nt, hsa; identical to SEQ ID NO: 302574

SEQ ID NO: 659509 - RNA, 64 nt, hsa; identical to SEQ ID NO: 302575

SEQ ID NO: 659510 - RNA, 64 nt, hsa; identical to SEQ ID NO: 302576

SEQ ID NO: 659511 - RNA, 64 nt, hsa; identical to SEQ ID NO: 302577

SEQ ID NO: 659512 - RNA, 64 nt, hsa; identical to SEQ ID NO: 302578

SEQ ID NO: 659513 - RNA, 64 nt, hsa; identical to SEQ ID NO: 302579

SEQ ID NO: 659514 - RNA, 64 nt, hsa; identical to SEQ ID NO: 302580

SEQ ID NO: 659515 - RNA, 64 nt, hsa; identical to SEQ ID NO: 302581

SEQ ID NO: 659516 - RNA, 64 nt, hsa; identical to SEQ ID NO: 196466

SEQ ID NO: 659517 - RNA, 64 nt, hsa; identical to SEQ ID NO: 196467

SEQ ID NO: 659518 - RNA, 64 nt, hsa; identical to SEQ ID NO: 196468

SEQ ID NO: 659519 - RNA, 64 nt, hsa; identical to SEQ ID NO: 196469

SEQ ID NO: 659520 - RNA, 64 nt, hsa; identical to SEQ ID NO: 196470

SEQ ID NO: 659521 - RNA, 64 nt, hsa; identical to SEQ ID NO: 196471

SEQ ID NO: 659522 - RNA, 64 nt, hsa; identical to SEQ ID NO: 196472

SEQ ID NO: 659523 - RNA, 64 nt, hsa; identical to SEQ ID NO: 196473

SEQ ID NO: 659524 - RNA, 64 nt, hsa; identical to SEQ ID NO: 196474

SEQ ID NO: 659525 - RNA, 64 nt, hsa; identical to SEQ ID NO: 196475

SEQ ID NO: 659526 - RNA, 64 nt, hsa; identical to SEQ ID NO: 196476

SEQ ID NO: 659527 - RNA, 64 nt, hsa; identical to SEQ ID NO: 196477

SEQ ID NO: 659528 - RNA, 64 nt, hsa; identical to SEQ ID NO: 196478

SEQ ID NO: 659529 - RNA, 64 nt, hsa; identical to SEQ ID NO: 196479

SEQ ID NO: 659530 - RNA, 64 nt, hsa; identical to SEQ ID NO: 196480

SEQ ID NO: 659531 - RNA, 64 nt, hsa; identical to SEQ ID NO: 196481

SEQ ID NO: 659532 - RNA, 64 nt, hsa; identical to SEQ ID NO: 196482

SEQ ID NO: 659533 - RNA, 64 nt, hsa; identical to SEQ ID NO: 196483

SEQ ID NO: 659534 - RNA, 64 nt, hsa; identical to SEQ ID NO: 196484

SEQ ID NO: 659535 - RNA, 64 nt, hsa; identical to SEQ ID NO: 71812

SEQ ID NO: 659536 - RNA, 64 nt, hsa; identical to SEQ ID NO: 71813

SEQ ID NO: 659537 - RNA, 64 nt, hsa; identical to SEQ ID NO: 71814

SEQ ID NO: 659538 - RNA, 64 nt, hsa; identical to SEQ ID NO: 71815

SEQ ID NO: 659539 - RNA, 64 nt, hsa; identical to SEQ ID NO: 71816

SEQ ID NO: 659540 - RNA, 64 nt, hsa; identical to SEQ ID NO: 71817

SEQ ID NO: 659541 - RNA, 64 nt, hsa; identical to SEQ ID NO: 71818

SEQ ID NO: 659542 - RNA, 64 nt, hsa; identical to SEQ ID NO: 71819

SEQ ID NO: 659543 - RNA, 64 nt, hsa; identical to SEQ ID NO: 71820

SEQ ID NO: 659544 - RNA, 64 nt, hsa; identical to SEQ ID NO: 71821

SEQ ID NO: 659545 - RNA, 64 nt, hsa; identical to SEQ ID NO: 71822

SEQ ID NO: 659546 - RNA, 64 nt, hsa; identical to SEQ ID NO: 71823

SEQ ID NO: 659547 - RNA, 64 nt, hsa; identical to SEQ ID NO: 71824

SEQ ID NO: 659548 - RNA, 64 nt, hsa; identical to SEQ ID NO: 71825

SEQ ID NO: 659549 - RNA, 64 nt, hsa; identical to SEQ ID NO: 71826

SEQ ID NO: 659550 - RNA, 64 nt, hsa; identical to SEQ ID NO: 71827

SEQ ID NO: 659551 - RNA, 64 nt, hsa; identical to SEQ ID NO: 71828

SEQ ID NO: 659552 - RNA, 64 nt, hsa; identical to SEQ ID NO: 71829

SEQ ID NO: 659553 - RNA, 64 nt, hsa; identical to SEQ ID NO: 71830

SEQ ID NO: 659554 - RNA, 64 nt, hsa; identical to SEQ ID NO: 71831

SEQ ID NO: 659555 - RNA, 64 nt, hsa; identical to SEQ ID NO: 71832

SEQ ID NO: 659556 - RNA, 64 nt, hsa; identical to SEQ ID NO: 71833

SEQ ID NO: 659557 - RNA, 64 nt, hsa; identical to SEQ ID NO: 71834

SEQ ID NO: 659558 - RNA, 64 nt, hsa; identical to SEQ ID NO: 71835

SEQ ID NO: 659559 - RNA, 64 nt, hsa; identical to SEQ ID NO: 71836

SEQ ID NO: 659560 - RNA, 64 nt, hsa; identical to SEQ ID NO: 71837

SEQ ID NO: 659561 - RNA, 64 nt, hsa; identical to SEQ ID NO: 71838

SEQ ID NO: 659562 - RNA, 64 nt, hsa; identical to SEQ ID NO: 71839

SEQ ID NO: 659563 - RNA, 64 nt, hsa; identical to SEQ ID NO: 71840

SEQ ID NO: 659564 - RNA, 64 nt, hsa; identical to SEQ ID NO: 71841

SEQ ID NO: 659565 - RNA, 64 nt, hsa; identical to SEQ ID NO: 71842

SEQ ID NO: 659566 - RNA, 64 nt, hsa; identical to SEQ ID NO: 71843

SEQ ID NO: 659567 - RNA, 64 nt, hsa; identical to SEQ ID NO: 71844

SEQ ID NO: 659568 - RNA, 64 nt, hsa; identical to SEQ ID NO: 71845

SEQ ID NO: 659569 - RNA, 64 nt, hsa; identical to SEQ ID NO: 71846

SEQ ID NO: 659570 - RNA, 64 nt, hsa; identical to SEQ ID NO: 71847

SEQ ID NO: 659571 - RNA, 64 nt, hsa; identical to SEQ ID NO: 71847

SEQ ID NO: 659572 - RNA, 64 nt, hsa; identical to SEQ ID NO: 71849

SEQ ID NO: 659573 - RNA, 64 nt, hsa; identical to SEQ ID NO: 71850

SEQ ID NO: 659574 - RNA, 64 nt, hsa; identical to SEQ ID NO: 71851

SEQ ID NO: 659575 - RNA, 64 nt, hsa; identical to SEQ ID NO: 71852

SEQ ID NO: 659576 - RNA, 64 nt, hsa; identical to SEQ ID NO: 71853

SEQ ID NO: 659577 - RNA, 64 nt, hsa; identical to SEQ ID NO: 71854

SEQ ID NO: 659578 - RNA, 64 nt, hsa; identical to SEQ ID NO: 71855

SEQ ID NO: 659579 - RNA, 64 nt, hsa; identical to SEQ ID NO: 71856

SEQ ID NO: 659580 - RNA, 57 nt, hsa; identical to SEQ ID NO: 71857

SEQ ID NO: 659581 - RNA, 64 nt, hsa; identical to SEQ ID NO: 71858

SEQ ID NO: 659582 - RNA, 64 nt, hsa; identical to SEQ ID NO: 195100

SEQ ID NO: 659583 - RNA, 64 nt, hsa; identical to SEQ ID NO: 195101

SEQ ID NO: 659584 - RNA, 64 nt, hsa; identical to SEQ ID NO: 195102

SEQ ID NO: 659585 - RNA, 64 nt, hsa; identical to SEQ ID NO: 195103

SEQ ID NO: 659586 - RNA, 64 nt, hsa; identical to SEQ ID NO: 195104

SEQ ID NO: 659587 - RNA, 64 nt, hsa; identical to SEQ ID NO: 195105

SEQ ID NO: 659588 - RNA, 64 nt, hsa; identical to SEQ ID NO: 195106

SEQ ID NO: 659589 - RNA, 64 nt, hsa; identical to SEQ ID NO: 195107

SEQ ID NO: 659590 - RNA, 64 nt, hsa; identical to SEQ ID NO: 195108

SEQ ID NO: 659591 - RNA, 64 nt, hsa; identical to SEQ ID NO: 195109

SEQ ID NO: 659592 - RNA, 64 nt, hsa; identical to SEQ ID NO: 195110

SEQ ID NO: 659593 - RNA, 64 nt, hsa; identical to SEQ ID NO: 195111

SEQ ID NO: 659594 - RNA, 64 nt, hsa; identical to SEQ ID NO: 195112

SEQ ID NO: 659595 - RNA, 64 nt, hsa; identical to SEQ ID NO: 195113

SEQ ID NO: 659596 - RNA, 64 nt, hsa; identical to SEQ ID NO: 195114

SEQ ID NO: 659597 - RNA, 64 nt, hsa; identical to SEQ ID NO: 195115

SEQ ID NO: 659598 - RNA, 64 nt, hsa; identical to SEQ ID NO: 195116

SEQ ID NO: 659599 - RNA, 64 nt, hsa; identical to SEQ ID NO: 195117

SEQ ID NO: 659600 - RNA, 64 nt, hsa; identical to SEQ ID NO: 195118

SEQ ID NO: 659601 - RNA, 64 nt, hsa; identical to SEQ ID NO: 195119

SEQ ID NO: 659602 - RNA, 64 nt, hsa; identical to SEQ ID NO: 96774

SEQ ID NO: 659603 - RNA, 64 nt, hsa; identical to SEQ ID NO: 96775

SEQ ID NO: 659604 - RNA, 64 nt, hsa; identical to SEQ ID NO: 96776

SEQ ID NO: 659605 - RNA, 64 nt, hsa; identical to SEQ ID NO: 96777

SEQ ID NO: 659606 - RNA, 64 nt, hsa; identical to SEQ ID NO: 96778

SEQ ID NO: 659607 - RNA, 64 nt, hsa; identical to SEQ ID NO: 96779

SEQ ID NO: 659608 - RNA, 64 nt, hsa; identical to SEQ ID NO: 96780

SEQ ID NO: 659609 - RNA, 64 nt, hsa; identical to SEQ ID NO: 96781

SEQ ID NO: 659610 - RNA, 64 nt, hsa; identical to SEQ ID NO: 96782

SEQ ID NO: 659611 - RNA, 64 nt, hsa; identical to SEQ ID NO: 96783

SEQ ID NO: 659612 - RNA, 64 nt, hsa; identical to SEQ ID NO: 96784

SEQ ID NO: 659613 - RNA, 64 nt, hsa; identical to SEQ ID NO: 96785

SEQ ID NO: 659614 - RNA, 64 nt, hsa; identical to SEQ ID NO: 96786

SEQ ID NO: 659615 - RNA, 64 nt, hsa; identical to SEQ ID NO: 96787

SEQ ID NO: 659616 - RNA, 64 nt, hsa; identical to SEQ ID NO: 96788

SEQ ID NO: 659617 - RNA, 64 nt, hsa; identical to SEQ ID NO: 96789

SEQ ID NO: 659618 - RNA, 64 nt, hsa; identical to SEQ ID NO: 96790

SEQ ID NO: 659619 - RNA, 64 nt, hsa; identical to SEQ ID NO: 96791

SEQ ID NO: 659620 - RNA, 64 nt, hsa; identical to SEQ ID NO: 96792

SEQ ID NO: 659621 - RNA, 64 nt, hsa; identical to SEQ ID NO: 96793

SEQ ID NO: 659622 - RNA, 64 nt, hsa; identical to SEQ ID NO: 96794

SEQ ID NO: 659623 - RNA, 64 nt, hsa; identical to SEQ ID NO: 96795

SEQ ID NO: 659624 - RNA, 64 nt, hsa; identical to SEQ ID NO: 96796

SEQ ID NO: 659625 - RNA, 64 nt, hsa; identical to SEQ ID NO: 96797

SEQ ID NO: 659626 - RNA, 64 nt, hsa; identical to SEQ ID NO: 96798

SEQ ID NO: 659627 - RNA, 64 nt, hsa; identical to SEQ ID NO: 96799

SEQ ID NO: 659628 - RNA, 64 nt, hsa; identical to SEQ ID NO: 96800

SEQ ID NO: 659629 - RNA, 64 nt, hsa; identical to SEQ ID NO: 96801

SEQ ID NO: 659630 - RNA, 64 nt, hsa; identical to SEQ ID NO: 96802

SEQ ID NO: 659631 - RNA, 64 nt, hsa; identical to SEQ ID NO: 96803

SEQ ID NO: 659632 - RNA, 64 nt, hsa; identical to SEQ ID NO: 96804

SEQ ID NO: 659633 - RNA, 64 nt, hsa; identical to SEQ ID NO: 96805

SEQ ID NO: 659634 - RNA, 64 nt, hsa; identical to SEQ ID NO: 96806

SEQ ID NO: 659635 - RNA, 64 nt, hsa; identical to SEQ ID NO: 96807

SEQ ID NO: 659636 - RNA, 64 nt, hsa; identical to SEQ ID NO: 96808

SEQ ID NO: 659637 - RNA, 64 nt, hsa; identical to SEQ ID NO: 96809

SEQ ID NO: 659638 - RNA, 64 nt, hsa; identical to SEQ ID NO: 96810

SEQ ID NO: 659639 - RNA, 64 nt, hsa; identical to SEQ ID NO: 96811

SEQ ID NO: 659640 - RNA, 64 nt, hsa; identical to SEQ ID NO: 96812

SEQ ID NO: 659641 - RNA, 64 nt, hsa; identical to SEQ ID NO: 96813

SEQ ID NO: 659642 - RNA, 64 nt, hsa; identical to SEQ ID NO: 96814

SEQ ID NO: 659643 - RNA, 64 nt, hsa; identical to SEQ ID NO: 96815

SEQ ID NO: 659644 - RNA, 64 nt, hsa; identical to SEQ ID NO: 96816

SEQ ID NO: 659645 - RNA, 64 nt, hsa; identical to SEQ ID NO: 96817

SEQ ID NO: 659646 - RNA, 64 nt, hsa; identical to SEQ ID NO: 96818

SEQ ID NO: 659647 - RNA, 64 nt, hsa; identical to SEQ ID NO: 96819

SEQ ID NO: 659648 - RNA, 64 nt, hsa; identical to SEQ ID NO: 96820

SEQ ID NO: 659649 - RNA, 64 nt, hsa; identical to SEQ ID NO: 96821

SEQ ID NO: 659650 - RNA, 64 nt, hsa; identical to SEQ ID NO: 96822

SEQ ID NO: 659651 - RNA, 64 nt, hsa; identical to SEQ ID NO: 96823

SEQ ID NO: 659652 - RNA, 64 nt, hsa; identical to SEQ ID NO: 96824

SEQ ID NO: 659653 - RNA, 64 nt, hsa; identical to SEQ ID NO: 369930

SEQ ID NO: 659654 - RNA, 64 nt, hsa; identical to SEQ ID NO: 369931

SEQ ID NO: 659655 - RNA, 64 nt, hsa; identical to SEQ ID NO: 369932

SEQ ID NO: 659656 - RNA, 64 nt, hsa; identical to SEQ ID NO: 369933

SEQ ID NO: 659657 - RNA, 64 nt, hsa; identical to SEQ ID NO: 369934

SEQ ID NO: 659658 - RNA, 64 nt, hsa; identical to SEQ ID NO: 369935

SEQ ID NO: 659659 - RNA, 64 nt, hsa; identical to SEQ ID NO: 369936

SEQ ID NO: 659660 - RNA, 64 nt, hsa; identical to SEQ ID NO: 369937

SEQ ID NO: 659661 - RNA, 64 nt, hsa; identical to SEQ ID NO: 369938

SEQ ID NO: 659662 - RNA, 64 nt, hsa; identical to SEQ ID NO: 369939

SEQ ID NO: 659663 - RNA, 64 nt, hsa; identical to SEQ ID NO: 369940

SEQ ID NO: 659664 - RNA, 64 nt, hsa; identical to SEQ ID NO: 369941

SEQ ID NO: 659665 - RNA, 64 nt, hsa; identical to SEQ ID NO: 369942

SEQ ID NO: 659666 - RNA, 64 nt, hsa; identical to SEQ ID NO: 369943

SEQ ID NO: 659667 - RNA, 64 nt, hsa; identical to SEQ ID NO: 369944

SEQ ID NO: 659668 - RNA, 64 nt, hsa; identical to SEQ ID NO: 369945

SEQ ID NO: 659669 - RNA, 64 nt, hsa; identical to SEQ ID NO: 369946

SEQ ID NO: 659670 - RNA, 64 nt, hsa; identical to SEQ ID NO: 369947

SEQ ID NO: 659671 - RNA, 64 nt, hsa; identical to SEQ ID NO: 369948

SEQ ID NO: 659672 - RNA, 64 nt, hsa; identical to SEQ ID NO: 369949

SEQ ID NO: 659673 - RNA, 64 nt, hsa; identical to SEQ ID NO: 369950

SEQ ID NO: 659674 - RNA, 64 nt, hsa; identical to SEQ ID NO: 369951

SEQ ID NO: 659675 - RNA, 64 nt, hsa; identical to SEQ ID NO: 369952

SEQ ID NO: 659676 - RNA, 64 nt, hsa; identical to SEQ ID NO: 369953

SEQ ID NO: 659677 - RNA, 64 nt, hsa; identical to SEQ ID NO: 369954

SEQ ID NO: 659678 - RNA, 64 nt, hsa; identical to SEQ ID NO: 369955

SEQ ID NO: 659679 - RNA, 64 nt, hsa; identical to SEQ ID NO: 369956

SEQ ID NO: 659680 - RNA, 64 nt, hsa; identical to SEQ ID NO: 369957

SEQ ID NO: 659681 - RNA, 64 nt, hsa; identical to SEQ ID NO: 369958

SEQ ID NO: 659682 - RNA, 64 nt, hsa; identical to SEQ ID NO: 369959

SEQ ID NO: 659683 - RNA, 64 nt, hsa; identical to SEQ ID NO: 369960

SEQ ID NO: 659684 - RNA, 64 nt, hsa
cauaauuuaggcuucagcaucucaccagccccucccucugaagaaguauuauguucagaagcca

SEQ ID NO: 659685 - RNA, 64 nt, hsa
ugaugguuauagcgggugggguuguauuuggaagccucugaagagaccaugucuuuuuaaaauc

SEQ ID NO: 659686 - RNA, 64 nt, hsa
aauuuauaacuaaaauaguguuaucugacuaauuccucugaauuuugauguaagaucuauauag

SEQ ID NO: 659687 - RNA, 64 nt, hsa
gggcucauguucucuacuggauuagggauaggcaccucugaaaucuccacccugaugauuggaa

SEQ ID NO: 659688 - RNA, 64 nt, hsa
aauuuuuaguucaaguuuaguucauugauauuauccucugaaugcaguuaaggcugggcagaaa

SEQ ID NO: 659689 - RNA, 64 nt, hsa
uuuuuuauuuccuucccucauaccuugcccauucccucugaauauuaggugugaugucaacagc

SEQ ID NO: 659690 - RNA, 64 nt, hsa
cucaagauaaauauggguuaaugccugcaugaugccucugaauucaggaauugcagggaaaacu

SEQ ID NO: 659691 - RNA, 64 nt, hsa
agcagcagggaucaucacaugcagccaaacuuggccucugaagggggaagguagugggaauagg

SEQ ID NO: 659692 - RNA, 64 nt, hsa
ugccugaaguuuuaguauuuguuuucuagguggaccucugaaaaccaaaccaguaccuggggag

SEQ ID NO: 659693 - RNA, 64 nt, hsa
uggguuuugcugagccauccacucugacugauuuccucugaaguaaacauauuuacaauccaaa

SEQ ID NO: 659694 - RNA, 64 nt, hsa
cauuaugcuggggcaucucugaucccaguagguaccucugaauauaccaggugucuggaguuag

SEQ ID NO: 659695 - RNA, 64 nt, hsa
acugaggguaggggacaggaggcucaggacgcgcccucugaaucgaguguuucuucuucacaag

SEQ ID NO: 659696 - RNA, 64 nt, hsa
cgccggcccgcccacuccuaccacaaggacuuugccucugaaggccaguggcagcagguggugg

SEQ ID NO: 659697 - RNA, 64 nt, hsa
aucugcuccuuuuccauccccugacauaccuuaaccucugaacucugaccucaggaggcucugg

SEQ ID NO: 659698 - RNA, 64 nt, hsa
accagucagcccucuguggagucauugugcuggaccucugaaaagaucugcaggggccaagaug

SEQ ID NO: 659699 - RNA, 64 nt, hsa
cuggcaugcugcagcccucugccggcugugguguccucugaauuuggacccagguugccugcuc

SEQ ID NO: 659700 - RNA, 64 nt, hsa
cuugaagagguacccaucauaaugacagcaucucccucugaaggguuuuggucaaaauggguga

SEQ ID NO: 659701 - RNA, 64 nt, hsa
gcuggaccuccucucagcacagccagcuccgugcccucugaauuauguuucgcagaaaaguguc

SEQ ID NO: 659702 - RNA, 64 nt, hsa
gcaggucuucuccuccucuccaucccuauucccuccucugaaaugcaccccuuuguaauugagg

SEQ ID NO: 659703 - RNA, 64 nt, hsa
ccucugcaugccagccugaaaauuccaaaucuagccucugaaugucuuggcuccaucucuucag

SEQ ID NO: 659704 - RNA, 64 nt, hsa
uuugcuauugauguagugugauagaaaauucaccccucugaacuggcuccuucccagucaaggu

SEQ ID NO: 659705 - RNA, 64 nt, hsa
ucccauucauguuagaucguugaaacccuguaucccucugaaacacuggaagagcuaguaaauu

SEQ ID NO: 659706 - RNA, 64 nt, hsa; identical to SEQ ID NO: 239468

SEQ ID NO: 659707 - RNA, 64 nt, hsa; identical to SEQ ID NO: 239469

SEQ ID NO: 659708 - RNA, 64 nt, hsa; identical to SEQ ID NO: 239470

SEQ ID NO: 659709 - RNA, 64 nt, hsa; identical to SEQ ID NO: 239471

SEQ ID NO: 659710 - RNA, 64 nt, hsa; identical to SEQ ID NO: 239472

SEQ ID NO: 659711 - RNA, 64 nt, hsa; identical to SEQ ID NO: 239473

SEQ ID NO: 659712 - RNA, 64 nt, hsa; identical to SEQ ID NO: 239474

SEQ ID NO: 659713 - RNA, 64 nt, hsa; identical to SEQ ID NO: 239475

SEQ ID NO: 659714 - RNA, 64 nt, hsa; identical to SEQ ID NO: 239476

SEQ ID NO: 659715 - RNA, 64 nt, hsa; identical to SEQ ID NO: 239477

SEQ ID NO: 659716 - RNA, 64 nt, hsa; identical to SEQ ID NO: 239478

SEQ ID NO: 659717 - RNA, 64 nt, hsa; identical to SEQ ID NO: 239479

SEQ ID NO: 659718 - RNA, 64 nt, hsa; identical to SEQ ID NO: 239480

SEQ ID NO: 659719 - RNA, 64 nt, hsa; identical to SEQ ID NO: 239481

SEQ ID NO: 659720 - RNA, 64 nt, hsa; identical to SEQ ID NO: 239482

SEQ ID NO: 659721 - RNA, 64 nt, hsa; identical to SEQ ID NO: 239483

SEQ ID NO: 659722 - RNA, 64 nt, hsa; identical to SEQ ID NO: 239484

SEQ ID NO: 659723 - RNA, 64 nt, hsa; identical to SEQ ID NO: 239485

SEQ ID NO: 659724 - RNA, 64 nt, hsa; identical to SEQ ID NO: 239486

SEQ ID NO: 659725 - RNA, 64 nt, hsa; identical to SEQ ID NO: 239487

SEQ ID NO: 659726 - RNA, 64 nt, hsa; identical to SEQ ID NO: 239488

SEQ ID NO: 659727 - RNA, 64 nt, hsa; identical to SEQ ID NO: 239489

SEQ ID NO: 659728 - RNA, 64 nt, hsa; identical to SEQ ID NO: 239490

SEQ ID NO: 659729 - RNA, 64 nt, hsa; identical to SEQ ID NO: 239491

SEQ ID NO: 659730 - RNA, 64 nt, hsa; identical to SEQ ID NO: 239492

SEQ ID NO: 659731 - RNA, 64 nt, hsa; identical to SEQ ID NO: 239493

SEQ ID NO: 659732 - RNA, 64 nt, hsa; identical to SEQ ID NO: 239494

SEQ ID NO: 659733 - RNA, 64 nt, hsa; identical to SEQ ID NO: 239495

SEQ ID NO: 659734 - RNA, 64 nt, hsa; identical to SEQ ID NO: 239496

SEQ ID NO: 659735 - RNA, 64 nt, hsa; identical to SEQ ID NO: 239497

SEQ ID NO: 659736 - RNA, 64 nt, hsa; identical to SEQ ID NO: 239498

SEQ ID NO: 659737 - RNA, 64 nt, hsa; identical to SEQ ID NO: 239499

SEQ ID NO: 659738 - RNA, 64 nt, hsa; identical to SEQ ID NO: 239500

SEQ ID NO: 659739 - RNA, 64 nt, hsa; identical to SEQ ID NO: 239501

SEQ ID NO: 659740 - RNA, 64 nt, hsa; identical to SEQ ID NO: 239502

SEQ ID NO: 659741 - RNA, 64 nt, hsa; identical to SEQ ID NO: 239503

SEQ ID NO: 659742 - RNA, 64 nt, hsa; identical to SEQ ID NO: 239504

SEQ ID NO: 659743 - RNA, 64 nt, hsa; identical to SEQ ID NO: 239505

SEQ ID NO: 659744 - RNA, 64 nt, hsa; identical to SEQ ID NO: 239506

SEQ ID NO: 659745 - RNA, 64 nt, hsa; identical to SEQ ID NO: 239507

SEQ ID NO: 659746 - RNA, 64 nt, hsa; identical to SEQ ID NO: 239508

SEQ ID NO: 659747 - RNA, 64 nt, hsa; identical to SEQ ID NO: 239509

SEQ ID NO: 659748 - RNA, 64 nt, hsa; identical to SEQ ID NO: 239510

SEQ ID NO: 659749 - RNA, 64 nt, hsa; identical to SEQ ID NO: 239511

SEQ ID NO: 659750 - RNA, 64 nt, hsa; identical to SEQ ID NO: 239512

SEQ ID NO: 659751 - RNA, 64 nt, hsa; identical to SEQ ID NO: 239513

SEQ ID NO: 659752 - RNA, 64 nt, hsa; identical to SEQ ID NO: 239514

SEQ ID NO: 659753 - RNA, 64 nt, hsa; identical to SEQ ID NO: 412246

SEQ ID NO: 659754 - RNA, 64 nt, hsa; identical to SEQ ID NO: 412247

SEQ ID NO: 659755 - RNA, 64 nt, hsa; identical to SEQ ID NO: 412248

SEQ ID NO: 659756 - RNA, 64 nt, hsa; identical to SEQ ID NO: 412249

SEQ ID NO: 659757 - RNA, 64 nt, hsa; identical to SEQ ID NO: 412250

SEQ ID NO: 659758 - RNA, 64 nt, hsa; identical to SEQ ID NO: 412251

SEQ ID NO: 659759 - RNA, 64 nt, hsa
auacucccagauccuaaauccaguagccucccaggcaaaauauagcaaucugccacaacugcca

SEQ ID NO: 659760 - RNA, 64 nt, hsa
agcagccccaaccacagcauucccuaacauggaggcaaaauaccacauggcuucucccgcauau

SEQ ID NO: 659761 - RNA, 64 nt, hsa
guaguaguugcuauguacugauuuaccucaaggugcaaaauaauuaaaccuguacauauuccau

SEQ ID NO: 659762 - RNA, 64 nt, hsa
uaguaauuauccagugccagaaaaaccgucacuugcaaaauacuuugcacucaaaauguuuuua

SEQ ID NO: 659763 - RNA, 64 nt, hsa
aaaaccuuugauauuuauaaaaucauuuuuacgugcaaaauauaaccuuaauauuugaagugac

SEQ ID NO: 659764 - RNA, 64 nt, hsa
uuagagggcacuuccgaaaaacacagcccugacagcaaaauaaaggucugauauguuggccccu

SEQ ID NO: 659765 - RNA, 64 nt, hsa
uuguaaauacugcuugaccguacucucacauguggcaaaauaugguuugguuuuucuuuuuuuu

SEQ ID NO: 659766 - RNA, 64 nt, hsa
ggcagggagugaugauuugggggaggcuuugggagcaaaauaaggaagagggcugagcugagcu

SEQ ID NO: 659767 - RNA, 64 nt, hsa
uucagacauucagugggcaaguaaauuauggacugcaaaauaaugauuuuuauucaagaaagcu

SEQ ID NO: 659768 - RNA, 64 nt, hsa
aaaguuuuauauccagauauacaaccacaauaaagcaaaauaaccuacuaucaaaauagaaaug

SEQ ID NO: 659769 - RNA, 64 nt, hsa
ucuuguaagcuuuaacuauaucucucuuuaaaaugcaaaauaaugucuuaagauucaaagucug

SEQ ID NO: 659770 - RNA, 64 nt, hsa
aaagucuguauuuuuaaagcauggcuuuggcuuugcaaaauaaaaaauguguuuuguacaugaa

SEQ ID NO: 659771 - RNA, 64 nt, hsa
auuuuguaaauacacuuuuuuacuuuucaaacgagcaaaauaaugugcaaugauuuuuauacaa

SEQ ID NO: 659772 - RNA, 64 nt, hsa
cuucgagauauccauucacuuuauaauuuugacugcaaaauauuuuguaaauacacuuuuuuac

SEQ ID NO: 659773 - RNA, 64 nt, hsa
cuugcucuguuuuugcuuuugugcuuaggcaagugcaaaauacucuauggaaaucauaauuguc

SEQ ID NO: 659774 - RNA, 64 nt, hsa
caucccuaauaacaaccuucauucuucuaauacagcaaaauaaaaauuuaacaaccaaggaaua

SEQ ID NO: 659775 - RNA, 64 nt, hsa
auuccacacagcaguuugacuuuguaaaaguuuagcaaaauaacugauuguuuuggauaacuca

SEQ ID NO: 659776 - RNA, 64 nt, hsa
ugauuccugcuacugcaaagugaauuuuauaaaggcaaaauacuggagcacuaaugcccaugag

SEQ ID NO: 659777 - RNA, 64 nt, hsa
aauugucgauuuuuagcuauuugacagauuaaaagcaaaauaaucaugccauauuuaguccugg

SEQ ID NO: 659778 - RNA, 64 nt, hsa
caccuucucuuccuucuuggucugucauuauauugcaaaauauuuuuccucugaaugaaauuau

SEQ ID NO: 659779 - RNA, 64 nt, hsa
uuuugugagcaguuugccauucagaaaccauugagcaaaauaagucuauagaugggacugaaac

SEQ ID NO: 659780 - RNA, 64 nt, hsa
uaaguuuuguuuuucacaaagcucuuauuaugaagcaaaauaaaaauucuaguuucuuguauga

SEQ ID NO: 659781 - RNA, 64 nt, hsa
auuuaacaucugcaguguucugugaauagcaguggcaaaauauuauguuaugaaaacccucgau

SEQ ID NO: 659782 - RNA, 64 nt, hsa
aaauuucuggcaaauauuuugucacugcuguaaagcaaaauauuugugaaagugccaaaauaaa

SEQ ID NO: 659783 - RNA, 64 nt, hsa
gccaccuaauaaauaaaccuugcaugacaaaccugcaaaauauuuuaucagcuguuauuggaaa

SEQ ID NO: 659784 - RNA, 64 nt, hsa
aagugcucaguuaaauguaaguguuauuccuucagcaaaauauucacugacccaaaacucuuua

SEQ ID NO: 659785 - RNA, 64 nt, hsa
ugaguacauuugaauugaauauauaauaaauauugcaaaauaaaauccaucuaaauagaagggu

SEQ ID NO: 659786 - RNA, 64 nt, hsa
cucuauggcaaagucuuucaaauacgagauaacugcaaaauauuuuccuuuuauacuacagaaa

SEQ ID NO: 659787 - RNA, 64 nt, hsa
gaaaauauauauugcuagcccaaaaaucccaggggcaaaauaaaguucaacaaaagugcaaaau

SEQ ID NO: 659788 - RNA, 64 nt, hsa
aaaucccaggggcaaaauaaaguucaacaaaagugcaaaauaugacaaaaauagguacauuuuu

SEQ ID NO: 659789 - RNA, 64 nt, hsa
cuucauagaacccagcaugacauaacagugcagggcaaaauauucacugggccaauucaauaca

SEQ ID NO: 659790 - RNA, 64 nt, hsa
uuaugaacccuuccugagcuuuaugguccuaaaagcaaaauaaaaacuauucgaaugaaaagac

SEQ ID NO: 659791 - RNA, 64 nt, hsa
ggcauacuuuucauguuuuaauuuuuuucuuccagcaaaauaaacacugaggcccuaaaaauag

SEQ ID NO: 659792 - RNA, 64 nt, hsa
agggcauguuauuugaagugcucagcaguugaaagcaaaauaauaacugcuauuuauaaaaaug

SEQ ID NO: 659793 - RNA, 64 nt, hsa
guaaaauuaaauuaguuauauuuuauuuuaaaaugcaaaauacauugauauuuauuaaucauug

SEQ ID NO: 659794 - RNA, 64 nt, hsa
gauuguauuugcccugaguauuaaagcuagcuuagcaaaauacuuuuaaaaacauauugguaaa

SEQ ID NO: 659795 - RNA, 64 nt, hsa
uauauaagaugaugugcccuguuaaaaggaggaggcaaaauagucaaacccaggguaguuuaca

SEQ ID NO: 659796 - RNA, 64 nt, hsa
gcacuaaagcuggcacucccccagccguucucaugcaaaauaccugugucagaauacuccuuuc

SEQ ID NO: 659797 - RNA, 64 nt, hsa
guagauauuguaaagcuuuuugugaauuaaaagugcaaaauaaagcaaccacauuuaaguagau

SEQ ID NO: 659798 - RNA, 64 nt, hsa
ccuucaaacaaauaauauuuuuacagaagcaggagcaaaauauggccuuucuucuaagagauau

SEQ ID NO: 659799 - RNA, 64 nt, hsa
aauauaagaaaagguuaucuuaaauagaucuuaggcaaaauaccagcugaugaaggcaucugau

SEQ ID NO: 659800 - RNA, 64 nt, hsa
ugauuauuugcauguuauguuuaauaagcuacuagcaaaauaaaacauagcaaauggcaucacu

SEQ ID NO: 659801 - RNA, 64 nt, hsa
aaaauaggugguagauauugaggccaagaauauugcaaaauacaugaagcuucaugcacuuaaa

SEQ ID NO: 659802 - RNA, 64 nt, hsa
aauagaacugagauuuuuauguaauuaguuauaggcaaaauacuuucauauuuuuagauuagac

SEQ ID NO: 659803 - RNA, 64 nt, hsa
cuuuuauagaauaugauauuauaaaguuaaauuugcaaaauaauucuaacauccacuauuguuc

SEQ ID NO: 659804 - RNA, 63 nt, hsa
ugguuaaauaacguuuaaaaacauguacugagaugaaucuaauuuuuagauugcccuguauuu

SEQ ID NO: 659805 - RNA, 63 nt, hsa
uggucuucuaccagcagcucggaauaguugcacugaaucuauacuuugcagcacugucugaug

SEQ ID NO: 659806 - RNA, 63 nt, hsa
gaagaaaauggaaaugugaguuccugcgaacgcugaaucuaggugggacgcuugccuugaaca

SEQ ID NO: 659807 - RNA, 63 nt, hsa
auagacauuuguaucugaauccacaagaagaucugaaucuaagaaggaauuaccuuugacaau

SEQ ID NO: 659808 - RNA, 63 nt, hsa
gagagacagagaaagagagagaauucuuucaagugaaucuaaaagcuuuugcuuuuccuuugu

SEQ ID NO: 659809 - RNA, 63 nt, hsa
guuuagauuaaaacuaguuuaaaaaauuauaaaugaaucuaaucaaaaugugaauaguaguca

SEQ ID NO: 659810 - RNA, 63 nt, hsa
gauuuguaguaucagcuuguugagcaaugacuuugaaucuaguuuucagugaucagaagcagc

SEQ ID NO: 659811 - RNA, 63 nt, hsa
acuaauuuuuaagaauuacaaagcucauucuucugaaucuaauaucacuaacuccuagacuuu

SEQ ID NO: 659812 - RNA, 63 nt, hsa
gguaugaaaagcccauauucuguucuugucaccugaaucuaggcuuccucuuuggaugugaac

SEQ ID NO: 659813 - RNA, 63 nt, hsa
gucagcucuccauccaucccccucuuuaaucuaugaaucuauaggcucgguguguguaacaca

SEQ ID NO: 659814 - RNA, 63 nt, hsa
acaacuagacuugaaaagaaaccauuugagauuugaaucuaaugguuaacgcuauucagauuu

SEQ ID NO: 659815 - RNA, 63 nt, hsa
uuucacuaagugagguuccuucccugcaaaugcugaaucuagccuaauucgcaaccacacaga

SEQ ID NO: 659816 - RNA, 63 nt, hsa
acacauuuugugcgcaugaugaagagagcaccgugaaucuagucuugacugccccugguggaa

SEQ ID NO: 659817 - RNA, 63 nt, hsa
ccaacuuccuaaaggcuuaugacuucuaaaaagugaaucuaucagcauuccacaucagauuua

SEQ ID NO: 659818 - RNA, 63 nt, hsa
cucauuuaucuccucuucauggcaucuucaauaugaaucuauaaguaguaaaucagaaaguaa

SEQ ID NO: 659819 - RNA, 63 nt, hsa
uaauauauauagauauauaaucccuauauaucuugaaucuacaaauaucuuuauauguauaua

SEQ ID NO: 659820 - RNA, 63 nt, hsa
ucgagguccccagugcgucauuggauuugcuuuugaaucuagagcgugucuuuacucauugug

SEQ ID NO: 659821 - RNA, 63 nt, hsa
aaauuuaugacucugcucauguucaggugcagcugaaucuaucgccauggauucauucuuuca

SEQ ID NO: 659822 - RNA, 63 nt, hsa
aaaaacuucggaguuuuuccuugcuuaaauauuugaaucuaaauuauuugugcugaacauuuc

SEQ ID NO: 659823 - RNA, 63 nt, hsa
cuuaacacaaucagaaauuuuucuuuuuguguuugaaucuaacacacugacguuuggaaaacu

SEQ ID NO: 659824 - RNA, 63 nt, hsa
cugucuaacacacaauagucacaauacuuuuugugaaucuacaaccagagacaggcaaaaacu

SEQ ID NO: 659825 - RNA, 63 nt, hsa
uugaagagcaaggauuggggugggguggguuggugaaucuaucucaggccacugcacugcaag

SEQ ID NO: 659826 - RNA, 63 nt, hsa
caguuguagucguuugagugcaguaaugaaaucugaaucuaaaauaaaaacaagauuauuuuu

SEQ ID NO: 659827 - RNA, 63 nt, hsa
gugacuaugaaacgaauauaagcuuaaaauaagugaaucuaauaaaauggcuauuccucuuuu

SEQ ID NO: 659828 - RNA, 63 nt, hsa
aacucuuuguuuuauacauauauaauuuauaacugaaucuaaguauuagacugcuacucauau

SEQ ID NO: 659829 - RNA, 63 nt, hsa
uuuuuaacaacuuuccauuuuuagauguuucguugaaucuauuuagagcuucaccauggcaau

SEQ ID NO: 659830 - RNA, 63 nt, hsa
aagacauaguucaccuaaaauggcauccugcucugaaucuagacuuuuuagaaauggcauaug

SEQ ID NO: 659831 - RNA, 63 nt, hsa
uuucuuauaauguugaaauguuuuagaauccuuugaaucuaaguauuuguuuccuaaaugaaa

SEQ ID NO: 659832 - RNA, 63 nt, hsa
agaaagucaucgguagcuugauggggauggcauugaaucuauaaauuaccuugggcaguaugg

SEQ ID NO: 659833 - RNA, 63 nt, hsa
uaugaauguauuugcuucuaaaaccucccaaagugaaucuaaucuuaaaacuacaaguuguaa

SEQ ID NO: 659834 - RNA, 63 nt, hsa
uaugaauuuagcauugggaaaagcccuuauucuugaaucuagaguuacuauuuuuguauauau

SEQ ID NO: 659835 - RNA, 63 nt, hsa
ccauguuuuaaguagcuacaggagcuauagauuugaaucuaauguugcauuagucuuuucagu

SEQ ID NO: 659836 - RNA, 63 nt, hsa
ggauguguacaguacaguacugaacuuguaauuugaaucuaguaugguguucuguuuucagcu

SEQ ID NO: 659837 - RNA, 63 nt, hsa
ggcccuucuccuuuugaaaagguaaggugaaggugaaucuagcuuauuuugaggcuuucaggu

SEQ ID NO: 659838 - RNA, 63 nt, hsa
acuguaguuaauuuugucacagaaucuauggacugaaucuaaugcuuccaaaaauguuguuug

SEQ ID NO: 659839 - RNA, 63 nt, hsa
guuguuagaaauguuuaaguugcuguucugugaugaaucuaaaucuuuucucuugcuaccaag

SEQ ID NO: 659840 - RNA, 63 nt, hsa
ugcuuuccuaacuccugcaguccaaggcagccaugaaucuacuuucuauguaagauuaaccua

SEQ ID NO: 659841 - RNA, 63 nt, hsa
uugacagugaggacaauguggcuugcuccuuuuugaaucuacagauaaugcauguuuuacagu

SEQ ID NO: 659842 - RNA, 63 nt, hsa
aagccugacuacaucuuuuuaucugcgguugauugaaucuauggauguggaaccugugcauau

SEQ ID NO: 659843 - RNA, 63 nt, hsa
accgguaauauauuguauuuccaccguacucugugaaucuaauuauuauucuuuaaguguuga

SEQ ID NO: 659844 - RNA, 63 nt, hsa
gaaaaggccuagcgaggcaaauucugauugauuugaaucuauauuuuucuuuaaaaagucaag

SEQ ID NO: 659845 - RNA, 63 nt, hsa
cugaacacauuaggcauaugagcagauuuccagugaaucuauuuauguuuauuuucugaguuu

SEQ ID NO: 659846 - RNA, 63 nt, hsa
gaaaaaugugcaaaacagcguuuaagacuguaaugaaucuaagcagcauuucugaaguggacu

SEQ ID NO: 659847 - RNA, 63 nt, hsa
gcaucaugaagaacgaucaacuaucuucuaauuugaaucuauaguuacuuuguaccauuugaa

SEQ ID NO: 659848 - RNA, 63 nt, hsa
gcauuucauaaacuaauagaaguugaggauuguugaaucuauuucacuuauuuuggcuguggu

SEQ ID NO: 659849 - RNA, 63 nt, hsa
gcacagggaccguguucuuagguucuuagucugugaaucuagcaauaggcaguccagauuucu

SEQ ID NO: 659850 - RNA, 63 nt, hsa
ucugcuaggcuggucuaccuccuaaauauacucugaaucuaucaccucuauugccuucuugca

SEQ ID NO: 659851 - RNA, 63 nt, hsa
auuguaaaugaauaaaacauucucaacuccucuugaaucuaucccccaagaaaccaucuuauc

SEQ ID NO: 659852 - RNA, 63 nt, hsa
aaucuuaagcaacaaagaaaaaacccuaauauuugaaucuauuuaugucuuucaauuuaaauu

SEQ ID NO: 659853 - RNA, 63 nt, hsa
auaaauuuuaugggcgggugccaaauacugcugugaaucuauuuguauaguauccaugaauga

SEQ ID NO: 659854 - RNA, 63 nt, hsa
uauuuuauaauuuaugacagaaugaagucauuuugaaucuacaugaaugaacacuuuggauuu

SEQ ID NO: 659855 - RNA, 63 nt, hsa
uuccuaacaaucauuuauaauuggaugugcuccugaaucuacuuuuuauaaaaaaaaaaaaau

SEQ ID NO: 659856 - RNA, 63 nt, hsa
gugaugcauuucaaguggcaguuuuaucacguuugaaucuaccauucauagccagauguguau

SEQ ID NO: 659857 - RNA, 63 nt, hsa
gagucauuacugccugccacuaagaaacgugcuugaaucuaauaaguauguguguaccguaaa

SEQ ID NO: 659858 - RNA, 63 nt, hsa
uaaauacauaaauaggauugaaucaacuagaaaugaaucuauauguucuguauauaugaauga

SEQ ID NO: 659859 - RNA, 63 nt, hsa
ugaagaaaguccccuugaauucugauaucucuuugaaucuaagagauccugauagcuucaugu

SEQ ID NO: 659860 - RNA, 63 nt, hsa
uauuuguuuuguguuucauuggucucuaucuccugaaucuaacacauuucauagccuacauuu

SEQ ID NO: 659861 - RNA, 63 nt, hsa
ggcagaggccucuaaaucucagggcaaacauggugaaucuaucucuccggagauaauuucaua

SEQ ID NO: 659862 - RNA, 63 nt, hsa
gugagguauugcaaauguucaaaaaagcucucuugaaucuagguagcaugaacaaauuauaaa

SEQ ID NO: 659863 - RNA, 63 nt, hsa
gaaagcuuuggcgaccccaauauauguauuuuuugaaucuaugaaccugaaaagggucagaag

SEQ ID NO: 659864 - RNA, 63 nt, hsa
cagaacauacuuauauguaaaguauuauuuauuugaaucuacaaaaaacaacaaauaauuuuu

SEQ ID NO: 659865 - RNA, 63 nt, hsa
guuaauguauucaaauguuagaguuuaauuuugugaaucuauuguuucuccucugaagcauuu

SEQ ID NO: 659866 - RNA, 63 nt, hsa
uuucaccuuuaggguuaaaaaaaacucuucuacugaaucuauaaaaacugcaguuuuacaucu

SEQ ID NO: 659867 - RNA, 63 nt, hsa
uagcuauauggauauuagcauaucugguaauuaugaaucuagaauuuuuuuacauauuuuuau

SEQ ID NO: 659868 - RNA, 63 nt, hsa
cuuacuugagaauuuugcaacugucuaugcagcugaaucuaaguaugguuuuuugucauauug

SEQ ID NO: 659869 - RNA, 63 nt, hsa
aacuuucccuccuauaguuaaaaagaaaaaaaaugaaucuauuuuucucuuuggcuucaaaag

SEQ ID NO: 659870 - RNA, 63 nt, hsa
guuaauauuuuauguguaaaauaagguuaugauugaaucuacuugcacacucucccauuauau

SEQ ID NO: 659871 - RNA, 63 nt, hsa
uguuuuaagccaauauuuuaagguaaaacucacugaaucuaaccauagcugaccuuuguagua

SEQ ID NO: 659872 - RNA, 63 nt, hsa
uuaauucuaauguucaaaucacugcgugcuguaugaaucuagaaagccuuaauuuacuaccaa

SEQ ID NO: 659873 - RNA, 63 nt, hsa
agccauggugucuucagaauuguagcgcauuucugaaucuagcaaauccuccuuuuacccguu

SEQ ID NO: 659874 - RNA, 63 nt, hsa
caauguuuauuucauaaagaauugugaacuucuugaaucuagggagggggaauguagugaagg

SEQ ID NO: 659875 - RNA, 63 nt, hsa
uaauuugacauugaugucacucuucauaccaagugaaucuauucucaugaacuuugaacccau

SEQ ID NO: 659876 - RNA, 63 nt, hsa
ugggcuuguccaggcucauaauaaaugcuccauugaaucuacuauucuuguuuuccacugcug

SEQ ID NO: 659877 - RNA, 63 nt, hsa
cauaauugugaccaauacauuuguauuuugugaugaaucuacauuuguuuguauucauguuca

SEQ ID NO: 659878 - RNA, 63 nt, hsa
cccagauugcuauuuuuauuguuauuuuuaacaugaaucuaaaguuuaugguuccagggacuu

SEQ ID NO: 659879 - RNA, 63 nt, hsa
aagaaaugacucugggagaggauuucccuuaugugaaucuagguaaaaagauggaaaaaaauu

SEQ ID NO: 659880 - RNA, 63 nt, hsa
gcuuuucacuuucugucuagguuaaagcuaaacugaaucuauggcuuuaaauaaauuaagauc

SEQ ID NO: 659881 - RNA, 63 nt, hsa
aggagaaaugaaugcauaaaauaacugauaauaugaaucuauacauagaacuuaggaagucuc

SEQ ID NO: 659882 - RNA, 63 nt, hsa
uaguucauaaacaaacuguguaacuucucaaaaugaaucuauuucauaacucggacaauuucu

SEQ ID NO: 659883 - RNA, 63 nt, hsa
gaaaauaaugauaaauguaaaauaucuaaagcaugaaucuaagagcacgcaauauauaauuuu

SEQ ID NO: 659884 - RNA, 63 nt, hsa
uucuccuacguauuagagaaacaaauccaucuuugaaucuaaugguguacucauagcaacuau

SEQ ID NO: 659885 - RNA, 63 nt, hsa
ucuucaaacaucauuauuauucuugaccagaccugaaucuaaguuaccaucccuuggaaauuc

SEQ ID NO: 659886 - RNA, 63 nt, hsa
ccuucuagaagaauguaagaccugaaagaguuaugaaucuaucacuaggcaaaaacuucucuu

SEQ ID NO: 659887 - RNA, 63 nt, hsa
auaugcuuaauggccuggggcucaauacaggugugaaucuauacaaagugauggaagcuggug

SEQ ID NO: 659888 - RNA, 63 nt, hsa
uccuugcaggauuccuucguuuuuaaaugcccuugaaucuagcuuugccuuggagaccccagu

SEQ ID NO: 659889 - RNA, 63 nt, hsa
agugacauucaauugguucuauugcauaguacaugaaucuauugucacuaaaaauuagguuac

SEQ ID NO: 659890 - RNA, 63 nt, hsa
ucuauuaagaguauuuaaaaucauauuuaaauaugaaucuauucaugcuaacauuauuuuuca

SEQ ID NO: 659891 - RNA, 63 nt, hsa
auuguauaggauugcaugugaagucuuuucuacugaaucuauauuuccauuuguaagugauuu

SEQ ID NO: 659892 - RNA, 63 nt, hsa
acuguuaucugaugucuuccugcauauuaaggaugaaucuacagaauuagaucaauaaggauc

SEQ ID NO: 659893 - RNA, 63 nt, hsa
uuaguauguuguaaguagaucauuuuaaaaaacugaaucuauauuauguuuaacuucagaagg

SEQ ID NO: 659894 - RNA, 63 nt, hsa
uaaaaagcuaugcaauuuucuuuuuauuaaggaugaaucuaaaugcauucaauugguaacuau

SEQ ID NO: 659895 - RNA, 55 nt, hsa
uacagagagaagaggaaugacugcaugaaucuaccugaguugcuggcauugggag

SEQ ID NO: 659896 - RNA, 63 nt, hsa
agaagaacccacuuccugcuuaguugagauaguugaaucuagcauucguuccuauaaaagaga

SEQ ID NO: 659897 - RNA, 63 nt, hsa
cuaaugggcauuauaauuguuucaucuacucugugaaucuacauaggucuuuuuuuuuagaug

SEQ ID NO: 659898 - RNA, 63 nt, hsa
auacucagcuaacaaaccugcccauguguuuccugaaucuaaaauaaaaaucgaaauaauuuu

SEQ ID NO: 659899 - RNA, 63 nt, hsa
uuauauggugcuuuguauaugccacuaauaaaaugaaucuaaacauugaaugugaauggcccu

SEQ ID NO: 659900 - RNA, 63 nt, hsa
auggacuggucaccaguuuuuauuuuauuuuuaugaaucuaccuuuccauugauugauuuaag

SEQ ID NO: 659901 - RNA, 63 nt, hsa
auuuggggucugguuagucgugacuaucuauccugaaucuaacagugacuucauaacuaggag

SEQ ID NO: 659902 - RNA, 63 nt, hsa
acacacacacacacacacaccacucgccuccacugaaucuacacacagauuuuacugugacuu

SEQ ID NO: 659903 - RNA, 63 nt, hsa
cuacacauauuacaagauauagcacuuucaaaaugaaucuaaaccuuuacagaaacuuucuua

SEQ ID NO: 659904 - RNA, 63 nt, hsa
aauugugaugaaaagaaauuaacugcuuauuuaugaaucuaaucauuuagaaaugucugagag

SEQ ID NO: 659905 - RNA, 63 nt, hsa
gcuuuacugucaaaauaauuuuauggcucacuaugaaucuauuauacuguauuaagagugaaa

SEQ ID NO: 659906 - RNA, 63 nt, hsa
accuuaaaggguauacuaagugauacaguacuuugaaucuaguuguuagauucucaaaauucc

SEQ ID NO: 659907 - RNA, 63 nt, hsa
ugaaaguggaauaauuuuuauaauagacuauagugaaucuaaaacuacacuguuaagaguaua

SEQ ID NO: 659908 - RNA, 63 nt, hsa
auuaaagaucuaaauacaaaggauauacagucuugaaucuaaaauaauuugcuaacuaacuau

SEQ ID NO: 659909 - RNA, 63 nt, hsa
uuuguuuuuaaacaaaagauauuauuuuguguaugaaucuaaaucaagcccaucugucauuau

SEQ ID NO: 659910 - RNA, 63 nt, hsa
acagcacagaggguaggggggcccucuaggugcugaaucuacacaucuguggggucuccuggg

SEQ ID NO: 659911 - RNA, 63 nt, hsa
uuaaaaauguagauuuuucauauuuuuaaaauuugaaucuauuugagcuuuaguucagcagaa

SEQ ID NO: 659912 - RNA, 63 nt, hsa
agaacauaaauauugugaauaaugaaaauccacugaaucuaauaagggacuuguaucgguaag

SEQ ID NO: 659913 - RNA, 63 nt, hsa
acugcugcucucccaaggguuuuauuuuauuucugaaucuagagaacaguauugggcaggagg

SEQ ID NO: 659914 - RNA, 63 nt, hsa
uauagaaucuaagaguugauuguggaaaacacgugaaucuauugcgcgcauuugucauuuagc

SEQ ID NO: 659915 - RNA, 63 nt, hsa
aaguuucauaccaaauauuugaaaggaugguauugaaucuaaaaccaaauauuaguuuuuauu

SEQ ID NO: 659916 - RNA, 63 nt, hsa
gggaacaugcugguucuggaaaagccacaauauugaaucuaaaaggaaaccguuuauuguuug

SEQ ID NO: 659917 - RNA, 63 nt, hsa
ccuuuaaaauaaacgauuuuaaguuauaaaaggugaaucuauugaaagaagaacaugaaagaa

SEQ ID NO: 659918 - RNA, 63 nt, hsa
cccucaagcauccucaguuccucuugcuguuuaugaaucuaagacaaggaaguccuauagaag

SEQ ID NO: 659919 - RNA, 63 nt, hsa
uaguuuugcacauauuuucuugggaguguuacuugaaucuaucucaaacugcagaaaaaauca

SEQ ID NO: 659920 - RNA, 63 nt, hsa
auggauuuauggaguauguggguauagaaaucaugaaucuagcauuuguuuucagagauucaa

SEQ ID NO: 659921 - RNA, 63 nt, hsa
aaacugccaaaaugugaauaugcaaagccuuucugaaucuauaauaaugguacuucuacuggg

SEQ ID NO: 659922 - RNA, 63 nt, hsa
ugauauaaaugcaauauuaaugccuuuaaaguaugaaucuaugccaaagaucacuuguuguuu

SEQ ID NO: 659923 - RNA, 63 nt, hsa
cucuuuuuuuuuuuaacuaaaacaaaucugcaaugaaucuagaugcaauuaauuuuauuccuu

SEQ ID NO: 659924 - RNA, 63 nt, hsa
auuaaaauaguuuuauauuugggaaggcaaaaaugaaucuauuguuuugcaauauagguuaua

SEQ ID NO: 659925 - RNA, 63 nt, hsa
aguguacaagucauuuuuaauguuaaaaauuagugaaucuaacaaaaggaauaaauuagcaau

SEQ ID NO: 659926 - RNA, 63 nt, hsa
uuaacagaguuuuuuaaucuauaagauuuuuuuugaaucuauuucauuguguuuguuuuucau

SEQ ID NO: 659927 - RNA, 63 nt, hsa
guuuuuguauggugcaauaugacagccugucauugaaucuaaacaacuuaauuugcuuguauu

SEQ ID NO: 659928 - RNA, 63 nt, hsa
auucuccuguuuguauuuuguaaaaugaagaagugaaucuaaguaacuuaaucacaguugugc

SEQ ID NO: 659929 - RNA, 63 nt, hsa
cagaagugcaauguauuuuucuccugugaaaccugaaucuacaaguuuuccugccaagccacu

SEQ ID NO: 659930 - RNA, 63 nt, hsa
uugacuagauuugaaaauacaagauugauuagaugaaucuacaaaaaaguuguccuccucuca

SEQ ID NO: 659931 - RNA, 63 nt, hsa
ugucagccuuuguuaaccuuaaauacacugaauugaaucuacaaaagugaaccaucucagacc

SEQ ID NO: 659932 - RNA, 63 nt, hsa
acacuacacacaccagauggcauccuugggaccugaaucuaucacccaggaaucucaaacucc

SEQ ID NO: 659933 - RNA, 63 nt, hsa
aaaagccuuucagauucagguguauggaauuuuugaaucuauuuuuaaaaucauaacauugau

SEQ ID NO: 659934 - RNA, 63 nt, hsa
uuuuuaacaacuuucaaucuucagauguuucguugaaucuauuuagagcuucaccauggcaau

SEQ ID NO: 659935 - RNA, 63 nt, hsa
ugugagaugacaacaggaacauacaagauacugugaaucuagauguucugaccuaaagaugua

SEQ ID NO: 659936 - RNA, 63 nt, hsa
ccuguguaucccggcuacacuuuaaggaaagauugaaucuaagcugugaaggacaguauagaa

SEQ ID NO: 659937 - RNA, 63 nt, hsa
aaaggccagaaaaaauuaauuaaccaugauggaugaaucuauguuauuggacuaauuugcuuc

SEQ ID NO: 659938 - RNA, 63 nt, hsa
aacugcuacaguucuccaacuucauugugccagugaaucuauugaaaagcuguuaauauuucc

SEQ ID NO: 659939 - RNA, 63 nt, hsa
cugguuuauguguggucaacuugaaaaacuaauugaaucuaggucucuguauuguuccuguuu

SEQ ID NO: 659940 - RNA, 63 nt, hsa
aaaauagcaaaagccucucucagcccacuggccugaaucuacacuggaagccaacuugcuggc

SEQ ID NO: 659941 - RNA, 63 nt, hsa
augauuuguaacauucacacaacaccucacuuuugaaucuauaaaagaauugcacguaugaga

SEQ ID NO: 659942 - RNA, 63 nt, hsa
guauucuucccccucacccaagggcagugggcaugaaucuacuuuuuaaaaaugauuaauuuu

SEQ ID NO: 659943 - RNA, 63 nt, hsa
agaggggagggucaaagcacucguggucaauuuugaaucuaucuuaaaauacugaggugugga

SEQ ID NO: 659944 - RNA, 61 nt, hsa
gauuguaccaugcaauacuauucguuaaauaucugaaucuaaccccguggcugcuuuguca

SEQ ID NO: 659945 - RNA, 63 nt, hsa
auuggagaacuccuggagauaagcuguacaaauugaaucuauguggaaaugcuuucagucuug

SEQ ID NO: 659946 - RNA, 63 nt, hsa
uaauaaauguaugacacugaaaagauuugagugugaaucuacugaaaucacuauaaugcacau

SEQ ID NO: 659947 - RNA, 63 nt, hsa
gauauuuuaaaugguugacaucauccagcgaaaugaaucuacauuaaauguuguuuuaacugc

SEQ ID NO: 659948 - RNA, 63 nt, hsa
cuugucccaaacuuauccagggccauagaaguaugaaucuaauuaaaacagaaaugggaauua

SEQ ID NO: 659949 - RNA, 63 nt, hsa
cuccccagucccccaccagacccacccucucccugaaucuacccacaucccccuucccugucu

SEQ ID NO: 659950 - RNA, 63 nt, hsa
aaugaguugcccuguaaauuuaaaaugauacaaugaaucuaaaaugcuuaucacaguacuuuc

SEQ ID NO: 659951 - RNA, 63 nt, hsa
ugucuuaauuucccuuauuucuacuucuuugguugaaucuaugaacuugauuguauaauuuuc

SEQ ID NO: 659952 - RNA, 63 nt, hsa
ugguacaagagucggggguauaacuuuuauacuugaaucuaccuaccaaguuuacauuucuca

SEQ ID NO: 659953 - RNA, 63 nt, hsa
agagcaagaacugcacugcaucucacugcagucugaaucuagacaucgccauuccccgaggug

SEQ ID NO: 659954 - RNA, 63 nt, hsa
ccucaaagcaccugaacaguuuaucgaccaguuugaaucuauuuaucuucauuugaaugucuu

SEQ ID NO: 659955 - RNA, 63 nt, hsa
agagaaugcugucaauauugguguacuguaaugugaaucuaugcuggugaaaacaauuuuuug

SEQ ID NO: 659956 - RNA, 63 nt, hsa
uuaugaacaugaauaccaacggaaaaccuuaacugaaucuaaaagaaaacuauuuugaagaug

SEQ ID NO: 659957 - RNA, 63 nt, hsa
aauuacucaaaaaguaagcaaaccaauaccuggugaaucuauggacagucauacacauacauc

SEQ ID NO: 659958 - RNA, 63 nt, hsa
gauuuuuuaagacugugucuguauuguugggauugaaucuaguauuugcugggagaauuuuuu

SEQ ID NO: 659959 - RNA, 63 nt, hsa
acacacacaccuagccagcugucaagggcagaaugaaucuaugcuggauaagaaaugguggaa

SEQ ID NO: 659960 - RNA, 63 nt, hsa
ggccgugaacgcuauuuucuaagcagccagcagugaaucuaaaacucuggaagaagucuucug

SEQ ID NO: 659961 - RNA, 63 nt, hsa
aguuaccauccuuaucugaguuaucacaguucaugaaucuaagaggcggaacucuacaucauu

SEQ ID NO: 659962 - RNA, 63 nt, hsa
ucuucuauucccacguuagccaguuguucuugaugaaucuauaugagucauagaacacaaauc

SEQ ID NO: 659963 - RNA, 63 nt, hsa
auuuuagauuguacuugucuuuauuuaaaaugaugaaucuagucugaaucagcuguuauucca

SEQ ID NO: 659964 - RNA, 63 nt, hsa
cuuccucgagaccauacagccaggaaauagcggugaaucuagugaucucgggucccuagauuu

SEQ ID NO: 659965 - RNA, 63 nt, hsa
gcguuagcucugcagagcuaagcuuugggagaaugaaucuaucacugagaaguuuuacuacuc

SEQ ID NO: 659966 - RNA, 63 nt, hsa
cuucauuccuuuuaugucauuucuagacaguuuugaaucuagguuaauaacacuuuauuuaua

SEQ ID NO: 659967 - RNA, 63 nt, hsa
ggaagugagaggcaugauggggagagaccagacugaaucuacgggugagcccuguaaccuggc

SEQ ID NO: 659968 - RNA, 63 nt, hsa
auuuuuauuaguuuaaagguaaauaaagucagcugaaucuacaugucucuuguuuuauuucuc

SEQ ID NO: 659969 - RNA, 63 nt, hsa
cuugugaucccagaauuuucuaagaggaugaguugaaucuauagcagcauugucaguacagac

SEQ ID NO: 659970 - RNA, 63 nt, hsa
gggcauucuguagucccaggcccacuggaaaaaugaaucuauauuuugguuccuggaccgaag

SEQ ID NO: 659971 - RNA, 63 nt, hsa
acauguauagaucuguccugugagcauuucugaugaaucuaugguucuuacagaaauuuuuca

SEQ ID NO: 659972 - RNA, 63 nt, hsa
uuuuuucaccauuugcaauaacuuugaugcaacugaaucuaaauaugacauaaguauuugugg

SEQ ID NO: 659973 - RNA, 63 nt, hsa
cugugagcuggagagaacccagauguuguuuauugaaucuacaacucugaaagagaaaucaau

SEQ ID NO: 659974 - RNA, 63 nt, hsa
uuggcugaaagaaaaaaaaaaaaauguaacugaugaaucuaaacgacccacugcaccaacaau

SEQ ID NO: 659975 - RNA, 63 nt, hsa
uuuuuagagcaaaauuguuggaaagcauuuggcugaaucuaaagaccugcagucagauucuuc

SEQ ID NO: 659976 - RNA, 63 nt, hsa
uuuccagaauugucacugugcauucaaaaguaaugaaucuaacagacauuugauuuaauguac

SEQ ID NO: 659977 - RNA, 63 nt, hsa
ggcagaagggaauugcucagagaaggaaaagacugaaucuaccugcccuaagggacuuaacuu

SEQ ID NO: 659978 - RNA, 63 nt, hsa
ggcaucuuguaaaaaaaaaaaaaaaguuuaaucugaaucuaaccaugaggaaauaaucagaca

SEQ ID NO: 659979 - RNA, 63 nt, hsa
aucucuauguauauucuauuuuauuaaauuaauugaaucuaguauaugcgggauguacgacau

SEQ ID NO: 659980 - RNA, 63 nt, hsa
gcaauaccugucuguaauaugagaaaaaaaaaaugaaucuauuuaaucauuucuacuugcagu

SEQ ID NO: 659981 - RNA, 63 nt, hsa
uuuugcauguuuauaauaaaccuuaauaacaagugaaucuauauuauugauauaaucguauca

SEQ ID NO: 659982 - RNA, 63 nt, hsa
guauauguauuugguucuaucuagauucuucugugaaucuaaaagcauuacagggguaaaugc

SEQ ID NO: 659983 - RNA, 63 nt, hsa
uuaauaaauuuuccauuuuuuuucaaacaaguaugaaucuaguugguugaugccuuuuuuuuc

SEQ ID NO: 659984 - RNA, 63 nt, hsa
ccuucauaguaauaaaaucucaaucuuaaagcaugaaucuaaaacauaaauauuuauauuaca

SEQ ID NO: 659985 - RNA, 63 nt, hsa
ggaagagaauuaacuagaauuaaauuuaauguuugaaucuaaaucauugggcaaacuucuaau

SEQ ID NO: 659986 - RNA, 63 nt, hsa
ugauauuuucugaagaugcuuuuuggaaagcucugaaucuauaccuaaugcucuuaauuauug

SEQ ID NO: 659987 - RNA, 63 nt, hsa
uaguauuccacuguguggcuggauuucuauaauugaaucuaauuuuagacaguuugaguaauu

SEQ ID NO: 659988 - RNA, 63 nt, hsa
auugguuaauugacuguuuaaggccuuaacaggugaaucuagagccuacuuuuauuuugguua

SEQ ID NO: 659989 - RNA, 63 nt, hsa
acauuuuuagaacuccaguuuucaaaucauguuugaaucuacauucacuuuuuuuuguuuucu

SEQ ID NO: 659990 - RNA, 63 nt, hsa
augugaauguagguugagagggcacugaagaccugaaucuacacuaguaaucucaagaaagau

SEQ ID NO: 659991 - RNA, 63 nt, hsa
uuacuuccauauaaagacagaucucuuaauaagugaaucuaguggaagaacauagguaucauu

SEQ ID NO: 659992 - RNA, 63 nt, hsa
guguuuguguuuguguguguuuguucuuuuuauugaaucuauuuaaguaaaaaaaaaauuggu

SEQ ID NO: 659993 - RNA, 63 nt, hsa
cacguaggggugggcuaugggcuguauuuauugugaaucuaguuugugaggcuguggccccga

SEQ ID NO: 659994 - RNA, 63 nt, hsa
auaguccugauaggguuugaauugggauuucugugaaucuauagaucaaucugaggagacuua

SEQ ID NO: 659995 - RNA, 63 nt, hsa
uucuaggguccaacaccagcuuaccuuggaguaugaaucuacccaugaaggaugagagauguu

SEQ ID NO: 659996 - RNA, 56 nt, hsa
auucaucagagaguccaugauggugaugaaucuauuaaucaugaugagugugauag

SEQ ID NO: 659997 - RNA, 63 nt, hsa
aggacacaagagagaaaagcucacuaagaagcuugaaucuacuuuuuuuuuuuuuugagacag

SEQ ID NO: 659998 - RNA, 63 nt, hsa
agcugcucgggaggcugaggcaggagaaucacuugaaucuaggaggcagaguuugcagugagc

SEQ ID NO: 659999 - RNA, 61 nt, hsa
ccuccucugaauuuuaggaugucauuaaaaagaugaaucuagccgcugccuaugugcuugu

SEQ ID NO: 660000 - RNA, 63 nt, hsa
gauuuuuaucuugcuauaaguucgaugacaccgugaaucuaauaagguucacuguugacacag

SEQ ID NO: 660001 - RNA, 63 nt, hsa
aauauacccaaauaaaauauauguauguguacaugaaucuaaacugucuucuucuguuccuca

SEQ ID NO: 660002 - RNA, 63 nt, hsa
aacaaaauuuaccaacuacaguuuuuccucauuugaaucuaacccauuucugauauacugaau

SEQ ID NO: 660003 - RNA, 63 nt, hsa
aaaaaguuauggggauuucuaugaguauuguguugaaucuaaaucacauucgguuauauaauc

SEQ ID NO: 660004 - RNA, 63 nt, hsa
aaaaaguuauagaaauuucucuggguauuguguugaaucuacaucacauucaguuauaaucau

SEQ ID NO: 660005 - RNA, 63 nt, hsa
guagauugggguuggggagggaugaagggcgagugaaucuaaggauaaugaaauaaucaguga

SEQ ID NO: 660006 - RNA, 63 nt, hsa
acacacacacacacacccuaacuaguaucuucuugaaucuaggcuguguuuccagcccugugc

SEQ ID NO: 660007 - RNA, 63 nt, hsa
ugguguaaauaauguacaauuuguggaugucauugaaucuagaggacuuuccccuuuuuauau

SEQ ID NO: 660008 - RNA, 63 nt, hsa
aaaaaaaucuguaugccugaguaccauccuggaugaaucuagaagguaugggguagagcuuga

SEQ ID NO: 660009 - RNA, 63 nt, hsa
gcgugucucugacaucucucacuuccuuuuagaugaaucuacuuuagguucauuccuauauuu

SEQ ID NO: 660010 - RNA, 63 nt, hsa
aauauuuauuucaaagacuucacuucuguuuccugaaucuaaagaaagacaacaugcugcuuu

SEQ ID NO: 660011 - RNA, 63 nt, hsa
ggcaggcccccggggaggggccagaguuuucuaugaaucuauuuuucuucagacugaggccuu

SEQ ID NO: 660012 - RNA, 63 nt, hsa
agagguauuaucaggguugacaacuccuaugauugaaucuaugggaauuauuccucagaagag

SEQ ID NO: 660013 - RNA, 63 nt, hsa
aaaauuaauauaaaaauuggcauaauguuggauugaaucuacauuuuggcagaaguuaaacau

SEQ ID NO: 660014 - RNA, 63 nt, hsa
uuuuuuuucaugaaaaugucaacaugguucuucugaaucuaucacagugaaaaguucuaacuu

SEQ ID NO: 660015 - RNA, 63 nt, hsa
aagcaucacaaaugauauuaaaaauuggcuaguugaaucuauugggauuuucuacaaguauuc

SEQ ID NO: 660016 - RNA, 63 nt, hsa
caguuauucugguaaaaauaggcaaaagugaccugaaucuacaaugaugucccaaaguaacca

SEQ ID NO: 660017 - RNA, 63 nt, hsa
gaaggagaaaacugcaucauaacuuuacagaauugaaucuagagucuuccccgaaaagcccag

SEQ ID NO: 660018 - RNA, 63 nt, hsa
cauacucaugcaugcaaauuagacaaccaaguaugaaucuauuugugggugugcuauagcuuu

SEQ ID NO: 660019 - RNA, 63 nt, hsa
cccucucuccaaucaucuaaaauugaagaugacugaaucuauuuuaagaucuaaauuagcauc

SEQ ID NO: 660020 - RNA, 64 nt, hsa; identical to SEQ ID NO: 432969

SEQ ID NO: 660021 - RNA, 64 nt, hsa; identical to SEQ ID NO: 432970

SEQ ID NO: 660022 - RNA, 64 nt, hsa; identical to SEQ ID NO: 432971

SEQ ID NO: 660023 - RNA, 64 nt, hsa; identical to SEQ ID NO: 432972

SEQ ID NO: 660024 - RNA, 64 nt, hsa; identical to SEQ ID NO: 432973

SEQ ID NO: 660025 - RNA, 64 nt, hsa; identical to SEQ ID NO: 432974

SEQ ID NO: 660026 - RNA, 64 nt, hsa; identical to SEQ ID NO: 432975

SEQ ID NO: 660027 - RNA, 64 nt, hsa; identical to SEQ ID NO: 432976

SEQ ID NO: 660028 - RNA, 64 nt, hsa; identical to SEQ ID NO: 432977

SEQ ID NO: 660029 - RNA, 64 nt, hsa; identical to SEQ ID NO: 432978

SEQ ID NO: 660030 - RNA, 64 nt, hsa; identical to SEQ ID NO: 432979

SEQ ID NO: 660031 - RNA, 64 nt, hsa; identical to SEQ ID NO: 432980

SEQ ID NO: 660032 - RNA, 64 nt, hsa; identical to SEQ ID NO: 432981

SEQ ID NO: 660033 - RNA, 64 nt, hsa; identical to SEQ ID NO: 432982

SEQ ID NO: 660034 - RNA, 64 nt, hsa; identical to SEQ ID NO: 432983

SEQ ID NO: 660035 - RNA, 64 nt, hsa; identical to SEQ ID NO: 432984

SEQ ID NO: 660036 - RNA, 64 nt, hsa; identical to SEQ ID NO: 432985

SEQ ID NO: 660037 - RNA, 64 nt, hsa; identical to SEQ ID NO: 432986

SEQ ID NO: 660038 - RNA, 64 nt, hsa; identical to SEQ ID NO: 432987

SEQ ID NO: 660039 - RNA, 64 nt, hsa; identical to SEQ ID NO: 432988

SEQ ID NO: 660040 - RNA, 64 nt, hsa; identical to SEQ ID NO: 432989

SEQ ID NO: 660041 - RNA, 64 nt, hsa; identical to SEQ ID NO: 432990

SEQ ID NO: 660042 - RNA, 64 nt, hsa; identical to SEQ ID NO: 432991

SEQ ID NO: 660043 - RNA, 64 nt, hsa; identical to SEQ ID NO: 432992

SEQ ID NO: 660044 - RNA, 64 nt, hsa; identical to SEQ ID NO: 432993

SEQ ID NO: 660045 - RNA, 64 nt, hsa; identical to SEQ ID NO: 432994

SEQ ID NO: 660046 - RNA, 64 nt, hsa; identical to SEQ ID NO: 432995

SEQ ID NO: 660047 - RNA, 64 nt, hsa; identical to SEQ ID NO: 432996

SEQ ID NO: 660048 - RNA, 64 nt, hsa; identical to SEQ ID NO: 432997

SEQ ID NO: 660049 - RNA, 64 nt, hsa; identical to SEQ ID NO: 154777

SEQ ID NO: 660050 - RNA, 64 nt, hsa; identical to SEQ ID NO: 154778

SEQ ID NO: 660051 - RNA, 64 nt, hsa; identical to SEQ ID NO: 154779

SEQ ID NO: 660052 - RNA, 64 nt, hsa; identical to SEQ ID NO: 154780

SEQ ID NO: 660053 - RNA, 64 nt, hsa; identical to SEQ ID NO: 154781

SEQ ID NO: 660054 - RNA, 64 nt, hsa; identical to SEQ ID NO: 154782

SEQ ID NO: 660055 - RNA, 64 nt, hsa; identical to SEQ ID NO: 154783

SEQ ID NO: 660056 - RNA, 64 nt, hsa; identical to SEQ ID NO: 154784

SEQ ID NO: 660057 - RNA, 64 nt, hsa; identical to SEQ ID NO: 154785

SEQ ID NO: 660058 - RNA, 64 nt, hsa; identical to SEQ ID NO: 154786

SEQ ID NO: 660059 - RNA, 64 nt, hsa; identical to SEQ ID NO: 154787

SEQ ID NO: 660060 - RNA, 64 nt, hsa; identical to SEQ ID NO: 154788

SEQ ID NO: 660061 - RNA, 64 nt, hsa; identical to SEQ ID NO: 154789

SEQ ID NO: 660062 - RNA, 64 nt, hsa; identical to SEQ ID NO: 154790

SEQ ID NO: 660063 - RNA, 64 nt, hsa; identical to SEQ ID NO: 154791

SEQ ID NO: 660064 - RNA, 64 nt, hsa; identical to SEQ ID NO: 154792

SEQ ID NO: 660065 - RNA, 64 nt, hsa; identical to SEQ ID NO: 154793

SEQ ID NO: 660066 - RNA, 64 nt, hsa; identical to SEQ ID NO: 154794

SEQ ID NO: 660067 - RNA, 64 nt, hsa; identical to SEQ ID NO: 154795

SEQ ID NO: 660068 - RNA, 64 nt, hsa; identical to SEQ ID NO: 154796

SEQ ID NO: 660069 - RNA, 64 nt, hsa; identical to SEQ ID NO: 154797

SEQ ID NO: 660070 - RNA, 64 nt, hsa; identical to SEQ ID NO: 154798

SEQ ID NO: 660071 - RNA, 64 nt, hsa; identical to SEQ ID NO: 154799

SEQ ID NO: 660072 - RNA, 64 nt, hsa; identical to SEQ ID NO: 154800

SEQ ID NO: 660073 - RNA, 64 nt, hsa; identical to SEQ ID NO: 315044

SEQ ID NO: 660074 - RNA, 64 nt, hsa; identical to SEQ ID NO: 315045

SEQ ID NO: 660075 - RNA, 64 nt, hsa; identical to SEQ ID NO: 315046

SEQ ID NO: 660076 - RNA, 64 nt, hsa; identical to SEQ ID NO: 315047

SEQ ID NO: 660077 - RNA, 64 nt, hsa; identical to SEQ ID NO: 315048

SEQ ID NO: 660078 - RNA, 64 nt, hsa; identical to SEQ ID NO: 315049

SEQ ID NO: 660079 - RNA, 64 nt, hsa; identical to SEQ ID NO: 315050

SEQ ID NO: 660080 - RNA, 64 nt, hsa; identical to SEQ ID NO: 315051

SEQ ID NO: 660081 - RNA, 64 nt, hsa; identical to SEQ ID NO: 315052

SEQ ID NO: 660082 - RNA, 64 nt, hsa; identical to SEQ ID NO: 315053

SEQ ID NO: 660083 - RNA, 64 nt, hsa; identical to SEQ ID NO: 315054

SEQ ID NO: 660084 - RNA, 64 nt, hsa; identical to SEQ ID NO: 315055

SEQ ID NO: 660085 - RNA, 64 nt, hsa; identical to SEQ ID NO: 315056

SEQ ID NO: 660086 - RNA, 64 nt, hsa; identical to SEQ ID NO: 315057

SEQ ID NO: 660087 - RNA, 64 nt, hsa; identical to SEQ ID NO: 315058

SEQ ID NO: 660088 - RNA, 64 nt, hsa; identical to SEQ ID NO: 315059

SEQ ID NO: 660089 - RNA, 64 nt, hsa; identical to SEQ ID NO: 315060

SEQ ID NO: 660090 - RNA, 64 nt, hsa; identical to SEQ ID NO: 315061

SEQ ID NO: 660091 - RNA, 64 nt, hsa; identical to SEQ ID NO: 315062

SEQ ID NO: 660092 - RNA, 64 nt, hsa; identical to SEQ ID NO: 315063

SEQ ID NO: 660093 - RNA, 64 nt, hsa; identical to SEQ ID NO: 315064

SEQ ID NO: 660094 - RNA, 64 nt, hsa; identical to SEQ ID NO: 315065

SEQ ID NO: 660095 - RNA, 64 nt, hsa; identical to SEQ ID NO: 315066

SEQ ID NO: 660096 - RNA, 64 nt, hsa; identical to SEQ ID NO: 315067

SEQ ID NO: 660097 - RNA, 57 nt, hsa; identical to SEQ ID NO: 315068

SEQ ID NO: 660098 - RNA, 64 nt, hsa; identical to SEQ ID NO: 315069

SEQ ID NO: 660099 - RNA, 64 nt, hsa; identical to SEQ ID NO: 315070

SEQ ID NO: 660100 - RNA, 64 nt, hsa; identical to SEQ ID NO: 315071

SEQ ID NO: 660101 - RNA, 64 nt, hsa; identical to SEQ ID NO: 315072

SEQ ID NO: 660102 - RNA, 64 nt, hsa; identical to SEQ ID NO: 315073

SEQ ID NO: 660103 - RNA, 64 nt, hsa; identical to SEQ ID NO: 315074

SEQ ID NO: 660104 - RNA, 64 nt, hsa; identical to SEQ ID NO: 315075

SEQ ID NO: 660105 - RNA, 64 nt, hsa; identical to SEQ ID NO: 194715

SEQ ID NO: 660106 - RNA, 64 nt, hsa; identical to SEQ ID NO: 194716

SEQ ID NO: 660107 - RNA, 64 nt, hsa; identical to SEQ ID NO: 194717

SEQ ID NO: 660108 - RNA, 64 nt, hsa; identical to SEQ ID NO: 194718

SEQ ID NO: 660109 - RNA, 64 nt, hsa; identical to SEQ ID NO: 194719

SEQ ID NO: 660110 - RNA, 64 nt, hsa; identical to SEQ ID NO: 194720

SEQ ID NO: 660111 - RNA, 64 nt, hsa; identical to SEQ ID NO: 194721

SEQ ID NO: 660112 - RNA, 64 nt, hsa; identical to SEQ ID NO: 194722

SEQ ID NO: 660113 - RNA, 64 nt, hsa; identical to SEQ ID NO: 194723

SEQ ID NO: 660114 - RNA, 64 nt, hsa; identical to SEQ ID NO: 194724

SEQ ID NO: 660115 - RNA, 64 nt, hsa; identical to SEQ ID NO: 194725

SEQ ID NO: 660116 - RNA, 64 nt, hsa; identical to SEQ ID NO: 194726

SEQ ID NO: 660117 - RNA, 64 nt, hsa; identical to SEQ ID NO: 194727

SEQ ID NO: 660118 - RNA, 64 nt, hsa; identical to SEQ ID NO: 194728

SEQ ID NO: 660119 - RNA, 64 nt, hsa; identical to SEQ ID NO: 194729

SEQ ID NO: 660120 - RNA, 64 nt, hsa; identical to SEQ ID NO: 194730

SEQ ID NO: 660121 - RNA, 64 nt, hsa; identical to SEQ ID NO: 194731

SEQ ID NO: 660122 - RNA, 64 nt, hsa; identical to SEQ ID NO: 194732

SEQ ID NO: 660123 - RNA, 64 nt, hsa; identical to SEQ ID NO: 194733

SEQ ID NO: 660124 - RNA, 64 nt, hsa; identical to SEQ ID NO: 194734

SEQ ID NO: 660125 - RNA, 64 nt, hsa; identical to SEQ ID NO: 194735

SEQ ID NO: 660126 - RNA, 64 nt, hsa; identical to SEQ ID NO: 194736

SEQ ID NO: 660127 - RNA, 64 nt, hsa; identical to SEQ ID NO: 194737

SEQ ID NO: 660128 - RNA, 64 nt, hsa; identical to SEQ ID NO: 194738

SEQ ID NO: 660129 - RNA, 64 nt, hsa; identical to SEQ ID NO: 194739

SEQ ID NO: 660130 - RNA, 64 nt, hsa; identical to SEQ ID NO: 194740

SEQ ID NO: 660131 - RNA, 64 nt, hsa; identical to SEQ ID NO: 194741

SEQ ID NO: 660132 - RNA, 64 nt, hsa; identical to SEQ ID NO: 194742

SEQ ID NO: 660133 - RNA, 64 nt, hsa; identical to SEQ ID NO: 194743

SEQ ID NO: 660134 - RNA, 64 nt, hsa; identical to SEQ ID NO: 194744

SEQ ID NO: 660135 - RNA, 64 nt, hsa; identical to SEQ ID NO: 194745

SEQ ID NO: 660136 - RNA, 64 nt, hsa; identical to SEQ ID NO: 194746

SEQ ID NO: 660137 - RNA, 64 nt, hsa; identical to SEQ ID NO: 194747

SEQ ID NO: 660138 - RNA, 64 nt, hsa
uaaauaauugaaacaaucugaaucccuugcaauuggagguaaauuaugucuuaguuauaauuag

SEQ ID NO: 660139 - RNA, 64 nt, hsa
cauaauccccacauguugugggagggacccagugggagguaauuaaaucaugggggugguuacc

SEQ ID NO: 660140 - RNA, 64 nt, hsa
aacaggcugguugcugguuagauuuucugaaacaggagguaaaauuuuucuuuggcagaggccc

SEQ ID NO: 660141 - RNA, 64 nt, hsa
gggggacuccguuuacuaccacagggagacagagggagguaagccaucccccgggagaccuugc

SEQ ID NO: 660142 - RNA, 64 nt, hsa; identical to SEQ ID NO: 323664

SEQ ID NO: 660143 - RNA, 64 nt, hsa; identical to SEQ ID NO: 323665

SEQ ID NO: 660144 - RNA, 64 nt, hsa; identical to SEQ ID NO: 323666

SEQ ID NO: 660145 - RNA, 64 nt, hsa; identical to SEQ ID NO: 323667

SEQ ID NO: 660146 - RNA, 64 nt, hsa; identical to SEQ ID NO: 323668

SEQ ID NO: 660147 - RNA, 64 nt, hsa; identical to SEQ ID NO: 323669

SEQ ID NO: 660148 - RNA, 64 nt, hsa; identical to SEQ ID NO: 323670

SEQ ID NO: 660149 - RNA, 64 nt, hsa; identical to SEQ ID NO: 323671

SEQ ID NO: 660150 - RNA, 64 nt, hsa; identical to SEQ ID NO: 323672

SEQ ID NO: 660151 - RNA, 64 nt, hsa; identical to SEQ ID NO: 323673

SEQ ID NO: 660152 - RNA, 64 nt, hsa; identical to SEQ ID NO: 323674

SEQ ID NO: 660153 - RNA, 64 nt, hsa; identical to SEQ ID NO: 323675

SEQ ID NO: 660154 - RNA, 64 nt, hsa; identical to SEQ ID NO: 323676

SEQ ID NO: 660155 - RNA, 64 nt, hsa; identical to SEQ ID NO: 323677

SEQ ID NO: 660156 - RNA, 64 nt, hsa; identical to SEQ ID NO: 323678

SEQ ID NO: 660157 - RNA, 64 nt, hsa; identical to SEQ ID NO: 323679

SEQ ID NO: 660158 - RNA, 64 nt, hsa; identical to SEQ ID NO: 323680

SEQ ID NO: 660159 - RNA, 64 nt, hsa; identical to SEQ ID NO: 323681

SEQ ID NO: 660160 - RNA, 64 nt, hsa; identical to SEQ ID NO: 323682

SEQ ID NO: 660161 - RNA, 64 nt, hsa; identical to SEQ ID NO: 323683

SEQ ID NO: 660162 - RNA, 64 nt, hsa; identical to SEQ ID NO: 323684

SEQ ID NO: 660163 - RNA, 64 nt, hsa; identical to SEQ ID NO: 323685

SEQ ID NO: 660164 - RNA, 64 nt, hsa; identical to SEQ ID NO: 323686

SEQ ID NO: 660165 - RNA, 64 nt, hsa; identical to SEQ ID NO: 323687

SEQ ID NO: 660166 - RNA, 64 nt, hsa; identical to SEQ ID NO: 323688

SEQ ID NO: 660167 - RNA, 64 nt, hsa; identical to SEQ ID NO: 323689

SEQ ID NO: 660168 - RNA, 64 nt, hsa; identical to SEQ ID NO: 323690

SEQ ID NO: 660169 - RNA, 64 nt, hsa; identical to SEQ ID NO: 323691

SEQ ID NO: 660170 - RNA, 64 nt, hsa; identical to SEQ ID NO: 323691

SEQ ID NO: 660171 - RNA, 64 nt, hsa; identical to SEQ ID NO: 323693

SEQ ID NO: 660172 - RNA, 64 nt, hsa; identical to SEQ ID NO: 323694

SEQ ID NO: 660173 - RNA, 64 nt, hsa; identical to SEQ ID NO: 323695

SEQ ID NO: 660174 - RNA, 64 nt, hsa; identical to SEQ ID NO: 323696

SEQ ID NO: 660175 - RNA, 64 nt, hsa; identical to SEQ ID NO: 323697

SEQ ID NO: 660176 - RNA, 64 nt, hsa; identical to SEQ ID NO: 323698

SEQ ID NO: 660177 - RNA, 64 nt, hsa; identical to SEQ ID NO: 323699

SEQ ID NO: 660178 - RNA, 64 nt, hsa; identical to SEQ ID NO: 323700

SEQ ID NO: 660179 - RNA, 64 nt, hsa; identical to SEQ ID NO: 323701

SEQ ID NO: 660180 - RNA, 64 nt, hsa; identical to SEQ ID NO: 426252

SEQ ID NO: 660181 - RNA, 64 nt, hsa; identical to SEQ ID NO: 426253

SEQ ID NO: 660182 - RNA, 64 nt, hsa; identical to SEQ ID NO: 426254

SEQ ID NO: 660183 - RNA, 64 nt, hsa; identical to SEQ ID NO: 426255

SEQ ID NO: 660184 - RNA, 64 nt, hsa; identical to SEQ ID NO: 426256

SEQ ID NO: 660185 - RNA, 64 nt, hsa; identical to SEQ ID NO: 426257

SEQ ID NO: 660186 - RNA, 64 nt, hsa; identical to SEQ ID NO: 426258

SEQ ID NO: 660187 - RNA, 64 nt, hsa; identical to SEQ ID NO: 426259

SEQ ID NO: 660188 - RNA, 64 nt, hsa; identical to SEQ ID NO: 426260

SEQ ID NO: 660189 - RNA, 64 nt, hsa; identical to SEQ ID NO: 426261

SEQ ID NO: 660190 - RNA, 64 nt, hsa; identical to SEQ ID NO: 426262

SEQ ID NO: 660191 - RNA, 64 nt, hsa; identical to SEQ ID NO: 426263

SEQ ID NO: 660192 - RNA, 64 nt, hsa; identical to SEQ ID NO: 426264

SEQ ID NO: 660193 - RNA, 64 nt, hsa; identical to SEQ ID NO: 426265

SEQ ID NO: 660194 - RNA, 64 nt, hsa; identical to SEQ ID NO: 426266

SEQ ID NO: 660195 - RNA, 64 nt, hsa; identical to SEQ ID NO: 426267

SEQ ID NO: 660196 - RNA, 64 nt, hsa; identical to SEQ ID NO: 426268

SEQ ID NO: 660197 - RNA, 64 nt, hsa; identical to SEQ ID NO: 426269

SEQ ID NO: 660198 - RNA, 64 nt, hsa; identical to SEQ ID NO: 426270

SEQ ID NO: 660199 - RNA, 64 nt, hsa; identical to SEQ ID NO: 426271

SEQ ID NO: 660200 - RNA, 64 nt, hsa; identical to SEQ ID NO: 426272

SEQ ID NO: 660201 - RNA, 64 nt, hsa; identical to SEQ ID NO: 426273

SEQ ID NO: 660202 - RNA, 64 nt, hsa; identical to SEQ ID NO: 426274

SEQ ID NO: 660203 - RNA, 64 nt, hsa; identical to SEQ ID NO: 426275

SEQ ID NO: 660204 - RNA, 60 nt, hsa; identical to SEQ ID NO: 90161

SEQ ID NO: 660205 - RNA, 64 nt, hsa; identical to SEQ ID NO: 426277

SEQ ID NO: 660206 - RNA, 64 nt, hsa; identical to SEQ ID NO: 426278

SEQ ID NO: 660207 - RNA, 64 nt, hsa; identical to SEQ ID NO: 426279

SEQ ID NO: 660208 - RNA, 64 nt, hsa; identical to SEQ ID NO: 426280

SEQ ID NO: 660209 - RNA, 64 nt, hsa; identical to SEQ ID NO: 426281

SEQ ID NO: 660210 - RNA, 64 nt, hsa; identical to SEQ ID NO: 426282

SEQ ID NO: 660211 - RNA, 64 nt, hsa; identical to SEQ ID NO: 426283

SEQ ID NO: 660212 - RNA, 64 nt, hsa; identical to SEQ ID NO: 426284

SEQ ID NO: 660213 - RNA, 64 nt, hsa; identical to SEQ ID NO: 426285

SEQ ID NO: 660214 - RNA, 64 nt, hsa; identical to SEQ ID NO: 426286

SEQ ID NO: 660215 - RNA, 64 nt, hsa; identical to SEQ ID NO: 426287

SEQ ID NO: 660216 - RNA, 64 nt, hsa; identical to SEQ ID NO: 426288

SEQ ID NO: 660217 - RNA, 64 nt, hsa; identical to SEQ ID NO: 426289

SEQ ID NO: 660218 - RNA, 64 nt, hsa; identical to SEQ ID NO: 426290

SEQ ID NO: 660219 - RNA, 64 nt, hsa; identical to SEQ ID NO: 426291

SEQ ID NO: 660220 - RNA, 64 nt, hsa; identical to SEQ ID NO: 426292

SEQ ID NO: 660221 - RNA, 64 nt, hsa; identical to SEQ ID NO: 426293

SEQ ID NO: 660222 - RNA, 64 nt, hsa; identical to SEQ ID NO: 426294

SEQ ID NO: 660223 - RNA, 64 nt, hsa; identical to SEQ ID NO: 426295

SEQ ID NO: 660224 - RNA, 64 nt, hsa; identical to SEQ ID NO: 426296

SEQ ID NO: 660225 - RNA, 64 nt, hsa; identical to SEQ ID NO: 426297

SEQ ID NO: 660226 - RNA, 64 nt, hsa; identical to SEQ ID NO: 426298

SEQ ID NO: 660227 - RNA, 64 nt, hsa; identical to SEQ ID NO: 426299

SEQ ID NO: 660228 - RNA, 64 nt, hsa; identical to SEQ ID NO: 426300

SEQ ID NO: 660229 - RNA, 64 nt, hsa; identical to SEQ ID NO: 426301

SEQ ID NO: 660230 - RNA, 64 nt, hsa; identical to SEQ ID NO: 426302

SEQ ID NO: 660231 - RNA, 64 nt, hsa; identical to SEQ ID NO: 426303

SEQ ID NO: 660232 - RNA, 64 nt, hsa; identical to SEQ ID NO: 618496

SEQ ID NO: 660233 - RNA, 64 nt, hsa; identical to SEQ ID NO: 618497

SEQ ID NO: 660234 - RNA, 64 nt, hsa; identical to SEQ ID NO: 618498

SEQ ID NO: 660235 - RNA, 64 nt, hsa; identical to SEQ ID NO: 618499

SEQ ID NO: 660236 - RNA, 64 nt, hsa; identical to SEQ ID NO: 618500

SEQ ID NO: 660237 - RNA, 64 nt, hsa; identical to SEQ ID NO: 618501

SEQ ID NO: 660238 - RNA, 64 nt, hsa; identical to SEQ ID NO: 618502

SEQ ID NO: 660239 - RNA, 64 nt, hsa; identical to SEQ ID NO: 618503

SEQ ID NO: 660240 - RNA, 64 nt, hsa; identical to SEQ ID NO: 618504

SEQ ID NO: 660241 - RNA, 64 nt, hsa; identical to SEQ ID NO: 618505

SEQ ID NO: 660242 - RNA, 64 nt, hsa; identical to SEQ ID NO: 618506

SEQ ID NO: 660243 - RNA, 64 nt, hsa; identical to SEQ ID NO: 618507

SEQ ID NO: 660244 - RNA, 54 nt, hsa; identical to SEQ ID NO: 618508

SEQ ID NO: 660245 - RNA, 64 nt, hsa; identical to SEQ ID NO: 618509

SEQ ID NO: 660246 - RNA, 64 nt, hsa; identical to SEQ ID NO: 618510

SEQ ID NO: 660247 - RNA, 64 nt, hsa; identical to SEQ ID NO: 618511

SEQ ID NO: 660248 - RNA, 64 nt, hsa; identical to SEQ ID NO: 618512

SEQ ID NO: 660249 - RNA, 64 nt, hsa; identical to SEQ ID NO: 618513

SEQ ID NO: 660250 - RNA, 64 nt, hsa; identical to SEQ ID NO: 618514

SEQ ID NO: 660251 - RNA, 64 nt, hsa; identical to SEQ ID NO: 618515

SEQ ID NO: 660252 - RNA, 64 nt, hsa; identical to SEQ ID NO: 618516

SEQ ID NO: 660253 - RNA, 64 nt, hsa; identical to SEQ ID NO: 618517

SEQ ID NO: 660254 - RNA, 64 nt, hsa; identical to SEQ ID NO: 618518

SEQ ID NO: 660255 - RNA, 64 nt, hsa; identical to SEQ ID NO: 618519

SEQ ID NO: 660256 - RNA, 64 nt, hsa; identical to SEQ ID NO: 618520

SEQ ID NO: 660257 - RNA, 64 nt, hsa; identical to SEQ ID NO: 618521

SEQ ID NO: 660258 - RNA, 64 nt, hsa; identical to SEQ ID NO: 618522

SEQ ID NO: 660259 - RNA, 64 nt, hsa; identical to SEQ ID NO: 618523

SEQ ID NO: 660260 - RNA, 64 nt, hsa; identical to SEQ ID NO: 618524

SEQ ID NO: 660261 - RNA, 64 nt, hsa; identical to SEQ ID NO: 618525

SEQ ID NO: 660262 - RNA, 57 nt, hsa; identical to SEQ ID NO: 618526

SEQ ID NO: 660263 - RNA, 64 nt, hsa; identical to SEQ ID NO: 618527

SEQ ID NO: 660264 - RNA, 51 nt, hsa; identical to SEQ ID NO: 618528

SEQ ID NO: 660265 - RNA, 64 nt, hsa; identical to SEQ ID NO: 618529

SEQ ID NO: 660266 - RNA, 64 nt, hsa; identical to SEQ ID NO: 618530

SEQ ID NO: 660267 - RNA, 64 nt, hsa; identical to SEQ ID NO: 618531

SEQ ID NO: 660268 - RNA, 64 nt, hsa; identical to SEQ ID NO: 618532

SEQ ID NO: 660269 - RNA, 64 nt, hsa; identical to SEQ ID NO: 618533

SEQ ID NO: 660270 - RNA, 64 nt, hsa; identical to SEQ ID NO: 618534

SEQ ID NO: 660271 - RNA, 64 nt, hsa; identical to SEQ ID NO: 618535

SEQ ID NO: 660272 - RNA, 64 nt, hsa; identical to SEQ ID NO: 618536

SEQ ID NO: 660273 - RNA, 64 nt, hsa; identical to SEQ ID NO: 618537

SEQ ID NO: 660274 - RNA, 64 nt, hsa; identical to SEQ ID NO: 618538

SEQ ID NO: 660275 - RNA, 64 nt, hsa; identical to SEQ ID NO: 618539

SEQ ID NO: 660276 - RNA, 64 nt, hsa; identical to SEQ ID NO: 618540

SEQ ID NO: 660277 - RNA, 64 nt, hsa; identical to SEQ ID NO: 618541

SEQ ID NO: 660278 - RNA, 64 nt, hsa; identical to SEQ ID NO: 618542

SEQ ID NO: 660279 - RNA, 64 nt, hsa; identical to SEQ ID NO: 618543

SEQ ID NO: 660280 - RNA, 64 nt, hsa; identical to SEQ ID NO: 618544

SEQ ID NO: 660281 - RNA, 64 nt, hsa; identical to SEQ ID NO: 618545

SEQ ID NO: 660282 - RNA, 64 nt, hsa; identical to SEQ ID NO: 618546

SEQ ID NO: 660283 - RNA, 64 nt, hsa; identical to SEQ ID NO: 618547

SEQ ID NO: 660284 - RNA, 64 nt, hsa; identical to SEQ ID NO: 618548

SEQ ID NO: 660285 - RNA, 64 nt, hsa; identical to SEQ ID NO: 618549

SEQ ID NO: 660286 - RNA, 64 nt, hsa; identical to SEQ ID NO: 618550

SEQ ID NO: 660287 - RNA, 63 nt, hsa; identical to SEQ ID NO: 618551

SEQ ID NO: 660288 - RNA, 64 nt, hsa; identical to SEQ ID NO: 618552

SEQ ID NO: 660289 - RNA, 64 nt, hsa; identical to SEQ ID NO: 618553

SEQ ID NO: 660290 - RNA, 64 nt, hsa; identical to SEQ ID NO: 618554

SEQ ID NO: 660291 - RNA, 64 nt, hsa; identical to SEQ ID NO: 618555

SEQ ID NO: 660292 - RNA, 64 nt, hsa; identical to SEQ ID NO: 618556

SEQ ID NO: 660293 - RNA, 64 nt, hsa; identical to SEQ ID NO: 618557

SEQ ID NO: 660294 - RNA, 64 nt, hsa; identical to SEQ ID NO: 618558

SEQ ID NO: 660295 - RNA, 64 nt, hsa; identical to SEQ ID NO: 618559

SEQ ID NO: 660296 - RNA, 64 nt, hsa; identical to SEQ ID NO: 618560

SEQ ID NO: 660297 - RNA, 64 nt, hsa; identical to SEQ ID NO: 618561

SEQ ID NO: 660298 - RNA, 64 nt, hsa; identical to SEQ ID NO: 618562

SEQ ID NO: 660299 - RNA, 64 nt, hsa; identical to SEQ ID NO: 618563

SEQ ID NO: 660300 - RNA, 64 nt, hsa; identical to SEQ ID NO: 618564

SEQ ID NO: 660301 - RNA, 64 nt, hsa; identical to SEQ ID NO: 618565

SEQ ID NO: 660302 - RNA, 64 nt, hsa; identical to SEQ ID NO: 618566

SEQ ID NO: 660303 - RNA, 64 nt, hsa; identical to SEQ ID NO: 618567

SEQ ID NO: 660304 - RNA, 64 nt, hsa; identical to SEQ ID NO: 618568

SEQ ID NO: 660305 - RNA, 64 nt, hsa; identical to SEQ ID NO: 107011

SEQ ID NO: 660306 - RNA, 64 nt, hsa; identical to SEQ ID NO: 107012

SEQ ID NO: 660307 - RNA, 64 nt, hsa; identical to SEQ ID NO: 107013

SEQ ID NO: 660308 - RNA, 64 nt, hsa; identical to SEQ ID NO: 107014

SEQ ID NO: 660309 - RNA, 64 nt, hsa; identical to SEQ ID NO: 107015

SEQ ID NO: 660310 - RNA, 64 nt, hsa; identical to SEQ ID NO: 107016

SEQ ID NO: 660311 - RNA, 64 nt, hsa; identical to SEQ ID NO: 107017

SEQ ID NO: 660312 - RNA, 64 nt, hsa; identical to SEQ ID NO: 107018

SEQ ID NO: 660313 - RNA, 64 nt, hsa; identical to SEQ ID NO: 107019

SEQ ID NO: 660314 - RNA, 64 nt, hsa; identical to SEQ ID NO: 107020

SEQ ID NO: 660315 - RNA, 64 nt, hsa; identical to SEQ ID NO: 107021

SEQ ID NO: 660316 - RNA, 64 nt, hsa; identical to SEQ ID NO: 107022

SEQ ID NO: 660317 - RNA, 64 nt, hsa; identical to SEQ ID NO: 107023

SEQ ID NO: 660318 - RNA, 64 nt, hsa; identical to SEQ ID NO: 107024

SEQ ID NO: 660319 - RNA, 64 nt, hsa; identical to SEQ ID NO: 107025

SEQ ID NO: 660320 - RNA, 64 nt, hsa; identical to SEQ ID NO: 107026

SEQ ID NO: 660321 - RNA, 64 nt, hsa; identical to SEQ ID NO: 107027

SEQ ID NO: 660322 - RNA, 64 nt, hsa; identical to SEQ ID NO: 107028

SEQ ID NO: 660323 - RNA, 64 nt, hsa; identical to SEQ ID NO: 107029

SEQ ID NO: 660324 - RNA, 64 nt, hsa; identical to SEQ ID NO: 107030

SEQ ID NO: 660325 - RNA, 64 nt, hsa; identical to SEQ ID NO: 107031

SEQ ID NO: 660326 - RNA, 64 nt, hsa; identical to SEQ ID NO: 107032

SEQ ID NO: 660327 - RNA, 64 nt, hsa; identical to SEQ ID NO: 264513

SEQ ID NO: 660328 - RNA, 64 nt, hsa; identical to SEQ ID NO: 264514

SEQ ID NO: 660329 - RNA, 64 nt, hsa; identical to SEQ ID NO: 264515

SEQ ID NO: 660330 - RNA, 64 nt, hsa; identical to SEQ ID NO: 264516

SEQ ID NO: 660331 - RNA, 64 nt, hsa; identical to SEQ ID NO: 264517

SEQ ID NO: 660332 - RNA, 64 nt, hsa; identical to SEQ ID NO: 264518

SEQ ID NO: 660333 - RNA, 64 nt, hsa; identical to SEQ ID NO: 264519

SEQ ID NO: 660334 - RNA, 64 nt, hsa; identical to SEQ ID NO: 264520

SEQ ID NO: 660335 - RNA, 64 nt, hsa; identical to SEQ ID NO: 264521

SEQ ID NO: 660336 - RNA, 64 nt, hsa; identical to SEQ ID NO: 264522

SEQ ID NO: 660337 - RNA, 64 nt, hsa; identical to SEQ ID NO: 264523

SEQ ID NO: 660338 - RNA, 64 nt, hsa; identical to SEQ ID NO: 264524

SEQ ID NO: 660339 - RNA, 64 nt, hsa; identical to SEQ ID NO: 264525

SEQ ID NO: 660340 - RNA, 64 nt, hsa; identical to SEQ ID NO: 264526

SEQ ID NO: 660341 - RNA, 64 nt, hsa; identical to SEQ ID NO: 264527

SEQ ID NO: 660342 - RNA, 64 nt, hsa; identical to SEQ ID NO: 264528

SEQ ID NO: 660343 - RNA, 64 nt, hsa; identical to SEQ ID NO: 264529

SEQ ID NO: 660344 - RNA, 64 nt, hsa; identical to SEQ ID NO: 264530

SEQ ID NO: 660345 - RNA, 64 nt, hsa; identical to SEQ ID NO: 264531

SEQ ID NO: 660346 - RNA, 64 nt, hsa; identical to SEQ ID NO: 264532

SEQ ID NO: 660347 - RNA, 64 nt, hsa; identical to SEQ ID NO: 264533

SEQ ID NO: 660348 - RNA, 64 nt, hsa; identical to SEQ ID NO: 264534

SEQ ID NO: 660349 - RNA, 64 nt, hsa; identical to SEQ ID NO: 264535

SEQ ID NO: 660350 - RNA, 64 nt, hsa; identical to SEQ ID NO: 264536

SEQ ID NO: 660351 - RNA, 64 nt, hsa; identical to SEQ ID NO: 264537

SEQ ID NO: 660352 - RNA, 64 nt, hsa; identical to SEQ ID NO: 264538

SEQ ID NO: 660353 - RNA, 64 nt, hsa; identical to SEQ ID NO: 264539

SEQ ID NO: 660354 - RNA, 64 nt, hsa; identical to SEQ ID NO: 264540

SEQ ID NO: 660355 - RNA, 64 nt, hsa; identical to SEQ ID NO: 264541

SEQ ID NO: 660356 - RNA, 64 nt, hsa; identical to SEQ ID NO: 264542

SEQ ID NO: 660357 - RNA, 64 nt, hsa; identical to SEQ ID NO: 379522

SEQ ID NO: 660358 - RNA, 64 nt, hsa; identical to SEQ ID NO: 379523

SEQ ID NO: 660359 - RNA, 64 nt, hsa; identical to SEQ ID NO: 379524

SEQ ID NO: 660360 - RNA, 64 nt, hsa; identical to SEQ ID NO: 379525

SEQ ID NO: 660361 - RNA, 64 nt, hsa; identical to SEQ ID NO: 379526

SEQ ID NO: 660362 - RNA, 64 nt, hsa; identical to SEQ ID NO: 379527

SEQ ID NO: 660363 - RNA, 64 nt, hsa; identical to SEQ ID NO: 379528

SEQ ID NO: 660364 - RNA, 64 nt, hsa; identical to SEQ ID NO: 379529

SEQ ID NO: 660365 - RNA, 64 nt, hsa; identical to SEQ ID NO: 379530

SEQ ID NO: 660366 - RNA, 64 nt, hsa; identical to SEQ ID NO: 379531

SEQ ID NO: 660367 - RNA, 64 nt, hsa; identical to SEQ ID NO: 379532

SEQ ID NO: 660368 - RNA, 64 nt, hsa; identical to SEQ ID NO: 379533

SEQ ID NO: 660369 - RNA, 64 nt, hsa; identical to SEQ ID NO: 379534

SEQ ID NO: 660370 - RNA, 64 nt, hsa; identical to SEQ ID NO: 379535

SEQ ID NO: 660371 - RNA, 64 nt, hsa; identical to SEQ ID NO: 379536

SEQ ID NO: 660372 - RNA, 64 nt, hsa; identical to SEQ ID NO: 379537

SEQ ID NO: 660373 - RNA, 64 nt, hsa; identical to SEQ ID NO: 379538

SEQ ID NO: 660374 - RNA, 64 nt, hsa; identical to SEQ ID NO: 379539

SEQ ID NO: 660375 - RNA, 64 nt, hsa; identical to SEQ ID NO: 379540

SEQ ID NO: 660376 - RNA, 64 nt, hsa; identical to SEQ ID NO: 379541

SEQ ID NO: 660377 - RNA, 64 nt, hsa; identical to SEQ ID NO: 379542

SEQ ID NO: 660378 - RNA, 64 nt, hsa; identical to SEQ ID NO: 379543

SEQ ID NO: 660379 - RNA, 64 nt, hsa; identical to SEQ ID NO: 379544

SEQ ID NO: 660380 - RNA, 64 nt, hsa; identical to SEQ ID NO: 379545

SEQ ID NO: 660381 - RNA, 64 nt, hsa; identical to SEQ ID NO: 379546

SEQ ID NO: 660382 - RNA, 64 nt, hsa; identical to SEQ ID NO: 379547

SEQ ID NO: 660383 - RNA, 64 nt, hsa; identical to SEQ ID NO: 379548

SEQ ID NO: 660384 - RNA, 64 nt, hsa; identical to SEQ ID NO: 379549

SEQ ID NO: 660385 - RNA, 64 nt, hsa; identical to SEQ ID NO: 379550

SEQ ID NO: 660386 - RNA, 64 nt, hsa
auuuccauguaaucauugagguuaucacccagauuagaaagacauauuuguuaucaguguacgu

SEQ ID NO: 660387 - RNA, 64 nt, hsa
cacuucaugcugaugauguaucaaauucauuuuauagaaagauuuaaaguuuuuuucuggaagu

SEQ ID NO: 660388 - RNA, 64 nt, hsa
guuuaccaugauucagagaaguucuucaggccuguagaaagaggaguauggaacaaccuuacau

SEQ ID NO: 660389 - RNA, 64 nt, hsa
auuuccugguaaggcuaacuccugaucguuucuguagaaagaugacaaauaaagaaaaaguuau

SEQ ID NO: 660390 - RNA, 64 nt, hsa
cacugccacccagggaguggaucaaaaauauacauagaaagagaaugagcaugucucuauaauu

SEQ ID NO: 660391 - RNA, 64 nt, hsa
uuuaaaucuggcuuuacuugauuuaauuccuuuuuagaaagaaauuuagggcaaaauaaagugu

SEQ ID NO: 660392 - RNA, 64 nt, hsa
aggacuuuugaggaaugaugugauguguagagaauagaaagauuuagauauaugccugugacag

SEQ ID NO: 660393 - RNA, 64 nt, hsa
uaaagcauuuguuuguuaguaucaaucacauagguagaaagaguuugaguuuuacuguggauua

SEQ ID NO: 660394 - RNA, 64 nt, hsa
ggcuuuucuaaccagacuugauuuccucauguucuagaaagaucacuaauggucaaguggaaca

SEQ ID NO: 660395 - RNA, 64 nt, hsa
auuucucaugcucauuuucuugcggcaguuaucuuagaaagacccccaaaggcuuugugauugu

SEQ ID NO: 660396 - RNA, 64 nt, hsa
ggacuuuucuuuuauuggaagaaguaaacauggcuagaaagaaccacguucagggaaugacguu

SEQ ID NO: 660397 - RNA, 64 nt, hsa
gauguaccccugggggaaaagccuggguuggguuuagaaagaucucaggaaaaugaguuucucu

SEQ ID NO: 660398 - RNA, 64 nt, hsa
gugucucaauaugaauagggggugaguagcuucauagaaagaauggggaacucccuuggccuca

SEQ ID NO: 660399 - RNA, 64 nt, hsa
ucuagguuaugaaaacuaucuuagaaggugcuuuuagaaagaaccaggagaacaaccaaagcag

SEQ ID NO: 660400 - RNA, 64 nt, hsa
ugaguaguugcuuacgugaagcucaagauaccuguagaaagaaauaugguauauuuguauaguu

SEQ ID NO: 660401 - RNA, 64 nt, hsa
agaaagaaauaugguauauuuguauaguuuuuaauagaaagaucuauguuuauaaaccagcacu

SEQ ID NO: 660402 - RNA, 64 nt, hsa
ugcuuuaaaaugcuauguaaauauacaaaaaaacuagaaagaaauauauauaaccuuguuauug

SEQ ID NO: 660403 - RNA, 64 nt, hsa
aauaguaaaguuguuguaaaaauaaaaguggauuuagaaagauccaguucuugaaaacacuguu

SEQ ID NO: 660404 - RNA, 64 nt, hsa
cagcauaauaaucccgggagaaugauuccccucauagaaagacaaaagcauccauccccucaua

SEQ ID NO: 660405 - RNA, 64 nt, hsa
gaacuaugaaaagacccuguuugugaauauauuuuagaaagagaggaaggaugucugcagaacu

SEQ ID NO: 660406 - RNA, 64 nt, hsa
uuaucuuaaaguauagguggaaggauacaaaugcuagaaagagggaaucaaaucagccccguuu

SEQ ID NO: 660407 - RNA, 64 nt, hsa
ggccccacuuuuuguugcuuucuagacuuguguguagaaagaagauuaaugaucacuuaaagua

SEQ ID NO: 660408 - RNA, 64 nt, hsa
aaacacuaguguccaauuucauuuuuaaaagauguagaaagaagaaucaagcaucaauuaauua

SEQ ID NO: 660409 - RNA, 64 nt, hsa
augagguaaaguacuucaguuccucaaugugccauagaaagaugggguuguuuuccaaaguuua

SEQ ID NO: 660410 - RNA, 64 nt, hsa
aucauuugcaaagcacucagcucaauuaucuucuuagaaagaaagaaaaaguaugaauggucaa

SEQ ID NO: 660411 - RNA, 64 nt, hsa
caaguagaaguucucuaccauugaaucagugaacuagaaagaucugauuuggccugggaccagu

SEQ ID NO: 660412 - RNA, 64 nt, hsa
cacuucauagcaagggaaggcuuuaagcaguuacuagaaagagauggggauuuggccccuggcu

SEQ ID NO: 660413 - RNA, 64 nt, hsa
gagucacuucaaggccuguuugaauguggcagguuagaaagagagagaaugucuuucauuugaa

SEQ ID NO: 660414 - RNA, 64 nt, hsa
gacuugcaguuauuacuaagcuccucuucaguaauagaaagacuuaugaagucuuuuacuaccu

SEQ ID NO: 660415 - RNA, 64 nt, hsa
ugaauugaggagucaagagucacuaagcagaauuuagaaagagaaguuuuuaaaaagcaaacag

SEQ ID NO: 660416 - RNA, 64 nt, hsa
uuuauauacuuuuccagcuugauaauuuucacaauagaaagagaccaaauauuuuguacuauau

SEQ ID NO: 660417 - RNA, 64 nt, hsa
uuauuuccauuugacagaugaaaaaccuaaugcauagaaagauaaguagaccagucaaggucua

SEQ ID NO: 660418 - RNA, 64 nt, hsa
gagcuaugugccuuccaaccagagggagacccaguagaaagaaaaacauccugggaaauccagc

SEQ ID NO: 660419 - RNA, 64 nt, hsa
uacuguauaaaacuuguugacaaugcacugacuuuagaaagauguuaauguacauaaauagagu

SEQ ID NO: 660420 - RNA, 64 nt, hsa
gcauuaacuaaaugcucauacacaguuaaauaaauagaaagaguucuauggagacuuugcuguu

SEQ ID NO: 660421 - RNA, 64 nt, hsa
uuagggaaaauggauauagaaaaucuuaguauaguagaaagacaucugccuguaauuaaacuag

SEQ ID NO: 660422 - RNA, 64 nt, hsa
gacuguauaaaacuuguugacaaugcacugacuuuagaaagauguuaaugugcauaaauagagu

SEQ ID NO: 660423 - RNA, 64 nt, hsa
gagcuaugugccuuccacccagagggagacccaguagaaagaaaaacauccugggaaauccagc

SEQ ID NO: 660424 - RNA, 64 nt, hsa; identical to SEQ ID NO: 660419

SEQ ID NO: 660425 - RNA, 64 nt, hsa
gugccuuccacccagagccuugugggagacccaguagaaagaaacagcauccugggaaauccag

SEQ ID NO: 660426 - RNA, 64 nt, hsa
uguuugugauaucacuuuaauuuuucuuggguggcuuagagacuaagggaggagacaucuggcc

SEQ ID NO: 660427 - RNA, 64 nt, hsa
ccgguucuauucaaaccagcaggaucugucggugcuuagagauggcugccuggacuggaaucaa

SEQ ID NO: 660428 - RNA, 64 nt, hsa
gaacacuccccauuaacagauggaaaaacugaggcuuagagauagacaaucacuacaagucagc

SEQ ID NO: 660429 - RNA, 64 nt, hsa
ccaggggacaagggauuugaggugaggguuggcgcuuagagaggacaauacugggguuggacug

SEQ ID NO: 660430 - RNA, 64 nt, hsa
guuuugcuagguauaaaaaauaaguaaaguuccacuuagagaacaaagggccaaauagaguuuu

SEQ ID NO: 660431 - RNA, 64 nt, hsa
aucuacucuuuggcacuuuuucacauaagccagccuuagagacuagacaaauaacuacugcaaa

SEQ ID NO: 660432 - RNA, 64 nt, hsa
agcuuagagaaaauguggaggaaauaauaugacacuuagagaaaaaggaagguuuauucuuguc

SEQ ID NO: 660433 - RNA, 64 nt, hsa
agagagguaggugaacauuccaggaaagaagcagcuuagagaaaauguggaggaaauaauauga

SEQ ID NO: 660434 - RNA, 64 nt, hsa
cacacacacaauuaaguugcugcaaauucaaaagcuuagagagaauaagcuucuugguggugaa

SEQ ID NO: 660435 - RNA, 64 nt, hsa
gguuguuuucucucucucucucucucucucucuucuuagagacauggucuaaccauguugucua

SEQ ID NO: 660436 - RNA, 64 nt, hsa
uguuucaucaaaugguuaaauggaccacugguuucuuagagaaauguuuuuaggcuuaauucau

SEQ ID NO: 660437 - RNA, 64 nt, hsa
aauuuucaagguuauaguacuuauuucaacaauucuuagagaugcuagcuaguguugaagcuaa

SEQ ID NO: 660438 - RNA, 64 nt, hsa
cucugggcgaugaaggacaauggugguagggccacuuagagagcaguagggcccaggcuggugc

SEQ ID NO: 660439 - RNA, 64 nt, hsa
gguguuuauaacuauuuuguauuauaaagugggccuuagagauaggaagaagaaugauggauuc

SEQ ID NO: 660440 - RNA, 64 nt, hsa
cugcacuucguacuuuccgagaguuuaacuggugcuuagagagaaaugcaucacuuccaaaccc

SEQ ID NO: 660441 - RNA, 64 nt, hsa
uaauaucuuuuaauauuauucucuuggguguugccuuagagauuucauacaugcccuugaguuc

SEQ ID NO: 660442 - RNA, 64 nt, hsa
ucuuacuaaauucagaggaauaggauaaagaucacuuagagaaagggugcuuauggacauagcc

SEQ ID NO: 660443 - RNA, 64 nt, hsa
ggguucugccccuugugaaggcccauuccuggcacuuagagacagaaagaacucagcaaucuuu

SEQ ID NO: 660444 - RNA, 64 nt, hsa
cgccuccugucagacacuucuagguguuggcuuccuuagagagccugggguuagguuagcuuuc

SEQ ID NO: 660445 - RNA, 64 nt, hsa
uggagcggguugcuuggggggcguuggccgacuucuuagagaaggcccuccaugugacuuccuc

SEQ ID NO: 660446 - RNA, 64 nt, hsa; identical to SEQ ID NO: 53018

SEQ ID NO: 660447 - RNA, 64 nt, hsa; identical to SEQ ID NO: 53019

SEQ ID NO: 660448 - RNA, 64 nt, hsa; identical to SEQ ID NO: 53020

SEQ ID NO: 660449 - RNA, 64 nt, hsa; identical to SEQ ID NO: 53021

SEQ ID NO: 660450 - RNA, 64 nt, hsa; identical to SEQ ID NO: 53022

SEQ ID NO: 660451 - RNA, 64 nt, hsa; identical to SEQ ID NO: 53023

SEQ ID NO: 660452 - RNA, 64 nt, hsa; identical to SEQ ID NO: 53024

SEQ ID NO: 660453 - RNA, 64 nt, hsa; identical to SEQ ID NO: 53025

SEQ ID NO: 660454 - RNA, 64 nt, hsa; identical to SEQ ID NO: 53026

SEQ ID NO: 660455 - RNA, 64 nt, hsa; identical to SEQ ID NO: 53027

SEQ ID NO: 660456 - RNA, 64 nt, hsa; identical to SEQ ID NO: 53028

SEQ ID NO: 660457 - RNA, 64 nt, hsa; identical to SEQ ID NO: 53029

SEQ ID NO: 660458 - RNA, 64 nt, hsa; identical to SEQ ID NO: 53030

SEQ ID NO: 660459 - RNA, 64 nt, hsa; identical to SEQ ID NO: 53031

SEQ ID NO: 660460 - RNA, 64 nt, hsa; identical to SEQ ID NO: 53032

SEQ ID NO: 660461 - RNA, 64 nt, hsa; identical to SEQ ID NO: 53033

SEQ ID NO: 660462 - RNA, 64 nt, hsa; identical to SEQ ID NO: 53034

SEQ ID NO: 660463 - RNA, 64 nt, hsa; identical to SEQ ID NO: 53035

SEQ ID NO: 660464 - RNA, 64 nt, hsa; identical to SEQ ID NO: 53036

SEQ ID NO: 660465 - RNA, 64 nt, hsa; identical to SEQ ID NO: 53037

SEQ ID NO: 660466 - RNA, 64 nt, hsa; identical to SEQ ID NO: 53038

SEQ ID NO: 660467 - RNA, 64 nt, hsa; identical to SEQ ID NO: 53039

SEQ ID NO: 660468 - RNA, 64 nt, hsa; identical to SEQ ID NO: 53040

SEQ ID NO: 660469 - RNA, 64 nt, hsa; identical to SEQ ID NO: 53041

SEQ ID NO: 660470 - RNA, 64 nt, hsa; identical to SEQ ID NO: 53042

SEQ ID NO: 660471 - RNA, 64 nt, hsa; identical to SEQ ID NO: 53043

SEQ ID NO: 660472 - RNA, 64 nt, hsa; identical to SEQ ID NO: 53044

SEQ ID NO: 660473 - RNA, 64 nt, hsa; identical to SEQ ID NO: 53045

SEQ ID NO: 660474 - RNA, 64 nt, hsa; identical to SEQ ID NO: 53046

SEQ ID NO: 660475 - RNA, 64 nt, hsa; identical to SEQ ID NO: 53047

SEQ ID NO: 660476 - RNA, 64 nt, hsa; identical to SEQ ID NO: 53048

SEQ ID NO: 660477 - RNA, 64 nt, hsa; identical to SEQ ID NO: 53049

SEQ ID NO: 660478 - RNA, 64 nt, hsa; identical to SEQ ID NO: 53050

SEQ ID NO: 660479 - RNA, 64 nt, hsa; identical to SEQ ID NO: 53051

SEQ ID NO: 660480 - RNA, 64 nt, hsa; identical to SEQ ID NO: 53052

SEQ ID NO: 660481 - RNA, 64 nt, hsa; identical to SEQ ID NO: 53053

SEQ ID NO: 660482 - RNA, 64 nt, hsa; identical to SEQ ID NO: 53054

SEQ ID NO: 660483 - RNA, 64 nt, hsa; identical to SEQ ID NO: 53055

SEQ ID NO: 660484 - RNA, 64 nt, hsa; identical to SEQ ID NO: 53056

SEQ ID NO: 660485 - RNA, 64 nt, hsa; identical to SEQ ID NO: 53057

SEQ ID NO: 660486 - RNA, 64 nt, hsa; identical to SEQ ID NO: 53058

SEQ ID NO: 660487 - RNA, 64 nt, hsa; identical to SEQ ID NO: 53059

SEQ ID NO: 660488 - RNA, 64 nt, hsa
gcucccagcucgcuguagccuuggagagggaagugauggaaaaagaauauagcagcuuauuagg

SEQ ID NO: 660489 - RNA, 64 nt, hsa
cuagagguuggaaagagaagagaggcugggagcggauggaaagcaugacugcaucuggagcccc

SEQ ID NO: 660490 - RNA, 64 nt, hsa
gaagcacuacaccuugccuugcuguuuguccugagauggaaaaguguccuucuugcucccccuc

SEQ ID NO: 660491 - RNA, 64 nt, hsa
acagggagggaagaaugaacacuccccauuaacagauggaaaaacugaggcuuagagauagaca

SEQ ID NO: 660492 - RNA, 64 nt, hsa
gauacugcugcgucauuacagggcacaggccauggauggaaaacgcucucuacucugcuuuuuu

SEQ ID NO: 660493 - RNA, 64 nt, hsa
ugccucccuggugagagggccgggcagaggggcagauggaaaggagccuaggccaggugcaacc

SEQ ID NO: 660494 - RNA, 64 nt, hsa
uucuuuuucuuuauagauaugaugccagcaaagggauggaaagucuagaggacaccuuuguauc

SEQ ID NO: 660495 - RNA, 64 nt, hsa
ugaauuaauagaggccuuauuagaguggauuguggauggaaagcacuccuacccuccagguaac

SEQ ID NO: 660496 - RNA, 64 nt, hsa
cucugcaucuccugucuuuucagguuugucaucagauggaaauauuuugauaauaaauugaaau

SEQ ID NO: 660497 - RNA, 64 nt, hsa
caugcugcaguguucgaguggauuguaggugcaagauggaaaggauuguaggugcaagcugucc

SEQ ID NO: 660498 - RNA, 64 nt, hsa
gaaauaaagagucuguuuuugcucaaaccaucaggauggaaacagucaggcacugacuggggug

SEQ ID NO: 660499 - RNA, 64 nt, hsa
aaaugaaacggauugcagagggaauaaauacaaagauggaaagccaguaaagaagucaguauag

SEQ ID NO: 660500 - RNA, 64 nt, hsa
uuuucccccuuucuagcuccaagaggaaaacgaggauggaaaaccuuuuaugcuguacugaagg

SEQ ID NO: 660501 - RNA, 64 nt, hsa
uggauucuuggcucggaaaauucaugcagauauggauggaaagaagaguaaguaucaugcguug

SEQ ID NO: 660502 - RNA, 64 nt, hsa
caucugugcacaccauccauuccgcucgcugagcgauggaaaagcuugccuggaagacuaugug

SEQ ID NO: 660503 - RNA, 64 nt, hsa
uugugcagcuguugguuuucauguagugcccugcgauggaaauuagauauauuucauguauuuu

SEQ ID NO: 660504 - RNA, 64 nt, hsa
cuguacguuaccucuuaacaauuucuguccuucagauggaaacucuuuaacuucucguaaaagu

SEQ ID NO: 660505 - RNA, 64 nt, hsa
gugcagguuuguuacauagguauauauaugccaugauggaaauauuuauuuuuuuaagcguaau

SEQ ID NO: 660506 - RNA, 64 nt, hsa
uucauuuaugguaaacaucuugggcaaacccaaagauggaaagugcuuguuggguggguaagca

SEQ ID NO: 660507 - RNA, 64 nt, hsa
aaaucugugucucuguguguauaacaaagaggaagauggaaacaauguucauggaaacugcugu

SEQ ID NO: 660508 - RNA, 64 nt, hsa
uguguuuuggcagaugagcuuucagcugaggccugauggaaauugagauaaccugcaaagacau

SEQ ID NO: 660509 - RNA, 64 nt, hsa
aaauguauuuuugcccugaauuaaguguuaauuugauggaaacucugcuuuuaaaaucaucauu

SEQ ID NO: 660510 - RNA, 64 nt, hsa
auacuucucaccucuacuuagcccauucuuguaggauggaaauauuugagaacuacugaguuag

SEQ ID NO: 660511 - RNA, 64 nt, hsa
augcuacuaucauucacgauggccaugaggagaagauggaaaauggucagaucacaccugaugg

SEQ ID NO: 660512 - RNA, 64 nt, hsa
aaauacauuuuuaaaagaaaacugagaccaaucagauggaaauggaguuuuaaggcaagaggcc

SEQ ID NO: 660513 - RNA, 64 nt, hsa
auagaaggcuuguuggugguggugauguuaaacugauggaaauucuuuuucgccuuagugguga

SEQ ID NO: 660514 - RNA, 64 nt, hsa
guuugagacuagccugggcaacauagugagaccccaucucuauuuaaaaaaugaacaaaauuac

SEQ ID NO: 660515 - RNA, 64 nt, hsa
uuuaaaccacuaaccagaaacauuacuuuggaugcaucucuaauaccauguuugagcaccucug

SEQ ID NO: 660516 - RNA, 64 nt, hsa
cuucggaggggacuucauguuccguguacguuugcaucucuauuuauaccucuguccugcuagg

SEQ ID NO: 660517 - RNA, 64 nt, hsa
auuugagaccagccuaggugacauagugagaccccaucucuacaaaaaauaaaaaauuaaccag

SEQ ID NO: 660518 - RNA, 64 nt, hsa
ggccuagaccagccugggcaacauggugaaaccccaucucuacaaaaaauuuuuaaaaaguugg

SEQ ID NO: 660519 - RNA, 64 nt, hsa
gaucaagaccauccuggccaacauggugaaaccccaucucuacugaauacacaaaaauuggcug

SEQ ID NO: 660520 - RNA, 64 nt, hsa
ggugguucuuugguuuuuuguguguuuuccccuucaucucuaccugugaaagugaaauucuauu

SEQ ID NO: 660521 - RNA, 64 nt, hsa
gguuuaacagacaaaauaaacuuacucuaguuuccaucucuaucauuuuauaauaaccguagcc

SEQ ID NO: 660522 - RNA, 64 nt, hsa
caaggacugcuguguguggguguguuccucagaccaucucuacucuuuuugguuaggacacuag

SEQ ID NO: 660523 - RNA, 64 nt, hsa
acacccucugccuaggaggcuguaugccagagcucaucucuagcaaggaauuuaucuucaggug

SEQ ID NO: 660524 - RNA, 64 nt, hsa
aaaaccaccaaagaucaguuauaggauaaaauggcaucucuaaccauaacacaggagaauugga

SEQ ID NO: 660525 - RNA, 64 nt, hsa
guucaagaccaacaugggcaauguggcgaaacuccaucucuacaaaaaaugcaaaaauaaaaaa

SEQ ID NO: 660526 - RNA, 64 nt, hsa
auacuggguuucuguaaguuuuuccucauggcuucaucucuaucuuuacuuucucuugaauaug

SEQ ID NO: 660527 - RNA, 64 nt, hsa
uggaaucuucuuuaaaggaaggauaagacauugccaucucuauuuaacucauccauauggguca

SEQ ID NO: 660528 - RNA, 64 nt, hsa
ggaaucucagugcagagguccucagaggcuccagcaucucuaguacuaccugaaggcucuccua

SEQ ID NO: 660529 - RNA, 64 nt, hsa
cucuccucuguaaagcgagagggcuaaauggguccaucucuaggggccuucccucccaggucug

SEQ ID NO: 660530 - RNA, 64 nt, hsa
auaaccuaugcacauccuccuguauacuuuaaaucaucucuagauuacuuauaauaccuaauac

SEQ ID NO: 660531 - RNA, 64 nt, hsa
gaguuugagaccagccuggccaacauggcaaaaccaucucuacuaaaaauagaaaaauuagcca

SEQ ID NO: 660532 - RNA, 64 nt, hsa
aggucaggaguuucagaccaauauggugaaaccccaucucuacuaaaauuacaaaaaaaauuau

SEQ ID NO: 660533 - RNA, 64 nt, hsa
guucaagaccagccuggccaacauggugaaaccccaucucuacuaaaaauacaaaaaauuaggu

SEQ ID NO: 660534 - RNA, 64 nt, hsa
gccccgucaggggccaaacuuacuaccuugacuucaucucuagcugcagaaacacuaagucuca

SEQ ID NO: 660535 - RNA, 64 nt, hsa
guucgagaccagccagggcaacauggugaaaccccaucucuacuaaaauacaaaaaguuagcug

SEQ ID NO: 660536 - RNA, 64 nt, hsa
ccugcacuccagccugggcaacagagcgagacuccaucucuaaauaaauaaauaaauaaauaaa

SEQ ID NO: 660537 - RNA, 64 nt, hsa
guuugagaccaggcugggcaucauagcaagaccucaucucuacuaaaauucaaaaacaaaauua

SEQ ID NO: 660538 - RNA, 64 nt, hsa
uucaagaccagccuguccaacauggugaaacccccaucucuacuaaaaauaccaaaaauuagcc

SEQ ID NO: 660539 - RNA, 64 nt, hsa
guucaagaccagccuggccaacauggcaaaaucccaucucuacuaaaaauacaaaaauucacag

SEQ ID NO: 660540 - RNA, 64 nt, hsa
gaucgagaccauccugaccaacguggugaaaccccaucucuacuaaaaauagaaaaaucagcug

SEQ ID NO: 660541 - RNA, 64 nt, hsa
guucgagaccagccuggucaagauggugaaaccccaucucuacuaaaauuacaaaaauuagccg

SEQ ID NO: 660542 - RNA, 64 nt, hsa
guuugaaaccagccuggccaacauggugaaaccccaucucuacuaaaaaaacaaaacuagcugg

SEQ ID NO: 660543 - RNA, 64 nt, hsa
cucuuuguaauuuacuuuacuuguaugaauuuaacaucucuagcauguauccuuacuugauauu

SEQ ID NO: 660544 - RNA, 64 nt, hsa
guucgagaccagccugaccaacauggugaaacgccaucucuacuaaaaauacaaaaauuagccg

SEQ ID NO: 660545 - RNA, 64 nt, hsa
guuugaaaccagccuggacuacauggugaaacuccaucucuacuaaaaguacaaaaauuagcug

SEQ ID NO: 660546 - RNA, 64 nt, hsa
uucaagaccggccugagcaacauagugaggaucccaucucuacgcccacccuccccccggcaaa

SEQ ID NO: 660547 - RNA, 64 nt, hsa
gcucgagaccagccuggccaacacggugaaaccccaucucuacuaaaaaaaaauacaaaaauua

SEQ ID NO: 660548 - RNA, 64 nt, hsa
gcucaagaccagccuggccaacauggugaaaccccaucucuacuaaaaaaaaaaaaaaaauuag

SEQ ID NO: 660549 - RNA, 64 nt, hsa
guuccagaccagccuggccaacauggcgaaaccccaucucuacuaaaaauacaaaaauuagccg

SEQ ID NO: 660550 - RNA, 64 nt, hsa
guucgagaccagccuggccaauauggugaaaccccaucucuacuaaaaauauaaaaaucagcaa

SEQ ID NO: 660551 - RNA, 64 nt, hsa
gaucgagaccauccuggcuaacacagugaaaccccaucucuacuaaaaaaaaaaaaaaaaaaaa

SEQ ID NO: 660552 - RNA, 64 nt, hsa
cucaggcugcagcuuuauuagcuuauaacuuacucaucucuaucuuuaccagcaggcucuguau

SEQ ID NO: 660553 - RNA, 64 nt, hsa
guucgagaccauccugucuaacacggugaaaccccaucucuacuaaaaauacaaaaaaauuagu

SEQ ID NO: 660554 - RNA, 64 nt, hsa
guucaagaccagccuggccaacauggugaaaccccaucucuacuaaaaauacaaaaauuagcua

SEQ ID NO: 660555 - RNA, 64 nt, hsa
cuggcaaacaccccaucucuacuaagcgaaaacccaucucuacuaaaauuacaaaaauuagcug

SEQ ID NO: 660556 - RNA, 64 nt, hsa
agucaggaguucgggaccagccuggcaaacaccccaucucuacuaagcgaaaacccaucucuac

SEQ ID NO: 660557 - RNA, 64 nt, hsa
ccucacaggugcucugcucguggccccaaagaaccaucucuacuugccagaguauguuccacca

SEQ ID NO: 660558 - RNA, 64 nt, hsa
guuuauguacguaugagauuucaaguuaauaaaucaucucuauggcuauuuuccccaugugggu

SEQ ID NO: 660559 - RNA, 64 nt, hsa
ugaacuuaaauggaaauuaauuuauuguagacuacaucucuauuuggaaugaugagguaaaugu

SEQ ID NO: 660560 - RNA, 64 nt, hsa
cccugggguggacgauguuugaugauuagacggucaucucuaacuacuaaacuaauaucugcau

SEQ ID NO: 660561 - RNA, 64 nt, hsa
guucaacaccagccugagcaacaugguaaaaccccaucucuaccaaaaauacaaaaauuagcug

SEQ ID NO: 660562 - RNA, 64 nt, hsa
guuugggaccagccugggcaacauagggggaucccaucucuacacacaaaaaaauuuuuuaaug

SEQ ID NO: 660563 - RNA, 64 nt, hsa
guuugagaccacccuggccaacauggugaaaccccaucucuacuaaaacaaaaauuagccaggc

SEQ ID NO: 660564 - RNA, 64 nt, hsa
guucgagaccagccuggccaacauagugaaaccccaucucuacuaaaaauacagaaauuagccg

SEQ ID NO: 660565 - RNA, 64 nt, hsa
ucuaaccacuccugggcuaaggaguaaccucccucaucucuaacugcccccacggggccagggc

SEQ ID NO: 660566 - RNA, 64 nt, hsa
ucuaacaccuccuagaggccaaggcuuaaacaggcaucucuaccagccccacugucucuaacca

SEQ ID NO: 660567 - RNA, 64 nt, hsa
guucaagagcacccuggcuaacauggugaaaccccaucucuacuaaaaauacaaaaguuagccg

SEQ ID NO: 660568 - RNA, 64 nt, hsa
gaucgagaccguccuggcuaacacggugaaaccccaucucuacuaaaaauauaaaauauuagcc

SEQ ID NO: 660569 - RNA, 64 nt, hsa
guucaagaccagccugggcaacauagugagaccccaucucuacuuaaaauaaagaagauaaaaa

SEQ ID NO: 660570 - RNA, 64 nt, hsa
aaacaagaucagccugugcaacauggugaaaccucaucucuaccaacaaaacaaaaaaacacaa

SEQ ID NO: 660571 - RNA, 64 nt, hsa
gaucgagaccagccuggccaacguggugaaaccccaucucuacuaaaaauacaaaaauuagccg

SEQ ID NO: 660572 - RNA, 64 nt, hsa
aagaucaaccaaccuggguaacauggccagaccccaucucuauuuauauauauauauauaaaac

SEQ ID NO: 660573 - RNA, 64 nt, hsa
uucgagaccagccuggccaacauggcaaaacccccaucucuacuaaaauacaaaaauuaggugu

SEQ ID NO: 660574 - RNA, 64 nt, hsa
guucgagaccgaccugggcagcauagcgagaccccaucucuauauaaaaaaaaagauguuaaaa

SEQ ID NO: 660575 - RNA, 64 nt, hsa
guuggagaccagucugggaaacguggugagaccucaucucuacaaaauacaaaaaaauuagccg

SEQ ID NO: 660576 - RNA, 64 nt, hsa
guucaagaccagccuggccaacauggugaaaccccaucucuacuaaaaauacaaaaauuagcug

SEQ ID NO: 660577 - RNA, 64 nt, hsa
uuugagaacuggccuggccaacauagcaaaaccucaucucuacuaaaauacaaaaauuagccgg

SEQ ID NO: 660578 - RNA, 64 nt, hsa
gcccaggaguucaauaccugucugggaaacaccucaucucuacaaaauacaaaaaaguuaacug

SEQ ID NO: 660579 - RNA, 64 nt, hsa
guuugagacuggccugggcagcauagcgagaccccaucucuauauaaaaaaaaagauguuaaaa

SEQ ID NO: 660580 - RNA, 64 nt, hsa; identical to SEQ ID NO: 415214

SEQ ID NO: 660581 - RNA, 64 nt, hsa; identical to SEQ ID NO: 415215

SEQ ID NO: 660582 - RNA, 64 nt, hsa; identical to SEQ ID NO: 415216

SEQ ID NO: 660583 - RNA, 64 nt, hsa; identical to SEQ ID NO: 415217

SEQ ID NO: 660584 - RNA, 64 nt, hsa; identical to SEQ ID NO: 415218

SEQ ID NO: 660585 - RNA, 64 nt, hsa; identical to SEQ ID NO: 415219

SEQ ID NO: 660586 - RNA, 64 nt, hsa; identical to SEQ ID NO: 415220

SEQ ID NO: 660587 - RNA, 64 nt, hsa; identical to SEQ ID NO: 415221

SEQ ID NO: 660588 - RNA, 55 nt, hsa; identical to SEQ ID NO: 415222

SEQ ID NO: 660589 - RNA, 64 nt, hsa; identical to SEQ ID NO: 415223

SEQ ID NO: 660590 - RNA, 64 nt, hsa; identical to SEQ ID NO: 415224

SEQ ID NO: 660591 - RNA, 64 nt, hsa; identical to SEQ ID NO: 415225

SEQ ID NO: 660592 - RNA, 64 nt, hsa; identical to SEQ ID NO: 415226

SEQ ID NO: 660593 - RNA, 64 nt, hsa; identical to SEQ ID NO: 415227

SEQ ID NO: 660594 - RNA, 64 nt, hsa; identical to SEQ ID NO: 415228

SEQ ID NO: 660595 - RNA, 50 nt, hsa; identical to SEQ ID NO: 415229

SEQ ID NO: 660596 - RNA, 64 nt, hsa; identical to SEQ ID NO: 415230

SEQ ID NO: 660597 - RNA, 64 nt, hsa; identical to SEQ ID NO: 415231

SEQ ID NO: 660598 - RNA, 64 nt, hsa; identical to SEQ ID NO: 415232

SEQ ID NO: 660599 - RNA, 64 nt, hsa; identical to SEQ ID NO: 415233

SEQ ID NO: 660600 - RNA, 64 nt, hsa; identical to SEQ ID NO: 415234

SEQ ID NO: 660601 - RNA, 64 nt, hsa; identical to SEQ ID NO: 415235

SEQ ID NO: 660602 - RNA, 64 nt, hsa; identical to SEQ ID NO: 415236

SEQ ID NO: 660603 - RNA, 64 nt, hsa; identical to SEQ ID NO: 415237

SEQ ID NO: 660604 - RNA, 64 nt, hsa; identical to SEQ ID NO: 415238

SEQ ID NO: 660605 - RNA, 64 nt, hsa; identical to SEQ ID NO: 415239

SEQ ID NO: 660606 - RNA, 64 nt, hsa; identical to SEQ ID NO: 415240

SEQ ID NO: 660607 - RNA, 64 nt, hsa; identical to SEQ ID NO: 415241

SEQ ID NO: 660608 - RNA, 64 nt, hsa; identical to SEQ ID NO: 415242

SEQ ID NO: 660609 - RNA, 64 nt, hsa; identical to SEQ ID NO: 415243

SEQ ID NO: 660610 - RNA, 64 nt, hsa; identical to SEQ ID NO: 415244

SEQ ID NO: 660611 - RNA, 64 nt, hsa; identical to SEQ ID NO: 415245

SEQ ID NO: 660612 - RNA, 64 nt, hsa; identical to SEQ ID NO: 415246

SEQ ID NO: 660613 - RNA, 64 nt, hsa; identical to SEQ ID NO: 415247

SEQ ID NO: 660614 - RNA, 64 nt, hsa; identical to SEQ ID NO: 415248

SEQ ID NO: 660615 - RNA, 64 nt, hsa; identical to SEQ ID NO: 415249

SEQ ID NO: 660616 - RNA, 64 nt, hsa; identical to SEQ ID NO: 415250

SEQ ID NO: 660617 - RNA, 64 nt, hsa; identical to SEQ ID NO: 415251

SEQ ID NO: 660618 - RNA, 64 nt, hsa; identical to SEQ ID NO: 415252

SEQ ID NO: 660619 - RNA, 64 nt, hsa; identical to SEQ ID NO: 415253

SEQ ID NO: 660620 - RNA, 64 nt, hsa; identical to SEQ ID NO: 415254

SEQ ID NO: 660621 - RNA, 64 nt, hsa; identical to SEQ ID NO: 415255

SEQ ID NO: 660622 - RNA, 64 nt, hsa; identical to SEQ ID NO: 415256

SEQ ID NO: 660623 - RNA, 64 nt, hsa; identical to SEQ ID NO: 370933

SEQ ID NO: 660624 - RNA, 64 nt, hsa; identical to SEQ ID NO: 370934

SEQ ID NO: 660625 - RNA, 64 nt, hsa; identical to SEQ ID NO: 370935

SEQ ID NO: 660626 - RNA, 64 nt, hsa; identical to SEQ ID NO: 370936

SEQ ID NO: 660627 - RNA, 64 nt, hsa; identical to SEQ ID NO: 370937

SEQ ID NO: 660628 - RNA, 64 nt, hsa; identical to SEQ ID NO: 370938

SEQ ID NO: 660629 - RNA, 64 nt, hsa; identical to SEQ ID NO: 370939

SEQ ID NO: 660630 - RNA, 64 nt, hsa; identical to SEQ ID NO: 370940

SEQ ID NO: 660631 - RNA, 64 nt, hsa; identical to SEQ ID NO: 370941

SEQ ID NO: 660632 - RNA, 64 nt, hsa; identical to SEQ ID NO: 370942

SEQ ID NO: 660633 - RNA, 64 nt, hsa; identical to SEQ ID NO: 370943

SEQ ID NO: 660634 - RNA, 64 nt, hsa; identical to SEQ ID NO: 370944

SEQ ID NO: 660635 - RNA, 64 nt, hsa; identical to SEQ ID NO: 370945

SEQ ID NO: 660636 - RNA, 58 nt, hsa; identical to SEQ ID NO: 370946

SEQ ID NO: 660637 - RNA, 64 nt, hsa; identical to SEQ ID NO: 370947

SEQ ID NO: 660638 - RNA, 64 nt, hsa; identical to SEQ ID NO: 370948

SEQ ID NO: 660639 - RNA, 64 nt, hsa; identical to SEQ ID NO: 370949

SEQ ID NO: 660640 - RNA, 64 nt, hsa; identical to SEQ ID NO: 370950

SEQ ID NO: 660641 - RNA, 64 nt, hsa; identical to SEQ ID NO: 370951

SEQ ID NO: 660642 - RNA, 64 nt, hsa; identical to SEQ ID NO: 370952

SEQ ID NO: 660643 - RNA, 64 nt, hsa; identical to SEQ ID NO: 370953

SEQ ID NO: 660644 - RNA, 64 nt, hsa; identical to SEQ ID NO: 370954

SEQ ID NO: 660645 - RNA, 64 nt, hsa; identical to SEQ ID NO: 370955

SEQ ID NO: 660646 - RNA, 64 nt, hsa; identical to SEQ ID NO: 370956

SEQ ID NO: 660647 - RNA, 64 nt, hsa; identical to SEQ ID NO: 370957

SEQ ID NO: 660648 - RNA, 64 nt, hsa; identical to SEQ ID NO: 370958

SEQ ID NO: 660649 - RNA, 64 nt, hsa; identical to SEQ ID NO: 370959

SEQ ID NO: 660650 - RNA, 64 nt, hsa; identical to SEQ ID NO: 370960

SEQ ID NO: 660651 - RNA, 64 nt, hsa; identical to SEQ ID NO: 370961

SEQ ID NO: 660652 - RNA, 64 nt, hsa; identical to SEQ ID NO: 370962

SEQ ID NO: 660653 - RNA, 64 nt, hsa; identical to SEQ ID NO: 370963

SEQ ID NO: 660654 - RNA, 64 nt, hsa; identical to SEQ ID NO: 370964

SEQ ID NO: 660655 - RNA, 64 nt, hsa; identical to SEQ ID NO: 370965

SEQ ID NO: 660656 - RNA, 64 nt, hsa; identical to SEQ ID NO: 370966

SEQ ID NO: 660657 - RNA, 64 nt, hsa; identical to SEQ ID NO: 370967

SEQ ID NO: 660658 - RNA, 64 nt, hsa; identical to SEQ ID NO: 370968

SEQ ID NO: 660659 - RNA, 64 nt, hsa; identical to SEQ ID NO: 370969

SEQ ID NO: 660660 - RNA, 64 nt, hsa; identical to SEQ ID NO: 370970

SEQ ID NO: 660661 - RNA, 64 nt, hsa; identical to SEQ ID NO: 370971

SEQ ID NO: 660662 - RNA, 64 nt, hsa; identical to SEQ ID NO: 370972

SEQ ID NO: 660663 - RNA, 64 nt, hsa; identical to SEQ ID NO: 370973

SEQ ID NO: 660664 - RNA, 64 nt, hsa; identical to SEQ ID NO: 370974

SEQ ID NO: 660665 - RNA, 64 nt, hsa; identical to SEQ ID NO: 370975

SEQ ID NO: 660666 - RNA, 64 nt, hsa; identical to SEQ ID NO: 370976

SEQ ID NO: 660667 - RNA, 64 nt, hsa; identical to SEQ ID NO: 370977

SEQ ID NO: 660668 - RNA, 64 nt, hsa; identical to SEQ ID NO: 370978

SEQ ID NO: 660669 - RNA, 64 nt, hsa; identical to SEQ ID NO: 370979

SEQ ID NO: 660670 - RNA, 64 nt, hsa; identical to SEQ ID NO: 370980

SEQ ID NO: 660671 - RNA, 64 nt, hsa; identical to SEQ ID NO: 370981

SEQ ID NO: 660672 - RNA, 64 nt, hsa; identical to SEQ ID NO: 370982

SEQ ID NO: 660673 - RNA, 64 nt, hsa; identical to SEQ ID NO: 370983

SEQ ID NO: 660674 - RNA, 64 nt, hsa; identical to SEQ ID NO: 370984

SEQ ID NO: 660675 - RNA, 64 nt, hsa; identical to SEQ ID NO: 370985

SEQ ID NO: 660676 - RNA, 64 nt, hsa; identical to SEQ ID NO: 370986

SEQ ID NO: 660677 - RNA, 64 nt, hsa; identical to SEQ ID NO: 370987

SEQ ID NO: 660678 - RNA, 64 nt, hsa; identical to SEQ ID NO: 370988

SEQ ID NO: 660679 - RNA, 64 nt, hsa; identical to SEQ ID NO: 108382

SEQ ID NO: 660680 - RNA, 64 nt, hsa; identical to SEQ ID NO: 108383

SEQ ID NO: 660681 - RNA, 64 nt, hsa; identical to SEQ ID NO: 108384

SEQ ID NO: 660682 - RNA, 64 nt, hsa; identical to SEQ ID NO: 108385

SEQ ID NO: 660683 - RNA, 64 nt, hsa; identical to SEQ ID NO: 108386

SEQ ID NO: 660684 - RNA, 64 nt, hsa; identical to SEQ ID NO: 108387

SEQ ID NO: 660685 - RNA, 64 nt, hsa; identical to SEQ ID NO: 108388

SEQ ID NO: 660686 - RNA, 64 nt, hsa; identical to SEQ ID NO: 108389

SEQ ID NO: 660687 - RNA, 64 nt, hsa; identical to SEQ ID NO: 108390

SEQ ID NO: 660688 - RNA, 64 nt, hsa; identical to SEQ ID NO: 108391

SEQ ID NO: 660689 - RNA, 64 nt, hsa; identical to SEQ ID NO: 108392

SEQ ID NO: 660690 - RNA, 64 nt, hsa; identical to SEQ ID NO: 108393

SEQ ID NO: 660691 - RNA, 64 nt, hsa; identical to SEQ ID NO: 108394

SEQ ID NO: 660692 - RNA, 64 nt, hsa; identical to SEQ ID NO: 108395

SEQ ID NO: 660693 - RNA, 64 nt, hsa
gguugaaaucugugcugugugugugugucucugcauguguaaaagaaggguaaaaaagagaugg

SEQ ID NO: 660694 - RNA, 64 nt, hsa
uuugaaaucugcacagaagcuguuuuagucauuaauguguaacaaaaguagcuuauagaauaug

SEQ ID NO: 660695 - RNA, 64 nt, hsa
uguuagaucuguagggacuuguacaacauuguggauguguaaacaggcaccacugcuuuaaaaa

SEQ ID NO: 660696 - RNA, 64 nt, hsa
uccagcaaacucuugcauguggccacuaggaggaauguguaagaauguucauaguuacauauuu

SEQ ID NO: 660697 - RNA, 64 nt, hsa
uaagaauuaucugcauuugucucguaacauaauaauguguaauaaagucuauagaaaauuaaaa

SEQ ID NO: 660698 - RNA, 64 nt, hsa
cuaaaaaccucuauucuaaacuaaucucauuuggauguguaagucuuuuguaaaggcaagaaua

SEQ ID NO: 660699 - RNA, 64 nt, hsa
aauagagcuaggaauuaagaaucaguugaguaaaauguguaauauuuauuccccauuaauaacu

SEQ ID NO: 660700 - RNA, 64 nt, hsa
ccuguaauuuccuucaauaugagagaaaauugagauguguaaaaaucuaguuacugccuguaaa

SEQ ID NO: 660701 - RNA, 64 nt, hsa
aacaaaaagaacaaaaaaaucugcagaaggaaaaauguguaauuuuguucuaguuuucaguuug

SEQ ID NO: 660702 - RNA, 64 nt, hsa
aaaacauuaagaaaaucauauugcuucuucuccuauguguaaggugaaccaugucagcaaaaag

SEQ ID NO: 660703 - RNA, 64 nt, hsa
uugucccagacuguuuguaaacaugaggucagacauguguaagguagacgccuauggccacugg

SEQ ID NO: 660704 - RNA, 64 nt, hsa
cucuuaggccacuaguuacuaguuguuuguugagauguguaagucacagugugccuguaaaaug

SEQ ID NO: 660705 - RNA, 64 nt, hsa
uggacagaggaaugccuguggucauaguuuugugauguguaacaguguauaauuacauacugaa

SEQ ID NO: 660706 - RNA, 64 nt, hsa
cuuuuacuuauugaaaggcauuuuagugugguuuauguguaauauuaaagauuauucaacaccu

SEQ ID NO: 660707 - RNA, 64 nt, hsa
guaauacauauuuuaaauucuaaaagcauacacaauguguaacugaaugguuugugaaaaauau

SEQ ID NO: 660708 - RNA, 64 nt, hsa
cacucuuaaugggagagcuauaaauggcagagcuauguguaaauauuuuaagagcaugcagcca

SEQ ID NO: 660709 - RNA, 64 nt, hsa
auguaaguuguacagugaaauaaguuauuaaagcauguguaaacauuguuauauaucuuuucuc

SEQ ID NO: 660710 - RNA, 50 nt, hsa
auguucuaaugacuuuuuaaauguguaacuuaauaagccuauuccaucac

SEQ ID NO: 660711 - RNA, 64 nt, hsa
gauaaaauguugugacuucauggcaaacagguggauguguaaaaauggaauaaaaaaaaaaaaa

SEQ ID NO: 660712 - RNA, 64 nt, hsa
ucacuaacccguuuuauucuauuccuaucuguggauguguaaauggcuggggggccagcccugg

SEQ ID NO: 660713 - RNA, 64 nt, hsa
auguaguguuguaauaaacuguuuaauggggcugauguguaaagcuguucaaguuauuugaugu

SEQ ID NO: 660714 - RNA, 64 nt, hsa
aaauagagauuugacagacauagcaaucuagucaauguguaaggggucaaaaaaacagagguuu

SEQ ID NO: 660715 - RNA, 64 nt, hsa
uuuuaacacauaaguaaaaacccguacauauuugauguguaaugcagguuaauuacaacacaga

SEQ ID NO: 660716 - RNA, 64 nt, hsa
uugagcuuaaggcaaaaggccugguuuuagagauauguguaauuggaagagggcauuuguuuga

SEQ ID NO: 660717 - RNA, 64 nt, hsa
aagguccaaguaaaaugagguaugauuuauguugauguguaaguucaccgcacaucccacuuuu

SEQ ID NO: 660718 - RNA, 64 nt, hsa
uuaaauguacaagauacaugaaauauuaaagaaaauguguaacuuuuuguguaaauacaucuug

SEQ ID NO: 660719 - RNA, 64 nt, hsa
uaaauuuagagagaaugccgcucuguuuaaagcaauguguaaagaugaguuuuuuuaagcaugg

SEQ ID NO: 660720 - RNA, 64 nt, hsa
aaguacuuggagaaacugaggccucuuauguguaauguguaaguuaagugagccauauauuuuc

SEQ ID NO: 660721 - RNA, 64 nt, hsa
aaugugaaaguacuuggagaaacugaggccucuuauguguaauguguaaguuaagugagccaua

SEQ ID NO: 660722 - RNA, 64 nt, hsa
uuuguacaggugagaagccuaaugaaagcccgauauguguaaagaucuacucucacaauauacu

SEQ ID NO: 660723 - RNA, 64 nt, hsa
uucauaccagugugaaacccuaugaauguaaggaauguguaaagaccuuuacuuggcuuucaaa

SEQ ID NO: 660724 - RNA, 64 nt, hsa
ucaaaaacacucagucaaaaauuuaaaaucuuaaauguguaagucacccccaccaaaaacaaaa

SEQ ID NO: 660725 - RNA, 64 nt, hsa
uggucugaagaagaaaaagaaauuuuauguauguauguguaaauauguguauauauuucuaucu

SEQ ID NO: 660726 - RNA, 64 nt, hsa
gucugcccuuuggcccaaaauuuaugucugucucauguguaaaagacauucaucccauccuaac

SEQ ID NO: 660727 - RNA, 64 nt, hsa
uguacuaccuaaaagucccagugcaugucucugaauguguaagcuauauaaaugcuauuuauau

SEQ ID NO: 660728 - RNA, 64 nt, hsa
agagaauggugguuucagagaucucucuucccaaauguguaaauauucuauaccagauaaguuu

SEQ ID NO: 660729 - RNA, 64 nt, hsa
gaucauuuuuauccuaggugauuuuuaaaugaaaauguguaaucuaaaauauaccagcgaauuu

SEQ ID NO: 660730 - RNA, 64 nt, hsa
aaacuguucaaaaagauuuugugaaauugcacagauguguaagcuuguugaacuucggccacga

SEQ ID NO: 660731 - RNA, 64 nt, hsa; identical to SEQ ID NO: 211620

SEQ ID NO: 660732 - RNA, 64 nt, hsa; identical to SEQ ID NO: 211621

SEQ ID NO: 660733 - RNA, 64 nt, hsa; identical to SEQ ID NO: 211622

SEQ ID NO: 660734 - RNA, 64 nt, hsa; identical to SEQ ID NO: 211623

SEQ ID NO: 660735 - RNA, 64 nt, hsa; identical to SEQ ID NO: 211624

SEQ ID NO: 660736 - RNA, 64 nt, hsa; identical to SEQ ID NO: 211625

SEQ ID NO: 660737 - RNA, 64 nt, hsa; identical to SEQ ID NO: 211626

SEQ ID NO: 660738 - RNA, 64 nt, hsa; identical to SEQ ID NO: 211627

SEQ ID NO: 660739 - RNA, 64 nt, hsa; identical to SEQ ID NO: 211628

SEQ ID NO: 660740 - RNA, 64 nt, hsa; identical to SEQ ID NO: 211629

SEQ ID NO: 660741 - RNA, 64 nt, hsa; identical to SEQ ID NO: 211630

SEQ ID NO: 660742 - RNA, 64 nt, hsa; identical to SEQ ID NO: 211631

SEQ ID NO: 660743 - RNA, 64 nt, hsa; identical to SEQ ID NO: 211632

SEQ ID NO: 660744 - RNA, 64 nt, hsa; identical to SEQ ID NO: 211633

SEQ ID NO: 660745 - RNA, 64 nt, hsa; identical to SEQ ID NO: 211634

SEQ ID NO: 660746 - RNA, 64 nt, hsa; identical to SEQ ID NO: 211635

SEQ ID NO: 660747 - RNA, 64 nt, hsa; identical to SEQ ID NO: 211636

SEQ ID NO: 660748 - RNA, 64 nt, hsa; identical to SEQ ID NO: 211637

SEQ ID NO: 660749 - RNA, 64 nt, hsa; identical to SEQ ID NO: 211638

SEQ ID NO: 660750 - RNA, 64 nt, hsa; identical to SEQ ID NO: 96939

SEQ ID NO: 660751 - RNA, 64 nt, hsa; identical to SEQ ID NO: 96940

SEQ ID NO: 660752 - RNA, 64 nt, hsa; identical to SEQ ID NO: 96941

SEQ ID NO: 660753 - RNA, 64 nt, hsa; identical to SEQ ID NO: 96942

SEQ ID NO: 660754 - RNA, 64 nt, hsa; identical to SEQ ID NO: 96943

SEQ ID NO: 660755 - RNA, 64 nt, hsa; identical to SEQ ID NO: 96944

SEQ ID NO: 660756 - RNA, 64 nt, hsa; identical to SEQ ID NO: 96945

SEQ ID NO: 660757 - RNA, 64 nt, hsa; identical to SEQ ID NO: 96946

SEQ ID NO: 660758 - RNA, 64 nt, hsa; identical to SEQ ID NO: 96947

SEQ ID NO: 660759 - RNA, 64 nt, hsa; identical to SEQ ID NO: 96948

SEQ ID NO: 660760 - RNA, 64 nt, hsa; identical to SEQ ID NO: 96949

SEQ ID NO: 660761 - RNA, 64 nt, hsa; identical to SEQ ID NO: 96950

SEQ ID NO: 660762 - RNA, 64 nt, hsa; identical to SEQ ID NO: 96951

SEQ ID NO: 660763 - RNA, 64 nt, hsa; identical to SEQ ID NO: 96952

SEQ ID NO: 660764 - RNA, 64 nt, hsa; identical to SEQ ID NO: 96953

SEQ ID NO: 660765 - RNA, 64 nt, hsa; identical to SEQ ID NO: 96954

SEQ ID NO: 660766 - RNA, 64 nt, hsa; identical to SEQ ID NO: 96955

SEQ ID NO: 660767 - RNA, 64 nt, hsa; identical to SEQ ID NO: 96956

SEQ ID NO: 660768 - RNA, 64 nt, hsa
cucaugcugccuccuaagugacuccgauuuucagcccugguagaauaaggaagacagcugaugc

SEQ ID NO: 660769 - RNA, 64 nt, hsa
acaggguggggcgggugagugaaaagguggaaaucccugguaccuugccuggugguuacacagu

SEQ ID NO: 660770 - RNA, 64 nt, hsa; identical to SEQ ID NO: 154299

SEQ ID NO: 660771 - RNA, 64 nt, hsa; identical to SEQ ID NO: 154300

SEQ ID NO: 660772 - RNA, 64 nt, hsa; identical to SEQ ID NO: 154301

SEQ ID NO: 660773 - RNA, 64 nt, hsa; identical to SEQ ID NO: 154302

SEQ ID NO: 660774 - RNA, 64 nt, hsa; identical to SEQ ID NO: 154303

SEQ ID NO: 660775 - RNA, 64 nt, hsa; identical to SEQ ID NO: 154304

SEQ ID NO: 660776 - RNA, 64 nt, hsa; identical to SEQ ID NO: 154305

SEQ ID NO: 660777 - RNA, 64 nt, hsa; identical to SEQ ID NO: 154306

SEQ ID NO: 660778 - RNA, 64 nt, hsa; identical to SEQ ID NO: 154307

SEQ ID NO: 660779 - RNA, 64 nt, hsa; identical to SEQ ID NO: 154308

SEQ ID NO: 660780 - RNA, 64 nt, hsa; identical to SEQ ID NO: 154309

SEQ ID NO: 660781 - RNA, 64 nt, hsa; identical to SEQ ID NO: 154310

SEQ ID NO: 660782 - RNA, 64 nt, hsa; identical to SEQ ID NO: 154311

SEQ ID NO: 660783 - RNA, 64 nt, hsa; identical to SEQ ID NO: 154312

SEQ ID NO: 660784 - RNA, 64 nt, hsa; identical to SEQ ID NO: 154313

SEQ ID NO: 660785 - RNA, 54 nt, hsa; identical to SEQ ID NO: 154314

SEQ ID NO: 660786 - RNA, 64 nt, hsa; identical to SEQ ID NO: 154315

SEQ ID NO: 660787 - RNA, 64 nt, hsa; identical to SEQ ID NO: 154316

SEQ ID NO: 660788 - RNA, 64 nt, hsa; identical to SEQ ID NO: 154317

SEQ ID NO: 660789 - RNA, 64 nt, hsa; identical to SEQ ID NO: 154318

SEQ ID NO: 660790 - RNA, 64 nt, hsa; identical to SEQ ID NO: 154319

SEQ ID NO: 660791 - RNA, 64 nt, hsa; identical to SEQ ID NO: 154320

SEQ ID NO: 660792 - RNA, 64 nt, hsa; identical to SEQ ID NO: 154321

SEQ ID NO: 660793 - RNA, 64 nt, hsa; identical to SEQ ID NO: 154322

SEQ ID NO: 660794 - RNA, 64 nt, hsa; identical to SEQ ID NO: 154323

SEQ ID NO: 660795 - RNA, 64 nt, hsa; identical to SEQ ID NO: 154324

SEQ ID NO: 660796 - RNA, 64 nt, hsa; identical to SEQ ID NO: 154325

SEQ ID NO: 660797 - RNA, 64 nt, hsa; identical to SEQ ID NO: 154326

SEQ ID NO: 660798 - RNA, 64 nt, hsa; identical to SEQ ID NO: 154327

SEQ ID NO: 660799 - RNA, 64 nt, hsa; identical to SEQ ID NO: 154328

SEQ ID NO: 660800 - RNA, 64 nt, hsa; identical to SEQ ID NO: 154329

SEQ ID NO: 660801 - RNA, 64 nt, hsa; identical to SEQ ID NO: 154330

SEQ ID NO: 660802 - RNA, 64 nt, hsa; identical to SEQ ID NO: 154331

SEQ ID NO: 660803 - RNA, 64 nt, hsa; identical to SEQ ID NO: 154332

SEQ ID NO: 660804 - RNA, 64 nt, hsa; identical to SEQ ID NO: 154333

SEQ ID NO: 660805 - RNA, 64 nt, hsa; identical to SEQ ID NO: 154334

SEQ ID NO: 660806 - RNA, 64 nt, hsa; identical to SEQ ID NO: 154335

SEQ ID NO: 660807 - RNA, 64 nt, hsa; identical to SEQ ID NO: 154336

SEQ ID NO: 660808 - RNA, 64 nt, hsa; identical to SEQ ID NO: 154337

SEQ ID NO: 660809 - RNA, 64 nt, hsa; identical to SEQ ID NO: 154338

SEQ ID NO: 660810 - RNA, 64 nt, hsa; identical to SEQ ID NO: 154339

SEQ ID NO: 660811 - RNA, 64 nt, hsa; identical to SEQ ID NO: 154340

SEQ ID NO: 660812 - RNA, 64 nt, hsa; identical to SEQ ID NO: 154341

SEQ ID NO: 660813 - RNA, 64 nt, hsa; identical to SEQ ID NO: 154342

SEQ ID NO: 660814 - RNA, 64 nt, hsa; identical to SEQ ID NO: 154343

SEQ ID NO: 660815 - RNA, 64 nt, hsa; identical to SEQ ID NO: 154344

SEQ ID NO: 660816 - RNA, 64 nt, hsa; identical to SEQ ID NO: 154345

SEQ ID NO: 660817 - RNA, 55 nt, hsa; identical to SEQ ID NO: 154346

SEQ ID NO: 660818 - RNA, 64 nt, hsa; identical to SEQ ID NO: 154347

SEQ ID NO: 660819 - RNA, 64 nt, hsa; identical to SEQ ID NO: 154348

SEQ ID NO: 660820 - RNA, 64 nt, hsa; identical to SEQ ID NO: 154349

SEQ ID NO: 660821 - RNA, 64 nt, hsa; identical to SEQ ID NO: 154350

SEQ ID NO: 660822 - RNA, 64 nt, hsa; identical to SEQ ID NO: 154351

SEQ ID NO: 660823 - RNA, 64 nt, hsa; identical to SEQ ID NO: 154352

SEQ ID NO: 660824 - RNA, 64 nt, hsa; identical to SEQ ID NO: 154353

SEQ ID NO: 660825 - RNA, 64 nt, hsa; identical to SEQ ID NO: 154354

SEQ ID NO: 660826 - RNA, 64 nt, hsa; identical to SEQ ID NO: 154355

SEQ ID NO: 660827 - RNA, 64 nt, hsa; identical to SEQ ID NO: 154356

SEQ ID NO: 660828 - RNA, 64 nt, hsa
gauggcagaacgaugccugcaggcauggaacuuuuuccguuaucacccaggccugauucacugg

SEQ ID NO: 660829 - RNA, 64 nt, hsa
agaaauggaauuuauauacaaaaauauuuuccauuuccguuauuaugcuaauuguuguaugaaa

SEQ ID NO: 660830 - RNA, 64 nt, hsa
cacuuaaaaugacucaauaaaaugacuugcuacguuccguuauucaauuugucauuacuguagu

SEQ ID NO: 660831 - RNA, 64 nt, hsa
uuucuaaaaucaguuuucguuaaaguacuucuacuuccguuauuggauaugguaucuccuaaag

SEQ ID NO: 660832 - RNA, 64 nt, hsa
aaaguuggaucacuaguggccagcauccccagaguuccguuaguaaacuuacuucauauguccc

SEQ ID NO: 660833 - RNA, 64 nt, hsa
ugcagcaucauguuguaauuaauuuuuuggaaguuuccguuaaauguaauauugcuucucuugu

SEQ ID NO: 660834 - RNA, 64 nt, hsa
caggagcuagcccagucccuggagcuguccuucauuccguuaggaauaacacugcagcccucuc

SEQ ID NO: 660835 - RNA, 64 nt, hsa
uagauguauuuaauauaauccuuacuuaaaauucuuccguuaccacccuugaaacaauuagcuu

SEQ ID NO: 660836 - RNA, 64 nt, hsa
accuauuuuuaaugaaacuucaaauagcaauaaguuccguuauauacuguggccugaaauaauu

SEQ ID NO: 660837 - RNA, 64 nt, hsa
uuauauaugauaauuuauauaaaaccacuaauuguuccguuaagcuucacagaaaauaaaaccu

SEQ ID NO: 660838 - RNA, 64 nt, hsa
ucccaguauucucagagcaugugucagaguguuguuccguuaaccuuuuuguaaauacugcuug

SEQ ID NO: 660839 - RNA, 64 nt, hsa
agcauuggucacaauguaccaacugcuuucugcauuccguuaaauaucaucuaacagucuaaaa

SEQ ID NO: 660840 - RNA, 64 nt, hsa
gacaggcacuaggacgucugccuuuuuaaggcaguuccguuaaggguuuuuguuuuuaaacuuu

SEQ ID NO: 660841 - RNA, 64 nt, hsa
cauucuugaacuuagaguauguaaauguaauaaauuccguuauccaggaguauaaauuauuugc

SEQ ID NO: 660842 - RNA, 64 nt, hsa
uuggcccgaaagcaguaaaaauuguucauuaaucuuccguuaggccaauaaaagaagggccuca

SEQ ID NO: 660843 - RNA, 64 nt, hsa
uaauuauuuuuucuauguucacaucagcauucacuuccguuaaauuugccaaaggaaacuguua

SEQ ID NO: 660844 - RNA, 64 nt, hsa
cuuauuccuaguuguagggacuccuauuuuuaccuuccguuacaguguugauucauaagaaaua

SEQ ID NO: 660845 - RNA, 64 nt, hsa
uuccacguuucuauagcaaccacauuugacuaauuuccguuaguugaauaagagguauuaugau

SEQ ID NO: 660846 - RNA, 64 nt, hsa
uuauguguuauaguuaauauaugcaccuaccuucuuccguuagugcaucaguaaauguguuauu

SEQ ID NO: 660847 - RNA, 64 nt, hsa
gauuuccuuccuguauuauacauauaauggaauguuccguuacaugugcguaccacacucuguu

SEQ ID NO: 660848 - RNA, 64 nt, hsa
auuacacuaaaaguauuauaguaacguauuguccuuccguuaacagaaacaucacaauucaaaa

SEQ ID NO: 660849 - RNA, 64 nt, hsa
agugacaacugaacacacuguguuggaucggagguuccguuaggggauccuuccuuaggcuuaa

SEQ ID NO: 660850 - RNA, 64 nt, hsa
uugacuuagcacugagagcuauuuaauaacuuuguuccguuaauuaguacuaauuaaguggaua

SEQ ID NO: 660851 - RNA, 64 nt, hsa
cuuaggaccugguaguuauuugcuugauuuuuuuuuccguuauuuucuacauaggcaaagagaa

SEQ ID NO: 660852 - RNA, 64 nt, hsa
ugguaugugccauuggguuggauguccccacuacuuccguuaacccuucccauugucaagaugu

SEQ ID NO: 660853 - RNA, 64 nt, hsa
uaaagaugugcaaccuaugcgcccccugcccuacuuccguuacccugagagucgguguguggcc

SEQ ID NO: 660854 - RNA, 64 nt, hsa
aggacaugaauggccuaaaacugauuuuuuuuuuuuccguuaaaaugugugugucaagauacgg

SEQ ID NO: 660855 - RNA, 64 nt, hsa
aauaacuccagauuucauaauuccaguuuuuacauuccguuaucuuucugguacaaccauuccc

SEQ ID NO: 660856 - RNA, 64 nt, hsa
ccccaucaggaccauuuuaucaaaguucguucauuuccguuaaccacauaacuaauaauuuaau

SEQ ID NO: 660857 - RNA, 64 nt, hsa
uuuuuaucgucacugcuuaacuucacauauugauuuccguuaaaauaccagccaguaaaugggg

SEQ ID NO: 660858 - RNA, 64 nt, hsa
cccuaaaaaaaaaauguagaauaucucuuaagauuuccguuaugguaaaaaccauaugcaauaa

SEQ ID NO: 660859 - RNA, 64 nt, hsa
aagaggaguggggguugggggcgcuccuuucuguuuccguuaggccacagacucuucaccuggc

SEQ ID NO: 660860 - RNA, 64 nt, hsa
cuucuuuuguauuaggcuguguauugauaguuaauuccguuaaaaauuacuuggaaaacagugg

SEQ ID NO: 660861 - RNA, 64 nt, hsa
ucuggggauuuuuuuccagccgaaggaaaaucacuuccguuaugucccccucuaauuuagccgc

SEQ ID NO: 660862 - RNA, 64 nt, hsa
auucuuaauucuguaaaagugaaauaaaauaacuuuccguuaauuauauauuuuugucaaaaca

SEQ ID NO: 660863 - RNA, 64 nt, hsa
gcuccaaagaagacaauaguucccacucaugauuuuccguuacaaacaggcagcuggggcaugg

SEQ ID NO: 660864 - RNA, 64 nt, hsa
gaagccccgcugcugagaugggcgcucccgacacagcgcagacccaccaggaggaaagaggccc

SEQ ID NO: 660865 - RNA, 64 nt, hsa
gugaauggugagggugggagucaggagacaagacagcgcagagagggcugguuagccggaaaag

SEQ ID NO: 660866 - RNA, 64 nt, hsa
uugcucccacauggucaggucucacccugcuugaagcgcagaaggcacagccuuacugaccagc

SEQ ID NO: 660867 - RNA, 64 nt, hsa
gucccuggcugaagggaauuaacagauaguaucaagcgcagaaggaaugugccaguauggcucc

SEQ ID NO: 660868 - RNA, 64 nt, hsa
ccuacuaacccuuuaacauacaguuuaggguccuagcgcagaguccuuguuuaaaggucauuga

SEQ ID NO: 660869 - RNA, 64 nt, hsa
ucaaggucacacaauuggauagugacauagcuagagcgcagaguuccugauuccaagucaccug

SEQ ID NO: 660870 - RNA, 64 nt, hsa
cucaggauggggaauagccaagaauggcagccucagcgcagaggcaaggucagaaagagacggc

SEQ ID NO: 660871 - RNA, 64 nt, hsa
ccuccaccuggaccagggagggccuccaugugcaagcgcagaggaagagacccucccauguacg

SEQ ID NO: 660872 - RNA, 64 nt, hsa
ucuccagcucucuuggcagggccuuuauuuaaagagcgcagagauuccuaugucucccuagugc

SEQ ID NO: 660873 - RNA, 64 nt, hsa
guuguugagucuguuuuguaaaguccccagagaaagcgcagaugcuagcacaugcccuaauguc

SEQ ID NO: 660874 - RNA, 64 nt, hsa
caacaaugccccgagugguggcagccaggagagcagcgcagaacagcccagaaaaggcggugcu

SEQ ID NO: 660875 - RNA, 64 nt, hsa
aaagacaccagccacucagaguucuauacuguaaagcgcagauaacauuuguguguuauaccuu

SEQ ID NO: 660876 - RNA, 64 nt, hsa
ucagagcugugagcggggggcgccguccaggccgagcgcagacuguuuaggacucagcagaccc

SEQ ID NO: 660877 - RNA, 64 nt, hsa
gaagucaauaauuuccagugagcgggaggcuucaagcgcagacccugggucccuagaccucgcc

SEQ ID NO: 660878 - RNA, 64 nt, hsa
ucccaccuccagggaggacgcuucgucuucggccagcgcagaccugguguuuguuuguugggcu

SEQ ID NO: 660879 - RNA, 64 nt, hsa
agggcccggggcggaggugcgaccgggcgucggcagcgcagaccucuuggccuucucucacagg

SEQ ID NO: 660880 - RNA, 64 nt, hsa
guaugccaucauggaagggguggcauugggauggagcgcagauauccaggcaagcauacuaaaa

SEQ ID NO: 660881 - RNA, 64 nt, hsa
auagcuuuucccuguccugacaccaggcaagaaaagcgcagagaaaucggugucugacgauuuu

SEQ ID NO: 660882 - RNA, 64 nt, hsa
gggcauucaggcaagugcaagugguucaggggccagcgcagagcagagugcugaguaaagaugu

SEQ ID NO: 660883 - RNA, 64 nt, hsa
cauuaacuggaucauugcuuccccagggcaggagagcgcagagcuagggaaagugaaagguaau

SEQ ID NO: 660884 - RNA, 64 nt, hsa
ucagcagggacagcacagacccucuggcuggggcagcgcagacccucuagcuggggcagaacaa

SEQ ID NO: 660885 - RNA, 64 nt, hsa
ugugcucuggugacccgaggaggucgugcagcacagcgcagaagccccugcccacgggauccgg

SEQ ID NO: 660886 - RNA, 64 nt, hsa
ccgcccaccacggcugugggaacuuccaggccucagcgcagagcccugcuuggggccagcacgg

SEQ ID NO: 660887 - RNA, 64 nt, hsa
cggcgccagagcugggcucuucaacacggcauuuagcgcagaaagucgugguucaggcaguaug

SEQ ID NO: 660888 - RNA, 64 nt, hsa
cuguuuuguccuuugagaaagaaauaauuguuugagcgcagaguaaaauaaggcuccuucaugu

SEQ ID NO: 660889 - RNA, 64 nt, hsa
cacgcuggaagcccacccaagccggcggggcccuagcgcagaaauucagaacccccuguccuga

SEQ ID NO: 660890 - RNA, 64 nt, hsa
acucgagagggggaggggguaaggagcgcaccaaagcgcagagcuugcugcccgccgcacgcac

SEQ ID NO: 660891 - RNA, 64 nt, hsa
uaagagguauuggauuuucacagaggaagaacacagcgcagaaugaagggccaggcuuacugag

SEQ ID NO: 660892 - RNA, 61 nt, hsa
gagaggcaguggcacacugaugggcgagcugagcgcagagcugcgaaggggaacuguuugc

SEQ ID NO: 660893 - RNA, 64 nt, hsa
ccagcuucccugaugucugcagccauggcuuugcagcgcagacagagcuucucugggaugcugg

SEQ ID NO: 660894 - RNA, 64 nt, hsa
gaccccagccuuccuggaacagggagucugcaggagcgcagacaggcacagcccuggagcaggc

SEQ ID NO: 660895 - RNA, 64 nt, hsa
cagcucagucagcccucggggacgagaaaccacaagcgcagagacgcugaggcccaggcaggug

SEQ ID NO: 660896 - RNA, 64 nt, hsa
guacauagaggaaaccugggcuagccccacccagagcgcagaggagggggcaccgacagcgcug

SEQ ID NO: 660897 - RNA, 64 nt, hsa
augacaaccugugaugucucacaguagagcacuuagcgcagaaucagguccccacggcuguugc

SEQ ID NO: 660898 - RNA, 64 nt, hsa
acaguucuggaugcugggaaguccaaguucaaggagcgcagauucaaugucuggugagggccca

SEQ ID NO: 660899 - RNA, 64 nt, hsa
cccuccucucccgcaggucugaaguuggccccccagcgcagaguagcugcuuccuggacgugcg

SEQ ID NO: 660900 - RNA, 64 nt, hsa
uccuugcgcucaccuugccagaaagucugguggcagcgcagagcccaaucauuccaaccaaagc

SEQ ID NO: 660901 - RNA, 64 nt, hsa
ggccugggugggggccggaaugagaccacaugagagcgcagagagguggguggucaggcccuga

SEQ ID NO: 660902 - RNA, 64 nt, hsa
aaagcauuauuacugauacuugcacacagucaaaagcgcagacuggauggauggucuuuuauaa

SEQ ID NO: 660903 - RNA, 64 nt, hsa
ccccaccuuuccgauagucuguuagaauuuuauuagcgcagauuccugggccaugccggguacc

SEQ ID NO: 660904 - RNA, 64 nt, hsa
ucagccgugggcccgggcgcggggaggccggcgcagcgcagagcgggcucgaagaaaauaauuc

SEQ ID NO: 660905 - RNA, 64 nt, hsa
aaaugcugcuuccauaucagcugcugcuagcgccagcgcagacucucagggagucaccacagcu

SEQ ID NO: 660906 - RNA, 64 nt, hsa
agccgcagccuuugggagggagaagagaaggaagagcgcagagccggcaaagugagaugcacgc

SEQ ID NO: 660907 - RNA, 64 nt, hsa
caugagaguacuagccuccuccacuccuccccacagcgcagaggaaacaggccagcccagugac

SEQ ID NO: 660908 - RNA, 64 nt, hsa
accccaucccucuggugugagccguggcagccgcagcgcagacuggcggagaaggagaggaacg

SEQ ID NO: 660909 - RNA, 64 nt, hsa
aacacuccaccgcgaucugccugcgggggaucucagcgcagagaaguugagaggacccaugaag

SEQ ID NO: 660910 - RNA, 64 nt, hsa
gucgagaaucgucagcuguaaguaggagcuacacagcgcagagaaaauggaaccacccauccgu

SEQ ID NO: 660911 - RNA, 64 nt, hsa
ccacacgcccgcggugaucccagccagggccccgagcgcagaggcggagcugugcucagcacag

SEQ ID NO: 660912 - RNA, 64 nt, hsa
gugcugcugcgcgcgcuucgccugugcgggagccagcgcagagcuuggcugcgccggggguucc

SEQ ID NO: 660913 - RNA, 64 nt, hsa
ccagacucccucauuuuaccaucaaggaaucucaagcgcagagagggagagaauucuccacaaa

SEQ ID NO: 660914 - RNA, 64 nt, hsa
acagaguguucuggcaaagaggaaaucccacagcagcgcagaggaccugggccuggaggggcag

SEQ ID NO: 660915 - RNA, 64 nt, hsa
ucaggaaagaggucggggcuggacagauggggagagcgcagauagauuuaagagaguccuguga

SEQ ID NO: 660916 - RNA, 64 nt, hsa
uggggacguggggcagccaccccugcccagcgagagcgcagacaccgugugaggggacagcagc

SEQ ID NO: 660917 - RNA, 64 nt, hsa
ccgcacagggaccgggaccgggaccgugagcgggagcgcagagagcggagccgggagcgagaca

SEQ ID NO: 660918 - RNA, 64 nt, hsa
auaccagcguguaacacggaacuuccaaaugcugagcgcagauccaaaguugucuucuguccac

SEQ ID NO: 660919 - RNA, 64 nt, hsa
gcacuuuaggagccccagacaggaggaucacuuaagcgcagaagaucaagaccagccugggaaa

SEQ ID NO: 660920 - RNA, 51 nt, hsa
gccuggagccugaccgcugagagcgcagacacccuucuucacacccgggac

SEQ ID NO: 660921 - RNA, 64 nt, hsa
ggguuuucuuggcuccccuguucaaaguggccacagcgcagaccgaagcaaaauucuuguauac

SEQ ID NO: 660922 - RNA, 64 nt, hsa
guugccacccacgugcccagcugucccacgcugcagcgcagacggccacgcccacacccggccu

SEQ ID NO: 660923 - RNA, 64 nt, hsa
aaauggaauucuguauuuauuauuauuuaaguguagcgcagaugugugugcuugggcguguuuc

SEQ ID NO: 660924 - RNA, 64 nt, hsa
uaguacuuucuuccugaugccaguucuucugggaagcgcagaauuucagauauauuuuaguaac

SEQ ID NO: 660925 - RNA, 64 nt, hsa
guuggggcuggcaggccacuggcaugugcugaguagcgcagagcuacccagugagaggccuugu

SEQ ID NO: 660926 - RNA, 64 nt, hsa
guuuuaacucuuggugacaguagaugcucucuggagcgcagacgaggcacaugugucuucauag

SEQ ID NO: 660927 - RNA, 64 nt, hsa
cuggggccgucugccuacacgcuccagaagggccagcgcagagcugggauggccacugagagcc

SEQ ID NO: 660928 - RNA, 64 nt, hsa
gggaccugaguuugggugggguggcaguuggcacagcgcagaugcgguagagaugggaggaaac

SEQ ID NO: 660929 - RNA, 64 nt, hsa
aagcacaacgggucauuuuccuuuguauguuccuagcgcagaacuguuucuaaaacaacuugaa

SEQ ID NO: 660930 - RNA, 64 nt, hsa
auaaauaggaugagguugaagaaaaguauauuggagcgcagauaaauauaaauuguggacugcu

SEQ ID NO: 660931 - RNA, 64 nt, hsa; identical to SEQ ID NO: 262453

SEQ ID NO: 660932 - RNA, 64 nt, hsa; identical to SEQ ID NO: 262454

SEQ ID NO: 660933 - RNA, 64 nt, hsa; identical to SEQ ID NO: 262455

SEQ ID NO: 660934 - RNA, 64 nt, hsa; identical to SEQ ID NO: 262456

SEQ ID NO: 660935 - RNA, 64 nt, hsa; identical to SEQ ID NO: 262457

SEQ ID NO: 660936 - RNA, 64 nt, hsa; identical to SEQ ID NO: 262458

SEQ ID NO: 660937 - RNA, 64 nt, hsa; identical to SEQ ID NO: 262459

SEQ ID NO: 660938 - RNA, 64 nt, hsa; identical to SEQ ID NO: 262460

SEQ ID NO: 660939 - RNA, 64 nt, hsa; identical to SEQ ID NO: 262461

SEQ ID NO: 660940 - RNA, 64 nt, hsa; identical to SEQ ID NO: 262462

SEQ ID NO: 660941 - RNA, 64 nt, hsa; identical to SEQ ID NO: 262463

SEQ ID NO: 660942 - RNA, 64 nt, hsa; identical to SEQ ID NO: 262464

SEQ ID NO: 660943 - RNA, 64 nt, hsa; identical to SEQ ID NO: 262465

SEQ ID NO: 660944 - RNA, 64 nt, hsa; identical to SEQ ID NO: 262466

SEQ ID NO: 660945 - RNA, 64 nt, hsa; identical to SEQ ID NO: 262467

SEQ ID NO: 660946 - RNA, 64 nt, hsa; identical to SEQ ID NO: 262468

SEQ ID NO: 660947 - RNA, 64 nt, hsa; identical to SEQ ID NO: 262469

SEQ ID NO: 660948 - RNA, 64 nt, hsa; identical to SEQ ID NO: 262470

SEQ ID NO: 660949 - RNA, 64 nt, hsa; identical to SEQ ID NO: 262471

SEQ ID NO: 660950 - RNA, 64 nt, hsa; identical to SEQ ID NO: 262472

SEQ ID NO: 660951 - RNA, 64 nt, hsa; identical to SEQ ID NO: 262473

SEQ ID NO: 660952 - RNA, 64 nt, hsa; identical to SEQ ID NO: 262474

SEQ ID NO: 660953 - RNA, 64 nt, hsa; identical to SEQ ID NO: 262475

SEQ ID NO: 660954 - RNA, 64 nt, hsa; identical to SEQ ID NO: 262476

SEQ ID NO: 660955 - RNA, 64 nt, hsa; identical to SEQ ID NO: 262477

SEQ ID NO: 660956 - RNA, 64 nt, hsa; identical to SEQ ID NO: 262478

SEQ ID NO: 660957 - RNA, 64 nt, hsa; identical to SEQ ID NO: 262479

SEQ ID NO: 660958 - RNA, 64 nt, hsa; identical to SEQ ID NO: 262480

SEQ ID NO: 660959 - RNA, 64 nt, hsa; identical to SEQ ID NO: 262481

SEQ ID NO: 660960 - RNA, 64 nt, hsa; identical to SEQ ID NO: 262482

SEQ ID NO: 660961 - RNA, 64 nt, hsa; identical to SEQ ID NO: 262483

SEQ ID NO: 660962 - RNA, 64 nt, hsa
aaccagcucauuucaacaaaggagcuccgaugugaggggcaaggcugcccccugccccagggcu

SEQ ID NO: 660963 - RNA, 64 nt, hsa
ugggcaagguugggacaaagccaucugggcagucaggggcaaggacuguuggaggagaguuagc

SEQ ID NO: 660964 - RNA, 64 nt, hsa
ccuggaugaaguuaucuggcuucaaauauuaugcaggggcaaacaccugcugauguggcaacug

SEQ ID NO: 660965 - RNA, 64 nt, hsa
uuccuagccaaguuuaagaggcaaguaaaaauauaggggcaaugucagaugaagucuuguucag

SEQ ID NO: 660966 - RNA, 64 nt, hsa
guuuugagcagaggacccuccaacuuauggcaucaggggcaaaaagucacagcuuaucccaggc

SEQ ID NO: 660967 - RNA, 64 nt, hsa
guccugcagccucauauggcucaauaaaacagaaaggggcaaguauagaagauuaggaugacua

SEQ ID NO: 660968 - RNA, 64 nt, hsa
augggacuuugggggcagugagagagagcuggaaaggggcaacccugagcagcaggugugcccc

SEQ ID NO: 660969 - RNA, 64 nt, hsa
agaaacuguucuucugguuccugcacaaccucagaggggcaaaaacccuccccaggaaggagga

SEQ ID NO: 660970 - RNA, 64 nt, hsa
aauuggggauccaggugucagagguaggggaaccaggggcaagcuggggcugagcuggaggugg

SEQ ID NO: 660971 - RNA, 64 nt, hsa
gggccgcuugggggagggaagaggcagcccggcgaggggcaagcgggggacccagccgggcugg

SEQ ID NO: 660972 - RNA, 64 nt, hsa
cugcucugagcccaucuguucucccccugcaagaaggggcaaugcucuuguguugucccucugu

SEQ ID NO: 660973 - RNA, 64 nt, hsa
ccccagagcgaaugagggcagagaugcccggggcaggggcaaacgcccuccgcucccucugcuc

SEQ ID NO: 660974 - RNA, 64 nt, hsa
aagcugcuugucaagaagcauuucccggcaagagaggggcaagucuggggcuccaacuggguac

SEQ ID NO: 660975 - RNA, 64 nt, hsa
gaauguccugggcuccuucaggagcucucuacccaggggcaaggagagcccagagagaagcgcc

SEQ ID NO: 660976 - RNA, 64 nt, hsa
guuccggcugugucugguggucuggcugcggggaaggggcaagaaggcgggcaggccuucacug

SEQ ID NO: 660977 - RNA, 64 nt, hsa
ugggagcugaugaagcaggugccagggcugugggaggggcaagcuacggccugggcuaggugag

SEQ ID NO: 660978 - RNA, 64 nt, hsa
augggaagaagccaggaaaaccucugaguguugaaggggcaacccaaggcaucacaguucacag

SEQ ID NO: 660979 - RNA, 64 nt, hsa
auucuugccuugaggcucugcaguggcaaaugguaggggcaauagcgcucccuuuucaccugaa

SEQ ID NO: 660980 - RNA, 66 nt, hsa; identical to SEQ ID NO: 551902

SEQ ID NO: 660981 - RNA, 66 nt, hsa; identical to SEQ ID NO: 551903

SEQ ID NO: 660982 - RNA, 66 nt, hsa; identical to SEQ ID NO: 551904

SEQ ID NO: 660983 - RNA, 66 nt, hsa; identical to SEQ ID NO: 551905

SEQ ID NO: 660984 - RNA, 66 nt, hsa; identical to SEQ ID NO: 551906

SEQ ID NO: 660985 - RNA, 66 nt, hsa; identical to SEQ ID NO: 551907

SEQ ID NO: 660986 - RNA, 66 nt, hsa; identical to SEQ ID NO: 551908

SEQ ID NO: 660987 - RNA, 66 nt, hsa; identical to SEQ ID NO: 551909

SEQ ID NO: 660988 - RNA, 66 nt, hsa; identical to SEQ ID NO: 551910

SEQ ID NO: 660989 - RNA, 66 nt, hsa; identical to SEQ ID NO: 551911

SEQ ID NO: 660990 - RNA, 66 nt, hsa; identical to SEQ ID NO: 551912

SEQ ID NO: 660991 - RNA, 66 nt, hsa; identical to SEQ ID NO: 551913

SEQ ID NO: 660992 - RNA, 66 nt, hsa; identical to SEQ ID NO: 551914

SEQ ID NO: 660993 - RNA, 66 nt, hsa; identical to SEQ ID NO: 551915

SEQ ID NO: 660994 - RNA, 66 nt, hsa; identical to SEQ ID NO: 551916

SEQ ID NO: 660995 - RNA, 66 nt, hsa; identical to SEQ ID NO: 551917

SEQ ID NO: 660996 - RNA, 66 nt, hsa; identical to SEQ ID NO: 551918

SEQ ID NO: 660997 - RNA, 66 nt, hsa; identical to SEQ ID NO: 551919

SEQ ID NO: 660998 - RNA, 66 nt, hsa; identical to SEQ ID NO: 551920

SEQ ID NO: 660999 - RNA, 66 nt, hsa; identical to SEQ ID NO: 551921

SEQ ID NO: 661000 - RNA, 66 nt, hsa; identical to SEQ ID NO: 551922

SEQ ID NO: 661001 - RNA, 66 nt, hsa; identical to SEQ ID NO: 551923

SEQ ID NO: 661002 - RNA, 66 nt, hsa; identical to SEQ ID NO: 551924

SEQ ID NO: 661003 - RNA, 66 nt, hsa; identical to SEQ ID NO: 551925

SEQ ID NO: 661004 - RNA, 66 nt, hsa; identical to SEQ ID NO: 551926

SEQ ID NO: 661005 - RNA, 66 nt, hsa; identical to SEQ ID NO: 551927

SEQ ID NO: 661006 - RNA, 66 nt, hsa; identical to SEQ ID NO: 551928

SEQ ID NO: 661007 - RNA, 66 nt, hsa; identical to SEQ ID NO: 551929

SEQ ID NO: 661008 - RNA, 66 nt, hsa; identical to SEQ ID NO: 551930

SEQ ID NO: 661009 - RNA, 66 nt, hsa; identical to SEQ ID NO: 551931

SEQ ID NO: 661010 - RNA, 66 nt, hsa; identical to SEQ ID NO: 551932

SEQ ID NO: 661011 - RNA, 66 nt, hsa; identical to SEQ ID NO: 551933

SEQ ID NO: 661012 - RNA, 66 nt, hsa; identical to SEQ ID NO: 551934

SEQ ID NO: 661013 - RNA, 64 nt, hsa; identical to SEQ ID NO: 219884

SEQ ID NO: 661014 - RNA, 64 nt, hsa; identical to SEQ ID NO: 219885

SEQ ID NO: 661015 - RNA, 64 nt, hsa; identical to SEQ ID NO: 219886

SEQ ID NO: 661016 - RNA, 64 nt, hsa; identical to SEQ ID NO: 219887

SEQ ID NO: 661017 - RNA, 64 nt, hsa; identical to SEQ ID NO: 219888

SEQ ID NO: 661018 - RNA, 64 nt, hsa; identical to SEQ ID NO: 219889

SEQ ID NO: 661019 - RNA, 64 nt, hsa; identical to SEQ ID NO: 219890

SEQ ID NO: 661020 - RNA, 64 nt, hsa; identical to SEQ ID NO: 219891

SEQ ID NO: 661021 - RNA, 64 nt, hsa; identical to SEQ ID NO: 219892

SEQ ID NO: 661022 - RNA, 64 nt, hsa; identical to SEQ ID NO: 219893

SEQ ID NO: 661023 - RNA, 64 nt, hsa; identical to SEQ ID NO: 219894

SEQ ID NO: 661024 - RNA, 64 nt, hsa; identical to SEQ ID NO: 219895

SEQ ID NO: 661025 - RNA, 64 nt, hsa; identical to SEQ ID NO: 219896

SEQ ID NO: 661026 - RNA, 64 nt, hsa; identical to SEQ ID NO: 219897

SEQ ID NO: 661027 - RNA, 64 nt, hsa; identical to SEQ ID NO: 614144

SEQ ID NO: 661028 - RNA, 64 nt, hsa; identical to SEQ ID NO: 614145

SEQ ID NO: 661029 - RNA, 64 nt, hsa; identical to SEQ ID NO: 614146

SEQ ID NO: 661030 - RNA, 64 nt, hsa; identical to SEQ ID NO: 614147

SEQ ID NO: 661031 - RNA, 64 nt, hsa; identical to SEQ ID NO: 614148

SEQ ID NO: 661032 - RNA, 64 nt, hsa; identical to SEQ ID NO: 614149

SEQ ID NO: 661033 - RNA, 64 nt, hsa; identical to SEQ ID NO: 614150

SEQ ID NO: 661034 - RNA, 64 nt, hsa; identical to SEQ ID NO: 614151

SEQ ID NO: 661035 - RNA, 64 nt, hsa; identical to SEQ ID NO: 614152

SEQ ID NO: 661036 - RNA, 64 nt, hsa; identical to SEQ ID NO: 614153

SEQ ID NO: 661037 - RNA, 64 nt, hsa; identical to SEQ ID NO: 614154

SEQ ID NO: 661038 - RNA, 64 nt, hsa; identical to SEQ ID NO: 614155

SEQ ID NO: 661039 - RNA, 64 nt, hsa; identical to SEQ ID NO: 614156

SEQ ID NO: 661040 - RNA, 64 nt, hsa; identical to SEQ ID NO: 614157

SEQ ID NO: 661041 - RNA, 64 nt, hsa; identical to SEQ ID NO: 614158

SEQ ID NO: 661042 - RNA, 64 nt, hsa; identical to SEQ ID NO: 614159

SEQ ID NO: 661043 - RNA, 64 nt, hsa; identical to SEQ ID NO: 614160

SEQ ID NO: 661044 - RNA, 64 nt, hsa; identical to SEQ ID NO: 614161

SEQ ID NO: 661045 - RNA, 64 nt, hsa; identical to SEQ ID NO: 614162

SEQ ID NO: 661046 - RNA, 64 nt, hsa; identical to SEQ ID NO: 614163

SEQ ID NO: 661047 - RNA, 64 nt, hsa; identical to SEQ ID NO: 614164

SEQ ID NO: 661048 - RNA, 64 nt, hsa; identical to SEQ ID NO: 614165

SEQ ID NO: 661049 - RNA, 64 nt, hsa; identical to SEQ ID NO: 614166

SEQ ID NO: 661050 - RNA, 64 nt, hsa; identical to SEQ ID NO: 614167

SEQ ID NO: 661051 - RNA, 64 nt, hsa; identical to SEQ ID NO: 614168

SEQ ID NO: 661052 - RNA, 64 nt, hsa; identical to SEQ ID NO: 614169

SEQ ID NO: 661053 - RNA, 64 nt, hsa; identical to SEQ ID NO: 614170

SEQ ID NO: 661054 - RNA, 64 nt, hsa; identical to SEQ ID NO: 614171

SEQ ID NO: 661055 - RNA, 64 nt, hsa; identical to SEQ ID NO: 614172

SEQ ID NO: 661056 - RNA, 64 nt, hsa; identical to SEQ ID NO: 614173

SEQ ID NO: 661057 - RNA, 64 nt, hsa; identical to SEQ ID NO: 614174

SEQ ID NO: 661058 - RNA, 64 nt, hsa; identical to SEQ ID NO: 614175

SEQ ID NO: 661059 - RNA, 64 nt, hsa
agagccccagauucccccuaagaagcaaaggaucgucuuuuaugccucuggcuaaggcagguuc

SEQ ID NO: 661060 - RNA, 64 nt, hsa
uaucaguauguaccuuuguaauuguuauuuuuaugucuuuuaugcccuugauuauuaguugggc

SEQ ID NO: 661061 - RNA, 64 nt, hsa
cuggugcuuaguacuguuuucccugcacguaggggucuuuuaaaaauauaaagcuugugauaaa

SEQ ID NO: 661062 - RNA, 64 nt, hsa
gccaagauaugcuguuggugccugauagggauuagucuuuuaggugcccuguucuccuaccaua

SEQ ID NO: 661063 - RNA, 64 nt, hsa
cuguuuuccuuuaguuuagaaauacauagacauugucuuuuaugaauucugaucauauuuaguc

SEQ ID NO: 661064 - RNA, 64 nt, hsa
auaaggcaccucccacuuuuauguauagaaagaggucuuuuaauuuuuuuuuaaugugagaagg

SEQ ID NO: 661065 - RNA, 64 nt, hsa
auaaauacagagcuuuauuauccugacgucuugggucuuuuaaguauauacuuuucugaaaggu

SEQ ID NO: 661066 - RNA, 64 nt, hsa
auuuuuuuuuuuuuaguaaucacuacuauaucaugucuuuuacucuguuuauaauaucaaguau

SEQ ID NO: 661067 - RNA, 64 nt, hsa
uuuuaccuucauuuuuagaugagguaaauguuuugucuuuuacuuaaggguacuaagcaagguc

SEQ ID NO: 661068 - RNA, 64 nt, hsa
ugggcucaaacaauucucagccuaaaacacuguugucuuuuaaaaugcuuccaacccaaaggcc

SEQ ID NO: 661069 - RNA, 64 nt, hsa
uggcuuucauuuuuauaguuauuauggaaauguugucuuuuauacuuaguuauauaagaaaaaa

SEQ ID NO: 661070 - RNA, 64 nt, hsa
uggucaaauccaacacuuggcuuaucaauauuaagucuuuuaccuaaaggcccagccgucacca

SEQ ID NO: 661071 - RNA, 64 nt, hsa
aauuauucucuuaaaagacaacauaacuuuuuaugucuuuuauuuacuuuuugguaauauuaac

SEQ ID NO: 661072 - RNA, 64 nt, hsa
gauaaaacauggacaauggcagaggacuuuuuuggucuuuuaguauugaacaugaaauuuguuc

SEQ ID NO: 661073 - RNA, 64 nt, hsa
gaguacuauaaaaugagggugccaaauauauugagucuuuuaugggauuaaaaguucuguugca

SEQ ID NO: 661074 - RNA, 64 nt, hsa
ccacaccucccuguccacuuuucagaaaaaccaugucuuuuaugcuauaaucauuccaaauuuu

SEQ ID NO: 661075 - RNA, 64 nt, hsa
ggugguuuauucucagaagaaaaagauauguaaggucuuuuagcuccuuagagugaagcaaaag

SEQ ID NO: 661076 - RNA, 64 nt, hsa
uuuguacucagaggaauuuuuuuuguuuuguuuugucuuuuaagaaaggaaagaaaggaugaaa

SEQ ID NO: 661077 - RNA, 64 nt, hsa
auagagauuucuuuggaguaauuaaauccauccugucuuuuacacaauggacaaaucaaguuaa

SEQ ID NO: 661078 - RNA, 64 nt, hsa
uucuguggcucauuuaaaagaaaaaaaagguuaagucuuuuaaauuuuggccuuguuuccaaau

SEQ ID NO: 661079 - RNA, 64 nt, hsa
uuugcucuugccauuuuaagguagcccucucaucgucuuuuaguuccaacaaagaaaggugcca

SEQ ID NO: 661080 - RNA, 64 nt, hsa
acguaggauauuuucccuaccuaagaauuucacugucuuuuaaaaaacaaaaaguaaaguaaug

SEQ ID NO: 661081 - RNA, 64 nt, hsa
guacuauauucuucuuaguccucaccucuuccuugucuuuuagaucuuaauuucaugcugauua

SEQ ID NO: 661082 - RNA, 64 nt, hsa
cuuuaaaccuuuaacuucaaacauuaaaauacaagucuuuuaaguacaugagugcuuagaaaug

SEQ ID NO: 661083 - RNA, 64 nt, hsa
ucauuuuagaaaaauggguuguuugaagaugaaagucuuuuaucuuuuuucacaauuuauuuug

SEQ ID NO: 661084 - RNA, 64 nt, hsa
uuuccuacaaaucagcguaguuacaaaggggucagucuuuuaaaauaaguauuuccuauuaaac

SEQ ID NO: 661085 - RNA, 64 nt, hsa; identical to SEQ ID NO: 313125

SEQ ID NO: 661086 - RNA, 64 nt, hsa; identical to SEQ ID NO: 313126

SEQ ID NO: 661087 - RNA, 64 nt, hsa; identical to SEQ ID NO: 313127

SEQ ID NO: 661088 - RNA, 64 nt, hsa; identical to SEQ ID NO: 313128

SEQ ID NO: 661089 - RNA, 64 nt, hsa; identical to SEQ ID NO: 313129

SEQ ID NO: 661090 - RNA, 64 nt, hsa; identical to SEQ ID NO: 313130

SEQ ID NO: 661091 - RNA, 64 nt, hsa; identical to SEQ ID NO: 313131

SEQ ID NO: 661092 - RNA, 64 nt, hsa; identical to SEQ ID NO: 313132

SEQ ID NO: 661093 - RNA, 64 nt, hsa; identical to SEQ ID NO: 313133

SEQ ID NO: 661094 - RNA, 64 nt, hsa; identical to SEQ ID NO: 313134

SEQ ID NO: 661095 - RNA, 64 nt, hsa; identical to SEQ ID NO: 313135

SEQ ID NO: 661096 - RNA, 51 nt, hsa; identical to SEQ ID NO: 313136

SEQ ID NO: 661097 - RNA, 64 nt, hsa; identical to SEQ ID NO: 313137

SEQ ID NO: 661098 - RNA, 64 nt, hsa; identical to SEQ ID NO: 313138

SEQ ID NO: 661099 - RNA, 64 nt, hsa; identical to SEQ ID NO: 313139

SEQ ID NO: 661100 - RNA, 64 nt, hsa; identical to SEQ ID NO: 313140

SEQ ID NO: 661101 - RNA, 64 nt, hsa; identical to SEQ ID NO: 313141

SEQ ID NO: 661102 - RNA, 64 nt, hsa; identical to SEQ ID NO: 313142

SEQ ID NO: 661103 - RNA, 64 nt, hsa; identical to SEQ ID NO: 313143

SEQ ID NO: 661104 - RNA, 64 nt, hsa; identical to SEQ ID NO: 313144

SEQ ID NO: 661105 - RNA, 64 nt, hsa; identical to SEQ ID NO: 313145

SEQ ID NO: 661106 - RNA, 64 nt, hsa; identical to SEQ ID NO: 313146

SEQ ID NO: 661107 - RNA, 64 nt, hsa; identical to SEQ ID NO: 313147

SEQ ID NO: 661108 - RNA, 64 nt, hsa; identical to SEQ ID NO: 313148

SEQ ID NO: 661109 - RNA, 64 nt, hsa; identical to SEQ ID NO: 313149

SEQ ID NO: 661110 - RNA, 64 nt, hsa; identical to SEQ ID NO: 313150

SEQ ID NO: 661111 - RNA, 64 nt, hsa; identical to SEQ ID NO: 313151

SEQ ID NO: 661112 - RNA, 64 nt, hsa; identical to SEQ ID NO: 517844

SEQ ID NO: 661113 - RNA, 64 nt, hsa; identical to SEQ ID NO: 517845

SEQ ID NO: 661114 - RNA, 64 nt, hsa; identical to SEQ ID NO: 517846

SEQ ID NO: 661115 - RNA, 64 nt, hsa; identical to SEQ ID NO: 517847

SEQ ID NO: 661116 - RNA, 64 nt, hsa; identical to SEQ ID NO: 517848

SEQ ID NO: 661117 - RNA, 64 nt, hsa; identical to SEQ ID NO: 517849

SEQ ID NO: 661118 - RNA, 64 nt, hsa; identical to SEQ ID NO: 517850

SEQ ID NO: 661119 - RNA, 64 nt, hsa; identical to SEQ ID NO: 517851

SEQ ID NO: 661120 - RNA, 64 nt, hsa; identical to SEQ ID NO: 313125

SEQ ID NO: 661121 - RNA, 64 nt, hsa; identical to SEQ ID NO: 313126

SEQ ID NO: 661122 - RNA, 64 nt, hsa; identical to SEQ ID NO: 313127

SEQ ID NO: 661123 - RNA, 64 nt, hsa; identical to SEQ ID NO: 313128

SEQ ID NO: 661124 - RNA, 64 nt, hsa; identical to SEQ ID NO: 313129

SEQ ID NO: 661125 - RNA, 64 nt, hsa; identical to SEQ ID NO: 313130

SEQ ID NO: 661126 - RNA, 64 nt, hsa; identical to SEQ ID NO: 313131

SEQ ID NO: 661127 - RNA, 64 nt, hsa; identical to SEQ ID NO: 313132

SEQ ID NO: 661128 - RNA, 64 nt, hsa; identical to SEQ ID NO: 313133

SEQ ID NO: 661129 - RNA, 64 nt, hsa; identical to SEQ ID NO: 313134

SEQ ID NO: 661130 - RNA, 64 nt, hsa; identical to SEQ ID NO: 313135

SEQ ID NO: 661131 - RNA, 51 nt, hsa; identical to SEQ ID NO: 313136

SEQ ID NO: 661132 - RNA, 64 nt, hsa; identical to SEQ ID NO: 313137

SEQ ID NO: 661133 - RNA, 64 nt, hsa; identical to SEQ ID NO: 313138

SEQ ID NO: 661134 - RNA, 64 nt, hsa; identical to SEQ ID NO: 313139

SEQ ID NO: 661135 - RNA, 64 nt, hsa; identical to SEQ ID NO: 313140

SEQ ID NO: 661136 - RNA, 64 nt, hsa; identical to SEQ ID NO: 313141

SEQ ID NO: 661137 - RNA, 64 nt, hsa; identical to SEQ ID NO: 313142

SEQ ID NO: 661138 - RNA, 64 nt, hsa; identical to SEQ ID NO: 313143

SEQ ID NO: 661139 - RNA, 64 nt, hsa; identical to SEQ ID NO: 313144

SEQ ID NO: 661140 - RNA, 64 nt, hsa; identical to SEQ ID NO: 313145

SEQ ID NO: 661141 - RNA, 64 nt, hsa; identical to SEQ ID NO: 313146

SEQ ID NO: 661142 - RNA, 64 nt, hsa; identical to SEQ ID NO: 313147

SEQ ID NO: 661143 - RNA, 64 nt, hsa; identical to SEQ ID NO: 313148

SEQ ID NO: 661144 - RNA, 64 nt, hsa; identical to SEQ ID NO: 313149

SEQ ID NO: 661145 - RNA, 64 nt, hsa; identical to SEQ ID NO: 313150

SEQ ID NO: 661146 - RNA, 64 nt, hsa; identical to SEQ ID NO: 313151

SEQ ID NO: 661147 - RNA, 64 nt, hsa; identical to SEQ ID NO: 517844

SEQ ID NO: 661148 - RNA, 64 nt, hsa; identical to SEQ ID NO: 517845

SEQ ID NO: 661149 - RNA, 64 nt, hsa; identical to SEQ ID NO: 517846

SEQ ID NO: 661150 - RNA, 64 nt, hsa; identical to SEQ ID NO: 517847

SEQ ID NO: 661151 - RNA, 64 nt, hsa; identical to SEQ ID NO: 517848

SEQ ID NO: 661152 - RNA, 64 nt, hsa; identical to SEQ ID NO: 517849

SEQ ID NO: 661153 - RNA, 64 nt, hsa; identical to SEQ ID NO: 517850

SEQ ID NO: 661154 - RNA, 64 nt, hsa; identical to SEQ ID NO: 517851

SEQ ID NO: 661155 - RNA, 64 nt, hsa; identical to SEQ ID NO: 563891

SEQ ID NO: 661156 - RNA, 64 nt, hsa; identical to SEQ ID NO: 563892

SEQ ID NO: 661157 - RNA, 64 nt, hsa; identical to SEQ ID NO: 563893

SEQ ID NO: 661158 - RNA, 64 nt, hsa; identical to SEQ ID NO: 563894

SEQ ID NO: 661159 - RNA, 64 nt, hsa; identical to SEQ ID NO: 563895

SEQ ID NO: 661160 - RNA, 64 nt, hsa; identical to SEQ ID NO: 563896

SEQ ID NO: 661161 - RNA, 64 nt, hsa; identical to SEQ ID NO: 563897

SEQ ID NO: 661162 - RNA, 64 nt, hsa; identical to SEQ ID NO: 563898

SEQ ID NO: 661163 - RNA, 64 nt, hsa; identical to SEQ ID NO: 563899

SEQ ID NO: 661164 - RNA, 64 nt, hsa; identical to SEQ ID NO: 563900

SEQ ID NO: 661165 - RNA, 64 nt, hsa; identical to SEQ ID NO: 563901

SEQ ID NO: 661166 - RNA, 64 nt, hsa; identical to SEQ ID NO: 563902

SEQ ID NO: 661167 - RNA, 64 nt, hsa; identical to SEQ ID NO: 563903

SEQ ID NO: 661168 - RNA, 64 nt, hsa; identical to SEQ ID NO: 563904

SEQ ID NO: 661169 - RNA, 64 nt, hsa; identical to SEQ ID NO: 563905

SEQ ID NO: 661170 - RNA, 64 nt, hsa; identical to SEQ ID NO: 563906

SEQ ID NO: 661171 - RNA, 64 nt, hsa; identical to SEQ ID NO: 563907

SEQ ID NO: 661172 - RNA, 64 nt, hsa; identical to SEQ ID NO: 563908

SEQ ID NO: 661173 - RNA, 64 nt, hsa; identical to SEQ ID NO: 563909

SEQ ID NO: 661174 - RNA, 64 nt, hsa; identical to SEQ ID NO: 563910

SEQ ID NO: 661175 - RNA, 64 nt, hsa; identical to SEQ ID NO: 563911

SEQ ID NO: 661176 - RNA, 64 nt, hsa; identical to SEQ ID NO: 563912

SEQ ID NO: 661177 - RNA, 64 nt, hsa; identical to SEQ ID NO: 563913

SEQ ID NO: 661178 - RNA, 64 nt, hsa; identical to SEQ ID NO: 563914

SEQ ID NO: 661179 - RNA, 64 nt, hsa; identical to SEQ ID NO: 563915

SEQ ID NO: 661180 - RNA, 64 nt, hsa; identical to SEQ ID NO: 563916

SEQ ID NO: 661181 - RNA, 64 nt, hsa; identical to SEQ ID NO: 563917

SEQ ID NO: 661182 - RNA, 64 nt, hsa; identical to SEQ ID NO: 563918

SEQ ID NO: 661183 - RNA, 64 nt, hsa; identical to SEQ ID NO: 563919

SEQ ID NO: 661184 - RNA, 64 nt, hsa; identical to SEQ ID NO: 563920

SEQ ID NO: 661185 - RNA, 64 nt, hsa; identical to SEQ ID NO: 563921

SEQ ID NO: 661186 - RNA, 64 nt, hsa; identical to SEQ ID NO: 563922

SEQ ID NO: 661187 - RNA, 64 nt, hsa; identical to SEQ ID NO: 563923

SEQ ID NO: 661188 - RNA, 64 nt, hsa; identical to SEQ ID NO: 563924

SEQ ID NO: 661189 - RNA, 64 nt, hsa; identical to SEQ ID NO: 563925

SEQ ID NO: 661190 - RNA, 64 nt, hsa; identical to SEQ ID NO: 563926

SEQ ID NO: 661191 - RNA, 64 nt, hsa; identical to SEQ ID NO: 563927

SEQ ID NO: 661192 - RNA, 64 nt, hsa; identical to SEQ ID NO: 563928

SEQ ID NO: 661193 - RNA, 64 nt, hsa; identical to SEQ ID NO: 563929

SEQ ID NO: 661194 - RNA, 64 nt, hsa; identical to SEQ ID NO: 138011

SEQ ID NO: 661195 - RNA, 64 nt, hsa; identical to SEQ ID NO: 138012

SEQ ID NO: 661196 - RNA, 64 nt, hsa; identical to SEQ ID NO: 138013

SEQ ID NO: 661197 - RNA, 64 nt, hsa; identical to SEQ ID NO: 138014

SEQ ID NO: 661198 - RNA, 64 nt, hsa; identical to SEQ ID NO: 138015

SEQ ID NO: 661199 - RNA, 59 nt, hsa; identical to SEQ ID NO: 138016

SEQ ID NO: 661200 - RNA, 64 nt, hsa; identical to SEQ ID NO: 138017

SEQ ID NO: 661201 - RNA, 64 nt, hsa; identical to SEQ ID NO: 138018

SEQ ID NO: 661202 - RNA, 64 nt, hsa; identical to SEQ ID NO: 138019

SEQ ID NO: 661203 - RNA, 64 nt, hsa; identical to SEQ ID NO: 138020

SEQ ID NO: 661204 - RNA, 64 nt, hsa; identical to SEQ ID NO: 138021

SEQ ID NO: 661205 - RNA, 64 nt, hsa; identical to SEQ ID NO: 138022

SEQ ID NO: 661206 - RNA, 64 nt, hsa; identical to SEQ ID NO: 138023

SEQ ID NO: 661207 - RNA, 64 nt, hsa; identical to SEQ ID NO: 138024

SEQ ID NO: 661208 - RNA, 64 nt, hsa; identical to SEQ ID NO: 138025

SEQ ID NO: 661209 - RNA, 64 nt, hsa; identical to SEQ ID NO: 138026

SEQ ID NO: 661210 - RNA, 64 nt, hsa; identical to SEQ ID NO: 138027

SEQ ID NO: 661211 - RNA, 64 nt, hsa; identical to SEQ ID NO: 138028

SEQ ID NO: 661212 - RNA, 64 nt, hsa; identical to SEQ ID NO: 138029

SEQ ID NO: 661213 - RNA, 64 nt, hsa; identical to SEQ ID NO: 138030

SEQ ID NO: 661214 - RNA, 64 nt, hsa; identical to SEQ ID NO: 138031

SEQ ID NO: 661215 - RNA, 64 nt, hsa; identical to SEQ ID NO: 138032

SEQ ID NO: 661216 - RNA, 64 nt, hsa; identical to SEQ ID NO: 138033

SEQ ID NO: 661217 - RNA, 64 nt, hsa; identical to SEQ ID NO: 138034

SEQ ID NO: 661218 - RNA, 64 nt, hsa; identical to SEQ ID NO: 138035

SEQ ID NO: 661219 - RNA, 64 nt, hsa; identical to SEQ ID NO: 138036

SEQ ID NO: 661220 - RNA, 64 nt, hsa; identical to SEQ ID NO: 138037

SEQ ID NO: 661221 - RNA, 64 nt, hsa; identical to SEQ ID NO: 138038

SEQ ID NO: 661222 - RNA, 64 nt, hsa; identical to SEQ ID NO: 138039

SEQ ID NO: 661223 - RNA, 64 nt, hsa; identical to SEQ ID NO: 138040

SEQ ID NO: 661224 - RNA, 64 nt, hsa; identical to SEQ ID NO: 138041

SEQ ID NO: 661225 - RNA, 64 nt, hsa; identical to SEQ ID NO: 138042

SEQ ID NO: 661226 - RNA, 64 nt, hsa; identical to SEQ ID NO: 138043

SEQ ID NO: 661227 - RNA, 64 nt, hsa; identical to SEQ ID NO: 138044

SEQ ID NO: 661228 - RNA, 64 nt, hsa; identical to SEQ ID NO: 138045

SEQ ID NO: 661229 - RNA, 64 nt, hsa; identical to SEQ ID NO: 138046

SEQ ID NO: 661230 - RNA, 64 nt, hsa; identical to SEQ ID NO: 138047

SEQ ID NO: 661231 - RNA, 64 nt, hsa; identical to SEQ ID NO: 138048

SEQ ID NO: 661232 - RNA, 64 nt, hsa; identical to SEQ ID NO: 138049

SEQ ID NO: 661233 - RNA, 64 nt, hsa; identical to SEQ ID NO: 138050

SEQ ID NO: 661234 - RNA, 64 nt, hsa; identical to SEQ ID NO: 138051

SEQ ID NO: 661235 - RNA, 64 nt, hsa; identical to SEQ ID NO: 138052

SEQ ID NO: 661236 - RNA, 64 nt, hsa; identical to SEQ ID NO: 138053

SEQ ID NO: 661237 - RNA, 64 nt, hsa; identical to SEQ ID NO: 138054

SEQ ID NO: 661238 - RNA, 64 nt, hsa; identical to SEQ ID NO: 138055

SEQ ID NO: 661239 - RNA, 64 nt, hsa; identical to SEQ ID NO: 138056

SEQ ID NO: 661240 - RNA, 64 nt, hsa; identical to SEQ ID NO: 138057

SEQ ID NO: 661241 - RNA, 64 nt, hsa; identical to SEQ ID NO: 138058

SEQ ID NO: 661242 - RNA, 64 nt, hsa; identical to SEQ ID NO: 138059

SEQ ID NO: 661243 - RNA, 64 nt, hsa; identical to SEQ ID NO: 138060

SEQ ID NO: 661244 - RNA, 64 nt, hsa; identical to SEQ ID NO: 138061

SEQ ID NO: 661245 - RNA, 64 nt, hsa; identical to SEQ ID NO: 138062

SEQ ID NO: 661246 - RNA, 64 nt, hsa; identical to SEQ ID NO: 138063

SEQ ID NO: 661247 - RNA, 64 nt, hsa; identical to SEQ ID NO: 138064

SEQ ID NO: 661248 - RNA, 64 nt, hsa; identical to SEQ ID NO: 138065

SEQ ID NO: 661249 - RNA, 64 nt, hsa; identical to SEQ ID NO: 138066

SEQ ID NO: 661250 - RNA, 64 nt, hsa; identical to SEQ ID NO: 433911

SEQ ID NO: 661251 - RNA, 64 nt, hsa; identical to SEQ ID NO: 433912

SEQ ID NO: 661252 - RNA, 64 nt, hsa; identical to SEQ ID NO: 433913

SEQ ID NO: 661253 - RNA, 64 nt, hsa; identical to SEQ ID NO: 433914

SEQ ID NO: 661254 - RNA, 64 nt, hsa; identical to SEQ ID NO: 433915

SEQ ID NO: 661255 - RNA, 64 nt, hsa; identical to SEQ ID NO: 433916

SEQ ID NO: 661256 - RNA, 64 nt, hsa; identical to SEQ ID NO: 433917

SEQ ID NO: 661257 - RNA, 64 nt, hsa; identical to SEQ ID NO: 433918

SEQ ID NO: 661258 - RNA, 64 nt, hsa; identical to SEQ ID NO: 433919

SEQ ID NO: 661259 - RNA, 64 nt, hsa; identical to SEQ ID NO: 433920

SEQ ID NO: 661260 - RNA, 64 nt, hsa; identical to SEQ ID NO: 433921

SEQ ID NO: 661261 - RNA, 64 nt, hsa; identical to SEQ ID NO: 433922

SEQ ID NO: 661262 - RNA, 64 nt, hsa; identical to SEQ ID NO: 433923

SEQ ID NO: 661263 - RNA, 61 nt, hsa; identical to SEQ ID NO: 433924

SEQ ID NO: 661264 - RNA, 64 nt, hsa; identical to SEQ ID NO: 433925

SEQ ID NO: 661265 - RNA, 60 nt, hsa; identical to SEQ ID NO: 433926

SEQ ID NO: 661266 - RNA, 64 nt, hsa; identical to SEQ ID NO: 433927

SEQ ID NO: 661267 - RNA, 64 nt, hsa; identical to SEQ ID NO: 433928

SEQ ID NO: 661268 - RNA, 64 nt, hsa; identical to SEQ ID NO: 433929

SEQ ID NO: 661269 - RNA, 64 nt, hsa; identical to SEQ ID NO: 433930

SEQ ID NO: 661270 - RNA, 64 nt, hsa; identical to SEQ ID NO: 433931

SEQ ID NO: 661271 - RNA, 64 nt, hsa; identical to SEQ ID NO: 433932

SEQ ID NO: 661272 - RNA, 64 nt, hsa; identical to SEQ ID NO: 433933

SEQ ID NO: 661273 - RNA, 64 nt, hsa; identical to SEQ ID NO: 433934

SEQ ID NO: 661274 - RNA, 64 nt, hsa; identical to SEQ ID NO: 433935

SEQ ID NO: 661275 - RNA, 64 nt, hsa; identical to SEQ ID NO: 433936

SEQ ID NO: 661276 - RNA, 64 nt, hsa; identical to SEQ ID NO: 433937

SEQ ID NO: 661277 - RNA, 64 nt, hsa; identical to SEQ ID NO: 433938

SEQ ID NO: 661278 - RNA, 64 nt, hsa; identical to SEQ ID NO: 433939

SEQ ID NO: 661279 - RNA, 64 nt, hsa; identical to SEQ ID NO: 433940

SEQ ID NO: 661280 - RNA, 64 nt, hsa; identical to SEQ ID NO: 433941

SEQ ID NO: 661281 - RNA, 64 nt, hsa; identical to SEQ ID NO: 433942

SEQ ID NO: 661282 - RNA, 64 nt, hsa
agaaaaugucagccacauuacugucuguguagugccaggugaaggguuaucagaaggcugguug

SEQ ID NO: 661283 - RNA, 64 nt, hsa
cugccacucuacccccagcccuacccaccagcccccaggugaggcuuccagcugggaccugccc

SEQ ID NO: 661284 - RNA, 64 nt, hsa
ccccaggcugggcucauucccaucgugagugagcccaggugaggacauagucggcucccguuug

SEQ ID NO: 661285 - RNA, 64 nt, hsa
cccccagaggcuuccccacccuccauugccuggcccaggugagcagcuuggcaggucuccaagu

SEQ ID NO: 661286 - RNA, 64 nt, hsa
ccaggcuacaccaucuucuuuagaaugagaacugccaggugacgcccucgcugcuccuaccugg

SEQ ID NO: 661287 - RNA, 64 nt, hsa
gcaggggcccagaacaccugcucucaccugagccccaggugaaggggcccgggaacaccugcuc

SEQ ID NO: 661288 - RNA, 64 nt, hsa
aaggggcccgggaacaccugcucucaccugagccccaggugaaggggcccgggaacaccugcuc

SEQ ID NO: 661289 - RNA, 64 nt, hsa
aaggggcccgggaacaccugcucucaccugaaccccaggugaaggggcccggaacaccugcucu

SEQ ID NO: 661290 - RNA, 64 nt, hsa
gaaggggcccggaacaccugcucucaccugagccccaggugaaggggcccggaacaccugcucu

SEQ ID NO: 661291 - RNA, 64 nt, hsa
gaaggggcccggaacaccugcucucaccugagccccaggugaaggggcccgggaacaccugcuc

SEQ ID NO: 661292 - RNA, 64 nt, hsa; identical to SEQ ID NO: 661288

SEQ ID NO: 661293 - RNA, 64 nt, hsa
aaggggcccgggaacaccugcucucaccugaaccccaggugaaggggcccagaacaccugcucu

SEQ ID NO: 661294 - RNA, 64 nt, hsa
gaaggggcccagaacaccugcucucaccugagccccaggugaaggggcccggaacaccugcucu

SEQ ID NO: 661295 - RNA, 64 nt, hsa; identical to SEQ ID NO: 661291

SEQ ID NO: 661296 - RNA, 64 nt, hsa
gaaggggcccggaacacuugcucucaccugagccccaggugaaggggcccggaacaccugcucu

SEQ ID NO: 661297 - RNA, 64 nt, hsa
gaaggggcccggaacacuugcucucaccugagccccaggugaaggggcccggaacaccuccucu

SEQ ID NO: 661298 - RNA, 64 nt, hsa
gaaggggcccggaacaccuccucucaccugagccccaggugaaggggcccggaacaccuccugu

SEQ ID NO: 661299 - RNA, 64 nt, hsa
gaaggggcccggaacaccuccugucaccugagccccaggugaaggggcccgggaacaccucuca

SEQ ID NO: 661300 - RNA, 64 nt, hsa
cauaaaaucuuaucuaugugcagcaugacucucuccaggugacagaaagggcucuagacagcug

SEQ ID NO: 661301 - RNA, 64 nt, hsa
cccaguguucagggaucucugaagaacccacagaccaggugaauuacugauuucuaaguccaaa

SEQ ID NO: 661302 - RNA, 64 nt, hsa
ugcaugcaggcccauguuucagccucagcccacgccaggugaaaggaucagcaaugcucuguug

SEQ ID NO: 661303 - RNA, 64 nt, hsa
gucucuucuguuccaaagccaggagagcugacuuccaggugaagggaugggaaaaguggacucu

SEQ ID NO: 661304 - RNA, 64 nt, hsa
aguuacugcacagcuucuguucucugucacaaccccaggugauuugguccggucaaaggccaua

SEQ ID NO: 661305 - RNA, 64 nt, hsa
cuaagaguguucaguauugaaugcugaucagcugccaggugaggagucagaagagggagccccc

SEQ ID NO: 661306 - RNA, 64 nt, hsa
ggcugacacaggugugaagaggccauccuggaacccaggugagggcaagaugaaggcuuccagg

SEQ ID NO: 661307 - RNA, 64 nt, hsa
uaaaguguuuagggcagugggaggagaaaauucuccaggugaauggggaagggucuguuccagc

SEQ ID NO: 661308 - RNA, 64 nt, hsa
ggagaacagccaggugaggugggagguuggagagccaggugaggucucuguaagucaggcuggg

SEQ ID NO: 661309 - RNA, 64 nt, hsa
uuuggagaugagcccaaagugccagggagaacagccaggugaggugggagguuggagagccagg

SEQ ID NO: 661310 - RNA, 64 nt, hsa
gcuucugagacgucaugaggagauucugccuuugccaggugacugucuggggagcgggucugcu

SEQ ID NO: 661311 - RNA, 64 nt, hsa
ccugaccagcucccccucccuccccuugccugugccaggugaggucagcacaucucaacaggcc

SEQ ID NO: 661312 - RNA, 64 nt, hsa
uugggggaggugcccagguggguggaccaguacuccaggugauggggcaugcugagaaauagag

SEQ ID NO: 661313 - RNA, 64 nt, hsa
ggaagaauauucccuuggguuuggacccauggucccaggugagagaaggaagugaggccauaga

SEQ ID NO: 661314 - RNA, 64 nt, hsa
gcagggaguugcgaggugggguuaguugcauggaccaggugaggugguggaacaaaaggccagg

SEQ ID NO: 661315 - RNA, 64 nt, hsa
gaggcagugugguccugggaaugugaccaacaugccaggugacauuggccccuagacccucucu

SEQ ID NO: 661316 - RNA, 64 nt, hsa
auuuagacgcccacgacagcacuacacagcaucuccaggugaugcccaaggcacagggcugcag

SEQ ID NO: 661317 - RNA, 64 nt, hsa
aucaagggauuuccuauggaaguccugcuuuauuccaggugaagggaaggaaguguauauacuu

SEQ ID NO: 661318 - RNA, 64 nt, hsa
gugauccagugaucuauggaagucgugucuuacuccaggugaagggggaaaaaaaaagccuaua

SEQ ID NO: 661319 - RNA, 64 nt, hsa
guggggccuaggacucugcauuucuuacagauucccaggugagcugaugcuggugguuaagggu

SEQ ID NO: 661320 - RNA, 64 nt, hsa
cuggcgcccccagccccacucuuggcugugcuggccaggugacuccuaguucuuggccacauca

SEQ ID NO: 661321 - RNA, 64 nt, hsa
gugacacuuuuuacuuuuucaauaaacgugacucccaggugagggggccugggucuacacacgu

SEQ ID NO: 661322 - RNA, 64 nt, hsa
gaccccgccaccccuccuaggccuggcuuuguccccaggugaauuuuuuacugugacacuuuuu

SEQ ID NO: 661323 - RNA, 64 nt, hsa
gaacagugcuucucuaaaaugcaauaauaaugggccaggugaaguggcucacaccuguaauccc

SEQ ID NO: 661324 - RNA, 64 nt, hsa
ggcucacaccuguaaucccagcacuaugggaggcccaggugagcagaucaccugaggucaggag

SEQ ID NO: 661325 - RNA, 64 nt, hsa
gggaaggaggaggaaacugugguguuccuuucuuccaggugacaucaccuaugcacauucccag

SEQ ID NO: 661326 - RNA, 64 nt, hsa
gagcugcaaagcaggcaggaagggaggaggagagccaggugagcaguggagagaaggggggccc

SEQ ID NO: 661327 - RNA, 64 nt, hsa
uuccagcaugugacuuuggugccguuacuugugaaaaaucuauucuguugucuuugaugugucc

SEQ ID NO: 661328 - RNA, 64 nt, hsa
uauuuggaagccucugaagagaccaugucuuuuuaaaaucuaacucuugagagugcagcagggg

SEQ ID NO: 661329 - RNA, 64 nt, hsa
uuuugaguauagccagagaaaacaaggauggagaaaaaucuaggacagguaauuuugaaaagag

SEQ ID NO: 661330 - RNA, 64 nt, hsa
uuuuggguauagccagagaaaacaaggauggagaaaaaucuaggacagguaauuuugaaaacag

SEQ ID NO: 661331 - RNA, 64 nt, hsa
uauggauaaaguugcacuuauaacacccuucaacaaaaucuaauuuuaaauugucuuuuucuuu

SEQ ID NO: 661332 - RNA, 64 nt, hsa
cauguuugcuuaaugcuucugcuaaguguuagccaaaaucuagccauuuauauuuaguugugua

SEQ ID NO: 661333 - RNA, 64 nt, hsa
guaaaauucacuuuggaagguuaucaggcuuuuaaaaaucuaguuuauggcaaaaauagccauu

SEQ ID NO: 661334 - RNA, 64 nt, hsa
ccagcugugaacccaggaggucaagugggcuauuaaaaucuaacguugaguaaaugugauagug

SEQ ID NO: 661335 - RNA, 64 nt, hsa
gugcucucuaaauucuuagcaucucacuggauguaaaaucuaucaguuaauaguuuuaaaaaug

SEQ ID NO: 661336 - RNA, 64 nt, hsa
cauuuuuuaagaaugcaagaugaaaaaaucagguaaaaucuaaccauuuuauucucugcuucau

SEQ ID NO: 661337 - RNA, 64 nt, hsa
caugguaacagaaauuuaccuuuuaauaaauuaaaaaaucuaaauuuuaaccuacuuguauguu

SEQ ID NO: 661338 - RNA, 64 nt, hsa
gaccuuccugugauacuuuauuuccgaacuaauaaaaaucuauaugacuuuuuauuauugugug

SEQ ID NO: 661339 - RNA, 64 nt, hsa
aagguaaucagaccagaguccaaguuguaugcaaaaaaucuauaauuugauucucauaaacaua

SEQ ID NO: 661340 - RNA, 64 nt, hsa
uuuauguaacaucuugcuguacuaaauacagcagaaaaucuacucuuuagcaauauauaacaca

SEQ ID NO: 661341 - RNA, 64 nt, hsa
aaguuuucaguacaaaucugugcuacacuggauaaaaaucuaauuuaugaauuuuacuugcacc

SEQ ID NO: 661342 - RNA, 64 nt, hsa
aagauuucagcuugguagagcugacaaagcagauaaaaucuacuccaaauuauuuucaagagag

SEQ ID NO: 661343 - RNA, 64 nt, hsa
gucugguuuacuuaauaaauugaaagugauuuauaaaaucuaaauuuggacuacuugcaaauga

SEQ ID NO: 661344 - RNA, 64 nt, hsa
caucuuuugagaauguaugugucucuaaguaaguaaaaucuaaugcguauaggagacugauagc

SEQ ID NO: 661345 - RNA, 64 nt, hsa
uuuguaugugucacuagugucuaaugaagcuuuuaaaaucuacaauuucuucuuuaaaaauauu

SEQ ID NO: 661346 - RNA, 64 nt, hsa
cugcaaaacacuaggcuuuaguagguacuuauauaaaaucuaguccaguucucucauuuaaaaa

SEQ ID NO: 661347 - RNA, 64 nt, hsa
aucaaaaauaaauggcaaagagaaaucaggacaaaaaaucuaauugcuguuugggaaaaaacuu

SEQ ID NO: 661348 - RNA, 64 nt, hsa
cugcuuagaaauacggcugggcucuguacuaugcaaaaucuagaaaguguggggaaacuuuaaa

SEQ ID NO: 661349 - RNA, 64 nt, hsa
auuuuucaguucugucagaaacucuaaauuuccaaaaaucuaagugaaacauggaugaaacucu

SEQ ID NO: 661350 - RNA, 64 nt, hsa
uuuacuuaccuacugucuugagcucacauaccucaaaaucuacuacuguguggcaccugaaagg

SEQ ID NO: 661351 - RNA, 64 nt, hsa
uuaaaugugugcauaaaaaacuaaaugugaauauaaaaucuaaauaaaggaauauguuugccua

SEQ ID NO: 661352 - RNA, 64 nt, hsa
uauuucuuccuuuuauaagaguaauuauauuuaaaaaaucuaccuacccuucuggaauugcuaa

SEQ ID NO: 661353 - RNA, 64 nt, hsa
uguguaacuuuguuuuuauuuuaacucuuacuagaaaaucuaaucuuaaaacauuugaauucua

SEQ ID NO: 661354 - RNA, 64 nt, hsa
uuaaguacaagaucucucuaaaaauaaacagaugaaaaucuauccccauuaucgauacagaauu

SEQ ID NO: 661355 - RNA, 64 nt, hsa
cagagugagacuccaucucaaaaaaaaaaaaaaaaaaaucuaugcuaguagauuacaacuucac

SEQ ID NO: 661356 - RNA, 64 nt, hsa
acaucagucuuuguuuuaauauuguacuguuaaaaaaaucuaugcagcugggugcaguggcuca

SEQ ID NO: 661357 - RNA, 64 nt, hsa
aucaaaaacauuuucauauauaccagaguacuguaaaaucuagguuuuuuucaacauuagcagu

SEQ ID NO: 661358 - RNA, 64 nt, hsa
cugauguaauugacauuacauuucuuaacauuuuaaaaucuagaauuucuaaaauggaauuuaa

SEQ ID NO: 661359 - RNA, 64 nt, hsa
aagcgaagucaaaacugaugaaaauuuauuuagaaaaaucuaaaaauucugguuuuaaauauga

SEQ ID NO: 661360 - RNA, 64 nt, hsa
gccugugucaaagauuuuaaaaucauggaaaguuaaaaucuagaaagaccuuagagaaccagcc

SEQ ID NO: 661361 - RNA, 64 nt, hsa
cucuccuuccucccuuccuuuacaguuuaaaaaaaaaaucuaaaaauaguuaagcacuguguca

SEQ ID NO: 661362 - RNA, 64 nt, hsa
ucuguuaugauugccauuucaauaaaugacauuaaaaaucuaaaggauauuauuguuugaauuu

SEQ ID NO: 661363 - RNA, 64 nt, hsa
aaugcuuuuuguaaacaagagcagaacaguuuuaaaaaucuaauuagaauuuccaaauaaaaca

SEQ ID NO: 661364 - RNA, 64 nt, hsa
aguauagaaaacucuuaaugauaaaacauuuaacaaaaucuauaacugugaagcuuaauucaga

SEQ ID NO: 661365 - RNA, 64 nt, hsa
gacuuuguauuuaaaaguuaaaaaggacaaaaaaaaaaucuaaagcauuuaaaaucuagugaaa

SEQ ID NO: 661366 - RNA, 64 nt, hsa
guuaaaaaggacaaaaaaaaaaucuaaagcauuuaaaaucuagugaaauaacugaagggccugc

SEQ ID NO: 661367 - RNA, 64 nt, hsa
cucaaaggaucuugcuuuaacuuucaacacuuagaaaaucuacaaacauucagaccugucuggg

SEQ ID NO: 661368 - RNA, 64 nt, hsa
uuuaaacuggacuuagcuugaguuaaaggcaaagaaaaucuaaaaacauaaauguuauauuuca

SEQ ID NO: 661369 - RNA, 64 nt, hsa
aucucugagugaaucccuuuguucucuguuuaaaaaaaucuaaaaagaaaaaggaaaaaaaaaa

SEQ ID NO: 661370 - RNA, 64 nt, hsa
guuuuaaauauuuugauugaauuaguaccaauguaaaaucuaguuucuuccugaaggaggaucc

SEQ ID NO: 661371 - RNA, 64 nt, hsa
gaaagcacaaaugcgaaagaggucaugucuucucaaaaucuagcaaaggaaguagucugcauug

SEQ ID NO: 661372 - RNA, 64 nt, hsa
cacugcaacaaagcaacaauguuguccaugauucaaaaucuaagcaguuucgauuuugccugug

SEQ ID NO: 661373 - RNA, 64 nt, hsa
cuaaacaucgagaaacuaugggaaaaaaaauugcaaaaucuaaaauaaaaaaugcaaaaucuaa

SEQ ID NO: 661374 - RNA, 64 nt, hsa
gaaaaaaaauugcaaaaucuaaaauaaaaaaugcaaaaucuaaaauaaaaaauggaaaggaaac

SEQ ID NO: 661375 - RNA, 64 nt, hsa
uguacacccccccaucaccaaccucacaacuuagaaaaucuaaguuguuugauuucuuugggau

SEQ ID NO: 661376 - RNA, 64 nt, hsa
uuuccacaccauaggcaauaauuucuuaauuuaaaaaaucuaaguauauuccuauuguacuaaa

SEQ ID NO: 661377 - RNA, 64 nt, hsa
gaauuuuaaaaaugugauugcucuaauaaagaauaaaaucuaugcuuuuuaacaaacauaguuu

SEQ ID NO: 661378 - RNA, 64 nt, hsa
agauggugauucugaagcuuacaucucccuuaaaaaaaucuaaagcagcucuuaugggcuucua

SEQ ID NO: 661379 - RNA, 64 nt, hsa; identical to SEQ ID NO: 188955

SEQ ID NO: 661380 - RNA, 64 nt, hsa; identical to SEQ ID NO: 188956

SEQ ID NO: 661381 - RNA, 64 nt, hsa; identical to SEQ ID NO: 188957

SEQ ID NO: 661382 - RNA, 64 nt, hsa; identical to SEQ ID NO: 188958

SEQ ID NO: 661383 - RNA, 64 nt, hsa; identical to SEQ ID NO: 193524

SEQ ID NO: 661384 - RNA, 64 nt, hsa; identical to SEQ ID NO: 193525

SEQ ID NO: 661385 - RNA, 64 nt, hsa; identical to SEQ ID NO: 193526

SEQ ID NO: 661386 - RNA, 64 nt, hsa; identical to SEQ ID NO: 193527

SEQ ID NO: 661387 - RNA, 64 nt, hsa; identical to SEQ ID NO: 193528

SEQ ID NO: 661388 - RNA, 64 nt, hsa; identical to SEQ ID NO: 193529

SEQ ID NO: 661389 - RNA, 64 nt, hsa; identical to SEQ ID NO: 193530

SEQ ID NO: 661390 - RNA, 64 nt, hsa; identical to SEQ ID NO: 193531

SEQ ID NO: 661391 - RNA, 64 nt, hsa; identical to SEQ ID NO: 193532

SEQ ID NO: 661392 - RNA, 64 nt, hsa; identical to SEQ ID NO: 193533

SEQ ID NO: 661393 - RNA, 64 nt, hsa; identical to SEQ ID NO: 193534

SEQ ID NO: 661394 - RNA, 64 nt, hsa; identical to SEQ ID NO: 193535

SEQ ID NO: 661395 - RNA, 64 nt, hsa; identical to SEQ ID NO: 193536

SEQ ID NO: 661396 - RNA, 64 nt, hsa; identical to SEQ ID NO: 193537

SEQ ID NO: 661397 - RNA, 64 nt, hsa; identical to SEQ ID NO: 193538

SEQ ID NO: 661398 - RNA, 64 nt, hsa; identical to SEQ ID NO: 193539

SEQ ID NO: 661399 - RNA, 64 nt, hsa; identical to SEQ ID NO: 193540

SEQ ID NO: 661400 - RNA, 64 nt, hsa; identical to SEQ ID NO: 193541

SEQ ID NO: 661401 - RNA, 64 nt, hsa; identical to SEQ ID NO: 193542

SEQ ID NO: 661402 - RNA, 64 nt, hsa; identical to SEQ ID NO: 193543

SEQ ID NO: 661403 - RNA, 64 nt, hsa; identical to SEQ ID NO: 193544

SEQ ID NO: 661404 - RNA, 64 nt, hsa; identical to SEQ ID NO: 193545

SEQ ID NO: 661405 - RNA, 64 nt, hsa; identical to SEQ ID NO: 193546

SEQ ID NO: 661406 - RNA, 64 nt, hsa; identical to SEQ ID NO: 193547

SEQ ID NO: 661407 - RNA, 64 nt, hsa; identical to SEQ ID NO: 193548

SEQ ID NO: 661408 - RNA, 64 nt, hsa; identical to SEQ ID NO: 193549

SEQ ID NO: 661409 - RNA, 64 nt, hsa; identical to SEQ ID NO: 193550

SEQ ID NO: 661410 - RNA, 64 nt, hsa; identical to SEQ ID NO: 193551

SEQ ID NO: 661411 - RNA, 64 nt, hsa; identical to SEQ ID NO: 193552

SEQ ID NO: 661412 - RNA, 64 nt, hsa; identical to SEQ ID NO: 193553

SEQ ID NO: 661413 - RNA, 64 nt, hsa; identical to SEQ ID NO: 193554

SEQ ID NO: 661414 - RNA, 64 nt, hsa; identical to SEQ ID NO: 193555

SEQ ID NO: 661415 - RNA, 64 nt, hsa; identical to SEQ ID NO: 193556

SEQ ID NO: 661416 - RNA, 64 nt, hsa; identical to SEQ ID NO: 193557

SEQ ID NO: 661417 - RNA, 64 nt, hsa; identical to SEQ ID NO: 193558

SEQ ID NO: 661418 - RNA, 64 nt, hsa; identical to SEQ ID NO: 193559

SEQ ID NO: 661419 - RNA, 64 nt, hsa; identical to SEQ ID NO: 193560

SEQ ID NO: 661420 - RNA, 64 nt, hsa; identical to SEQ ID NO: 193561

SEQ ID NO: 661421 - RNA, 64 nt, hsa; identical to SEQ ID NO: 193562

SEQ ID NO: 661422 - RNA, 64 nt, hsa; identical to SEQ ID NO: 193563

SEQ ID NO: 661423 - RNA, 64 nt, hsa; identical to SEQ ID NO: 193564

SEQ ID NO: 661424 - RNA, 64 nt, hsa; identical to SEQ ID NO: 193565

SEQ ID NO: 661425 - RNA, 64 nt, hsa; identical to SEQ ID NO: 193566

SEQ ID NO: 661426 - RNA, 64 nt, hsa; identical to SEQ ID NO: 193567

SEQ ID NO: 661427 - RNA, 64 nt, hsa; identical to SEQ ID NO: 193568

SEQ ID NO: 661428 - RNA, 64 nt, hsa; identical to SEQ ID NO: 193569

SEQ ID NO: 661429 - RNA, 64 nt, hsa; identical to SEQ ID NO: 193570

SEQ ID NO: 661430 - RNA, 64 nt, hsa; identical to SEQ ID NO: 193571

SEQ ID NO: 661431 - RNA, 64 nt, hsa; identical to SEQ ID NO: 193572

SEQ ID NO: 661432 - RNA, 64 nt, hsa; identical to SEQ ID NO: 193573

SEQ ID NO: 661433 - RNA, 64 nt, hsa; identical to SEQ ID NO: 193574

SEQ ID NO: 661434 - RNA, 64 nt, hsa; identical to SEQ ID NO: 193575

SEQ ID NO: 661435 - RNA, 64 nt, hsa; identical to SEQ ID NO: 193576

SEQ ID NO: 661436 - RNA, 64 nt, hsa; identical to SEQ ID NO: 193577

SEQ ID NO: 661437 - RNA, 64 nt, hsa; identical to SEQ ID NO: 193578

SEQ ID NO: 661438 - RNA, 64 nt, hsa; identical to SEQ ID NO: 193579

SEQ ID NO: 661439 - RNA, 64 nt, hsa; identical to SEQ ID NO: 193580

SEQ ID NO: 661440 - RNA, 64 nt, hsa; identical to SEQ ID NO: 193581

SEQ ID NO: 661441 - RNA, 64 nt, hsa; identical to SEQ ID NO: 193582

SEQ ID NO: 661442 - RNA, 64 nt, hsa; identical to SEQ ID NO: 193583

SEQ ID NO: 661443 - RNA, 64 nt, hsa; identical to SEQ ID NO: 193584

SEQ ID NO: 661444 - RNA, 64 nt, hsa; identical to SEQ ID NO: 193585

SEQ ID NO: 661445 - RNA, 64 nt, hsa; identical to SEQ ID NO: 193586

SEQ ID NO: 661446 - RNA, 64 nt, hsa; identical to SEQ ID NO: 193587

SEQ ID NO: 661447 - RNA, 64 nt, hsa; identical to SEQ ID NO: 193588

SEQ ID NO: 661448 - RNA, 64 nt, hsa; identical to SEQ ID NO: 193589

SEQ ID NO: 661449 - RNA, 64 nt, hsa; identical to SEQ ID NO: 193590

SEQ ID NO: 661450 - RNA, 64 nt, hsa; identical to SEQ ID NO: 193591

SEQ ID NO: 661451 - RNA, 64 nt, hsa; identical to SEQ ID NO: 193592

SEQ ID NO: 661452 - RNA, 64 nt, hsa; identical to SEQ ID NO: 193593

SEQ ID NO: 661453 - RNA, 64 nt, hsa; identical to SEQ ID NO: 193594

SEQ ID NO: 661454 - RNA, 64 nt, hsa; identical to SEQ ID NO: 193595

SEQ ID NO: 661455 - RNA, 64 nt, hsa; identical to SEQ ID NO: 193596

SEQ ID NO: 661456 - RNA, 52 nt, hsa; identical to SEQ ID NO: 482720

SEQ ID NO: 661457 - RNA, 64 nt, hsa; identical to SEQ ID NO: 482721

SEQ ID NO: 661458 - RNA, 64 nt, hsa; identical to SEQ ID NO: 482722

SEQ ID NO: 661459 - RNA, 64 nt, hsa; identical to SEQ ID NO: 482723

SEQ ID NO: 661460 - RNA, 64 nt, hsa; identical to SEQ ID NO: 482724

SEQ ID NO: 661461 - RNA, 64 nt, hsa; identical to SEQ ID NO: 482725

SEQ ID NO: 661462 - RNA, 64 nt, hsa; identical to SEQ ID NO: 482726

SEQ ID NO: 661463 - RNA, 64 nt, hsa; identical to SEQ ID NO: 482727

SEQ ID NO: 661464 - RNA, 64 nt, hsa; identical to SEQ ID NO: 482728

SEQ ID NO: 661465 - RNA, 64 nt, hsa; identical to SEQ ID NO: 482729

SEQ ID NO: 661466 - RNA, 64 nt, hsa; identical to SEQ ID NO: 482730

SEQ ID NO: 661467 - RNA, 64 nt, hsa; identical to SEQ ID NO: 482731

SEQ ID NO: 661468 - RNA, 64 nt, hsa; identical to SEQ ID NO: 482732

SEQ ID NO: 661469 - RNA, 64 nt, hsa; identical to SEQ ID NO: 482733

SEQ ID NO: 661470 - RNA, 64 nt, hsa; identical to SEQ ID NO: 482734

SEQ ID NO: 661471 - RNA, 64 nt, hsa; identical to SEQ ID NO: 482735

SEQ ID NO: 661472 - RNA, 64 nt, hsa; identical to SEQ ID NO: 482736

SEQ ID NO: 661473 - RNA, 64 nt, hsa; identical to SEQ ID NO: 482737

SEQ ID NO: 661474 - RNA, 64 nt, hsa; identical to SEQ ID NO: 482738

SEQ ID NO: 661475 - RNA, 64 nt, hsa; identical to SEQ ID NO: 482739

SEQ ID NO: 661476 - RNA, 64 nt, hsa; identical to SEQ ID NO: 482740

SEQ ID NO: 661477 - RNA, 64 nt, hsa; identical to SEQ ID NO: 482741

SEQ ID NO: 661478 - RNA, 64 nt, hsa; identical to SEQ ID NO: 482742

SEQ ID NO: 661479 - RNA, 64 nt, hsa; identical to SEQ ID NO: 482743

SEQ ID NO: 661480 - RNA, 64 nt, hsa; identical to SEQ ID NO: 482744

SEQ ID NO: 661481 - RNA, 64 nt, hsa; identical to SEQ ID NO: 482745

SEQ ID NO: 661482 - RNA, 64 nt, hsa; identical to SEQ ID NO: 482746

SEQ ID NO: 661483 - RNA, 64 nt, hsa; identical to SEQ ID NO: 482747

SEQ ID NO: 661484 - RNA, 64 nt, hsa; identical to SEQ ID NO: 52917

SEQ ID NO: 661485 - RNA, 64 nt, hsa; identical to SEQ ID NO: 52918

SEQ ID NO: 661486 - RNA, 64 nt, hsa; identical to SEQ ID NO: 52919

SEQ ID NO: 661487 - RNA, 64 nt, hsa; identical to SEQ ID NO: 52920

SEQ ID NO: 661488 - RNA, 64 nt, hsa; identical to SEQ ID NO: 52921

SEQ ID NO: 661489 - RNA, 64 nt, hsa; identical to SEQ ID NO: 52922

SEQ ID NO: 661490 - RNA, 64 nt, hsa; identical to SEQ ID NO: 52923

SEQ ID NO: 661491 - RNA, 64 nt, hsa; identical to SEQ ID NO: 52924

SEQ ID NO: 661492 - RNA, 64 nt, hsa; identical to SEQ ID NO: 52925

SEQ ID NO: 661493 - RNA, 64 nt, hsa; identical to SEQ ID NO: 52926

SEQ ID NO: 661494 - RNA, 64 nt, hsa; identical to SEQ ID NO: 52927

SEQ ID NO: 661495 - RNA, 64 nt, hsa; identical to SEQ ID NO: 52928

SEQ ID NO: 661496 - RNA, 64 nt, hsa; identical to SEQ ID NO: 52929

SEQ ID NO: 661497 - RNA, 64 nt, hsa; identical to SEQ ID NO: 52930

SEQ ID NO: 661498 - RNA, 64 nt, hsa; identical to SEQ ID NO: 52931

SEQ ID NO: 661499 - RNA, 64 nt, hsa; identical to SEQ ID NO: 52932

SEQ ID NO: 661500 - RNA, 64 nt, hsa; identical to SEQ ID NO: 52933

SEQ ID NO: 661501 - RNA, 64 nt, hsa; identical to SEQ ID NO: 52934

SEQ ID NO: 661502 - RNA, 64 nt, hsa; identical to SEQ ID NO: 52935

SEQ ID NO: 661503 - RNA, 64 nt, hsa; identical to SEQ ID NO: 52936

SEQ ID NO: 661504 - RNA, 64 nt, hsa; identical to SEQ ID NO: 52937

SEQ ID NO: 661505 - RNA, 64 nt, hsa; identical to SEQ ID NO: 52938

SEQ ID NO: 661506 - RNA, 64 nt, hsa; identical to SEQ ID NO: 52939

SEQ ID NO: 661507 - RNA, 64 nt, hsa; identical to SEQ ID NO: 52940

SEQ ID NO: 661508 - RNA, 64 nt, hsa; identical to SEQ ID NO: 52941

SEQ ID NO: 661509 - RNA, 64 nt, hsa; identical to SEQ ID NO: 52942

SEQ ID NO: 661510 - RNA, 64 nt, hsa; identical to SEQ ID NO: 52943

SEQ ID NO: 661511 - RNA, 64 nt, hsa; identical to SEQ ID NO: 52944

SEQ ID NO: 661512 - RNA, 64 nt, hsa; identical to SEQ ID NO: 52945

SEQ ID NO: 661513 - RNA, 64 nt, hsa; identical to SEQ ID NO: 52946

SEQ ID NO: 661514 - RNA, 64 nt, hsa; identical to SEQ ID NO: 52947

SEQ ID NO: 661515 - RNA, 64 nt, hsa; identical to SEQ ID NO: 52948

SEQ ID NO: 661516 - RNA, 64 nt, hsa; identical to SEQ ID NO: 52949

SEQ ID NO: 661517 - RNA, 64 nt, hsa; identical to SEQ ID NO: 52950

SEQ ID NO: 661518 - RNA, 64 nt, hsa; identical to SEQ ID NO: 52951

SEQ ID NO: 661519 - RNA, 64 nt, hsa; identical to SEQ ID NO: 52952

SEQ ID NO: 661520 - RNA, 64 nt, hsa; identical to SEQ ID NO: 52953

SEQ ID NO: 661521 - RNA, 64 nt, hsa; identical to SEQ ID NO: 52954

SEQ ID NO: 661522 - RNA, 64 nt, hsa; identical to SEQ ID NO: 52955

SEQ ID NO: 661523 - RNA, 64 nt, hsa; identical to SEQ ID NO: 52956

SEQ ID NO: 661524 - RNA, 64 nt, hsa; identical to SEQ ID NO: 52957

SEQ ID NO: 661525 - RNA, 64 nt, hsa; identical to SEQ ID NO: 52958

SEQ ID NO: 661526 - RNA, 64 nt, hsa; identical to SEQ ID NO: 52959

SEQ ID NO: 661527 - RNA, 64 nt, hsa; identical to SEQ ID NO: 52960

SEQ ID NO: 661528 - RNA, 64 nt, hsa; identical to SEQ ID NO: 52961

SEQ ID NO: 661529 - RNA, 64 nt, hsa; identical to SEQ ID NO: 52962

SEQ ID NO: 661530 - RNA, 64 nt, hsa; identical to SEQ ID NO: 52963

SEQ ID NO: 661531 - RNA, 64 nt, hsa; identical to SEQ ID NO: 52964

SEQ ID NO: 661532 - RNA, 64 nt, hsa; identical to SEQ ID NO: 52965

SEQ ID NO: 661533 - RNA, 64 nt, hsa; identical to SEQ ID NO: 52966

SEQ ID NO: 661534 - RNA, 64 nt, hsa; identical to SEQ ID NO: 52967

SEQ ID NO: 661535 - RNA, 64 nt, hsa; identical to SEQ ID NO: 52968

SEQ ID NO: 661536 - RNA, 64 nt, hsa; identical to SEQ ID NO: 52969

SEQ ID NO: 661537 - RNA, 64 nt, hsa; identical to SEQ ID NO: 52970

SEQ ID NO: 661538 - RNA, 64 nt, hsa; identical to SEQ ID NO: 52971

SEQ ID NO: 661539 - RNA, 64 nt, hsa; identical to SEQ ID NO: 52972

SEQ ID NO: 661540 - RNA, 64 nt, hsa; identical to SEQ ID NO: 52973

SEQ ID NO: 661541 - RNA, 64 nt, hsa; identical to SEQ ID NO: 52974

SEQ ID NO: 661542 - RNA, 64 nt, hsa; identical to SEQ ID NO: 52975

SEQ ID NO: 661543 - RNA, 64 nt, hsa; identical to SEQ ID NO: 52976

SEQ ID NO: 661544 - RNA, 64 nt, hsa; identical to SEQ ID NO: 52977

SEQ ID NO: 661545 - RNA, 64 nt, hsa; identical to SEQ ID NO: 52978

SEQ ID NO: 661546 - RNA, 64 nt, hsa
aaccagcccagaucagucccaaggccagaguccuuuguccuacaucucccugaaccagagugug

SEQ ID NO: 661547 - RNA, 64 nt, hsa
cugauccccagcauccagcugagguccaaggucuuuguccuagaaucagaguggggaggggaca

SEQ ID NO: 661548 - RNA, 64 nt, hsa
cgaacaaucuguauuuuuugcuuuucauguguuuuuguccuagggguucgaucuaaaauguuuc

SEQ ID NO: 661549 - RNA, 64 nt, hsa
uuuucuggcgcgugcugcaaagaagcuauuucuguuguccuacauauuuuaguauaaaucacua

SEQ ID NO: 661550 - RNA, 64 nt, hsa
ccauuguaugggggggauuaggaaguaggagggauuguccuacaacaggcccuuauacuucaac

SEQ ID NO: 661551 - RNA, 64 nt, hsa
gaccuuccaugaauguugccagcaauaaagugacuuguccuaaucuauggauugagaacuugaa

SEQ ID NO: 661552 - RNA, 64 nt, hsa
ucugaagaaaggaucccugagagucucuguuucaucaggacauucugaaauuuacccacaguga

SEQ ID NO: 661553 - RNA, 64 nt, hsa
gggccagcgugcuucuucuggcuacacaaccuucucaggacaagcccacugucuuaagccacuu

SEQ ID NO: 661554 - RNA, 64 nt, hsa
caaacaucaguucuucaaauaaggacgcaaaucuucaggacaguaagcagaacaaucagaaugg

SEQ ID NO: 661555 - RNA, 64 nt, hsa
ugucauguaaauucccacuuuacauaaaaacccaucaggacagaaugaugcucaauauuuuaaa

SEQ ID NO: 661556 - RNA, 64 nt, hsa
uuuugcugcuuccucggcccagggagaaagcaugucaggacagagcuguuggauuggcuuugau

SEQ ID NO: 661557 - RNA, 64 nt, hsa
cacucuuagcaucuccucuaguauuuuccauguaucaggacagaggugucuuauguagggaggg

SEQ ID NO: 661558 - RNA, 64 nt, hsa
uggcgugauugcugcagcaguggcgccuccuagcucaggacaguggcgacugcccggcugcaug

SEQ ID NO: 661559 - RNA, 64 nt, hsa
cugccacacaucccgcccccucccggaggcagcuucaggacaggacaccaggcuggcugcuuuu

SEQ ID NO: 661560 - RNA, 64 nt, hsa
caguggagcuagaccugaguagggggcagggaguucaggacaacccuccuguaaguugggggug

SEQ ID NO: 661561 - RNA, 64 nt, hsa
ucccuugcucacaaaguuacaggguaggcaccugucaggacagaacagcagcagcgcuacagcc

SEQ ID NO: 661562 - RNA, 64 nt, hsa
ugacgaggcagcuggcccagucuugggagucugcucaggacagugguggagcugggucuugaac

SEQ ID NO: 661563 - RNA, 64 nt, hsa
cuggagagagaaguugcuugacggaugccacuugucaggacaguaugugagugucuggagacag

SEQ ID NO: 661564 - RNA, 64 nt, hsa; identical to SEQ ID NO: 153216

SEQ ID NO: 661565 - RNA, 64 nt, hsa; identical to SEQ ID NO: 153217

SEQ ID NO: 661566 - RNA, 64 nt, hsa; identical to SEQ ID NO: 153218

SEQ ID NO: 661567 - RNA, 64 nt, hsa; identical to SEQ ID NO: 153219

SEQ ID NO: 661568 - RNA, 64 nt, hsa; identical to SEQ ID NO: 153220

SEQ ID NO: 661569 - RNA, 64 nt, hsa; identical to SEQ ID NO: 153221

SEQ ID NO: 661570 - RNA, 64 nt, hsa; identical to SEQ ID NO: 153222

SEQ ID NO: 661571 - RNA, 64 nt, hsa; identical to SEQ ID NO: 153223

SEQ ID NO: 661572 - RNA, 64 nt, hsa; identical to SEQ ID NO: 153224

SEQ ID NO: 661573 - RNA, 64 nt, hsa; identical to SEQ ID NO: 153225

SEQ ID NO: 661574 - RNA, 64 nt, hsa; identical to SEQ ID NO: 153226

SEQ ID NO: 661575 - RNA, 64 nt, hsa; identical to SEQ ID NO: 153227

SEQ ID NO: 661576 - RNA, 64 nt, hsa; identical to SEQ ID NO: 153228

SEQ ID NO: 661577 - RNA, 64 nt, hsa; identical to SEQ ID NO: 153229

SEQ ID NO: 661578 - RNA, 64 nt, hsa; identical to SEQ ID NO: 153230

SEQ ID NO: 661579 - RNA, 64 nt, hsa; identical to SEQ ID NO: 153231

SEQ ID NO: 661580 - RNA, 64 nt, hsa; identical to SEQ ID NO: 153232

SEQ ID NO: 661581 - RNA, 64 nt, hsa; identical to SEQ ID NO: 153233

SEQ ID NO: 661582 - RNA, 64 nt, hsa; identical to SEQ ID NO: 153234

SEQ ID NO: 661583 - RNA, 64 nt, hsa; identical to SEQ ID NO: 153235

SEQ ID NO: 661584 - RNA, 64 nt, hsa; identical to SEQ ID NO: 153236

SEQ ID NO: 661585 - RNA, 64 nt, hsa; identical to SEQ ID NO: 276199

SEQ ID NO: 661586 - RNA, 64 nt, hsa; identical to SEQ ID NO: 276200

SEQ ID NO: 661587 - RNA, 64 nt, hsa; identical to SEQ ID NO: 276201

SEQ ID NO: 661588 - RNA, 64 nt, hsa; identical to SEQ ID NO: 276202

SEQ ID NO: 661589 - RNA, 64 nt, hsa; identical to SEQ ID NO: 276203

SEQ ID NO: 661590 - RNA, 64 nt, hsa; identical to SEQ ID NO: 276204

SEQ ID NO: 661591 - RNA, 64 nt, hsa; identical to SEQ ID NO: 276205

SEQ ID NO: 661592 - RNA, 64 nt, hsa; identical to SEQ ID NO: 276206

SEQ ID NO: 661593 - RNA, 64 nt, hsa; identical to SEQ ID NO: 276207

SEQ ID NO: 661594 - RNA, 64 nt, hsa; identical to SEQ ID NO: 276208

SEQ ID NO: 661595 - RNA, 64 nt, hsa; identical to SEQ ID NO: 276209

SEQ ID NO: 661596 - RNA, 56 nt, hsa; identical to SEQ ID NO: 276210

SEQ ID NO: 661597 - RNA, 64 nt, hsa; identical to SEQ ID NO: 276211

SEQ ID NO: 661598 - RNA, 64 nt, hsa; identical to SEQ ID NO: 276212

SEQ ID NO: 661599 - RNA, 64 nt, hsa; identical to SEQ ID NO: 276213

SEQ ID NO: 661600 - RNA, 64 nt, hsa; identical to SEQ ID NO: 276214

SEQ ID NO: 661601 - RNA, 64 nt, hsa; identical to SEQ ID NO: 276215

SEQ ID NO: 661602 - RNA, 64 nt, hsa; identical to SEQ ID NO: 276216

SEQ ID NO: 661603 - RNA, 64 nt, hsa; identical to SEQ ID NO: 276217

SEQ ID NO: 661604 - RNA, 64 nt, hsa; identical to SEQ ID NO: 276218

SEQ ID NO: 661605 - RNA, 64 nt, hsa; identical to SEQ ID NO: 276219

SEQ ID NO: 661606 - RNA, 64 nt, hsa; identical to SEQ ID NO: 276220

SEQ ID NO: 661607 - RNA, 64 nt, hsa; identical to SEQ ID NO: 276221

SEQ ID NO: 661608 - RNA, 64 nt, hsa; identical to SEQ ID NO: 276222

SEQ ID NO: 661609 - RNA, 64 nt, hsa; identical to SEQ ID NO: 276222

SEQ ID NO: 661610 - RNA, 64 nt, hsa; identical to SEQ ID NO: 276224

SEQ ID NO: 661611 - RNA, 64 nt, hsa; identical to SEQ ID NO: 276225

SEQ ID NO: 661612 - RNA, 64 nt, hsa; identical to SEQ ID NO: 276226

SEQ ID NO: 661613 - RNA, 64 nt, hsa; identical to SEQ ID NO: 276227

SEQ ID NO: 661614 - RNA, 58 nt, hsa
auucccaagauugaggaggcaguaguuaaucugggaaggcaguagaauggccagcauu

SEQ ID NO: 661615 - RNA, 58 nt, hsa
gggaggcugaguugggaggauugcugcaaucugggagguggaaguugcagugagccga

SEQ ID NO: 661616 - RNA, 58 nt, hsa
uagccacagaaauaaaggagggaccaauaucugggacagguaauuuugcaaaacacau

SEQ ID NO: 661617 - RNA, 58 nt, hsa
uagccacagaaauaaagaagggacaacaaucugggacagguaauuuugcaaaacacau

SEQ ID NO: 661618 - RNA, 58 nt, hsa
uagccacagaaauaaaggauggagaaaaaucugggacagguaauuuugcaaaacacau

SEQ ID NO: 661619 - RNA, 58 nt, hsa
uagccacagaaauaaaggauggagaaaaaucugggacagguaauuuugcaaaagacau

SEQ ID NO: 661620 - RNA, 58 nt, hsa
cccaggucuccugccucacaucacaauaaucugggacccaggcuugugcccuuucagu

SEQ ID NO: 661621 - RNA, 58 nt, hsa
ugaaucagaaaggcuuagccaaggccacaucugggaagaguggagaaauuugccacuu

SEQ ID NO: 661622 - RNA, 58 nt, hsa
aggagccccuccgcccggcagccaccccaucugggaagugaggagcgucuacgcccgg

SEQ ID NO: 661623 - RNA, 58 nt, hsa
aggagccccucugccuggccaccaccccaucugggaggugugcccagcagcucauuga

SEQ ID NO: 661624 - RNA, 58 nt, hsa
cuccaacccuaagaaggucgaccucaucaucugggagaucgaggugccaaagguaggg

SEQ ID NO: 661625 - RNA, 58 nt, hsa
gacaggugacuguaugguagagacugugaucugggaacuuuuugcuguacaaaucugu

SEQ ID NO: 661626 - RNA, 58 nt, hsa
ugggaaaugucccagucagaagaagauuaucugggacacugauacugacagggagaug

SEQ ID NO: 661627 - RNA, 58 nt, hsa
cuggagaaaggccuuaugagugcugucaaucugggaaacaucagaaugucugcucucc

SEQ ID NO: 661628 - RNA, 64 nt, hsa; identical to SEQ ID NO: 99154

SEQ ID NO: 661629 - RNA, 64 nt, hsa; identical to SEQ ID NO: 99155

SEQ ID NO: 661630 - RNA, 64 nt, hsa; identical to SEQ ID NO: 99156

SEQ ID NO: 661631 - RNA, 64 nt, hsa; identical to SEQ ID NO: 99157

SEQ ID NO: 661632 - RNA, 64 nt, hsa; identical to SEQ ID NO: 99158

SEQ ID NO: 661633 - RNA, 64 nt, hsa; identical to SEQ ID NO: 99159

SEQ ID NO: 661634 - RNA, 64 nt, hsa; identical to SEQ ID NO: 99160

SEQ ID NO: 661635 - RNA, 64 nt, hsa; identical to SEQ ID NO: 99161

SEQ ID NO: 661636 - RNA, 64 nt, hsa; identical to SEQ ID NO: 99162

SEQ ID NO: 661637 - RNA, 64 nt, hsa; identical to SEQ ID NO: 99163

SEQ ID NO: 661638 - RNA, 64 nt, hsa; identical to SEQ ID NO: 99164

SEQ ID NO: 661639 - RNA, 64 nt, hsa; identical to SEQ ID NO: 99165

SEQ ID NO: 661640 - RNA, 64 nt, hsa; identical to SEQ ID NO: 99166

SEQ ID NO: 661641 - RNA, 64 nt, hsa; identical to SEQ ID NO: 99167

SEQ ID NO: 661642 - RNA, 64 nt, hsa; identical to SEQ ID NO: 99168

SEQ ID NO: 661643 - RNA, 64 nt, hsa; identical to SEQ ID NO: 99169

SEQ ID NO: 661644 - RNA, 64 nt, hsa; identical to SEQ ID NO: 99170

SEQ ID NO: 661645 - RNA, 64 nt, hsa; identical to SEQ ID NO: 99171

SEQ ID NO: 661646 - RNA, 64 nt, hsa; identical to SEQ ID NO: 99172

SEQ ID NO: 661647 - RNA, 64 nt, hsa; identical to SEQ ID NO: 99173

SEQ ID NO: 661648 - RNA, 64 nt, hsa; identical to SEQ ID NO: 99174

SEQ ID NO: 661649 - RNA, 64 nt, hsa; identical to SEQ ID NO: 99175

SEQ ID NO: 661650 - RNA, 64 nt, hsa; identical to SEQ ID NO: 99176

SEQ ID NO: 661651 - RNA, 64 nt, hsa; identical to SEQ ID NO: 99177

SEQ ID NO: 661652 - RNA, 64 nt, hsa; identical to SEQ ID NO: 99178

SEQ ID NO: 661653 - RNA, 64 nt, hsa; identical to SEQ ID NO: 99179

SEQ ID NO: 661654 - RNA, 63 nt, hsa
ucaccugaauucagucuguuuggugucugcacagacuggaauucaaucugucaaauuuguuuu

SEQ ID NO: 661655 - RNA, 63 nt, hsa
aagguagaaaagaaaagccaagaucauacuaaggacuggaaauauuuuguucuauggaaucaa

SEQ ID NO: 661656 - RNA, 63 nt, hsa
uauuuaggacauuuaccaugaacaaguuggcaggacuggaagcuggcucugggugagucagua

SEQ ID NO: 661657 - RNA, 63 nt, hsa
gguagaaaggcaaaaaguaggauauuuugaccugacuggaaagaugguuguguuuuuauugcc

SEQ ID NO: 661658 - RNA, 63 nt, hsa
gaucugguuuuuuggucaaagggaacauguucggacuggaaacauuucuuuacauuugcauuc

SEQ ID NO: 661659 - RNA, 63 nt, hsa
ccaaaggggcacccacauuuuuuugaaagacuggacuggaaucuuagcaaacaauuguaaguc

SEQ ID NO: 661660 - RNA, 64 nt, hsa; identical to SEQ ID NO: 154420

SEQ ID NO: 661661 - RNA, 64 nt, hsa; identical to SEQ ID NO: 154421

SEQ ID NO: 661662 - RNA, 64 nt, hsa; identical to SEQ ID NO: 154422

SEQ ID NO: 661663 - RNA, 64 nt, hsa; identical to SEQ ID NO: 154423

SEQ ID NO: 661664 - RNA, 64 nt, hsa; identical to SEQ ID NO: 154424

SEQ ID NO: 661665 - RNA, 64 nt, hsa; identical to SEQ ID NO: 154425

SEQ ID NO: 661666 - RNA, 64 nt, hsa; identical to SEQ ID NO: 154426

SEQ ID NO: 661667 - RNA, 64 nt, hsa; identical to SEQ ID NO: 154427

SEQ ID NO: 661668 - RNA, 64 nt, hsa; identical to SEQ ID NO: 154428

SEQ ID NO: 661669 - RNA, 64 nt, hsa; identical to SEQ ID NO: 154429

SEQ ID NO: 661670 - RNA, 64 nt, hsa; identical to SEQ ID NO: 154430

SEQ ID NO: 661671 - RNA, 64 nt, hsa; identical to SEQ ID NO: 154431

SEQ ID NO: 661672 - RNA, 64 nt, hsa; identical to SEQ ID NO: 154432

SEQ ID NO: 661673 - RNA, 64 nt, hsa; identical to SEQ ID NO: 154433

SEQ ID NO: 661674 - RNA, 64 nt, hsa; identical to SEQ ID NO: 154434

SEQ ID NO: 661675 - RNA, 64 nt, hsa; identical to SEQ ID NO: 154435

SEQ ID NO: 661676 - RNA, 64 nt, hsa; identical to SEQ ID NO: 154436

SEQ ID NO: 661677 - RNA, 64 nt, hsa; identical to SEQ ID NO: 237342

SEQ ID NO: 661678 - RNA, 64 nt, hsa; identical to SEQ ID NO: 237343

SEQ ID NO: 661679 - RNA, 64 nt, hsa; identical to SEQ ID NO: 237344

SEQ ID NO: 661680 - RNA, 64 nt, hsa; identical to SEQ ID NO: 237345

SEQ ID NO: 661681 - RNA, 64 nt, hsa; identical to SEQ ID NO: 237346

SEQ ID NO: 661682 - RNA, 64 nt, hsa; identical to SEQ ID NO: 237347

SEQ ID NO: 661683 - RNA, 64 nt, hsa; identical to SEQ ID NO: 237348

SEQ ID NO: 661684 - RNA, 64 nt, hsa; identical to SEQ ID NO: 237349

SEQ ID NO: 661685 - RNA, 64 nt, hsa; identical to SEQ ID NO: 237350

SEQ ID NO: 661686 - RNA, 64 nt, hsa; identical to SEQ ID NO: 237351

SEQ ID NO: 661687 - RNA, 64 nt, hsa; identical to SEQ ID NO: 237352

SEQ ID NO: 661688 - RNA, 64 nt, hsa; identical to SEQ ID NO: 237353

SEQ ID NO: 661689 - RNA, 64 nt, hsa; identical to SEQ ID NO: 333348

SEQ ID NO: 661690 - RNA, 64 nt, hsa; identical to SEQ ID NO: 333349

SEQ ID NO: 661691 - RNA, 64 nt, hsa; identical to SEQ ID NO: 333350

SEQ ID NO: 661692 - RNA, 64 nt, hsa; identical to SEQ ID NO: 333351

SEQ ID NO: 661693 - RNA, 64 nt, hsa; identical to SEQ ID NO: 333352

SEQ ID NO: 661694 - RNA, 64 nt, hsa; identical to SEQ ID NO: 333353

SEQ ID NO: 661695 - RNA, 64 nt, hsa; identical to SEQ ID NO: 333354

SEQ ID NO: 661696 - RNA, 64 nt, hsa; identical to SEQ ID NO: 333355

SEQ ID NO: 661697 - RNA, 64 nt, hsa; identical to SEQ ID NO: 333356

SEQ ID NO: 661698 - RNA, 64 nt, hsa; identical to SEQ ID NO: 333357

SEQ ID NO: 661699 - RNA, 64 nt, hsa; identical to SEQ ID NO: 333358

SEQ ID NO: 661700 - RNA, 64 nt, hsa; identical to SEQ ID NO: 333359

SEQ ID NO: 661701 - RNA, 64 nt, hsa; identical to SEQ ID NO: 333360

SEQ ID NO: 661702 - RNA, 64 nt, hsa; identical to SEQ ID NO: 333361

SEQ ID NO: 661703 - RNA, 64 nt, hsa; identical to SEQ ID NO: 333362

SEQ ID NO: 661704 - RNA, 64 nt, hsa; identical to SEQ ID NO: 333363

SEQ ID NO: 661705 - RNA, 64 nt, hsa; identical to SEQ ID NO: 333364

SEQ ID NO: 661706 - RNA, 64 nt, hsa; identical to SEQ ID NO: 333365

SEQ ID NO: 661707 - RNA, 64 nt, hsa; identical to SEQ ID NO: 333366

SEQ ID NO: 661708 - RNA, 64 nt, hsa; identical to SEQ ID NO: 333367

SEQ ID NO: 661709 - RNA, 64 nt, hsa; identical to SEQ ID NO: 333368

SEQ ID NO: 661710 - RNA, 64 nt, hsa; identical to SEQ ID NO: 333369

SEQ ID NO: 661711 - RNA, 64 nt, hsa; identical to SEQ ID NO: 333370

SEQ ID NO: 661712 - RNA, 64 nt, hsa; identical to SEQ ID NO: 333371

SEQ ID NO: 661713 - RNA, 64 nt, hsa; identical to SEQ ID NO: 333372

SEQ ID NO: 661714 - RNA, 64 nt, hsa; identical to SEQ ID NO: 333373

SEQ ID NO: 661715 - RNA, 64 nt, hsa; identical to SEQ ID NO: 333374

SEQ ID NO: 661716 - RNA, 64 nt, hsa; identical to SEQ ID NO: 333375

SEQ ID NO: 661717 - RNA, 64 nt, hsa; identical to SEQ ID NO: 333376

SEQ ID NO: 661718 - RNA, 64 nt, hsa; identical to SEQ ID NO: 333377

SEQ ID NO: 661719 - RNA, 64 nt, hsa; identical to SEQ ID NO: 333378

SEQ ID NO: 661720 - RNA, 64 nt, hsa; identical to SEQ ID NO: 333379

SEQ ID NO: 661721 - RNA, 64 nt, hsa; identical to SEQ ID NO: 333380

SEQ ID NO: 661722 - RNA, 64 nt, hsa; identical to SEQ ID NO: 333381

SEQ ID NO: 661723 - RNA, 64 nt, hsa; identical to SEQ ID NO: 333382

SEQ ID NO: 661724 - RNA, 64 nt, hsa; identical to SEQ ID NO: 333383

SEQ ID NO: 661725 - RNA, 64 nt, hsa; identical to SEQ ID NO: 333384

SEQ ID NO: 661726 - RNA, 64 nt, hsa; identical to SEQ ID NO: 333385

SEQ ID NO: 661727 - RNA, 64 nt, hsa; identical to SEQ ID NO: 333386

SEQ ID NO: 661728 - RNA, 64 nt, hsa; identical to SEQ ID NO: 333387

SEQ ID NO: 661729 - RNA, 64 nt, hsa; identical to SEQ ID NO: 333388

SEQ ID NO: 661730 - RNA, 64 nt, hsa; identical to SEQ ID NO: 333389

SEQ ID NO: 661731 - RNA, 64 nt, hsa; identical to SEQ ID NO: 333390

SEQ ID NO: 661732 - RNA, 64 nt, hsa; identical to SEQ ID NO: 333391

SEQ ID NO: 661733 - RNA, 64 nt, hsa; identical to SEQ ID NO: 333392

SEQ ID NO: 661734 - RNA, 64 nt, hsa; identical to SEQ ID NO: 333393

SEQ ID NO: 661735 - RNA, 64 nt, hsa; identical to SEQ ID NO: 333394

SEQ ID NO: 661736 - RNA, 64 nt, hsa; identical to SEQ ID NO: 333395

SEQ ID NO: 661737 - RNA, 64 nt, hsa; identical to SEQ ID NO: 333396

SEQ ID NO: 661738 - RNA, 64 nt, hsa; identical to SEQ ID NO: 333397

SEQ ID NO: 661739 - RNA, 64 nt, hsa; identical to SEQ ID NO: 333398

SEQ ID NO: 661740 - RNA, 64 nt, hsa; identical to SEQ ID NO: 333399

SEQ ID NO: 661741 - RNA, 64 nt, hsa; identical to SEQ ID NO: 333400

SEQ ID NO: 661742 - RNA, 64 nt, hsa; identical to SEQ ID NO: 333401

SEQ ID NO: 661743 - RNA, 64 nt, hsa; identical to SEQ ID NO: 333402

SEQ ID NO: 661744 - RNA, 64 nt, hsa; identical to SEQ ID NO: 333403

SEQ ID NO: 661745 - RNA, 64 nt, hsa; identical to SEQ ID NO: 333404

SEQ ID NO: 661746 - RNA, 64 nt, hsa; identical to SEQ ID NO: 333405

SEQ ID NO: 661747 - RNA, 64 nt, hsa; identical to SEQ ID NO: 333406

SEQ ID NO: 661748 - RNA, 64 nt, hsa; identical to SEQ ID NO: 333407

SEQ ID NO: 661749 - RNA, 64 nt, hsa; identical to SEQ ID NO: 333408

SEQ ID NO: 661750 - RNA, 64 nt, hsa; identical to SEQ ID NO: 333409

SEQ ID NO: 661751 - RNA, 64 nt, hsa; identical to SEQ ID NO: 333410

SEQ ID NO: 661752 - RNA, 64 nt, hsa; identical to SEQ ID NO: 333411

SEQ ID NO: 661753 - RNA, 64 nt, hsa; identical to SEQ ID NO: 333412

SEQ ID NO: 661754 - RNA, 64 nt, hsa; identical to SEQ ID NO: 333413

SEQ ID NO: 661755 - RNA, 64 nt, hsa; identical to SEQ ID NO: 333414

SEQ ID NO: 661756 - RNA, 64 nt, hsa; identical to SEQ ID NO: 333415

SEQ ID NO: 661757 - RNA, 64 nt, hsa; identical to SEQ ID NO: 333416

SEQ ID NO: 661758 - RNA, 64 nt, hsa; identical to SEQ ID NO: 333417

SEQ ID NO: 661759 - RNA, 64 nt, hsa; identical to SEQ ID NO: 333418

SEQ ID NO: 661760 - RNA, 64 nt, hsa; identical to SEQ ID NO: 333419

SEQ ID NO: 661761 - RNA, 64 nt, hsa; identical to SEQ ID NO: 333420

SEQ ID NO: 661762 - RNA, 64 nt, hsa; identical to SEQ ID NO: 333421

SEQ ID NO: 661763 - RNA, 64 nt, hsa; identical to SEQ ID NO: 333422

SEQ ID NO: 661764 - RNA, 64 nt, hsa; identical to SEQ ID NO: 333423

SEQ ID NO: 661765 - RNA, 64 nt, hsa; identical to SEQ ID NO: 333424

SEQ ID NO: 661766 - RNA, 64 nt, hsa; identical to SEQ ID NO: 333425

SEQ ID NO: 661767 - RNA, 64 nt, hsa; identical to SEQ ID NO: 333426

SEQ ID NO: 661768 - RNA, 64 nt, hsa; identical to SEQ ID NO: 333427

SEQ ID NO: 661769 - RNA, 64 nt, hsa; identical to SEQ ID NO: 333428

SEQ ID NO: 661770 - RNA, 64 nt, hsa; identical to SEQ ID NO: 333429

SEQ ID NO: 661771 - RNA, 64 nt, hsa; identical to SEQ ID NO: 333430

SEQ ID NO: 661772 - RNA, 64 nt, hsa; identical to SEQ ID NO: 333431

SEQ ID NO: 661773 - RNA, 64 nt, hsa; identical to SEQ ID NO: 333432

SEQ ID NO: 661774 - RNA, 64 nt, hsa; identical to SEQ ID NO: 333433

SEQ ID NO: 661775 - RNA, 64 nt, hsa; identical to SEQ ID NO: 333434

SEQ ID NO: 661776 - RNA, 64 nt, hsa; identical to SEQ ID NO: 333435

SEQ ID NO: 661777 - RNA, 64 nt, hsa; identical to SEQ ID NO: 333436

SEQ ID NO: 661778 - RNA, 64 nt, hsa; identical to SEQ ID NO: 333437

SEQ ID NO: 661779 - RNA, 64 nt, hsa; identical to SEQ ID NO: 333438

SEQ ID NO: 661780 - RNA, 64 nt, hsa; identical to SEQ ID NO: 333439

SEQ ID NO: 661781 - RNA, 64 nt, hsa; identical to SEQ ID NO: 333440

SEQ ID NO: 661782 - RNA, 64 nt, hsa; identical to SEQ ID NO: 333441

SEQ ID NO: 661783 - RNA, 64 nt, hsa; identical to SEQ ID NO: 333442

SEQ ID NO: 661784 - RNA, 64 nt, hsa; identical to SEQ ID NO: 333443

SEQ ID NO: 661785 - RNA, 64 nt, hsa; identical to SEQ ID NO: 333444

SEQ ID NO: 661786 - RNA, 64 nt, hsa; identical to SEQ ID NO: 333445

SEQ ID NO: 661787 - RNA, 64 nt, hsa; identical to SEQ ID NO: 333446

SEQ ID NO: 661788 - RNA, 64 nt, hsa; identical to SEQ ID NO: 333447

SEQ ID NO: 661789 - RNA, 64 nt, hsa; identical to SEQ ID NO: 333448

SEQ ID NO: 661790 - RNA, 64 nt, hsa; identical to SEQ ID NO: 333449

SEQ ID NO: 661791 - RNA, 64 nt, hsa; identical to SEQ ID NO: 333450

SEQ ID NO: 661792 - RNA, 64 nt, hsa; identical to SEQ ID NO: 333451

SEQ ID NO: 661793 - RNA, 64 nt, hsa; identical to SEQ ID NO: 333452

SEQ ID NO: 661794 - RNA, 64 nt, hsa; identical to SEQ ID NO: 333453

SEQ ID NO: 661795 - RNA, 64 nt, hsa; identical to SEQ ID NO: 333454

SEQ ID NO: 661796 - RNA, 55 nt, hsa; identical to SEQ ID NO: 333455

SEQ ID NO: 661797 - RNA, 64 nt, hsa; identical to SEQ ID NO: 333456

SEQ ID NO: 661798 - RNA, 64 nt, hsa; identical to SEQ ID NO: 333457

SEQ ID NO: 661799 - RNA, 64 nt, hsa; identical to SEQ ID NO: 333458

SEQ ID NO: 661800 - RNA, 64 nt, hsa; identical to SEQ ID NO: 237342

SEQ ID NO: 661801 - RNA, 64 nt, hsa; identical to SEQ ID NO: 237343

SEQ ID NO: 661802 - RNA, 64 nt, hsa; identical to SEQ ID NO: 237344

SEQ ID NO: 661803 - RNA, 64 nt, hsa; identical to SEQ ID NO: 237345

SEQ ID NO: 661804 - RNA, 64 nt, hsa; identical to SEQ ID NO: 237346

SEQ ID NO: 661805 - RNA, 64 nt, hsa; identical to SEQ ID NO: 237347

SEQ ID NO: 661806 - RNA, 64 nt, hsa; identical to SEQ ID NO: 237348

SEQ ID NO: 661807 - RNA, 64 nt, hsa; identical to SEQ ID NO: 237349

SEQ ID NO: 661808 - RNA, 64 nt, hsa; identical to SEQ ID NO: 237350

SEQ ID NO: 661809 - RNA, 64 nt, hsa; identical to SEQ ID NO: 237351

SEQ ID NO: 661810 - RNA, 64 nt, hsa; identical to SEQ ID NO: 237352

SEQ ID NO: 661811 - RNA, 64 nt, hsa; identical to SEQ ID NO: 237353

SEQ ID NO: 661812 - RNA, 64 nt, hsa; identical to SEQ ID NO: 333348

SEQ ID NO: 661813 - RNA, 64 nt, hsa; identical to SEQ ID NO: 333349

SEQ ID NO: 661814 - RNA, 64 nt, hsa; identical to SEQ ID NO: 333350

SEQ ID NO: 661815 - RNA, 64 nt, hsa; identical to SEQ ID NO: 333351

SEQ ID NO: 661816 - RNA, 64 nt, hsa; identical to SEQ ID NO: 333352

SEQ ID NO: 661817 - RNA, 64 nt, hsa; identical to SEQ ID NO: 333353

SEQ ID NO: 661818 - RNA, 64 nt, hsa; identical to SEQ ID NO: 333354

SEQ ID NO: 661819 - RNA, 64 nt, hsa; identical to SEQ ID NO: 333355

SEQ ID NO: 661820 - RNA, 64 nt, hsa; identical to SEQ ID NO: 333356

SEQ ID NO: 661821 - RNA, 64 nt, hsa; identical to SEQ ID NO: 333357

SEQ ID NO: 661822 - RNA, 64 nt, hsa; identical to SEQ ID NO: 333358

SEQ ID NO: 661823 - RNA, 64 nt, hsa; identical to SEQ ID NO: 333359

SEQ ID NO: 661824 - RNA, 64 nt, hsa; identical to SEQ ID NO: 333360

SEQ ID NO: 661825 - RNA, 64 nt, hsa; identical to SEQ ID NO: 333361

SEQ ID NO: 661826 - RNA, 64 nt, hsa; identical to SEQ ID NO: 333362

SEQ ID NO: 661827 - RNA, 64 nt, hsa; identical to SEQ ID NO: 333363

SEQ ID NO: 661828 - RNA, 64 nt, hsa; identical to SEQ ID NO: 333364

SEQ ID NO: 661829 - RNA, 64 nt, hsa; identical to SEQ ID NO: 333365

SEQ ID NO: 661830 - RNA, 64 nt, hsa; identical to SEQ ID NO: 333366

SEQ ID NO: 661831 - RNA, 64 nt, hsa; identical to SEQ ID NO: 333367

SEQ ID NO: 661832 - RNA, 64 nt, hsa; identical to SEQ ID NO: 333368

SEQ ID NO: 661833 - RNA, 64 nt, hsa; identical to SEQ ID NO: 333369

SEQ ID NO: 661834 - RNA, 64 nt, hsa; identical to SEQ ID NO: 333370

SEQ ID NO: 661835 - RNA, 64 nt, hsa; identical to SEQ ID NO: 333371

SEQ ID NO: 661836 - RNA, 64 nt, hsa; identical to SEQ ID NO: 333372

SEQ ID NO: 661837 - RNA, 64 nt, hsa; identical to SEQ ID NO: 333373

SEQ ID NO: 661838 - RNA, 64 nt, hsa; identical to SEQ ID NO: 333374

SEQ ID NO: 661839 - RNA, 64 nt, hsa; identical to SEQ ID NO: 333375

SEQ ID NO: 661840 - RNA, 64 nt, hsa; identical to SEQ ID NO: 333376

SEQ ID NO: 661841 - RNA, 64 nt, hsa; identical to SEQ ID NO: 333377

SEQ ID NO: 661842 - RNA, 64 nt, hsa; identical to SEQ ID NO: 333378

SEQ ID NO: 661843 - RNA, 64 nt, hsa; identical to SEQ ID NO: 333379

SEQ ID NO: 661844 - RNA, 64 nt, hsa; identical to SEQ ID NO: 333380

SEQ ID NO: 661845 - RNA, 64 nt, hsa; identical to SEQ ID NO: 333381

SEQ ID NO: 661846 - RNA, 64 nt, hsa; identical to SEQ ID NO: 333382

SEQ ID NO: 661847 - RNA, 64 nt, hsa; identical to SEQ ID NO: 333383

SEQ ID NO: 661848 - RNA, 64 nt, hsa; identical to SEQ ID NO: 333384

SEQ ID NO: 661849 - RNA, 64 nt, hsa; identical to SEQ ID NO: 333385

SEQ ID NO: 661850 - RNA, 64 nt, hsa; identical to SEQ ID NO: 333386

SEQ ID NO: 661851 - RNA, 64 nt, hsa; identical to SEQ ID NO: 333387

SEQ ID NO: 661852 - RNA, 64 nt, hsa; identical to SEQ ID NO: 333388

SEQ ID NO: 661853 - RNA, 64 nt, hsa; identical to SEQ ID NO: 333389

SEQ ID NO: 661854 - RNA, 64 nt, hsa; identical to SEQ ID NO: 333390

SEQ ID NO: 661855 - RNA, 64 nt, hsa; identical to SEQ ID NO: 333391

SEQ ID NO: 661856 - RNA, 64 nt, hsa; identical to SEQ ID NO: 333392

SEQ ID NO: 661857 - RNA, 64 nt, hsa; identical to SEQ ID NO: 333393

SEQ ID NO: 661858 - RNA, 64 nt, hsa; identical to SEQ ID NO: 333394

SEQ ID NO: 661859 - RNA, 64 nt, hsa; identical to SEQ ID NO: 333395

SEQ ID NO: 661860 - RNA, 64 nt, hsa; identical to SEQ ID NO: 333396

SEQ ID NO: 661861 - RNA, 64 nt, hsa; identical to SEQ ID NO: 333397

SEQ ID NO: 661862 - RNA, 64 nt, hsa; identical to SEQ ID NO: 333398

SEQ ID NO: 661863 - RNA, 64 nt, hsa; identical to SEQ ID NO: 333399

SEQ ID NO: 661864 - RNA, 64 nt, hsa; identical to SEQ ID NO: 333400

SEQ ID NO: 661865 - RNA, 64 nt, hsa; identical to SEQ ID NO: 333401

SEQ ID NO: 661866 - RNA, 64 nt, hsa; identical to SEQ ID NO: 333402

SEQ ID NO: 661867 - RNA, 64 nt, hsa; identical to SEQ ID NO: 333403

SEQ ID NO: 661868 - RNA, 64 nt, hsa; identical to SEQ ID NO: 333404

SEQ ID NO: 661869 - RNA, 64 nt, hsa; identical to SEQ ID NO: 333405

SEQ ID NO: 661870 - RNA, 64 nt, hsa; identical to SEQ ID NO: 333406

SEQ ID NO: 661871 - RNA, 64 nt, hsa; identical to SEQ ID NO: 333407

SEQ ID NO: 661872 - RNA, 64 nt, hsa; identical to SEQ ID NO: 333408

SEQ ID NO: 661873 - RNA, 64 nt, hsa; identical to SEQ ID NO: 333409

SEQ ID NO: 661874 - RNA, 64 nt, hsa; identical to SEQ ID NO: 333410

SEQ ID NO: 661875 - RNA, 64 nt, hsa; identical to SEQ ID NO: 333411

SEQ ID NO: 661876 - RNA, 64 nt, hsa; identical to SEQ ID NO: 333412

SEQ ID NO: 661877 - RNA, 64 nt, hsa; identical to SEQ ID NO: 333413

SEQ ID NO: 661878 - RNA, 64 nt, hsa; identical to SEQ ID NO: 333414

SEQ ID NO: 661879 - RNA, 64 nt, hsa; identical to SEQ ID NO: 333415

SEQ ID NO: 661880 - RNA, 64 nt, hsa; identical to SEQ ID NO: 333416

SEQ ID NO: 661881 - RNA, 64 nt, hsa; identical to SEQ ID NO: 333417

SEQ ID NO: 661882 - RNA, 64 nt, hsa; identical to SEQ ID NO: 333418

SEQ ID NO: 661883 - RNA, 64 nt, hsa; identical to SEQ ID NO: 333419

SEQ ID NO: 661884 - RNA, 64 nt, hsa; identical to SEQ ID NO: 333420

SEQ ID NO: 661885 - RNA, 64 nt, hsa; identical to SEQ ID NO: 333421

SEQ ID NO: 661886 - RNA, 64 nt, hsa; identical to SEQ ID NO: 333422

SEQ ID NO: 661887 - RNA, 64 nt, hsa; identical to SEQ ID NO: 333423

SEQ ID NO: 661888 - RNA, 64 nt, hsa; identical to SEQ ID NO: 333424

SEQ ID NO: 661889 - RNA, 64 nt, hsa; identical to SEQ ID NO: 333425

SEQ ID NO: 661890 - RNA, 64 nt, hsa; identical to SEQ ID NO: 333426

SEQ ID NO: 661891 - RNA, 64 nt, hsa; identical to SEQ ID NO: 333427

SEQ ID NO: 661892 - RNA, 64 nt, hsa; identical to SEQ ID NO: 333428

SEQ ID NO: 661893 - RNA, 64 nt, hsa; identical to SEQ ID NO: 333429

SEQ ID NO: 661894 - RNA, 64 nt, hsa; identical to SEQ ID NO: 333430

SEQ ID NO: 661895 - RNA, 64 nt, hsa; identical to SEQ ID NO: 333431

SEQ ID NO: 661896 - RNA, 64 nt, hsa; identical to SEQ ID NO: 333432

SEQ ID NO: 661897 - RNA, 64 nt, hsa; identical to SEQ ID NO: 333433

SEQ ID NO: 661898 - RNA, 64 nt, hsa; identical to SEQ ID NO: 333434

SEQ ID NO: 661899 - RNA, 64 nt, hsa; identical to SEQ ID NO: 333435

SEQ ID NO: 661900 - RNA, 64 nt, hsa; identical to SEQ ID NO: 333436

SEQ ID NO: 661901 - RNA, 64 nt, hsa; identical to SEQ ID NO: 333437

SEQ ID NO: 661902 - RNA, 64 nt, hsa; identical to SEQ ID NO: 333438

SEQ ID NO: 661903 - RNA, 64 nt, hsa; identical to SEQ ID NO: 333439

SEQ ID NO: 661904 - RNA, 64 nt, hsa; identical to SEQ ID NO: 333440

SEQ ID NO: 661905 - RNA, 64 nt, hsa; identical to SEQ ID NO: 333441

SEQ ID NO: 661906 - RNA, 64 nt, hsa; identical to SEQ ID NO: 333442

SEQ ID NO: 661907 - RNA, 64 nt, hsa; identical to SEQ ID NO: 333443

SEQ ID NO: 661908 - RNA, 64 nt, hsa; identical to SEQ ID NO: 333444

SEQ ID NO: 661909 - RNA, 64 nt, hsa; identical to SEQ ID NO: 333445

SEQ ID NO: 661910 - RNA, 64 nt, hsa; identical to SEQ ID NO: 333446

SEQ ID NO: 661911 - RNA, 64 nt, hsa; identical to SEQ ID NO: 333447

SEQ ID NO: 661912 - RNA, 64 nt, hsa; identical to SEQ ID NO: 333448

SEQ ID NO: 661913 - RNA, 64 nt, hsa; identical to SEQ ID NO: 333449

SEQ ID NO: 661914 - RNA, 64 nt, hsa; identical to SEQ ID NO: 333450

SEQ ID NO: 661915 - RNA, 64 nt, hsa; identical to SEQ ID NO: 333451

SEQ ID NO: 661916 - RNA, 64 nt, hsa; identical to SEQ ID NO: 333452

SEQ ID NO: 661917 - RNA, 64 nt, hsa; identical to SEQ ID NO: 333453

SEQ ID NO: 661918 - RNA, 64 nt, hsa; identical to SEQ ID NO: 333454

SEQ ID NO: 661919 - RNA, 55 nt, hsa; identical to SEQ ID NO: 333455

SEQ ID NO: 661920 - RNA, 64 nt, hsa; identical to SEQ ID NO: 333456

SEQ ID NO: 661921 - RNA, 64 nt, hsa; identical to SEQ ID NO: 333457

SEQ ID NO: 661922 - RNA, 64 nt, hsa; identical to SEQ ID NO: 333458

SEQ ID NO: 661923 - RNA, 64 nt, hsa; identical to SEQ ID NO: 237342

SEQ ID NO: 661924 - RNA, 64 nt, hsa; identical to SEQ ID NO: 237343

SEQ ID NO: 661925 - RNA, 64 nt, hsa; identical to SEQ ID NO: 237344

SEQ ID NO: 661926 - RNA, 64 nt, hsa; identical to SEQ ID NO: 237345

SEQ ID NO: 661927 - RNA, 64 nt, hsa; identical to SEQ ID NO: 237346

SEQ ID NO: 661928 - RNA, 64 nt, hsa; identical to SEQ ID NO: 237347

SEQ ID NO: 661929 - RNA, 64 nt, hsa; identical to SEQ ID NO: 237348

SEQ ID NO: 661930 - RNA, 64 nt, hsa; identical to SEQ ID NO: 237349

SEQ ID NO: 661931 - RNA, 64 nt, hsa; identical to SEQ ID NO: 237350

SEQ ID NO: 661932 - RNA, 64 nt, hsa; identical to SEQ ID NO: 237351

SEQ ID NO: 661933 - RNA, 64 nt, hsa; identical to SEQ ID NO: 237352

SEQ ID NO: 661934 - RNA, 64 nt, hsa; identical to SEQ ID NO: 237353

SEQ ID NO: 661935 - RNA, 64 nt, hsa; identical to SEQ ID NO: 333348

SEQ ID NO: 661936 - RNA, 64 nt, hsa; identical to SEQ ID NO: 333349

SEQ ID NO: 661937 - RNA, 64 nt, hsa; identical to SEQ ID NO: 333350

SEQ ID NO: 661938 - RNA, 64 nt, hsa; identical to SEQ ID NO: 333351

SEQ ID NO: 661939 - RNA, 64 nt, hsa; identical to SEQ ID NO: 333352

SEQ ID NO: 661940 - RNA, 64 nt, hsa; identical to SEQ ID NO: 333353

SEQ ID NO: 661941 - RNA, 64 nt, hsa; identical to SEQ ID NO: 333354

SEQ ID NO: 661942 - RNA, 64 nt, hsa; identical to SEQ ID NO: 333355

SEQ ID NO: 661943 - RNA, 64 nt, hsa; identical to SEQ ID NO: 333356

SEQ ID NO: 661944 - RNA, 64 nt, hsa; identical to SEQ ID NO: 333357

SEQ ID NO: 661945 - RNA, 64 nt, hsa; identical to SEQ ID NO: 333358

SEQ ID NO: 661946 - RNA, 64 nt, hsa; identical to SEQ ID NO: 333359

SEQ ID NO: 661947 - RNA, 64 nt, hsa; identical to SEQ ID NO: 333360

SEQ ID NO: 661948 - RNA, 64 nt, hsa; identical to SEQ ID NO: 333361

SEQ ID NO: 661949 - RNA, 64 nt, hsa; identical to SEQ ID NO: 333362

SEQ ID NO: 661950 - RNA, 64 nt, hsa; identical to SEQ ID NO: 333363

SEQ ID NO: 661951 - RNA, 64 nt, hsa; identical to SEQ ID NO: 333364

SEQ ID NO: 661952 - RNA, 64 nt, hsa; identical to SEQ ID NO: 333365

SEQ ID NO: 661953 - RNA, 64 nt, hsa; identical to SEQ ID NO: 333366

SEQ ID NO: 661954 - RNA, 64 nt, hsa; identical to SEQ ID NO: 333367

SEQ ID NO: 661955 - RNA, 64 nt, hsa; identical to SEQ ID NO: 333368

SEQ ID NO: 661956 - RNA, 64 nt, hsa; identical to SEQ ID NO: 333369

SEQ ID NO: 661957 - RNA, 64 nt, hsa; identical to SEQ ID NO: 333370

SEQ ID NO: 661958 - RNA, 64 nt, hsa; identical to SEQ ID NO: 333371

SEQ ID NO: 661959 - RNA, 64 nt, hsa; identical to SEQ ID NO: 333372

SEQ ID NO: 661960 - RNA, 64 nt, hsa; identical to SEQ ID NO: 333373

SEQ ID NO: 661961 - RNA, 64 nt, hsa; identical to SEQ ID NO: 333374

SEQ ID NO: 661962 - RNA, 64 nt, hsa; identical to SEQ ID NO: 333375

SEQ ID NO: 661963 - RNA, 64 nt, hsa; identical to SEQ ID NO: 333376

SEQ ID NO: 661964 - RNA, 64 nt, hsa; identical to SEQ ID NO: 333377

SEQ ID NO: 661965 - RNA, 64 nt, hsa; identical to SEQ ID NO: 333378

SEQ ID NO: 661966 - RNA, 64 nt, hsa; identical to SEQ ID NO: 333379

SEQ ID NO: 661967 - RNA, 64 nt, hsa; identical to SEQ ID NO: 333380

SEQ ID NO: 661968 - RNA, 64 nt, hsa; identical to SEQ ID NO: 333381

SEQ ID NO: 661969 - RNA, 64 nt, hsa; identical to SEQ ID NO: 333382

SEQ ID NO: 661970 - RNA, 64 nt, hsa; identical to SEQ ID NO: 333383

SEQ ID NO: 661971 - RNA, 64 nt, hsa; identical to SEQ ID NO: 333384

SEQ ID NO: 661972 - RNA, 64 nt, hsa; identical to SEQ ID NO: 333385

SEQ ID NO: 661973 - RNA, 64 nt, hsa; identical to SEQ ID NO: 333386

SEQ ID NO: 661974 - RNA, 64 nt, hsa; identical to SEQ ID NO: 333387

SEQ ID NO: 661975 - RNA, 64 nt, hsa; identical to SEQ ID NO: 333388

SEQ ID NO: 661976 - RNA, 64 nt, hsa; identical to SEQ ID NO: 333389

SEQ ID NO: 661977 - RNA, 64 nt, hsa; identical to SEQ ID NO: 333390

SEQ ID NO: 661978 - RNA, 64 nt, hsa; identical to SEQ ID NO: 333391

SEQ ID NO: 661979 - RNA, 64 nt, hsa; identical to SEQ ID NO: 333392

SEQ ID NO: 661980 - RNA, 64 nt, hsa; identical to SEQ ID NO: 333393

SEQ ID NO: 661981 - RNA, 64 nt, hsa; identical to SEQ ID NO: 333394

SEQ ID NO: 661982 - RNA, 64 nt, hsa; identical to SEQ ID NO: 333395

SEQ ID NO: 661983 - RNA, 64 nt, hsa; identical to SEQ ID NO: 333396

SEQ ID NO: 661984 - RNA, 64 nt, hsa; identical to SEQ ID NO: 333397

SEQ ID NO: 661985 - RNA, 64 nt, hsa; identical to SEQ ID NO: 333398

SEQ ID NO: 661986 - RNA, 64 nt, hsa; identical to SEQ ID NO: 333399

SEQ ID NO: 661987 - RNA, 64 nt, hsa; identical to SEQ ID NO: 333400

SEQ ID NO: 661988 - RNA, 64 nt, hsa; identical to SEQ ID NO: 333401

SEQ ID NO: 661989 - RNA, 64 nt, hsa; identical to SEQ ID NO: 333402

SEQ ID NO: 661990 - RNA, 64 nt, hsa; identical to SEQ ID NO: 333403

SEQ ID NO: 661991 - RNA, 64 nt, hsa; identical to SEQ ID NO: 333404

SEQ ID NO: 661992 - RNA, 64 nt, hsa; identical to SEQ ID NO: 333405

SEQ ID NO: 661993 - RNA, 64 nt, hsa; identical to SEQ ID NO: 333406

SEQ ID NO: 661994 - RNA, 64 nt, hsa; identical to SEQ ID NO: 333407

SEQ ID NO: 661995 - RNA, 64 nt, hsa; identical to SEQ ID NO: 333408

SEQ ID NO: 661996 - RNA, 64 nt, hsa; identical to SEQ ID NO: 333409

SEQ ID NO: 661997 - RNA, 64 nt, hsa; identical to SEQ ID NO: 333410

SEQ ID NO: 661998 - RNA, 64 nt, hsa; identical to SEQ ID NO: 333411

SEQ ID NO: 661999 - RNA, 64 nt, hsa; identical to SEQ ID NO: 333412

SEQ ID NO: 662000 - RNA, 64 nt, hsa; identical to SEQ ID NO: 333413

SEQ ID NO: 662001 - RNA, 64 nt, hsa; identical to SEQ ID NO: 333414

SEQ ID NO: 662002 - RNA, 64 nt, hsa; identical to SEQ ID NO: 333415

SEQ ID NO: 662003 - RNA, 64 nt, hsa; identical to SEQ ID NO: 333416

SEQ ID NO: 662004 - RNA, 64 nt, hsa; identical to SEQ ID NO: 333417

SEQ ID NO: 662005 - RNA, 64 nt, hsa; identical to SEQ ID NO: 333418

SEQ ID NO: 662006 - RNA, 64 nt, hsa; identical to SEQ ID NO: 333419

SEQ ID NO: 662007 - RNA, 64 nt, hsa; identical to SEQ ID NO: 333420

SEQ ID NO: 662008 - RNA, 64 nt, hsa; identical to SEQ ID NO: 333421

SEQ ID NO: 662009 - RNA, 64 nt, hsa; identical to SEQ ID NO: 333422

SEQ ID NO: 662010 - RNA, 64 nt, hsa; identical to SEQ ID NO: 333423

SEQ ID NO: 662011 - RNA, 64 nt, hsa; identical to SEQ ID NO: 333424

SEQ ID NO: 662012 - RNA, 64 nt, hsa; identical to SEQ ID NO: 333425

SEQ ID NO: 662013 - RNA, 64 nt, hsa; identical to SEQ ID NO: 333426

SEQ ID NO: 662014 - RNA, 64 nt, hsa; identical to SEQ ID NO: 333427

SEQ ID NO: 662015 - RNA, 64 nt, hsa; identical to SEQ ID NO: 333428

SEQ ID NO: 662016 - RNA, 64 nt, hsa; identical to SEQ ID NO: 333429

SEQ ID NO: 662017 - RNA, 64 nt, hsa; identical to SEQ ID NO: 333430

SEQ ID NO: 662018 - RNA, 64 nt, hsa; identical to SEQ ID NO: 333431

SEQ ID NO: 662019 - RNA, 64 nt, hsa; identical to SEQ ID NO: 333432

SEQ ID NO: 662020 - RNA, 64 nt, hsa; identical to SEQ ID NO: 333433

SEQ ID NO: 662021 - RNA, 64 nt, hsa; identical to SEQ ID NO: 333434

SEQ ID NO: 662022 - RNA, 64 nt, hsa; identical to SEQ ID NO: 333435

SEQ ID NO: 662023 - RNA, 64 nt, hsa; identical to SEQ ID NO: 333436

SEQ ID NO: 662024 - RNA, 64 nt, hsa; identical to SEQ ID NO: 333437

SEQ ID NO: 662025 - RNA, 64 nt, hsa; identical to SEQ ID NO: 333438

SEQ ID NO: 662026 - RNA, 64 nt, hsa; identical to SEQ ID NO: 333439

SEQ ID NO: 662027 - RNA, 64 nt, hsa; identical to SEQ ID NO: 333440

SEQ ID NO: 662028 - RNA, 64 nt, hsa; identical to SEQ ID NO: 333441

SEQ ID NO: 662029 - RNA, 64 nt, hsa; identical to SEQ ID NO: 333442

SEQ ID NO: 662030 - RNA, 64 nt, hsa; identical to SEQ ID NO: 333443

SEQ ID NO: 662031 - RNA, 64 nt, hsa; identical to SEQ ID NO: 333444

SEQ ID NO: 662032 - RNA, 64 nt, hsa; identical to SEQ ID NO: 333445

SEQ ID NO: 662033 - RNA, 64 nt, hsa; identical to SEQ ID NO: 333446

SEQ ID NO: 662034 - RNA, 64 nt, hsa; identical to SEQ ID NO: 333447

SEQ ID NO: 662035 - RNA, 64 nt, hsa; identical to SEQ ID NO: 333448

SEQ ID NO: 662036 - RNA, 64 nt, hsa; identical to SEQ ID NO: 333449

SEQ ID NO: 662037 - RNA, 64 nt, hsa; identical to SEQ ID NO: 333450

SEQ ID NO: 662038 - RNA, 64 nt, hsa; identical to SEQ ID NO: 333451

SEQ ID NO: 662039 - RNA, 64 nt, hsa; identical to SEQ ID NO: 333452

SEQ ID NO: 662040 - RNA, 64 nt, hsa; identical to SEQ ID NO: 333453

SEQ ID NO: 662041 - RNA, 64 nt, hsa; identical to SEQ ID NO: 333454

SEQ ID NO: 662042 - RNA, 55 nt, hsa; identical to SEQ ID NO: 333455

SEQ ID NO: 662043 - RNA, 64 nt, hsa; identical to SEQ ID NO: 333456

SEQ ID NO: 662044 - RNA, 64 nt, hsa; identical to SEQ ID NO: 333457

SEQ ID NO: 662045 - RNA, 64 nt, hsa; identical to SEQ ID NO: 333458

SEQ ID NO: 662046 - RNA, 64 nt, hsa; identical to SEQ ID NO: 237342

SEQ ID NO: 662047 - RNA, 64 nt, hsa; identical to SEQ ID NO: 237343

SEQ ID NO: 662048 - RNA, 64 nt, hsa; identical to SEQ ID NO: 237344

SEQ ID NO: 662049 - RNA, 64 nt, hsa; identical to SEQ ID NO: 237345

SEQ ID NO: 662050 - RNA, 64 nt, hsa; identical to SEQ ID NO: 237346

SEQ ID NO: 662051 - RNA, 64 nt, hsa; identical to SEQ ID NO: 237347

SEQ ID NO: 662052 - RNA, 64 nt, hsa; identical to SEQ ID NO: 237348

SEQ ID NO: 662053 - RNA, 64 nt, hsa; identical to SEQ ID NO: 237349

SEQ ID NO: 662054 - RNA, 64 nt, hsa; identical to SEQ ID NO: 237350

SEQ ID NO: 662055 - RNA, 64 nt, hsa; identical to SEQ ID NO: 237351

SEQ ID NO: 662056 - RNA, 64 nt, hsa; identical to SEQ ID NO: 237352

SEQ ID NO: 662057 - RNA, 64 nt, hsa; identical to SEQ ID NO: 237353

SEQ ID NO: 662058 - RNA, 64 nt, hsa; identical to SEQ ID NO: 333348

SEQ ID NO: 662059 - RNA, 64 nt, hsa; identical to SEQ ID NO: 333349

SEQ ID NO: 662060 - RNA, 64 nt, hsa; identical to SEQ ID NO: 333350

SEQ ID NO: 662061 - RNA, 64 nt, hsa; identical to SEQ ID NO: 333351

SEQ ID NO: 662062 - RNA, 64 nt, hsa; identical to SEQ ID NO: 333352

SEQ ID NO: 662063 - RNA, 64 nt, hsa; identical to SEQ ID NO: 333353

SEQ ID NO: 662064 - RNA, 64 nt, hsa; identical to SEQ ID NO: 333354

SEQ ID NO: 662065 - RNA, 64 nt, hsa; identical to SEQ ID NO: 333355

SEQ ID NO: 662066 - RNA, 64 nt, hsa; identical to SEQ ID NO: 333356

SEQ ID NO: 662067 - RNA, 64 nt, hsa; identical to SEQ ID NO: 333357

SEQ ID NO: 662068 - RNA, 64 nt, hsa; identical to SEQ ID NO: 333358

SEQ ID NO: 662069 - RNA, 64 nt, hsa; identical to SEQ ID NO: 333359

SEQ ID NO: 662070 - RNA, 64 nt, hsa; identical to SEQ ID NO: 333360

SEQ ID NO: 662071 - RNA, 64 nt, hsa; identical to SEQ ID NO: 333361

SEQ ID NO: 662072 - RNA, 64 nt, hsa; identical to SEQ ID NO: 333362

SEQ ID NO: 662073 - RNA, 64 nt, hsa; identical to SEQ ID NO: 333363

SEQ ID NO: 662074 - RNA, 64 nt, hsa; identical to SEQ ID NO: 333364

SEQ ID NO: 662075 - RNA, 64 nt, hsa; identical to SEQ ID NO: 333365

SEQ ID NO: 662076 - RNA, 64 nt, hsa; identical to SEQ ID NO: 333366

SEQ ID NO: 662077 - RNA, 64 nt, hsa; identical to SEQ ID NO: 333367

SEQ ID NO: 662078 - RNA, 64 nt, hsa; identical to SEQ ID NO: 333368

SEQ ID NO: 662079 - RNA, 64 nt, hsa; identical to SEQ ID NO: 333369

SEQ ID NO: 662080 - RNA, 64 nt, hsa; identical to SEQ ID NO: 333370

SEQ ID NO: 662081 - RNA, 64 nt, hsa; identical to SEQ ID NO: 333371

SEQ ID NO: 662082 - RNA, 64 nt, hsa; identical to SEQ ID NO: 333372

SEQ ID NO: 662083 - RNA, 64 nt, hsa; identical to SEQ ID NO: 333373

SEQ ID NO: 662084 - RNA, 64 nt, hsa; identical to SEQ ID NO: 333374

SEQ ID NO: 662085 - RNA, 64 nt, hsa; identical to SEQ ID NO: 333375

SEQ ID NO: 662086 - RNA, 64 nt, hsa; identical to SEQ ID NO: 333376

SEQ ID NO: 662087 - RNA, 64 nt, hsa; identical to SEQ ID NO: 333377

SEQ ID NO: 662088 - RNA, 64 nt, hsa; identical to SEQ ID NO: 333378

SEQ ID NO: 662089 - RNA, 64 nt, hsa; identical to SEQ ID NO: 333379

SEQ ID NO: 662090 - RNA, 64 nt, hsa; identical to SEQ ID NO: 333380

SEQ ID NO: 662091 - RNA, 64 nt, hsa; identical to SEQ ID NO: 333381

SEQ ID NO: 662092 - RNA, 64 nt, hsa; identical to SEQ ID NO: 333382

SEQ ID NO: 662093 - RNA, 64 nt, hsa; identical to SEQ ID NO: 333383

SEQ ID NO: 662094 - RNA, 64 nt, hsa; identical to SEQ ID NO: 333384

SEQ ID NO: 662095 - RNA, 64 nt, hsa; identical to SEQ ID NO: 333385

SEQ ID NO: 662096 - RNA, 64 nt, hsa; identical to SEQ ID NO: 333386

SEQ ID NO: 662097 - RNA, 64 nt, hsa; identical to SEQ ID NO: 333387

SEQ ID NO: 662098 - RNA, 64 nt, hsa; identical to SEQ ID NO: 333388

SEQ ID NO: 662099 - RNA, 64 nt, hsa; identical to SEQ ID NO: 333389

SEQ ID NO: 662100 - RNA, 64 nt, hsa; identical to SEQ ID NO: 333390

SEQ ID NO: 662101 - RNA, 64 nt, hsa; identical to SEQ ID NO: 333391

SEQ ID NO: 662102 - RNA, 64 nt, hsa; identical to SEQ ID NO: 333392

SEQ ID NO: 662103 - RNA, 64 nt, hsa; identical to SEQ ID NO: 333393

SEQ ID NO: 662104 - RNA, 64 nt, hsa; identical to SEQ ID NO: 333394

SEQ ID NO: 662105 - RNA, 64 nt, hsa; identical to SEQ ID NO: 333395

SEQ ID NO: 662106 - RNA, 64 nt, hsa; identical to SEQ ID NO: 333396

SEQ ID NO: 662107 - RNA, 64 nt, hsa; identical to SEQ ID NO: 333397

SEQ ID NO: 662108 - RNA, 64 nt, hsa; identical to SEQ ID NO: 333398

SEQ ID NO: 662109 - RNA, 64 nt, hsa; identical to SEQ ID NO: 333399

SEQ ID NO: 662110 - RNA, 64 nt, hsa; identical to SEQ ID NO: 333400

SEQ ID NO: 662111 - RNA, 64 nt, hsa; identical to SEQ ID NO: 333401

SEQ ID NO: 662112 - RNA, 64 nt, hsa; identical to SEQ ID NO: 333402

SEQ ID NO: 662113 - RNA, 64 nt, hsa; identical to SEQ ID NO: 333403

SEQ ID NO: 662114 - RNA, 64 nt, hsa; identical to SEQ ID NO: 333404

SEQ ID NO: 662115 - RNA, 64 nt, hsa; identical to SEQ ID NO: 333405

SEQ ID NO: 662116 - RNA, 64 nt, hsa; identical to SEQ ID NO: 333406

SEQ ID NO: 662117 - RNA, 64 nt, hsa; identical to SEQ ID NO: 333407

SEQ ID NO: 662118 - RNA, 64 nt, hsa; identical to SEQ ID NO: 333408

SEQ ID NO: 662119 - RNA, 64 nt, hsa; identical to SEQ ID NO: 333409

SEQ ID NO: 662120 - RNA, 64 nt, hsa; identical to SEQ ID NO: 333410

SEQ ID NO: 662121 - RNA, 64 nt, hsa; identical to SEQ ID NO: 333411

SEQ ID NO: 662122 - RNA, 64 nt, hsa; identical to SEQ ID NO: 333412

SEQ ID NO: 662123 - RNA, 64 nt, hsa; identical to SEQ ID NO: 333413

SEQ ID NO: 662124 - RNA, 64 nt, hsa; identical to SEQ ID NO: 333414

SEQ ID NO: 662125 - RNA, 64 nt, hsa; identical to SEQ ID NO: 333415

SEQ ID NO: 662126 - RNA, 64 nt, hsa; identical to SEQ ID NO: 333416

SEQ ID NO: 662127 - RNA, 64 nt, hsa; identical to SEQ ID NO: 333417

SEQ ID NO: 662128 - RNA, 64 nt, hsa; identical to SEQ ID NO: 333418

SEQ ID NO: 662129 - RNA, 64 nt, hsa; identical to SEQ ID NO: 333419

SEQ ID NO: 662130 - RNA, 64 nt, hsa; identical to SEQ ID NO: 333420

SEQ ID NO: 662131 - RNA, 64 nt, hsa; identical to SEQ ID NO: 333421

SEQ ID NO: 662132 - RNA, 64 nt, hsa; identical to SEQ ID NO: 333422

SEQ ID NO: 662133 - RNA, 64 nt, hsa; identical to SEQ ID NO: 333423

SEQ ID NO: 662134 - RNA, 64 nt, hsa; identical to SEQ ID NO: 333424

SEQ ID NO: 662135 - RNA, 64 nt, hsa; identical to SEQ ID NO: 333425

SEQ ID NO: 662136 - RNA, 64 nt, hsa; identical to SEQ ID NO: 333426

SEQ ID NO: 662137 - RNA, 64 nt, hsa; identical to SEQ ID NO: 333427

SEQ ID NO: 662138 - RNA, 64 nt, hsa; identical to SEQ ID NO: 333428

SEQ ID NO: 662139 - RNA, 64 nt, hsa; identical to SEQ ID NO: 333429

SEQ ID NO: 662140 - RNA, 64 nt, hsa; identical to SEQ ID NO: 333430

SEQ ID NO: 662141 - RNA, 64 nt, hsa; identical to SEQ ID NO: 333431

SEQ ID NO: 662142 - RNA, 64 nt, hsa; identical to SEQ ID NO: 333432

SEQ ID NO: 662143 - RNA, 64 nt, hsa; identical to SEQ ID NO: 333433

SEQ ID NO: 662144 - RNA, 64 nt, hsa; identical to SEQ ID NO: 333434

SEQ ID NO: 662145 - RNA, 64 nt, hsa; identical to SEQ ID NO: 333435

SEQ ID NO: 662146 - RNA, 64 nt, hsa; identical to SEQ ID NO: 333436

SEQ ID NO: 662147 - RNA, 64 nt, hsa; identical to SEQ ID NO: 333437

SEQ ID NO: 662148 - RNA, 64 nt, hsa; identical to SEQ ID NO: 333438

SEQ ID NO: 662149 - RNA, 64 nt, hsa; identical to SEQ ID NO: 333439

SEQ ID NO: 662150 - RNA, 64 nt, hsa; identical to SEQ ID NO: 333440

SEQ ID NO: 662151 - RNA, 64 nt, hsa; identical to SEQ ID NO: 333441

SEQ ID NO: 662152 - RNA, 64 nt, hsa; identical to SEQ ID NO: 333442

SEQ ID NO: 662153 - RNA, 64 nt, hsa; identical to SEQ ID NO: 333443

SEQ ID NO: 662154 - RNA, 64 nt, hsa; identical to SEQ ID NO: 333444

SEQ ID NO: 662155 - RNA, 64 nt, hsa; identical to SEQ ID NO: 333445

SEQ ID NO: 662156 - RNA, 64 nt, hsa; identical to SEQ ID NO: 333446

SEQ ID NO: 662157 - RNA, 64 nt, hsa; identical to SEQ ID NO: 333447

SEQ ID NO: 662158 - RNA, 64 nt, hsa; identical to SEQ ID NO: 333448

SEQ ID NO: 662159 - RNA, 64 nt, hsa; identical to SEQ ID NO: 333449

SEQ ID NO: 662160 - RNA, 64 nt, hsa; identical to SEQ ID NO: 333450

SEQ ID NO: 662161 - RNA, 64 nt, hsa; identical to SEQ ID NO: 333451

SEQ ID NO: 662162 - RNA, 64 nt, hsa; identical to SEQ ID NO: 333452

SEQ ID NO: 662163 - RNA, 64 nt, hsa; identical to SEQ ID NO: 333453

SEQ ID NO: 662164 - RNA, 64 nt, hsa; identical to SEQ ID NO: 333454

SEQ ID NO: 662165 - RNA, 55 nt, hsa; identical to SEQ ID NO: 333455

SEQ ID NO: 662166 - RNA, 64 nt, hsa; identical to SEQ ID NO: 333456

SEQ ID NO: 662167 - RNA, 64 nt, hsa; identical to SEQ ID NO: 333457

SEQ ID NO: 662168 - RNA, 64 nt, hsa; identical to SEQ ID NO: 333458

SEQ ID NO: 662169 - RNA, 63 nt, hsa; identical to SEQ ID NO: 129380

SEQ ID NO: 662170 - RNA, 63 nt, hsa; identical to SEQ ID NO: 129381

SEQ ID NO: 662171 - RNA, 64 nt, hsa; identical to SEQ ID NO: 532305

SEQ ID NO: 662172 - RNA, 64 nt, hsa; identical to SEQ ID NO: 532306

SEQ ID NO: 662173 - RNA, 64 nt, hsa; identical to SEQ ID NO: 532307

SEQ ID NO: 662174 - RNA, 64 nt, hsa; identical to SEQ ID NO: 532308

SEQ ID NO: 662175 - RNA, 64 nt, hsa; identical to SEQ ID NO: 532309

SEQ ID NO: 662176 - RNA, 57 nt, hsa; identical to SEQ ID NO: 83127

SEQ ID NO: 662177 - RNA, 64 nt, hsa; identical to SEQ ID NO: 532311

SEQ ID NO: 662178 - RNA, 64 nt, hsa; identical to SEQ ID NO: 532312

SEQ ID NO: 662179 - RNA, 64 nt, hsa; identical to SEQ ID NO: 532313

SEQ ID NO: 662180 - RNA, 64 nt, hsa; identical to SEQ ID NO: 532314

SEQ ID NO: 662181 - RNA, 64 nt, hsa; identical to SEQ ID NO: 532315

SEQ ID NO: 662182 - RNA, 64 nt, hsa; identical to SEQ ID NO: 532316

SEQ ID NO: 662183 - RNA, 64 nt, hsa; identical to SEQ ID NO: 532317

SEQ ID NO: 662184 - RNA, 64 nt, hsa; identical to SEQ ID NO: 532318

SEQ ID NO: 662185 - RNA, 59 nt, hsa; identical to SEQ ID NO: 83136

SEQ ID NO: 662186 - RNA, 64 nt, hsa; identical to SEQ ID NO: 532320

SEQ ID NO: 662187 - RNA, 64 nt, hsa; identical to SEQ ID NO: 532321

SEQ ID NO: 662188 - RNA, 64 nt, hsa; identical to SEQ ID NO: 532322

SEQ ID NO: 662189 - RNA, 64 nt, hsa; identical to SEQ ID NO: 532323

SEQ ID NO: 662190 - RNA, 64 nt, hsa; identical to SEQ ID NO: 532324

SEQ ID NO: 662191 - RNA, 64 nt, hsa; identical to SEQ ID NO: 532325

SEQ ID NO: 662192 - RNA, 64 nt, hsa; identical to SEQ ID NO: 532326

SEQ ID NO: 662193 - RNA, 64 nt, hsa; identical to SEQ ID NO: 532327

SEQ ID NO: 662194 - RNA, 64 nt, hsa; identical to SEQ ID NO: 532328

SEQ ID NO: 662195 - RNA, 64 nt, hsa; identical to SEQ ID NO: 532329

SEQ ID NO: 662196 - RNA, 64 nt, hsa; identical to SEQ ID NO: 532330

SEQ ID NO: 662197 - RNA, 64 nt, hsa; identical to SEQ ID NO: 532331

SEQ ID NO: 662198 - RNA, 64 nt, hsa; identical to SEQ ID NO: 532332

SEQ ID NO: 662199 - RNA, 64 nt, hsa; identical to SEQ ID NO: 532333

SEQ ID NO: 662200 - RNA, 64 nt, hsa; identical to SEQ ID NO: 532334

SEQ ID NO: 662201 - RNA, 64 nt, hsa; identical to SEQ ID NO: 532335

SEQ ID NO: 662202 - RNA, 64 nt, hsa; identical to SEQ ID NO: 532336

SEQ ID NO: 662203 - RNA, 64 nt, hsa; identical to SEQ ID NO: 532337

SEQ ID NO: 662204 - RNA, 64 nt, hsa; identical to SEQ ID NO: 532338

SEQ ID NO: 662205 - RNA, 64 nt, hsa
aagcauaaaacaaaaauagguaguucuuggcuuuuaacauuaaugcaaaucaugcagaauuuga

SEQ ID NO: 662206 - RNA, 64 nt, hsa
cuuaauuuugaaaucguauauaugagcuauacuuuaacauuaugagagaaaagcauaaaacaaa

SEQ ID NO: 662207 - RNA, 64 nt, hsa
cggagugcugaagcagagagcagauuuaauauaguaacauuaacaguguauuuaauugacauuu

SEQ ID NO: 662208 - RNA, 64 nt, hsa
aaggcagagaacaaaggauguggcauaauggucuuaacauuauccaaagacuugaagcuccaug

SEQ ID NO: 662209 - RNA, 64 nt, hsa
cuaaguaaacauaacauuaauaccuaaguaaacauaacauuacuuggaggguugcaguuucuaa

SEQ ID NO: 662210 - RNA, 64 nt, hsa
aaauuauugccucugauacauaccuaaguaaacauaacauuaauaccuaaguaaacauaacauu

SEQ ID NO: 662211 - RNA, 64 nt, hsa
ugugaugcaguguaagaaggaaaauacucaucucuaacauuaugguaauaacauuuagccucuu

SEQ ID NO: 662212 - RNA, 64 nt, hsa
cuuggucuuguuuuaagucuuaaaaaauuaaagauaacauuauaauguagaauacagaugggac

SEQ ID NO: 662213 - RNA, 64 nt, hsa
aaugugugguaaacauucauauggccauuaauuuuaacauuaaaucguagguagggcaauguag

SEQ ID NO: 662214 - RNA, 64 nt, hsa
uuaagcauaaaauauguaaccaggaaaagacuguuaacauuacauuuaugcaaauuaaaugccc

SEQ ID NO: 662215 - RNA, 64 nt, hsa
aaacauuucuuuggauaaauccugcaaauacuucuaacauuauucuuugauuccagcuuuuaga

SEQ ID NO: 662216 - RNA, 64 nt, hsa
uuaauauguacauuuggaugaugauuuuucuugauaacauuaacauuaauuuuauuuuuucaga

SEQ ID NO: 662217 - RNA, 64 nt, hsa
uguacauuuggaugaugauuuuucuugauaacauuaacauuaauuuuauuuuuucagacauacu

SEQ ID NO: 662218 - RNA, 64 nt, hsa
ugauuggguauuaauuacuugauuaagaaaaaauuaacauuauagauacucuggcauuacgcuu

SEQ ID NO: 662219 - RNA, 64 nt, hsa
augauuuuucugucaucuuaaaauuguaugaucguaacauuauuuauuaccacaaaacagcaaa

SEQ ID NO: 662220 - RNA, 64 nt, hsa
agaaaaauugucuugugccacacauacaauacacuaacauuaacaauagcugaugagcuaagaa

SEQ ID NO: 662221 - RNA, 64 nt, hsa
ucuaaaacuucauccucuuuugucccuuucgaguuaacauuacagccacagugaccuuucaaaa

SEQ ID NO: 662222 - RNA, 64 nt, hsa
uauauugcauagcauuacacauuuaugccuauuuuaacauuaacuucuaaagaaguuuuuucua

SEQ ID NO: 662223 - RNA, 64 nt, hsa
uuuuuuaaaagcuguuauguugaauucaguaaaauaacauuaccuuauuuuuuuucuuauucaa

SEQ ID NO: 662224 - RNA, 64 nt, hsa
cuuguaggauguggagaagggaaaauacggacauuaacauuaaaagacaccagugaaauuguua

SEQ ID NO: 662225 - RNA, 64 nt, hsa
cagaaauaauuuuauauuaauauauaauacagauuaacauuauauauaauauguaccuguguca

SEQ ID NO: 662226 - RNA, 64 nt, hsa
gauaaauaaugucuauacauguuucgacuguuuaaugaguaaucaacaaaaucugccagagagu

SEQ ID NO: 662227 - RNA, 64 nt, hsa
uuggcuguuggaaggauguauaaaguguuacugcaugaguaauguagacaaaaaaaaaagccag

SEQ ID NO: 662228 - RNA, 64 nt, hsa
gaaugcccaaauccgaaugaccccaguuuuccuaaugaguaaaaugaucccagaugugccccag

SEQ ID NO: 662229 - RNA, 64 nt, hsa
cagcucaaggcuauuagguugaauauuugcuuucaugaguaaauguggaucuuuggggaauggc

SEQ ID NO: 662230 - RNA, 64 nt, hsa
uagugggcuucucaacuuuugauccucagcucugugguuuuaagaccacagugugacaguuccc

SEQ ID NO: 662231 - RNA, 64 nt, hsa
auugcaguccugaugauccuaaccugcagcacggugguuuuacaauguuccagagcaggaacgc

SEQ ID NO: 662232 - RNA, 64 nt, hsa
gcaaaauucugcaauuucaccuuaaagauacuguugguuuuacagaugcucuccaaccuauuuu

SEQ ID NO: 662233 - RNA, 64 nt, hsa
cagcaacacccaacacugucuguuuuccauuuguugguuuuaaucauaaaauugucaagugauu

SEQ ID NO: 662234 - RNA, 64 nt, hsa
ccaauuacaaacugguuuuaaauauuggacauacugguuuuaauaccugcuuugcauauucaca

SEQ ID NO: 662235 - RNA, 64 nt, hsa
aauuaaggauuuagaaguucccccaauuacaaacugguuuuaaauauuggacauacugguuuua

SEQ ID NO: 662236 - RNA, 64 nt, hsa
aaaaacuuuauggaggcuguuuguccucucaauaugguuuuaagauugaaaguaagaaaacgga

SEQ ID NO: 662237 - RNA, 64 nt, hsa
aucacuugcccucugaagcuuauuuuugcuucuuugguuuuaagaauugagaaauaucacauug

SEQ ID NO: 662238 - RNA, 64 nt, hsa
cccuuaaaccgcccagaggagcccuauuccacucugguuuuaggcugaucugagagggucuccc

SEQ ID NO: 662239 - RNA, 64 nt, hsa
cuguaacauuccugaagcuguucccacucccagaugguuuuaucaauagccuagagguaaagaa

SEQ ID NO: 662240 - RNA, 64 nt, hsa
uucagauaaaucuaggcaggauacugcauuuuugugguuuuaaaaaaguccuuaggacagacug

SEQ ID NO: 662241 - RNA, 64 nt, hsa
uuaugaugcaaaugauuauguugucugaaaggugugguuuuauugaaugucuauuugaguauca

SEQ ID NO: 662242 - RNA, 64 nt, hsa
agcaggugaaaaauaaaacgcaguucaaauuucaugguuuuaauuuucaacucagaagcacuca

SEQ ID NO: 662243 - RNA, 64 nt, hsa
uaccacuuucaucugcugaaaggacaaaugugcuugguuuuacuauuauguaaucacaacuuac

SEQ ID NO: 662244 - RNA, 64 nt, hsa
ugauggacuucaauuguacucacuguucuauuguugguuuuaauuagcagcaaguugugaucac

SEQ ID NO: 662245 - RNA, 64 nt, hsa
guuucccuucuuuuuguucuucaucuaagccuucugguuuuaugggucagaguuccgacugcca

SEQ ID NO: 662246 - RNA, 64 nt, hsa
cucaguguauuuaauuucaaauuguuuuuuuaauugguuuuaugcugcuuuguuaggacagaug

SEQ ID NO: 662247 - RNA, 64 nt, hsa
ggcuagucuuauugucacuauguaaguaauccaaugguuuuagaaacuaaacuuucuagagcaa

SEQ ID NO: 662248 - RNA, 64 nt, hsa
uuuuuuuuaguccaaaagccaaaaauauuuaucuugguuuuacauuuuaauuuccauucuuaau

SEQ ID NO: 662249 - RNA, 64 nt, hsa
gcucaguuauuggaugagugaaagauaaucauguugguuuuaauagugucaauuuuuguaaaau

SEQ ID NO: 662250 - RNA, 64 nt, hsa
cuguaaaaaaauacuacauuugaaauuauuucauugguuuuagaacuggcauugaagguaccca

SEQ ID NO: 662251 - RNA, 64 nt, hsa
uagcuuugauuuucucacugguguuucauuaacuugguuuuaaauguugacaauauuuacaagu

SEQ ID NO: 662252 - RNA, 64 nt, hsa
uucccucucaucgccagacaacugacgauuucccugguuuuagucugcgucucugcuuuaaagu

SEQ ID NO: 662253 - RNA, 64 nt, hsa
uccuacugauguuccuuuggaagaaaaaaucugcugguuuuaacaacugugcuuuugcuaugua

SEQ ID NO: 662254 - RNA, 64 nt, hsa
uuauuuauugcuuuuucaaugugcagccaguggaugguuuuaguucuuucagaugaacugccau

SEQ ID NO: 662255 - RNA, 64 nt, hsa
augagcaaguaucuuaggguaguagguagccuggugguuuuagaaguguuuggugauuuuuaug

SEQ ID NO: 662256 - RNA, 64 nt, hsa
uuauaaaccacucuucaacagcuggcuccagugcugguuuuagaacaagaaugaagucauuuug

SEQ ID NO: 662257 - RNA, 64 nt, hsa
gcagagcuauagucucaauuguuacuuuauaaggugguuuuauuaacaaacccaaauccuggau

SEQ ID NO: 662258 - RNA, 64 nt, hsa
uaggaauucacuguguuuucauuugaugucguacugguuuuaaaccuugugcucuacuccuucc

SEQ ID NO: 662259 - RNA, 64 nt, hsa; identical to SEQ ID NO: 662258

SEQ ID NO: 662260 - RNA, 64 nt, hsa
cagaaauggagggacucaagcugccacuugggccugguuuuagauguuuuuaauuuuguaaaag

SEQ ID NO: 662261 - RNA, 64 nt, hsa
uaguccucaucugagucucagccugggucccccaugguuuuagcaacacggguggcaagcagau

SEQ ID NO: 662262 - RNA, 64 nt, hsa
uuuuaguuuaaaaaccuuguauaucuuguuuuggugguuuuagugauuuuaauaauauauuuua

SEQ ID NO: 662263 - RNA, 64 nt, hsa
auuauuccuguggauguaaagugauauuuccccaugguuuuaaucuguauuuccccaacaugua

SEQ ID NO: 662264 - RNA, 64 nt, hsa
uacaauaauguugucacuuacuguaaauguacuaugguuuuauuaacaauaaacacucauuaac

SEQ ID NO: 662265 - RNA, 64 nt, hsa
uguguaggaauggccucagcucuuguuuugcugcugguuuuaggggccaaaguaaaugggugga

SEQ ID NO: 662266 - RNA, 64 nt, hsa
cuuguuuugagccuguucucuaagaagauaggauugguuuuagcccaaacucugcuucuauggu

SEQ ID NO: 662267 - RNA, 64 nt, hsa
uucuaugguagggcaugaggacaacuauucagcaugguuuuagcuucuuggagaugauuccaac

SEQ ID NO: 662268 - RNA, 64 nt, hsa
uauauaaaaaguauaauuuuucuauuuuuguuuuugguuuuaauuugcagagauuugcugccag

SEQ ID NO: 662269 - RNA, 64 nt, hsa
ccuuaauaauuagucucuuggcuuaaauguccacugguuuuacuuugacacaguugaacaacac

SEQ ID NO: 662270 - RNA, 64 nt, hsa
gcguaacucagauauuaaugggcuguguauuaaaugguuuuauuuucaguuuugcagcacagaa

SEQ ID NO: 662271 - RNA, 64 nt, hsa
aagaaacauaugucugcgugcuacuuuacaauguugguuuuaaagauaagcacauggguaaaaa

SEQ ID NO: 662272 - RNA, 64 nt, hsa
uacuccaucugacuacgacuaagagagugaggggugguuuuaaugaacccucuaagcucucuca

SEQ ID NO: 662273 - RNA, 64 nt, hsa
gggaaguaaacgcuuuuuuuaaaaguauuuuuacugguuuuauaccaauauuauaugcagaaau

SEQ ID NO: 662274 - RNA, 64 nt, hsa
aucaaaaagaaaauugagcuuaaggcaaaaggccugguuuuagagauauguguaauuggaagag

SEQ ID NO: 662275 - RNA, 64 nt, hsa
uuuauaauaacaaaaucuccauguuguuaaaaugugguuuuauugagucacaguucuuucuugg

SEQ ID NO: 662276 - RNA, 64 nt, hsa
uauuggaccacuacugcuuuucacauuuguaaauugguuuuauguuaaaccuuguagccuaaca

SEQ ID NO: 662277 - RNA, 64 nt, hsa
aucugugagugaaaguugccauuauucuauguagugguuuuaggauacuuaacaaauacauuca

SEQ ID NO: 662278 - RNA, 64 nt, hsa
ggguuuuuguuuuguuuugggguuuuguuuuguuugguuuuacauuuuaguuacugaagccuua

SEQ ID NO: 662279 - RNA, 64 nt, hsa
aaauccaacaacaacaacaacaaaacaauguucuugguuuuaauguuccaguugcugugaaaua

SEQ ID NO: 662280 - RNA, 64 nt, hsa
uugaaaauauuucuaguuuuguagccaaagcaauugguuuuaguaaaaugagacuucuucagga

SEQ ID NO: 662281 - RNA, 64 nt, hsa
uuuauaacuaauuuuaaaagagaaguuucuuuucugguuuuaguuugggaauaaucauucauua

SEQ ID NO: 662282 - RNA, 64 nt, hsa
aucauccucauuuuggggcaguccaagacauagcugguuuuagaaacccaaguuccucuaagca

SEQ ID NO: 662283 - RNA, 64 nt, hsa
auauuuauuuuagacuaauugguuuuaggugaauugguuuuaggcaaauuaauuuaguaaucuu

SEQ ID NO: 662284 - RNA, 64 nt, hsa
cugcagauuugauaaauauuuauuuuagacuaauugguuuuaggugaauugguuuuaggcaaau

SEQ ID NO: 662285 - RNA, 64 nt, hsa
uuuguucccaugaguuuuguggggauggggauucugguuuuauuagcuuuguguguguccucuu

SEQ ID NO: 662286 - RNA, 64 nt, hsa
guuuuuuuuaaauaaaggaaaagcaguauuguccugguuuuaaaccuaugauggaauucuaaug

SEQ ID NO: 662287 - RNA, 64 nt, hsa
gcuuuugguuuaaaaguuaauugauauuauacuuugguuuuaucuaaaaaguaaauguauuugc

SEQ ID NO: 662288 - RNA, 64 nt, hsa
ccauucacauagauguguguaaugauaccacaugugguuuuaauuugcauuuccaauggcuaau

SEQ ID NO: 662289 - RNA, 64 nt, hsa
ugcuucauaaugauucuuuuuccaucuuaaaauaugguuuuacuauuaagagccaagaucaugc

SEQ ID NO: 662290 - RNA, 64 nt, hsa
uuuugcugaaauacucagguaauugagauagcaaugguuuuauggcaugaauuauccaaaaaaa

SEQ ID NO: 662291 - RNA, 64 nt, hsa
uguagcuaacgguugccuugaggaagaaauaauuugguuuuauuaagagucuacucucaaucca

SEQ ID NO: 662292 - RNA, 64 nt, hsa
cugcaauuacuuuuuuaaaggcacuuuuacucuuugguuuuaucauuccauuuugcuaauauuu

SEQ ID NO: 662293 - RNA, 64 nt, hsa
cucugugcugggcuuugguaugguaacucuuuggugguuuuaugaugcuuacaaacuugagcuu

SEQ ID NO: 662294 - RNA, 64 nt, hsa
uuugucuuauuaacacauguauaaagguauccuuugguuuuaagucgagaacaggaauuucuuc

SEQ ID NO: 662295 - RNA, 64 nt, hsa
uuaacuugaaguuguguacauagagaagaaaauuugguuuuagcaaaugacagagccuucaaaa

SEQ ID NO: 662296 - RNA, 64 nt, hsa
acaguguagaauaaaugugguagaaaaguuuuuuugguuuuaucucuuuugcgaucccuaaauu

SEQ ID NO: 662297 - RNA, 64 nt, hsa
uguuaccaaaacagcaauuugaaauuagaacuagugguuuuagagaacucagguauucuuuccu

SEQ ID NO: 662298 - RNA, 64 nt, hsa
ggauuuucagggcuaccagaaaaauguuuccagaugguuuuagaauguaggacuuaugauccaa

SEQ ID NO: 662299 - RNA, 64 nt, hsa
gaaucuauagauugagauuuugaugaauuuauauugguuuuaaugagacccaaaugacucucuc

SEQ ID NO: 662300 - RNA, 64 nt, hsa
acaaguaaaauacaaauucuugucuacuuucaugugguuuuaaauggcagggacuucgcugagu

SEQ ID NO: 662301 - RNA, 64 nt, hsa
ugaaauucauaaauaaagaauuguucuuucuuugugguuuuaauaagaguucaagaauuguuca

SEQ ID NO: 662302 - RNA, 64 nt, hsa
gagaguauguucucaaggaagauuuaacucucuuugguuuuaaauuacuuuuuaaccagccuaa

SEQ ID NO: 662303 - RNA, 64 nt, hsa
uccacaggguaauucacuaagagcuuguggagcuugguuuuaaaauccuuagccuggucugacu

SEQ ID NO: 662304 - RNA, 64 nt, hsa
cgaggacacugagccgggcuggcucuccuuucugugguuuuauuuaaugggcuugaauuugcau

SEQ ID NO: 662305 - RNA, 64 nt, hsa
ggcuggcugccuuuugcugugggguuuuguuaccugguuuuaauaacaguaaaugugcccagcc

SEQ ID NO: 662306 - RNA, 64 nt, hsa
auuacauguaaaacauuaucuugucacuguaguuugguuuuauuugaaaaccugacaaaaaaaa

SEQ ID NO: 662307 - RNA, 64 nt, hsa
gagguuaaaaauaaugugguuuuauauagcauagugguuuuauuuuguuaguuauuuuuaaagg

SEQ ID NO: 662308 - RNA, 64 nt, hsa
uccauguaucaagauuaugagguuaaaaauaaugugguuuuauauagcauagugguuuuauuuu

SEQ ID NO: 662309 - RNA, 64 nt, hsa
cagggagccuccgcugggcccagacagcagcguuugguuuuauccacuuuucuuggauaaucag

SEQ ID NO: 662310 - RNA, 64 nt, hsa
aggggguggggguccugcucagcaggguagguggugguuuuaggucuugucacccucacucagu

SEQ ID NO: 662311 - RNA, 64 nt, hsa
uagcuaaaaauguuagccuuguaauucgaauaucugguuuuaaaugauagagguuuuuguggga

SEQ ID NO: 662312 - RNA, 64 nt, hsa
gaauggggaacuggcaggccgcgcagaagguucuugguuuuaauggauaggcugaauuggauua

SEQ ID NO: 662313 - RNA, 64 nt, hsa
gaacagaugaauaugcaccuucuccagaguuaugugguuuuagaauuuagaagagcauguaucu

SEQ ID NO: 662314 - RNA, 64 nt, hsa
cuuuuuuaucuccauggugugggugggaccaccaugguuuuacaccccacccuaccuuagggaa

SEQ ID NO: 662315 - RNA, 64 nt, hsa
aagaaagauaaaagugugaucuaagaaaaagugaugguuuuaggaaagugaaaauauuuuuguu

SEQ ID NO: 662316 - RNA, 64 nt, hsa
uaacauuuauaucucacauagagacaugcuuauaugguuuuauuuaaaaugaaaugccagucca

SEQ ID NO: 662317 - RNA, 64 nt, hsa
uguauguccaaaguccuaugguuuuauucauuuaugguuuuacaggcuuugaaguacucagauu

SEQ ID NO: 662318 - RNA, 64 nt, hsa
aaaacuacuuugguuguguauguccaaaguccuaugguuuuauucauuuaugguuuuacaggcu

SEQ ID NO: 662319 - RNA, 64 nt, hsa
uugaauauaugcuuaugguuaaaagaaaaacgaaugguuuuauaauucuguguauuuugucaua

SEQ ID NO: 662320 - RNA, 64 nt, hsa
uuuuaaaaaauagguuuucauuuauggcuuuuugugguuuuagcacuuuaagaaguuuaauuuu

SEQ ID NO: 662321 - RNA, 64 nt, hsa; identical to SEQ ID NO: 300664

SEQ ID NO: 662322 - RNA, 64 nt, hsa; identical to SEQ ID NO: 300665

SEQ ID NO: 662323 - RNA, 64 nt, hsa; identical to SEQ ID NO: 300666

SEQ ID NO: 662324 - RNA, 64 nt, hsa; identical to SEQ ID NO: 300667

SEQ ID NO: 662325 - RNA, 64 nt, hsa; identical to SEQ ID NO: 300668

SEQ ID NO: 662326 - RNA, 64 nt, hsa; identical to SEQ ID NO: 300669

SEQ ID NO: 662327 - RNA, 64 nt, hsa; identical to SEQ ID NO: 300670

SEQ ID NO: 662328 - RNA, 64 nt, hsa; identical to SEQ ID NO: 300671

SEQ ID NO: 662329 - RNA, 64 nt, hsa; identical to SEQ ID NO: 300672

SEQ ID NO: 662330 - RNA, 64 nt, hsa; identical to SEQ ID NO: 300673

SEQ ID NO: 662331 - RNA, 64 nt, hsa; identical to SEQ ID NO: 300674

SEQ ID NO: 662332 - RNA, 64 nt, hsa; identical to SEQ ID NO: 300675

SEQ ID NO: 662333 - RNA, 64 nt, hsa; identical to SEQ ID NO: 300676

SEQ ID NO: 662334 - RNA, 64 nt, hsa; identical to SEQ ID NO: 300677

SEQ ID NO: 662335 - RNA, 64 nt, hsa; identical to SEQ ID NO: 300678

SEQ ID NO: 662336 - RNA, 64 nt, hsa; identical to SEQ ID NO: 300679

SEQ ID NO: 662337 - RNA, 64 nt, hsa; identical to SEQ ID NO: 300680

SEQ ID NO: 662338 - RNA, 64 nt, hsa; identical to SEQ ID NO: 300681

SEQ ID NO: 662339 - RNA, 64 nt, hsa; identical to SEQ ID NO: 300682

SEQ ID NO: 662340 - RNA, 64 nt, hsa; identical to SEQ ID NO: 300683

SEQ ID NO: 662341 - RNA, 64 nt, hsa; identical to SEQ ID NO: 300684

SEQ ID NO: 662342 - RNA, 64 nt, hsa; identical to SEQ ID NO: 300685

SEQ ID NO: 662343 - RNA, 64 nt, hsa; identical to SEQ ID NO: 300686

SEQ ID NO: 662344 - RNA, 64 nt, hsa; identical to SEQ ID NO: 300687

SEQ ID NO: 662345 - RNA, 64 nt, hsa; identical to SEQ ID NO: 300688

SEQ ID NO: 662346 - RNA, 64 nt, hsa; identical to SEQ ID NO: 300689

SEQ ID NO: 662347 - RNA, 64 nt, hsa; identical to SEQ ID NO: 300690

SEQ ID NO: 662348 - RNA, 64 nt, hsa; identical to SEQ ID NO: 300691

SEQ ID NO: 662349 - RNA, 64 nt, hsa; identical to SEQ ID NO: 300692

SEQ ID NO: 662350 - RNA, 64 nt, hsa; identical to SEQ ID NO: 300693

SEQ ID NO: 662351 - RNA, 64 nt, hsa
cuuugagaggggcaaaacugagaggggcuuuuccuagagaaagagaacaaggagcuugccaggc

SEQ ID NO: 662352 - RNA, 64 nt, hsa
ugugauacacuaauguauuugcuuuuuuuggaaauagagaaaaucaauaaauugcuaguguuuc

SEQ ID NO: 662353 - RNA, 64 nt, hsa
uuuuucauuuuuuaccuguauugcauuuucccccuagagaaauagaucaaaagagcacaagagu

SEQ ID NO: 662354 - RNA, 64 nt, hsa
aauaucuauuauucuccuaaacgaaugccuagcauagagaaaauacuuaauacacauuuguuga

SEQ ID NO: 662355 - RNA, 64 nt, hsa
aaguuaauaagcaaaauccugacuauuauguuguuagagaaaaaugcuuugcuuugucuggaag

SEQ ID NO: 662356 - RNA, 64 nt, hsa
uuacuuuuuuccaauuuuagaaaaucaagcagguuagagaaaauagagaugaauuaggggacac

SEQ ID NO: 662357 - RNA, 64 nt, hsa
cuuagagaaaauguggaggaaauaauaugacacuuagagaaaaaggaagguuuauucuugucuu

SEQ ID NO: 662358 - RNA, 64 nt, hsa
agagguaggugaacauuccaggaaagaagcagcuuagagaaaauguggaggaaauaauaugaca

SEQ ID NO: 662359 - RNA, 64 nt, hsa
gaaaagaaaauaggcgcuuugucuccuacaaucuuagagaaaguuuuacauacuuaagugggua

SEQ ID NO: 662360 - RNA, 64 nt, hsa
cuuauaaugauuagguuuuguucugaguuauuucuagagaaagaaaguauuuuaguauguguaa

SEQ ID NO: 662361 - RNA, 64 nt, hsa
aaaagauggacaagaacgagugucggugaggauguagagaaacugguagaaauuuaaauuguug

SEQ ID NO: 662362 - RNA, 64 nt, hsa
auugauuuuugacaagguucccaagacaauucaauagagaaaggagagucuuuucaacaaaugg

SEQ ID NO: 662363 - RNA, 64 nt, hsa
agaaaccuuugagaucuuucugacuuuucaaaauuagagaaagcaaaugggauggauagauuuu

SEQ ID NO: 662364 - RNA, 64 nt, hsa
aauaaagccagaaugagaaauuaccaucuucuacuagagaaaaccaagagaaaaauuuuuaugc

SEQ ID NO: 662365 - RNA, 64 nt, hsa
auaaaagacagagccuguuuacucauuuagaagauagagaaaauuggucuaaaauugaacaucc

SEQ ID NO: 662366 - RNA, 64 nt, hsa
uguuugcuuugugaaggugaagaauauguugguuuagagaaagaaauuggauguaauuuuaugc

SEQ ID NO: 662367 - RNA, 64 nt, hsa
auccaaaacucuaugaugaugucuuccuagggaguagagaaaggcagugaaauggcaguuagac

SEQ ID NO: 662368 - RNA, 64 nt, hsa
aauauuauggaaggguuucuaugucagucuaccuuagagaaagccagugauucaauaucacaaa

SEQ ID NO: 662369 - RNA, 64 nt, hsa
agaaauuuagaaaucauuguguuaaagagagcuauagagaaacaauaugaaagucuucccuuac

SEQ ID NO: 662370 - RNA, 64 nt, hsa
ggaucugauuaauguuuccuuuccuuacaacagcuagagaaaacaucucaucacaauuggagac

SEQ ID NO: 662371 - RNA, 64 nt, hsa
gccuuucucccagcuuugccgccugugcugccauuagagaaaaaaagaagcauaaucgugggca

SEQ ID NO: 662372 - RNA, 64 nt, hsa
uccaaauuauugcuucaaccaucagucauaacucuagagaaaaacuucaucuucaucucggaau

SEQ ID NO: 662373 - RNA, 64 nt, hsa
agguaacauuuaacaauaaucugauacacauaaauagagaaagagcaauugauaaaguaaauga

SEQ ID NO: 662374 - RNA, 64 nt, hsa
gauagauagauagauagauagauagauagauagauagagaaaugagaagguuucucuuuugcaa

SEQ ID NO: 662375 - RNA, 64 nt, hsa
cauugugaaacuguagagagcagguagcccaaaauagagaaagauuagauaaagagaaaauaag

SEQ ID NO: 662376 - RNA, 64 nt, hsa
augaguaaaugaauaaaacauuugcaaagaccuuuagagaaagagaaugggagcauaugugaga

SEQ ID NO: 662377 - RNA, 64 nt, hsa
uguaagaauguuguauauuuuaacauaaaucauuuagagaaauuaucuagauucauuaauuuuc

SEQ ID NO: 662378 - RNA, 64 nt, hsa
uuacacauauuuuaauccugugaaagauuccacauagagaaaagaaagauaccuaaccuucaac

SEQ ID NO: 662379 - RNA, 64 nt, hsa
ggaccugcaauagaagauguugccuuuauggcccuagagaaagucaaggaacauggggaccaac

SEQ ID NO: 662380 - RNA, 64 nt, hsa
aucucuaaguuugggguaucuccaagcauguauguagagaaaggacuuugccgcuuuuuaaaac

SEQ ID NO: 662381 - RNA, 64 nt, hsa
aacacuacugcuaaauccucauguuacucaguguuagagaaauccuuccuaaacccaaugacuu

SEQ ID NO: 662382 - RNA, 64 nt, hsa
uuuuuuuuuugacuaacaagaauguaacuccagauagagaaauagugacaagugaagaacacua

SEQ ID NO: 662383 - RNA, 64 nt, hsa
gugugugauuuacuuuucugaucucuuugagaaauagagaaauauaaaaguguguucuuaacuc

SEQ ID NO: 662384 - RNA, 64 nt, hsa
gaagcaugaauuauuuucauauaaauauagaaaauagagaaaaggcuaugccuguaauuuuuaa

SEQ ID NO: 662385 - RNA, 64 nt, hsa
uugcuuuagccaaagccauaaaaaaccugcaacguagagaaaauaaugcagauacccugacuag

SEQ ID NO: 662386 - RNA, 64 nt, hsa
cuuuauauauauuuuuuguugcaaagugucucucuagagaaacucuauauauuauucgaauuuu

SEQ ID NO: 662387 - RNA, 64 nt, hsa
gcccaaacauuuguaacaaacucccuaauaaauuuagagaaagucacucuguuaccauuucauu

SEQ ID NO: 662388 - RNA, 64 nt, hsa
uauaaaacaacauaaauuuagaccauaacuuuuauagagaaaggguuuugucaaauguuuucug

SEQ ID NO: 662389 - RNA, 64 nt, hsa
auacuaucuucuaggcuguauguagugcuacaauuagagaaacagaaguccaaggcuggcgaca

SEQ ID NO: 662390 - RNA, 64 nt, hsa
aauguuuuccauuaaagucuucuauuuuaaaauuuagagaaaaauaaaauggcuuuccaucaga

SEQ ID NO: 662391 - RNA, 64 nt, hsa
aaaauuuuguauaugcaaaacuguugaaggaccauagagaaauguguacuacugacggggcuuu

SEQ ID NO: 662392 - RNA, 64 nt, hsa
cauuguuuuauucuaaaaacccaacucagugguguagagaaacuuguguaccaaaauuuuaguu

SEQ ID NO: 662393 - RNA, 64 nt, hsa
ucauuuugguauuugaucuuaaccaagugauuauuagagaaauguaucaacuccaugccaucuc

SEQ ID NO: 662394 - RNA, 64 nt, hsa
augaauugacuuaaguaucuugaaaaagaaacuuuagagaaagcaucagggguguguacucagu

SEQ ID NO: 662395 - RNA, 64 nt, hsa
agugauucuuccaccuaaauuuuuuuuuuuuuuuuagagaaagggucucacuauguugcccagg

SEQ ID NO: 662396 - RNA, 64 nt, hsa
ucaugcucaauuccaagcauaauaaauuuuauauuagagaaagaauauguugauuuaaaagccu

SEQ ID NO: 662397 - RNA, 64 nt, hsa
uauugguguucauuuuucuuuugauuuaaaggauuagagaaaucuacaaauguaugucauaaau

SEQ ID NO: 662398 - RNA, 64 nt, hsa
uggagagaacacauaaaugauuuuggcauaccauuagagaaaccauuuguaaaacucaaaugac

SEQ ID NO: 662399 - RNA, 64 nt, hsa
cucuuuagauagcaagucucaccauucccuuuuuuagagaaaagguauuguagcccacccucca

SEQ ID NO: 662400 - RNA, 64 nt, hsa
auuuucaaugagcuuuuucuaacuucucaaguucuagagaaagaauuaaccaacugaugacuua

SEQ ID NO: 662401 - RNA, 64 nt, hsa
aauaauauauaggagggauaucagaaugucuagauagagaaaguauuuucaaauucuugaauau

SEQ ID NO: 662402 - RNA, 64 nt, hsa
ugcucugucagacuaaccuagagagcuguuaugguagagaaaguuaucauauguguguggcaug

SEQ ID NO: 662403 - RNA, 64 nt, hsa; identical to SEQ ID NO: 45025

SEQ ID NO: 662404 - RNA, 64 nt, hsa; identical to SEQ ID NO: 45026

SEQ ID NO: 662405 - RNA, 64 nt, hsa; identical to SEQ ID NO: 45027

SEQ ID NO: 662406 - RNA, 64 nt, hsa; identical to SEQ ID NO: 45028

SEQ ID NO: 662407 - RNA, 64 nt, hsa; identical to SEQ ID NO: 45029

SEQ ID NO: 662408 - RNA, 64 nt, hsa; identical to SEQ ID NO: 45030

SEQ ID NO: 662409 - RNA, 64 nt, hsa; identical to SEQ ID NO: 45031

SEQ ID NO: 662410 - RNA, 64 nt, hsa; identical to SEQ ID NO: 45032

SEQ ID NO: 662411 - RNA, 64 nt, hsa; identical to SEQ ID NO: 45033

SEQ ID NO: 662412 - RNA, 64 nt, hsa; identical to SEQ ID NO: 45034

SEQ ID NO: 662413 - RNA, 64 nt, hsa; identical to SEQ ID NO: 45035

SEQ ID NO: 662414 - RNA, 64 nt, hsa; identical to SEQ ID NO: 45036

SEQ ID NO: 662415 - RNA, 64 nt, hsa; identical to SEQ ID NO: 45037

SEQ ID NO: 662416 - RNA, 64 nt, hsa; identical to SEQ ID NO: 45038

SEQ ID NO: 662417 - RNA, 64 nt, hsa; identical to SEQ ID NO: 45039

SEQ ID NO: 662418 - RNA, 64 nt, hsa; identical to SEQ ID NO: 45040

SEQ ID NO: 662419 - RNA, 64 nt, hsa; identical to SEQ ID NO: 45041

SEQ ID NO: 662420 - RNA, 64 nt, hsa; identical to SEQ ID NO: 45042

SEQ ID NO: 662421 - RNA, 64 nt, hsa; identical to SEQ ID NO: 45043

SEQ ID NO: 662422 - RNA, 64 nt, hsa; identical to SEQ ID NO: 45044

SEQ ID NO: 662423 - RNA, 64 nt, hsa; identical to SEQ ID NO: 45045

SEQ ID NO: 662424 - RNA, 64 nt, hsa; identical to SEQ ID NO: 45046

SEQ ID NO: 662425 - RNA, 64 nt, hsa; identical to SEQ ID NO: 45047

SEQ ID NO: 662426 - RNA, 64 nt, hsa; identical to SEQ ID NO: 45048

SEQ ID NO: 662427 - RNA, 64 nt, hsa; identical to SEQ ID NO: 45049

SEQ ID NO: 662428 - RNA, 64 nt, hsa; identical to SEQ ID NO: 45050

SEQ ID NO: 662429 - RNA, 64 nt, hsa; identical to SEQ ID NO: 45051

SEQ ID NO: 662430 - RNA, 64 nt, hsa; identical to SEQ ID NO: 45052

SEQ ID NO: 662431 - RNA, 64 nt, hsa; identical to SEQ ID NO: 45053

SEQ ID NO: 662432 - RNA, 64 nt, hsa; identical to SEQ ID NO: 45054

SEQ ID NO: 662433 - RNA, 64 nt, hsa; identical to SEQ ID NO: 45055

SEQ ID NO: 662434 - RNA, 64 nt, hsa; identical to SEQ ID NO: 45056

SEQ ID NO: 662435 - RNA, 64 nt, hsa; identical to SEQ ID NO: 45057

SEQ ID NO: 662436 - RNA, 64 nt, hsa; identical to SEQ ID NO: 45058

SEQ ID NO: 662437 - RNA, 64 nt, hsa; identical to SEQ ID NO: 45059

SEQ ID NO: 662438 - RNA, 64 nt, hsa; identical to SEQ ID NO: 45060

SEQ ID NO: 662439 - RNA, 64 nt, hsa; identical to SEQ ID NO: 45061

SEQ ID NO: 662440 - RNA, 64 nt, hsa; identical to SEQ ID NO: 45062

SEQ ID NO: 662441 - RNA, 64 nt, hsa; identical to SEQ ID NO: 45063

SEQ ID NO: 662442 - RNA, 64 nt, hsa; identical to SEQ ID NO: 45064

SEQ ID NO: 662443 - RNA, 64 nt, hsa; identical to SEQ ID NO: 45065

SEQ ID NO: 662444 - RNA, 64 nt, hsa; identical to SEQ ID NO: 45066

SEQ ID NO: 662445 - RNA, 64 nt, hsa; identical to SEQ ID NO: 488487

SEQ ID NO: 662446 - RNA, 64 nt, hsa; identical to SEQ ID NO: 488488

SEQ ID NO: 662447 - RNA, 64 nt, hsa; identical to SEQ ID NO: 488489

SEQ ID NO: 662448 - RNA, 64 nt, hsa; identical to SEQ ID NO: 488490

SEQ ID NO: 662449 - RNA, 64 nt, hsa; identical to SEQ ID NO: 488491

SEQ ID NO: 662450 - RNA, 64 nt, hsa; identical to SEQ ID NO: 488492

SEQ ID NO: 662451 - RNA, 64 nt, hsa; identical to SEQ ID NO: 488493

SEQ ID NO: 662452 - RNA, 64 nt, hsa; identical to SEQ ID NO: 488494

SEQ ID NO: 662453 - RNA, 64 nt, hsa; identical to SEQ ID NO: 488495

SEQ ID NO: 662454 - RNA, 64 nt, hsa; identical to SEQ ID NO: 488496

SEQ ID NO: 662455 - RNA, 64 nt, hsa; identical to SEQ ID NO: 488497

SEQ ID NO: 662456 - RNA, 64 nt, hsa; identical to SEQ ID NO: 488498

SEQ ID NO: 662457 - RNA, 64 nt, hsa; identical to SEQ ID NO: 488499

SEQ ID NO: 662458 - RNA, 64 nt, hsa; identical to SEQ ID NO: 488500

SEQ ID NO: 662459 - RNA, 64 nt, hsa; identical to SEQ ID NO: 488501

SEQ ID NO: 662460 - RNA, 64 nt, hsa; identical to SEQ ID NO: 488502

SEQ ID NO: 662461 - RNA, 64 nt, hsa; identical to SEQ ID NO: 488503

SEQ ID NO: 662462 - RNA, 64 nt, hsa; identical to SEQ ID NO: 488504

SEQ ID NO: 662463 - RNA, 64 nt, hsa; identical to SEQ ID NO: 488505

SEQ ID NO: 662464 - RNA, 64 nt, hsa; identical to SEQ ID NO: 488506

SEQ ID NO: 662465 - RNA, 64 nt, hsa; identical to SEQ ID NO: 488507

SEQ ID NO: 662466 - RNA, 64 nt, hsa; identical to SEQ ID NO: 488508

SEQ ID NO: 662467 - RNA, 64 nt, hsa; identical to SEQ ID NO: 488509

SEQ ID NO: 662468 - RNA, 64 nt, hsa; identical to SEQ ID NO: 488510

SEQ ID NO: 662469 - RNA, 64 nt, hsa; identical to SEQ ID NO: 488511

SEQ ID NO: 662470 - RNA, 64 nt, hsa; identical to SEQ ID NO: 488512

SEQ ID NO: 662471 - RNA, 64 nt, hsa; identical to SEQ ID NO: 488513

SEQ ID NO: 662472 - RNA, 64 nt, hsa; identical to SEQ ID NO: 488514

SEQ ID NO: 662473 - RNA, 64 nt, hsa; identical to SEQ ID NO: 488515

SEQ ID NO: 662474 - RNA, 64 nt, hsa; identical to SEQ ID NO: 488516

SEQ ID NO: 662475 - RNA, 64 nt, hsa; identical to SEQ ID NO: 488517

SEQ ID NO: 662476 - RNA, 64 nt, hsa; identical to SEQ ID NO: 488518

SEQ ID NO: 662477 - RNA, 64 nt, hsa; identical to SEQ ID NO: 488519

SEQ ID NO: 662478 - RNA, 64 nt, hsa; identical to SEQ ID NO: 488520

SEQ ID NO: 662479 - RNA, 64 nt, hsa; identical to SEQ ID NO: 488521

SEQ ID NO: 662480 - RNA, 64 nt, hsa; identical to SEQ ID NO: 488522

SEQ ID NO: 662481 - RNA, 64 nt, hsa; identical to SEQ ID NO: 488523

SEQ ID NO: 662482 - RNA, 64 nt, hsa; identical to SEQ ID NO: 488524

SEQ ID NO: 662483 - RNA, 64 nt, hsa; identical to SEQ ID NO: 488525

SEQ ID NO: 662484 - RNA, 64 nt, hsa; identical to SEQ ID NO: 488526

SEQ ID NO: 662485 - RNA, 64 nt, hsa; identical to SEQ ID NO: 488527

SEQ ID NO: 662486 - RNA, 64 nt, hsa; identical to SEQ ID NO: 488528

SEQ ID NO: 662487 - RNA, 64 nt, hsa; identical to SEQ ID NO: 488529

SEQ ID NO: 662488 - RNA, 64 nt, hsa; identical to SEQ ID NO: 488530

SEQ ID NO: 662489 - RNA, 64 nt, hsa; identical to SEQ ID NO: 488531

SEQ ID NO: 662490 - RNA, 64 nt, hsa; identical to SEQ ID NO: 488532

SEQ ID NO: 662491 - RNA, 64 nt, hsa; identical to SEQ ID NO: 488533

SEQ ID NO: 662492 - RNA, 64 nt, hsa; identical to SEQ ID NO: 488534

SEQ ID NO: 662493 - RNA, 64 nt, hsa; identical to SEQ ID NO: 488535

SEQ ID NO: 662494 - RNA, 64 nt, hsa; identical to SEQ ID NO: 488536

SEQ ID NO: 662495 - RNA, 64 nt, hsa; identical to SEQ ID NO: 488537

SEQ ID NO: 662496 - RNA, 64 nt, hsa; identical to SEQ ID NO: 488538

SEQ ID NO: 662497 - RNA, 64 nt, hsa; identical to SEQ ID NO: 488539

SEQ ID NO: 662498 - RNA, 64 nt, hsa; identical to SEQ ID NO: 488540

SEQ ID NO: 662499 - RNA, 64 nt, hsa; identical to SEQ ID NO: 488541

SEQ ID NO: 662500 - RNA, 64 nt, hsa; identical to SEQ ID NO: 488542

SEQ ID NO: 662501 - RNA, 64 nt, hsa; identical to SEQ ID NO: 488543

SEQ ID NO: 662502 - RNA, 64 nt, hsa; identical to SEQ ID NO: 488544

SEQ ID NO: 662503 - RNA, 64 nt, hsa; identical to SEQ ID NO: 488545

SEQ ID NO: 662504 - RNA, 64 nt, hsa; identical to SEQ ID NO: 488546

SEQ ID NO: 662505 - RNA, 64 nt, hsa; identical to SEQ ID NO: 488547

SEQ ID NO: 662506 - RNA, 64 nt, hsa; identical to SEQ ID NO: 488548

SEQ ID NO: 662507 - RNA, 64 nt, hsa; identical to SEQ ID NO: 488549

SEQ ID NO: 662508 - RNA, 64 nt, hsa
auugagaaugugcuuuguaagauccacccccugcccacaaaaaauugcuccuaacuccaccgcc

SEQ ID NO: 662509 - RNA, 64 nt, hsa
guauacacccagauggccugaagcaacugaagauccacaaaagaagugaaaauagccaguuccu

SEQ ID NO: 662510 - RNA, 64 nt, hsa
gcagaugugcgaguuauugacuguggaguacuugccacaaaaucaauaaaagaugguaagaacu

SEQ ID NO: 662511 - RNA, 64 nt, hsa
guccuguuccaauucggaaaacaauaggggaaagccacaaaagcacaaacaugggucaaaggaa

SEQ ID NO: 662512 - RNA, 64 nt, hsa
guauacauccagauggccuaaaguaacugaagauccacaaaagaaguaaaaauagccuuaacug

SEQ ID NO: 662513 - RNA, 64 nt, hsa
cccuugagaauguacuuugugagauccacccugcccacaaaacauugcucuuaacuucaccgcc

SEQ ID NO: 662514 - RNA, 64 nt, hsa
agagucaaaguaguuaguuuugguuauuucuaaaccacaaaaguuguuuaauaaguauaucuua

SEQ ID NO: 662515 - RNA, 64 nt, hsa
ugagcuuugcauuuaugauuucuccagaaauuuaccacaaaagcaaaauuuuuaaaacugcauu

SEQ ID NO: 662516 - RNA, 64 nt, hsa
aaaaguacuuuuggaaggcaugggguugccaguaccacaaaaacuguguuguauauaauguaaa

SEQ ID NO: 662517 - RNA, 64 nt, hsa
uuaaaaauguauuugucauguuaaaaaguguuagccacaaaaggcuacuuacuuucuuuuccuu

SEQ ID NO: 662518 - RNA, 64 nt, hsa
ucauuuccacaugaaggagaggcaaggaaaagccccacaaaauuccuguuacccgcugaacucc

SEQ ID NO: 662519 - RNA, 64 nt, hsa
uacucccugcacccuucugacugacaguucauccccacaaaacacauugguuuugagaggugau

SEQ ID NO: 662520 - RNA, 64 nt, hsa
ccauauccagaacaaaaugauacuugacauccuuccacaaaagucagccuaaagaaguuauggu

SEQ ID NO: 662521 - RNA, 64 nt, hsa
uuuaauccauguggauuuuuuuuuucuuagagaaccacaaaacauaaaaggagcaagucggacu

SEQ ID NO: 662522 - RNA, 64 nt, hsa
accaacugccaaguuauuaguuccuaaauacuauccacaaaaaaggggaacagggaugauuccu

SEQ ID NO: 662523 - RNA, 64 nt, hsa
aauagaaaacacaauccuaaaauuuauaugggaaccacaaaagacuuagaauagucagcuaucc

SEQ ID NO: 662524 - RNA, 64 nt, hsa
agaaagcaggaguaaugugccgauucugaaguugccacaaaaaauaagacacuggugaaugaga

SEQ ID NO: 662525 - RNA, 64 nt, hsa
auuaauauauaugaaauauuccuuuuugaugacaccacaaaauuguugaacaguuuaagaauuu

SEQ ID NO: 662526 - RNA, 64 nt, hsa
guagaguuuguucagcuauuuuccagauaucuccccacaaaaggaggcaaaggguaccagcuuu

SEQ ID NO: 662527 - RNA, 64 nt, hsa
cccuucacccugcagucuguggaaaaauugucuuccacaaaacuggucccuggugccaaaaaug

SEQ ID NO: 662528 - RNA, 64 nt, hsa
agaauaaagaacuucaggagcuucuuaggucuugccacaaaaaucugcaaauuugauaauucuc

SEQ ID NO: 662529 - RNA, 64 nt, hsa
ggaaaugugucccuaaauggaaacaaauauaaucccacaaaaccaacaauuuuauuugccucua

SEQ ID NO: 662530 - RNA, 64 nt, hsa
cuacaaauucuugugaguccuaauuccuccuuauccacaaaacagucaauguucccguggagug

SEQ ID NO: 662531 - RNA, 64 nt, hsa
agucauuuggucaaaccaaugacaaaaccgccuuccacaaaaguugaaauaagaaacaagagua

SEQ ID NO: 662532 - RNA, 64 nt, hsa
aaaauaugaacagacucagcuuugggacguccaaccacaaaagaaauuauauauaaauauauau

SEQ ID NO: 662533 - RNA, 64 nt, hsa
augacuggugacuguuuaaugagcugugcaucccccacaaaaacaugagugccccucugugugg

SEQ ID NO: 662534 - RNA, 64 nt, hsa; identical to SEQ ID NO: 363631

SEQ ID NO: 662535 - RNA, 64 nt, hsa; identical to SEQ ID NO: 363632

SEQ ID NO: 662536 - RNA, 64 nt, hsa; identical to SEQ ID NO: 363633

SEQ ID NO: 662537 - RNA, 64 nt, hsa; identical to SEQ ID NO: 363634

SEQ ID NO: 662538 - RNA, 64 nt, hsa; identical to SEQ ID NO: 363635

SEQ ID NO: 662539 - RNA, 64 nt, hsa; identical to SEQ ID NO: 363636

SEQ ID NO: 662540 - RNA, 64 nt, hsa; identical to SEQ ID NO: 363637

SEQ ID NO: 662541 - RNA, 64 nt, hsa; identical to SEQ ID NO: 363638

SEQ ID NO: 662542 - RNA, 64 nt, hsa; identical to SEQ ID NO: 363639

SEQ ID NO: 662543 - RNA, 64 nt, hsa; identical to SEQ ID NO: 363640

SEQ ID NO: 662544 - RNA, 64 nt, hsa; identical to SEQ ID NO: 363641

SEQ ID NO: 662545 - RNA, 64 nt, hsa; identical to SEQ ID NO: 363642

SEQ ID NO: 662546 - RNA, 63 nt, hsa; identical to SEQ ID NO: 363643

SEQ ID NO: 662547 - RNA, 64 nt, hsa; identical to SEQ ID NO: 363644

SEQ ID NO: 662548 - RNA, 64 nt, hsa; identical to SEQ ID NO: 363645

SEQ ID NO: 662549 - RNA, 64 nt, hsa; identical to SEQ ID NO: 363646

SEQ ID NO: 662550 - RNA, 64 nt, hsa; identical to SEQ ID NO: 363647

SEQ ID NO: 662551 - RNA, 64 nt, hsa; identical to SEQ ID NO: 363648

SEQ ID NO: 662552 - RNA, 64 nt, hsa; identical to SEQ ID NO: 363649

SEQ ID NO: 662553 - RNA, 64 nt, hsa; identical to SEQ ID NO: 363650

SEQ ID NO: 662554 - RNA, 64 nt, hsa; identical to SEQ ID NO: 363651

SEQ ID NO: 662555 - RNA, 64 nt, hsa; identical to SEQ ID NO: 363652

SEQ ID NO: 662556 - RNA, 64 nt, hsa; identical to SEQ ID NO: 363653

SEQ ID NO: 662557 - RNA, 64 nt, hsa; identical to SEQ ID NO: 363654

SEQ ID NO: 662558 - RNA, 64 nt, hsa; identical to SEQ ID NO: 363655

SEQ ID NO: 662559 - RNA, 64 nt, hsa; identical to SEQ ID NO: 363656

SEQ ID NO: 662560 - RNA, 64 nt, hsa; identical to SEQ ID NO: 363657

SEQ ID NO: 662561 - RNA, 64 nt, hsa; identical to SEQ ID NO: 363658

SEQ ID NO: 662562 - RNA, 64 nt, hsa; identical to SEQ ID NO: 363659

SEQ ID NO: 662563 - RNA, 64 nt, hsa; identical to SEQ ID NO: 363660

SEQ ID NO: 662564 - RNA, 64 nt, hsa; identical to SEQ ID NO: 363661

SEQ ID NO: 662565 - RNA, 64 nt, hsa; identical to SEQ ID NO: 363662

SEQ ID NO: 662566 - RNA, 64 nt, hsa; identical to SEQ ID NO: 363663

SEQ ID NO: 662567 - RNA, 64 nt, hsa; identical to SEQ ID NO: 363664

SEQ ID NO: 662568 - RNA, 64 nt, hsa; identical to SEQ ID NO: 363665

SEQ ID NO: 662569 - RNA, 57 nt, hsa; identical to SEQ ID NO: 262389

SEQ ID NO: 662570 - RNA, 64 nt, hsa; identical to SEQ ID NO: 363667

SEQ ID NO: 662571 - RNA, 64 nt, hsa; identical to SEQ ID NO: 363668

SEQ ID NO: 662572 - RNA, 64 nt, hsa; identical to SEQ ID NO: 363669

SEQ ID NO: 662573 - RNA, 64 nt, hsa; identical to SEQ ID NO: 363670

SEQ ID NO: 662574 - RNA, 64 nt, hsa; identical to SEQ ID NO: 363671

SEQ ID NO: 662575 - RNA, 64 nt, hsa; identical to SEQ ID NO: 363672

SEQ ID NO: 662576 - RNA, 64 nt, hsa; identical to SEQ ID NO: 363673

SEQ ID NO: 662577 - RNA, 64 nt, hsa; identical to SEQ ID NO: 363674

SEQ ID NO: 662578 - RNA, 64 nt, hsa; identical to SEQ ID NO: 363675

SEQ ID NO: 662579 - RNA, 64 nt, hsa; identical to SEQ ID NO: 363676

SEQ ID NO: 662580 - RNA, 64 nt, hsa; identical to SEQ ID NO: 363677

SEQ ID NO: 662581 - RNA, 64 nt, hsa; identical to SEQ ID NO: 363678

SEQ ID NO: 662582 - RNA, 64 nt, hsa; identical to SEQ ID NO: 363679

SEQ ID NO: 662583 - RNA, 64 nt, hsa; identical to SEQ ID NO: 363680

SEQ ID NO: 662584 - RNA, 64 nt, hsa; identical to SEQ ID NO: 523002

SEQ ID NO: 662585 - RNA, 64 nt, hsa; identical to SEQ ID NO: 523003

SEQ ID NO: 662586 - RNA, 64 nt, hsa; identical to SEQ ID NO: 523004

SEQ ID NO: 662587 - RNA, 64 nt, hsa; identical to SEQ ID NO: 523005

SEQ ID NO: 662588 - RNA, 64 nt, hsa; identical to SEQ ID NO: 523006

SEQ ID NO: 662589 - RNA, 64 nt, hsa; identical to SEQ ID NO: 523007

SEQ ID NO: 662590 - RNA, 64 nt, hsa; identical to SEQ ID NO: 523008

SEQ ID NO: 662591 - RNA, 64 nt, hsa; identical to SEQ ID NO: 523009

SEQ ID NO: 662592 - RNA, 64 nt, hsa; identical to SEQ ID NO: 523010

SEQ ID NO: 662593 - RNA, 64 nt, hsa; identical to SEQ ID NO: 523011

SEQ ID NO: 662594 - RNA, 64 nt, hsa; identical to SEQ ID NO: 523012

SEQ ID NO: 662595 - RNA, 64 nt, hsa; identical to SEQ ID NO: 523013

SEQ ID NO: 662596 - RNA, 64 nt, hsa; identical to SEQ ID NO: 523014

SEQ ID NO: 662597 - RNA, 64 nt, hsa; identical to SEQ ID NO: 523015

SEQ ID NO: 662598 - RNA, 64 nt, hsa; identical to SEQ ID NO: 523016

SEQ ID NO: 662599 - RNA, 64 nt, hsa; identical to SEQ ID NO: 523017

SEQ ID NO: 662600 - RNA, 64 nt, hsa; identical to SEQ ID NO: 523018

SEQ ID NO: 662601 - RNA, 64 nt, hsa; identical to SEQ ID NO: 523019

SEQ ID NO: 662602 - RNA, 64 nt, hsa; identical to SEQ ID NO: 523019

SEQ ID NO: 662603 - RNA, 64 nt, hsa; identical to SEQ ID NO: 151188

SEQ ID NO: 662604 - RNA, 64 nt, hsa; identical to SEQ ID NO: 151189

SEQ ID NO: 662605 - RNA, 64 nt, hsa; identical to SEQ ID NO: 151190

SEQ ID NO: 662606 - RNA, 64 nt, hsa; identical to SEQ ID NO: 151191

SEQ ID NO: 662607 - RNA, 64 nt, hsa; identical to SEQ ID NO: 151192

SEQ ID NO: 662608 - RNA, 64 nt, hsa; identical to SEQ ID NO: 151193

SEQ ID NO: 662609 - RNA, 64 nt, hsa; identical to SEQ ID NO: 151194

SEQ ID NO: 662610 - RNA, 64 nt, hsa; identical to SEQ ID NO: 151195

SEQ ID NO: 662611 - RNA, 64 nt, hsa; identical to SEQ ID NO: 151196

SEQ ID NO: 662612 - RNA, 64 nt, hsa; identical to SEQ ID NO: 151197

SEQ ID NO: 662613 - RNA, 64 nt, hsa; identical to SEQ ID NO: 151198

SEQ ID NO: 662614 - RNA, 64 nt, hsa; identical to SEQ ID NO: 151199

SEQ ID NO: 662615 - RNA, 64 nt, hsa; identical to SEQ ID NO: 151200

SEQ ID NO: 662616 - RNA, 64 nt, hsa; identical to SEQ ID NO: 151201

SEQ ID NO: 662617 - RNA, 64 nt, hsa; identical to SEQ ID NO: 151202

SEQ ID NO: 662618 - RNA, 64 nt, hsa; identical to SEQ ID NO: 151203

SEQ ID NO: 662619 - RNA, 64 nt, hsa; identical to SEQ ID NO: 151204

SEQ ID NO: 662620 - RNA, 64 nt, hsa; identical to SEQ ID NO: 151205

SEQ ID NO: 662621 - RNA, 64 nt, hsa; identical to SEQ ID NO: 151206

SEQ ID NO: 662622 - RNA, 64 nt, hsa; identical to SEQ ID NO: 151207

SEQ ID NO: 662623 - RNA, 64 nt, hsa; identical to SEQ ID NO: 151208

SEQ ID NO: 662624 - RNA, 64 nt, hsa; identical to SEQ ID NO: 151209

SEQ ID NO: 662625 - RNA, 64 nt, hsa; identical to SEQ ID NO: 151210

SEQ ID NO: 662626 - RNA, 64 nt, hsa; identical to SEQ ID NO: 151211

SEQ ID NO: 662627 - RNA, 64 nt, hsa; identical to SEQ ID NO: 151212

SEQ ID NO: 662628 - RNA, 64 nt, hsa; identical to SEQ ID NO: 151213

SEQ ID NO: 662629 - RNA, 64 nt, hsa; identical to SEQ ID NO: 151214

SEQ ID NO: 662630 - RNA, 64 nt, hsa; identical to SEQ ID NO: 151215

SEQ ID NO: 662631 - RNA, 64 nt, hsa; identical to SEQ ID NO: 151216

SEQ ID NO: 662632 - RNA, 64 nt, hsa; identical to SEQ ID NO: 151217

SEQ ID NO: 662633 - RNA, 64 nt, hsa; identical to SEQ ID NO: 151218

SEQ ID NO: 662634 - RNA, 64 nt, hsa; identical to SEQ ID NO: 151219

SEQ ID NO: 662635 - RNA, 64 nt, hsa; identical to SEQ ID NO: 151220

SEQ ID NO: 662636 - RNA, 64 nt, hsa; identical to SEQ ID NO: 151221

SEQ ID NO: 662637 - RNA, 64 nt, hsa; identical to SEQ ID NO: 151222

SEQ ID NO: 662638 - RNA, 64 nt, hsa; identical to SEQ ID NO: 151223

SEQ ID NO: 662639 - RNA, 64 nt, hsa; identical to SEQ ID NO: 151224

SEQ ID NO: 662640 - RNA, 64 nt, hsa; identical to SEQ ID NO: 151225

SEQ ID NO: 662641 - RNA, 64 nt, hsa; identical to SEQ ID NO: 151226

SEQ ID NO: 662642 - RNA, 64 nt, hsa; identical to SEQ ID NO: 151227

SEQ ID NO: 662643 - RNA, 64 nt, hsa; identical to SEQ ID NO: 151228

SEQ ID NO: 662644 - RNA, 64 nt, hsa; identical to SEQ ID NO: 151229

SEQ ID NO: 662645 - RNA, 64 nt, hsa; identical to SEQ ID NO: 151230

SEQ ID NO: 662646 - RNA, 64 nt, hsa; identical to SEQ ID NO: 151231

SEQ ID NO: 662647 - RNA, 64 nt, hsa; identical to SEQ ID NO: 151232

SEQ ID NO: 662648 - RNA, 64 nt, hsa; identical to SEQ ID NO: 151233

SEQ ID NO: 662649 - RNA, 64 nt, hsa; identical to SEQ ID NO: 151234

SEQ ID NO: 662650 - RNA, 64 nt, hsa; identical to SEQ ID NO: 151235

SEQ ID NO: 662651 - RNA, 64 nt, hsa; identical to SEQ ID NO: 151236

SEQ ID NO: 662652 - RNA, 64 nt, hsa; identical to SEQ ID NO: 151237

SEQ ID NO: 662653 - RNA, 64 nt, hsa; identical to SEQ ID NO: 151238

SEQ ID NO: 662654 - RNA, 64 nt, hsa; identical to SEQ ID NO: 151239

SEQ ID NO: 662655 - RNA, 64 nt, hsa; identical to SEQ ID NO: 151240

SEQ ID NO: 662656 - RNA, 64 nt, hsa; identical to SEQ ID NO: 151241

SEQ ID NO: 662657 - RNA, 64 nt, hsa; identical to SEQ ID NO: 151242

SEQ ID NO: 662658 - RNA, 64 nt, hsa; identical to SEQ ID NO: 151243

SEQ ID NO: 662659 - RNA, 64 nt, hsa; identical to SEQ ID NO: 151244

SEQ ID NO: 662660 - RNA, 64 nt, hsa; identical to SEQ ID NO: 151245

SEQ ID NO: 662661 - RNA, 64 nt, hsa; identical to SEQ ID NO: 151246

SEQ ID NO: 662662 - RNA, 64 nt, hsa; identical to SEQ ID NO: 151247

SEQ ID NO: 662663 - RNA, 64 nt, hsa; identical to SEQ ID NO: 151248

SEQ ID NO: 662664 - RNA, 64 nt, hsa; identical to SEQ ID NO: 151249

SEQ ID NO: 662665 - RNA, 64 nt, hsa; identical to SEQ ID NO: 151250

SEQ ID NO: 662666 - RNA, 64 nt, hsa; identical to SEQ ID NO: 151251

SEQ ID NO: 662667 - RNA, 64 nt, hsa; identical to SEQ ID NO: 151252

SEQ ID NO: 662668 - RNA, 64 nt, hsa; identical to SEQ ID NO: 151253

SEQ ID NO: 662669 - RNA, 64 nt, hsa; identical to SEQ ID NO: 151254

SEQ ID NO: 662670 - RNA, 64 nt, hsa; identical to SEQ ID NO: 151255

SEQ ID NO: 662671 - RNA, 64 nt, hsa; identical to SEQ ID NO: 151256

SEQ ID NO: 662672 - RNA, 64 nt, hsa; identical to SEQ ID NO: 151257

SEQ ID NO: 662673 - RNA, 64 nt, hsa; identical to SEQ ID NO: 151258

SEQ ID NO: 662674 - RNA, 64 nt, hsa; identical to SEQ ID NO: 151259

SEQ ID NO: 662675 - RNA, 64 nt, hsa; identical to SEQ ID NO: 151260

SEQ ID NO: 662676 - RNA, 64 nt, hsa; identical to SEQ ID NO: 151261

SEQ ID NO: 662677 - RNA, 64 nt, hsa; identical to SEQ ID NO: 151262

SEQ ID NO: 662678 - RNA, 64 nt, hsa; identical to SEQ ID NO: 151263

SEQ ID NO: 662679 - RNA, 64 nt, hsa; identical to SEQ ID NO: 151264

SEQ ID NO: 662680 - RNA, 64 nt, hsa; identical to SEQ ID NO: 151265

SEQ ID NO: 662681 - RNA, 64 nt, hsa; identical to SEQ ID NO: 151266

SEQ ID NO: 662682 - RNA, 64 nt, hsa; identical to SEQ ID NO: 151267

SEQ ID NO: 662683 - RNA, 64 nt, hsa; identical to SEQ ID NO: 151268

SEQ ID NO: 662684 - RNA, 64 nt, hsa; identical to SEQ ID NO: 151269

SEQ ID NO: 662685 - RNA, 64 nt, hsa; identical to SEQ ID NO: 151270

SEQ ID NO: 662686 - RNA, 64 nt, hsa; identical to SEQ ID NO: 151271

SEQ ID NO: 662687 - RNA, 64 nt, hsa; identical to SEQ ID NO: 151272

SEQ ID NO: 662688 - RNA, 64 nt, hsa; identical to SEQ ID NO: 151273

SEQ ID NO: 662689 - RNA, 64 nt, hsa; identical to SEQ ID NO: 151274

SEQ ID NO: 662690 - RNA, 64 nt, hsa; identical to SEQ ID NO: 151275

SEQ ID NO: 662691 - RNA, 64 nt, hsa; identical to SEQ ID NO: 151276

SEQ ID NO: 662692 - RNA, 64 nt, hsa; identical to SEQ ID NO: 151277

SEQ ID NO: 662693 - RNA, 64 nt, hsa; identical to SEQ ID NO: 151278

SEQ ID NO: 662694 - RNA, 64 nt, hsa; identical to SEQ ID NO: 151279

SEQ ID NO: 662695 - RNA, 64 nt, hsa; identical to SEQ ID NO: 151280

SEQ ID NO: 662696 - RNA, 64 nt, hsa; identical to SEQ ID NO: 151281

SEQ ID NO: 662697 - RNA, 64 nt, hsa; identical to SEQ ID NO: 151282

SEQ ID NO: 662698 - RNA, 64 nt, hsa; identical to SEQ ID NO: 151283

SEQ ID NO: 662699 - RNA, 64 nt, hsa; identical to SEQ ID NO: 151284

SEQ ID NO: 662700 - RNA, 64 nt, hsa; identical to SEQ ID NO: 151285

SEQ ID NO: 662701 - RNA, 64 nt, hsa; identical to SEQ ID NO: 151286

SEQ ID NO: 662702 - RNA, 64 nt, hsa; identical to SEQ ID NO: 151287

SEQ ID NO: 662703 - RNA, 64 nt, hsa; identical to SEQ ID NO: 151288

SEQ ID NO: 662704 - RNA, 64 nt, hsa; identical to SEQ ID NO: 151289

SEQ ID NO: 662705 - RNA, 64 nt, hsa; identical to SEQ ID NO: 151290

SEQ ID NO: 662706 - RNA, 64 nt, hsa; identical to SEQ ID NO: 151291

SEQ ID NO: 662707 - RNA, 64 nt, hsa; identical to SEQ ID NO: 151292

SEQ ID NO: 662708 - RNA, 64 nt, hsa; identical to SEQ ID NO: 151293

SEQ ID NO: 662709 - RNA, 64 nt, hsa; identical to SEQ ID NO: 151294

SEQ ID NO: 662710 - RNA, 64 nt, hsa; identical to SEQ ID NO: 151295

SEQ ID NO: 662711 - RNA, 64 nt, hsa; identical to SEQ ID NO: 151296

SEQ ID NO: 662712 - RNA, 64 nt, hsa; identical to SEQ ID NO: 151297

SEQ ID NO: 662713 - RNA, 64 nt, hsa; identical to SEQ ID NO: 151298

SEQ ID NO: 662714 - RNA, 64 nt, hsa; identical to SEQ ID NO: 151299

SEQ ID NO: 662715 - RNA, 64 nt, hsa; identical to SEQ ID NO: 151300

SEQ ID NO: 662716 - RNA, 64 nt, hsa; identical to SEQ ID NO: 151301

SEQ ID NO: 662717 - RNA, 64 nt, hsa; identical to SEQ ID NO: 151302

SEQ ID NO: 662718 - RNA, 64 nt, hsa; identical to SEQ ID NO: 151303

SEQ ID NO: 662719 - RNA, 64 nt, hsa; identical to SEQ ID NO: 151304

SEQ ID NO: 662720 - RNA, 64 nt, hsa; identical to SEQ ID NO: 151305

SEQ ID NO: 662721 - RNA, 64 nt, hsa; identical to SEQ ID NO: 151306

SEQ ID NO: 662722 - RNA, 64 nt, hsa; identical to SEQ ID NO: 151307

SEQ ID NO: 662723 - RNA, 64 nt, hsa; identical to SEQ ID NO: 151308

SEQ ID NO: 662724 - RNA, 64 nt, hsa; identical to SEQ ID NO: 151309

SEQ ID NO: 662725 - RNA, 64 nt, hsa; identical to SEQ ID NO: 151310

SEQ ID NO: 662726 - RNA, 64 nt, hsa; identical to SEQ ID NO: 151311

SEQ ID NO: 662727 - RNA, 64 nt, hsa; identical to SEQ ID NO: 151312

SEQ ID NO: 662728 - RNA, 64 nt, hsa; identical to SEQ ID NO: 151313

SEQ ID NO: 662729 - RNA, 64 nt, hsa; identical to SEQ ID NO: 151314

SEQ ID NO: 662730 - RNA, 64 nt, hsa; identical to SEQ ID NO: 151315

SEQ ID NO: 662731 - RNA, 64 nt, hsa; identical to SEQ ID NO: 151316

SEQ ID NO: 662732 - RNA, 64 nt, hsa; identical to SEQ ID NO: 333348

SEQ ID NO: 662733 - RNA, 64 nt, hsa; identical to SEQ ID NO: 333349

SEQ ID NO: 662734 - RNA, 64 nt, hsa; identical to SEQ ID NO: 333350

SEQ ID NO: 662735 - RNA, 64 nt, hsa; identical to SEQ ID NO: 333351

SEQ ID NO: 662736 - RNA, 64 nt, hsa; identical to SEQ ID NO: 333352

SEQ ID NO: 662737 - RNA, 64 nt, hsa; identical to SEQ ID NO: 333353

SEQ ID NO: 662738 - RNA, 64 nt, hsa; identical to SEQ ID NO: 333354

SEQ ID NO: 662739 - RNA, 64 nt, hsa; identical to SEQ ID NO: 333355

SEQ ID NO: 662740 - RNA, 64 nt, hsa; identical to SEQ ID NO: 333356

SEQ ID NO: 662741 - RNA, 64 nt, hsa; identical to SEQ ID NO: 333357

SEQ ID NO: 662742 - RNA, 64 nt, hsa; identical to SEQ ID NO: 333358

SEQ ID NO: 662743 - RNA, 64 nt, hsa; identical to SEQ ID NO: 333359

SEQ ID NO: 662744 - RNA, 64 nt, hsa; identical to SEQ ID NO: 333360

SEQ ID NO: 662745 - RNA, 64 nt, hsa; identical to SEQ ID NO: 333361

SEQ ID NO: 662746 - RNA, 64 nt, hsa; identical to SEQ ID NO: 333362

SEQ ID NO: 662747 - RNA, 64 nt, hsa; identical to SEQ ID NO: 333363

SEQ ID NO: 662748 - RNA, 64 nt, hsa; identical to SEQ ID NO: 333364

SEQ ID NO: 662749 - RNA, 64 nt, hsa; identical to SEQ ID NO: 333365

SEQ ID NO: 662750 - RNA, 64 nt, hsa; identical to SEQ ID NO: 333366

SEQ ID NO: 662751 - RNA, 64 nt, hsa; identical to SEQ ID NO: 333367

SEQ ID NO: 662752 - RNA, 64 nt, hsa; identical to SEQ ID NO: 333368

SEQ ID NO: 662753 - RNA, 64 nt, hsa; identical to SEQ ID NO: 333369

SEQ ID NO: 662754 - RNA, 64 nt, hsa; identical to SEQ ID NO: 333370

SEQ ID NO: 662755 - RNA, 64 nt, hsa; identical to SEQ ID NO: 333371

SEQ ID NO: 662756 - RNA, 64 nt, hsa; identical to SEQ ID NO: 333372

SEQ ID NO: 662757 - RNA, 64 nt, hsa; identical to SEQ ID NO: 333373

SEQ ID NO: 662758 - RNA, 64 nt, hsa; identical to SEQ ID NO: 333374

SEQ ID NO: 662759 - RNA, 64 nt, hsa; identical to SEQ ID NO: 333375

SEQ ID NO: 662760 - RNA, 64 nt, hsa; identical to SEQ ID NO: 333376

SEQ ID NO: 662761 - RNA, 64 nt, hsa; identical to SEQ ID NO: 333377

SEQ ID NO: 662762 - RNA, 64 nt, hsa; identical to SEQ ID NO: 333378

SEQ ID NO: 662763 - RNA, 64 nt, hsa; identical to SEQ ID NO: 333379

SEQ ID NO: 662764 - RNA, 64 nt, hsa; identical to SEQ ID NO: 333380

SEQ ID NO: 662765 - RNA, 64 nt, hsa; identical to SEQ ID NO: 333381

SEQ ID NO: 662766 - RNA, 64 nt, hsa; identical to SEQ ID NO: 333382

SEQ ID NO: 662767 - RNA, 64 nt, hsa; identical to SEQ ID NO: 333383

SEQ ID NO: 662768 - RNA, 64 nt, hsa; identical to SEQ ID NO: 333384

SEQ ID NO: 662769 - RNA, 64 nt, hsa; identical to SEQ ID NO: 333385

SEQ ID NO: 662770 - RNA, 64 nt, hsa; identical to SEQ ID NO: 333386

SEQ ID NO: 662771 - RNA, 64 nt, hsa; identical to SEQ ID NO: 333387

SEQ ID NO: 662772 - RNA, 64 nt, hsa; identical to SEQ ID NO: 333388

SEQ ID NO: 662773 - RNA, 64 nt, hsa; identical to SEQ ID NO: 333389

SEQ ID NO: 662774 - RNA, 64 nt, hsa; identical to SEQ ID NO: 333390

SEQ ID NO: 662775 - RNA, 64 nt, hsa; identical to SEQ ID NO: 333391

SEQ ID NO: 662776 - RNA, 64 nt, hsa; identical to SEQ ID NO: 333392

SEQ ID NO: 662777 - RNA, 64 nt, hsa; identical to SEQ ID NO: 333393

SEQ ID NO: 662778 - RNA, 64 nt, hsa; identical to SEQ ID NO: 333394

SEQ ID NO: 662779 - RNA, 64 nt, hsa; identical to SEQ ID NO: 333395

SEQ ID NO: 662780 - RNA, 64 nt, hsa; identical to SEQ ID NO: 333396

SEQ ID NO: 662781 - RNA, 64 nt, hsa; identical to SEQ ID NO: 333397

SEQ ID NO: 662782 - RNA, 64 nt, hsa; identical to SEQ ID NO: 333398

SEQ ID NO: 662783 - RNA, 64 nt, hsa; identical to SEQ ID NO: 333399

SEQ ID NO: 662784 - RNA, 64 nt, hsa; identical to SEQ ID NO: 333400

SEQ ID NO: 662785 - RNA, 64 nt, hsa; identical to SEQ ID NO: 333401

SEQ ID NO: 662786 - RNA, 64 nt, hsa; identical to SEQ ID NO: 333402

SEQ ID NO: 662787 - RNA, 64 nt, hsa; identical to SEQ ID NO: 333403

SEQ ID NO: 662788 - RNA, 64 nt, hsa; identical to SEQ ID NO: 333404

SEQ ID NO: 662789 - RNA, 64 nt, hsa; identical to SEQ ID NO: 333405

SEQ ID NO: 662790 - RNA, 64 nt, hsa; identical to SEQ ID NO: 333406

SEQ ID NO: 662791 - RNA, 64 nt, hsa; identical to SEQ ID NO: 333407

SEQ ID NO: 662792 - RNA, 64 nt, hsa; identical to SEQ ID NO: 333408

SEQ ID NO: 662793 - RNA, 64 nt, hsa; identical to SEQ ID NO: 333409

SEQ ID NO: 662794 - RNA, 64 nt, hsa; identical to SEQ ID NO: 333410

SEQ ID NO: 662795 - RNA, 64 nt, hsa; identical to SEQ ID NO: 333411

SEQ ID NO: 662796 - RNA, 64 nt, hsa; identical to SEQ ID NO: 333412

SEQ ID NO: 662797 - RNA, 64 nt, hsa; identical to SEQ ID NO: 333413

SEQ ID NO: 662798 - RNA, 64 nt, hsa; identical to SEQ ID NO: 333414

SEQ ID NO: 662799 - RNA, 64 nt, hsa; identical to SEQ ID NO: 333415

SEQ ID NO: 662800 - RNA, 64 nt, hsa; identical to SEQ ID NO: 333416

SEQ ID NO: 662801 - RNA, 64 nt, hsa; identical to SEQ ID NO: 333417

SEQ ID NO: 662802 - RNA, 64 nt, hsa; identical to SEQ ID NO: 333418

SEQ ID NO: 662803 - RNA, 64 nt, hsa; identical to SEQ ID NO: 333419

SEQ ID NO: 662804 - RNA, 64 nt, hsa; identical to SEQ ID NO: 333420

SEQ ID NO: 662805 - RNA, 64 nt, hsa; identical to SEQ ID NO: 333421

SEQ ID NO: 662806 - RNA, 64 nt, hsa; identical to SEQ ID NO: 333422

SEQ ID NO: 662807 - RNA, 64 nt, hsa; identical to SEQ ID NO: 333423

SEQ ID NO: 662808 - RNA, 64 nt, hsa; identical to SEQ ID NO: 333424

SEQ ID NO: 662809 - RNA, 64 nt, hsa; identical to SEQ ID NO: 333425

SEQ ID NO: 662810 - RNA, 64 nt, hsa; identical to SEQ ID NO: 333426

SEQ ID NO: 662811 - RNA, 64 nt, hsa; identical to SEQ ID NO: 333427

SEQ ID NO: 662812 - RNA, 64 nt, hsa; identical to SEQ ID NO: 333428

SEQ ID NO: 662813 - RNA, 64 nt, hsa; identical to SEQ ID NO: 333429

SEQ ID NO: 662814 - RNA, 64 nt, hsa; identical to SEQ ID NO: 333430

SEQ ID NO: 662815 - RNA, 64 nt, hsa; identical to SEQ ID NO: 333431

SEQ ID NO: 662816 - RNA, 64 nt, hsa; identical to SEQ ID NO: 333432

SEQ ID NO: 662817 - RNA, 64 nt, hsa; identical to SEQ ID NO: 333433

SEQ ID NO: 662818 - RNA, 64 nt, hsa; identical to SEQ ID NO: 333434

SEQ ID NO: 662819 - RNA, 64 nt, hsa; identical to SEQ ID NO: 333435

SEQ ID NO: 662820 - RNA, 64 nt, hsa; identical to SEQ ID NO: 333436

SEQ ID NO: 662821 - RNA, 64 nt, hsa; identical to SEQ ID NO: 333437

SEQ ID NO: 662822 - RNA, 64 nt, hsa; identical to SEQ ID NO: 333438

SEQ ID NO: 662823 - RNA, 64 nt, hsa; identical to SEQ ID NO: 333439

SEQ ID NO: 662824 - RNA, 64 nt, hsa; identical to SEQ ID NO: 333440

SEQ ID NO: 662825 - RNA, 64 nt, hsa; identical to SEQ ID NO: 333441

SEQ ID NO: 662826 - RNA, 64 nt, hsa; identical to SEQ ID NO: 333442

SEQ ID NO: 662827 - RNA, 64 nt, hsa; identical to SEQ ID NO: 333443

SEQ ID NO: 662828 - RNA, 64 nt, hsa; identical to SEQ ID NO: 333444

SEQ ID NO: 662829 - RNA, 64 nt, hsa; identical to SEQ ID NO: 333445

SEQ ID NO: 662830 - RNA, 64 nt, hsa; identical to SEQ ID NO: 333446

SEQ ID NO: 662831 - RNA, 64 nt, hsa; identical to SEQ ID NO: 333447

SEQ ID NO: 662832 - RNA, 64 nt, hsa; identical to SEQ ID NO: 333448

SEQ ID NO: 662833 - RNA, 64 nt, hsa; identical to SEQ ID NO: 333449

SEQ ID NO: 662834 - RNA, 64 nt, hsa; identical to SEQ ID NO: 333450

SEQ ID NO: 662835 - RNA, 64 nt, hsa; identical to SEQ ID NO: 333451

SEQ ID NO: 662836 - RNA, 64 nt, hsa; identical to SEQ ID NO: 333452

SEQ ID NO: 662837 - RNA, 64 nt, hsa; identical to SEQ ID NO: 333453

SEQ ID NO: 662838 - RNA, 64 nt, hsa; identical to SEQ ID NO: 333454

SEQ ID NO: 662839 - RNA, 55 nt, hsa; identical to SEQ ID NO: 333455

SEQ ID NO: 662840 - RNA, 64 nt, hsa; identical to SEQ ID NO: 333456

SEQ ID NO: 662841 - RNA, 64 nt, hsa; identical to SEQ ID NO: 333457

SEQ ID NO: 662842 - RNA, 64 nt, hsa; identical to SEQ ID NO: 333458

SEQ ID NO: 662843 - RNA, 64 nt, hsa; identical to SEQ ID NO: 437584

SEQ ID NO: 662844 - RNA, 64 nt, hsa; identical to SEQ ID NO: 437585

SEQ ID NO: 662845 - RNA, 64 nt, hsa; identical to SEQ ID NO: 437586

SEQ ID NO: 662846 - RNA, 64 nt, hsa; identical to SEQ ID NO: 437587

SEQ ID NO: 662847 - RNA, 64 nt, hsa; identical to SEQ ID NO: 437588

SEQ ID NO: 662848 - RNA, 64 nt, hsa; identical to SEQ ID NO: 437589

SEQ ID NO: 662849 - RNA, 64 nt, hsa; identical to SEQ ID NO: 46031

SEQ ID NO: 662850 - RNA, 64 nt, hsa; identical to SEQ ID NO: 46032

SEQ ID NO: 662851 - RNA, 64 nt, hsa; identical to SEQ ID NO: 46033

SEQ ID NO: 662852 - RNA, 64 nt, hsa; identical to SEQ ID NO: 46034

SEQ ID NO: 662853 - RNA, 64 nt, hsa; identical to SEQ ID NO: 189531

SEQ ID NO: 662854 - RNA, 64 nt, hsa; identical to SEQ ID NO: 189532

SEQ ID NO: 662855 - RNA, 64 nt, hsa; identical to SEQ ID NO: 189533

SEQ ID NO: 662856 - RNA, 64 nt, hsa; identical to SEQ ID NO: 189534

SEQ ID NO: 662857 - RNA, 64 nt, hsa; identical to SEQ ID NO: 189535

SEQ ID NO: 662858 - RNA, 64 nt, hsa; identical to SEQ ID NO: 189536

SEQ ID NO: 662859 - RNA, 64 nt, hsa; identical to SEQ ID NO: 189537

SEQ ID NO: 662860 - RNA, 64 nt, hsa; identical to SEQ ID NO: 189538

SEQ ID NO: 662861 - RNA, 64 nt, hsa; identical to SEQ ID NO: 189539

SEQ ID NO: 662862 - RNA, 64 nt, hsa; identical to SEQ ID NO: 189540

SEQ ID NO: 662863 - RNA, 64 nt, hsa; identical to SEQ ID NO: 189541

SEQ ID NO: 662864 - RNA, 64 nt, hsa; identical to SEQ ID NO: 189542

SEQ ID NO: 662865 - RNA, 64 nt, hsa; identical to SEQ ID NO: 189543

SEQ ID NO: 662866 - RNA, 64 nt, hsa; identical to SEQ ID NO: 189544

SEQ ID NO: 662867 - RNA, 64 nt, hsa; identical to SEQ ID NO: 189545

SEQ ID NO: 662868 - RNA, 64 nt, hsa; identical to SEQ ID NO: 189546

SEQ ID NO: 662869 - RNA, 64 nt, hsa; identical to SEQ ID NO: 189547

SEQ ID NO: 662870 - RNA, 64 nt, hsa; identical to SEQ ID NO: 189548

SEQ ID NO: 662871 - RNA, 64 nt, hsa; identical to SEQ ID NO: 189549

SEQ ID NO: 662872 - RNA, 64 nt, hsa; identical to SEQ ID NO: 189550

SEQ ID NO: 662873 - RNA, 64 nt, hsa; identical to SEQ ID NO: 189551

SEQ ID NO: 662874 - RNA, 64 nt, hsa; identical to SEQ ID NO: 189552

SEQ ID NO: 662875 - RNA, 64 nt, hsa; identical to SEQ ID NO: 189553

SEQ ID NO: 662876 - RNA, 64 nt, hsa; identical to SEQ ID NO: 189554

SEQ ID NO: 662877 - RNA, 64 nt, hsa; identical to SEQ ID NO: 189555

SEQ ID NO: 662878 - RNA, 64 nt, hsa; identical to SEQ ID NO: 189556

SEQ ID NO: 662879 - RNA, 64 nt, hsa; identical to SEQ ID NO: 189557

SEQ ID NO: 662880 - RNA, 64 nt, hsa; identical to SEQ ID NO: 189558

SEQ ID NO: 662881 - RNA, 64 nt, hsa; identical to SEQ ID NO: 189559

SEQ ID NO: 662882 - RNA, 53 nt, hsa; identical to SEQ ID NO: 189560

SEQ ID NO: 662883 - RNA, 64 nt, hsa; identical to SEQ ID NO: 189561

SEQ ID NO: 662884 - RNA, 64 nt, hsa; identical to SEQ ID NO: 189562

SEQ ID NO: 662885 - RNA, 63 nt, hsa; identical to SEQ ID NO: 189563

SEQ ID NO: 662886 - RNA, 64 nt, hsa; identical to SEQ ID NO: 189564

SEQ ID NO: 662887 - RNA, 64 nt, hsa; identical to SEQ ID NO: 189565

SEQ ID NO: 662888 - RNA, 64 nt, hsa; identical to SEQ ID NO: 189566

SEQ ID NO: 662889 - RNA, 64 nt, hsa; identical to SEQ ID NO: 189567

SEQ ID NO: 662890 - RNA, 64 nt, hsa; identical to SEQ ID NO: 189568

SEQ ID NO: 662891 - RNA, 64 nt, hsa; identical to SEQ ID NO: 189569

SEQ ID NO: 662892 - RNA, 64 nt, hsa; identical to SEQ ID NO: 189570

SEQ ID NO: 662893 - RNA, 64 nt, hsa; identical to SEQ ID NO: 189571

SEQ ID NO: 662894 - RNA, 64 nt, hsa; identical to SEQ ID NO: 189572

SEQ ID NO: 662895 - RNA, 64 nt, hsa; identical to SEQ ID NO: 189573

SEQ ID NO: 662896 - RNA, 64 nt, hsa; identical to SEQ ID NO: 189574

SEQ ID NO: 662897 - RNA, 64 nt, hsa; identical to SEQ ID NO: 189575

SEQ ID NO: 662898 - RNA, 64 nt, hsa; identical to SEQ ID NO: 189576

SEQ ID NO: 662899 - RNA, 64 nt, hsa; identical to SEQ ID NO: 189577

SEQ ID NO: 662900 - RNA, 64 nt, hsa; identical to SEQ ID NO: 189578

SEQ ID NO: 662901 - RNA, 64 nt, hsa; identical to SEQ ID NO: 189579

SEQ ID NO: 662902 - RNA, 64 nt, hsa; identical to SEQ ID NO: 189580

SEQ ID NO: 662903 - RNA, 64 nt, hsa; identical to SEQ ID NO: 189581

SEQ ID NO: 662904 - RNA, 64 nt, hsa; identical to SEQ ID NO: 189582

SEQ ID NO: 662905 - RNA, 64 nt, hsa; identical to SEQ ID NO: 189583

SEQ ID NO: 662906 - RNA, 64 nt, hsa; identical to SEQ ID NO: 189584

SEQ ID NO: 662907 - RNA, 64 nt, hsa; identical to SEQ ID NO: 189585

SEQ ID NO: 662908 - RNA, 64 nt, hsa; identical to SEQ ID NO: 189586

SEQ ID NO: 662909 - RNA, 64 nt, hsa; identical to SEQ ID NO: 189587

SEQ ID NO: 662910 - RNA, 64 nt, hsa; identical to SEQ ID NO: 189588

SEQ ID NO: 662911 - RNA, 64 nt, hsa; identical to SEQ ID NO: 189589

SEQ ID NO: 662912 - RNA, 64 nt, hsa; identical to SEQ ID NO: 189590

SEQ ID NO: 662913 - RNA, 64 nt, hsa; identical to SEQ ID NO: 189591

SEQ ID NO: 662914 - RNA, 64 nt, hsa; identical to SEQ ID NO: 189592

SEQ ID NO: 662915 - RNA, 64 nt, hsa; identical to SEQ ID NO: 189593

SEQ ID NO: 662916 - RNA, 64 nt, hsa; identical to SEQ ID NO: 189594

SEQ ID NO: 662917 - RNA, 64 nt, hsa; identical to SEQ ID NO: 189595

SEQ ID NO: 662918 - RNA, 64 nt, hsa; identical to SEQ ID NO: 189596

SEQ ID NO: 662919 - RNA, 64 nt, hsa; identical to SEQ ID NO: 189597

SEQ ID NO: 662920 - RNA, 64 nt, hsa; identical to SEQ ID NO: 189598

SEQ ID NO: 662921 - RNA, 64 nt, hsa; identical to SEQ ID NO: 395856

SEQ ID NO: 662922 - RNA, 64 nt, hsa; identical to SEQ ID NO: 395857

SEQ ID NO: 662923 - RNA, 64 nt, hsa; identical to SEQ ID NO: 395858

SEQ ID NO: 662924 - RNA, 64 nt, hsa; identical to SEQ ID NO: 395859

SEQ ID NO: 662925 - RNA, 64 nt, hsa; identical to SEQ ID NO: 395860

SEQ ID NO: 662926 - RNA, 64 nt, hsa; identical to SEQ ID NO: 395861

SEQ ID NO: 662927 - RNA, 64 nt, hsa; identical to SEQ ID NO: 395862

SEQ ID NO: 662928 - RNA, 64 nt, hsa; identical to SEQ ID NO: 395863

SEQ ID NO: 662929 - RNA, 64 nt, hsa; identical to SEQ ID NO: 395864

SEQ ID NO: 662930 - RNA, 64 nt, hsa; identical to SEQ ID NO: 395865

SEQ ID NO: 662931 - RNA, 64 nt, hsa; identical to SEQ ID NO: 127462

SEQ ID NO: 662932 - RNA, 64 nt, hsa; identical to SEQ ID NO: 127463

SEQ ID NO: 662933 - RNA, 64 nt, hsa; identical to SEQ ID NO: 127464

SEQ ID NO: 662934 - RNA, 64 nt, hsa; identical to SEQ ID NO: 127465

SEQ ID NO: 662935 - RNA, 64 nt, hsa; identical to SEQ ID NO: 127466

SEQ ID NO: 662936 - RNA, 64 nt, hsa; identical to SEQ ID NO: 127467

SEQ ID NO: 662937 - RNA, 64 nt, hsa; identical to SEQ ID NO: 127468

SEQ ID NO: 662938 - RNA, 64 nt, hsa; identical to SEQ ID NO: 127469

SEQ ID NO: 662939 - RNA, 64 nt, hsa; identical to SEQ ID NO: 127470

SEQ ID NO: 662940 - RNA, 64 nt, hsa; identical to SEQ ID NO: 127471

SEQ ID NO: 662941 - RNA, 64 nt, hsa; identical to SEQ ID NO: 127472

SEQ ID NO: 662942 - RNA, 64 nt, hsa; identical to SEQ ID NO: 127473

SEQ ID NO: 662943 - RNA, 64 nt, hsa; identical to SEQ ID NO: 127474

SEQ ID NO: 662944 - RNA, 64 nt, hsa; identical to SEQ ID NO: 127475

SEQ ID NO: 662945 - RNA, 64 nt, hsa; identical to SEQ ID NO: 127476

SEQ ID NO: 662946 - RNA, 64 nt, hsa; identical to SEQ ID NO: 127477

SEQ ID NO: 662947 - RNA, 64 nt, hsa; identical to SEQ ID NO: 127476

SEQ ID NO: 662948 - RNA, 64 nt, hsa; identical to SEQ ID NO: 127477

SEQ ID NO: 662949 - RNA, 64 nt, hsa; identical to SEQ ID NO: 127480

SEQ ID NO: 662950 - RNA, 64 nt, hsa; identical to SEQ ID NO: 127477

SEQ ID NO: 662951 - RNA, 64 nt, hsa; identical to SEQ ID NO: 127482

SEQ ID NO: 662952 - RNA, 64 nt, hsa; identical to SEQ ID NO: 127483

SEQ ID NO: 662953 - RNA, 64 nt, hsa; identical to SEQ ID NO: 127484

SEQ ID NO: 662954 - RNA, 64 nt, hsa; identical to SEQ ID NO: 127485

SEQ ID NO: 662955 - RNA, 64 nt, hsa; identical to SEQ ID NO: 127486

SEQ ID NO: 662956 - RNA, 64 nt, hsa; identical to SEQ ID NO: 127487

SEQ ID NO: 662957 - RNA, 64 nt, hsa; identical to SEQ ID NO: 127488

SEQ ID NO: 662958 - RNA, 64 nt, hsa; identical to SEQ ID NO: 127489

SEQ ID NO: 662959 - RNA, 64 nt, hsa; identical to SEQ ID NO: 127490

SEQ ID NO: 662960 - RNA, 64 nt, hsa; identical to SEQ ID NO: 127491

SEQ ID NO: 662961 - RNA, 64 nt, hsa; identical to SEQ ID NO: 127492

SEQ ID NO: 662962 - RNA, 64 nt, hsa; identical to SEQ ID NO: 127493

SEQ ID NO: 662963 - RNA, 64 nt, hsa; identical to SEQ ID NO: 127494

SEQ ID NO: 662964 - RNA, 64 nt, hsa; identical to SEQ ID NO: 127495

SEQ ID NO: 662965 - RNA, 64 nt, hsa
cggugaugcgcucaccuucugcugggaaguuaauccaguacauuguagaagauggaggucaugu

SEQ ID NO: 662966 - RNA, 64 nt, hsa
uguggaauuaauucuugauauugcuaaaaggaucccaguacaagcagugugggcuggcuggggu

SEQ ID NO: 662967 - RNA, 64 nt, hsa
agaccaagaucagagggguucauuauaccccuggcuagagaacccagcuacugacaugcaagca

SEQ ID NO: 662968 - RNA, 64 nt, hsa
acccaaagcugugcagucaggcacccuggcugagcuagagaagccaguaccugcaucuugguuu

SEQ ID NO: 662969 - RNA, 64 nt, hsa
guuugugaauucagacuaugagcucaccuacaaccuagagaagaagcgagaugagcgcagugug

SEQ ID NO: 662970 - RNA, 64 nt, hsa
guacaaggaagcagcucgacuugagaucaacgugcuagagaaaaucaaugagaaagacccugac

SEQ ID NO: 662971 - RNA, 64 nt, hsa
uggauuguauuuguucguagauaugcccagaagacuagagaauuaguguuauauaccauauaga

SEQ ID NO: 662972 - RNA, 64 nt, hsa
acugcaaaaacaaauauagacaaauauuuugauucuagagaacgucucagaugugcuuauaaag

SEQ ID NO: 662973 - RNA, 64 nt, hsa
uuuauugcacaaccagccuggguucuaagaaagccuagagaauuucuuauugcccuguuagaaa

SEQ ID NO: 662974 - RNA, 64 nt, hsa
ucuuauugcccuguuagaaaaauuaacugagcuccuagagaagaacaauccucauguaagcuuc

SEQ ID NO: 662975 - RNA, 64 nt, hsa
gcugaacaguacuugugcaggauuguuguggcuacuagagaacaagagggaaaguagggcagaa

SEQ ID NO: 662976 - RNA, 64 nt, hsa
auuuacagccauuucuaaaauggcagcuucaguucuagagaagaaagaacaacaucagcaguaa

SEQ ID NO: 662977 - RNA, 64 nt, hsa
caggaucuacaggucuuugaucuggaaacuaagacuagagaagucuuaagagaugacugcucag

SEQ ID NO: 662978 - RNA, 64 nt, hsa
agacucaaacacgauauuacccaaguuccugagacuagagaaguguauaagucugaggacagau

SEQ ID NO: 662979 - RNA, 64 nt, hsa
agcucaagucuuagucgacauaaaagaauacacacuagagaaaaaccuuacaaaugugaagcau

SEQ ID NO: 662980 - RNA, 64 nt, hsa
gagcagaucuuggaaugaaugacaugaccuuucccuagagaauaaggaugaaauaaucacucau

SEQ ID NO: 662981 - RNA, 64 nt, hsa
auucauuuuaaaguggacuuauuaaaauuggaugcuagagaaucaaguuuauuuuauguauaua

SEQ ID NO: 662982 - RNA, 64 nt, hsa
auuauuucuuagacauaaucuaaagaaaaacagacuagagaagccaccugguuguaacagaaua

SEQ ID NO: 662983 - RNA, 64 nt, hsa
caaauuuuuacuguuuguagacaggaaugcuguccuagagaaccuccuccucaaccagcuacgu

SEQ ID NO: 662984 - RNA, 64 nt, hsa
aaaacuaggaaaggggaucagaaacauccucuccccgcucuagguuucuucucccaaaggggac

SEQ ID NO: 662985 - RNA, 64 nt, hsa
aacuaaaagggugauugacauccauguuuacacuccgcucuaauguuugauauauaaauaaguu

SEQ ID NO: 662986 - RNA, 64 nt, hsa
guguggcuguguccaucucugcucccccaaaggcccgcucuaggccuuauccucccucuagguc

SEQ ID NO: 662987 - RNA, 64 nt, hsa
cuaauggugguuugggcuugucuucuagucugggccgcucuaaacauuuauaauuccaacauug

SEQ ID NO: 662988 - RNA, 64 nt, hsa
ggggcaucauuauccggugcuugaacaaggagcuccgcucuacaacugguuuuuuuaggacuug

SEQ ID NO: 662989 - RNA, 64 nt, hsa
gagcacaagccccacagagggggaacagccagcaccgcucuagcugguuguugccaugccggaa

SEQ ID NO: 662990 - RNA, 64 nt, hsa
ccugcaguccuggaagcgcgagggccucaaaggcccgcucuacaucuucugccuuagucucagu

SEQ ID NO: 662991 - RNA, 64 nt, hsa
cauaauuaugcuuaagcuuuuaacagcauuuuaaccgcucuaaaaauuaccagaguaagaaaaa

SEQ ID NO: 662992 - RNA, 64 nt, hsa
uccacuugccggcccccaccaguucuuggguuccccgcucuaguuugaccugugcagcacauuc

SEQ ID NO: 662993 - RNA, 64 nt, hsa
aaccuggccucccuggccacagcagccuuacccaccgcucuacgugucccgggcacuucccgca

SEQ ID NO: 662994 - RNA, 64 nt, hsa
uuuucaucuuugacuccaaaaugucagagggaggccgcucuaaacuaaaaauaacgaaagguug

SEQ ID NO: 662995 - RNA, 64 nt, hsa
ggccuccccgcacaggcuguggcuugcacuccagccgcucuagucucucaggaauuugcuuguu

SEQ ID NO: 662996 - RNA, 64 nt, hsa
aggggccucauuucucccagagggagcugcuggcccgcucuaaggggugcaagaggaaggagug

SEQ ID NO: 662997 - RNA, 64 nt, hsa
ugccagucagcuccugggguugcgccaggcgcccccgcucuagcucacuguugccucgcugucu

SEQ ID NO: 662998 - RNA, 64 nt, hsa
cgacugcagucaguguugaguggugccaugugggccgcucuauuccaaaggaaucauggauuag

SEQ ID NO: 662999 - RNA, 64 nt, hsa
gauucaaaccuggguggcccugagaccagagcuuccgcucuacccacuucacuauacuucucuu

SEQ ID NO: 663000 - RNA, 64 nt, hsa
aauauagaugauugugccaucuucuguagccccuccgcucuacucauuccuuccaccaucugca

SEQ ID NO: 663001 - RNA, 64 nt, hsa
gguggaaugccgcugucucugaggggugggggugccgcucuaaauuggcuccauaucauuugag

SEQ ID NO: 663002 - RNA, 64 nt, hsa
gcuccucuccaacgugcugcucuccacgccggccccgcucuacggaggccuggcacugcugacc

SEQ ID NO: 663003 - RNA, 64 nt, hsa
acauccauagaaaaugacuuauuuccagaagauaccgcucuaaaaaugaaauuguuaggugaaa

SEQ ID NO: 663004 - RNA, 64 nt, hsa
ggccucagccuuggggcuguuuuuccuuguugccccgcucuagacuuuuagcagaucugcagcc

SEQ ID NO: 663005 - RNA, 64 nt, hsa
ugacauaauugacacaguuuauuggguguuaaguccgcucuauagggauagugacuacuuuuuu

SEQ ID NO: 663006 - RNA, 64 nt, hsa
aucauguugugggagcccucguccccccuccugcccgcucuacccugaccugggcuugucaucu

SEQ ID NO: 663007 - RNA, 64 nt, hsa
agaaguacccaugcccugaaugugggagcuucuuccgcucuaaguccuacuugaacaaacacau

SEQ ID NO: 663008 - RNA, 64 nt, hsa
cuuacccuuuaaacugucacugcauaugcaaguaccgcucuaauuuuuggaucauuaaagggag

SEQ ID NO: 663009 - RNA, 64 nt, hsa
uuauuccuguaauucagccaccugauuuugugaggggggggaauaauaugugguuuuuguacaa

SEQ ID NO: 663010 - RNA, 64 nt, hsa
guuaauaggaaccaaaaaauaaugaugggcagaagggggggaauagccacaggggacaaaccuu

SEQ ID NO: 663011 - RNA, 64 nt, hsa
uagugacaugcaguuauauauuuuguuuuuaaaagggggggagcaaaagaaacaccaguguuag

SEQ ID NO: 663012 - RNA, 64 nt, hsa
ccuaaagucauugccaugggaggaagacgauuuggggggggaggggggggggggcaggguaggu

SEQ ID NO: 663013 - RNA, 64 nt, hsa
cccgcugucugugcugugagagucgccgcucgcugggggggaagggggggacacagcuacacgc

SEQ ID NO: 663014 - RNA, 64 nt, hsa
ugugcugugagagucgccgcucgcugggggggaagggggggacacagcuacacgcccauuaaag

SEQ ID NO: 663015 - RNA, 64 nt, hsa
acaaaacgggguucacaagccauggucgggguccgggggggacagaaauggauuuucuuggcaa

SEQ ID NO: 663016 - RNA, 64 nt, hsa
aggggagggguagcgggggaggggggcuucagaagggggggaacaccccagaucucagggaacc

SEQ ID NO: 663017 - RNA, 64 nt, hsa
ugugcugggacgacccuugucucccuggguaggggggggggaaugggggagggcugaugaggcc

SEQ ID NO: 663018 - RNA, 64 nt, hsa
ucaagugacuuuuggaaaucaaccuuuuuuauuugggggggaggauggggaaaagagcugagag

SEQ ID NO: 663019 - RNA, 64 nt, hsa
uuucugugcccuuaaacccauuuagaaaauaacuacaaaguaaaaauguagaggaaauagaaau

SEQ ID NO: 663020 - RNA, 64 nt, hsa
uccauccuuuauaaauagucaagguuugggccacacaaaguauauuuuuaucauggaaaaauuu

SEQ ID NO: 663021 - RNA, 64 nt, hsa
caucucaauuaguggcuggaaaguacaugguaaaacaaaguaaauuuuuuuauguucuuuuuuu

SEQ ID NO: 663022 - RNA, 64 nt, hsa
augauaaauuuuucaacauacuugccauuagaaaacaaaguauugcuaaguacuauaacauauu

SEQ ID NO: 663023 - RNA, 64 nt, hsa
gacaguaaaauaauaacugacaugccaccgaaguacaaaguaaaauaaauaaauaaauacacau

SEQ ID NO: 663024 - RNA, 64 nt, hsa
uccucuugcagugugucuccagcgcccucuacugacaaaguaugccaucaugcaagcugcaaag

SEQ ID NO: 663025 - RNA, 64 nt, hsa
uugcugagcccauaucaguagguccugggacuugacaaaguaugugggaggggaaggaaggaca

SEQ ID NO: 663026 - RNA, 64 nt, hsa
uuuccucuaaagccuuuacucugaggauaaggucacaaaguagggugugacuugaaaguaucgu

SEQ ID NO: 663027 - RNA, 64 nt, hsa
uccagggucaaaguacagaauagaauacauugauacaaaguacagaaaaauacuuugauuuuua

SEQ ID NO: 663028 - RNA, 64 nt, hsa
ucuccaucagauguguuccuccauuuucuuauccacaaaguacuccucacuuuucaauuuguca

SEQ ID NO: 663029 - RNA, 64 nt, hsa
uacuuggagaaaucguguuuuaaagcaguaguccacaaaguauucugcucaugugcccccaaaa

SEQ ID NO: 663030 - RNA, 64 nt, hsa
uaucuaaaauuuuucaugggaaguuaaauaguugacaaaguauguauuugcuggugucguguaa

SEQ ID NO: 663031 - RNA, 64 nt, hsa
aauaacuacagcucaugggaaauguuuugacuuuacaaaguauagauguuggaacauuaagaaa

SEQ ID NO: 663032 - RNA, 64 nt, hsa
aacaucugucaguuauagacaaagauaauaauucacaaaguacaugcuaucagaaugaacuuug

SEQ ID NO: 663033 - RNA, 64 nt, hsa
ggcuauuucccuuauaacucaauaguaccuuaacacaaaguauaacucuguagaguuggugaau

SEQ ID NO: 663034 - RNA, 64 nt, hsa
agaaaauaaguaguuuuugugaauugacuugcagacaaaguagaaacugugcugcaugauguua

SEQ ID NO: 663035 - RNA, 64 nt, hsa
uguuggaacgugcuaugcuguagcgugucuggaaacaaaguacacaaaccuggcuacggugaug

SEQ ID NO: 663036 - RNA, 64 nt, hsa
ccauaauagugcuguauuugcagugugggcuaagacaaaguauauuaauaagcuuuucagcccc

SEQ ID NO: 663037 - RNA, 64 nt, hsa
auuccuggaagugaggcaagacucuugcaucucuacaaaguaguuuugucaauuugaauucagg

SEQ ID NO: 663038 - RNA, 64 nt, hsa
uuuuuuuuuuacugcauguuacauugaaauaaaaacaaaguaaaaugagcaauugccuuauugu

SEQ ID NO: 663039 - RNA, 58 nt, hsa; identical to SEQ ID NO: 160291

SEQ ID NO: 663040 - RNA, 64 nt, hsa; identical to SEQ ID NO: 160292

SEQ ID NO: 663041 - RNA, 64 nt, hsa; identical to SEQ ID NO: 160293

SEQ ID NO: 663042 - RNA, 64 nt, hsa; identical to SEQ ID NO: 160294

SEQ ID NO: 663043 - RNA, 64 nt, hsa; identical to SEQ ID NO: 160295

SEQ ID NO: 663044 - RNA, 64 nt, hsa; identical to SEQ ID NO: 160296

SEQ ID NO: 663045 - RNA, 64 nt, hsa; identical to SEQ ID NO: 160297

SEQ ID NO: 663046 - RNA, 64 nt, hsa; identical to SEQ ID NO: 160298

SEQ ID NO: 663047 - RNA, 64 nt, hsa; identical to SEQ ID NO: 160299

SEQ ID NO: 663048 - RNA, 64 nt, hsa; identical to SEQ ID NO: 160300

SEQ ID NO: 663049 - RNA, 64 nt, hsa; identical to SEQ ID NO: 160301

SEQ ID NO: 663050 - RNA, 64 nt, hsa; identical to SEQ ID NO: 160302

SEQ ID NO: 663051 - RNA, 64 nt, hsa; identical to SEQ ID NO: 160303

SEQ ID NO: 663052 - RNA, 64 nt, hsa; identical to SEQ ID NO: 160304

SEQ ID NO: 663053 - RNA, 64 nt, hsa; identical to SEQ ID NO: 160305

SEQ ID NO: 663054 - RNA, 64 nt, hsa; identical to SEQ ID NO: 160306

SEQ ID NO: 663055 - RNA, 64 nt, hsa; identical to SEQ ID NO: 160307

SEQ ID NO: 663056 - RNA, 64 nt, hsa; identical to SEQ ID NO: 160308

SEQ ID NO: 663057 - RNA, 64 nt, hsa; identical to SEQ ID NO: 160309

SEQ ID NO: 663058 - RNA, 64 nt, hsa; identical to SEQ ID NO: 160310

SEQ ID NO: 663059 - RNA, 64 nt, hsa; identical to SEQ ID NO: 160311

SEQ ID NO: 663060 - RNA, 64 nt, hsa; identical to SEQ ID NO: 160312

SEQ ID NO: 663061 - RNA, 64 nt, hsa; identical to SEQ ID NO: 160313

SEQ ID NO: 663062 - RNA, 64 nt, hsa; identical to SEQ ID NO: 160314

SEQ ID NO: 663063 - RNA, 64 nt, hsa; identical to SEQ ID NO: 160315

SEQ ID NO: 663064 - RNA, 64 nt, hsa; identical to SEQ ID NO: 160316

SEQ ID NO: 663065 - RNA, 64 nt, hsa; identical to SEQ ID NO: 160317

SEQ ID NO: 663066 - RNA, 64 nt, hsa; identical to SEQ ID NO: 160318

SEQ ID NO: 663067 - RNA, 64 nt, hsa; identical to SEQ ID NO: 160319

SEQ ID NO: 663068 - RNA, 64 nt, hsa; identical to SEQ ID NO: 160320

SEQ ID NO: 663069 - RNA, 64 nt, hsa; identical to SEQ ID NO: 160321

SEQ ID NO: 663070 - RNA, 64 nt, hsa; identical to SEQ ID NO: 160322

SEQ ID NO: 663071 - RNA, 64 nt, hsa; identical to SEQ ID NO: 160323

SEQ ID NO: 663072 - RNA, 64 nt, hsa; identical to SEQ ID NO: 160324

SEQ ID NO: 663073 - RNA, 64 nt, hsa; identical to SEQ ID NO: 160325

SEQ ID NO: 663074 - RNA, 64 nt, hsa; identical to SEQ ID NO: 160326

SEQ ID NO: 663075 - RNA, 64 nt, hsa; identical to SEQ ID NO: 160327

SEQ ID NO: 663076 - RNA, 64 nt, hsa; identical to SEQ ID NO: 160328

SEQ ID NO: 663077 - RNA, 64 nt, hsa; identical to SEQ ID NO: 160329

SEQ ID NO: 663078 - RNA, 64 nt, hsa; identical to SEQ ID NO: 160330

SEQ ID NO: 663079 - RNA, 64 nt, hsa; identical to SEQ ID NO: 160331

SEQ ID NO: 663080 - RNA, 64 nt, hsa; identical to SEQ ID NO: 160332

SEQ ID NO: 663081 - RNA, 64 nt, hsa; identical to SEQ ID NO: 160333

SEQ ID NO: 663082 - RNA, 64 nt, hsa; identical to SEQ ID NO: 160334

SEQ ID NO: 663083 - RNA, 64 nt, hsa; identical to SEQ ID NO: 160335

SEQ ID NO: 663084 - RNA, 64 nt, hsa; identical to SEQ ID NO: 160336

SEQ ID NO: 663085 - RNA, 64 nt, hsa; identical to SEQ ID NO: 160337

SEQ ID NO: 663086 - RNA, 64 nt, hsa; identical to SEQ ID NO: 160338

SEQ ID NO: 663087 - RNA, 64 nt, hsa; identical to SEQ ID NO: 160339

SEQ ID NO: 663088 - RNA, 64 nt, hsa; identical to SEQ ID NO: 160340

SEQ ID NO: 663089 - RNA, 64 nt, hsa; identical to SEQ ID NO: 160341

SEQ ID NO: 663090 - RNA, 64 nt, hsa; identical to SEQ ID NO: 160342

SEQ ID NO: 663091 - RNA, 64 nt, hsa; identical to SEQ ID NO: 160343

SEQ ID NO: 663092 - RNA, 64 nt, hsa; identical to SEQ ID NO: 160344

SEQ ID NO: 663093 - RNA, 64 nt, hsa; identical to SEQ ID NO: 160345

SEQ ID NO: 663094 - RNA, 64 nt, hsa; identical to SEQ ID NO: 160346

SEQ ID NO: 663095 - RNA, 64 nt, hsa; identical to SEQ ID NO: 160347

SEQ ID NO: 663096 - RNA, 64 nt, hsa; identical to SEQ ID NO: 160348

SEQ ID NO: 663097 - RNA, 64 nt, hsa; identical to SEQ ID NO: 160349

SEQ ID NO: 663098 - RNA, 64 nt, hsa; identical to SEQ ID NO: 160350

SEQ ID NO: 663099 - RNA, 64 nt, hsa; identical to SEQ ID NO: 160351

SEQ ID NO: 663100 - RNA, 64 nt, hsa; identical to SEQ ID NO: 160352

SEQ ID NO: 663101 - RNA, 64 nt, hsa; identical to SEQ ID NO: 160353

SEQ ID NO: 663102 - RNA, 64 nt, hsa
agggcugguguugauuuuccucccugcagagccaauggugcacauugguuuaagcccagagauc

SEQ ID NO: 663103 - RNA, 64 nt, hsa
cccagccucccggagcucugagcacgccccacgcauggugcaggagggacuggacagaucugag

SEQ ID NO: 663104 - RNA, 64 nt, hsa
ucucacagagguggcucacagagaaggauggcagauggugcagccaacaaugcugaccggugcu

SEQ ID NO: 663105 - RNA, 64 nt, hsa
ucuagaaacacuucugaugcaugaaaaaugugugauggugcaaggaauggauucaggauguugu

SEQ ID NO: 663106 - RNA, 64 nt, hsa
uacagagugauuggcaaauauuuucaagauuuaauaugagcaacccauuauuugcccuauccaa

SEQ ID NO: 663107 - RNA, 64 nt, hsa
aaauuaaaaacaacguauuccuuuguagugugaauaugagcaaucuauuuuauaugaacuuuuu

SEQ ID NO: 663108 - RNA, 64 nt, hsa
uucaguuuugugccaacauuccauguauuuugaauaugagcaaaaacugaucuuaagagcagac

SEQ ID NO: 663109 - RNA, 64 nt, hsa
cuuaguuacaagucuuuggaaacucuuguuuacuuaugagcauaaucauuccuuggaguuauac

SEQ ID NO: 663110 - RNA, 64 nt, hsa
acuuaaaaauugugaauucuguuguugugauaaauaugagcaaaugaaguguaauaucuauaga

SEQ ID NO: 663111 - RNA, 64 nt, hsa
ucauuuucucaauaguacaugaaaucaagaugcuuaugagcauggaaauguauuuaaaguuuuu

SEQ ID NO: 663112 - RNA, 64 nt, hsa
uaaacauuuuaugcuugcauuuaaacuugaaauguaugagcagaaugagacaaucaguuaaauc

SEQ ID NO: 663113 - RNA, 64 nt, hsa
ggaccaugagguagcuuuggccaauggauuccuuuaugagcaugaagcauguggcaauggcugu

SEQ ID NO: 663114 - RNA, 64 nt, hsa
ugaaauugacaccgacucugccuacauucuuuucuaugagcagcaggggauagacuacgcacaa

SEQ ID NO: 663115 - RNA, 64 nt, hsa; identical to SEQ ID NO: 91745

SEQ ID NO: 663116 - RNA, 64 nt, hsa; identical to SEQ ID NO: 91746

SEQ ID NO: 663117 - RNA, 64 nt, hsa; identical to SEQ ID NO: 91747

SEQ ID NO: 663118 - RNA, 64 nt, hsa; identical to SEQ ID NO: 91748

SEQ ID NO: 663119 - RNA, 64 nt, hsa; identical to SEQ ID NO: 91749

SEQ ID NO: 663120 - RNA, 64 nt, hsa; identical to SEQ ID NO: 91750

SEQ ID NO: 663121 - RNA, 64 nt, hsa; identical to SEQ ID NO: 91751

SEQ ID NO: 663122 - RNA, 64 nt, hsa; identical to SEQ ID NO: 91752

SEQ ID NO: 663123 - RNA, 64 nt, hsa; identical to SEQ ID NO: 91753

SEQ ID NO: 663124 - RNA, 64 nt, hsa; identical to SEQ ID NO: 91754

SEQ ID NO: 663125 - RNA, 64 nt, hsa; identical to SEQ ID NO: 91755

SEQ ID NO: 663126 - RNA, 64 nt, hsa; identical to SEQ ID NO: 91756

SEQ ID NO: 663127 - RNA, 64 nt, hsa; identical to SEQ ID NO: 91757

SEQ ID NO: 663128 - RNA, 64 nt, hsa; identical to SEQ ID NO: 91758

SEQ ID NO: 663129 - RNA, 64 nt, hsa; identical to SEQ ID NO: 91759

SEQ ID NO: 663130 - RNA, 64 nt, hsa; identical to SEQ ID NO: 91760

SEQ ID NO: 663131 - RNA, 64 nt, hsa; identical to SEQ ID NO: 91761

SEQ ID NO: 663132 - RNA, 64 nt, hsa; identical to SEQ ID NO: 91762

SEQ ID NO: 663133 - RNA, 64 nt, hsa; identical to SEQ ID NO: 91763

SEQ ID NO: 663134 - RNA, 64 nt, hsa; identical to SEQ ID NO: 91764

SEQ ID NO: 663135 - RNA, 64 nt, hsa; identical to SEQ ID NO: 91765

SEQ ID NO: 663136 - RNA, 64 nt, hsa; identical to SEQ ID NO: 91766

SEQ ID NO: 663137 - RNA, 64 nt, hsa; identical to SEQ ID NO: 91767

SEQ ID NO: 663138 - RNA, 64 nt, hsa; identical to SEQ ID NO: 91768

SEQ ID NO: 663139 - RNA, 64 nt, hsa; identical to SEQ ID NO: 91769

SEQ ID NO: 663140 - RNA, 64 nt, hsa; identical to SEQ ID NO: 91770

SEQ ID NO: 663141 - RNA, 64 nt, hsa; identical to SEQ ID NO: 91771

SEQ ID NO: 663142 - RNA, 64 nt, hsa; identical to SEQ ID NO: 91772

SEQ ID NO: 663143 - RNA, 64 nt, hsa; identical to SEQ ID NO: 91773

SEQ ID NO: 663144 - RNA, 64 nt, hsa; identical to SEQ ID NO: 91774

SEQ ID NO: 663145 - RNA, 64 nt, hsa; identical to SEQ ID NO: 91775

SEQ ID NO: 663146 - RNA, 64 nt, hsa; identical to SEQ ID NO: 91776

SEQ ID NO: 663147 - RNA, 64 nt, hsa; identical to SEQ ID NO: 91777

SEQ ID NO: 663148 - RNA, 64 nt, hsa; identical to SEQ ID NO: 91778

SEQ ID NO: 663149 - RNA, 64 nt, hsa; identical to SEQ ID NO: 91779

SEQ ID NO: 663150 - RNA, 64 nt, hsa; identical to SEQ ID NO: 91780

SEQ ID NO: 663151 - RNA, 64 nt, hsa; identical to SEQ ID NO: 91781

SEQ ID NO: 663152 - RNA, 64 nt, hsa; identical to SEQ ID NO: 91782

SEQ ID NO: 663153 - RNA, 64 nt, hsa; identical to SEQ ID NO: 91783

SEQ ID NO: 663154 - RNA, 64 nt, hsa; identical to SEQ ID NO: 91784

SEQ ID NO: 663155 - RNA, 64 nt, hsa; identical to SEQ ID NO: 91785

SEQ ID NO: 663156 - RNA, 64 nt, hsa; identical to SEQ ID NO: 91786

SEQ ID NO: 663157 - RNA, 64 nt, hsa; identical to SEQ ID NO: 91787

SEQ ID NO: 663158 - RNA, 64 nt, hsa; identical to SEQ ID NO: 91788

SEQ ID NO: 663159 - RNA, 64 nt, hsa; identical to SEQ ID NO: 91789

SEQ ID NO: 663160 - RNA, 64 nt, hsa; identical to SEQ ID NO: 91790

SEQ ID NO: 663161 - RNA, 64 nt, hsa; identical to SEQ ID NO: 91791

SEQ ID NO: 663162 - RNA, 64 nt, hsa; identical to SEQ ID NO: 91792

SEQ ID NO: 663163 - RNA, 64 nt, hsa; identical to SEQ ID NO: 91793

SEQ ID NO: 663164 - RNA, 64 nt, hsa; identical to SEQ ID NO: 91794

SEQ ID NO: 663165 - RNA, 64 nt, hsa; identical to SEQ ID NO: 91795

SEQ ID NO: 663166 - RNA, 64 nt, hsa; identical to SEQ ID NO: 91796

SEQ ID NO: 663167 - RNA, 64 nt, hsa; identical to SEQ ID NO: 91797

SEQ ID NO: 663168 - RNA, 64 nt, hsa; identical to SEQ ID NO: 91798

SEQ ID NO: 663169 - RNA, 64 nt, hsa; identical to SEQ ID NO: 91799

SEQ ID NO: 663170 - RNA, 64 nt, hsa; identical to SEQ ID NO: 91800

SEQ ID NO: 663171 - RNA, 54 nt, hsa; identical to SEQ ID NO: 91801

SEQ ID NO: 663172 - RNA, 64 nt, hsa
ugaaugcccaggagcauuucuggggggcagcuaagacuggcagcuggguugguguguuagcggg

SEQ ID NO: 663173 - RNA, 64 nt, hsa
gaagcacuucucagccaaggcaccccugcccugggacuggcagggcaggggcaggggcagggac

SEQ ID NO: 663174 - RNA, 64 nt, hsa
guggagaaaacagaggaaaacuugcaguuacgaagacuggcaacuuggcuuuacuaaguuuuca

SEQ ID NO: 663175 - RNA, 64 nt, hsa
cgaagacuggcaacuuggcuuuacuaaguuuucagacuggcaggaagucaaaccuauuaggcug

SEQ ID NO: 663176 - RNA, 64 nt, hsa
gggaaugucauggucuugcuuuacuaaguuuugagacuggcagguagugaaacucauuaggcug

SEQ ID NO: 663177 - RNA, 64 nt, hsa
uuauauauuugcaagcaaaggacaguaagaaguugacuggcaaaagagcagugcugaaggagga

SEQ ID NO: 663178 - RNA, 64 nt, hsa
uuguuuaagguauuaagcacgaauuauuacaugagacuggcagauagcuauuaauccucuuaca

SEQ ID NO: 663179 - RNA, 64 nt, hsa; identical to SEQ ID NO: 193898

SEQ ID NO: 663180 - RNA, 64 nt, hsa; identical to SEQ ID NO: 193899

SEQ ID NO: 663181 - RNA, 64 nt, hsa; identical to SEQ ID NO: 193900

SEQ ID NO: 663182 - RNA, 64 nt, hsa; identical to SEQ ID NO: 193901

SEQ ID NO: 663183 - RNA, 64 nt, hsa; identical to SEQ ID NO: 193902

SEQ ID NO: 663184 - RNA, 64 nt, hsa; identical to SEQ ID NO: 193903

SEQ ID NO: 663185 - RNA, 64 nt, hsa; identical to SEQ ID NO: 193904

SEQ ID NO: 663186 - RNA, 64 nt, hsa; identical to SEQ ID NO: 193905

SEQ ID NO: 663187 - RNA, 64 nt, hsa; identical to SEQ ID NO: 193906

SEQ ID NO: 663188 - RNA, 64 nt, hsa; identical to SEQ ID NO: 193907

SEQ ID NO: 663189 - RNA, 64 nt, hsa; identical to SEQ ID NO: 193908

SEQ ID NO: 663190 - RNA, 64 nt, hsa; identical to SEQ ID NO: 193909

SEQ ID NO: 663191 - RNA, 64 nt, hsa; identical to SEQ ID NO: 193910

SEQ ID NO: 663192 - RNA, 64 nt, hsa; identical to SEQ ID NO: 193911

SEQ ID NO: 663193 - RNA, 64 nt, hsa; identical to SEQ ID NO: 193912

SEQ ID NO: 663194 - RNA, 64 nt, hsa; identical to SEQ ID NO: 193913

SEQ ID NO: 663195 - RNA, 64 nt, hsa; identical to SEQ ID NO: 193914

SEQ ID NO: 663196 - RNA, 64 nt, hsa; identical to SEQ ID NO: 193915

SEQ ID NO: 663197 - RNA, 64 nt, hsa; identical to SEQ ID NO: 193916

SEQ ID NO: 663198 - RNA, 64 nt, hsa; identical to SEQ ID NO: 193917

SEQ ID NO: 663199 - RNA, 64 nt, hsa; identical to SEQ ID NO: 193918

SEQ ID NO: 663200 - RNA, 64 nt, hsa; identical to SEQ ID NO: 193919

SEQ ID NO: 663201 - RNA, 66 nt, hsa
uuuaaguauuggaauuucacaaaagacauaggacuuaacuggaaaaugaaaaaaaaaagaaaaaga

SEQ ID NO: 663202 - RNA, 66 nt, hsa
caccccagaaagugggaauuugauuuuauccuuccgaacuggaagaacauuuuuaugaagaauuuu

SEQ ID NO: 663203 - RNA, 66 nt, hsa
agaauacaaaggguauacucuguuggaugcaccagaaacuggaaacugggaccaguggcagagaug

SEQ ID NO: 663204 - RNA, 66 nt, hsa
aacccagaugcccaugagcaagagaguggacaaguaaacuggaauauucacauaauagaacauuau

SEQ ID NO: 663205 - RNA, 66 nt, hsa
uggagguucaacacuacguaccgcacuuuauaauuuaacuggaauugagaugaaggccagugacau

SEQ ID NO: 663206 - RNA, 66 nt, hsa
gacaaaagccaggcucaacuuauagaauguuuuggaaacuggaaguaaugauacauuucacuucag

SEQ ID NO: 663207 - RNA, 66 nt, hsa
gagcugaugugagugugugugaugggaucuguaaggaacuggaacacacauguccuauccaaagga

SEQ ID NO: 663208 - RNA, 66 nt, hsa
ucaggaccuggcuuggcuuuaaccguuuuucaagaaaacuggaaaucuggauuuucagcgaacaug

SEQ ID NO: 663209 - RNA, 66 nt, hsa
ggaggagaguccuucucggcagagcucacugcaaacaacuggaauugagguugcacacugugauuu

SEQ ID NO: 663210 - RNA, 66 nt, hsa
uuagaaaacagaggaguuuguagccagcagccuguaaacuggaaacacuggucucagccaaccucc

SEQ ID NO: 663211 - RNA, 66 nt, hsa
uguguaaaaugguauauucuuuaaaauaguguugauaacuggaauauuguauguaugcuuggagau

SEQ ID NO: 663212 - RNA, 66 nt, hsa
ucaacuccguaaaaaagacagcuguauuuuccguccaacuggaauuguugaaucacacugcauagc

SEQ ID NO: 663213 - RNA, 66 nt, hsa
ccuuucaguauaagcugaauaaauuuagagcuuucaaacuggaaaaaaaaaugaaacaaaacaaau

SEQ ID NO: 663214 - RNA, 66 nt, hsa
gcagguggauacccgcuuccauggucuugcacuauaaacuggaauggauuucucaaugcgggacca

SEQ ID NO: 663215 - RNA, 66 nt, hsa
caaagcuaauuuuuuuuacaugucaauauuggcacaaacuggaaugaaagaauaguuugauucaga

SEQ ID NO: 663216 - RNA, 66 nt, hsa
cuacuaaauauacaggguauguccuaacauggaguuaacuggaauagcaguacacuagcaaguauc

SEQ ID NO: 663217 - RNA, 66 nt, hsa
cacacccuccaauucacacugccuucuaguugugccaacuggaaccacccuuuggcugugcugcga

SEQ ID NO: 663218 - RNA, 66 nt, hsa
ccauugaaaguuaaacuauuuaacgugaaauccauuaacuggaauaauugaguuucuuuauuuuua

SEQ ID NO: 663219 - RNA, 66 nt, hsa
gcucugcuggacacccaagaaagccaugggaacgccaacuggaaagguccccuuccccaggggagc

SEQ ID NO: 663220 - RNA, 66 nt, hsa
uuucauaucaccuccaucccauaaaguuguacugugaacuggaagaugguggaauguuuuggaauu

SEQ ID NO: 663221 - RNA, 66 nt, hsa
ggcuccagggcgggaggcaagcccccuugccuuucaaacuggaaaccccagagaaaacggugcccc

SEQ ID NO: 663222 - RNA, 66 nt, hsa
gacgguugggggcugggagcccugggcguguaguguaacuggaaucuuuugccucucccagccacc

SEQ ID NO: 663223 - RNA, 66 nt, hsa
uuuguauaacucuaaacgcccaugauaguagcuucaaacuggaaauagcgaaauaaaauaacucag

SEQ ID NO: 663224 - RNA, 66 nt, hsa
uguugguaacuucacuagagcauacauaacaacuggaacuggaaauuauacaaaaguaaauuggga

SEQ ID NO: 663225 - RNA, 66 nt, hsa
auagacuguugguaacuucacuagagcauacauaacaacuggaacuggaaauuauacaaaaguaaa

SEQ ID NO: 663226 - RNA, 66 nt, hsa
uugguaguagguauuucgugagaaguucaacaccaaaacuggaacauaguucuccuucaaguguug

SEQ ID NO: 663227 - RNA, 54 nt, hsa; identical to SEQ ID NO: 116395

SEQ ID NO: 663228 - RNA, 66 nt, hsa
aaucuaauuuuaggaggaccaaauucaguggauggcaacuggaacauugauuguaaggccagugaa

SEQ ID NO: 663229 - RNA, 66 nt, hsa
ggaacauugauuguaaggccagugaaguuuucacccaacuggaauuugauggaaagaagguuugug

SEQ ID NO: 663230 - RNA, 66 nt, hsa
uacaaaugugaaugaucgacugacugcuuguugccaaacuggaaauguucuguagggauuuacugg

SEQ ID NO: 663231 - RNA, 66 nt, hsa
aacaagaggcaacuugucacuuucuuucucaauauuaacuggaaugcugccucuuggguucucacc

SEQ ID NO: 663232 - RNA, 66 nt, hsa
ucagagucccgcagguaccccagcucugcuugccgaaacuggaaguuauuuauuuuuuaauaaccc

SEQ ID NO: 663233 - RNA, 66 nt, hsa
aggccaaauucccuccucccuucuacugcuucuaccaacuggaagcacagaaaacuagaauuucau

SEQ ID NO: 663234 - RNA, 66 nt, hsa
uagaacgcuugagaggcacuuuguaaagauuuguuaaacuggaaacguuuuacaugaucugauaca

SEQ ID NO: 663235 - RNA, 66 nt, hsa
uagaaugcuugagaggcacugaguaaagauuuguugaacuggaaauguuuuacaugauucuuaaac

SEQ ID NO: 663236 - RNA, 66 nt, hsa
uuuaaaauuuauuauuuugaucuugaauuauuuauaaacuggaaagugguuugauuauugugaguc

SEQ ID NO: 663237 - RNA, 66 nt, hsa
acaaacaaacaaacaaacaacguaucuuacugacuaaacuggaauggaaaucuuauaauuaguguu

SEQ ID NO: 663238 - RNA, 66 nt, hsa
ggggccagccugaggacccccgccuaccaccucgagaacuggaagccaaccucuaaccuccugacc

SEQ ID NO: 663239 - RNA, 66 nt, hsa
ggcuucaccagugcccaagucucuauggagaaugagaacuggaagccacugcuaccgucuacccag

SEQ ID NO: 663240 - RNA, 66 nt, hsa
accagcuuuggcucgggagaguggggcugcuuguagaacuggaagugaauaacuuuuucaagcaau

SEQ ID NO: 663241 - RNA, 66 nt, hsa
uggcuuggaccuuggcauuccguuugaauuccuucuaacuggaacauuuguguuguaucuguaaca

SEQ ID NO: 663242 - RNA, 66 nt, hsa
cgagcuguaccuggcacggcccauccuggacugagaaacuggaaccucagaggaacccgugccucu

SEQ ID NO: 663243 - RNA, 66 nt, hsa
cccugcugaauggaggagccgggggucccccaggccaacuggaaaaucucccaggcuaggccaauu

SEQ ID NO: 663244 - RNA, 64 nt, hsa
guguucccaucugagcccagagauaagggugucuuccuagaacauuagccguaguggaauuaac

SEQ ID NO: 663245 - RNA, 64 nt, hsa
cuucaagcagggaagccccagugaguagcugcauuccuagaaauugaaguuucagagcuacaca

SEQ ID NO: 663246 - RNA, 64 nt, hsa
cuacaugaaauguuuagcucuuacacucuauccuuccuagaaaaugguaauugagauuacucag

SEQ ID NO: 663247 - RNA, 64 nt, hsa
uuaaucuucaagaaaucaugcuacacuuaacuucuccuagaagcuaaucuauaccauaauauuu

SEQ ID NO: 663248 - RNA, 64 nt, hsa
ugugcucaaauaaauguuuacuuaucuuacaaagcucaaauacuggauuguaaccaugugauga

SEQ ID NO: 663249 - RNA, 64 nt, hsa
aaucccagaauacuguguguagacuuuuguugugcucaaauaaauguuuacuuaucuuacaaag

SEQ ID NO: 663250 - RNA, 64 nt, hsa
gcaaaagagccauguucaaaauagucauuaugggcucaaauagaaagaagacuuuuaaguuuua

SEQ ID NO: 663251 - RNA, 64 nt, hsa
caaggaaaaaagguauaucacaugucucauucuccucaaauauuccauuugcagacagaccguc

SEQ ID NO: 663252 - RNA, 64 nt, hsa
acauccagaagguaaagaaauacauuuucuuuuucucaaauaugccaucauaugggauggguag

SEQ ID NO: 663253 - RNA, 64 nt, hsa
aaagauccuggccugugguagugguagcaguuuucucaaauaauguggugacagucacuagauc

SEQ ID NO: 663254 - RNA, 64 nt, hsa
uauauacaaaggagacuuuuuuuuugagauaacacucaaauaguauucucuucuuuugaaaauu

SEQ ID NO: 663255 - RNA, 64 nt, hsa
uauaguaauuugcauucccacauaaguuugaguguuacgaaaacauuccuuuaaagggaucugu

SEQ ID NO: 663256 - RNA, 64 nt, hsa
uuugcaauuuuaucaguaauuugacuuagaguuuuuacgaaaccucuuuuguuguccuugcccc

SEQ ID NO: 663257 - RNA, 64 nt, hsa
cacuuacaguauacauauauauuuauaucacaauuuacgaaaccaaaaaguugaguuuccaaug

SEQ ID NO: 663258 - RNA, 64 nt, hsa
ucugaggaaaauaauccuugugccauagaaguauuuacgaaauugcauuucauuguuauguuuu

SEQ ID NO: 663259 - RNA, 64 nt, hsa
gcugcucaucagcgucaaaauaguucaaauaauuuuacgaaaaaaaacucagcuucuguuguuu

SEQ ID NO: 663260 - RNA, 64 nt, hsa
gucuuuguauauaucuguauaauguugagauuacuuacgaaauaugucugagugacacuuuuca

SEQ ID NO: 663261 - RNA, 64 nt, hsa
uguucucucuuucuugagggguggcauuaggaacuuacgaaaccagagaccuuucccuaugacu

SEQ ID NO: 663262 - RNA, 64 nt, hsa
agaagaagggcaaagauaagaacaauauuagcuguuacgaaauuuuaacuguaucuuccaaaau

SEQ ID NO: 663263 - RNA, 64 nt, hsa
aaguucaaaacuuauuggaauguugagagugugguuacgaaauacguuaggaggacaaaaggaa

SEQ ID NO: 663264 - RNA, 64 nt, hsa
uuucuugucuuuugaaauugacacuuggccugacuuacgaaacuuguacuauaugaaauugguc

SEQ ID NO: 663265 - RNA, 64 nt, hsa
ucuuuucuuuucucucucucucucucuuuuuuuuuuacgaaagacuuagaauugcauuuguccu

SEQ ID NO: 663266 - RNA, 64 nt, hsa
gcaacucuguucucccccuuccccuagacuuuucuuacgaaaagucaauaauuaagcaaauugc

SEQ ID NO: 663267 - RNA, 64 nt, hsa
caggcauucacagaacccuucugauucguaaggguuacgaaacucauguucuucuccagucccc

SEQ ID NO: 663268 - RNA, 64 nt, hsa
aauuuggaaauuagguugaaacauaucucuuaucuuacgaaaaaaugguagcauuuuaaacaaa

SEQ ID NO: 663269 - RNA, 64 nt, hsa
gacuuugaauauacucuaaaaguggacagaaaauuuacgaaaaucuuagauuuuguuuagaaug

SEQ ID NO: 663270 - RNA, 64 nt, hsa
gaugggacuacugaugcacacugccaugcuggccuuacgaaauguuuuaauaggcauuucacua

SEQ ID NO: 663271 - RNA, 64 nt, hsa
augggaugaggaaaugcuuggauccuuaaggaguuuacgaaaucugcuguuuuaucaaagugaa

SEQ ID NO: 663272 - RNA, 64 nt, hsa
uagggcaugauacaguaagguguaauuacagaauuuacgaaauguaaauggccucuacagaguu

SEQ ID NO: 663273 - RNA, 64 nt, hsa
ugaacucauguuucaguucgcgaacauugacuccuuacgaaagucacuucauucuaacuagaug

SEQ ID NO: 663274 - RNA, 64 nt, hsa
ggcccucugcuuuucuucccagcaaagguuggccuuacgaaauccuuugugucgauuucaccaa

SEQ ID NO: 663275 - RNA, 64 nt, hsa
gucauuccugccuaauccaucgagagaaagaggcuuacgaaaaacuuugccucugaugcucagc

SEQ ID NO: 663276 - RNA, 64 nt, hsa
gggaggggggcauuuuuuauguuacaaaaaaaaauuacgaaagaaaagaaaucucuaugcaaaa

SEQ ID NO: 663277 - RNA, 64 nt, hsa
auauguccuacuucaggaaaaguaaaacagucauuuacgaaagaaagucaaucuguauccuaag

SEQ ID NO: 663278 - RNA, 64 nt, hsa
agcugaccgagcucugguaaaucucuuugucaaauuacgaaaacuucagggugaaauccuaugc

SEQ ID NO: 663279 - RNA, 64 nt, hsa
cauuguaauauugcugugcuguacauuuuggcccuuacgaaauacgucuuuuucagaacuguua

SEQ ID NO: 663280 - RNA, 64 nt, hsa
uaccuacaguugaagcuaauguugagacugagacuuacgaaacugugaaucccacugggaaaaa

SEQ ID NO: 663281 - RNA, 64 nt, hsa
guuuccuauuccauacuguucauuucuaauacucuuacgaaaacuauucuaaaggaggcaggag

SEQ ID NO: 663282 - RNA, 64 nt, hsa
agcuauauuuuccaauaguaccccuuguguaaaguuacgaaaaaaacaagcccuucaguacugg

SEQ ID NO: 663283 - RNA, 64 nt, hsa
augugcauuggauugcacacuaagauguauuuucuuacgaaauaguucuguguuuauuuuuuaa

SEQ ID NO: 663284 - RNA, 64 nt, hsa
ugggaauuaggcuuauuuugaaugcaucuuuaacuuacgaaagauguacuaauugugggggugc

SEQ ID NO: 663285 - RNA, 64 nt, hsa
acacaagcaguacggaugaagacucugagucugauuacgaaaaguacucuauguuacaguaaag

SEQ ID NO: 663286 - RNA, 64 nt, hsa
uucugggacacugaguuagaugguaaauacugacuuacgaaaguugaauugggugaggcgggca

SEQ ID NO: 663287 - RNA, 64 nt, hsa
uguauuccuugcucacuugcuacuagcaggcgacuuacgaaauaaugauguuggcaccaguucc

SEQ ID NO: 663288 - RNA, 64 nt, hsa
cccuuuccuuaaaauauaagaaauaaaggagcucuuacgaaaaacccagguuagaccgcauaaa

SEQ ID NO: 663289 - RNA, 64 nt, hsa
aacacgucauugauagcaaaagaaagguacaggcuuacgaaaaugaucuuuacaauguauccca

SEQ ID NO: 663290 - RNA, 64 nt, hsa
agguaaaagcagcguuuaaugaagaaacucauucuuacgaaauuagaacgacuucacguuggag

SEQ ID NO: 663291 - RNA, 64 nt, hsa
gauucacuuuucuccaaagacauguaaaaggcuguuacgaaagcuuggcuucugucauggagac

SEQ ID NO: 663292 - RNA, 64 nt, hsa
uuuuuagaauauuuauuuugaaucaauccuuucauuacgaaagacuugaaguuuuguguccauu

SEQ ID NO: 663293 - RNA, 64 nt, hsa
uuuucuuuuuucuaauuaaaaccacuauacaaacuuacgaaacaugcauagcauuagaagacaa

SEQ ID NO: 663294 - RNA, 64 nt, hsa
uagggagugcagcccugagccugcccacuccucauuacgaaaugacuguauuuaaaggaaaucu

SEQ ID NO: 663295 - RNA, 64 nt, hsa
aauacguuuucaggaaaaugcuaaaucugauagauuacgaaauauauuuuuagaacuuguuuag

SEQ ID NO: 663296 - RNA, 64 nt, hsa; identical to SEQ ID NO: 72435

SEQ ID NO: 663297 - RNA, 64 nt, hsa; identical to SEQ ID NO: 72436

SEQ ID NO: 663298 - RNA, 64 nt, hsa; identical to SEQ ID NO: 72437

SEQ ID NO: 663299 - RNA, 64 nt, hsa; identical to SEQ ID NO: 72438

SEQ ID NO: 663300 - RNA, 64 nt, hsa; identical to SEQ ID NO: 72439

SEQ ID NO: 663301 - RNA, 64 nt, hsa; identical to SEQ ID NO: 72440

SEQ ID NO: 663302 - RNA, 64 nt, hsa; identical to SEQ ID NO: 52004

SEQ ID NO: 663303 - RNA, 64 nt, hsa; identical to SEQ ID NO: 52005

SEQ ID NO: 663304 - RNA, 64 nt, hsa; identical to SEQ ID NO: 52006

SEQ ID NO: 663305 - RNA, 64 nt, hsa; identical to SEQ ID NO: 52007

SEQ ID NO: 663306 - RNA, 64 nt, hsa; identical to SEQ ID NO: 52008

SEQ ID NO: 663307 - RNA, 64 nt, hsa; identical to SEQ ID NO: 52009

SEQ ID NO: 663308 - RNA, 64 nt, hsa; identical to SEQ ID NO: 52010

SEQ ID NO: 663309 - RNA, 64 nt, hsa; identical to SEQ ID NO: 52011

SEQ ID NO: 663310 - RNA, 64 nt, hsa; identical to SEQ ID NO: 52012

SEQ ID NO: 663311 - RNA, 64 nt, hsa; identical to SEQ ID NO: 52013

SEQ ID NO: 663312 - RNA, 64 nt, hsa; identical to SEQ ID NO: 52014

SEQ ID NO: 663313 - RNA, 64 nt, hsa; identical to SEQ ID NO: 52015

SEQ ID NO: 663314 - RNA, 64 nt, hsa; identical to SEQ ID NO: 52016

SEQ ID NO: 663315 - RNA, 64 nt, hsa; identical to SEQ ID NO: 52017

SEQ ID NO: 663316 - RNA, 64 nt, hsa; identical to SEQ ID NO: 52018

SEQ ID NO: 663317 - RNA, 64 nt, hsa; identical to SEQ ID NO: 52019

SEQ ID NO: 663318 - RNA, 64 nt, hsa; identical to SEQ ID NO: 52020

SEQ ID NO: 663319 - RNA, 64 nt, hsa; identical to SEQ ID NO: 52021

SEQ ID NO: 663320 - RNA, 64 nt, hsa; identical to SEQ ID NO: 52022

SEQ ID NO: 663321 - RNA, 64 nt, hsa; identical to SEQ ID NO: 52023

SEQ ID NO: 663322 - RNA, 64 nt, hsa; identical to SEQ ID NO: 52024

SEQ ID NO: 663323 - RNA, 64 nt, hsa; identical to SEQ ID NO: 52025

SEQ ID NO: 663324 - RNA, 64 nt, hsa; identical to SEQ ID NO: 52026

SEQ ID NO: 663325 - RNA, 64 nt, hsa; identical to SEQ ID NO: 52027

SEQ ID NO: 663326 - RNA, 64 nt, hsa; identical to SEQ ID NO: 52028

SEQ ID NO: 663327 - RNA, 64 nt, hsa; identical to SEQ ID NO: 52029

SEQ ID NO: 663328 - RNA, 64 nt, hsa; identical to SEQ ID NO: 52030

SEQ ID NO: 663329 - RNA, 64 nt, hsa; identical to SEQ ID NO: 52031

SEQ ID NO: 663330 - RNA, 64 nt, hsa; identical to SEQ ID NO: 52032

SEQ ID NO: 663331 - RNA, 64 nt, hsa; identical to SEQ ID NO: 52033

SEQ ID NO: 663332 - RNA, 64 nt, hsa; identical to SEQ ID NO: 52034

SEQ ID NO: 663333 - RNA, 64 nt, hsa; identical to SEQ ID NO: 52035

SEQ ID NO: 663334 - RNA, 64 nt, hsa; identical to SEQ ID NO: 52036

SEQ ID NO: 663335 - RNA, 64 nt, hsa; identical to SEQ ID NO: 52037

SEQ ID NO: 663336 - RNA, 64 nt, hsa; identical to SEQ ID NO: 52038

SEQ ID NO: 663337 - RNA, 64 nt, hsa; identical to SEQ ID NO: 52039

SEQ ID NO: 663338 - RNA, 64 nt, hsa; identical to SEQ ID NO: 52040

SEQ ID NO: 663339 - RNA, 64 nt, hsa; identical to SEQ ID NO: 52041

SEQ ID NO: 663340 - RNA, 64 nt, hsa; identical to SEQ ID NO: 52042

SEQ ID NO: 663341 - RNA, 64 nt, hsa; identical to SEQ ID NO: 52043

SEQ ID NO: 663342 - RNA, 64 nt, hsa; identical to SEQ ID NO: 52044

SEQ ID NO: 663343 - RNA, 64 nt, hsa; identical to SEQ ID NO: 52045

SEQ ID NO: 663344 - RNA, 64 nt, hsa; identical to SEQ ID NO: 52046

SEQ ID NO: 663345 - RNA, 64 nt, hsa; identical to SEQ ID NO: 52047

SEQ ID NO: 663346 - RNA, 64 nt, hsa; identical to SEQ ID NO: 52048

SEQ ID NO: 663347 - RNA, 64 nt, hsa; identical to SEQ ID NO: 52049

SEQ ID NO: 663348 - RNA, 64 nt, hsa; identical to SEQ ID NO: 52050

SEQ ID NO: 663349 - RNA, 64 nt, hsa; identical to SEQ ID NO: 52051

SEQ ID NO: 663350 - RNA, 64 nt, hsa; identical to SEQ ID NO: 52052

SEQ ID NO: 663351 - RNA, 64 nt, hsa; identical to SEQ ID NO: 52053

SEQ ID NO: 663352 - RNA, 64 nt, hsa; identical to SEQ ID NO: 52054

SEQ ID NO: 663353 - RNA, 64 nt, hsa; identical to SEQ ID NO: 52055

SEQ ID NO: 663354 - RNA, 64 nt, hsa; identical to SEQ ID NO: 52056

SEQ ID NO: 663355 - RNA, 64 nt, hsa; identical to SEQ ID NO: 52057

SEQ ID NO: 663356 - RNA, 64 nt, hsa; identical to SEQ ID NO: 52058

SEQ ID NO: 663357 - RNA, 64 nt, hsa; identical to SEQ ID NO: 52059

SEQ ID NO: 663358 - RNA, 64 nt, hsa; identical to SEQ ID NO: 52060

SEQ ID NO: 663359 - RNA, 64 nt, hsa; identical to SEQ ID NO: 52061

SEQ ID NO: 663360 - RNA, 64 nt, hsa; identical to SEQ ID NO: 52062

SEQ ID NO: 663361 - RNA, 64 nt, hsa; identical to SEQ ID NO: 52063

SEQ ID NO: 663362 - RNA, 64 nt, hsa; identical to SEQ ID NO: 52064

SEQ ID NO: 663363 - RNA, 64 nt, hsa; identical to SEQ ID NO: 52065

SEQ ID NO: 663364 - RNA, 64 nt, hsa; identical to SEQ ID NO: 52066

SEQ ID NO: 663365 - RNA, 64 nt, hsa; identical to SEQ ID NO: 52067

SEQ ID NO: 663366 - RNA, 64 nt, hsa; identical to SEQ ID NO: 52068

SEQ ID NO: 663367 - RNA, 64 nt, hsa; identical to SEQ ID NO: 52069

SEQ ID NO: 663368 - RNA, 64 nt, hsa; identical to SEQ ID NO: 52070

SEQ ID NO: 663369 - RNA, 64 nt, hsa; identical to SEQ ID NO: 52071

SEQ ID NO: 663370 - RNA, 64 nt, hsa; identical to SEQ ID NO: 52072

SEQ ID NO: 663371 - RNA, 64 nt, hsa; identical to SEQ ID NO: 52073

SEQ ID NO: 663372 - RNA, 64 nt, hsa; identical to SEQ ID NO: 52074

SEQ ID NO: 663373 - RNA, 64 nt, hsa; identical to SEQ ID NO: 52075

SEQ ID NO: 663374 - RNA, 64 nt, hsa; identical to SEQ ID NO: 52076

SEQ ID NO: 663375 - RNA, 64 nt, hsa; identical to SEQ ID NO: 52077

SEQ ID NO: 663376 - RNA, 64 nt, hsa; identical to SEQ ID NO: 52078

SEQ ID NO: 663377 - RNA, 64 nt, hsa; identical to SEQ ID NO: 52079

SEQ ID NO: 663378 - RNA, 64 nt, hsa; identical to SEQ ID NO: 52080

SEQ ID NO: 663379 - RNA, 64 nt, hsa; identical to SEQ ID NO: 52081

SEQ ID NO: 663380 - RNA, 64 nt, hsa; identical to SEQ ID NO: 52082

SEQ ID NO: 663381 - RNA, 64 nt, hsa; identical to SEQ ID NO: 52083

SEQ ID NO: 663382 - RNA, 64 nt, hsa; identical to SEQ ID NO: 52084

SEQ ID NO: 663383 - RNA, 64 nt, hsa; identical to SEQ ID NO: 52085

SEQ ID NO: 663384 - RNA, 64 nt, hsa; identical to SEQ ID NO: 52086

SEQ ID NO: 663385 - RNA, 64 nt, hsa; identical to SEQ ID NO: 52087

SEQ ID NO: 663386 - RNA, 64 nt, hsa; identical to SEQ ID NO: 52088

SEQ ID NO: 663387 - RNA, 64 nt, hsa; identical to SEQ ID NO: 52089

SEQ ID NO: 663388 - RNA, 64 nt, hsa; identical to SEQ ID NO: 52090

SEQ ID NO: 663389 - RNA, 64 nt, hsa; identical to SEQ ID NO: 52091

SEQ ID NO: 663390 - RNA, 64 nt, hsa; identical to SEQ ID NO: 52092

SEQ ID NO: 663391 - RNA, 64 nt, hsa; identical to SEQ ID NO: 52093

SEQ ID NO: 663392 - RNA, 64 nt, hsa; identical to SEQ ID NO: 52094

SEQ ID NO: 663393 - RNA, 64 nt, hsa; identical to SEQ ID NO: 52095

SEQ ID NO: 663394 - RNA, 64 nt, hsa; identical to SEQ ID NO: 52096

SEQ ID NO: 663395 - RNA, 64 nt, hsa; identical to SEQ ID NO: 52097

SEQ ID NO: 663396 - RNA, 64 nt, hsa; identical to SEQ ID NO: 52098

SEQ ID NO: 663397 - RNA, 64 nt, hsa; identical to SEQ ID NO: 52099

SEQ ID NO: 663398 - RNA, 64 nt, hsa; identical to SEQ ID NO: 52100

SEQ ID NO: 663399 - RNA, 64 nt, hsa; identical to SEQ ID NO: 52101

SEQ ID NO: 663400 - RNA, 64 nt, hsa; identical to SEQ ID NO: 52102

SEQ ID NO: 663401 - RNA, 64 nt, hsa; identical to SEQ ID NO: 52103

SEQ ID NO: 663402 - RNA, 64 nt, hsa; identical to SEQ ID NO: 52104

SEQ ID NO: 663403 - RNA, 64 nt, hsa; identical to SEQ ID NO: 52105

SEQ ID NO: 663404 - RNA, 64 nt, hsa; identical to SEQ ID NO: 52106

SEQ ID NO: 663405 - RNA, 64 nt, hsa; identical to SEQ ID NO: 52107

SEQ ID NO: 663406 - RNA, 64 nt, hsa; identical to SEQ ID NO: 52108

SEQ ID NO: 663407 - RNA, 64 nt, hsa; identical to SEQ ID NO: 52109

SEQ ID NO: 663408 - RNA, 64 nt, hsa; identical to SEQ ID NO: 52110

SEQ ID NO: 663409 - RNA, 64 nt, hsa; identical to SEQ ID NO: 52111

SEQ ID NO: 663410 - RNA, 64 nt, hsa; identical to SEQ ID NO: 52112

SEQ ID NO: 663411 - RNA, 64 nt, hsa; identical to SEQ ID NO: 52113

SEQ ID NO: 663412 - RNA, 64 nt, hsa; identical to SEQ ID NO: 52114

SEQ ID NO: 663413 - RNA, 64 nt, hsa; identical to SEQ ID NO: 52115

SEQ ID NO: 663414 - RNA, 64 nt, hsa; identical to SEQ ID NO: 52116

SEQ ID NO: 663415 - RNA, 64 nt, hsa; identical to SEQ ID NO: 52117

SEQ ID NO: 663416 - RNA, 64 nt, hsa; identical to SEQ ID NO: 52118

SEQ ID NO: 663417 - RNA, 64 nt, hsa; identical to SEQ ID NO: 52119

SEQ ID NO: 663418 - RNA, 64 nt, hsa; identical to SEQ ID NO: 52120

SEQ ID NO: 663419 - RNA, 64 nt, hsa; identical to SEQ ID NO: 52121

SEQ ID NO: 663420 - RNA, 64 nt, hsa; identical to SEQ ID NO: 52122

SEQ ID NO: 663421 - RNA, 64 nt, hsa; identical to SEQ ID NO: 52123

SEQ ID NO: 663422 - RNA, 64 nt, hsa; identical to SEQ ID NO: 52124

SEQ ID NO: 663423 - RNA, 64 nt, hsa; identical to SEQ ID NO: 52125

SEQ ID NO: 663424 - RNA, 64 nt, hsa; identical to SEQ ID NO: 52126

SEQ ID NO: 663425 - RNA, 64 nt, hsa; identical to SEQ ID NO: 52127

SEQ ID NO: 663426 - RNA, 64 nt, hsa; identical to SEQ ID NO: 52128

SEQ ID NO: 663427 - RNA, 64 nt, hsa; identical to SEQ ID NO: 52129

SEQ ID NO: 663428 - RNA, 64 nt, hsa; identical to SEQ ID NO: 52130

SEQ ID NO: 663429 - RNA, 64 nt, hsa; identical to SEQ ID NO: 52131

SEQ ID NO: 663430 - RNA, 64 nt, hsa; identical to SEQ ID NO: 52132

SEQ ID NO: 663431 - RNA, 64 nt, hsa; identical to SEQ ID NO: 52133

SEQ ID NO: 663432 - RNA, 64 nt, hsa; identical to SEQ ID NO: 52134

SEQ ID NO: 663433 - RNA, 64 nt, hsa; identical to SEQ ID NO: 52135

SEQ ID NO: 663434 - RNA, 64 nt, hsa; identical to SEQ ID NO: 52136

SEQ ID NO: 663435 - RNA, 64 nt, hsa; identical to SEQ ID NO: 52137

SEQ ID NO: 663436 - RNA, 64 nt, hsa; identical to SEQ ID NO: 52138

SEQ ID NO: 663437 - RNA, 64 nt, hsa; identical to SEQ ID NO: 52139

SEQ ID NO: 663438 - RNA, 64 nt, hsa; identical to SEQ ID NO: 52140

SEQ ID NO: 663439 - RNA, 64 nt, hsa; identical to SEQ ID NO: 52141

SEQ ID NO: 663440 - RNA, 64 nt, hsa; identical to SEQ ID NO: 52142

SEQ ID NO: 663441 - RNA, 64 nt, hsa; identical to SEQ ID NO: 52143

SEQ ID NO: 663442 - RNA, 64 nt, hsa; identical to SEQ ID NO: 52144

SEQ ID NO: 663443 - RNA, 64 nt, hsa; identical to SEQ ID NO: 52145

SEQ ID NO: 663444 - RNA, 64 nt, hsa; identical to SEQ ID NO: 52146

SEQ ID NO: 663445 - RNA, 64 nt, hsa; identical to SEQ ID NO: 52147

SEQ ID NO: 663446 - RNA, 64 nt, hsa; identical to SEQ ID NO: 52148

SEQ ID NO: 663447 - RNA, 64 nt, hsa; identical to SEQ ID NO: 52149

SEQ ID NO: 663448 - RNA, 64 nt, hsa; identical to SEQ ID NO: 52150

SEQ ID NO: 663449 - RNA, 64 nt, hsa; identical to SEQ ID NO: 52151

SEQ ID NO: 663450 - RNA, 64 nt, hsa; identical to SEQ ID NO: 52152

SEQ ID NO: 663451 - RNA, 64 nt, hsa; identical to SEQ ID NO: 52153

SEQ ID NO: 663452 - RNA, 63 nt, hsa; identical to SEQ ID NO: 52154

SEQ ID NO: 663453 - RNA, 64 nt, hsa; identical to SEQ ID NO: 52155

SEQ ID NO: 663454 - RNA, 64 nt, hsa; identical to SEQ ID NO: 52156

SEQ ID NO: 663455 - RNA, 64 nt, hsa; identical to SEQ ID NO: 52157

SEQ ID NO: 663456 - RNA, 64 nt, hsa; identical to SEQ ID NO: 52158

SEQ ID NO: 663457 - RNA, 64 nt, hsa; identical to SEQ ID NO: 52159

SEQ ID NO: 663458 - RNA, 64 nt, hsa; identical to SEQ ID NO: 52160

SEQ ID NO: 663459 - RNA, 64 nt, hsa; identical to SEQ ID NO: 52161

SEQ ID NO: 663460 - RNA, 64 nt, hsa; identical to SEQ ID NO: 52162

SEQ ID NO: 663461 - RNA, 64 nt, hsa; identical to SEQ ID NO: 52163

SEQ ID NO: 663462 - RNA, 64 nt, hsa; identical to SEQ ID NO: 52164

SEQ ID NO: 663463 - RNA, 64 nt, hsa; identical to SEQ ID NO: 52165

SEQ ID NO: 663464 - RNA, 64 nt, hsa; identical to SEQ ID NO: 52166

SEQ ID NO: 663465 - RNA, 64 nt, hsa; identical to SEQ ID NO: 52167

SEQ ID NO: 663466 - RNA, 64 nt, hsa; identical to SEQ ID NO: 52168

SEQ ID NO: 663467 - RNA, 64 nt, hsa; identical to SEQ ID NO: 52169

SEQ ID NO: 663468 - RNA, 64 nt, hsa; identical to SEQ ID NO: 52170

SEQ ID NO: 663469 - RNA, 64 nt, hsa; identical to SEQ ID NO: 52171

SEQ ID NO: 663470 - RNA, 64 nt, hsa; identical to SEQ ID NO: 52172

SEQ ID NO: 663471 - RNA, 64 nt, hsa; identical to SEQ ID NO: 52173

SEQ ID NO: 663472 - RNA, 64 nt, hsa; identical to SEQ ID NO: 52174

SEQ ID NO: 663473 - RNA, 64 nt, hsa; identical to SEQ ID NO: 52175

SEQ ID NO: 663474 - RNA, 64 nt, hsa; identical to SEQ ID NO: 52176

SEQ ID NO: 663475 - RNA, 64 nt, hsa; identical to SEQ ID NO: 52177

SEQ ID NO: 663476 - RNA, 64 nt, hsa; identical to SEQ ID NO: 52178

SEQ ID NO: 663477 - RNA, 64 nt, hsa; identical to SEQ ID NO: 52179

SEQ ID NO: 663478 - RNA, 64 nt, hsa; identical to SEQ ID NO: 52180

SEQ ID NO: 663479 - RNA, 64 nt, hsa; identical to SEQ ID NO: 52181

SEQ ID NO: 663480 - RNA, 64 nt, hsa; identical to SEQ ID NO: 52182

SEQ ID NO: 663481 - RNA, 64 nt, hsa; identical to SEQ ID NO: 52183

SEQ ID NO: 663482 - RNA, 57 nt, hsa; identical to SEQ ID NO: 52184

SEQ ID NO: 663483 - RNA, 52 nt, hsa; identical to SEQ ID NO: 52185

SEQ ID NO: 663484 - RNA, 64 nt, hsa; identical to SEQ ID NO: 52186

SEQ ID NO: 663485 - RNA, 64 nt, hsa; identical to SEQ ID NO: 52187

SEQ ID NO: 663486 - RNA, 64 nt, hsa; identical to SEQ ID NO: 52188

SEQ ID NO: 663487 - RNA, 64 nt, hsa; identical to SEQ ID NO: 52189

SEQ ID NO: 663488 - RNA, 64 nt, hsa; identical to SEQ ID NO: 52190

SEQ ID NO: 663489 - RNA, 64 nt, hsa; identical to SEQ ID NO: 52191

SEQ ID NO: 663490 - RNA, 64 nt, hsa; identical to SEQ ID NO: 52192

SEQ ID NO: 663491 - RNA, 64 nt, hsa; identical to SEQ ID NO: 52193

SEQ ID NO: 663492 - RNA, 64 nt, hsa; identical to SEQ ID NO: 52194

SEQ ID NO: 663493 - RNA, 64 nt, hsa; identical to SEQ ID NO: 52195

SEQ ID NO: 663494 - RNA, 64 nt, hsa; identical to SEQ ID NO: 52196

SEQ ID NO: 663495 - RNA, 64 nt, hsa; identical to SEQ ID NO: 52197

SEQ ID NO: 663496 - RNA, 64 nt, hsa; identical to SEQ ID NO: 52198

SEQ ID NO: 663497 - RNA, 64 nt, hsa; identical to SEQ ID NO: 52199

SEQ ID NO: 663498 - RNA, 64 nt, hsa; identical to SEQ ID NO: 52200

SEQ ID NO: 663499 - RNA, 64 nt, hsa; identical to SEQ ID NO: 52201

SEQ ID NO: 663500 - RNA, 64 nt, hsa; identical to SEQ ID NO: 52202

SEQ ID NO: 663501 - RNA, 64 nt, hsa; identical to SEQ ID NO: 52203

SEQ ID NO: 663502 - RNA, 64 nt, hsa; identical to SEQ ID NO: 52204

SEQ ID NO: 663503 - RNA, 64 nt, hsa; identical to SEQ ID NO: 52205

SEQ ID NO: 663504 - RNA, 64 nt, hsa; identical to SEQ ID NO: 52206

SEQ ID NO: 663505 - RNA, 64 nt, hsa; identical to SEQ ID NO: 52207

SEQ ID NO: 663506 - RNA, 64 nt, hsa; identical to SEQ ID NO: 52208

SEQ ID NO: 663507 - RNA, 64 nt, hsa; identical to SEQ ID NO: 52209

SEQ ID NO: 663508 - RNA, 64 nt, hsa; identical to SEQ ID NO: 52210

SEQ ID NO: 663509 - RNA, 64 nt, hsa; identical to SEQ ID NO: 52211

SEQ ID NO: 663510 - RNA, 64 nt, hsa; identical to SEQ ID NO: 52212

SEQ ID NO: 663511 - RNA, 64 nt, hsa; identical to SEQ ID NO: 52213

SEQ ID NO: 663512 - RNA, 64 nt, hsa; identical to SEQ ID NO: 52214

SEQ ID NO: 663513 - RNA, 64 nt, hsa; identical to SEQ ID NO: 52215

SEQ ID NO: 663514 - RNA, 64 nt, hsa; identical to SEQ ID NO: 52216

SEQ ID NO: 663515 - RNA, 64 nt, hsa; identical to SEQ ID NO: 52217

SEQ ID NO: 663516 - RNA, 64 nt, hsa; identical to SEQ ID NO: 52218

SEQ ID NO: 663517 - RNA, 64 nt, hsa; identical to SEQ ID NO: 52219

SEQ ID NO: 663518 - RNA, 64 nt, hsa; identical to SEQ ID NO: 52220

SEQ ID NO: 663519 - RNA, 64 nt, hsa; identical to SEQ ID NO: 52221

SEQ ID NO: 663520 - RNA, 64 nt, hsa; identical to SEQ ID NO: 52222

SEQ ID NO: 663521 - RNA, 64 nt, hsa; identical to SEQ ID NO: 52223

SEQ ID NO: 663522 - RNA, 64 nt, hsa; identical to SEQ ID NO: 52224

SEQ ID NO: 663523 - RNA, 64 nt, hsa; identical to SEQ ID NO: 52225

SEQ ID NO: 663524 - RNA, 64 nt, hsa; identical to SEQ ID NO: 52226

SEQ ID NO: 663525 - RNA, 64 nt, hsa; identical to SEQ ID NO: 52227

SEQ ID NO: 663526 - RNA, 64 nt, hsa; identical to SEQ ID NO: 52228

SEQ ID NO: 663527 - RNA, 64 nt, hsa; identical to SEQ ID NO: 52229

SEQ ID NO: 663528 - RNA, 64 nt, hsa; identical to SEQ ID NO: 52230

SEQ ID NO: 663529 - RNA, 64 nt, hsa; identical to SEQ ID NO: 52231

SEQ ID NO: 663530 - RNA, 64 nt, hsa; identical to SEQ ID NO: 52232

SEQ ID NO: 663531 - RNA, 64 nt, hsa; identical to SEQ ID NO: 52233

SEQ ID NO: 663532 - RNA, 64 nt, hsa; identical to SEQ ID NO: 52234

SEQ ID NO: 663533 - RNA, 64 nt, hsa; identical to SEQ ID NO: 52235

SEQ ID NO: 663534 - RNA, 62 nt, hsa
auuuuauuuuuacaacuaacauccauuccccuucauuuaaacaccuuuuguguuuuacuuca

SEQ ID NO: 663535 - RNA, 62 nt, hsa
auuuuuucaugaacauuuugauacaaauuucaucauuuaaugauucaccaauuucuugcauu

SEQ ID NO: 663536 - RNA, 62 nt, hsa
guuucacucaugucugucauuuuauaagcauaucauuuaaaaagcuucuaaaaagcuauuuc

SEQ ID NO: 663537 - RNA, 62 nt, hsa
augaaaauauauuucccuguaagcugaauuacucauuuaaaaauuuuaacuucuauauggga

SEQ ID NO: 663538 - RNA, 62 nt, hsa
ugagacagagacaaaugaaccccccucuaaagucauuuaacuaauagccagcacaucccuuc

SEQ ID NO: 663539 - RNA, 62 nt, hsa
acaaccaaaggaaaauggggaggcuugggauuucauuuaaauaaucuaagccaagaugauaa

SEQ ID NO: 663540 - RNA, 62 nt, hsa
aaugcuuacuaugugccagguacuacauccugucauuuaaucuuaaccuagucugggagaug

SEQ ID NO: 663541 - RNA, 62 nt, hsa
uuauaaagaauuugagguuaagauaaaaggacucauuuaagcucacauggucaguagguggc

SEQ ID NO: 663542 - RNA, 62 nt, hsa
aaauugcucuaucugggcugauagacauuucgucauuuaaguaagggaucgaagacauuuca

SEQ ID NO: 663543 - RNA, 62 nt, hsa
uccaauuuacagauaguaugauauacauuucaucauuuaaguaagggaucgaaaacauuuca

SEQ ID NO: 663544 - RNA, 62 nt, hsa
cacgucagcaagagccucuuugucucacuccaucauuuaaaaccaguauauucaguaguuga

SEQ ID NO: 663545 - RNA, 62 nt, hsa
gauuugugaagacaucagauaggaauuuugacucauuuaaacuuugaugcuuaguuauguug

SEQ ID NO: 663546 - RNA, 62 nt, hsa
uuuuuaccguaacuauuucguuuaaauuuguuucauuuaaguuuccuacacgcuaacuucgu

SEQ ID NO: 663547 - RNA, 62 nt, hsa
uuuucuggccuuuacaacagaauggaagagaaucauuuaagaguuccuguaacaguuaugca

SEQ ID NO: 663548 - RNA, 62 nt, hsa
gcuggccauggaagccucuuaacaacacacugucauuuaaggcugugcuugugcuuuauaca

SEQ ID NO: 663549 - RNA, 62 nt, hsa
ugcacuuuauguaagaauguaaaccuggagucucauuuaagaaugaucagcaauacguuuag

SEQ ID NO: 663550 - RNA, 62 nt, hsa
aucaaugaaaaacccauauguaauaaucgaauucauuuaacaugaaucuugaguacguggac

SEQ ID NO: 663551 - RNA, 62 nt, hsa
ugaaggugccauucuuaugagccaaaaguuugucauuuaaaaguucauuuugagggaauaac

SEQ ID NO: 663552 - RNA, 62 nt, hsa
acaguacaugcugaagcgugccguuucagcccucauuuaauucaauuuguaaguagcgcagc

SEQ ID NO: 663553 - RNA, 62 nt, hsa
ucccuccaccccaggacgccacucauuucaucucauuuaagggaaaaauauauaucuaucua

SEQ ID NO: 663554 - RNA, 62 nt, hsa
gucugccaucuuuaaaaaaaaauacaguauuuucauuuaaauucucugauggagggacaaca

SEQ ID NO: 663555 - RNA, 62 nt, hsa
uuauucucuuuuucaucuggggauuuaccuguucauuuaaucugccuguuuugaucuguuuu

SEQ ID NO: 663556 - RNA, 62 nt, hsa
uuaauaaugguguacuuuaaaaaauauauguuucauuuaaucuucacaaaagaucuguagag

SEQ ID NO: 663557 - RNA, 62 nt, hsa
ggaucacuuacauccaauauauguauauuuugucauuuaaaucagaacaaccacuugaaauu

SEQ ID NO: 663558 - RNA, 62 nt, hsa
uuuugucacucaguuauuuaacuguguuuagcucauuuaaaucaaaauguguacuuuaaucu

SEQ ID NO: 663559 - RNA, 62 nt, hsa
gaauauuugaucuucuugagauuuucauacuaucauuuaaccaccaggaagcugaagugugu

SEQ ID NO: 663560 - RNA, 62 nt, hsa
ugcugcguucuguuugcugagguugggcuuauucauuuaacacauaccaaccauuauccaga

SEQ ID NO: 663561 - RNA, 62 nt, hsa
agaguuuaaaaguuuagcuuauugaguaguugucauuuaaaauauaauugcgaauaucagaa

SEQ ID NO: 663562 - RNA, 62 nt, hsa
ggaaaugaaaguagcgucuuuuaaauugcuauucauuuaauauaccuguuuucccaucuuuu

SEQ ID NO: 663563 - RNA, 62 nt, hsa
uuuacaguaucagccuuugauuauagaugugaucauuuaaaauuugauaaugacuuuaguga

SEQ ID NO: 663564 - RNA, 62 nt, hsa
caguuuuucuuuugaucgugcacuuauagucuucauuuaauuccucauagaaucccagucac

SEQ ID NO: 663565 - RNA, 62 nt, hsa
uacaucuacccacuccauuauuuuuuaaaacuucauuuaauaguuuaaacaagauugguuuu

SEQ ID NO: 663566 - RNA, 62 nt, hsa
gaauuauuguuacucauauuuuaaucaguaagucauuuaagcuaugacagaguaggaauuga

SEQ ID NO: 663567 - RNA, 62 nt, hsa
uuguuucagucauuuaaaauuuaaauuuucagucauuuaaaauuuuaaaaauuuaaaauuuc

SEQ ID NO: 663568 - RNA, 62 nt, hsa
uuuugaauaauaauguuuaaauuuuguuucagucauuuaaaauuuaaauuuucagucauuua

SEQ ID NO: 663569 - RNA, 62 nt, hsa
gacugaaaagcaaauuuauucuuucgaagauuucauuuaaaucucuguacuaugcauuuuug

SEQ ID NO: 663570 - RNA, 62 nt, hsa
uagacuugcugaguuuggcauagauagugcacucauuuaaucugugccucucaaaacuucag

SEQ ID NO: 663571 - RNA, 62 nt, hsa
uuaaaaucauaacuuaauuucauuaacuuuuaucauuuaacucucucauguuuguuguaacc

SEQ ID NO: 663572 - RNA, 62 nt, hsa
aaagcaaauagcauugacacauuuaaagcuuuucauuuaaaguaguggauguuuuugaagua

SEQ ID NO: 663573 - RNA, 62 nt, hsa
acagucauuuaugccuaaagccuggugauuauucauuuaaaugaagaucacauuucauauca

SEQ ID NO: 663574 - RNA, 62 nt, hsa
ccaauugaauuaaaguguggccucguuuuuagucauuuaaaauuguuuucuaaguaauugcu

SEQ ID NO: 663575 - RNA, 62 nt, hsa
acuugcacaauguugaacauagccuuuaagcaucauuuaaauuuuaaaggaauggaguuuuu

SEQ ID NO: 663576 - RNA, 62 nt, hsa
uuauuuucuuuuaaugugcaaugauggcuggaucauuuaaaguucuuuuuagaaaauaacau

SEQ ID NO: 663577 - RNA, 62 nt, hsa
ggaaguggaacuuugguaaaugacuguuugccucauuuaauaguauacaggcucagcccaua

SEQ ID NO: 663578 - RNA, 62 nt, hsa
cuucuuaauggagauauucaguuuucuuuuuuucauuuaaacaaagaaaaaaaauguaucua

SEQ ID NO: 663579 - RNA, 62 nt, hsa
aaagacaggaucauacacaugacuuauaccucucauuuaaauauuuuauaguauaaaguauu

SEQ ID NO: 663580 - RNA, 62 nt, hsa
aauuuuaauaaaagugaaccagaacaaaucacucauuuaaaaaguaauucagaagaacagug

SEQ ID NO: 663581 - RNA, 62 nt, hsa
aaaccaaaaaaaccaaggugcaucauuaauauucauuuaauucaaauaccaaauaguuuaca

SEQ ID NO: 663582 - RNA, 62 nt, hsa
uuuccauauucugauuuuuaacagaaaagcacucauuuaauagauguagggaaacuagauau

SEQ ID NO: 663583 - RNA, 62 nt, hsa
uuuuauaaugcauuuuacucccaguauuauguucauuuaauaaauuauuuuuucacuacaac

SEQ ID NO: 663584 - RNA, 62 nt, hsa
uucuagacuuacaaaaggcuuaaaaagaacaaucauuuaaucaguaccauucuguaucuuau

SEQ ID NO: 663585 - RNA, 62 nt, hsa
auuaagauauguauuuguaaguuauugguggcucauuuaaacuguaucauacaguaaugcca

SEQ ID NO: 663586 - RNA, 62 nt, hsa
caaauuuagcauuauuuugacacuuuuaauuuucauuuaacaauggauuagaaaaauauuuu

SEQ ID NO: 663587 - RNA, 62 nt, hsa
uucugagauuaaaaaaaauuuuuaaagagugaucauuuaaauaauuucuaaaagggucuuuu

SEQ ID NO: 663588 - RNA, 62 nt, hsa
uagucucagggcuuguguaauauucugggaggucauuuaaaugccagaaauggucaagcaau

SEQ ID NO: 663589 - RNA, 62 nt, hsa
cauuuuuaaaaacgaauuguaguuguuuuucuucauuuaaaauggaucuguuggagguuaug

SEQ ID NO: 663590 - RNA, 62 nt, hsa
auauauauuuucuguauuaagcucauuuggcuucauuuaagcuguauacuuagucauauauc

SEQ ID NO: 663591 - RNA, 62 nt, hsa
aggucccacgcuggauauuuucacaccuuaccucauuuaauacaacaagcaaggagguagac

SEQ ID NO: 663592 - RNA, 62 nt, hsa
cugugcuaggcacagacuuucuagggauuauuucauuuaauucucauggcaaccaccaugca

SEQ ID NO: 663593 - RNA, 62 nt, hsa
aagucccugucucuuucagacacagacaagcuucauuuaaauuauuucaucugaucauuauc

SEQ ID NO: 663594 - RNA, 62 nt, hsa
ggaaauuuaaagcugcauggucugucuuguuuucauuuaauuauugugaauaccuagaaucu

SEQ ID NO: 663595 - RNA, 62 nt, hsa
ugggagccuuuaucugucauuagaaaucuuucucauuuaagaacuuaugaauaugcugaaga

SEQ ID NO: 663596 - RNA, 62 nt, hsa
gucuuacuuguacuguaucacauuccauacccucauuuaauucuuaauaaaacuguucacuu

SEQ ID NO: 663597 - RNA, 62 nt, hsa
uguauuggggauauguuuuacauaaauagaacucauuuaaaaguaugguucaaguacugcuc

SEQ ID NO: 663598 - RNA, 62 nt, hsa
acuaucaagagugaccuuugaagcaagcuaaaucauuuaaauguuuaaauugaaaaugggcc

SEQ ID NO: 663599 - RNA, 62 nt, hsa
cccaggggaaaaugaagguuaggauuuaacagucauuuaaaaaaaaaauuuguuuugacgga

SEQ ID NO: 663600 - RNA, 62 nt, hsa
aaaaaauuuguuuugacggaugauuggauuauucauuuaaaaugauuagaaggcaaguuucu

SEQ ID NO: 663601 - RNA, 62 nt, hsa
aauaugguauaacaacaagugaauuugaagacucauuuaaaauauuguguuauuuauaaagu

SEQ ID NO: 663602 - RNA, 62 nt, hsa
gguuaaacuuauggcuauuuuuaaagggcuauucauuuaaucugaguuuucccuuauuuuca

SEQ ID NO: 663603 - RNA, 62 nt, hsa
uuucuuuauuguguuggugcaauauuuuauuaucauuuaaccucaggauauucagaccaaca

SEQ ID NO: 663604 - RNA, 62 nt, hsa
acccuggugcuuccccugcagaauacuguacuucauuuaacagaaugauugauuuuucuuuc

SEQ ID NO: 663605 - RNA, 62 nt, hsa
aauguauuauucaggaagaauacugagugccuucauuuaacuaaaguugaauguaaaaguca

SEQ ID NO: 663606 - RNA, 62 nt, hsa
agaauuauaaauuguuaaaaccuugauaauugucauuuaauuauauuucagguguccugaac

SEQ ID NO: 663607 - RNA, 62 nt, hsa
augaaaguguucauccagauuucauacuuuacucauuuaacaaauuaucuuuaguuaauugc

SEQ ID NO: 663608 - RNA, 62 nt, hsa
uacagagaaacuauaagcaauuaugugggaaaucauuuaauaauauuaaaucuuagaaguua

SEQ ID NO: 663609 - RNA, 62 nt, hsa
aaauggccaaauauauaccgugaaaauugguuucauuuaacaaaagaucagaucccuccuuc

SEQ ID NO: 663610 - RNA, 62 nt, hsa
ucacuuuacugcauaggaaacaaucuaccucaucauuuaaaaugacaugggugucgguuuug

SEQ ID NO: 663611 - RNA, 62 nt, hsa
auaacuuucuggcauuuagaauuuuguuccauucauuuaauuuguucaucugagaauuuuuu

SEQ ID NO: 663612 - RNA, 62 nt, hsa
guuguguuuauguagaaaauucacaaaucuguucauuuaauuuuuuaauuugagaauuuuua

SEQ ID NO: 663613 - RNA, 62 nt, hsa
cuaauguuuuuaagguuuuuaggaaaaucaggucauuuaagaaauuguuuuguaguuucugg

SEQ ID NO: 663614 - RNA, 62 nt, hsa
uuugguauuucauauaggaauuauuuuuuuuuucauuuaaaacaaauccacaucuuuuguaa

SEQ ID NO: 663615 - RNA, 64 nt, hsa
aagcuuacaucuuccucagccaucuuugugaguccuucaagagcaguuaucaauuguuaguuag

SEQ ID NO: 663616 - RNA, 64 nt, hsa
caccuuugugagaaagaaaaaauagaugccucuucuucaagaugcauuguuucuauuggucagg

SEQ ID NO: 663617 - RNA, 64 nt, hsa
caaaguagaagagcccccaaccuuuucucucugccuucaagaaggcagacauuugguaugauuu

SEQ ID NO: 663618 - RNA, 64 nt, hsa
aaucuuuucuuucucaaauuaauuaaucuuuaagcuucaagaaacuugcucugaccccucuaag

SEQ ID NO: 663619 - RNA, 64 nt, hsa
aacugauuauuuggaucagaaaccauugaaacugcuucaagaauuguaucuuuaaguacugcua

SEQ ID NO: 663620 - RNA, 64 nt, hsa
cuguuuugaagcuuacauggacaaauguuuaggacuucaagaucacacuugugggcaaucuggg

SEQ ID NO: 663621 - RNA, 64 nt, hsa
agcaugucucccugaucugaacuauuugcuuucucuucaagauaaguuguauuuuaccauggaa

SEQ ID NO: 663622 - RNA, 64 nt, hsa
aauuauguagucuccguuaucacuaaaauguuaucuucaagagauguuaaauauuuauaugcuu

SEQ ID NO: 663623 - RNA, 64 nt, hsa
guugcuuuacagacuuccaagaggcugauucuggcuucaagauggagccuuggaguugguuuuu

SEQ ID NO: 663624 - RNA, 64 nt, hsa
aauuucacaugcacuuguacuucauuauuucccucuucaagagucguuucuauucuaguuucug

SEQ ID NO: 663625 - RNA, 64 nt, hsa
caugauaaugauaggauaaacaaaauaccacugucuucaagaaacauuaucuuagguuuguuug

SEQ ID NO: 663626 - RNA, 64 nt, hsa
agauauguuguguuugcuucauuuuuaaugaugacuucaagauugaugaugugauccaauaacu

SEQ ID NO: 663627 - RNA, 64 nt, hsa
acagccauucuuuggacugugguuaauuugauaacuucaagaaguuauaacuuugcuacccugg

SEQ ID NO: 663628 - RNA, 64 nt, hsa
cuccauuaaaauguagaugcuuugucuaauuccacuucaagaugauuuaauugagcuucuauaa

SEQ ID NO: 663629 - RNA, 64 nt, hsa
uuucauauaauuguuagaagguuuguuucccaaacuaccauaguuacaaaggugaaaagccaaa

SEQ ID NO: 663630 - RNA, 64 nt, hsa
uggucugaggcauauagaguauaugccaagaacacuaccauauauggcaucagcuuugguuacc

SEQ ID NO: 663631 - RNA, 64 nt, hsa; identical to SEQ ID NO: 662508

SEQ ID NO: 663632 - RNA, 64 nt, hsa; identical to SEQ ID NO: 662509

SEQ ID NO: 663633 - RNA, 64 nt, hsa; identical to SEQ ID NO: 662510

SEQ ID NO: 663634 - RNA, 64 nt, hsa; identical to SEQ ID NO: 662511

SEQ ID NO: 663635 - RNA, 64 nt, hsa; identical to SEQ ID NO: 662512

SEQ ID NO: 663636 - RNA, 64 nt, hsa; identical to SEQ ID NO: 662513

SEQ ID NO: 663637 - RNA, 64 nt, hsa; identical to SEQ ID NO: 662514

SEQ ID NO: 663638 - RNA, 64 nt, hsa; identical to SEQ ID NO: 662515

SEQ ID NO: 663639 - RNA, 64 nt, hsa; identical to SEQ ID NO: 662516

SEQ ID NO: 663640 - RNA, 64 nt, hsa; identical to SEQ ID NO: 662517

SEQ ID NO: 663641 - RNA, 64 nt, hsa; identical to SEQ ID NO: 662518

SEQ ID NO: 663642 - RNA, 64 nt, hsa; identical to SEQ ID NO: 662519

SEQ ID NO: 663643 - RNA, 64 nt, hsa; identical to SEQ ID NO: 662520

SEQ ID NO: 663644 - RNA, 64 nt, hsa; identical to SEQ ID NO: 662521

SEQ ID NO: 663645 - RNA, 64 nt, hsa; identical to SEQ ID NO: 662522

SEQ ID NO: 663646 - RNA, 64 nt, hsa; identical to SEQ ID NO: 662523

SEQ ID NO: 663647 - RNA, 64 nt, hsa; identical to SEQ ID NO: 662524

SEQ ID NO: 663648 - RNA, 64 nt, hsa; identical to SEQ ID NO: 662525

SEQ ID NO: 663649 - RNA, 64 nt, hsa; identical to SEQ ID NO: 662526

SEQ ID NO: 663650 - RNA, 64 nt, hsa; identical to SEQ ID NO: 662527

SEQ ID NO: 663651 - RNA, 64 nt, hsa; identical to SEQ ID NO: 662528

SEQ ID NO: 663652 - RNA, 64 nt, hsa; identical to SEQ ID NO: 662529

SEQ ID NO: 663653 - RNA, 64 nt, hsa; identical to SEQ ID NO: 662530

SEQ ID NO: 663654 - RNA, 64 nt, hsa; identical to SEQ ID NO: 662531

SEQ ID NO: 663655 - RNA, 64 nt, hsa; identical to SEQ ID NO: 662532

SEQ ID NO: 663656 - RNA, 64 nt, hsa; identical to SEQ ID NO: 662533

SEQ ID NO: 663657 - RNA, 64 nt, hsa
ugguccaucuauauuuaaaacgugcaagaaaaaaauaaaauacucugcucuagcaaguuuugug

SEQ ID NO: 663658 - RNA, 64 nt, hsa
aucgucauguuaauaaauuuaaaacaucauucguauaaaauauuuuaauuuucuuguauuucau

SEQ ID NO: 663659 - RNA, 64 nt, hsa
gucaauagccuagggcugaauuuuugucagauaaauaaaauaaaucauucauccuuuuuuuuga

SEQ ID NO: 663660 - RNA, 64 nt, hsa
uacuaaauguauuuuagacuuccuguagggggcgauaaaauaaaaugcuaaacaacuggguaua

SEQ ID NO: 663661 - RNA, 64 nt, hsa
aaucaugucaucuucuauuuguacagaaaugaaaauaaaauaugaaaauaaugaaagaaaugaa

SEQ ID NO: 663662 - RNA, 64 nt, hsa
ugcuauauaauauucaguggcucauuuauaccuaauaaaauaaugguauuuuaaaauaaugcua

SEQ ID NO: 663663 - RNA, 64 nt, hsa
ccucauugauauauugcacuauuucauaaauacuauaaaauaaugacuaggaaguaacuuauua

SEQ ID NO: 663664 - RNA, 64 nt, hsa
gugugauagcugauuucaauauugaaguauugaaauaaaauauucuuuacaccugaaguaaaua

SEQ ID NO: 663665 - RNA, 64 nt, hsa
aguccugccugccaagaacucaaguguaacugugauaaaauaaccuuucccagguauauuggca

SEQ ID NO: 663666 - RNA, 64 nt, hsa
ccauugagcuguguaugcauuuuuguuuauuucaauaaaauauauuuguauuauuuguccuuca

SEQ ID NO: 663667 - RNA, 64 nt, hsa
uaaaauuaguuacuaaguauuuugaucaaagcuuauaaaauaacuuacggagauuuuuguaagu

SEQ ID NO: 663668 - RNA, 64 nt, hsa
uuucauuuuuaagaagaaaaacaccacucauuuuauaaaauauaguacagcuacuauaaggcuu

SEQ ID NO: 663669 - RNA, 64 nt, hsa
gagcauaaaauguaugcuguugugaccaauaaauauaaaauaugguaauuggaauuaacuccac

SEQ ID NO: 663670 - RNA, 64 nt, hsa
uaugaauuuuggcauguuucagagagaucaguaaauaaaauauuagauaaaauauauauuguuu

SEQ ID NO: 663671 - RNA, 64 nt, hsa
uucaauuuuucugccuuaagaaugaauguccuucauaaaauauuggaugcaguguaacacuauc

SEQ ID NO: 663672 - RNA, 64 nt, hsa
cuauccaaggcagugacuucagcuuuauauacauauaaaauauaguuaguuuuaaaauuauuga

SEQ ID NO: 663673 - RNA, 64 nt, hsa
ucucaaaaaauaaaauaaaauaaaauaaaauaaaauaaaauaaaauaaaauaaaauaaaauaaa

SEQ ID NO: 663674 - RNA, 64 nt, hsa
cucugucucaaaaaauaaaauaaaauaaaauaaaauaaaauaaaauaaaauaaaauaaaauaaa

SEQ ID NO: 663675 - RNA, 64 nt, hsa
ugacacucugucucaaaaaauaaaauaaaauaaaauaaaauaaaauaaaauaaaauaaaauaaa

SEQ ID NO: 663676 - RNA, 64 nt, hsa
cagagugacacucugucucaaaaaauaaaauaaaauaaaauaaaauaaaauaaaauaaaauaaa

SEQ ID NO: 663677 - RNA, 64 nt, hsa
ggcaacagagugacacucugucucaaaaaauaaaauaaaauaaaauaaaauaaaauaaaauaaa

SEQ ID NO: 663678 - RNA, 64 nt, hsa
gccugggcaacagagugacacucugucucaaaaaauaaaauaaaauaaaauaaaauaaaauaaa

SEQ ID NO: 663679 - RNA, 64 nt, hsa
uugccacaaaaccuguauuacugaauaauaucaaauaaaauaucauaaagcauuuuaaauaugg

SEQ ID NO: 663680 - RNA, 64 nt, hsa
augucucaugucaaugaccauucaauuaguggucauaaaauagaauaauucuuuucugaggaua

SEQ ID NO: 663681 - RNA, 64 nt, hsa
agcccugaggaguuauuggcaagauuugugcaaaauaaaauauggggagacuugggaguugucu

SEQ ID NO: 663682 - RNA, 64 nt, hsa
guaucucuucacuucugugaaaguaauauuuuuuauaaaauacacugaaauuuaaccucaguaa

SEQ ID NO: 663683 - RNA, 64 nt, hsa
augaaugccuucuuaaaaucauguuuuuaaaugcauaaaauauauaggauuacaaaggaaucua

SEQ ID NO: 663684 - RNA, 64 nt, hsa
ggccuuuauuuggcaaauaacugagccaaccagaauaaaauaaccaauacuccacugcucauau

SEQ ID NO: 663685 - RNA, 64 nt, hsa
aaauuauaagacucugcaauaauaucucauaaucauaaaauauuaauucauauauauagauuac

SEQ ID NO: 663686 - RNA, 64 nt, hsa
aaauucucuuccuaaauuucuacaaaaacaaauaauaaaauauucagcagugggggacaccacu

SEQ ID NO: 663687 - RNA, 64 nt, hsa
ccugccacuguagcgccuuuuuaaaauaaauaaaauaaaauaaagcaccauuuuguuucccuuu

SEQ ID NO: 663688 - RNA, 64 nt, hsa
agcguccugccacuguagcgccuuuuuaaaauaaauaaaauaaaauaaagcaccauuuuguuuc

SEQ ID NO: 663689 - RNA, 64 nt, hsa
gauggauuaaacaaguauaaaauaaaauacauuuauaaaauaaaaaggaaaacagacuuaaauu

SEQ ID NO: 663690 - RNA, 64 nt, hsa
gugcuaggucuaagauggauuaaacaaguauaaaauaaaauacauuuauaaaauaaaaaggaaa

SEQ ID NO: 663691 - RNA, 64 nt, hsa
aggaugugcuaggucuaagauggauuaaacaaguauaaaauaaaauacauuuauaaaauaaaaa

SEQ ID NO: 663692 - RNA, 64 nt, hsa
aaggauuuuauucucaacagaugcaaaaugcaaaauaaaauauuggcaaacaauacagcaacaa

SEQ ID NO: 663693 - RNA, 64 nt, hsa
cuaacagaacaacugaaauacuugaaauagaccuauaaaauaguaauuaaaaugagaaauacau

SEQ ID NO: 663694 - RNA, 64 nt, hsa
aggaauagcaacuaauacaaaugccaauaugauaauaaaauacauuugucuauaaucguuuaaa

SEQ ID NO: 663695 - RNA, 60 nt, hsa
cugaagauaauuuacagugaccccaucuaaauaaaauacugcuuuugcaaacagaacacu

SEQ ID NO: 663696 - RNA, 64 nt, hsa
ucuuuaucucaaguauauaaaguuuugccccaugauaaaauaaguaacauauaaauuaauacau

SEQ ID NO: 663697 - RNA, 64 nt, hsa
auagugaauuuuaaaauguagaagaaagcaaaaaauaaaauaaguccuaaagugaagaagccau

SEQ ID NO: 663698 - RNA, 64 nt, hsa
agaccugauuuucaaaaucugcccucagaugaaaauaaaauaaacgaaacauuuagacaauggc

SEQ ID NO: 663699 - RNA, 64 nt, hsa
acacgugccauuauaguaucuaacaaaaaguggcauaaaauauuacaaaacauccaacacuaga

SEQ ID NO: 663700 - RNA, 64 nt, hsa
ucuucacauuaaacuauggacucuaauuuucuggauaaaauauccugccuuauggaaaugaaau

SEQ ID NO: 663701 - RNA, 64 nt, hsa
uuuacauguaaaaauaaacuaaacaaaucuaaugauaaaauaugucagauccauguucuaaaaa

SEQ ID NO: 663702 - RNA, 64 nt, hsa
uucagaaagucaaaagauuaccuaucguucuacaauaaaauacauggaaauagcuugcuauuuu

SEQ ID NO: 663703 - RNA, 64 nt, hsa
ugcuacaguuugcaggugaaaaaaaauaaauauuauaaaauaugcuauuguuuuuguguucuug

SEQ ID NO: 663704 - RNA, 64 nt, hsa
aaugggggcucuuacugacuuuaaauuagcgcuuauaaaauaaaaauguuuaguucaagaagag

SEQ ID NO: 663705 - RNA, 64 nt, hsa
auggcuuaagcaccucagcauuccuuacuaugugauaaaauacauauagaauauaagauauacu

SEQ ID NO: 663706 - RNA, 64 nt, hsa
ccugucaguauuacaguuaguuuucuagugacucauaaaauaagauuuccuguuucauguagaa

SEQ ID NO: 663707 - RNA, 64 nt, hsa
gacaggcauacuguuacuuugcaauauccacuuuauaaaauagcuccugcccaguggcucuugg

SEQ ID NO: 663708 - RNA, 64 nt, hsa
aacuaguacuaauuauaaauauaaaauacacaauauaaaauaugaaacucaauaauaaacagug

SEQ ID NO: 663709 - RNA, 64 nt, hsa
caugucauauguguaacuaguacuaauuauaaauauaaaauacacaauauaaaauaugaaacuc

SEQ ID NO: 663710 - RNA, 64 nt, hsa
ucagcacagaaacuuuccuaccuuuuuguggaagauaaaauauuaaaacugcuuucaaaacuac

SEQ ID NO: 663711 - RNA, 64 nt, hsa
uuuuaaauacucacaacaugugauucauuuucugauaaaauauuugucuaauaaaacagaggca

SEQ ID NO: 663712 - RNA, 64 nt, hsa
uaucggggcgaaccuuuuaggauuccaugugaaaauaaaauaugaggaaaaguuuaaccuaaau

SEQ ID NO: 663713 - RNA, 64 nt, hsa
uguuuauacaauaauuuaaauauuuuuuaaaaccauaaaauaaauuuuuauaaggaauacuguu

SEQ ID NO: 663714 - RNA, 64 nt, hsa
gcaagacucuaucucaaaaauaaaauaaaauaaaauaaaauaauuaauaaaaugguguaguauu

SEQ ID NO: 663715 - RNA, 64 nt, hsa
acagagcaagacucuaucucaaaaauaaaauaaaauaaaauaaaauaauuaauaaaauggugua

SEQ ID NO: 663716 - RNA, 64 nt, hsa
gagcaacagagcaagacucuaucucaaaaauaaaauaaaauaaaauaaaauaauuaauaaaaug

SEQ ID NO: 663717 - RNA, 64 nt, hsa
agccugagcaacagagcaagacucuaucucaaaaauaaaauaaaauaaaauaaaauaauuaaua

SEQ ID NO: 663718 - RNA, 64 nt, hsa
agccuggccaacauggcgaaaccccgucucuacuauaaaauacaaaaaauuaguuggguguggu

SEQ ID NO: 663719 - RNA, 64 nt, hsa
cugucaucuuuucgccuaccugaucuuucuuggaauaaaauaauauauccuuggggucaagauc

SEQ ID NO: 663720 - RNA, 64 nt, hsa
uuaguaauauauuagaauauacaaauauguguguauaaaauaaacauacacacacacacacacc

SEQ ID NO: 663721 - RNA, 64 nt, hsa
uguucuuguauugcuuucuuucaacaguuucaaaauaaaauaucauauaaauauugagggaaau

SEQ ID NO: 663722 - RNA, 64 nt, hsa
auucauauauuuuaugaaucagaauaaccuucaaauaaaauaaaucuaagucgguuaaaaugga

SEQ ID NO: 663723 - RNA, 64 nt, hsa
acauaaauauauuuuuauagaaaaacaaaucuacauaaaauaaaucuacuguuuagugagcagu

SEQ ID NO: 663724 - RNA, 64 nt, hsa
auguuucuucucauguaagaaauaaaaaauaaaaauaaaauaaaauauauugguauguaacuac

SEQ ID NO: 663725 - RNA, 64 nt, hsa
ucuucucauguaagaaauaaaaaauaaaaauaaaauaaaauauauugguauguaacuacaggaa

SEQ ID NO: 663726 - RNA, 64 nt, hsa
uugauugguuuuauaguucauugaaaauccucaaauaaaauauaauuauuacugaaauauguuu

SEQ ID NO: 663727 - RNA, 64 nt, hsa
ggauccuaguccuuuucauuaccugaugguagaaauaaaauaauugauuuuaaauuccuuugcu

SEQ ID NO: 663728 - RNA, 64 nt, hsa
aauagauggucacauugcugaacauaauucuaaaauaaaauauuggcacaaagaggugagauug

SEQ ID NO: 663729 - RNA, 64 nt, hsa
gauuuuuuucuauuuguaaaggauuaugaguuguauaaaauacauacucccuaaacuagaucau

SEQ ID NO: 663730 - RNA, 64 nt, hsa
uucuguuuuaugcaguugucauuuguaaagucuaauaaaauauucucuauaauugcuucuagau

SEQ ID NO: 663731 - RNA, 64 nt, hsa
ccucucugugccucaguuuucccaugcaugaaaaauaaaauaaaauaaaacggggauucuaaug

SEQ ID NO: 663732 - RNA, 64 nt, hsa
cugugccucaguuuucccaugcaugaaaaauaaaauaaaauaaaacggggauucuaauguuugu

SEQ ID NO: 663733 - RNA, 64 nt, hsa
auauaacuauauauauugccaucacacacgaacaauaaaauaaaguguucuauuaaccugaucu

SEQ ID NO: 663734 - RNA, 64 nt, hsa
ugggcaacauagugagaccuugucucuacaaaaaauaaaauaaaauaaaaaccaaauuagccag

SEQ ID NO: 663735 - RNA, 64 nt, hsa
aacauagugagaccuugucucuacaaaaaauaaaauaaaauaaaaaccaaauuagccagacaug

SEQ ID NO: 663736 - RNA, 64 nt, hsa
aagcuacaaauugagaaaaccguuauaaauaagaauaaaauaggccaggcacaguggcucacac

SEQ ID NO: 663737 - RNA, 64 nt, hsa
gacccugucuccaaaggaaaaacaaaaaagaagaauaaaauaauuuggaugaaaaucauguuua

SEQ ID NO: 663738 - RNA, 64 nt, hsa
uuuuuaccugauaauguaguaauaaguuguauucauaaaauacugaucuguguugcauuucaaa

SEQ ID NO: 663739 - RNA, 64 nt, hsa
cucucauuuuauucuuccauaauguauuucuacuauaaaauagaaucaacuuggguuauauuug

SEQ ID NO: 663740 - RNA, 64 nt, hsa
ucauagauccuuuucuuaaagaagaaaaacauguauaaaauaguuuuaguaguccaaaauguca

SEQ ID NO: 663741 - RNA, 64 nt, hsa
ggguacaaugauuacaaauuaaucuucuaacaaaauaaaauaugaaauauuagucauguuaauu

SEQ ID NO: 663742 - RNA, 64 nt, hsa
uuuucuaacaccauguguuagaaaauuauaaaaaauaaaauaauuuuagaaaguuuuguuguuc

SEQ ID NO: 663743 - RNA, 64 nt, hsa
auaaugacaauuuaugaauuuguguuucaaauugauaaaauauuuagguacaaauaacaagacu

SEQ ID NO: 663744 - RNA, 64 nt, hsa
uucauaacgucucuuggucacagaugccuuauauauaaaauaaguugccagaucucuaagauug

SEQ ID NO: 663745 - RNA, 64 nt, hsa
aacaauaaggcuuuuuagagcagacuuuguuggcauaaaauaaccuggcuucuaucccuaaccc

SEQ ID NO: 663746 - RNA, 64 nt, hsa
ccugucacuaacaaaauuaaaaaauaaaauaaauauaaaauauaggcuuuaaaaaagcauaguc

SEQ ID NO: 663747 - RNA, 64 nt, hsa
uaaagugagacccugucacuaacaaaauuaaaaaauaaaauaaauauaaaauauaggcuuuaaa

SEQ ID NO: 663748 - RNA, 64 nt, hsa
auuauuuaagaugguagcacuagucuuaaauuguauaaaauauccccuaacauguuuaaauguc

SEQ ID NO: 663749 - RNA, 64 nt, hsa
auuuuguuauauuuaauaauagaauuagauugaaauaaaauauaaugggaaauaaucugcagaa

SEQ ID NO: 663750 - RNA, 64 nt, hsa
guuuacuguacuauuucaaagcuucuaaauaaauauaaaauauauauauuauauuauauaauuu

SEQ ID NO: 663751 - RNA, 64 nt, hsa
uuuuuaaauggaugcauacaguccacaucauacaauaaaauaaaagguaauucagggucccaaa

SEQ ID NO: 663752 - RNA, 64 nt, hsa
gauauagaaacaucugaacugguaaagaauaacuauaaaauaugaaagcucuaaauuuaaaaua

SEQ ID NO: 663753 - RNA, 64 nt, hsa
uuccuuauugccucuucagaacccuuuagaaaguauaaaauauugccuccaacaugcugaaaaa

SEQ ID NO: 663754 - RNA, 64 nt, hsa
auaacaugauuacagucaacucuccauuaucuauauaaaauagugacuaagccucagguuuuua

SEQ ID NO: 663755 - RNA, 64 nt, hsa
uauguguacacauaaucauauuuaaguuuuuugcauaaaauaaaugcuucuagaugucauggca

SEQ ID NO: 663756 - RNA, 64 nt, hsa
uuguguuuccauauucuggcauuaguauaucaucauaaaauagacaauguuuuugucucaagaa

SEQ ID NO: 663757 - RNA, 64 nt, hsa
uaaggauaaauaaaaaauaaaguaguaauaaagaauaaaauacuuuacuaaaauauuguauggc

SEQ ID NO: 663758 - RNA, 64 nt, hsa
ggaguauuuucaauucucagauuauacauauguuauaaaauauguucauuaaagcucuuagauu

SEQ ID NO: 663759 - RNA, 64 nt, hsa
uccagccugggugacagagugagacugucucaaaauaaaauaaaaauaacauauuggugaagau

SEQ ID NO: 663760 - RNA, 64 nt, hsa
uucaugagcaacaguauauacacugaguaaaaauauaaaauaguaaaauuucacuaaauuuaga

SEQ ID NO: 663761 - RNA, 64 nt, hsa
ccucucauuuuuucacugcuaugauauauuuauuauaaaauagggaaugaaugaaugaauaugg

SEQ ID NO: 663762 - RNA, 64 nt, hsa
gacauucauaaaaacuuacauuguuuauuggaguauaaaauauuacccaaguuucuucaugagu

SEQ ID NO: 663763 - RNA, 64 nt, hsa
cauauauaaaaguauauuuauugacuguaauaaaauaaaauaugauguaaacaaaaaaaauuac

SEQ ID NO: 663764 - RNA, 64 nt, hsa
gauuucauauauaaaaguauauuuauugacuguaauaaaauaaaauaugauguaaacaaaaaaa

SEQ ID NO: 663765 - RNA, 64 nt, hsa
aucaaaauuuaugauuuacauucauaggaauaaaauaaaauauuauuagaacucugguaaaugu

SEQ ID NO: 663766 - RNA, 64 nt, hsa
aaaacaucaaaauuuaugauuuacauucauaggaauaaaauaaaauauuauuagaacucuggua

SEQ ID NO: 663767 - RNA, 64 nt, hsa
ucaaaguugaaaauucauaguaagauugauaucuauaaaauagauauaaauuuuuaagagaaag

SEQ ID NO: 663768 - RNA, 64 nt, hsa
uacaguccaaaauacuguucuuuccaggcuauguauaaaauacauagugaaaauuguuuaguga

SEQ ID NO: 663769 - RNA, 64 nt, hsa
cgugguaguauguuuuuauuaggagaauaaugcaauaaaauauguaaugucuuuuuuauaaagc

SEQ ID NO: 663770 - RNA, 64 nt, hsa
uagaauuuugcuguaauaaaguuucaaaauuugaauaaaauaauuaaauuuuuugaggaagugg

SEQ ID NO: 663771 - RNA, 64 nt, hsa
uuuggaaaacaggacuuaaaaugacauucaguauauaaaauauguacauaauauuggaugacua

SEQ ID NO: 663772 - RNA, 64 nt, hsa
augccaaauucuuauuuuuuaaaaagcuaguucuauaaaauacugguauuauggguggggagga

SEQ ID NO: 663773 - RNA, 64 nt, hsa
gccgagauugcaccacugcacuccagcuugggugauaaaauaaaauaaaauagucgugaaucuu

SEQ ID NO: 663774 - RNA, 64 nt, hsa
gauugcaccacugcacuccagcuugggugauaaaauaaaauaaaauagucgugaaucuuguuca

SEQ ID NO: 663775 - RNA, 64 nt, hsa
caccacugcacuccagcuugggugauaaaauaaaauaaaauagucgugaaucuuguucaaaaug

SEQ ID NO: 663776 - RNA, 64 nt, hsa
accuuauauuuuauuuuugccaaaauauuuuauuauaaaauaugaccaaaauauuuaaaaugca

SEQ ID NO: 663777 - RNA, 64 nt, hsa
uaauaggaaauauauaauaauagcauuuuauguaauaaaauaugggcaacgauuaucuuggaaa

SEQ ID NO: 663778 - RNA, 64 nt, hsa
caagauucaaacagcuuuaaacacuuccaaugagauaaaauauuuacuauuaugcuuauuagaa

SEQ ID NO: 663779 - RNA, 64 nt, hsa
aaaaauuguuuuuuuaauuuucuauauuauaaacauaaaauaaguaaugagcacuuucuacuca

SEQ ID NO: 663780 - RNA, 64 nt, hsa
acaauuaugaauuacaugcucagcuauauauguaauaaaauacuuuggucuguggaaauauugu

SEQ ID NO: 663781 - RNA, 64 nt, hsa
aaguucuauuuucccuguauugguaucuccuuaaauaaaauaaaauauuccuauuguaagugau

SEQ ID NO: 663782 - RNA, 64 nt, hsa
cuauuuucccuguauugguaucuccuuaaauaaaauaaaauauuccuauuguaagugauaugag

SEQ ID NO: 663783 - RNA, 64 nt, hsa
ccagccugggcaauaagagcaaaacuccaucaaaauaaaauaaaauaaaauauaaaauaacuua

SEQ ID NO: 663784 - RNA, 64 nt, hsa
cugggcaauaagagcaaaacuccaucaaaauaaaauaaaauaaaauauaaaauaacuuaaaaag

SEQ ID NO: 663785 - RNA, 64 nt, hsa
caauaagagcaaaacuccaucaaaauaaaauaaaauaaaauauaaaauaacuuaaaaagaacuu

SEQ ID NO: 663786 - RNA, 64 nt, hsa
agcaaaacuccaucaaaauaaaauaaaauaaaauauaaaauaacuuaaaaagaacuuugaauaa

SEQ ID NO: 663787 - RNA, 64 nt, hsa
ggaugucuagauuauauagguuuagguugaaguuauaaaauaaaauaaaauucauuuuccacug

SEQ ID NO: 663788 - RNA, 64 nt, hsa
ucuagauuauauagguuuagguugaaguuauaaaauaaaauaaaauucauuuuccacuggaacu

SEQ ID NO: 663789 - RNA, 64 nt, hsa
uucaauaaguguuguaccauauguagcauuaaauauaaaauacauaaaagaauguacagaaaau

SEQ ID NO: 663790 - RNA, 64 nt, hsa
caccaauaucauguguagauauuauguauagaaaauaaaauaaauuauggcucuaacuucugug

SEQ ID NO: 663791 - RNA, 64 nt, hsa
cuuagagcuuguuuauggaagauucaagaaaacuauaaaauacuuaaagauauauaaauuuaaa

SEQ ID NO: 663792 - RNA, 64 nt, hsa
uucccccacagagugccuagaaucuuaauaaugaauaaaauaaaaagcagcaauaugucauuaa

SEQ ID NO: 663793 - RNA, 64 nt, hsa
ccggacaaguuuauaucaaguuaaauguaaauggauaaaauaaaaucauuuucaguaugugaua

SEQ ID NO: 663794 - RNA, 64 nt, hsa
ucugacccauuuugauaagucuuuauaaggaagaauaaaauaaacguguaagcaaaauuuucuu

SEQ ID NO: 663795 - RNA, 64 nt, hsa
auguuauuuaauucaucuaaugcuacacaaaagcauaaaauaaugauuuuucacucucuuuaaa

SEQ ID NO: 663796 - RNA, 64 nt, hsa
aaaauguuuguaaaagcucaaacaugacgauuccauaaaauaaacuugagguuaaauaaugggu

SEQ ID NO: 663797 - RNA, 64 nt, hsa
cagccaguggcuguggucuacagaauuguuucauauaaaauacggguagagugguagaguuuca

SEQ ID NO: 663798 - RNA, 64 nt, hsa
gcacugauaaaaccgcaacaaaaacauguaagaaauaaaauagaaaugcuuuauauaauuuagu

SEQ ID NO: 663799 - RNA, 64 nt, hsa
caguuaauaguaugaucuuuaaaguuuugacaauauaaaauaaacuugguaacuguuuuacaaa

SEQ ID NO: 663800 - RNA, 64 nt, hsa
uguauuuauuguuaauucuuaaaauaguguguaaauaaaauaacaucagugugcuuuaaagaaa

SEQ ID NO: 663801 - RNA, 64 nt, hsa
aacccuuaacuugugccuagaaacuacagcacauauaaaauauguaaacaccagccuguugcug

SEQ ID NO: 663802 - RNA, 64 nt, hsa
uagguacaaacuuuauaaagaauguuaguaugucauaaaauauaacauuacagcuuauuuaaaa

SEQ ID NO: 663803 - RNA, 64 nt, hsa
aaguaacugaaauacuuuuaccuuucuguccuugauaaaauaguaaagaaaaccaaacaaaccc

SEQ ID NO: 663804 - RNA, 64 nt, hsa
ccauucagaaacaaaaauuagcacuaaauuuuuuauaaaauagaccagaugacaaaauuuauuu

SEQ ID NO: 663805 - RNA, 64 nt, hsa
guuuauauuaauauaguuuuuuucucccuuuuuaauaaaauaauuacagucaucccucaguguc

SEQ ID NO: 663806 - RNA, 64 nt, hsa
gugacaaagcaagacugugucucaaaauaaauaaauaaaauaaaauaaaaugacguacagagau

SEQ ID NO: 663807 - RNA, 64 nt, hsa
aaagcaagacugugucucaaaauaaauaaauaaaauaaaauaaaaugacguacagagauucuau

SEQ ID NO: 663808 - RNA, 64 nt, hsa
aaaauauuacauucaugauuauuuuauuuaguaaauaaaauaauagagagcccagaaaucaacc

SEQ ID NO: 663809 - RNA, 64 nt, hsa
uuguauuauauagguugaaauuaaagaugaauaaauaaaauaaaaugacacaaggccaaaaaca

SEQ ID NO: 663810 - RNA, 64 nt, hsa
uuuauaauuuaaucuguuuaaaucaucaggucuuauaaaauauaauguacuuagagcuggauuc

SEQ ID NO: 663811 - RNA, 61 nt, hsa
aucuacuuacagaaaaguaaaugagacauagauaaaauaaaaucacacugacauguuuuug

SEQ ID NO: 663812 - RNA, 64 nt, hsa
uuucauuucauugcaaaggcaguauaaaagauauauaaaauagcauaauaugagaaauuaaguc

SEQ ID NO: 663813 - RNA, 64 nt, hsa
auucuguaaagccacuugucugugugacacugagauaaaauaggucuuuguuauuuucaacugu

SEQ ID NO: 663814 - RNA, 64 nt, hsa
gaagaugaucauauuucauuuugcagauguggccauaaaauauuauuuacuucuauauagguga

SEQ ID NO: 663815 - RNA, 64 nt, hsa
acaacucauaaauaauuucuuaacccauauaaggauaaaauaauaccauugauauucuuguuua

SEQ ID NO: 663816 - RNA, 64 nt, hsa
uuauauggaaagaugucaacuauagccauaaccaauaaaauaaaaacugaugaggcaugcagcu

SEQ ID NO: 663817 - RNA, 64 nt, hsa
auuauuuauuguaaaaaaaguuuccuuagaagucauaaaauauuuugaaauuuagagaggaauu

SEQ ID NO: 663818 - RNA, 64 nt, hsa
auucucuauuugaauuauuucugucacaguaaaaauaaaauacuuugaguuuugagcuacugga

SEQ ID NO: 663819 - RNA, 64 nt, hsa
aguuugaaaagcaauauuguauauuuuuaucuauauaaaauaacuaaaauguaucuaagaauaa

SEQ ID NO: 663820 - RNA, 64 nt, hsa
uaaggcugcaugauagcauuccuauauuucucucauaaaauaggauuugaaggaugaaauuaau

SEQ ID NO: 663821 - RNA, 64 nt, hsa
uuuuauuugaauuguaaaauauuuaaaaguaugaauaaaauauauuuauagguauuuaucagag

SEQ ID NO: 663822 - RNA, 64 nt, hsa
gguauuugggagcuggauucuugucaacugcuguauaaaauauacucacaaaaccauugcagaa

SEQ ID NO: 663823 - RNA, 64 nt, hsa
ucuagagauaacuauuaacaguauucuuucaaacauaaaauaauaagauaauugggagcugagc

SEQ ID NO: 663824 - RNA, 64 nt, hsa
auuguuuaaccuuagagagaccauuaaauuauuuauaaaauauuuuguaauuaccuguagcuaa

SEQ ID NO: 663825 - RNA, 64 nt, hsa
ccuggauaacagagcgagacccugucucaaaaaaauaaaauaaaaaauaaaaacacccuugccu

SEQ ID NO: 663826 - RNA, 64 nt, hsa
uuaugugcuggccuuggccuauuggugaaaugguauaaaauaucauaugcaguuuuaaaacuuu

SEQ ID NO: 663827 - RNA, 64 nt, hsa
uuaaauuuuccuuacaauaaagcacacuuuuauaauaaaauacaugaauuauuguuuuucauac

SEQ ID NO: 663828 - RNA, 64 nt, hsa
acucguuuuguaauaauugcuguauuucuguguaauaaaauauaaaaauaaaauauucaguggu

SEQ ID NO: 663829 - RNA, 64 nt, hsa
uaauugcuguauuucuguguaauaaaauauaaaaauaaaauauucagugguauucaacaucaaa

SEQ ID NO: 663830 - RNA, 64 nt, hsa
cuuuaaacccauaaauuaauuuuauaucaauaaaauaaaauacuuucucuaguuuuggagcuuc

SEQ ID NO: 663831 - RNA, 64 nt, hsa
uauaccuuuaaacccauaaauuaauuuuauaucaauaaaauaaaauacuuucucuaguuuugga

SEQ ID NO: 663832 - RNA, 64 nt, hsa
aauuacaguuuugugauauaaaauaaagcugaguauaaaauaaaaccaaucaaacacagaauuu

SEQ ID NO: 663833 - RNA, 64 nt, hsa
aaauaaccuuauaccugaauuacaguuuugugauauaaaauaaagcugaguauaaaauaaaacc

SEQ ID NO: 663834 - RNA, 64 nt, hsa
auguagcuuguccaaauugagaugugcugucaguauaaaauacauaccagauuuuaaagaugua

SEQ ID NO: 663835 - RNA, 64 nt, hsa
aucauggcuuucuacaguauuucuauuguuuaacauaaaauaguuugccaaagaaguuucugaa

SEQ ID NO: 663836 - RNA, 64 nt, hsa
uuaauuugcacacccuguacacacagaaaaugguauaaaauaugagaacgaaguuuaaaauugu

SEQ ID NO: 663837 - RNA, 64 nt, hsa
cauagaacuauacuaaucuucucacaaaaggucuauaaaauacagucguugaaaaaaauuuugu

SEQ ID NO: 663838 - RNA, 64 nt, hsa
gccaaaugcauauaaaucuugauaaacaaagucuauaaaauaaaacaugggacauuagcuuugg

SEQ ID NO: 663839 - RNA, 64 nt, hsa
auauuaaauucugauauugcacuucuuauuuuauauaaaauaauccuuuaauauccaaaugaau

SEQ ID NO: 663840 - RNA, 64 nt, hsa
acacacacguauacacacacacaguuuauuuuuaauaaaauaggauuauaccacacacauccug

SEQ ID NO: 663841 - RNA, 64 nt, hsa
gcucuuacuucaaaauuaguccaaaauguuggaaauaaaauauaagacauugaucuagauauga

SEQ ID NO: 663842 - RNA, 64 nt, hsa
auagguaaacaaagaaaugacaaaaauaaaauaaauaaaauaaaaauggauagguggugaccca

SEQ ID NO: 663843 - RNA, 64 nt, hsa
uaaaaaaggauagguaaacaaagaaaugacaaaaauaaaauaaauaaaauaaaaauggauaggu

SEQ ID NO: 663844 - RNA, 64 nt, hsa
cuguuuuuaucaagaagggaaauauauuugaaauauaaaauauuaaaauuaugcucauuucuau

SEQ ID NO: 663845 - RNA, 64 nt, hsa
cauugauaacugacagauaucucauagcauuaacauaaaauaccagaaacaaacuuuaucuccc

SEQ ID NO: 663846 - RNA, 64 nt, hsa
auuuuuaaacuuuuauauuguacacuauuuuugcauaaaauaagagcuguagcuaccaaauacu

SEQ ID NO: 663847 - RNA, 64 nt, hsa
caaauugcuuacuuuggaauacauuucuccuuugauaaaauaaaugagcuauguauuaacacug

SEQ ID NO: 663848 - RNA, 64 nt, hsa
auaucuguauuuaauuuugacacuauaucuguauauaaaauauuuucauacagcauuacaaauu

SEQ ID NO: 663849 - RNA, 64 nt, hsa
ugacaugaaaaaaggacaauuucaaaaaaauaaaauaaaauaaaaauaaauucaccuagucuaa

SEQ ID NO: 663850 - RNA, 64 nt, hsa
uguuuugacaugaaaaaaggacaauuucaaaaaaauaaaauaaaauaaaaauaaauucaccuag

SEQ ID NO: 663851 - RNA, 64 nt, hsa
auuuggaaccaugcgagugauaccuauuuauaaaauaaaauaaaccaagcacaaguacgaacuu

SEQ ID NO: 663852 - RNA, 64 nt, hsa
accgcauuuggaaccaugcgagugauaccuauuuauaaaauaaaauaaaccaagcacaaguacg

SEQ ID NO: 663853 - RNA, 64 nt, hsa
cguaacuugcgaaucuguuuacccucacuugcaaauaaaauaagugcaaauaaagcaaugauua

SEQ ID NO: 663854 - RNA, 64 nt, hsa
ugugcuguagucauacaauuggauaaagcauaauauaaaauaaggcacaauugcuauaugaaac

SEQ ID NO: 663855 - RNA, 64 nt, hsa
auuauaaaacuguuauggugucuucaaagacuugauaaaauaacacugagagagaauuggucca

SEQ ID NO: 663856 - RNA, 64 nt, hsa
auugauguucauauuguguaaaauaacucauuuaauaaaauaguacuuugauuuacgacaucac

SEQ ID NO: 663857 - RNA, 64 nt, hsa
aauacuauuuccaaacucauauuacaaaaacaaaauaaaauaauaaaaaaagaaagcaugauau

SEQ ID NO: 663858 - RNA, 64 nt, hsa
gucuauaaaagaaacacuuugaagucuauaaaaaauaaaauaauuauaaauaucauuguacaua

SEQ ID NO: 663859 - RNA, 64 nt, hsa
cugggugacagagugagacucugucucaaaaaaaauaaaauaaaaagucaauuuagaaugugaa

SEQ ID NO: 663860 - RNA, 64 nt, hsa
auugaugguuguauaagaacuagcucauguaaaaauaaaauaacauuauuacauugccucaaaa

SEQ ID NO: 663861 - RNA, 64 nt, hsa
uuuccuugccugacaguauuuuugaauuauuuauauaaaauaucuaucuuuucaucaugucuau

SEQ ID NO: 663862 - RNA, 64 nt, hsa
auuuaccaacuuuauugaaaauguuguuacaucaauaaaauagcaugcugggaaccugagaagg

SEQ ID NO: 663863 - RNA, 64 nt, hsa
uuauauaucuuuucuccuaaauggagaauuuugaauaaaauauauuugaaauuuugccucuuuc

SEQ ID NO: 663864 - RNA, 64 nt, hsa
guuuucuuaaugcguuuggaccauuuugcuggcuauaaaauaacugauuaauauaauucuaaca

SEQ ID NO: 663865 - RNA, 64 nt, hsa
aguuguaggaugcagggcuaaauugcaaaauaaaauaaaauagccagcguacacaaugagauau

SEQ ID NO: 663866 - RNA, 64 nt, hsa
ucaagaguuguaggaugcagggcuaaauugcaaaauaaaauaaaauagccagcguacacaauga

SEQ ID NO: 663867 - RNA, 64 nt, hsa
augcgucccaagauguugauuuuuacuguguuuuauaaaauagaguguaguuuacagaaaaaga

SEQ ID NO: 663868 - RNA, 64 nt, hsa
uuccuacguaggaugaaaagauucuucuguguuuauaaaauauaaacaaagauucaugauuuau

SEQ ID NO: 663869 - RNA, 64 nt, hsa
auauaauagaaaaauauuuuauuuguauuguuguauaaaauauuuacaaucauauagaauauau

SEQ ID NO: 663870 - RNA, 64 nt, hsa
uuuaugaaggacauuauucugauucauaaaaguuauaaaauauuagguaaauacagagaaaaca

SEQ ID NO: 663871 - RNA, 64 nt, hsa
uuuacaaaaaugaaaauaauaaacauguuuucguauaaaauaacacaaaaugauauacacugaa

SEQ ID NO: 663872 - RNA, 64 nt, hsa
uugguaaccagaaauguaaaauuucaaauaacggauaaaauaauguguuauuuuuauagagaaa

SEQ ID NO: 663873 - RNA, 64 nt, hsa
ccucucacauucaaguauuagcaacuugcaguauauaaaauaguuagauaaugagaaguuguua

SEQ ID NO: 663874 - RNA, 64 nt, hsa
cagaagagucaaaugcuucuaaugucucaaggugauaaaauacaaaaacuaaguagacagauau

SEQ ID NO: 663875 - RNA, 64 nt, hsa
acaugucaugaacccauguuugcaaucaaagaugauaaaauagauucuuauuuuucccccaccc

SEQ ID NO: 663876 - RNA, 64 nt, hsa
auggaggauuuuuuugccccuuguguuuggaauuauaaaauauagguaaaaguacguaauuaaa

SEQ ID NO: 663877 - RNA, 64 nt, hsa
gggaaggauuuaaggaggugaagucgggucaaaaauaaaauauauauacauauauacauugcuu

SEQ ID NO: 663878 - RNA, 64 nt, hsa
gagaagguuacugagugaguuauugggagucuuaauaaaauaaacuagauauuagguccauuca

SEQ ID NO: 663879 - RNA, 64 nt, hsa
caaauaauaauaauauuaauaauaauaaagagaaauaaaauaauaaaauaaaaaacaauagcac

SEQ ID NO: 663880 - RNA, 64 nt, hsa
aauaauauuaauaauaauaaagagaaauaaaauaauaaaauaaaaaacaauagcacagcccuug

SEQ ID NO: 663881 - RNA, 64 nt, hsa
uacaguuucaaaaggaagacucaugagaaauuucauaaaauacaaguuuuuagauguuuaugcu

SEQ ID NO: 663882 - RNA, 64 nt, hsa
aggaaaaagaguguuaauaccaugaugcauuaacauaaaauaucaaacacacaaagucauaaaa

SEQ ID NO: 663883 - RNA, 64 nt, hsa
aguaucuuuauuccuuuauuaacuuagggcagauauaaaauaaaggauaauauaugacaaauuc

SEQ ID NO: 663884 - RNA, 64 nt, hsa
uaaauuagaaaaauuugguaaaauauaugcaacuauaaaauaucagagaaauaacaauuucuac

SEQ ID NO: 663885 - RNA, 64 nt, hsa
agauuuauuagagggagcauggccauaaaauaaaauaaaauaaaauuuagauuuaagucgagcu

SEQ ID NO: 663886 - RNA, 64 nt, hsa
aauuuagauuuauuagagggagcauggccauaaaauaaaauaaaauaaaauuuagauuuaaguc

SEQ ID NO: 663887 - RNA, 64 nt, hsa
uuuaaaauuuagauuuauuagagggagcauggccauaaaauaaaauaaaauaaaauuuagauuu

SEQ ID NO: 663888 - RNA, 64 nt, hsa
uauaugauuguaaauauuuuauacaacaauacaaauaaaauauuuuucuauuauauuuauuaug

SEQ ID NO: 663889 - RNA, 64 nt, hsa
ucuuugucuauaacugacagauguuuauauuaaaauaaaauauuguauuaaaaauuuaaaauag

SEQ ID NO: 663890 - RNA, 64 nt, hsa
uaucuguugucuaggggaugaauuuuaaguuacaauaaaauauuuuucuuuguuuugcaucagu

SEQ ID NO: 663891 - RNA, 64 nt, hsa
uaccucauucuuuagucccugucaagguuaguaaauaaaauaagugacauaaaaaaaaaaaaaa

SEQ ID NO: 663892 - RNA, 64 nt, hsa
ggugacgauugccacucauaaaauaaaggauuuuauaaaauaccuuccuacuguguauguagga

SEQ ID NO: 663893 - RNA, 64 nt, hsa
uauguguuggguagggaggugacgauugccacucauaaaauaaaggauuuuauaaaauaccuuc

SEQ ID NO: 663894 - RNA, 64 nt, hsa
ucuaauguauuuuguuaguugcuuagaaauggaaauaaaauauaugugcuuauuaaauaaugca

SEQ ID NO: 663895 - RNA, 64 nt, hsa
uacaugaauauauauauauucauguaucuuguauauaaaauauaggcauauaccucauauauac

SEQ ID NO: 663896 - RNA, 64 nt, hsa
uuuugaccuugaaagaugaauuccuucaagaaaaauaaaauaaugcuuaagauaauguguacga

SEQ ID NO: 663897 - RNA, 64 nt, hsa
agcuuggcaguacguucuuugacuuaaggauggcauaaaauaaucauuuuugaaccuguguaau

SEQ ID NO: 663898 - RNA, 64 nt, hsa
gggcuacagagagcaagacucugucucaaaaaaaauaaaauaaaauaaauaaaaaaagauauag

SEQ ID NO: 663899 - RNA, 64 nt, hsa
acagagagcaagacucugucucaaaaaaaauaaaauaaaauaaauaaaaaaagauauaguauua

SEQ ID NO: 663900 - RNA, 64 nt, hsa
ugggaaaugggggaucuucaauguuuauuuuaaaauaaaauaaaauaaguucuugacuuuucuc

SEQ ID NO: 663901 - RNA, 64 nt, hsa
aaugggggaucuucaauguuuauuuuaaaauaaaauaaaauaaguucuugacuuuucucaugug

SEQ ID NO: 663902 - RNA, 64 nt, hsa
acaaccauauguuaccuguaucuuaggggaauggauaaaauauuugugguuuacuggguaaucc

SEQ ID NO: 663903 - RNA, 64 nt, hsa
auagucuuugaauucauuuauuuuaaauaaaugaauaaaauaaaauaaaaaagaauauucaguc

SEQ ID NO: 663904 - RNA, 64 nt, hsa
cuuugaauucauuuauuuuaaauaaaugaauaaaauaaaauaaaaaagaauauucagucguugg

SEQ ID NO: 663905 - RNA, 64 nt, hsa
ucaagaaaaaauucugugaauuaagauguaauuuauaaaauaacauuucaauggggguaaacag

SEQ ID NO: 663906 - RNA, 64 nt, hsa
cagccugggcaauguagcaagaccccaucucuauauaaaauauaaaaauguuggcugugcacgg

SEQ ID NO: 663907 - RNA, 64 nt, hsa
acagagcaagacuccgucucacaaaaaugaauaaauaaaauaaaaauaaaaauguuacuuuuua

SEQ ID NO: 663908 - RNA, 64 nt, hsa
agccucaaaucuaagagggcuucccauccuagauauaaaauagguguugccuauugcugugcuu

SEQ ID NO: 663909 - RNA, 64 nt, hsa
cauccuccuuucccucucugagaaugaacuauguauaaaauaagcuucugccuauuugcauuua

SEQ ID NO: 663910 - RNA, 64 nt, hsa
agaaaauagagugaggcuuuuuuaccguauauacauaaaauacuuaugaaaauuagaagauaau

SEQ ID NO: 663911 - RNA, 64 nt, hsa
gggcaggaguauucuggaaucuuuuuacuuagauauaaaauaaaccucgaauauuaaaaaguug

SEQ ID NO: 663912 - RNA, 64 nt, hsa
uauucaaacauuagauuugaaagaguaauaguuuauaaaauaaggaaguaacaugugaggcucu

SEQ ID NO: 663913 - RNA, 64 nt, hsa
augcauacugucauuugcaggcugucauuugagcauaaaauauuuucagauauuuuccagggug

SEQ ID NO: 663914 - RNA, 64 nt, hsa
gguaaaaugagugaucucaaauccacugacagauauaaaauaggcuuagagaggaaaagcugcc

SEQ ID NO: 663915 - RNA, 64 nt, hsa
ucccuuugcuucccaaccuaaaauuucaaguuuaauaaaauagcaauuagcagaagugaccaaa

SEQ ID NO: 663916 - RNA, 64 nt, hsa
uguauuagaaaauuagcgugacuucucauuuuaaauaaaauauuuuaggaauucuaaacaucua

SEQ ID NO: 663917 - RNA, 64 nt, hsa
ggaccuuaagaaacuauuuacucuguaaucucuaauaaaauauggaauuccauauuagggcaau

SEQ ID NO: 663918 - RNA, 64 nt, hsa
auaggcuauuuucuaaagacuuguauagcaugaaauaaaauauaucuuauaaaguggaaguaug

SEQ ID NO: 663919 - RNA, 64 nt, hsa
gcauauaaugaauaaaucauucuuacuaaaaaguauaaaauaguaugaaaauggaaauuuggga

SEQ ID NO: 663920 - RNA, 64 nt, hsa
gaauggaaucuucuccaguaugaaauuaccagauauaaaauaauguaaugaugcugaggauaua

SEQ ID NO: 663921 - RNA, 64 nt, hsa
caaccccggaaaacauugcuuuugaaaacugcugauaaaauaugagccgguuauuacuucuguu

SEQ ID NO: 663922 - RNA, 64 nt, hsa
ugcuucaaaauuagcauauuuuaaguuuaccaguauaaaauaccaaugcaacuacucuacauag

SEQ ID NO: 663923 - RNA, 64 nt, hsa
uuuaguuguuuaaauaaguaauauuuucaaaagaauaaaauaaccaaugauaucucuuggaaua

SEQ ID NO: 663924 - RNA, 64 nt, hsa
aauaauuuuggaagcugugaagauaaaauaccaaauaaaauaauauaaaagugauuuauaugaa

SEQ ID NO: 663925 - RNA, 64 nt, hsa
aaauaaaugauaaauaauuuuggaagcugugaagauaaaauaccaaauaaaauaauauaaaagu

SEQ ID NO: 663926 - RNA, 64 nt, hsa
accuuggaaaugcaggaacuuauaugaauguacuauaaaauaaaaugcggacugauucccagga

SEQ ID NO: 663927 - RNA, 64 nt, hsa
cugcugcuggggggcuuuuuucagggguuguauuauaaaauaugcacuggcugugguuuuucau

SEQ ID NO: 663928 - RNA, 64 nt, hsa
aguauagccccacuuauacuauguaaaauuaccaauaaaauauuuuuaugacuacagauuuugc

SEQ ID NO: 663929 - RNA, 64 nt, hsa
uacauucaugcacaauccauaauuugaguuuuacauaaaauagaaauuuguuagaauuuguuag

SEQ ID NO: 663930 - RNA, 64 nt, hsa
uuguaaauaccuauaaaauaaauuauaaauaccuauaaaauauaaaguaacauagcucuaaaag

SEQ ID NO: 663931 - RNA, 64 nt, hsa
gcuuuaucccaaucuggauaaauuguaaauaccuauaaaauaaauuauaaauaccuauaaaaua

SEQ ID NO: 663932 - RNA, 64 nt, hsa
aaccguugguccauuuuugucuguuucuaugaagauaaaauaauugggggccaucuagaaauag

SEQ ID NO: 663933 - RNA, 64 nt, hsa
agaauggaagauaaugcagauauuucugugggaaauaaaauaacuaauuuugagguaccaaaua

SEQ ID NO: 663934 - RNA, 64 nt, hsa
gaacuuuauucagaagcaguuaucaauaaauuccauaaaauaaugucauugguauuuaaaaaug

SEQ ID NO: 663935 - RNA, 64 nt, hsa
auuuguuguaaacugcauguuuuauaaaauaaaaauaaaauaucguuuguuauuuaucucauua

SEQ ID NO: 663936 - RNA, 64 nt, hsa
auuuuuuaaaaauuuguuguaaacugcauguuuuauaaaauaaaaauaaaauaucguuuguuau

SEQ ID NO: 663937 - RNA, 64 nt, hsa
agucuuaguugguuuagggucucaauuuuaauuaauaaaauacuugguuuuuauuugcuugucc

SEQ ID NO: 663938 - RNA, 64 nt, hsa
gagcaagacucugucucaaaaaaaaaaaauaauaauaaaauaagugagcugaacucaccugaag

SEQ ID NO: 663939 - RNA, 64 nt, hsa
auauacagaauaauacacacaguugugugugcauauaaaauacauauuuacgccaggcguggug

SEQ ID NO: 663940 - RNA, 64 nt, hsa
acaagagcaaaacuccgucucaaaaaagaugaaaauaaaauaaaauauauauuuacaggccuac

SEQ ID NO: 663941 - RNA, 64 nt, hsa
agcaaaacuccgucucaaaaaagaugaaaauaaaauaaaauauauauuuacaggccuacaacuu

SEQ ID NO: 663942 - RNA, 64 nt, hsa
cuccgaacaauuccuuuacuacgaaguauaauuuauaaaauaaaauauacccauuuuaagggua

SEQ ID NO: 663943 - RNA, 64 nt, hsa
aacaauuccuuuacuacgaaguauaauuuauaaaauaaaauauacccauuuuaaggguacaguu

SEQ ID NO: 663944 - RNA, 64 nt, hsa
guuagugggaagaauaugguaaauuuuuuguuaaauaaaauagacccuuauguuuagcauuuug

SEQ ID NO: 663945 - RNA, 64 nt, hsa
uagagaacuauucugguacuaucagaacaaauacauaaaauaacuucccauagagaacaggaua

SEQ ID NO: 663946 - RNA, 64 nt, hsa
agauuucaccauuugauuguauaaucuuuuaccuauaaaauauuuauuugaaguagaggguaaa

SEQ ID NO: 663947 - RNA, 64 nt, hsa
aucagcgguaagaacagugaacacagugguugggauaaaauaaggugacaaacaucacaccaaa

SEQ ID NO: 663948 - RNA, 64 nt, hsa
aauguaugugauuuuguuauacuucuuaauuuaaauaaaauauuuaaugcacuauuaaaauaau

SEQ ID NO: 663949 - RNA, 64 nt, hsa
cauauagaaaucuagaauuuuuacuuagauacuaauaaaauacauuuagaaacuuuuaaaguca

SEQ ID NO: 663950 - RNA, 64 nt, hsa
ugaucuggcagacucauugcagcaggugguaaugauaaaauacuaaacuacauuuuauuuuugu

SEQ ID NO: 663951 - RNA, 64 nt, hsa
uguguaaugcaaauuucauaguaauaguaacuuuauaaaauaauauuauaaaauacaggauuua

SEQ ID NO: 663952 - RNA, 64 nt, hsa
uuucauaguaauaguaacuuuauaaaauaauauuauaaaauacaggauuuaaaccuuucuaaau

SEQ ID NO: 663953 - RNA, 64 nt, hsa
aauuauugccuuuguuguuguauuacaaaucugcauaaaauaccucauuucaaaucaaaucuua

SEQ ID NO: 663954 - RNA, 64 nt, hsa
ugucagggagcccccaggccgcagguggagggugauaaaauauguucucugacaggacccagcc

SEQ ID NO: 663955 - RNA, 64 nt, hsa
acugcuagcuugcaaaguuaugagaguuuaaaaaauaaaauauaugaaaauauguaaagcuguu

SEQ ID NO: 663956 - RNA, 64 nt, hsa
guuuaaaaaguauucuaucuuaaggccaacuaauauaaaauaccauuguuaaagaaugguacuu

SEQ ID NO: 663957 - RNA, 64 nt, hsa
uggucuuuuggaugagggaauaaugcauuuuuaaauaaaauaccaauaucaggaagccauuuuu

SEQ ID NO: 663958 - RNA, 64 nt, hsa
aggcugccauaauauauuuuuuuaauuuggcaggauaaaauauugcaaaaaaaacacauuugua

SEQ ID NO: 663959 - RNA, 64 nt, hsa
uggcauucacaauacuggcacuauaaagaacaaaauaaaauaauaauuuauaggacaguuuuuc

SEQ ID NO: 663960 - RNA, 64 nt, hsa
aaaaaaauucucaaaaaaacuauuaugaaagucaauaaaauagauaauuuaacaaaaguacagg

SEQ ID NO: 663961 - RNA, 64 nt, hsa
uacagaaauuuaaauagaaauaguguauauacauauaaaauacaagcuauguuaggaccaaaug

SEQ ID NO: 663962 - RNA, 64 nt, hsa
caggaccagccuagagagaucccaucucuaaaaaauaaaauauaagaaaauaaaacuuagggga

SEQ ID NO: 663963 - RNA, 64 nt, hsa
ugaaugucuuuuugguuguaauuuaacaagucaaauaaaauaaucauugcugagcacaaucaca

SEQ ID NO: 663964 - RNA, 64 nt, hsa
auuuauggguacaacguauguucauuauuuguacauaaaauaaaaccauuuaaaaaguaaugcu

SEQ ID NO: 663965 - RNA, 64 nt, hsa
uaauggcaaaaauucauggcuagugauguauaaaauaaaauauucuuugcaguaaaauauuccc

SEQ ID NO: 663966 - RNA, 64 nt, hsa
guaacuaauggcaaaaauucauggcuagugauguauaaaauaaaauauucuuugcaguaaaaua

SEQ ID NO: 663967 - RNA, 64 nt, hsa
ugucgcuauuuaaguuaaauuuaaaugaaauaaaauaaaauaaaaucaguuccugagucacaca

SEQ ID NO: 663968 - RNA, 64 nt, hsa
ccaagugucgcuauuuaaguuaaauuuaaaugaaauaaaauaaaauaaaaucaguuccugaguc

SEQ ID NO: 663969 - RNA, 64 nt, hsa
gugaugaggaaaucccuaaacaaaauuaguugccauaaaauaugacaacugcuuuaugguuucu

SEQ ID NO: 663970 - RNA, 64 nt, hsa
uguaaacauucaauguauauuguauagucaguguauaaaauaacacuuuuagacucuaaauauu

SEQ ID NO: 663971 - RNA, 64 nt, hsa
cuugggcaauagcaagacuccaucucaaaauaaaauaaaauaaaacuuagagcaaaguuuaaaa

SEQ ID NO: 663972 - RNA, 64 nt, hsa
uccagcuugggcaauagcaagacuccaucucaaaauaaaauaaaauaaaacuuagagcaaaguu

SEQ ID NO: 663973 - RNA, 64 nt, hsa
uucacaaguuuugggccaccuauuucaauaaaaaauaaaauauaaauuaaaaaaguugccgggg

SEQ ID NO: 663974 - RNA, 64 nt, hsa
uaauacaguaaacugaaagaguauauagauagcaauaaaauaacauaaguggacauguuuauag

SEQ ID NO: 663975 - RNA, 64 nt, hsa
ucuuucugggccuuacugugcugguauaauuaaaauaaaauauauuuuguucuauugguagguu

SEQ ID NO: 663976 - RNA, 64 nt, hsa
aauguaauuuuaugucugcuuuaaggaaaauaaaauaaaauauuaauaggaguugugagccuga

SEQ ID NO: 663977 - RNA, 64 nt, hsa
uuccaaauguaauuuuaugucugcuuuaaggaaaauaaaauaaaauauuaauaggaguugugag

SEQ ID NO: 663978 - RNA, 64 nt, hsa
uguauguaaccauuuggcaaaaguaugcaggaacauaaaauaaaauauccuuuagcucagaaau

SEQ ID NO: 663979 - RNA, 64 nt, hsa
guaaccauuuggcaaaaguaugcaggaacauaaaauaaaauauccuuuagcucagaaauucuau

SEQ ID NO: 663980 - RNA, 64 nt, hsa
uaggucaguaauuuaaaccuuggaucuucaaaaaauaaaauaaugugaagcaaaaccaacuaaa

SEQ ID NO: 663981 - RNA, 64 nt, hsa
uucauuauuuuaggacgccaacaugagaccuguaauaaaauauguaaugggguugaaagcuggg

SEQ ID NO: 663982 - RNA, 64 nt, hsa
ggcuagcuuguuuucaaauuuuaaaaguuuaaaaauaaaauacuuugcauucuaaguugccaau

SEQ ID NO: 663983 - RNA, 64 nt, hsa
uuaaaaauaaaauacuuugcauucuaaguugccaauaaaauagaccuucaaguuauuuuaaugc

SEQ ID NO: 663984 - RNA, 64 nt, hsa
gggcaacauagugagauucuguuaaaaaaauaaaauaaaauaaaaccaauuuuuaaaaagagaa

SEQ ID NO: 663985 - RNA, 64 nt, hsa
aaccugggcaacauagugagauucuguuaaaaaaauaaaauaaaauaaaaccaauuuuuaaaaa

SEQ ID NO: 663986 - RNA, 64 nt, hsa
gugugcgaaucaaaccugaccaagcggcucaagaauaaaauaugaauugagggcccgggacggu

SEQ ID NO: 663987 - RNA, 64 nt, hsa
cugagaccucagaguauguaggaguaaauaguauauaaaauagcucugguggcucaugccugua

SEQ ID NO: 663988 - RNA, 64 nt, hsa
accaaaagccaucugcuccccaaaaacuauugaaauaaaauaaaauauaaaaagaaagagaaag

SEQ ID NO: 663989 - RNA, 64 nt, hsa
aagccaucugcuccccaaaaacuauugaaauaaaauaaaauauaaaaagaaagagaaagaaaag

SEQ ID NO: 663990 - RNA, 64 nt, hsa
auguaaaaauaaaauucaaacgcccaggauuaaaauaaaauauaaucugaaaaccucauguucu

SEQ ID NO: 663991 - RNA, 64 nt, hsa
acaggaaaugacugguaauggaaaaaauguuguaauaaaauaaucuaaucaaagaauauuauua

SEQ ID NO: 663992 - RNA, 64 nt, hsa
uccagccaaacuaagcuucauaagugaaggagaaauaaaauacuuuacagacaagcaaaugcug

SEQ ID NO: 663993 - RNA, 64 nt, hsa
auauccuugaugaacauugaugugaaaauccucaauaaaauacuggcaaaccgaauccagcagc

SEQ ID NO: 663994 - RNA, 64 nt, hsa
caaccuaaauauucaucagugggguaauggaugaauaaaauaugauauauucaaaugauagaau

SEQ ID NO: 663995 - RNA, 64 nt, hsa
uguaguuuuuauaccuuaaaaagacugguagcauauaaaauaaaucuuaaaagcuaauuauaca

SEQ ID NO: 663996 - RNA, 64 nt, hsa
uaacugacagcugacaccauaugagaaccuuuguauaaaauauuggcauguaaacagcacagac

SEQ ID NO: 663997 - RNA, 64 nt, hsa
aagcacuuuugcauuaauuugguuaaaaaauaaaauaaaauaauaauaauguaugaagcucugu

SEQ ID NO: 663998 - RNA, 64 nt, hsa
cuuugaagcacuuuugcauuaauuugguuaaaaaauaaaauaaaauaauaauaauguaugaagc

SEQ ID NO: 663999 - RNA, 64 nt, hsa
gacaguuguugauuuucugagguaauauacccaaauaaaauauauguauguguacaugaaucua

SEQ ID NO: 664000 - RNA, 64 nt, hsa
cuucauauggaaaaauaauaucucccaucauaauauaaaauauuuuucuuaugaauucuuaaag

SEQ ID NO: 664001 - RNA, 64 nt, hsa
guggaauagaugaauaagugugaucauuucugugauaaaauacagaauuuagaaacaaaaucua

SEQ ID NO: 664002 - RNA, 64 nt, hsa
uaaacacaacaaugaguuaggucuuuaucaaguuauaaaauauguugaaaggcacaaaagaaca

SEQ ID NO: 664003 - RNA, 64 nt, hsa
caagagcaaaauuucaucucaaaaauaagauaaaauaaaauaaacaaauaagacagcacuuuau

SEQ ID NO: 664004 - RNA, 64 nt, hsa
ggcaacaagagcaaaauuucaucucaaaaauaagauaaaauaaaauaaacaaauaagacagcac

SEQ ID NO: 664005 - RNA, 64 nt, hsa
caaccauugauaauacaacuuaaacauguuugcuauaaaauaccaucacaaguaaaugagcuug

SEQ ID NO: 664006 - RNA, 64 nt, hsa
uuuggcacuaacaucucaugaaaaauuaugguuaauaaaauaucaccacauuuggauugccaau

SEQ ID NO: 664007 - RNA, 64 nt, hsa
uuuuuuuuuuuuugcugaauccaaagauauauaaauaaaauauauauauuuuauaaagaucaga

SEQ ID NO: 664008 - RNA, 64 nt, hsa
cucucuuccuuucuaauauauggaguuucgaagaauaaaauaugagagcaauauuuaaauucuc

SEQ ID NO: 664009 - RNA, 64 nt, hsa
uggaacugugaguccaauuaaaccucuuuuauucauaaaauauccaguuucugguaguucuuua

SEQ ID NO: 664010 - RNA, 64 nt, hsa
cuucauuaaaggcaccuucuauaaacuaccuuguauaaaauauuauuuauuuucucuaucccgg

SEQ ID NO: 664011 - RNA, 64 nt, hsa
gcccagccaacauugugagacauaaucucuacaaauaaaauaaauuaguuggacaugauggugu

SEQ ID NO: 664012 - RNA, 64 nt, hsa
ccugagugacagagugagacuuugcaaccaaaaaauaaaauaauaauaauaaugaaauaaauaa

SEQ ID NO: 664013 - RNA, 64 nt, hsa
aaaucaguaguacuuaaaguauauguuauguaagauaaaauauuugcucaauucuuuugguugu

SEQ ID NO: 664014 - RNA, 64 nt, hsa
aacaaauuuccuuaggauuauaguauuacaugccauaaaauacuaugcuuuauuggucccaugu

SEQ ID NO: 664015 - RNA, 64 nt, hsa
aauuguaauuucccaaauuuuaaaauaucuuauaauaaaauaaaaauauaugauggcuaacugu

SEQ ID NO: 664016 - RNA, 64 nt, hsa
agacauacugugugauagggagaaaaagcagcuuauaaaauaauguauauagcaugauacuauu

SEQ ID NO: 664017 - RNA, 64 nt, hsa
uauauagcaugauacuauuuuuguuuaaaaauauauaaaauauauaaaugcauaaaaaaauccu

SEQ ID NO: 664018 - RNA, 64 nt, hsa
gagagaggcugagaaaugcagagaagaauaagacauaaaauagcuccgaccuccaugauccgag

SEQ ID NO: 664019 - RNA, 64 nt, hsa
ugaaaaucauauugguauuugcaccaacauagucauaaaauaguauguuaauauguuuuuacuu

SEQ ID NO: 664020 - RNA, 64 nt, hsa
ggccuaguuucuauuaauaaauuggauaaauuuaauaaaauaagagugauacugaaagugcuca

SEQ ID NO: 664021 - RNA, 64 nt, hsa
auuuguauugauucucuuuaaauauaaaauguaaauaaaauauuccaauaaaaguuugugucug

SEQ ID NO: 664022 - RNA, 64 nt, hsa
augauucuaguucuaggacuuuguaggcuuaacuauaaaauauuuccuuuccucuggguuuaag

SEQ ID NO: 664023 - RNA, 64 nt, hsa
auaagccaccucagucaggauuaauaauucauuaauaaaauauauuuaacccaauaucagagug

SEQ ID NO: 664024 - RNA, 64 nt, hsa
cuaaauaucuguugcauguacuuuaaaguuuauuauaaaauauaaacagauauauaaagauguu

SEQ ID NO: 664025 - RNA, 64 nt, hsa
aauucacacauaacacuaagcguaaaucuaaucaauaaaauauauuuuugacuaaauuauugau

SEQ ID NO: 664026 - RNA, 64 nt, hsa
uguuguuccagauuuaacauaaguaguaaauaacauaaaauaacauaaaacaguauuuuuagga

SEQ ID NO: 664027 - RNA, 64 nt, hsa
aggucuguucuauuugguaacacaauacguucuuauaaaauacaacacaugcauaaaaauagaa

SEQ ID NO: 664028 - RNA, 64 nt, hsa
aaagaaaucagauacaaacuacugcaauuagaaaauaaaauaugaacaacuuucaacaauguau

SEQ ID NO: 664029 - RNA, 64 nt, hsa
uccaguuucugaaugaaaaagcuacagcugagaaauaaaauaaaaugucaugcugcagaauaug

SEQ ID NO: 664030 - RNA, 64 nt, hsa
auauaaauuuuaauuucauagcaacuuguaaaaaauaaaauacuuguugaaaagccuuuuucaa

SEQ ID NO: 664031 - RNA, 64 nt, hsa
ggcuaaaauguguagaagguaauuuacuacacuuauaaaauagugugacuuuugugaaaauuuu

SEQ ID NO: 664032 - RNA, 64 nt, hsa
gaaaaggacucccuuagaaugggaaagaaaaaucauaaaauauugagcugaugccuguauauag

SEQ ID NO: 664033 - RNA, 64 nt, hsa
cgacccugcaguccaccuguuuguaacuuuuuuaauaaaauagacaucuguauuacugagguug

SEQ ID NO: 664034 - RNA, 64 nt, hsa
gaguuguucaaaucacugcaguagggcucugcaaauaaaauaauguaaccuauuaucauggauc

SEQ ID NO: 664035 - RNA, 64 nt, hsa
gagcccagcuuuagucauuugaacaugcuucuaaauaaaauaaaacaaaaccaaaacuauacuu

SEQ ID NO: 664036 - RNA, 64 nt, hsa
cucuugaggauacuuaggguaaacuggauccuuccugcucaaggauccucauuuguauaccuag

SEQ ID NO: 664037 - RNA, 64 nt, hsa
acuuuucugaaaaaucuccauuguugaggagaggcugcucaaucgacaccccgaguucucauga

SEQ ID NO: 664038 - RNA, 64 nt, hsa
ccuuaaguugacaggauugauggaacaugcucuccugcucaaggcacaaccucugggcuggagu

SEQ ID NO: 664039 - RNA, 64 nt, hsa
ggagaugcauuuaugccugaaucaaagcugccuucugcucaaacaaaucagauuuauuucacau

SEQ ID NO: 664040 - RNA, 64 nt, hsa
aaggaaugugggaaagccuucaguuaccacuguacugcucaaaaacaugagaggaaucacacug

SEQ ID NO: 664041 - RNA, 64 nt, hsa
aaaaaaugugggaaaguguucguauaucacaacucugcucaaagacaugaaaagacucauacug

SEQ ID NO: 664042 - RNA, 64 nt, hsa
aaagaauguggaaaagcauuccgauaccaccaaucugcucaaaaacaugaaaaggcucauacug

SEQ ID NO: 664043 - RNA, 64 nt, hsa
cuuggugagcauccucuguagagggacuccaccccugcucaacagcuuggcuuccaggcaagac

SEQ ID NO: 664044 - RNA, 64 nt, hsa
agaugacuaacuaaaaucauuuuuacagcaaaaacugcucaaagccauuuaaauuauauccuca

SEQ ID NO: 664045 - RNA, 64 nt, hsa
cuuacagggcuaggauuucaguguugucagaguauuaccacacagcaacagcaacauacagaag

SEQ ID NO: 664046 - RNA, 64 nt, hsa
gaaugcaccuauaaauuauggagcauuguagauuuuaccacaucaauucauagcaguaacuuua

SEQ ID NO: 664047 - RNA, 64 nt, hsa
auaaaugguuaaaagguuuuauguuauguauauuuuaccacaauaaaugcaaaaaauaaaaagu

SEQ ID NO: 664048 - RNA, 64 nt, hsa
guuugauuacucuauuuaguguaucccaaaguuauuaccacauaaucuuuuaaacaauaaaaca

SEQ ID NO: 664049 - RNA, 64 nt, hsa
aagcaggaaucagugucucuaaggcugcauccuauuaccacaauggggugugcuauaacugcug

SEQ ID NO: 664050 - RNA, 64 nt, hsa
ccuuuguugagccuuuugagggguucaugauucauuaccacaguuuuaagaguuucaguuacca

SEQ ID NO: 664051 - RNA, 64 nt, hsa
ggugaagauuuggaaucuugaaugcuuauaaagguuaccacaugacuaggguacagccagauuu

SEQ ID NO: 664052 - RNA, 64 nt, hsa
uucuguaauugcuguauagauugucaucauaugauuaccacauuuuacuuacgcauuucuuuug

SEQ ID NO: 664053 - RNA, 64 nt, hsa; identical to SEQ ID NO: 257521

SEQ ID NO: 664054 - RNA, 64 nt, hsa; identical to SEQ ID NO: 257522

SEQ ID NO: 664055 - RNA, 64 nt, hsa; identical to SEQ ID NO: 257523

SEQ ID NO: 664056 - RNA, 64 nt, hsa; identical to SEQ ID NO: 257524

SEQ ID NO: 664057 - RNA, 64 nt, hsa
uccugccguccugcgccugcuggggccuccaggcaaggccaagugggguuggggguggggcugg

SEQ ID NO: 664058 - RNA, 64 nt, hsa
uaucuaaguggaacuaauugcccgagggcucagcaaggccaagaggagacagccgugacgguaa

SEQ ID NO: 664059 - RNA, 64 nt, hsa
uggccagaacugcugucgaagaaaaucaggccggaaggccaagaaggcgcuaagggggauggga

SEQ ID NO: 664060 - RNA, 64 nt, hsa
guuuaggcugaaugccuuccacgugauggaggaaaaggccaacucuguccuggucuugcugugg

SEQ ID NO: 664061 - RNA, 64 nt, hsa
ccuggacuaguccuagaugcaaacucaagagcccaaggccaaggggauguggggaagauggcag

SEQ ID NO: 664062 - RNA, 64 nt, hsa
cuauggcaaugugcaagucgcacugaaauccugaaaggccaagccuggagcccguccaggcuuu

SEQ ID NO: 664063 - RNA, 64 nt, hsa
uuauaguaucuacuucugguacuaauauacacaaaaggccaaaaccaugccuauucugcaggug

SEQ ID NO: 664064 - RNA, 64 nt, hsa
ugcuccaccagugggccuuggaaaaugcaucaagaaggccaaaccagcuugacccuggcucaca

SEQ ID NO: 664065 - RNA, 64 nt, hsa
gcaggggcaugcgccuagaaucccagcuacucggaaggccaaggcaggaggaccgcuugagucc

SEQ ID NO: 664066 - RNA, 64 nt, hsa
ccaaggcaggaggaccgcuugaguccagggauucaaggccaaccugggcaauagagcgagaccc

SEQ ID NO: 664067 - RNA, 64 nt, hsa
uuaaagcauucaacauuguguaaaugaaucuuggaaggccaaagcuacugaauuuagcgaauuu

SEQ ID NO: 664068 - RNA, 64 nt, hsa
agcacuucggcucuggaguuacagaucuggguucaaggccaaauuccaccacuuacuagguuug

SEQ ID NO: 664069 - RNA, 64 nt, hsa
agggagcguggucguggaagaaacaacccaccugaaggccaaaugccagagauuugggguuggg

SEQ ID NO: 664070 - RNA, 64 nt, hsa
ucaggcuccuccuugcccccaccuugccccaggaaaggccaaaguccaggugacugcccuccuu

SEQ ID NO: 664071 - RNA, 64 nt, hsa
gugcaggcagggagcacaguuugagaucaugcugaaggccaagcaggcccggaacucccaguuu

SEQ ID NO: 664072 - RNA, 64 nt, hsa
aauagcuuccuuugcuccaauaagcuuugcaaucaaggccaaagaaaaugaucugcuuccccug

SEQ ID NO: 664073 - RNA, 64 nt, hsa
gaugaugacagugaugaugaugaagaaagcaaagaaggccaagaaaguucuaguagugcugcaa

SEQ ID NO: 664074 - RNA, 64 nt, hsa
gugaguuauccuggacauuucgaugguuuuugguaaggccaaacucugauaagcaaaacagaga

SEQ ID NO: 664075 - RNA, 64 nt, hsa
uuggaucuauuugguuuaaaaaguauucuaucuuaaggccaacuaauauaaaauaccauuguua

SEQ ID NO: 664076 - RNA, 64 nt, hsa
gcugugaaugugauccgcucacugacacucuguaaaggccaaucaaugcacugucugucucucc

SEQ ID NO: 664077 - RNA, 64 nt, hsa
ggucgguuuaccacuggacgggugcugcaucggcaaggccaaguugaacaccggauggugccaa

SEQ ID NO: 664078 - RNA, 58 nt, hsa
aggugcugcugcagacguagggcaggugaaggccaaagcggguguugguggucaggcc

SEQ ID NO: 664079 - RNA, 64 nt, hsa
auuuguuagaacucugcccuuuugucugaaacucaaggccaaggagaaugauaggagacuuagg

SEQ ID NO: 664080 - RNA, 64 nt, hsa; identical to SEQ ID NO: 159163

SEQ ID NO: 664081 - RNA, 64 nt, hsa; identical to SEQ ID NO: 159164

SEQ ID NO: 664082 - RNA, 64 nt, hsa; identical to SEQ ID NO: 159165

SEQ ID NO: 664083 - RNA, 64 nt, hsa; identical to SEQ ID NO: 159166

SEQ ID NO: 664084 - RNA, 64 nt, hsa; identical to SEQ ID NO: 159167

SEQ ID NO: 664085 - RNA, 64 nt, hsa; identical to SEQ ID NO: 159168

SEQ ID NO: 664086 - RNA, 64 nt, hsa; identical to SEQ ID NO: 159169

SEQ ID NO: 664087 - RNA, 64 nt, hsa; identical to SEQ ID NO: 159170

SEQ ID NO: 664088 - RNA, 64 nt, hsa; identical to SEQ ID NO: 159171

SEQ ID NO: 664089 - RNA, 64 nt, hsa; identical to SEQ ID NO: 159172

SEQ ID NO: 664090 - RNA, 64 nt, hsa; identical to SEQ ID NO: 159173

SEQ ID NO: 664091 - RNA, 64 nt, hsa; identical to SEQ ID NO: 159174

SEQ ID NO: 664092 - RNA, 64 nt, hsa; identical to SEQ ID NO: 159175

SEQ ID NO: 664093 - RNA, 64 nt, hsa; identical to SEQ ID NO: 159176

SEQ ID NO: 664094 - RNA, 64 nt, hsa; identical to SEQ ID NO: 159177

SEQ ID NO: 664095 - RNA, 64 nt, hsa; identical to SEQ ID NO: 159178

SEQ ID NO: 664096 - RNA, 64 nt, hsa; identical to SEQ ID NO: 159179

SEQ ID NO: 664097 - RNA, 64 nt, hsa; identical to SEQ ID NO: 159180

SEQ ID NO: 664098 - RNA, 64 nt, hsa; identical to SEQ ID NO: 159181

SEQ ID NO: 664099 - RNA, 64 nt, hsa; identical to SEQ ID NO: 159182

SEQ ID NO: 664100 - RNA, 64 nt, hsa; identical to SEQ ID NO: 159183

SEQ ID NO: 664101 - RNA, 64 nt, hsa; identical to SEQ ID NO: 159184

SEQ ID NO: 664102 - RNA, 64 nt, hsa; identical to SEQ ID NO: 159185

SEQ ID NO: 664103 - RNA, 64 nt, hsa; identical to SEQ ID NO: 159186

SEQ ID NO: 664104 - RNA, 64 nt, hsa; identical to SEQ ID NO: 159187

SEQ ID NO: 664105 - RNA, 64 nt, hsa; identical to SEQ ID NO: 159188

SEQ ID NO: 664106 - RNA, 64 nt, hsa; identical to SEQ ID NO: 159189

SEQ ID NO: 664107 - RNA, 64 nt, hsa; identical to SEQ ID NO: 159190

SEQ ID NO: 664108 - RNA, 64 nt, hsa; identical to SEQ ID NO: 159191

SEQ ID NO: 664109 - RNA, 64 nt, hsa; identical to SEQ ID NO: 159192

SEQ ID NO: 664110 - RNA, 64 nt, hsa; identical to SEQ ID NO: 159193

SEQ ID NO: 664111 - RNA, 64 nt, hsa; identical to SEQ ID NO: 159194

SEQ ID NO: 664112 - RNA, 64 nt, hsa; identical to SEQ ID NO: 159195

SEQ ID NO: 664113 - RNA, 64 nt, hsa; identical to SEQ ID NO: 159196

SEQ ID NO: 664114 - RNA, 64 nt, hsa; identical to SEQ ID NO: 159197

SEQ ID NO: 664115 - RNA, 64 nt, hsa; identical to SEQ ID NO: 159198

SEQ ID NO: 664116 - RNA, 64 nt, hsa; identical to SEQ ID NO: 159199

SEQ ID NO: 664117 - RNA, 64 nt, hsa; identical to SEQ ID NO: 159200

SEQ ID NO: 664118 - RNA, 64 nt, hsa; identical to SEQ ID NO: 159201

SEQ ID NO: 664119 - RNA, 63 nt, hsa
ucuaucccaauugagacagcuagaaacaguugacugacuaaauggaaacuagucuauuugaca

SEQ ID NO: 664120 - RNA, 63 nt, hsa
aauaagcaguuugccuuuauaaaaacuugcugccugacuaaagauuaacagguuauaguuuaa

SEQ ID NO: 664121 - RNA, 63 nt, hsa
caugaaaguaauaaugugggauuacuagaaaaccugacuaauggugucacugcuggcaauggu

SEQ ID NO: 664122 - RNA, 63 nt, hsa
cacggaaguacucaugucggauucccagaaaaccugacuaauggugccacugcuggcaauggu

SEQ ID NO: 664123 - RNA, 63 nt, hsa
cuacaaaacuugaauauaacacauuuuggaaggcugacuaaccucgauucuguguugugaugu

SEQ ID NO: 664124 - RNA, 63 nt, hsa
uaaguaauuuuuaaauauuuguaauauuguugacugacuaauaaacuauuaaguuauuggcau

SEQ ID NO: 664125 - RNA, 63 nt, hsa
gcaaccugaggaagucuuuugccagccuguucucugacuaacgccauccaggcugggagggga

SEQ ID NO: 664126 - RNA, 63 nt, hsa
cccuugccuuucuguuucagcaaaucucagucccugacuaacagccucagcacauccgacacc

SEQ ID NO: 664127 - RNA, 64 nt, hsa
agugauuuuaaaaaccagaauuuuaguugcaauacaauuuuaauaucacccuacauauuauuua

SEQ ID NO: 664128 - RNA, 64 nt, hsa
acaguagauaagcugucgaaaauggaaaacaauucaauuuuaauuuucugcucugaguauuuag

SEQ ID NO: 664129 - RNA, 64 nt, hsa
ucugcaaauuguauaagaauaaaguuagaauuaacaauuuuauuuuguacaacaguggaauuuu

SEQ ID NO: 664130 - RNA, 64 nt, hsa
aaauccacaaauuuuucagauagugcccuaaaaacaauuuuauaugccucacugguuguuauuc

SEQ ID NO: 664131 - RNA, 64 nt, hsa
uuucugcaagaauuauucugauauuuaagagagccaauuuuaacugcugugaaaauguuuccag

SEQ ID NO: 664132 - RNA, 64 nt, hsa
cugagucaaaggauuuuccuuuaaaugcuugucucaauuuuagucuggucuuuuguacuuuucu

SEQ ID NO: 664133 - RNA, 64 nt, hsa
uguuuuggaacauuaauugugagaugggauuuuucaauuuuauuauuuuauuuuuguuuuuuuc

SEQ ID NO: 664134 - RNA, 64 nt, hsa
uuucccauuuuuuuuuucagcuuaaguaaccacacaauuuuaggccucaauuuuuuuuuuuuuc

SEQ ID NO: 664135 - RNA, 64 nt, hsa
aauuguguaacuuuuauguuuaaauuuugcacugcaauuuuauuuggugauaagcacaaaucuc

SEQ ID NO: 664136 - RNA, 64 nt, hsa
gcuuaaaaaaagaaauuaaaguuuuauuuagaaucaauuuuaccugucauuguaauugacccau

SEQ ID NO: 664137 - RNA, 64 nt, hsa
acucuuacguguuuauuuugagucaugagauaaucaauuuuaacccaaagucauuggauuauuu

SEQ ID NO: 664138 - RNA, 64 nt, hsa
cuauuucauauacauuguauuaaaacugccauaucaauuuuaauguauagauuuugcaaauauu

SEQ ID NO: 664139 - RNA, 64 nt, hsa
augcuaauuuuauuauaguaaugugacuuggauucaauuuuaaggcauauuuaacaaaauuuga

SEQ ID NO: 664140 - RNA, 60 nt, hsa
uagaaaucaacuggucaugaagaucaccaucaauuuuaguugucaaugggaaaaaacacc

SEQ ID NO: 664141 - RNA, 64 nt, hsa
aguuuuuaacugaaggaaccaguuguaacagucucaauuuuaacuaaaacuugaagaacuaaaa

SEQ ID NO: 664142 - RNA, 64 nt, hsa
gagcuaaauuccuaauguguauuguauuccaacccaauuuuacuggaacuauugaauaaaucuu

SEQ ID NO: 664143 - RNA, 64 nt, hsa
auucuuauaguauucuuggguucaaccuuugaaucaauuuuaccacugauuaaauaaaugacuc

SEQ ID NO: 664144 - RNA, 64 nt, hsa
gugucauuuaucauuuuguaauauuaaauuauggcaauuuuauuucaaacuaaaguuugaacac

SEQ ID NO: 664145 - RNA, 64 nt, hsa
ggauggcuggguagagcaaucugggcacuuuggccaauuuuagucuugcuguuucuugaugcuc

SEQ ID NO: 664146 - RNA, 64 nt, hsa
aauuacuacaaauggaugacacauuuaaugaacacaauuuuauuuuuuuucuguaacugugcuu

SEQ ID NO: 664147 - RNA, 64 nt, hsa
ugagcacaggaacaggcaugaagauauugccauacaauuuuaauuuauacaaguauuggccccu

SEQ ID NO: 664148 - RNA, 64 nt, hsa
uaagaaacagaccuaguuuaaaaggaauaaucaacaauuuuauaaaggagauggcuuauucaac

SEQ ID NO: 664149 - RNA, 64 nt, hsa
aauugauucaauuuuaugguaaaggaaacccaugcaauuuuaccuagacagucuuaaauauguc

SEQ ID NO: 664150 - RNA, 64 nt, hsa
agauagugauacugaggguaaaaaaaaauugauucaauuuuaugguaaaggaaacccaugcaau

SEQ ID NO: 664151 - RNA, 64 nt, hsa
gguuuuaacuuaaaaaaaauuguauugugauuuucaauuuuauguugaaaucgguguaguaucc

SEQ ID NO: 664152 - RNA, 64 nt, hsa
guagacuccaggauacaaaccauaguaggcaauacaauuuuagaauguaauauauagagguaua

SEQ ID NO: 664153 - RNA, 64 nt, hsa
ucaaguuggaaccaagaaauagcaaggaaauguacaauuuuaucuucuggcaaagggacaucau

SEQ ID NO: 664154 - RNA, 64 nt, hsa
gaaaacaaagcaaaugaauacuggacagucuuaacaauuuuauaaguuauaaaaugacuuuaga

SEQ ID NO: 664155 - RNA, 64 nt, hsa
auacauacccagcaacuuuuauaaauguguuaaacaauuuuacugauuuuuauaauaaauauuu

SEQ ID NO: 664156 - RNA, 64 nt, hsa
uuucuccuugagaaaacuuuuauuuuugucuaagcaauuuuauauuuuagaauaucaucuugaa

SEQ ID NO: 664157 - RNA, 64 nt, hsa
auuaauuguaauuaagggaaaugaauuauuaaaacaauuuuaaaauggccaaugauguauacau

SEQ ID NO: 664158 - RNA, 64 nt, hsa
uuuauacugucuaaaaaagcaaaguuuuaaagugcaauuuuaaaacuguaaauuacaucugaag

SEQ ID NO: 664159 - RNA, 50 nt, hsa
auuuagaagacacagacuaacaauuuuagaugguaagguucacaaauagg

SEQ ID NO: 664160 - RNA, 64 nt, hsa
cuaauguugauuaauaugugaaaagaaauuguaccaauuuuacuaaauuaugcaguuuaaaaug

SEQ ID NO: 664161 - RNA, 64 nt, hsa
aagaaaugggaaaaaaucuucaccacagucagagcaauuuuauuauuuucaucaguaugaucau

SEQ ID NO: 664162 - RNA, 64 nt, hsa
ucugugaccuuaagcaaauaacuccugugagccucaauuuuauuuguaaagugauggaauaaaa

SEQ ID NO: 664163 - RNA, 64 nt, hsa
ggagguaaaaggugaaaggaacaacauuaauuaacaauuuuacgucaugucccuggacauaaaa

SEQ ID NO: 664164 - RNA, 64 nt, hsa
uaggaaauuccuaggucuagugagaauuauuuuucaauuuuauuuuaguucuaaauuauguuuc

SEQ ID NO: 664165 - RNA, 64 nt, hsa
aucaccauuugaauuucaaauguaguuuucaugacaauuuuauauugauguguguuuacaauga

SEQ ID NO: 664166 - RNA, 64 nt, hsa
uguguacagguaugggccaaguguaaaaucucaucaauuuuaagaacacucgggaaaugaguaa

SEQ ID NO: 664167 - RNA, 64 nt, hsa
uugugugcauuuguaaacacuaucaugauauuuucaauuuuauguguaaauuuuauugucuguu

SEQ ID NO: 664168 - RNA, 64 nt, hsa
caccccugucauucacuuccaauuuuacccaauccaauuuuagcacucaaguuccauuguguua

SEQ ID NO: 664169 - RNA, 64 nt, hsa
guaacugagcuccuccaccccugucauucacuuccaauuuuacccaauccaauuuuagcacuca

SEQ ID NO: 664170 - RNA, 64 nt, hsa
caaaguguacucuuggaauggauucuuuccuguaaagucuuaucugcgacucugucucgggaau

SEQ ID NO: 664171 - RNA, 64 nt, hsa
ggcuguucaacauccucccuccuuagccccuccuaagucuuaaugcugagauuucuaaagaugc

SEQ ID NO: 664172 - RNA, 64 nt, hsa
aaacugguuauuuaaaauguaaaaaggaauaugaaagucuuauuaaaacacuucauugaaaaua

SEQ ID NO: 664173 - RNA, 64 nt, hsa
cagucuaaauuuauuauuuaaauuuuacuagcaaaagucuuaggugaacaaucaacuaguauuu

SEQ ID NO: 664174 - RNA, 64 nt, hsa
cuacaggucuuugaucuggaaacuaagacuagagaagucuuaagagaugacugcucaggugagu

SEQ ID NO: 664175 - RNA, 64 nt, hsa
guaaagaaugugaaaagucuuucagucagagcucaagucuuagucgacauaaaagaauacacac

SEQ ID NO: 664176 - RNA, 64 nt, hsa
agauuaagugguaaugucauagugguggguuuuuaagucuuaaccaaucucuaagguuuguuuc

SEQ ID NO: 664177 - RNA, 64 nt, hsa
auccucacagaaaaguuggaaauaaccaaaacugaagucuuaauuuaccuucaguuuaaucugu

SEQ ID NO: 664178 - RNA, 64 nt, hsa
uaauagcaauaaaccuaacuggauuuggaugaagaagucuuaauacugacauacuggauuuuua

SEQ ID NO: 664179 - RNA, 64 nt, hsa
gccuaguuagaguuagaccugucuuuggaugaagaagucuuaauacugaaauacugaauuuuua

SEQ ID NO: 664180 - RNA, 64 nt, hsa
uuaauauuuugaaagucuuaaaggagacacugcaaagucuuagacaaucuuuggcaucuuaaaa

SEQ ID NO: 664181 - RNA, 64 nt, hsa
acuuuuucguaacuuuugaaucuuaauauuuugaaagucuuaaaggagacacugcaaagucuua

SEQ ID NO: 664182 - RNA, 64 nt, hsa
acuugaaacuuaucucaacccguagaugucuuacaagucuuauauuuuugucuuacuuuuuuuu

SEQ ID NO: 664183 - RNA, 64 nt, hsa
uuguauuuuuaaauuuuucuuggguuaguauuuaaagucuuaacauuuauuuaauaauuauauu

SEQ ID NO: 664184 - RNA, 64 nt, hsa
guugauucguuuugaaaaauuguuguuagagcaaaagucuuacugaauuuguauuuuuaaauuu

SEQ ID NO: 664185 - RNA, 64 nt, hsa
acaaaagcaggguauaaggcgauauuggugaugaaagucuuaggaaaaaugcauaauuuugcua

SEQ ID NO: 664186 - RNA, 64 nt, hsa
cauacaagucaggguguuuggcuaaucuacaaauaagucuuaaaccuauguuuuuaaauuuuuu

SEQ ID NO: 664187 - RNA, 64 nt, hsa
ugaccuuguaaaagacaguguauguagaagcaugaagucuuaaggacaaagugccaaagaaagu

SEQ ID NO: 664188 - RNA, 64 nt, hsa
aagagauccaaagacucuugggagggaguuacugaagucuuacuacagaaaugaggaggaugcu

SEQ ID NO: 664189 - RNA, 64 nt, hsa; identical to SEQ ID NO: 93643

SEQ ID NO: 664190 - RNA, 64 nt, hsa; identical to SEQ ID NO: 93644

SEQ ID NO: 664191 - RNA, 64 nt, hsa; identical to SEQ ID NO: 93645

SEQ ID NO: 664192 - RNA, 64 nt, hsa; identical to SEQ ID NO: 93646

SEQ ID NO: 664193 - RNA, 64 nt, hsa; identical to SEQ ID NO: 93647

SEQ ID NO: 664194 - RNA, 64 nt, hsa; identical to SEQ ID NO: 93648

SEQ ID NO: 664195 - RNA, 64 nt, hsa; identical to SEQ ID NO: 93649

SEQ ID NO: 664196 - RNA, 64 nt, hsa; identical to SEQ ID NO: 93650

SEQ ID NO: 664197 - RNA, 64 nt, hsa; identical to SEQ ID NO: 93651

SEQ ID NO: 664198 - RNA, 64 nt, hsa; identical to SEQ ID NO: 93652

SEQ ID NO: 664199 - RNA, 64 nt, hsa; identical to SEQ ID NO: 93653

SEQ ID NO: 664200 - RNA, 64 nt, hsa; identical to SEQ ID NO: 93654

SEQ ID NO: 664201 - RNA, 64 nt, hsa; identical to SEQ ID NO: 93655

SEQ ID NO: 664202 - RNA, 64 nt, hsa; identical to SEQ ID NO: 93656

SEQ ID NO: 664203 - RNA, 64 nt, hsa; identical to SEQ ID NO: 93657

SEQ ID NO: 664204 - RNA, 64 nt, hsa; identical to SEQ ID NO: 93658

SEQ ID NO: 664205 - RNA, 64 nt, hsa; identical to SEQ ID NO: 93659

SEQ ID NO: 664206 - RNA, 64 nt, hsa; identical to SEQ ID NO: 93660

SEQ ID NO: 664207 - RNA, 64 nt, hsa; identical to SEQ ID NO: 93661

SEQ ID NO: 664208 - RNA, 64 nt, hsa; identical to SEQ ID NO: 93662

SEQ ID NO: 664209 - RNA, 64 nt, hsa; identical to SEQ ID NO: 93663

SEQ ID NO: 664210 - RNA, 64 nt, hsa; identical to SEQ ID NO: 93664

SEQ ID NO: 664211 - RNA, 64 nt, hsa; identical to SEQ ID NO: 226834

SEQ ID NO: 664212 - RNA, 64 nt, hsa; identical to SEQ ID NO: 226835

SEQ ID NO: 664213 - RNA, 64 nt, hsa; identical to SEQ ID NO: 226836

SEQ ID NO: 664214 - RNA, 64 nt, hsa; identical to SEQ ID NO: 226837

SEQ ID NO: 664215 - RNA, 64 nt, hsa; identical to SEQ ID NO: 226838

SEQ ID NO: 664216 - RNA, 64 nt, hsa; identical to SEQ ID NO: 226839

SEQ ID NO: 664217 - RNA, 64 nt, hsa; identical to SEQ ID NO: 226840

SEQ ID NO: 664218 - RNA, 64 nt, hsa; identical to SEQ ID NO: 226841

SEQ ID NO: 664219 - RNA, 64 nt, hsa; identical to SEQ ID NO: 226842

SEQ ID NO: 664220 - RNA, 64 nt, hsa; identical to SEQ ID NO: 226843

SEQ ID NO: 664221 - RNA, 64 nt, hsa; identical to SEQ ID NO: 226844

SEQ ID NO: 664222 - RNA, 64 nt, hsa; identical to SEQ ID NO: 226845

SEQ ID NO: 664223 - RNA, 64 nt, hsa; identical to SEQ ID NO: 226846

SEQ ID NO: 664224 - RNA, 64 nt, hsa; identical to SEQ ID NO: 226847

SEQ ID NO: 664225 - RNA, 64 nt, hsa; identical to SEQ ID NO: 226848

SEQ ID NO: 664226 - RNA, 64 nt, hsa; identical to SEQ ID NO: 226849

SEQ ID NO: 664227 - RNA, 64 nt, hsa; identical to SEQ ID NO: 226850

SEQ ID NO: 664228 - RNA, 64 nt, hsa; identical to SEQ ID NO: 226851

SEQ ID NO: 664229 - RNA, 64 nt, hsa; identical to SEQ ID NO: 226852

SEQ ID NO: 664230 - RNA, 64 nt, hsa; identical to SEQ ID NO: 226853

SEQ ID NO: 664231 - RNA, 64 nt, hsa; identical to SEQ ID NO: 226854

SEQ ID NO: 664232 - RNA, 64 nt, hsa; identical to SEQ ID NO: 226855

SEQ ID NO: 664233 - RNA, 64 nt, hsa; identical to SEQ ID NO: 226856

SEQ ID NO: 664234 - RNA, 64 nt, hsa; identical to SEQ ID NO: 226857

SEQ ID NO: 664235 - RNA, 64 nt, hsa; identical to SEQ ID NO: 226858

SEQ ID NO: 664236 - RNA, 64 nt, hsa; identical to SEQ ID NO: 226859

SEQ ID NO: 664237 - RNA, 64 nt, hsa; identical to SEQ ID NO: 226860

SEQ ID NO: 664238 - RNA, 64 nt, hsa; identical to SEQ ID NO: 226861

SEQ ID NO: 664239 - RNA, 64 nt, hsa; identical to SEQ ID NO: 226862

SEQ ID NO: 664240 - RNA, 64 nt, hsa; identical to SEQ ID NO: 226863

SEQ ID NO: 664241 - RNA, 64 nt, hsa; identical to SEQ ID NO: 226864

SEQ ID NO: 664242 - RNA, 64 nt, hsa; identical to SEQ ID NO: 226865

SEQ ID NO: 664243 - RNA, 64 nt, hsa; identical to SEQ ID NO: 226866

SEQ ID NO: 664244 - RNA, 64 nt, hsa; identical to SEQ ID NO: 226867

SEQ ID NO: 664245 - RNA, 64 nt, hsa; identical to SEQ ID NO: 226868

SEQ ID NO: 664246 - RNA, 64 nt, hsa; identical to SEQ ID NO: 226869

SEQ ID NO: 664247 - RNA, 64 nt, hsa; identical to SEQ ID NO: 226870

SEQ ID NO: 664248 - RNA, 64 nt, hsa; identical to SEQ ID NO: 226871

SEQ ID NO: 664249 - RNA, 64 nt, hsa; identical to SEQ ID NO: 226872

SEQ ID NO: 664250 - RNA, 64 nt, hsa; identical to SEQ ID NO: 226873

SEQ ID NO: 664251 - RNA, 64 nt, hsa; identical to SEQ ID NO: 226874

SEQ ID NO: 664252 - RNA, 64 nt, hsa; identical to SEQ ID NO: 226875

SEQ ID NO: 664253 - RNA, 64 nt, hsa; identical to SEQ ID NO: 226876

SEQ ID NO: 664254 - RNA, 64 nt, hsa; identical to SEQ ID NO: 226877

SEQ ID NO: 664255 - RNA, 64 nt, hsa; identical to SEQ ID NO: 226878

SEQ ID NO: 664256 - RNA, 64 nt, hsa; identical to SEQ ID NO: 226879

SEQ ID NO: 664257 - RNA, 64 nt, hsa; identical to SEQ ID NO: 226880

SEQ ID NO: 664258 - RNA, 64 nt, hsa; identical to SEQ ID NO: 226881

SEQ ID NO: 664259 - RNA, 64 nt, hsa; identical to SEQ ID NO: 226882

SEQ ID NO: 664260 - RNA, 64 nt, hsa; identical to SEQ ID NO: 226883

SEQ ID NO: 664261 - RNA, 64 nt, hsa; identical to SEQ ID NO: 226884

SEQ ID NO: 664262 - RNA, 64 nt, hsa; identical to SEQ ID NO: 226885

SEQ ID NO: 664263 - RNA, 64 nt, hsa; identical to SEQ ID NO: 226886

SEQ ID NO: 664264 - RNA, 64 nt, hsa; identical to SEQ ID NO: 226887

SEQ ID NO: 664265 - RNA, 64 nt, hsa; identical to SEQ ID NO: 226888

SEQ ID NO: 664266 - RNA, 64 nt, hsa; identical to SEQ ID NO: 226889

SEQ ID NO: 664267 - RNA, 64 nt, hsa; identical to SEQ ID NO: 226890

SEQ ID NO: 664268 - RNA, 64 nt, hsa
uggacuggguucucaagacacgaccagguucucaagacacgaguccccuuguuccuccccauua

SEQ ID NO: 664269 - RNA, 64 nt, hsa
ccagaggccugauucuguuuggacuggguucucaagacacgaccagguucucaagacacgaguc

SEQ ID NO: 664270 - RNA, 64 nt, hsa
gcaacaccucccuauucuguuauuucuuaguguagguagacaauucuuucaggagcagagcagc

SEQ ID NO: 664271 - RNA, 64 nt, hsa
gaaacaaugaaaggaacauuugaaagaaaauguggguagacaauuucuugcaacuugggggaaa

SEQ ID NO: 664272 - RNA, 64 nt, hsa; identical to SEQ ID NO: 236234

SEQ ID NO: 664273 - RNA, 64 nt, hsa; identical to SEQ ID NO: 236235

SEQ ID NO: 664274 - RNA, 64 nt, hsa; identical to SEQ ID NO: 236236

SEQ ID NO: 664275 - RNA, 64 nt, hsa; identical to SEQ ID NO: 236237

SEQ ID NO: 664276 - RNA, 64 nt, hsa; identical to SEQ ID NO: 236238

SEQ ID NO: 664277 - RNA, 64 nt, hsa; identical to SEQ ID NO: 236239

SEQ ID NO: 664278 - RNA, 64 nt, hsa; identical to SEQ ID NO: 164794

SEQ ID NO: 664279 - RNA, 64 nt, hsa; identical to SEQ ID NO: 164795

SEQ ID NO: 664280 - RNA, 64 nt, hsa; identical to SEQ ID NO: 164796

SEQ ID NO: 664281 - RNA, 64 nt, hsa; identical to SEQ ID NO: 164797

SEQ ID NO: 664282 - RNA, 64 nt, hsa; identical to SEQ ID NO: 164798

SEQ ID NO: 664283 - RNA, 64 nt, hsa; identical to SEQ ID NO: 164799

SEQ ID NO: 664284 - RNA, 64 nt, hsa; identical to SEQ ID NO: 164800

SEQ ID NO: 664285 - RNA, 64 nt, hsa; identical to SEQ ID NO: 164801

SEQ ID NO: 664286 - RNA, 64 nt, hsa; identical to SEQ ID NO: 164802

SEQ ID NO: 664287 - RNA, 64 nt, hsa; identical to SEQ ID NO: 164803

SEQ ID NO: 664288 - RNA, 64 nt, hsa; identical to SEQ ID NO: 164804

SEQ ID NO: 664289 - RNA, 64 nt, hsa; identical to SEQ ID NO: 164805

SEQ ID NO: 664290 - RNA, 64 nt, hsa; identical to SEQ ID NO: 164806

SEQ ID NO: 664291 - RNA, 64 nt, hsa; identical to SEQ ID NO: 164807

SEQ ID NO: 664292 - RNA, 64 nt, hsa; identical to SEQ ID NO: 164808

SEQ ID NO: 664293 - RNA, 64 nt, hsa; identical to SEQ ID NO: 164809

SEQ ID NO: 664294 - RNA, 64 nt, hsa; identical to SEQ ID NO: 164810

SEQ ID NO: 664295 - RNA, 64 nt, hsa; identical to SEQ ID NO: 164811

SEQ ID NO: 664296 - RNA, 64 nt, hsa; identical to SEQ ID NO: 164812

SEQ ID NO: 664297 - RNA, 64 nt, hsa; identical to SEQ ID NO: 164813

SEQ ID NO: 664298 - RNA, 64 nt, hsa; identical to SEQ ID NO: 164814

SEQ ID NO: 664299 - RNA, 64 nt, hsa; identical to SEQ ID NO: 164815

SEQ ID NO: 664300 - RNA, 64 nt, hsa; identical to SEQ ID NO: 164816

SEQ ID NO: 664301 - RNA, 64 nt, hsa; identical to SEQ ID NO: 164817

SEQ ID NO: 664302 - RNA, 64 nt, hsa; identical to SEQ ID NO: 164818

SEQ ID NO: 664303 - RNA, 64 nt, hsa; identical to SEQ ID NO: 164819

SEQ ID NO: 664304 - RNA, 64 nt, hsa; identical to SEQ ID NO: 164820

SEQ ID NO: 664305 - RNA, 64 nt, hsa; identical to SEQ ID NO: 164821

SEQ ID NO: 664306 - RNA, 64 nt, hsa; identical to SEQ ID NO: 164822

SEQ ID NO: 664307 - RNA, 64 nt, hsa; identical to SEQ ID NO: 164823

SEQ ID NO: 664308 - RNA, 64 nt, hsa; identical to SEQ ID NO: 164824

SEQ ID NO: 664309 - RNA, 64 nt, hsa; identical to SEQ ID NO: 164825

SEQ ID NO: 664310 - RNA, 64 nt, hsa; identical to SEQ ID NO: 164826

SEQ ID NO: 664311 - RNA, 64 nt, hsa; identical to SEQ ID NO: 164827

SEQ ID NO: 664312 - RNA, 64 nt, hsa; identical to SEQ ID NO: 164828

SEQ ID NO: 664313 - RNA, 64 nt, hsa; identical to SEQ ID NO: 133550

SEQ ID NO: 664314 - RNA, 64 nt, hsa; identical to SEQ ID NO: 133551

SEQ ID NO: 664315 - RNA, 64 nt, hsa; identical to SEQ ID NO: 133552

SEQ ID NO: 664316 - RNA, 64 nt, hsa; identical to SEQ ID NO: 133553

SEQ ID NO: 664317 - RNA, 64 nt, hsa; identical to SEQ ID NO: 133554

SEQ ID NO: 664318 - RNA, 64 nt, hsa; identical to SEQ ID NO: 133555

SEQ ID NO: 664319 - RNA, 64 nt, hsa; identical to SEQ ID NO: 133556

SEQ ID NO: 664320 - RNA, 64 nt, hsa; identical to SEQ ID NO: 133557

SEQ ID NO: 664321 - RNA, 64 nt, hsa; identical to SEQ ID NO: 133558

SEQ ID NO: 664322 - RNA, 64 nt, hsa; identical to SEQ ID NO: 133559

SEQ ID NO: 664323 - RNA, 64 nt, hsa; identical to SEQ ID NO: 133560

SEQ ID NO: 664324 - RNA, 64 nt, hsa; identical to SEQ ID NO: 133561

SEQ ID NO: 664325 - RNA, 64 nt, hsa; identical to SEQ ID NO: 133562

SEQ ID NO: 664326 - RNA, 64 nt, hsa; identical to SEQ ID NO: 133563

SEQ ID NO: 664327 - RNA, 64 nt, hsa; identical to SEQ ID NO: 133564

SEQ ID NO: 664328 - RNA, 64 nt, hsa; identical to SEQ ID NO: 133565

SEQ ID NO: 664329 - RNA, 64 nt, hsa; identical to SEQ ID NO: 133566

SEQ ID NO: 664330 - RNA, 64 nt, hsa; identical to SEQ ID NO: 133567

SEQ ID NO: 664331 - RNA, 64 nt, hsa; identical to SEQ ID NO: 133568

SEQ ID NO: 664332 - RNA, 64 nt, hsa; identical to SEQ ID NO: 133569

SEQ ID NO: 664333 - RNA, 64 nt, hsa; identical to SEQ ID NO: 133570

SEQ ID NO: 664334 - RNA, 64 nt, hsa; identical to SEQ ID NO: 133571

SEQ ID NO: 664335 - RNA, 64 nt, hsa; identical to SEQ ID NO: 133572

SEQ ID NO: 664336 - RNA, 64 nt, hsa; identical to SEQ ID NO: 133573

SEQ ID NO: 664337 - RNA, 64 nt, hsa; identical to SEQ ID NO: 133574

SEQ ID NO: 664338 - RNA, 64 nt, hsa; identical to SEQ ID NO: 133575

SEQ ID NO: 664339 - RNA, 64 nt, hsa; identical to SEQ ID NO: 133576

SEQ ID NO: 664340 - RNA, 64 nt, hsa; identical to SEQ ID NO: 133577

SEQ ID NO: 664341 - RNA, 64 nt, hsa; identical to SEQ ID NO: 133578

SEQ ID NO: 664342 - RNA, 64 nt, hsa; identical to SEQ ID NO: 133579

SEQ ID NO: 664343 - RNA, 64 nt, hsa; identical to SEQ ID NO: 133580

SEQ ID NO: 664344 - RNA, 64 nt, hsa; identical to SEQ ID NO: 133581

SEQ ID NO: 664345 - RNA, 64 nt, hsa; identical to SEQ ID NO: 133582

SEQ ID NO: 664346 - RNA, 64 nt, hsa; identical to SEQ ID NO: 133583

SEQ ID NO: 664347 - RNA, 64 nt, hsa; identical to SEQ ID NO: 133584

SEQ ID NO: 664348 - RNA, 64 nt, hsa; identical to SEQ ID NO: 133585

SEQ ID NO: 664349 - RNA, 64 nt, hsa; identical to SEQ ID NO: 133586

SEQ ID NO: 664350 - RNA, 64 nt, hsa; identical to SEQ ID NO: 133587

SEQ ID NO: 664351 - RNA, 64 nt, hsa; identical to SEQ ID NO: 133588

SEQ ID NO: 664352 - RNA, 64 nt, hsa; identical to SEQ ID NO: 133589

SEQ ID NO: 664353 - RNA, 64 nt, hsa; identical to SEQ ID NO: 133590

SEQ ID NO: 664354 - RNA, 64 nt, hsa; identical to SEQ ID NO: 133591

SEQ ID NO: 664355 - RNA, 64 nt, hsa; identical to SEQ ID NO: 133592

SEQ ID NO: 664356 - RNA, 64 nt, hsa; identical to SEQ ID NO: 133593

SEQ ID NO: 664357 - RNA, 64 nt, hsa; identical to SEQ ID NO: 133594

SEQ ID NO: 664358 - RNA, 64 nt, hsa; identical to SEQ ID NO: 133595

SEQ ID NO: 664359 - RNA, 64 nt, hsa; identical to SEQ ID NO: 133596

SEQ ID NO: 664360 - RNA, 64 nt, hsa; identical to SEQ ID NO: 133597

SEQ ID NO: 664361 - RNA, 64 nt, hsa; identical to SEQ ID NO: 133598

SEQ ID NO: 664362 - RNA, 64 nt, hsa; identical to SEQ ID NO: 133599

SEQ ID NO: 664363 - RNA, 64 nt, hsa; identical to SEQ ID NO: 133600

SEQ ID NO: 664364 - RNA, 64 nt, hsa; identical to SEQ ID NO: 133601

SEQ ID NO: 664365 - RNA, 64 nt, hsa; identical to SEQ ID NO: 133602

SEQ ID NO: 664366 - RNA, 64 nt, hsa; identical to SEQ ID NO: 133603

SEQ ID NO: 664367 - RNA, 64 nt, hsa; identical to SEQ ID NO: 133604

SEQ ID NO: 664368 - RNA, 64 nt, hsa; identical to SEQ ID NO: 133605

SEQ ID NO: 664369 - RNA, 64 nt, hsa; identical to SEQ ID NO: 133606

SEQ ID NO: 664370 - RNA, 64 nt, hsa; identical to SEQ ID NO: 133607

SEQ ID NO: 664371 - RNA, 64 nt, hsa; identical to SEQ ID NO: 133608

SEQ ID NO: 664372 - RNA, 64 nt, hsa; identical to SEQ ID NO: 133609

SEQ ID NO: 664373 - RNA, 64 nt, hsa; identical to SEQ ID NO: 133610

SEQ ID NO: 664374 - RNA, 52 nt, hsa; identical to SEQ ID NO: 133611

SEQ ID NO: 664375 - RNA, 55 nt, hsa; identical to SEQ ID NO: 133612

SEQ ID NO: 664376 - RNA, 64 nt, hsa; identical to SEQ ID NO: 133613

SEQ ID NO: 664377 - RNA, 64 nt, hsa; identical to SEQ ID NO: 133614

SEQ ID NO: 664378 - RNA, 64 nt, hsa; identical to SEQ ID NO: 133615

SEQ ID NO: 664379 - RNA, 64 nt, hsa; identical to SEQ ID NO: 133616

SEQ ID NO: 664380 - RNA, 64 nt, hsa; identical to SEQ ID NO: 133617

SEQ ID NO: 664381 - RNA, 64 nt, hsa; identical to SEQ ID NO: 133618

SEQ ID NO: 664382 - RNA, 64 nt, hsa; identical to SEQ ID NO: 133619

SEQ ID NO: 664383 - RNA, 64 nt, hsa; identical to SEQ ID NO: 133620

SEQ ID NO: 664384 - RNA, 64 nt, hsa; identical to SEQ ID NO: 133621

SEQ ID NO: 664385 - RNA, 64 nt, hsa; identical to SEQ ID NO: 133622

SEQ ID NO: 664386 - RNA, 64 nt, hsa; identical to SEQ ID NO: 133623

SEQ ID NO: 664387 - RNA, 64 nt, hsa; identical to SEQ ID NO: 133624

SEQ ID NO: 664388 - RNA, 64 nt, hsa; identical to SEQ ID NO: 133625

SEQ ID NO: 664389 - RNA, 64 nt, hsa; identical to SEQ ID NO: 133626

SEQ ID NO: 664390 - RNA, 64 nt, hsa; identical to SEQ ID NO: 133627

SEQ ID NO: 664391 - RNA, 64 nt, hsa; identical to SEQ ID NO: 133628

SEQ ID NO: 664392 - RNA, 64 nt, hsa; identical to SEQ ID NO: 133629

SEQ ID NO: 664393 - RNA, 64 nt, hsa; identical to SEQ ID NO: 133630

SEQ ID NO: 664394 - RNA, 64 nt, hsa; identical to SEQ ID NO: 133631

SEQ ID NO: 664395 - RNA, 64 nt, hsa; identical to SEQ ID NO: 133632

SEQ ID NO: 664396 - RNA, 64 nt, hsa; identical to SEQ ID NO: 133633

SEQ ID NO: 664397 - RNA, 64 nt, hsa; identical to SEQ ID NO: 133634

SEQ ID NO: 664398 - RNA, 64 nt, hsa; identical to SEQ ID NO: 133635

SEQ ID NO: 664399 - RNA, 64 nt, hsa; identical to SEQ ID NO: 133636

SEQ ID NO: 664400 - RNA, 64 nt, hsa; identical to SEQ ID NO: 133637

SEQ ID NO: 664401 - RNA, 64 nt, hsa; identical to SEQ ID NO: 133638

SEQ ID NO: 664402 - RNA, 63 nt, hsa; identical to SEQ ID NO: 133639

SEQ ID NO: 664403 - RNA, 51 nt, hsa; identical to SEQ ID NO: 133640

SEQ ID NO: 664404 - RNA, 64 nt, hsa; identical to SEQ ID NO: 133641

SEQ ID NO: 664405 - RNA, 64 nt, hsa; identical to SEQ ID NO: 133642

SEQ ID NO: 664406 - RNA, 64 nt, hsa; identical to SEQ ID NO: 133643

SEQ ID NO: 664407 - RNA, 64 nt, hsa; identical to SEQ ID NO: 133644

SEQ ID NO: 664408 - RNA, 64 nt, hsa; identical to SEQ ID NO: 133645

SEQ ID NO: 664409 - RNA, 64 nt, hsa; identical to SEQ ID NO: 133646

SEQ ID NO: 664410 - RNA, 64 nt, hsa; identical to SEQ ID NO: 133647

SEQ ID NO: 664411 - RNA, 64 nt, hsa; identical to SEQ ID NO: 133648

SEQ ID NO: 664412 - RNA, 64 nt, hsa; identical to SEQ ID NO: 133649

SEQ ID NO: 664413 - RNA, 64 nt, hsa; identical to SEQ ID NO: 133650

SEQ ID NO: 664414 - RNA, 64 nt, hsa; identical to SEQ ID NO: 133651

SEQ ID NO: 664415 - RNA, 64 nt, hsa; identical to SEQ ID NO: 133652

SEQ ID NO: 664416 - RNA, 64 nt, hsa; identical to SEQ ID NO: 133653

SEQ ID NO: 664417 - RNA, 64 nt, hsa; identical to SEQ ID NO: 133654

SEQ ID NO: 664418 - RNA, 64 nt, hsa; identical to SEQ ID NO: 133655

SEQ ID NO: 664419 - RNA, 64 nt, hsa; identical to SEQ ID NO: 133656

SEQ ID NO: 664420 - RNA, 64 nt, hsa; identical to SEQ ID NO: 133657

SEQ ID NO: 664421 - RNA, 64 nt, hsa; identical to SEQ ID NO: 133658

SEQ ID NO: 664422 - RNA, 64 nt, hsa; identical to SEQ ID NO: 133659

SEQ ID NO: 664423 - RNA, 64 nt, hsa; identical to SEQ ID NO: 133660

SEQ ID NO: 664424 - RNA, 64 nt, hsa; identical to SEQ ID NO: 133661

SEQ ID NO: 664425 - RNA, 64 nt, hsa; identical to SEQ ID NO: 133662

SEQ ID NO: 664426 - RNA, 64 nt, hsa; identical to SEQ ID NO: 133663

SEQ ID NO: 664427 - RNA, 64 nt, hsa; identical to SEQ ID NO: 133664

SEQ ID NO: 664428 - RNA, 64 nt, hsa; identical to SEQ ID NO: 133665

SEQ ID NO: 664429 - RNA, 64 nt, hsa; identical to SEQ ID NO: 133666

SEQ ID NO: 664430 - RNA, 64 nt, hsa; identical to SEQ ID NO: 133667

SEQ ID NO: 664431 - RNA, 64 nt, hsa; identical to SEQ ID NO: 133668

SEQ ID NO: 664432 - RNA, 64 nt, hsa; identical to SEQ ID NO: 133669

SEQ ID NO: 664433 - RNA, 64 nt, hsa; identical to SEQ ID NO: 133670

SEQ ID NO: 664434 - RNA, 64 nt, hsa; identical to SEQ ID NO: 133671

SEQ ID NO: 664435 - RNA, 64 nt, hsa; identical to SEQ ID NO: 133672

SEQ ID NO: 664436 - RNA, 64 nt, hsa; identical to SEQ ID NO: 133673

SEQ ID NO: 664437 - RNA, 64 nt, hsa; identical to SEQ ID NO: 133674

SEQ ID NO: 664438 - RNA, 64 nt, hsa; identical to SEQ ID NO: 133675

SEQ ID NO: 664439 - RNA, 64 nt, hsa; identical to SEQ ID NO: 133676

SEQ ID NO: 664440 - RNA, 50 nt, hsa; identical to SEQ ID NO: 133677

SEQ ID NO: 664441 - RNA, 64 nt, hsa; identical to SEQ ID NO: 133678

SEQ ID NO: 664442 - RNA, 64 nt, hsa; identical to SEQ ID NO: 133679

SEQ ID NO: 664443 - RNA, 64 nt, hsa; identical to SEQ ID NO: 133680

SEQ ID NO: 664444 - RNA, 64 nt, hsa; identical to SEQ ID NO: 133681

SEQ ID NO: 664445 - RNA, 64 nt, hsa; identical to SEQ ID NO: 133682

SEQ ID NO: 664446 - RNA, 64 nt, hsa; identical to SEQ ID NO: 133683

SEQ ID NO: 664447 - RNA, 64 nt, hsa; identical to SEQ ID NO: 133684

SEQ ID NO: 664448 - RNA, 64 nt, hsa; identical to SEQ ID NO: 133685

SEQ ID NO: 664449 - RNA, 64 nt, hsa; identical to SEQ ID NO: 133686

SEQ ID NO: 664450 - RNA, 64 nt, hsa; identical to SEQ ID NO: 133687

SEQ ID NO: 664451 - RNA, 64 nt, hsa; identical to SEQ ID NO: 133688

SEQ ID NO: 664452 - RNA, 64 nt, hsa; identical to SEQ ID NO: 133689

SEQ ID NO: 664453 - RNA, 64 nt, hsa; identical to SEQ ID NO: 133690

SEQ ID NO: 664454 - RNA, 64 nt, hsa; identical to SEQ ID NO: 133691

SEQ ID NO: 664455 - RNA, 64 nt, hsa; identical to SEQ ID NO: 133692

SEQ ID NO: 664456 - RNA, 64 nt, hsa; identical to SEQ ID NO: 133693

SEQ ID NO: 664457 - RNA, 64 nt, hsa; identical to SEQ ID NO: 133694

SEQ ID NO: 664458 - RNA, 64 nt, hsa; identical to SEQ ID NO: 133695

SEQ ID NO: 664459 - RNA, 64 nt, hsa; identical to SEQ ID NO: 133696

SEQ ID NO: 664460 - RNA, 64 nt, hsa; identical to SEQ ID NO: 133697

SEQ ID NO: 664461 - RNA, 64 nt, hsa; identical to SEQ ID NO: 133698

SEQ ID NO: 664462 - RNA, 64 nt, hsa; identical to SEQ ID NO: 133699

SEQ ID NO: 664463 - RNA, 64 nt, hsa; identical to SEQ ID NO: 133700

SEQ ID NO: 664464 - RNA, 64 nt, hsa; identical to SEQ ID NO: 133701

SEQ ID NO: 664465 - RNA, 64 nt, hsa; identical to SEQ ID NO: 133702

SEQ ID NO: 664466 - RNA, 64 nt, hsa; identical to SEQ ID NO: 133703

SEQ ID NO: 664467 - RNA, 64 nt, hsa; identical to SEQ ID NO: 133704

SEQ ID NO: 664468 - RNA, 64 nt, hsa; identical to SEQ ID NO: 133705

SEQ ID NO: 664469 - RNA, 64 nt, hsa; identical to SEQ ID NO: 133706

SEQ ID NO: 664470 - RNA, 64 nt, hsa; identical to SEQ ID NO: 133707

SEQ ID NO: 664471 - RNA, 64 nt, hsa; identical to SEQ ID NO: 133708

SEQ ID NO: 664472 - RNA, 64 nt, hsa; identical to SEQ ID NO: 133709

SEQ ID NO: 664473 - RNA, 64 nt, hsa; identical to SEQ ID NO: 133710

SEQ ID NO: 664474 - RNA, 64 nt, hsa; identical to SEQ ID NO: 133711

SEQ ID NO: 664475 - RNA, 64 nt, hsa; identical to SEQ ID NO: 133712

SEQ ID NO: 664476 - RNA, 64 nt, hsa; identical to SEQ ID NO: 133713

SEQ ID NO: 664477 - RNA, 64 nt, hsa; identical to SEQ ID NO: 133714

SEQ ID NO: 664478 - RNA, 64 nt, hsa; identical to SEQ ID NO: 133715

SEQ ID NO: 664479 - RNA, 64 nt, hsa; identical to SEQ ID NO: 133716

SEQ ID NO: 664480 - RNA, 64 nt, hsa; identical to SEQ ID NO: 133717

SEQ ID NO: 664481 - RNA, 64 nt, hsa; identical to SEQ ID NO: 133718

SEQ ID NO: 664482 - RNA, 64 nt, hsa; identical to SEQ ID NO: 133719

SEQ ID NO: 664483 - RNA, 64 nt, hsa; identical to SEQ ID NO: 133720

SEQ ID NO: 664484 - RNA, 64 nt, hsa; identical to SEQ ID NO: 133721

SEQ ID NO: 664485 - RNA, 64 nt, hsa; identical to SEQ ID NO: 133722

SEQ ID NO: 664486 - RNA, 64 nt, hsa; identical to SEQ ID NO: 133723

SEQ ID NO: 664487 - RNA, 64 nt, hsa; identical to SEQ ID NO: 133724

SEQ ID NO: 664488 - RNA, 64 nt, hsa; identical to SEQ ID NO: 133725

SEQ ID NO: 664489 - RNA, 64 nt, hsa; identical to SEQ ID NO: 133726

SEQ ID NO: 664490 - RNA, 64 nt, hsa; identical to SEQ ID NO: 133727

SEQ ID NO: 664491 - RNA, 64 nt, hsa; identical to SEQ ID NO: 133728

SEQ ID NO: 664492 - RNA, 64 nt, hsa; identical to SEQ ID NO: 133729

SEQ ID NO: 664493 - RNA, 64 nt, hsa; identical to SEQ ID NO: 133730

SEQ ID NO: 664494 - RNA, 64 nt, hsa; identical to SEQ ID NO: 133731

SEQ ID NO: 664495 - RNA, 64 nt, hsa; identical to SEQ ID NO: 133732

SEQ ID NO: 664496 - RNA, 64 nt, hsa; identical to SEQ ID NO: 133733

SEQ ID NO: 664497 - RNA, 64 nt, hsa; identical to SEQ ID NO: 133734

SEQ ID NO: 664498 - RNA, 64 nt, hsa; identical to SEQ ID NO: 133735

SEQ ID NO: 664499 - RNA, 64 nt, hsa; identical to SEQ ID NO: 133736

SEQ ID NO: 664500 - RNA, 64 nt, hsa; identical to SEQ ID NO: 133737

SEQ ID NO: 664501 - RNA, 64 nt, hsa; identical to SEQ ID NO: 133738

SEQ ID NO: 664502 - RNA, 64 nt, hsa; identical to SEQ ID NO: 133739

SEQ ID NO: 664503 - RNA, 64 nt, hsa; identical to SEQ ID NO: 133740

SEQ ID NO: 664504 - RNA, 64 nt, hsa; identical to SEQ ID NO: 133741

SEQ ID NO: 664505 - RNA, 64 nt, hsa; identical to SEQ ID NO: 133742

SEQ ID NO: 664506 - RNA, 64 nt, hsa; identical to SEQ ID NO: 133743

SEQ ID NO: 664507 - RNA, 64 nt, hsa; identical to SEQ ID NO: 133744

SEQ ID NO: 664508 - RNA, 64 nt, hsa; identical to SEQ ID NO: 133745

SEQ ID NO: 664509 - RNA, 64 nt, hsa; identical to SEQ ID NO: 133746

SEQ ID NO: 664510 - RNA, 64 nt, hsa; identical to SEQ ID NO: 133747

SEQ ID NO: 664511 - RNA, 64 nt, hsa; identical to SEQ ID NO: 133748

SEQ ID NO: 664512 - RNA, 64 nt, hsa; identical to SEQ ID NO: 133749

SEQ ID NO: 664513 - RNA, 64 nt, hsa; identical to SEQ ID NO: 133750

SEQ ID NO: 664514 - RNA, 64 nt, hsa; identical to SEQ ID NO: 133751

SEQ ID NO: 664515 - RNA, 64 nt, hsa; identical to SEQ ID NO: 133752

SEQ ID NO: 664516 - RNA, 64 nt, hsa; identical to SEQ ID NO: 133753

SEQ ID NO: 664517 - RNA, 64 nt, hsa; identical to SEQ ID NO: 133754

SEQ ID NO: 664518 - RNA, 64 nt, hsa; identical to SEQ ID NO: 133755

SEQ ID NO: 664519 - RNA, 64 nt, hsa; identical to SEQ ID NO: 133756

SEQ ID NO: 664520 - RNA, 64 nt, hsa; identical to SEQ ID NO: 133757

SEQ ID NO: 664521 - RNA, 64 nt, hsa; identical to SEQ ID NO: 133758

SEQ ID NO: 664522 - RNA, 64 nt, hsa; identical to SEQ ID NO: 133759

SEQ ID NO: 664523 - RNA, 64 nt, hsa; identical to SEQ ID NO: 133760

SEQ ID NO: 664524 - RNA, 64 nt, hsa; identical to SEQ ID NO: 133761

SEQ ID NO: 664525 - RNA, 64 nt, hsa; identical to SEQ ID NO: 133762

SEQ ID NO: 664526 - RNA, 64 nt, hsa; identical to SEQ ID NO: 133763

SEQ ID NO: 664527 - RNA, 64 nt, hsa; identical to SEQ ID NO: 133764

SEQ ID NO: 664528 - RNA, 64 nt, hsa; identical to SEQ ID NO: 133765

SEQ ID NO: 664529 - RNA, 60 nt, hsa; identical to SEQ ID NO: 133766

SEQ ID NO: 664530 - RNA, 57 nt, hsa; identical to SEQ ID NO: 133767

SEQ ID NO: 664531 - RNA, 64 nt, hsa; identical to SEQ ID NO: 133768

SEQ ID NO: 664532 - RNA, 64 nt, hsa; identical to SEQ ID NO: 133769

SEQ ID NO: 664533 - RNA, 64 nt, hsa; identical to SEQ ID NO: 133770

SEQ ID NO: 664534 - RNA, 64 nt, hsa; identical to SEQ ID NO: 133771

SEQ ID NO: 664535 - RNA, 64 nt, hsa; identical to SEQ ID NO: 133772

SEQ ID NO: 664536 - RNA, 64 nt, hsa; identical to SEQ ID NO: 133773

SEQ ID NO: 664537 - RNA, 64 nt, hsa; identical to SEQ ID NO: 133774

SEQ ID NO: 664538 - RNA, 64 nt, hsa; identical to SEQ ID NO: 133775

SEQ ID NO: 664539 - RNA, 64 nt, hsa; identical to SEQ ID NO: 133776

SEQ ID NO: 664540 - RNA, 64 nt, hsa; identical to SEQ ID NO: 133777

SEQ ID NO: 664541 - RNA, 64 nt, hsa; identical to SEQ ID NO: 133778

SEQ ID NO: 664542 - RNA, 64 nt, hsa; identical to SEQ ID NO: 133779

SEQ ID NO: 664543 - RNA, 64 nt, hsa; identical to SEQ ID NO: 133780

SEQ ID NO: 664544 - RNA, 64 nt, hsa; identical to SEQ ID NO: 133781

SEQ ID NO: 664545 - RNA, 64 nt, hsa; identical to SEQ ID NO: 133782

SEQ ID NO: 664546 - RNA, 64 nt, hsa; identical to SEQ ID NO: 133783

SEQ ID NO: 664547 - RNA, 64 nt, hsa; identical to SEQ ID NO: 133784

SEQ ID NO: 664548 - RNA, 64 nt, hsa; identical to SEQ ID NO: 133785

SEQ ID NO: 664549 - RNA, 64 nt, hsa; identical to SEQ ID NO: 133786

SEQ ID NO: 664550 - RNA, 64 nt, hsa; identical to SEQ ID NO: 133787

SEQ ID NO: 664551 - RNA, 64 nt, hsa; identical to SEQ ID NO: 133788

SEQ ID NO: 664552 - RNA, 64 nt, hsa; identical to SEQ ID NO: 133789

SEQ ID NO: 664553 - RNA, 64 nt, hsa; identical to SEQ ID NO: 133790

SEQ ID NO: 664554 - RNA, 64 nt, hsa; identical to SEQ ID NO: 133791

SEQ ID NO: 664555 - RNA, 64 nt, hsa; identical to SEQ ID NO: 133792

SEQ ID NO: 664556 - RNA, 64 nt, hsa; identical to SEQ ID NO: 133793

SEQ ID NO: 664557 - RNA, 64 nt, hsa; identical to SEQ ID NO: 133794

SEQ ID NO: 664558 - RNA, 64 nt, hsa; identical to SEQ ID NO: 133795

SEQ ID NO: 664559 - RNA, 64 nt, hsa; identical to SEQ ID NO: 133796

SEQ ID NO: 664560 - RNA, 64 nt, hsa; identical to SEQ ID NO: 133797

SEQ ID NO: 664561 - RNA, 64 nt, hsa; identical to SEQ ID NO: 133798

SEQ ID NO: 664562 - RNA, 64 nt, hsa; identical to SEQ ID NO: 133799

SEQ ID NO: 664563 - RNA, 64 nt, hsa; identical to SEQ ID NO: 133800

SEQ ID NO: 664564 - RNA, 64 nt, hsa; identical to SEQ ID NO: 133801

SEQ ID NO: 664565 - RNA, 64 nt, hsa; identical to SEQ ID NO: 133802

SEQ ID NO: 664566 - RNA, 64 nt, hsa; identical to SEQ ID NO: 133803

SEQ ID NO: 664567 - RNA, 64 nt, hsa; identical to SEQ ID NO: 133804

SEQ ID NO: 664568 - RNA, 64 nt, hsa; identical to SEQ ID NO: 133805

SEQ ID NO: 664569 - RNA, 64 nt, hsa; identical to SEQ ID NO: 133806

SEQ ID NO: 664570 - RNA, 64 nt, hsa; identical to SEQ ID NO: 133807

SEQ ID NO: 664571 - RNA, 64 nt, hsa; identical to SEQ ID NO: 133808

SEQ ID NO: 664572 - RNA, 64 nt, hsa; identical to SEQ ID NO: 133809

SEQ ID NO: 664573 - RNA, 64 nt, hsa; identical to SEQ ID NO: 133810

SEQ ID NO: 664574 - RNA, 64 nt, hsa; identical to SEQ ID NO: 133811

SEQ ID NO: 664575 - RNA, 64 nt, hsa; identical to SEQ ID NO: 133812

SEQ ID NO: 664576 - RNA, 64 nt, hsa; identical to SEQ ID NO: 133813

SEQ ID NO: 664577 - RNA, 64 nt, hsa; identical to SEQ ID NO: 133814

SEQ ID NO: 664578 - RNA, 64 nt, hsa; identical to SEQ ID NO: 133815

SEQ ID NO: 664579 - RNA, 64 nt, hsa; identical to SEQ ID NO: 133816

SEQ ID NO: 664580 - RNA, 64 nt, hsa; identical to SEQ ID NO: 133817

SEQ ID NO: 664581 - RNA, 64 nt, hsa; identical to SEQ ID NO: 133818

SEQ ID NO: 664582 - RNA, 64 nt, hsa; identical to SEQ ID NO: 133819

SEQ ID NO: 664583 - RNA, 64 nt, hsa; identical to SEQ ID NO: 133820

SEQ ID NO: 664584 - RNA, 64 nt, hsa; identical to SEQ ID NO: 133821

SEQ ID NO: 664585 - RNA, 64 nt, hsa; identical to SEQ ID NO: 133822

SEQ ID NO: 664586 - RNA, 64 nt, hsa; identical to SEQ ID NO: 133823

SEQ ID NO: 664587 - RNA, 64 nt, hsa; identical to SEQ ID NO: 133824

SEQ ID NO: 664588 - RNA, 64 nt, hsa; identical to SEQ ID NO: 133825

SEQ ID NO: 664589 - RNA, 64 nt, hsa; identical to SEQ ID NO: 133826

SEQ ID NO: 664590 - RNA, 64 nt, hsa; identical to SEQ ID NO: 133827

SEQ ID NO: 664591 - RNA, 64 nt, hsa; identical to SEQ ID NO: 133828

SEQ ID NO: 664592 - RNA, 64 nt, hsa; identical to SEQ ID NO: 133829

SEQ ID NO: 664593 - RNA, 64 nt, hsa; identical to SEQ ID NO: 628410

SEQ ID NO: 664594 - RNA, 64 nt, hsa; identical to SEQ ID NO: 628411

SEQ ID NO: 664595 - RNA, 64 nt, hsa; identical to SEQ ID NO: 628412

SEQ ID NO: 664596 - RNA, 64 nt, hsa; identical to SEQ ID NO: 628413

SEQ ID NO: 664597 - RNA, 56 nt, hsa; identical to SEQ ID NO: 628414

SEQ ID NO: 664598 - RNA, 64 nt, hsa; identical to SEQ ID NO: 628415

SEQ ID NO: 664599 - RNA, 64 nt, hsa; identical to SEQ ID NO: 628416

SEQ ID NO: 664600 - RNA, 64 nt, hsa; identical to SEQ ID NO: 628417

SEQ ID NO: 664601 - RNA, 64 nt, hsa; identical to SEQ ID NO: 628418

SEQ ID NO: 664602 - RNA, 64 nt, hsa; identical to SEQ ID NO: 628419

SEQ ID NO: 664603 - RNA, 64 nt, hsa; identical to SEQ ID NO: 227843

SEQ ID NO: 664604 - RNA, 64 nt, hsa; identical to SEQ ID NO: 227844

SEQ ID NO: 664605 - RNA, 64 nt, hsa; identical to SEQ ID NO: 227845

SEQ ID NO: 664606 - RNA, 64 nt, hsa; identical to SEQ ID NO: 227846

SEQ ID NO: 664607 - RNA, 64 nt, hsa; identical to SEQ ID NO: 227847

SEQ ID NO: 664608 - RNA, 64 nt, hsa; identical to SEQ ID NO: 227848

SEQ ID NO: 664609 - RNA, 64 nt, hsa; identical to SEQ ID NO: 227849

SEQ ID NO: 664610 - RNA, 64 nt, hsa; identical to SEQ ID NO: 227850

SEQ ID NO: 664611 - RNA, 64 nt, hsa; identical to SEQ ID NO: 227851

SEQ ID NO: 664612 - RNA, 64 nt, hsa; identical to SEQ ID NO: 227852

SEQ ID NO: 664613 - RNA, 64 nt, hsa; identical to SEQ ID NO: 227853

SEQ ID NO: 664614 - RNA, 64 nt, hsa; identical to SEQ ID NO: 227854

SEQ ID NO: 664615 - RNA, 64 nt, hsa; identical to SEQ ID NO: 227855

SEQ ID NO: 664616 - RNA, 64 nt, hsa; identical to SEQ ID NO: 227856

SEQ ID NO: 664617 - RNA, 64 nt, hsa; identical to SEQ ID NO: 478274

SEQ ID NO: 664618 - RNA, 64 nt, hsa; identical to SEQ ID NO: 478275

SEQ ID NO: 664619 - RNA, 64 nt, hsa; identical to SEQ ID NO: 478276

SEQ ID NO: 664620 - RNA, 64 nt, hsa; identical to SEQ ID NO: 478277

SEQ ID NO: 664621 - RNA, 64 nt, hsa; identical to SEQ ID NO: 478278

SEQ ID NO: 664622 - RNA, 64 nt, hsa; identical to SEQ ID NO: 478279

SEQ ID NO: 664623 - RNA, 64 nt, hsa; identical to SEQ ID NO: 478280

SEQ ID NO: 664624 - RNA, 64 nt, hsa; identical to SEQ ID NO: 478281

SEQ ID NO: 664625 - RNA, 64 nt, hsa; identical to SEQ ID NO: 478282

SEQ ID NO: 664626 - RNA, 64 nt, hsa; identical to SEQ ID NO: 478283

SEQ ID NO: 664627 - RNA, 64 nt, hsa; identical to SEQ ID NO: 478284

SEQ ID NO: 664628 - RNA, 64 nt, hsa; identical to SEQ ID NO: 478285

SEQ ID NO: 664629 - RNA, 64 nt, hsa; identical to SEQ ID NO: 478286

SEQ ID NO: 664630 - RNA, 64 nt, hsa; identical to SEQ ID NO: 478287

SEQ ID NO: 664631 - RNA, 64 nt, hsa; identical to SEQ ID NO: 478288

SEQ ID NO: 664632 - RNA, 64 nt, hsa; identical to SEQ ID NO: 478289

SEQ ID NO: 664633 - RNA, 64 nt, hsa; identical to SEQ ID NO: 478290

SEQ ID NO: 664634 - RNA, 64 nt, hsa; identical to SEQ ID NO: 478291

SEQ ID NO: 664635 - RNA, 64 nt, hsa; identical to SEQ ID NO: 478292

SEQ ID NO: 664636 - RNA, 64 nt, hsa; identical to SEQ ID NO: 478293

SEQ ID NO: 664637 - RNA, 64 nt, hsa; identical to SEQ ID NO: 478294

SEQ ID NO: 664638 - RNA, 64 nt, hsa; identical to SEQ ID NO: 478295

SEQ ID NO: 664639 - RNA, 64 nt, hsa; identical to SEQ ID NO: 478296

SEQ ID NO: 664640 - RNA, 64 nt, hsa; identical to SEQ ID NO: 478297

SEQ ID NO: 664641 - RNA, 64 nt, hsa; identical to SEQ ID NO: 380102

SEQ ID NO: 664642 - RNA, 64 nt, hsa; identical to SEQ ID NO: 380103

SEQ ID NO: 664643 - RNA, 64 nt, hsa; identical to SEQ ID NO: 380104

SEQ ID NO: 664644 - RNA, 64 nt, hsa; identical to SEQ ID NO: 380105

SEQ ID NO: 664645 - RNA, 64 nt, hsa; identical to SEQ ID NO: 380106

SEQ ID NO: 664646 - RNA, 64 nt, hsa; identical to SEQ ID NO: 380107

SEQ ID NO: 664647 - RNA, 64 nt, hsa; identical to SEQ ID NO: 380108

SEQ ID NO: 664648 - RNA, 64 nt, hsa; identical to SEQ ID NO: 380109

SEQ ID NO: 664649 - RNA, 64 nt, hsa; identical to SEQ ID NO: 380110

SEQ ID NO: 664650 - RNA, 64 nt, hsa; identical to SEQ ID NO: 380111

SEQ ID NO: 664651 - RNA, 64 nt, hsa; identical to SEQ ID NO: 380112

SEQ ID NO: 664652 - RNA, 64 nt, hsa; identical to SEQ ID NO: 380113

SEQ ID NO: 664653 - RNA, 64 nt, hsa; identical to SEQ ID NO: 380114

SEQ ID NO: 664654 - RNA, 64 nt, hsa; identical to SEQ ID NO: 380115

SEQ ID NO: 664655 - RNA, 58 nt, hsa; identical to SEQ ID NO: 380116

SEQ ID NO: 664656 - RNA, 64 nt, hsa; identical to SEQ ID NO: 380117

SEQ ID NO: 664657 - RNA, 64 nt, hsa; identical to SEQ ID NO: 380118

SEQ ID NO: 664658 - RNA, 64 nt, hsa; identical to SEQ ID NO: 380119

SEQ ID NO: 664659 - RNA, 64 nt, hsa; identical to SEQ ID NO: 380120

SEQ ID NO: 664660 - RNA, 64 nt, hsa; identical to SEQ ID NO: 380121

SEQ ID NO: 664661 - RNA, 64 nt, hsa; identical to SEQ ID NO: 380122

SEQ ID NO: 664662 - RNA, 64 nt, hsa; identical to SEQ ID NO: 380123

SEQ ID NO: 664663 - RNA, 64 nt, hsa; identical to SEQ ID NO: 380124

SEQ ID NO: 664664 - RNA, 64 nt, hsa; identical to SEQ ID NO: 380125

SEQ ID NO: 664665 - RNA, 64 nt, hsa; identical to SEQ ID NO: 380126

SEQ ID NO: 664666 - RNA, 64 nt, hsa; identical to SEQ ID NO: 380127

SEQ ID NO: 664667 - RNA, 64 nt, hsa; identical to SEQ ID NO: 380128

SEQ ID NO: 664668 - RNA, 64 nt, hsa; identical to SEQ ID NO: 380129

SEQ ID NO: 664669 - RNA, 64 nt, hsa; identical to SEQ ID NO: 380130

SEQ ID NO: 664670 - RNA, 64 nt, hsa; identical to SEQ ID NO: 380131

SEQ ID NO: 664671 - RNA, 64 nt, hsa; identical to SEQ ID NO: 380132

SEQ ID NO: 664672 - RNA, 64 nt, hsa; identical to SEQ ID NO: 380133

SEQ ID NO: 664673 - RNA, 64 nt, hsa; identical to SEQ ID NO: 380134

SEQ ID NO: 664674 - RNA, 64 nt, hsa; identical to SEQ ID NO: 380135

SEQ ID NO: 664675 - RNA, 64 nt, hsa; identical to SEQ ID NO: 380136

SEQ ID NO: 664676 - RNA, 64 nt, hsa; identical to SEQ ID NO: 380137

SEQ ID NO: 664677 - RNA, 64 nt, hsa; identical to SEQ ID NO: 380138

SEQ ID NO: 664678 - RNA, 64 nt, hsa; identical to SEQ ID NO: 380139

SEQ ID NO: 664679 - RNA, 64 nt, hsa; identical to SEQ ID NO: 380140

SEQ ID NO: 664680 - RNA, 64 nt, hsa; identical to SEQ ID NO: 380141

SEQ ID NO: 664681 - RNA, 64 nt, hsa; identical to SEQ ID NO: 380142

SEQ ID NO: 664682 - RNA, 64 nt, hsa; identical to SEQ ID NO: 380143

SEQ ID NO: 664683 - RNA, 64 nt, hsa; identical to SEQ ID NO: 380144

SEQ ID NO: 664684 - RNA, 64 nt, hsa; identical to SEQ ID NO: 380145

SEQ ID NO: 664685 - RNA, 64 nt, hsa; identical to SEQ ID NO: 380146

SEQ ID NO: 664686 - RNA, 64 nt, hsa; identical to SEQ ID NO: 380147

SEQ ID NO: 664687 - RNA, 59 nt, hsa; identical to SEQ ID NO: 380148

SEQ ID NO: 664688 - RNA, 64 nt, hsa; identical to SEQ ID NO: 380149

SEQ ID NO: 664689 - RNA, 64 nt, hsa; identical to SEQ ID NO: 380150

SEQ ID NO: 664690 - RNA, 64 nt, hsa; identical to SEQ ID NO: 380151

SEQ ID NO: 664691 - RNA, 64 nt, hsa; identical to SEQ ID NO: 380152

SEQ ID NO: 664692 - RNA, 64 nt, hsa; identical to SEQ ID NO: 380153

SEQ ID NO: 664693 - RNA, 64 nt, hsa; identical to SEQ ID NO: 380154

SEQ ID NO: 664694 - RNA, 64 nt, hsa; identical to SEQ ID NO: 380155

SEQ ID NO: 664695 - RNA, 64 nt, hsa; identical to SEQ ID NO: 380156

SEQ ID NO: 664696 - RNA, 64 nt, hsa; identical to SEQ ID NO: 380157

SEQ ID NO: 664697 - RNA, 64 nt, hsa; identical to SEQ ID NO: 380158

SEQ ID NO: 664698 - RNA, 64 nt, hsa; identical to SEQ ID NO: 380159

SEQ ID NO: 664699 - RNA, 64 nt, hsa; identical to SEQ ID NO: 380160

SEQ ID NO: 664700 - RNA, 64 nt, hsa; identical to SEQ ID NO: 380161

SEQ ID NO: 664701 - RNA, 54 nt, hsa; identical to SEQ ID NO: 380162

SEQ ID NO: 664702 - RNA, 64 nt, hsa; identical to SEQ ID NO: 380163

SEQ ID NO: 664703 - RNA, 64 nt, hsa; identical to SEQ ID NO: 380164

SEQ ID NO: 664704 - RNA, 64 nt, hsa; identical to SEQ ID NO: 380165

SEQ ID NO: 664705 - RNA, 64 nt, hsa; identical to SEQ ID NO: 380166

SEQ ID NO: 664706 - RNA, 64 nt, hsa; identical to SEQ ID NO: 380167

SEQ ID NO: 664707 - RNA, 64 nt, hsa; identical to SEQ ID NO: 380168

SEQ ID NO: 664708 - RNA, 64 nt, hsa; identical to SEQ ID NO: 380169

SEQ ID NO: 664709 - RNA, 64 nt, hsa; identical to SEQ ID NO: 380170

SEQ ID NO: 664710 - RNA, 64 nt, hsa; identical to SEQ ID NO: 380171

SEQ ID NO: 664711 - RNA, 64 nt, hsa; identical to SEQ ID NO: 380172

SEQ ID NO: 664712 - RNA, 64 nt, hsa; identical to SEQ ID NO: 380173

SEQ ID NO: 664713 - RNA, 64 nt, hsa; identical to SEQ ID NO: 380174

SEQ ID NO: 664714 - RNA, 64 nt, hsa; identical to SEQ ID NO: 380175

SEQ ID NO: 664715 - RNA, 64 nt, hsa; identical to SEQ ID NO: 380176

SEQ ID NO: 664716 - RNA, 64 nt, hsa; identical to SEQ ID NO: 380177

SEQ ID NO: 664717 - RNA, 64 nt, hsa; identical to SEQ ID NO: 380178

SEQ ID NO: 664718 - RNA, 64 nt, hsa; identical to SEQ ID NO: 380179

SEQ ID NO: 664719 - RNA, 64 nt, hsa; identical to SEQ ID NO: 380180

SEQ ID NO: 664720 - RNA, 64 nt, hsa; identical to SEQ ID NO: 380181

SEQ ID NO: 664721 - RNA, 64 nt, hsa; identical to SEQ ID NO: 380182

SEQ ID NO: 664722 - RNA, 64 nt, hsa; identical to SEQ ID NO: 380183

SEQ ID NO: 664723 - RNA, 64 nt, hsa; identical to SEQ ID NO: 380184

SEQ ID NO: 664724 - RNA, 64 nt, hsa; identical to SEQ ID NO: 380185

SEQ ID NO: 664725 - RNA, 64 nt, hsa; identical to SEQ ID NO: 380186

SEQ ID NO: 664726 - RNA, 64 nt, hsa; identical to SEQ ID NO: 380187

SEQ ID NO: 664727 - RNA, 64 nt, hsa; identical to SEQ ID NO: 380188

SEQ ID NO: 664728 - RNA, 64 nt, hsa; identical to SEQ ID NO: 380189

SEQ ID NO: 664729 - RNA, 64 nt, hsa; identical to SEQ ID NO: 380190

SEQ ID NO: 664730 - RNA, 64 nt, hsa; identical to SEQ ID NO: 380191

SEQ ID NO: 664731 - RNA, 64 nt, hsa; identical to SEQ ID NO: 380192

SEQ ID NO: 664732 - RNA, 64 nt, hsa; identical to SEQ ID NO: 380193

SEQ ID NO: 664733 - RNA, 64 nt, hsa; identical to SEQ ID NO: 380194

SEQ ID NO: 664734 - RNA, 64 nt, hsa; identical to SEQ ID NO: 380195

SEQ ID NO: 664735 - RNA, 58 nt, hsa; identical to SEQ ID NO: 380196

SEQ ID NO: 664736 - RNA, 64 nt, hsa; identical to SEQ ID NO: 380197

SEQ ID NO: 664737 - RNA, 64 nt, hsa; identical to SEQ ID NO: 380198

SEQ ID NO: 664738 - RNA, 64 nt, hsa; identical to SEQ ID NO: 380199

SEQ ID NO: 664739 - RNA, 64 nt, hsa; identical to SEQ ID NO: 380200

SEQ ID NO: 664740 - RNA, 64 nt, hsa; identical to SEQ ID NO: 380201

SEQ ID NO: 664741 - RNA, 64 nt, hsa; identical to SEQ ID NO: 380202

SEQ ID NO: 664742 - RNA, 64 nt, hsa; identical to SEQ ID NO: 380203

SEQ ID NO: 664743 - RNA, 64 nt, hsa; identical to SEQ ID NO: 380204

SEQ ID NO: 664744 - RNA, 64 nt, hsa; identical to SEQ ID NO: 380205

SEQ ID NO: 664745 - RNA, 64 nt, hsa; identical to SEQ ID NO: 380206

SEQ ID NO: 664746 - RNA, 64 nt, hsa; identical to SEQ ID NO: 380207

SEQ ID NO: 664747 - RNA, 64 nt, hsa; identical to SEQ ID NO: 380208

SEQ ID NO: 664748 - RNA, 64 nt, hsa; identical to SEQ ID NO: 380209

SEQ ID NO: 664749 - RNA, 63 nt, hsa; identical to SEQ ID NO: 380210

SEQ ID NO: 664750 - RNA, 64 nt, hsa; identical to SEQ ID NO: 380211

SEQ ID NO: 664751 - RNA, 64 nt, hsa; identical to SEQ ID NO: 380212

SEQ ID NO: 664752 - RNA, 64 nt, hsa; identical to SEQ ID NO: 380213

SEQ ID NO: 664753 - RNA, 64 nt, hsa; identical to SEQ ID NO: 380214

SEQ ID NO: 664754 - RNA, 64 nt, hsa; identical to SEQ ID NO: 380215

SEQ ID NO: 664755 - RNA, 64 nt, hsa; identical to SEQ ID NO: 380216

SEQ ID NO: 664756 - RNA, 64 nt, hsa; identical to SEQ ID NO: 380217

SEQ ID NO: 664757 - RNA, 64 nt, hsa; identical to SEQ ID NO: 380218

SEQ ID NO: 664758 - RNA, 64 nt, hsa; identical to SEQ ID NO: 380219

SEQ ID NO: 664759 - RNA, 64 nt, hsa; identical to SEQ ID NO: 380220

SEQ ID NO: 664760 - RNA, 64 nt, hsa; identical to SEQ ID NO: 380221

SEQ ID NO: 664761 - RNA, 64 nt, hsa; identical to SEQ ID NO: 380222

SEQ ID NO: 664762 - RNA, 64 nt, hsa; identical to SEQ ID NO: 380223

SEQ ID NO: 664763 - RNA, 64 nt, hsa; identical to SEQ ID NO: 380224

SEQ ID NO: 664764 - RNA, 64 nt, hsa; identical to SEQ ID NO: 380225

SEQ ID NO: 664765 - RNA, 64 nt, hsa; identical to SEQ ID NO: 380226

SEQ ID NO: 664766 - RNA, 64 nt, hsa; identical to SEQ ID NO: 380227

SEQ ID NO: 664767 - RNA, 64 nt, hsa; identical to SEQ ID NO: 380228

SEQ ID NO: 664768 - RNA, 64 nt, hsa; identical to SEQ ID NO: 380229

SEQ ID NO: 664769 - RNA, 64 nt, hsa; identical to SEQ ID NO: 380230

SEQ ID NO: 664770 - RNA, 64 nt, hsa; identical to SEQ ID NO: 380231

SEQ ID NO: 664771 - RNA, 64 nt, hsa; identical to SEQ ID NO: 380232

SEQ ID NO: 664772 - RNA, 64 nt, hsa; identical to SEQ ID NO: 380233

SEQ ID NO: 664773 - RNA, 64 nt, hsa; identical to SEQ ID NO: 380234

SEQ ID NO: 664774 - RNA, 64 nt, hsa; identical to SEQ ID NO: 380235

SEQ ID NO: 664775 - RNA, 51 nt, hsa; identical to SEQ ID NO: 380236

SEQ ID NO: 664776 - RNA, 64 nt, hsa; identical to SEQ ID NO: 380237

SEQ ID NO: 664777 - RNA, 64 nt, hsa; identical to SEQ ID NO: 380238

SEQ ID NO: 664778 - RNA, 64 nt, hsa; identical to SEQ ID NO: 380239

SEQ ID NO: 664779 - RNA, 64 nt, hsa; identical to SEQ ID NO: 380240

SEQ ID NO: 664780 - RNA, 64 nt, hsa; identical to SEQ ID NO: 380241

SEQ ID NO: 664781 - RNA, 64 nt, hsa; identical to SEQ ID NO: 380242

SEQ ID NO: 664782 - RNA, 64 nt, hsa; identical to SEQ ID NO: 380243

SEQ ID NO: 664783 - RNA, 64 nt, hsa; identical to SEQ ID NO: 380244

SEQ ID NO: 664784 - RNA, 64 nt, hsa; identical to SEQ ID NO: 380245

SEQ ID NO: 664785 - RNA, 64 nt, hsa; identical to SEQ ID NO: 380246

SEQ ID NO: 664786 - RNA, 64 nt, hsa; identical to SEQ ID NO: 380247

SEQ ID NO: 664787 - RNA, 64 nt, hsa; identical to SEQ ID NO: 380248

SEQ ID NO: 664788 - RNA, 64 nt, hsa; identical to SEQ ID NO: 380249

SEQ ID NO: 664789 - RNA, 64 nt, hsa; identical to SEQ ID NO: 380250

SEQ ID NO: 664790 - RNA, 64 nt, hsa; identical to SEQ ID NO: 380251

SEQ ID NO: 664791 - RNA, 64 nt, hsa; identical to SEQ ID NO: 380252

SEQ ID NO: 664792 - RNA, 64 nt, hsa; identical to SEQ ID NO: 380253

SEQ ID NO: 664793 - RNA, 64 nt, hsa; identical to SEQ ID NO: 380254

SEQ ID NO: 664794 - RNA, 64 nt, hsa; identical to SEQ ID NO: 380255

SEQ ID NO: 664795 - RNA, 64 nt, hsa; identical to SEQ ID NO: 380256

SEQ ID NO: 664796 - RNA, 64 nt, hsa; identical to SEQ ID NO: 380257

SEQ ID NO: 664797 - RNA, 64 nt, hsa; identical to SEQ ID NO: 380258

SEQ ID NO: 664798 - RNA, 64 nt, hsa; identical to SEQ ID NO: 380259

SEQ ID NO: 664799 - RNA, 64 nt, hsa; identical to SEQ ID NO: 380260

SEQ ID NO: 664800 - RNA, 64 nt, hsa; identical to SEQ ID NO: 380261

SEQ ID NO: 664801 - RNA, 64 nt, hsa; identical to SEQ ID NO: 380262

SEQ ID NO: 664802 - RNA, 64 nt, hsa; identical to SEQ ID NO: 380263

SEQ ID NO: 664803 - RNA, 64 nt, hsa; identical to SEQ ID NO: 380264

SEQ ID NO: 664804 - RNA, 64 nt, hsa; identical to SEQ ID NO: 380265

SEQ ID NO: 664805 - RNA, 64 nt, hsa; identical to SEQ ID NO: 380266

SEQ ID NO: 664806 - RNA, 64 nt, hsa; identical to SEQ ID NO: 380267

SEQ ID NO: 664807 - RNA, 64 nt, hsa; identical to SEQ ID NO: 380268

SEQ ID NO: 664808 - RNA, 64 nt, hsa; identical to SEQ ID NO: 380269

SEQ ID NO: 664809 - RNA, 64 nt, hsa; identical to SEQ ID NO: 380270

SEQ ID NO: 664810 - RNA, 64 nt, hsa; identical to SEQ ID NO: 380271

SEQ ID NO: 664811 - RNA, 64 nt, hsa; identical to SEQ ID NO: 380272

SEQ ID NO: 664812 - RNA, 64 nt, hsa; identical to SEQ ID NO: 380273

SEQ ID NO: 664813 - RNA, 64 nt, hsa; identical to SEQ ID NO: 380274

SEQ ID NO: 664814 - RNA, 64 nt, hsa; identical to SEQ ID NO: 380275

SEQ ID NO: 664815 - RNA, 64 nt, hsa; identical to SEQ ID NO: 380276

SEQ ID NO: 664816 - RNA, 64 nt, hsa; identical to SEQ ID NO: 380277

SEQ ID NO: 664817 - RNA, 64 nt, hsa; identical to SEQ ID NO: 380278

SEQ ID NO: 664818 - RNA, 64 nt, hsa; identical to SEQ ID NO: 380279

SEQ ID NO: 664819 - RNA, 50 nt, hsa; identical to SEQ ID NO: 380280

SEQ ID NO: 664820 - RNA, 64 nt, hsa; identical to SEQ ID NO: 380281

SEQ ID NO: 664821 - RNA, 63 nt, hsa; identical to SEQ ID NO: 380282

SEQ ID NO: 664822 - RNA, 64 nt, hsa; identical to SEQ ID NO: 380283

SEQ ID NO: 664823 - RNA, 64 nt, hsa; identical to SEQ ID NO: 380284

SEQ ID NO: 664824 - RNA, 64 nt, hsa; identical to SEQ ID NO: 380285

SEQ ID NO: 664825 - RNA, 64 nt, hsa; identical to SEQ ID NO: 380286

SEQ ID NO: 664826 - RNA, 64 nt, hsa; identical to SEQ ID NO: 380287

SEQ ID NO: 664827 - RNA, 64 nt, hsa; identical to SEQ ID NO: 380288

SEQ ID NO: 664828 - RNA, 64 nt, hsa; identical to SEQ ID NO: 380289

SEQ ID NO: 664829 - RNA, 64 nt, hsa; identical to SEQ ID NO: 380290

SEQ ID NO: 664830 - RNA, 64 nt, hsa; identical to SEQ ID NO: 380291

SEQ ID NO: 664831 - RNA, 64 nt, hsa; identical to SEQ ID NO: 380292

SEQ ID NO: 664832 - RNA, 64 nt, hsa; identical to SEQ ID NO: 380293

SEQ ID NO: 664833 - RNA, 64 nt, hsa; identical to SEQ ID NO: 380294

SEQ ID NO: 664834 - RNA, 64 nt, hsa; identical to SEQ ID NO: 380295

SEQ ID NO: 664835 - RNA, 64 nt, hsa; identical to SEQ ID NO: 380296

SEQ ID NO: 664836 - RNA, 64 nt, hsa; identical to SEQ ID NO: 380297

SEQ ID NO: 664837 - RNA, 64 nt, hsa; identical to SEQ ID NO: 380298

SEQ ID NO: 664838 - RNA, 64 nt, hsa; identical to SEQ ID NO: 380299

SEQ ID NO: 664839 - RNA, 64 nt, hsa; identical to SEQ ID NO: 380300

SEQ ID NO: 664840 - RNA, 64 nt, hsa; identical to SEQ ID NO: 380301

SEQ ID NO: 664841 - RNA, 64 nt, hsa; identical to SEQ ID NO: 380302

SEQ ID NO: 664842 - RNA, 64 nt, hsa; identical to SEQ ID NO: 380303

SEQ ID NO: 664843 - RNA, 64 nt, hsa; identical to SEQ ID NO: 380304

SEQ ID NO: 664844 - RNA, 64 nt, hsa; identical to SEQ ID NO: 380304

SEQ ID NO: 664845 - RNA, 64 nt, hsa; identical to SEQ ID NO: 380306

SEQ ID NO: 664846 - RNA, 64 nt, hsa; identical to SEQ ID NO: 380307

SEQ ID NO: 664847 - RNA, 64 nt, hsa; identical to SEQ ID NO: 380308

SEQ ID NO: 664848 - RNA, 64 nt, hsa; identical to SEQ ID NO: 380309

SEQ ID NO: 664849 - RNA, 64 nt, hsa; identical to SEQ ID NO: 380310

SEQ ID NO: 664850 - RNA, 64 nt, hsa; identical to SEQ ID NO: 380311

SEQ ID NO: 664851 - RNA, 64 nt, hsa
ugucccucaugucauuucaaacuguuuuccaaagggauuugagcauauacaacuacaaauccaa

SEQ ID NO: 664852 - RNA, 64 nt, hsa
uaaacauugagaagugcugcucuccguuuauuugggauuugauucucauuuuaccauagcuuau

SEQ ID NO: 664853 - RNA, 64 nt, hsa
gaugugaacaaccugcucacaguccucauuuacuggauuugacuucagccaggugaacuggaau

SEQ ID NO: 664854 - RNA, 64 nt, hsa
aagaacacuguucugauaucucugauugucauguggauuugaauguagcuugacagagggaaug

SEQ ID NO: 664855 - RNA, 64 nt, hsa
caaaagauaauuggaaaaaauugaauauauuguaggauuugaauauacagccuacuuuuauguc

SEQ ID NO: 664856 - RNA, 64 nt, hsa
ccucucucuucuuuauucccuguaauagaagguaggauuugaaaaaaagcaggacuccaccucu

SEQ ID NO: 664857 - RNA, 64 nt, hsa
auuuccuuagcuuccccaccauauguauuuucuaggauuugagaggaaagagaggaaaaugggg

SEQ ID NO: 664858 - RNA, 64 nt, hsa
caauaaacucagcuuuuuuguggggcacaguacuggauuugacagugauuccccacguguguuc

SEQ ID NO: 664859 - RNA, 64 nt, hsa
agacagucucccagugucugacucucggauauuuggauuugacuggugugaggcaaagugaaaa

SEQ ID NO: 664860 - RNA, 64 nt, hsa
agagggaaugugaaagaaaauaagagaauccacgggauuugaugccuggaagauucuccuucaa

SEQ ID NO: 664861 - RNA, 64 nt, hsa
cagcuccaucaagaaugugggaugugccgaccaaggauuugagaaaguuguacagaaauguguu

SEQ ID NO: 664862 - RNA, 64 nt, hsa
gagcuuuauaaaugacuuuacagagacuaauaagggauuugaucuuucuuuuuuuguuaucgag

SEQ ID NO: 664863 - RNA, 64 nt, hsa
ucuauuugucgaugaaauaaacacaacucuuugaggauuugagacuacauucacccuuuauuca

SEQ ID NO: 664864 - RNA, 64 nt, hsa
ugccuccagccaaaugccuagcacagagcucaguggauuugauucuuccauucagauacucaua

SEQ ID NO: 664865 - RNA, 64 nt, hsa
gguuuugugcagggucuuggguuagagccaaaauggauuugaggaugaguauuuuuuuuuuugg

SEQ ID NO: 664866 - RNA, 64 nt, hsa
uauaucccacugcacugagagggcucaaucagcuggauuugaguucuggaacacacaucauccc

SEQ ID NO: 664867 - RNA, 64 nt, hsa
gaccugacaugucugagauaaccaaggugauucaggauuugaucaaaagaagucuaguaagaau

SEQ ID NO: 664868 - RNA, 64 nt, hsa
aacugauuuguuuccaaugucggguucacuuaaaggauuugacuuaccaccagagcauagaaaa

SEQ ID NO: 664869 - RNA, 64 nt, hsa
gguggaugguuggugucauuuacuaaaauggggaggauuugaggugaaaaaauuuuaggugaag

SEQ ID NO: 664870 - RNA, 64 nt, hsa
gguuaauucuucaggaugcagcccggaggaacguggauuugacuuaaagaaguaaagagcaucg

SEQ ID NO: 664871 - RNA, 64 nt, hsa
cccaaaucugucagcaucuggcugucuagaauguggauuugauucauuuuccuguucagugaga

SEQ ID NO: 664872 - RNA, 64 nt, hsa
cugccugaguuuccagccugcuagucugcccuauggauuugaaguuugccaaccccaacaauug

SEQ ID NO: 664873 - RNA, 64 nt, hsa
gcuuuguuacaauaaaacuaaauguguacacaaaggauuugaugcuuuucucucagcauaggua

SEQ ID NO: 664874 - RNA, 64 nt, hsa
aggaugaccucagggcuauguggauugaguaaugggauuugaaucaauguauuaauaucuccau

SEQ ID NO: 664875 - RNA, 64 nt, hsa
acauagcugggauuugaacugagccgugcagcugggauuugaaccaggccuucugauuucaagg

SEQ ID NO: 664876 - RNA, 64 nt, hsa
uuugucuuugaacguacccaaggucacauagcugggauuugaacugagccgugcagcugggauu

SEQ ID NO: 664877 - RNA, 64 nt, hsa
cacugaauuguaaauguuuuuacagugaguuuuauuaauagaaugcuucaccuuaaauuggaaa

SEQ ID NO: 664878 - RNA, 64 nt, hsa
cacucuuucacccuggaacagacaagaggugggcuuaauagaggcagagacuggggauauaccu

SEQ ID NO: 664879 - RNA, 64 nt, hsa
uuguaaaaaguauguauuuggaauuuucuucguuuuaauagaauauuauaaacucaaaauauaa

SEQ ID NO: 664880 - RNA, 64 nt, hsa
aacaagggaaauuuaaaucuccaaauaaggcauuuuaauagacuguacugcuucuuaaaccagc

SEQ ID NO: 664881 - RNA, 64 nt, hsa
ucuauuagacacaucugugcuucagucauagauguuaauagaggaagcaguuuuccugcugcag

SEQ ID NO: 664882 - RNA, 64 nt, hsa
guugccuaaaacagacaaaauagacuuagauuuauuaauagaaacuauacucucugccaauuuu

SEQ ID NO: 664883 - RNA, 64 nt, hsa
uaugaaugugauugguaacuaggauauguauauuuuaauagaauuuuuaacaaaacuucuuaga

SEQ ID NO: 664884 - RNA, 64 nt, hsa
aauucccugcuaaaugccauguuuaucacccuaauuaauagaauggaggggacuccaaagcugg

SEQ ID NO: 664885 - RNA, 64 nt, hsa
gcauuucuggaaauauuugauuuaaaaacauauauuaauagauguuuucccuagcagacuuuug

SEQ ID NO: 664886 - RNA, 64 nt, hsa
uauuuuuuuccuuuuucuaaucuuuuccuuaaaauuaauagauaacaaacuaaguuacuuuuuu

SEQ ID NO: 664887 - RNA, 64 nt, hsa
uuguuuauucuuuuuaaauaaaaaugucacaaguuuaauagaucagccuuguaaagcaagcaua

SEQ ID NO: 664888 - RNA, 64 nt, hsa
gugaggcugguguguaugauugucuuaaaauuuuuuaauagauauggccgagcgugauggcuca

SEQ ID NO: 664889 - RNA, 64 nt, hsa
uuugacagugagacugucaaaaaaaaaaaaaaaauuaauagauaaaacaggccacuagagggug

SEQ ID NO: 664890 - RNA, 64 nt, hsa
ugcuaguaaucagcacucuuucuuuuuuuuuuuuuuaauagagacagggucucgcaguguugcc

SEQ ID NO: 664891 - RNA, 64 nt, hsa
acaguuauauauaugguauuuugcaaaaggacuauuaauagaaccuuuugagaugaauuaaugu

SEQ ID NO: 664892 - RNA, 64 nt, hsa
uaaaugcucuuaucauuuugaaaugggcucuugauuaauagacccauauuuuuuaguggcuucu

SEQ ID NO: 664893 - RNA, 64 nt, hsa
ugccagauguagcuacuuaaggaaaaaaggguuuuuaauagaaaugaacuuuugauuaguaugg

SEQ ID NO: 664894 - RNA, 64 nt, hsa
ugagcacuaccacgcccggcuaauuuuuguauuuuuaauagagacgggguuucaccauguuggc

SEQ ID NO: 664895 - RNA, 64 nt, hsa
gugccaccaugucuggcuaauuuuuuguauuuuuuuaauagauaugggguuucgccauguuggc

SEQ ID NO: 664896 - RNA, 64 nt, hsa
aggaaugugggaaggccuuugcuuguuuccuaccuuaauagaaaucagagaauucacacuagug

SEQ ID NO: 664897 - RNA, 64 nt, hsa
gaaugugggaaugccuucauuuguuuuuuugauuuuaauagacaucagagaauucacaaaggag

SEQ ID NO: 664898 - RNA, 64 nt, hsa
ggauacagauuauauauauauauacauauuuuccuuaauagaggaaugcuucauauuauucaaa

SEQ ID NO: 664899 - RNA, 64 nt, hsa
cuuguaaucugcauucuccaggaguuuuauguguuuaauagaugaauuuauuuuauuucuaaag

SEQ ID NO: 664900 - RNA, 64 nt, hsa
gguauaaaacaauauuuugacaguuuaggcuucauuaauagaacuauucugauuauuuggacug

SEQ ID NO: 664901 - RNA, 64 nt, hsa
gaauucgugugccuuagauuuagaaguguguucuuuaauagaguguacagggcuaaaagaguau

SEQ ID NO: 664902 - RNA, 64 nt, hsa
aauaaucaaaaauauuuuauuaggcccccaaaauuuaauagauaucuauuucuguuacauuuua

SEQ ID NO: 664903 - RNA, 64 nt, hsa
uagucuuaagcauuuuugcaauuuuuuaaauguauuaauagagucaauggaacuuuaaaauauu

SEQ ID NO: 664904 - RNA, 64 nt, hsa
guccuucguuugaucaauaaacaguguuacagauaacuucaaguuuauaaaaauacagugaaau

SEQ ID NO: 664905 - RNA, 64 nt, hsa
uauauaugcucagaucaauauacuuguuuagaaaaacuucaagacauucaaaaacuaggaagga

SEQ ID NO: 664906 - RNA, 64 nt, hsa
ugaucauggaggaaaaagguacuggauaaaaguaaacuucaaaccuuagggcgggagcacuaaa

SEQ ID NO: 664907 - RNA, 50 nt, hsa
aggagucugaggauaacuaaaacuucaaauacacaaaaugaaacaaaaga

SEQ ID NO: 664908 - RNA, 64 nt, hsa
uucauuuaguacucuucuuuccuccuacucuaugaacuucaaaacaaaaacaaaacuuugagag

SEQ ID NO: 664909 - RNA, 64 nt, hsa
gcuaaaaggugcugauauuuuauuuaguacugccaacuucaagugauuuagauaucuaucuauc

SEQ ID NO: 664910 - RNA, 64 nt, hsa
uaucugaacauaccuguuuuucgaaacuucaagaaacuucaauaagggaugcauugagcagucu

SEQ ID NO: 664911 - RNA, 64 nt, hsa
ugcugaaaauuaucugaacauaccuguuuuucgaaacuucaagaaacuucaauaagggaugcau

SEQ ID NO: 664912 - RNA, 64 nt, hsa
aaauucacaaaaaaauuaauaccucuguggagaaaacuucaaaacuuaaaaaaggacauagaaa

SEQ ID NO: 664913 - RNA, 64 nt, hsa
aaguggcauaguuuuaucaauaucugucaaauuaaacuucaaggcaaaacuuuuuuauugagau

SEQ ID NO: 664914 - RNA, 64 nt, hsa
acauuuauauuuaaacuucaauuuuuuauauuuaaacuucaauuuuuuagcaacagcugaauag

SEQ ID NO: 664915 - RNA, 64 nt, hsa
ggaaaaaagguccgaauuuucacauuuauauuuaaacuucaauuuuuuauauuuaaacuucaau

SEQ ID NO: 664916 - RNA, 64 nt, hsa
ugauuauguguccuuucuugauggcuguaaugagaacuucaaucacuguagucuaagaccugau

SEQ ID NO: 664917 - RNA, 64 nt, hsa
gcagcaguuccaugaagacacgcuuaaaaccuagaacuucaaaauguucguauucuauucaaaa

SEQ ID NO: 664918 - RNA, 64 nt, hsa
ucaucucaggcacaaauauauauggggacaucaaaacuucaauaaucaagauaccuaauauuua

SEQ ID NO: 664919 - RNA, 64 nt, hsa
gucauaugcagugaccuuuggugaucuucuuaggaacuucaagaaaaggaauuuuccuguuaaa

SEQ ID NO: 664920 - RNA, 64 nt, hsa
uacacacacagacacacagaugugggguacacugaacuucaaagcccaaaugaauagaaacaca

SEQ ID NO: 664921 - RNA, 64 nt, hsa
ggcccucugcuggcugaguggcaauacuacaacaaacuucaaggcaaguuuggcugaaaacagu

SEQ ID NO: 664922 - RNA, 64 nt, hsa
ggugugauuagguguagagaauuugcuuaaauuuaacuucaaaguucaucacacagcuuaauga

SEQ ID NO: 664923 - RNA, 64 nt, hsa
guauguuagcauauuuucuaugcagcaguuggucaacuucaacucaaaacacuguuuucuuaug

SEQ ID NO: 664924 - RNA, 64 nt, hsa
auacccacuuuucaggaugggacaguaucagaugaacuucaacccauggagaacaagccucaac

SEQ ID NO: 664925 - RNA, 64 nt, hsa
gacaggaaacgaauauggacguaauugcagaaggaacuucaaggagaugaaugaaugcuaaaag

SEQ ID NO: 664926 - RNA, 64 nt, hsa
acgacgugugaccauuucgucauauuuaaaauauaacuucaagaaaagaguaaacauccauugg

SEQ ID NO: 664927 - RNA, 64 nt, hsa
auguugauguuuucaacuccaaaucaauucuaaaaacuucaagcacuuaauggaaagguaaaug

SEQ ID NO: 664928 - RNA, 64 nt, hsa
uaagaguauauaauucuuaacaggaauuauaaauaacuucaauaugaugagagcacuuaagauc

SEQ ID NO: 664929 - RNA, 64 nt, hsa
aaguaauggaugagcaaacagaauuaccugagcuaacuucaagguggucacguacaguuguaug

SEQ ID NO: 664930 - RNA, 64 nt, hsa
auguuuaauguuguaauauuaucuaacuggucuaaacuucaaauaucauuuuaccuuugaagaa

SEQ ID NO: 664931 - RNA, 64 nt, hsa
uuaccuuugaagaaaaccagaaaacauucaaaagaacuucaacaaaucaucacguaacaggauc

SEQ ID NO: 664932 - RNA, 64 nt, hsa
auugucuaagcuuuaauccacuguguuaggucaaaacuucaaauacaugcauuuuucaauauag

SEQ ID NO: 664933 - RNA, 64 nt, hsa
accuaucagcuuaguuuuuuaacaugguagucuaaacuucaaggcuugcucuaucuccuagagc

SEQ ID NO: 664934 - RNA, 64 nt, hsa
gaaauuguugaauuaguuagugaauaaagaaauaaacuucaacuagaaauccaguuagaagugc

SEQ ID NO: 664935 - RNA, 64 nt, hsa
gcuagaaauggauugaauuaguagaccagaaaguaacuucaaauguguauuaugauaauuuccc

SEQ ID NO: 664936 - RNA, 64 nt, hsa
ugagacaugcuuauuuugcuaaaggaugcacccaaacuucaaacuucaagcaaaugaaauggac

SEQ ID NO: 664937 - RNA, 64 nt, hsa
ugcuuauuuugcuaaaggaugcacccaaacuucaaacuucaagcaaaugaaauggacaaugcag

SEQ ID NO: 664938 - RNA, 64 nt, hsa
uuugcauaugaaagaggccagaacccacaggaaaaacuucaaaacuugacauuugccagaaugu

SEQ ID NO: 664939 - RNA, 64 nt, hsa
acccuccaccccgcuguuuuucuuaaauuugcagaacuucaaauuggcuauuccucuugcaaau

SEQ ID NO: 664940 - RNA, 64 nt, hsa
cccuucucaccccucaaccuccggaguccaggagaacccguacccccacagagccuuaagcaac

SEQ ID NO: 664941 - RNA, 50 nt, hsa
ucauaccauuccuuggaugaaacccguauaguucacaauagagcucaggg

SEQ ID NO: 664942 - RNA, 64 nt, hsa
gugugcaaaaagcacaaccccaaucacacacagaaacccguaggcacggacacacccagucuca

SEQ ID NO: 664943 - RNA, 64 nt, hsa
caaacaugauugccuucuuguuuucuguauguauaacccguaaauauccauuuugacauaggaa

SEQ ID NO: 664944 - RNA, 64 nt, hsa
gggaaaacugagaaaacccauauucuccuaauacaacccguaauagcauuuuugccugccucga

SEQ ID NO: 664945 - RNA, 64 nt, hsa
cuauacuagacagauacaguggagauagcuuucaaacccguaucuauuccuaacuacugccucu

SEQ ID NO: 664946 - RNA, 61 nt, hsa
acucaaccagugaugauuagaacaaaagaaaaacccguaagauuccuuuugugaaaaguuu

SEQ ID NO: 664947 - RNA, 64 nt, hsa
ucagagaucuguagggccgagguuacauuuggagaacccguacucuagggccaaauccauucuu

SEQ ID NO: 664948 - RNA, 64 nt, hsa
accagaugcgagacauguuugaugacuacguccgaacccguacgcugcacaacuggaaguucug

SEQ ID NO: 664949 - RNA, 64 nt, hsa
gugaugcuguaauuuuacuuuucaacauaaguugaacccguagcagucuguuuaccuuguaaag

SEQ ID NO: 664950 - RNA, 64 nt, hsa
cccuccucccccacucucaauaccuagagagugaaacccguacaaugagauaaagacuaaaaag

SEQ ID NO: 664951 - RNA, 64 nt, hsa
uaaauaugagacaccaggacuugaaacuuaucucaacccguagaugucuuacaagucuuauauu

SEQ ID NO: 664952 - RNA, 64 nt, hsa
gucaaaaaaacagagguuuuaacacauaaguaaaaacccguacauauuugauguguaaugcagg

SEQ ID NO: 664953 - RNA, 64 nt, hsa
uaaaagccuuaaaaccauguaugugcgcuguuugaacccguaagccacuucuuugacauuagaa

SEQ ID NO: 664954 - RNA, 64 nt, hsa
ugguuucagcuuugauugcccacucuuggcuuucaacccguaggcuccggcuccugacgccaca

SEQ ID NO: 664955 - RNA, 64 nt, hsa
ggagagagagagaagccuuguuguuggauaggaaaacccguacuaaagauacucuaccuacauu

SEQ ID NO: 664956 - RNA, 64 nt, hsa
cuucuuaccucagaugccugaacagaacaaggcaaacccguagcagccucucaggagcugacag

SEQ ID NO: 664957 - RNA, 64 nt, hsa
uauuuuugaaagaauacauuuggucauaaagugaaacccguauuagcaaguacguggcaauguu

SEQ ID NO: 664958 - RNA, 64 nt, hsa
gcuauaugguauagucuguugcuccuaggcuacaaacccguauagcauguuacuguccugcaug

SEQ ID NO: 664959 - RNA, 64 nt, hsa
cauggagacaguagaauuagugaaccccugaguuaacccguaaggccuuccguguaaccugcau

SEQ ID NO: 664960 - RNA, 64 nt, hsa
cuaugauguuuaauaaguauuauaguguaaagaaaacccguacccccaaaacucccacaacaag

SEQ ID NO: 664961 - RNA, 64 nt, hsa
gcuucuguaugucucuugugguauuggaacaauaaacccguacaaccugcaguuguggucucag

SEQ ID NO: 664962 - RNA, 64 nt, hsa
cuuguuucagaaagauggaagagaguucuuuggaaacccguagauacagagaaguggucgauuc

SEQ ID NO: 664963 - RNA, 64 nt, hsa; identical to SEQ ID NO: 311803

SEQ ID NO: 664964 - RNA, 64 nt, hsa; identical to SEQ ID NO: 311804

SEQ ID NO: 664965 - RNA, 64 nt, hsa; identical to SEQ ID NO: 311805

SEQ ID NO: 664966 - RNA, 64 nt, hsa; identical to SEQ ID NO: 311806

SEQ ID NO: 664967 - RNA, 64 nt, hsa; identical to SEQ ID NO: 311807

SEQ ID NO: 664968 - RNA, 64 nt, hsa; identical to SEQ ID NO: 311808

SEQ ID NO: 664969 - RNA, 64 nt, hsa; identical to SEQ ID NO: 311809

SEQ ID NO: 664970 - RNA, 64 nt, hsa; identical to SEQ ID NO: 311810

SEQ ID NO: 664971 - RNA, 64 nt, hsa; identical to SEQ ID NO: 311811

SEQ ID NO: 664972 - RNA, 64 nt, hsa; identical to SEQ ID NO: 311812

SEQ ID NO: 664973 - RNA, 64 nt, hsa; identical to SEQ ID NO: 311813

SEQ ID NO: 664974 - RNA, 64 nt, hsa; identical to SEQ ID NO: 311814

SEQ ID NO: 664975 - RNA, 64 nt, hsa; identical to SEQ ID NO: 311815

SEQ ID NO: 664976 - RNA, 64 nt, hsa; identical to SEQ ID NO: 311816

SEQ ID NO: 664977 - RNA, 64 nt, hsa; identical to SEQ ID NO: 311817

SEQ ID NO: 664978 - RNA, 64 nt, hsa; identical to SEQ ID NO: 311818

SEQ ID NO: 664979 - RNA, 64 nt, hsa; identical to SEQ ID NO: 311819

SEQ ID NO: 664980 - RNA, 64 nt, hsa; identical to SEQ ID NO: 311820

SEQ ID NO: 664981 - RNA, 64 nt, hsa; identical to SEQ ID NO: 311821

SEQ ID NO: 664982 - RNA, 64 nt, hsa; identical to SEQ ID NO: 311822

SEQ ID NO: 664983 - RNA, 64 nt, hsa; identical to SEQ ID NO: 311823

SEQ ID NO: 664984 - RNA, 64 nt, hsa; identical to SEQ ID NO: 311824

SEQ ID NO: 664985 - RNA, 64 nt, hsa; identical to SEQ ID NO: 311825

SEQ ID NO: 664986 - RNA, 64 nt, hsa; identical to SEQ ID NO: 311824

SEQ ID NO: 664987 - RNA, 64 nt, hsa; identical to SEQ ID NO: 311824

SEQ ID NO: 664988 - RNA, 64 nt, hsa; identical to SEQ ID NO: 311828

SEQ ID NO: 664989 - RNA, 64 nt, hsa; identical to SEQ ID NO: 311829

SEQ ID NO: 664990 - RNA, 64 nt, hsa; identical to SEQ ID NO: 311830

SEQ ID NO: 664991 - RNA, 64 nt, hsa; identical to SEQ ID NO: 311831

SEQ ID NO: 664992 - RNA, 64 nt, hsa; identical to SEQ ID NO: 311832

SEQ ID NO: 664993 - RNA, 64 nt, hsa; identical to SEQ ID NO: 311833

SEQ ID NO: 664994 - RNA, 64 nt, hsa; identical to SEQ ID NO: 311834

SEQ ID NO: 664995 - RNA, 64 nt, hsa; identical to SEQ ID NO: 311835

SEQ ID NO: 664996 - RNA, 64 nt, hsa; identical to SEQ ID NO: 311836

SEQ ID NO: 664997 - RNA, 64 nt, hsa; identical to SEQ ID NO: 311837

SEQ ID NO: 664998 - RNA, 64 nt, hsa; identical to SEQ ID NO: 311838

SEQ ID NO: 664999 - RNA, 64 nt, hsa; identical to SEQ ID NO: 311839

SEQ ID NO: 665000 - RNA, 64 nt, hsa; identical to SEQ ID NO: 311840

SEQ ID NO: 665001 - RNA, 64 nt, hsa; identical to SEQ ID NO: 311841

SEQ ID NO: 665002 - RNA, 64 nt, hsa; identical to SEQ ID NO: 311842

SEQ ID NO: 665003 - RNA, 64 nt, hsa; identical to SEQ ID NO: 311843

SEQ ID NO: 665004 - RNA, 64 nt, hsa; identical to SEQ ID NO: 311844

SEQ ID NO: 665005 - RNA, 64 nt, hsa; identical to SEQ ID NO: 311845

SEQ ID NO: 665006 - RNA, 64 nt, hsa; identical to SEQ ID NO: 311846

SEQ ID NO: 665007 - RNA, 64 nt, hsa
agauguaucuguaccuucucauuugauguauuaaucauaaaauuucacuacaagguaauuuuug

SEQ ID NO: 665008 - RNA, 64 nt, hsa
caugcugaccagaauccuguuauuuuuauaugcaucauaaaauuucccauuucugcauuaaaua

SEQ ID NO: 665009 - RNA, 64 nt, hsa
uccuuucuagaguauauguucagcaauguugaucucauaaaaggaaaaacaaaagauuuaagua

SEQ ID NO: 665010 - RNA, 64 nt, hsa
gggauugguguaggguuaaaucaucaacauuauuucauaaaauaagaauuuguucuguguuauc

SEQ ID NO: 665011 - RNA, 64 nt, hsa
auccuuuauagccagggacuuuuuucuuauuuauucauaaaauaaauuauaguuaauuauaccc

SEQ ID NO: 665012 - RNA, 64 nt, hsa
agaaucagccugggcaacauagcaauacuccgucucauaaaaauuaauaaauaaaaagucucag

SEQ ID NO: 665013 - RNA, 64 nt, hsa
ugaugugcugugauaugagggaaucugaaauguuucauaaaaauaaagcuuaaaaauugucuua

SEQ ID NO: 665014 - RNA, 64 nt, hsa
uacucugauccuuacagaauccaagaggaagcuuucauaaaaacaauucagcaaauauuuccaa

SEQ ID NO: 665015 - RNA, 63 nt, hsa
uauauacacugccucuucaauuuggaaauaaauuucauaaaaauagauguaaacaccucuucu

SEQ ID NO: 665016 - RNA, 64 nt, hsa
cagguaucuuggauuucagacacauucuguuucuucauaaaaauuuuacuuaaaaucuguaacg

SEQ ID NO: 665017 - RNA, 64 nt, hsa
caucugcaucccaaguccuauuuuauaaggauauucauaaaaauuccauggugaauccuugucu

SEQ ID NO: 665018 - RNA, 64 nt, hsa
acccuucuccuuggauuguuuuggaaguuauucuucauaaaaaauguuaacgugggcugggcau

SEQ ID NO: 665019 - RNA, 64 nt, hsa
uguaauuuguggaugguugaguuuguaagaacaaucauaaaaggacuuguuagucuccagaaca

SEQ ID NO: 665020 - RNA, 64 nt, hsa
aaauaucacugacucaucccuacccauauucuuuucauaaaacccacucaccagguacaauaga

SEQ ID NO: 665021 - RNA, 64 nt, hsa
guguauauauaaacacaaauaauuagugacagauucauaaaaaauugaauguuguacacaguaa

SEQ ID NO: 665022 - RNA, 64 nt, hsa
agcaaagucauacuuacguguugucacuggauuaucauaaaagggagaaauuaaauauuacugu

SEQ ID NO: 665023 - RNA, 64 nt, hsa
aaggaaauacguugcagugauguggguacugcuuucauaaaacaguuuuuucaguauuuugaga

SEQ ID NO: 665024 - RNA, 64 nt, hsa
aauggaaaacuuaauaaauugcuacuguuuuauaucauaaaauuaaaauaccaugguaauauuu

SEQ ID NO: 665025 - RNA, 64 nt, hsa
acaagaaaaacugaguaacaaaaaagaccaugcaucauaaaauugcccagucuucagcggagca

SEQ ID NO: 665026 - RNA, 64 nt, hsa
gagggagguauccuguuguucuuacucacucuucucauaaaauaggaaauauuuuaguucuguu

SEQ ID NO: 665027 - RNA, 64 nt, hsa
auuuaguacuaaaaucacagucaugaaaucauagucauaaaauggucuucacacagcagucauc

SEQ ID NO: 665028 - RNA, 64 nt, hsa
aaguuuuguauauuuauuguauuaacacagagugucauaaaauaaaaugcuguuuacuggaugu

SEQ ID NO: 665029 - RNA, 64 nt, hsa
aaagcuauuaugcaggaggauuuagaagucacauucauaaaacccaagugcuauggguguauua

SEQ ID NO: 665030 - RNA, 64 nt, hsa
aaugaagcuuuuucucaguacaagauucugaguaucauaaaaugguuauuuaauugaaacguag

SEQ ID NO: 665031 - RNA, 64 nt, hsa
uuuagaauauuuuauguugcuugcacuauaggagucauaaaaggaacuuaguuaaaauauguug

SEQ ID NO: 665032 - RNA, 64 nt, hsa
uuuagguacaaacuuuauaaagaauguuaguaugucauaaaauauaacauuacagcuuauuuaa

SEQ ID NO: 665033 - RNA, 64 nt, hsa
aaaaaaguuuuuacuucuaagauuugcauuuacaucauaaaauuaaaccauuuucaggaaaauc

SEQ ID NO: 665034 - RNA, 64 nt, hsa
aggggagaaaacaccaggaaagaggaacccugggucauaaaaugacggaccuguuaggaaaaug

SEQ ID NO: 665035 - RNA, 64 nt, hsa
auuaggauagacccuaauucaauaugacugaugaucauaaaagaagaggcgaguagggcacaac

SEQ ID NO: 665036 - RNA, 64 nt, hsa
aaauaaaaacuacggguagaaaacauaagaacuaucauaaaauuuacuuacaaggaggcugcuc

SEQ ID NO: 665037 - RNA, 64 nt, hsa
gguaaggcugcaugauagcauuccuauauuucucucauaaaauaggauuugaaggaugaaauua

SEQ ID NO: 665038 - RNA, 64 nt, hsa
aucuacucuagagacauauaaucauacagauuauucauaaaauuuuucagugcuguccuuccac

SEQ ID NO: 665039 - RNA, 64 nt, hsa
gccagaggcagaaauggucuggguauaagcuauuucauaaaagcagcuuuaaauugucaguauu

SEQ ID NO: 665040 - RNA, 64 nt, hsa
ucuuaauuucuaacauuaucuuugcuuuuauguuucauaaaaauuugucauuauuuaugcuggu

SEQ ID NO: 665041 - RNA, 64 nt, hsa
gaacacauaacacuacugaauuauaaaaauucaaucauaaaagucaaaauauauuacauaauau

SEQ ID NO: 665042 - RNA, 64 nt, hsa
uagucauuauucuugaugaagagucuguuuuuaaucauaaaaaucaugacaguuacucagaccc

SEQ ID NO: 665043 - RNA, 64 nt, hsa
uaguaccucaaugcgauucugagauauuugaauuucauaaaauuguaacugaaauuuaaaauuu

SEQ ID NO: 665044 - RNA, 64 nt, hsa
auaauugcuuguuuucuagccuggcaagauauuuucauaaaagagggauaacaaugcugauuac

SEQ ID NO: 665045 - RNA, 64 nt, hsa
aauacaguuucaaaaggaagacucaugagaaauuucauaaaauacaaguuuuuagauguuuaug

SEQ ID NO: 665046 - RNA, 64 nt, hsa
ugaugcauuaacauaaaauaucaaacacacaaagucauaaaaugaaaauuuacaguuuuaccug

SEQ ID NO: 665047 - RNA, 64 nt, hsa
uuuucguuuucaguuaucaaaagugacuuugaccucauaaaagaguugagaacaucucucgugu

SEQ ID NO: 665048 - RNA, 64 nt, hsa
uuuuuuuuaaacuaaugaaugacauuuagauacuucauaaaauuaugaacagauauggaggcca

SEQ ID NO: 665049 - RNA, 64 nt, hsa
uaacugugcguuaaauaagcaaauaaacaguggcucauaaaaauaaaagucgcauuccauaucu

SEQ ID NO: 665050 - RNA, 64 nt, hsa
uuggaugggccuuuuagaaaccucauuggccagcucauaaaauggaagcaauugcucauguugg

SEQ ID NO: 665051 - RNA, 64 nt, hsa
aaaaaagcuuguggccaauggaacaguaagaacaucauaaaauuuuuauauauauaguuuauuu

SEQ ID NO: 665052 - RNA, 64 nt, hsa
gguuaaaauucuucaccauauuaguuuuguugcuucauaaaauuuaccuaagcaaguggucuug

SEQ ID NO: 665053 - RNA, 64 nt, hsa
aaaguuagagaacauuauguuuguaucauuucuuucauaaaaccucaagagcauuuuuaagccc

SEQ ID NO: 665054 - RNA, 64 nt, hsa
aacuauaaugugauucaagguguuuauaggcuugucauaaaagggucauuucuguguguuacuu

SEQ ID NO: 665055 - RNA, 64 nt, hsa
uaucaaucuuauaaauauauguaaucuauuuucuucauaaaacaggcacaaaaguuuuaucagu

SEQ ID NO: 665056 - RNA, 64 nt, hsa
aauucugaauuucauguaaugacaacauauucuuucauaaaacuauggccuguuuaagauggaa

SEQ ID NO: 665057 - RNA, 64 nt, hsa
aucugguugaccaugauuuuaauccagaacuuccucauaaaaugcaugaaggacuuugaucgug

SEQ ID NO: 665058 - RNA, 64 nt, hsa
aauugagugcuuuuaaauacuuuuuagaaaguaaucauaaaaguaaauugaauuucaaaccuau

SEQ ID NO: 665059 - RNA, 64 nt, hsa
aggcugaaugaacuucauacaaaugaaaaaaaucucauaaaaauacauaaacuauguagcaaaa

SEQ ID NO: 665060 - RNA, 64 nt, hsa
ugagaguauuacagguagacuugguuuuuagaauucauaaaacugacaggcaggggaaucuucc

SEQ ID NO: 665061 - RNA, 64 nt, hsa
ugaaguguagauuuguauuuaguccugcuugcucucauaaaaagagccaguucuuuucucugcu

SEQ ID NO: 665062 - RNA, 64 nt, hsa
augccacugugugcauccauuuuaaaggguucccucauaaaaaaauguuauuccccauuaucac

SEQ ID NO: 665063 - RNA, 64 nt, hsa
accuguugaguuucuaaugaauauuuguagaaucucauaaaacaguuuaaauacaagcuuaagu

SEQ ID NO: 665064 - RNA, 64 nt, hsa
agucugcuguugaacuauuagauuaagucauaauucauaaaauuuuaguuuaaugugcucuuug

SEQ ID NO: 665065 - RNA, 64 nt, hsa
acaauacuuaauguauuguacuagauugccaaauucauaaaauguuaauggaagcuuuuugaug

SEQ ID NO: 665066 - RNA, 64 nt, hsa
ucugucaucaucauucauguuuuuuaaggccuggucauaaaacuuuaaauuuuacuaguguuac

SEQ ID NO: 665067 - RNA, 64 nt, hsa
aaauagcuacacucugcccucuguaauguagcauucauaaaaauuuggaaguauuuacauccuc

SEQ ID NO: 665068 - RNA, 64 nt, hsa
aaagcugcuuaaaacuguggcucuaagagaguaaucauaaaauaccuuagauaaaauugcacua

SEQ ID NO: 665069 - RNA, 64 nt, hsa
uacuaauacacaucugcuucaaaaugaacauauuucauaaaauuggcaucaauuuuaaugacgc

SEQ ID NO: 665070 - RNA, 64 nt, hsa
auauaccacucugauaacucauauaaaaauaucaucauaaaaagcuuaauuucaucccuuuuau

SEQ ID NO: 665071 - RNA, 64 nt, hsa
auuuuuaaagcacuagguuuuaaaucaguggguaucauaaaagccauauauaaaagauccuuuc

SEQ ID NO: 665072 - RNA, 64 nt, hsa
uucuaagaauuccauuugccucuaugaucuuagcucauaaaaauauaauaugacuugauaaagc

SEQ ID NO: 665073 - RNA, 64 nt, hsa
ugaaguuauaaguuuaaaacucaauuucagaugcucauaaaaguuacuuagcuaaaauuuuagc

SEQ ID NO: 665074 - RNA, 64 nt, hsa
cauaauauggaacaauuauaacaauauacuguaaucauaaaaguuaugugaauaugaucuuucu

SEQ ID NO: 665075 - RNA, 64 nt, hsa
cuagaaucaucaaaauuauuuguuguugaagcagucauaaaacugagacugagacagaauauug

SEQ ID NO: 665076 - RNA, 64 nt, hsa; identical to SEQ ID NO: 605451

SEQ ID NO: 665077 - RNA, 64 nt, hsa; identical to SEQ ID NO: 605452

SEQ ID NO: 665078 - RNA, 64 nt, hsa; identical to SEQ ID NO: 605453

SEQ ID NO: 665079 - RNA, 64 nt, hsa; identical to SEQ ID NO: 605454

SEQ ID NO: 665080 - RNA, 64 nt, hsa; identical to SEQ ID NO: 605455

SEQ ID NO: 665081 - RNA, 64 nt, hsa; identical to SEQ ID NO: 605456

SEQ ID NO: 665082 - RNA, 64 nt, hsa; identical to SEQ ID NO: 605457

SEQ ID NO: 665083 - RNA, 64 nt, hsa; identical to SEQ ID NO: 605458

SEQ ID NO: 665084 - RNA, 64 nt, hsa; identical to SEQ ID NO: 605459

SEQ ID NO: 665085 - RNA, 64 nt, hsa; identical to SEQ ID NO: 605460

SEQ ID NO: 665086 - RNA, 64 nt, hsa; identical to SEQ ID NO: 605461

SEQ ID NO: 665087 - RNA, 64 nt, hsa; identical to SEQ ID NO: 605462

SEQ ID NO: 665088 - RNA, 64 nt, hsa; identical to SEQ ID NO: 605463

SEQ ID NO: 665089 - RNA, 64 nt, hsa; identical to SEQ ID NO: 605464

SEQ ID NO: 665090 - RNA, 64 nt, hsa; identical to SEQ ID NO: 605465

SEQ ID NO: 665091 - RNA, 64 nt, hsa; identical to SEQ ID NO: 605466

SEQ ID NO: 665092 - RNA, 64 nt, hsa; identical to SEQ ID NO: 605467

SEQ ID NO: 665093 - RNA, 64 nt, hsa; identical to SEQ ID NO: 605468

SEQ ID NO: 665094 - RNA, 64 nt, hsa; identical to SEQ ID NO: 605469

SEQ ID NO: 665095 - RNA, 64 nt, hsa; identical to SEQ ID NO: 605470

SEQ ID NO: 665096 - RNA, 64 nt, hsa; identical to SEQ ID NO: 605471

SEQ ID NO: 665097 - RNA, 64 nt, hsa; identical to SEQ ID NO: 605472

SEQ ID NO: 665098 - RNA, 64 nt, hsa; identical to SEQ ID NO: 605473

SEQ ID NO: 665099 - RNA, 64 nt, hsa; identical to SEQ ID NO: 605474

SEQ ID NO: 665100 - RNA, 64 nt, hsa; identical to SEQ ID NO: 605475

SEQ ID NO: 665101 - RNA, 64 nt, hsa; identical to SEQ ID NO: 605476

SEQ ID NO: 665102 - RNA, 64 nt, hsa; identical to SEQ ID NO: 605477

SEQ ID NO: 665103 - RNA, 64 nt, hsa; identical to SEQ ID NO: 605478

SEQ ID NO: 665104 - RNA, 64 nt, hsa; identical to SEQ ID NO: 605479

SEQ ID NO: 665105 - RNA, 64 nt, hsa; identical to SEQ ID NO: 605480

SEQ ID NO: 665106 - RNA, 64 nt, hsa; identical to SEQ ID NO: 605481

SEQ ID NO: 665107 - RNA, 64 nt, hsa; identical to SEQ ID NO: 605482

SEQ ID NO: 665108 - RNA, 64 nt, hsa; identical to SEQ ID NO: 605483

SEQ ID NO: 665109 - RNA, 64 nt, hsa; identical to SEQ ID NO: 605484

SEQ ID NO: 665110 - RNA, 64 nt, hsa; identical to SEQ ID NO: 605485

SEQ ID NO: 665111 - RNA, 64 nt, hsa; identical to SEQ ID NO: 605486

SEQ ID NO: 665112 - RNA, 64 nt, hsa; identical to SEQ ID NO: 605487

SEQ ID NO: 665113 - RNA, 64 nt, hsa; identical to SEQ ID NO: 605488

SEQ ID NO: 665114 - RNA, 64 nt, hsa; identical to SEQ ID NO: 605489

SEQ ID NO: 665115 - RNA, 64 nt, hsa; identical to SEQ ID NO: 605490

SEQ ID NO: 665116 - RNA, 64 nt, hsa; identical to SEQ ID NO: 605491

SEQ ID NO: 665117 - RNA, 64 nt, hsa; identical to SEQ ID NO: 605492

SEQ ID NO: 665118 - RNA, 64 nt, hsa; identical to SEQ ID NO: 605493

SEQ ID NO: 665119 - RNA, 64 nt, hsa; identical to SEQ ID NO: 605494

SEQ ID NO: 665120 - RNA, 64 nt, hsa; identical to SEQ ID NO: 605495

SEQ ID NO: 665121 - RNA, 64 nt, hsa; identical to SEQ ID NO: 605496

SEQ ID NO: 665122 - RNA, 64 nt, hsa; identical to SEQ ID NO: 605497

SEQ ID NO: 665123 - RNA, 64 nt, hsa; identical to SEQ ID NO: 605498

SEQ ID NO: 665124 - RNA, 64 nt, hsa; identical to SEQ ID NO: 605499

SEQ ID NO: 665125 - RNA, 64 nt, hsa; identical to SEQ ID NO: 605500

SEQ ID NO: 665126 - RNA, 64 nt, hsa; identical to SEQ ID NO: 605501

SEQ ID NO: 665127 - RNA, 64 nt, hsa; identical to SEQ ID NO: 605502

SEQ ID NO: 665128 - RNA, 64 nt, hsa; identical to SEQ ID NO: 605503

SEQ ID NO: 665129 - RNA, 64 nt, hsa; identical to SEQ ID NO: 605504

SEQ ID NO: 665130 - RNA, 64 nt, hsa; identical to SEQ ID NO: 605505

SEQ ID NO: 665131 - RNA, 64 nt, hsa; identical to SEQ ID NO: 605506

SEQ ID NO: 665132 - RNA, 64 nt, hsa; identical to SEQ ID NO: 605507

SEQ ID NO: 665133 - RNA, 64 nt, hsa; identical to SEQ ID NO: 605508

SEQ ID NO: 665134 - RNA, 64 nt, hsa; identical to SEQ ID NO: 605509

SEQ ID NO: 665135 - RNA, 64 nt, hsa; identical to SEQ ID NO: 605510

SEQ ID NO: 665136 - RNA, 64 nt, hsa
uauaauaaaugacuaggguucacuuucugggacugauguuuaauuguaacacagauacaacagg

SEQ ID NO: 665137 - RNA, 64 nt, hsa
uaauugaaggcauuguuuuguuagaugcaguaaugauguuuaccagagauuauuguuuccuaug

SEQ ID NO: 665138 - RNA, 64 nt, hsa
uaaagggacauuuuccuguacuuuuucaaauaaugauguuuaaaaauuaucuugacauaagcgu

SEQ ID NO: 665139 - RNA, 64 nt, hsa
auuaccuuauguaaagcagaacuaaugcugacuggauguuuaaugggaugagcauuaaagcugc

SEQ ID NO: 665140 - RNA, 64 nt, hsa
uguuuacaagacugcuuuuaccuuaaacuuuguagauguuuacaucuuuuuguuguguuuuaag

SEQ ID NO: 665141 - RNA, 64 nt, hsa
ucugugaucaaccauuuuaacuuucaucucuagggauguuuaacauuuauaauugcaaaauaaa

SEQ ID NO: 665142 - RNA, 64 nt, hsa
cuauuguguaugaaagauguuuguacaaugaauugauguuuaguuugcuuuagucauuuaaaaa

SEQ ID NO: 665143 - RNA, 64 nt, hsa
guauuuugcuauaguugcuaauuaaaaaaauauagauguuuauuuauuuuuaaugcaguaauau

SEQ ID NO: 665144 - RNA, 64 nt, hsa
ugagaccaccuuggauuuuuauuuuugccauuuagauguuuauacuuauuuagcuuuuauaaaa

SEQ ID NO: 665145 - RNA, 64 nt, hsa
cucuuaaagucuaauuuuaggauggaugaauucagauguuuaccagaguguguauuuuacauaa

SEQ ID NO: 665146 - RNA, 64 nt, hsa
auggggcugauguguaaagcuguucaaguuauuugauguuuacaccucagggaaagucuugugu

SEQ ID NO: 665147 - RNA, 64 nt, hsa
uuuuguguuugaaguaucugugcaugggaucguugauguuuaucagaacuguucacuuucagaa

SEQ ID NO: 665148 - RNA, 64 nt, hsa
aauauuuguaaacugaaauucuguauguguaagagauguuuaaauauguuuggguccuaaacag

SEQ ID NO: 665149 - RNA, 64 nt, hsa
aaaacuaccaagagaacacgaggaaggcagaaacgauguuuagcaacaguauucugcaugguuc

SEQ ID NO: 665150 - RNA, 64 nt, hsa
accuuuaacagacuuguuuaaucuucucgauguagauguuuauguagguacuucacauugcaaa

SEQ ID NO: 665151 - RNA, 64 nt, hsa
cagcugcuuguuggauuccagugcagguaccugcgauguuuacguccacaccgagcccagugug

SEQ ID NO: 665152 - RNA, 64 nt, hsa; identical to SEQ ID NO: 155809

SEQ ID NO: 665153 - RNA, 64 nt, hsa; identical to SEQ ID NO: 155810

SEQ ID NO: 665154 - RNA, 64 nt, hsa; identical to SEQ ID NO: 155811

SEQ ID NO: 665155 - RNA, 64 nt, hsa; identical to SEQ ID NO: 155812

SEQ ID NO: 665156 - RNA, 64 nt, hsa; identical to SEQ ID NO: 155813

SEQ ID NO: 665157 - RNA, 64 nt, hsa; identical to SEQ ID NO: 155814

SEQ ID NO: 665158 - RNA, 64 nt, hsa; identical to SEQ ID NO: 155815

SEQ ID NO: 665159 - RNA, 64 nt, hsa; identical to SEQ ID NO: 155816

SEQ ID NO: 665160 - RNA, 64 nt, hsa; identical to SEQ ID NO: 155817

SEQ ID NO: 665161 - RNA, 64 nt, hsa; identical to SEQ ID NO: 155817

SEQ ID NO: 665162 - RNA, 64 nt, hsa; identical to SEQ ID NO: 155819

SEQ ID NO: 665163 - RNA, 64 nt, hsa; identical to SEQ ID NO: 155820

SEQ ID NO: 665164 - RNA, 64 nt, hsa; identical to SEQ ID NO: 155821

SEQ ID NO: 665165 - RNA, 64 nt, hsa
caagcuccuugaaaguaggaccuuugugagccacgccuuucauucuucaacagugccuugcaug

SEQ ID NO: 665166 - RNA, 64 nt, hsa
agcccuugcaguauuucugccucccuuucuuucugccuuucaccccacuaaauguauguuauug

SEQ ID NO: 665167 - RNA, 64 nt, hsa
ucaaggcucuuauucaauaccacguuccgaguuggccuuucaucuucuuugagacuggcccugc

SEQ ID NO: 665168 - RNA, 64 nt, hsa
gugagcugggccuacucucagcugccuaucuucugccuuucacuugcauccaacuccuggggcu

SEQ ID NO: 665169 - RNA, 64 nt, hsa
auaauguucccucaaauagcacggggaagcaacugccuuucaaggguaauugaggcugaaugaa

SEQ ID NO: 665170 - RNA, 64 nt, hsa
ggucauucaaucuguuuuuuuaaauguuauuuuugccuuucaauguaaucaauuggauuaacaa

SEQ ID NO: 665171 - RNA, 64 nt, hsa
ugcagaccucagagaggucccagcaccggcuguggccuuucagguguaggcaggugggcucugc

SEQ ID NO: 665172 - RNA, 64 nt, hsa
agugggaguggggcgugcgcguuauccauguauugccuuucagcucuagaucccccuccccugc

SEQ ID NO: 665173 - RNA, 53 nt, hsa; identical to SEQ ID NO: 588180

SEQ ID NO: 665174 - RNA, 64 nt, hsa; identical to SEQ ID NO: 588181

SEQ ID NO: 665175 - RNA, 52 nt, hsa; identical to SEQ ID NO: 588182

SEQ ID NO: 665176 - RNA, 64 nt, hsa; identical to SEQ ID NO: 588183

SEQ ID NO: 665177 - RNA, 64 nt, hsa; identical to SEQ ID NO: 588184

SEQ ID NO: 665178 - RNA, 64 nt, hsa; identical to SEQ ID NO: 588185

SEQ ID NO: 665179 - RNA, 64 nt, hsa; identical to SEQ ID NO: 588186

SEQ ID NO: 665180 - RNA, 64 nt, hsa; identical to SEQ ID NO: 588187

SEQ ID NO: 665181 - RNA, 64 nt, hsa; identical to SEQ ID NO: 588188

SEQ ID NO: 665182 - RNA, 64 nt, hsa; identical to SEQ ID NO: 588189

SEQ ID NO: 665183 - RNA, 64 nt, hsa; identical to SEQ ID NO: 588190

SEQ ID NO: 665184 - RNA, 64 nt, hsa; identical to SEQ ID NO: 588191

SEQ ID NO: 665185 - RNA, 64 nt, hsa; identical to SEQ ID NO: 588192

SEQ ID NO: 665186 - RNA, 64 nt, hsa; identical to SEQ ID NO: 588193

SEQ ID NO: 665187 - RNA, 64 nt, hsa; identical to SEQ ID NO: 588194

SEQ ID NO: 665188 - RNA, 64 nt, hsa; identical to SEQ ID NO: 588195

SEQ ID NO: 665189 - RNA, 64 nt, hsa; identical to SEQ ID NO: 588196

SEQ ID NO: 665190 - RNA, 64 nt, hsa; identical to SEQ ID NO: 588197

SEQ ID NO: 665191 - RNA, 64 nt, hsa; identical to SEQ ID NO: 588198

SEQ ID NO: 665192 - RNA, 64 nt, hsa; identical to SEQ ID NO: 588199

SEQ ID NO: 665193 - RNA, 64 nt, hsa; identical to SEQ ID NO: 588200

SEQ ID NO: 665194 - RNA, 64 nt, hsa; identical to SEQ ID NO: 588201

SEQ ID NO: 665195 - RNA, 64 nt, hsa; identical to SEQ ID NO: 588202

SEQ ID NO: 665196 - RNA, 64 nt, hsa; identical to SEQ ID NO: 588203

SEQ ID NO: 665197 - RNA, 64 nt, hsa; identical to SEQ ID NO: 588204

SEQ ID NO: 665198 - RNA, 64 nt, hsa; identical to SEQ ID NO: 588205

SEQ ID NO: 665199 - RNA, 64 nt, hsa; identical to SEQ ID NO: 588206

SEQ ID NO: 665200 - RNA, 64 nt, hsa; identical to SEQ ID NO: 588207

SEQ ID NO: 665201 - RNA, 64 nt, hsa; identical to SEQ ID NO: 588208

SEQ ID NO: 665202 - RNA, 64 nt, hsa; identical to SEQ ID NO: 588209

SEQ ID NO: 665203 - RNA, 64 nt, hsa; identical to SEQ ID NO: 588210

SEQ ID NO: 665204 - RNA, 64 nt, hsa; identical to SEQ ID NO: 588211

SEQ ID NO: 665205 - RNA, 64 nt, hsa; identical to SEQ ID NO: 588212

SEQ ID NO: 665206 - RNA, 64 nt, hsa; identical to SEQ ID NO: 588213

SEQ ID NO: 665207 - RNA, 64 nt, hsa; identical to SEQ ID NO: 588214

SEQ ID NO: 665208 - RNA, 64 nt, hsa; identical to SEQ ID NO: 588215

SEQ ID NO: 665209 - RNA, 64 nt, hsa; identical to SEQ ID NO: 588216

SEQ ID NO: 665210 - RNA, 64 nt, hsa; identical to SEQ ID NO: 588217

SEQ ID NO: 665211 - RNA, 64 nt, hsa; identical to SEQ ID NO: 588218

SEQ ID NO: 665212 - RNA, 64 nt, hsa; identical to SEQ ID NO: 588219

SEQ ID NO: 665213 - RNA, 64 nt, hsa; identical to SEQ ID NO: 588220

SEQ ID NO: 665214 - RNA, 64 nt, hsa; identical to SEQ ID NO: 588221

SEQ ID NO: 665215 - RNA, 64 nt, hsa; identical to SEQ ID NO: 588222

SEQ ID NO: 665216 - RNA, 64 nt, hsa; identical to SEQ ID NO: 588223

SEQ ID NO: 665217 - RNA, 64 nt, hsa; identical to SEQ ID NO: 588224

SEQ ID NO: 665218 - RNA, 64 nt, hsa; identical to SEQ ID NO: 588225

SEQ ID NO: 665219 - RNA, 64 nt, hsa; identical to SEQ ID NO: 588226

SEQ ID NO: 665220 - RNA, 64 nt, hsa; identical to SEQ ID NO: 588227

SEQ ID NO: 665221 - RNA, 64 nt, hsa; identical to SEQ ID NO: 588228

SEQ ID NO: 665222 - RNA, 64 nt, hsa; identical to SEQ ID NO: 588229

SEQ ID NO: 665223 - RNA, 64 nt, hsa; identical to SEQ ID NO: 588230

SEQ ID NO: 665224 - RNA, 64 nt, hsa; identical to SEQ ID NO: 588231

SEQ ID NO: 665225 - RNA, 64 nt, hsa; identical to SEQ ID NO: 588232

SEQ ID NO: 665226 - RNA, 64 nt, hsa; identical to SEQ ID NO: 588233

SEQ ID NO: 665227 - RNA, 64 nt, hsa; identical to SEQ ID NO: 588234

SEQ ID NO: 665228 - RNA, 64 nt, hsa; identical to SEQ ID NO: 588235

SEQ ID NO: 665229 - RNA, 64 nt, hsa; identical to SEQ ID NO: 588236

SEQ ID NO: 665230 - RNA, 64 nt, hsa; identical to SEQ ID NO: 588237

SEQ ID NO: 665231 - RNA, 64 nt, hsa; identical to SEQ ID NO: 588238

SEQ ID NO: 665232 - RNA, 64 nt, hsa
aacauaagcaacucaacaauauuaguugcauuccuuuauagacauaccaugucaaagacguuuu

SEQ ID NO: 665233 - RNA, 64 nt, hsa
uugagaguuuuuuagugcaaucugggccaguauuuuuauagauuaugauuaugugguaauuuau

SEQ ID NO: 665234 - RNA, 64 nt, hsa
uguaaacucucauaacugaauugcuuaaguauaauuuauagaauuucagugcaguucauucuua

SEQ ID NO: 665235 - RNA, 64 nt, hsa
uaugcuuguagcaaauugauguucuaacuguaguuuuauagaaaguauuaaugcuuuuauguau

SEQ ID NO: 665236 - RNA, 64 nt, hsa
cauuguguugcuacccaagagaaaaugcuacaguuuuauagauugcacaucauucuuuaaggca

SEQ ID NO: 665237 - RNA, 64 nt, hsa
cagcuagcagaauaauuacaauggcuaaaacguuuuuauagagaaucuuguuuuucaaaaaaga

SEQ ID NO: 665238 - RNA, 64 nt, hsa
gugcaccacaacucucagcuaauuuuuaaaauuuuuuauagaggugggguuuuacuaugcuguc

SEQ ID NO: 665239 - RNA, 64 nt, hsa
auacuuuuugaaacuagaccagaagauaguagacuuuauagagaaagaccaguuuuaccuagau

SEQ ID NO: 665240 - RNA, 64 nt, hsa
ccauguauugauguaguuaguccacauuuaaauuuuuauagaauuauauaguuuuugaaaaaua

SEQ ID NO: 665241 - RNA, 64 nt, hsa
uagucauucuaaaaaacaccuaauuauuaaaacauuuauagagugccuacuguaugcaugaguu

SEQ ID NO: 665242 - RNA, 64 nt, hsa
gagggaguauuacuuuuauguacaaaguuauuuauuuauagaaauuuugguacaguguacauug

SEQ ID NO: 665243 - RNA, 64 nt, hsa
gaaauaguucuggugccuuaacgcauggcuggaauuuauagaggcuacaaccacauuuguucac

SEQ ID NO: 665244 - RNA, 64 nt, hsa
cacguucuuauagcuguaaaguauagcuuagcuauuuauagaagacuaugagguacuguuguga

SEQ ID NO: 665245 - RNA, 64 nt, hsa
uggacuuuauuuucaucauaugauuucaauucucuuuauagaguuuuauuucauauccggugug

SEQ ID NO: 665246 - RNA, 64 nt, hsa
uuuuauaugaggauagggaccuuuaaauauguguuuuauagaauaucucacacauuuguaaugg

SEQ ID NO: 665247 - RNA, 64 nt, hsa
acucuuuguaaaacaaaagcaacuuugggugaguuuuauagauuuauuaaauuuugauaaagua

SEQ ID NO: 665248 - RNA, 64 nt, hsa
gcuugggcuaccaaaacuuggaguagcaaaaaccuuuauagaugauguuugcaaaauaagacug

SEQ ID NO: 665249 - RNA, 64 nt, hsa
uuucuuuccuuaagggggaaacuauauuuucuguuuuauagauucccucuuuuuggcacaaguu

SEQ ID NO: 665250 - RNA, 64 nt, hsa
uaagugcuucuuguugcugggugagaaauacuacuuuauagacaguuuugguuuucuguuugca

SEQ ID NO: 665251 - RNA, 64 nt, hsa
ugaacuauauauaaacuguacaaucuguaaaguuuuuauagaauaaauauucagcugugaaaac

SEQ ID NO: 665252 - RNA, 64 nt, hsa
uuccuccaaauccauacagugaggaaucagaguguuuauagauauaugaguugaaugcaauuuu

SEQ ID NO: 665253 - RNA, 64 nt, hsa
agaauacaucauuucucacagucuuaaguugauauuuauagaaaugaauaccuuugugaaccua

SEQ ID NO: 665254 - RNA, 64 nt, hsa
uuuuuauuugucaaauaaagaacaucuauaaauauuuauagauuucaaaauugagaaagaagua

SEQ ID NO: 665255 - RNA, 64 nt, hsa
aucuguguucagggaaugauuugcaagaaguugguuuauagacguuuacucuggaggcacaagc

SEQ ID NO: 665256 - RNA, 64 nt, hsa
ucuggauugaccacccacaaugcuuugagcuucuuuuauagaagggaucaugaaaaggucuggu

SEQ ID NO: 665257 - RNA, 64 nt, hsa
uguuagaauuucauaagcaauaauuaaaugugucuuuauagauauugcaggaauguauacauau

SEQ ID NO: 665258 - RNA, 64 nt, hsa
uccauacauacuauaaggcacuuuuaacagauuguuuauagagugauuuuacuagaaagaauuu

SEQ ID NO: 665259 - RNA, 64 nt, hsa
uugucauccuuuuccugcacuucucuugaauuccuuuauagauguacaguuuugcuuuaaccac

SEQ ID NO: 665260 - RNA, 64 nt, hsa
gaaagcaauuuauaacauaugagucuuauuuuuauuuauagaaauguggaaagcuugcuguaau

SEQ ID NO: 665261 - RNA, 64 nt, hsa
guuaaguaaaaauggauaauuuauagacagauaauuuauagacagguaaaugugaguuaaauau

SEQ ID NO: 665262 - RNA, 64 nt, hsa
uuaaauuuauagacaguuaaguaaaaauggauaauuuauagacagauaauuuauagacagguaa

SEQ ID NO: 665263 - RNA, 64 nt, hsa
uuuaaaauuaauggauaauuuauagacaguuaaauuuauagacaguuaaguaaaaauggauaau

SEQ ID NO: 665264 - RNA, 64 nt, hsa
cuacuccagccaacauuuuaaaauuaauggauaauuuauagacaguuaaauuuauagacaguua

SEQ ID NO: 665265 - RNA, 64 nt, hsa
ucuucaaugaccucccauuuggacccauaguuuauuuauagagagcacacacucccuaauuguc

SEQ ID NO: 665266 - RNA, 64 nt, hsa
ucauuauuaagcucugaaauucaggacacauacauuuauagagugugaggcugugcauacguac

SEQ ID NO: 665267 - RNA, 64 nt, hsa
aaaugcauuuccaaacugccuuaaacguuguauuuuuauagacauguuuuuuaaaaauccuaag

SEQ ID NO: 665268 - RNA, 64 nt, hsa
uauauuuagaacagucuuaaaauguacaguguauuuuauagaauugaaguuaacauucuuauuu

SEQ ID NO: 665269 - RNA, 64 nt, hsa
uauaaggcaguaucacccauccaaaagaaaggucuuuauagaccugcacagucacuagauuaau

SEQ ID NO: 665270 - RNA, 64 nt, hsa
gccaucgaaaagugauuuaaauaagcagguuaucuuuauagauuuuaaagaaaacuagaaaguu

SEQ ID NO: 665271 - RNA, 64 nt, hsa
cuuuguaaauuguaaaaugauacaaaauuuaaaguuuauagagccaguuacaaaauccuauuag

SEQ ID NO: 665272 - RNA, 64 nt, hsa
auagagccaguuacaaaauccuauuagucauauauuuauagauuguguucacagcaaucauuua

SEQ ID NO: 665273 - RNA, 64 nt, hsa
auuuuuguacauaagagagaaagagagagaaaaauuuauagaaguuuuguacaaaugguuuaaa

SEQ ID NO: 665274 - RNA, 64 nt, hsa
ccaccaguuguacuucagcaccaaugugucuuacuuuauagaaauguuguuaauguauuaauga

SEQ ID NO: 665275 - RNA, 64 nt, hsa
auuagcuuaugaacuguugcuucuacuuagcccuuuuauagaaacucugagcuguuacuuuggg

SEQ ID NO: 665276 - RNA, 64 nt, hsa
guuaucagcuuccugucucugaaguuuggaucauuuuauagauccacgcaauagagagcuuccu

SEQ ID NO: 665277 - RNA, 64 nt, hsa
aagucccuuuacauaaauaguauuugguaauacauuuauagaugagaguuauaugaaaaggcua

SEQ ID NO: 665278 - RNA, 64 nt, hsa
ucauaaucaguuuucagugugaauucacugaauguuuauagacaaaagaaaauacacacuaaaa

SEQ ID NO: 665279 - RNA, 64 nt, hsa
gccuuauaaaacaacauaaauuuagaccauaacuuuuauagagaaaggguuuugucaaauguuu

SEQ ID NO: 665280 - RNA, 64 nt, hsa
uagaaguucuaucuaagaaauggcauucuguagguuuauagaagguuuagccuucauauuuuaa

SEQ ID NO: 665281 - RNA, 64 nt, hsa
gguuguacagcuuucaaaauauaauuaauuuuguuuuauagauaugauaggcaacagacugaaa

SEQ ID NO: 665282 - RNA, 64 nt, hsa
ugagauugccaaucacgguuaaacacaaaguguuuuuauagaaugaagaaacagucuuuaacag

SEQ ID NO: 665283 - RNA, 64 nt, hsa
gcuuauguggcauacaauauuuauaacuauaaacuuuauagaaguacaguauuaaagucagugg

SEQ ID NO: 665284 - RNA, 64 nt, hsa
uuucuaaaugcucaaauguuaucaaaauacuauauuuauagaaguaaucuucucuguuaacagc

SEQ ID NO: 665285 - RNA, 64 nt, hsa
aaguuagcuguuaacuccuugugagcugcuucucuuuauagagcucuuggguauguagaacugu

SEQ ID NO: 665286 - RNA, 64 nt, hsa
auauucuuucacaaggcauccauacuguuuaauauuuauagaguucauagaaauacaucaauaa

SEQ ID NO: 665287 - RNA, 64 nt, hsa
aaugcuuugaaaauguuuuuaagugcuaugcauauuuauagaguuauuauaguuauucaaaucc

SEQ ID NO: 665288 - RNA, 64 nt, hsa
augaugacuguagaacauuugagcaaguaaaauaguaaagcacauagugaguguauguccgucu

SEQ ID NO: 665289 - RNA, 64 nt, hsa
aaugaaaccaguggaugugcuuaacguaagguuaguaaagcauacaaagaaucuagugugcuca

SEQ ID NO: 665290 - RNA, 64 nt, hsa
uaagugcugauugugauuuuaaaaugauaguaccguaaagcauuaaaguaaacaaugugcuauu

SEQ ID NO: 665291 - RNA, 64 nt, hsa
ucuuuccuuuuuuggacacuuggaucuaaaugauguaaagcaaaacagcaucaauauauaugug

SEQ ID NO: 665292 - RNA, 64 nt, hsa
aaaaagagaaaaggagagaaaguaacuuuguuugguaaagcaccaguacuccaaccuuccagaa

SEQ ID NO: 665293 - RNA, 64 nt, hsa
accuaaauaauuagaauauuacuuggucucaguuguaaagcaacugaauuuauagugaagcaaa

SEQ ID NO: 665294 - RNA, 64 nt, hsa
gccaggcuuuggcauaucuguucuaaaucuggggguaaagcaagaaccugaacauuuuggagcc

SEQ ID NO: 665295 - RNA, 64 nt, hsa
cagggaaacauugaagaggcaguucgcuuguaucguaaagcauuagaaguaugugaggguggug

SEQ ID NO: 665296 - RNA, 64 nt, hsa; identical to SEQ ID NO: 322895

SEQ ID NO: 665297 - RNA, 64 nt, hsa; identical to SEQ ID NO: 322896

SEQ ID NO: 665298 - RNA, 64 nt, hsa; identical to SEQ ID NO: 322897

SEQ ID NO: 665299 - RNA, 64 nt, hsa; identical to SEQ ID NO: 322898

SEQ ID NO: 665300 - RNA, 64 nt, hsa; identical to SEQ ID NO: 322899

SEQ ID NO: 665301 - RNA, 64 nt, hsa; identical to SEQ ID NO: 322900

SEQ ID NO: 665302 - RNA, 64 nt, hsa; identical to SEQ ID NO: 322901

SEQ ID NO: 665303 - RNA, 64 nt, hsa; identical to SEQ ID NO: 322902

SEQ ID NO: 665304 - RNA, 64 nt, hsa; identical to SEQ ID NO: 322903

SEQ ID NO: 665305 - RNA, 64 nt, hsa; identical to SEQ ID NO: 322904

SEQ ID NO: 665306 - RNA, 64 nt, hsa; identical to SEQ ID NO: 322905

SEQ ID NO: 665307 - RNA, 64 nt, hsa; identical to SEQ ID NO: 322906

SEQ ID NO: 665308 - RNA, 64 nt, hsa; identical to SEQ ID NO: 322907

SEQ ID NO: 665309 - RNA, 64 nt, hsa; identical to SEQ ID NO: 322908

SEQ ID NO: 665310 - RNA, 64 nt, hsa; identical to SEQ ID NO: 322909

SEQ ID NO: 665311 - RNA, 64 nt, hsa; identical to SEQ ID NO: 322910

SEQ ID NO: 665312 - RNA, 64 nt, hsa; identical to SEQ ID NO: 322911

SEQ ID NO: 665313 - RNA, 64 nt, hsa; identical to SEQ ID NO: 322912

SEQ ID NO: 665314 - RNA, 64 nt, hsa; identical to SEQ ID NO: 322913

SEQ ID NO: 665315 - RNA, 64 nt, hsa; identical to SEQ ID NO: 322914

SEQ ID NO: 665316 - RNA, 64 nt, hsa; identical to SEQ ID NO: 322915

SEQ ID NO: 665317 - RNA, 64 nt, hsa; identical to SEQ ID NO: 322916

SEQ ID NO: 665318 - RNA, 64 nt, hsa; identical to SEQ ID NO: 322917

SEQ ID NO: 665319 - RNA, 64 nt, hsa; identical to SEQ ID NO: 322918

SEQ ID NO: 665320 - RNA, 64 nt, hsa; identical to SEQ ID NO: 322919

SEQ ID NO: 665321 - RNA, 64 nt, hsa; identical to SEQ ID NO: 322920

SEQ ID NO: 665322 - RNA, 64 nt, hsa; identical to SEQ ID NO: 322921

SEQ ID NO: 665323 - RNA, 64 nt, hsa; identical to SEQ ID NO: 322922

SEQ ID NO: 665324 - RNA, 64 nt, hsa; identical to SEQ ID NO: 322923

SEQ ID NO: 665325 - RNA, 64 nt, hsa; identical to SEQ ID NO: 322924

SEQ ID NO: 665326 - RNA, 64 nt, hsa; identical to SEQ ID NO: 322925

SEQ ID NO: 665327 - RNA, 64 nt, hsa; identical to SEQ ID NO: 322926

SEQ ID NO: 665328 - RNA, 64 nt, hsa; identical to SEQ ID NO: 322927

SEQ ID NO: 665329 - RNA, 64 nt, hsa; identical to SEQ ID NO: 322928

SEQ ID NO: 665330 - RNA, 64 nt, hsa; identical to SEQ ID NO: 322929

SEQ ID NO: 665331 - RNA, 64 nt, hsa; identical to SEQ ID NO: 322930

SEQ ID NO: 665332 - RNA, 64 nt, hsa; identical to SEQ ID NO: 322931

SEQ ID NO: 665333 - RNA, 64 nt, hsa; identical to SEQ ID NO: 322932

SEQ ID NO: 665334 - RNA, 51 nt, hsa; identical to SEQ ID NO: 201885

SEQ ID NO: 665335 - RNA, 64 nt, hsa; identical to SEQ ID NO: 322934

SEQ ID NO: 665336 - RNA, 64 nt, hsa; identical to SEQ ID NO: 322935

SEQ ID NO: 665337 - RNA, 64 nt, hsa; identical to SEQ ID NO: 322936

SEQ ID NO: 665338 - RNA, 64 nt, hsa; identical to SEQ ID NO: 322937

SEQ ID NO: 665339 - RNA, 64 nt, hsa; identical to SEQ ID NO: 322938

SEQ ID NO: 665340 - RNA, 64 nt, hsa; identical to SEQ ID NO: 322939

SEQ ID NO: 665341 - RNA, 64 nt, hsa; identical to SEQ ID NO: 322940

SEQ ID NO: 665342 - RNA, 64 nt, hsa; identical to SEQ ID NO: 322941

SEQ ID NO: 665343 - RNA, 64 nt, hsa; identical to SEQ ID NO: 322942

SEQ ID NO: 665344 - RNA, 64 nt, hsa; identical to SEQ ID NO: 322943

SEQ ID NO: 665345 - RNA, 64 nt, hsa; identical to SEQ ID NO: 322944

SEQ ID NO: 665346 - RNA, 64 nt, hsa; identical to SEQ ID NO: 322945

SEQ ID NO: 665347 - RNA, 64 nt, hsa; identical to SEQ ID NO: 322946

SEQ ID NO: 665348 - RNA, 64 nt, hsa; identical to SEQ ID NO: 322947

SEQ ID NO: 665349 - RNA, 64 nt, hsa; identical to SEQ ID NO: 322948

SEQ ID NO: 665350 - RNA, 64 nt, hsa; identical to SEQ ID NO: 322949

SEQ ID NO: 665351 - RNA, 64 nt, hsa; identical to SEQ ID NO: 322950

SEQ ID NO: 665352 - RNA, 64 nt, hsa; identical to SEQ ID NO: 322951

SEQ ID NO: 665353 - RNA, 64 nt, hsa; identical to SEQ ID NO: 322952

SEQ ID NO: 665354 - RNA, 64 nt, hsa; identical to SEQ ID NO: 322953

SEQ ID NO: 665355 - RNA, 64 nt, hsa; identical to SEQ ID NO: 322954

SEQ ID NO: 665356 - RNA, 64 nt, hsa; identical to SEQ ID NO: 322955

SEQ ID NO: 665357 - RNA, 64 nt, hsa; identical to SEQ ID NO: 322956

SEQ ID NO: 665358 - RNA, 64 nt, hsa; identical to SEQ ID NO: 322957

SEQ ID NO: 665359 - RNA, 64 nt, hsa; identical to SEQ ID NO: 322958

SEQ ID NO: 665360 - RNA, 64 nt, hsa; identical to SEQ ID NO: 322959

SEQ ID NO: 665361 - RNA, 64 nt, hsa; identical to SEQ ID NO: 322960

SEQ ID NO: 665362 - RNA, 64 nt, hsa; identical to SEQ ID NO: 322961

SEQ ID NO: 665363 - RNA, 64 nt, hsa; identical to SEQ ID NO: 322962

SEQ ID NO: 665364 - RNA, 64 nt, hsa; identical to SEQ ID NO: 322963

SEQ ID NO: 665365 - RNA, 64 nt, hsa; identical to SEQ ID NO: 322964

SEQ ID NO: 665366 - RNA, 64 nt, hsa; identical to SEQ ID NO: 322965

SEQ ID NO: 665367 - RNA, 64 nt, hsa; identical to SEQ ID NO: 322966

SEQ ID NO: 665368 - RNA, 64 nt, hsa; identical to SEQ ID NO: 322967

SEQ ID NO: 665369 - RNA, 64 nt, hsa; identical to SEQ ID NO: 322968

SEQ ID NO: 665370 - RNA, 64 nt, hsa; identical to SEQ ID NO: 322969

SEQ ID NO: 665371 - RNA, 64 nt, hsa; identical to SEQ ID NO: 322970

SEQ ID NO: 665372 - RNA, 64 nt, hsa; identical to SEQ ID NO: 322971

SEQ ID NO: 665373 - RNA, 54 nt, hsa; identical to SEQ ID NO: 201924

SEQ ID NO: 665374 - RNA, 64 nt, hsa; identical to SEQ ID NO: 322973

SEQ ID NO: 665375 - RNA, 64 nt, hsa; identical to SEQ ID NO: 322974

SEQ ID NO: 665376 - RNA, 64 nt, hsa; identical to SEQ ID NO: 322975

SEQ ID NO: 665377 - RNA, 64 nt, hsa; identical to SEQ ID NO: 322976

SEQ ID NO: 665378 - RNA, 64 nt, hsa; identical to SEQ ID NO: 322977

SEQ ID NO: 665379 - RNA, 64 nt, hsa; identical to SEQ ID NO: 322978

SEQ ID NO: 665380 - RNA, 64 nt, hsa; identical to SEQ ID NO: 322979

SEQ ID NO: 665381 - RNA, 64 nt, hsa; identical to SEQ ID NO: 322980

SEQ ID NO: 665382 - RNA, 64 nt, hsa; identical to SEQ ID NO: 322981

SEQ ID NO: 665383 - RNA, 64 nt, hsa; identical to SEQ ID NO: 322982

SEQ ID NO: 665384 - RNA, 64 nt, hsa; identical to SEQ ID NO: 322983

SEQ ID NO: 665385 - RNA, 64 nt, hsa; identical to SEQ ID NO: 322984

SEQ ID NO: 665386 - RNA, 64 nt, hsa; identical to SEQ ID NO: 322985

SEQ ID NO: 665387 - RNA, 64 nt, hsa; identical to SEQ ID NO: 322986

SEQ ID NO: 665388 - RNA, 64 nt, hsa; identical to SEQ ID NO: 322987

SEQ ID NO: 665389 - RNA, 64 nt, hsa; identical to SEQ ID NO: 322988

SEQ ID NO: 665390 - RNA, 64 nt, hsa; identical to SEQ ID NO: 322989

SEQ ID NO: 665391 - RNA, 64 nt, hsa; identical to SEQ ID NO: 322990

SEQ ID NO: 665392 - RNA, 64 nt, hsa; identical to SEQ ID NO: 322991

SEQ ID NO: 665393 - RNA, 64 nt, hsa; identical to SEQ ID NO: 322992

SEQ ID NO: 665394 - RNA, 64 nt, hsa; identical to SEQ ID NO: 322993

SEQ ID NO: 665395 - RNA, 64 nt, hsa; identical to SEQ ID NO: 322994

SEQ ID NO: 665396 - RNA, 64 nt, hsa
uuaacacucaaauauuaacauuuuagguuucucuugcagauaugagagauagcacagauggacc

SEQ ID NO: 665397 - RNA, 64 nt, hsa
uugagagauuacagaagaggaggccugcuucacuugcagauaaguuuauuauaauucuccagaa

SEQ ID NO: 665398 - RNA, 64 nt, hsa
cagucccaguccuaugguaaugacuuaggaggaaugcagauaaaaguaccuuguaagauaaaua

SEQ ID NO: 665399 - RNA, 64 nt, hsa
cguuggaaauagaugagaaauggaugcagaauaaugcagauagugaucccauguuuguuaauug

SEQ ID NO: 665400 - RNA, 64 nt, hsa
ucauguauauuaaaauuggcuaauauuaaguuauugcagauaccacauucauuaugcugcagua

SEQ ID NO: 665401 - RNA, 64 nt, hsa
gguuuagucacaucauuuuuccuguucagguaucugcagauaucccuguucaggaaagaucuuu

SEQ ID NO: 665402 - RNA, 64 nt, hsa
acacacacggauaugcugucuggacgcacacacgugcagauaugguauccggacacacacgugc

SEQ ID NO: 665403 - RNA, 64 nt, hsa
gugcacagauaugcugucuggacacgcacacacaugcagauaugcugccuggacacacacuucc

SEQ ID NO: 665404 - RNA, 64 nt, hsa
cacacagauaaugcugccucaacacucacacacgugcagauauugccuggacacacacaugugc

SEQ ID NO: 665405 - RNA, 64 nt, hsa
gugcacagauaugcugucuggacaugcacacacgugcagauaugcuguccggauacacacgcac

SEQ ID NO: 665406 - RNA, 64 nt, hsa
agauaugcuguccggauacacacgcacgcacacaugcagauaugcugccugggcacacacuucc

SEQ ID NO: 665407 - RNA, 64 nt, hsa
ggcacacacuuccggacacacaugcacacacaggugcagauaugcugccuggacacacgcagac

SEQ ID NO: 665408 - RNA, 64 nt, hsa
gugaucugcaugccuguuaaagucugagcucuguugcagauaaccagagacccaacaaccaaag

SEQ ID NO: 665409 - RNA, 64 nt, hsa
aaguccaucauuagguuaagcgauuuacugaaggugcagauaucaugcuuauuucauuggguug

SEQ ID NO: 665410 - RNA, 64 nt, hsa
auuuucuugguguauccuuuuccuuucaacacagugcagauaagaguugaauauugauaucaua

SEQ ID NO: 665411 - RNA, 64 nt, hsa
uuuuauuucucucuaaacuugaaaacaguaaaucugcagauacugugaggcacaaauuauacug

SEQ ID NO: 665412 - RNA, 64 nt, hsa
acaggacguggugguuccugagcagagagggaucugcagauacaggcuuggcgcucgggguggu

SEQ ID NO: 665413 - RNA, 64 nt, hsa
cccaacaacucugcuuuuagggaggccuccgaaaugcagauaggcgguugagugggguccuggg

SEQ ID NO: 665414 - RNA, 64 nt, hsa
aaauauucauguagcaaaucugagaauugaaaacugcagauaaccggccggguauggugacuca

SEQ ID NO: 665415 - RNA, 64 nt, hsa
aaaaaaaaaaaacagaaagaaagaaaaagaaaacugcagauaacccuauacauuaauacuggua

SEQ ID NO: 665416 - RNA, 64 nt, hsa
ugguuuucucucuuuuugugguauuagcagcugcugcagauaaaugcauuaauucaugaugcuu

SEQ ID NO: 665417 - RNA, 64 nt, hsa
agacaauaauuggaguaguuuaaucuuauucaugugcagauaaaagagguuuaugaaguuuagg

SEQ ID NO: 665418 - RNA, 64 nt, hsa
uuacuuuuccccuuuacuuaauuauauuguagugugcagauaacaaaacugcuaccuucucauc

SEQ ID NO: 665419 - RNA, 64 nt, hsa
uuaucuuauuuauauuuucccuuauuuuccucaaugcagauaauagcuuuuggugcacuuuugu

SEQ ID NO: 665420 - RNA, 64 nt, hsa
gggaaaaaacagaauuguaacaguuccuugauucugcagauacugcugcuguuuuacgauuuca

SEQ ID NO: 665421 - RNA, 64 nt, hsa
gauacagcucaucauucuguagaaaugugcaguuugcagauagaacacugcacacagaaauguu

SEQ ID NO: 665422 - RNA, 64 nt, hsa; identical to SEQ ID NO: 165822

SEQ ID NO: 665423 - RNA, 64 nt, hsa; identical to SEQ ID NO: 165823

SEQ ID NO: 665424 - RNA, 64 nt, hsa; identical to SEQ ID NO: 22017

SEQ ID NO: 665425 - RNA, 64 nt, hsa; identical to SEQ ID NO: 22018

SEQ ID NO: 665426 - RNA, 64 nt, hsa; identical to SEQ ID NO: 22019

SEQ ID NO: 665427 - RNA, 64 nt, hsa; identical to SEQ ID NO: 22020

SEQ ID NO: 665428 - RNA, 64 nt, hsa; identical to SEQ ID NO: 22021

SEQ ID NO: 665429 - RNA, 64 nt, hsa; identical to SEQ ID NO: 22022

SEQ ID NO: 665430 - RNA, 64 nt, hsa; identical to SEQ ID NO: 22023

SEQ ID NO: 665431 - RNA, 64 nt, hsa; identical to SEQ ID NO: 22024

SEQ ID NO: 665432 - RNA, 64 nt, hsa; identical to SEQ ID NO: 22025

SEQ ID NO: 665433 - RNA, 64 nt, hsa; identical to SEQ ID NO: 22026

SEQ ID NO: 665434 - RNA, 64 nt, hsa; identical to SEQ ID NO: 22027

SEQ ID NO: 665435 - RNA, 64 nt, hsa; identical to SEQ ID NO: 22028

SEQ ID NO: 665436 - RNA, 64 nt, hsa; identical to SEQ ID NO: 22029

SEQ ID NO: 665437 - RNA, 64 nt, hsa; identical to SEQ ID NO: 22030

SEQ ID NO: 665438 - RNA, 64 nt, hsa
ggagauccuucauguugaggguuuugcuggguucucaggcuagugggggcauuaggaacagacc

SEQ ID NO: 665439 - RNA, 64 nt, hsa
gugcauaaggaagaacucuacagcagcccaaucuucaggcuagugggauugguugcauuacaga

SEQ ID NO: 665440 - RNA, 64 nt, hsa
uuaaaaugguauuauuaauaccauaauacucuauucaggcuaggauaucaauuaaacacaaaaa

SEQ ID NO: 665441 - RNA, 64 nt, hsa
acaguauguagacugccauucucaucagcggccgucaggcuacugucugugauucuuuuguuug

SEQ ID NO: 665442 - RNA, 56 nt, hsa
guccuaacgagaagagauaauuacaaucaggcuaccagaggaagccuuugguccua

SEQ ID NO: 665443 - RNA, 64 nt, hsa
agccuuugguccuaacgagaagagauaauuacaaucaggcuaccaaaggaagcacuaacuuugg

SEQ ID NO: 665444 - RNA, 64 nt, hsa
auagggaccagaguuuaacauagcgaucuaggccagaauugacaauguuuaaguaaugguggaa

SEQ ID NO: 665445 - RNA, 64 nt, hsa
aagguaaacauucuauauauucuaugccugcucuagaauugaaagacuucagcaguauuaaagc

SEQ ID NO: 665446 - RNA, 64 nt, hsa
ugucauucaucaauaaaccaaagccaauagcuggagaauugagaucugguugaaagugguuuau

SEQ ID NO: 665447 - RNA, 64 nt, hsa
aaggcacuuugaaaucauuccaguauauuugggaagaauugagugaaugagaaugcucuuccuu

SEQ ID NO: 665448 - RNA, 64 nt, hsa
cauuuaggauaaucuuugacauuuuggaaaaauaagaauugaggaaaaaaaguguaucuuucaa

SEQ ID NO: 665449 - RNA, 64 nt, hsa
uauacuggucuguuagcagagacaaacuuuuuuuagaauugaagucugaaacaaacaaaagcaa

SEQ ID NO: 665450 - RNA, 64 nt, hsa
uugguuauuuuacuuuuuggaaaagaauaaaccaagaauugauugggcacaucauuucaagaag

SEQ ID NO: 665451 - RNA, 64 nt, hsa
augauucaaacauagaugacuggauuccuguuccagaauugagaacuaaccguuguaaugcagg

SEQ ID NO: 665452 - RNA, 64 nt, hsa
uaucucuuuacuguaaugacucaaaagguauuuaagaauugacgagagcuuguguuguuuagca

SEQ ID NO: 665453 - RNA, 64 nt, hsa
agggauaaaacaguuuacuuguuauggaguaaauagaauugagacugcaaaggaagaauaauga

SEQ ID NO: 665454 - RNA, 64 nt, hsa
ugguguuaauaucaaagaauugaaugaauacaacagaauugagguugaaaaauauuugauugcc

SEQ ID NO: 665455 - RNA, 64 nt, hsa
cugauguucucuaugauauugguguuaauaucaaagaauugaaugaauacaacagaauugaggu

SEQ ID NO: 665456 - RNA, 64 nt, hsa
agcauuugagaauucuuaaauaugaaauuuauucagaauugaagauggugaccuauucagagcc

SEQ ID NO: 665457 - RNA, 64 nt, hsa
aucuagcuuucuuuaugauguuucugauaauacgagaauugaaaacuuuaccuucucuuguaca

SEQ ID NO: 665458 - RNA, 64 nt, hsa
uuugguuucccaagagcuacguauuuaauagcaaagaauugacuggggcaauaacguuuaagcc

SEQ ID NO: 665459 - RNA, 64 nt, hsa
auucucucucuugcaggaaggacuaugaaaagcuagaauugaguguuuaaaguucaacauguua

SEQ ID NO: 665460 - RNA, 64 nt, hsa
agagcggagaaacuuaagcuaaagucuguuauacagaauugaaagccuucguaucuugaaccuc

SEQ ID NO: 665461 - RNA, 64 nt, hsa
gcaguuuaaauuuaguaauuuuaauuuagugaacagaauugagaagaacgugccaaaugagaau

SEQ ID NO: 665462 - RNA, 64 nt, hsa
auuaauacugauuauauagagcacggaaagauaaagaauugaacauuuucuuuguauacuuuuu

SEQ ID NO: 665463 - RNA, 63 nt, hsa
aaaaaucuaaguauagaugaaagaugaagaggcagaauugagaggcuaacauauuuacucuug

SEQ ID NO: 665464 - RNA, 64 nt, hsa
aaaccucuccugucauuccuggcuuccuugcuucagaauugaaauggaagugggggugucccua

SEQ ID NO: 665465 - RNA, 64 nt, hsa
agcucucauaacuaaguuaauuuaguauaaaaauagaauugauagugaggguauaaaguguaac

SEQ ID NO: 665466 - RNA, 64 nt, hsa
uauguuuggccuuuugcauguuucucuacaaaagagaauugaguuaccucacagagaacagaua

SEQ ID NO: 665467 - RNA, 64 nt, hsa
aacuagguuucuuuguauucuucaguccuuuuacagaauugaugugcuaacugaauaucauugc

SEQ ID NO: 665468 - RNA, 64 nt, hsa
cacuacuaccaacaagaggauuuuuuaaaaucacagaauugauauuuaucucaagacuaucuua

SEQ ID NO: 665469 - RNA, 64 nt, hsa
gugacauuaugcauuacuccacauccacccuuuaagaauugauuuauuacaaaauuauguucua

SEQ ID NO: 665470 - RNA, 64 nt, hsa
gaguuguuccucaggaauagauuuuucauaaagcagaauugauccuguggcugguuucucagaa

SEQ ID NO: 665471 - RNA, 64 nt, hsa
cuaacccauuuuuaaguacauuugcaugugggcaagaauugaaaguauacagauaauugaacag

SEQ ID NO: 665472 - RNA, 64 nt, hsa
ugggcaagaauugaaaguauacagauaauugaacagaauugauuuguuagauaaggagauuuug

SEQ ID NO: 665473 - RNA, 64 nt, hsa
cagcuauuuuaaaugagcuguaacuuucuaguaaagaauugaaaagcaaaucucacuaaugaua

SEQ ID NO: 665474 - RNA, 64 nt, hsa
cauucuuuuaucuuuuuugcuccacauguacauaagaauugacacaggaaccuacugaauagcg

SEQ ID NO: 665475 - RNA, 64 nt, hsa
acaugugguuagucuuuuauuuuaagaagaauugagaauugauagauuuggagaugagcuuugc

SEQ ID NO: 665476 - RNA, 64 nt, hsa
uggcugaacaugugguuagucuuuuauuuuaagaagaauugagaauugauagauuuggagauga

SEQ ID NO: 665477 - RNA, 64 nt, hsa
ccuagugcuacuuguuuuacaaacuacacuuuguagaauugauuagauuaccuuguuuauuuaa

SEQ ID NO: 665478 - RNA, 64 nt, hsa
cuccacuuggagggaauuguccaguguggccccuagaauugagucacccccuagauaccaacug

SEQ ID NO: 665479 - RNA, 64 nt, hsa
ugucagaauugaauuauagaacacccaguuguucagaauugaauuguagaacacccaauuggug

SEQ ID NO: 665480 - RNA, 64 nt, hsa
guggagucugcacuaacuuggagaaguuagugucagaauugaauuauagaacacccaguuguuc

SEQ ID NO: 665481 - RNA, 64 nt, hsa
agggugggggugccuagccaggugcaguccccgccccgccuaguccucggcgucacgcaaugcu

SEQ ID NO: 665482 - RNA, 64 nt, hsa
aagucgagaacacuugaacacacagaagggagaccccgccuagcauagauuugcaguuacggcc

SEQ ID NO: 665483 - RNA, 64 nt, hsa
cacugaugcccaaacugucagacuuugggggauccccgccuagggcagugcugcauggcugccc

SEQ ID NO: 665484 - RNA, 64 nt, hsa
uaagguggguccaggaaggcagcugcucuuagugcccgccuaggaguugaguacagugaggagg

SEQ ID NO: 665485 - RNA, 64 nt, hsa
aaccuaggcagaaggcggcugucugagggcuguccccgccuaggacagggucaaucgaggaaug

SEQ ID NO: 665486 - RNA, 64 nt, hsa
ucugggugcaggauagcaguccagaguccauggccccgccuaggccaucugggugcugggcaug

SEQ ID NO: 665487 - RNA, 64 nt, hsa
gccucaggucuggccagccagggcuggugcuguccccgccuaccuccacuuccuuucccuugcu

SEQ ID NO: 665488 - RNA, 64 nt, hsa
ccacuuagcacagcugaagggguuugugaauacucccgccuaaaucccuucuacuucacuccuc

SEQ ID NO: 665489 - RNA, 64 nt, hsa
ccccuaccucuguucugccuguccucgcucucuccccgccuagucaucugacaggcuuaucauu

SEQ ID NO: 665490 - RNA, 64 nt, hsa
cucauguuucgcaacucuuuuuuucccccucgcucccgccuaccccgucggcauuuucuucuuc

SEQ ID NO: 665491 - RNA, 64 nt, hsa
cgaguagcugggacuacaggcgccugccaccaugcccgccuaauuuuuuuguauuuuuaguaga

SEQ ID NO: 665492 - RNA, 64 nt, hsa
caaccucugguggccguaccugaugcacgaacaccccgccuaccuguacucgugggagguaaug

SEQ ID NO: 665493 - RNA, 64 nt, hsa
guguuggagaaggugaagaacccucccauucacgcccgccuaccaacaacaaacgugcuuuuuu

SEQ ID NO: 665494 - RNA, 64 nt, hsa
acaucccaggugcacccuccccaaguacucccaccccgccuacuguccaugcggccucacuggg

SEQ ID NO: 665495 - RNA, 64 nt, hsa
aacucuugaagacuccaguaugaaaaucagcaugcccgccuaguuaccuaccggagaguuaucc

SEQ ID NO: 665496 - RNA, 51 nt, hsa
agagugagaagccugacugaccccgccuagacgccaggcccacuucacgcc

SEQ ID NO: 665497 - RNA, 64 nt, hsa
gccucuugugccccagcaccuucucucucugccccccgccuaaaguccugcauucagugugugg

SEQ ID NO: 665498 - RNA, 64 nt, hsa
agcaccccugcccaucuggugccacagccuugcccccgccuagucuucaucagucaagucacca

SEQ ID NO: 665499 - RNA, 64 nt, hsa
uuucugcuucccauagcaggucugguuccugcuccccgccuaggacaggagcugucuggagcuc

SEQ ID NO: 665500 - RNA, 64 nt, hsa
accuguggagggcauuucccgugggcccccgagacccgccuagauggaggaagcgcugcugggc

SEQ ID NO: 665501 - RNA, 64 nt, hsa
cgacaucgagugcuuccuuauggagcuggagcagcccgccuagaacccagucuaaugagaacuc

SEQ ID NO: 665502 - RNA, 64 nt, hsa
cuggagugcaguggcgcgaucuuggcccaccacgcccgccuaauuuuuuguauuuuuuaguaga

SEQ ID NO: 665503 - RNA, 64 nt, hsa
ggacaacuccaccccuuccuuggccuugccccugcccgccuacacuccuacguguccagggcuu

SEQ ID NO: 665504 - RNA, 64 nt, hsa
cccaucccccagcgcuuguccugcuucacccuaccccgccuaagacuguaaaggccuaaaaacc

SEQ ID NO: 665505 - RNA, 64 nt, hsa
aacgugcugggauuauaggcgugagccaccacgccccgccuaaaauccauauucaaagaagcaa

SEQ ID NO: 665506 - RNA, 64 nt, hsa
agccaggacaggagugggggccagccugaggacccccgccuaccaccucgagaacuggaagcca

SEQ ID NO: 665507 - RNA, 64 nt, hsa
aaagugcugggauuacagucgugagccacuguaccccgccuaaaacugaugaauuauuucugaa

SEQ ID NO: 665508 - RNA, 64 nt, hsa
acguggguagugugugaagccccucagccugggucccgccuagccuaagagugguggccucgag

SEQ ID NO: 665509 - RNA, 64 nt, hsa
cuuugugaggcucagaggaaggacagucugcaagcccgccuaggagguccauccccagcaaaug

SEQ ID NO: 665510 - RNA, 64 nt, hsa
uaacaagggugagugcucucgcuaagaagugucccccgccuaaucauguguuuauaggauagua

SEQ ID NO: 665511 - RNA, 64 nt, hsa
ugacuccccucagcucccccuucaccccuccuugcccgccuacccucccuccagaauagccccu

SEQ ID NO: 665512 - RNA, 59 nt, hsa
gucuugaacugcuggccuaaagcgauccccccgccuaggccucccaaagugcuggguuu

SEQ ID NO: 665513 - RNA, 64 nt, hsa
ggagggguccgugcugguucugaauaaagcaggacccgccuaguggcugccugugugcauggcu

SEQ ID NO: 665514 - RNA, 64 nt, hsa
ucguucuccgcuggacucagaagccaagcugcuucccgccuagacucggcgcagggccccgcac

SEQ ID NO: 665515 - RNA, 64 nt, hsa
ugagcugggcccugggauacugccuucucuuucgcccgccuaucugccugccggccuggugggg

SEQ ID NO: 665516 - RNA, 64 nt, hsa
gcuggaaccgcgcagccugcuggugcuccgcggccccgccuacacgcgucuucuccacggcauc

SEQ ID NO: 665517 - RNA, 64 nt, hsa
guguccugugaauguaucgcuacugugagcuguucccgccuagccagggccaugucuuaggugc

SEQ ID NO: 665518 - RNA, 64 nt, hsa
ggcacacacuuuagagucuggggcuccaguggggcccgccuaauuuuuuuuccccccaagacag

SEQ ID NO: 665519 - RNA, 64 nt, hsa
caggcuggucuugaacuccugaccucgugauccacccgccuaggccucccaaaguguugggauu

SEQ ID NO: 665520 - RNA, 64 nt, hsa
gccaacccaucaucuagaguaguggccaucagcacccgccuaacgggcaccaugccaagcacuu

SEQ ID NO: 665521 - RNA, 64 nt, hsa
auagcgcucccaggcuuauuaggaagaggaaauucccgccuaauaaauuuuggucagaccgguu

SEQ ID NO: 665522 - RNA, 64 nt, hsa
aguaaacccuggaguccgaggcccaggcagcagccccgccuaguggugggcccugaugcugcca

SEQ ID NO: 665523 - RNA, 64 nt, hsa
agacuucauugcuguaguuuggauuaacuccccucccgccuacccccaucccaaacugcauuua

SEQ ID NO: 665524 - RNA, 64 nt, hsa
uuuggaacaaucacagggaauggccacaaaccugcccgccuaagacccugaauccguacuuggg

SEQ ID NO: 665525 - RNA, 64 nt, hsa
ucccccuccagcccuagccgagcugguccuaggccccgccuagugccccacccccacccacagu

SEQ ID NO: 665526 - RNA, 64 nt, hsa; identical to SEQ ID NO: 391367

SEQ ID NO: 665527 - RNA, 64 nt, hsa; identical to SEQ ID NO: 391368

SEQ ID NO: 665528 - RNA, 64 nt, hsa; identical to SEQ ID NO: 391369

SEQ ID NO: 665529 - RNA, 64 nt, hsa; identical to SEQ ID NO: 391370

SEQ ID NO: 665530 - RNA, 64 nt, hsa; identical to SEQ ID NO: 391371

SEQ ID NO: 665531 - RNA, 64 nt, hsa; identical to SEQ ID NO: 391372

SEQ ID NO: 665532 - RNA, 64 nt, hsa; identical to SEQ ID NO: 391373

SEQ ID NO: 665533 - RNA, 64 nt, hsa; identical to SEQ ID NO: 391374

SEQ ID NO: 665534 - RNA, 64 nt, hsa; identical to SEQ ID NO: 391375

SEQ ID NO: 665535 - RNA, 64 nt, hsa; identical to SEQ ID NO: 391376

SEQ ID NO: 665536 - RNA, 64 nt, hsa; identical to SEQ ID NO: 391377

SEQ ID NO: 665537 - RNA, 64 nt, hsa; identical to SEQ ID NO: 391378

SEQ ID NO: 665538 - RNA, 64 nt, hsa; identical to SEQ ID NO: 391379

SEQ ID NO: 665539 - RNA, 64 nt, hsa; identical to SEQ ID NO: 391380

SEQ ID NO: 665540 - RNA, 64 nt, hsa; identical to SEQ ID NO: 391381

SEQ ID NO: 665541 - RNA, 64 nt, hsa; identical to SEQ ID NO: 391382

SEQ ID NO: 665542 - RNA, 64 nt, hsa; identical to SEQ ID NO: 391383

SEQ ID NO: 665543 - RNA, 64 nt, hsa; identical to SEQ ID NO: 391384

SEQ ID NO: 665544 - RNA, 64 nt, hsa; identical to SEQ ID NO: 391385

SEQ ID NO: 665545 - RNA, 64 nt, hsa; identical to SEQ ID NO: 391386

SEQ ID NO: 665546 - RNA, 64 nt, hsa; identical to SEQ ID NO: 391387

SEQ ID NO: 665547 - RNA, 64 nt, hsa; identical to SEQ ID NO: 391388

SEQ ID NO: 665548 - RNA, 64 nt, hsa
agcccuuucugcacagcuggugucggcaucauacuaaaagcaauguuuaaaucaaacuaaagau

SEQ ID NO: 665549 - RNA, 64 nt, hsa
uguguguguuuuuuuuuuuuuuuuuuuuguuguuuaaaagcaaggcaugcuuguggaugacucu

SEQ ID NO: 665550 - RNA, 64 nt, hsa
gcuagcauguucacagauuugaaagaaguuucauuaaaagcaccauugcuuucuguacugcguc

SEQ ID NO: 665551 - RNA, 64 nt, hsa
gaucauuauuuggaaauauguccuauggaaagaauaaaagcauguacuucacagcuagcauguu

SEQ ID NO: 665552 - RNA, 64 nt, hsa
agggaccuauccuugucuugaaaguuuguugcuuuaaaagcaaguaucucuccauaaauauuau

SEQ ID NO: 665553 - RNA, 64 nt, hsa
gauuuuaauagcaugcuuuaaagacugaugaguauaaaagcagaaguuuugcguuuuuuacugc

SEQ ID NO: 665554 - RNA, 64 nt, hsa
ucuauauguaagauagcacacaaguagaaauauuuaaaagcagucuuauucacagauugcagua

SEQ ID NO: 665555 - RNA, 64 nt, hsa
uacaagauugaaaaacucaacaagaauuuaauucuaaaagcaaaaauugguuugaguuuucaag

SEQ ID NO: 665556 - RNA, 64 nt, hsa
caggauuaaacuagguuugguuccuucagcccucuaaaagcauagggcuuagccugcaggcuuc

SEQ ID NO: 665557 - RNA, 64 nt, hsa
acuaugggaggagggcaagaguacaccaauuuguuaaaagcaagaaaccacagugucucuucac

SEQ ID NO: 665558 - RNA, 64 nt, hsa
cuugaagauuuagaaguuauauaaaaaauuaauuuaaaagcaaaccaaaagagguuuccauuaa

SEQ ID NO: 665559 - RNA, 64 nt, hsa
caguguuuugccaauuaauauuauaugcuuguaauaaaagcaaaagaaaagcuuaagugaaagu

SEQ ID NO: 665560 - RNA, 64 nt, hsa
ugaaaaguagagcaaucguguauaagcuaauguuuaaaagcaaaacugcaaauuguagcccagu

SEQ ID NO: 665561 - RNA, 64 nt, hsa
gccauaucaccagucuuaccaaacaauaggcuuuuaaaagcauugagucauugucagaauccac

SEQ ID NO: 665562 - RNA, 64 nt, hsa
uuccuggucaaagcuccuuaaaguucugggcagcuaaaagcaucccugugagcaaaaaugccag

SEQ ID NO: 665563 - RNA, 64 nt, hsa
ccacuauuuuugugcaaauaauaugaaagugaaguaaaagcaauagaagaaauuucuauaggau

SEQ ID NO: 665564 - RNA, 64 nt, hsa
uauuuugccauaucauuuagcuggaagugacauuuaaaagcacccugcaucacuaguaauagug

SEQ ID NO: 665565 - RNA, 64 nt, hsa
auuagugaaaguauugaaaauacuaaauuauaacuaaaagcaacuuuuuauguuauugaaaaua

SEQ ID NO: 665566 - RNA, 64 nt, hsa
agagugucccauugcugccaaaaauacacgucuuuaaaagcaacaaaaauugaaauaagacauc

SEQ ID NO: 665567 - RNA, 64 nt, hsa
uauaagggcuauuauuuccugaacuggaugucccuaaaagcaaauaaacugcccacuaucucua

SEQ ID NO: 665568 - RNA, 64 nt, hsa
uucaguugguguccaagacuuaucuugagacucuuaaaagcaucagucuguaacuagaacaaau

SEQ ID NO: 665569 - RNA, 64 nt, hsa
caguaguaccaaaaagguauuuuccuuucucauuuaaaagcaaaaaccucccuuuuuaauugcc

SEQ ID NO: 665570 - RNA, 64 nt, hsa
ucaauuuaacaauccugacaugcucccuccaauuuaaaagcacacacacacacacacacacaca

SEQ ID NO: 665571 - RNA, 64 nt, hsa
ggcgauaugauaaugcaaaccuauuucaucacucuaaaagcacugaccucaaaaaaccuuauaa

SEQ ID NO: 665572 - RNA, 64 nt, hsa
uaauuuaaccaagccccucuccacuucuuuuauuuaaaagcacugauucaauugcuaggaauau

SEQ ID NO: 665573 - RNA, 64 nt, hsa
aagaaaacacgcuaguuauuuaacugcaagcuacuaaaagcauagguguguugagauuucugug

SEQ ID NO: 665574 - RNA, 64 nt, hsa
uucuguguucuccacucuuccacuguuauccuaguaaaagcaucaggggcuggggacaauuucu

SEQ ID NO: 665575 - RNA, 64 nt, hsa
uauccuguauucuccuccaacaucaccacuagcguaaaagcaaaaagcuuuuacaaaacacagc

SEQ ID NO: 665576 - RNA, 64 nt, hsa
ugaauaucaagauaccucauugaaucccuaaauuuaaaagcaguccaguaaaagguuaacugua

SEQ ID NO: 665577 - RNA, 64 nt, hsa
uguguaccuuucagcauccuaggaauuuuuauacuaaaagcaaaauguuuuuuccaguuagucu

SEQ ID NO: 665578 - RNA, 64 nt, hsa
aggaacauugguuaagaacuguuggaaacaaaacuaaaagcaaacucaacauaugugauguuua

SEQ ID NO: 665579 - RNA, 64 nt, hsa
ugggauacuguaauacuucuuuguuauuauaacauaaaagcaccacuguucuguucauuuccua

SEQ ID NO: 665580 - RNA, 64 nt, hsa
uaguuaauauaaauguugcucuaaucagauugcuuaaaagcauuuuuauuauauuuauguuguu

SEQ ID NO: 665581 - RNA, 64 nt, hsa
aaccuaaaguuuagaugcauuguauaaaaaaaccuaaaagcaguaucuguuauuuagcuguaaa

SEQ ID NO: 665582 - RNA, 64 nt, hsa
uuuagacugcuaugguaauacauauuuuaaauucuaaaagcauacacaauguguaacugaaugg

SEQ ID NO: 665583 - RNA, 64 nt, hsa
gggauuaugucaaggcuucuuucaaggaggcucauaaaagcagugaccucauccggggcuuugg

SEQ ID NO: 665584 - RNA, 64 nt, hsa
cuaagauuaugauucaggggcauuuuggugcuguuaaaagcaagagccgaauuuagaaguuccc

SEQ ID NO: 665585 - RNA, 64 nt, hsa
uguacuucacuagugcugccagaggaauuguuaauaaaagcaccuucuuuaacaauaaaugucu

SEQ ID NO: 665586 - RNA, 64 nt, hsa
aaaaugagucuuauaaaauuaagugaagugcaaauaaaagcacugcuacuauaagacauucugg

SEQ ID NO: 665587 - RNA, 64 nt, hsa
cucugucaucgaagagaccagcucugacacagacuaaaagcaucaccugcucaacucucaauau

SEQ ID NO: 665588 - RNA, 64 nt, hsa
auacagagcugcaguuagacgggguuacgggggcuaaaagcagaaaaaaaauuccauuucaucg

SEQ ID NO: 665589 - RNA, 64 nt, hsa
uuucccccuuuuuuggugaucuaauugcauugguuaaaagcagcuaaccaggucuuuagaauau

SEQ ID NO: 665590 - RNA, 64 nt, hsa
gcuagaaguaucaucuggauuguugugaaacguuuaaaagcaguggccccucccugcuuuuauu

SEQ ID NO: 665591 - RNA, 64 nt, hsa
gagccuugggcuaaucuggcugaguagucaguuauaaaagcauaauugcuuuauauuuuggauc

SEQ ID NO: 665592 - RNA, 64 nt, hsa
guauggcugacccuguuucagaagcaggauaguauaaaagcaucagccuaagaauggcacuccc

SEQ ID NO: 665593 - RNA, 64 nt, hsa
auuaaugauuauaauaaaaaguuacaggucacuuuaaaagcaaacaguaccacuugaugauuuu

SEQ ID NO: 665594 - RNA, 64 nt, hsa
ccuagaaaacugcuugaugacaauaaaaaguaaauaaaagcacugcuaccuucuuugauuguau

SEQ ID NO: 665595 - RNA, 64 nt, hsa
uguggaaaauuauauugguaaguuuacagaucaauaaaagcaccuguucuccaucugaacuaga

SEQ ID NO: 665596 - RNA, 64 nt, hsa
aaauuuaaaaugaucaaaaagcaauauaguugcauaaaagcacuguaaaauauuuaaaagguua

SEQ ID NO: 665597 - RNA, 64 nt, hsa
uuuuuuauuuaucucuuuaaucuuuuuuuauuauuaaaagcaaguuucuuuguauuccucaccc

SEQ ID NO: 665598 - RNA, 64 nt, hsa
agcacucauaauauggcauccuucaauuucuguauaaaagcagaucuuuuuaaaaagauacuuc

SEQ ID NO: 665599 - RNA, 64 nt, hsa
ucuuuuuguucugaaauugaguuuauucaaaguguaaaagcacauacugcauuuucugcugaaa

SEQ ID NO: 665600 - RNA, 64 nt, hsa
cccuuuguucagauaccuuaaaaguuacuuuauuuaaaagcauuuauuaaucuuagucugaaau

SEQ ID NO: 665601 - RNA, 64 nt, hsa
uuuauuuucucuguucccuuucuuaggaauguuauaaaagcaaaucccaagcaucauaucauuu

SEQ ID NO: 665602 - RNA, 64 nt, hsa
auggaucuuuucuuuagaccuauuuuugaaggcauaaaagcaguugaguuucuggagaauuuuu

SEQ ID NO: 665603 - RNA, 64 nt, hsa
auucuauguauuauuaaauauuuacuaguucuguuaaaagcagagcagaaguuagacacuaagg

SEQ ID NO: 665604 - RNA, 64 nt, hsa
aaauagcguucauggcuacgaauauguagaauguuaaaagcacagcaaacugcacugcacuuau

SEQ ID NO: 665605 - RNA, 64 nt, hsa; identical to SEQ ID NO: 426691

SEQ ID NO: 665606 - RNA, 64 nt, hsa; identical to SEQ ID NO: 426692

SEQ ID NO: 665607 - RNA, 64 nt, hsa; identical to SEQ ID NO: 426693

SEQ ID NO: 665608 - RNA, 64 nt, hsa; identical to SEQ ID NO: 426694

SEQ ID NO: 665609 - RNA, 64 nt, hsa; identical to SEQ ID NO: 426695

SEQ ID NO: 665610 - RNA, 64 nt, hsa; identical to SEQ ID NO: 426696

SEQ ID NO: 665611 - RNA, 64 nt, hsa; identical to SEQ ID NO: 426697

SEQ ID NO: 665612 - RNA, 64 nt, hsa; identical to SEQ ID NO: 426698

SEQ ID NO: 665613 - RNA, 64 nt, hsa; identical to SEQ ID NO: 426699

SEQ ID NO: 665614 - RNA, 64 nt, hsa; identical to SEQ ID NO: 426700

SEQ ID NO: 665615 - RNA, 64 nt, hsa; identical to SEQ ID NO: 426701

SEQ ID NO: 665616 - RNA, 64 nt, hsa; identical to SEQ ID NO: 426702

SEQ ID NO: 665617 - RNA, 64 nt, hsa; identical to SEQ ID NO: 426703

SEQ ID NO: 665618 - RNA, 64 nt, hsa; identical to SEQ ID NO: 426704

SEQ ID NO: 665619 - RNA, 64 nt, hsa; identical to SEQ ID NO: 426705

SEQ ID NO: 665620 - RNA, 64 nt, hsa; identical to SEQ ID NO: 426706

SEQ ID NO: 665621 - RNA, 54 nt, hsa; identical to SEQ ID NO: 426707

SEQ ID NO: 665622 - RNA, 64 nt, hsa; identical to SEQ ID NO: 426708

SEQ ID NO: 665623 - RNA, 64 nt, hsa; identical to SEQ ID NO: 426709

SEQ ID NO: 665624 - RNA, 64 nt, hsa; identical to SEQ ID NO: 426710

SEQ ID NO: 665625 - RNA, 64 nt, hsa; identical to SEQ ID NO: 426711

SEQ ID NO: 665626 - RNA, 64 nt, hsa; identical to SEQ ID NO: 426712

SEQ ID NO: 665627 - RNA, 64 nt, hsa; identical to SEQ ID NO: 426713

SEQ ID NO: 665628 - RNA, 64 nt, hsa; identical to SEQ ID NO: 426714

SEQ ID NO: 665629 - RNA, 64 nt, hsa; identical to SEQ ID NO: 426715

SEQ ID NO: 665630 - RNA, 64 nt, hsa; identical to SEQ ID NO: 426716

SEQ ID NO: 665631 - RNA, 64 nt, hsa; identical to SEQ ID NO: 426717

SEQ ID NO: 665632 - RNA, 64 nt, hsa; identical to SEQ ID NO: 426718

SEQ ID NO: 665633 - RNA, 64 nt, hsa; identical to SEQ ID NO: 426719

SEQ ID NO: 665634 - RNA, 64 nt, hsa; identical to SEQ ID NO: 426720

SEQ ID NO: 665635 - RNA, 64 nt, hsa; identical to SEQ ID NO: 426721

SEQ ID NO: 665636 - RNA, 64 nt, hsa; identical to SEQ ID NO: 426722

SEQ ID NO: 665637 - RNA, 64 nt, hsa; identical to SEQ ID NO: 426723

SEQ ID NO: 665638 - RNA, 64 nt, hsa; identical to SEQ ID NO: 426724

SEQ ID NO: 665639 - RNA, 64 nt, hsa; identical to SEQ ID NO: 426725

SEQ ID NO: 665640 - RNA, 64 nt, hsa; identical to SEQ ID NO: 426726

SEQ ID NO: 665641 - RNA, 61 nt, hsa; identical to SEQ ID NO: 426727

SEQ ID NO: 665642 - RNA, 64 nt, hsa; identical to SEQ ID NO: 426728

SEQ ID NO: 665643 - RNA, 64 nt, hsa; identical to SEQ ID NO: 426729

SEQ ID NO: 665644 - RNA, 64 nt, hsa; identical to SEQ ID NO: 426730

SEQ ID NO: 665645 - RNA, 64 nt, hsa; identical to SEQ ID NO: 426731

SEQ ID NO: 665646 - RNA, 64 nt, hsa; identical to SEQ ID NO: 426732

SEQ ID NO: 665647 - RNA, 64 nt, hsa; identical to SEQ ID NO: 426733

SEQ ID NO: 665648 - RNA, 64 nt, hsa; identical to SEQ ID NO: 426734

SEQ ID NO: 665649 - RNA, 64 nt, hsa; identical to SEQ ID NO: 426735

SEQ ID NO: 665650 - RNA, 64 nt, hsa; identical to SEQ ID NO: 426736

SEQ ID NO: 665651 - RNA, 64 nt, hsa; identical to SEQ ID NO: 426737

SEQ ID NO: 665652 - RNA, 64 nt, hsa; identical to SEQ ID NO: 426738

SEQ ID NO: 665653 - RNA, 64 nt, hsa; identical to SEQ ID NO: 426739

SEQ ID NO: 665654 - RNA, 64 nt, hsa; identical to SEQ ID NO: 426740

SEQ ID NO: 665655 - RNA, 64 nt, hsa; identical to SEQ ID NO: 426741

SEQ ID NO: 665656 - RNA, 64 nt, hsa; identical to SEQ ID NO: 426742

SEQ ID NO: 665657 - RNA, 64 nt, hsa; identical to SEQ ID NO: 426743

SEQ ID NO: 665658 - RNA, 64 nt, hsa; identical to SEQ ID NO: 426744

SEQ ID NO: 665659 - RNA, 64 nt, hsa; identical to SEQ ID NO: 426745

SEQ ID NO: 665660 - RNA, 64 nt, hsa; identical to SEQ ID NO: 426746

SEQ ID NO: 665661 - RNA, 64 nt, hsa; identical to SEQ ID NO: 426747

SEQ ID NO: 665662 - RNA, 64 nt, hsa; identical to SEQ ID NO: 426748

SEQ ID NO: 665663 - RNA, 64 nt, hsa; identical to SEQ ID NO: 426749

SEQ ID NO: 665664 - RNA, 64 nt, hsa; identical to SEQ ID NO: 426750

SEQ ID NO: 665665 - RNA, 64 nt, hsa; identical to SEQ ID NO: 426751

SEQ ID NO: 665666 - RNA, 64 nt, hsa; identical to SEQ ID NO: 426752

SEQ ID NO: 665667 - RNA, 64 nt, hsa; identical to SEQ ID NO: 426753

SEQ ID NO: 665668 - RNA, 64 nt, hsa; identical to SEQ ID NO: 426754

SEQ ID NO: 665669 - RNA, 64 nt, hsa; identical to SEQ ID NO: 426755

SEQ ID NO: 665670 - RNA, 64 nt, hsa; identical to SEQ ID NO: 426756

SEQ ID NO: 665671 - RNA, 64 nt, hsa; identical to SEQ ID NO: 426757

SEQ ID NO: 665672 - RNA, 64 nt, hsa; identical to SEQ ID NO: 426758

SEQ ID NO: 665673 - RNA, 64 nt, hsa; identical to SEQ ID NO: 426759

SEQ ID NO: 665674 - RNA, 64 nt, hsa; identical to SEQ ID NO: 426760

SEQ ID NO: 665675 - RNA, 64 nt, hsa; identical to SEQ ID NO: 426761

SEQ ID NO: 665676 - RNA, 64 nt, hsa; identical to SEQ ID NO: 426762

SEQ ID NO: 665677 - RNA, 64 nt, hsa; identical to SEQ ID NO: 426763

SEQ ID NO: 665678 - RNA, 64 nt, hsa; identical to SEQ ID NO: 426764

SEQ ID NO: 665679 - RNA, 64 nt, hsa; identical to SEQ ID NO: 426765

SEQ ID NO: 665680 - RNA, 64 nt, hsa; identical to SEQ ID NO: 426766

SEQ ID NO: 665681 - RNA, 64 nt, hsa; identical to SEQ ID NO: 426767

SEQ ID NO: 665682 - RNA, 64 nt, hsa; identical to SEQ ID NO: 426768

SEQ ID NO: 665683 - RNA, 64 nt, hsa
gcagcuucccuacauuacacacacucagguugagucauucuaacuauaaaagugcaaugacuaa

SEQ ID NO: 665684 - RNA, 64 nt, hsa
acgucuuuuguuuccaacaagaggauuuucuuuuucauucuagaauuaucuccuugauaacuug

SEQ ID NO: 665685 - RNA, 64 nt, hsa
uaccuaaaucaccccagagcuuuaugucuuuuauucauucuaauucuuauuaaccggaauaugu

SEQ ID NO: 665686 - RNA, 64 nt, hsa
aggaaaaugcacacuuuguuuuuacuuuuccguuucauucuaaagguaguuaagaugaaauuua

SEQ ID NO: 665687 - RNA, 64 nt, hsa
cugucagccucuuucauagugugcaaacauuuuaucauucuaaauggugacucucugcccuugg

SEQ ID NO: 665688 - RNA, 64 nt, hsa
ucauugcuuguaugacuucacaagcaacucaggaucauucuagcaggcuuucccacugucaaac

SEQ ID NO: 665689 - RNA, 64 nt, hsa
uucuagcaggcuuucccacugucaaacagagacuucauucuaaaaagagaagugauaaacagag

SEQ ID NO: 665690 - RNA, 64 nt, hsa
augagccaccgugccuggcuggguauuuauauuaucauucuaguuucagaguauacagaaguuu

SEQ ID NO: 665691 - RNA, 64 nt, hsa
guugagauuucaguggggacacagccaaaccauaucauucuaccccuggcaccuccaaaucuca

SEQ ID NO: 665692 - RNA, 64 nt, hsa
ggcugagagggaauaaucugagcaaagguaugaaacagccuaaugcauuagagaaaaaaguucu

SEQ ID NO: 665693 - RNA, 64 nt, hsa
ugaauaaagcauuauuucugcccuagaguuguucacagccuagucaggcauauggauauguaaa

SEQ ID NO: 665694 - RNA, 64 nt, hsa
ugguuuucacucauuugauugguuugagcccagaacagccuacaggggaaaaacaagcuggaua

SEQ ID NO: 665695 - RNA, 64 nt, hsa
uacuuccugccucauuucaugcagucuuuucugaacagccuaugcugcugcccugcuggccccu

SEQ ID NO: 665696 - RNA, 64 nt, hsa; identical to SEQ ID NO: 217362

SEQ ID NO: 665697 - RNA, 64 nt, hsa; identical to SEQ ID NO: 217363

SEQ ID NO: 665698 - RNA, 64 nt, hsa; identical to SEQ ID NO: 217364

SEQ ID NO: 665699 - RNA, 64 nt, hsa; identical to SEQ ID NO: 217365

SEQ ID NO: 665700 - RNA, 64 nt, hsa; identical to SEQ ID NO: 217366

SEQ ID NO: 665701 - RNA, 64 nt, hsa; identical to SEQ ID NO: 217367

SEQ ID NO: 665702 - RNA, 64 nt, hsa; identical to SEQ ID NO: 217368

SEQ ID NO: 665703 - RNA, 64 nt, hsa; identical to SEQ ID NO: 217369

SEQ ID NO: 665704 - RNA, 64 nt, hsa; identical to SEQ ID NO: 217370

SEQ ID NO: 665705 - RNA, 64 nt, hsa; identical to SEQ ID NO: 217371

SEQ ID NO: 665706 - RNA, 64 nt, hsa; identical to SEQ ID NO: 217372

SEQ ID NO: 665707 - RNA, 64 nt, hsa; identical to SEQ ID NO: 217373

SEQ ID NO: 665708 - RNA, 64 nt, hsa; identical to SEQ ID NO: 217374

SEQ ID NO: 665709 - RNA, 64 nt, hsa; identical to SEQ ID NO: 217375

SEQ ID NO: 665710 - RNA, 64 nt, hsa; identical to SEQ ID NO: 217376

SEQ ID NO: 665711 - RNA, 64 nt, hsa; identical to SEQ ID NO: 217377

SEQ ID NO: 665712 - RNA, 64 nt, hsa; identical to SEQ ID NO: 217378

SEQ ID NO: 665713 - RNA, 64 nt, hsa; identical to SEQ ID NO: 217379

SEQ ID NO: 665714 - RNA, 64 nt, hsa; identical to SEQ ID NO: 217380

SEQ ID NO: 665715 - RNA, 64 nt, hsa; identical to SEQ ID NO: 217381

SEQ ID NO: 665716 - RNA, 64 nt, hsa; identical to SEQ ID NO: 217382

SEQ ID NO: 665717 - RNA, 64 nt, hsa; identical to SEQ ID NO: 217383

SEQ ID NO: 665718 - RNA, 64 nt, hsa; identical to SEQ ID NO: 217384

SEQ ID NO: 665719 - RNA, 64 nt, hsa; identical to SEQ ID NO: 217385

SEQ ID NO: 665720 - RNA, 55 nt, hsa; identical to SEQ ID NO: 217386

SEQ ID NO: 665721 - RNA, 64 nt, hsa; identical to SEQ ID NO: 217387

SEQ ID NO: 665722 - RNA, 64 nt, hsa; identical to SEQ ID NO: 217388

SEQ ID NO: 665723 - RNA, 64 nt, hsa; identical to SEQ ID NO: 217389

SEQ ID NO: 665724 - RNA, 64 nt, hsa; identical to SEQ ID NO: 217390

SEQ ID NO: 665725 - RNA, 64 nt, hsa; identical to SEQ ID NO: 217391

SEQ ID NO: 665726 - RNA, 64 nt, hsa; identical to SEQ ID NO: 217392

SEQ ID NO: 665727 - RNA, 64 nt, hsa; identical to SEQ ID NO: 217393

SEQ ID NO: 665728 - RNA, 64 nt, hsa; identical to SEQ ID NO: 217394

SEQ ID NO: 665729 - RNA, 64 nt, hsa; identical to SEQ ID NO: 175055

SEQ ID NO: 665730 - RNA, 64 nt, hsa; identical to SEQ ID NO: 175056

SEQ ID NO: 665731 - RNA, 64 nt, hsa; identical to SEQ ID NO: 175057

SEQ ID NO: 665732 - RNA, 64 nt, hsa; identical to SEQ ID NO: 175058

SEQ ID NO: 665733 - RNA, 64 nt, hsa; identical to SEQ ID NO: 175059

SEQ ID NO: 665734 - RNA, 64 nt, hsa; identical to SEQ ID NO: 175060

SEQ ID NO: 665735 - RNA, 64 nt, hsa; identical to SEQ ID NO: 175061

SEQ ID NO: 665736 - RNA, 64 nt, hsa; identical to SEQ ID NO: 175062

SEQ ID NO: 665737 - RNA, 64 nt, hsa; identical to SEQ ID NO: 175063

SEQ ID NO: 665738 - RNA, 64 nt, hsa; identical to SEQ ID NO: 175064

SEQ ID NO: 665739 - RNA, 64 nt, hsa; identical to SEQ ID NO: 175065

SEQ ID NO: 665740 - RNA, 64 nt, hsa; identical to SEQ ID NO: 175066

SEQ ID NO: 665741 - RNA, 64 nt, hsa; identical to SEQ ID NO: 175067

SEQ ID NO: 665742 - RNA, 64 nt, hsa; identical to SEQ ID NO: 175068

SEQ ID NO: 665743 - RNA, 64 nt, hsa; identical to SEQ ID NO: 175069

SEQ ID NO: 665744 - RNA, 64 nt, hsa; identical to SEQ ID NO: 175070

SEQ ID NO: 665745 - RNA, 64 nt, hsa; identical to SEQ ID NO: 175071

SEQ ID NO: 665746 - RNA, 64 nt, hsa; identical to SEQ ID NO: 175072

SEQ ID NO: 665747 - RNA, 64 nt, hsa; identical to SEQ ID NO: 175073

SEQ ID NO: 665748 - RNA, 64 nt, hsa; identical to SEQ ID NO: 175074

SEQ ID NO: 665749 - RNA, 64 nt, hsa; identical to SEQ ID NO: 218812

SEQ ID NO: 665750 - RNA, 64 nt, hsa; identical to SEQ ID NO: 218813

SEQ ID NO: 665751 - RNA, 64 nt, hsa; identical to SEQ ID NO: 218814

SEQ ID NO: 665752 - RNA, 64 nt, hsa; identical to SEQ ID NO: 218815

SEQ ID NO: 665753 - RNA, 64 nt, hsa; identical to SEQ ID NO: 218816

SEQ ID NO: 665754 - RNA, 64 nt, hsa; identical to SEQ ID NO: 218817

SEQ ID NO: 665755 - RNA, 64 nt, hsa; identical to SEQ ID NO: 218818

SEQ ID NO: 665756 - RNA, 64 nt, hsa; identical to SEQ ID NO: 218819

SEQ ID NO: 665757 - RNA, 64 nt, hsa; identical to SEQ ID NO: 218820

SEQ ID NO: 665758 - RNA, 64 nt, hsa; identical to SEQ ID NO: 218821

SEQ ID NO: 665759 - RNA, 64 nt, hsa; identical to SEQ ID NO: 218822

SEQ ID NO: 665760 - RNA, 64 nt, hsa; identical to SEQ ID NO: 218823

SEQ ID NO: 665761 - RNA, 64 nt, hsa; identical to SEQ ID NO: 218824

SEQ ID NO: 665762 - RNA, 64 nt, hsa; identical to SEQ ID NO: 218825

SEQ ID NO: 665763 - RNA, 64 nt, hsa; identical to SEQ ID NO: 218826

SEQ ID NO: 665764 - RNA, 64 nt, hsa; identical to SEQ ID NO: 218827

SEQ ID NO: 665765 - RNA, 64 nt, hsa; identical to SEQ ID NO: 218828

SEQ ID NO: 665766 - RNA, 64 nt, hsa; identical to SEQ ID NO: 218829

SEQ ID NO: 665767 - RNA, 64 nt, hsa; identical to SEQ ID NO: 218830

SEQ ID NO: 665768 - RNA, 64 nt, hsa; identical to SEQ ID NO: 218831

SEQ ID NO: 665769 - RNA, 64 nt, hsa; identical to SEQ ID NO: 218832

SEQ ID NO: 665770 - RNA, 64 nt, hsa; identical to SEQ ID NO: 218833

SEQ ID NO: 665771 - RNA, 64 nt, hsa; identical to SEQ ID NO: 218834

SEQ ID NO: 665772 - RNA, 64 nt, hsa; identical to SEQ ID NO: 218835

SEQ ID NO: 665773 - RNA, 64 nt, hsa; identical to SEQ ID NO: 218836

SEQ ID NO: 665774 - RNA, 64 nt, hsa; identical to SEQ ID NO: 161149

SEQ ID NO: 665775 - RNA, 64 nt, hsa; identical to SEQ ID NO: 161150

SEQ ID NO: 665776 - RNA, 64 nt, hsa; identical to SEQ ID NO: 161151

SEQ ID NO: 665777 - RNA, 64 nt, hsa; identical to SEQ ID NO: 161152

SEQ ID NO: 665778 - RNA, 64 nt, hsa; identical to SEQ ID NO: 161153

SEQ ID NO: 665779 - RNA, 64 nt, hsa; identical to SEQ ID NO: 161154

SEQ ID NO: 665780 - RNA, 64 nt, hsa; identical to SEQ ID NO: 161155

SEQ ID NO: 665781 - RNA, 64 nt, hsa; identical to SEQ ID NO: 161156

SEQ ID NO: 665782 - RNA, 64 nt, hsa; identical to SEQ ID NO: 161157

SEQ ID NO: 665783 - RNA, 64 nt, hsa; identical to SEQ ID NO: 161158

SEQ ID NO: 665784 - RNA, 64 nt, hsa; identical to SEQ ID NO: 161159

SEQ ID NO: 665785 - RNA, 64 nt, hsa; identical to SEQ ID NO: 161160

SEQ ID NO: 665786 - RNA, 64 nt, hsa; identical to SEQ ID NO: 161161

SEQ ID NO: 665787 - RNA, 64 nt, hsa; identical to SEQ ID NO: 161162

SEQ ID NO: 665788 - RNA, 64 nt, hsa; identical to SEQ ID NO: 161163

SEQ ID NO: 665789 - RNA, 64 nt, hsa; identical to SEQ ID NO: 161164

SEQ ID NO: 665790 - RNA, 64 nt, hsa; identical to SEQ ID NO: 161165

SEQ ID NO: 665791 - RNA, 64 nt, hsa; identical to SEQ ID NO: 161166

SEQ ID NO: 665792 - RNA, 64 nt, hsa; identical to SEQ ID NO: 161167

SEQ ID NO: 665793 - RNA, 64 nt, hsa; identical to SEQ ID NO: 161168

SEQ ID NO: 665794 - RNA, 64 nt, hsa; identical to SEQ ID NO: 161169

SEQ ID NO: 665795 - RNA, 64 nt, hsa; identical to SEQ ID NO: 161170

SEQ ID NO: 665796 - RNA, 64 nt, hsa; identical to SEQ ID NO: 161171

SEQ ID NO: 665797 - RNA, 64 nt, hsa; identical to SEQ ID NO: 161172

SEQ ID NO: 665798 - RNA, 64 nt, hsa; identical to SEQ ID NO: 161173

SEQ ID NO: 665799 - RNA, 64 nt, hsa; identical to SEQ ID NO: 161174

SEQ ID NO: 665800 - RNA, 64 nt, hsa; identical to SEQ ID NO: 161175

SEQ ID NO: 665801 - RNA, 64 nt, hsa; identical to SEQ ID NO: 161176

SEQ ID NO: 665802 - RNA, 64 nt, hsa; identical to SEQ ID NO: 161177

SEQ ID NO: 665803 - RNA, 64 nt, hsa; identical to SEQ ID NO: 161178

SEQ ID NO: 665804 - RNA, 64 nt, hsa; identical to SEQ ID NO: 161179

SEQ ID NO: 665805 - RNA, 64 nt, hsa; identical to SEQ ID NO: 161180

SEQ ID NO: 665806 - RNA, 64 nt, hsa; identical to SEQ ID NO: 161181

SEQ ID NO: 665807 - RNA, 64 nt, hsa; identical to SEQ ID NO: 161182

SEQ ID NO: 665808 - RNA, 64 nt, hsa; identical to SEQ ID NO: 161183

SEQ ID NO: 665809 - RNA, 64 nt, hsa; identical to SEQ ID NO: 525800

SEQ ID NO: 665810 - RNA, 64 nt, hsa; identical to SEQ ID NO: 525801

SEQ ID NO: 665811 - RNA, 64 nt, hsa; identical to SEQ ID NO: 525802

SEQ ID NO: 665812 - RNA, 64 nt, hsa; identical to SEQ ID NO: 525803

SEQ ID NO: 665813 - RNA, 64 nt, hsa; identical to SEQ ID NO: 525804

SEQ ID NO: 665814 - RNA, 64 nt, hsa; identical to SEQ ID NO: 525805

SEQ ID NO: 665815 - RNA, 64 nt, hsa; identical to SEQ ID NO: 525806

SEQ ID NO: 665816 - RNA, 64 nt, hsa; identical to SEQ ID NO: 525807

SEQ ID NO: 665817 - RNA, 64 nt, hsa; identical to SEQ ID NO: 525808

SEQ ID NO: 665818 - RNA, 64 nt, hsa; identical to SEQ ID NO: 525809

SEQ ID NO: 665819 - RNA, 64 nt, hsa; identical to SEQ ID NO: 525810

SEQ ID NO: 665820 - RNA, 64 nt, hsa; identical to SEQ ID NO: 525811

SEQ ID NO: 665821 - RNA, 64 nt, hsa; identical to SEQ ID NO: 525812

SEQ ID NO: 665822 - RNA, 64 nt, hsa; identical to SEQ ID NO: 525813

SEQ ID NO: 665823 - RNA, 64 nt, hsa; identical to SEQ ID NO: 525814

SEQ ID NO: 665824 - RNA, 64 nt, hsa; identical to SEQ ID NO: 525815

SEQ ID NO: 665825 - RNA, 64 nt, hsa; identical to SEQ ID NO: 525816

SEQ ID NO: 665826 - RNA, 64 nt, hsa; identical to SEQ ID NO: 525817

SEQ ID NO: 665827 - RNA, 64 nt, hsa; identical to SEQ ID NO: 525818

SEQ ID NO: 665828 - RNA, 64 nt, hsa; identical to SEQ ID NO: 525819

SEQ ID NO: 665829 - RNA, 64 nt, hsa; identical to SEQ ID NO: 525820

SEQ ID NO: 665830 - RNA, 64 nt, hsa; identical to SEQ ID NO: 525821

SEQ ID NO: 665831 - RNA, 64 nt, hsa; identical to SEQ ID NO: 525822

SEQ ID NO: 665832 - RNA, 64 nt, hsa; identical to SEQ ID NO: 525823

SEQ ID NO: 665833 - RNA, 64 nt, hsa; identical to SEQ ID NO: 525824

SEQ ID NO: 665834 - RNA, 64 nt, hsa; identical to SEQ ID NO: 525825

SEQ ID NO: 665835 - RNA, 64 nt, hsa; identical to SEQ ID NO: 525826

SEQ ID NO: 665836 - RNA, 64 nt, hsa; identical to SEQ ID NO: 525827

SEQ ID NO: 665837 - RNA, 64 nt, hsa; identical to SEQ ID NO: 525828

SEQ ID NO: 665838 - RNA, 64 nt, hsa; identical to SEQ ID NO: 525829

SEQ ID NO: 665839 - RNA, 64 nt, hsa; identical to SEQ ID NO: 525830

SEQ ID NO: 665840 - RNA, 64 nt, hsa; identical to SEQ ID NO: 525831

SEQ ID NO: 665841 - RNA, 64 nt, hsa; identical to SEQ ID NO: 525832

SEQ ID NO: 665842 - RNA, 64 nt, hsa; identical to SEQ ID NO: 525833

SEQ ID NO: 665843 - RNA, 64 nt, hsa; identical to SEQ ID NO: 525834

SEQ ID NO: 665844 - RNA, 64 nt, hsa; identical to SEQ ID NO: 525835

SEQ ID NO: 665845 - RNA, 64 nt, hsa; identical to SEQ ID NO: 525836

SEQ ID NO: 665846 - RNA, 64 nt, hsa; identical to SEQ ID NO: 525837

SEQ ID NO: 665847 - RNA, 64 nt, hsa; identical to SEQ ID NO: 525838

SEQ ID NO: 665848 - RNA, 64 nt, hsa; identical to SEQ ID NO: 525839

SEQ ID NO: 665849 - RNA, 64 nt, hsa; identical to SEQ ID NO: 525840

SEQ ID NO: 665850 - RNA, 64 nt, hsa; identical to SEQ ID NO: 525841

SEQ ID NO: 665851 - RNA, 64 nt, hsa; identical to SEQ ID NO: 525842

SEQ ID NO: 665852 - RNA, 64 nt, hsa; identical to SEQ ID NO: 525843

SEQ ID NO: 665853 - RNA, 64 nt, hsa; identical to SEQ ID NO: 525844

SEQ ID NO: 665854 - RNA, 64 nt, hsa; identical to SEQ ID NO: 525845

SEQ ID NO: 665855 - RNA, 64 nt, hsa; identical to SEQ ID NO: 525846

SEQ ID NO: 665856 - RNA, 64 nt, hsa; identical to SEQ ID NO: 525847

SEQ ID NO: 665857 - RNA, 64 nt, hsa; identical to SEQ ID NO: 525848

SEQ ID NO: 665858 - RNA, 64 nt, hsa; identical to SEQ ID NO: 525849

SEQ ID NO: 665859 - RNA, 64 nt, hsa; identical to SEQ ID NO: 525850

SEQ ID NO: 665860 - RNA, 64 nt, hsa; identical to SEQ ID NO: 525851

SEQ ID NO: 665861 - RNA, 64 nt, hsa; identical to SEQ ID NO: 525852

SEQ ID NO: 665862 - RNA, 64 nt, hsa; identical to SEQ ID NO: 525853

SEQ ID NO: 665863 - RNA, 64 nt, hsa; identical to SEQ ID NO: 525854

SEQ ID NO: 665864 - RNA, 64 nt, hsa; identical to SEQ ID NO: 525855

SEQ ID NO: 665865 - RNA, 64 nt, hsa; identical to SEQ ID NO: 525856

SEQ ID NO: 665866 - RNA, 64 nt, hsa; identical to SEQ ID NO: 525857

SEQ ID NO: 665867 - RNA, 64 nt, hsa; identical to SEQ ID NO: 525858

SEQ ID NO: 665868 - RNA, 64 nt, hsa; identical to SEQ ID NO: 525859

SEQ ID NO: 665869 - RNA, 64 nt, hsa; identical to SEQ ID NO: 525860

SEQ ID NO: 665870 - RNA, 64 nt, hsa; identical to SEQ ID NO: 525861

SEQ ID NO: 665871 - RNA, 64 nt, hsa; identical to SEQ ID NO: 525862

SEQ ID NO: 665872 - RNA, 64 nt, hsa; identical to SEQ ID NO: 525863

SEQ ID NO: 665873 - RNA, 64 nt, hsa; identical to SEQ ID NO: 525864

SEQ ID NO: 665874 - RNA, 64 nt, hsa; identical to SEQ ID NO: 525865

SEQ ID NO: 665875 - RNA, 64 nt, hsa; identical to SEQ ID NO: 525866

SEQ ID NO: 665876 - RNA, 64 nt, hsa; identical to SEQ ID NO: 525867

SEQ ID NO: 665877 - RNA, 64 nt, hsa; identical to SEQ ID NO: 525868

SEQ ID NO: 665878 - RNA, 64 nt, hsa; identical to SEQ ID NO: 525869

SEQ ID NO: 665879 - RNA, 64 nt, hsa; identical to SEQ ID NO: 525870

SEQ ID NO: 665880 - RNA, 64 nt, hsa; identical to SEQ ID NO: 525871

SEQ ID NO: 665881 - RNA, 64 nt, hsa; identical to SEQ ID NO: 525872

SEQ ID NO: 665882 - RNA, 64 nt, hsa; identical to SEQ ID NO: 525873

SEQ ID NO: 665883 - RNA, 64 nt, hsa; identical to SEQ ID NO: 525874

SEQ ID NO: 665884 - RNA, 64 nt, hsa; identical to SEQ ID NO: 525875

SEQ ID NO: 665885 - RNA, 64 nt, hsa; identical to SEQ ID NO: 525876

SEQ ID NO: 665886 - RNA, 64 nt, hsa; identical to SEQ ID NO: 525877

SEQ ID NO: 665887 - RNA, 64 nt, hsa; identical to SEQ ID NO: 525878

SEQ ID NO: 665888 - RNA, 64 nt, hsa; identical to SEQ ID NO: 525879

SEQ ID NO: 665889 - RNA, 64 nt, hsa; identical to SEQ ID NO: 525880

SEQ ID NO: 665890 - RNA, 64 nt, hsa; identical to SEQ ID NO: 525881

SEQ ID NO: 665891 - RNA, 64 nt, hsa; identical to SEQ ID NO: 525882

SEQ ID NO: 665892 - RNA, 64 nt, hsa; identical to SEQ ID NO: 525883

SEQ ID NO: 665893 - RNA, 64 nt, hsa; identical to SEQ ID NO: 525884

SEQ ID NO: 665894 - RNA, 64 nt, hsa; identical to SEQ ID NO: 525885

SEQ ID NO: 665895 - RNA, 64 nt, hsa; identical to SEQ ID NO: 525886

SEQ ID NO: 665896 - RNA, 64 nt, hsa; identical to SEQ ID NO: 525887

SEQ ID NO: 665897 - RNA, 64 nt, hsa; identical to SEQ ID NO: 525888

SEQ ID NO: 665898 - RNA, 64 nt, hsa; identical to SEQ ID NO: 525889

SEQ ID NO: 665899 - RNA, 64 nt, hsa; identical to SEQ ID NO: 525890

SEQ ID NO: 665900 - RNA, 64 nt, hsa; identical to SEQ ID NO: 525891

SEQ ID NO: 665901 - RNA, 64 nt, hsa; identical to SEQ ID NO: 525892

SEQ ID NO: 665902 - RNA, 64 nt, hsa; identical to SEQ ID NO: 525893

SEQ ID NO: 665903 - RNA, 64 nt, hsa; identical to SEQ ID NO: 525894

SEQ ID NO: 665904 - RNA, 64 nt, hsa; identical to SEQ ID NO: 525895

SEQ ID NO: 665905 - RNA, 64 nt, hsa; identical to SEQ ID NO: 525896

SEQ ID NO: 665906 - RNA, 64 nt, hsa; identical to SEQ ID NO: 525897

SEQ ID NO: 665907 - RNA, 64 nt, hsa; identical to SEQ ID NO: 525898

SEQ ID NO: 665908 - RNA, 64 nt, hsa; identical to SEQ ID NO: 525899

SEQ ID NO: 665909 - RNA, 64 nt, hsa; identical to SEQ ID NO: 525900

SEQ ID NO: 665910 - RNA, 64 nt, hsa; identical to SEQ ID NO: 525901

SEQ ID NO: 665911 - RNA, 64 nt, hsa; identical to SEQ ID NO: 525902

SEQ ID NO: 665912 - RNA, 64 nt, hsa; identical to SEQ ID NO: 525903

SEQ ID NO: 665913 - RNA, 64 nt, hsa; identical to SEQ ID NO: 525904

SEQ ID NO: 665914 - RNA, 64 nt, hsa; identical to SEQ ID NO: 525905

SEQ ID NO: 665915 - RNA, 64 nt, hsa; identical to SEQ ID NO: 525906

SEQ ID NO: 665916 - RNA, 64 nt, hsa; identical to SEQ ID NO: 525907

SEQ ID NO: 665917 - RNA, 64 nt, hsa; identical to SEQ ID NO: 525908

SEQ ID NO: 665918 - RNA, 64 nt, hsa; identical to SEQ ID NO: 525909

SEQ ID NO: 665919 - RNA, 64 nt, hsa; identical to SEQ ID NO: 525910

SEQ ID NO: 665920 - RNA, 64 nt, hsa; identical to SEQ ID NO: 525911

SEQ ID NO: 665921 - RNA, 64 nt, hsa; identical to SEQ ID NO: 525912

SEQ ID NO: 665922 - RNA, 64 nt, hsa; identical to SEQ ID NO: 525913

SEQ ID NO: 665923 - RNA, 64 nt, hsa; identical to SEQ ID NO: 525914

SEQ ID NO: 665924 - RNA, 64 nt, hsa; identical to SEQ ID NO: 525915

SEQ ID NO: 665925 - RNA, 64 nt, hsa; identical to SEQ ID NO: 525916

SEQ ID NO: 665926 - RNA, 64 nt, hsa; identical to SEQ ID NO: 525917

SEQ ID NO: 665927 - RNA, 64 nt, hsa; identical to SEQ ID NO: 525918

SEQ ID NO: 665928 - RNA, 64 nt, hsa; identical to SEQ ID NO: 525919

SEQ ID NO: 665929 - RNA, 64 nt, hsa; identical to SEQ ID NO: 525920

SEQ ID NO: 665930 - RNA, 64 nt, hsa; identical to SEQ ID NO: 525921

SEQ ID NO: 665931 - RNA, 64 nt, hsa; identical to SEQ ID NO: 525922

SEQ ID NO: 665932 - RNA, 64 nt, hsa; identical to SEQ ID NO: 525923

SEQ ID NO: 665933 - RNA, 64 nt, hsa; identical to SEQ ID NO: 525924

SEQ ID NO: 665934 - RNA, 64 nt, hsa; identical to SEQ ID NO: 525925

SEQ ID NO: 665935 - RNA, 64 nt, hsa; identical to SEQ ID NO: 525926

SEQ ID NO: 665936 - RNA, 64 nt, hsa; identical to SEQ ID NO: 525927

SEQ ID NO: 665937 - RNA, 64 nt, hsa; identical to SEQ ID NO: 525928

SEQ ID NO: 665938 - RNA, 64 nt, hsa; identical to SEQ ID NO: 525929

SEQ ID NO: 665939 - RNA, 64 nt, hsa; identical to SEQ ID NO: 525930

SEQ ID NO: 665940 - RNA, 64 nt, hsa; identical to SEQ ID NO: 525931

SEQ ID NO: 665941 - RNA, 64 nt, hsa; identical to SEQ ID NO: 525932

SEQ ID NO: 665942 - RNA, 64 nt, hsa; identical to SEQ ID NO: 525933

SEQ ID NO: 665943 - RNA, 64 nt, hsa; identical to SEQ ID NO: 525934

SEQ ID NO: 665944 - RNA, 64 nt, hsa; identical to SEQ ID NO: 525935

SEQ ID NO: 665945 - RNA, 64 nt, hsa; identical to SEQ ID NO: 525936

SEQ ID NO: 665946 - RNA, 64 nt, hsa; identical to SEQ ID NO: 525937

SEQ ID NO: 665947 - RNA, 64 nt, hsa; identical to SEQ ID NO: 525938

SEQ ID NO: 665948 - RNA, 64 nt, hsa; identical to SEQ ID NO: 525939

SEQ ID NO: 665949 - RNA, 64 nt, hsa; identical to SEQ ID NO: 525940

SEQ ID NO: 665950 - RNA, 64 nt, hsa; identical to SEQ ID NO: 525941

SEQ ID NO: 665951 - RNA, 64 nt, hsa; identical to SEQ ID NO: 525942

SEQ ID NO: 665952 - RNA, 64 nt, hsa; identical to SEQ ID NO: 525943

SEQ ID NO: 665953 - RNA, 64 nt, hsa; identical to SEQ ID NO: 525944

SEQ ID NO: 665954 - RNA, 64 nt, hsa; identical to SEQ ID NO: 525945

SEQ ID NO: 665955 - RNA, 64 nt, hsa; identical to SEQ ID NO: 525946

SEQ ID NO: 665956 - RNA, 64 nt, hsa; identical to SEQ ID NO: 525947

SEQ ID NO: 665957 - RNA, 64 nt, hsa; identical to SEQ ID NO: 525948

SEQ ID NO: 665958 - RNA, 64 nt, hsa; identical to SEQ ID NO: 525949

SEQ ID NO: 665959 - RNA, 64 nt, hsa; identical to SEQ ID NO: 525950

SEQ ID NO: 665960 - RNA, 64 nt, hsa; identical to SEQ ID NO: 525951

SEQ ID NO: 665961 - RNA, 64 nt, hsa; identical to SEQ ID NO: 525952

SEQ ID NO: 665962 - RNA, 64 nt, hsa; identical to SEQ ID NO: 525953

SEQ ID NO: 665963 - RNA, 64 nt, hsa; identical to SEQ ID NO: 525954

SEQ ID NO: 665964 - RNA, 64 nt, hsa; identical to SEQ ID NO: 525955

SEQ ID NO: 665965 - RNA, 64 nt, hsa; identical to SEQ ID NO: 525956

SEQ ID NO: 665966 - RNA, 64 nt, hsa; identical to SEQ ID NO: 525957

SEQ ID NO: 665967 - RNA, 64 nt, hsa; identical to SEQ ID NO: 525958

SEQ ID NO: 665968 - RNA, 64 nt, hsa; identical to SEQ ID NO: 525959

SEQ ID NO: 665969 - RNA, 58 nt, hsa; identical to SEQ ID NO: 525960

SEQ ID NO: 665970 - RNA, 64 nt, hsa; identical to SEQ ID NO: 525961

SEQ ID NO: 665971 - RNA, 64 nt, hsa; identical to SEQ ID NO: 525962

SEQ ID NO: 665972 - RNA, 64 nt, hsa; identical to SEQ ID NO: 525963

SEQ ID NO: 665973 - RNA, 64 nt, hsa; identical to SEQ ID NO: 525964

SEQ ID NO: 665974 - RNA, 64 nt, hsa; identical to SEQ ID NO: 525965

SEQ ID NO: 665975 - RNA, 64 nt, hsa; identical to SEQ ID NO: 525966

SEQ ID NO: 665976 - RNA, 64 nt, hsa; identical to SEQ ID NO: 525967

SEQ ID NO: 665977 - RNA, 64 nt, hsa; identical to SEQ ID NO: 525968

SEQ ID NO: 665978 - RNA, 64 nt, hsa; identical to SEQ ID NO: 525969

SEQ ID NO: 665979 - RNA, 64 nt, hsa; identical to SEQ ID NO: 525970

SEQ ID NO: 665980 - RNA, 64 nt, hsa; identical to SEQ ID NO: 525971

SEQ ID NO: 665981 - RNA, 64 nt, hsa; identical to SEQ ID NO: 525972

SEQ ID NO: 665982 - RNA, 64 nt, hsa; identical to SEQ ID NO: 525973

SEQ ID NO: 665983 - RNA, 64 nt, hsa; identical to SEQ ID NO: 525974

SEQ ID NO: 665984 - RNA, 64 nt, hsa; identical to SEQ ID NO: 525975

SEQ ID NO: 665985 - RNA, 64 nt, hsa; identical to SEQ ID NO: 525976

SEQ ID NO: 665986 - RNA, 64 nt, hsa; identical to SEQ ID NO: 525977

SEQ ID NO: 665987 - RNA, 64 nt, hsa; identical to SEQ ID NO: 525978

SEQ ID NO: 665988 - RNA, 64 nt, hsa; identical to SEQ ID NO: 525979

SEQ ID NO: 665989 - RNA, 64 nt, hsa; identical to SEQ ID NO: 525980

SEQ ID NO: 665990 - RNA, 64 nt, hsa; identical to SEQ ID NO: 525981

SEQ ID NO: 665991 - RNA, 64 nt, hsa; identical to SEQ ID NO: 525982

SEQ ID NO: 665992 - RNA, 64 nt, hsa; identical to SEQ ID NO: 525983

SEQ ID NO: 665993 - RNA, 64 nt, hsa; identical to SEQ ID NO: 525984

SEQ ID NO: 665994 - RNA, 64 nt, hsa; identical to SEQ ID NO: 525985

SEQ ID NO: 665995 - RNA, 64 nt, hsa; identical to SEQ ID NO: 525986

SEQ ID NO: 665996 - RNA, 64 nt, hsa; identical to SEQ ID NO: 525987

SEQ ID NO: 665997 - RNA, 64 nt, hsa; identical to SEQ ID NO: 525988

SEQ ID NO: 665998 - RNA, 64 nt, hsa; identical to SEQ ID NO: 525989

SEQ ID NO: 665999 - RNA, 64 nt, hsa; identical to SEQ ID NO: 525990

SEQ ID NO: 666000 - RNA, 64 nt, hsa; identical to SEQ ID NO: 525991

SEQ ID NO: 666001 - RNA, 64 nt, hsa; identical to SEQ ID NO: 525992

SEQ ID NO: 666002 - RNA, 64 nt, hsa; identical to SEQ ID NO: 525993

SEQ ID NO: 666003 - RNA, 64 nt, hsa; identical to SEQ ID NO: 525994

SEQ ID NO: 666004 - RNA, 64 nt, hsa; identical to SEQ ID NO: 525995

SEQ ID NO: 666005 - RNA, 64 nt, hsa; identical to SEQ ID NO: 525996

SEQ ID NO: 666006 - RNA, 64 nt, hsa; identical to SEQ ID NO: 525997

SEQ ID NO: 666007 - RNA, 64 nt, hsa; identical to SEQ ID NO: 525998

SEQ ID NO: 666008 - RNA, 64 nt, hsa; identical to SEQ ID NO: 525999

SEQ ID NO: 666009 - RNA, 64 nt, hsa; identical to SEQ ID NO: 526000

SEQ ID NO: 666010 - RNA, 64 nt, hsa; identical to SEQ ID NO: 526001

SEQ ID NO: 666011 - RNA, 64 nt, hsa; identical to SEQ ID NO: 526002

SEQ ID NO: 666012 - RNA, 64 nt, hsa; identical to SEQ ID NO: 526003

SEQ ID NO: 666013 - RNA, 64 nt, hsa; identical to SEQ ID NO: 526004

SEQ ID NO: 666014 - RNA, 64 nt, hsa; identical to SEQ ID NO: 526005

SEQ ID NO: 666015 - RNA, 64 nt, hsa; identical to SEQ ID NO: 526006

SEQ ID NO: 666016 - RNA, 64 nt, hsa; identical to SEQ ID NO: 526007

SEQ ID NO: 666017 - RNA, 64 nt, hsa; identical to SEQ ID NO: 526008

SEQ ID NO: 666018 - RNA, 64 nt, hsa; identical to SEQ ID NO: 526009

SEQ ID NO: 666019 - RNA, 64 nt, hsa; identical to SEQ ID NO: 526010

SEQ ID NO: 666020 - RNA, 64 nt, hsa; identical to SEQ ID NO: 526011

SEQ ID NO: 666021 - RNA, 64 nt, hsa; identical to SEQ ID NO: 526012

SEQ ID NO: 666022 - RNA, 64 nt, hsa; identical to SEQ ID NO: 526013

SEQ ID NO: 666023 - RNA, 64 nt, hsa; identical to SEQ ID NO: 526014

SEQ ID NO: 666024 - RNA, 64 nt, hsa; identical to SEQ ID NO: 526015

SEQ ID NO: 666025 - RNA, 64 nt, hsa; identical to SEQ ID NO: 526016

SEQ ID NO: 666026 - RNA, 64 nt, hsa; identical to SEQ ID NO: 526017

SEQ ID NO: 666027 - RNA, 64 nt, hsa; identical to SEQ ID NO: 526018

SEQ ID NO: 666028 - RNA, 64 nt, hsa; identical to SEQ ID NO: 526019

SEQ ID NO: 666029 - RNA, 64 nt, hsa; identical to SEQ ID NO: 526020

SEQ ID NO: 666030 - RNA, 64 nt, hsa; identical to SEQ ID NO: 526021

SEQ ID NO: 666031 - RNA, 64 nt, hsa; identical to SEQ ID NO: 526022

SEQ ID NO: 666032 - RNA, 64 nt, hsa; identical to SEQ ID NO: 526023

SEQ ID NO: 666033 - RNA, 64 nt, hsa; identical to SEQ ID NO: 526024

SEQ ID NO: 666034 - RNA, 64 nt, hsa; identical to SEQ ID NO: 526025

SEQ ID NO: 666035 - RNA, 64 nt, hsa; identical to SEQ ID NO: 526026

SEQ ID NO: 666036 - RNA, 64 nt, hsa; identical to SEQ ID NO: 526027

SEQ ID NO: 666037 - RNA, 64 nt, hsa; identical to SEQ ID NO: 526028

SEQ ID NO: 666038 - RNA, 64 nt, hsa; identical to SEQ ID NO: 526029

SEQ ID NO: 666039 - RNA, 64 nt, hsa; identical to SEQ ID NO: 526030

SEQ ID NO: 666040 - RNA, 64 nt, hsa; identical to SEQ ID NO: 526031

SEQ ID NO: 666041 - RNA, 64 nt, hsa; identical to SEQ ID NO: 526032

SEQ ID NO: 666042 - RNA, 64 nt, hsa; identical to SEQ ID NO: 526033

SEQ ID NO: 666043 - RNA, 64 nt, hsa; identical to SEQ ID NO: 526034

SEQ ID NO: 666044 - RNA, 64 nt, hsa; identical to SEQ ID NO: 526035

SEQ ID NO: 666045 - RNA, 64 nt, hsa; identical to SEQ ID NO: 526036

SEQ ID NO: 666046 - RNA, 64 nt, hsa; identical to SEQ ID NO: 526037

SEQ ID NO: 666047 - RNA, 64 nt, hsa; identical to SEQ ID NO: 526038

SEQ ID NO: 666048 - RNA, 64 nt, hsa; identical to SEQ ID NO: 526039

SEQ ID NO: 666049 - RNA, 64 nt, hsa; identical to SEQ ID NO: 526040

SEQ ID NO: 666050 - RNA, 64 nt, hsa; identical to SEQ ID NO: 526041

SEQ ID NO: 666051 - RNA, 64 nt, hsa; identical to SEQ ID NO: 526042

SEQ ID NO: 666052 - RNA, 64 nt, hsa; identical to SEQ ID NO: 526043

SEQ ID NO: 666053 - RNA, 64 nt, hsa; identical to SEQ ID NO: 526044

SEQ ID NO: 666054 - RNA, 64 nt, hsa; identical to SEQ ID NO: 526045

SEQ ID NO: 666055 - RNA, 64 nt, hsa; identical to SEQ ID NO: 526046

SEQ ID NO: 666056 - RNA, 64 nt, hsa; identical to SEQ ID NO: 526047

SEQ ID NO: 666057 - RNA, 64 nt, hsa; identical to SEQ ID NO: 526048

SEQ ID NO: 666058 - RNA, 64 nt, hsa; identical to SEQ ID NO: 526049

SEQ ID NO: 666059 - RNA, 64 nt, hsa; identical to SEQ ID NO: 526050

SEQ ID NO: 666060 - RNA, 64 nt, hsa; identical to SEQ ID NO: 526051

SEQ ID NO: 666061 - RNA, 64 nt, hsa; identical to SEQ ID NO: 526052

SEQ ID NO: 666062 - RNA, 64 nt, hsa; identical to SEQ ID NO: 526053

SEQ ID NO: 666063 - RNA, 64 nt, hsa; identical to SEQ ID NO: 526054

SEQ ID NO: 666064 - RNA, 64 nt, hsa; identical to SEQ ID NO: 526055

SEQ ID NO: 666065 - RNA, 64 nt, hsa; identical to SEQ ID NO: 526056

SEQ ID NO: 666066 - RNA, 64 nt, hsa; identical to SEQ ID NO: 526057

SEQ ID NO: 666067 - RNA, 64 nt, hsa; identical to SEQ ID NO: 526058

SEQ ID NO: 666068 - RNA, 64 nt, hsa; identical to SEQ ID NO: 526059

SEQ ID NO: 666069 - RNA, 64 nt, hsa; identical to SEQ ID NO: 526060

SEQ ID NO: 666070 - RNA, 64 nt, hsa; identical to SEQ ID NO: 526061

SEQ ID NO: 666071 - RNA, 64 nt, hsa; identical to SEQ ID NO: 526062

SEQ ID NO: 666072 - RNA, 64 nt, hsa; identical to SEQ ID NO: 526063

SEQ ID NO: 666073 - RNA, 64 nt, hsa; identical to SEQ ID NO: 526064

SEQ ID NO: 666074 - RNA, 64 nt, hsa; identical to SEQ ID NO: 526065

SEQ ID NO: 666075 - RNA, 64 nt, hsa; identical to SEQ ID NO: 526066

SEQ ID NO: 666076 - RNA, 64 nt, hsa; identical to SEQ ID NO: 526067

SEQ ID NO: 666077 - RNA, 64 nt, hsa; identical to SEQ ID NO: 526068

SEQ ID NO: 666078 - RNA, 64 nt, hsa; identical to SEQ ID NO: 526069

SEQ ID NO: 666079 - RNA, 64 nt, hsa; identical to SEQ ID NO: 526070

SEQ ID NO: 666080 - RNA, 64 nt, hsa; identical to SEQ ID NO: 526071

SEQ ID NO: 666081 - RNA, 64 nt, hsa; identical to SEQ ID NO: 526072

SEQ ID NO: 666082 - RNA, 64 nt, hsa; identical to SEQ ID NO: 526073

SEQ ID NO: 666083 - RNA, 64 nt, hsa; identical to SEQ ID NO: 526074

SEQ ID NO: 666084 - RNA, 64 nt, hsa; identical to SEQ ID NO: 526075

SEQ ID NO: 666085 - RNA, 64 nt, hsa; identical to SEQ ID NO: 526076

SEQ ID NO: 666086 - RNA, 64 nt, hsa; identical to SEQ ID NO: 526077

SEQ ID NO: 666087 - RNA, 64 nt, hsa; identical to SEQ ID NO: 526078

SEQ ID NO: 666088 - RNA, 64 nt, hsa; identical to SEQ ID NO: 526079

SEQ ID NO: 666089 - RNA, 64 nt, hsa; identical to SEQ ID NO: 526080

SEQ ID NO: 666090 - RNA, 64 nt, hsa; identical to SEQ ID NO: 526081

SEQ ID NO: 666091 - RNA, 64 nt, hsa; identical to SEQ ID NO: 526082

SEQ ID NO: 666092 - RNA, 64 nt, hsa; identical to SEQ ID NO: 526083

SEQ ID NO: 666093 - RNA, 64 nt, hsa; identical to SEQ ID NO: 526084

SEQ ID NO: 666094 - RNA, 64 nt, hsa; identical to SEQ ID NO: 526085

SEQ ID NO: 666095 - RNA, 64 nt, hsa; identical to SEQ ID NO: 526086

SEQ ID NO: 666096 - RNA, 64 nt, hsa; identical to SEQ ID NO: 526087

SEQ ID NO: 666097 - RNA, 64 nt, hsa; identical to SEQ ID NO: 526088

SEQ ID NO: 666098 - RNA, 64 nt, hsa; identical to SEQ ID NO: 526089

SEQ ID NO: 666099 - RNA, 64 nt, hsa; identical to SEQ ID NO: 526090

SEQ ID NO: 666100 - RNA, 64 nt, hsa; identical to SEQ ID NO: 526091

SEQ ID NO: 666101 - RNA, 64 nt, hsa; identical to SEQ ID NO: 526092

SEQ ID NO: 666102 - RNA, 64 nt, hsa; identical to SEQ ID NO: 526093

SEQ ID NO: 666103 - RNA, 64 nt, hsa; identical to SEQ ID NO: 526094

SEQ ID NO: 666104 - RNA, 64 nt, hsa; identical to SEQ ID NO: 526095

SEQ ID NO: 666105 - RNA, 64 nt, hsa; identical to SEQ ID NO: 526096

SEQ ID NO: 666106 - RNA, 64 nt, hsa; identical to SEQ ID NO: 526097

SEQ ID NO: 666107 - RNA, 64 nt, hsa; identical to SEQ ID NO: 526098

SEQ ID NO: 666108 - RNA, 63 nt, hsa; identical to SEQ ID NO: 526099

SEQ ID NO: 666109 - RNA, 64 nt, hsa; identical to SEQ ID NO: 526100

SEQ ID NO: 666110 - RNA, 64 nt, hsa; identical to SEQ ID NO: 526101

SEQ ID NO: 666111 - RNA, 64 nt, hsa; identical to SEQ ID NO: 526102

SEQ ID NO: 666112 - RNA, 64 nt, hsa; identical to SEQ ID NO: 526103

SEQ ID NO: 666113 - RNA, 64 nt, hsa; identical to SEQ ID NO: 526104

SEQ ID NO: 666114 - RNA, 64 nt, hsa; identical to SEQ ID NO: 526105

SEQ ID NO: 666115 - RNA, 64 nt, hsa; identical to SEQ ID NO: 526106

SEQ ID NO: 666116 - RNA, 64 nt, hsa; identical to SEQ ID NO: 526107

SEQ ID NO: 666117 - RNA, 64 nt, hsa; identical to SEQ ID NO: 526108

SEQ ID NO: 666118 - RNA, 64 nt, hsa; identical to SEQ ID NO: 526109

SEQ ID NO: 666119 - RNA, 64 nt, hsa; identical to SEQ ID NO: 526110

SEQ ID NO: 666120 - RNA, 64 nt, hsa; identical to SEQ ID NO: 526111

SEQ ID NO: 666121 - RNA, 64 nt, hsa; identical to SEQ ID NO: 526112

SEQ ID NO: 666122 - RNA, 64 nt, hsa; identical to SEQ ID NO: 526113

SEQ ID NO: 666123 - RNA, 64 nt, hsa; identical to SEQ ID NO: 526114

SEQ ID NO: 666124 - RNA, 64 nt, hsa; identical to SEQ ID NO: 526115

SEQ ID NO: 666125 - RNA, 64 nt, hsa; identical to SEQ ID NO: 526116

SEQ ID NO: 666126 - RNA, 64 nt, hsa; identical to SEQ ID NO: 526117

SEQ ID NO: 666127 - RNA, 64 nt, hsa; identical to SEQ ID NO: 526118

SEQ ID NO: 666128 - RNA, 64 nt, hsa; identical to SEQ ID NO: 526119

SEQ ID NO: 666129 - RNA, 64 nt, hsa; identical to SEQ ID NO: 526120

SEQ ID NO: 666130 - RNA, 64 nt, hsa; identical to SEQ ID NO: 526121

SEQ ID NO: 666131 - RNA, 64 nt, hsa; identical to SEQ ID NO: 526122

SEQ ID NO: 666132 - RNA, 64 nt, hsa; identical to SEQ ID NO: 526123

SEQ ID NO: 666133 - RNA, 64 nt, hsa; identical to SEQ ID NO: 526124

SEQ ID NO: 666134 - RNA, 64 nt, hsa; identical to SEQ ID NO: 526125

SEQ ID NO: 666135 - RNA, 64 nt, hsa; identical to SEQ ID NO: 526126

SEQ ID NO: 666136 - RNA, 64 nt, hsa; identical to SEQ ID NO: 526127

SEQ ID NO: 666137 - RNA, 64 nt, hsa; identical to SEQ ID NO: 526128

SEQ ID NO: 666138 - RNA, 64 nt, hsa; identical to SEQ ID NO: 526129

SEQ ID NO: 666139 - RNA, 64 nt, hsa; identical to SEQ ID NO: 526130

SEQ ID NO: 666140 - RNA, 64 nt, hsa; identical to SEQ ID NO: 526131

SEQ ID NO: 666141 - RNA, 64 nt, hsa; identical to SEQ ID NO: 526132

SEQ ID NO: 666142 - RNA, 64 nt, hsa; identical to SEQ ID NO: 526133

SEQ ID NO: 666143 - RNA, 64 nt, hsa; identical to SEQ ID NO: 526134

SEQ ID NO: 666144 - RNA, 64 nt, hsa; identical to SEQ ID NO: 526135

SEQ ID NO: 666145 - RNA, 64 nt, hsa; identical to SEQ ID NO: 526136

SEQ ID NO: 666146 - RNA, 64 nt, hsa; identical to SEQ ID NO: 526137

SEQ ID NO: 666147 - RNA, 64 nt, hsa; identical to SEQ ID NO: 526138

SEQ ID NO: 666148 - RNA, 64 nt, hsa; identical to SEQ ID NO: 526139

SEQ ID NO: 666149 - RNA, 64 nt, hsa; identical to SEQ ID NO: 526140

SEQ ID NO: 666150 - RNA, 64 nt, hsa; identical to SEQ ID NO: 526141

SEQ ID NO: 666151 - RNA, 64 nt, hsa; identical to SEQ ID NO: 526142

SEQ ID NO: 666152 - RNA, 64 nt, hsa; identical to SEQ ID NO: 526143

SEQ ID NO: 666153 - RNA, 64 nt, hsa; identical to SEQ ID NO: 526144

SEQ ID NO: 666154 - RNA, 64 nt, hsa; identical to SEQ ID NO: 526145

SEQ ID NO: 666155 - RNA, 64 nt, hsa; identical to SEQ ID NO: 526146

SEQ ID NO: 666156 - RNA, 52 nt, hsa; identical to SEQ ID NO: 526147

SEQ ID NO: 666157 - RNA, 64 nt, hsa; identical to SEQ ID NO: 526148

SEQ ID NO: 666158 - RNA, 64 nt, hsa; identical to SEQ ID NO: 526149

SEQ ID NO: 666159 - RNA, 64 nt, hsa; identical to SEQ ID NO: 526150

SEQ ID NO: 666160 - RNA, 64 nt, hsa; identical to SEQ ID NO: 526151

SEQ ID NO: 666161 - RNA, 64 nt, hsa; identical to SEQ ID NO: 526152

SEQ ID NO: 666162 - RNA, 64 nt, hsa; identical to SEQ ID NO: 526153

SEQ ID NO: 666163 - RNA, 64 nt, hsa; identical to SEQ ID NO: 526154

SEQ ID NO: 666164 - RNA, 64 nt, hsa; identical to SEQ ID NO: 526155

SEQ ID NO: 666165 - RNA, 64 nt, hsa; identical to SEQ ID NO: 526156

SEQ ID NO: 666166 - RNA, 64 nt, hsa; identical to SEQ ID NO: 526157

SEQ ID NO: 666167 - RNA, 64 nt, hsa; identical to SEQ ID NO: 526158

SEQ ID NO: 666168 - RNA, 64 nt, hsa; identical to SEQ ID NO: 526159

SEQ ID NO: 666169 - RNA, 64 nt, hsa; identical to SEQ ID NO: 526160

SEQ ID NO: 666170 - RNA, 64 nt, hsa; identical to SEQ ID NO: 526161

SEQ ID NO: 666171 - RNA, 64 nt, hsa; identical to SEQ ID NO: 526162

SEQ ID NO: 666172 - RNA, 64 nt, hsa; identical to SEQ ID NO: 526163

SEQ ID NO: 666173 - RNA, 64 nt, hsa; identical to SEQ ID NO: 526164

SEQ ID NO: 666174 - RNA, 64 nt, hsa; identical to SEQ ID NO: 526165

SEQ ID NO: 666175 - RNA, 64 nt, hsa; identical to SEQ ID NO: 526166

SEQ ID NO: 666176 - RNA, 64 nt, hsa; identical to SEQ ID NO: 526167

SEQ ID NO: 666177 - RNA, 64 nt, hsa; identical to SEQ ID NO: 526168

SEQ ID NO: 666178 - RNA, 64 nt, hsa; identical to SEQ ID NO: 526169

SEQ ID NO: 666179 - RNA, 64 nt, hsa; identical to SEQ ID NO: 526170

SEQ ID NO: 666180 - RNA, 64 nt, hsa; identical to SEQ ID NO: 526171

SEQ ID NO: 666181 - RNA, 64 nt, hsa; identical to SEQ ID NO: 526172

SEQ ID NO: 666182 - RNA, 64 nt, hsa; identical to SEQ ID NO: 526173

SEQ ID NO: 666183 - RNA, 64 nt, hsa; identical to SEQ ID NO: 526174

SEQ ID NO: 666184 - RNA, 64 nt, hsa; identical to SEQ ID NO: 526175

SEQ ID NO: 666185 - RNA, 64 nt, hsa; identical to SEQ ID NO: 526176

SEQ ID NO: 666186 - RNA, 64 nt, hsa; identical to SEQ ID NO: 526177

SEQ ID NO: 666187 - RNA, 64 nt, hsa; identical to SEQ ID NO: 526178

SEQ ID NO: 666188 - RNA, 64 nt, hsa; identical to SEQ ID NO: 526179

SEQ ID NO: 666189 - RNA, 64 nt, hsa; identical to SEQ ID NO: 526180

SEQ ID NO: 666190 - RNA, 64 nt, hsa; identical to SEQ ID NO: 526181

SEQ ID NO: 666191 - RNA, 64 nt, hsa; identical to SEQ ID NO: 526182

SEQ ID NO: 666192 - RNA, 64 nt, hsa; identical to SEQ ID NO: 526183

SEQ ID NO: 666193 - RNA, 64 nt, hsa; identical to SEQ ID NO: 526184

SEQ ID NO: 666194 - RNA, 64 nt, hsa; identical to SEQ ID NO: 526185

SEQ ID NO: 666195 - RNA, 64 nt, hsa; identical to SEQ ID NO: 526186

SEQ ID NO: 666196 - RNA, 64 nt, hsa; identical to SEQ ID NO: 526187

SEQ ID NO: 666197 - RNA, 64 nt, hsa; identical to SEQ ID NO: 526188

SEQ ID NO: 666198 - RNA, 64 nt, hsa; identical to SEQ ID NO: 526189

SEQ ID NO: 666199 - RNA, 64 nt, hsa; identical to SEQ ID NO: 526190

SEQ ID NO: 666200 - RNA, 64 nt, hsa; identical to SEQ ID NO: 526191

SEQ ID NO: 666201 - RNA, 64 nt, hsa; identical to SEQ ID NO: 526192

SEQ ID NO: 666202 - RNA, 64 nt, hsa; identical to SEQ ID NO: 526193

SEQ ID NO: 666203 - RNA, 64 nt, hsa; identical to SEQ ID NO: 526194

SEQ ID NO: 666204 - RNA, 64 nt, hsa; identical to SEQ ID NO: 526195

SEQ ID NO: 666205 - RNA, 64 nt, hsa; identical to SEQ ID NO: 526196

SEQ ID NO: 666206 - RNA, 64 nt, hsa; identical to SEQ ID NO: 526197

SEQ ID NO: 666207 - RNA, 64 nt, hsa; identical to SEQ ID NO: 526198

SEQ ID NO: 666208 - RNA, 64 nt, hsa; identical to SEQ ID NO: 526199

SEQ ID NO: 666209 - RNA, 64 nt, hsa; identical to SEQ ID NO: 526200

SEQ ID NO: 666210 - RNA, 64 nt, hsa; identical to SEQ ID NO: 526201

SEQ ID NO: 666211 - RNA, 64 nt, hsa; identical to SEQ ID NO: 526202

SEQ ID NO: 666212 - RNA, 64 nt, hsa; identical to SEQ ID NO: 526203

SEQ ID NO: 666213 - RNA, 64 nt, hsa; identical to SEQ ID NO: 526204

SEQ ID NO: 666214 - RNA, 64 nt, hsa; identical to SEQ ID NO: 526205

SEQ ID NO: 666215 - RNA, 64 nt, hsa; identical to SEQ ID NO: 526206

SEQ ID NO: 666216 - RNA, 64 nt, hsa; identical to SEQ ID NO: 526207

SEQ ID NO: 666217 - RNA, 64 nt, hsa; identical to SEQ ID NO: 526208

SEQ ID NO: 666218 - RNA, 64 nt, hsa; identical to SEQ ID NO: 526209

SEQ ID NO: 666219 - RNA, 64 nt, hsa; identical to SEQ ID NO: 526210

SEQ ID NO: 666220 - RNA, 64 nt, hsa; identical to SEQ ID NO: 526211

SEQ ID NO: 666221 - RNA, 64 nt, hsa; identical to SEQ ID NO: 526212

SEQ ID NO: 666222 - RNA, 64 nt, hsa; identical to SEQ ID NO: 526213

SEQ ID NO: 666223 - RNA, 64 nt, hsa; identical to SEQ ID NO: 526214

SEQ ID NO: 666224 - RNA, 64 nt, hsa; identical to SEQ ID NO: 526215

SEQ ID NO: 666225 - RNA, 64 nt, hsa; identical to SEQ ID NO: 526216

SEQ ID NO: 666226 - RNA, 64 nt, hsa; identical to SEQ ID NO: 526217

SEQ ID NO: 666227 - RNA, 64 nt, hsa; identical to SEQ ID NO: 526218

SEQ ID NO: 666228 - RNA, 64 nt, hsa; identical to SEQ ID NO: 526219

SEQ ID NO: 666229 - RNA, 64 nt, hsa; identical to SEQ ID NO: 526220

SEQ ID NO: 666230 - RNA, 64 nt, hsa; identical to SEQ ID NO: 526221

SEQ ID NO: 666231 - RNA, 64 nt, hsa; identical to SEQ ID NO: 526222

SEQ ID NO: 666232 - RNA, 64 nt, hsa; identical to SEQ ID NO: 526223

SEQ ID NO: 666233 - RNA, 64 nt, hsa; identical to SEQ ID NO: 526224

SEQ ID NO: 666234 - RNA, 64 nt, hsa; identical to SEQ ID NO: 526225

SEQ ID NO: 666235 - RNA, 64 nt, hsa; identical to SEQ ID NO: 526226

SEQ ID NO: 666236 - RNA, 64 nt, hsa; identical to SEQ ID NO: 526227

SEQ ID NO: 666237 - RNA, 64 nt, hsa; identical to SEQ ID NO: 526228

SEQ ID NO: 666238 - RNA, 64 nt, hsa; identical to SEQ ID NO: 526229

SEQ ID NO: 666239 - RNA, 64 nt, hsa; identical to SEQ ID NO: 526230

SEQ ID NO: 666240 - RNA, 64 nt, hsa; identical to SEQ ID NO: 526231

SEQ ID NO: 666241 - RNA, 64 nt, hsa; identical to SEQ ID NO: 526232

SEQ ID NO: 666242 - RNA, 64 nt, hsa; identical to SEQ ID NO: 526233

SEQ ID NO: 666243 - RNA, 64 nt, hsa; identical to SEQ ID NO: 526234

SEQ ID NO: 666244 - RNA, 64 nt, hsa; identical to SEQ ID NO: 526235

SEQ ID NO: 666245 - RNA, 64 nt, hsa; identical to SEQ ID NO: 526236

SEQ ID NO: 666246 - RNA, 64 nt, hsa; identical to SEQ ID NO: 526237

SEQ ID NO: 666247 - RNA, 64 nt, hsa; identical to SEQ ID NO: 526238

SEQ ID NO: 666248 - RNA, 64 nt, hsa; identical to SEQ ID NO: 526239

SEQ ID NO: 666249 - RNA, 64 nt, hsa; identical to SEQ ID NO: 526240

SEQ ID NO: 666250 - RNA, 64 nt, hsa; identical to SEQ ID NO: 526241

SEQ ID NO: 666251 - RNA, 64 nt, hsa; identical to SEQ ID NO: 526242

SEQ ID NO: 666252 - RNA, 64 nt, hsa; identical to SEQ ID NO: 526243

SEQ ID NO: 666253 - RNA, 64 nt, hsa; identical to SEQ ID NO: 526244

SEQ ID NO: 666254 - RNA, 64 nt, hsa; identical to SEQ ID NO: 526245

SEQ ID NO: 666255 - RNA, 64 nt, hsa; identical to SEQ ID NO: 526246

SEQ ID NO: 666256 - RNA, 64 nt, hsa; identical to SEQ ID NO: 526247

SEQ ID NO: 666257 - RNA, 64 nt, hsa; identical to SEQ ID NO: 526248

SEQ ID NO: 666258 - RNA, 64 nt, hsa; identical to SEQ ID NO: 526249

SEQ ID NO: 666259 - RNA, 64 nt, hsa; identical to SEQ ID NO: 526250

SEQ ID NO: 666260 - RNA, 64 nt, hsa; identical to SEQ ID NO: 526251

SEQ ID NO: 666261 - RNA, 64 nt, hsa; identical to SEQ ID NO: 526252

SEQ ID NO: 666262 - RNA, 64 nt, hsa; identical to SEQ ID NO: 526253

SEQ ID NO: 666263 - RNA, 64 nt, hsa; identical to SEQ ID NO: 526254

SEQ ID NO: 666264 - RNA, 64 nt, hsa; identical to SEQ ID NO: 526255

SEQ ID NO: 666265 - RNA, 64 nt, hsa; identical to SEQ ID NO: 526256

SEQ ID NO: 666266 - RNA, 64 nt, hsa; identical to SEQ ID NO: 526257

SEQ ID NO: 666267 - RNA, 64 nt, hsa; identical to SEQ ID NO: 526258

SEQ ID NO: 666268 - RNA, 64 nt, hsa; identical to SEQ ID NO: 526259

SEQ ID NO: 666269 - RNA, 64 nt, hsa; identical to SEQ ID NO: 526260

SEQ ID NO: 666270 - RNA, 64 nt, hsa; identical to SEQ ID NO: 526261

SEQ ID NO: 666271 - RNA, 64 nt, hsa; identical to SEQ ID NO: 526262

SEQ ID NO: 666272 - RNA, 64 nt, hsa; identical to SEQ ID NO: 526263

SEQ ID NO: 666273 - RNA, 64 nt, hsa; identical to SEQ ID NO: 526264

SEQ ID NO: 666274 - RNA, 64 nt, hsa; identical to SEQ ID NO: 526265

SEQ ID NO: 666275 - RNA, 64 nt, hsa; identical to SEQ ID NO: 526266

SEQ ID NO: 666276 - RNA, 64 nt, hsa; identical to SEQ ID NO: 526267

SEQ ID NO: 666277 - RNA, 64 nt, hsa; identical to SEQ ID NO: 526268

SEQ ID NO: 666278 - RNA, 64 nt, hsa; identical to SEQ ID NO: 526269

SEQ ID NO: 666279 - RNA, 64 nt, hsa; identical to SEQ ID NO: 526270

SEQ ID NO: 666280 - RNA, 64 nt, hsa; identical to SEQ ID NO: 526271

SEQ ID NO: 666281 - RNA, 64 nt, hsa; identical to SEQ ID NO: 526272

SEQ ID NO: 666282 - RNA, 64 nt, hsa; identical to SEQ ID NO: 526273

SEQ ID NO: 666283 - RNA, 64 nt, hsa; identical to SEQ ID NO: 526274

SEQ ID NO: 666284 - RNA, 64 nt, hsa; identical to SEQ ID NO: 526275

SEQ ID NO: 666285 - RNA, 64 nt, hsa; identical to SEQ ID NO: 526276

SEQ ID NO: 666286 - RNA, 64 nt, hsa; identical to SEQ ID NO: 526277

SEQ ID NO: 666287 - RNA, 64 nt, hsa; identical to SEQ ID NO: 526278

SEQ ID NO: 666288 - RNA, 64 nt, hsa; identical to SEQ ID NO: 526279

SEQ ID NO: 666289 - RNA, 64 nt, hsa; identical to SEQ ID NO: 526280

SEQ ID NO: 666290 - RNA, 64 nt, hsa; identical to SEQ ID NO: 526281

SEQ ID NO: 666291 - RNA, 64 nt, hsa; identical to SEQ ID NO: 526282

SEQ ID NO: 666292 - RNA, 64 nt, hsa; identical to SEQ ID NO: 526283

SEQ ID NO: 666293 - RNA, 64 nt, hsa; identical to SEQ ID NO: 526284

SEQ ID NO: 666294 - RNA, 64 nt, hsa; identical to SEQ ID NO: 526285

SEQ ID NO: 666295 - RNA, 64 nt, hsa; identical to SEQ ID NO: 526286

SEQ ID NO: 666296 - RNA, 64 nt, hsa; identical to SEQ ID NO: 526287

SEQ ID NO: 666297 - RNA, 64 nt, hsa; identical to SEQ ID NO: 526288

SEQ ID NO: 666298 - RNA, 64 nt, hsa; identical to SEQ ID NO: 526289

SEQ ID NO: 666299 - RNA, 64 nt, hsa; identical to SEQ ID NO: 526290

SEQ ID NO: 666300 - RNA, 64 nt, hsa; identical to SEQ ID NO: 526291

SEQ ID NO: 666301 - RNA, 64 nt, hsa; identical to SEQ ID NO: 526292

SEQ ID NO: 666302 - RNA, 64 nt, hsa; identical to SEQ ID NO: 526293

SEQ ID NO: 666303 - RNA, 64 nt, hsa; identical to SEQ ID NO: 526294

SEQ ID NO: 666304 - RNA, 64 nt, hsa; identical to SEQ ID NO: 526295

SEQ ID NO: 666305 - RNA, 64 nt, hsa; identical to SEQ ID NO: 526296

SEQ ID NO: 666306 - RNA, 64 nt, hsa; identical to SEQ ID NO: 526297

SEQ ID NO: 666307 - RNA, 64 nt, hsa; identical to SEQ ID NO: 526298

SEQ ID NO: 666308 - RNA, 64 nt, hsa; identical to SEQ ID NO: 526299

SEQ ID NO: 666309 - RNA, 64 nt, hsa; identical to SEQ ID NO: 526300

SEQ ID NO: 666310 - RNA, 64 nt, hsa; identical to SEQ ID NO: 526301

SEQ ID NO: 666311 - RNA, 64 nt, hsa; identical to SEQ ID NO: 526302

SEQ ID NO: 666312 - RNA, 64 nt, hsa; identical to SEQ ID NO: 526303

SEQ ID NO: 666313 - RNA, 64 nt, hsa; identical to SEQ ID NO: 526304

SEQ ID NO: 666314 - RNA, 64 nt, hsa; identical to SEQ ID NO: 526305

SEQ ID NO: 666315 - RNA, 64 nt, hsa; identical to SEQ ID NO: 526306

SEQ ID NO: 666316 - RNA, 64 nt, hsa; identical to SEQ ID NO: 526307

SEQ ID NO: 666317 - RNA, 64 nt, hsa; identical to SEQ ID NO: 526308

SEQ ID NO: 666318 - RNA, 64 nt, hsa; identical to SEQ ID NO: 526309

SEQ ID NO: 666319 - RNA, 64 nt, hsa; identical to SEQ ID NO: 526310

SEQ ID NO: 666320 - RNA, 64 nt, hsa; identical to SEQ ID NO: 526311

SEQ ID NO: 666321 - RNA, 64 nt, hsa; identical to SEQ ID NO: 526312

SEQ ID NO: 666322 - RNA, 64 nt, hsa; identical to SEQ ID NO: 526313

SEQ ID NO: 666323 - RNA, 64 nt, hsa; identical to SEQ ID NO: 526314

SEQ ID NO: 666324 - RNA, 64 nt, hsa; identical to SEQ ID NO: 526315

SEQ ID NO: 666325 - RNA, 64 nt, hsa; identical to SEQ ID NO: 526316

SEQ ID NO: 666326 - RNA, 64 nt, hsa; identical to SEQ ID NO: 526317

SEQ ID NO: 666327 - RNA, 64 nt, hsa; identical to SEQ ID NO: 526318

SEQ ID NO: 666328 - RNA, 64 nt, hsa; identical to SEQ ID NO: 526319

SEQ ID NO: 666329 - RNA, 64 nt, hsa; identical to SEQ ID NO: 526320

SEQ ID NO: 666330 - RNA, 64 nt, hsa; identical to SEQ ID NO: 526321

SEQ ID NO: 666331 - RNA, 64 nt, hsa; identical to SEQ ID NO: 526322

SEQ ID NO: 666332 - RNA, 64 nt, hsa; identical to SEQ ID NO: 526323

SEQ ID NO: 666333 - RNA, 64 nt, hsa; identical to SEQ ID NO: 526324

SEQ ID NO: 666334 - RNA, 64 nt, hsa; identical to SEQ ID NO: 526325

SEQ ID NO: 666335 - RNA, 64 nt, hsa; identical to SEQ ID NO: 526326

SEQ ID NO: 666336 - RNA, 64 nt, hsa; identical to SEQ ID NO: 526327

SEQ ID NO: 666337 - RNA, 64 nt, hsa; identical to SEQ ID NO: 526328

SEQ ID NO: 666338 - RNA, 64 nt, hsa; identical to SEQ ID NO: 526329

SEQ ID NO: 666339 - RNA, 64 nt, hsa; identical to SEQ ID NO: 526330

SEQ ID NO: 666340 - RNA, 64 nt, hsa; identical to SEQ ID NO: 526331

SEQ ID NO: 666341 - RNA, 64 nt, hsa; identical to SEQ ID NO: 526332

SEQ ID NO: 666342 - RNA, 64 nt, hsa; identical to SEQ ID NO: 526333

SEQ ID NO: 666343 - RNA, 64 nt, hsa; identical to SEQ ID NO: 526334

SEQ ID NO: 666344 - RNA, 64 nt, hsa; identical to SEQ ID NO: 526335

SEQ ID NO: 666345 - RNA, 64 nt, hsa; identical to SEQ ID NO: 526336

SEQ ID NO: 666346 - RNA, 64 nt, hsa; identical to SEQ ID NO: 526337

SEQ ID NO: 666347 - RNA, 64 nt, hsa; identical to SEQ ID NO: 526338

SEQ ID NO: 666348 - RNA, 64 nt, hsa; identical to SEQ ID NO: 526339

SEQ ID NO: 666349 - RNA, 64 nt, hsa; identical to SEQ ID NO: 526340

SEQ ID NO: 666350 - RNA, 64 nt, hsa; identical to SEQ ID NO: 526341

SEQ ID NO: 666351 - RNA, 64 nt, hsa; identical to SEQ ID NO: 526342

SEQ ID NO: 666352 - RNA, 64 nt, hsa; identical to SEQ ID NO: 526343

SEQ ID NO: 666353 - RNA, 64 nt, hsa; identical to SEQ ID NO: 526344

SEQ ID NO: 666354 - RNA, 64 nt, hsa; identical to SEQ ID NO: 526345

SEQ ID NO: 666355 - RNA, 64 nt, hsa; identical to SEQ ID NO: 526346

SEQ ID NO: 666356 - RNA, 64 nt, hsa; identical to SEQ ID NO: 526347

SEQ ID NO: 666357 - RNA, 64 nt, hsa; identical to SEQ ID NO: 526348

SEQ ID NO: 666358 - RNA, 64 nt, hsa; identical to SEQ ID NO: 526349

SEQ ID NO: 666359 - RNA, 64 nt, hsa; identical to SEQ ID NO: 526350

SEQ ID NO: 666360 - RNA, 64 nt, hsa; identical to SEQ ID NO: 526351

SEQ ID NO: 666361 - RNA, 64 nt, hsa; identical to SEQ ID NO: 526352

SEQ ID NO: 666362 - RNA, 64 nt, hsa; identical to SEQ ID NO: 608305

SEQ ID NO: 666363 - RNA, 64 nt, hsa; identical to SEQ ID NO: 608306

SEQ ID NO: 666364 - RNA, 64 nt, hsa; identical to SEQ ID NO: 608307

SEQ ID NO: 666365 - RNA, 64 nt, hsa; identical to SEQ ID NO: 608308

SEQ ID NO: 666366 - RNA, 64 nt, hsa; identical to SEQ ID NO: 608309

SEQ ID NO: 666367 - RNA, 64 nt, hsa; identical to SEQ ID NO: 608310

SEQ ID NO: 666368 - RNA, 64 nt, hsa; identical to SEQ ID NO: 608311

SEQ ID NO: 666369 - RNA, 64 nt, hsa; identical to SEQ ID NO: 608312

SEQ ID NO: 666370 - RNA, 64 nt, hsa; identical to SEQ ID NO: 608313

SEQ ID NO: 666371 - RNA, 64 nt, hsa; identical to SEQ ID NO: 608314

SEQ ID NO: 666372 - RNA, 64 nt, hsa; identical to SEQ ID NO: 608315

SEQ ID NO: 666373 - RNA, 64 nt, hsa; identical to SEQ ID NO: 608316

SEQ ID NO: 666374 - RNA, 64 nt, hsa; identical to SEQ ID NO: 608317

SEQ ID NO: 666375 - RNA, 64 nt, hsa; identical to SEQ ID NO: 608318

SEQ ID NO: 666376 - RNA, 64 nt, hsa; identical to SEQ ID NO: 608319

SEQ ID NO: 666377 - RNA, 64 nt, hsa; identical to SEQ ID NO: 608320

SEQ ID NO: 666378 - RNA, 64 nt, hsa; identical to SEQ ID NO: 608321

SEQ ID NO: 666379 - RNA, 64 nt, hsa; identical to SEQ ID NO: 608322

SEQ ID NO: 666380 - RNA, 64 nt, hsa; identical to SEQ ID NO: 608323

SEQ ID NO: 666381 - RNA, 64 nt, hsa; identical to SEQ ID NO: 608324

SEQ ID NO: 666382 - RNA, 64 nt, hsa; identical to SEQ ID NO: 608325

SEQ ID NO: 666383 - RNA, 64 nt, hsa; identical to SEQ ID NO: 608326

SEQ ID NO: 666384 - RNA, 64 nt, hsa; identical to SEQ ID NO: 608327

SEQ ID NO: 666385 - RNA, 64 nt, hsa; identical to SEQ ID NO: 608328

SEQ ID NO: 666386 - RNA, 64 nt, hsa; identical to SEQ ID NO: 608329

SEQ ID NO: 666387 - RNA, 64 nt, hsa; identical to SEQ ID NO: 608330

SEQ ID NO: 666388 - RNA, 64 nt, hsa; identical to SEQ ID NO: 608331

SEQ ID NO: 666389 - RNA, 64 nt, hsa; identical to SEQ ID NO: 608332

SEQ ID NO: 666390 - RNA, 56 nt, hsa; identical to SEQ ID NO: 608333

SEQ ID NO: 666391 - RNA, 64 nt, hsa; identical to SEQ ID NO: 608334

SEQ ID NO: 666392 - RNA, 64 nt, hsa; identical to SEQ ID NO: 608335

SEQ ID NO: 666393 - RNA, 64 nt, hsa; identical to SEQ ID NO: 608336

SEQ ID NO: 666394 - RNA, 64 nt, hsa; identical to SEQ ID NO: 608337

SEQ ID NO: 666395 - RNA, 64 nt, hsa; identical to SEQ ID NO: 608338

SEQ ID NO: 666396 - RNA, 64 nt, hsa; identical to SEQ ID NO: 608339

SEQ ID NO: 666397 - RNA, 64 nt, hsa; identical to SEQ ID NO: 608340

SEQ ID NO: 666398 - RNA, 64 nt, hsa; identical to SEQ ID NO: 608341

SEQ ID NO: 666399 - RNA, 64 nt, hsa; identical to SEQ ID NO: 608342

SEQ ID NO: 666400 - RNA, 64 nt, hsa; identical to SEQ ID NO: 608343

SEQ ID NO: 666401 - RNA, 64 nt, hsa; identical to SEQ ID NO: 608344

SEQ ID NO: 666402 - RNA, 64 nt, hsa; identical to SEQ ID NO: 608345

SEQ ID NO: 666403 - RNA, 64 nt, hsa; identical to SEQ ID NO: 608346

SEQ ID NO: 666404 - RNA, 64 nt, hsa; identical to SEQ ID NO: 608347

SEQ ID NO: 666405 - RNA, 64 nt, hsa; identical to SEQ ID NO: 608348

SEQ ID NO: 666406 - RNA, 64 nt, hsa; identical to SEQ ID NO: 608349

SEQ ID NO: 666407 - RNA, 64 nt, hsa; identical to SEQ ID NO: 608350

SEQ ID NO: 666408 - RNA, 64 nt, hsa; identical to SEQ ID NO: 608351

SEQ ID NO: 666409 - RNA, 64 nt, hsa; identical to SEQ ID NO: 608352

SEQ ID NO: 666410 - RNA, 64 nt, hsa; identical to SEQ ID NO: 608353

SEQ ID NO: 666411 - RNA, 64 nt, hsa; identical to SEQ ID NO: 608354

SEQ ID NO: 666412 - RNA, 64 nt, hsa; identical to SEQ ID NO: 608355

SEQ ID NO: 666413 - RNA, 64 nt, hsa; identical to SEQ ID NO: 608356

SEQ ID NO: 666414 - RNA, 64 nt, hsa; identical to SEQ ID NO: 608357

SEQ ID NO: 666415 - RNA, 64 nt, hsa; identical to SEQ ID NO: 608358

SEQ ID NO: 666416 - RNA, 64 nt, hsa; identical to SEQ ID NO: 608359

SEQ ID NO: 666417 - RNA, 64 nt, hsa; identical to SEQ ID NO: 608360

SEQ ID NO: 666418 - RNA, 64 nt, hsa; identical to SEQ ID NO: 608361

SEQ ID NO: 666419 - RNA, 64 nt, hsa; identical to SEQ ID NO: 608362

SEQ ID NO: 666420 - RNA, 64 nt, hsa; identical to SEQ ID NO: 608363

SEQ ID NO: 666421 - RNA, 64 nt, hsa; identical to SEQ ID NO: 608364

SEQ ID NO: 666422 - RNA, 64 nt, hsa; identical to SEQ ID NO: 608365

SEQ ID NO: 666423 - RNA, 64 nt, hsa; identical to SEQ ID NO: 608366

SEQ ID NO: 666424 - RNA, 64 nt, hsa; identical to SEQ ID NO: 608367

SEQ ID NO: 666425 - RNA, 64 nt, hsa; identical to SEQ ID NO: 608368

SEQ ID NO: 666426 - RNA, 64 nt, hsa; identical to SEQ ID NO: 608369

SEQ ID NO: 666427 - RNA, 64 nt, hsa; identical to SEQ ID NO: 608370

SEQ ID NO: 666428 - RNA, 64 nt, hsa; identical to SEQ ID NO: 608371

SEQ ID NO: 666429 - RNA, 64 nt, hsa; identical to SEQ ID NO: 608372

SEQ ID NO: 666430 - RNA, 64 nt, hsa; identical to SEQ ID NO: 608373

SEQ ID NO: 666431 - RNA, 64 nt, hsa; identical to SEQ ID NO: 608374

SEQ ID NO: 666432 - RNA, 64 nt, hsa; identical to SEQ ID NO: 608375

SEQ ID NO: 666433 - RNA, 64 nt, hsa; identical to SEQ ID NO: 608376

SEQ ID NO: 666434 - RNA, 64 nt, hsa; identical to SEQ ID NO: 608377

SEQ ID NO: 666435 - RNA, 64 nt, hsa; identical to SEQ ID NO: 608378

SEQ ID NO: 666436 - RNA, 64 nt, hsa; identical to SEQ ID NO: 608379

SEQ ID NO: 666437 - RNA, 64 nt, hsa; identical to SEQ ID NO: 608380

SEQ ID NO: 666438 - RNA, 64 nt, hsa; identical to SEQ ID NO: 608381

SEQ ID NO: 666439 - RNA, 64 nt, hsa; identical to SEQ ID NO: 608382

SEQ ID NO: 666440 - RNA, 64 nt, hsa; identical to SEQ ID NO: 608383

SEQ ID NO: 666441 - RNA, 64 nt, hsa; identical to SEQ ID NO: 608384

SEQ ID NO: 666442 - RNA, 64 nt, hsa; identical to SEQ ID NO: 608385

SEQ ID NO: 666443 - RNA, 64 nt, hsa; identical to SEQ ID NO: 608386

SEQ ID NO: 666444 - RNA, 64 nt, hsa; identical to SEQ ID NO: 608387

SEQ ID NO: 666445 - RNA, 64 nt, hsa; identical to SEQ ID NO: 608388

SEQ ID NO: 666446 - RNA, 64 nt, hsa; identical to SEQ ID NO: 608389

SEQ ID NO: 666447 - RNA, 64 nt, hsa; identical to SEQ ID NO: 608390

SEQ ID NO: 666448 - RNA, 64 nt, hsa; identical to SEQ ID NO: 608391

SEQ ID NO: 666449 - RNA, 64 nt, hsa; identical to SEQ ID NO: 608392

SEQ ID NO: 666450 - RNA, 64 nt, hsa; identical to SEQ ID NO: 608393

SEQ ID NO: 666451 - RNA, 64 nt, hsa; identical to SEQ ID NO: 608394

SEQ ID NO: 666452 - RNA, 64 nt, hsa; identical to SEQ ID NO: 608395

SEQ ID NO: 666453 - RNA, 64 nt, hsa; identical to SEQ ID NO: 608396

SEQ ID NO: 666454 - RNA, 64 nt, hsa; identical to SEQ ID NO: 608397

SEQ ID NO: 666455 - RNA, 64 nt, hsa; identical to SEQ ID NO: 608398

SEQ ID NO: 666456 - RNA, 64 nt, hsa; identical to SEQ ID NO: 608399

SEQ ID NO: 666457 - RNA, 64 nt, hsa; identical to SEQ ID NO: 608400

SEQ ID NO: 666458 - RNA, 64 nt, hsa; identical to SEQ ID NO: 608401

SEQ ID NO: 666459 - RNA, 64 nt, hsa; identical to SEQ ID NO: 608402

SEQ ID NO: 666460 - RNA, 64 nt, hsa; identical to SEQ ID NO: 608403

SEQ ID NO: 666461 - RNA, 64 nt, hsa; identical to SEQ ID NO: 608404

SEQ ID NO: 666462 - RNA, 64 nt, hsa; identical to SEQ ID NO: 608405

SEQ ID NO: 666463 - RNA, 64 nt, hsa; identical to SEQ ID NO: 608406

SEQ ID NO: 666464 - RNA, 64 nt, hsa; identical to SEQ ID NO: 608407

SEQ ID NO: 666465 - RNA, 64 nt, hsa; identical to SEQ ID NO: 608408

SEQ ID NO: 666466 - RNA, 64 nt, hsa; identical to SEQ ID NO: 608409

SEQ ID NO: 666467 - RNA, 64 nt, hsa; identical to SEQ ID NO: 608410

SEQ ID NO: 666468 - RNA, 64 nt, hsa; identical to SEQ ID NO: 608411

SEQ ID NO: 666469 - RNA, 64 nt, hsa; identical to SEQ ID NO: 608412

SEQ ID NO: 666470 - RNA, 64 nt, hsa; identical to SEQ ID NO: 608413

SEQ ID NO: 666471 - RNA, 64 nt, hsa; identical to SEQ ID NO: 608414

SEQ ID NO: 666472 - RNA, 64 nt, hsa; identical to SEQ ID NO: 608415

SEQ ID NO: 666473 - RNA, 64 nt, hsa; identical to SEQ ID NO: 608416

SEQ ID NO: 666474 - RNA, 64 nt, hsa; identical to SEQ ID NO: 608417

SEQ ID NO: 666475 - RNA, 64 nt, hsa; identical to SEQ ID NO: 608418

SEQ ID NO: 666476 - RNA, 64 nt, hsa; identical to SEQ ID NO: 608419

SEQ ID NO: 666477 - RNA, 64 nt, hsa; identical to SEQ ID NO: 608420

SEQ ID NO: 666478 - RNA, 64 nt, hsa; identical to SEQ ID NO: 608421

SEQ ID NO: 666479 - RNA, 64 nt, hsa; identical to SEQ ID NO: 608422

SEQ ID NO: 666480 - RNA, 64 nt, hsa; identical to SEQ ID NO: 608423

SEQ ID NO: 666481 - RNA, 64 nt, hsa; identical to SEQ ID NO: 608424

SEQ ID NO: 666482 - RNA, 64 nt, hsa; identical to SEQ ID NO: 608425

SEQ ID NO: 666483 - RNA, 64 nt, hsa; identical to SEQ ID NO: 608426

SEQ ID NO: 666484 - RNA, 64 nt, hsa; identical to SEQ ID NO: 608427

SEQ ID NO: 666485 - RNA, 64 nt, hsa; identical to SEQ ID NO: 608428

SEQ ID NO: 666486 - RNA, 64 nt, hsa; identical to SEQ ID NO: 608429

SEQ ID NO: 666487 - RNA, 64 nt, hsa; identical to SEQ ID NO: 608430

SEQ ID NO: 666488 - RNA, 64 nt, hsa; identical to SEQ ID NO: 608431

SEQ ID NO: 666489 - RNA, 64 nt, hsa; identical to SEQ ID NO: 608432

SEQ ID NO: 666490 - RNA, 64 nt, hsa; identical to SEQ ID NO: 608433

SEQ ID NO: 666491 - RNA, 64 nt, hsa; identical to SEQ ID NO: 608434

SEQ ID NO: 666492 - RNA, 64 nt, hsa; identical to SEQ ID NO: 608435

SEQ ID NO: 666493 - RNA, 64 nt, hsa; identical to SEQ ID NO: 608436

SEQ ID NO: 666494 - RNA, 64 nt, hsa; identical to SEQ ID NO: 608437

SEQ ID NO: 666495 - RNA, 64 nt, hsa; identical to SEQ ID NO: 608438

SEQ ID NO: 666496 - RNA, 64 nt, hsa; identical to SEQ ID NO: 608439

SEQ ID NO: 666497 - RNA, 64 nt, hsa; identical to SEQ ID NO: 608440

SEQ ID NO: 666498 - RNA, 64 nt, hsa; identical to SEQ ID NO: 608441

SEQ ID NO: 666499 - RNA, 64 nt, hsa; identical to SEQ ID NO: 608442

SEQ ID NO: 666500 - RNA, 64 nt, hsa; identical to SEQ ID NO: 608443

SEQ ID NO: 666501 - RNA, 64 nt, hsa; identical to SEQ ID NO: 608444

SEQ ID NO: 666502 - RNA, 64 nt, hsa; identical to SEQ ID NO: 608445

SEQ ID NO: 666503 - RNA, 64 nt, hsa; identical to SEQ ID NO: 608446

SEQ ID NO: 666504 - RNA, 64 nt, hsa; identical to SEQ ID NO: 608447

SEQ ID NO: 666505 - RNA, 64 nt, hsa; identical to SEQ ID NO: 608448

SEQ ID NO: 666506 - RNA, 64 nt, hsa; identical to SEQ ID NO: 608449

SEQ ID NO: 666507 - RNA, 64 nt, hsa; identical to SEQ ID NO: 608450

SEQ ID NO: 666508 - RNA, 64 nt, hsa; identical to SEQ ID NO: 608451

SEQ ID NO: 666509 - RNA, 64 nt, hsa; identical to SEQ ID NO: 608452

SEQ ID NO: 666510 - RNA, 64 nt, hsa; identical to SEQ ID NO: 244748

SEQ ID NO: 666511 - RNA, 64 nt, hsa; identical to SEQ ID NO: 244749

SEQ ID NO: 666512 - RNA, 64 nt, hsa; identical to SEQ ID NO: 244750

SEQ ID NO: 666513 - RNA, 64 nt, hsa; identical to SEQ ID NO: 244751

SEQ ID NO: 666514 - RNA, 64 nt, hsa; identical to SEQ ID NO: 244752

SEQ ID NO: 666515 - RNA, 64 nt, hsa; identical to SEQ ID NO: 244753

SEQ ID NO: 666516 - RNA, 64 nt, hsa; identical to SEQ ID NO: 244754

SEQ ID NO: 666517 - RNA, 64 nt, hsa; identical to SEQ ID NO: 244755

SEQ ID NO: 666518 - RNA, 64 nt, hsa; identical to SEQ ID NO: 244756

SEQ ID NO: 666519 - RNA, 64 nt, hsa; identical to SEQ ID NO: 244757

SEQ ID NO: 666520 - RNA, 64 nt, hsa; identical to SEQ ID NO: 244758

SEQ ID NO: 666521 - RNA, 64 nt, hsa; identical to SEQ ID NO: 244759

SEQ ID NO: 666522 - RNA, 64 nt, hsa; identical to SEQ ID NO: 244760

SEQ ID NO: 666523 - RNA, 64 nt, hsa; identical to SEQ ID NO: 244761

SEQ ID NO: 666524 - RNA, 64 nt, hsa; identical to SEQ ID NO: 244762

SEQ ID NO: 666525 - RNA, 64 nt, hsa; identical to SEQ ID NO: 244763

SEQ ID NO: 666526 - RNA, 64 nt, hsa; identical to SEQ ID NO: 244764

SEQ ID NO: 666527 - RNA, 61 nt, hsa
gaaccucaggacccgcccauuucucggcaguacugugaauuuugaaguuaaacuaaauuuu

SEQ ID NO: 666528 - RNA, 61 nt, hsa
acaugaagaguuuaguuuuuuuacuuuauaaacugugaauaugaguaugccagcugcauac

SEQ ID NO: 666529 - RNA, 61 nt, hsa
caacaacaacaaaccacaaaauuauuugaguacugugaaggauuauuugucuaacaguuca

SEQ ID NO: 666530 - RNA, 61 nt, hsa
uggaaagagcguccauaggagaagugagaauacugugaaaaagggauguuagcauucauua

SEQ ID NO: 666531 - RNA, 61 nt, hsa
acaugaagaguuuaguuuuuuuacuuuauaaacugugaauaugaguaugccagcugcauua

SEQ ID NO: 666532 - RNA, 61 nt, hsa; identical to SEQ ID NO: 666527

SEQ ID NO: 666533 - RNA, 61 nt, hsa
cucauucuccaagagccacaacucaagcugaacugugaaagugguuuaacacuguauccua

SEQ ID NO: 666534 - RNA, 61 nt, hsa
uuuuucuggaguggaaaagcuuaaaaaaauuacugugaauuguuuuuguacaguuaucaug

SEQ ID NO: 666535 - RNA, 61 nt, hsa
ggcuguaauuggagcagcuuuuggcugcguaacugugaacuauggccauauauaauuuuuu

SEQ ID NO: 666536 - RNA, 61 nt, hsa
guugagagcauuucagccagaggacuuuggaacugugaauauacuuccugaaggggaggga

SEQ ID NO: 666537 - RNA, 61 nt, hsa
uuaugggauugcuaccuguauaaacaauggcacugugaaaauacuguuaguuuuaauacaa

SEQ ID NO: 666538 - RNA, 61 nt, hsa
aacacuagcuuuguauuuuuuuuucuguaaaacugugaacugauauauuuuccuuuaucac

SEQ ID NO: 666539 - RNA, 61 nt, hsa
uccuugaaguguugcaagggaaccuccuagcacugugaaagucagaaucgccucagcauuu

SEQ ID NO: 666540 - RNA, 61 nt, hsa
gacugaucacucagaaauuaaaguccguuuuacugugaauauagcaauauaguacuggaca

SEQ ID NO: 666541 - RNA, 61 nt, hsa
ucuuugggacaccucagaaaacuuauuaacaacugugaauaugagaaauacagaagaaaau

SEQ ID NO: 666542 - RNA, 61 nt, hsa
uucaaggccauauuuuaaaaaaucaaaaggcacugugaacuauuuugaagaaaacacaaca

SEQ ID NO: 666543 - RNA, 61 nt, hsa
guaaucauguuggcuggucuggucacaggugacugugaaacagaugcccuggucuugcuuu

SEQ ID NO: 666544 - RNA, 61 nt, hsa; identical to SEQ ID NO: 379771

SEQ ID NO: 666545 - RNA, 61 nt, hsa
uuuauuucuuaagaaaaagcaucccucauuuacugugaacuaaaguucauucuguagugca

SEQ ID NO: 666546 - RNA, 61 nt, hsa
gguuaaugaucagaagaugucuccugagccaacugugaaccucacccaggcaaaauggcua

SEQ ID NO: 666547 - RNA, 61 nt, hsa
agauacaauaucacaccccuuccccacaaggacugugaauauugggauuuauguccuugcc

SEQ ID NO: 666548 - RNA, 61 nt, hsa
cuccccccaugguguuuucauaugagguacuacugugaaggaucugguuccucauucacug

SEQ ID NO: 666549 - RNA, 61 nt, hsa
cagccuuuuccuccucaguuuucucuuuaaaacugugaaguacuaacuuuccaaggccugc

SEQ ID NO: 666550 - RNA, 61 nt, hsa
gggcccacaucaucuaggcuccccagcccccacugugaaggggcuggccaggggcccgagc

SEQ ID NO: 666551 - RNA, 61 nt, hsa
gcauuaggcuguaguucuaauauugaguucaacugugaaauccaucagaugugccaaaugg

SEQ ID NO: 666552 - RNA, 61 nt, hsa
uucacuggaaaacagggaggggggauuucagacugugaagaaaguugaauggugguuuuua

SEQ ID NO: 666553 - RNA, 61 nt, hsa
aacauaauuaaugauggagagaaaccauacaacugugaagaauguggcaaagcuuuuaacc

SEQ ID NO: 666554 - RNA, 61 nt, hsa
uuuauauuugagaaaaauuguagaaauauagacugugaaaaagacgucaauaucugcucac

SEQ ID NO: 666555 - RNA, 61 nt, hsa
auuauucugaugcugggacaggugagaagaaacugugaaguauaugagccuuugaaaguuc

SEQ ID NO: 666556 - RNA, 61 nt, hsa
cauucaacagagaacucugucuuaagcuucaacugugaaaaugaugacgggcuuguagcac

SEQ ID NO: 666557 - RNA, 61 nt, hsa
uauacuugagaaauauuguacaaauauaaagacugugaaaaagccauuaauacaugcucac

SEQ ID NO: 666558 - RNA, 61 nt, hsa
aaaaaaauucauacuggagggaacuccugugacugugaagaauauggcaaagccuuuaaua

SEQ ID NO: 666559 - RNA, 61 nt, hsa
gguagcaccgugagaaaugggcuguauugauacugugaauguuuguuuuccaagcuguuuu

SEQ ID NO: 666560 - RNA, 61 nt, hsa
ucacaaaaaggaggugccccccugugcugucacugugaauggaaaggaugggucaccucuc

SEQ ID NO: 666561 - RNA, 61 nt, hsa
aaugccuguggcuucagucaauugucuugagacugugaagaggcugaaagacaccuucccg

SEQ ID NO: 666562 - RNA, 61 nt, hsa
cuucuccuuugaaugcuguuuugugaaagaaacugugaauguaauggaaacguaggagcau

SEQ ID NO: 666563 - RNA, 61 nt, hsa
uggcccguugguuuucugagcagggggcugaacugugaacaagucagacaaauaaagcaag

SEQ ID NO: 666564 - RNA, 61 nt, hsa
auaaagaacuuagucaucccuuccaccuccuacugugaagaacagacccugggucccacac

SEQ ID NO: 666565 - RNA, 64 nt, hsa; identical to SEQ ID NO: 612739

SEQ ID NO: 666566 - RNA, 64 nt, hsa; identical to SEQ ID NO: 612740

SEQ ID NO: 666567 - RNA, 64 nt, hsa; identical to SEQ ID NO: 612741

SEQ ID NO: 666568 - RNA, 64 nt, hsa; identical to SEQ ID NO: 612742

SEQ ID NO: 666569 - RNA, 64 nt, hsa; identical to SEQ ID NO: 612743

SEQ ID NO: 666570 - RNA, 64 nt, hsa; identical to SEQ ID NO: 612744

SEQ ID NO: 666571 - RNA, 64 nt, hsa; identical to SEQ ID NO: 564088

SEQ ID NO: 666572 - RNA, 64 nt, hsa; identical to SEQ ID NO: 564089

SEQ ID NO: 666573 - RNA, 64 nt, hsa; identical to SEQ ID NO: 564090

SEQ ID NO: 666574 - RNA, 64 nt, hsa; identical to SEQ ID NO: 564091

SEQ ID NO: 666575 - RNA, 64 nt, hsa; identical to SEQ ID NO: 564092

SEQ ID NO: 666576 - RNA, 64 nt, hsa; identical to SEQ ID NO: 564093

SEQ ID NO: 666577 - RNA, 64 nt, hsa; identical to SEQ ID NO: 564094

SEQ ID NO: 666578 - RNA, 64 nt, hsa; identical to SEQ ID NO: 564095

SEQ ID NO: 666579 - RNA, 64 nt, hsa; identical to SEQ ID NO: 564096

SEQ ID NO: 666580 - RNA, 64 nt, hsa; identical to SEQ ID NO: 564097

SEQ ID NO: 666581 - RNA, 64 nt, hsa; identical to SEQ ID NO: 564098

SEQ ID NO: 666582 - RNA, 64 nt, hsa; identical to SEQ ID NO: 564099

SEQ ID NO: 666583 - RNA, 64 nt, hsa; identical to SEQ ID NO: 510924

SEQ ID NO: 666584 - RNA, 64 nt, hsa; identical to SEQ ID NO: 510925

SEQ ID NO: 666585 - RNA, 57 nt, hsa; identical to SEQ ID NO: 510926

SEQ ID NO: 666586 - RNA, 64 nt, hsa; identical to SEQ ID NO: 510927

SEQ ID NO: 666587 - RNA, 64 nt, hsa; identical to SEQ ID NO: 510928

SEQ ID NO: 666588 - RNA, 64 nt, hsa; identical to SEQ ID NO: 510929

SEQ ID NO: 666589 - RNA, 64 nt, hsa; identical to SEQ ID NO: 510930

SEQ ID NO: 666590 - RNA, 64 nt, hsa; identical to SEQ ID NO: 510931

SEQ ID NO: 666591 - RNA, 64 nt, hsa; identical to SEQ ID NO: 510932

SEQ ID NO: 666592 - RNA, 64 nt, hsa; identical to SEQ ID NO: 510933

SEQ ID NO: 666593 - RNA, 64 nt, hsa; identical to SEQ ID NO: 510934

SEQ ID NO: 666594 - RNA, 64 nt, hsa; identical to SEQ ID NO: 510935

SEQ ID NO: 666595 - RNA, 64 nt, hsa; identical to SEQ ID NO: 510936

SEQ ID NO: 666596 - RNA, 64 nt, hsa; identical to SEQ ID NO: 510937

SEQ ID NO: 666597 - RNA, 64 nt, hsa; identical to SEQ ID NO: 510938

SEQ ID NO: 666598 - RNA, 64 nt, hsa; identical to SEQ ID NO: 510939

SEQ ID NO: 666599 - RNA, 64 nt, hsa; identical to SEQ ID NO: 510940

SEQ ID NO: 666600 - RNA, 64 nt, hsa; identical to SEQ ID NO: 510941

SEQ ID NO: 666601 - RNA, 64 nt, hsa; identical to SEQ ID NO: 510942

SEQ ID NO: 666602 - RNA, 64 nt, hsa; identical to SEQ ID NO: 510943

SEQ ID NO: 666603 - RNA, 64 nt, hsa; identical to SEQ ID NO: 510944

SEQ ID NO: 666604 - RNA, 64 nt, hsa; identical to SEQ ID NO: 510945

SEQ ID NO: 666605 - RNA, 64 nt, hsa; identical to SEQ ID NO: 510946

SEQ ID NO: 666606 - RNA, 64 nt, hsa; identical to SEQ ID NO: 510947

SEQ ID NO: 666607 - RNA, 64 nt, hsa; identical to SEQ ID NO: 510948

SEQ ID NO: 666608 - RNA, 64 nt, hsa; identical to SEQ ID NO: 510949

SEQ ID NO: 666609 - RNA, 64 nt, hsa; identical to SEQ ID NO: 510950

SEQ ID NO: 666610 - RNA, 64 nt, hsa; identical to SEQ ID NO: 510951

SEQ ID NO: 666611 - RNA, 64 nt, hsa; identical to SEQ ID NO: 510952

SEQ ID NO: 666612 - RNA, 64 nt, hsa; identical to SEQ ID NO: 510953

SEQ ID NO: 666613 - RNA, 64 nt, hsa; identical to SEQ ID NO: 510954

SEQ ID NO: 666614 - RNA, 64 nt, hsa; identical to SEQ ID NO: 510955

SEQ ID NO: 666615 - RNA, 64 nt, hsa; identical to SEQ ID NO: 510956

SEQ ID NO: 666616 - RNA, 64 nt, hsa; identical to SEQ ID NO: 510957

SEQ ID NO: 666617 - RNA, 64 nt, hsa; identical to SEQ ID NO: 510958

SEQ ID NO: 666618 - RNA, 64 nt, hsa; identical to SEQ ID NO: 510959

SEQ ID NO: 666619 - RNA, 64 nt, hsa; identical to SEQ ID NO: 510960

SEQ ID NO: 666620 - RNA, 64 nt, hsa; identical to SEQ ID NO: 510961

SEQ ID NO: 666621 - RNA, 64 nt, hsa; identical to SEQ ID NO: 510962

SEQ ID NO: 666622 - RNA, 64 nt, hsa; identical to SEQ ID NO: 510963

SEQ ID NO: 666623 - RNA, 64 nt, hsa; identical to SEQ ID NO: 510964

SEQ ID NO: 666624 - RNA, 64 nt, hsa; identical to SEQ ID NO: 510965

SEQ ID NO: 666625 - RNA, 64 nt, hsa; identical to SEQ ID NO: 510966

SEQ ID NO: 666626 - RNA, 64 nt, hsa; identical to SEQ ID NO: 510967

SEQ ID NO: 666627 - RNA, 64 nt, hsa; identical to SEQ ID NO: 510968

SEQ ID NO: 666628 - RNA, 64 nt, hsa; identical to SEQ ID NO: 510969

SEQ ID NO: 666629 - RNA, 64 nt, hsa; identical to SEQ ID NO: 510970

SEQ ID NO: 666630 - RNA, 64 nt, hsa; identical to SEQ ID NO: 510971

SEQ ID NO: 666631 - RNA, 64 nt, hsa; identical to SEQ ID NO: 510972

SEQ ID NO: 666632 - RNA, 64 nt, hsa; identical to SEQ ID NO: 510973

SEQ ID NO: 666633 - RNA, 64 nt, hsa; identical to SEQ ID NO: 510974

SEQ ID NO: 666634 - RNA, 64 nt, hsa; identical to SEQ ID NO: 510975

SEQ ID NO: 666635 - RNA, 64 nt, hsa; identical to SEQ ID NO: 510976

SEQ ID NO: 666636 - RNA, 64 nt, hsa; identical to SEQ ID NO: 510977

SEQ ID NO: 666637 - RNA, 64 nt, hsa; identical to SEQ ID NO: 510978

SEQ ID NO: 666638 - RNA, 64 nt, hsa; identical to SEQ ID NO: 510979

SEQ ID NO: 666639 - RNA, 64 nt, hsa; identical to SEQ ID NO: 510980

SEQ ID NO: 666640 - RNA, 64 nt, hsa; identical to SEQ ID NO: 510981

SEQ ID NO: 666641 - RNA, 64 nt, hsa; identical to SEQ ID NO: 510982

SEQ ID NO: 666642 - RNA, 64 nt, hsa; identical to SEQ ID NO: 510983

SEQ ID NO: 666643 - RNA, 64 nt, hsa; identical to SEQ ID NO: 657951

SEQ ID NO: 666644 - RNA, 64 nt, hsa; identical to SEQ ID NO: 657952

SEQ ID NO: 666645 - RNA, 64 nt, hsa; identical to SEQ ID NO: 657953

SEQ ID NO: 666646 - RNA, 64 nt, hsa; identical to SEQ ID NO: 657954

SEQ ID NO: 666647 - RNA, 64 nt, hsa; identical to SEQ ID NO: 657955

SEQ ID NO: 666648 - RNA, 64 nt, hsa; identical to SEQ ID NO: 657956

SEQ ID NO: 666649 - RNA, 64 nt, hsa; identical to SEQ ID NO: 657957

SEQ ID NO: 666650 - RNA, 64 nt, hsa; identical to SEQ ID NO: 657958

SEQ ID NO: 666651 - RNA, 64 nt, hsa; identical to SEQ ID NO: 657959

SEQ ID NO: 666652 - RNA, 64 nt, hsa; identical to SEQ ID NO: 657960

SEQ ID NO: 666653 - RNA, 64 nt, hsa; identical to SEQ ID NO: 657961

SEQ ID NO: 666654 - RNA, 64 nt, hsa; identical to SEQ ID NO: 657962

SEQ ID NO: 666655 - RNA, 64 nt, hsa; identical to SEQ ID NO: 657963

SEQ ID NO: 666656 - RNA, 64 nt, hsa; identical to SEQ ID NO: 657964

SEQ ID NO: 666657 - RNA, 64 nt, hsa; identical to SEQ ID NO: 657965

SEQ ID NO: 666658 - RNA, 64 nt, hsa; identical to SEQ ID NO: 657966

SEQ ID NO: 666659 - RNA, 64 nt, hsa; identical to SEQ ID NO: 657967

SEQ ID NO: 666660 - RNA, 64 nt, hsa; identical to SEQ ID NO: 657968

SEQ ID NO: 666661 - RNA, 64 nt, hsa; identical to SEQ ID NO: 657969

SEQ ID NO: 666662 - RNA, 64 nt, hsa; identical to SEQ ID NO: 657970

SEQ ID NO: 666663 - RNA, 64 nt, hsa; identical to SEQ ID NO: 657971

SEQ ID NO: 666664 - RNA, 64 nt, hsa; identical to SEQ ID NO: 657972

SEQ ID NO: 666665 - RNA, 64 nt, hsa; identical to SEQ ID NO: 657973

SEQ ID NO: 666666 - RNA, 64 nt, hsa
ugaucaccaagcugucucaucaccaaauagguagucaaggcagccucaucuccccaggugaggg

SEQ ID NO: 666667 - RNA, 64 nt, hsa
ugaucaccgagcugucacaucagcaaauauguagucaaggcagccaggccaacuagaccacacu

SEQ ID NO: 666668 - RNA, 64 nt, hsa
gccguguauuuauuuuucaccuaucuccuuccugucaaggcaggccgggcuccagggcuccccu

SEQ ID NO: 666669 - RNA, 64 nt, hsa
cgagcuucagcuuccaggaugcuucucuggaaccucaaggcaggcagcccaggcccugggccug

SEQ ID NO: 666670 - RNA, 64 nt, hsa; identical to SEQ ID NO: 166184

SEQ ID NO: 666671 - RNA, 64 nt, hsa; identical to SEQ ID NO: 166185

SEQ ID NO: 666672 - RNA, 64 nt, hsa; identical to SEQ ID NO: 166186

SEQ ID NO: 666673 - RNA, 64 nt, hsa; identical to SEQ ID NO: 166187

SEQ ID NO: 666674 - RNA, 64 nt, hsa; identical to SEQ ID NO: 166188

SEQ ID NO: 666675 - RNA, 64 nt, hsa; identical to SEQ ID NO: 166189

SEQ ID NO: 666676 - RNA, 64 nt, hsa; identical to SEQ ID NO: 166190

SEQ ID NO: 666677 - RNA, 64 nt, hsa; identical to SEQ ID NO: 166191

SEQ ID NO: 666678 - RNA, 64 nt, hsa; identical to SEQ ID NO: 166192

SEQ ID NO: 666679 - RNA, 64 nt, hsa; identical to SEQ ID NO: 166193

SEQ ID NO: 666680 - RNA, 64 nt, hsa; identical to SEQ ID NO: 166194

SEQ ID NO: 666681 - RNA, 64 nt, hsa; identical to SEQ ID NO: 166195

SEQ ID NO: 666682 - RNA, 64 nt, hsa; identical to SEQ ID NO: 166196

SEQ ID NO: 666683 - RNA, 64 nt, hsa; identical to SEQ ID NO: 166197

SEQ ID NO: 666684 - RNA, 64 nt, hsa; identical to SEQ ID NO: 166198

SEQ ID NO: 666685 - RNA, 64 nt, hsa; identical to SEQ ID NO: 166199

SEQ ID NO: 666686 - RNA, 64 nt, hsa; identical to SEQ ID NO: 166200

SEQ ID NO: 666687 - RNA, 64 nt, hsa; identical to SEQ ID NO: 166201

SEQ ID NO: 666688 - RNA, 64 nt, hsa; identical to SEQ ID NO: 166202

SEQ ID NO: 666689 - RNA, 64 nt, hsa; identical to SEQ ID NO: 166203

SEQ ID NO: 666690 - RNA, 64 nt, hsa; identical to SEQ ID NO: 166204

SEQ ID NO: 666691 - RNA, 64 nt, hsa; identical to SEQ ID NO: 166205

SEQ ID NO: 666692 - RNA, 64 nt, hsa; identical to SEQ ID NO: 166206

SEQ ID NO: 666693 - RNA, 64 nt, hsa; identical to SEQ ID NO: 166207

SEQ ID NO: 666694 - RNA, 64 nt, hsa; identical to SEQ ID NO: 166208

SEQ ID NO: 666695 - RNA, 64 nt, hsa; identical to SEQ ID NO: 166209

SEQ ID NO: 666696 - RNA, 64 nt, hsa; identical to SEQ ID NO: 166210

SEQ ID NO: 666697 - RNA, 64 nt, hsa; identical to SEQ ID NO: 166211

SEQ ID NO: 666698 - RNA, 64 nt, hsa; identical to SEQ ID NO: 166212

SEQ ID NO: 666699 - RNA, 64 nt, hsa; identical to SEQ ID NO: 166213

SEQ ID NO: 666700 - RNA, 64 nt, hsa; identical to SEQ ID NO: 166214

SEQ ID NO: 666701 - RNA, 64 nt, hsa; identical to SEQ ID NO: 166215

SEQ ID NO: 666702 - RNA, 64 nt, hsa; identical to SEQ ID NO: 166216

SEQ ID NO: 666703 - RNA, 64 nt, hsa; identical to SEQ ID NO: 166217

SEQ ID NO: 666704 - RNA, 64 nt, hsa; identical to SEQ ID NO: 166218

SEQ ID NO: 666705 - RNA, 64 nt, hsa; identical to SEQ ID NO: 166219

SEQ ID NO: 666706 - RNA, 64 nt, hsa; identical to SEQ ID NO: 166220

SEQ ID NO: 666707 - RNA, 64 nt, hsa; identical to SEQ ID NO: 166221

SEQ ID NO: 666708 - RNA, 64 nt, hsa; identical to SEQ ID NO: 166222

SEQ ID NO: 666709 - RNA, 64 nt, hsa; identical to SEQ ID NO: 166223

SEQ ID NO: 666710 - RNA, 64 nt, hsa; identical to SEQ ID NO: 166224

SEQ ID NO: 666711 - RNA, 58 nt, hsa; identical to SEQ ID NO: 96080

SEQ ID NO: 666712 - RNA, 64 nt, hsa; identical to SEQ ID NO: 166226

SEQ ID NO: 666713 - RNA, 64 nt, hsa; identical to SEQ ID NO: 166227

SEQ ID NO: 666714 - RNA, 64 nt, hsa; identical to SEQ ID NO: 166228

SEQ ID NO: 666715 - RNA, 64 nt, hsa; identical to SEQ ID NO: 166229

SEQ ID NO: 666716 - RNA, 64 nt, hsa; identical to SEQ ID NO: 166230

SEQ ID NO: 666717 - RNA, 64 nt, hsa; identical to SEQ ID NO: 166231

SEQ ID NO: 666718 - RNA, 64 nt, hsa; identical to SEQ ID NO: 166232

SEQ ID NO: 666719 - RNA, 64 nt, hsa; identical to SEQ ID NO: 166233

SEQ ID NO: 666720 - RNA, 64 nt, hsa; identical to SEQ ID NO: 166234

SEQ ID NO: 666721 - RNA, 64 nt, hsa; identical to SEQ ID NO: 166235

SEQ ID NO: 666722 - RNA, 64 nt, hsa; identical to SEQ ID NO: 166236

SEQ ID NO: 666723 - RNA, 64 nt, hsa; identical to SEQ ID NO: 166237

SEQ ID NO: 666724 - RNA, 64 nt, hsa; identical to SEQ ID NO: 166238

SEQ ID NO: 666725 - RNA, 64 nt, hsa; identical to SEQ ID NO: 166239

SEQ ID NO: 666726 - RNA, 64 nt, hsa; identical to SEQ ID NO: 166240

SEQ ID NO: 666727 - RNA, 64 nt, hsa; identical to SEQ ID NO: 166241

SEQ ID NO: 666728 - RNA, 64 nt, hsa; identical to SEQ ID NO: 166242

SEQ ID NO: 666729 - RNA, 64 nt, hsa; identical to SEQ ID NO: 166243

SEQ ID NO: 666730 - RNA, 64 nt, hsa; identical to SEQ ID NO: 166244

SEQ ID NO: 666731 - RNA, 64 nt, hsa; identical to SEQ ID NO: 166245

SEQ ID NO: 666732 - RNA, 64 nt, hsa; identical to SEQ ID NO: 166246

SEQ ID NO: 666733 - RNA, 64 nt, hsa; identical to SEQ ID NO: 166247

SEQ ID NO: 666734 - RNA, 64 nt, hsa; identical to SEQ ID NO: 166248

SEQ ID NO: 666735 - RNA, 64 nt, hsa; identical to SEQ ID NO: 166249

SEQ ID NO: 666736 - RNA, 64 nt, hsa; identical to SEQ ID NO: 166250

SEQ ID NO: 666737 - RNA, 64 nt, hsa; identical to SEQ ID NO: 166251

SEQ ID NO: 666738 - RNA, 64 nt, hsa; identical to SEQ ID NO: 166252

SEQ ID NO: 666739 - RNA, 64 nt, hsa; identical to SEQ ID NO: 166253

SEQ ID NO: 666740 - RNA, 64 nt, hsa; identical to SEQ ID NO: 166254

SEQ ID NO: 666741 - RNA, 64 nt, hsa; identical to SEQ ID NO: 166255

SEQ ID NO: 666742 - RNA, 64 nt, hsa; identical to SEQ ID NO: 166256

SEQ ID NO: 666743 - RNA, 64 nt, hsa; identical to SEQ ID NO: 166257

SEQ ID NO: 666744 - RNA, 64 nt, hsa; identical to SEQ ID NO: 166258

SEQ ID NO: 666745 - RNA, 64 nt, hsa; identical to SEQ ID NO: 166259

SEQ ID NO: 666746 - RNA, 64 nt, hsa; identical to SEQ ID NO: 166260

SEQ ID NO: 666747 - RNA, 64 nt, hsa; identical to SEQ ID NO: 166261

SEQ ID NO: 666748 - RNA, 64 nt, hsa; identical to SEQ ID NO: 166262

SEQ ID NO: 666749 - RNA, 64 nt, hsa; identical to SEQ ID NO: 166263

SEQ ID NO: 666750 - RNA, 64 nt, hsa; identical to SEQ ID NO: 166264

SEQ ID NO: 666751 - RNA, 64 nt, hsa; identical to SEQ ID NO: 166265

SEQ ID NO: 666752 - RNA, 64 nt, hsa; identical to SEQ ID NO: 166266

SEQ ID NO: 666753 - RNA, 64 nt, hsa; identical to SEQ ID NO: 166267

SEQ ID NO: 666754 - RNA, 64 nt, hsa; identical to SEQ ID NO: 166268

SEQ ID NO: 666755 - RNA, 64 nt, hsa; identical to SEQ ID NO: 166269

SEQ ID NO: 666756 - RNA, 64 nt, hsa; identical to SEQ ID NO: 166270

SEQ ID NO: 666757 - RNA, 64 nt, hsa; identical to SEQ ID NO: 166271

SEQ ID NO: 666758 - RNA, 64 nt, hsa; identical to SEQ ID NO: 166272

SEQ ID NO: 666759 - RNA, 64 nt, hsa; identical to SEQ ID NO: 166273

SEQ ID NO: 666760 - RNA, 64 nt, hsa; identical to SEQ ID NO: 166274

SEQ ID NO: 666761 - RNA, 64 nt, hsa; identical to SEQ ID NO: 166275

SEQ ID NO: 666762 - RNA, 64 nt, hsa; identical to SEQ ID NO: 166276

SEQ ID NO: 666763 - RNA, 64 nt, hsa; identical to SEQ ID NO: 166277

SEQ ID NO: 666764 - RNA, 64 nt, hsa; identical to SEQ ID NO: 166278

SEQ ID NO: 666765 - RNA, 64 nt, hsa; identical to SEQ ID NO: 166279

SEQ ID NO: 666766 - RNA, 64 nt, hsa; identical to SEQ ID NO: 166280

SEQ ID NO: 666767 - RNA, 64 nt, hsa; identical to SEQ ID NO: 166281

SEQ ID NO: 666768 - RNA, 64 nt, hsa; identical to SEQ ID NO: 166282

SEQ ID NO: 666769 - RNA, 64 nt, hsa; identical to SEQ ID NO: 166283

SEQ ID NO: 666770 - RNA, 64 nt, hsa; identical to SEQ ID NO: 166284

SEQ ID NO: 666771 - RNA, 64 nt, hsa; identical to SEQ ID NO: 166285

SEQ ID NO: 666772 - RNA, 64 nt, hsa; identical to SEQ ID NO: 166286

SEQ ID NO: 666773 - RNA, 64 nt, hsa; identical to SEQ ID NO: 166287

SEQ ID NO: 666774 - RNA, 64 nt, hsa; identical to SEQ ID NO: 166288

SEQ ID NO: 666775 - RNA, 64 nt, hsa; identical to SEQ ID NO: 166289

SEQ ID NO: 666776 - RNA, 64 nt, hsa; identical to SEQ ID NO: 166290

SEQ ID NO: 666777 - RNA, 64 nt, hsa; identical to SEQ ID NO: 166291

SEQ ID NO: 666778 - RNA, 64 nt, hsa; identical to SEQ ID NO: 166292

SEQ ID NO: 666779 - RNA, 64 nt, hsa; identical to SEQ ID NO: 166293

SEQ ID NO: 666780 - RNA, 64 nt, hsa; identical to SEQ ID NO: 166294

SEQ ID NO: 666781 - RNA, 64 nt, hsa; identical to SEQ ID NO: 166295

SEQ ID NO: 666782 - RNA, 64 nt, hsa; identical to SEQ ID NO: 166296

SEQ ID NO: 666783 - RNA, 64 nt, hsa; identical to SEQ ID NO: 166297

SEQ ID NO: 666784 - RNA, 64 nt, hsa; identical to SEQ ID NO: 166298

SEQ ID NO: 666785 - RNA, 64 nt, hsa; identical to SEQ ID NO: 166299

SEQ ID NO: 666786 - RNA, 64 nt, hsa; identical to SEQ ID NO: 166300

SEQ ID NO: 666787 - RNA, 64 nt, hsa; identical to SEQ ID NO: 166301

SEQ ID NO: 666788 - RNA, 64 nt, hsa; identical to SEQ ID NO: 166302

SEQ ID NO: 666789 - RNA, 64 nt, hsa; identical to SEQ ID NO: 166303

SEQ ID NO: 666790 - RNA, 64 nt, hsa; identical to SEQ ID NO: 166304

SEQ ID NO: 666791 - RNA, 64 nt, hsa; identical to SEQ ID NO: 166305

SEQ ID NO: 666792 - RNA, 64 nt, hsa; identical to SEQ ID NO: 166306

SEQ ID NO: 666793 - RNA, 64 nt, hsa; identical to SEQ ID NO: 166307

SEQ ID NO: 666794 - RNA, 64 nt, hsa; identical to SEQ ID NO: 166308

SEQ ID NO: 666795 - RNA, 64 nt, hsa; identical to SEQ ID NO: 166309

SEQ ID NO: 666796 - RNA, 64 nt, hsa; identical to SEQ ID NO: 166310

SEQ ID NO: 666797 - RNA, 64 nt, hsa; identical to SEQ ID NO: 166311

SEQ ID NO: 666798 - RNA, 64 nt, hsa; identical to SEQ ID NO: 166312

SEQ ID NO: 666799 - RNA, 64 nt, hsa; identical to SEQ ID NO: 166313

SEQ ID NO: 666800 - RNA, 64 nt, hsa; identical to SEQ ID NO: 166314

SEQ ID NO: 666801 - RNA, 64 nt, hsa; identical to SEQ ID NO: 166315

SEQ ID NO: 666802 - RNA, 64 nt, hsa; identical to SEQ ID NO: 56858

SEQ ID NO: 666803 - RNA, 64 nt, hsa; identical to SEQ ID NO: 56859

SEQ ID NO: 666804 - RNA, 64 nt, hsa; identical to SEQ ID NO: 56860

SEQ ID NO: 666805 - RNA, 64 nt, hsa; identical to SEQ ID NO: 56861

SEQ ID NO: 666806 - RNA, 64 nt, hsa; identical to SEQ ID NO: 56862

SEQ ID NO: 666807 - RNA, 64 nt, hsa; identical to SEQ ID NO: 56863

SEQ ID NO: 666808 - RNA, 64 nt, hsa; identical to SEQ ID NO: 56864

SEQ ID NO: 666809 - RNA, 64 nt, hsa; identical to SEQ ID NO: 56865

SEQ ID NO: 666810 - RNA, 64 nt, hsa; identical to SEQ ID NO: 56866

SEQ ID NO: 666811 - RNA, 64 nt, hsa; identical to SEQ ID NO: 56867

SEQ ID NO: 666812 - RNA, 64 nt, hsa; identical to SEQ ID NO: 56868

SEQ ID NO: 666813 - RNA, 64 nt, hsa; identical to SEQ ID NO: 56869

SEQ ID NO: 666814 - RNA, 64 nt, hsa; identical to SEQ ID NO: 56870

SEQ ID NO: 666815 - RNA, 64 nt, hsa; identical to SEQ ID NO: 56871

SEQ ID NO: 666816 - RNA, 64 nt, hsa; identical to SEQ ID NO: 56872

SEQ ID NO: 666817 - RNA, 64 nt, hsa; identical to SEQ ID NO: 56873

SEQ ID NO: 666818 - RNA, 64 nt, hsa; identical to SEQ ID NO: 56874

SEQ ID NO: 666819 - RNA, 64 nt, hsa; identical to SEQ ID NO: 56875

SEQ ID NO: 666820 - RNA, 64 nt, hsa; identical to SEQ ID NO: 56876

SEQ ID NO: 666821 - RNA, 64 nt, hsa; identical to SEQ ID NO: 56877

SEQ ID NO: 666822 - RNA, 64 nt, hsa; identical to SEQ ID NO: 56878

SEQ ID NO: 666823 - RNA, 64 nt, hsa; identical to SEQ ID NO: 56879

SEQ ID NO: 666824 - RNA, 64 nt, hsa; identical to SEQ ID NO: 56880

SEQ ID NO: 666825 - RNA, 64 nt, hsa; identical to SEQ ID NO: 56881

SEQ ID NO: 666826 - RNA, 64 nt, hsa
ggggaugaaauuccucaagaugauuauuccugaaaguguggaugcgcuggaugcgcagggaaca

SEQ ID NO: 666827 - RNA, 64 nt, hsa
ccagcagauggcuuuucuauagacaaacuagguuaguguggaagauauagguuaaaauaaacua

SEQ ID NO: 666828 - RNA, 64 nt, hsa
ucggggaguggcuuuuccagcucucaugccccgcaguguggaacaaggcagaaaaggauccuag

SEQ ID NO: 666829 - RNA, 64 nt, hsa
ugcugucucuuggaggcagggcccaggagaacaaaguguggaggccucggggaguggcuuuucc

SEQ ID NO: 666830 - RNA, 64 nt, hsa
ugcgauggcauugucucgguucccgcagugcugcaguguggaagggagugccccauccucauua

SEQ ID NO: 666831 - RNA, 64 nt, hsa
gagugccccauccucauuacagaugacacacuggaguguggaggggucgaugacuugugcaggg

SEQ ID NO: 666832 - RNA, 64 nt, hsa
uucuuugggguuuguuuguuugcuucuuuuccagaguguggaaagucuacagugcagaaaggcu

SEQ ID NO: 666833 - RNA, 64 nt, hsa
gcaagcccccuuucucuucccaaucacguggcugaguguggaugacuuuuauuuuaggagaagg

SEQ ID NO: 666834 - RNA, 64 nt, hsa
auguacaaguuaggucaccaaacacggaagugugaguguggaaggaucuuggcacuguaagcaa

SEQ ID NO: 666835 - RNA, 64 nt, hsa
aaaaccuauuuuuaaauagaaaucacaaauagcaaguguggaagcacuacuuuauucuguuuaa

SEQ ID NO: 666836 - RNA, 64 nt, hsa
uugccacucuuaaaaauugugcccaaaauauaaaaguguggaacuuuagaacuuggaauaauuu

SEQ ID NO: 666837 - RNA, 64 nt, hsa
ucaaacaaaggcauuggauuuggauccgucugaaaguguggauguggggaagccagugagcauu

SEQ ID NO: 666838 - RNA, 64 nt, hsa
uuuagcccgguuuguuucucccugcucaggucuagaaucccaagcaguguucuuuucuggugaa

SEQ ID NO: 666839 - RNA, 64 nt, hsa
accugauuuaggccagcaaccagggaagcucuuagaaucccaggcggacacccuuucucaaaag

SEQ ID NO: 666840 - RNA, 64 nt, hsa
cagagcccuggcuggugaugugcuggcugggggugaaucccaaugagggucccucucagagcgg

SEQ ID NO: 666841 - RNA, 64 nt, hsa
cagagcccuggauggugaugcgcuggcugggggugaaucccaaugagggucccucucagaaagg

SEQ ID NO: 666842 - RNA, 64 nt, hsa
ggccuuguccaagggacagagccuucuauucugagaaucccaggggcccucagacccugccuga

SEQ ID NO: 666843 - RNA, 64 nt, hsa
uucauaguacauuaaaaagagagagagagagaaagaaucccacagggcacuauuaaaauacuuc

SEQ ID NO: 666844 - RNA, 64 nt, hsa
ggacccccaaaucauggaaucccaaauccccagggaaucccaaauuugaaaauccaaucccaag

SEQ ID NO: 666845 - RNA, 64 nt, hsa
ccaaugccguaacuccuaggacccccaaaucauggaaucccaaauccccagggaaucccaaauu

SEQ ID NO: 666846 - RNA, 64 nt, hsa
ugcggaacggguguggauuugaauguggacuucggaaucccaggaggcaggggccgggcucucc

SEQ ID NO: 666847 - RNA, 64 nt, hsa
acaaccgcuguaaaaugacggagagagagagaaagaaucccagacauuaacgguauuagagagu

SEQ ID NO: 666848 - RNA, 64 nt, hsa
aauacacacauauuuuaucccaaguuuauaaugguggucugaacaaggcaccuguaaauaaauc

SEQ ID NO: 666849 - RNA, 64 nt, hsa
aaacacagagcugcccaggcuuucuggaagcuucuggucugagggaggugucuccgaggauccu

SEQ ID NO: 666850 - RNA, 64 nt, hsa
auaccuauuauaucuguguggaguagguuuucucuggucugauuuugacaaauagaagaguguc

SEQ ID NO: 666851 - RNA, 64 nt, hsa
auaguaaauugaccagaacacaguugugggaauuuggucugaaguuagugaaauaaaacuuuaa

SEQ ID NO: 666852 - RNA, 64 nt, hsa
uuggacaggagaucagcagcgugcacaucugcuguggucugaagugguuugcaggucagccucc

SEQ ID NO: 666853 - RNA, 64 nt, hsa
ccgaaugucacugguggaucuaagaagggcugaguggucugacaccaaaacaugccgcagggag

SEQ ID NO: 666854 - RNA, 64 nt, hsa
ggcagcaguguguccagccugccucuucccaggcuggucugacaugcagcuuaggcuuucaucc

SEQ ID NO: 666855 - RNA, 64 nt, hsa
gaauggcauggacuugcugaucaacagaaggaaauggucugaagucugaccagcacaaggaagg

SEQ ID NO: 666856 - RNA, 64 nt, hsa
cucuccugcugauggaaaugggaaugaaguuaaguggucugaaaaacuugaaucguucacauuu

SEQ ID NO: 666857 - RNA, 64 nt, hsa
aaugcacucuucccuugccggcuccugguaccauuggucugaacagcuguaguuggucuacucc

SEQ ID NO: 666858 - RNA, 64 nt, hsa
acagaagccagccaagugccaaggucagcuuggcuggucugaggccaccuucuuagccaaaaac

SEQ ID NO: 666859 - RNA, 64 nt, hsa
aggccaaggccauucccuaacucccuccugccccuggucugaggaggagggacucuggaguagc

SEQ ID NO: 666860 - RNA, 64 nt, hsa
acugaguuuggccucuggcucgguuuccuuucuuuggucugauacuucauguauuugaauauag

SEQ ID NO: 666861 - RNA, 64 nt, hsa
aaacaagucucugucucaguuaagagaaaucuauuggucugaagguuucugaaccucuuucugg

SEQ ID NO: 666862 - RNA, 64 nt, hsa
uuucagccuuugagguuuuaagaaucccuuuucauggucugaucuuaaguuguuugaaaaaaga

SEQ ID NO: 666863 - RNA, 64 nt, hsa
aaaccagagcaggaaaaagaaggcacacuucuuuuggucugaagguaacccccaucaugacuag

SEQ ID NO: 666864 - RNA, 64 nt, hsa
acacagggcagucauucagcaccagagcacgugauggucugagacucucuuaggagcagagcuc

SEQ ID NO: 666865 - RNA, 64 nt, hsa
gcucugccgcaauggccauguggggauccacaccuggucugaggggcaacugagucugcgggag

SEQ ID NO: 666866 - RNA, 64 nt, hsa
uauacaguguugaaaucucaaugcaguugaaaucuggucugaugugccuaauuuaucuguggaa

SEQ ID NO: 666867 - RNA, 64 nt, hsa
aaaauucuauaauacauacuaaaauagugguuauuggucugauauaugcugcucuugguucuau

SEQ ID NO: 666868 - RNA, 64 nt, hsa; identical to SEQ ID NO: 265240

SEQ ID NO: 666869 - RNA, 64 nt, hsa; identical to SEQ ID NO: 265241

SEQ ID NO: 666870 - RNA, 64 nt, hsa; identical to SEQ ID NO: 265242

SEQ ID NO: 666871 - RNA, 64 nt, hsa; identical to SEQ ID NO: 265243

SEQ ID NO: 666872 - RNA, 64 nt, hsa; identical to SEQ ID NO: 561089

SEQ ID NO: 666873 - RNA, 64 nt, hsa; identical to SEQ ID NO: 561090

SEQ ID NO: 666874 - RNA, 64 nt, hsa; identical to SEQ ID NO: 561091

SEQ ID NO: 666875 - RNA, 64 nt, hsa; identical to SEQ ID NO: 561092

SEQ ID NO: 666876 - RNA, 64 nt, hsa; identical to SEQ ID NO: 561093

SEQ ID NO: 666877 - RNA, 64 nt, hsa; identical to SEQ ID NO: 561094

SEQ ID NO: 666878 - RNA, 64 nt, hsa; identical to SEQ ID NO: 561095

SEQ ID NO: 666879 - RNA, 64 nt, hsa; identical to SEQ ID NO: 561096

SEQ ID NO: 666880 - RNA, 64 nt, hsa; identical to SEQ ID NO: 561097

SEQ ID NO: 666881 - RNA, 64 nt, hsa; identical to SEQ ID NO: 561098

SEQ ID NO: 666882 - RNA, 64 nt, hsa; identical to SEQ ID NO: 561099

SEQ ID NO: 666883 - RNA, 64 nt, hsa; identical to SEQ ID NO: 561100

SEQ ID NO: 666884 - RNA, 64 nt, hsa; identical to SEQ ID NO: 561101

SEQ ID NO: 666885 - RNA, 64 nt, hsa; identical to SEQ ID NO: 561102

SEQ ID NO: 666886 - RNA, 64 nt, hsa; identical to SEQ ID NO: 561103

SEQ ID NO: 666887 - RNA, 64 nt, hsa; identical to SEQ ID NO: 561104

SEQ ID NO: 666888 - RNA, 64 nt, hsa; identical to SEQ ID NO: 561105

SEQ ID NO: 666889 - RNA, 64 nt, hsa; identical to SEQ ID NO: 561106

SEQ ID NO: 666890 - RNA, 64 nt, hsa; identical to SEQ ID NO: 561107

SEQ ID NO: 666891 - RNA, 64 nt, hsa; identical to SEQ ID NO: 561108

SEQ ID NO: 666892 - RNA, 64 nt, hsa; identical to SEQ ID NO: 561109

SEQ ID NO: 666893 - RNA, 64 nt, hsa; identical to SEQ ID NO: 561110

SEQ ID NO: 666894 - RNA, 64 nt, hsa; identical to SEQ ID NO: 561111

SEQ ID NO: 666895 - RNA, 64 nt, hsa; identical to SEQ ID NO: 561112

SEQ ID NO: 666896 - RNA, 64 nt, hsa; identical to SEQ ID NO: 561113

SEQ ID NO: 666897 - RNA, 64 nt, hsa; identical to SEQ ID NO: 561114

SEQ ID NO: 666898 - RNA, 64 nt, hsa; identical to SEQ ID NO: 561115

SEQ ID NO: 666899 - RNA, 64 nt, hsa; identical to SEQ ID NO: 561116

SEQ ID NO: 666900 - RNA, 64 nt, hsa; identical to SEQ ID NO: 561117

SEQ ID NO: 666901 - RNA, 64 nt, hsa; identical to SEQ ID NO: 561118

SEQ ID NO: 666902 - RNA, 64 nt, hsa; identical to SEQ ID NO: 561119

SEQ ID NO: 666903 - RNA, 64 nt, hsa; identical to SEQ ID NO: 561120

SEQ ID NO: 666904 - RNA, 64 nt, hsa; identical to SEQ ID NO: 561121

SEQ ID NO: 666905 - RNA, 64 nt, hsa; identical to SEQ ID NO: 561122

SEQ ID NO: 666906 - RNA, 64 nt, hsa; identical to SEQ ID NO: 561123

SEQ ID NO: 666907 - RNA, 64 nt, hsa; identical to SEQ ID NO: 561124

SEQ ID NO: 666908 - RNA, 64 nt, hsa; identical to SEQ ID NO: 561125

SEQ ID NO: 666909 - RNA, 64 nt, hsa; identical to SEQ ID NO: 561126

SEQ ID NO: 666910 - RNA, 64 nt, hsa; identical to SEQ ID NO: 561127

SEQ ID NO: 666911 - RNA, 64 nt, hsa; identical to SEQ ID NO: 561128

SEQ ID NO: 666912 - RNA, 64 nt, hsa; identical to SEQ ID NO: 561129

SEQ ID NO: 666913 - RNA, 64 nt, hsa; identical to SEQ ID NO: 561130

SEQ ID NO: 666914 - RNA, 64 nt, hsa; identical to SEQ ID NO: 561131

SEQ ID NO: 666915 - RNA, 64 nt, hsa; identical to SEQ ID NO: 561132

SEQ ID NO: 666916 - RNA, 64 nt, hsa; identical to SEQ ID NO: 561133

SEQ ID NO: 666917 - RNA, 64 nt, hsa; identical to SEQ ID NO: 561134

SEQ ID NO: 666918 - RNA, 64 nt, hsa; identical to SEQ ID NO: 561135

SEQ ID NO: 666919 - RNA, 64 nt, hsa; identical to SEQ ID NO: 561136

SEQ ID NO: 666920 - RNA, 64 nt, hsa; identical to SEQ ID NO: 561137

SEQ ID NO: 666921 - RNA, 64 nt, hsa; identical to SEQ ID NO: 561138

SEQ ID NO: 666922 - RNA, 64 nt, hsa; identical to SEQ ID NO: 561139

SEQ ID NO: 666923 - RNA, 64 nt, hsa; identical to SEQ ID NO: 561140

SEQ ID NO: 666924 - RNA, 64 nt, hsa; identical to SEQ ID NO: 561141

SEQ ID NO: 666925 - RNA, 64 nt, hsa; identical to SEQ ID NO: 561142

SEQ ID NO: 666926 - RNA, 64 nt, hsa; identical to SEQ ID NO: 561143

SEQ ID NO: 666927 - RNA, 64 nt, hsa; identical to SEQ ID NO: 561144

SEQ ID NO: 666928 - RNA, 64 nt, hsa; identical to SEQ ID NO: 561145

SEQ ID NO: 666929 - RNA, 64 nt, hsa; identical to SEQ ID NO: 561146

SEQ ID NO: 666930 - RNA, 64 nt, hsa; identical to SEQ ID NO: 561147

SEQ ID NO: 666931 - RNA, 64 nt, hsa; identical to SEQ ID NO: 561148

SEQ ID NO: 666932 - RNA, 64 nt, hsa; identical to SEQ ID NO: 561149

SEQ ID NO: 666933 - RNA, 64 nt, hsa; identical to SEQ ID NO: 561150

SEQ ID NO: 666934 - RNA, 64 nt, hsa; identical to SEQ ID NO: 561151

SEQ ID NO: 666935 - RNA, 64 nt, hsa; identical to SEQ ID NO: 561152

SEQ ID NO: 666936 - RNA, 64 nt, hsa; identical to SEQ ID NO: 561153

SEQ ID NO: 666937 - RNA, 64 nt, hsa; identical to SEQ ID NO: 561154

SEQ ID NO: 666938 - RNA, 64 nt, hsa; identical to SEQ ID NO: 561155

SEQ ID NO: 666939 - RNA, 64 nt, hsa; identical to SEQ ID NO: 561156

SEQ ID NO: 666940 - RNA, 64 nt, hsa; identical to SEQ ID NO: 561157

SEQ ID NO: 666941 - RNA, 64 nt, hsa; identical to SEQ ID NO: 561158

SEQ ID NO: 666942 - RNA, 64 nt, hsa; identical to SEQ ID NO: 561159

SEQ ID NO: 666943 - RNA, 64 nt, hsa; identical to SEQ ID NO: 561160

SEQ ID NO: 666944 - RNA, 64 nt, hsa; identical to SEQ ID NO: 561161

SEQ ID NO: 666945 - RNA, 64 nt, hsa; identical to SEQ ID NO: 561162

SEQ ID NO: 666946 - RNA, 64 nt, hsa; identical to SEQ ID NO: 561163

SEQ ID NO: 666947 - RNA, 64 nt, hsa; identical to SEQ ID NO: 561164

SEQ ID NO: 666948 - RNA, 64 nt, hsa; identical to SEQ ID NO: 561165

SEQ ID NO: 666949 - RNA, 64 nt, hsa; identical to SEQ ID NO: 561166

SEQ ID NO: 666950 - RNA, 64 nt, hsa; identical to SEQ ID NO: 561167

SEQ ID NO: 666951 - RNA, 64 nt, hsa; identical to SEQ ID NO: 561168

SEQ ID NO: 666952 - RNA, 64 nt, hsa; identical to SEQ ID NO: 561169

SEQ ID NO: 666953 - RNA, 64 nt, hsa; identical to SEQ ID NO: 561170

SEQ ID NO: 666954 - RNA, 64 nt, hsa; identical to SEQ ID NO: 561171

SEQ ID NO: 666955 - RNA, 64 nt, hsa; identical to SEQ ID NO: 561172

SEQ ID NO: 666956 - RNA, 64 nt, hsa; identical to SEQ ID NO: 561173

SEQ ID NO: 666957 - RNA, 64 nt, hsa; identical to SEQ ID NO: 561174

SEQ ID NO: 666958 - RNA, 64 nt, hsa; identical to SEQ ID NO: 561175

SEQ ID NO: 666959 - RNA, 64 nt, hsa; identical to SEQ ID NO: 561176

SEQ ID NO: 666960 - RNA, 64 nt, hsa; identical to SEQ ID NO: 561177

SEQ ID NO: 666961 - RNA, 64 nt, hsa; identical to SEQ ID NO: 561178

SEQ ID NO: 666962 - RNA, 64 nt, hsa; identical to SEQ ID NO: 561179

SEQ ID NO: 666963 - RNA, 64 nt, hsa; identical to SEQ ID NO: 561180

SEQ ID NO: 666964 - RNA, 64 nt, hsa; identical to SEQ ID NO: 561181

SEQ ID NO: 666965 - RNA, 64 nt, hsa; identical to SEQ ID NO: 561182

SEQ ID NO: 666966 - RNA, 64 nt, hsa; identical to SEQ ID NO: 561183

SEQ ID NO: 666967 - RNA, 64 nt, hsa; identical to SEQ ID NO: 561184

SEQ ID NO: 666968 - RNA, 64 nt, hsa; identical to SEQ ID NO: 561185

SEQ ID NO: 666969 - RNA, 64 nt, hsa; identical to SEQ ID NO: 561186

SEQ ID NO: 666970 - RNA, 64 nt, hsa; identical to SEQ ID NO: 561187

SEQ ID NO: 666971 - RNA, 64 nt, hsa; identical to SEQ ID NO: 561188

SEQ ID NO: 666972 - RNA, 64 nt, hsa; identical to SEQ ID NO: 561189

SEQ ID NO: 666973 - RNA, 64 nt, hsa; identical to SEQ ID NO: 561190

SEQ ID NO: 666974 - RNA, 64 nt, hsa; identical to SEQ ID NO: 561191

SEQ ID NO: 666975 - RNA, 64 nt, hsa; identical to SEQ ID NO: 561192

SEQ ID NO: 666976 - RNA, 64 nt, hsa; identical to SEQ ID NO: 561193

SEQ ID NO: 666977 - RNA, 64 nt, hsa; identical to SEQ ID NO: 561194

SEQ ID NO: 666978 - RNA, 64 nt, hsa; identical to SEQ ID NO: 561195

SEQ ID NO: 666979 - RNA, 64 nt, hsa; identical to SEQ ID NO: 561196

SEQ ID NO: 666980 - RNA, 64 nt, hsa; identical to SEQ ID NO: 561197

SEQ ID NO: 666981 - RNA, 64 nt, hsa; identical to SEQ ID NO: 561198

SEQ ID NO: 666982 - RNA, 64 nt, hsa; identical to SEQ ID NO: 561199

SEQ ID NO: 666983 - RNA, 64 nt, hsa
uugagaacacacucgugugugcacauaaagacacgcagauuacauuugauaaauguuacacaga

SEQ ID NO: 666984 - RNA, 64 nt, hsa
ugucagaauaaauuccugguggucagaugaaagggcagauuaaauggacucaucaggguaagag

SEQ ID NO: 666985 - RNA, 64 nt, hsa
aauuuauugguguuucuaacuuaaaaguaagacugcagauuaucccccaccagccuuaguccag

SEQ ID NO: 666986 - RNA, 64 nt, hsa
guuucauguuaguaaauucacuuguucuugggaagcagauuaaguagcagaaaguccaggaaag

SEQ ID NO: 666987 - RNA, 61 nt, hsa
gagccuugcuggacaagugguuuguuugugugcaaaccaaacuuucuuuacccagugcaau

SEQ ID NO: 666988 - RNA, 61 nt, hsa
aucagucaucucuuuauggugacuucccuuugcaaaccaggcugugaccaacacaugugag

SEQ ID NO: 666989 - RNA, 61 nt, hsa
uuucacauuaaauggugugaagcguuguuuggcaaaccaacagcuuuggcuucuggugugg

SEQ ID NO: 666990 - RNA, 61 nt, hsa
uuuaaaacaaacaaacaaacaaaacaaaaaagcaaaccacauuuguuaucucaaauuuuga

SEQ ID NO: 666991 - RNA, 61 nt, hsa
ggcuuuguuagcacuuucaaaaaaaaaaaaagcaaaccauacuuguccacuguccugugcu

SEQ ID NO: 666992 - RNA, 64 nt, hsa; identical to SEQ ID NO: 486861

SEQ ID NO: 666993 - RNA, 64 nt, hsa; identical to SEQ ID NO: 486862

SEQ ID NO: 666994 - RNA, 64 nt, hsa; identical to SEQ ID NO: 486863

SEQ ID NO: 666995 - RNA, 64 nt, hsa; identical to SEQ ID NO: 486864

SEQ ID NO: 666996 - RNA, 64 nt, hsa; identical to SEQ ID NO: 486865

SEQ ID NO: 666997 - RNA, 64 nt, hsa; identical to SEQ ID NO: 486866

SEQ ID NO: 666998 - RNA, 64 nt, hsa; identical to SEQ ID NO: 486867

SEQ ID NO: 666999 - RNA, 64 nt, hsa; identical to SEQ ID NO: 486868

SEQ ID NO: 667000 - RNA, 64 nt, hsa; identical to SEQ ID NO: 486869

SEQ ID NO: 667001 - RNA, 64 nt, hsa; identical to SEQ ID NO: 486870

SEQ ID NO: 667002 - RNA, 64 nt, hsa; identical to SEQ ID NO: 486871

SEQ ID NO: 667003 - RNA, 64 nt, hsa; identical to SEQ ID NO: 486872

SEQ ID NO: 667004 - RNA, 64 nt, hsa; identical to SEQ ID NO: 486873

SEQ ID NO: 667005 - RNA, 64 nt, hsa; identical to SEQ ID NO: 486874

SEQ ID NO: 667006 - RNA, 64 nt, hsa; identical to SEQ ID NO: 486875

SEQ ID NO: 667007 - RNA, 64 nt, hsa; identical to SEQ ID NO: 486876

SEQ ID NO: 667008 - RNA, 64 nt, hsa; identical to SEQ ID NO: 486877

SEQ ID NO: 667009 - RNA, 64 nt, hsa; identical to SEQ ID NO: 486878

SEQ ID NO: 667010 - RNA, 64 nt, hsa; identical to SEQ ID NO: 486879

SEQ ID NO: 667011 - RNA, 64 nt, hsa; identical to SEQ ID NO: 486880

SEQ ID NO: 667012 - RNA, 64 nt, hsa; identical to SEQ ID NO: 486881

SEQ ID NO: 667013 - RNA, 64 nt, hsa; identical to SEQ ID NO: 486882

SEQ ID NO: 667014 - RNA, 64 nt, hsa; identical to SEQ ID NO: 486883

SEQ ID NO: 667015 - RNA, 64 nt, hsa; identical to SEQ ID NO: 486884

SEQ ID NO: 667016 - RNA, 64 nt, hsa; identical to SEQ ID NO: 486885

SEQ ID NO: 667017 - RNA, 64 nt, hsa; identical to SEQ ID NO: 486886

SEQ ID NO: 667018 - RNA, 64 nt, hsa
auaucuccuuuucugagcucuaagaauuaucagaaacaggaaagaauuuagaaaaacuugagaa

SEQ ID NO: 667019 - RNA, 64 nt, hsa
guaauccugcugauccaguuguacuuaaguguguaacaggaauauuuugcagaauauagguuua

SEQ ID NO: 667020 - RNA, 64 nt, hsa
cugaacaggagaaagacaaacagaaagaauagagaacaggaacgagguggagagcaagacugac

SEQ ID NO: 667021 - RNA, 64 nt, hsa
gauccuccucuuugggaguccagugucuuugaaaaacaggaaccguguuuuuuuuuuuuuuuuu

SEQ ID NO: 667022 - RNA, 64 nt, hsa
gaagaccagaucauggguggucugcaugugaaugaacaggaaugagccggacagccuggcuguc

SEQ ID NO: 667023 - RNA, 64 nt, hsa
aaaggucuuugaggguuccuaggcuccuuuguacaacaggaaaaugccucaaagccuugcuucc

SEQ ID NO: 667024 - RNA, 64 nt, hsa
caccugagaggcagacagaucaaaccaaacaggaaacaggaaaugcauguuugaucuguuguca

SEQ ID NO: 667025 - RNA, 64 nt, hsa
uauaagucaccugagaggcagacagaucaaaccaaacaggaaacaggaaaugcauguuugaucu

SEQ ID NO: 667026 - RNA, 64 nt, hsa
uuaccugaacaaccaugagcgcuccagugaacagaacaggaaucugaugaacaagcuggugaau

SEQ ID NO: 667027 - RNA, 64 nt, hsa
agugauuuuuuuaaaaaaaagucuucuguuuauuaacaggaaaauuuauuuauuugacaggauu

SEQ ID NO: 667028 - RNA, 64 nt, hsa
gcacuuagcuagaaccucauuuuuaaagauuaacaacaggaaauaaauuguaaaaaagguuuuc

SEQ ID NO: 667029 - RNA, 64 nt, hsa
ccuuucuguuaauagucaucacauuucuaugccaaacaggaacaauccauaacuuuagucuuaa

SEQ ID NO: 667030 - RNA, 64 nt, hsa
uguucuccuacagaaaagugauucugugagggugaacaggaaaugccuuguggaaacaggaagu

SEQ ID NO: 667031 - RNA, 64 nt, hsa
auucugugagggugaacaggaaaugccuuguggaaacaggaaguccaagugauucauguacuga

SEQ ID NO: 667032 - RNA, 64 nt, hsa
uuaucuuuugagaacuuuugguaagggaaaagggaacaggaaaagaaaccccaaacucaggccg

SEQ ID NO: 667033 - RNA, 64 nt, hsa
gagcccuguaucaacccagaaacaccuagaucagaacaggaauccacauugccagugacaugag

SEQ ID NO: 667034 - RNA, 64 nt, hsa
ccuuagaaaagacaauaaaugcacaaaagauauaaacaggaacagcaaauauuuauauuuuuuc

SEQ ID NO: 667035 - RNA, 64 nt, hsa
aaguugagacaaaccaggcagauucaguguguggaacaggaaggaugugcuuuaaaaaaaggug

SEQ ID NO: 667036 - RNA, 64 nt, hsa
aggaaucuauuaaggucaauauuaauaacacugaaacaggaaaucuaacucccaauauuggaau

SEQ ID NO: 667037 - RNA, 64 nt, hsa
guuuucuuacuguuuaauuuauuuuuauuguuugaacaggaagugaacauagucguuuccaaca

SEQ ID NO: 667038 - RNA, 64 nt, hsa
ugccuucauccaggacaggaaguagcacuucugaaacaggaaguggucuggcuggaacuccaag

SEQ ID NO: 667039 - RNA, 64 nt, hsa
uccuuccugauuuuucuaaucgcuccuucuggggaacaggaaguugauauugccaugguggcgg

SEQ ID NO: 667040 - RNA, 64 nt, hsa
aacaucuccacccaagacgucuuuggaauccaagaacaggaagccaagagagugagcagggagg

SEQ ID NO: 667041 - RNA, 64 nt, hsa
uccugguuccuccgccacucuuccucuuggggacaacaggaagugucugauuccagucugccua

SEQ ID NO: 667042 - RNA, 64 nt, hsa
ggacaggaagcugauagaaagugaacaggaagcaaacaggaagugagcaaggggccacuuccua

SEQ ID NO: 667043 - RNA, 64 nt, hsa
ugucuggcaagggacaggaagcugauagaaagugaacaggaagcaaacaggaagugagcaaggg

SEQ ID NO: 667044 - RNA, 64 nt, hsa
uccagggaggccuggccuggaggaggaguccacuaacaggaaacacuucucacccccucacaca

SEQ ID NO: 667045 - RNA, 64 nt, hsa
ggggagccccuggagggaaauuccuuggcaggggaacaggaaauguggccgccucugccccacu

SEQ ID NO: 667046 - RNA, 64 nt, hsa
aaucaaaccuuggcacacaggugugauacaacuuaacaggaaucaucgauucauccauaaauaa

SEQ ID NO: 667047 - RNA, 64 nt, hsa
gcuaguguugauguuuuuuggucaagaggguaugaacaggaagaauuaaaugcagcaggcuuua

SEQ ID NO: 667048 - RNA, 64 nt, hsa; identical to SEQ ID NO: 443640

SEQ ID NO: 667049 - RNA, 64 nt, hsa; identical to SEQ ID NO: 443641

SEQ ID NO: 667050 - RNA, 64 nt, hsa; identical to SEQ ID NO: 443642

SEQ ID NO: 667051 - RNA, 64 nt, hsa; identical to SEQ ID NO: 443643

SEQ ID NO: 667052 - RNA, 64 nt, hsa; identical to SEQ ID NO: 443644

SEQ ID NO: 667053 - RNA, 64 nt, hsa; identical to SEQ ID NO: 443645

SEQ ID NO: 667054 - RNA, 64 nt, hsa; identical to SEQ ID NO: 443646

SEQ ID NO: 667055 - RNA, 64 nt, hsa; identical to SEQ ID NO: 443647

SEQ ID NO: 667056 - RNA, 56 nt, hsa; identical to SEQ ID NO: 443648

SEQ ID NO: 667057 - RNA, 64 nt, hsa; identical to SEQ ID NO: 443649

SEQ ID NO: 667058 - RNA, 64 nt, hsa; identical to SEQ ID NO: 443650

SEQ ID NO: 667059 - RNA, 64 nt, hsa; identical to SEQ ID NO: 443651

SEQ ID NO: 667060 - RNA, 64 nt, hsa; identical to SEQ ID NO: 443652

SEQ ID NO: 667061 - RNA, 64 nt, hsa; identical to SEQ ID NO: 443653

SEQ ID NO: 667062 - RNA, 64 nt, hsa; identical to SEQ ID NO: 443654

SEQ ID NO: 667063 - RNA, 64 nt, hsa; identical to SEQ ID NO: 443655

SEQ ID NO: 667064 - RNA, 64 nt, hsa; identical to SEQ ID NO: 443656

SEQ ID NO: 667065 - RNA, 64 nt, hsa; identical to SEQ ID NO: 443657

SEQ ID NO: 667066 - RNA, 64 nt, hsa; identical to SEQ ID NO: 443658

SEQ ID NO: 667067 - RNA, 64 nt, hsa; identical to SEQ ID NO: 443659

SEQ ID NO: 667068 - RNA, 64 nt, hsa; identical to SEQ ID NO: 443660

SEQ ID NO: 667069 - RNA, 64 nt, hsa; identical to SEQ ID NO: 443661

SEQ ID NO: 667070 - RNA, 64 nt, hsa; identical to SEQ ID NO: 443662

SEQ ID NO: 667071 - RNA, 64 nt, hsa; identical to SEQ ID NO: 443663

SEQ ID NO: 667072 - RNA, 64 nt, hsa; identical to SEQ ID NO: 443664

SEQ ID NO: 667073 - RNA, 64 nt, hsa; identical to SEQ ID NO: 443665

SEQ ID NO: 667074 - RNA, 64 nt, hsa; identical to SEQ ID NO: 443666

SEQ ID NO: 667075 - RNA, 64 nt, hsa; identical to SEQ ID NO: 443667

SEQ ID NO: 667076 - RNA, 64 nt, hsa; identical to SEQ ID NO: 443668

SEQ ID NO: 667077 - RNA, 64 nt, hsa; identical to SEQ ID NO: 443669

SEQ ID NO: 667078 - RNA, 64 nt, hsa; identical to SEQ ID NO: 443670

SEQ ID NO: 667079 - RNA, 64 nt, hsa; identical to SEQ ID NO: 443671

SEQ ID NO: 667080 - RNA, 64 nt, hsa; identical to SEQ ID NO: 443672

SEQ ID NO: 667081 - RNA, 64 nt, hsa; identical to SEQ ID NO: 443673

SEQ ID NO: 667082 - RNA, 64 nt, hsa; identical to SEQ ID NO: 443674

SEQ ID NO: 667083 - RNA, 64 nt, hsa; identical to SEQ ID NO: 443675

SEQ ID NO: 667084 - RNA, 64 nt, hsa; identical to SEQ ID NO: 443676

SEQ ID NO: 667085 - RNA, 64 nt, hsa; identical to SEQ ID NO: 443677

SEQ ID NO: 667086 - RNA, 64 nt, hsa; identical to SEQ ID NO: 443678

SEQ ID NO: 667087 - RNA, 64 nt, hsa; identical to SEQ ID NO: 443679

SEQ ID NO: 667088 - RNA, 64 nt, hsa; identical to SEQ ID NO: 443680

SEQ ID NO: 667089 - RNA, 64 nt, hsa; identical to SEQ ID NO: 443681

SEQ ID NO: 667090 - RNA, 64 nt, hsa; identical to SEQ ID NO: 443682

SEQ ID NO: 667091 - RNA, 64 nt, hsa; identical to SEQ ID NO: 443683

SEQ ID NO: 667092 - RNA, 64 nt, hsa; identical to SEQ ID NO: 443684

SEQ ID NO: 667093 - RNA, 64 nt, hsa; identical to SEQ ID NO: 443685

SEQ ID NO: 667094 - RNA, 64 nt, hsa; identical to SEQ ID NO: 443686

SEQ ID NO: 667095 - RNA, 64 nt, hsa; identical to SEQ ID NO: 443687

SEQ ID NO: 667096 - RNA, 64 nt, hsa; identical to SEQ ID NO: 443688

SEQ ID NO: 667097 - RNA, 64 nt, hsa; identical to SEQ ID NO: 443689

SEQ ID NO: 667098 - RNA, 64 nt, hsa; identical to SEQ ID NO: 443690

SEQ ID NO: 667099 - RNA, 64 nt, hsa; identical to SEQ ID NO: 443691

SEQ ID NO: 667100 - RNA, 64 nt, hsa; identical to SEQ ID NO: 443692

SEQ ID NO: 667101 - RNA, 64 nt, hsa; identical to SEQ ID NO: 443693

SEQ ID NO: 667102 - RNA, 64 nt, hsa; identical to SEQ ID NO: 443694

SEQ ID NO: 667103 - RNA, 64 nt, hsa; identical to SEQ ID NO: 443695

SEQ ID NO: 667104 - RNA, 64 nt, hsa; identical to SEQ ID NO: 443696

SEQ ID NO: 667105 - RNA, 64 nt, hsa; identical to SEQ ID NO: 443697

SEQ ID NO: 667106 - RNA, 64 nt, hsa; identical to SEQ ID NO: 443698

SEQ ID NO: 667107 - RNA, 64 nt, hsa; identical to SEQ ID NO: 443699

SEQ ID NO: 667108 - RNA, 64 nt, hsa; identical to SEQ ID NO: 443700

SEQ ID NO: 667109 - RNA, 64 nt, hsa; identical to SEQ ID NO: 443701

SEQ ID NO: 667110 - RNA, 64 nt, hsa; identical to SEQ ID NO: 443702

SEQ ID NO: 667111 - RNA, 64 nt, hsa; identical to SEQ ID NO: 443703

SEQ ID NO: 667112 - RNA, 64 nt, hsa; identical to SEQ ID NO: 443704

SEQ ID NO: 667113 - RNA, 64 nt, hsa; identical to SEQ ID NO: 443705

SEQ ID NO: 667114 - RNA, 64 nt, hsa; identical to SEQ ID NO: 443706

SEQ ID NO: 667115 - RNA, 64 nt, hsa; identical to SEQ ID NO: 443707

SEQ ID NO: 667116 - RNA, 64 nt, hsa; identical to SEQ ID NO: 443708

SEQ ID NO: 667117 - RNA, 64 nt, hsa; identical to SEQ ID NO: 443709

SEQ ID NO: 667118 - RNA, 64 nt, hsa; identical to SEQ ID NO: 443710

SEQ ID NO: 667119 - RNA, 64 nt, hsa; identical to SEQ ID NO: 443711

SEQ ID NO: 667120 - RNA, 64 nt, hsa; identical to SEQ ID NO: 443712

SEQ ID NO: 667121 - RNA, 64 nt, hsa; identical to SEQ ID NO: 443713

SEQ ID NO: 667122 - RNA, 64 nt, hsa; identical to SEQ ID NO: 443714

SEQ ID NO: 667123 - RNA, 64 nt, hsa; identical to SEQ ID NO: 443715

SEQ ID NO: 667124 - RNA, 64 nt, hsa; identical to SEQ ID NO: 443716

SEQ ID NO: 667125 - RNA, 64 nt, hsa; identical to SEQ ID NO: 443717

SEQ ID NO: 667126 - RNA, 64 nt, hsa; identical to SEQ ID NO: 443718

SEQ ID NO: 667127 - RNA, 64 nt, hsa; identical to SEQ ID NO: 443719

SEQ ID NO: 667128 - RNA, 64 nt, hsa; identical to SEQ ID NO: 443720

SEQ ID NO: 667129 - RNA, 64 nt, hsa; identical to SEQ ID NO: 443721

SEQ ID NO: 667130 - RNA, 64 nt, hsa; identical to SEQ ID NO: 443722

SEQ ID NO: 667131 - RNA, 64 nt, hsa; identical to SEQ ID NO: 443723

SEQ ID NO: 667132 - RNA, 64 nt, hsa; identical to SEQ ID NO: 443724

SEQ ID NO: 667133 - RNA, 64 nt, hsa; identical to SEQ ID NO: 443725

SEQ ID NO: 667134 - RNA, 64 nt, hsa; identical to SEQ ID NO: 443726

SEQ ID NO: 667135 - RNA, 64 nt, hsa; identical to SEQ ID NO: 443727

SEQ ID NO: 667136 - RNA, 64 nt, hsa; identical to SEQ ID NO: 443728

SEQ ID NO: 667137 - RNA, 64 nt, hsa; identical to SEQ ID NO: 443729

SEQ ID NO: 667138 - RNA, 64 nt, hsa; identical to SEQ ID NO: 443730

SEQ ID NO: 667139 - RNA, 64 nt, hsa; identical to SEQ ID NO: 443731

SEQ ID NO: 667140 - RNA, 64 nt, hsa; identical to SEQ ID NO: 443732

SEQ ID NO: 667141 - RNA, 64 nt, hsa; identical to SEQ ID NO: 443733

SEQ ID NO: 667142 - RNA, 64 nt, hsa; identical to SEQ ID NO: 443734

SEQ ID NO: 667143 - RNA, 64 nt, hsa; identical to SEQ ID NO: 443735

SEQ ID NO: 667144 - RNA, 64 nt, hsa; identical to SEQ ID NO: 443736

SEQ ID NO: 667145 - RNA, 64 nt, hsa; identical to SEQ ID NO: 443737

SEQ ID NO: 667146 - RNA, 64 nt, hsa; identical to SEQ ID NO: 443738

SEQ ID NO: 667147 - RNA, 64 nt, hsa; identical to SEQ ID NO: 443739

SEQ ID NO: 667148 - RNA, 58 nt, hsa
gggcgcucccgacacagcgcagacccaccaggaggaaagaggcccagcucucagcuga

SEQ ID NO: 667149 - RNA, 58 nt, hsa
cugcgggcugcccugugggcuggugcuucaggaggaauccagagaaguguucagaugc

SEQ ID NO: 667150 - RNA, 58 nt, hsa
ccccagcugaccagaaccaggcugagcgcaggaggacaggcaccaccggaugccacac

SEQ ID NO: 667151 - RNA, 58 nt, hsa
gacaggcaccaccggaugccacaccaggcaggaggagguguggacagugaugguacgg

SEQ ID NO: 667152 - RNA, 58 nt, hsa
guggucccagcuacucaggaggcugaggcaggaggaucacuugagcacaggaguuuga

SEQ ID NO: 667153 - RNA, 58 nt, hsa
aggcugaggcagguggaucaccugaggucaggaggaguucaagaccagccuggccaac

SEQ ID NO: 667154 - RNA, 58 nt, hsa
ggaggaagggggagucauuuauauucugcaggaggaaggggccccagcugucgccuuu

SEQ ID NO: 667155 - RNA, 58 nt, hsa
ucugacugcaguguagggaauaggucaccaggaggagcccuucauccuggcaggccgg

SEQ ID NO: 667156 - RNA, 58 nt, hsa
guaaucccgacacuuugggaggccaaggcaggaggauggcuugaagccaguaguucaa

SEQ ID NO: 667157 - RNA, 58 nt, hsa
guaguccuagcuacuugggaggcugaggcaggaggaucccuugaguccaggagguuga

SEQ ID NO: 667158 - RNA, 58 nt, hsa
ucccuccccuccuuuucagguaaggagacaggaggaguaggaggaggcagggccucuc

SEQ ID NO: 667159 - RNA, 58 nt, hsa
aauacuugaaccuucucccagguaggggcaggaggagccacaugagagagggagaagg

SEQ ID NO: 667160 - RNA, 58 nt, hsa
guagacacuaaaccucaugcccuaaggacaggaggaaagacccucuguuuggagcauu

SEQ ID NO: 667161 - RNA, 58 nt, hsa
ggguggacauaaaugagucaagugacaacaggaggaaauagacuuagacgaaagaaag

SEQ ID NO: 667162 - RNA, 58 nt, hsa
ucucgggguugucugcaggagagcaagccaggaggacaugggccuggacgacacggcc

SEQ ID NO: 667163 - RNA, 58 nt, hsa
cauccugugaagggacacagagaacaggcaggaggaaaggcaggagccaguccgugca

SEQ ID NO: 667164 - RNA, 58 nt, hsa
uauagucccacuacuuguggggcuaaggcaggaggaucacuugagccccggaggucga

SEQ ID NO: 667165 - RNA, 58 nt, hsa
guaauccuugcauuuuggaaggcugaggcaggaggaucacuuuaggccugguguguuc

SEQ ID NO: 667166 - RNA, 58 nt, hsa
cugucaucacauccccugggaggggaggcaggaggaggccgagggccccaggaugucu

SEQ ID NO: 667167 - RNA, 58 nt, hsa
gacagcguggugagccguggccggacggcaggaggagaggggagcccccucuggcugu

SEQ ID NO: 667168 - RNA, 58 nt, hsa
aucccaacacuuuguugggaggccaaagcaggaggauagcuugaggccaggaguucca

SEQ ID NO: 667169 - RNA, 58 nt, hsa
guguucccagcuacucaggaggcugaagcaggaggauagcuugagcccaggaguuuga

SEQ ID NO: 667170 - RNA, 58 nt, hsa
ccauacauuccucccugcuccccacugccaggaggaccacuguccccagccagccaaa

SEQ ID NO: 667171 - RNA, 58 nt, hsa
ccaugcgcuuccagggccccacgguccccaggaggacgcuuccuggccaaagccccaa

SEQ ID NO: 667172 - RNA, 58 nt, hsa
gaguaggagagaccaugaguauguguaacaggaggacacagcauuauucuagugcugu

SEQ ID NO: 667173 - RNA, 58 nt, hsa
agcauuuguucauuuggagcuuagaguccaggaggaauacauuagauaaugacacaau

SEQ ID NO: 667174 - RNA, 58 nt, hsa
acuccuggcucuguucagggaggcugcccaggaggaagacuggccauuaugcaucccc

SEQ ID NO: 667175 - RNA, 58 nt, hsa
agguacuauucguaggcaguguagacagcaggaggagcaccgggcuugggcuuccucu

SEQ ID NO: 667176 - RNA, 58 nt, hsa
guccucacccccaccucucuaaaagacacaggaggaugacacagaaacaccguaagug

SEQ ID NO: 667177 - RNA, 58 nt, hsa
guggucccagcuguucaggaggaugaggcaggaggaucucuugagcccaggaggucaa

SEQ ID NO: 667178 - RNA, 58 nt, hsa
guggcucaugcuuguggucccagcuguucaggaggaugaggcaggaggaucucuugag

SEQ ID NO: 667179 - RNA, 58 nt, hsa
uggcagccugggcaaaccgggugagcaacaggaggacgaggggccggggcggugccag

SEQ ID NO: 667180 - RNA, 58 nt, hsa
aaucuagcgaguccauggagcugagcagcaggaggaggagccgugacccuguggaagg

SEQ ID NO: 667181 - RNA, 58 nt, hsa
uuuugauaucauuuggcuuauaaauccacaggaggagauaauguauggaaaacauuua

SEQ ID NO: 667182 - RNA, 58 nt, hsa
auagucccagcuacuugagaggcugaggcaggaggauuguugagcccaggaguuugag

SEQ ID NO: 667183 - RNA, 58 nt, hsa
gcagucccagcuacucaggaggcugaggcaggaggaucacagugaccuauaaugagcc

SEQ ID NO: 667184 - RNA, 58 nt, hsa
guaaucccagcauuuuaggaggccaaggcaggaggaucacuuggagccaggaguuuga

SEQ ID NO: 667185 - RNA, 58 nt, hsa
aaggggaaggagaagagggagaauggagcaggaggaaaagcagaguuggucuagagag

SEQ ID NO: 667186 - RNA, 58 nt, hsa
ugguuuccugucacucagagcugauucacaggaggaggggagguuggggggcgggaga

SEQ ID NO: 667187 - RNA, 58 nt, hsa
uuagauuuugauauugauuuagaagacacaggaggagaccaucaaaugaauuaauauc

SEQ ID NO: 667188 - RNA, 58 nt, hsa
guaaucccagcuacucaggaggcugaggcaggaggauugcuugaacccuggaggcgga

SEQ ID NO: 667189 - RNA, 58 nt, hsa
gcacuuggcuccuggcagagggagaggacaggaggaggagccuuccccaggaggaacg

SEQ ID NO: 667190 - RNA, 58 nt, hsa
gggagaggacaggaggaggagccuuccccaggaggaacgaggagagguggccacgugg

SEQ ID NO: 667191 - RNA, 58 nt, hsa
ggcccuguucugggggagcaggguaaggcaggaggaagugggugagcuccgagaugau

SEQ ID NO: 667192 - RNA, 58 nt, hsa
uguggcucugcuggcucagugugggcugcaggaggacugcagacucagcugcaauucu

SEQ ID NO: 667193 - RNA, 58 nt, hsa
gugcugaggcgggaggauuacuugagcccaggaggauuacuucaaccugggagguuga

SEQ ID NO: 667194 - RNA, 58 nt, hsa
uguaauucuagcacuuuggaggccaaggcaggaggacugcuugagcccaggaguuuga

SEQ ID NO: 667195 - RNA, 58 nt, hsa
uuagccaugccugcuccucugccuggaccaggaggagggccccuggggcagaaguuag

SEQ ID NO: 667196 - RNA, 58 nt, hsa
ccugcagggcuggucagggugucuggggcaggaggaggccaacucacugaacuagugc

SEQ ID NO: 667197 - RNA, 58 nt, hsa
uaggccacucgagcaucagagcuuccagcaggaggaagggcuguaggaauggaagcuu

SEQ ID NO: 667198 - RNA, 58 nt, hsa
cuguagucccggccacucggggcugaggcaggaggaucacuggaaccugggagguugc

SEQ ID NO: 667199 - RNA, 58 nt, hsa
auaaucccaggacuuugggaggccaaggcaggaggaucacuugaguccagaaauucaa

SEQ ID NO: 667200 - RNA, 58 nt, hsa
gcggggauccuguuacaaaggugaaacccaggaggagaguguggaguccagagugcug

SEQ ID NO: 667201 - RNA, 58 nt, hsa
uucugccaccaucagggacaaacgggggcaggaggaaagucacugaugcccagauguu

SEQ ID NO: 667202 - RNA, 58 nt, hsa
gcaggaagcccaggaggcugaugccugccaggaggagcuggcacugaagguggaacag

SEQ ID NO: 667203 - RNA, 58 nt, hsa
ccagcugcaagaccguguaaaugagcuccaggaggaagcccaggaggcugaugccugc

SEQ ID NO: 667204 - RNA, 58 nt, hsa
cccuaggacccuaggaugccauucuugccaggaggaggaaugagagugauguuggcca

SEQ ID NO: 667205 - RNA, 58 nt, hsa
cugccuguguucucauguggauuuagaacaggaggauauucuauguguauguauaugu

SEQ ID NO: 667206 - RNA, 58 nt, hsa
gagaccagucaguacuucuuggagggggcaggaggagagaggaaaagggagggcgaga

SEQ ID NO: 667207 - RNA, 58 nt, hsa
ccacccgcgcccugggacgcagccacgccaggaggaggacacggccgccgagagcaag

SEQ ID NO: 667208 - RNA, 58 nt, hsa
agaucugaggaaggccguaaaauggggacaggaggauucagcucaggaguaagggaag

SEQ ID NO: 667209 - RNA, 58 nt, hsa
cagggcuagaagcacaggcccgucaccccaggaggaaaagcccagggucuggggcagc

SEQ ID NO: 667210 - RNA, 58 nt, hsa
gaaagagagcuucaaccucaagagggcucaggaggacaucucacggcugcggcgcaag

SEQ ID NO: 667211 - RNA, 58 nt, hsa
ggucuacgcagaugccgacgaaauccuccaggaggagaucaaggaguacaaggugggg

SEQ ID NO: 667212 - RNA, 58 nt, hsa
cagagccuuggaggacacuaagaggaggcaggaggagcaacucaaauccccaagaaca

SEQ ID NO: 667213 - RNA, 58 nt, hsa
uggcagcaugcaaacuuggaucagauagcaggaggaacuuucaaaagucuggcccacu

SEQ ID NO: 667214 - RNA, 58 nt, hsa
guagucccagguacuugggagccugaggcaggaggauugcuugagcucaggaguucaa

SEQ ID NO: 667215 - RNA, 58 nt, hsa
guagucccagcuacuagggaggcugagccaggaggaucacuugagcccgggagguuga

SEQ ID NO: 667216 - RNA, 58 nt, hsa
uauaaucgagcacuuugggaggccaagacaggaggaucacuugaggccaggagucuga

SEQ ID NO: 667217 - RNA, 58 nt, hsa
guagucccagccacucagaaggcugaggcaggaggaucgcuugagaccaagaguuuga

SEQ ID NO: 667218 - RNA, 58 nt, hsa
aagaccuugccucugugccgcggagguccaggaggaaacggggcggccgcuaggccuc

SEQ ID NO: 667219 - RNA, 58 nt, hsa
acacgcucaaugccccacgugccuucuccaggaggaacgaagcaggguuugaggguug

SEQ ID NO: 667220 - RNA, 58 nt, hsa
ggggcagcugugucaucuuucuggggcccaggaggaucugggcugguuugucugggga

SEQ ID NO: 667221 - RNA, 58 nt, hsa
auaaucccagcuguuugagaggccaaugcaggaggaugguugagcucaggaguucgag

SEQ ID NO: 667222 - RNA, 58 nt, hsa
gcaaucccagugcuuugggagacugaggcaggaggaucacuuaaggccaggaguucga

SEQ ID NO: 667223 - RNA, 58 nt, hsa
guaauccgagugcuuugggaggcugaggcaggaggaucacucgagcucaagaauucaa

SEQ ID NO: 667224 - RNA, 58 nt, hsa
ucucauguuaggccuaagaggcuuucuccaggaggauuagcuuggaguucucuauacu

SEQ ID NO: 667225 - RNA, 58 nt, hsa
aaauguaucuuauaauaaaaaggaaggacaggaggaagacaggcaaauguacuucuca

SEQ ID NO: 667226 - RNA, 58 nt, hsa
uggccgaguaggggugggggugggauggcaggaggagccgcaggaggaaggagguugu

SEQ ID NO: 667227 - RNA, 58 nt, hsa
ggugggggugggauggcaggaggagccgcaggaggaaggagguugugcagggucugga

SEQ ID NO: 667228 - RNA, 58 nt, hsa
agaagaaaaaaaccccuggccuuugggccaggaggaaucuguuacucgaauccaccca

SEQ ID NO: 667229 - RNA, 58 nt, hsa
acucugaagucacuaguccagcugggugcaggaggacuucaaguguguggacgaaaga

SEQ ID NO: 667230 - RNA, 58 nt, hsa
uugggcuccgugugggagaccggccugccaggaggacccagggcucuguaaguagaug

SEQ ID NO: 667231 - RNA, 57 nt, hsa
gggcucuguaaguagaugcauuuggguccaggaggaagcguggacaccucguaggga

SEQ ID NO: 667232 - RNA, 58 nt, hsa
agaccuagacuuaccugaaggaucuucacaggaggauaaagacguagaauuaccugaa

SEQ ID NO: 667233 - RNA, 58 nt, hsa
agacguagaauuaccugaaggaucuucacaggaggaugaagaccuagagaaaaagcga

SEQ ID NO: 667234 - RNA, 58 nt, hsa
agaccuacaauuaccugaaggaucuucacaggaggaugaagaccuaggguuaucugaa

SEQ ID NO: 667235 - RNA, 58 nt, hsa
ccaagaggaggaggacgaaggauccucacaggaggaugaagaccuagacucaucugca

SEQ ID NO: 667236 - RNA, 64 nt, hsa
uucagugugugucauaacgacgucacugcuuuuuaaacucgauaacucuuuauuuuaguaaaau

SEQ ID NO: 667237 - RNA, 64 nt, hsa
uucauuauuuauuuuaccuuuuacugacaaugugaaacucgaagaaaauguucucuuuuuaaau

SEQ ID NO: 667238 - RNA, 64 nt, hsa
agugcucugucugaggauguguauaugcauaugcaaacucgacccccguuccugcccagauaau

SEQ ID NO: 667239 - RNA, 64 nt, hsa
guguauuuccccuuaauuaggaugcauguugauuaaacucgagauacagcuuuuugcaguaugg

SEQ ID NO: 667240 - RNA, 64 nt, hsa
ccgagaucaugccacugcacugggcaacagagcaaaacucgaucucaaaaaaaaaaaaaaaaaa

SEQ ID NO: 667241 - RNA, 64 nt, hsa
caaucuggauaauuuguacugcuaaaguuuuaauaaacucgacaugagaaaaacacuuuggugu

SEQ ID NO: 667242 - RNA, 64 nt, hsa
ugugccacaauagcaguucuggaaugaagcuaggaaacucgagugugcuuuuuguuuaaugagc

SEQ ID NO: 667243 - RNA, 64 nt, hsa
agacagaugacggcugcucgaagaacaaugucagaaacucgaugaauguguugauuugagaaau

SEQ ID NO: 667244 - RNA, 64 nt, hsa
cauggagucucacuggccaagaaaauugccuuuaaaacucgaaaauaaggccagguguggugac

SEQ ID NO: 667245 - RNA, 63 nt, hsa
caacacaaccagcagagugacacauacuaucuaaaacucgaccaaaugagguucuucucuguu

SEQ ID NO: 667246 - RNA, 64 nt, hsa
ggccuggggcgagcacugugagcaccugagcaugaaacucgacgcguucuucggcaucuucuuu

SEQ ID NO: 667247 - RNA, 64 nt, hsa
ucuuucaccccuuaccccaaagagaaagaguuugaaacucgagaccauaaagauauucuuuagu

SEQ ID NO: 667248 - RNA, 64 nt, hsa
uccaaaguuugggcuagaagugaggagaaucccuaaacucgagguggugugcccagacccacag

SEQ ID NO: 667249 - RNA, 64 nt, hsa
cuggcagugcgugucccguggggugugcauuuuaaaacucgauucauagacacagguaccaugu

SEQ ID NO: 667250 - RNA, 64 nt, hsa
ggaccaagacagaacucaagaaagccacuggggaaaacucgagaagaaagggaguauacuagua

SEQ ID NO: 667251 - RNA, 64 nt, hsa
ggaugggggaaaaauugacaucuuuauuuuugcuaaacucgaucuaaaguuuagcauuuccauc

SEQ ID NO: 667252 - RNA, 64 nt, hsa
aacaccgacagcuguaaaauguucuaagauaaaaaaacucgagcuacaaagaaagaaugaacua

SEQ ID NO: 667253 - RNA, 64 nt, hsa
cuuugcugucuugcucaagcuugguauggcaugaaaacucgacuuuauuccaaaaguaacuuca

SEQ ID NO: 667254 - RNA, 64 nt, hsa
uuuuacaccauacuguuaagaguccuuuugaauuaaacucgacuaaaacaaguguauaacuaaa

SEQ ID NO: 667255 - RNA, 64 nt, hsa
cauaccucucagaaaaaguguuuggguaucuuaaaaacucgaaaaacaaugauaaauuucucag

SEQ ID NO: 667256 - RNA, 64 nt, hsa
aacuauagucauacucacacaaagggagaaauuuaaacucgaaccaagcaaaaggcuucacgga

SEQ ID NO: 667257 - RNA, 64 nt, hsa
aaaaucuuuaaugaacuggagaacacuaagauuuaaacucgaaaauucguuguucaaguaaaga

SEQ ID NO: 667258 - RNA, 64 nt, hsa
caggagucaagaugugcucauaggagccaagggcaaacucgaaaacagcccugcccugugguua

SEQ ID NO: 667259 - RNA, 64 nt, hsa
ggcaccaacagaauuaaaaacgaaaaacaaaaaaaaacucgaaugacuuaggcagaacaugccu

SEQ ID NO: 667260 - RNA, 64 nt, hsa
guuuauagagugauuuuacuagaaagaauuuaauaaacucgaaguuuagguuuaugaguauaua

SEQ ID NO: 667261 - RNA, 64 nt, hsa
gaguauggcaucugaagguaaauggcucaucaauaaacucgauaucaacaauuaauuguuucau

SEQ ID NO: 667262 - RNA, 64 nt, hsa
gccucucgcagcccggggagcacgucgccucuugaaacucgagauuucuuaaaucccaauauaa

SEQ ID NO: 667263 - RNA, 64 nt, hsa
uaguagacaagaauuugauguaacgcaaauggaaaaacucgacaccacauuucaggcuuuaccc

SEQ ID NO: 667264 - RNA, 64 nt, hsa
ccaaaacccauguauuaaauaaauuguccaagugaaacucgacuaacuuuggccuuuguguauu

SEQ ID NO: 667265 - RNA, 64 nt, hsa
cuugccucccugaggaccacacuggcugcaacccaaacucgacucuucuacuuacacuugcuca

SEQ ID NO: 667266 - RNA, 64 nt, hsa
gcugggugcguuaaaaagcccaaguauuuugaaaaaacucgaacagauuugacaaggguagcca

SEQ ID NO: 667267 - RNA, 64 nt, hsa
gucuguuggagcaagaggaacaugcuuguuuugaaaacucgagaugaugagggugguacaugca

SEQ ID NO: 667268 - RNA, 64 nt, hsa
ugcccacagggauagggaggguguugagaauccuaaacucgaaccguuucacugucagccugcc

SEQ ID NO: 667269 - RNA, 64 nt, hsa
uaguuaucuagaucuggguaauuucauguuuauuaaacucgaacuuuggcuaguuaaacucaua

SEQ ID NO: 667270 - RNA, 64 nt, hsa
ugcucgugauaugugcucaagccaguugugggaaaaacucgaguccuccccuccucccgaccua

SEQ ID NO: 667271 - RNA, 64 nt, hsa
uuuguguaauauguucugugugagccucugcauuaaacucgauuucuugggcaauuauggaaau

SEQ ID NO: 667272 - RNA, 64 nt, hsa
gugacugauuacuggcugugucuugggugggcagaaacucgaacuugcuauguaauuugugucu

SEQ ID NO: 667273 - RNA, 64 nt, hsa
auguuuuagacaaauacucauguguaugggcaaaaaacucgaggacuguauuugugacuaauug

SEQ ID NO: 667274 - RNA, 64 nt, hsa
uguaaaucauauuguaguauucaauaguuaauaaaaacucgagaaauguguuguuucugaugug

SEQ ID NO: 667275 - RNA, 64 nt, hsa; identical to SEQ ID NO: 667273

SEQ ID NO: 667276 - RNA, 64 nt, hsa
augauuacagcgaagacuuuccugauaaguucucaaacucgaugugugacuguuuggcacuuga

SEQ ID NO: 667277 - RNA, 64 nt, hsa
aaaucaugcaagcgcucuaauuccuauaaauacgaaacucgagaagauucaaucacuguauaga

SEQ ID NO: 667278 - RNA, 64 nt, hsa
accucagugcccugacuacaauuggaaaugccaaaaacucgagucuuuaauuguaaugacuuug

SEQ ID NO: 667279 - RNA, 64 nt, hsa
uuuuuuuuuuuuaccaucuugugaaagguuucugaaacucgauaauaaaaagcgguugguguaa

SEQ ID NO: 667280 - RNA, 64 nt, hsa
caacgucagggucggggcuaggguaggggcaaggaaacucgaauaaaggaugggaccaacccca

SEQ ID NO: 667281 - RNA, 64 nt, hsa
agacuggauagaaaaucuagcguagaagugcaucaaacucgauuuauugccaaaacccuagauu

SEQ ID NO: 667282 - RNA, 64 nt, hsa
ugauggauugauuugacaugaaccaaacacagccaaacucgauacccacaagcugucagcugaa

SEQ ID NO: 667283 - RNA, 64 nt, hsa
ccaguucaaggacccggaugugaauggcaugcugaaacucgaagucauggccaccuccagggac

SEQ ID NO: 667284 - RNA, 64 nt, hsa
ccagcaacgugggcagcacagugaaggguggacaaaacucgacugcugcgucuaccaaguacga

SEQ ID NO: 667285 - RNA, 62 nt, hsa
aauaacaacaacaacaacaauaauaaagaugugaaaacucgacgcucggucaccuccaaucc

SEQ ID NO: 667286 - RNA, 64 nt, hsa
gccuucuagucuuuugauaauuaaaccuuuggcaaaacucgaauguuugguuagcaaccaagcc

SEQ ID NO: 667287 - RNA, 64 nt, hsa
agaccaugaaaccagacaacacauguauugguuuaaacucgauaaugacaggaaaauuccaaac

SEQ ID NO: 667288 - RNA, 64 nt, hsa
gggauggcagucagacucaaacccgugacacuccaaacucgauuaugcuccagggcccacuuuc

SEQ ID NO: 667289 - RNA, 64 nt, hsa
aauuagcugggugucccugcacgcccaccccaugaaacucgagcaggucucuggaagccauuug

SEQ ID NO: 667290 - RNA, 64 nt, hsa
ugaccacaaauguccacagugucuuccucugaggaaacucgaauccugaaauggaaauucuuug

SEQ ID NO: 667291 - RNA, 64 nt, hsa
auaaugcaguggcaaaagguucugaaagccuuuuaaacucgaaccagugggggaaagauggauc

SEQ ID NO: 667292 - RNA, 64 nt, hsa
cucauugggucagcaccugugaaaggaagauuaaaaacucgacaccccaauucacucaaccaag

SEQ ID NO: 667293 - RNA, 64 nt, hsa
cacgugaccaugccgaccacaaaggugucugcggaaacucgaggacauucaccacgaugauuuu

SEQ ID NO: 667294 - RNA, 64 nt, hsa
aggagagaaccggcgcugggcaacacgggccugcaaacucgacaggacccugcccgaggggccc

SEQ ID NO: 667295 - RNA, 64 nt, hsa
caucgauaccccauuuagcuccagaaagcaaagaaaacucgaguaacacuuguuugaaagagau

SEQ ID NO: 667296 - RNA, 64 nt, hsa
acgccaauguaguuuuccuucuuuacaauguauuaaacucgaucgaugauuucaaagcccugug

SEQ ID NO: 667297 - RNA, 64 nt, hsa
aggucagcccugaggccagggugaaaggucccagacuucgaaugcccaccuuugggcuuucccu

SEQ ID NO: 667298 - RNA, 64 nt, hsa
ggauccaggcuugcuagggguccugaaccaggcuacuucgaaccaggaaagccagauuccagcc

SEQ ID NO: 667299 - RNA, 64 nt, hsa
ugcgcauugucuacuggagcuuuagucuucugagacggaggaaaacugcugaauacucuggauu

SEQ ID NO: 667300 - RNA, 64 nt, hsa
gacuaagcgggugaugccccagcggauguuggccacggaggagcugaggcucucccuuucucug

SEQ ID NO: 667301 - RNA, 62 nt, hsa
acuccugagaaugggcuccuguuagaugggcacgggcggauuaauuuuagcaaaauguucug

SEQ ID NO: 667302 - RNA, 62 nt, hsa
gccuguaaucccaacacuuugggaggccgaggcgggcggaucacgaggucagaucaagaaca

SEQ ID NO: 667303 - RNA, 62 nt, hsa
accuguaaucccagcacuuugggaggccgaggcgggcggaucacgaggucaggaguucgaga

SEQ ID NO: 667304 - RNA, 62 nt, hsa
gccuguaaucucagcacuuugggaggcugaggcgggcggaucacaagguccagaguucaaga

SEQ ID NO: 667305 - RNA, 62 nt, hsa
auaaaggaugagccuggggucacagggggugucgggcggaggaaagugcaucccccagagcu

SEQ ID NO: 667306 - RNA, 62 nt, hsa
gccuguaaucccagcacuuugggaggcugaggcgggcggaucaccugaggucgggaguucga

SEQ ID NO: 667307 - RNA, 62 nt, hsa
gccuguaaucccagcacuuugagagaccgaggcgggcggaucacgaggucaggagaucgaga

SEQ ID NO: 667308 - RNA, 62 nt, hsa
gccuguaauccuagcacuuugggaggccaagacgggcggaucaccugaggugaggaguucaa

SEQ ID NO: 667309 - RNA, 62 nt, hsa
gccuguaaucccagcacuuugggaggccgaggcgggcggaucacgaggucaggagauugaga

SEQ ID NO: 667310 - RNA, 62 nt, hsa
gacuauguguaaugcucuaagaccucucagcacgggcggaagaaacucccggagagcucacc

SEQ ID NO: 667311 - RNA, 62 nt, hsa
ggcuguaaucccaacacuuugggagucugaggcgggcggaucaugaggucaggagauuaaga

SEQ ID NO: 667312 - RNA, 62 nt, hsa
gccugugaucccagcacuuugggaggccaagacgggcggaucaugaggucaagagaucaaga

SEQ ID NO: 667313 - RNA, 62 nt, hsa
gccuguaaucccagcacuuugggaggccgaggcgggcggaucacgaggucaggagaucgaga

SEQ ID NO: 667314 - RNA, 62 nt, hsa
accugcaaucccagcacuuugggaggccgaggcgggcggaucaccugaggucagcaguucaa

SEQ ID NO: 667315 - RNA, 62 nt, hsa
gccuauaaucccagcacuuugggaggccgaggcgggcggaucacgaggucaggagauugaga

SEQ ID NO: 667316 - RNA, 62 nt, hsa
gccuguaaucccagcacuuugggaggccgaggcgggcggaucacaaggucaggagaucgaga

SEQ ID NO: 667317 - RNA, 62 nt, hsa
cgccuguaauccaacacuuugagaggcugaggcgggcggaucaccugagucaggaguucgag

SEQ ID NO: 667318 - RNA, 62 nt, hsa
ccgggcauccacguagggggcaggggcaggggcgggcggagggaggggaggggugaaaucca

SEQ ID NO: 667319 - RNA, 62 nt, hsa
gccuguaaucccagcacuuugggaggccgaggcgggcggaugaguugaggucgggaguuuga

SEQ ID NO: 667320 - RNA, 62 nt, hsa
gccuguaaucccagcacuuugggaggcugaggcgggcggaucaccugagguugggaguucga

SEQ ID NO: 667321 - RNA, 62 nt, hsa
cucaagaggggaggagcggggcugauccuggucgggcggaccugagucgggcagccgcucuc

SEQ ID NO: 667322 - RNA, 62 nt, hsa
gccuguaaucccagcacuuugggaggccgaggcgggcggaugaccugaggucaggaguucaa

SEQ ID NO: 667323 - RNA, 62 nt, hsa
gccuguaaucccagcacuuugggaggccaaggcgggcggaucaugaggucaggagaucgaga

SEQ ID NO: 667324 - RNA, 62 nt, hsa
gccuguaaucccagcacuuugggaggccgaggcgggcggaucaugaggucaggaguucgaga

SEQ ID NO: 667325 - RNA, 62 nt, hsa
gccuguaaucccagcacuuugggaggccgaggcgggcggaucaugaggucaggagaucgaga

SEQ ID NO: 667326 - RNA, 62 nt, hsa
gcccugguccagcugggugcccccucgagcuccgggcggacucgcacacacucgugucaucc

SEQ ID NO: 667327 - RNA, 62 nt, hsa
gccuguaaucccaacacuuugggaggcccaggcgggcggaucacgaggucaggagaucgaga

SEQ ID NO: 667328 - RNA, 62 nt, hsa; identical to SEQ ID NO: 667313

SEQ ID NO: 667329 - RNA, 62 nt, hsa
gccuguaaucccagcacguugggaggccaagucgggcggaucacaaggucaggagaucaagg

SEQ ID NO: 667330 - RNA, 62 nt, hsa
aauacuucuggcagcacuuugggaggccaaggcgggcggaucacgaggucaggagaucgaga

SEQ ID NO: 667331 - RNA, 62 nt, hsa
cuccggugcuguaaaacgcaggcgcugggccgcgggcggagcugaggacaggccuuggcugg

SEQ ID NO: 667332 - RNA, 62 nt, hsa
gccgguaaucccagcacuuugggaggccgaggcgggcggaucacgaggucaggagaucgaga

SEQ ID NO: 667333 - RNA, 62 nt, hsa
accuguaaucccagcacuuuggggagcugaggcgggcggaucacgaggucaagagaucgaga

SEQ ID NO: 667334 - RNA, 62 nt, hsa
uccuguaaucccagcacuuugggaggccgaggcgggcggaucaccaggucaggagaucaaga

SEQ ID NO: 667335 - RNA, 62 nt, hsa
gccuguaaucccagcacuuugggaggccgaggcgggcggaucacuugagaccaggaguucga

SEQ ID NO: 667336 - RNA, 62 nt, hsa
uuguuucuguuuucuuggguggggagcagggacgggcggagggaggagagcagguuucagau

SEQ ID NO: 667337 - RNA, 62 nt, hsa
gccuguaaucccagcacuuugggaggccgaggcgggcggaucacaaagucaggacgagacca

SEQ ID NO: 667338 - RNA, 62 nt, hsa
ccccaaagugcagauuccggagcagacacauccgggcggagagacucagcagacaagugcug

SEQ ID NO: 667339 - RNA, 62 nt, hsa
accuguaaucccagcacuuugggagaccaaggcgggcggaucacuuaaagucaggaguccaa

SEQ ID NO: 667340 - RNA, 62 nt, hsa
gccuguaaucccagcacuuugggaggccgagccgggcggaucaccuguggucaggaguuuga

SEQ ID NO: 667341 - RNA, 62 nt, hsa
cccauccccacgcgggccgggcacgaccacaccgggcggaccgcuggacagacgcacccacu

SEQ ID NO: 667342 - RNA, 62 nt, hsa
gccuguaaucccagcauuuugggaggccaaggcgggcggaucacuugaggucaggagcucaa

SEQ ID NO: 667343 - RNA, 62 nt, hsa
gccuguaaucccaacacuuuaggaguccaaggcgggcggaucacuugaggucaggaguucaa

SEQ ID NO: 667344 - RNA, 62 nt, hsa
cgccacggccuggcuggugggaaggccggcagcgggcggaggggauccagccacuucccccu

SEQ ID NO: 667345 - RNA, 62 nt, hsa
accuguaaucccagcacuuugggaggccgaggcgggcggaucaccugaagucaggaguuuga

SEQ ID NO: 667346 - RNA, 62 nt, hsa; identical to SEQ ID NO: 667316

SEQ ID NO: 667347 - RNA, 62 nt, hsa
gcuuguaaucccagcacuuugggaggccgaggcgggcggaucacgaggucaggaguucgaga

SEQ ID NO: 667348 - RNA, 62 nt, hsa
gccuguaaucccagcacuuugggaggccgaggcgggcggaucaccugagguggggaguauga

SEQ ID NO: 667349 - RNA, 62 nt, hsa
gccuauaaucccagcacguugggaggcugaggcgggcggaucgguugagcucaggcguucgg

SEQ ID NO: 667350 - RNA, 62 nt, hsa
gccuguaaucccagcacuuugggaggccgaggcgggcggaucaccugaggccaggaguugga

SEQ ID NO: 667351 - RNA, 62 nt, hsa
gagcgggcauccagagaggaguccugggagagcgggcggagcgagcgagggcccccggacug

SEQ ID NO: 667352 - RNA, 62 nt, hsa
gccuguaaucccagcacuuugggaggccgaggcgggcggaucaugagguuaggagagcgaga

SEQ ID NO: 667353 - RNA, 62 nt, hsa
acugucaaucccagcacuuugggaggccuaggcgggcggaucaugaagucaagaguucgaga

SEQ ID NO: 667354 - RNA, 62 nt, hsa
cggccgggccuggcaccaaucugcgcugcggucgggcggagcuucuguuucucccagccaau

SEQ ID NO: 667355 - RNA, 62 nt, hsa
gccuguaaucccagcacuuugggaggccgagacgggcggaucaccugaggucaggaguucga

SEQ ID NO: 667356 - RNA, 62 nt, hsa
gccuguaaucccagcacuuugggaggccaaggcgggcggaucaccugaggucgggaguuuga

SEQ ID NO: 667357 - RNA, 62 nt, hsa
gucacucagccgucgugagcgcaggcgcggggcgggcggagcgggaccccuggggcucuccc

SEQ ID NO: 667358 - RNA, 62 nt, hsa
gccuguaaucccagcacuuugggaggcugaggcgggcggaucacgaggucaggagaucgaga

SEQ ID NO: 667359 - RNA, 62 nt, hsa
accuguaaucccagcacuuugggaggccgaggcgggcggaucacaaggucaggaguucgaga

SEQ ID NO: 667360 - RNA, 62 nt, hsa
accuguaaucccagcacuuugggaggccaaggcgggcggaucagcugaggucaggaguugga

SEQ ID NO: 667361 - RNA, 62 nt, hsa
gccuguaaucccagcacuuugggaggccgaggcgggcggaucagaccauccuggcuaacacg

SEQ ID NO: 667362 - RNA, 62 nt, hsa
ugugggacugagucagcgguggcgaggagaggcgggcggauuuggggagggcccugaggacc

SEQ ID NO: 667363 - RNA, 51 nt, hsa; identical to SEQ ID NO: 497424

SEQ ID NO: 667364 - RNA, 62 nt, hsa
gaccugcuccucacagagccccucccaaggaucgggcggaagcugcugggacccuccugggc

SEQ ID NO: 667365 - RNA, 62 nt, hsa
uuuauuggagccccaucuccccagcgggcaggcgggcggagccuguauauauguauauacuc

SEQ ID NO: 667366 - RNA, 62 nt, hsa
gcagugcacgcggcuuguugacuucgcagccccgggcggagccuucccgggcgggcguggga

SEQ ID NO: 667367 - RNA, 62 nt, hsa
gcccugaggucgcgcgcagcgcgugcacagcgcgggcggaggcggcuccagguccggagggg

SEQ ID NO: 667368 - RNA, 62 nt, hsa
gccuauaaucccagcacuuugggaggccgaggcgggcggaucacuaggucaggaaauggaga

SEQ ID NO: 667369 - RNA, 62 nt, hsa
gccuguaaucccagcacuuugggaggccaagacgggcggaucuuuugaggucgggaguugga

SEQ ID NO: 667370 - RNA, 62 nt, hsa
gccuguaaucccaacacuuugggagcccgaggcgggcggaucacaaggucaggaguucgaga

SEQ ID NO: 667371 - RNA, 62 nt, hsa
ugguguaauccuaacacuuugggaggccaaggcgggcggauugccugagcucaggaguucaa

SEQ ID NO: 667372 - RNA, 62 nt, hsa
gucuguaaucccagcacuuugggaggcugaggcgggcggaucaccugagguugggaguucaa

SEQ ID NO: 667373 - RNA, 62 nt, hsa
accuguaaucccagcacuuugggaggcugaggcgggcggaacaccugaggucagguguucga

SEQ ID NO: 667374 - RNA, 62 nt, hsa
acaccacuggccccggaugccucugccccucccgggcggaccuccugaggccuggaccccca

SEQ ID NO: 667375 - RNA, 62 nt, hsa
cggcgggggcgccccgugacccgagcucggggcgggcggagcccgcguggccgaagcuggaa

SEQ ID NO: 667376 - RNA, 62 nt, hsa
cccugucaucccagcacuuugagaggccaaggcgggcggaucacuggaggucaggaguuuaa

SEQ ID NO: 667377 - RNA, 62 nt, hsa; identical to SEQ ID NO: 667313

SEQ ID NO: 667378 - RNA, 62 nt, hsa
gcgccggccuccgucaugaaugccuuccgggccgggcggaaggggacgcgggcugugccuua

SEQ ID NO: 667379 - RNA, 62 nt, hsa
gccuguaauccuagcaccuugggaggccgaggcgggcggaucacuugaggucaggaguucca

SEQ ID NO: 667380 - RNA, 62 nt, hsa
gccuguaaucccagcacuaugggaggccgagacgggcggaucacgaggucaggagacugaga

SEQ ID NO: 667381 - RNA, 62 nt, hsa
ucccuaacagggcggcuucccagggcugcaggcgggcggagguuccaggagaugggacuuca

SEQ ID NO: 667382 - RNA, 62 nt, hsa
gccuguaaucccagcacuuugggaggccgaagcgggcggaucaccugaggucgggaguucga

SEQ ID NO: 667383 - RNA, 62 nt, hsa
gccuguaaucccagcacuuugggaggccgaggcgggcggaucaauaggucaggaaauccaga

SEQ ID NO: 667384 - RNA, 62 nt, hsa
cagaccguucuccuguaaguucauuacaaacacgggcggaaggcacucaggcuuucguugga

SEQ ID NO: 667385 - RNA, 62 nt, hsa
gccugcaaucccagcacuuugggagacugaggcgggcggaucaugaggucaggagaucgcga

SEQ ID NO: 667386 - RNA, 61 nt, hsa
gcauguaaucccagcacuuugggaggccaaggcgggcggaucacgaggucaggaguucgag

SEQ ID NO: 667387 - RNA, 62 nt, hsa
gccuguaauccgagcacuuugggaggccaaggcgggcggaucacgaggucaggagaucgaga

SEQ ID NO: 667388 - RNA, 62 nt, hsa
gccuguaaucccagcacuuugggaggccgaggcgggcggaucacgaggucaggaguucgaga

SEQ ID NO: 667389 - RNA, 62 nt, hsa
gccuguaaucccagcaauuugggaguccgaggcgggcggaucacucgaggucaggaguucca

SEQ ID NO: 667390 - RNA, 62 nt, hsa
ccuucagugcccugccuguacucgagcggcuccgggcggagaacaagucggcugugaguuuc

SEQ ID NO: 667391 - RNA, 62 nt, hsa
ggaggccagaccaagggaggcacgcgcgcugccgggcggacagaggcugaggcucacacccc

SEQ ID NO: 667392 - RNA, 64 nt, hsa
gugcuggcugacucaacugugcgucccagguucagggucuuacagagcuccacccccugggguc

SEQ ID NO: 667393 - RNA, 64 nt, hsa
ccagguucagggucuuacagagcuccacccccuggggucuuaccucacugggaauguguuuuga

SEQ ID NO: 667394 - RNA, 64 nt, hsa
ccgucggccacaagauccucagcgggcagcggaagcucgagauggaggggcggcagguggugag

SEQ ID NO: 667395 - RNA, 64 nt, hsa
uagaaaugccugugaagaccuuggcagcgacguggcucgagaagcauucaucauuacuguggac

SEQ ID NO: 667396 - RNA, 64 nt, hsa
uuucccgggcacaggccugcgccgacccgacccugcucgagagcccgcgcuagagucggggagg

SEQ ID NO: 667397 - RNA, 64 nt, hsa
cuggcuuuagacggggagaaacaucuggaaggaugcucgagagaacaaauggagguggugaaaa

SEQ ID NO: 667398 - RNA, 64 nt, hsa
caaucaaaauggugggcucuagaaugguuuuggagcucgagaucuucauggguuagacuugcug

SEQ ID NO: 667399 - RNA, 64 nt, hsa
gggugaguggguuugcuccacaccguccugugcugcucgagaggaccugggacgugcgagggaa

SEQ ID NO: 667400 - RNA, 64 nt, hsa
guggagaguucucucaggucaggucugcagcagagcucgagacagggaucugaaugcacuuggu

SEQ ID NO: 667401 - RNA, 64 nt, hsa
aaaaaccauugucuuaccucccaacuggaagacagcucgagauccagaagggaagauuuauuac

SEQ ID NO: 667402 - RNA, 64 nt, hsa
ugaccgaucucccuccuccucaccccaagugaaggcucgagacuuccugccccacccagugggu

SEQ ID NO: 667403 - RNA, 64 nt, hsa
uucacaauacgguggaauuucaaaagcuggaagagcucgagaucaugccucaggcaaaggcgug

SEQ ID NO: 667404 - RNA, 64 nt, hsa
uguugguagauuacaacucuuuuuauuugaaguugcucgagaaguuagacaugcuuuagaauua

SEQ ID NO: 667405 - RNA, 64 nt, hsa
uuaacuuaagggaggcuaauuuuuaauuuaaacugcucgagauaugaguucugcaaaagguggu

SEQ ID NO: 667406 - RNA, 64 nt, hsa
ccuugagaggagaaaugcaauaacucugggaggggcucgagagggcugguccuuauuuauuuaa

SEQ ID NO: 667407 - RNA, 64 nt, hsa
cacaacacugccccagagggugggaccacugcaagcucgagaccuugcuuggugacaugugcca

SEQ ID NO: 667408 - RNA, 64 nt, hsa
uucccuggccauguugcaaacagcgcaauuccaagcucgagagcuucagccucaggaaagaacu

SEQ ID NO: 667409 - RNA, 64 nt, hsa
ccauaggccgaugcucugaaagaagagacguggggcucgagagauuuaaagauuuuauuuuuac

SEQ ID NO: 667410 - RNA, 64 nt, hsa
ccuggugugguggcacacaccuguagucccagcugcucgagaggcugaggcacgagaaucaguu

SEQ ID NO: 667411 - RNA, 64 nt, hsa
agcuacaacuccacaucaacuccacaugcgcccagcucgagacugaugaguggaaucagcuucc

SEQ ID NO: 667412 - RNA, 64 nt, hsa
uuugggcugagcuguuagaggggcuucuccagaggcucgagagcaggccauuucccaagaagau

SEQ ID NO: 667413 - RNA, 64 nt, hsa
cagauggccaggaagggcccuggccucuaaacuggcucgagagcaucuuggccccggccaccuu

SEQ ID NO: 667414 - RNA, 64 nt, hsa
ggaaucccuuugcuuaggcccaaccuggucgauagcucgagaaagaauuuuuuccaaggaaaug

SEQ ID NO: 667415 - RNA, 64 nt, hsa
cuuuaugccggaugugcuuuucuccaauaucagugcucgagacacagugaagcaaauuaaaaaa

SEQ ID NO: 667416 - RNA, 64 nt, hsa
acacuuuuaaaccuaaagagccuuauuauuauuagcucgagaaauaccacaugccagucuuccc

SEQ ID NO: 667417 - RNA, 64 nt, hsa
gcaccccagcgcagccuggcgccgcgggacugaagcucgagaagggccugaccuaaaggucagg

SEQ ID NO: 667418 - RNA, 64 nt, hsa
gacuuaguucagugcagagagauaggugaggccagcucgagaucuuauaccacucuguauugga

SEQ ID NO: 667419 - RNA, 64 nt, hsa
ggaaucgaacaccagucaugccuacuggcucucugcucgagagccaauacccugugcccuccac

SEQ ID NO: 667420 - RNA, 64 nt, hsa
uuccugacuuacuaauacuaaagaaguugggggagcucgagagccagacggccagacaggcaga

SEQ ID NO: 667421 - RNA, 64 nt, hsa
caaagcaaggucuugcuucuaucugggggacgcugcucgagagaggccaagaggccgcagaaca

SEQ ID NO: 667422 - RNA, 64 nt, hsa
gaggcugaggcaggcggaucacuugaggucaggagcucgagaccagccuggccaacacggugaa

SEQ ID NO: 667423 - RNA, 64 nt, hsa
gugcaggggucuccugccugugccauccacuggggcucgagacaauuucccacucaccugugag

SEQ ID NO: 667424 - RNA, 64 nt, hsa
guguaagccacuagucuguggcauuguuauagcagcucgagaagacuaaggcagaugggcuucc

SEQ ID NO: 667425 - RNA, 64 nt, hsa
uaggugaaacccccuacccuccccaacguuaaaugcucgagaggaaucuuccacaaggcagggc

SEQ ID NO: 667426 - RNA, 64 nt, hsa
ucugaaggaacgucguaaggaagcugaacggauugcucgagaaagagaggaacucagaaggcaa

SEQ ID NO: 667427 - RNA, 64 nt, hsa
gaggccaagguggguggaucaccugaggucaggagcucgagaccagccuggccaacauggugaa

SEQ ID NO: 667428 - RNA, 64 nt, hsa
gaggcugagguggguggaucacuugaggucaggagcucgagaccagcuuggccaacauggugag

SEQ ID NO: 667429 - RNA, 64 nt, hsa
cacaugcacaccaacaugcaugccgccggcacaugcucgagacguguggacaccccagcgugcg

SEQ ID NO: 667430 - RNA, 64 nt, hsa
acagaugccaugguaugggccacaggacacacuugcucgagaaccaaagugcauuugggugaca

SEQ ID NO: 667431 - RNA, 64 nt, hsa
gucugaugugaaaauucaaucacgacguuaaccggcucgagagagcgccggccuagaggcucau

SEQ ID NO: 667432 - RNA, 64 nt, hsa
uuaaacuuaugaaaauguauuaagaaagagugcagcucgagagagauucagagauggaacacac

SEQ ID NO: 667433 - RNA, 64 nt, hsa; identical to SEQ ID NO: 667432

SEQ ID NO: 667434 - RNA, 64 nt, hsa; identical to SEQ ID NO: 667432

SEQ ID NO: 667435 - RNA, 64 nt, hsa
gaaguugaaacccuagggcacccccaccaccucugcucgagagguccgugggggaggccguggg

SEQ ID NO: 667436 - RNA, 64 nt, hsa
gggaggccaaggcggguggaucgcgagaucaggagcucgagaccacccuggccaacauggugaa

SEQ ID NO: 667437 - RNA, 64 nt, hsa
aaagcacugauuacccaaugcaccucccuccccagcucgagaucauucuucacucaggacacaa

SEQ ID NO: 667438 - RNA, 50 nt, hsa
agcacgugcgccuccacuaagcucgagacccggccugugcugcccugccc

SEQ ID NO: 667439 - RNA, 64 nt, hsa
ucacauggcgcccagcacugggcuucagccaggugcucgagagcuuugaggccaugaucucugc

SEQ ID NO: 667440 - RNA, 64 nt, hsa
uuguuuuauaauuccuauugcaaccucgugcacugcucgagacacaagugcugcuguaguuagc

SEQ ID NO: 667441 - RNA, 64 nt, hsa
ucuucaccccucgcagauggagcggcagcgccucgcucgagagaagcagaugagggaggaggcu

SEQ ID NO: 667442 - RNA, 64 nt, hsa
gcuuuggggagaugggcgauaaguguugagguaggcucgagaacugcuccccaaaucagugaga

SEQ ID NO: 667443 - RNA, 64 nt, hsa; identical to SEQ ID NO: 461032

SEQ ID NO: 667444 - RNA, 64 nt, hsa; identical to SEQ ID NO: 461033

SEQ ID NO: 667445 - RNA, 64 nt, hsa; identical to SEQ ID NO: 461034

SEQ ID NO: 667446 - RNA, 64 nt, hsa; identical to SEQ ID NO: 461035

SEQ ID NO: 667447 - RNA, 64 nt, hsa; identical to SEQ ID NO: 461036

SEQ ID NO: 667448 - RNA, 64 nt, hsa; identical to SEQ ID NO: 461037

SEQ ID NO: 667449 - RNA, 64 nt, hsa; identical to SEQ ID NO: 461038

SEQ ID NO: 667450 - RNA, 64 nt, hsa; identical to SEQ ID NO: 461039

SEQ ID NO: 667451 - RNA, 64 nt, hsa; identical to SEQ ID NO: 461040

SEQ ID NO: 667452 - RNA, 64 nt, hsa; identical to SEQ ID NO: 461041

SEQ ID NO: 667453 - RNA, 64 nt, hsa; identical to SEQ ID NO: 461042

SEQ ID NO: 667454 - RNA, 64 nt, hsa; identical to SEQ ID NO: 461043

SEQ ID NO: 667455 - RNA, 64 nt, hsa; identical to SEQ ID NO: 461044

SEQ ID NO: 667456 - RNA, 64 nt, hsa; identical to SEQ ID NO: 461045

SEQ ID NO: 667457 - RNA, 64 nt, hsa; identical to SEQ ID NO: 461046

SEQ ID NO: 667458 - RNA, 64 nt, hsa; identical to SEQ ID NO: 461047

SEQ ID NO: 667459 - RNA, 64 nt, hsa; identical to SEQ ID NO: 461048

SEQ ID NO: 667460 - RNA, 64 nt, hsa; identical to SEQ ID NO: 461049

SEQ ID NO: 667461 - RNA, 64 nt, hsa; identical to SEQ ID NO: 461050

SEQ ID NO: 667462 - RNA, 64 nt, hsa; identical to SEQ ID NO: 461051

SEQ ID NO: 667463 - RNA, 64 nt, hsa; identical to SEQ ID NO: 461052

SEQ ID NO: 667464 - RNA, 64 nt, hsa; identical to SEQ ID NO: 461053

SEQ ID NO: 667465 - RNA, 64 nt, hsa; identical to SEQ ID NO: 461054

SEQ ID NO: 667466 - RNA, 64 nt, hsa; identical to SEQ ID NO: 461055

SEQ ID NO: 667467 - RNA, 64 nt, hsa; identical to SEQ ID NO: 461056

SEQ ID NO: 667468 - RNA, 64 nt, hsa; identical to SEQ ID NO: 461057

SEQ ID NO: 667469 - RNA, 64 nt, hsa; identical to SEQ ID NO: 461058

SEQ ID NO: 667470 - RNA, 64 nt, hsa; identical to SEQ ID NO: 461059

SEQ ID NO: 667471 - RNA, 64 nt, hsa; identical to SEQ ID NO: 461060

SEQ ID NO: 667472 - RNA, 64 nt, hsa; identical to SEQ ID NO: 461061

SEQ ID NO: 667473 - RNA, 64 nt, hsa; identical to SEQ ID NO: 461062

SEQ ID NO: 667474 - RNA, 64 nt, hsa; identical to SEQ ID NO: 461063

SEQ ID NO: 667475 - RNA, 64 nt, hsa; identical to SEQ ID NO: 461064

SEQ ID NO: 667476 - RNA, 64 nt, hsa; identical to SEQ ID NO: 461065

SEQ ID NO: 667477 - RNA, 64 nt, hsa; identical to SEQ ID NO: 461066

SEQ ID NO: 667478 - RNA, 64 nt, hsa; identical to SEQ ID NO: 461067

SEQ ID NO: 667479 - RNA, 64 nt, hsa; identical to SEQ ID NO: 461068

SEQ ID NO: 667480 - RNA, 64 nt, hsa; identical to SEQ ID NO: 461069

SEQ ID NO: 667481 - RNA, 64 nt, hsa; identical to SEQ ID NO: 461070

SEQ ID NO: 667482 - RNA, 64 nt, hsa; identical to SEQ ID NO: 461071

SEQ ID NO: 667483 - RNA, 64 nt, hsa; identical to SEQ ID NO: 461072

SEQ ID NO: 667484 - RNA, 64 nt, hsa; identical to SEQ ID NO: 461073

SEQ ID NO: 667485 - RNA, 64 nt, hsa; identical to SEQ ID NO: 461074

SEQ ID NO: 667486 - RNA, 64 nt, hsa; identical to SEQ ID NO: 461075

SEQ ID NO: 667487 - RNA, 64 nt, hsa; identical to SEQ ID NO: 461076

SEQ ID NO: 667488 - RNA, 64 nt, hsa; identical to SEQ ID NO: 461077

SEQ ID NO: 667489 - RNA, 64 nt, hsa; identical to SEQ ID NO: 461078

SEQ ID NO: 667490 - RNA, 64 nt, hsa; identical to SEQ ID NO: 461079

SEQ ID NO: 667491 - RNA, 64 nt, hsa; identical to SEQ ID NO: 461080

SEQ ID NO: 667492 - RNA, 64 nt, hsa; identical to SEQ ID NO: 461081

SEQ ID NO: 667493 - RNA, 64 nt, hsa; identical to SEQ ID NO: 461082

SEQ ID NO: 667494 - RNA, 64 nt, hsa; identical to SEQ ID NO: 461083

SEQ ID NO: 667495 - RNA, 64 nt, hsa; identical to SEQ ID NO: 461084

SEQ ID NO: 667496 - RNA, 64 nt, hsa; identical to SEQ ID NO: 461085

SEQ ID NO: 667497 - RNA, 64 nt, hsa; identical to SEQ ID NO: 461086

SEQ ID NO: 667498 - RNA, 64 nt, hsa; identical to SEQ ID NO: 461087

SEQ ID NO: 667499 - RNA, 64 nt, hsa; identical to SEQ ID NO: 461088

SEQ ID NO: 667500 - RNA, 64 nt, hsa; identical to SEQ ID NO: 461089

SEQ ID NO: 667501 - RNA, 64 nt, hsa; identical to SEQ ID NO: 461090

SEQ ID NO: 667502 - RNA, 64 nt, hsa; identical to SEQ ID NO: 461091

SEQ ID NO: 667503 - RNA, 64 nt, hsa; identical to SEQ ID NO: 461092

SEQ ID NO: 667504 - RNA, 64 nt, hsa; identical to SEQ ID NO: 461093

SEQ ID NO: 667505 - RNA, 64 nt, hsa; identical to SEQ ID NO: 461094

SEQ ID NO: 667506 - RNA, 64 nt, hsa; identical to SEQ ID NO: 461095

SEQ ID NO: 667507 - RNA, 64 nt, hsa; identical to SEQ ID NO: 461096

SEQ ID NO: 667508 - RNA, 64 nt, hsa; identical to SEQ ID NO: 461097

SEQ ID NO: 667509 - RNA, 61 nt, hsa; identical to SEQ ID NO: 461098

SEQ ID NO: 667510 - RNA, 64 nt, hsa; identical to SEQ ID NO: 461099

SEQ ID NO: 667511 - RNA, 64 nt, hsa; identical to SEQ ID NO: 461100

SEQ ID NO: 667512 - RNA, 64 nt, hsa; identical to SEQ ID NO: 461101

SEQ ID NO: 667513 - RNA, 64 nt, hsa; identical to SEQ ID NO: 461102

SEQ ID NO: 667514 - RNA, 64 nt, hsa; identical to SEQ ID NO: 461103

SEQ ID NO: 667515 - RNA, 64 nt, hsa; identical to SEQ ID NO: 461104

SEQ ID NO: 667516 - RNA, 64 nt, hsa; identical to SEQ ID NO: 461105

SEQ ID NO: 667517 - RNA, 64 nt, hsa; identical to SEQ ID NO: 461106

SEQ ID NO: 667518 - RNA, 64 nt, hsa; identical to SEQ ID NO: 461107

SEQ ID NO: 667519 - RNA, 64 nt, hsa; identical to SEQ ID NO: 461108

SEQ ID NO: 667520 - RNA, 64 nt, hsa; identical to SEQ ID NO: 461109

SEQ ID NO: 667521 - RNA, 64 nt, hsa; identical to SEQ ID NO: 461110

SEQ ID NO: 667522 - RNA, 64 nt, hsa; identical to SEQ ID NO: 461111

SEQ ID NO: 667523 - RNA, 64 nt, hsa; identical to SEQ ID NO: 461112

SEQ ID NO: 667524 - RNA, 64 nt, hsa; identical to SEQ ID NO: 461113

SEQ ID NO: 667525 - RNA, 64 nt, hsa; identical to SEQ ID NO: 461114

SEQ ID NO: 667526 - RNA, 64 nt, hsa; identical to SEQ ID NO: 461115

SEQ ID NO: 667527 - RNA, 64 nt, hsa; identical to SEQ ID NO: 461116

SEQ ID NO: 667528 - RNA, 64 nt, hsa; identical to SEQ ID NO: 461117

SEQ ID NO: 667529 - RNA, 64 nt, hsa; identical to SEQ ID NO: 461118

SEQ ID NO: 667530 - RNA, 64 nt, hsa; identical to SEQ ID NO: 461119

SEQ ID NO: 667531 - RNA, 64 nt, hsa; identical to SEQ ID NO: 461120

SEQ ID NO: 667532 - RNA, 64 nt, hsa; identical to SEQ ID NO: 461121

SEQ ID NO: 667533 - RNA, 64 nt, hsa; identical to SEQ ID NO: 461122

SEQ ID NO: 667534 - RNA, 64 nt, hsa; identical to SEQ ID NO: 461123

SEQ ID NO: 667535 - RNA, 64 nt, hsa; identical to SEQ ID NO: 461124

SEQ ID NO: 667536 - RNA, 64 nt, hsa; identical to SEQ ID NO: 461125

SEQ ID NO: 667537 - RNA, 64 nt, hsa; identical to SEQ ID NO: 461126

SEQ ID NO: 667538 - RNA, 64 nt, hsa; identical to SEQ ID NO: 461127

SEQ ID NO: 667539 - RNA, 64 nt, hsa; identical to SEQ ID NO: 461128

SEQ ID NO: 667540 - RNA, 64 nt, hsa; identical to SEQ ID NO: 461129

SEQ ID NO: 667541 - RNA, 64 nt, hsa; identical to SEQ ID NO: 461130

SEQ ID NO: 667542 - RNA, 64 nt, hsa; identical to SEQ ID NO: 461131

SEQ ID NO: 667543 - RNA, 64 nt, hsa; identical to SEQ ID NO: 461132

SEQ ID NO: 667544 - RNA, 64 nt, hsa; identical to SEQ ID NO: 461133

SEQ ID NO: 667545 - RNA, 64 nt, hsa; identical to SEQ ID NO: 461134

SEQ ID NO: 667546 - RNA, 64 nt, hsa; identical to SEQ ID NO: 461135

SEQ ID NO: 667547 - RNA, 64 nt, hsa; identical to SEQ ID NO: 461136

SEQ ID NO: 667548 - RNA, 64 nt, hsa; identical to SEQ ID NO: 461137

SEQ ID NO: 667549 - RNA, 64 nt, hsa; identical to SEQ ID NO: 461138

SEQ ID NO: 667550 - RNA, 64 nt, hsa; identical to SEQ ID NO: 461139

SEQ ID NO: 667551 - RNA, 64 nt, hsa; identical to SEQ ID NO: 461140

SEQ ID NO: 667552 - RNA, 64 nt, hsa; identical to SEQ ID NO: 461141

SEQ ID NO: 667553 - RNA, 64 nt, hsa; identical to SEQ ID NO: 461142

SEQ ID NO: 667554 - RNA, 64 nt, hsa; identical to SEQ ID NO: 461143

SEQ ID NO: 667555 - RNA, 64 nt, hsa; identical to SEQ ID NO: 461144

SEQ ID NO: 667556 - RNA, 64 nt, hsa; identical to SEQ ID NO: 461145

SEQ ID NO: 667557 - RNA, 64 nt, hsa; identical to SEQ ID NO: 461146

SEQ ID NO: 667558 - RNA, 64 nt, hsa; identical to SEQ ID NO: 461147

SEQ ID NO: 667559 - RNA, 64 nt, hsa; identical to SEQ ID NO: 461148

SEQ ID NO: 667560 - RNA, 64 nt, hsa; identical to SEQ ID NO: 461149

SEQ ID NO: 667561 - RNA, 64 nt, hsa; identical to SEQ ID NO: 461150

SEQ ID NO: 667562 - RNA, 64 nt, hsa; identical to SEQ ID NO: 461151

SEQ ID NO: 667563 - RNA, 64 nt, hsa; identical to SEQ ID NO: 461152

SEQ ID NO: 667564 - RNA, 64 nt, hsa; identical to SEQ ID NO: 461153

SEQ ID NO: 667565 - RNA, 64 nt, hsa; identical to SEQ ID NO: 461154

SEQ ID NO: 667566 - RNA, 64 nt, hsa; identical to SEQ ID NO: 461155

SEQ ID NO: 667567 - RNA, 64 nt, hsa; identical to SEQ ID NO: 461156

SEQ ID NO: 667568 - RNA, 64 nt, hsa; identical to SEQ ID NO: 461157

SEQ ID NO: 667569 - RNA, 64 nt, hsa; identical to SEQ ID NO: 461158

SEQ ID NO: 667570 - RNA, 64 nt, hsa; identical to SEQ ID NO: 461159

SEQ ID NO: 667571 - RNA, 64 nt, hsa; identical to SEQ ID NO: 461160

SEQ ID NO: 667572 - RNA, 64 nt, hsa; identical to SEQ ID NO: 461161

SEQ ID NO: 667573 - RNA, 64 nt, hsa; identical to SEQ ID NO: 461162

SEQ ID NO: 667574 - RNA, 64 nt, hsa; identical to SEQ ID NO: 461163

SEQ ID NO: 667575 - RNA, 64 nt, hsa; identical to SEQ ID NO: 461164

SEQ ID NO: 667576 - RNA, 64 nt, hsa; identical to SEQ ID NO: 461165

SEQ ID NO: 667577 - RNA, 64 nt, hsa; identical to SEQ ID NO: 461166

SEQ ID NO: 667578 - RNA, 64 nt, hsa; identical to SEQ ID NO: 461167

SEQ ID NO: 667579 - RNA, 64 nt, hsa; identical to SEQ ID NO: 461168

SEQ ID NO: 667580 - RNA, 64 nt, hsa; identical to SEQ ID NO: 461169

SEQ ID NO: 667581 - RNA, 64 nt, hsa; identical to SEQ ID NO: 461170

SEQ ID NO: 667582 - RNA, 64 nt, hsa; identical to SEQ ID NO: 461171

SEQ ID NO: 667583 - RNA, 64 nt, hsa; identical to SEQ ID NO: 461172

SEQ ID NO: 667584 - RNA, 64 nt, hsa; identical to SEQ ID NO: 461173

SEQ ID NO: 667585 - RNA, 64 nt, hsa; identical to SEQ ID NO: 461174

SEQ ID NO: 667586 - RNA, 64 nt, hsa
agugacuucaguugagggcaagucucuggaaaagaggcuguaggcaucuggcagcuaccaugca

SEQ ID NO: 667587 - RNA, 64 nt, hsa
acagucaauauugucaguacuuugcuuugauugaaggcuguagagcugaguuaccaaaauuucu

SEQ ID NO: 667588 - RNA, 64 nt, hsa; identical to SEQ ID NO: 627088

SEQ ID NO: 667589 - RNA, 64 nt, hsa; identical to SEQ ID NO: 627089

SEQ ID NO: 667590 - RNA, 64 nt, hsa; identical to SEQ ID NO: 627090

SEQ ID NO: 667591 - RNA, 64 nt, hsa; identical to SEQ ID NO: 627091

SEQ ID NO: 667592 - RNA, 64 nt, hsa; identical to SEQ ID NO: 627092

SEQ ID NO: 667593 - RNA, 64 nt, hsa; identical to SEQ ID NO: 627093

SEQ ID NO: 667594 - RNA, 64 nt, hsa; identical to SEQ ID NO: 627094

SEQ ID NO: 667595 - RNA, 64 nt, hsa; identical to SEQ ID NO: 627095

SEQ ID NO: 667596 - RNA, 64 nt, hsa; identical to SEQ ID NO: 627096

SEQ ID NO: 667597 - RNA, 64 nt, hsa; identical to SEQ ID NO: 627097

SEQ ID NO: 667598 - RNA, 64 nt, hsa; identical to SEQ ID NO: 627098

SEQ ID NO: 667599 - RNA, 64 nt, hsa; identical to SEQ ID NO: 627099

SEQ ID NO: 667600 - RNA, 64 nt, hsa; identical to SEQ ID NO: 627100

SEQ ID NO: 667601 - RNA, 64 nt, hsa; identical to SEQ ID NO: 627101

SEQ ID NO: 667602 - RNA, 64 nt, hsa; identical to SEQ ID NO: 627102

SEQ ID NO: 667603 - RNA, 64 nt, hsa; identical to SEQ ID NO: 627103

SEQ ID NO: 667604 - RNA, 64 nt, hsa; identical to SEQ ID NO: 104783

SEQ ID NO: 667605 - RNA, 64 nt, hsa; identical to SEQ ID NO: 104784

SEQ ID NO: 667606 - RNA, 64 nt, hsa; identical to SEQ ID NO: 104785

SEQ ID NO: 667607 - RNA, 64 nt, hsa; identical to SEQ ID NO: 104786

SEQ ID NO: 667608 - RNA, 64 nt, hsa; identical to SEQ ID NO: 104787

SEQ ID NO: 667609 - RNA, 64 nt, hsa; identical to SEQ ID NO: 104788

SEQ ID NO: 667610 - RNA, 64 nt, hsa; identical to SEQ ID NO: 104789

SEQ ID NO: 667611 - RNA, 64 nt, hsa; identical to SEQ ID NO: 104790

SEQ ID NO: 667612 - RNA, 64 nt, hsa; identical to SEQ ID NO: 104791

SEQ ID NO: 667613 - RNA, 64 nt, hsa; identical to SEQ ID NO: 104792

SEQ ID NO: 667614 - RNA, 64 nt, hsa; identical to SEQ ID NO: 104793

SEQ ID NO: 667615 - RNA, 64 nt, hsa; identical to SEQ ID NO: 104794

SEQ ID NO: 667616 - RNA, 64 nt, hsa; identical to SEQ ID NO: 104795

SEQ ID NO: 667617 - RNA, 64 nt, hsa; identical to SEQ ID NO: 104796

SEQ ID NO: 667618 - RNA, 64 nt, hsa; identical to SEQ ID NO: 104797

SEQ ID NO: 667619 - RNA, 64 nt, hsa; identical to SEQ ID NO: 104798

SEQ ID NO: 667620 - RNA, 64 nt, hsa; identical to SEQ ID NO: 104799

SEQ ID NO: 667621 - RNA, 64 nt, hsa; identical to SEQ ID NO: 104800

SEQ ID NO: 667622 - RNA, 64 nt, hsa; identical to SEQ ID NO: 104801

SEQ ID NO: 667623 - RNA, 64 nt, hsa; identical to SEQ ID NO: 104802

SEQ ID NO: 667624 - RNA, 64 nt, hsa; identical to SEQ ID NO: 104803

SEQ ID NO: 667625 - RNA, 64 nt, hsa; identical to SEQ ID NO: 104804

SEQ ID NO: 667626 - RNA, 64 nt, hsa; identical to SEQ ID NO: 104805

SEQ ID NO: 667627 - RNA, 64 nt, hsa; identical to SEQ ID NO: 104806

SEQ ID NO: 667628 - RNA, 64 nt, hsa; identical to SEQ ID NO: 104807

SEQ ID NO: 667629 - RNA, 64 nt, hsa; identical to SEQ ID NO: 104808

SEQ ID NO: 667630 - RNA, 64 nt, hsa; identical to SEQ ID NO: 104809

SEQ ID NO: 667631 - RNA, 64 nt, hsa; identical to SEQ ID NO: 104810

SEQ ID NO: 667632 - RNA, 64 nt, hsa; identical to SEQ ID NO: 104811

SEQ ID NO: 667633 - RNA, 64 nt, hsa; identical to SEQ ID NO: 104812

SEQ ID NO: 667634 - RNA, 64 nt, hsa; identical to SEQ ID NO: 104813

SEQ ID NO: 667635 - RNA, 64 nt, hsa; identical to SEQ ID NO: 104814

SEQ ID NO: 667636 - RNA, 64 nt, hsa; identical to SEQ ID NO: 104815

SEQ ID NO: 667637 - RNA, 64 nt, hsa; identical to SEQ ID NO: 104816

SEQ ID NO: 667638 - RNA, 64 nt, hsa; identical to SEQ ID NO: 104817

SEQ ID NO: 667639 - RNA, 64 nt, hsa; identical to SEQ ID NO: 104818

SEQ ID NO: 667640 - RNA, 64 nt, hsa; identical to SEQ ID NO: 104819

SEQ ID NO: 667641 - RNA, 64 nt, hsa; identical to SEQ ID NO: 104820

SEQ ID NO: 667642 - RNA, 64 nt, hsa; identical to SEQ ID NO: 104821

SEQ ID NO: 667643 - RNA, 64 nt, hsa; identical to SEQ ID NO: 104822

SEQ ID NO: 667644 - RNA, 64 nt, hsa; identical to SEQ ID NO: 104823

SEQ ID NO: 667645 - RNA, 64 nt, hsa; identical to SEQ ID NO: 104824

SEQ ID NO: 667646 - RNA, 64 nt, hsa; identical to SEQ ID NO: 104825

SEQ ID NO: 667647 - RNA, 64 nt, hsa; identical to SEQ ID NO: 104826

SEQ ID NO: 667648 - RNA, 64 nt, hsa; identical to SEQ ID NO: 104827

SEQ ID NO: 667649 - RNA, 64 nt, hsa; identical to SEQ ID NO: 104828

SEQ ID NO: 667650 - RNA, 64 nt, hsa; identical to SEQ ID NO: 104829

SEQ ID NO: 667651 - RNA, 64 nt, hsa; identical to SEQ ID NO: 104830

SEQ ID NO: 667652 - RNA, 64 nt, hsa; identical to SEQ ID NO: 104831

SEQ ID NO: 667653 - RNA, 64 nt, hsa; identical to SEQ ID NO: 104832

SEQ ID NO: 667654 - RNA, 64 nt, hsa; identical to SEQ ID NO: 104833

SEQ ID NO: 667655 - RNA, 64 nt, hsa; identical to SEQ ID NO: 104834

SEQ ID NO: 667656 - RNA, 64 nt, hsa; identical to SEQ ID NO: 104835

SEQ ID NO: 667657 - RNA, 64 nt, hsa; identical to SEQ ID NO: 104836

SEQ ID NO: 667658 - RNA, 64 nt, hsa; identical to SEQ ID NO: 104837

SEQ ID NO: 667659 - RNA, 64 nt, hsa; identical to SEQ ID NO: 104838

SEQ ID NO: 667660 - RNA, 64 nt, hsa; identical to SEQ ID NO: 104839

SEQ ID NO: 667661 - RNA, 64 nt, hsa; identical to SEQ ID NO: 104840

SEQ ID NO: 667662 - RNA, 64 nt, hsa; identical to SEQ ID NO: 104841

SEQ ID NO: 667663 - RNA, 64 nt, hsa; identical to SEQ ID NO: 104842

SEQ ID NO: 667664 - RNA, 64 nt, hsa; identical to SEQ ID NO: 104843

SEQ ID NO: 667665 - RNA, 64 nt, hsa; identical to SEQ ID NO: 104844

SEQ ID NO: 667666 - RNA, 64 nt, hsa; identical to SEQ ID NO: 104845

SEQ ID NO: 667667 - RNA, 64 nt, hsa; identical to SEQ ID NO: 104846

SEQ ID NO: 667668 - RNA, 64 nt, hsa; identical to SEQ ID NO: 104847

SEQ ID NO: 667669 - RNA, 64 nt, hsa; identical to SEQ ID NO: 104848

SEQ ID NO: 667670 - RNA, 64 nt, hsa; identical to SEQ ID NO: 104849

SEQ ID NO: 667671 - RNA, 64 nt, hsa; identical to SEQ ID NO: 104850

SEQ ID NO: 667672 - RNA, 64 nt, hsa; identical to SEQ ID NO: 104851

SEQ ID NO: 667673 - RNA, 64 nt, hsa; identical to SEQ ID NO: 104852

SEQ ID NO: 667674 - RNA, 64 nt, hsa; identical to SEQ ID NO: 104853

SEQ ID NO: 667675 - RNA, 64 nt, hsa; identical to SEQ ID NO: 104854

SEQ ID NO: 667676 - RNA, 64 nt, hsa; identical to SEQ ID NO: 104855

SEQ ID NO: 667677 - RNA, 64 nt, hsa; identical to SEQ ID NO: 104856

SEQ ID NO: 667678 - RNA, 64 nt, hsa; identical to SEQ ID NO: 104857

SEQ ID NO: 667679 - RNA, 64 nt, hsa; identical to SEQ ID NO: 104858

SEQ ID NO: 667680 - RNA, 64 nt, hsa; identical to SEQ ID NO: 104859

SEQ ID NO: 667681 - RNA, 64 nt, hsa; identical to SEQ ID NO: 104860

SEQ ID NO: 667682 - RNA, 64 nt, hsa; identical to SEQ ID NO: 104861

SEQ ID NO: 667683 - RNA, 64 nt, hsa; identical to SEQ ID NO: 104862

SEQ ID NO: 667684 - RNA, 64 nt, hsa; identical to SEQ ID NO: 104863

SEQ ID NO: 667685 - RNA, 64 nt, hsa; identical to SEQ ID NO: 104864

SEQ ID NO: 667686 - RNA, 64 nt, hsa; identical to SEQ ID NO: 104865

SEQ ID NO: 667687 - RNA, 64 nt, hsa; identical to SEQ ID NO: 104866

SEQ ID NO: 667688 - RNA, 64 nt, hsa; identical to SEQ ID NO: 104867

SEQ ID NO: 667689 - RNA, 64 nt, hsa; identical to SEQ ID NO: 104868

SEQ ID NO: 667690 - RNA, 64 nt, hsa; identical to SEQ ID NO: 104869

SEQ ID NO: 667691 - RNA, 64 nt, hsa; identical to SEQ ID NO: 104870

SEQ ID NO: 667692 - RNA, 64 nt, hsa; identical to SEQ ID NO: 104871

SEQ ID NO: 667693 - RNA, 64 nt, hsa; identical to SEQ ID NO: 104872

SEQ ID NO: 667694 - RNA, 64 nt, hsa; identical to SEQ ID NO: 104873

SEQ ID NO: 667695 - RNA, 64 nt, hsa; identical to SEQ ID NO: 104874

SEQ ID NO: 667696 - RNA, 64 nt, hsa; identical to SEQ ID NO: 104875

SEQ ID NO: 667697 - RNA, 64 nt, hsa; identical to SEQ ID NO: 104876

SEQ ID NO: 667698 - RNA, 64 nt, hsa; identical to SEQ ID NO: 104877

SEQ ID NO: 667699 - RNA, 61 nt, hsa; identical to SEQ ID NO: 104878

SEQ ID NO: 667700 - RNA, 64 nt, hsa; identical to SEQ ID NO: 104879

SEQ ID NO: 667701 - RNA, 64 nt, hsa
cuggcccauucuuuuuuugacgcagccaaucugugaccacgauuccucccacagaugccuccug

SEQ ID NO: 667702 - RNA, 64 nt, hsa
aagcaccaaagaccuguuaagcaugugcacuacugaccacgacucuggucuuuccuguuguugg

SEQ ID NO: 667703 - RNA, 64 nt, hsa
ggcccucgaggcucagcagagcgugcaccaaugagaccacgaugggaaagggccuauuuaacuc

SEQ ID NO: 667704 - RNA, 64 nt, hsa
uggauuuaaacauauuucccuguggaggggcuuugaccacgaccuuugaagagcuucauuuuga

SEQ ID NO: 667705 - RNA, 64 nt, hsa
gguuauucagugugaccuagagaagaaaucagcggaccacgauuucaagacuuguuaaaaaaga

SEQ ID NO: 667706 - RNA, 64 nt, hsa
cugccaaaugcagucuugguucuaaguucacugugaccacgaagcagcugacugugcaucacgc

SEQ ID NO: 667707 - RNA, 64 nt, hsa
ggcuguugcuggacuacaugcuggccacugcugugaccacgacacugcuggggcagcuucuucc

SEQ ID NO: 667708 - RNA, 64 nt, hsa
acgggcagaaguacagaacagaaauggagaagcugaccacgacuccaucucuucucauuccaga

SEQ ID NO: 667709 - RNA, 64 nt, hsa
aucauuggaacauggggacgagugacggcaggaggaccacgaggaaauacccucaaaacuaacu

SEQ ID NO: 667710 - RNA, 64 nt, hsa
gacccuggaguccaugagggcuccuuuccuuuuugaccacgaccuuggccccagcucugcacuc

SEQ ID NO: 667711 - RNA, 64 nt, hsa
ccaccugagaacuccacuacccuuuucccucccagaccacgaauuagaagauauguggaagaaa

SEQ ID NO: 667712 - RNA, 64 nt, hsa
uaguaaccaaggcccugucucuggcuacucccuggaccacgaggcugauuccucucauuuccag

SEQ ID NO: 667713 - RNA, 64 nt, hsa
cgaucuggugauaauuuugugugcacagcccaaggaccacgaggcuuucugcacuuucugcacc

SEQ ID NO: 667714 - RNA, 64 nt, hsa
guucccuggugcugccucacacuccugagauccagaccacgagaagugaccuucagggucauca

SEQ ID NO: 667715 - RNA, 64 nt, hsa
gagcaaaggaagcauuuaccccgaugguuaccuagaccacgauuauuuggauuggggggagggg

SEQ ID NO: 667716 - RNA, 64 nt, hsa
gugggugcccuguugaccuacccuggaccgaguggaccacgaccucguccauuuaaacccggcu

SEQ ID NO: 667717 - RNA, 64 nt, hsa
ugacuccgccgccccucugccuccgccagggcuggaccacgagcuggccuucucucgucugauc

SEQ ID NO: 667718 - RNA, 64 nt, hsa
ggugguugcauccaaguaucugucuuucuuuauggaccacgaagggaagcccaccuuccuggag

SEQ ID NO: 667719 - RNA, 64 nt, hsa
aggagagcgugcauagcgacacucgggaccuguggaccacgaccacgcugucccaggcacagcu

SEQ ID NO: 667720 - RNA, 64 nt, hsa
acauuuuuuccuaaggaaggaaauaaucaucuaagaccacgaaaaaaggcuguuuuuuguuuuu

SEQ ID NO: 667721 - RNA, 64 nt, hsa
guaugaauguacauaaauauuuuuaacuccuauugaccacgagucucacuucaguuucccaguu

SEQ ID NO: 667722 - RNA, 64 nt, hsa
aggguauuuauugaacuaccagcaguaucuaggagaccacgaaggaauaccacgaaggaauuua

SEQ ID NO: 667723 - RNA, 64 nt, hsa
cugugauugaacgugaaauguguagugccauugggaccacgaagggaauucuugcacaugcucg

SEQ ID NO: 667724 - RNA, 64 nt, hsa
uuggucucuguccugccccauccucgucacuugggaccacgagcccugguucagucacccaggg

SEQ ID NO: 667725 - RNA, 64 nt, hsa
guguucccagcgccccagccugcagcugacugaggaccacgagugagccagcgagggggcggga

SEQ ID NO: 667726 - RNA, 61 nt, hsa
ccgguguuccaacuguuuaaaauugaucagagaccacgaaaagaaauuugugcuucaccga

SEQ ID NO: 667727 - RNA, 64 nt, hsa
cacugcugaugacgaacuaucucuaacuggucuugaccacgagcuaguucugaauugcaggggc

SEQ ID NO: 667728 - RNA, 64 nt, hsa
cuggcguuucgaauaccgaaaagucaacccuguggaccacgacagggcagaaggaguuucuccg

SEQ ID NO: 667729 - RNA, 64 nt, hsa
auuaaucugaaagaucagagaccauguuauuccugaccacgauagaacugcuccugugguuugg

SEQ ID NO: 667730 - RNA, 64 nt, hsa
accugucuuauggaagaaauaugcagguauauaagaccacgauuuucuaaagugcauauuagaa

SEQ ID NO: 667731 - RNA, 64 nt, hsa
cuuaguguccuucuuaacagacucaaaccacauggaccacgaauauucuuucuguccagaaggg

SEQ ID NO: 667732 - RNA, 64 nt, hsa
gugccccuucaccaucaagcucagcgcccggaaggaccacgagggcagcugugacuacaggccu

SEQ ID NO: 667733 - RNA, 64 nt, hsa
caccggcacagggcagagaugcggguggcccaaggaccacgaucaagggguccgggggaccgag

SEQ ID NO: 667734 - RNA, 64 nt, hsa
uugagggcagcguccaggagagcucgggcccugugaccacgaucuacaugcuggcagggaagcc

SEQ ID NO: 667735 - RNA, 64 nt, hsa
ugugucgggcguggggccugcaggugggcgccccgaccacgacuuggcuuccuugugccuuaaa

SEQ ID NO: 667736 - RNA, 64 nt, hsa
uuuucaaaacauuuugaaaagcauuuacuuuuuugaccacgagccaugaguuuucaaaaaaauc

SEQ ID NO: 667737 - RNA, 64 nt, hsa
aggggccaucuggaaacuuguggacagagaagaagaccacgacuggagaagcccccuuucugag

SEQ ID NO: 667738 - RNA, 64 nt, hsa
gcccccgucugugacugaaggcccggugggaaaagaccacgauccuccuugacgaguuuuguuu

SEQ ID NO: 667739 - RNA, 64 nt, hsa
acaccacccagagcacccucugguugugggcuuggaccacgagcccuuagcagggaaggcuggu

SEQ ID NO: 667740 - RNA, 64 nt, hsa
auaaucccagcacuuugggaggccgaggcaggcggaccacgaggucaguaguucgagaccagcc

SEQ ID NO: 667741 - RNA, 64 nt, hsa
ccccuuucccccgccaaauaagaaacgcaagccagaccacgaugauuguagaagucccucccgc

SEQ ID NO: 667742 - RNA, 64 nt, hsa
aaggaaugagaauauguaauacuuaaauaaacaugaccacgaagaaugcuguucugauuuacua

SEQ ID NO: 667743 - RNA, 64 nt, hsa
uacuuaggcacagggacuccgccgcacgcugacggaccacgagggcugaccccuuccagccuga

SEQ ID NO: 667744 - RNA, 64 nt, hsa
ggaagcaccagggcaaggcggacgcucacccugugaccacgauggugaccgugacugugggagg

SEQ ID NO: 667745 - RNA, 64 nt, hsa; identical to SEQ ID NO: 360502

SEQ ID NO: 667746 - RNA, 64 nt, hsa; identical to SEQ ID NO: 360503

SEQ ID NO: 667747 - RNA, 64 nt, hsa; identical to SEQ ID NO: 360504

SEQ ID NO: 667748 - RNA, 64 nt, hsa; identical to SEQ ID NO: 360505

SEQ ID NO: 667749 - RNA, 64 nt, hsa; identical to SEQ ID NO: 360506

SEQ ID NO: 667750 - RNA, 64 nt, hsa; identical to SEQ ID NO: 360507

SEQ ID NO: 667751 - RNA, 64 nt, hsa; identical to SEQ ID NO: 360508

SEQ ID NO: 667752 - RNA, 64 nt, hsa; identical to SEQ ID NO: 360509

SEQ ID NO: 667753 - RNA, 64 nt, hsa; identical to SEQ ID NO: 360510

SEQ ID NO: 667754 - RNA, 64 nt, hsa; identical to SEQ ID NO: 360511

SEQ ID NO: 667755 - RNA, 64 nt, hsa; identical to SEQ ID NO: 360512

SEQ ID NO: 667756 - RNA, 64 nt, hsa; identical to SEQ ID NO: 360513

SEQ ID NO: 667757 - RNA, 64 nt, hsa; identical to SEQ ID NO: 360514

SEQ ID NO: 667758 - RNA, 64 nt, hsa; identical to SEQ ID NO: 360515

SEQ ID NO: 667759 - RNA, 64 nt, hsa; identical to SEQ ID NO: 360516

SEQ ID NO: 667760 - RNA, 64 nt, hsa; identical to SEQ ID NO: 360517

SEQ ID NO: 667761 - RNA, 64 nt, hsa; identical to SEQ ID NO: 360518

SEQ ID NO: 667762 - RNA, 64 nt, hsa; identical to SEQ ID NO: 360519

SEQ ID NO: 667763 - RNA, 64 nt, hsa; identical to SEQ ID NO: 360520

SEQ ID NO: 667764 - RNA, 64 nt, hsa; identical to SEQ ID NO: 360521

SEQ ID NO: 667765 - RNA, 64 nt, hsa; identical to SEQ ID NO: 360522

SEQ ID NO: 667766 - RNA, 64 nt, hsa; identical to SEQ ID NO: 360523

SEQ ID NO: 667767 - RNA, 64 nt, hsa; identical to SEQ ID NO: 360524

SEQ ID NO: 667768 - RNA, 64 nt, hsa; identical to SEQ ID NO: 360525

SEQ ID NO: 667769 - RNA, 64 nt, hsa; identical to SEQ ID NO: 360526

SEQ ID NO: 667770 - RNA, 64 nt, hsa; identical to SEQ ID NO: 360527

SEQ ID NO: 667771 - RNA, 64 nt, hsa; identical to SEQ ID NO: 360528

SEQ ID NO: 667772 - RNA, 64 nt, hsa; identical to SEQ ID NO: 360529

SEQ ID NO: 667773 - RNA, 64 nt, hsa; identical to SEQ ID NO: 360530

SEQ ID NO: 667774 - RNA, 64 nt, hsa; identical to SEQ ID NO: 360531

SEQ ID NO: 667775 - RNA, 64 nt, hsa; identical to SEQ ID NO: 360532

SEQ ID NO: 667776 - RNA, 64 nt, hsa; identical to SEQ ID NO: 360533

SEQ ID NO: 667777 - RNA, 64 nt, hsa; identical to SEQ ID NO: 360534

SEQ ID NO: 667778 - RNA, 64 nt, hsa; identical to SEQ ID NO: 360535

SEQ ID NO: 667779 - RNA, 64 nt, hsa; identical to SEQ ID NO: 360536

SEQ ID NO: 667780 - RNA, 64 nt, hsa; identical to SEQ ID NO: 360537

SEQ ID NO: 667781 - RNA, 64 nt, hsa; identical to SEQ ID NO: 360538

SEQ ID NO: 667782 - RNA, 64 nt, hsa; identical to SEQ ID NO: 360539

SEQ ID NO: 667783 - RNA, 64 nt, hsa; identical to SEQ ID NO: 360540

SEQ ID NO: 667784 - RNA, 64 nt, hsa; identical to SEQ ID NO: 360541

SEQ ID NO: 667785 - RNA, 64 nt, hsa; identical to SEQ ID NO: 360542

SEQ ID NO: 667786 - RNA, 64 nt, hsa; identical to SEQ ID NO: 360543

SEQ ID NO: 667787 - RNA, 64 nt, hsa; identical to SEQ ID NO: 360544

SEQ ID NO: 667788 - RNA, 64 nt, hsa; identical to SEQ ID NO: 360545

SEQ ID NO: 667789 - RNA, 64 nt, hsa; identical to SEQ ID NO: 360546

SEQ ID NO: 667790 - RNA, 56 nt, hsa; identical to SEQ ID NO: 360547

SEQ ID NO: 667791 - RNA, 64 nt, hsa; identical to SEQ ID NO: 360548

SEQ ID NO: 667792 - RNA, 64 nt, hsa; identical to SEQ ID NO: 360549

SEQ ID NO: 667793 - RNA, 64 nt, hsa; identical to SEQ ID NO: 360550

SEQ ID NO: 667794 - RNA, 64 nt, hsa; identical to SEQ ID NO: 360551

SEQ ID NO: 667795 - RNA, 64 nt, hsa; identical to SEQ ID NO: 360552

SEQ ID NO: 667796 - RNA, 64 nt, hsa; identical to SEQ ID NO: 360553

SEQ ID NO: 667797 - RNA, 64 nt, hsa; identical to SEQ ID NO: 360554

SEQ ID NO: 667798 - RNA, 64 nt, hsa; identical to SEQ ID NO: 360555

SEQ ID NO: 667799 - RNA, 64 nt, hsa; identical to SEQ ID NO: 360556

SEQ ID NO: 667800 - RNA, 64 nt, hsa; identical to SEQ ID NO: 360557

SEQ ID NO: 667801 - RNA, 64 nt, hsa; identical to SEQ ID NO: 360558

SEQ ID NO: 667802 - RNA, 64 nt, hsa; identical to SEQ ID NO: 360559

SEQ ID NO: 667803 - RNA, 64 nt, hsa; identical to SEQ ID NO: 360560

SEQ ID NO: 667804 - RNA, 64 nt, hsa; identical to SEQ ID NO: 360561

SEQ ID NO: 667805 - RNA, 64 nt, hsa; identical to SEQ ID NO: 360562

SEQ ID NO: 667806 - RNA, 64 nt, hsa; identical to SEQ ID NO: 360563

SEQ ID NO: 667807 - RNA, 64 nt, hsa; identical to SEQ ID NO: 360564

SEQ ID NO: 667808 - RNA, 64 nt, hsa; identical to SEQ ID NO: 360565

SEQ ID NO: 667809 - RNA, 64 nt, hsa; identical to SEQ ID NO: 360566

SEQ ID NO: 667810 - RNA, 64 nt, hsa; identical to SEQ ID NO: 360567

SEQ ID NO: 667811 - RNA, 64 nt, hsa; identical to SEQ ID NO: 360568

SEQ ID NO: 667812 - RNA, 64 nt, hsa; identical to SEQ ID NO: 360569

SEQ ID NO: 667813 - RNA, 64 nt, hsa; identical to SEQ ID NO: 360570

SEQ ID NO: 667814 - RNA, 64 nt, hsa; identical to SEQ ID NO: 360571

SEQ ID NO: 667815 - RNA, 64 nt, hsa; identical to SEQ ID NO: 360572

SEQ ID NO: 667816 - RNA, 64 nt, hsa; identical to SEQ ID NO: 360573

SEQ ID NO: 667817 - RNA, 64 nt, hsa; identical to SEQ ID NO: 360574

SEQ ID NO: 667818 - RNA, 64 nt, hsa; identical to SEQ ID NO: 360575

SEQ ID NO: 667819 - RNA, 64 nt, hsa; identical to SEQ ID NO: 360576

SEQ ID NO: 667820 - RNA, 64 nt, hsa; identical to SEQ ID NO: 360577

SEQ ID NO: 667821 - RNA, 62 nt, hsa; identical to SEQ ID NO: 360578

SEQ ID NO: 667822 - RNA, 64 nt, hsa; identical to SEQ ID NO: 360579

SEQ ID NO: 667823 - RNA, 64 nt, hsa; identical to SEQ ID NO: 360580

SEQ ID NO: 667824 - RNA, 64 nt, hsa; identical to SEQ ID NO: 360581

SEQ ID NO: 667825 - RNA, 64 nt, hsa; identical to SEQ ID NO: 360582

SEQ ID NO: 667826 - RNA, 64 nt, hsa; identical to SEQ ID NO: 360583

SEQ ID NO: 667827 - RNA, 64 nt, hsa; identical to SEQ ID NO: 360584

SEQ ID NO: 667828 - RNA, 64 nt, hsa; identical to SEQ ID NO: 360585

SEQ ID NO: 667829 - RNA, 64 nt, hsa; identical to SEQ ID NO: 360586

SEQ ID NO: 667830 - RNA, 64 nt, hsa; identical to SEQ ID NO: 360587

SEQ ID NO: 667831 - RNA, 64 nt, hsa; identical to SEQ ID NO: 360588

SEQ ID NO: 667832 - RNA, 64 nt, hsa; identical to SEQ ID NO: 360589

SEQ ID NO: 667833 - RNA, 64 nt, hsa; identical to SEQ ID NO: 360590

SEQ ID NO: 667834 - RNA, 64 nt, hsa; identical to SEQ ID NO: 360591

SEQ ID NO: 667835 - RNA, 64 nt, hsa; identical to SEQ ID NO: 360592

SEQ ID NO: 667836 - RNA, 64 nt, hsa; identical to SEQ ID NO: 360593

SEQ ID NO: 667837 - RNA, 64 nt, hsa; identical to SEQ ID NO: 360594

SEQ ID NO: 667838 - RNA, 64 nt, hsa; identical to SEQ ID NO: 360595

SEQ ID NO: 667839 - RNA, 64 nt, hsa; identical to SEQ ID NO: 360596

SEQ ID NO: 667840 - RNA, 64 nt, hsa; identical to SEQ ID NO: 360597

SEQ ID NO: 667841 - RNA, 64 nt, hsa; identical to SEQ ID NO: 360598

SEQ ID NO: 667842 - RNA, 64 nt, hsa; identical to SEQ ID NO: 360599

SEQ ID NO: 667843 - RNA, 64 nt, hsa; identical to SEQ ID NO: 360600

SEQ ID NO: 667844 - RNA, 64 nt, hsa; identical to SEQ ID NO: 360601

SEQ ID NO: 667845 - RNA, 64 nt, hsa; identical to SEQ ID NO: 360602

SEQ ID NO: 667846 - RNA, 64 nt, hsa; identical to SEQ ID NO: 360603

SEQ ID NO: 667847 - RNA, 64 nt, hsa; identical to SEQ ID NO: 360604

SEQ ID NO: 667848 - RNA, 64 nt, hsa; identical to SEQ ID NO: 360605

SEQ ID NO: 667849 - RNA, 64 nt, hsa; identical to SEQ ID NO: 360606

SEQ ID NO: 667850 - RNA, 64 nt, hsa; identical to SEQ ID NO: 360607

SEQ ID NO: 667851 - RNA, 64 nt, hsa; identical to SEQ ID NO: 360608

SEQ ID NO: 667852 - RNA, 64 nt, hsa; identical to SEQ ID NO: 360609

SEQ ID NO: 667853 - RNA, 64 nt, hsa; identical to SEQ ID NO: 360610

SEQ ID NO: 667854 - RNA, 64 nt, hsa; identical to SEQ ID NO: 366291

SEQ ID NO: 667855 - RNA, 64 nt, hsa; identical to SEQ ID NO: 366292

SEQ ID NO: 667856 - RNA, 64 nt, hsa; identical to SEQ ID NO: 366293

SEQ ID NO: 667857 - RNA, 64 nt, hsa; identical to SEQ ID NO: 366294

SEQ ID NO: 667858 - RNA, 64 nt, hsa; identical to SEQ ID NO: 366295

SEQ ID NO: 667859 - RNA, 64 nt, hsa; identical to SEQ ID NO: 366296

SEQ ID NO: 667860 - RNA, 64 nt, hsa; identical to SEQ ID NO: 366297

SEQ ID NO: 667861 - RNA, 64 nt, hsa; identical to SEQ ID NO: 366298

SEQ ID NO: 667862 - RNA, 64 nt, hsa; identical to SEQ ID NO: 366299

SEQ ID NO: 667863 - RNA, 64 nt, hsa; identical to SEQ ID NO: 366300

SEQ ID NO: 667864 - RNA, 64 nt, hsa; identical to SEQ ID NO: 366301

SEQ ID NO: 667865 - RNA, 64 nt, hsa; identical to SEQ ID NO: 366302

SEQ ID NO: 667866 - RNA, 64 nt, hsa; identical to SEQ ID NO: 366303

SEQ ID NO: 667867 - RNA, 64 nt, hsa; identical to SEQ ID NO: 366304

SEQ ID NO: 667868 - RNA, 64 nt, hsa; identical to SEQ ID NO: 366305

SEQ ID NO: 667869 - RNA, 64 nt, hsa; identical to SEQ ID NO: 366306

SEQ ID NO: 667870 - RNA, 64 nt, hsa; identical to SEQ ID NO: 366307

SEQ ID NO: 667871 - RNA, 64 nt, hsa; identical to SEQ ID NO: 366308

SEQ ID NO: 667872 - RNA, 64 nt, hsa; identical to SEQ ID NO: 366309

SEQ ID NO: 667873 - RNA, 64 nt, hsa; identical to SEQ ID NO: 366310

SEQ ID NO: 667874 - RNA, 64 nt, hsa; identical to SEQ ID NO: 366311

SEQ ID NO: 667875 - RNA, 64 nt, hsa; identical to SEQ ID NO: 366312

SEQ ID NO: 667876 - RNA, 64 nt, hsa; identical to SEQ ID NO: 366313

SEQ ID NO: 667877 - RNA, 64 nt, hsa; identical to SEQ ID NO: 366314

SEQ ID NO: 667878 - RNA, 64 nt, hsa; identical to SEQ ID NO: 366315

SEQ ID NO: 667879 - RNA, 64 nt, hsa; identical to SEQ ID NO: 366316

SEQ ID NO: 667880 - RNA, 64 nt, hsa; identical to SEQ ID NO: 366317

SEQ ID NO: 667881 - RNA, 64 nt, hsa; identical to SEQ ID NO: 366318

SEQ ID NO: 667882 - RNA, 64 nt, hsa; identical to SEQ ID NO: 366319

SEQ ID NO: 667883 - RNA, 64 nt, hsa; identical to SEQ ID NO: 366320

SEQ ID NO: 667884 - RNA, 64 nt, hsa; identical to SEQ ID NO: 366321

SEQ ID NO: 667885 - RNA, 64 nt, hsa; identical to SEQ ID NO: 366322

SEQ ID NO: 667886 - RNA, 64 nt, hsa; identical to SEQ ID NO: 366323

SEQ ID NO: 667887 - RNA, 64 nt, hsa; identical to SEQ ID NO: 366324

SEQ ID NO: 667888 - RNA, 64 nt, hsa; identical to SEQ ID NO: 366325

SEQ ID NO: 667889 - RNA, 64 nt, hsa
gccugggaaucuaagugggagacaauauuaauuuggauccgauuaauuggagauuacuaacugu

SEQ ID NO: 667890 - RNA, 64 nt, hsa
augaagcgagucggguccccaacccgugccccugggauccgagggccccucuccaagcgccugg

SEQ ID NO: 667891 - RNA, 64 nt, hsa
ggacaucguuuaacaccuaaacucauuuaacaaaggauccgagaagaacagggacaguguggga

SEQ ID NO: 667892 - RNA, 64 nt, hsa
aagaggaagaagaaguaggaggagcugugugcccggauccgaggagcaaguuaaucugucccuu

SEQ ID NO: 667893 - RNA, 64 nt, hsa
agccucuccccagguccagcucuggaggggagggggauccgacugcuuuggaccuaaauggccu

SEQ ID NO: 667894 - RNA, 64 nt, hsa
aguuggaagcauacugaagugucuuggugaaccuggauccgaguccaugaguuugaggacuaca

SEQ ID NO: 667895 - RNA, 64 nt, hsa
cccacuggugccggagacggaguggagugggccuggauccgagggaugcuaccucucccuuucc

SEQ ID NO: 667896 - RNA, 64 nt, hsa
ugaacccuuggccauugauagucuaccuuugcugggauccgaaggaacuguacucccccugccc

SEQ ID NO: 667897 - RNA, 64 nt, hsa
ugagccugcuagacugagugacugcaguuaggagggauccgacagagaagaccauuuccacuca

SEQ ID NO: 667898 - RNA, 64 nt, hsa
cacugggaaggacaaagaguuugccgccuuucggggauccgagggacuguggcgaccgugccuc

SEQ ID NO: 667899 - RNA, 64 nt, hsa
ucugcucugugcuccucaaaauauaauuucaaauggauccgaucuaaaucuauaccuagugcag

SEQ ID NO: 667900 - RNA, 64 nt, hsa
uaaaaggauucuuuacugugccagcacggggauuggauccgaagaaacuggcuacugggguuug

SEQ ID NO: 667901 - RNA, 64 nt, hsa
ccauccccccucaccaggggcaggcacagcacagggauccgacuugaauuuucccacugcaccc

SEQ ID NO: 667902 - RNA, 64 nt, hsa
gcccggcccccuguccuggccaagcugccggccuggauccgagcccguguggaggucaaagcua

SEQ ID NO: 667903 - RNA, 64 nt, hsa
auuagcggauuccguuccauuaucaaacccgaguggauccgaauguucucaacuccugaacugc

SEQ ID NO: 667904 - RNA, 64 nt, hsa
cgcuagccuggucaguggucagcaaauuggaagaggauccgaugggaguguaaaugugagacac

SEQ ID NO: 667905 - RNA, 64 nt, hsa
uuggcgagaaaugacuuccaaugauguuguagcuggauccgacuaaguauagcucccccuuccc

SEQ ID NO: 667906 - RNA, 64 nt, hsa
gucagccaccugggaacacaguucugggcaaagaggauccgagguugagaggaaggaggguccc

SEQ ID NO: 667907 - RNA, 64 nt, hsa
guugucucuagauacagaugcacgauuuggccauggauccgacuacucucgccaacagaacaga

SEQ ID NO: 667908 - RNA, 64 nt, hsa
gagccucccaucugggcaguggagccauaaacggggauccgagaagagaguauccacuuuuuuu

SEQ ID NO: 667909 - RNA, 64 nt, hsa
ccaccucuguuccuaacaaagcgguugugagccuggauccgacucccggcagugcugacccugc

SEQ ID NO: 667910 - RNA, 64 nt, hsa
ggcaucuuuucuagagacacauuggaccagaugaggauccgaaacggcagccuuuacguucauc

SEQ ID NO: 667911 - RNA, 64 nt, hsa
uccauggugcccccuggucaacauaaggagcgugggauccgauggaaagguggagcucagggaa

SEQ ID NO: 667912 - RNA, 64 nt, hsa
gaccacgaucuacaugcuggcagggaagccccgcggauccgaaggcccuguccgcucugucuuc

SEQ ID NO: 667913 - RNA, 64 nt, hsa
ucucugcugccuugggguuggcagaacacgugaaggauccgaggagcgagaggaauguccauuu

SEQ ID NO: 667914 - RNA, 64 nt, hsa
ggcaggcccucuaggggcacuggggaacgucuugggauccgaccccgggccgaccgcaccguac

SEQ ID NO: 667915 - RNA, 64 nt, hsa
guguggccaggaaaagacaagcucuucagcuuggggauccgaucuggaagagagauucugaucu

SEQ ID NO: 667916 - RNA, 64 nt, hsa
aagcuguuggaugguuugaugaaggggagugacaggauccgauguaccuauuuaagaauuuaag

SEQ ID NO: 667917 - RNA, 64 nt, hsa
guggggggacagccgaugggagccagcaccagcaggauccgagggcgccccggacagaggucug

SEQ ID NO: 667918 - RNA, 64 nt, hsa
ggguggcugggcagucagggaaggagggucgcccggauccgacauuuuggagagauuccuucac

SEQ ID NO: 667919 - RNA, 64 nt, hsa
caagcagucucuggugcuuuucuucucucaaaauggauccgauaaauauuugaauagagcagau

SEQ ID NO: 667920 - RNA, 64 nt, hsa
aacuuuugauucucuuuuguagcuugagcagggaggauccgaaguucaaaaaugauuucacugc

SEQ ID NO: 667921 - RNA, 64 nt, hsa
aggagcagcugggacccagaacugagccugggagggauccgacagaaaagcucagggcgggucu

SEQ ID NO: 667922 - RNA, 64 nt, hsa
uggcgucaaguucagcuccacgugugccaucaguggauccgauccguccagccauggcuuccua

SEQ ID NO: 667923 - RNA, 64 nt, hsa
gggaaccagagagaaucaacagaucaaugacauaggauccgaagugcaaugauagucacuucua

SEQ ID NO: 667924 - RNA, 64 nt, hsa
aggcugggcaccacaguguuuccaagagcaagcuggauccgaguagauucccuagggcuuguug

SEQ ID NO: 667925 - RNA, 64 nt, hsa; identical to SEQ ID NO: 360473

SEQ ID NO: 667926 - RNA, 64 nt, hsa; identical to SEQ ID NO: 360474

SEQ ID NO: 667927 - RNA, 64 nt, hsa; identical to SEQ ID NO: 360475

SEQ ID NO: 667928 - RNA, 64 nt, hsa; identical to SEQ ID NO: 360476

SEQ ID NO: 667929 - RNA, 64 nt, hsa; identical to SEQ ID NO: 360477

SEQ ID NO: 667930 - RNA, 64 nt, hsa; identical to SEQ ID NO: 360478

SEQ ID NO: 667931 - RNA, 64 nt, hsa; identical to SEQ ID NO: 360479

SEQ ID NO: 667932 - RNA, 64 nt, hsa; identical to SEQ ID NO: 360480

SEQ ID NO: 667933 - RNA, 64 nt, hsa; identical to SEQ ID NO: 360481

SEQ ID NO: 667934 - RNA, 64 nt, hsa; identical to SEQ ID NO: 360482

SEQ ID NO: 667935 - RNA, 64 nt, hsa; identical to SEQ ID NO: 360483

SEQ ID NO: 667936 - RNA, 64 nt, hsa; identical to SEQ ID NO: 360484

SEQ ID NO: 667937 - RNA, 64 nt, hsa
gguggacugaguggugcgagguggagggcuaacaagaggaaagaacuacauucuucagaauaca

SEQ ID NO: 667938 - RNA, 64 nt, hsa
acccauuuagaaaauaacuacaaaguaaaaauguagaggaaauagaaauguauuuuuucaugaa

SEQ ID NO: 667939 - RNA, 64 nt, hsa
ugucauaauuuuuuucccuguuucaaauguguucagaggaaauagaauguaaaacaucacaaaa

SEQ ID NO: 667940 - RNA, 64 nt, hsa
guuagugauauuuggaaauaccuggauauuugcuagaggaaaaaugaaagcaaaacuucguaca

SEQ ID NO: 667941 - RNA, 64 nt, hsa
cuuuugaaaagacagacuccucaaggagagauaaagaggaaagcaccucuuucauuuuuuagug

SEQ ID NO: 667942 - RNA, 64 nt, hsa
uuccccggcuccacccuaggccacuuuuucuaacagaggaaacaaaugguccagcagucguucc

SEQ ID NO: 667943 - RNA, 64 nt, hsa
guagugaaaugaugcggaaagacagcuaucaggaagaggaaauacagaagccugaauaaucuau

SEQ ID NO: 667944 - RNA, 64 nt, hsa
augaaaggacguuuaaaguauauauauuuugucaagaggaaagaagauaaaacuaugccaguuu

SEQ ID NO: 667945 - RNA, 64 nt, hsa
uaucacauauuuaagcaaacaucacauuuggagaagaggaaaucauaaaaucauccuagaagac

SEQ ID NO: 667946 - RNA, 64 nt, hsa
aaauacuccucccaccacacacacaugcuccaaaagaggaaagaaaaaaagauaauuuuuagga

SEQ ID NO: 667947 - RNA, 64 nt, hsa
ucugcacaaaauucugaagagucacaugauccuaagaggaaaguucuguucuauuuuagugaua

SEQ ID NO: 667948 - RNA, 64 nt, hsa
uaccuuuguaaaccugcagaacauuuuacuuaaaagaggaaacacaagaucuucaaugaacguc

SEQ ID NO: 667949 - RNA, 64 nt, hsa
ugacuugcaaauauguuuguacuccagaagaauuagaggaaaagcagauacuagaauucuaauu

SEQ ID NO: 667950 - RNA, 64 nt, hsa
auaguaacaauaccuugcagaggaaaggugggagagaggaaaaaaggaaauucuauagaaaucu

SEQ ID NO: 667951 - RNA, 64 nt, hsa
aaaucaguaacaaaaaauaguaacaauaccuugcagaggaaaggugggagagaggaaaaaagga

SEQ ID NO: 667952 - RNA, 64 nt, hsa
uggcuuuggguuguauaaggaggaucaaaacaacagaggaaaugcugacuuucuagcuuugcau

SEQ ID NO: 667953 - RNA, 64 nt, hsa
ugguggucaacgggagggaggaggagcagacggcagaggaaauccucagcaaaggccugagcca

SEQ ID NO: 667954 - RNA, 64 nt, hsa
caccauauguauuuucuaggauuugagaggaaagagaggaaaaugggggaauggguugcaaaau

SEQ ID NO: 667955 - RNA, 64 nt, hsa
uagcuuccccaccauauguauuuucuaggauuugagaggaaagagaggaaaaugggggaauggg

SEQ ID NO: 667956 - RNA, 64 nt, hsa
cauacauuuccaaaauaaaaugugauuccuuugaagaggaaaaugaauaauacauugaauuaga

SEQ ID NO: 667957 - RNA, 64 nt, hsa
gagauggccugagaagagagaucaaauggaaaggagaggaaagaacucagugcugccuauuagu

SEQ ID NO: 667958 - RNA, 64 nt, hsa
caagagucaaugguacuuguccuagcguuuuggaagaggaaaacaggaacccaccaaaccaacc

SEQ ID NO: 667959 - RNA, 64 nt, hsa
guguaugucaacagaagggauaccgucuccuugaagaggaaacucugucacuccucaugccugu

SEQ ID NO: 667960 - RNA, 64 nt, hsa
aaaaaaguaguuuuuaauacauugguuaggacucagaggaaauacggaaaaaacauuguagaug

SEQ ID NO: 667961 - RNA, 64 nt, hsa
aauuuucagaaaugaauuaucuguacauaugaauagaggaaaauacugagugcuaauguuacag

SEQ ID NO: 667962 - RNA, 64 nt, hsa
gaagcaggccuguuacuuguaugucgcuuuggacagaggaaagugggguaaaaugcuaccugua

SEQ ID NO: 667963 - RNA, 64 nt, hsa
uuuuuucuccuuuucuuuguccucaaccauacuuagaggaaagaaggaauggucuuccaugaac

SEQ ID NO: 667964 - RNA, 64 nt, hsa
uaacucaggagauuccaugucuuucucauauuucagaggaaagauuauaaaauauaaaauuucu

SEQ ID NO: 667965 - RNA, 64 nt, hsa
uaucaacauuccuuaacaggaaauuacaugguugagaggaaaugcauaaaaugaaagaugaaaa

SEQ ID NO: 667966 - RNA, 64 nt, hsa
uuugaggggcacucuaccuugguuaugauucaguagaggaaaaagaccaccuuucuucaauuua

SEQ ID NO: 667967 - RNA, 64 nt, hsa
gguuuguacaagaaaguuuguuugaauguguagaagaggaaaaagcaacaacagcaacaacacg

SEQ ID NO: 667968 - RNA, 64 nt, hsa
cuuguccauucgggguucuucucauaggaaugcuagaggaaagagaacacugccuuacagucac

SEQ ID NO: 667969 - RNA, 64 nt, hsa
ccacuaucaagguuuagugugaagaagaaagcucagaggaaauggcacaguuccacaaucucuu

SEQ ID NO: 667970 - RNA, 64 nt, hsa
uuuauaggaauuugcuuccuaagucuacuuuugaagaggaaaacaggaacguaccauauauuuu

SEQ ID NO: 667971 - RNA, 64 nt, hsa
ucuuuauacuaaaaauauaggcucuugggauuggagaggaaaaauuagaggugauuuucagauu

SEQ ID NO: 667972 - RNA, 64 nt, hsa
cuucuaacaucgcuuccaguaagggagaaacugaagaggaaagacugucuugccagaaauggcc

SEQ ID NO: 667973 - RNA, 64 nt, hsa
ccccuuuccccacuccccucuaguggugaacuuuagaggaaaaggaaguaauugcacaaggagu

SEQ ID NO: 667974 - RNA, 64 nt, hsa
caauagggaaaagaggggaagaagcaucuuaagaagaggaaacagcagagaacuggcuggauga

SEQ ID NO: 667975 - RNA, 64 nt, hsa
cugaaagagcucuugggaagacagagaaacauaaagaggaaauuacagcacaguguggugggug

SEQ ID NO: 667976 - RNA, 64 nt, hsa
guuaacaugucuuucuaaaauugucuauuaaagcagaggaaauaccugccaaaggaaguaugua

SEQ ID NO: 667977 - RNA, 64 nt, hsa
uuugagucauggucuuagauauuagcuauuugugagaggaaacugguuuguaacaauacugcaa

SEQ ID NO: 667978 - RNA, 64 nt, hsa
caggaagaaaauguuuucucuccugcguauguuaagaggaaaucaguuuaaaaugccugcuaau

SEQ ID NO: 667979 - RNA, 64 nt, hsa
gaugugaagauaaaauagugcuuuuuugaaauggagaggaaaaacuuggggaggaagaggccug

SEQ ID NO: 667980 - RNA, 64 nt, hsa
acuggagggucuugcuuuuucaaacucagagcccagaggaaaugcaaggguggauaaacaaaau

SEQ ID NO: 667981 - RNA, 64 nt, hsa
aauucaugcagauauggauggaaagaagacuccaagaggaaaacgaggauggaaaaccuuuuau

SEQ ID NO: 667982 - RNA, 64 nt, hsa
ccauaaaguaaacuaaaaugacacagaggaaaguagaggaaaaugaaauaauuucgguacaucu

SEQ ID NO: 667983 - RNA, 64 nt, hsa
cauauaaauaccauaaaguaaacuaaaaugacacagaggaaaguagaggaaaaugaaauaauuu

SEQ ID NO: 667984 - RNA, 64 nt, hsa
auccuccuuuauguaaaaccacaccaagauucugagaggaaacauuuucaaugagaaaaaugug

SEQ ID NO: 667985 - RNA, 64 nt, hsa
cuaaggagagagaaggcuaaauagagaggaguuuagaggaaaguuuagaagcaggggaaauaca

SEQ ID NO: 667986 - RNA, 64 nt, hsa
ccaaaccuuuaguguuggugguaggaggauggggagaggaaaaaagagcuggcaaagaaaugga

SEQ ID NO: 667987 - RNA, 64 nt, hsa
augugugcaaaacugcagaagcucacugccuauaagaggaaauaagagagaaaguggaggagag

SEQ ID NO: 667988 - RNA, 64 nt, hsa
augugugccuuuguuucccaucagacugucaagaagaggaaagggaggaaaccuagcagaggaa

SEQ ID NO: 667989 - RNA, 64 nt, hsa
gacugucaagaagaggaaagggaggaaaccuagcagaggaaaguguaauuuugguuuaugacuc

SEQ ID NO: 667990 - RNA, 64 nt, hsa
gagugaacuucuuaugggaggcugcagcuggaucagaggaaaaauccagugugacagagugcaa

SEQ ID NO: 667991 - RNA, 64 nt, hsa
agacaguaacuucuaaggucacguuuacuauuucagaggaaauaucuugccaggauaccuaccc

SEQ ID NO: 667992 - RNA, 64 nt, hsa
cccuuacuaaaaaaaguguguauuaggaggagagagaggaaaaaaagaggaaagaaggaaaaaa

SEQ ID NO: 667993 - RNA, 64 nt, hsa
aaaaguguguauuaggaggagagagaggaaaaaaagaggaaagaaggaaaaaaaaaagaauuaa

SEQ ID NO: 667994 - RNA, 64 nt, hsa
uuguuuauuuuuuugauaaugacuggacaucagaagaggaaaaaaacucaaaacaaaagcgaga

SEQ ID NO: 667995 - RNA, 64 nt, hsa
guuccuguccauucacccagccaaauuguguuaaagaggaaagccccacaaacuaaaacagccu

SEQ ID NO: 667996 - RNA, 64 nt, hsa
gguuuauauucugguugucuuuuucuuuuuguaaagaggaaacaauguacagaaaaacaauaaa

SEQ ID NO: 667997 - RNA, 64 nt, hsa
ggacuuaauucuuguuuuuuucccaguuuuauauagaggaaacacuaugauaggauuuccuaaa

SEQ ID NO: 667998 - RNA, 64 nt, hsa
aggacuuacuucuuguuuuuucccaguuuuauauagaggaaacacugucuaugauaggauuucc

SEQ ID NO: 667999 - RNA, 64 nt, hsa
agcaaacucuauaauuauuuugacuaauuacuuaagaggaaaacaguauaaguaucucauucag

SEQ ID NO: 668000 - RNA, 64 nt, hsa
gcccaugauauguauuuuacuuauacuaugccagagaggaaacuauaaaguaauuacacaugua

SEQ ID NO: 668001 - RNA, 64 nt, hsa
uggaaacaggccuucagcccauuggcugcgcuggagaggaaagcaugguuccuuucuuaaagaa

SEQ ID NO: 668002 - RNA, 64 nt, hsa
ccuuacaaaaaaaaaaaaauuguuuagugaauacagaggaaaggaaaaacaaguauuaaaggca

SEQ ID NO: 668003 - RNA, 64 nt, hsa
auguccggguccuuuaucauccuauucauccuggagaggaaaagugucgggcaaagggggaucu

SEQ ID NO: 668004 - RNA, 64 nt, hsa
uucacccacccucagcuucccuuuuccuaaauuaagaggaaaaguggucaaagaaaaacucuuc

SEQ ID NO: 668005 - RNA, 64 nt, hsa
auuuuggcaguagcuguaugggagaaaaagaguaagaggaaauauucccacagccaugaagggu

SEQ ID NO: 668006 - RNA, 64 nt, hsa
ccucagguuugauaucuggcagguuugacuauccagaggaaauuaaauauuuuuauauaaaauu

SEQ ID NO: 668007 - RNA, 64 nt, hsa
acuaauacuguggggaaaaaaaauuuucaagagcagaggaaagucuuucugccuuuuuauaauu

SEQ ID NO: 668008 - RNA, 64 nt, hsa
caggaccccaaaugaaauccaaguggucuucuguagaggaaagcaugauaagaggaggaagaca

SEQ ID NO: 668009 - RNA, 64 nt, hsa
gaucccugggggacucaaagccaaaacugcccaaagaggaaagauugaauccuaaaggggaucc

SEQ ID NO: 668010 - RNA, 64 nt, hsa
caaucccuguccugguuguccaagucgggaucucagaggaaauugcagugauuccacgguuagg

SEQ ID NO: 668011 - RNA, 64 nt, hsa
ugcuuggcugccugucuuucuaggcagucccccuagaggaaaaauguaggaauuuauuuuuucu

SEQ ID NO: 668012 - RNA, 64 nt, hsa
aacacauuuugauucugaucauggggugggggagagaggaaaggagggaggggagaagcccagc

SEQ ID NO: 668013 - RNA, 64 nt, hsa
auuccuuccucccccucaucucacaggggaagggagaggaaagaguuguucucccacuggaagg

SEQ ID NO: 668014 - RNA, 64 nt, hsa
augacauacgcuuuuaaugaaaaggaaucacguuagaggaaaaauauuuauucauuauuuguca

SEQ ID NO: 668015 - RNA, 64 nt, hsa
uugucucuucaucuaauaugauagcgggaaaaggagaggaaacuacugccuuuagaaaauauaa

SEQ ID NO: 668016 - RNA, 64 nt, hsa
cacccaaggaacauuugaucuagcagcagggaugagaggaaagcagaaaugaaugaacugugaa

SEQ ID NO: 668017 - RNA, 64 nt, hsa
cacccccgugucacccuaggccugauaagcgaucagaggaaaggacucauucaugucacgcuuc

SEQ ID NO: 668018 - RNA, 64 nt, hsa
aacacccugccuacaaggagauguuuugaaauggagaggaaaauuggcaccucaucuuuuaaag

SEQ ID NO: 668019 - RNA, 64 nt, hsa
gggcuuuuuaccaccacugugcaggagaacagacagaggaaaugugucucccuccaaggcccca

SEQ ID NO: 668020 - RNA, 64 nt, hsa
ccugaauaucuucucugcucacuuccaccaucuaagaggaaaaggugaguugcucaugcugauu

SEQ ID NO: 668021 - RNA, 64 nt, hsa
aaagguuccuuucaaauaguagagcugcaccuaaagaggaaauuggguuuauaagaaaauggag

SEQ ID NO: 668022 - RNA, 64 nt, hsa
accuuaugaccuugagggaaagccaguucauuuaagaggaaauggacuggcauuuauggugaaa

SEQ ID NO: 668023 - RNA, 64 nt, hsa
uuaauaauuuuaugaaauggcaaagguuuagccaagaggaaauuuuggcaugaauacaggcuug

SEQ ID NO: 668024 - RNA, 64 nt, hsa
uaauaaucuguaccuugugguauuugguacuauuagaggaaaaacuuuggauucagaccuucuu

SEQ ID NO: 668025 - RNA, 64 nt, hsa
gugacaccgcuguggcuuagcccaagacacucccagaggaaaacacugcagaaggaacugguuu

SEQ ID NO: 668026 - RNA, 64 nt, hsa
gaccacagaaaagagaaaggaaaggccaaaaaaaagaggaaaagaaaaauguacaaaaagauuu

SEQ ID NO: 668027 - RNA, 64 nt, hsa
uaugcucucugcucacugguuuucaauaccaccaagaggaaaauauugacaaguuuaaaggcug

SEQ ID NO: 668028 - RNA, 64 nt, hsa
uugcugugacuuaugugcagcuuuccaguugagcagaggaaaauaguggcaggacuguccccca

SEQ ID NO: 668029 - RNA, 64 nt, hsa
ucccaaagagcuaaacaauuccuuacauuuaccaagaggaaagcuuuuacuguguugaagcuaa

SEQ ID NO: 668030 - RNA, 64 nt, hsa
auaggcagacugugucuagagucaugcauggacaagaggaaagugaaaguugaauacucucuuc

SEQ ID NO: 668031 - RNA, 64 nt, hsa; identical to SEQ ID NO: 438956

SEQ ID NO: 668032 - RNA, 64 nt, hsa; identical to SEQ ID NO: 438957

SEQ ID NO: 668033 - RNA, 64 nt, hsa; identical to SEQ ID NO: 438958

SEQ ID NO: 668034 - RNA, 64 nt, hsa; identical to SEQ ID NO: 438959

SEQ ID NO: 668035 - RNA, 64 nt, hsa; identical to SEQ ID NO: 438960

SEQ ID NO: 668036 - RNA, 64 nt, hsa; identical to SEQ ID NO: 438961

SEQ ID NO: 668037 - RNA, 64 nt, hsa; identical to SEQ ID NO: 438962

SEQ ID NO: 668038 - RNA, 64 nt, hsa; identical to SEQ ID NO: 438963

SEQ ID NO: 668039 - RNA, 64 nt, hsa; identical to SEQ ID NO: 438964

SEQ ID NO: 668040 - RNA, 64 nt, hsa; identical to SEQ ID NO: 438965

SEQ ID NO: 668041 - RNA, 64 nt, hsa; identical to SEQ ID NO: 438966

SEQ ID NO: 668042 - RNA, 64 nt, hsa; identical to SEQ ID NO: 438967

SEQ ID NO: 668043 - RNA, 64 nt, hsa; identical to SEQ ID NO: 438968

SEQ ID NO: 668044 - RNA, 64 nt, hsa; identical to SEQ ID NO: 438969

SEQ ID NO: 668045 - RNA, 64 nt, hsa; identical to SEQ ID NO: 438970

SEQ ID NO: 668046 - RNA, 64 nt, hsa; identical to SEQ ID NO: 438971

SEQ ID NO: 668047 - RNA, 64 nt, hsa; identical to SEQ ID NO: 248368

SEQ ID NO: 668048 - RNA, 64 nt, hsa; identical to SEQ ID NO: 248369

SEQ ID NO: 668049 - RNA, 64 nt, hsa; identical to SEQ ID NO: 248370

SEQ ID NO: 668050 - RNA, 64 nt, hsa; identical to SEQ ID NO: 248371

SEQ ID NO: 668051 - RNA, 64 nt, hsa; identical to SEQ ID NO: 248372

SEQ ID NO: 668052 - RNA, 64 nt, hsa; identical to SEQ ID NO: 248373

SEQ ID NO: 668053 - RNA, 64 nt, hsa; identical to SEQ ID NO: 248374

SEQ ID NO: 668054 - RNA, 64 nt, hsa; identical to SEQ ID NO: 248375

SEQ ID NO: 668055 - RNA, 64 nt, hsa; identical to SEQ ID NO: 248376

SEQ ID NO: 668056 - RNA, 64 nt, hsa; identical to SEQ ID NO: 248377

SEQ ID NO: 668057 - RNA, 64 nt, hsa
gaagcuuuuaaaagacacuaaauuguacucuaaaagacacuaaauuguacuaauuguacaaagg

SEQ ID NO: 668058 - RNA, 64 nt, hsa
ugaaaauguuuuaaauauuuaggaagcuuuuaaaagacacuaaauuguacucuaaaagacacua

SEQ ID NO: 668059 - RNA, 64 nt, hsa
ucgggggcggggcgguagguccgaaagaaaccgcagacacuacgaugcacuccucaagcugucu

SEQ ID NO: 668060 - RNA, 64 nt, hsa
agcucucugcgucccuccugggcccuccagcgucagacacuaaugggaguucccgagaugcucg

SEQ ID NO: 668061 - RNA, 64 nt, hsa
uuuuuugagucaagagacugcuccuuguacugggagacacuaguaguauauguuuguaauguua

SEQ ID NO: 668062 - RNA, 64 nt, hsa
ugauaaccaaucacauaguuuuaucaguguauuuagacacuaucuugaaaaucagauuuauaug

SEQ ID NO: 668063 - RNA, 64 nt, hsa
uguaauacagacggcaaugcaauagccuauuuaaagacacuacgugaucugauugagauguaca

SEQ ID NO: 668064 - RNA, 64 nt, hsa
aaauccuguauauguaucuacaugggagacagguagacacuacuuauuuguuacauuuuguacu

SEQ ID NO: 668065 - RNA, 64 nt, hsa; identical to SEQ ID NO: 44393

SEQ ID NO: 668066 - RNA, 64 nt, hsa; identical to SEQ ID NO: 44394

SEQ ID NO: 668067 - RNA, 64 nt, hsa; identical to SEQ ID NO: 44395

SEQ ID NO: 668068 - RNA, 64 nt, hsa; identical to SEQ ID NO: 44396

SEQ ID NO: 668069 - RNA, 64 nt, hsa; identical to SEQ ID NO: 44397

SEQ ID NO: 668070 - RNA, 64 nt, hsa; identical to SEQ ID NO: 44398

SEQ ID NO: 668071 - RNA, 64 nt, hsa; identical to SEQ ID NO: 265889

SEQ ID NO: 668072 - RNA, 64 nt, hsa; identical to SEQ ID NO: 265890

SEQ ID NO: 668073 - RNA, 64 nt, hsa; identical to SEQ ID NO: 265891

SEQ ID NO: 668074 - RNA, 64 nt, hsa; identical to SEQ ID NO: 265892

SEQ ID NO: 668075 - RNA, 64 nt, hsa; identical to SEQ ID NO: 265893

SEQ ID NO: 668076 - RNA, 64 nt, hsa; identical to SEQ ID NO: 265894

SEQ ID NO: 668077 - RNA, 64 nt, hsa; identical to SEQ ID NO: 265895

SEQ ID NO: 668078 - RNA, 64 nt, hsa; identical to SEQ ID NO: 265896

SEQ ID NO: 668079 - RNA, 64 nt, hsa; identical to SEQ ID NO: 265897

SEQ ID NO: 668080 - RNA, 64 nt, hsa; identical to SEQ ID NO: 265898

SEQ ID NO: 668081 - RNA, 64 nt, hsa; identical to SEQ ID NO: 265899

SEQ ID NO: 668082 - RNA, 64 nt, hsa; identical to SEQ ID NO: 265900

SEQ ID NO: 668083 - RNA, 64 nt, hsa; identical to SEQ ID NO: 265901

SEQ ID NO: 668084 - RNA, 64 nt, hsa; identical to SEQ ID NO: 265902

SEQ ID NO: 668085 - RNA, 64 nt, hsa; identical to SEQ ID NO: 265903

SEQ ID NO: 668086 - RNA, 64 nt, hsa; identical to SEQ ID NO: 265904

SEQ ID NO: 668087 - RNA, 64 nt, hsa; identical to SEQ ID NO: 265905

SEQ ID NO: 668088 - RNA, 64 nt, hsa; identical to SEQ ID NO: 265906

SEQ ID NO: 668089 - RNA, 64 nt, hsa; identical to SEQ ID NO: 76596

SEQ ID NO: 668090 - RNA, 64 nt, hsa; identical to SEQ ID NO: 76597

SEQ ID NO: 668091 - RNA, 64 nt, hsa; identical to SEQ ID NO: 76598

SEQ ID NO: 668092 - RNA, 64 nt, hsa; identical to SEQ ID NO: 76599

SEQ ID NO: 668093 - RNA, 64 nt, hsa; identical to SEQ ID NO: 76600

SEQ ID NO: 668094 - RNA, 64 nt, hsa; identical to SEQ ID NO: 76601

SEQ ID NO: 668095 - RNA, 64 nt, hsa; identical to SEQ ID NO: 76602

SEQ ID NO: 668096 - RNA, 64 nt, hsa; identical to SEQ ID NO: 76603

SEQ ID NO: 668097 - RNA, 64 nt, hsa; identical to SEQ ID NO: 76604

SEQ ID NO: 668098 - RNA, 64 nt, hsa; identical to SEQ ID NO: 76605

SEQ ID NO: 668099 - RNA, 64 nt, hsa; identical to SEQ ID NO: 76606

SEQ ID NO: 668100 - RNA, 64 nt, hsa; identical to SEQ ID NO: 76607

SEQ ID NO: 668101 - RNA, 64 nt, hsa; identical to SEQ ID NO: 76608

SEQ ID NO: 668102 - RNA, 64 nt, hsa; identical to SEQ ID NO: 76609

SEQ ID NO: 668103 - RNA, 64 nt, hsa; identical to SEQ ID NO: 76610

SEQ ID NO: 668104 - RNA, 64 nt, hsa; identical to SEQ ID NO: 76611

SEQ ID NO: 668105 - RNA, 64 nt, hsa; identical to SEQ ID NO: 76612

SEQ ID NO: 668106 - RNA, 64 nt, hsa; identical to SEQ ID NO: 76613

SEQ ID NO: 668107 - RNA, 64 nt, hsa; identical to SEQ ID NO: 76614

SEQ ID NO: 668108 - RNA, 64 nt, hsa; identical to SEQ ID NO: 76615

SEQ ID NO: 668109 - RNA, 64 nt, hsa; identical to SEQ ID NO: 76616

SEQ ID NO: 668110 - RNA, 64 nt, hsa; identical to SEQ ID NO: 76617

SEQ ID NO: 668111 - RNA, 64 nt, hsa; identical to SEQ ID NO: 76618

SEQ ID NO: 668112 - RNA, 64 nt, hsa; identical to SEQ ID NO: 76619

SEQ ID NO: 668113 - RNA, 64 nt, hsa; identical to SEQ ID NO: 76620

SEQ ID NO: 668114 - RNA, 50 nt, hsa; identical to SEQ ID NO: 76621

SEQ ID NO: 668115 - RNA, 64 nt, hsa; identical to SEQ ID NO: 76622

SEQ ID NO: 668116 - RNA, 64 nt, hsa; identical to SEQ ID NO: 76623

SEQ ID NO: 668117 - RNA, 64 nt, hsa; identical to SEQ ID NO: 76624

SEQ ID NO: 668118 - RNA, 64 nt, hsa; identical to SEQ ID NO: 76625

SEQ ID NO: 668119 - RNA, 64 nt, hsa; identical to SEQ ID NO: 76626

SEQ ID NO: 668120 - RNA, 64 nt, hsa; identical to SEQ ID NO: 76627

SEQ ID NO: 668121 - RNA, 64 nt, hsa; identical to SEQ ID NO: 76628

SEQ ID NO: 668122 - RNA, 64 nt, hsa; identical to SEQ ID NO: 76629

SEQ ID NO: 668123 - RNA, 64 nt, hsa; identical to SEQ ID NO: 76630

SEQ ID NO: 668124 - RNA, 64 nt, hsa; identical to SEQ ID NO: 76631

SEQ ID NO: 668125 - RNA, 64 nt, hsa; identical to SEQ ID NO: 76632

SEQ ID NO: 668126 - RNA, 64 nt, hsa; identical to SEQ ID NO: 76633

SEQ ID NO: 668127 - RNA, 64 nt, hsa; identical to SEQ ID NO: 76634

SEQ ID NO: 668128 - RNA, 64 nt, hsa; identical to SEQ ID NO: 76635

SEQ ID NO: 668129 - RNA, 64 nt, hsa; identical to SEQ ID NO: 76636

SEQ ID NO: 668130 - RNA, 64 nt, hsa; identical to SEQ ID NO: 76637

SEQ ID NO: 668131 - RNA, 64 nt, hsa; identical to SEQ ID NO: 76638

SEQ ID NO: 668132 - RNA, 64 nt, hsa; identical to SEQ ID NO: 76639

SEQ ID NO: 668133 - RNA, 64 nt, hsa; identical to SEQ ID NO: 76640

SEQ ID NO: 668134 - RNA, 64 nt, hsa; identical to SEQ ID NO: 76641

SEQ ID NO: 668135 - RNA, 64 nt, hsa; identical to SEQ ID NO: 76642

SEQ ID NO: 668136 - RNA, 64 nt, hsa; identical to SEQ ID NO: 76643

SEQ ID NO: 668137 - RNA, 64 nt, hsa; identical to SEQ ID NO: 76644

SEQ ID NO: 668138 - RNA, 64 nt, hsa; identical to SEQ ID NO: 76645

SEQ ID NO: 668139 - RNA, 64 nt, hsa; identical to SEQ ID NO: 76646

SEQ ID NO: 668140 - RNA, 64 nt, hsa; identical to SEQ ID NO: 76647

SEQ ID NO: 668141 - RNA, 64 nt, hsa; identical to SEQ ID NO: 76648

SEQ ID NO: 668142 - RNA, 64 nt, hsa; identical to SEQ ID NO: 76649

SEQ ID NO: 668143 - RNA, 64 nt, hsa; identical to SEQ ID NO: 76650

SEQ ID NO: 668144 - RNA, 64 nt, hsa; identical to SEQ ID NO: 76651

SEQ ID NO: 668145 - RNA, 64 nt, hsa; identical to SEQ ID NO: 76652

SEQ ID NO: 668146 - RNA, 64 nt, hsa; identical to SEQ ID NO: 76653

SEQ ID NO: 668147 - RNA, 64 nt, hsa; identical to SEQ ID NO: 76654

SEQ ID NO: 668148 - RNA, 64 nt, hsa; identical to SEQ ID NO: 76655

SEQ ID NO: 668149 - RNA, 64 nt, hsa; identical to SEQ ID NO: 76656

SEQ ID NO: 668150 - RNA, 64 nt, hsa; identical to SEQ ID NO: 76657

SEQ ID NO: 668151 - RNA, 64 nt, hsa; identical to SEQ ID NO: 76658

SEQ ID NO: 668152 - RNA, 64 nt, hsa; identical to SEQ ID NO: 76659

SEQ ID NO: 668153 - RNA, 64 nt, hsa; identical to SEQ ID NO: 76660

SEQ ID NO: 668154 - RNA, 64 nt, hsa; identical to SEQ ID NO: 76661

SEQ ID NO: 668155 - RNA, 64 nt, hsa; identical to SEQ ID NO: 76662

SEQ ID NO: 668156 - RNA, 64 nt, hsa; identical to SEQ ID NO: 76663

SEQ ID NO: 668157 - RNA, 64 nt, hsa; identical to SEQ ID NO: 76664

SEQ ID NO: 668158 - RNA, 64 nt, hsa; identical to SEQ ID NO: 76665

SEQ ID NO: 668159 - RNA, 64 nt, hsa; identical to SEQ ID NO: 76666

SEQ ID NO: 668160 - RNA, 64 nt, hsa; identical to SEQ ID NO: 76667

SEQ ID NO: 668161 - RNA, 64 nt, hsa; identical to SEQ ID NO: 76668

SEQ ID NO: 668162 - RNA, 64 nt, hsa; identical to SEQ ID NO: 76669

SEQ ID NO: 668163 - RNA, 64 nt, hsa; identical to SEQ ID NO: 76670

SEQ ID NO: 668164 - RNA, 64 nt, hsa; identical to SEQ ID NO: 76671

SEQ ID NO: 668165 - RNA, 64 nt, hsa; identical to SEQ ID NO: 76672

SEQ ID NO: 668166 - RNA, 64 nt, hsa; identical to SEQ ID NO: 76673

SEQ ID NO: 668167 - RNA, 64 nt, hsa; identical to SEQ ID NO: 76674

SEQ ID NO: 668168 - RNA, 64 nt, hsa; identical to SEQ ID NO: 76675

SEQ ID NO: 668169 - RNA, 64 nt, hsa; identical to SEQ ID NO: 76676

SEQ ID NO: 668170 - RNA, 64 nt, hsa; identical to SEQ ID NO: 76677

SEQ ID NO: 668171 - RNA, 64 nt, hsa; identical to SEQ ID NO: 76678

SEQ ID NO: 668172 - RNA, 64 nt, hsa; identical to SEQ ID NO: 76679

SEQ ID NO: 668173 - RNA, 64 nt, hsa; identical to SEQ ID NO: 76680

SEQ ID NO: 668174 - RNA, 64 nt, hsa; identical to SEQ ID NO: 76681

SEQ ID NO: 668175 - RNA, 64 nt, hsa; identical to SEQ ID NO: 76682

SEQ ID NO: 668176 - RNA, 64 nt, hsa; identical to SEQ ID NO: 76683

SEQ ID NO: 668177 - RNA, 64 nt, hsa; identical to SEQ ID NO: 76684

SEQ ID NO: 668178 - RNA, 64 nt, hsa; identical to SEQ ID NO: 76685

SEQ ID NO: 668179 - RNA, 64 nt, hsa; identical to SEQ ID NO: 76686

SEQ ID NO: 668180 - RNA, 64 nt, hsa; identical to SEQ ID NO: 76687

SEQ ID NO: 668181 - RNA, 64 nt, hsa; identical to SEQ ID NO: 76688

SEQ ID NO: 668182 - RNA, 64 nt, hsa; identical to SEQ ID NO: 76689

SEQ ID NO: 668183 - RNA, 64 nt, hsa; identical to SEQ ID NO: 76690

SEQ ID NO: 668184 - RNA, 64 nt, hsa; identical to SEQ ID NO: 76691

SEQ ID NO: 668185 - RNA, 64 nt, hsa; identical to SEQ ID NO: 76692

SEQ ID NO: 668186 - RNA, 64 nt, hsa; identical to SEQ ID NO: 76693

SEQ ID NO: 668187 - RNA, 64 nt, hsa; identical to SEQ ID NO: 76694

SEQ ID NO: 668188 - RNA, 64 nt, hsa; identical to SEQ ID NO: 76695

SEQ ID NO: 668189 - RNA, 64 nt, hsa; identical to SEQ ID NO: 76696

SEQ ID NO: 668190 - RNA, 64 nt, hsa; identical to SEQ ID NO: 76697

SEQ ID NO: 668191 - RNA, 64 nt, hsa; identical to SEQ ID NO: 76698

SEQ ID NO: 668192 - RNA, 64 nt, hsa; identical to SEQ ID NO: 76699

SEQ ID NO: 668193 - RNA, 64 nt, hsa; identical to SEQ ID NO: 76700

SEQ ID NO: 668194 - RNA, 64 nt, hsa; identical to SEQ ID NO: 76701

SEQ ID NO: 668195 - RNA, 64 nt, hsa; identical to SEQ ID NO: 76702

SEQ ID NO: 668196 - RNA, 64 nt, hsa; identical to SEQ ID NO: 76703

SEQ ID NO: 668197 - RNA, 64 nt, hsa; identical to SEQ ID NO: 76704

SEQ ID NO: 668198 - RNA, 64 nt, hsa; identical to SEQ ID NO: 76705

SEQ ID NO: 668199 - RNA, 64 nt, hsa; identical to SEQ ID NO: 76706

SEQ ID NO: 668200 - RNA, 64 nt, hsa; identical to SEQ ID NO: 76707

SEQ ID NO: 668201 - RNA, 64 nt, hsa; identical to SEQ ID NO: 76708

SEQ ID NO: 668202 - RNA, 64 nt, hsa; identical to SEQ ID NO: 76709

SEQ ID NO: 668203 - RNA, 64 nt, hsa; identical to SEQ ID NO: 76710

SEQ ID NO: 668204 - RNA, 64 nt, hsa; identical to SEQ ID NO: 76711

SEQ ID NO: 668205 - RNA, 64 nt, hsa; identical to SEQ ID NO: 76712

SEQ ID NO: 668206 - RNA, 64 nt, hsa; identical to SEQ ID NO: 102117

SEQ ID NO: 668207 - RNA, 64 nt, hsa; identical to SEQ ID NO: 102118

SEQ ID NO: 668208 - RNA, 64 nt, hsa; identical to SEQ ID NO: 102119

SEQ ID NO: 668209 - RNA, 64 nt, hsa; identical to SEQ ID NO: 102120

SEQ ID NO: 668210 - RNA, 64 nt, hsa; identical to SEQ ID NO: 102121

SEQ ID NO: 668211 - RNA, 64 nt, hsa; identical to SEQ ID NO: 102122

SEQ ID NO: 668212 - RNA, 64 nt, hsa; identical to SEQ ID NO: 102123

SEQ ID NO: 668213 - RNA, 64 nt, hsa; identical to SEQ ID NO: 102124

SEQ ID NO: 668214 - RNA, 64 nt, hsa; identical to SEQ ID NO: 102125

SEQ ID NO: 668215 - RNA, 64 nt, hsa; identical to SEQ ID NO: 102126

SEQ ID NO: 668216 - RNA, 64 nt, hsa; identical to SEQ ID NO: 102127

SEQ ID NO: 668217 - RNA, 64 nt, hsa; identical to SEQ ID NO: 102128

SEQ ID NO: 668218 - RNA, 64 nt, hsa; identical to SEQ ID NO: 102129

SEQ ID NO: 668219 - RNA, 64 nt, hsa; identical to SEQ ID NO: 102130

SEQ ID NO: 668220 - RNA, 64 nt, hsa; identical to SEQ ID NO: 102131

SEQ ID NO: 668221 - RNA, 64 nt, hsa; identical to SEQ ID NO: 102132

SEQ ID NO: 668222 - RNA, 64 nt, hsa; identical to SEQ ID NO: 102133

SEQ ID NO: 668223 - RNA, 64 nt, hsa; identical to SEQ ID NO: 102134

SEQ ID NO: 668224 - RNA, 64 nt, hsa; identical to SEQ ID NO: 102135

SEQ ID NO: 668225 - RNA, 64 nt, hsa; identical to SEQ ID NO: 102136

SEQ ID NO: 668226 - RNA, 64 nt, hsa; identical to SEQ ID NO: 102137

SEQ ID NO: 668227 - RNA, 64 nt, hsa; identical to SEQ ID NO: 102138

SEQ ID NO: 668228 - RNA, 64 nt, hsa; identical to SEQ ID NO: 102139

SEQ ID NO: 668229 - RNA, 64 nt, hsa; identical to SEQ ID NO: 102140

SEQ ID NO: 668230 - RNA, 64 nt, hsa; identical to SEQ ID NO: 102141

SEQ ID NO: 668231 - RNA, 64 nt, hsa; identical to SEQ ID NO: 102142

SEQ ID NO: 668232 - RNA, 64 nt, hsa; identical to SEQ ID NO: 102143

SEQ ID NO: 668233 - RNA, 64 nt, hsa; identical to SEQ ID NO: 102144

SEQ ID NO: 668234 - RNA, 64 nt, hsa; identical to SEQ ID NO: 102145

SEQ ID NO: 668235 - RNA, 64 nt, hsa; identical to SEQ ID NO: 102146

SEQ ID NO: 668236 - RNA, 64 nt, hsa; identical to SEQ ID NO: 102147

SEQ ID NO: 668237 - RNA, 64 nt, hsa; identical to SEQ ID NO: 102148

SEQ ID NO: 668238 - RNA, 64 nt, hsa; identical to SEQ ID NO: 102149

SEQ ID NO: 668239 - RNA, 64 nt, hsa; identical to SEQ ID NO: 102150

SEQ ID NO: 668240 - RNA, 64 nt, hsa; identical to SEQ ID NO: 102151

SEQ ID NO: 668241 - RNA, 64 nt, hsa; identical to SEQ ID NO: 102152

SEQ ID NO: 668242 - RNA, 64 nt, hsa; identical to SEQ ID NO: 102153

SEQ ID NO: 668243 - RNA, 64 nt, hsa; identical to SEQ ID NO: 102154

SEQ ID NO: 668244 - RNA, 64 nt, hsa; identical to SEQ ID NO: 102155

SEQ ID NO: 668245 - RNA, 64 nt, hsa; identical to SEQ ID NO: 102156

SEQ ID NO: 668246 - RNA, 64 nt, hsa; identical to SEQ ID NO: 102157

SEQ ID NO: 668247 - RNA, 64 nt, hsa; identical to SEQ ID NO: 102158

SEQ ID NO: 668248 - RNA, 64 nt, hsa; identical to SEQ ID NO: 102159

SEQ ID NO: 668249 - RNA, 64 nt, hsa; identical to SEQ ID NO: 102160

SEQ ID NO: 668250 - RNA, 64 nt, hsa; identical to SEQ ID NO: 102161

SEQ ID NO: 668251 - RNA, 64 nt, hsa; identical to SEQ ID NO: 102162

SEQ ID NO: 668252 - RNA, 64 nt, hsa; identical to SEQ ID NO: 102163

SEQ ID NO: 668253 - RNA, 64 nt, hsa; identical to SEQ ID NO: 102164

SEQ ID NO: 668254 - RNA, 64 nt, hsa; identical to SEQ ID NO: 102165

SEQ ID NO: 668255 - RNA, 64 nt, hsa; identical to SEQ ID NO: 102166

SEQ ID NO: 668256 - RNA, 64 nt, hsa; identical to SEQ ID NO: 102167

SEQ ID NO: 668257 - RNA, 64 nt, hsa; identical to SEQ ID NO: 102168

SEQ ID NO: 668258 - RNA, 64 nt, hsa; identical to SEQ ID NO: 102169

SEQ ID NO: 668259 - RNA, 64 nt, hsa; identical to SEQ ID NO: 102170

SEQ ID NO: 668260 - RNA, 64 nt, hsa; identical to SEQ ID NO: 102171

SEQ ID NO: 668261 - RNA, 64 nt, hsa; identical to SEQ ID NO: 102172

SEQ ID NO: 668262 - RNA, 64 nt, hsa; identical to SEQ ID NO: 102173

SEQ ID NO: 668263 - RNA, 64 nt, hsa; identical to SEQ ID NO: 102174

SEQ ID NO: 668264 - RNA, 64 nt, hsa; identical to SEQ ID NO: 102175

SEQ ID NO: 668265 - RNA, 64 nt, hsa; identical to SEQ ID NO: 102176

SEQ ID NO: 668266 - RNA, 64 nt, hsa; identical to SEQ ID NO: 102177

SEQ ID NO: 668267 - RNA, 64 nt, hsa; identical to SEQ ID NO: 102178

SEQ ID NO: 668268 - RNA, 64 nt, hsa; identical to SEQ ID NO: 102179

SEQ ID NO: 668269 - RNA, 64 nt, hsa; identical to SEQ ID NO: 102180

SEQ ID NO: 668270 - RNA, 64 nt, hsa; identical to SEQ ID NO: 102181

SEQ ID NO: 668271 - RNA, 64 nt, hsa; identical to SEQ ID NO: 102182

SEQ ID NO: 668272 - RNA, 64 nt, hsa; identical to SEQ ID NO: 102183

SEQ ID NO: 668273 - RNA, 64 nt, hsa; identical to SEQ ID NO: 102184

SEQ ID NO: 668274 - RNA, 64 nt, hsa; identical to SEQ ID NO: 102185

SEQ ID NO: 668275 - RNA, 64 nt, hsa; identical to SEQ ID NO: 102186

SEQ ID NO: 668276 - RNA, 64 nt, hsa; identical to SEQ ID NO: 102187

SEQ ID NO: 668277 - RNA, 64 nt, hsa; identical to SEQ ID NO: 102188

SEQ ID NO: 668278 - RNA, 64 nt, hsa; identical to SEQ ID NO: 102189

SEQ ID NO: 668279 - RNA, 64 nt, hsa; identical to SEQ ID NO: 102190

SEQ ID NO: 668280 - RNA, 64 nt, hsa; identical to SEQ ID NO: 102191

SEQ ID NO: 668281 - RNA, 64 nt, hsa; identical to SEQ ID NO: 102192

SEQ ID NO: 668282 - RNA, 64 nt, hsa; identical to SEQ ID NO: 102193

SEQ ID NO: 668283 - RNA, 64 nt, hsa; identical to SEQ ID NO: 102194

SEQ ID NO: 668284 - RNA, 64 nt, hsa; identical to SEQ ID NO: 102195

SEQ ID NO: 668285 - RNA, 64 nt, hsa; identical to SEQ ID NO: 102196

SEQ ID NO: 668286 - RNA, 64 nt, hsa; identical to SEQ ID NO: 102197

SEQ ID NO: 668287 - RNA, 64 nt, hsa; identical to SEQ ID NO: 102198

SEQ ID NO: 668288 - RNA, 64 nt, hsa; identical to SEQ ID NO: 102199

SEQ ID NO: 668289 - RNA, 64 nt, hsa; identical to SEQ ID NO: 102200

SEQ ID NO: 668290 - RNA, 64 nt, hsa; identical to SEQ ID NO: 102201

SEQ ID NO: 668291 - RNA, 64 nt, hsa; identical to SEQ ID NO: 102202

SEQ ID NO: 668292 - RNA, 64 nt, hsa; identical to SEQ ID NO: 102203

SEQ ID NO: 668293 - RNA, 64 nt, hsa; identical to SEQ ID NO: 102204

SEQ ID NO: 668294 - RNA, 64 nt, hsa; identical to SEQ ID NO: 102205

SEQ ID NO: 668295 - RNA, 64 nt, hsa; identical to SEQ ID NO: 102206

SEQ ID NO: 668296 - RNA, 64 nt, hsa; identical to SEQ ID NO: 102207

SEQ ID NO: 668297 - RNA, 64 nt, hsa; identical to SEQ ID NO: 102208

SEQ ID NO: 668298 - RNA, 64 nt, hsa; identical to SEQ ID NO: 102209

SEQ ID NO: 668299 - RNA, 64 nt, hsa; identical to SEQ ID NO: 573683

SEQ ID NO: 668300 - RNA, 64 nt, hsa; identical to SEQ ID NO: 573684

SEQ ID NO: 668301 - RNA, 64 nt, hsa; identical to SEQ ID NO: 573685

SEQ ID NO: 668302 - RNA, 64 nt, hsa; identical to SEQ ID NO: 573686

SEQ ID NO: 668303 - RNA, 64 nt, hsa; identical to SEQ ID NO: 573687

SEQ ID NO: 668304 - RNA, 64 nt, hsa; identical to SEQ ID NO: 573688

SEQ ID NO: 668305 - RNA, 64 nt, hsa; identical to SEQ ID NO: 573689

SEQ ID NO: 668306 - RNA, 64 nt, hsa; identical to SEQ ID NO: 573690

SEQ ID NO: 668307 - RNA, 64 nt, hsa; identical to SEQ ID NO: 573691

SEQ ID NO: 668308 - RNA, 64 nt, hsa; identical to SEQ ID NO: 573692

SEQ ID NO: 668309 - RNA, 64 nt, hsa; identical to SEQ ID NO: 573693

SEQ ID NO: 668310 - RNA, 64 nt, hsa; identical to SEQ ID NO: 573694

SEQ ID NO: 668311 - RNA, 64 nt, hsa; identical to SEQ ID NO: 573695

SEQ ID NO: 668312 - RNA, 64 nt, hsa; identical to SEQ ID NO: 573696

SEQ ID NO: 668313 - RNA, 64 nt, hsa; identical to SEQ ID NO: 573697

SEQ ID NO: 668314 - RNA, 64 nt, hsa; identical to SEQ ID NO: 573698

SEQ ID NO: 668315 - RNA, 64 nt, hsa; identical to SEQ ID NO: 573699

SEQ ID NO: 668316 - RNA, 64 nt, hsa; identical to SEQ ID NO: 573700

SEQ ID NO: 668317 - RNA, 64 nt, hsa; identical to SEQ ID NO: 573701

SEQ ID NO: 668318 - RNA, 64 nt, hsa; identical to SEQ ID NO: 573702

SEQ ID NO: 668319 - RNA, 64 nt, hsa; identical to SEQ ID NO: 573703

SEQ ID NO: 668320 - RNA, 64 nt, hsa; identical to SEQ ID NO: 573704

SEQ ID NO: 668321 - RNA, 64 nt, hsa; identical to SEQ ID NO: 573705

SEQ ID NO: 668322 - RNA, 64 nt, hsa; identical to SEQ ID NO: 573706

SEQ ID NO: 668323 - RNA, 64 nt, hsa; identical to SEQ ID NO: 573707

SEQ ID NO: 668324 - RNA, 64 nt, hsa; identical to SEQ ID NO: 573708

SEQ ID NO: 668325 - RNA, 64 nt, hsa; identical to SEQ ID NO: 573709

SEQ ID NO: 668326 - RNA, 64 nt, hsa; identical to SEQ ID NO: 573710

SEQ ID NO: 668327 - RNA, 64 nt, hsa; identical to SEQ ID NO: 573711

SEQ ID NO: 668328 - RNA, 64 nt, hsa; identical to SEQ ID NO: 573712

SEQ ID NO: 668329 - RNA, 64 nt, hsa; identical to SEQ ID NO: 573713

SEQ ID NO: 668330 - RNA, 64 nt, hsa; identical to SEQ ID NO: 573714

SEQ ID NO: 668331 - RNA, 64 nt, hsa; identical to SEQ ID NO: 573715

SEQ ID NO: 668332 - RNA, 64 nt, hsa; identical to SEQ ID NO: 573716

SEQ ID NO: 668333 - RNA, 64 nt, hsa; identical to SEQ ID NO: 573717

SEQ ID NO: 668334 - RNA, 64 nt, hsa; identical to SEQ ID NO: 573718

SEQ ID NO: 668335 - RNA, 64 nt, hsa; identical to SEQ ID NO: 573719

SEQ ID NO: 668336 - RNA, 64 nt, hsa; identical to SEQ ID NO: 573720

SEQ ID NO: 668337 - RNA, 64 nt, hsa; identical to SEQ ID NO: 573721

SEQ ID NO: 668338 - RNA, 64 nt, hsa; identical to SEQ ID NO: 573722

SEQ ID NO: 668339 - RNA, 63 nt, hsa; identical to SEQ ID NO: 573723

SEQ ID NO: 668340 - RNA, 64 nt, hsa; identical to SEQ ID NO: 573724

SEQ ID NO: 668341 - RNA, 64 nt, hsa; identical to SEQ ID NO: 573725

SEQ ID NO: 668342 - RNA, 64 nt, hsa; identical to SEQ ID NO: 573726

SEQ ID NO: 668343 - RNA, 64 nt, hsa; identical to SEQ ID NO: 573727

SEQ ID NO: 668344 - RNA, 64 nt, hsa; identical to SEQ ID NO: 573728

SEQ ID NO: 668345 - RNA, 64 nt, hsa; identical to SEQ ID NO: 573729

SEQ ID NO: 668346 - RNA, 64 nt, hsa; identical to SEQ ID NO: 573730

SEQ ID NO: 668347 - RNA, 64 nt, hsa; identical to SEQ ID NO: 573731

SEQ ID NO: 668348 - RNA, 64 nt, hsa; identical to SEQ ID NO: 573732

SEQ ID NO: 668349 - RNA, 64 nt, hsa; identical to SEQ ID NO: 573733

SEQ ID NO: 668350 - RNA, 64 nt, hsa; identical to SEQ ID NO: 573734

SEQ ID NO: 668351 - RNA, 64 nt, hsa; identical to SEQ ID NO: 573735

SEQ ID NO: 668352 - RNA, 64 nt, hsa; identical to SEQ ID NO: 573736

SEQ ID NO: 668353 - RNA, 64 nt, hsa; identical to SEQ ID NO: 573737

SEQ ID NO: 668354 - RNA, 64 nt, hsa; identical to SEQ ID NO: 573738

SEQ ID NO: 668355 - RNA, 64 nt, hsa; identical to SEQ ID NO: 573739

SEQ ID NO: 668356 - RNA, 64 nt, hsa; identical to SEQ ID NO: 573740

SEQ ID NO: 668357 - RNA, 64 nt, hsa; identical to SEQ ID NO: 573741

SEQ ID NO: 668358 - RNA, 64 nt, hsa; identical to SEQ ID NO: 573742

SEQ ID NO: 668359 - RNA, 64 nt, hsa; identical to SEQ ID NO: 573743

SEQ ID NO: 668360 - RNA, 64 nt, hsa; identical to SEQ ID NO: 573744

SEQ ID NO: 668361 - RNA, 64 nt, hsa; identical to SEQ ID NO: 573745

SEQ ID NO: 668362 - RNA, 64 nt, hsa; identical to SEQ ID NO: 573746

SEQ ID NO: 668363 - RNA, 64 nt, hsa; identical to SEQ ID NO: 573747

SEQ ID NO: 668364 - RNA, 64 nt, hsa; identical to SEQ ID NO: 573748

SEQ ID NO: 668365 - RNA, 64 nt, hsa; identical to SEQ ID NO: 573749

SEQ ID NO: 668366 - RNA, 64 nt, hsa; identical to SEQ ID NO: 573750

SEQ ID NO: 668367 - RNA, 64 nt, hsa; identical to SEQ ID NO: 573751

SEQ ID NO: 668368 - RNA, 64 nt, hsa; identical to SEQ ID NO: 573752

SEQ ID NO: 668369 - RNA, 64 nt, hsa; identical to SEQ ID NO: 573753

SEQ ID NO: 668370 - RNA, 64 nt, hsa; identical to SEQ ID NO: 573754

SEQ ID NO: 668371 - RNA, 64 nt, hsa; identical to SEQ ID NO: 573755

SEQ ID NO: 668372 - RNA, 64 nt, hsa; identical to SEQ ID NO: 573756

SEQ ID NO: 668373 - RNA, 64 nt, hsa; identical to SEQ ID NO: 573757

SEQ ID NO: 668374 - RNA, 64 nt, hsa; identical to SEQ ID NO: 573758

SEQ ID NO: 668375 - RNA, 64 nt, hsa; identical to SEQ ID NO: 573759

SEQ ID NO: 668376 - RNA, 64 nt, hsa; identical to SEQ ID NO: 573760

SEQ ID NO: 668377 - RNA, 64 nt, hsa; identical to SEQ ID NO: 573761

SEQ ID NO: 668378 - RNA, 64 nt, hsa; identical to SEQ ID NO: 573762

SEQ ID NO: 668379 - RNA, 64 nt, hsa; identical to SEQ ID NO: 573763

SEQ ID NO: 668380 - RNA, 64 nt, hsa; identical to SEQ ID NO: 573764

SEQ ID NO: 668381 - RNA, 64 nt, hsa; identical to SEQ ID NO: 573765

SEQ ID NO: 668382 - RNA, 64 nt, hsa; identical to SEQ ID NO: 573766

SEQ ID NO: 668383 - RNA, 64 nt, hsa; identical to SEQ ID NO: 573767

SEQ ID NO: 668384 - RNA, 64 nt, hsa
uccacaaauggugugaacuaauaugcuggcugcuaccuugcauaaauuaaugauuugaucacac

SEQ ID NO: 668385 - RNA, 64 nt, hsa
gaaggcaccagcuugcaauaugccaucccauuucaccuugcaugugagacagcaaacaaaaucc

SEQ ID NO: 668386 - RNA, 64 nt, hsa
aacuuccuaggacuucucggcucugcccucugugaccuugcagccugcucaggucuuugugcuc

SEQ ID NO: 668387 - RNA, 64 nt, hsa
cacaagacuaacuuuggucucuugaccuuuucuuaccuugcaacugucagugccuccagccaaa

SEQ ID NO: 668388 - RNA, 64 nt, hsa
agucauaugucuggugugacacuuuggagcaaaaaccuugcagugguaaauaaaaaauuuccaa

SEQ ID NO: 668389 - RNA, 64 nt, hsa
ucaauaucuauuuguugagcacuuauugauuaagaccuugcauaugucuguccauuuugauuug

SEQ ID NO: 668390 - RNA, 64 nt, hsa; identical to SEQ ID NO: 564507

SEQ ID NO: 668391 - RNA, 64 nt, hsa; identical to SEQ ID NO: 564508

SEQ ID NO: 668392 - RNA, 64 nt, hsa; identical to SEQ ID NO: 133894

SEQ ID NO: 668393 - RNA, 64 nt, hsa; identical to SEQ ID NO: 133895

SEQ ID NO: 668394 - RNA, 64 nt, hsa; identical to SEQ ID NO: 133896

SEQ ID NO: 668395 - RNA, 64 nt, hsa; identical to SEQ ID NO: 133897

SEQ ID NO: 668396 - RNA, 64 nt, hsa; identical to SEQ ID NO: 133898

SEQ ID NO: 668397 - RNA, 64 nt, hsa; identical to SEQ ID NO: 133899

SEQ ID NO: 668398 - RNA, 64 nt, hsa; identical to SEQ ID NO: 133900

SEQ ID NO: 668399 - RNA, 64 nt, hsa; identical to SEQ ID NO: 133901

SEQ ID NO: 668400 - RNA, 64 nt, hsa; identical to SEQ ID NO: 133902

SEQ ID NO: 668401 - RNA, 64 nt, hsa; identical to SEQ ID NO: 133903

SEQ ID NO: 668402 - RNA, 64 nt, hsa; identical to SEQ ID NO: 133904

SEQ ID NO: 668403 - RNA, 64 nt, hsa; identical to SEQ ID NO: 133905

SEQ ID NO: 668404 - RNA, 64 nt, hsa; identical to SEQ ID NO: 133906

SEQ ID NO: 668405 - RNA, 64 nt, hsa; identical to SEQ ID NO: 133907

SEQ ID NO: 668406 - RNA, 64 nt, hsa; identical to SEQ ID NO: 133908

SEQ ID NO: 668407 - RNA, 64 nt, hsa; identical to SEQ ID NO: 133909

SEQ ID NO: 668408 - RNA, 64 nt, hsa; identical to SEQ ID NO: 133910

SEQ ID NO: 668409 - RNA, 64 nt, hsa; identical to SEQ ID NO: 133911

SEQ ID NO: 668410 - RNA, 64 nt, hsa; identical to SEQ ID NO: 133912

SEQ ID NO: 668411 - RNA, 64 nt, hsa; identical to SEQ ID NO: 133913

SEQ ID NO: 668412 - RNA, 64 nt, hsa; identical to SEQ ID NO: 133914

SEQ ID NO: 668413 - RNA, 64 nt, hsa; identical to SEQ ID NO: 133915

SEQ ID NO: 668414 - RNA, 64 nt, hsa
uagucuaagauuauuaccuucauuaauaccaacaggcugcaaagcaagaguauagauuauugua

SEQ ID NO: 668415 - RNA, 64 nt, hsa
gguuugagaaaaggagggaaguuugcuacaaaggggcugcaaagggaauaggcugauggagcug

SEQ ID NO: 668416 - RNA, 64 nt, hsa
cuaucccugcccagaggugggaacuggaggagugggcugcaagacugagccuaaaugucucccc

SEQ ID NO: 668417 - RNA, 64 nt, hsa
uguuugggggaacuuaagucagauccagaaccuuggcugcaagggagucugggaaaugucauuu

SEQ ID NO: 668418 - RNA, 64 nt, hsa
aacuucuuccuuccccaugcuuugggucaccucgggcugcaacccugucugugccagauugccc

SEQ ID NO: 668419 - RNA, 64 nt, hsa
caggcagcugucuccaccuccaggauguccagcaggcugcaaggagaaggaugccagccaccca

SEQ ID NO: 668420 - RNA, 64 nt, hsa
gacucuccuacauguggcccccauaggccucuguggcugcaaggcggucaguugcugcuugucc

SEQ ID NO: 668421 - RNA, 64 nt, hsa
agagaccaccuugucuuuaaagaucacuuuccugggcugcaauguuccaacccaguuguuccag

SEQ ID NO: 668422 - RNA, 64 nt, hsa
aacagggcaguguuguggggacugcaaaagagaaaacguccaggcgagcccaguuguccucgcc

SEQ ID NO: 668423 - RNA, 64 nt, hsa
caaacaaaacacaauaugccuaggggcacggaugaacguccagggagcccgggccccaggcuuu

SEQ ID NO: 668424 - RNA, 64 nt, hsa
ccaguuaagugucccuucgccaggaagcugccgcaacguccagaccugggucaaguucccacuc

SEQ ID NO: 668425 - RNA, 64 nt, hsa
cccgcuccccaucgccugcccgcagcagcgacgaaacguccaucugaggagccugggccuugcc

SEQ ID NO: 668426 - RNA, 64 nt, hsa
gagacggcaggaggccugagcgauccguacucagaacguccaggagagacgcauggcccgaagu

SEQ ID NO: 668427 - RNA, 64 nt, hsa
caauugguucguggcaggaagcuauuagaagucaaacguccagaugcauuacugcuaucuuagu

SEQ ID NO: 668428 - RNA, 64 nt, hsa
ugucuccaccacacauaguguacuuuggaagcacaacguccaggcugguaccgcagcgccaugc

SEQ ID NO: 668429 - RNA, 64 nt, hsa
uugccaucuggaugacaaacggaagauccacuaaaacguccacgggauuaacagaacguccuug

SEQ ID NO: 668430 - RNA, 64 nt, hsa
cuguauguaauucagucauaaguaagcauuuucuaacguccauuauaucccuuuagguauuacu

SEQ ID NO: 668431 - RNA, 64 nt, hsa
ggggggccuuccuggagugucagggucucugggcaacguccauucagggugcggcauggcuguc

SEQ ID NO: 668432 - RNA, 64 nt, hsa
gacuuuucauucacaacagacagcuuuuaaggcuaacguccagcuguauuuacuucuggcugug

SEQ ID NO: 668433 - RNA, 64 nt, hsa
uuaccccuaaagugagcgagucccuuccugcucuaacguccagugcuuccuugagaucauggaa

SEQ ID NO: 668434 - RNA, 64 nt, hsa
cacggccugcacugugcccacccacuugcuccacaacguccaguugguccugcugccaagagcc

SEQ ID NO: 668435 - RNA, 54 nt, hsa
ugagccucgcgaucuuuugaguccaacguccagcucguucucugggccuucuca

SEQ ID NO: 668436 - RNA, 64 nt, hsa
ggagcuguucucugucgugagugucucuugucuaaacguccauuaagcugagagugcuaugaag

SEQ ID NO: 668437 - RNA, 64 nt, hsa
guuaagaaauuuuauuuuaaaaaauauaaagguuaacguccauaauaaauacuucucuuugaag

SEQ ID NO: 668438 - RNA, 64 nt, hsa
uccaggagggucuccuuccccacugcagaggcagaacguccaagaauggaguaagauuagucau

SEQ ID NO: 668439 - RNA, 64 nt, hsa
uguaaccaccucucugucuuuuuccuuccugagaaacguccaucucucucccuuacuauuccca

SEQ ID NO: 668440 - RNA, 64 nt, hsa
ccaugauuuaagcccauccaaaaagaagggaggaaacguccauuccucucgcacucuccuucuc

SEQ ID NO: 668441 - RNA, 64 nt, hsa
ugcaacccucccugaaccccugcaaaugaaaccaaacguccaccuggguguguucauuccuucc

SEQ ID NO: 668442 - RNA, 64 nt, hsa
ggaauuuuauuuuuucaaguaaaauuuucaaugaaacguccacauaguauugugcuguaacuua

SEQ ID NO: 668443 - RNA, 64 nt, hsa
uuuuuccguuugcuuuuguuccaaugucaaugugaacguccacaugaaaccuacacacugucau

SEQ ID NO: 668444 - RNA, 64 nt, hsa
gaggggauuuuacagccgagggaccuccaaagggaacguccauuugcaugugugcccugguauu

SEQ ID NO: 668445 - RNA, 64 nt, hsa
gaugccaaaugacuuacaucuuaagaagucucagaacguccagcccuucagcagcucucguucu

SEQ ID NO: 668446 - RNA, 64 nt, hsa
gauagcacuggggcagaauaugcaugcauuuuguaacguccaguguggcguugaauagaugugu

SEQ ID NO: 668447 - RNA, 64 nt, hsa
aacauucccaagcaggaaaaccguccguccgaggaacguccauccuggcucucugcggcuggug

SEQ ID NO: 668448 - RNA, 64 nt, hsa
gcaguuuucaggcuaauacagaaaaagaugaacaaacguccagcaagauacuuuaauccucuau

SEQ ID NO: 668449 - RNA, 64 nt, hsa
agcaucagcauccuacuccuggcaacaucaggccaacguccaccccagccucacauugccagau

SEQ ID NO: 668450 - RNA, 64 nt, hsa
gcuggagggcaauggcgccaucucagcucacugcaacguccaccuccuggguucaagcgauucu

SEQ ID NO: 668451 - RNA, 64 nt, hsa
ugaccugccccuggcccuagaacagauccagggcaacguccaggccaaugugccagcuggaggc

SEQ ID NO: 668452 - RNA, 64 nt, hsa
auuguccugccuguguuccagcaugcuuauuucaaacguccaguguugugugugaauauguguu

SEQ ID NO: 668453 - RNA, 64 nt, hsa
ggaauuagauggaagaugauguugaacagcuguuaacguccaaaaaacuuucagaaaaagcugu

SEQ ID NO: 668454 - RNA, 64 nt, hsa
aggccagcuccacaguguugccagagccuuaauaaacguccacagaguauaaauaaccaauucc

SEQ ID NO: 668455 - RNA, 64 nt, hsa
ugcuggaaaagugacuaaugagucaggagcaaggaacguccagggagugggagcagcacaugcg

SEQ ID NO: 668456 - RNA, 64 nt, hsa
gcauacagcacccucuacccuccguggccauggcaacguccagggcccagaacccugaggagug

SEQ ID NO: 668457 - RNA, 64 nt, hsa
uuuauuguuuuuuaaagaauguuuggcacucucuaacguccacuagcuuacugaguuaucaggu

SEQ ID NO: 668458 - RNA, 64 nt, hsa
cccaacuccuuaauuuuauucuccgcuagauuuuaacguccagccuucccucagcugagugggg

SEQ ID NO: 668459 - RNA, 64 nt, hsa
caauugcucugaagaaagaaagacauucaacuugaacguccaaaugaacucaauggacauccgu

SEQ ID NO: 668460 - RNA, 64 nt, hsa
ccuuucauuugucaaccuucauuaaaacuaugacaacguccacaugacaaauguguaagguaca

SEQ ID NO: 668461 - RNA, 64 nt, hsa
cuccgccugcacuuuugaaaccccgguuuccuucaacguccacauuccaggugaccacacgugu

SEQ ID NO: 668462 - RNA, 64 nt, hsa
cgacauuaagaagccucugguuucugucuacuccaacguccacgcgcauagauacaggcauccc

SEQ ID NO: 668463 - RNA, 64 nt, hsa
ccggcaaguucucuuucuucucucugggaaaaugaacguccaggacacaccuguaucccagaga

SEQ ID NO: 668464 - RNA, 64 nt, hsa
uugcuccauucacucccaggugagaauucaggcaaacguccacaaaggucacaggcagcguaca

SEQ ID NO: 668465 - RNA, 64 nt, hsa
ggguauaaacuagaaguuuaaaaaugcuucauagaacguccaggguuuacauuacaagauucuc

SEQ ID NO: 668466 - RNA, 64 nt, hsa
gaugaguuuguagcagggccacaaaacaaagugaaacguccaggggaacccaacaguccuaugu

SEQ ID NO: 668467 - RNA, 64 nt, hsa
aauggcuuugugcuuuugaagauggauugaagagaacguccaccuuaaggcuuuaaaagacagu

SEQ ID NO: 668468 - RNA, 64 nt, hsa
uuugguauccaguuucugaaugugcaaaaugguuaacguccaaaacgcuuaacgucuuuuuuua

SEQ ID NO: 668469 - RNA, 64 nt, hsa
aauggcuuuuugcuuuugaaggugguaugaagagaacguccacuuuaaggcuuuaaaagacagu

SEQ ID NO: 668470 - RNA, 64 nt, hsa; identical to SEQ ID NO: 113667

SEQ ID NO: 668471 - RNA, 64 nt, hsa; identical to SEQ ID NO: 113668

SEQ ID NO: 668472 - RNA, 64 nt, hsa; identical to SEQ ID NO: 113669

SEQ ID NO: 668473 - RNA, 64 nt, hsa; identical to SEQ ID NO: 113670

SEQ ID NO: 668474 - RNA, 64 nt, hsa; identical to SEQ ID NO: 113671

SEQ ID NO: 668475 - RNA, 64 nt, hsa; identical to SEQ ID NO: 113672

SEQ ID NO: 668476 - RNA, 64 nt, hsa; identical to SEQ ID NO: 113673

SEQ ID NO: 668477 - RNA, 64 nt, hsa; identical to SEQ ID NO: 113674

SEQ ID NO: 668478 - RNA, 64 nt, hsa; identical to SEQ ID NO: 113675

SEQ ID NO: 668479 - RNA, 64 nt, hsa; identical to SEQ ID NO: 113676

SEQ ID NO: 668480 - RNA, 64 nt, hsa; identical to SEQ ID NO: 113677

SEQ ID NO: 668481 - RNA, 64 nt, hsa; identical to SEQ ID NO: 113678

SEQ ID NO: 668482 - RNA, 64 nt, hsa; identical to SEQ ID NO: 113679

SEQ ID NO: 668483 - RNA, 64 nt, hsa; identical to SEQ ID NO: 113680

SEQ ID NO: 668484 - RNA, 64 nt, hsa; identical to SEQ ID NO: 113681

SEQ ID NO: 668485 - RNA, 64 nt, hsa; identical to SEQ ID NO: 113682

SEQ ID NO: 668486 - RNA, 64 nt, hsa; identical to SEQ ID NO: 113683

SEQ ID NO: 668487 - RNA, 64 nt, hsa; identical to SEQ ID NO: 113684

SEQ ID NO: 668488 - RNA, 64 nt, hsa; identical to SEQ ID NO: 113685

SEQ ID NO: 668489 - RNA, 64 nt, hsa; identical to SEQ ID NO: 113686

SEQ ID NO: 668490 - RNA, 64 nt, hsa; identical to SEQ ID NO: 113687

SEQ ID NO: 668491 - RNA, 64 nt, hsa; identical to SEQ ID NO: 113688

SEQ ID NO: 668492 - RNA, 64 nt, hsa; identical to SEQ ID NO: 113689

SEQ ID NO: 668493 - RNA, 62 nt, hsa; identical to SEQ ID NO: 113690

SEQ ID NO: 668494 - RNA, 64 nt, hsa; identical to SEQ ID NO: 113691

SEQ ID NO: 668495 - RNA, 59 nt, hsa; identical to SEQ ID NO: 113692

SEQ ID NO: 668496 - RNA, 64 nt, hsa; identical to SEQ ID NO: 113693

SEQ ID NO: 668497 - RNA, 64 nt, hsa; identical to SEQ ID NO: 113694

SEQ ID NO: 668498 - RNA, 64 nt, hsa; identical to SEQ ID NO: 113695

SEQ ID NO: 668499 - RNA, 64 nt, hsa; identical to SEQ ID NO: 113696

SEQ ID NO: 668500 - RNA, 64 nt, hsa; identical to SEQ ID NO: 113697

SEQ ID NO: 668501 - RNA, 64 nt, hsa; identical to SEQ ID NO: 113698

SEQ ID NO: 668502 - RNA, 64 nt, hsa; identical to SEQ ID NO: 113699

SEQ ID NO: 668503 - RNA, 64 nt, hsa; identical to SEQ ID NO: 113700

SEQ ID NO: 668504 - RNA, 64 nt, hsa; identical to SEQ ID NO: 113701

SEQ ID NO: 668505 - RNA, 64 nt, hsa; identical to SEQ ID NO: 113702

SEQ ID NO: 668506 - RNA, 64 nt, hsa; identical to SEQ ID NO: 113703

SEQ ID NO: 668507 - RNA, 64 nt, hsa; identical to SEQ ID NO: 113704

SEQ ID NO: 668508 - RNA, 64 nt, hsa; identical to SEQ ID NO: 113705

SEQ ID NO: 668509 - RNA, 64 nt, hsa; identical to SEQ ID NO: 113706

SEQ ID NO: 668510 - RNA, 64 nt, hsa; identical to SEQ ID NO: 113707

SEQ ID NO: 668511 - RNA, 64 nt, hsa; identical to SEQ ID NO: 113708

SEQ ID NO: 668512 - RNA, 64 nt, hsa; identical to SEQ ID NO: 113709

SEQ ID NO: 668513 - RNA, 64 nt, hsa; identical to SEQ ID NO: 113710

SEQ ID NO: 668514 - RNA, 64 nt, hsa; identical to SEQ ID NO: 113711

SEQ ID NO: 668515 - RNA, 64 nt, hsa; identical to SEQ ID NO: 113712

SEQ ID NO: 668516 - RNA, 64 nt, hsa; identical to SEQ ID NO: 113713

SEQ ID NO: 668517 - RNA, 64 nt, hsa; identical to SEQ ID NO: 113714

SEQ ID NO: 668518 - RNA, 64 nt, hsa; identical to SEQ ID NO: 113715

SEQ ID NO: 668519 - RNA, 64 nt, hsa; identical to SEQ ID NO: 113716

SEQ ID NO: 668520 - RNA, 64 nt, hsa; identical to SEQ ID NO: 113717

SEQ ID NO: 668521 - RNA, 64 nt, hsa; identical to SEQ ID NO: 113718

SEQ ID NO: 668522 - RNA, 64 nt, hsa; identical to SEQ ID NO: 113719

SEQ ID NO: 668523 - RNA, 64 nt, hsa; identical to SEQ ID NO: 113720

SEQ ID NO: 668524 - RNA, 64 nt, hsa; identical to SEQ ID NO: 113721

SEQ ID NO: 668525 - RNA, 64 nt, hsa; identical to SEQ ID NO: 113722

SEQ ID NO: 668526 - RNA, 64 nt, hsa; identical to SEQ ID NO: 113723

SEQ ID NO: 668527 - RNA, 64 nt, hsa; identical to SEQ ID NO: 113724

SEQ ID NO: 668528 - RNA, 64 nt, hsa; identical to SEQ ID NO: 113725

SEQ ID NO: 668529 - RNA, 64 nt, hsa; identical to SEQ ID NO: 113726

SEQ ID NO: 668530 - RNA, 64 nt, hsa; identical to SEQ ID NO: 113727

SEQ ID NO: 668531 - RNA, 64 nt, hsa; identical to SEQ ID NO: 113728

SEQ ID NO: 668532 - RNA, 64 nt, hsa; identical to SEQ ID NO: 113729

SEQ ID NO: 668533 - RNA, 64 nt, hsa; identical to SEQ ID NO: 113730

SEQ ID NO: 668534 - RNA, 64 nt, hsa; identical to SEQ ID NO: 113731

SEQ ID NO: 668535 - RNA, 64 nt, hsa; identical to SEQ ID NO: 113732

SEQ ID NO: 668536 - RNA, 64 nt, hsa; identical to SEQ ID NO: 113733

SEQ ID NO: 668537 - RNA, 64 nt, hsa; identical to SEQ ID NO: 113734

SEQ ID NO: 668538 - RNA, 64 nt, hsa; identical to SEQ ID NO: 113735

SEQ ID NO: 668539 - RNA, 64 nt, hsa; identical to SEQ ID NO: 113736

SEQ ID NO: 668540 - RNA, 64 nt, hsa; identical to SEQ ID NO: 113737

SEQ ID NO: 668541 - RNA, 64 nt, hsa; identical to SEQ ID NO: 113738

SEQ ID NO: 668542 - RNA, 64 nt, hsa; identical to SEQ ID NO: 113739

SEQ ID NO: 668543 - RNA, 64 nt, hsa; identical to SEQ ID NO: 113740

SEQ ID NO: 668544 - RNA, 64 nt, hsa; identical to SEQ ID NO: 113741

SEQ ID NO: 668545 - RNA, 64 nt, hsa; identical to SEQ ID NO: 113742

SEQ ID NO: 668546 - RNA, 64 nt, hsa; identical to SEQ ID NO: 113743

SEQ ID NO: 668547 - RNA, 64 nt, hsa; identical to SEQ ID NO: 113744

SEQ ID NO: 668548 - RNA, 64 nt, hsa; identical to SEQ ID NO: 113745

SEQ ID NO: 668549 - RNA, 64 nt, hsa; identical to SEQ ID NO: 113746

SEQ ID NO: 668550 - RNA, 64 nt, hsa; identical to SEQ ID NO: 113747

SEQ ID NO: 668551 - RNA, 64 nt, hsa; identical to SEQ ID NO: 113748

SEQ ID NO: 668552 - RNA, 64 nt, hsa; identical to SEQ ID NO: 113749

SEQ ID NO: 668553 - RNA, 64 nt, hsa; identical to SEQ ID NO: 113750

SEQ ID NO: 668554 - RNA, 64 nt, hsa; identical to SEQ ID NO: 113751

SEQ ID NO: 668555 - RNA, 64 nt, hsa; identical to SEQ ID NO: 113752

SEQ ID NO: 668556 - RNA, 64 nt, hsa; identical to SEQ ID NO: 113753

SEQ ID NO: 668557 - RNA, 64 nt, hsa; identical to SEQ ID NO: 113754

SEQ ID NO: 668558 - RNA, 64 nt, hsa; identical to SEQ ID NO: 113755

SEQ ID NO: 668559 - RNA, 64 nt, hsa; identical to SEQ ID NO: 113756

SEQ ID NO: 668560 - RNA, 64 nt, hsa; identical to SEQ ID NO: 113757

SEQ ID NO: 668561 - RNA, 64 nt, hsa; identical to SEQ ID NO: 113758

SEQ ID NO: 668562 - RNA, 64 nt, hsa; identical to SEQ ID NO: 113759

SEQ ID NO: 668563 - RNA, 64 nt, hsa; identical to SEQ ID NO: 113760

SEQ ID NO: 668564 - RNA, 64 nt, hsa; identical to SEQ ID NO: 113761

SEQ ID NO: 668565 - RNA, 64 nt, hsa; identical to SEQ ID NO: 113762

SEQ ID NO: 668566 - RNA, 64 nt, hsa; identical to SEQ ID NO: 113763

SEQ ID NO: 668567 - RNA, 64 nt, hsa; identical to SEQ ID NO: 113764

SEQ ID NO: 668568 - RNA, 61 nt, hsa; identical to SEQ ID NO: 113765

SEQ ID NO: 668569 - RNA, 64 nt, hsa; identical to SEQ ID NO: 113766

SEQ ID NO: 668570 - RNA, 64 nt, hsa; identical to SEQ ID NO: 113767

SEQ ID NO: 668571 - RNA, 64 nt, hsa; identical to SEQ ID NO: 113768

SEQ ID NO: 668572 - RNA, 64 nt, hsa; identical to SEQ ID NO: 113769

SEQ ID NO: 668573 - RNA, 64 nt, hsa; identical to SEQ ID NO: 113770

SEQ ID NO: 668574 - RNA, 64 nt, hsa; identical to SEQ ID NO: 113771

SEQ ID NO: 668575 - RNA, 64 nt, hsa; identical to SEQ ID NO: 113772

SEQ ID NO: 668576 - RNA, 64 nt, hsa; identical to SEQ ID NO: 113773

SEQ ID NO: 668577 - RNA, 64 nt, hsa; identical to SEQ ID NO: 113774

SEQ ID NO: 668578 - RNA, 64 nt, hsa; identical to SEQ ID NO: 113775

SEQ ID NO: 668579 - RNA, 64 nt, hsa; identical to SEQ ID NO: 113776

SEQ ID NO: 668580 - RNA, 64 nt, hsa; identical to SEQ ID NO: 113777

SEQ ID NO: 668581 - RNA, 64 nt, hsa; identical to SEQ ID NO: 113778

SEQ ID NO: 668582 - RNA, 64 nt, hsa; identical to SEQ ID NO: 113779

SEQ ID NO: 668583 - RNA, 64 nt, hsa; identical to SEQ ID NO: 113780

SEQ ID NO: 668584 - RNA, 64 nt, hsa; identical to SEQ ID NO: 113781

SEQ ID NO: 668585 - RNA, 64 nt, hsa; identical to SEQ ID NO: 113782

SEQ ID NO: 668586 - RNA, 64 nt, hsa; identical to SEQ ID NO: 113783

SEQ ID NO: 668587 - RNA, 64 nt, hsa; identical to SEQ ID NO: 113784

SEQ ID NO: 668588 - RNA, 64 nt, hsa; identical to SEQ ID NO: 113785

SEQ ID NO: 668589 - RNA, 64 nt, hsa; identical to SEQ ID NO: 113786

SEQ ID NO: 668590 - RNA, 64 nt, hsa; identical to SEQ ID NO: 113787

SEQ ID NO: 668591 - RNA, 64 nt, hsa; identical to SEQ ID NO: 113788

SEQ ID NO: 668592 - RNA, 64 nt, hsa; identical to SEQ ID NO: 113789

SEQ ID NO: 668593 - RNA, 64 nt, hsa; identical to SEQ ID NO: 113790

SEQ ID NO: 668594 - RNA, 64 nt, hsa; identical to SEQ ID NO: 113791

SEQ ID NO: 668595 - RNA, 64 nt, hsa; identical to SEQ ID NO: 113792

SEQ ID NO: 668596 - RNA, 64 nt, hsa; identical to SEQ ID NO: 113793

SEQ ID NO: 668597 - RNA, 64 nt, hsa; identical to SEQ ID NO: 113794

SEQ ID NO: 668598 - RNA, 64 nt, hsa; identical to SEQ ID NO: 113795

SEQ ID NO: 668599 - RNA, 64 nt, hsa; identical to SEQ ID NO: 113796

SEQ ID NO: 668600 - RNA, 64 nt, hsa; identical to SEQ ID NO: 113797

SEQ ID NO: 668601 - RNA, 64 nt, hsa; identical to SEQ ID NO: 113798

SEQ ID NO: 668602 - RNA, 64 nt, hsa; identical to SEQ ID NO: 113799

SEQ ID NO: 668603 - RNA, 64 nt, hsa; identical to SEQ ID NO: 113800

SEQ ID NO: 668604 - RNA, 64 nt, hsa; identical to SEQ ID NO: 113801

SEQ ID NO: 668605 - RNA, 64 nt, hsa; identical to SEQ ID NO: 113802

SEQ ID NO: 668606 - RNA, 64 nt, hsa; identical to SEQ ID NO: 113803

SEQ ID NO: 668607 - RNA, 64 nt, hsa; identical to SEQ ID NO: 113804

SEQ ID NO: 668608 - RNA, 64 nt, hsa; identical to SEQ ID NO: 113805

SEQ ID NO: 668609 - RNA, 64 nt, hsa; identical to SEQ ID NO: 113806

SEQ ID NO: 668610 - RNA, 64 nt, hsa; identical to SEQ ID NO: 113807

SEQ ID NO: 668611 - RNA, 64 nt, hsa; identical to SEQ ID NO: 113808

SEQ ID NO: 668612 - RNA, 64 nt, hsa; identical to SEQ ID NO: 113809

SEQ ID NO: 668613 - RNA, 64 nt, hsa; identical to SEQ ID NO: 113810

SEQ ID NO: 668614 - RNA, 64 nt, hsa; identical to SEQ ID NO: 113811

SEQ ID NO: 668615 - RNA, 64 nt, hsa; identical to SEQ ID NO: 125388

SEQ ID NO: 668616 - RNA, 64 nt, hsa; identical to SEQ ID NO: 125389

SEQ ID NO: 668617 - RNA, 64 nt, hsa; identical to SEQ ID NO: 125390

SEQ ID NO: 668618 - RNA, 64 nt, hsa; identical to SEQ ID NO: 125391

SEQ ID NO: 668619 - RNA, 64 nt, hsa; identical to SEQ ID NO: 125392

SEQ ID NO: 668620 - RNA, 64 nt, hsa; identical to SEQ ID NO: 125393

SEQ ID NO: 668621 - RNA, 64 nt, hsa; identical to SEQ ID NO: 125394

SEQ ID NO: 668622 - RNA, 64 nt, hsa; identical to SEQ ID NO: 125395

SEQ ID NO: 668623 - RNA, 64 nt, hsa; identical to SEQ ID NO: 125396

SEQ ID NO: 668624 - RNA, 64 nt, hsa; identical to SEQ ID NO: 125397

SEQ ID NO: 668625 - RNA, 64 nt, hsa; identical to SEQ ID NO: 125398

SEQ ID NO: 668626 - RNA, 64 nt, hsa; identical to SEQ ID NO: 125399

SEQ ID NO: 668627 - RNA, 64 nt, hsa; identical to SEQ ID NO: 125400

SEQ ID NO: 668628 - RNA, 64 nt, hsa; identical to SEQ ID NO: 125401

SEQ ID NO: 668629 - RNA, 64 nt, hsa
uaguccaugguacauauauaccacauuuucuuuauccacuuaucaguugauggacacuuagguu

SEQ ID NO: 668630 - RNA, 64 nt, hsa
acuguguauguucuuguguaccuacagcuaagcuuccacuuauaagugagaacaugcaguauuu

SEQ ID NO: 668631 - RNA, 64 nt, hsa
uuaaagaacaaaccaugugacaaaauuguuaccuuccacuuacuguagcaaauaauaccuacaa

SEQ ID NO: 668632 - RNA, 64 nt, hsa
uauuugcuguuguguaauauccauggacauguaauccacuuacuccaucuuuacaaucccuuuu

SEQ ID NO: 668633 - RNA, 64 nt, hsa
gccauuaccaacuccaaauaaucucaaauaauuuuccacuuaauaacuguaaaguuuuuuucug

SEQ ID NO: 668634 - RNA, 64 nt, hsa
cuauuugcccuuaguuuagaucuccaucaucaauuccacuuacuauuguaauaccuucagcugg

SEQ ID NO: 668635 - RNA, 64 nt, hsa
acagcaguuucaccaucuuugaggugaggguggggugccccagcuaggaagcaagaucgcugug

SEQ ID NO: 668636 - RNA, 64 nt, hsa
gauaauauauacaaaccuuuagcugugaauggcugugccccaccuguuguccugaacugugagu

SEQ ID NO: 668637 - RNA, 50 nt, hsa
gggcguccgcugcucccugagugccccacuccggaguuauccugcucccc

SEQ ID NO: 668638 - RNA, 64 nt, hsa
ucccccaucgugggacacgacacacccagaccgcgugccccaccgucuuagcuucaauccuggc

SEQ ID NO: 668639 - RNA, 64 nt, hsa
gagaaaugcuggcugagggucacuugcuugcucugugccccaugaggcagcaccugccccagau

SEQ ID NO: 668640 - RNA, 64 nt, hsa
aggucacugcuguggcgagucuugcuaugucugggugccccauagucacagaacaccuggacac

SEQ ID NO: 668641 - RNA, 64 nt, hsa
gggucacugccacauggagucuugccaugccugugugccccacagaccuaauauauguccggac

SEQ ID NO: 668642 - RNA, 64 nt, hsa
ggagccacugucaugcaggucauaucagaucugagugccccacagagucacagugugucuggac

SEQ ID NO: 668643 - RNA, 64 nt, hsa
agacauccagggaaagaggaagaaaggccuuagugugccccagcagucuggcugcguccagcca

SEQ ID NO: 668644 - RNA, 64 nt, hsa
gugcacgaagggggcacaggagaggagaggggcugugccccaggcuccccauuucccagcuccu

SEQ ID NO: 668645 - RNA, 64 nt, hsa
uggcgauggcuucugcuagcugucacccugccuugugccccaggcauccucagccucuggugag

SEQ ID NO: 668646 - RNA, 64 nt, hsa
cugccagagaccauccaggacguggagagaaagagugccccaaccagucuucaggaggaagaga

SEQ ID NO: 668647 - RNA, 64 nt, hsa
aagcuuguagguggguggugugcauaggccacgugugccccacauaugcagggggugccccaca

SEQ ID NO: 668648 - RNA, 64 nt, hsa
ugcauaggccacgugugccccacauaugcagggggugccccacacagcuagagcggccaggaga

SEQ ID NO: 668649 - RNA, 64 nt, hsa
gagagcuggaaaggggcaacccugagcagcaggugugccccaugcccuguggguuuccccuaug

SEQ ID NO: 668650 - RNA, 64 nt, hsa
gugccaggagccaaccuggucuucccgagggucagugccccagugaagacagaagcgagagaau

SEQ ID NO: 668651 - RNA, 64 nt, hsa
cuuccuccucccugcuuccucuccuccccuguacgugccccagcauucugggguuauuuaacaa

SEQ ID NO: 668652 - RNA, 64 nt, hsa
gauacaacccugauuuuugaccuugcccuuggcagugccccacauccucuuauuccuacauccc

SEQ ID NO: 668653 - RNA, 64 nt, hsa
gagaccaucaccuggcucaucguuuccaccaagagugccccacaggagugccccacagacccgc

SEQ ID NO: 668654 - RNA, 64 nt, hsa
ggcucaucguuuccaccaagagugccccacaggagugccccacagacccgcuggaccagccugc

SEQ ID NO: 668655 - RNA, 64 nt, hsa
ccagcggcacuaaugacccgcuccuuugacauuggugccccacuccaucagcacuaacgcccug

SEQ ID NO: 668656 - RNA, 64 nt, hsa
uccaucaucacuacguccagcuccaacggcacuggugccccauuccaucggcacuaacgccccg

SEQ ID NO: 668657 - RNA, 64 nt, hsa
ggugggggguccagucugugauccuuggugcugugugccccacuccagccuggggaccccacuu

SEQ ID NO: 668658 - RNA, 64 nt, hsa
cuguucucuuggcugcaaauaaggacagcagcuggugccccaccugccuggugcauugcugugu

SEQ ID NO: 668659 - RNA, 64 nt, hsa
cagcagguccuaauccugugugccagggcaggcagugccccaggggcaccacgccugacucucc

SEQ ID NO: 668660 - RNA, 64 nt, hsa
uugguuuuauccacuuuucuuggauaaucaggaggugccccaguggucacaguguggcauuccg

SEQ ID NO: 668661 - RNA, 64 nt, hsa
gggugagggugucuuuaagaugcccaccgugacagugccccagcuugagcuggacguggggcua

SEQ ID NO: 668662 - RNA, 64 nt, hsa
uucagcagagggcacagcaggcuacaggguucaggugccccaggugacccugucucugccugga

SEQ ID NO: 668663 - RNA, 64 nt, hsa
acugggaggccaaggagaagcaagacuggcauaugugccccaacaucuucugagcgccacccuu

SEQ ID NO: 668664 - RNA, 64 nt, hsa
uugcaucccuccucauccuaggaggccccuaggggugccccaucucaguguccccugaacucuu

SEQ ID NO: 668665 - RNA, 64 nt, hsa
cuuuggaagcagcaaggugggggucaggcuacaggugccccaccuccccagagcccugcaguca

SEQ ID NO: 668666 - RNA, 64 nt, hsa
gcacccugcaggcaggcagaccacgguguggggggugccccacaaggcccagcccugggcaagg

SEQ ID NO: 668667 - RNA, 64 nt, hsa
gcuggugggauaggagggugccccugggaacacagugccccaguggugcgggccaggucuggcg

SEQ ID NO: 668668 - RNA, 64 nt, hsa
uccaaaugcuucuuccaguucauuuuucagccaucaguucaagagccaaugccuuuuuaaaaua

SEQ ID NO: 668669 - RNA, 64 nt, hsa
auguauuuucaaauagaguucaggaucugcaauucaguucaacacaaguuuguugagcuuuaaa

SEQ ID NO: 668670 - RNA, 64 nt, hsa
uccaaguucucacugcuggaaagagcuagaagcacaguucaaaguucuggcuucuggacucugc

SEQ ID NO: 668671 - RNA, 64 nt, hsa
aaguggcccauaacuugaaggaaaaguuuaaagacaguucaauuuaaucaucagaaugcauucu

SEQ ID NO: 668672 - RNA, 64 nt, hsa
ucauguguuuaaacaaaucccauauguugggcaacaguucaaauaagcacggagaaguguugcc

SEQ ID NO: 668673 - RNA, 64 nt, hsa
agacaauguugcaauguugaaugacaaaaauaaacaguucaagugaagcacaaggauuaaguug

SEQ ID NO: 668674 - RNA, 64 nt, hsa
aaagcacaacacuaauguucguuuccuuagaccucaguucaagugccccuauuuauuucaauaa

SEQ ID NO: 668675 - RNA, 64 nt, hsa
guugauuuccuguuuccuccucccccgccucuuccaguucaaaggagucugcaauuggaacugc

SEQ ID NO: 668676 - RNA, 64 nt, hsa
uuugaagggcaugcuguaauuucacacaauuuuccaguucaaaaauggagaauacuucgccuaa

SEQ ID NO: 668677 - RNA, 64 nt, hsa
acgugaucuuggcucacugcgaccuccaccuccccaguucaagcgauucuccugccucagccuc

SEQ ID NO: 668678 - RNA, 64 nt, hsa
aucucggcucacuucagccuccgccaccucaaggcaguucaagcaauucuccugccucagccuc

SEQ ID NO: 668679 - RNA, 64 nt, hsa
acacuggacacucuuaggaaguaucaaaauagaacaguucaauuugcagcuacuuaaugauuaa

SEQ ID NO: 668680 - RNA, 64 nt, hsa; identical to SEQ ID NO: 87407

SEQ ID NO: 668681 - RNA, 64 nt, hsa; identical to SEQ ID NO: 87408

SEQ ID NO: 668682 - RNA, 64 nt, hsa; identical to SEQ ID NO: 87409

SEQ ID NO: 668683 - RNA, 64 nt, hsa; identical to SEQ ID NO: 87410

SEQ ID NO: 668684 - RNA, 64 nt, hsa; identical to SEQ ID NO: 87411

SEQ ID NO: 668685 - RNA, 64 nt, hsa; identical to SEQ ID NO: 87412

SEQ ID NO: 668686 - RNA, 64 nt, hsa; identical to SEQ ID NO: 87413

SEQ ID NO: 668687 - RNA, 64 nt, hsa; identical to SEQ ID NO: 87414

SEQ ID NO: 668688 - RNA, 64 nt, hsa; identical to SEQ ID NO: 87415

SEQ ID NO: 668689 - RNA, 64 nt, hsa; identical to SEQ ID NO: 87416

SEQ ID NO: 668690 - RNA, 64 nt, hsa; identical to SEQ ID NO: 87417

SEQ ID NO: 668691 - RNA, 64 nt, hsa; identical to SEQ ID NO: 87418

SEQ ID NO: 668692 - RNA, 64 nt, hsa; identical to SEQ ID NO: 87419

SEQ ID NO: 668693 - RNA, 64 nt, hsa; identical to SEQ ID NO: 87420

SEQ ID NO: 668694 - RNA, 64 nt, hsa; identical to SEQ ID NO: 87421

SEQ ID NO: 668695 - RNA, 64 nt, hsa; identical to SEQ ID NO: 87422

SEQ ID NO: 668696 - RNA, 64 nt, hsa; identical to SEQ ID NO: 87423

SEQ ID NO: 668697 - RNA, 64 nt, hsa; identical to SEQ ID NO: 87424

SEQ ID NO: 668698 - RNA, 64 nt, hsa; identical to SEQ ID NO: 238476

SEQ ID NO: 668699 - RNA, 64 nt, hsa; identical to SEQ ID NO: 238477

SEQ ID NO: 668700 - RNA, 53 nt, hsa; identical to SEQ ID NO: 238478

SEQ ID NO: 668701 - RNA, 64 nt, hsa; identical to SEQ ID NO: 238479

SEQ ID NO: 668702 - RNA, 64 nt, hsa; identical to SEQ ID NO: 238480

SEQ ID NO: 668703 - RNA, 64 nt, hsa; identical to SEQ ID NO: 238481

SEQ ID NO: 668704 - RNA, 64 nt, hsa; identical to SEQ ID NO: 238482

SEQ ID NO: 668705 - RNA, 64 nt, hsa; identical to SEQ ID NO: 238483

SEQ ID NO: 668706 - RNA, 64 nt, hsa; identical to SEQ ID NO: 238484

SEQ ID NO: 668707 - RNA, 64 nt, hsa; identical to SEQ ID NO: 238485

SEQ ID NO: 668708 - RNA, 64 nt, hsa; identical to SEQ ID NO: 238486

SEQ ID NO: 668709 - RNA, 64 nt, hsa; identical to SEQ ID NO: 238487

SEQ ID NO: 668710 - RNA, 64 nt, hsa; identical to SEQ ID NO: 238488

SEQ ID NO: 668711 - RNA, 64 nt, hsa; identical to SEQ ID NO: 238489

SEQ ID NO: 668712 - RNA, 64 nt, hsa; identical to SEQ ID NO: 294474

SEQ ID NO: 668713 - RNA, 64 nt, hsa; identical to SEQ ID NO: 294475

SEQ ID NO: 668714 - RNA, 64 nt, hsa; identical to SEQ ID NO: 294476

SEQ ID NO: 668715 - RNA, 64 nt, hsa; identical to SEQ ID NO: 294477

SEQ ID NO: 668716 - RNA, 64 nt, hsa; identical to SEQ ID NO: 294478

SEQ ID NO: 668717 - RNA, 64 nt, hsa; identical to SEQ ID NO: 294479

SEQ ID NO: 668718 - RNA, 64 nt, hsa; identical to SEQ ID NO: 667937

SEQ ID NO: 668719 - RNA, 64 nt, hsa; identical to SEQ ID NO: 667938

SEQ ID NO: 668720 - RNA, 64 nt, hsa; identical to SEQ ID NO: 667939

SEQ ID NO: 668721 - RNA, 64 nt, hsa; identical to SEQ ID NO: 667940

SEQ ID NO: 668722 - RNA, 64 nt, hsa; identical to SEQ ID NO: 667941

SEQ ID NO: 668723 - RNA, 64 nt, hsa; identical to SEQ ID NO: 667942

SEQ ID NO: 668724 - RNA, 64 nt, hsa; identical to SEQ ID NO: 667943

SEQ ID NO: 668725 - RNA, 64 nt, hsa; identical to SEQ ID NO: 667944

SEQ ID NO: 668726 - RNA, 64 nt, hsa; identical to SEQ ID NO: 667945

SEQ ID NO: 668727 - RNA, 64 nt, hsa; identical to SEQ ID NO: 667946

SEQ ID NO: 668728 - RNA, 64 nt, hsa; identical to SEQ ID NO: 667947

SEQ ID NO: 668729 - RNA, 64 nt, hsa; identical to SEQ ID NO: 667948

SEQ ID NO: 668730 - RNA, 64 nt, hsa; identical to SEQ ID NO: 667949

SEQ ID NO: 668731 - RNA, 64 nt, hsa; identical to SEQ ID NO: 667950

SEQ ID NO: 668732 - RNA, 64 nt, hsa; identical to SEQ ID NO: 667951

SEQ ID NO: 668733 - RNA, 64 nt, hsa; identical to SEQ ID NO: 667952

SEQ ID NO: 668734 - RNA, 64 nt, hsa; identical to SEQ ID NO: 667953

SEQ ID NO: 668735 - RNA, 64 nt, hsa; identical to SEQ ID NO: 667954

SEQ ID NO: 668736 - RNA, 64 nt, hsa; identical to SEQ ID NO: 667955

SEQ ID NO: 668737 - RNA, 64 nt, hsa; identical to SEQ ID NO: 667956

SEQ ID NO: 668738 - RNA, 64 nt, hsa; identical to SEQ ID NO: 667957

SEQ ID NO: 668739 - RNA, 64 nt, hsa; identical to SEQ ID NO: 667958

SEQ ID NO: 668740 - RNA, 64 nt, hsa; identical to SEQ ID NO: 667959

SEQ ID NO: 668741 - RNA, 64 nt, hsa; identical to SEQ ID NO: 667960

SEQ ID NO: 668742 - RNA, 64 nt, hsa; identical to SEQ ID NO: 667961

SEQ ID NO: 668743 - RNA, 64 nt, hsa; identical to SEQ ID NO: 667962

SEQ ID NO: 668744 - RNA, 64 nt, hsa; identical to SEQ ID NO: 667963

SEQ ID NO: 668745 - RNA, 64 nt, hsa; identical to SEQ ID NO: 667964

SEQ ID NO: 668746 - RNA, 64 nt, hsa; identical to SEQ ID NO: 667965

SEQ ID NO: 668747 - RNA, 64 nt, hsa; identical to SEQ ID NO: 667966

SEQ ID NO: 668748 - RNA, 64 nt, hsa; identical to SEQ ID NO: 667967

SEQ ID NO: 668749 - RNA, 64 nt, hsa; identical to SEQ ID NO: 667968

SEQ ID NO: 668750 - RNA, 64 nt, hsa; identical to SEQ ID NO: 667969

SEQ ID NO: 668751 - RNA, 64 nt, hsa; identical to SEQ ID NO: 667970

SEQ ID NO: 668752 - RNA, 64 nt, hsa; identical to SEQ ID NO: 667971

SEQ ID NO: 668753 - RNA, 64 nt, hsa; identical to SEQ ID NO: 667972

SEQ ID NO: 668754 - RNA, 64 nt, hsa; identical to SEQ ID NO: 667973

SEQ ID NO: 668755 - RNA, 64 nt, hsa; identical to SEQ ID NO: 667974

SEQ ID NO: 668756 - RNA, 64 nt, hsa; identical to SEQ ID NO: 667975

SEQ ID NO: 668757 - RNA, 64 nt, hsa; identical to SEQ ID NO: 667976

SEQ ID NO: 668758 - RNA, 64 nt, hsa; identical to SEQ ID NO: 667977

SEQ ID NO: 668759 - RNA, 64 nt, hsa; identical to SEQ ID NO: 667978

SEQ ID NO: 668760 - RNA, 64 nt, hsa; identical to SEQ ID NO: 667979

SEQ ID NO: 668761 - RNA, 64 nt, hsa; identical to SEQ ID NO: 667980

SEQ ID NO: 668762 - RNA, 64 nt, hsa; identical to SEQ ID NO: 667981

SEQ ID NO: 668763 - RNA, 64 nt, hsa; identical to SEQ ID NO: 667982

SEQ ID NO: 668764 - RNA, 64 nt, hsa; identical to SEQ ID NO: 667983

SEQ ID NO: 668765 - RNA, 64 nt, hsa; identical to SEQ ID NO: 667984

SEQ ID NO: 668766 - RNA, 64 nt, hsa; identical to SEQ ID NO: 667985

SEQ ID NO: 668767 - RNA, 64 nt, hsa; identical to SEQ ID NO: 667986

SEQ ID NO: 668768 - RNA, 64 nt, hsa; identical to SEQ ID NO: 667987

SEQ ID NO: 668769 - RNA, 64 nt, hsa; identical to SEQ ID NO: 667988

SEQ ID NO: 668770 - RNA, 64 nt, hsa; identical to SEQ ID NO: 667989

SEQ ID NO: 668771 - RNA, 64 nt, hsa; identical to SEQ ID NO: 667990

SEQ ID NO: 668772 - RNA, 64 nt, hsa; identical to SEQ ID NO: 667991

SEQ ID NO: 668773 - RNA, 64 nt, hsa; identical to SEQ ID NO: 667992

SEQ ID NO: 668774 - RNA, 64 nt, hsa; identical to SEQ ID NO: 667993

SEQ ID NO: 668775 - RNA, 64 nt, hsa; identical to SEQ ID NO: 667994

SEQ ID NO: 668776 - RNA, 64 nt, hsa; identical to SEQ ID NO: 667995

SEQ ID NO: 668777 - RNA, 64 nt, hsa; identical to SEQ ID NO: 667996

SEQ ID NO: 668778 - RNA, 64 nt, hsa; identical to SEQ ID NO: 667997

SEQ ID NO: 668779 - RNA, 64 nt, hsa; identical to SEQ ID NO: 667998

SEQ ID NO: 668780 - RNA, 64 nt, hsa; identical to SEQ ID NO: 667999

SEQ ID NO: 668781 - RNA, 64 nt, hsa; identical to SEQ ID NO: 668000

SEQ ID NO: 668782 - RNA, 64 nt, hsa; identical to SEQ ID NO: 668001

SEQ ID NO: 668783 - RNA, 64 nt, hsa; identical to SEQ ID NO: 668002

SEQ ID NO: 668784 - RNA, 64 nt, hsa; identical to SEQ ID NO: 668003

SEQ ID NO: 668785 - RNA, 64 nt, hsa; identical to SEQ ID NO: 668004

SEQ ID NO: 668786 - RNA, 64 nt, hsa; identical to SEQ ID NO: 668005

SEQ ID NO: 668787 - RNA, 64 nt, hsa; identical to SEQ ID NO: 668006

SEQ ID NO: 668788 - RNA, 64 nt, hsa; identical to SEQ ID NO: 668007

SEQ ID NO: 668789 - RNA, 64 nt, hsa; identical to SEQ ID NO: 668008

SEQ ID NO: 668790 - RNA, 64 nt, hsa; identical to SEQ ID NO: 668009

SEQ ID NO: 668791 - RNA, 64 nt, hsa; identical to SEQ ID NO: 668010

SEQ ID NO: 668792 - RNA, 64 nt, hsa; identical to SEQ ID NO: 668011

SEQ ID NO: 668793 - RNA, 64 nt, hsa; identical to SEQ ID NO: 668012

SEQ ID NO: 668794 - RNA, 64 nt, hsa; identical to SEQ ID NO: 668013

SEQ ID NO: 668795 - RNA, 64 nt, hsa; identical to SEQ ID NO: 668014

SEQ ID NO: 668796 - RNA, 64 nt, hsa; identical to SEQ ID NO: 668015

SEQ ID NO: 668797 - RNA, 64 nt, hsa; identical to SEQ ID NO: 668016

SEQ ID NO: 668798 - RNA, 64 nt, hsa; identical to SEQ ID NO: 668017

SEQ ID NO: 668799 - RNA, 64 nt, hsa; identical to SEQ ID NO: 668018

SEQ ID NO: 668800 - RNA, 64 nt, hsa; identical to SEQ ID NO: 668019

SEQ ID NO: 668801 - RNA, 64 nt, hsa; identical to SEQ ID NO: 668020

SEQ ID NO: 668802 - RNA, 64 nt, hsa; identical to SEQ ID NO: 668021

SEQ ID NO: 668803 - RNA, 64 nt, hsa; identical to SEQ ID NO: 668022

SEQ ID NO: 668804 - RNA, 64 nt, hsa; identical to SEQ ID NO: 668023

SEQ ID NO: 668805 - RNA, 64 nt, hsa; identical to SEQ ID NO: 668024

SEQ ID NO: 668806 - RNA, 64 nt, hsa; identical to SEQ ID NO: 668025

SEQ ID NO: 668807 - RNA, 64 nt, hsa; identical to SEQ ID NO: 668026

SEQ ID NO: 668808 - RNA, 64 nt, hsa; identical to SEQ ID NO: 668027

SEQ ID NO: 668809 - RNA, 64 nt, hsa; identical to SEQ ID NO: 668028

SEQ ID NO: 668810 - RNA, 64 nt, hsa; identical to SEQ ID NO: 668029

SEQ ID NO: 668811 - RNA, 64 nt, hsa; identical to SEQ ID NO: 668030

SEQ ID NO: 668812 - RNA, 64 nt, hsa; identical to SEQ ID NO: 420116

SEQ ID NO: 668813 - RNA, 64 nt, hsa; identical to SEQ ID NO: 420117

SEQ ID NO: 668814 - RNA, 64 nt, hsa; identical to SEQ ID NO: 420118

SEQ ID NO: 668815 - RNA, 64 nt, hsa; identical to SEQ ID NO: 420119

SEQ ID NO: 668816 - RNA, 64 nt, hsa; identical to SEQ ID NO: 420120

SEQ ID NO: 668817 - RNA, 64 nt, hsa; identical to SEQ ID NO: 420121

SEQ ID NO: 668818 - RNA, 64 nt, hsa; identical to SEQ ID NO: 420122

SEQ ID NO: 668819 - RNA, 64 nt, hsa; identical to SEQ ID NO: 420123

SEQ ID NO: 668820 - RNA, 64 nt, hsa; identical to SEQ ID NO: 420124

SEQ ID NO: 668821 - RNA, 64 nt, hsa; identical to SEQ ID NO: 420125

SEQ ID NO: 668822 - RNA, 64 nt, hsa; identical to SEQ ID NO: 420126

SEQ ID NO: 668823 - RNA, 64 nt, hsa; identical to SEQ ID NO: 420127

SEQ ID NO: 668824 - RNA, 64 nt, hsa; identical to SEQ ID NO: 420128

SEQ ID NO: 668825 - RNA, 64 nt, hsa; identical to SEQ ID NO: 420129

SEQ ID NO: 668826 - RNA, 64 nt, hsa; identical to SEQ ID NO: 420130

SEQ ID NO: 668827 - RNA, 64 nt, hsa; identical to SEQ ID NO: 420131

SEQ ID NO: 668828 - RNA, 64 nt, hsa; identical to SEQ ID NO: 420132

SEQ ID NO: 668829 - RNA, 64 nt, hsa; identical to SEQ ID NO: 420133

SEQ ID NO: 668830 - RNA, 64 nt, hsa; identical to SEQ ID NO: 420134

SEQ ID NO: 668831 - RNA, 64 nt, hsa; identical to SEQ ID NO: 420135

SEQ ID NO: 668832 - RNA, 64 nt, hsa; identical to SEQ ID NO: 420136

SEQ ID NO: 668833 - RNA, 64 nt, hsa; identical to SEQ ID NO: 420137

SEQ ID NO: 668834 - RNA, 64 nt, hsa; identical to SEQ ID NO: 420138

SEQ ID NO: 668835 - RNA, 64 nt, hsa; identical to SEQ ID NO: 420139

SEQ ID NO: 668836 - RNA, 64 nt, hsa; identical to SEQ ID NO: 420140

SEQ ID NO: 668837 - RNA, 64 nt, hsa; identical to SEQ ID NO: 117329

SEQ ID NO: 668838 - RNA, 64 nt, hsa; identical to SEQ ID NO: 117330

SEQ ID NO: 668839 - RNA, 64 nt, hsa; identical to SEQ ID NO: 117331

SEQ ID NO: 668840 - RNA, 64 nt, hsa; identical to SEQ ID NO: 117332

SEQ ID NO: 668841 - RNA, 64 nt, hsa; identical to SEQ ID NO: 117333

SEQ ID NO: 668842 - RNA, 64 nt, hsa; identical to SEQ ID NO: 117334

SEQ ID NO: 668843 - RNA, 64 nt, hsa; identical to SEQ ID NO: 117335

SEQ ID NO: 668844 - RNA, 64 nt, hsa; identical to SEQ ID NO: 117336

SEQ ID NO: 668845 - RNA, 64 nt, hsa; identical to SEQ ID NO: 117337

SEQ ID NO: 668846 - RNA, 64 nt, hsa; identical to SEQ ID NO: 117338

SEQ ID NO: 668847 - RNA, 64 nt, hsa; identical to SEQ ID NO: 117339

SEQ ID NO: 668848 - RNA, 64 nt, hsa; identical to SEQ ID NO: 117340

SEQ ID NO: 668849 - RNA, 64 nt, hsa; identical to SEQ ID NO: 117341

SEQ ID NO: 668850 - RNA, 64 nt, hsa; identical to SEQ ID NO: 117342

SEQ ID NO: 668851 - RNA, 64 nt, hsa; identical to SEQ ID NO: 117343

SEQ ID NO: 668852 - RNA, 64 nt, hsa; identical to SEQ ID NO: 117344

SEQ ID NO: 668853 - RNA, 64 nt, hsa; identical to SEQ ID NO: 117345

SEQ ID NO: 668854 - RNA, 64 nt, hsa; identical to SEQ ID NO: 117346

SEQ ID NO: 668855 - RNA, 64 nt, hsa; identical to SEQ ID NO: 117347

SEQ ID NO: 668856 - RNA, 64 nt, hsa; identical to SEQ ID NO: 117348

SEQ ID NO: 668857 - RNA, 64 nt, hsa; identical to SEQ ID NO: 117349

SEQ ID NO: 668858 - RNA, 64 nt, hsa; identical to SEQ ID NO: 117350

SEQ ID NO: 668859 - RNA, 64 nt, hsa; identical to SEQ ID NO: 117351

SEQ ID NO: 668860 - RNA, 64 nt, hsa; identical to SEQ ID NO: 117352

SEQ ID NO: 668861 - RNA, 64 nt, hsa; identical to SEQ ID NO: 117353

SEQ ID NO: 668862 - RNA, 64 nt, hsa; identical to SEQ ID NO: 117354

SEQ ID NO: 668863 - RNA, 64 nt, hsa; identical to SEQ ID NO: 117355

SEQ ID NO: 668864 - RNA, 64 nt, hsa; identical to SEQ ID NO: 117356

SEQ ID NO: 668865 - RNA, 64 nt, hsa; identical to SEQ ID NO: 117357

SEQ ID NO: 668866 - RNA, 64 nt, hsa; identical to SEQ ID NO: 117358

SEQ ID NO: 668867 - RNA, 64 nt, hsa; identical to SEQ ID NO: 117359

SEQ ID NO: 668868 - RNA, 64 nt, hsa; identical to SEQ ID NO: 117360

SEQ ID NO: 668869 - RNA, 64 nt, hsa; identical to SEQ ID NO: 117361

SEQ ID NO: 668870 - RNA, 64 nt, hsa; identical to SEQ ID NO: 117362

SEQ ID NO: 668871 - RNA, 64 nt, hsa
aguaagguacccccaucccagaaugauaacugcacaguggcagaacaaacuccacccuaaugug

SEQ ID NO: 668872 - RNA, 64 nt, hsa
ccaguuaaagcccugacuggcagguuuuuuaauccaguggcaaggugcucccacuccagggccc

SEQ ID NO: 668873 - RNA, 64 nt, hsa
aacagggucuugcucuauugccuaggcuggagcacaguggcaugaucuuggcucacugcaaccu

SEQ ID NO: 668874 - RNA, 64 nt, hsa
agaagcagggaugccuggggugaucagcuccaaccaguggcagcagagugguggcucuuccuag

SEQ ID NO: 668875 - RNA, 64 nt, hsa
agacggagucugcucugucgcucgcgcuggagugcaguggcaugaucucggcucacugcaagcu

SEQ ID NO: 668876 - RNA, 64 nt, hsa
gacagggucucacugugucccccaggcuggagugcaguggcacaaugacgacucacugcagccu

SEQ ID NO: 668877 - RNA, 64 nt, hsa
gauacaguuucacucugucacccaggcuggagugcaguggcaugaucucagcucacugcaaccu

SEQ ID NO: 668878 - RNA, 64 nt, hsa
gagacagagucucacugucacccaggcuggagugcaguggcaugaucucaguuuaugcaacuuc

SEQ ID NO: 668879 - RNA, 64 nt, hsa
ggaagaaucucaaacagcgcuacuuacucaggaucaguggcaccagccaacucagcuuugggac

SEQ ID NO: 668880 - RNA, 64 nt, hsa
caucucuacuaaaaauacaaaaauuagccggacgcaguggcacgcgccuguaaucccagcuacu

SEQ ID NO: 668881 - RNA, 64 nt, hsa
gcaggagaaucaccugaacccccaggcuggaguacaguggcaggaucucagcuuacugcagcuu

SEQ ID NO: 668882 - RNA, 64 nt, hsa
ucuaauuuaaaaaagaaaaagaaaaaaacauucccaguggcagccugccuaagacugucuuacc

SEQ ID NO: 668883 - RNA, 64 nt, hsa
gauagggucuugcucaauuucuuaggcuggagugcaguggcacgaucauagcucacugaaguuu

SEQ ID NO: 668884 - RNA, 64 nt, hsa
aagcuguauagagcccggguccacggugaacagucaguggcagggaguuugccaagaccaugcu

SEQ ID NO: 668885 - RNA, 64 nt, hsa
augggccgucacaaaggcuugaucacugccugggcaguggcacaaccaucccccaugucgcuac

SEQ ID NO: 668886 - RNA, 64 nt, hsa
auagcagaagcagcuugguaggauggaaggcacgcaguggcauggccuggcuccuucccugagu

SEQ ID NO: 668887 - RNA, 64 nt, hsa
gacagagucucgcucuguugcccaggcuggagugcaguggcacgaucucggcucacggcacgcu

SEQ ID NO: 668888 - RNA, 64 nt, hsa
gacggagucucacucuuccgcccaggcugcagugcaguggcaugaucuuggcuuacugcaaccu

SEQ ID NO: 668889 - RNA, 64 nt, hsa
gagacaggcucacucugucacccaggccagagugcaguggcacgaucauaguuaccgcagcauc

SEQ ID NO: 668890 - RNA, 64 nt, hsa
ggugcggcuacuaagaugggaaaaacuaucacgacaguggcaccaccugauuucaugauguacc

SEQ ID NO: 668891 - RNA, 64 nt, hsa
acagucuuacucugucucccaggcugcuggagugcaguggcacaaucucggcccgcugcagccu

SEQ ID NO: 668892 - RNA, 64 nt, hsa
gacagagucuugcucugucucccaggcuggagugcaguggcacaaucauggcucacugcagccu

SEQ ID NO: 668893 - RNA, 64 nt, hsa
cagaggaggcagcagcauugcacagccccaggcacaguggcaguuaggauggcuggagaguagg

SEQ ID NO: 668894 - RNA, 64 nt, hsa
uuucucauccagaaauuauggaaacagggucugucaguggcaggaggccgugcuguguuuuacu

SEQ ID NO: 668895 - RNA, 64 nt, hsa
cugcaauacacaguuaccagaugggaaugcagcacaguggcacagagagguaacuacggagccc

SEQ ID NO: 668896 - RNA, 64 nt, hsa
uguccaagcuaagaaagggcugucucuguggguacaguggcauucucuguugaccuaaccaagc

SEQ ID NO: 668897 - RNA, 64 nt, hsa
gguucucaugaaucuccaacuuuaaauccugaaacaguggcaauaaauuuaucugguaaggcuu

SEQ ID NO: 668898 - RNA, 64 nt, hsa
uaguugggaaaacaaacuucaucaagaguaaaugcaguggcaugcuaaguacccaaauaggagu

SEQ ID NO: 668899 - RNA, 64 nt, hsa
uggguugggggagccccacagcuuucuggcuggccaguggcaaucuacuggccuuguccagagg

SEQ ID NO: 668900 - RNA, 64 nt, hsa
gggggcuggcuggauguucucuuuacugaaaagacaguggcaaggaaaagcacaagugcaugag

SEQ ID NO: 668901 - RNA, 64 nt, hsa
uguuggccugucagagcuugauuagaagccaagacaguggcagcaaaggaagacuuggcccagg

SEQ ID NO: 668902 - RNA, 64 nt, hsa
auggccccuccauuuauuugacuaaagcaucacacaguggcacuagcauuauaccaagaguaug

SEQ ID NO: 668903 - RNA, 64 nt, hsa
ggugucaccccccuccagcugaggagaccaggcccaguggcagggguuucucugucuguccgug

SEQ ID NO: 668904 - RNA, 64 nt, hsa
gacagaaucuugaucuguuacccaggcuggagugcaguggcaugaucucggcucacugcaaccu

SEQ ID NO: 668905 - RNA, 64 nt, hsa
gugguggagucuugcugucuccccggcuggagcgcaguggcacgaucgcggcucacugcagccu

SEQ ID NO: 668906 - RNA, 64 nt, hsa
gacagagacucgcucugucacccaggcuggagugcaguggcaugauuucggcucacugcaaccu

SEQ ID NO: 668907 - RNA, 64 nt, hsa
uuuuguuuuuguuuuuuuucaucuuaauauguaccaguggcacuuaaccaaaagauacagugau

SEQ ID NO: 668908 - RNA, 64 nt, hsa
auuuugagcugugaaggcagucgucucuguuacacaguggcagcucuugaguuaugcacuguga

SEQ ID NO: 668909 - RNA, 64 nt, hsa
cgggcauagggacguggggugcaggcgccaacaucaguggcagcagccagggccgugguccagu

SEQ ID NO: 668910 - RNA, 64 nt, hsa
gcggcgcccagcucccugguggccgcggcagccucaguggcagcagcugccgguggugaccugg

SEQ ID NO: 668911 - RNA, 64 nt, hsa
gucuugcauuugcaagcuagagacucaggaaagacaguggcauaaugcagucugaguccaaagg

SEQ ID NO: 668912 - RNA, 64 nt, hsa
agcucagauuuuggcuggaauggcuauggcuaugcaguggcacuucuuguuguagucuuuuugc

SEQ ID NO: 668913 - RNA, 64 nt, hsa
cucugggauaauuggggacuucugcucaacauggcaguggcauguuaggcauguuagggcuuga

SEQ ID NO: 668914 - RNA, 64 nt, hsa
guccuguguguggugggcuccacccacuagaugccaguggcacccccucccagagaugacaaac

SEQ ID NO: 668915 - RNA, 64 nt, hsa
cugugggaacuucagggguucccaguggggagagcaguggcagugggaggcaucugggggccaa

SEQ ID NO: 668916 - RNA, 64 nt, hsa
caguggcagugggaggcaucugggggccaaaggucaguggcaggggguauuucaguauuauaca

SEQ ID NO: 668917 - RNA, 64 nt, hsa
gucagagucuuguucuguugccugggcuggagugcaguggcaugaucucagcucacugcaaccu

SEQ ID NO: 668918 - RNA, 64 nt, hsa
aauggugguuuuuauuauuauuacucagauuccacaguggcaagaaacaucauucuacauaaug

SEQ ID NO: 668919 - RNA, 64 nt, hsa
auggagucuugcuccuguugugcaggcuggagugcaguggcacagucuuggcucacugcaaccu

SEQ ID NO: 668920 - RNA, 64 nt, hsa
auggagucuugcuccuguugugcaggcuguagugcaguggcacgaucuuggcucacugcaaccu

SEQ ID NO: 668921 - RNA, 64 nt, hsa; identical to SEQ ID NO: 615388

SEQ ID NO: 668922 - RNA, 64 nt, hsa; identical to SEQ ID NO: 615389

SEQ ID NO: 668923 - RNA, 64 nt, hsa; identical to SEQ ID NO: 615390

SEQ ID NO: 668924 - RNA, 64 nt, hsa; identical to SEQ ID NO: 615391

SEQ ID NO: 668925 - RNA, 64 nt, hsa; identical to SEQ ID NO: 615392

SEQ ID NO: 668926 - RNA, 64 nt, hsa; identical to SEQ ID NO: 615393

SEQ ID NO: 668927 - RNA, 64 nt, hsa; identical to SEQ ID NO: 615394

SEQ ID NO: 668928 - RNA, 64 nt, hsa; identical to SEQ ID NO: 615395

SEQ ID NO: 668929 - RNA, 64 nt, hsa; identical to SEQ ID NO: 152091

SEQ ID NO: 668930 - RNA, 64 nt, hsa; identical to SEQ ID NO: 152092

SEQ ID NO: 668931 - RNA, 64 nt, hsa; identical to SEQ ID NO: 152093

SEQ ID NO: 668932 - RNA, 64 nt, hsa; identical to SEQ ID NO: 152094

SEQ ID NO: 668933 - RNA, 64 nt, hsa; identical to SEQ ID NO: 152095

SEQ ID NO: 668934 - RNA, 64 nt, hsa; identical to SEQ ID NO: 152096

SEQ ID NO: 668935 - RNA, 64 nt, hsa; identical to SEQ ID NO: 328239

SEQ ID NO: 668936 - RNA, 64 nt, hsa; identical to SEQ ID NO: 328240

SEQ ID NO: 668937 - RNA, 64 nt, hsa; identical to SEQ ID NO: 328241

SEQ ID NO: 668938 - RNA, 64 nt, hsa; identical to SEQ ID NO: 328242

SEQ ID NO: 668939 - RNA, 64 nt, hsa; identical to SEQ ID NO: 328243

SEQ ID NO: 668940 - RNA, 64 nt, hsa; identical to SEQ ID NO: 328244

SEQ ID NO: 668941 - RNA, 64 nt, hsa; identical to SEQ ID NO: 328245

SEQ ID NO: 668942 - RNA, 64 nt, hsa; identical to SEQ ID NO: 328246

SEQ ID NO: 668943 - RNA, 64 nt, hsa; identical to SEQ ID NO: 328247

SEQ ID NO: 668944 - RNA, 64 nt, hsa; identical to SEQ ID NO: 328248

SEQ ID NO: 668945 - RNA, 64 nt, hsa; identical to SEQ ID NO: 328249

SEQ ID NO: 668946 - RNA, 64 nt, hsa; identical to SEQ ID NO: 328250

SEQ ID NO: 668947 - RNA, 64 nt, hsa; identical to SEQ ID NO: 328251

SEQ ID NO: 668948 - RNA, 64 nt, hsa; identical to SEQ ID NO: 328252

SEQ ID NO: 668949 - RNA, 64 nt, hsa; identical to SEQ ID NO: 328253

SEQ ID NO: 668950 - RNA, 64 nt, hsa; identical to SEQ ID NO: 328254

SEQ ID NO: 668951 - RNA, 64 nt, hsa; identical to SEQ ID NO: 328255

SEQ ID NO: 668952 - RNA, 64 nt, hsa; identical to SEQ ID NO: 328256

SEQ ID NO: 668953 - RNA, 64 nt, hsa; identical to SEQ ID NO: 328257

SEQ ID NO: 668954 - RNA, 64 nt, hsa; identical to SEQ ID NO: 328258

SEQ ID NO: 668955 - RNA, 64 nt, hsa; identical to SEQ ID NO: 328259

SEQ ID NO: 668956 - RNA, 64 nt, hsa; identical to SEQ ID NO: 328260

SEQ ID NO: 668957 - RNA, 64 nt, hsa; identical to SEQ ID NO: 328261

SEQ ID NO: 668958 - RNA, 64 nt, hsa; identical to SEQ ID NO: 328262

SEQ ID NO: 668959 - RNA, 64 nt, hsa; identical to SEQ ID NO: 328263

SEQ ID NO: 668960 - RNA, 64 nt, hsa; identical to SEQ ID NO: 328264

SEQ ID NO: 668961 - RNA, 64 nt, hsa; identical to SEQ ID NO: 328265

SEQ ID NO: 668962 - RNA, 64 nt, hsa; identical to SEQ ID NO: 328266

SEQ ID NO: 668963 - RNA, 64 nt, hsa; identical to SEQ ID NO: 328267

SEQ ID NO: 668964 - RNA, 64 nt, hsa; identical to SEQ ID NO: 328268

SEQ ID NO: 668965 - RNA, 64 nt, hsa; identical to SEQ ID NO: 328269

SEQ ID NO: 668966 - RNA, 64 nt, hsa; identical to SEQ ID NO: 328270

SEQ ID NO: 668967 - RNA, 64 nt, hsa; identical to SEQ ID NO: 328271

SEQ ID NO: 668968 - RNA, 64 nt, hsa; identical to SEQ ID NO: 328272

SEQ ID NO: 668969 - RNA, 64 nt, hsa; identical to SEQ ID NO: 328273

SEQ ID NO: 668970 - RNA, 64 nt, hsa; identical to SEQ ID NO: 328274

SEQ ID NO: 668971 - RNA, 64 nt, hsa; identical to SEQ ID NO: 328275

SEQ ID NO: 668972 - RNA, 64 nt, hsa; identical to SEQ ID NO: 328276

SEQ ID NO: 668973 - RNA, 64 nt, hsa; identical to SEQ ID NO: 328277

SEQ ID NO: 668974 - RNA, 64 nt, hsa; identical to SEQ ID NO: 328278

SEQ ID NO: 668975 - RNA, 64 nt, hsa; identical to SEQ ID NO: 328279

SEQ ID NO: 668976 - RNA, 64 nt, hsa; identical to SEQ ID NO: 328280

SEQ ID NO: 668977 - RNA, 64 nt, hsa; identical to SEQ ID NO: 328281

SEQ ID NO: 668978 - RNA, 64 nt, hsa; identical to SEQ ID NO: 328282

SEQ ID NO: 668979 - RNA, 64 nt, hsa; identical to SEQ ID NO: 328283

SEQ ID NO: 668980 - RNA, 64 nt, hsa; identical to SEQ ID NO: 328284

SEQ ID NO: 668981 - RNA, 64 nt, hsa; identical to SEQ ID NO: 328285

SEQ ID NO: 668982 - RNA, 64 nt, hsa; identical to SEQ ID NO: 328286

SEQ ID NO: 668983 - RNA, 64 nt, hsa; identical to SEQ ID NO: 328287

SEQ ID NO: 668984 - RNA, 64 nt, hsa; identical to SEQ ID NO: 328288

SEQ ID NO: 668985 - RNA, 64 nt, hsa; identical to SEQ ID NO: 328289

SEQ ID NO: 668986 - RNA, 64 nt, hsa; identical to SEQ ID NO: 328290

SEQ ID NO: 668987 - RNA, 64 nt, hsa
ucucauacaucugugaaaaagauaaugugaaauaaacaguaaaaaaaaaaaguauguugauggc

SEQ ID NO: 668988 - RNA, 64 nt, hsa
gaacuugaauuaugcauuuauuggcauuaauguaaacaguaaguccuaagcuuugauggaaggg

SEQ ID NO: 668989 - RNA, 64 nt, hsa
ugaaugagaagaaaugauucauaaauuuugaacuaacaguaauaacuucuugaaaauccaauaa

SEQ ID NO: 668990 - RNA, 64 nt, hsa
uucuugaaaaaaaauuuuuugauaugacuacucuaacaguaauaacuauaaaucucacuuuaaa

SEQ ID NO: 668991 - RNA, 64 nt, hsa
uugauuuaaauccuuucugaauaaagaucagauaaacaguaacugaaggagcauguauagcucu

SEQ ID NO: 668992 - RNA, 64 nt, hsa
acugccaaauacauaggaauuuucuuucuuaaaaaacaguaaugaagacuauaucuccuuuccc

SEQ ID NO: 668993 - RNA, 64 nt, hsa
ucagggugcccacaacucacucaccaagauguuuaacaguaaguaacaguaaauguaaaagauu

SEQ ID NO: 668994 - RNA, 64 nt, hsa
cacaacucacucaccaagauguuuaacaguaaguaacaguaaauguaaaagauucauuuugggc

SEQ ID NO: 668995 - RNA, 64 nt, hsa
gcacagcacuuuugcaguaagauuggugugaaauacuaaacacuauggauuuuguaggugucag

SEQ ID NO: 668996 - RNA, 64 nt, hsa
agauuaauauggccaacccuguacacaucacuacacuaaacacugcucuagauaaacugcucaa

SEQ ID NO: 668997 - RNA, 64 nt, hsa
auguggcaaauccuuuaacugauccucaacuuuuacuaaacauaagguaauucauacuggagaa

SEQ ID NO: 668998 - RNA, 64 nt, hsa
auguggcaauacuuuaaaccaauccucaaaccucacuaaacauaagauaauacugaaaacuuua

SEQ ID NO: 668999 - RNA, 64 nt, hsa
auguggcaaagguuuuagccaacucucaaaccuuacuaaacacaagaagauucauacuagagag

SEQ ID NO: 669000 - RNA, 64 nt, hsa
augugguaaugcuuuuaaccaauucucaaaucuuacuaaacaaaauuaauacugaaaauguuac

SEQ ID NO: 669001 - RNA, 64 nt, hsa
uacuuaauuuucuuaaaacuauuuuuaaugauccacuaaacaaagcaggggauccugaagcuga

SEQ ID NO: 669002 - RNA, 64 nt, hsa
auucugucuggguuuuuaaugucuguggaaaaaaacuaaacaagucucugucucaguuaagaga

SEQ ID NO: 669003 - RNA, 64 nt, hsa
auaacaucuaauauauauauuacaggccaaaugaacuaaacauugccuugcuauauucaccaaa

SEQ ID NO: 669004 - RNA, 64 nt, hsa
accauguaucaggauuuccgcauuauaaaaaugaacuaaacauugccuugcuauauucaccaaa

SEQ ID NO: 669005 - RNA, 64 nt, hsa
auguggcaaaggcuuuaauuaguucucaucccuuacuaaacauaagagaauucauaccauagag

SEQ ID NO: 669006 - RNA, 64 nt, hsa
augucucaaagcuuuuuacugauucuuauaccuuacuaaacauaaaauaauucauaaaggagau

SEQ ID NO: 669007 - RNA, 64 nt, hsa
auguggcaaagcuuuuaaccaauuuucaaaccuuacuaaacauaagauaacucauacuggagaa

SEQ ID NO: 669008 - RNA, 64 nt, hsa
augugacaaagccuuuaaccaguccucaauuuuuacuaaacauaagaaaauucauacuggagag

SEQ ID NO: 669009 - RNA, 64 nt, hsa
cugugaaaaagacgucaauaucugcucacaucuuacuaaacaccagagaguucaugcuuaauaa

SEQ ID NO: 669010 - RNA, 64 nt, hsa
augugucaaagcuuuuaacuguuccucaauccuuacuaaacauaagggaauucauaauagagaa

SEQ ID NO: 669011 - RNA, 64 nt, hsa
auguggcauagccucuucccaguucucaacucuuacuaaacaugagaacacauguggaagauaa

SEQ ID NO: 669012 - RNA, 64 nt, hsa
guugacuuucuucuguccaaacaaacaaacaaaaacuaaacacacacacaaacccccagaaacc

SEQ ID NO: 669013 - RNA, 64 nt, hsa
ccuguaauuguugcuagacuuuauguguuguacaacuaaacauugcuguuugaacaguaacugc

SEQ ID NO: 669014 - RNA, 64 nt, hsa
aaacauuuauuuucugagucugcaggagaaacaaacuaaacauuauaguuuuauagcugcuauc

SEQ ID NO: 669015 - RNA, 64 nt, hsa
ggcuuuacuugucuuuauaaaaauaaauauaucuacuaaacaugaaaaaugguuuacuuaaaaa

SEQ ID NO: 669016 - RNA, 64 nt, hsa
ccccccauccugcucagcugcgucaugggccccccaugcauacguacauuccuggacacccuca

SEQ ID NO: 669017 - RNA, 64 nt, hsa
uuuuuuguaaaaguagcaguuugguaugaguuggcaugcauacaagauuuacuaagugggauaa

SEQ ID NO: 669018 - RNA, 64 nt, hsa
aauacacaugcauuuaugugcguguguguauacacaugcauauauuuacuaauccuaucugcca

SEQ ID NO: 669019 - RNA, 64 nt, hsa
guuuauauguauuauaauugcauacacaugccuccaugcauauaugugugugauaauacacaug

SEQ ID NO: 669020 - RNA, 64 nt, hsa
cacuggaaacucuguauuauauacaaguguaauacaugcauauaauagaaaaaaaacauggaau

SEQ ID NO: 669021 - RNA, 64 nt, hsa
auggaaugaaauggcuuucugccuccauuuuaaucaugcauaaaaugaauuagauggcuuugag

SEQ ID NO: 669022 - RNA, 64 nt, hsa
cugacaaaagaacuugaaccuauguuauaugauacaugcauaacuugagcuacacuaaaccaca

SEQ ID NO: 669023 - RNA, 64 nt, hsa
uugguaacacaauacguucuuauaaaauacaacacaugcauaaaaauagaagacaaucugcuug

SEQ ID NO: 669024 - RNA, 64 nt, hsa; identical to SEQ ID NO: 614595

SEQ ID NO: 669025 - RNA, 64 nt, hsa; identical to SEQ ID NO: 614596

SEQ ID NO: 669026 - RNA, 64 nt, hsa; identical to SEQ ID NO: 614597

SEQ ID NO: 669027 - RNA, 64 nt, hsa; identical to SEQ ID NO: 614598

SEQ ID NO: 669028 - RNA, 64 nt, hsa; identical to SEQ ID NO: 614599

SEQ ID NO: 669029 - RNA, 64 nt, hsa; identical to SEQ ID NO: 614600

SEQ ID NO: 669030 - RNA, 64 nt, hsa; identical to SEQ ID NO: 614601

SEQ ID NO: 669031 - RNA, 64 nt, hsa; identical to SEQ ID NO: 614602

SEQ ID NO: 669032 - RNA, 64 nt, hsa; identical to SEQ ID NO: 614603

SEQ ID NO: 669033 - RNA, 64 nt, hsa; identical to SEQ ID NO: 614604

SEQ ID NO: 669034 - RNA, 64 nt, hsa; identical to SEQ ID NO: 614605

SEQ ID NO: 669035 - RNA, 64 nt, hsa; identical to SEQ ID NO: 614606

SEQ ID NO: 669036 - RNA, 64 nt, hsa; identical to SEQ ID NO: 614607

SEQ ID NO: 669037 - RNA, 64 nt, hsa; identical to SEQ ID NO: 614608

SEQ ID NO: 669038 - RNA, 64 nt, hsa; identical to SEQ ID NO: 614609

SEQ ID NO: 669039 - RNA, 64 nt, hsa; identical to SEQ ID NO: 614610

SEQ ID NO: 669040 - RNA, 64 nt, hsa; identical to SEQ ID NO: 614611

SEQ ID NO: 669041 - RNA, 64 nt, hsa; identical to SEQ ID NO: 614612

SEQ ID NO: 669042 - RNA, 64 nt, hsa; identical to SEQ ID NO: 614613

SEQ ID NO: 669043 - RNA, 64 nt, hsa; identical to SEQ ID NO: 614614

SEQ ID NO: 669044 - RNA, 64 nt, hsa; identical to SEQ ID NO: 614615

SEQ ID NO: 669045 - RNA, 64 nt, hsa; identical to SEQ ID NO: 614616

SEQ ID NO: 669046 - RNA, 64 nt, hsa; identical to SEQ ID NO: 614617

SEQ ID NO: 669047 - RNA, 64 nt, hsa; identical to SEQ ID NO: 614618

SEQ ID NO: 669048 - RNA, 64 nt, hsa; identical to SEQ ID NO: 614619

SEQ ID NO: 669049 - RNA, 64 nt, hsa; identical to SEQ ID NO: 614620

SEQ ID NO: 669050 - RNA, 64 nt, hsa; identical to SEQ ID NO: 614621

SEQ ID NO: 669051 - RNA, 64 nt, hsa; identical to SEQ ID NO: 614622

SEQ ID NO: 669052 - RNA, 64 nt, hsa; identical to SEQ ID NO: 614623

SEQ ID NO: 669053 - RNA, 64 nt, hsa; identical to SEQ ID NO: 614624

SEQ ID NO: 669054 - RNA, 64 nt, hsa; identical to SEQ ID NO: 614625

SEQ ID NO: 669055 - RNA, 64 nt, hsa; identical to SEQ ID NO: 614626

SEQ ID NO: 669056 - RNA, 64 nt, hsa; identical to SEQ ID NO: 614627

SEQ ID NO: 669057 - RNA, 64 nt, hsa; identical to SEQ ID NO: 614628

SEQ ID NO: 669058 - RNA, 64 nt, hsa; identical to SEQ ID NO: 614629

SEQ ID NO: 669059 - RNA, 64 nt, hsa; identical to SEQ ID NO: 614630

SEQ ID NO: 669060 - RNA, 64 nt, hsa; identical to SEQ ID NO: 614631

SEQ ID NO: 669061 - RNA, 64 nt, hsa; identical to SEQ ID NO: 614632

SEQ ID NO: 669062 - RNA, 64 nt, hsa; identical to SEQ ID NO: 614633

SEQ ID NO: 669063 - RNA, 64 nt, hsa; identical to SEQ ID NO: 614634

SEQ ID NO: 669064 - RNA, 64 nt, hsa; identical to SEQ ID NO: 614635

SEQ ID NO: 669065 - RNA, 64 nt, hsa; identical to SEQ ID NO: 614636

SEQ ID NO: 669066 - RNA, 64 nt, hsa; identical to SEQ ID NO: 614637

SEQ ID NO: 669067 - RNA, 64 nt, hsa; identical to SEQ ID NO: 614638

SEQ ID NO: 669068 - RNA, 64 nt, hsa; identical to SEQ ID NO: 614639

SEQ ID NO: 669069 - RNA, 64 nt, hsa; identical to SEQ ID NO: 614640

SEQ ID NO: 669070 - RNA, 64 nt, hsa; identical to SEQ ID NO: 614641

SEQ ID NO: 669071 - RNA, 64 nt, hsa; identical to SEQ ID NO: 614642

SEQ ID NO: 669072 - RNA, 64 nt, hsa; identical to SEQ ID NO: 614643

SEQ ID NO: 669073 - RNA, 64 nt, hsa; identical to SEQ ID NO: 614644

SEQ ID NO: 669074 - RNA, 56 nt, hsa; identical to SEQ ID NO: 614645

SEQ ID NO: 669075 - RNA, 64 nt, hsa; identical to SEQ ID NO: 614646

SEQ ID NO: 669076 - RNA, 64 nt, hsa; identical to SEQ ID NO: 614647

SEQ ID NO: 669077 - RNA, 64 nt, hsa; identical to SEQ ID NO: 614648

SEQ ID NO: 669078 - RNA, 64 nt, hsa; identical to SEQ ID NO: 614649

SEQ ID NO: 669079 - RNA, 64 nt, hsa; identical to SEQ ID NO: 614650

SEQ ID NO: 669080 - RNA, 64 nt, hsa; identical to SEQ ID NO: 614651

SEQ ID NO: 669081 - RNA, 64 nt, hsa; identical to SEQ ID NO: 614652

SEQ ID NO: 669082 - RNA, 64 nt, hsa; identical to SEQ ID NO: 614653

SEQ ID NO: 669083 - RNA, 64 nt, hsa; identical to SEQ ID NO: 614654

SEQ ID NO: 669084 - RNA, 64 nt, hsa; identical to SEQ ID NO: 614655

SEQ ID NO: 669085 - RNA, 64 nt, hsa; identical to SEQ ID NO: 614656

SEQ ID NO: 669086 - RNA, 64 nt, hsa; identical to SEQ ID NO: 614657

SEQ ID NO: 669087 - RNA, 64 nt, hsa; identical to SEQ ID NO: 614658

SEQ ID NO: 669088 - RNA, 64 nt, hsa; identical to SEQ ID NO: 614659

SEQ ID NO: 669089 - RNA, 64 nt, hsa; identical to SEQ ID NO: 614660

SEQ ID NO: 669090 - RNA, 64 nt, hsa; identical to SEQ ID NO: 614661

SEQ ID NO: 669091 - RNA, 64 nt, hsa; identical to SEQ ID NO: 614662

SEQ ID NO: 669092 - RNA, 64 nt, hsa; identical to SEQ ID NO: 614663

SEQ ID NO: 669093 - RNA, 64 nt, hsa; identical to SEQ ID NO: 614664

SEQ ID NO: 669094 - RNA, 64 nt, hsa; identical to SEQ ID NO: 614665

SEQ ID NO: 669095 - RNA, 64 nt, hsa; identical to SEQ ID NO: 614666

SEQ ID NO: 669096 - RNA, 64 nt, hsa; identical to SEQ ID NO: 614667

SEQ ID NO: 669097 - RNA, 64 nt, hsa; identical to SEQ ID NO: 614668

SEQ ID NO: 669098 - RNA, 64 nt, hsa; identical to SEQ ID NO: 614669

SEQ ID NO: 669099 - RNA, 64 nt, hsa; identical to SEQ ID NO: 614670

SEQ ID NO: 669100 - RNA, 64 nt, hsa; identical to SEQ ID NO: 614671

SEQ ID NO: 669101 - RNA, 64 nt, hsa; identical to SEQ ID NO: 614672

SEQ ID NO: 669102 - RNA, 64 nt, hsa; identical to SEQ ID NO: 614673

SEQ ID NO: 669103 - RNA, 64 nt, hsa; identical to SEQ ID NO: 614674

SEQ ID NO: 669104 - RNA, 64 nt, hsa; identical to SEQ ID NO: 614675

SEQ ID NO: 669105 - RNA, 64 nt, hsa; identical to SEQ ID NO: 614676

SEQ ID NO: 669106 - RNA, 64 nt, hsa; identical to SEQ ID NO: 614677

SEQ ID NO: 669107 - RNA, 64 nt, hsa; identical to SEQ ID NO: 614678

SEQ ID NO: 669108 - RNA, 64 nt, hsa; identical to SEQ ID NO: 614679

SEQ ID NO: 669109 - RNA, 64 nt, hsa; identical to SEQ ID NO: 614680

SEQ ID NO: 669110 - RNA, 64 nt, hsa; identical to SEQ ID NO: 614681

SEQ ID NO: 669111 - RNA, 64 nt, hsa; identical to SEQ ID NO: 614682

SEQ ID NO: 669112 - RNA, 64 nt, hsa; identical to SEQ ID NO: 614683

SEQ ID NO: 669113 - RNA, 64 nt, hsa; identical to SEQ ID NO: 614684

SEQ ID NO: 669114 - RNA, 64 nt, hsa; identical to SEQ ID NO: 614685

SEQ ID NO: 669115 - RNA, 64 nt, hsa; identical to SEQ ID NO: 614686

SEQ ID NO: 669116 - RNA, 64 nt, hsa; identical to SEQ ID NO: 614687

SEQ ID NO: 669117 - RNA, 64 nt, hsa; identical to SEQ ID NO: 614688

SEQ ID NO: 669118 - RNA, 64 nt, hsa; identical to SEQ ID NO: 614689

SEQ ID NO: 669119 - RNA, 64 nt, hsa; identical to SEQ ID NO: 614690

SEQ ID NO: 669120 - RNA, 64 nt, hsa; identical to SEQ ID NO: 614691

SEQ ID NO: 669121 - RNA, 64 nt, hsa; identical to SEQ ID NO: 614692

SEQ ID NO: 669122 - RNA, 64 nt, hsa; identical to SEQ ID NO: 614693

SEQ ID NO: 669123 - RNA, 64 nt, hsa; identical to SEQ ID NO: 614694

SEQ ID NO: 669124 - RNA, 64 nt, hsa; identical to SEQ ID NO: 614695

SEQ ID NO: 669125 - RNA, 64 nt, hsa; identical to SEQ ID NO: 614696

SEQ ID NO: 669126 - RNA, 64 nt, hsa; identical to SEQ ID NO: 614697

SEQ ID NO: 669127 - RNA, 64 nt, hsa; identical to SEQ ID NO: 614698

SEQ ID NO: 669128 - RNA, 64 nt, hsa; identical to SEQ ID NO: 614699

SEQ ID NO: 669129 - RNA, 64 nt, hsa; identical to SEQ ID NO: 614700

SEQ ID NO: 669130 - RNA, 64 nt, hsa; identical to SEQ ID NO: 614701

SEQ ID NO: 669131 - RNA, 64 nt, hsa; identical to SEQ ID NO: 614702

SEQ ID NO: 669132 - RNA, 64 nt, hsa; identical to SEQ ID NO: 614703

SEQ ID NO: 669133 - RNA, 64 nt, hsa; identical to SEQ ID NO: 614704

SEQ ID NO: 669134 - RNA, 64 nt, hsa; identical to SEQ ID NO: 614705

SEQ ID NO: 669135 - RNA, 64 nt, hsa; identical to SEQ ID NO: 614706

SEQ ID NO: 669136 - RNA, 64 nt, hsa; identical to SEQ ID NO: 614707

SEQ ID NO: 669137 - RNA, 64 nt, hsa; identical to SEQ ID NO: 614708

SEQ ID NO: 669138 - RNA, 64 nt, hsa; identical to SEQ ID NO: 614709

SEQ ID NO: 669139 - RNA, 64 nt, hsa; identical to SEQ ID NO: 614710

SEQ ID NO: 669140 - RNA, 64 nt, hsa; identical to SEQ ID NO: 614711

SEQ ID NO: 669141 - RNA, 64 nt, hsa; identical to SEQ ID NO: 614712

SEQ ID NO: 669142 - RNA, 64 nt, hsa; identical to SEQ ID NO: 614713

SEQ ID NO: 669143 - RNA, 64 nt, hsa; identical to SEQ ID NO: 614714

SEQ ID NO: 669144 - RNA, 64 nt, hsa; identical to SEQ ID NO: 614715

SEQ ID NO: 669145 - RNA, 64 nt, hsa; identical to SEQ ID NO: 614716

SEQ ID NO: 669146 - RNA, 64 nt, hsa; identical to SEQ ID NO: 614717

SEQ ID NO: 669147 - RNA, 64 nt, hsa; identical to SEQ ID NO: 614718

SEQ ID NO: 669148 - RNA, 64 nt, hsa; identical to SEQ ID NO: 614719

SEQ ID NO: 669149 - RNA, 64 nt, hsa; identical to SEQ ID NO: 614720

SEQ ID NO: 669150 - RNA, 64 nt, hsa; identical to SEQ ID NO: 614721

SEQ ID NO: 669151 - RNA, 64 nt, hsa; identical to SEQ ID NO: 614722

SEQ ID NO: 669152 - RNA, 64 nt, hsa; identical to SEQ ID NO: 614723

SEQ ID NO: 669153 - RNA, 64 nt, hsa; identical to SEQ ID NO: 614724

SEQ ID NO: 669154 - RNA, 64 nt, hsa; identical to SEQ ID NO: 614725

SEQ ID NO: 669155 - RNA, 64 nt, hsa; identical to SEQ ID NO: 614726

SEQ ID NO: 669156 - RNA, 64 nt, hsa; identical to SEQ ID NO: 614727

SEQ ID NO: 669157 - RNA, 64 nt, hsa; identical to SEQ ID NO: 614728

SEQ ID NO: 669158 - RNA, 64 nt, hsa; identical to SEQ ID NO: 614729

SEQ ID NO: 669159 - RNA, 64 nt, hsa; identical to SEQ ID NO: 614730

SEQ ID NO: 669160 - RNA, 64 nt, hsa; identical to SEQ ID NO: 614731

SEQ ID NO: 669161 - RNA, 64 nt, hsa; identical to SEQ ID NO: 614732

SEQ ID NO: 669162 - RNA, 64 nt, hsa; identical to SEQ ID NO: 614733

SEQ ID NO: 669163 - RNA, 64 nt, hsa; identical to SEQ ID NO: 614734

SEQ ID NO: 669164 - RNA, 64 nt, hsa; identical to SEQ ID NO: 614735

SEQ ID NO: 669165 - RNA, 64 nt, hsa; identical to SEQ ID NO: 614736

SEQ ID NO: 669166 - RNA, 64 nt, hsa; identical to SEQ ID NO: 614737

SEQ ID NO: 669167 - RNA, 64 nt, hsa; identical to SEQ ID NO: 614738

SEQ ID NO: 669168 - RNA, 64 nt, hsa; identical to SEQ ID NO: 614739

SEQ ID NO: 669169 - RNA, 64 nt, hsa; identical to SEQ ID NO: 614740

SEQ ID NO: 669170 - RNA, 64 nt, hsa; identical to SEQ ID NO: 614741

SEQ ID NO: 669171 - RNA, 64 nt, hsa; identical to SEQ ID NO: 614742

SEQ ID NO: 669172 - RNA, 64 nt, hsa; identical to SEQ ID NO: 614743

SEQ ID NO: 669173 - RNA, 64 nt, hsa; identical to SEQ ID NO: 614744

SEQ ID NO: 669174 - RNA, 64 nt, hsa; identical to SEQ ID NO: 614745

SEQ ID NO: 669175 - RNA, 64 nt, hsa; identical to SEQ ID NO: 614746

SEQ ID NO: 669176 - RNA, 64 nt, hsa; identical to SEQ ID NO: 614747

SEQ ID NO: 669177 - RNA, 64 nt, hsa; identical to SEQ ID NO: 614748

SEQ ID NO: 669178 - RNA, 64 nt, hsa; identical to SEQ ID NO: 614749

SEQ ID NO: 669179 - RNA, 64 nt, hsa; identical to SEQ ID NO: 614750

SEQ ID NO: 669180 - RNA, 64 nt, hsa; identical to SEQ ID NO: 614751

SEQ ID NO: 669181 - RNA, 64 nt, hsa; identical to SEQ ID NO: 614752

SEQ ID NO: 669182 - RNA, 64 nt, hsa; identical to SEQ ID NO: 614753

SEQ ID NO: 669183 - RNA, 64 nt, hsa; identical to SEQ ID NO: 614754

SEQ ID NO: 669184 - RNA, 64 nt, hsa; identical to SEQ ID NO: 614755

SEQ ID NO: 669185 - RNA, 64 nt, hsa; identical to SEQ ID NO: 614756

SEQ ID NO: 669186 - RNA, 64 nt, hsa; identical to SEQ ID NO: 614757

SEQ ID NO: 669187 - RNA, 64 nt, hsa; identical to SEQ ID NO: 614758

SEQ ID NO: 669188 - RNA, 64 nt, hsa; identical to SEQ ID NO: 614759

SEQ ID NO: 669189 - RNA, 64 nt, hsa; identical to SEQ ID NO: 614760

SEQ ID NO: 669190 - RNA, 64 nt, hsa; identical to SEQ ID NO: 614761

SEQ ID NO: 669191 - RNA, 64 nt, hsa; identical to SEQ ID NO: 614762

SEQ ID NO: 669192 - RNA, 64 nt, hsa; identical to SEQ ID NO: 614763

SEQ ID NO: 669193 - RNA, 64 nt, hsa; identical to SEQ ID NO: 614764

SEQ ID NO: 669194 - RNA, 64 nt, hsa; identical to SEQ ID NO: 614765

SEQ ID NO: 669195 - RNA, 64 nt, hsa; identical to SEQ ID NO: 458751

SEQ ID NO: 669196 - RNA, 64 nt, hsa; identical to SEQ ID NO: 458752

SEQ ID NO: 669197 - RNA, 64 nt, hsa; identical to SEQ ID NO: 458753

SEQ ID NO: 669198 - RNA, 64 nt, hsa; identical to SEQ ID NO: 458754

SEQ ID NO: 669199 - RNA, 64 nt, hsa; identical to SEQ ID NO: 458755

SEQ ID NO: 669200 - RNA, 64 nt, hsa; identical to SEQ ID NO: 458756

SEQ ID NO: 669201 - RNA, 64 nt, hsa; identical to SEQ ID NO: 458757

SEQ ID NO: 669202 - RNA, 64 nt, hsa; identical to SEQ ID NO: 458758

SEQ ID NO: 669203 - RNA, 64 nt, hsa; identical to SEQ ID NO: 358630

SEQ ID NO: 669204 - RNA, 64 nt, hsa; identical to SEQ ID NO: 358631

SEQ ID NO: 669205 - RNA, 64 nt, hsa; identical to SEQ ID NO: 358632

SEQ ID NO: 669206 - RNA, 64 nt, hsa; identical to SEQ ID NO: 358633

SEQ ID NO: 669207 - RNA, 64 nt, hsa; identical to SEQ ID NO: 358634

SEQ ID NO: 669208 - RNA, 64 nt, hsa; identical to SEQ ID NO: 358635

SEQ ID NO: 669209 - RNA, 64 nt, hsa; identical to SEQ ID NO: 358636

SEQ ID NO: 669210 - RNA, 64 nt, hsa; identical to SEQ ID NO: 358637

SEQ ID NO: 669211 - RNA, 64 nt, hsa; identical to SEQ ID NO: 358638

SEQ ID NO: 669212 - RNA, 64 nt, hsa; identical to SEQ ID NO: 358639

SEQ ID NO: 669213 - RNA, 64 nt, hsa; identical to SEQ ID NO: 358640

SEQ ID NO: 669214 - RNA, 64 nt, hsa; identical to SEQ ID NO: 358641

SEQ ID NO: 669215 - RNA, 64 nt, hsa; identical to SEQ ID NO: 358642

SEQ ID NO: 669216 - RNA, 64 nt, hsa; identical to SEQ ID NO: 358643

SEQ ID NO: 669217 - RNA, 64 nt, hsa; identical to SEQ ID NO: 358644

SEQ ID NO: 669218 - RNA, 64 nt, hsa; identical to SEQ ID NO: 358645

SEQ ID NO: 669219 - RNA, 64 nt, hsa; identical to SEQ ID NO: 358646

SEQ ID NO: 669220 - RNA, 64 nt, hsa; identical to SEQ ID NO: 358647

SEQ ID NO: 669221 - RNA, 55 nt, hsa; identical to SEQ ID NO: 316954

SEQ ID NO: 669222 - RNA, 64 nt, hsa; identical to SEQ ID NO: 316955

SEQ ID NO: 669223 - RNA, 64 nt, hsa; identical to SEQ ID NO: 316956

SEQ ID NO: 669224 - RNA, 64 nt, hsa; identical to SEQ ID NO: 316957

SEQ ID NO: 669225 - RNA, 64 nt, hsa; identical to SEQ ID NO: 316958

SEQ ID NO: 669226 - RNA, 64 nt, hsa; identical to SEQ ID NO: 316959

SEQ ID NO: 669227 - RNA, 64 nt, hsa; identical to SEQ ID NO: 316960

SEQ ID NO: 669228 - RNA, 64 nt, hsa; identical to SEQ ID NO: 316961

SEQ ID NO: 669229 - RNA, 64 nt, hsa; identical to SEQ ID NO: 316962

SEQ ID NO: 669230 - RNA, 64 nt, hsa; identical to SEQ ID NO: 316963

SEQ ID NO: 669231 - RNA, 64 nt, hsa; identical to SEQ ID NO: 316964

SEQ ID NO: 669232 - RNA, 64 nt, hsa; identical to SEQ ID NO: 316965

SEQ ID NO: 669233 - RNA, 64 nt, hsa; identical to SEQ ID NO: 316966

SEQ ID NO: 669234 - RNA, 64 nt, hsa; identical to SEQ ID NO: 316967

SEQ ID NO: 669235 - RNA, 64 nt, hsa; identical to SEQ ID NO: 316968

SEQ ID NO: 669236 - RNA, 64 nt, hsa; identical to SEQ ID NO: 316969

SEQ ID NO: 669237 - RNA, 64 nt, hsa; identical to SEQ ID NO: 316970

SEQ ID NO: 669238 - RNA, 64 nt, hsa; identical to SEQ ID NO: 316971

SEQ ID NO: 669239 - RNA, 64 nt, hsa; identical to SEQ ID NO: 316972

SEQ ID NO: 669240 - RNA, 64 nt, hsa; identical to SEQ ID NO: 316973

SEQ ID NO: 669241 - RNA, 64 nt, hsa; identical to SEQ ID NO: 316974

SEQ ID NO: 669242 - RNA, 64 nt, hsa; identical to SEQ ID NO: 316975

SEQ ID NO: 669243 - RNA, 64 nt, hsa; identical to SEQ ID NO: 316976

SEQ ID NO: 669244 - RNA, 64 nt, hsa; identical to SEQ ID NO: 316977

SEQ ID NO: 669245 - RNA, 64 nt, hsa; identical to SEQ ID NO: 316978

SEQ ID NO: 669246 - RNA, 64 nt, hsa; identical to SEQ ID NO: 316979

SEQ ID NO: 669247 - RNA, 64 nt, hsa; identical to SEQ ID NO: 316980

SEQ ID NO: 669248 - RNA, 64 nt, hsa; identical to SEQ ID NO: 316981

SEQ ID NO: 669249 - RNA, 64 nt, hsa; identical to SEQ ID NO: 316982

SEQ ID NO: 669250 - RNA, 64 nt, hsa; identical to SEQ ID NO: 316983

SEQ ID NO: 669251 - RNA, 64 nt, hsa; identical to SEQ ID NO: 316984

SEQ ID NO: 669252 - RNA, 64 nt, hsa; identical to SEQ ID NO: 316985

SEQ ID NO: 669253 - RNA, 64 nt, hsa; identical to SEQ ID NO: 316986

SEQ ID NO: 669254 - RNA, 64 nt, hsa; identical to SEQ ID NO: 316987

SEQ ID NO: 669255 - RNA, 64 nt, hsa; identical to SEQ ID NO: 316988

SEQ ID NO: 669256 - RNA, 64 nt, hsa; identical to SEQ ID NO: 316989

SEQ ID NO: 669257 - RNA, 64 nt, hsa; identical to SEQ ID NO: 316990

SEQ ID NO: 669258 - RNA, 64 nt, hsa; identical to SEQ ID NO: 316991

SEQ ID NO: 669259 - RNA, 64 nt, hsa; identical to SEQ ID NO: 316992

SEQ ID NO: 669260 - RNA, 64 nt, hsa; identical to SEQ ID NO: 316993

SEQ ID NO: 669261 - RNA, 64 nt, hsa; identical to SEQ ID NO: 316994

SEQ ID NO: 669262 - RNA, 64 nt, hsa
auucagaagcaacgcuaugaacuucagcugacuuguuacuuaaaaauugugaauucuguuguug

SEQ ID NO: 669263 - RNA, 64 nt, hsa
uucacagaauggaugaauuaguuguuucuucagaguuacuuaugaacaguugaaugcuuuaaaa

SEQ ID NO: 669264 - RNA, 64 nt, hsa
cuuuugugguauuuaaagcauauuuuagguugaaguuacuuauuucuagucuuguacuucuggc

SEQ ID NO: 669265 - RNA, 64 nt, hsa
ugauguacuguauugacuugggguuugcuuauuuguuacuuaacauguguacaugcaugaaagc

SEQ ID NO: 669266 - RNA, 64 nt, hsa
aagucaaaaaucaaaaucaaacaacaaguucugaguuacuuaggaaacagacuucgcauuucaa

SEQ ID NO: 669267 - RNA, 64 nt, hsa
augauuuuaauaaaaucuugaguuuguaucacauguuacuuauugacucagaauaaaagaacag

SEQ ID NO: 669268 - RNA, 64 nt, hsa; identical to SEQ ID NO: 293538

SEQ ID NO: 669269 - RNA, 64 nt, hsa; identical to SEQ ID NO: 293539

SEQ ID NO: 669270 - RNA, 64 nt, hsa; identical to SEQ ID NO: 293540

SEQ ID NO: 669271 - RNA, 64 nt, hsa; identical to SEQ ID NO: 293541

SEQ ID NO: 669272 - RNA, 64 nt, hsa; identical to SEQ ID NO: 293542

SEQ ID NO: 669273 - RNA, 64 nt, hsa; identical to SEQ ID NO: 293543

SEQ ID NO: 669274 - RNA, 64 nt, hsa; identical to SEQ ID NO: 293544

SEQ ID NO: 669275 - RNA, 64 nt, hsa; identical to SEQ ID NO: 293545

SEQ ID NO: 669276 - RNA, 64 nt, hsa; identical to SEQ ID NO: 293546

SEQ ID NO: 669277 - RNA, 64 nt, hsa; identical to SEQ ID NO: 293547

SEQ ID NO: 669278 - RNA, 64 nt, hsa; identical to SEQ ID NO: 293548

SEQ ID NO: 669279 - RNA, 64 nt, hsa; identical to SEQ ID NO: 293549

SEQ ID NO: 669280 - RNA, 64 nt, hsa; identical to SEQ ID NO: 293550

SEQ ID NO: 669281 - RNA, 64 nt, hsa; identical to SEQ ID NO: 293551

SEQ ID NO: 669282 - RNA, 64 nt, hsa; identical to SEQ ID NO: 293552

SEQ ID NO: 669283 - RNA, 64 nt, hsa; identical to SEQ ID NO: 293553

SEQ ID NO: 669284 - RNA, 64 nt, hsa; identical to SEQ ID NO: 293554

SEQ ID NO: 669285 - RNA, 64 nt, hsa; identical to SEQ ID NO: 293555

SEQ ID NO: 669286 - RNA, 64 nt, hsa; identical to SEQ ID NO: 293556

SEQ ID NO: 669287 - RNA, 64 nt, hsa; identical to SEQ ID NO: 293557

SEQ ID NO: 669288 - RNA, 64 nt, hsa; identical to SEQ ID NO: 293558

SEQ ID NO: 669289 - RNA, 64 nt, hsa; identical to SEQ ID NO: 293559

SEQ ID NO: 669290 - RNA, 64 nt, hsa; identical to SEQ ID NO: 293560

SEQ ID NO: 669291 - RNA, 64 nt, hsa; identical to SEQ ID NO: 293561

SEQ ID NO: 669292 - RNA, 64 nt, hsa; identical to SEQ ID NO: 293562

SEQ ID NO: 669293 - RNA, 64 nt, hsa; identical to SEQ ID NO: 293563

SEQ ID NO: 669294 - RNA, 64 nt, hsa; identical to SEQ ID NO: 293564

SEQ ID NO: 669295 - RNA, 64 nt, hsa; identical to SEQ ID NO: 293565

SEQ ID NO: 669296 - RNA, 64 nt, hsa; identical to SEQ ID NO: 293566

SEQ ID NO: 669297 - RNA, 64 nt, hsa; identical to SEQ ID NO: 293567

SEQ ID NO: 669298 - RNA, 64 nt, hsa; identical to SEQ ID NO: 293568

SEQ ID NO: 669299 - RNA, 64 nt, hsa; identical to SEQ ID NO: 293569

SEQ ID NO: 669300 - RNA, 64 nt, hsa; identical to SEQ ID NO: 293570

SEQ ID NO: 669301 - RNA, 64 nt, hsa; identical to SEQ ID NO: 293571

SEQ ID NO: 669302 - RNA, 64 nt, hsa
cacugaagugggcucagugguuuuuggagugaagaagccuuacucccugcacauucccucaugc

SEQ ID NO: 669303 - RNA, 64 nt, hsa
gguuaccuugaacgaaacagaacuugaggggcccaagccuuaucucagccuuuccucaauaugg

SEQ ID NO: 669304 - RNA, 64 nt, hsa
agucuguuuauguagaaacaaauguaauauauuaaagccuuauauauaaugaacuuuguacuau

SEQ ID NO: 669305 - RNA, 64 nt, hsa
caagaggcuuuguuuaggacgugggucccaagccaagccuuaaguguggaauucggauugauag

SEQ ID NO: 669306 - RNA, 64 nt, hsa
ugaacuggccacagaaaagccuuaguauuagcucaagccuuaauaauuacuagaaacccaauua

SEQ ID NO: 669307 - RNA, 64 nt, hsa
acagugguaaaaucauaaugaacuggccacagaaaagccuuaguauuagcucaagccuuaauaa

SEQ ID NO: 669308 - RNA, 64 nt, hsa
gcacaguuaaggccaacuaacguaaaaugcacugaagccuuagggaauauugaagggccugaca

SEQ ID NO: 669309 - RNA, 64 nt, hsa
ugagcauaaauagcuucuguuuggagauucaggaaagccuuaggguggaaugaggaacaucuuc

SEQ ID NO: 669310 - RNA, 64 nt, hsa
ucuuguuugucugucaaggugccuuccucugcugaagccuuaccuccuucucacccaguaacgg

SEQ ID NO: 669311 - RNA, 64 nt, hsa
uucccaaaugcagaacuuggucuuuucauguuaaaagccuuaaucucauuuggguacucaaaag

SEQ ID NO: 669312 - RNA, 64 nt, hsa
cuaaaaucuggggggucggggggaaagaaaaaaaaagccuuaguggccugguuguucaaaggau

SEQ ID NO: 669313 - RNA, 64 nt, hsa
uucagccuaagccaguacuccuuguuugagguaaaagccuuaaaauuuagcucccuagcucuug

SEQ ID NO: 669314 - RNA, 64 nt, hsa
ucccagcaacaccugcaguccagccccccucuucuaggaugagccacuguagaucauuaaaguu

SEQ ID NO: 669315 - RNA, 64 nt, hsa
gagucucugcugaaaugaaucaggauucgagcucuaggaugagacagaaaaugaaagcauguug

SEQ ID NO: 669316 - RNA, 64 nt, hsa
cagaaaauugcaaucaugcaggggcugggaggguuaggaugaaaaaacuggggccauuggaggc

SEQ ID NO: 669317 - RNA, 64 nt, hsa
gggucagcaaaccagauggcuuguuguuggaauguaggaugagaggccugcuuggugaccuagc

SEQ ID NO: 669318 - RNA, 64 nt, hsa
accaaugauuaccucauagggcuguugugaggauuaggaugaaauaccugugaaagugccuagg

SEQ ID NO: 669319 - RNA, 64 nt, hsa
acaccugaaacaaucaacgcccaauaaaacaaaguaggaugaaaauucucuuaguucuuugaua

SEQ ID NO: 669320 - RNA, 64 nt, hsa
aucuaagaccaaagggauguguuuuauuaaugucuaggaugaagaaaugcauagaacauuguag

SEQ ID NO: 669321 - RNA, 64 nt, hsa
auuuaauuaaaugacagucuuuugguuacagacuuaggaugaguaaaaacaagaaaauuugggg

SEQ ID NO: 669322 - RNA, 64 nt, hsa
gggaaaugacaaaggggcagcuggccagauaagcuaggaugagagcagagacucaguguguggg

SEQ ID NO: 669323 - RNA, 64 nt, hsa
caugcuggcugggcggcccaagcacagcccugacuaggaugacagcagcacaaaagaccaccuu

SEQ ID NO: 669324 - RNA, 64 nt, hsa
agagauuauaaguuugacacaacaucugagacacuaggaugaauuaucuuggaugagaaagaug

SEQ ID NO: 669325 - RNA, 64 nt, hsa
uaagccauacauauuucuuuucccacauucuguuuaggaugacaguaauucuguugucuaccau

SEQ ID NO: 669326 - RNA, 64 nt, hsa
agaaaugaguaagacacagugcccacccccaaguuaggaugaaaaaaguuccagagguuuuuaa

SEQ ID NO: 669327 - RNA, 64 nt, hsa
uugaauaccagauaccacuauguaguaagucuuuuaggaugauuuuaauuuagucgugcgucau

SEQ ID NO: 669328 - RNA, 64 nt, hsa
uauauaaauauauauguauaugugcucgcuuguguaggaugaaugucuuagagucguuuguggu

SEQ ID NO: 669329 - RNA, 64 nt, hsa
agaaguaauucucuauaccaagauaugcuaggaguaggaugaugauucaaagugguaacccaaa

SEQ ID NO: 669330 - RNA, 64 nt, hsa
guuguuccuggcaacagaauuugaauaucuaggauaggaugaucaccuccaguccuucggacuu

SEQ ID NO: 669331 - RNA, 64 nt, hsa
gggaauaguauugcagggaagacugagaaaacaguaggaugacaguuuugaguauacucugcac

SEQ ID NO: 669332 - RNA, 64 nt, hsa
ggggaaaacuacaaacguuugacaaacacaauucuaggaugaacaauguauacaaugcacuuuu

SEQ ID NO: 669333 - RNA, 64 nt, hsa
gcuucguuuaauguagcucuugcaugggaguuucuaggaugaaacacuccuccaugggauuuga

SEQ ID NO: 669334 - RNA, 64 nt, hsa
uugcauuguaugaaagagcaagugacuuucuaaguaggaugaaucauauucauaugcagauguc

SEQ ID NO: 669335 - RNA, 64 nt, hsa
aucgcaugagcccacacaguagcacccccguccuuaggaugagagucagagccuuuggaaaggc

SEQ ID NO: 669336 - RNA, 64 nt, hsa
uaugguuuuaagauugaaaguaagaaaacggauuuaggaugaaaacucuagaacuacccuaugc

SEQ ID NO: 669337 - RNA, 64 nt, hsa
gaauugcaaguccucugaagacaaugagaggauuuaggaugagcccgauagguguggcagacca

SEQ ID NO: 669338 - RNA, 61 nt, hsa
auuucuaccaaacagugugaagaaaggcaacuaggaugagguuucaaaagacggaagacga

SEQ ID NO: 669339 - RNA, 64 nt, hsa
uggcauccugcccacaaagaacucacagucugauuaggaugaacuuaaugacuauuuacaccuc

SEQ ID NO: 669340 - RNA, 64 nt, hsa
gguggugugauggcuccugcacaggcccugcacauaggaugagggcaucugcucccacucagcc

SEQ ID NO: 669341 - RNA, 64 nt, hsa
cugagauggugccacuguacuccagccugggugauaggaugagacuccaucucaggggaaaaaa

SEQ ID NO: 669342 - RNA, 64 nt, hsa
aacucaguauuucuacaauugcagcuaagaacauuaggaugaauggcuggcugcuucuaggaau

SEQ ID NO: 669343 - RNA, 64 nt, hsa
aacagaguggaauaaauauaaaugagauucuaacuaggaugaaugugguaguaaugauguauau

SEQ ID NO: 669344 - RNA, 64 nt, hsa
uaugugucucuccuuuuguugccuggcagcugucuaggaugaucacugauuacuauuuacuaag

SEQ ID NO: 669345 - RNA, 64 nt, hsa
acacacacacgggaugaauggagccuuaaagaguuaggaugagccaccagaauaugccugcuca

SEQ ID NO: 669346 - RNA, 64 nt, hsa
ccucuaucucucucuguguaauuuaccauagaauuaggaugauuagauugaaacacauguugua

SEQ ID NO: 669347 - RNA, 64 nt, hsa
cacucaaguagacccuucacucccugcgagaaauuaggaugaauaacuaccuguggcauuguug

SEQ ID NO: 669348 - RNA, 64 nt, hsa
aaugucagaugaagucuuguucaggguauggggcuaggaugagagagaaugccacagaguauga

SEQ ID NO: 669349 - RNA, 64 nt, hsa
cugacuggcagcaccagcuuugggggcagaguccuaggaugaggcuugggcagugcugguaggg

SEQ ID NO: 669350 - RNA, 64 nt, hsa
uugccaaaaagcauacaagcaaccuggucauacauaggaugacaaaauucuuucugguuguuuu

SEQ ID NO: 669351 - RNA, 64 nt, hsa
uuauuguauugcuuaaugucuuuugguuuggauuuaggaugauagaaaacagaaguauaauugg

SEQ ID NO: 669352 - RNA, 64 nt, hsa
cucaauaaaacagaaaggggcaaguauagaagauuaggaugacuaaauuaauggggaaaugaug

SEQ ID NO: 669353 - RNA, 64 nt, hsa
auaauacauaaccacagcaagacugacauccacuuaggaugauacaaagcaguguaacugaaaa

SEQ ID NO: 669354 - RNA, 64 nt, hsa
gugcuucccagccucacaaugugggaauuugacauaggaugagagucagaguauagguuuaaaa

SEQ ID NO: 669355 - RNA, 64 nt, hsa
gccacagaaauaucaaaaauggugacaucacuauuaggaugaaaauuuuaugaaauuccaaugc

SEQ ID NO: 669356 - RNA, 64 nt, hsa
caauuucuguguuccccuuccacccuuuaaaucuuaggaugacaaguuauaaagaaagaagauc

SEQ ID NO: 669357 - RNA, 64 nt, hsa
guggagauuuuuggagaaaccaugacggauaguuuaggaugacuacaugucaaaguaauaaaag

SEQ ID NO: 669358 - RNA, 64 nt, hsa
gcucugauaaauuguguucuguuaaagagguuaguaggaugaaaacagcaaaacaauaauuuuu

SEQ ID NO: 669359 - RNA, 64 nt, hsa
uugauagacgaaauauacuugguuuuaucugcuauaggaugagagacuuuuuaaaauggcagau

SEQ ID NO: 669360 - RNA, 64 nt, hsa
uuaaacuuugauuuuguaugcuauuuuuucacuauaggaugacuauaauucuggucacuaaaua

SEQ ID NO: 669361 - RNA, 64 nt, hsa
ugguuuucaggugagauugaaaaugaagcaaagauaggaugaaucugaacaucucuccaucuag

SEQ ID NO: 669362 - RNA, 64 nt, hsa
ggggcagauauuucccaauacauaccacuuugaauaggaugauaggaaauaaaugauguacuac

SEQ ID NO: 669363 - RNA, 64 nt, hsa
ugagacacauacaaaaaaaaucuuuaaugguuaauaggaugaaugggaaaguauuuuugaaaga

SEQ ID NO: 669364 - RNA, 64 nt, hsa
acugauggugacagcuguacaucaacucugccccuaggaugagcagaaguaccuggagcaucau

SEQ ID NO: 669365 - RNA, 64 nt, hsa
cuccauaguacauggacuuguuacagaaaagugauaggaugaaaggucaauacugcccucucac

SEQ ID NO: 669366 - RNA, 64 nt, hsa
cauuucaguguagucauucauuucuagcuguacauaggaugaaggagagaucagauacaugaac

SEQ ID NO: 669367 - RNA, 64 nt, hsa
acuuuugcuguuggauuuagguuccauucuaaccuaggaugaucucauuuggaaauccuuaauu

SEQ ID NO: 669368 - RNA, 64 nt, hsa
cuuccaaggucaguacauagguaaaaugggcuauuaggaugauccuugaaagcccuuuagaagg

SEQ ID NO: 669369 - RNA, 64 nt, hsa
ucuuucugaauuuuuguaauucucgccuucacacuaggaugacagacucagcuaauguuuccuu

SEQ ID NO: 669370 - RNA, 64 nt, hsa
uuguaugugcuugccgcuauuuuuuucuuccuuuuaggaugauagaucauaacagaacuuauuc

SEQ ID NO: 669371 - RNA, 64 nt, hsa
agaugccuuucccagccaugggagugugaagugcuaggaugaaccuggccauccuagcaaggag

SEQ ID NO: 669372 - RNA, 64 nt, hsa
acuccauauuaaugcaggagccagguuggucuguuaggaugaacaaagguugaggggagggcag

SEQ ID NO: 669373 - RNA, 64 nt, hsa
aagggagaaaaaggaagcaagauaaauggguauguaggaugaaggguuauuuaaaauggaacua

SEQ ID NO: 669374 - RNA, 64 nt, hsa
uugagacuuuuuuuuuuuuaauguucugauacauuaggaugaaguuaaaucuuaaaucuuauua

SEQ ID NO: 669375 - RNA, 64 nt, hsa
agccugucauuuuucagcugcauguaaaaggagguaggaugaauugaucauuauaaagauuuaa

SEQ ID NO: 669376 - RNA, 64 nt, hsa
uauguuuguauauuguguguggcugcuuuugcauuaggaugacagaggugaauaguugcaacag

SEQ ID NO: 669377 - RNA, 64 nt, hsa
acugaggaaaaaaaauucagcacuuggacuaucauaggaugaguaaaacuuuucuuguacaaag

SEQ ID NO: 669378 - RNA, 64 nt, hsa
cuuaacuacgguguuucccuuaccauggcauucauaggaugaaaugaaugacugcccagaauga

SEQ ID NO: 669379 - RNA, 64 nt, hsa
acaggauggagcucuucaugacugucuccagcaauaggaugauuuacuauaaauuucauccaac

SEQ ID NO: 669380 - RNA, 64 nt, hsa
uuuuuagauggcuuucuacccccugaacaauaaauaggaugagguuuuacuguaauuggguaaa

SEQ ID NO: 669381 - RNA, 64 nt, hsa
ugagaugaguagaguaagauuugggugggauggguaggaugaaguauauugcccaacucuaugu

SEQ ID NO: 669382 - RNA, 64 nt, hsa
gaagcugcagcucuggaaagaggguuuaagaugcuaggaugaggcaggcccaguccuccuccag

SEQ ID NO: 669383 - RNA, 64 nt, hsa
uuuuaauugagaaaagacuuugcaauuuuuuuuuuaggaugagccucuccuagacuugaccuag

SEQ ID NO: 669384 - RNA, 64 nt, hsa
agacauuagcaagcauagucuauaaaccuuucaguaggaugauauucucuugguuguuuuucau

SEQ ID NO: 669385 - RNA, 64 nt, hsa
cugagagaaaauucagcaucucaggaggugguauuaggaugacuguguuaacccauuaccuuuu

SEQ ID NO: 669386 - RNA, 64 nt, hsa
ugaaguuuuuuguagguccuuguuguaacuaauuuaggaugaguuucuauguuguauauuaaag

SEQ ID NO: 669387 - RNA, 64 nt, hsa
uauucauucacauuaggucacugucauacugucauaggaugagagaguucuucaaaaauuaugu

SEQ ID NO: 669388 - RNA, 64 nt, hsa
cacaaaccuguguuuauauauuuaaaagauacucuaggaugaucacuugugcuuagcuuagcau

SEQ ID NO: 669389 - RNA, 64 nt, hsa
ugaggcaauuggaaauuugaacacugaucaacuauaggaugauuggaauuauuaauuuuuaaag

SEQ ID NO: 669390 - RNA, 64 nt, hsa
aagaaguuccuuugagcauguaugugucugccucuaggaugagcucagagcgagagaugacaca

SEQ ID NO: 669391 - RNA, 64 nt, hsa
cuggaaaccugaugcuuuuauaagccauugugauuaggaugacuguuacaggcuuagcuuugug

SEQ ID NO: 669392 - RNA, 64 nt, hsa
gaaacauuagcuucuuuuaccaaccugagaaaauuaggaugaccuggcaaauaagaucuugaau

SEQ ID NO: 669393 - RNA, 64 nt, hsa
uguuuuuuguaccucucccagguggguaacacucuaggaugacaugauguuauaauuuuagggg

SEQ ID NO: 669394 - RNA, 64 nt, hsa
auuucccagcuguguaaaaacaauaaaacucaaauaggaugauaaagaauaaaggacacuuugg

SEQ ID NO: 669395 - RNA, 64 nt, hsa
acuccaauugugcugaagcugauuugucuguucguaggaugaugugcagccugucacaguggca

SEQ ID NO: 669396 - RNA, 64 nt, hsa
uaacaaacacaauccauugucaugaaauuacccuuaggaugagucuucuuuaaucaaucauaua

SEQ ID NO: 669397 - RNA, 64 nt, hsa
gcuaaguaauuuuuaguucuaucuauaaucuccguaggaugaauuagaaauaaauugugaugaa

SEQ ID NO: 669398 - RNA, 64 nt, hsa
guacagucauuaaaagugccuuguuucauuuuuauaggaugaaguuauuuauuuucuauuuuca

SEQ ID NO: 669399 - RNA, 64 nt, hsa
cuccuugaacagcuuccccuccagcccacugcuuuaggaugacacaaugaauaacaccuaguca

SEQ ID NO: 669400 - RNA, 64 nt, hsa
ccugggugguuugcagcccuaaugaaauuaugucuaggaugauucagucuauuucccauuuacu

SEQ ID NO: 669401 - RNA, 64 nt, hsa
aaccuccuuuugucuuucauaaaauaaaagcuacuaggaugaguuguuuuaaggauuucagauu

SEQ ID NO: 669402 - RNA, 64 nt, hsa
cuacuuauauaaaagcuagaaauaaugugauuccuaggaugagaaauugguuaacagagcucug

SEQ ID NO: 669403 - RNA, 64 nt, hsa
aauuggugcacagcaggagaaauuucuggacuguuaggaugaauggacgccuucuccccguuau

SEQ ID NO: 669404 - RNA, 64 nt, hsa
ucccaucuuuuggcagcaaaaccaccugcguggcuaggaugauuaauuaugaggaugaugauuu

SEQ ID NO: 669405 - RNA, 64 nt, hsa
cuaaagcuaaccaaagaaaauggcuucaguaaauuaggaugaaaaaugaaaauauaaaauaaag

SEQ ID NO: 669406 - RNA, 64 nt, hsa
aaugcuuuuguuauuaaacucaaaaggcagugauuaggaugaaauaauuguacauaauuuauuu

SEQ ID NO: 669407 - RNA, 64 nt, hsa
ccaguauuaucucugcuuucagaaguagacauaauaggaugaaucauauaacagaaaaaaaaaa

SEQ ID NO: 669408 - RNA, 64 nt, hsa
uuucaauuccacagaaagaaagugagcuugaacauaggaugagcuuuagaaagaaaauugauca

SEQ ID NO: 669409 - RNA, 64 nt, hsa
agcaggacauuggaccucuagagcaagaugucaguaggaugaccuccacccuccuuggacauga

SEQ ID NO: 669410 - RNA, 64 nt, hsa
ccagagcuccugaguggaaucaaguucuugucuuuaggaugaccguuucuuaacaaucaaaucu

SEQ ID NO: 669411 - RNA, 64 nt, hsa
aaaguacuuuuuacuuuuuaugauacucagaaauuaggaugaagaacuuuuaaaauugcugaag

SEQ ID NO: 669412 - RNA, 64 nt, hsa
acaagcaaguucugagagccaggguuuuccuacguaggaugaaaagauucuucuguguuuauaa

SEQ ID NO: 669413 - RNA, 64 nt, hsa
uuccucggaguuuaauuugaaagucugggugucuuaggaugaugguuaggaacauugaaaaaug

SEQ ID NO: 669414 - RNA, 64 nt, hsa
cuugagugaaauaauuuugcauugcaaaguguuuuaggaugaacuuuguuauaguuuuaacucc

SEQ ID NO: 669415 - RNA, 64 nt, hsa
cagaccuuuuucuaugcuuuuuugaauaucagaguaggaugaacacccagauucaaauauguca

SEQ ID NO: 669416 - RNA, 64 nt, hsa
caagaaacuugucuauguaccuuaauacuuuguuuaggaugaggagucuuugugucccuguaca

SEQ ID NO: 669417 - RNA, 64 nt, hsa
guaaauauacuaaacaaaugcuaaaacucaguuuuaggaugaaaccauuguugauauccacauc

SEQ ID NO: 669418 - RNA, 64 nt, hsa
ucuugucuuacauuagggugagaguuugauuauuuaggaugaucccagugauuucaugugugcu

SEQ ID NO: 669419 - RNA, 64 nt, hsa
uuuuuauguacucuuaguuuuauguaagaaaccuuaggaugagcucccuuuucuaagguguuuu

SEQ ID NO: 669420 - RNA, 64 nt, hsa
gaacugaaagcacuagagcagccuuggggacugcuaggaugaagcccuaaagaaugcaaccuag

SEQ ID NO: 669421 - RNA, 64 nt, hsa
cacaccagugucuguucuugaugcaguugcuauuuaggaugaguuaagugccuggggagucccu

SEQ ID NO: 669422 - RNA, 64 nt, hsa
uuuauauuccauaugugguucuuacccauuuaucuaggaugaaagugugaauuagagggacucc

SEQ ID NO: 669423 - RNA, 64 nt, hsa
ccuccaaugucugggacuugccagcucagcccguuaggaugagggugcugagaggaaacaggaa

SEQ ID NO: 669424 - RNA, 64 nt, hsa
cuuaaaugauguuuuguauauuuuaauagacugauaggaugagaaagauuuauauuauuagauu

SEQ ID NO: 669425 - RNA, 64 nt, hsa
aagaagaucgguuuuuaauaauuuuuuauuuucauaggaugaaguuagagaaaauauucagcug

SEQ ID NO: 669426 - RNA, 64 nt, hsa
acacugcaggcaagguguugguaacugccugcucuaggaugaauaguagcguuagcagcacccu

SEQ ID NO: 669427 - RNA, 64 nt, hsa
acaguuuuggaagccucucucaggauugagauucuaggaugagauuggcuuacugcuaucuugu

SEQ ID NO: 669428 - RNA, 64 nt, hsa
ccuuuuuuagcaagccuucugcugauggaagcacuaggaugauucuaggcuguuaaauagauuu

SEQ ID NO: 669429 - RNA, 64 nt, hsa
gaguauagggaggccccauauagguccauccuccuaggaugaagccuucugagagcuuggugaa

SEQ ID NO: 669430 - RNA, 64 nt, hsa
aaaguucagucacuuuauuuauuuuaaaucucucuaggaugaguuuagaacuguagcagugcag

SEQ ID NO: 669431 - RNA, 64 nt, hsa
uuaugaagcagucaacaauuuagggguacgaaaguaggaugagagccuucaaagucuaccagca

SEQ ID NO: 669432 - RNA, 64 nt, hsa
uuuaaagcaauaucccaggagaauauguuagacuuaggaugauaccuucagccacuugaagaag

SEQ ID NO: 669433 - RNA, 64 nt, hsa
aagcaguccuccagccucagccuucucaaagugcuaggaugauuggcaugagccaccucgucug

SEQ ID NO: 669434 - RNA, 64 nt, hsa
uuagaucauuauccagagacugccagaagguggguaggaugaccugggguuucaauugacuucu

SEQ ID NO: 669435 - RNA, 64 nt, hsa
gggcugauacauccuucuguggcuuggagaugaauaggaugauuccguguguguacugauucaa

SEQ ID NO: 669436 - RNA, 64 nt, hsa
ccuaaagugucaacguuuuucuaugacuuuuagguaggaugagagcagaagguagauccuaaaa

SEQ ID NO: 669437 - RNA, 64 nt, hsa
aaaaaaaaaaauuuauguccuucuuauuuauuucuaggaugaggggaggauaacauuuuugcuu

SEQ ID NO: 669438 - RNA, 64 nt, hsa
cuuauugauauaugguaaggguguacuaggggauuaggaugauuguaagagaaugagaaagaug

SEQ ID NO: 669439 - RNA, 64 nt, hsa
guuuggcaaugcucuucuucaauauuuacaauaauaggaugaucuacaagaaaauaaguuucuu

SEQ ID NO: 669440 - RNA, 64 nt, hsa
cuccaacacccggcagcacuuggcccugcaagcuuaggaugagaaccacuuagugucccauucu

SEQ ID NO: 669441 - RNA, 64 nt, hsa
uuucaaaauauuuaaagcauaaccuaacugaugguaggaugauuguaucuugaauaugugguag

SEQ ID NO: 669442 - RNA, 64 nt, hsa
cauauucauuauaagauggcaaaucaaacuuuucuaggaugaagacagcuuauuuuuaaguugu

SEQ ID NO: 669443 - RNA, 64 nt, hsa
uggcaauggaagcuccaguacccagauuggagauuaggaugagacaacuuuguguauaugugca

SEQ ID NO: 669444 - RNA, 64 nt, hsa
guuuguuagauaagagucuauguaugucucugguuaggaugaaguuaauuuuauguuuuuaaca

SEQ ID NO: 669445 - RNA, 64 nt, hsa
gucacccuccucacagaccucugcuuggaguauuuaggaugacugcugugaaauggagaacagu

SEQ ID NO: 669446 - RNA, 64 nt, hsa
aauauagcuuuauuuuucaguggagaucauuguuuaggaugagacauuuuugguuuugguuuug

SEQ ID NO: 669447 - RNA, 64 nt, hsa
gagaucagaucagauagguaaacugcaagauagauaggaugaaacuuuuggccuacuguauuac

SEQ ID NO: 669448 - RNA, 64 nt, hsa
ucacuggcuaaugagaaaaggagacagcuaacucuaggaugaagcugugacuaggcuggaguug

SEQ ID NO: 669449 - RNA, 64 nt, hsa
acaagagacacagacaguaaaaucaaaguauuauuaggaugacuaaauaaauuauaaagucugu

SEQ ID NO: 669450 - RNA, 64 nt, hsa
agaaggccauggagcuuaaaccuccagcagucccuaggaugauguagauucuucuccaucucuc

SEQ ID NO: 669451 - RNA, 64 nt, hsa
cuuaagaagccuuaccacgcaguaacuaaagcuuuaggaugacuguauucgaggagugccgugu

SEQ ID NO: 669452 - RNA, 64 nt, hsa
cucagguuauucguuacucuaagguaaaaccaucuaggaugauuuucccccuugcaguuauguu

SEQ ID NO: 669453 - RNA, 64 nt, hsa
acccacuaaaguagacaauaaaguuuuccacaaauaggaugacccucuagcuauagauacugcc

SEQ ID NO: 669454 - RNA, 64 nt, hsa
ccucagucuucaccguuuuauaaacguauaagauuaggaugaacuuuugaauuuacuugguagg

SEQ ID NO: 669455 - RNA, 64 nt, hsa
ugacacauucuuagcacugaacuccucugugaucuaggaugaucuguucccccucugaugaaca

SEQ ID NO: 669456 - RNA, 64 nt, hsa
cccacgagcagcaggcaacggcguccaaggagacuaggaugaguucuuggcaagggccagcguu

SEQ ID NO: 669457 - RNA, 64 nt, hsa
cuggauuagagaagacuuuucaguggguuaucucuaggaugaucaguaguucagcacuuaaaaa

SEQ ID NO: 669458 - RNA, 64 nt, hsa
ucauguaguuuuggcggaaauuuccccaucauucuaggaugauacagaaagaaaaacugugccu

SEQ ID NO: 669459 - RNA, 64 nt, hsa
cuuuugucagaauagaugaugugucagaucucuuuaggaugacuguauuuuucaguugccgaua

SEQ ID NO: 669460 - RNA, 64 nt, hsa
uaaauggguuuuugcugauuuccugggugcaugcuaggaugauggggcuugaugcaguagggaa

SEQ ID NO: 669461 - RNA, 64 nt, hsa
gaaaauggacauaaagucaaagaaugauggcagguaggaugaaggagagauacuuaggaaaucc

SEQ ID NO: 669462 - RNA, 64 nt, hsa
uuguuuuucuucagcauuuacuugaagauuaauguaggaugacaggcucuccuggcuguccuac

SEQ ID NO: 669463 - RNA, 64 nt, hsa
gagacuaaagaaaucuaucuguucaaguucuaauuaggaugauuguuaauacugcacuguggau

SEQ ID NO: 669464 - RNA, 64 nt, hsa
uguuccugcguguuucacccaaaggagaaaaugcuaggaugaagucaaucuucuugcaggaaca

SEQ ID NO: 669465 - RNA, 64 nt, hsa
cuucccucaaggcugccacacaaaguagcagaaauaggaugauguuugugagcaccagacucaa

SEQ ID NO: 669466 - RNA, 64 nt, hsa
uacuguugcugaauaauacuagguuuuuauggaauaggaugaaugcuuuugaaguauuagggcu

SEQ ID NO: 669467 - RNA, 64 nt, hsa
aucauagucuaaaacuaucacgucugaguugccuuaggaugacagugcugacacccaguaggaa

SEQ ID NO: 669468 - RNA, 64 nt, hsa
agcauuuuuaaaaaauacaauaaauuuguagagauaggaugaccaaggacaacaguuuuaggcu

SEQ ID NO: 669469 - RNA, 64 nt, hsa
uggugccaacacucauucaucauucccgaucaacuaggaugaauuuaagacugugcuaccaugu

SEQ ID NO: 669470 - RNA, 64 nt, hsa
gagccaggaagcagcgucucaucaggacagaagguaggaugaagacaugggguaaugugagaga

SEQ ID NO: 669471 - RNA, 64 nt, hsa
ucucuggcuaccgggcugggggcgaccuuuaccauaggaugaaguaaccuugcauucggcugca

SEQ ID NO: 669472 - RNA, 64 nt, hsa
uucccacagcaaggcugcauuugaaugauuuccuuaggaugaauggucccuacacaaagaggcc

SEQ ID NO: 669473 - RNA, 64 nt, hsa
uccucaccgugaugcauucugccuuccugucuacuaggaugacaaggaguaugugggcuuugca

SEQ ID NO: 669474 - RNA, 64 nt, hsa
cccugcuauuuuucauugacucuauugaacucuuuaggaugaugacugaucauacaaaacguau

SEQ ID NO: 669475 - RNA, 64 nt, hsa
uuaauuuaaaccgcuauuuauuauuaaguuauucuaggaugauuaaaguaaucaaaagaaauaa

SEQ ID NO: 669476 - RNA, 64 nt, hsa
ucaauaaugauuacaguuuucauuuuuaaaaauuuaggaugaaggaaacaaggaaauauaggga

SEQ ID NO: 669477 - RNA, 64 nt, hsa
gagaagaaaaaaucaaagaaaucugucuaauucuuaggaugaccacugggaggucuuaauguuu

SEQ ID NO: 669478 - RNA, 64 nt, hsa
uuccuaggaggaaaauuccauuagagaguggcaauaggaugagguuucuucaggguaaacuagc

SEQ ID NO: 669479 - RNA, 64 nt, hsa
uugcauugucuauacaugcaaaagacuauuaaguuaggaugaacuagauucccuaauuacagug

SEQ ID NO: 669480 - RNA, 64 nt, hsa
ggguugaucuggccccgaggguuuuggauguuuuuaggaugacauaaaaagcaaguguuuuccc

SEQ ID NO: 669481 - RNA, 64 nt, hsa
gaucccagggaggaaguguuggggcuucaugaacuaggaugaaaggaggccccugagccaugac

SEQ ID NO: 669482 - RNA, 64 nt, hsa
gaaaaaccccugaggacccccccccauccucuucuaggaugaggggaagcuggagccccaacuu

SEQ ID NO: 669483 - RNA, 64 nt, hsa
cuacaguuaauucugacacuguaucuuauuaaaauaggaugauuugcauuuuguaaaauuaucc

SEQ ID NO: 669484 - RNA, 64 nt, hsa
gugccuguagucccagcuacucaggaggcugagguaggaugauggcuugagcccaggaguucga

SEQ ID NO: 669485 - RNA, 64 nt, hsa
aggccauucacuguggucccugggaaagaaucaguaggaugacagggcugacuucauuagcuga

SEQ ID NO: 669486 - RNA, 64 nt, hsa
gaacaugugacucucagcauuggaaggacagagcuaggaugauggcuuuccgguggcacucguu

SEQ ID NO: 669487 - RNA, 64 nt, hsa
acauuugggcagugccacccacuccuugggccccuaggaugacccaacuacccccauaacuuuc

SEQ ID NO: 669488 - RNA, 64 nt, hsa
gaaaaaucauauuucaaaauccaguguuauucacuaggaugaaugcuaucaaugucagaaaggc

SEQ ID NO: 669489 - RNA, 64 nt, hsa
uaagucugcucauuggggaacuccagagacaacuuaggaugagggcagaaaagucuuuggggau

SEQ ID NO: 669490 - RNA, 64 nt, hsa
aggugcugggcuggacuggccauuuuucuggggguaggaugaagagaaggcacacagagauucu

SEQ ID NO: 669491 - RNA, 64 nt, hsa
uucccuccuuaaaagaaaaauuaccuucuaguccuaggaugaggacacacuauuaguuugaauu

SEQ ID NO: 669492 - RNA, 64 nt, hsa
gcugauuaggauugaaaugauuuguuucucuuccuaggaugaaaacuaaaucaauuaauuauuc

SEQ ID NO: 669493 - RNA, 64 nt, hsa
aauguaucugcagcaacucugcagguuugugaaauaggaugaaacucaaucuuuuucuauugug

SEQ ID NO: 669494 - RNA, 64 nt, hsa
uucccuaggggaucaccacggcucuagggcauucuaggaugaggucagaccccuuggccauugg

SEQ ID NO: 669495 - RNA, 64 nt, hsa
cggguucucaauuuggucuucuuuuguuguuaauuaggaugagugccgucagugaagggguggg

SEQ ID NO: 669496 - RNA, 64 nt, hsa
caccaaggaaauauugagagagaagucggccagguaggaugaacacaggcaaugacugcgcaga

SEQ ID NO: 669497 - RNA, 64 nt, hsa
ggaaggacaguuacgcuaacuccaaaaggcugucuaggaugagcugcuuuaucagggagcuccu

SEQ ID NO: 669498 - RNA, 64 nt, hsa
gcacagcugcuuccaaauaggagaaaccauaaaauaggaugaaaaucaaguaaaaugcaaagau

SEQ ID NO: 669499 - RNA, 64 nt, hsa
aaauuugaaauggcauuuuguauugccacagagguaggaugagccauauauuagugaaauguuu

SEQ ID NO: 669500 - RNA, 64 nt, hsa
aaauuuugaugcugagggggauuauucaagggacuaggaugaacuaaauaagaacucaguuguu

SEQ ID NO: 669501 - RNA, 64 nt, hsa
aacagugacugauguugguuguaaugguuggguuuaggaugaaccauuuuaaggaugccaaaug

SEQ ID NO: 669502 - RNA, 64 nt, hsa
uuguaucuuaaaguuucaugugaguuuuuaccguuaggaugauuaagauguauauaggacaaaa

SEQ ID NO: 669503 - RNA, 64 nt, hsa
guguuaaugggggacuuugaaaauguuugggagauaggaugaagucaugauuuugcuuuugcaa

SEQ ID NO: 669504 - RNA, 64 nt, hsa
guguguucauguuuuguccagcggaucaggauguuaggaugacgagcaagaguccaggucacug

SEQ ID NO: 669505 - RNA, 64 nt, hsa
aaagugcuuugaugauguaauaccuaauaaaggguaggaugaauauuucacaauaaauguuugu

SEQ ID NO: 669506 - RNA, 64 nt, hsa
guccuccacacaggaggaggauguauucagccuuuaggaugaucagaaaagcagaaagagagag

SEQ ID NO: 669507 - RNA, 64 nt, hsa
cuguaagcacuguaguugaaaagagaguagcaauuaggaugaucauuuuguguaaaauucauua

SEQ ID NO: 669508 - RNA, 64 nt, hsa
aggagccuaggcugaauuugauuccaagagagcuuaggaugacagcaccccugagcugggcaaa

SEQ ID NO: 669509 - RNA, 64 nt, hsa
ccuuuuuaaaugugauuucccgucaucacagcaguaggaugaagccuuguuuugggugagacag

SEQ ID NO: 669510 - RNA, 64 nt, hsa
aguucguuucaagauaggugagauuuaaaauaaauaggaugagguugaagaaaaguauauugga

SEQ ID NO: 669511 - RNA, 64 nt, hsa
uaccgaaggcaaaucuuccagacuauggcuugaguaggaugaaagacaaacacaucugcccaau

SEQ ID NO: 669512 - RNA, 64 nt, hsa; identical to SEQ ID NO: 276789

SEQ ID NO: 669513 - RNA, 64 nt, hsa; identical to SEQ ID NO: 276790

SEQ ID NO: 669514 - RNA, 64 nt, hsa; identical to SEQ ID NO: 276791

SEQ ID NO: 669515 - RNA, 64 nt, hsa; identical to SEQ ID NO: 276792

SEQ ID NO: 669516 - RNA, 64 nt, hsa; identical to SEQ ID NO: 276793

SEQ ID NO: 669517 - RNA, 64 nt, hsa; identical to SEQ ID NO: 276794

SEQ ID NO: 669518 - RNA, 64 nt, hsa; identical to SEQ ID NO: 276795

SEQ ID NO: 669519 - RNA, 64 nt, hsa; identical to SEQ ID NO: 276796

SEQ ID NO: 669520 - RNA, 64 nt, hsa; identical to SEQ ID NO: 276797

SEQ ID NO: 669521 - RNA, 64 nt, hsa; identical to SEQ ID NO: 276798

SEQ ID NO: 669522 - RNA, 64 nt, hsa; identical to SEQ ID NO: 276799

SEQ ID NO: 669523 - RNA, 64 nt, hsa; identical to SEQ ID NO: 276800

SEQ ID NO: 669524 - RNA, 64 nt, hsa; identical to SEQ ID NO: 276801

SEQ ID NO: 669525 - RNA, 64 nt, hsa; identical to SEQ ID NO: 276802

SEQ ID NO: 669526 - RNA, 64 nt, hsa; identical to SEQ ID NO: 276803

SEQ ID NO: 669527 - RNA, 64 nt, hsa; identical to SEQ ID NO: 276804

SEQ ID NO: 669528 - RNA, 64 nt, hsa; identical to SEQ ID NO: 276805

SEQ ID NO: 669529 - RNA, 64 nt, hsa; identical to SEQ ID NO: 276806

SEQ ID NO: 669530 - RNA, 64 nt, hsa; identical to SEQ ID NO: 276807

SEQ ID NO: 669531 - RNA, 64 nt, hsa; identical to SEQ ID NO: 276808

SEQ ID NO: 669532 - RNA, 64 nt, hsa; identical to SEQ ID NO: 276809

SEQ ID NO: 669533 - RNA, 64 nt, hsa; identical to SEQ ID NO: 276810

SEQ ID NO: 669534 - RNA, 64 nt, hsa; identical to SEQ ID NO: 276811

SEQ ID NO: 669535 - RNA, 64 nt, hsa; identical to SEQ ID NO: 276812

SEQ ID NO: 669536 - RNA, 64 nt, hsa; identical to SEQ ID NO: 276813

SEQ ID NO: 669537 - RNA, 64 nt, hsa; identical to SEQ ID NO: 276814

SEQ ID NO: 669538 - RNA, 64 nt, hsa; identical to SEQ ID NO: 276815

SEQ ID NO: 669539 - RNA, 64 nt, hsa; identical to SEQ ID NO: 276816

SEQ ID NO: 669540 - RNA, 64 nt, hsa; identical to SEQ ID NO: 276817

SEQ ID NO: 669541 - RNA, 64 nt, hsa; identical to SEQ ID NO: 276818

SEQ ID NO: 669542 - RNA, 64 nt, hsa; identical to SEQ ID NO: 276819

SEQ ID NO: 669543 - RNA, 64 nt, hsa; identical to SEQ ID NO: 276820

SEQ ID NO: 669544 - RNA, 64 nt, hsa; identical to SEQ ID NO: 276821

SEQ ID NO: 669545 - RNA, 64 nt, hsa; identical to SEQ ID NO: 276822

SEQ ID NO: 669546 - RNA, 64 nt, hsa; identical to SEQ ID NO: 276823

SEQ ID NO: 669547 - RNA, 64 nt, hsa; identical to SEQ ID NO: 276824

SEQ ID NO: 669548 - RNA, 64 nt, hsa; identical to SEQ ID NO: 276825

SEQ ID NO: 669549 - RNA, 64 nt, hsa; identical to SEQ ID NO: 276826

SEQ ID NO: 669550 - RNA, 64 nt, hsa; identical to SEQ ID NO: 276827

SEQ ID NO: 669551 - RNA, 64 nt, hsa; identical to SEQ ID NO: 276828

SEQ ID NO: 669552 - RNA, 64 nt, hsa; identical to SEQ ID NO: 276829

SEQ ID NO: 669553 - RNA, 64 nt, hsa; identical to SEQ ID NO: 276830

SEQ ID NO: 669554 - RNA, 64 nt, hsa; identical to SEQ ID NO: 276831

SEQ ID NO: 669555 - RNA, 64 nt, hsa; identical to SEQ ID NO: 276832

SEQ ID NO: 669556 - RNA, 64 nt, hsa; identical to SEQ ID NO: 276833

SEQ ID NO: 669557 - RNA, 64 nt, hsa; identical to SEQ ID NO: 276834

SEQ ID NO: 669558 - RNA, 64 nt, hsa; identical to SEQ ID NO: 276835

SEQ ID NO: 669559 - RNA, 64 nt, hsa; identical to SEQ ID NO: 276836

SEQ ID NO: 669560 - RNA, 64 nt, hsa; identical to SEQ ID NO: 276837

SEQ ID NO: 669561 - RNA, 64 nt, hsa; identical to SEQ ID NO: 276838

SEQ ID NO: 669562 - RNA, 64 nt, hsa; identical to SEQ ID NO: 276839

SEQ ID NO: 669563 - RNA, 64 nt, hsa; identical to SEQ ID NO: 276840

SEQ ID NO: 669564 - RNA, 64 nt, hsa; identical to SEQ ID NO: 276841

SEQ ID NO: 669565 - RNA, 64 nt, hsa; identical to SEQ ID NO: 276842

SEQ ID NO: 669566 - RNA, 64 nt, hsa; identical to SEQ ID NO: 276843

SEQ ID NO: 669567 - RNA, 64 nt, hsa; identical to SEQ ID NO: 276844

SEQ ID NO: 669568 - RNA, 64 nt, hsa; identical to SEQ ID NO: 276845

SEQ ID NO: 669569 - RNA, 64 nt, hsa; identical to SEQ ID NO: 276846

SEQ ID NO: 669570 - RNA, 64 nt, hsa; identical to SEQ ID NO: 276847

SEQ ID NO: 669571 - RNA, 64 nt, hsa; identical to SEQ ID NO: 276848

SEQ ID NO: 669572 - RNA, 64 nt, hsa; identical to SEQ ID NO: 276849

SEQ ID NO: 669573 - RNA, 64 nt, hsa; identical to SEQ ID NO: 276850

SEQ ID NO: 669574 - RNA, 64 nt, hsa; identical to SEQ ID NO: 276851

SEQ ID NO: 669575 - RNA, 64 nt, hsa; identical to SEQ ID NO: 276852

SEQ ID NO: 669576 - RNA, 64 nt, hsa; identical to SEQ ID NO: 276853

SEQ ID NO: 669577 - RNA, 64 nt, hsa; identical to SEQ ID NO: 276854

SEQ ID NO: 669578 - RNA, 64 nt, hsa; identical to SEQ ID NO: 276855

SEQ ID NO: 669579 - RNA, 64 nt, hsa; identical to SEQ ID NO: 276856

SEQ ID NO: 669580 - RNA, 64 nt, hsa; identical to SEQ ID NO: 276857

SEQ ID NO: 669581 - RNA, 64 nt, hsa; identical to SEQ ID NO: 218520

SEQ ID NO: 669582 - RNA, 64 nt, hsa; identical to SEQ ID NO: 218521

SEQ ID NO: 669583 - RNA, 64 nt, hsa; identical to SEQ ID NO: 218522

SEQ ID NO: 669584 - RNA, 64 nt, hsa; identical to SEQ ID NO: 218523

SEQ ID NO: 669585 - RNA, 64 nt, hsa; identical to SEQ ID NO: 218524

SEQ ID NO: 669586 - RNA, 64 nt, hsa; identical to SEQ ID NO: 218525

SEQ ID NO: 669587 - RNA, 64 nt, hsa; identical to SEQ ID NO: 218526

SEQ ID NO: 669588 - RNA, 64 nt, hsa; identical to SEQ ID NO: 218527

SEQ ID NO: 669589 - RNA, 64 nt, hsa; identical to SEQ ID NO: 218528

SEQ ID NO: 669590 - RNA, 64 nt, hsa; identical to SEQ ID NO: 218529

SEQ ID NO: 669591 - RNA, 64 nt, hsa; identical to SEQ ID NO: 218530

SEQ ID NO: 669592 - RNA, 64 nt, hsa; identical to SEQ ID NO: 218531

SEQ ID NO: 669593 - RNA, 64 nt, hsa; identical to SEQ ID NO: 218532

SEQ ID NO: 669594 - RNA, 64 nt, hsa; identical to SEQ ID NO: 218533

SEQ ID NO: 669595 - RNA, 64 nt, hsa; identical to SEQ ID NO: 218534

SEQ ID NO: 669596 - RNA, 64 nt, hsa; identical to SEQ ID NO: 218535

SEQ ID NO: 669597 - RNA, 64 nt, hsa; identical to SEQ ID NO: 218536

SEQ ID NO: 669598 - RNA, 64 nt, hsa; identical to SEQ ID NO: 218537

SEQ ID NO: 669599 - RNA, 64 nt, hsa; identical to SEQ ID NO: 218538

SEQ ID NO: 669600 - RNA, 61 nt, hsa; identical to SEQ ID NO: 218539

SEQ ID NO: 669601 - RNA, 64 nt, hsa; identical to SEQ ID NO: 218540

SEQ ID NO: 669602 - RNA, 64 nt, hsa; identical to SEQ ID NO: 218541

SEQ ID NO: 669603 - RNA, 64 nt, hsa; identical to SEQ ID NO: 218542

SEQ ID NO: 669604 - RNA, 64 nt, hsa; identical to SEQ ID NO: 218543

SEQ ID NO: 669605 - RNA, 64 nt, hsa; identical to SEQ ID NO: 218544

SEQ ID NO: 669606 - RNA, 64 nt, hsa; identical to SEQ ID NO: 218545

SEQ ID NO: 669607 - RNA, 64 nt, hsa; identical to SEQ ID NO: 218546

SEQ ID NO: 669608 - RNA, 64 nt, hsa; identical to SEQ ID NO: 218547

SEQ ID NO: 669609 - RNA, 64 nt, hsa; identical to SEQ ID NO: 218548

SEQ ID NO: 669610 - RNA, 64 nt, hsa; identical to SEQ ID NO: 218549

SEQ ID NO: 669611 - RNA, 64 nt, hsa; identical to SEQ ID NO: 218550

SEQ ID NO: 669612 - RNA, 64 nt, hsa; identical to SEQ ID NO: 218551

SEQ ID NO: 669613 - RNA, 64 nt, hsa; identical to SEQ ID NO: 218552

SEQ ID NO: 669614 - RNA, 64 nt, hsa; identical to SEQ ID NO: 218553

SEQ ID NO: 669615 - RNA, 63 nt, hsa; identical to SEQ ID NO: 218554

SEQ ID NO: 669616 - RNA, 64 nt, hsa; identical to SEQ ID NO: 218555

SEQ ID NO: 669617 - RNA, 64 nt, hsa; identical to SEQ ID NO: 218556

SEQ ID NO: 669618 - RNA, 64 nt, hsa; identical to SEQ ID NO: 218557

SEQ ID NO: 669619 - RNA, 64 nt, hsa; identical to SEQ ID NO: 218558

SEQ ID NO: 669620 - RNA, 64 nt, hsa; identical to SEQ ID NO: 218559

SEQ ID NO: 669621 - RNA, 64 nt, hsa; identical to SEQ ID NO: 218560

SEQ ID NO: 669622 - RNA, 64 nt, hsa; identical to SEQ ID NO: 218561

SEQ ID NO: 669623 - RNA, 64 nt, hsa; identical to SEQ ID NO: 218562

SEQ ID NO: 669624 - RNA, 64 nt, hsa; identical to SEQ ID NO: 218563

SEQ ID NO: 669625 - RNA, 64 nt, hsa; identical to SEQ ID NO: 218564

SEQ ID NO: 669626 - RNA, 64 nt, hsa; identical to SEQ ID NO: 218565

SEQ ID NO: 669627 - RNA, 64 nt, hsa; identical to SEQ ID NO: 218566

SEQ ID NO: 669628 - RNA, 64 nt, hsa; identical to SEQ ID NO: 218567

SEQ ID NO: 669629 - RNA, 64 nt, hsa; identical to SEQ ID NO: 218568

SEQ ID NO: 669630 - RNA, 64 nt, hsa; identical to SEQ ID NO: 218569

SEQ ID NO: 669631 - RNA, 64 nt, hsa; identical to SEQ ID NO: 218570

SEQ ID NO: 669632 - RNA, 64 nt, hsa; identical to SEQ ID NO: 218571

SEQ ID NO: 669633 - RNA, 64 nt, hsa; identical to SEQ ID NO: 218572

SEQ ID NO: 669634 - RNA, 64 nt, hsa; identical to SEQ ID NO: 218573

SEQ ID NO: 669635 - RNA, 64 nt, hsa; identical to SEQ ID NO: 218574

SEQ ID NO: 669636 - RNA, 64 nt, hsa; identical to SEQ ID NO: 218575

SEQ ID NO: 669637 - RNA, 64 nt, hsa; identical to SEQ ID NO: 218576

SEQ ID NO: 669638 - RNA, 64 nt, hsa; identical to SEQ ID NO: 218577

SEQ ID NO: 669639 - RNA, 64 nt, hsa; identical to SEQ ID NO: 218578

SEQ ID NO: 669640 - RNA, 64 nt, hsa; identical to SEQ ID NO: 218579

SEQ ID NO: 669641 - RNA, 64 nt, hsa; identical to SEQ ID NO: 218580

SEQ ID NO: 669642 - RNA, 64 nt, hsa; identical to SEQ ID NO: 218581

SEQ ID NO: 669643 - RNA, 64 nt, hsa; identical to SEQ ID NO: 218582

SEQ ID NO: 669644 - RNA, 64 nt, hsa; identical to SEQ ID NO: 218583

SEQ ID NO: 669645 - RNA, 64 nt, hsa; identical to SEQ ID NO: 218584

SEQ ID NO: 669646 - RNA, 64 nt, hsa; identical to SEQ ID NO: 218585

SEQ ID NO: 669647 - RNA, 64 nt, hsa; identical to SEQ ID NO: 218586

SEQ ID NO: 669648 - RNA, 64 nt, hsa; identical to SEQ ID NO: 218587

SEQ ID NO: 669649 - RNA, 64 nt, hsa; identical to SEQ ID NO: 218588

SEQ ID NO: 669650 - RNA, 64 nt, hsa; identical to SEQ ID NO: 218589

SEQ ID NO: 669651 - RNA, 64 nt, hsa; identical to SEQ ID NO: 218590

SEQ ID NO: 669652 - RNA, 64 nt, hsa; identical to SEQ ID NO: 218591

SEQ ID NO: 669653 - RNA, 64 nt, hsa; identical to SEQ ID NO: 218592

SEQ ID NO: 669654 - RNA, 64 nt, hsa; identical to SEQ ID NO: 218593

SEQ ID NO: 669655 - RNA, 64 nt, hsa; identical to SEQ ID NO: 218594

SEQ ID NO: 669656 - RNA, 64 nt, hsa; identical to SEQ ID NO: 218595

SEQ ID NO: 669657 - RNA, 64 nt, hsa; identical to SEQ ID NO: 218596

SEQ ID NO: 669658 - RNA, 64 nt, hsa; identical to SEQ ID NO: 218597

SEQ ID NO: 669659 - RNA, 64 nt, hsa; identical to SEQ ID NO: 218598

SEQ ID NO: 669660 - RNA, 64 nt, hsa; identical to SEQ ID NO: 218599

SEQ ID NO: 669661 - RNA, 64 nt, hsa; identical to SEQ ID NO: 218600

SEQ ID NO: 669662 - RNA, 64 nt, hsa; identical to SEQ ID NO: 218601

SEQ ID NO: 669663 - RNA, 64 nt, hsa; identical to SEQ ID NO: 218602

SEQ ID NO: 669664 - RNA, 64 nt, hsa; identical to SEQ ID NO: 218603

SEQ ID NO: 669665 - RNA, 64 nt, hsa; identical to SEQ ID NO: 218604

SEQ ID NO: 669666 - RNA, 64 nt, hsa; identical to SEQ ID NO: 218605

SEQ ID NO: 669667 - RNA, 64 nt, hsa; identical to SEQ ID NO: 218606

SEQ ID NO: 669668 - RNA, 64 nt, hsa; identical to SEQ ID NO: 218607

SEQ ID NO: 669669 - RNA, 64 nt, hsa; identical to SEQ ID NO: 218608

SEQ ID NO: 669670 - RNA, 64 nt, hsa; identical to SEQ ID NO: 218609

SEQ ID NO: 669671 - RNA, 64 nt, hsa; identical to SEQ ID NO: 218610

SEQ ID NO: 669672 - RNA, 64 nt, hsa; identical to SEQ ID NO: 218611

SEQ ID NO: 669673 - RNA, 64 nt, hsa; identical to SEQ ID NO: 218612

SEQ ID NO: 669674 - RNA, 62 nt, hsa; identical to SEQ ID NO: 218613

SEQ ID NO: 669675 - RNA, 64 nt, hsa; identical to SEQ ID NO: 218614

SEQ ID NO: 669676 - RNA, 64 nt, hsa; identical to SEQ ID NO: 218615

SEQ ID NO: 669677 - RNA, 64 nt, hsa; identical to SEQ ID NO: 218616

SEQ ID NO: 669678 - RNA, 64 nt, hsa; identical to SEQ ID NO: 218617

SEQ ID NO: 669679 - RNA, 64 nt, hsa; identical to SEQ ID NO: 218618

SEQ ID NO: 669680 - RNA, 64 nt, hsa; identical to SEQ ID NO: 218619

SEQ ID NO: 669681 - RNA, 64 nt, hsa; identical to SEQ ID NO: 218620

SEQ ID NO: 669682 - RNA, 64 nt, hsa; identical to SEQ ID NO: 218621

SEQ ID NO: 669683 - RNA, 64 nt, hsa; identical to SEQ ID NO: 218622

SEQ ID NO: 669684 - RNA, 64 nt, hsa; identical to SEQ ID NO: 218623

SEQ ID NO: 669685 - RNA, 64 nt, hsa; identical to SEQ ID NO: 218624

SEQ ID NO: 669686 - RNA, 64 nt, hsa; identical to SEQ ID NO: 218625

SEQ ID NO: 669687 - RNA, 64 nt, hsa; identical to SEQ ID NO: 218626

SEQ ID NO: 669688 - RNA, 64 nt, hsa; identical to SEQ ID NO: 218627

SEQ ID NO: 669689 - RNA, 64 nt, hsa; identical to SEQ ID NO: 218628

SEQ ID NO: 669690 - RNA, 64 nt, hsa; identical to SEQ ID NO: 218629

SEQ ID NO: 669691 - RNA, 64 nt, hsa; identical to SEQ ID NO: 218630

SEQ ID NO: 669692 - RNA, 64 nt, hsa; identical to SEQ ID NO: 218631

SEQ ID NO: 669693 - RNA, 64 nt, hsa; identical to SEQ ID NO: 218632

SEQ ID NO: 669694 - RNA, 64 nt, hsa; identical to SEQ ID NO: 218633

SEQ ID NO: 669695 - RNA, 64 nt, hsa; identical to SEQ ID NO: 218634

SEQ ID NO: 669696 - RNA, 64 nt, hsa; identical to SEQ ID NO: 218635

SEQ ID NO: 669697 - RNA, 64 nt, hsa; identical to SEQ ID NO: 218636

SEQ ID NO: 669698 - RNA, 64 nt, hsa; identical to SEQ ID NO: 218637

SEQ ID NO: 669699 - RNA, 64 nt, hsa; identical to SEQ ID NO: 218638

SEQ ID NO: 669700 - RNA, 64 nt, hsa; identical to SEQ ID NO: 218639

SEQ ID NO: 669701 - RNA, 64 nt, hsa; identical to SEQ ID NO: 218640

SEQ ID NO: 669702 - RNA, 64 nt, hsa; identical to SEQ ID NO: 218641

SEQ ID NO: 669703 - RNA, 64 nt, hsa; identical to SEQ ID NO: 218642

SEQ ID NO: 669704 - RNA, 64 nt, hsa; identical to SEQ ID NO: 218643

SEQ ID NO: 669705 - RNA, 64 nt, hsa; identical to SEQ ID NO: 218644

SEQ ID NO: 669706 - RNA, 64 nt, hsa; identical to SEQ ID NO: 218645

SEQ ID NO: 669707 - RNA, 64 nt, hsa; identical to SEQ ID NO: 218646

SEQ ID NO: 669708 - RNA, 64 nt, hsa; identical to SEQ ID NO: 218647

SEQ ID NO: 669709 - RNA, 64 nt, hsa; identical to SEQ ID NO: 218648

SEQ ID NO: 669710 - RNA, 64 nt, hsa; identical to SEQ ID NO: 218649

SEQ ID NO: 669711 - RNA, 64 nt, hsa; identical to SEQ ID NO: 218650

SEQ ID NO: 669712 - RNA, 64 nt, hsa; identical to SEQ ID NO: 218651

SEQ ID NO: 669713 - RNA, 64 nt, hsa; identical to SEQ ID NO: 218652

SEQ ID NO: 669714 - RNA, 64 nt, hsa; identical to SEQ ID NO: 218653

SEQ ID NO: 669715 - RNA, 64 nt, hsa; identical to SEQ ID NO: 218654

SEQ ID NO: 669716 - RNA, 64 nt, hsa; identical to SEQ ID NO: 218655

SEQ ID NO: 669717 - RNA, 64 nt, hsa; identical to SEQ ID NO: 218656

SEQ ID NO: 669718 - RNA, 64 nt, hsa; identical to SEQ ID NO: 218657

SEQ ID NO: 669719 - RNA, 64 nt, hsa; identical to SEQ ID NO: 218658

SEQ ID NO: 669720 - RNA, 64 nt, hsa; identical to SEQ ID NO: 218659

SEQ ID NO: 669721 - RNA, 64 nt, hsa; identical to SEQ ID NO: 218660

SEQ ID NO: 669722 - RNA, 64 nt, hsa; identical to SEQ ID NO: 218661

SEQ ID NO: 669723 - RNA, 61 nt, hsa; identical to SEQ ID NO: 218662

SEQ ID NO: 669724 - RNA, 64 nt, hsa; identical to SEQ ID NO: 218663

SEQ ID NO: 669725 - RNA, 64 nt, hsa; identical to SEQ ID NO: 218664

SEQ ID NO: 669726 - RNA, 64 nt, hsa; identical to SEQ ID NO: 218665

SEQ ID NO: 669727 - RNA, 64 nt, hsa; identical to SEQ ID NO: 218666

SEQ ID NO: 669728 - RNA, 64 nt, hsa; identical to SEQ ID NO: 218667

SEQ ID NO: 669729 - RNA, 64 nt, hsa; identical to SEQ ID NO: 218668

SEQ ID NO: 669730 - RNA, 64 nt, hsa; identical to SEQ ID NO: 218669

SEQ ID NO: 669731 - RNA, 64 nt, hsa; identical to SEQ ID NO: 218670

SEQ ID NO: 669732 - RNA, 64 nt, hsa; identical to SEQ ID NO: 218671

SEQ ID NO: 669733 - RNA, 64 nt, hsa; identical to SEQ ID NO: 218672

SEQ ID NO: 669734 - RNA, 64 nt, hsa; identical to SEQ ID NO: 218673

SEQ ID NO: 669735 - RNA, 64 nt, hsa; identical to SEQ ID NO: 218674

SEQ ID NO: 669736 - RNA, 64 nt, hsa; identical to SEQ ID NO: 218675

SEQ ID NO: 669737 - RNA, 64 nt, hsa; identical to SEQ ID NO: 218676

SEQ ID NO: 669738 - RNA, 64 nt, hsa; identical to SEQ ID NO: 218677

SEQ ID NO: 669739 - RNA, 64 nt, hsa; identical to SEQ ID NO: 218678

SEQ ID NO: 669740 - RNA, 64 nt, hsa; identical to SEQ ID NO: 218679

SEQ ID NO: 669741 - RNA, 64 nt, hsa; identical to SEQ ID NO: 218680

SEQ ID NO: 669742 - RNA, 64 nt, hsa; identical to SEQ ID NO: 218681

SEQ ID NO: 669743 - RNA, 64 nt, hsa; identical to SEQ ID NO: 218682

SEQ ID NO: 669744 - RNA, 64 nt, hsa; identical to SEQ ID NO: 218683

SEQ ID NO: 669745 - RNA, 64 nt, hsa; identical to SEQ ID NO: 218684

SEQ ID NO: 669746 - RNA, 64 nt, hsa; identical to SEQ ID NO: 218685

SEQ ID NO: 669747 - RNA, 59 nt, hsa; identical to SEQ ID NO: 218686

SEQ ID NO: 669748 - RNA, 64 nt, hsa; identical to SEQ ID NO: 218687

SEQ ID NO: 669749 - RNA, 64 nt, hsa; identical to SEQ ID NO: 218688

SEQ ID NO: 669750 - RNA, 64 nt, hsa; identical to SEQ ID NO: 218689

SEQ ID NO: 669751 - RNA, 64 nt, hsa; identical to SEQ ID NO: 218690

SEQ ID NO: 669752 - RNA, 64 nt, hsa; identical to SEQ ID NO: 218691

SEQ ID NO: 669753 - RNA, 64 nt, hsa; identical to SEQ ID NO: 218692

SEQ ID NO: 669754 - RNA, 64 nt, hsa; identical to SEQ ID NO: 218693

SEQ ID NO: 669755 - RNA, 64 nt, hsa; identical to SEQ ID NO: 218694

SEQ ID NO: 669756 - RNA, 64 nt, hsa; identical to SEQ ID NO: 218695

SEQ ID NO: 669757 - RNA, 64 nt, hsa; identical to SEQ ID NO: 218696

SEQ ID NO: 669758 - RNA, 64 nt, hsa; identical to SEQ ID NO: 218697

SEQ ID NO: 669759 - RNA, 64 nt, hsa; identical to SEQ ID NO: 218698

SEQ ID NO: 669760 - RNA, 64 nt, hsa; identical to SEQ ID NO: 218699

SEQ ID NO: 669761 - RNA, 64 nt, hsa; identical to SEQ ID NO: 218700

SEQ ID NO: 669762 - RNA, 64 nt, hsa; identical to SEQ ID NO: 218701

SEQ ID NO: 669763 - RNA, 64 nt, hsa; identical to SEQ ID NO: 218702

SEQ ID NO: 669764 - RNA, 64 nt, hsa; identical to SEQ ID NO: 218703

SEQ ID NO: 669765 - RNA, 64 nt, hsa; identical to SEQ ID NO: 218704

SEQ ID NO: 669766 - RNA, 64 nt, hsa; identical to SEQ ID NO: 218705

SEQ ID NO: 669767 - RNA, 64 nt, hsa; identical to SEQ ID NO: 218706

SEQ ID NO: 669768 - RNA, 64 nt, hsa; identical to SEQ ID NO: 218707

SEQ ID NO: 669769 - RNA, 64 nt, hsa; identical to SEQ ID NO: 218708

SEQ ID NO: 669770 - RNA, 64 nt, hsa; identical to SEQ ID NO: 218709

SEQ ID NO: 669771 - RNA, 64 nt, hsa; identical to SEQ ID NO: 218710

SEQ ID NO: 669772 - RNA, 64 nt, hsa; identical to SEQ ID NO: 218711

SEQ ID NO: 669773 - RNA, 64 nt, hsa; identical to SEQ ID NO: 218712

SEQ ID NO: 669774 - RNA, 64 nt, hsa; identical to SEQ ID NO: 218713

SEQ ID NO: 669775 - RNA, 64 nt, hsa; identical to SEQ ID NO: 218714

SEQ ID NO: 669776 - RNA, 64 nt, hsa; identical to SEQ ID NO: 218715

SEQ ID NO: 669777 - RNA, 64 nt, hsa; identical to SEQ ID NO: 218716

SEQ ID NO: 669778 - RNA, 64 nt, hsa; identical to SEQ ID NO: 218717

SEQ ID NO: 669779 - RNA, 64 nt, hsa; identical to SEQ ID NO: 218718

SEQ ID NO: 669780 - RNA, 64 nt, hsa; identical to SEQ ID NO: 218719

SEQ ID NO: 669781 - RNA, 64 nt, hsa; identical to SEQ ID NO: 218720

SEQ ID NO: 669782 - RNA, 64 nt, hsa; identical to SEQ ID NO: 218721

SEQ ID NO: 669783 - RNA, 64 nt, hsa; identical to SEQ ID NO: 218722

SEQ ID NO: 669784 - RNA, 64 nt, hsa; identical to SEQ ID NO: 218723

SEQ ID NO: 669785 - RNA, 64 nt, hsa; identical to SEQ ID NO: 218724

SEQ ID NO: 669786 - RNA, 64 nt, hsa; identical to SEQ ID NO: 218725

SEQ ID NO: 669787 - RNA, 64 nt, hsa; identical to SEQ ID NO: 218726

SEQ ID NO: 669788 - RNA, 64 nt, hsa; identical to SEQ ID NO: 218727

SEQ ID NO: 669789 - RNA, 64 nt, hsa; identical to SEQ ID NO: 218728

SEQ ID NO: 669790 - RNA, 64 nt, hsa; identical to SEQ ID NO: 218729

SEQ ID NO: 669791 - RNA, 64 nt, hsa; identical to SEQ ID NO: 218730

SEQ ID NO: 669792 - RNA, 64 nt, hsa; identical to SEQ ID NO: 218731

SEQ ID NO: 669793 - RNA, 64 nt, hsa; identical to SEQ ID NO: 218732

SEQ ID NO: 669794 - RNA, 64 nt, hsa; identical to SEQ ID NO: 218733

SEQ ID NO: 669795 - RNA, 64 nt, hsa; identical to SEQ ID NO: 218734

SEQ ID NO: 669796 - RNA, 64 nt, hsa; identical to SEQ ID NO: 218735

SEQ ID NO: 669797 - RNA, 64 nt, hsa; identical to SEQ ID NO: 218736

SEQ ID NO: 669798 - RNA, 64 nt, hsa; identical to SEQ ID NO: 218737

SEQ ID NO: 669799 - RNA, 64 nt, hsa; identical to SEQ ID NO: 218738

SEQ ID NO: 669800 - RNA, 64 nt, hsa; identical to SEQ ID NO: 218739

SEQ ID NO: 669801 - RNA, 64 nt, hsa; identical to SEQ ID NO: 218740

SEQ ID NO: 669802 - RNA, 64 nt, hsa; identical to SEQ ID NO: 218741

SEQ ID NO: 669803 - RNA, 64 nt, hsa; identical to SEQ ID NO: 218742

SEQ ID NO: 669804 - RNA, 64 nt, hsa; identical to SEQ ID NO: 218743

SEQ ID NO: 669805 - RNA, 64 nt, hsa; identical to SEQ ID NO: 218744

SEQ ID NO: 669806 - RNA, 64 nt, hsa; identical to SEQ ID NO: 218745

SEQ ID NO: 669807 - RNA, 64 nt, hsa; identical to SEQ ID NO: 218746

SEQ ID NO: 669808 - RNA, 64 nt, hsa; identical to SEQ ID NO: 218747

SEQ ID NO: 669809 - RNA, 64 nt, hsa; identical to SEQ ID NO: 218748

SEQ ID NO: 669810 - RNA, 64 nt, hsa; identical to SEQ ID NO: 218749

SEQ ID NO: 669811 - RNA, 64 nt, hsa; identical to SEQ ID NO: 218750

SEQ ID NO: 669812 - RNA, 64 nt, hsa; identical to SEQ ID NO: 218751

SEQ ID NO: 669813 - RNA, 64 nt, hsa; identical to SEQ ID NO: 218752

SEQ ID NO: 669814 - RNA, 64 nt, hsa; identical to SEQ ID NO: 218753

SEQ ID NO: 669815 - RNA, 64 nt, hsa; identical to SEQ ID NO: 218754

SEQ ID NO: 669816 - RNA, 64 nt, hsa; identical to SEQ ID NO: 218755

SEQ ID NO: 669817 - RNA, 64 nt, hsa; identical to SEQ ID NO: 218756

SEQ ID NO: 669818 - RNA, 64 nt, hsa; identical to SEQ ID NO: 218757

SEQ ID NO: 669819 - RNA, 64 nt, hsa; identical to SEQ ID NO: 218758

SEQ ID NO: 669820 - RNA, 64 nt, hsa; identical to SEQ ID NO: 218759

SEQ ID NO: 669821 - RNA, 64 nt, hsa; identical to SEQ ID NO: 218760

SEQ ID NO: 669822 - RNA, 64 nt, hsa; identical to SEQ ID NO: 218761

SEQ ID NO: 669823 - RNA, 64 nt, hsa; identical to SEQ ID NO: 218762

SEQ ID NO: 669824 - RNA, 64 nt, hsa; identical to SEQ ID NO: 218763

SEQ ID NO: 669825 - RNA, 64 nt, hsa; identical to SEQ ID NO: 218764

SEQ ID NO: 669826 - RNA, 64 nt, hsa; identical to SEQ ID NO: 218765

SEQ ID NO: 669827 - RNA, 64 nt, hsa; identical to SEQ ID NO: 218766

SEQ ID NO: 669828 - RNA, 64 nt, hsa; identical to SEQ ID NO: 218767

SEQ ID NO: 669829 - RNA, 64 nt, hsa; identical to SEQ ID NO: 218768

SEQ ID NO: 669830 - RNA, 64 nt, hsa; identical to SEQ ID NO: 218769

SEQ ID NO: 669831 - RNA, 64 nt, hsa; identical to SEQ ID NO: 218770

SEQ ID NO: 669832 - RNA, 64 nt, hsa; identical to SEQ ID NO: 218771

SEQ ID NO: 669833 - RNA, 64 nt, hsa; identical to SEQ ID NO: 218772

SEQ ID NO: 669834 - RNA, 64 nt, hsa; identical to SEQ ID NO: 218773

SEQ ID NO: 669835 - RNA, 64 nt, hsa; identical to SEQ ID NO: 218774

SEQ ID NO: 669836 - RNA, 64 nt, hsa; identical to SEQ ID NO: 218775

SEQ ID NO: 669837 - RNA, 64 nt, hsa; identical to SEQ ID NO: 218776

SEQ ID NO: 669838 - RNA, 64 nt, hsa; identical to SEQ ID NO: 218777

SEQ ID NO: 669839 - RNA, 64 nt, hsa; identical to SEQ ID NO: 218778

SEQ ID NO: 669840 - RNA, 64 nt, hsa; identical to SEQ ID NO: 218779

SEQ ID NO: 669841 - RNA, 64 nt, hsa; identical to SEQ ID NO: 218780

SEQ ID NO: 669842 - RNA, 64 nt, hsa; identical to SEQ ID NO: 218781

SEQ ID NO: 669843 - RNA, 64 nt, hsa; identical to SEQ ID NO: 218782

SEQ ID NO: 669844 - RNA, 64 nt, hsa; identical to SEQ ID NO: 218783

SEQ ID NO: 669845 - RNA, 64 nt, hsa; identical to SEQ ID NO: 218784

SEQ ID NO: 669846 - RNA, 64 nt, hsa; identical to SEQ ID NO: 218785

SEQ ID NO: 669847 - RNA, 64 nt, hsa; identical to SEQ ID NO: 218786

SEQ ID NO: 669848 - RNA, 64 nt, hsa; identical to SEQ ID NO: 218787

SEQ ID NO: 669849 - RNA, 64 nt, hsa; identical to SEQ ID NO: 218788

SEQ ID NO: 669850 - RNA, 64 nt, hsa; identical to SEQ ID NO: 218789

SEQ ID NO: 669851 - RNA, 64 nt, hsa; identical to SEQ ID NO: 218790

SEQ ID NO: 669852 - RNA, 64 nt, hsa; identical to SEQ ID NO: 218791

SEQ ID NO: 669853 - RNA, 64 nt, hsa; identical to SEQ ID NO: 218792

SEQ ID NO: 669854 - RNA, 64 nt, hsa; identical to SEQ ID NO: 218793

SEQ ID NO: 669855 - RNA, 64 nt, hsa; identical to SEQ ID NO: 218794

SEQ ID NO: 669856 - RNA, 64 nt, hsa; identical to SEQ ID NO: 218795

SEQ ID NO: 669857 - RNA, 64 nt, hsa; identical to SEQ ID NO: 218796

SEQ ID NO: 669858 - RNA, 64 nt, hsa; identical to SEQ ID NO: 218797

SEQ ID NO: 669859 - RNA, 64 nt, hsa; identical to SEQ ID NO: 218798

SEQ ID NO: 669860 - RNA, 64 nt, hsa; identical to SEQ ID NO: 218799

SEQ ID NO: 669861 - RNA, 64 nt, hsa; identical to SEQ ID NO: 218800

SEQ ID NO: 669862 - RNA, 64 nt, hsa; identical to SEQ ID NO: 218801

SEQ ID NO: 669863 - RNA, 64 nt, hsa; identical to SEQ ID NO: 218802

SEQ ID NO: 669864 - RNA, 64 nt, hsa; identical to SEQ ID NO: 218803

SEQ ID NO: 669865 - RNA, 64 nt, hsa; identical to SEQ ID NO: 218804

SEQ ID NO: 669866 - RNA, 64 nt, hsa; identical to SEQ ID NO: 218805

SEQ ID NO: 669867 - RNA, 64 nt, hsa; identical to SEQ ID NO: 218806

SEQ ID NO: 669868 - RNA, 64 nt, hsa; identical to SEQ ID NO: 218807

SEQ ID NO: 669869 - RNA, 64 nt, hsa; identical to SEQ ID NO: 218808

SEQ ID NO: 669870 - RNA, 59 nt, hsa; identical to SEQ ID NO: 218809

SEQ ID NO: 669871 - RNA, 64 nt, hsa; identical to SEQ ID NO: 218810

SEQ ID NO: 669872 - RNA, 64 nt, hsa; identical to SEQ ID NO: 218811

SEQ ID NO: 669873 - RNA, 64 nt, hsa; identical to SEQ ID NO: 168129

SEQ ID NO: 669874 - RNA, 64 nt, hsa; identical to SEQ ID NO: 168130

SEQ ID NO: 669875 - RNA, 64 nt, hsa; identical to SEQ ID NO: 168131

SEQ ID NO: 669876 - RNA, 64 nt, hsa; identical to SEQ ID NO: 168132

SEQ ID NO: 669877 - RNA, 64 nt, hsa; identical to SEQ ID NO: 168133

SEQ ID NO: 669878 - RNA, 64 nt, hsa; identical to SEQ ID NO: 168134

SEQ ID NO: 669879 - RNA, 64 nt, hsa; identical to SEQ ID NO: 168135

SEQ ID NO: 669880 - RNA, 64 nt, hsa; identical to SEQ ID NO: 168136

SEQ ID NO: 669881 - RNA, 64 nt, hsa; identical to SEQ ID NO: 168137

SEQ ID NO: 669882 - RNA, 64 nt, hsa; identical to SEQ ID NO: 168138

SEQ ID NO: 669883 - RNA, 64 nt, hsa; identical to SEQ ID NO: 168139

SEQ ID NO: 669884 - RNA, 64 nt, hsa; identical to SEQ ID NO: 168140

SEQ ID NO: 669885 - RNA, 64 nt, hsa; identical to SEQ ID NO: 168141

SEQ ID NO: 669886 - RNA, 64 nt, hsa; identical to SEQ ID NO: 168142

SEQ ID NO: 669887 - RNA, 64 nt, hsa; identical to SEQ ID NO: 168143

SEQ ID NO: 669888 - RNA, 64 nt, hsa; identical to SEQ ID NO: 168144

SEQ ID NO: 669889 - RNA, 64 nt, hsa; identical to SEQ ID NO: 168145

SEQ ID NO: 669890 - RNA, 64 nt, hsa; identical to SEQ ID NO: 168146

SEQ ID NO: 669891 - RNA, 64 nt, hsa; identical to SEQ ID NO: 168147

SEQ ID NO: 669892 - RNA, 64 nt, hsa; identical to SEQ ID NO: 168148

SEQ ID NO: 669893 - RNA, 64 nt, hsa; identical to SEQ ID NO: 168149

SEQ ID NO: 669894 - RNA, 64 nt, hsa; identical to SEQ ID NO: 168150

SEQ ID NO: 669895 - RNA, 64 nt, hsa; identical to SEQ ID NO: 168151

SEQ ID NO: 669896 - RNA, 64 nt, hsa; identical to SEQ ID NO: 168152

SEQ ID NO: 669897 - RNA, 64 nt, hsa; identical to SEQ ID NO: 168153

SEQ ID NO: 669898 - RNA, 64 nt, hsa; identical to SEQ ID NO: 168154

SEQ ID NO: 669899 - RNA, 64 nt, hsa; identical to SEQ ID NO: 168155

SEQ ID NO: 669900 - RNA, 64 nt, hsa; identical to SEQ ID NO: 168156

SEQ ID NO: 669901 - RNA, 64 nt, hsa; identical to SEQ ID NO: 168157

SEQ ID NO: 669902 - RNA, 64 nt, hsa; identical to SEQ ID NO: 168158

SEQ ID NO: 669903 - RNA, 64 nt, hsa; identical to SEQ ID NO: 168159

SEQ ID NO: 669904 - RNA, 64 nt, hsa; identical to SEQ ID NO: 168160

SEQ ID NO: 669905 - RNA, 64 nt, hsa; identical to SEQ ID NO: 168161

SEQ ID NO: 669906 - RNA, 64 nt, hsa; identical to SEQ ID NO: 168162

SEQ ID NO: 669907 - RNA, 64 nt, hsa; identical to SEQ ID NO: 168163

SEQ ID NO: 669908 - RNA, 64 nt, hsa; identical to SEQ ID NO: 168164

SEQ ID NO: 669909 - RNA, 64 nt, hsa; identical to SEQ ID NO: 168165

SEQ ID NO: 669910 - RNA, 64 nt, hsa; identical to SEQ ID NO: 168166

SEQ ID NO: 669911 - RNA, 64 nt, hsa; identical to SEQ ID NO: 168167

SEQ ID NO: 669912 - RNA, 64 nt, hsa; identical to SEQ ID NO: 168168

SEQ ID NO: 669913 - RNA, 64 nt, hsa; identical to SEQ ID NO: 168169

SEQ ID NO: 669914 - RNA, 64 nt, hsa; identical to SEQ ID NO: 168170

SEQ ID NO: 669915 - RNA, 64 nt, hsa; identical to SEQ ID NO: 168171

SEQ ID NO: 669916 - RNA, 64 nt, hsa; identical to SEQ ID NO: 168172

SEQ ID NO: 669917 - RNA, 64 nt, hsa; identical to SEQ ID NO: 168173

SEQ ID NO: 669918 - RNA, 64 nt, hsa; identical to SEQ ID NO: 168174

SEQ ID NO: 669919 - RNA, 64 nt, hsa; identical to SEQ ID NO: 168175

SEQ ID NO: 669920 - RNA, 64 nt, hsa; identical to SEQ ID NO: 168176

SEQ ID NO: 669921 - RNA, 64 nt, hsa; identical to SEQ ID NO: 168177

SEQ ID NO: 669922 - RNA, 64 nt, hsa; identical to SEQ ID NO: 168178

SEQ ID NO: 669923 - RNA, 64 nt, hsa; identical to SEQ ID NO: 168179

SEQ ID NO: 669924 - RNA, 64 nt, hsa; identical to SEQ ID NO: 168180

SEQ ID NO: 669925 - RNA, 64 nt, hsa; identical to SEQ ID NO: 168181

SEQ ID NO: 669926 - RNA, 64 nt, hsa; identical to SEQ ID NO: 168182

SEQ ID NO: 669927 - RNA, 64 nt, hsa; identical to SEQ ID NO: 168183

SEQ ID NO: 669928 - RNA, 64 nt, hsa; identical to SEQ ID NO: 168184

SEQ ID NO: 669929 - RNA, 64 nt, hsa; identical to SEQ ID NO: 168185

SEQ ID NO: 669930 - RNA, 64 nt, hsa; identical to SEQ ID NO: 168186

SEQ ID NO: 669931 - RNA, 64 nt, hsa; identical to SEQ ID NO: 168187

SEQ ID NO: 669932 - RNA, 64 nt, hsa; identical to SEQ ID NO: 168188

SEQ ID NO: 669933 - RNA, 64 nt, hsa; identical to SEQ ID NO: 168189

SEQ ID NO: 669934 - RNA, 64 nt, hsa; identical to SEQ ID NO: 168190

SEQ ID NO: 669935 - RNA, 64 nt, hsa; identical to SEQ ID NO: 168191

SEQ ID NO: 669936 - RNA, 64 nt, hsa; identical to SEQ ID NO: 168192

SEQ ID NO: 669937 - RNA, 64 nt, hsa; identical to SEQ ID NO: 168193

SEQ ID NO: 669938 - RNA, 64 nt, hsa; identical to SEQ ID NO: 168194

SEQ ID NO: 669939 - RNA, 64 nt, hsa; identical to SEQ ID NO: 168195

SEQ ID NO: 669940 - RNA, 64 nt, hsa; identical to SEQ ID NO: 168196

SEQ ID NO: 669941 - RNA, 64 nt, hsa; identical to SEQ ID NO: 168197

SEQ ID NO: 669942 - RNA, 64 nt, hsa; identical to SEQ ID NO: 168198

SEQ ID NO: 669943 - RNA, 64 nt, hsa; identical to SEQ ID NO: 168199

SEQ ID NO: 669944 - RNA, 64 nt, hsa; identical to SEQ ID NO: 168200

SEQ ID NO: 669945 - RNA, 64 nt, hsa; identical to SEQ ID NO: 168201

SEQ ID NO: 669946 - RNA, 64 nt, hsa; identical to SEQ ID NO: 168202

SEQ ID NO: 669947 - RNA, 64 nt, hsa; identical to SEQ ID NO: 168203

SEQ ID NO: 669948 - RNA, 64 nt, hsa; identical to SEQ ID NO: 168204

SEQ ID NO: 669949 - RNA, 64 nt, hsa; identical to SEQ ID NO: 168205

SEQ ID NO: 669950 - RNA, 64 nt, hsa; identical to SEQ ID NO: 168206

SEQ ID NO: 669951 - RNA, 64 nt, hsa; identical to SEQ ID NO: 168207

SEQ ID NO: 669952 - RNA, 64 nt, hsa; identical to SEQ ID NO: 168208

SEQ ID NO: 669953 - RNA, 64 nt, hsa; identical to SEQ ID NO: 168209

SEQ ID NO: 669954 - RNA, 64 nt, hsa; identical to SEQ ID NO: 168210

SEQ ID NO: 669955 - RNA, 64 nt, hsa; identical to SEQ ID NO: 168211

SEQ ID NO: 669956 - RNA, 64 nt, hsa; identical to SEQ ID NO: 168212

SEQ ID NO: 669957 - RNA, 64 nt, hsa; identical to SEQ ID NO: 168213

SEQ ID NO: 669958 - RNA, 51 nt, hsa; identical to SEQ ID NO: 168214

SEQ ID NO: 669959 - RNA, 64 nt, hsa; identical to SEQ ID NO: 168215

SEQ ID NO: 669960 - RNA, 64 nt, hsa; identical to SEQ ID NO: 168216

SEQ ID NO: 669961 - RNA, 64 nt, hsa; identical to SEQ ID NO: 168217

SEQ ID NO: 669962 - RNA, 64 nt, hsa; identical to SEQ ID NO: 168218

SEQ ID NO: 669963 - RNA, 64 nt, hsa; identical to SEQ ID NO: 168219

SEQ ID NO: 669964 - RNA, 64 nt, hsa; identical to SEQ ID NO: 168220

SEQ ID NO: 669965 - RNA, 64 nt, hsa; identical to SEQ ID NO: 168221

SEQ ID NO: 669966 - RNA, 64 nt, hsa; identical to SEQ ID NO: 168222

SEQ ID NO: 669967 - RNA, 64 nt, hsa; identical to SEQ ID NO: 168223

SEQ ID NO: 669968 - RNA, 64 nt, hsa; identical to SEQ ID NO: 168224

SEQ ID NO: 669969 - RNA, 64 nt, hsa; identical to SEQ ID NO: 168225

SEQ ID NO: 669970 - RNA, 64 nt, hsa; identical to SEQ ID NO: 168226

SEQ ID NO: 669971 - RNA, 64 nt, hsa; identical to SEQ ID NO: 168227

SEQ ID NO: 669972 - RNA, 64 nt, hsa; identical to SEQ ID NO: 168228

SEQ ID NO: 669973 - RNA, 64 nt, hsa; identical to SEQ ID NO: 168229

SEQ ID NO: 669974 - RNA, 64 nt, hsa; identical to SEQ ID NO: 168230

SEQ ID NO: 669975 - RNA, 64 nt, hsa; identical to SEQ ID NO: 168231

SEQ ID NO: 669976 - RNA, 64 nt, hsa; identical to SEQ ID NO: 168232

SEQ ID NO: 669977 - RNA, 64 nt, hsa; identical to SEQ ID NO: 168233

SEQ ID NO: 669978 - RNA, 64 nt, hsa; identical to SEQ ID NO: 168234

SEQ ID NO: 669979 - RNA, 64 nt, hsa; identical to SEQ ID NO: 168235

SEQ ID NO: 669980 - RNA, 64 nt, hsa; identical to SEQ ID NO: 168236

SEQ ID NO: 669981 - RNA, 64 nt, hsa; identical to SEQ ID NO: 168237

SEQ ID NO: 669982 - RNA, 64 nt, hsa; identical to SEQ ID NO: 168238

SEQ ID NO: 669983 - RNA, 64 nt, hsa; identical to SEQ ID NO: 168239

SEQ ID NO: 669984 - RNA, 64 nt, hsa; identical to SEQ ID NO: 168240

SEQ ID NO: 669985 - RNA, 64 nt, hsa; identical to SEQ ID NO: 168241

SEQ ID NO: 669986 - RNA, 64 nt, hsa; identical to SEQ ID NO: 168242

SEQ ID NO: 669987 - RNA, 64 nt, hsa; identical to SEQ ID NO: 168243

SEQ ID NO: 669988 - RNA, 64 nt, hsa; identical to SEQ ID NO: 168244

SEQ ID NO: 669989 - RNA, 64 nt, hsa; identical to SEQ ID NO: 168245

SEQ ID NO: 669990 - RNA, 64 nt, hsa; identical to SEQ ID NO: 168246

SEQ ID NO: 669991 - RNA, 64 nt, hsa; identical to SEQ ID NO: 168247

SEQ ID NO: 669992 - RNA, 64 nt, hsa; identical to SEQ ID NO: 168248

SEQ ID NO: 669993 - RNA, 64 nt, hsa; identical to SEQ ID NO: 168249

SEQ ID NO: 669994 - RNA, 64 nt, hsa; identical to SEQ ID NO: 168250

SEQ ID NO: 669995 - RNA, 64 nt, hsa; identical to SEQ ID NO: 168251

SEQ ID NO: 669996 - RNA, 64 nt, hsa; identical to SEQ ID NO: 168252

SEQ ID NO: 669997 - RNA, 64 nt, hsa; identical to SEQ ID NO: 168253

SEQ ID NO: 669998 - RNA, 64 nt, hsa; identical to SEQ ID NO: 168254

SEQ ID NO: 669999 - RNA, 64 nt, hsa; identical to SEQ ID NO: 168255

SEQ ID NO: 670000 - RNA, 64 nt, hsa; identical to SEQ ID NO: 168256

SEQ ID NO: 670001 - RNA, 64 nt, hsa; identical to SEQ ID NO: 168257

SEQ ID NO: 670002 - RNA, 64 nt, hsa; identical to SEQ ID NO: 168258

SEQ ID NO: 670003 - RNA, 64 nt, hsa; identical to SEQ ID NO: 168259

SEQ ID NO: 670004 - RNA, 64 nt, hsa; identical to SEQ ID NO: 168260

SEQ ID NO: 670005 - RNA, 64 nt, hsa; identical to SEQ ID NO: 168261

SEQ ID NO: 670006 - RNA, 64 nt, hsa; identical to SEQ ID NO: 168262

SEQ ID NO: 670007 - RNA, 64 nt, hsa; identical to SEQ ID NO: 168263

SEQ ID NO: 670008 - RNA, 64 nt, hsa; identical to SEQ ID NO: 168264

SEQ ID NO: 670009 - RNA, 64 nt, hsa; identical to SEQ ID NO: 168265

SEQ ID NO: 670010 - RNA, 64 nt, hsa; identical to SEQ ID NO: 168266

SEQ ID NO: 670011 - RNA, 64 nt, hsa; identical to SEQ ID NO: 168267

SEQ ID NO: 670012 - RNA, 64 nt, hsa; identical to SEQ ID NO: 168268

SEQ ID NO: 670013 - RNA, 64 nt, hsa; identical to SEQ ID NO: 168269

SEQ ID NO: 670014 - RNA, 64 nt, hsa; identical to SEQ ID NO: 168270

SEQ ID NO: 670015 - RNA, 64 nt, hsa; identical to SEQ ID NO: 168271

SEQ ID NO: 670016 - RNA, 64 nt, hsa; identical to SEQ ID NO: 168272

SEQ ID NO: 670017 - RNA, 64 nt, hsa; identical to SEQ ID NO: 168273

SEQ ID NO: 670018 - RNA, 64 nt, hsa; identical to SEQ ID NO: 168274

SEQ ID NO: 670019 - RNA, 64 nt, hsa; identical to SEQ ID NO: 168275

SEQ ID NO: 670020 - RNA, 64 nt, hsa; identical to SEQ ID NO: 168276

SEQ ID NO: 670021 - RNA, 64 nt, hsa; identical to SEQ ID NO: 168277

SEQ ID NO: 670022 - RNA, 64 nt, hsa; identical to SEQ ID NO: 168278

SEQ ID NO: 670023 - RNA, 64 nt, hsa; identical to SEQ ID NO: 168279

SEQ ID NO: 670024 - RNA, 64 nt, hsa; identical to SEQ ID NO: 168280

SEQ ID NO: 670025 - RNA, 64 nt, hsa; identical to SEQ ID NO: 168281

SEQ ID NO: 670026 - RNA, 64 nt, hsa; identical to SEQ ID NO: 168282

SEQ ID NO: 670027 - RNA, 64 nt, hsa; identical to SEQ ID NO: 168283

SEQ ID NO: 670028 - RNA, 64 nt, hsa; identical to SEQ ID NO: 168284

SEQ ID NO: 670029 - RNA, 64 nt, hsa; identical to SEQ ID NO: 168285

SEQ ID NO: 670030 - RNA, 64 nt, hsa; identical to SEQ ID NO: 168286

SEQ ID NO: 670031 - RNA, 64 nt, hsa; identical to SEQ ID NO: 168287

SEQ ID NO: 670032 - RNA, 64 nt, hsa; identical to SEQ ID NO: 168288

SEQ ID NO: 670033 - RNA, 64 nt, hsa; identical to SEQ ID NO: 168289

SEQ ID NO: 670034 - RNA, 64 nt, hsa; identical to SEQ ID NO: 168290

SEQ ID NO: 670035 - RNA, 64 nt, hsa; identical to SEQ ID NO: 168291

SEQ ID NO: 670036 - RNA, 64 nt, hsa; identical to SEQ ID NO: 168292

SEQ ID NO: 670037 - RNA, 64 nt, hsa; identical to SEQ ID NO: 168293

SEQ ID NO: 670038 - RNA, 64 nt, hsa; identical to SEQ ID NO: 168294

SEQ ID NO: 670039 - RNA, 64 nt, hsa; identical to SEQ ID NO: 168295

SEQ ID NO: 670040 - RNA, 64 nt, hsa; identical to SEQ ID NO: 168296

SEQ ID NO: 670041 - RNA, 64 nt, hsa; identical to SEQ ID NO: 168297

SEQ ID NO: 670042 - RNA, 64 nt, hsa; identical to SEQ ID NO: 168298

SEQ ID NO: 670043 - RNA, 64 nt, hsa; identical to SEQ ID NO: 168299

SEQ ID NO: 670044 - RNA, 64 nt, hsa; identical to SEQ ID NO: 168300

SEQ ID NO: 670045 - RNA, 64 nt, hsa; identical to SEQ ID NO: 168301

SEQ ID NO: 670046 - RNA, 64 nt, hsa; identical to SEQ ID NO: 168302

SEQ ID NO: 670047 - RNA, 64 nt, hsa; identical to SEQ ID NO: 168303

SEQ ID NO: 670048 - RNA, 64 nt, hsa; identical to SEQ ID NO: 168304

SEQ ID NO: 670049 - RNA, 64 nt, hsa; identical to SEQ ID NO: 168305

SEQ ID NO: 670050 - RNA, 64 nt, hsa; identical to SEQ ID NO: 168306

SEQ ID NO: 670051 - RNA, 64 nt, hsa; identical to SEQ ID NO: 168307

SEQ ID NO: 670052 - RNA, 64 nt, hsa; identical to SEQ ID NO: 168308

SEQ ID NO: 670053 - RNA, 64 nt, hsa; identical to SEQ ID NO: 168309

SEQ ID NO: 670054 - RNA, 64 nt, hsa; identical to SEQ ID NO: 168310

SEQ ID NO: 670055 - RNA, 64 nt, hsa; identical to SEQ ID NO: 168311

SEQ ID NO: 670056 - RNA, 64 nt, hsa; identical to SEQ ID NO: 168312

SEQ ID NO: 670057 - RNA, 64 nt, hsa; identical to SEQ ID NO: 168313

SEQ ID NO: 670058 - RNA, 64 nt, hsa; identical to SEQ ID NO: 168314

SEQ ID NO: 670059 - RNA, 64 nt, hsa; identical to SEQ ID NO: 168315

SEQ ID NO: 670060 - RNA, 64 nt, hsa; identical to SEQ ID NO: 168316

SEQ ID NO: 670061 - RNA, 64 nt, hsa; identical to SEQ ID NO: 168317

SEQ ID NO: 670062 - RNA, 64 nt, hsa; identical to SEQ ID NO: 168318

SEQ ID NO: 670063 - RNA, 64 nt, hsa; identical to SEQ ID NO: 168319

SEQ ID NO: 670064 - RNA, 64 nt, hsa; identical to SEQ ID NO: 168320

SEQ ID NO: 670065 - RNA, 64 nt, hsa; identical to SEQ ID NO: 168321

SEQ ID NO: 670066 - RNA, 64 nt, hsa; identical to SEQ ID NO: 168322

SEQ ID NO: 670067 - RNA, 64 nt, hsa; identical to SEQ ID NO: 168323

SEQ ID NO: 670068 - RNA, 64 nt, hsa; identical to SEQ ID NO: 168324

SEQ ID NO: 670069 - RNA, 64 nt, hsa; identical to SEQ ID NO: 168325

SEQ ID NO: 670070 - RNA, 64 nt, hsa; identical to SEQ ID NO: 168326

SEQ ID NO: 670071 - RNA, 64 nt, hsa; identical to SEQ ID NO: 168327

SEQ ID NO: 670072 - RNA, 64 nt, hsa; identical to SEQ ID NO: 168328

SEQ ID NO: 670073 - RNA, 64 nt, hsa; identical to SEQ ID NO: 168329

SEQ ID NO: 670074 - RNA, 64 nt, hsa; identical to SEQ ID NO: 168330

SEQ ID NO: 670075 - RNA, 64 nt, hsa; identical to SEQ ID NO: 168331

SEQ ID NO: 670076 - RNA, 64 nt, hsa; identical to SEQ ID NO: 168332

SEQ ID NO: 670077 - RNA, 64 nt, hsa; identical to SEQ ID NO: 168333

SEQ ID NO: 670078 - RNA, 64 nt, hsa; identical to SEQ ID NO: 168334

SEQ ID NO: 670079 - RNA, 64 nt, hsa; identical to SEQ ID NO: 168335

SEQ ID NO: 670080 - RNA, 64 nt, hsa; identical to SEQ ID NO: 168336

SEQ ID NO: 670081 - RNA, 64 nt, hsa; identical to SEQ ID NO: 168337

SEQ ID NO: 670082 - RNA, 64 nt, hsa; identical to SEQ ID NO: 168338

SEQ ID NO: 670083 - RNA, 64 nt, hsa; identical to SEQ ID NO: 168339

SEQ ID NO: 670084 - RNA, 64 nt, hsa; identical to SEQ ID NO: 168340

SEQ ID NO: 670085 - RNA, 64 nt, hsa; identical to SEQ ID NO: 168341

SEQ ID NO: 670086 - RNA, 64 nt, hsa; identical to SEQ ID NO: 168342

SEQ ID NO: 670087 - RNA, 64 nt, hsa; identical to SEQ ID NO: 168343

SEQ ID NO: 670088 - RNA, 64 nt, hsa; identical to SEQ ID NO: 168344

SEQ ID NO: 670089 - RNA, 64 nt, hsa; identical to SEQ ID NO: 168345

SEQ ID NO: 670090 - RNA, 64 nt, hsa; identical to SEQ ID NO: 168346

SEQ ID NO: 670091 - RNA, 64 nt, hsa; identical to SEQ ID NO: 168347

SEQ ID NO: 670092 - RNA, 64 nt, hsa; identical to SEQ ID NO: 168348

SEQ ID NO: 670093 - RNA, 64 nt, hsa; identical to SEQ ID NO: 168349

SEQ ID NO: 670094 - RNA, 64 nt, hsa; identical to SEQ ID NO: 168350

SEQ ID NO: 670095 - RNA, 64 nt, hsa; identical to SEQ ID NO: 168351

SEQ ID NO: 670096 - RNA, 64 nt, hsa; identical to SEQ ID NO: 168352

SEQ ID NO: 670097 - RNA, 64 nt, hsa; identical to SEQ ID NO: 168353

SEQ ID NO: 670098 - RNA, 64 nt, hsa; identical to SEQ ID NO: 168354

SEQ ID NO: 670099 - RNA, 64 nt, hsa; identical to SEQ ID NO: 168355

SEQ ID NO: 670100 - RNA, 64 nt, hsa; identical to SEQ ID NO: 168356

SEQ ID NO: 670101 - RNA, 64 nt, hsa; identical to SEQ ID NO: 168357

SEQ ID NO: 670102 - RNA, 64 nt, hsa; identical to SEQ ID NO: 168358

SEQ ID NO: 670103 - RNA, 64 nt, hsa; identical to SEQ ID NO: 168359

SEQ ID NO: 670104 - RNA, 64 nt, hsa; identical to SEQ ID NO: 168360

SEQ ID NO: 670105 - RNA, 64 nt, hsa; identical to SEQ ID NO: 168361

SEQ ID NO: 670106 - RNA, 64 nt, hsa; identical to SEQ ID NO: 168362

SEQ ID NO: 670107 - RNA, 64 nt, hsa; identical to SEQ ID NO: 168363

SEQ ID NO: 670108 - RNA, 64 nt, hsa; identical to SEQ ID NO: 168364

SEQ ID NO: 670109 - RNA, 64 nt, hsa; identical to SEQ ID NO: 168365

SEQ ID NO: 670110 - RNA, 64 nt, hsa; identical to SEQ ID NO: 168366

SEQ ID NO: 670111 - RNA, 64 nt, hsa; identical to SEQ ID NO: 168367

SEQ ID NO: 670112 - RNA, 64 nt, hsa; identical to SEQ ID NO: 168368

SEQ ID NO: 670113 - RNA, 64 nt, hsa; identical to SEQ ID NO: 168369

SEQ ID NO: 670114 - RNA, 64 nt, hsa; identical to SEQ ID NO: 168370

SEQ ID NO: 670115 - RNA, 64 nt, hsa; identical to SEQ ID NO: 168371

SEQ ID NO: 670116 - RNA, 64 nt, hsa; identical to SEQ ID NO: 168372

SEQ ID NO: 670117 - RNA, 64 nt, hsa; identical to SEQ ID NO: 168373

SEQ ID NO: 670118 - RNA, 64 nt, hsa; identical to SEQ ID NO: 168374

SEQ ID NO: 670119 - RNA, 64 nt, hsa; identical to SEQ ID NO: 168375

SEQ ID NO: 670120 - RNA, 64 nt, hsa; identical to SEQ ID NO: 168376

SEQ ID NO: 670121 - RNA, 64 nt, hsa; identical to SEQ ID NO: 168377

SEQ ID NO: 670122 - RNA, 64 nt, hsa; identical to SEQ ID NO: 168378

SEQ ID NO: 670123 - RNA, 64 nt, hsa; identical to SEQ ID NO: 168379

SEQ ID NO: 670124 - RNA, 64 nt, hsa; identical to SEQ ID NO: 168380

SEQ ID NO: 670125 - RNA, 64 nt, hsa; identical to SEQ ID NO: 168381

SEQ ID NO: 670126 - RNA, 64 nt, hsa; identical to SEQ ID NO: 168382

SEQ ID NO: 670127 - RNA, 64 nt, hsa; identical to SEQ ID NO: 168383

SEQ ID NO: 670128 - RNA, 64 nt, hsa; identical to SEQ ID NO: 168384

SEQ ID NO: 670129 - RNA, 64 nt, hsa; identical to SEQ ID NO: 168385

SEQ ID NO: 670130 - RNA, 64 nt, hsa; identical to SEQ ID NO: 168386

SEQ ID NO: 670131 - RNA, 64 nt, hsa; identical to SEQ ID NO: 168387

SEQ ID NO: 670132 - RNA, 64 nt, hsa; identical to SEQ ID NO: 168388

SEQ ID NO: 670133 - RNA, 64 nt, hsa; identical to SEQ ID NO: 168389

SEQ ID NO: 670134 - RNA, 64 nt, hsa; identical to SEQ ID NO: 168390

SEQ ID NO: 670135 - RNA, 64 nt, hsa; identical to SEQ ID NO: 168391

SEQ ID NO: 670136 - RNA, 64 nt, hsa; identical to SEQ ID NO: 168392

SEQ ID NO: 670137 - RNA, 64 nt, hsa; identical to SEQ ID NO: 168393

SEQ ID NO: 670138 - RNA, 64 nt, hsa; identical to SEQ ID NO: 168394

SEQ ID NO: 670139 - RNA, 64 nt, hsa; identical to SEQ ID NO: 168395

SEQ ID NO: 670140 - RNA, 64 nt, hsa; identical to SEQ ID NO: 168396

SEQ ID NO: 670141 - RNA, 64 nt, hsa; identical to SEQ ID NO: 168397

SEQ ID NO: 670142 - RNA, 64 nt, hsa; identical to SEQ ID NO: 168398

SEQ ID NO: 670143 - RNA, 64 nt, hsa; identical to SEQ ID NO: 168399

SEQ ID NO: 670144 - RNA, 64 nt, hsa; identical to SEQ ID NO: 168400

SEQ ID NO: 670145 - RNA, 64 nt, hsa; identical to SEQ ID NO: 168401

SEQ ID NO: 670146 - RNA, 64 nt, hsa; identical to SEQ ID NO: 168402

SEQ ID NO: 670147 - RNA, 64 nt, hsa; identical to SEQ ID NO: 168403

SEQ ID NO: 670148 - RNA, 64 nt, hsa; identical to SEQ ID NO: 168404

SEQ ID NO: 670149 - RNA, 64 nt, hsa; identical to SEQ ID NO: 168405

SEQ ID NO: 670150 - RNA, 64 nt, hsa; identical to SEQ ID NO: 168406

SEQ ID NO: 670151 - RNA, 64 nt, hsa; identical to SEQ ID NO: 168407

SEQ ID NO: 670152 - RNA, 64 nt, hsa; identical to SEQ ID NO: 168408

SEQ ID NO: 670153 - RNA, 64 nt, hsa; identical to SEQ ID NO: 168409

SEQ ID NO: 670154 - RNA, 64 nt, hsa; identical to SEQ ID NO: 168410

SEQ ID NO: 670155 - RNA, 64 nt, hsa; identical to SEQ ID NO: 168411

SEQ ID NO: 670156 - RNA, 64 nt, hsa; identical to SEQ ID NO: 168412

SEQ ID NO: 670157 - RNA, 64 nt, hsa; identical to SEQ ID NO: 168413

SEQ ID NO: 670158 - RNA, 64 nt, hsa; identical to SEQ ID NO: 168414

SEQ ID NO: 670159 - RNA, 64 nt, hsa; identical to SEQ ID NO: 168415

SEQ ID NO: 670160 - RNA, 64 nt, hsa; identical to SEQ ID NO: 168416

SEQ ID NO: 670161 - RNA, 64 nt, hsa; identical to SEQ ID NO: 168417

SEQ ID NO: 670162 - RNA, 64 nt, hsa; identical to SEQ ID NO: 168418

SEQ ID NO: 670163 - RNA, 64 nt, hsa; identical to SEQ ID NO: 168419

SEQ ID NO: 670164 - RNA, 64 nt, hsa; identical to SEQ ID NO: 168420

SEQ ID NO: 670165 - RNA, 64 nt, hsa; identical to SEQ ID NO: 168421

SEQ ID NO: 670166 - RNA, 64 nt, hsa; identical to SEQ ID NO: 168422

SEQ ID NO: 670167 - RNA, 64 nt, hsa; identical to SEQ ID NO: 168423

SEQ ID NO: 670168 - RNA, 64 nt, hsa; identical to SEQ ID NO: 168424

SEQ ID NO: 670169 - RNA, 64 nt, hsa
ugucccccuccagguucggcacccaggucuccggaggagacacaguuacccgaacccuucgccu

SEQ ID NO: 670170 - RNA, 64 nt, hsa
gcuccuggcccuggccagaagcaggagugugaggaggagacagccucagcggacaagcagcugg

SEQ ID NO: 670171 - RNA, 64 nt, hsa
gaggggcccagcuggagaaugauucugcuacaaaaggagacaguugagacuuuugcuuguugga

SEQ ID NO: 670172 - RNA, 64 nt, hsa
cuggcuggccucguggggccugucucacuuuuccaggagacaugacccacuaacguggcaacuu

SEQ ID NO: 670173 - RNA, 64 nt, hsa
gggcagucugugucacgcuggccauuugacauaaaggagacagccccuggucccagcuugucag

SEQ ID NO: 670174 - RNA, 64 nt, hsa
gucuucccuugaguuggccaagggaauaagcaagaggagacauuuccucccugccccagcacuc

SEQ ID NO: 670175 - RNA, 64 nt, hsa
uuaggcaagcuguaugcaguggaauuuuccuuuuaggagacacacaauuaagacucucugguuc

SEQ ID NO: 670176 - RNA, 64 nt, hsa
guucugggaggcaacagcauuaagugauaagaaaaggagacauucuggcaaagccaaucugcuu

SEQ ID NO: 670177 - RNA, 64 nt, hsa
uucuuuaguagacaguuuaauuucccccaagauuaggagacacuucugugcagguucuaaaagg

SEQ ID NO: 670178 - RNA, 64 nt, hsa
uucugcacugggggacuggaugcuagccaucuccaggagacaggaucaguuuuacggaaacaac

SEQ ID NO: 670179 - RNA, 64 nt, hsa
ucucugcccucaagggaaccccacaguaucuuagaggagacaaucaugucggugagauggugug

SEQ ID NO: 670180 - RNA, 64 nt, hsa
cuuuacaaagguuacuaaugucccagccuuuuuaaggagacacacucauucauccccuacuaug

SEQ ID NO: 670181 - RNA, 64 nt, hsa
aguaccugcauccagcuucccugccaaacucacaaggagacaucaaccucuagacagggaacag

SEQ ID NO: 670182 - RNA, 64 nt, hsa
accucuagacagggaacagcuucaggauacuuccaggagacagagccaccagcagcaaaacaaa

SEQ ID NO: 670183 - RNA, 64 nt, hsa
cacguauuuucuuuuuugucaguauuguuugggaaggagacaugccgggaugugucaucgugcc

SEQ ID NO: 670184 - RNA, 64 nt, hsa
uuucccaaagggacuuaagcgauugugcaggaguaggagacaaaauguacacucacuguaaaaa

SEQ ID NO: 670185 - RNA, 64 nt, hsa
caaaaacaaagagaaaaaaacacacaucaauuaaaggagacaaaaagaggcagagcgaguagag

SEQ ID NO: 670186 - RNA, 64 nt, hsa
ucaaccaucccacuaaguuauagccaagaagggaaggagacacggggauuugggguucucugcu

SEQ ID NO: 670187 - RNA, 64 nt, hsa
caccgccugaaacaugcacacugcaaauaucaaaaggagacacccccaaaucccacucuaaauu

SEQ ID NO: 670188 - RNA, 64 nt, hsa
ccagccacaagcauuagcaugauccgagacauccaggagacagagccccugccccauggcccug

SEQ ID NO: 670189 - RNA, 64 nt, hsa
gaaagugcauuagaauggaauugcccuuuccuuaaggagacaguuugggcucuccccuugccac

SEQ ID NO: 670190 - RNA, 64 nt, hsa
uuagaagucauccagaugcuucuggaggaggggcaggagacacuugggcuguuugccuugggug

SEQ ID NO: 670191 - RNA, 64 nt, hsa
cauuuuagaaggccaaggagagccacaccgaaaaaggagacaguuccugugaucuccuuugcag

SEQ ID NO: 670192 - RNA, 64 nt, hsa
gguuacuaaaugaauaaaaacucggaauuaggccaggagacauggaauaccauucaugggaugg

SEQ ID NO: 670193 - RNA, 64 nt, hsa
ucuguucacaagcccaaggugcuagaacuagcuuaggagacaugcaggccacagggcuucuagg

SEQ ID NO: 670194 - RNA, 64 nt, hsa
gagacuuugaccaugugacgugucaacagacucaaggagacaaccaccucaacugggucaugug

SEQ ID NO: 670195 - RNA, 64 nt, hsa
uacagcggccaaaccaugacgugaagaaugagauaggagacaggagaucaccauaagcgucccu

SEQ ID NO: 670196 - RNA, 64 nt, hsa
uucugccuccaucucugccuccauggcuaccuuuaggagacagagaagauccuguguguuucuc

SEQ ID NO: 670197 - RNA, 64 nt, hsa
agagugaggucaucccggggccauggaagcuggcaggagacacuggucucagaggagggauaga

SEQ ID NO: 670198 - RNA, 64 nt, hsa
cguguccccugccugugagugacaucgguucaggaggagacagucaggaagccuccugcugagu

SEQ ID NO: 670199 - RNA, 64 nt, hsa
augccaugacagguguccuuccaagagacagaagaggagacacagacacagagcaggaggacac

SEQ ID NO: 670200 - RNA, 64 nt, hsa
gggcccaauccagugucccuaugagagacggaagaggagacacagacacaaagcaggaggccac

SEQ ID NO: 670201 - RNA, 64 nt, hsa
ucuggcuaauuuuuuuuuuuuuuuuuuuuuuuuguagagacaggguuucgccauguugacgaga

SEQ ID NO: 670202 - RNA, 64 nt, hsa
gccagcacgccuggcuaauuuuuuguauuuuuaguagagacaggguuucaccguguuagccagg

SEQ ID NO: 670203 - RNA, 64 nt, hsa
ccaccacaucuggcuaauuuuauuuuuauuuuuguagagacaggagucuugccauguugcccag

SEQ ID NO: 670204 - RNA, 64 nt, hsa
caccaugcccagcaaauuuuguauuuuuuuuugguagagacaggguucaaccauguuggucagg

SEQ ID NO: 670205 - RNA, 64 nt, hsa
uggaaugaguugggagagaaaggcccucagcuuuuagagacacaaaaauccaugaagucucuuc

SEQ ID NO: 670206 - RNA, 64 nt, hsa
ugccacuaugccuggcuaauuuuuguguuuuuaguagagacaggguuucaccauauuggccagg

SEQ ID NO: 670207 - RNA, 64 nt, hsa
gcaccaccaugcccagcuaauuuuguauuuuuauuagagacaggguuucuccguguuggucagg

SEQ ID NO: 670208 - RNA, 64 nt, hsa
guaccgucaugccuggcuaauuuuuguauuuuuguagagacaggguuucaccauguugcccagu

SEQ ID NO: 670209 - RNA, 64 nt, hsa
auucucuccagagacuuuugauuuuacuuuuauguagagacagggucucacuuuguugcccacg

SEQ ID NO: 670210 - RNA, 64 nt, hsa
gccaccacgcccagcuaauuuuuuguauuuuuaguagagacaggguuucaccauguuggucagg

SEQ ID NO: 670211 - RNA, 64 nt, hsa
uuggguaauuaaaaaauaaauaaauacuuuuuuguagagacagggucucacuguguugcccagg

SEQ ID NO: 670212 - RNA, 64 nt, hsa
uuauacaauucauuuuuguuuuguuuuguuuguuuagagacagggucugacucuguugcccaag

SEQ ID NO: 670213 - RNA, 64 nt, hsa
cacaucaaugaauuugggguccuauacacuugacuagagacaugcuuguguuuuggaauuucac

SEQ ID NO: 670214 - RNA, 64 nt, hsa
gaacagcagguugauaguagauuaugucucuagguagagacagauacaugagaagagccuccaa

SEQ ID NO: 670215 - RNA, 64 nt, hsa
caccaccacacccagcuaauuuuuguauuuuuaguagagacagggguuucaccacguuggccag

SEQ ID NO: 670216 - RNA, 64 nt, hsa
cccugccaccaagcccagcuaauuguauuuuuaguagagacaggauuucaccauguuggccagg

SEQ ID NO: 670217 - RNA, 64 nt, hsa
ugccaccaugcccggcuacuuuuuguauuuuuaguagagacaggguuucaucauguuggccagg

SEQ ID NO: 670218 - RNA, 64 nt, hsa
ccacuguggccaaccuaauuuuuguauuauuuaguagagacaggguuucaccacauuggccagg

SEQ ID NO: 670219 - RNA, 64 nt, hsa
cgccaccacgcccagcuaauuuuuauauuuuuaguagagacaggauugcaccauauuggucagc

SEQ ID NO: 670220 - RNA, 64 nt, hsa
cgccaccacgccuggcuacuuuuuguauuuuuaguagagacaggguuucaccacguuagccaug

SEQ ID NO: 670221 - RNA, 64 nt, hsa
cgccaccacgcccagcuaauuccuguauuuuuaguagagacaggguuucaccauguuggccagg

SEQ ID NO: 670222 - RNA, 64 nt, hsa
ucaccaugccuggcuaauuuuuuuugauuuuuaguagagacaggguuucaccguguuagccagg

SEQ ID NO: 670223 - RNA, 64 nt, hsa
agaugagaagguuugacaaaaagacagagagauguagagacagugauagagacagaggaacaaa

SEQ ID NO: 670224 - RNA, 64 nt, hsa
uugacaaaaagacagagagauguagagacagugauagagacagaggaacaaaaagagcagcagu

SEQ ID NO: 670225 - RNA, 64 nt, hsa
gacagggucuugcucuguugcccaggcuggaguguagagacacaguuacaccucaauguaaccu

SEQ ID NO: 670226 - RNA, 64 nt, hsa
uggaugguucuuugacucuauuuuuauuuuuacuuagagacagggucuugcucuguugcccagg

SEQ ID NO: 670227 - RNA, 64 nt, hsa
ccauguugcguucaaagaggugaacauuaaaauauagagacaggacagaauguguucuuuucuc

SEQ ID NO: 670228 - RNA, 64 nt, hsa
gccgaugugguaggugauaaagaggcaucuuuucuagagacacauuggaccagaugaggauccg

SEQ ID NO: 670229 - RNA, 64 nt, hsa
agccaacaagcccggcuaauuuuuguauuuuuaguagagacaagguuucaccauguuggucagg

SEQ ID NO: 670230 - RNA, 64 nt, hsa
gaggguauucccaacuugugaucuucuaccacuuuagagacauucaaguaauaguuuucuuaga

SEQ ID NO: 670231 - RNA, 62 nt, hsa
uguggaaaaggcuccagugagcgcgccugcuuuagagacacaggaugauucagaccggaaac

SEQ ID NO: 670232 - RNA, 64 nt, hsa
cgauuuggcugucuaggcgucauuuggcaaugucuagagacauuuuugguaguuagaauggggg

SEQ ID NO: 670233 - RNA, 64 nt, hsa
accgucacacccggcuaauuuuuuuguauuuuaguagagacaggguuucaccguguuagccagg

SEQ ID NO: 670234 - RNA, 64 nt, hsa
cgccaccacgcccaggaaauuauuguaguuuuaguagagacaagauuucaccauguuggccagg

SEQ ID NO: 670235 - RNA, 64 nt, hsa
auuuuucuacagauuuuuuuuuuuuuggucauacuagagacaggggucucgcugaacuccuggc

SEQ ID NO: 670236 - RNA, 64 nt, hsa
uuuuguucaugcuuugauuuuuuuuuaaauuuuuuagagacagggucucacucuguugcccagg

SEQ ID NO: 670237 - RNA, 59 nt, hsa
agcaagaagaccagcugugaggugagggcuagagacagcccacgggcccucccuccaag

SEQ ID NO: 670238 - RNA, 64 nt, hsa
cgcccggcuaauuuuuuuuuaaaaauauuuuuaguagagacaggguuucaccauuuuggccagg

SEQ ID NO: 670239 - RNA, 64 nt, hsa
ccaccacagcccagcuaauuuuuuguauuuuuaguagagacagaguuuugcuauguuggccagg

SEQ ID NO: 670240 - RNA, 64 nt, hsa
cccagcuaauuauuuauuucuuuuguauuuuuaguagagacaggguuucaccauguuggccagg

SEQ ID NO: 670241 - RNA, 64 nt, hsa
ccaggugauccccccgccauuaucucccccuaguuagagacaguccuuccgugaggccuggggg

SEQ ID NO: 670242 - RNA, 64 nt, hsa
gugccaucaugccugacuaauuuuguauuuuuaguagagacaggguuucaccauguuggccagg

SEQ ID NO: 670243 - RNA, 64 nt, hsa
ccaccaagcccugcaaauuuuuuuguauuuuuaguagagacaguguuuugccauguuggccagg

SEQ ID NO: 670244 - RNA, 64 nt, hsa
caccaccacaccuggcuaauuuuuguauuuuuaguagagacaggguuucaccauauuggucagg

SEQ ID NO: 670245 - RNA, 64 nt, hsa
ugccaccacgcccggcuaauuuuuguauuuuuaguagagacaggguuucaccauauuggucagg

SEQ ID NO: 670246 - RNA, 64 nt, hsa; identical to SEQ ID NO: 144852

SEQ ID NO: 670247 - RNA, 64 nt, hsa; identical to SEQ ID NO: 144853

SEQ ID NO: 670248 - RNA, 64 nt, hsa; identical to SEQ ID NO: 144854

SEQ ID NO: 670249 - RNA, 64 nt, hsa; identical to SEQ ID NO: 144855

SEQ ID NO: 670250 - RNA, 64 nt, hsa; identical to SEQ ID NO: 144856

SEQ ID NO: 670251 - RNA, 64 nt, hsa; identical to SEQ ID NO: 144857

SEQ ID NO: 670252 - RNA, 64 nt, hsa; identical to SEQ ID NO: 144858

SEQ ID NO: 670253 - RNA, 64 nt, hsa; identical to SEQ ID NO: 144859

SEQ ID NO: 670254 - RNA, 64 nt, hsa; identical to SEQ ID NO: 144860

SEQ ID NO: 670255 - RNA, 64 nt, hsa; identical to SEQ ID NO: 144861

SEQ ID NO: 670256 - RNA, 64 nt, hsa; identical to SEQ ID NO: 276116

SEQ ID NO: 670257 - RNA, 64 nt, hsa; identical to SEQ ID NO: 276117

SEQ ID NO: 670258 - RNA, 64 nt, hsa; identical to SEQ ID NO: 276118

SEQ ID NO: 670259 - RNA, 64 nt, hsa; identical to SEQ ID NO: 276119

SEQ ID NO: 670260 - RNA, 64 nt, hsa; identical to SEQ ID NO: 276120

SEQ ID NO: 670261 - RNA, 64 nt, hsa; identical to SEQ ID NO: 276121

SEQ ID NO: 670262 - RNA, 64 nt, hsa; identical to SEQ ID NO: 276122

SEQ ID NO: 670263 - RNA, 64 nt, hsa; identical to SEQ ID NO: 276123

SEQ ID NO: 670264 - RNA, 64 nt, hsa; identical to SEQ ID NO: 276124

SEQ ID NO: 670265 - RNA, 64 nt, hsa; identical to SEQ ID NO: 276125

SEQ ID NO: 670266 - RNA, 64 nt, hsa; identical to SEQ ID NO: 276126

SEQ ID NO: 670267 - RNA, 64 nt, hsa; identical to SEQ ID NO: 276127

SEQ ID NO: 670268 - RNA, 64 nt, hsa; identical to SEQ ID NO: 276128

SEQ ID NO: 670269 - RNA, 64 nt, hsa; identical to SEQ ID NO: 276129

SEQ ID NO: 670270 - RNA, 64 nt, hsa; identical to SEQ ID NO: 276130

SEQ ID NO: 670271 - RNA, 64 nt, hsa; identical to SEQ ID NO: 276131

SEQ ID NO: 670272 - RNA, 64 nt, hsa; identical to SEQ ID NO: 276132

SEQ ID NO: 670273 - RNA, 64 nt, hsa; identical to SEQ ID NO: 276133

SEQ ID NO: 670274 - RNA, 64 nt, hsa; identical to SEQ ID NO: 276134

SEQ ID NO: 670275 - RNA, 64 nt, hsa; identical to SEQ ID NO: 276135

SEQ ID NO: 670276 - RNA, 64 nt, hsa; identical to SEQ ID NO: 276136

SEQ ID NO: 670277 - RNA, 64 nt, hsa; identical to SEQ ID NO: 276137

SEQ ID NO: 670278 - RNA, 64 nt, hsa; identical to SEQ ID NO: 276138

SEQ ID NO: 670279 - RNA, 64 nt, hsa; identical to SEQ ID NO: 276139

SEQ ID NO: 670280 - RNA, 64 nt, hsa; identical to SEQ ID NO: 276140

SEQ ID NO: 670281 - RNA, 64 nt, hsa; identical to SEQ ID NO: 276141

SEQ ID NO: 670282 - RNA, 64 nt, hsa; identical to SEQ ID NO: 276142

SEQ ID NO: 670283 - RNA, 64 nt, hsa; identical to SEQ ID NO: 276143

SEQ ID NO: 670284 - RNA, 64 nt, hsa; identical to SEQ ID NO: 276144

SEQ ID NO: 670285 - RNA, 64 nt, hsa; identical to SEQ ID NO: 276145

SEQ ID NO: 670286 - RNA, 64 nt, hsa; identical to SEQ ID NO: 276146

SEQ ID NO: 670287 - RNA, 64 nt, hsa; identical to SEQ ID NO: 276147

SEQ ID NO: 670288 - RNA, 64 nt, hsa; identical to SEQ ID NO: 276148

SEQ ID NO: 670289 - RNA, 64 nt, hsa; identical to SEQ ID NO: 88200

SEQ ID NO: 670290 - RNA, 64 nt, hsa; identical to SEQ ID NO: 88201

SEQ ID NO: 670291 - RNA, 64 nt, hsa; identical to SEQ ID NO: 88202

SEQ ID NO: 670292 - RNA, 64 nt, hsa; identical to SEQ ID NO: 88203

SEQ ID NO: 670293 - RNA, 64 nt, hsa; identical to SEQ ID NO: 88204

SEQ ID NO: 670294 - RNA, 64 nt, hsa; identical to SEQ ID NO: 88205

SEQ ID NO: 670295 - RNA, 64 nt, hsa; identical to SEQ ID NO: 88206

SEQ ID NO: 670296 - RNA, 64 nt, hsa; identical to SEQ ID NO: 88207

SEQ ID NO: 670297 - RNA, 64 nt, hsa; identical to SEQ ID NO: 88208

SEQ ID NO: 670298 - RNA, 64 nt, hsa; identical to SEQ ID NO: 88209

SEQ ID NO: 670299 - RNA, 64 nt, hsa; identical to SEQ ID NO: 88210

SEQ ID NO: 670300 - RNA, 64 nt, hsa; identical to SEQ ID NO: 88211

SEQ ID NO: 670301 - RNA, 64 nt, hsa; identical to SEQ ID NO: 88212

SEQ ID NO: 670302 - RNA, 64 nt, hsa; identical to SEQ ID NO: 88213

SEQ ID NO: 670303 - RNA, 64 nt, hsa; identical to SEQ ID NO: 88214

SEQ ID NO: 670304 - RNA, 64 nt, hsa; identical to SEQ ID NO: 88215

SEQ ID NO: 670305 - RNA, 64 nt, hsa; identical to SEQ ID NO: 88216

SEQ ID NO: 670306 - RNA, 64 nt, hsa; identical to SEQ ID NO: 88217

SEQ ID NO: 670307 - RNA, 64 nt, hsa; identical to SEQ ID NO: 88218

SEQ ID NO: 670308 - RNA, 64 nt, hsa; identical to SEQ ID NO: 88219

SEQ ID NO: 670309 - RNA, 64 nt, hsa; identical to SEQ ID NO: 88220

SEQ ID NO: 670310 - RNA, 64 nt, hsa; identical to SEQ ID NO: 88221

SEQ ID NO: 670311 - RNA, 64 nt, hsa; identical to SEQ ID NO: 88222

SEQ ID NO: 670312 - RNA, 64 nt, hsa; identical to SEQ ID NO: 88223

SEQ ID NO: 670313 - RNA, 64 nt, hsa; identical to SEQ ID NO: 88224

SEQ ID NO: 670314 - RNA, 64 nt, hsa; identical to SEQ ID NO: 88225

SEQ ID NO: 670315 - RNA, 64 nt, hsa; identical to SEQ ID NO: 88226

SEQ ID NO: 670316 - RNA, 64 nt, hsa; identical to SEQ ID NO: 88227

SEQ ID NO: 670317 - RNA, 64 nt, hsa; identical to SEQ ID NO: 88228

SEQ ID NO: 670318 - RNA, 64 nt, hsa; identical to SEQ ID NO: 88229

SEQ ID NO: 670319 - RNA, 64 nt, hsa; identical to SEQ ID NO: 88230

SEQ ID NO: 670320 - RNA, 64 nt, hsa; identical to SEQ ID NO: 88231

SEQ ID NO: 670321 - RNA, 64 nt, hsa; identical to SEQ ID NO: 88232

SEQ ID NO: 670322 - RNA, 64 nt, hsa; identical to SEQ ID NO: 88233

SEQ ID NO: 670323 - RNA, 64 nt, hsa; identical to SEQ ID NO: 88234

SEQ ID NO: 670324 - RNA, 64 nt, hsa; identical to SEQ ID NO: 88235

SEQ ID NO: 670325 - RNA, 64 nt, hsa; identical to SEQ ID NO: 88236

SEQ ID NO: 670326 - RNA, 64 nt, hsa; identical to SEQ ID NO: 88237

SEQ ID NO: 670327 - RNA, 64 nt, hsa; identical to SEQ ID NO: 88238

SEQ ID NO: 670328 - RNA, 64 nt, hsa; identical to SEQ ID NO: 88239

SEQ ID NO: 670329 - RNA, 64 nt, hsa; identical to SEQ ID NO: 88240

SEQ ID NO: 670330 - RNA, 64 nt, hsa; identical to SEQ ID NO: 88241

SEQ ID NO: 670331 - RNA, 64 nt, hsa; identical to SEQ ID NO: 88242

SEQ ID NO: 670332 - RNA, 64 nt, hsa; identical to SEQ ID NO: 88243

SEQ ID NO: 670333 - RNA, 64 nt, hsa; identical to SEQ ID NO: 88244

SEQ ID NO: 670334 - RNA, 64 nt, hsa; identical to SEQ ID NO: 88245

SEQ ID NO: 670335 - RNA, 64 nt, hsa; identical to SEQ ID NO: 88246

SEQ ID NO: 670336 - RNA, 64 nt, hsa; identical to SEQ ID NO: 88247

SEQ ID NO: 670337 - RNA, 64 nt, hsa; identical to SEQ ID NO: 88248

SEQ ID NO: 670338 - RNA, 61 nt, hsa; identical to SEQ ID NO: 88249

SEQ ID NO: 670339 - RNA, 64 nt, hsa; identical to SEQ ID NO: 88250

SEQ ID NO: 670340 - RNA, 64 nt, hsa; identical to SEQ ID NO: 88251

SEQ ID NO: 670341 - RNA, 64 nt, hsa; identical to SEQ ID NO: 88252

SEQ ID NO: 670342 - RNA, 64 nt, hsa; identical to SEQ ID NO: 88253

SEQ ID NO: 670343 - RNA, 64 nt, hsa; identical to SEQ ID NO: 88254

SEQ ID NO: 670344 - RNA, 64 nt, hsa; identical to SEQ ID NO: 88255

SEQ ID NO: 670345 - RNA, 64 nt, hsa; identical to SEQ ID NO: 88256

SEQ ID NO: 670346 - RNA, 64 nt, hsa; identical to SEQ ID NO: 542858

SEQ ID NO: 670347 - RNA, 64 nt, hsa; identical to SEQ ID NO: 542859

SEQ ID NO: 670348 - RNA, 64 nt, hsa; identical to SEQ ID NO: 542860

SEQ ID NO: 670349 - RNA, 64 nt, hsa; identical to SEQ ID NO: 542861

SEQ ID NO: 670350 - RNA, 64 nt, hsa; identical to SEQ ID NO: 542862

SEQ ID NO: 670351 - RNA, 64 nt, hsa; identical to SEQ ID NO: 542863

SEQ ID NO: 670352 - RNA, 64 nt, hsa; identical to SEQ ID NO: 542864

SEQ ID NO: 670353 - RNA, 64 nt, hsa; identical to SEQ ID NO: 542865

SEQ ID NO: 670354 - RNA, 64 nt, hsa; identical to SEQ ID NO: 542866

SEQ ID NO: 670355 - RNA, 64 nt, hsa; identical to SEQ ID NO: 542867

SEQ ID NO: 670356 - RNA, 64 nt, hsa; identical to SEQ ID NO: 542868

SEQ ID NO: 670357 - RNA, 62 nt, hsa; identical to SEQ ID NO: 542869

SEQ ID NO: 670358 - RNA, 64 nt, hsa; identical to SEQ ID NO: 542870

SEQ ID NO: 670359 - RNA, 64 nt, hsa; identical to SEQ ID NO: 542871

SEQ ID NO: 670360 - RNA, 64 nt, hsa; identical to SEQ ID NO: 542872

SEQ ID NO: 670361 - RNA, 64 nt, hsa; identical to SEQ ID NO: 542873

SEQ ID NO: 670362 - RNA, 64 nt, hsa; identical to SEQ ID NO: 542874

SEQ ID NO: 670363 - RNA, 64 nt, hsa; identical to SEQ ID NO: 542875

SEQ ID NO: 670364 - RNA, 64 nt, hsa; identical to SEQ ID NO: 542876

SEQ ID NO: 670365 - RNA, 64 nt, hsa; identical to SEQ ID NO: 542877

SEQ ID NO: 670366 - RNA, 64 nt, hsa; identical to SEQ ID NO: 542878

SEQ ID NO: 670367 - RNA, 64 nt, hsa; identical to SEQ ID NO: 542879

SEQ ID NO: 670368 - RNA, 64 nt, hsa; identical to SEQ ID NO: 542880

SEQ ID NO: 670369 - RNA, 64 nt, hsa; identical to SEQ ID NO: 542881

SEQ ID NO: 670370 - RNA, 64 nt, hsa; identical to SEQ ID NO: 542882

SEQ ID NO: 670371 - RNA, 64 nt, hsa; identical to SEQ ID NO: 542883

SEQ ID NO: 670372 - RNA, 64 nt, hsa; identical to SEQ ID NO: 542884

SEQ ID NO: 670373 - RNA, 64 nt, hsa; identical to SEQ ID NO: 542885

SEQ ID NO: 670374 - RNA, 51 nt, hsa; identical to SEQ ID NO: 542886

SEQ ID NO: 670375 - RNA, 64 nt, hsa; identical to SEQ ID NO: 542887

SEQ ID NO: 670376 - RNA, 64 nt, hsa; identical to SEQ ID NO: 542888

SEQ ID NO: 670377 - RNA, 53 nt, hsa; identical to SEQ ID NO: 542889

SEQ ID NO: 670378 - RNA, 64 nt, hsa; identical to SEQ ID NO: 542890

SEQ ID NO: 670379 - RNA, 64 nt, hsa; identical to SEQ ID NO: 542891

SEQ ID NO: 670380 - RNA, 64 nt, hsa; identical to SEQ ID NO: 542892

SEQ ID NO: 670381 - RNA, 64 nt, hsa; identical to SEQ ID NO: 542893

SEQ ID NO: 670382 - RNA, 64 nt, hsa; identical to SEQ ID NO: 542894

SEQ ID NO: 670383 - RNA, 64 nt, hsa; identical to SEQ ID NO: 542895

SEQ ID NO: 670384 - RNA, 64 nt, hsa; identical to SEQ ID NO: 542896

SEQ ID NO: 670385 - RNA, 64 nt, hsa; identical to SEQ ID NO: 542897

SEQ ID NO: 670386 - RNA, 64 nt, hsa; identical to SEQ ID NO: 542898

SEQ ID NO: 670387 - RNA, 64 nt, hsa; identical to SEQ ID NO: 542899

SEQ ID NO: 670388 - RNA, 64 nt, hsa; identical to SEQ ID NO: 542900

SEQ ID NO: 670389 - RNA, 64 nt, hsa; identical to SEQ ID NO: 542901

SEQ ID NO: 670390 - RNA, 64 nt, hsa; identical to SEQ ID NO: 542902

SEQ ID NO: 670391 - RNA, 64 nt, hsa; identical to SEQ ID NO: 542903

SEQ ID NO: 670392 - RNA, 64 nt, hsa; identical to SEQ ID NO: 542904

SEQ ID NO: 670393 - RNA, 64 nt, hsa; identical to SEQ ID NO: 542905

SEQ ID NO: 670394 - RNA, 64 nt, hsa; identical to SEQ ID NO: 542906

SEQ ID NO: 670395 - RNA, 64 nt, hsa; identical to SEQ ID NO: 542907

SEQ ID NO: 670396 - RNA, 64 nt, hsa; identical to SEQ ID NO: 542908

SEQ ID NO: 670397 - RNA, 62 nt, hsa; identical to SEQ ID NO: 542909

SEQ ID NO: 670398 - RNA, 64 nt, hsa; identical to SEQ ID NO: 542910

SEQ ID NO: 670399 - RNA, 64 nt, hsa; identical to SEQ ID NO: 542911

SEQ ID NO: 670400 - RNA, 64 nt, hsa; identical to SEQ ID NO: 542912

SEQ ID NO: 670401 - RNA, 64 nt, hsa; identical to SEQ ID NO: 542913

SEQ ID NO: 670402 - RNA, 64 nt, hsa; identical to SEQ ID NO: 542914

SEQ ID NO: 670403 - RNA, 64 nt, hsa; identical to SEQ ID NO: 542915

SEQ ID NO: 670404 - RNA, 64 nt, hsa; identical to SEQ ID NO: 542916

SEQ ID NO: 670405 - RNA, 64 nt, hsa; identical to SEQ ID NO: 542917

SEQ ID NO: 670406 - RNA, 64 nt, hsa; identical to SEQ ID NO: 542918

SEQ ID NO: 670407 - RNA, 64 nt, hsa; identical to SEQ ID NO: 542919

SEQ ID NO: 670408 - RNA, 64 nt, hsa; identical to SEQ ID NO: 542920

SEQ ID NO: 670409 - RNA, 64 nt, hsa; identical to SEQ ID NO: 542921

SEQ ID NO: 670410 - RNA, 64 nt, hsa; identical to SEQ ID NO: 542922

SEQ ID NO: 670411 - RNA, 64 nt, hsa; identical to SEQ ID NO: 542923

SEQ ID NO: 670412 - RNA, 64 nt, hsa; identical to SEQ ID NO: 542924

SEQ ID NO: 670413 - RNA, 64 nt, hsa; identical to SEQ ID NO: 542925

SEQ ID NO: 670414 - RNA, 64 nt, hsa; identical to SEQ ID NO: 542926

SEQ ID NO: 670415 - RNA, 64 nt, hsa; identical to SEQ ID NO: 542927

SEQ ID NO: 670416 - RNA, 64 nt, hsa; identical to SEQ ID NO: 542928

SEQ ID NO: 670417 - RNA, 64 nt, hsa; identical to SEQ ID NO: 542929

SEQ ID NO: 670418 - RNA, 64 nt, hsa; identical to SEQ ID NO: 542930

SEQ ID NO: 670419 - RNA, 64 nt, hsa; identical to SEQ ID NO: 542931

SEQ ID NO: 670420 - RNA, 64 nt, hsa; identical to SEQ ID NO: 542932

SEQ ID NO: 670421 - RNA, 64 nt, hsa; identical to SEQ ID NO: 542933

SEQ ID NO: 670422 - RNA, 64 nt, hsa; identical to SEQ ID NO: 542934

SEQ ID NO: 670423 - RNA, 64 nt, hsa; identical to SEQ ID NO: 542935

SEQ ID NO: 670424 - RNA, 64 nt, hsa; identical to SEQ ID NO: 542936

SEQ ID NO: 670425 - RNA, 64 nt, hsa; identical to SEQ ID NO: 542937

SEQ ID NO: 670426 - RNA, 64 nt, hsa; identical to SEQ ID NO: 542938

SEQ ID NO: 670427 - RNA, 64 nt, hsa; identical to SEQ ID NO: 542939

SEQ ID NO: 670428 - RNA, 64 nt, hsa; identical to SEQ ID NO: 542940

SEQ ID NO: 670429 - RNA, 64 nt, hsa; identical to SEQ ID NO: 542941

SEQ ID NO: 670430 - RNA, 64 nt, hsa; identical to SEQ ID NO: 542942

SEQ ID NO: 670431 - RNA, 64 nt, hsa; identical to SEQ ID NO: 542943

SEQ ID NO: 670432 - RNA, 64 nt, hsa; identical to SEQ ID NO: 542944

SEQ ID NO: 670433 - RNA, 64 nt, hsa; identical to SEQ ID NO: 542945

SEQ ID NO: 670434 - RNA, 64 nt, hsa; identical to SEQ ID NO: 542946

SEQ ID NO: 670435 - RNA, 64 nt, hsa; identical to SEQ ID NO: 189695

SEQ ID NO: 670436 - RNA, 64 nt, hsa; identical to SEQ ID NO: 189696

SEQ ID NO: 670437 - RNA, 64 nt, hsa; identical to SEQ ID NO: 189697

SEQ ID NO: 670438 - RNA, 64 nt, hsa; identical to SEQ ID NO: 189698

SEQ ID NO: 670439 - RNA, 64 nt, hsa; identical to SEQ ID NO: 189699

SEQ ID NO: 670440 - RNA, 64 nt, hsa; identical to SEQ ID NO: 189700

SEQ ID NO: 670441 - RNA, 64 nt, hsa; identical to SEQ ID NO: 189701

SEQ ID NO: 670442 - RNA, 64 nt, hsa; identical to SEQ ID NO: 189702

SEQ ID NO: 670443 - RNA, 64 nt, hsa; identical to SEQ ID NO: 189703

SEQ ID NO: 670444 - RNA, 64 nt, hsa; identical to SEQ ID NO: 189704

SEQ ID NO: 670445 - RNA, 64 nt, hsa; identical to SEQ ID NO: 189705

SEQ ID NO: 670446 - RNA, 64 nt, hsa; identical to SEQ ID NO: 189706

SEQ ID NO: 670447 - RNA, 64 nt, hsa; identical to SEQ ID NO: 189707

SEQ ID NO: 670448 - RNA, 64 nt, hsa; identical to SEQ ID NO: 189708

SEQ ID NO: 670449 - RNA, 64 nt, hsa; identical to SEQ ID NO: 189709

SEQ ID NO: 670450 - RNA, 64 nt, hsa; identical to SEQ ID NO: 189710

SEQ ID NO: 670451 - RNA, 64 nt, hsa; identical to SEQ ID NO: 189711

SEQ ID NO: 670452 - RNA, 64 nt, hsa; identical to SEQ ID NO: 189712

SEQ ID NO: 670453 - RNA, 64 nt, hsa; identical to SEQ ID NO: 189713

SEQ ID NO: 670454 - RNA, 64 nt, hsa; identical to SEQ ID NO: 189714

SEQ ID NO: 670455 - RNA, 64 nt, hsa; identical to SEQ ID NO: 189715

SEQ ID NO: 670456 - RNA, 64 nt, hsa; identical to SEQ ID NO: 189716

SEQ ID NO: 670457 - RNA, 64 nt, hsa; identical to SEQ ID NO: 189717

SEQ ID NO: 670458 - RNA, 64 nt, hsa; identical to SEQ ID NO: 189718

SEQ ID NO: 670459 - RNA, 64 nt, hsa; identical to SEQ ID NO: 189719

SEQ ID NO: 670460 - RNA, 64 nt, hsa; identical to SEQ ID NO: 189720

SEQ ID NO: 670461 - RNA, 64 nt, hsa; identical to SEQ ID NO: 189721

SEQ ID NO: 670462 - RNA, 64 nt, hsa; identical to SEQ ID NO: 189722

SEQ ID NO: 670463 - RNA, 64 nt, hsa; identical to SEQ ID NO: 189723

SEQ ID NO: 670464 - RNA, 64 nt, hsa; identical to SEQ ID NO: 189724

SEQ ID NO: 670465 - RNA, 64 nt, hsa; identical to SEQ ID NO: 189725

SEQ ID NO: 670466 - RNA, 64 nt, hsa; identical to SEQ ID NO: 189726

SEQ ID NO: 670467 - RNA, 64 nt, hsa; identical to SEQ ID NO: 189727

SEQ ID NO: 670468 - RNA, 64 nt, hsa; identical to SEQ ID NO: 189728

SEQ ID NO: 670469 - RNA, 64 nt, hsa; identical to SEQ ID NO: 189729

SEQ ID NO: 670470 - RNA, 64 nt, hsa; identical to SEQ ID NO: 189730

SEQ ID NO: 670471 - RNA, 64 nt, hsa; identical to SEQ ID NO: 189731

SEQ ID NO: 670472 - RNA, 64 nt, hsa; identical to SEQ ID NO: 189732

SEQ ID NO: 670473 - RNA, 64 nt, hsa; identical to SEQ ID NO: 189733

SEQ ID NO: 670474 - RNA, 64 nt, hsa; identical to SEQ ID NO: 189734

SEQ ID NO: 670475 - RNA, 64 nt, hsa; identical to SEQ ID NO: 189735

SEQ ID NO: 670476 - RNA, 64 nt, hsa; identical to SEQ ID NO: 189736

SEQ ID NO: 670477 - RNA, 64 nt, hsa; identical to SEQ ID NO: 189737

SEQ ID NO: 670478 - RNA, 64 nt, hsa; identical to SEQ ID NO: 189738

SEQ ID NO: 670479 - RNA, 60 nt, hsa
uugguaaauggacaaaagcuagcuaguaaaaaggacgacccagcaacaugcuuuaacccc

SEQ ID NO: 670480 - RNA, 60 nt, hsa
acccacccucauugcauuccgcuguagugaaaggacgagccauuucugggcacguggcag

SEQ ID NO: 670481 - RNA, 60 nt, hsa
caucuuucguugccauucuucauuccuacaaaggacgaacuuggauuacaucaacuuugg

SEQ ID NO: 670482 - RNA, 60 nt, hsa
cuuccagcucagcuccacacaaagcugcagaaggacgaaaugaaaagcauuuggaaguuu

SEQ ID NO: 670483 - RNA, 60 nt, hsa
uaauuugaggugaaauucaguuauaaagucaaggacgaauuugcacagugauauauuucu

SEQ ID NO: 670484 - RNA, 60 nt, hsa
gaggagggcgcagggugggggguaucaaagaaggacgaauagcacccuaccugugggugu

SEQ ID NO: 670485 - RNA, 60 nt, hsa
ucuacugaguacuuucugcaggggccuguuaaggacgaggccuccccagcccugcccggu

SEQ ID NO: 670486 - RNA, 60 nt, hsa
ccuagcucaaggauuugcaaaguuaggaagaaggacgagagagccucucuccccacccca

SEQ ID NO: 670487 - RNA, 60 nt, hsa
cugcuggaaggaguaauucugugcuugacaaaggacgauuucuccuuuaucgugaccagu

SEQ ID NO: 670488 - RNA, 60 nt, hsa
auuuaucuuguugauuucuuacaaaagaaaaaggacgaugucagucaagcagcacuuuuu

SEQ ID NO: 670489 - RNA, 60 nt, hsa
ucgcccacccuggcaaggacagcugcggccaaggacgaaagcccucccuuggcuggccuc

SEQ ID NO: 670490 - RNA, 60 nt, hsa
gaggaaaggacagugugcuugguuagaguaaaggacgaggucauuagccauauuguauau

SEQ ID NO: 670491 - RNA, 60 nt, hsa
uuucuuuuaagggggaaacaagguagagaaaaggacgaagaaguguaagucccgcugauu

SEQ ID NO: 670492 - RNA, 60 nt, hsa
accauauccuguaauuuaauaaaaaaaacuaaggacgaaaaaacccuccaauuuucccaa

SEQ ID NO: 670493 - RNA, 60 nt, hsa
ucagggacuggcagagcaagaggccaucagaaggacgaggugcuguuggcaauugcagcu

SEQ ID NO: 670494 - RNA, 60 nt, hsa
cugcugggacuagauaguggaugaagaaagaaggacgaggaagccguggggcagccucuu

SEQ ID NO: 670495 - RNA, 60 nt, hsa
accauauguugugucuaaucuccuucugagaaggacgaaaaacuuucuuccaagugaaga

SEQ ID NO: 670496 - RNA, 60 nt, hsa
gcauggagaguggcaucuucuuugcauccuaaggacgaaaaacacagugcacucagagcu

SEQ ID NO: 670497 - RNA, 60 nt, hsa
agauuaagaaaaagcaagauaauuuugaagaaggacgagaggaagaggcaugaacuuguc

SEQ ID NO: 670498 - RNA, 60 nt, hsa
uaucauuguugacuuguucuuccuuaggagaaggacgauuuucacccacccuuucuguuc

SEQ ID NO: 670499 - RNA, 60 nt, hsa
gcucgugauugcuuccugugaacgccucccaaggacgagcccaguguaguuguguggcgu

SEQ ID NO: 670500 - RNA, 60 nt, hsa
ugugacucucucucuaaugcugcucucgggaaggacgaaagugaccugcaaggagagaaa

SEQ ID NO: 670501 - RNA, 60 nt, hsa
uuaccccgauuuaggacaaagugaauuuauaaggacgaaucacaaagauggucugagaaa

SEQ ID NO: 670502 - RNA, 60 nt, hsa
aaagguucuugaacaccacugugauucuccaaggacgaauuacguaaauuauacuuucau

SEQ ID NO: 670503 - RNA, 60 nt, hsa
guggccucugcuuccuccguccuccugcccaaggacgacgaggauugcuccagggcugcu

SEQ ID NO: 670504 - RNA, 60 nt, hsa
ucucacagacccuucagcaauggcuacuagaaggacgaacaauugcccuccuuuggaagu

SEQ ID NO: 670505 - RNA, 60 nt, hsa
ugucauugugacaaagucaaauaaacccccaaggacgacacacaguauggaucacauauu

SEQ ID NO: 670506 - RNA, 60 nt, hsa
aguggcugcaacagagaaaagacuuccauaaaggacgacaaaagaauuggacugaugggu

SEQ ID NO: 670507 - RNA, 60 nt, hsa
uacuugaccuuuucuucccuggcuacagcaaaggacgaugaucugccugcuuucacugug

SEQ ID NO: 670508 - RNA, 60 nt, hsa
agcuuaagauaaguaagcagagacaguguuaaggacgaguuggugucugugguagcuuuu

SEQ ID NO: 670509 - RNA, 60 nt, hsa
auccaagggcaagacuuggugcccagcuggaaggacgaaagcacacuuugugaccgccau

SEQ ID NO: 670510 - RNA, 60 nt, hsa
gauuggccggcagggugauaugacugauucaaggacgaauagcuucuuacauauucuaga

SEQ ID NO: 670511 - RNA, 60 nt, hsa
gccguguggcccugggacccugggcccagaaaggacgaugaacuaccugcaguggugaug

SEQ ID NO: 670512 - RNA, 60 nt, hsa
aaggccuguguugagaaagaugucaugcaaaaggacgacgguggccaacuaaagcaaguc

SEQ ID NO: 670513 - RNA, 60 nt, hsa
gagacgcaacugcaggcugaggaccgcgacaaggacgacauucuguucuacacccuccag

SEQ ID NO: 670514 - RNA, 60 nt, hsa
auagaaaauagaacuuuuauuuugugaccuaaggacgauggugaaaagaucacguuuuca

SEQ ID NO: 670515 - RNA, 60 nt, hsa
aacucuuguuuucuaguccaggauaugcuaaaggacgaagauuuucuauuguuuccaggc

SEQ ID NO: 670516 - RNA, 60 nt, hsa
cagggucaaccugccuaccacaggcacuagaaggacgaaucugccuacugcccaugaacg

SEQ ID NO: 670517 - RNA, 60 nt, hsa
gaugagagacagcgcaugcuggugcagcguaaggacgaacuccuccagcaagcucgcaag

SEQ ID NO: 670518 - RNA, 60 nt, hsa
ucagcugagugcaggugggguucgaggggaaaggacgauggggcaugaccucagucaggc

SEQ ID NO: 670519 - RNA, 60 nt, hsa
cccuucugauuaccuucaugacgggaaccuaaggacgaagccuacaggggcaagggccgc

SEQ ID NO: 670520 - RNA, 60 nt, hsa
gaaugagggacuucuccuccaguggaccugaaggacgagggaugggauuucauguaacca

SEQ ID NO: 670521 - RNA, 60 nt, hsa
ucccuaaauguaaagccaucuguccggcguaaggacgacaccgucagcuguccgacucgc

SEQ ID NO: 670522 - RNA, 60 nt, hsa
aaaaucaaccaacacaagaucaaaaaggaaaaggacgagagaaaaauuauuuuuaagaua

SEQ ID NO: 670523 - RNA, 60 nt, hsa
gugcgggggcgauucaaccugugugcugcgaaggacgagacuuccucuugaacagugugc

SEQ ID NO: 670524 - RNA, 60 nt, hsa
gccuccagccugagccuagcucagcagcccaaggacgauggugaggggagguggggccag

SEQ ID NO: 670525 - RNA, 60 nt, hsa
acuaagauaaccaagaugaacauaaugucaaaggacgaaaucauggggacaauuuggauu

SEQ ID NO: 670526 - RNA, 59 nt, hsa
ugcacggggcacugcccugagcucuggguaaggacgagaagagccaagguccgccuacu

SEQ ID NO: 670527 - RNA, 64 nt, hsa
uucucuuguguuuuguuugaaugugcaauaguuuauaggccacaaauaagcuuucuuguaagcu

SEQ ID NO: 670528 - RNA, 64 nt, hsa
aagacaaaauaguguuauagccuucauucucugaauaggccaucuuugacucauaaaauuaccc

SEQ ID NO: 670529 - RNA, 64 nt, hsa
auuguauuggcuguucauguauguaggaguuaaaauaggccaaacuggagaaauaaacgcauuc

SEQ ID NO: 670530 - RNA, 64 nt, hsa
cagucuucaggacaccauuagaugggcuuucccaauaggccaaaaaaaugcugcgcauacccag

SEQ ID NO: 670531 - RNA, 64 nt, hsa
uuccuuaaggugcacaguaaauguacagauaguuauaggccacuguuuuguaauguaguacauu

SEQ ID NO: 670532 - RNA, 64 nt, hsa
auuuuuguuuuucuuaagucagcugguucauaacauaggccaaauucuagagauguuuauagag

SEQ ID NO: 670533 - RNA, 64 nt, hsa; identical to SEQ ID NO: 238457

SEQ ID NO: 670534 - RNA, 64 nt, hsa; identical to SEQ ID NO: 238458

SEQ ID NO: 670535 - RNA, 64 nt, hsa; identical to SEQ ID NO: 238459

SEQ ID NO: 670536 - RNA, 64 nt, hsa; identical to SEQ ID NO: 238460

SEQ ID NO: 670537 - RNA, 64 nt, hsa; identical to SEQ ID NO: 392567

SEQ ID NO: 670538 - RNA, 64 nt, hsa; identical to SEQ ID NO: 392568

SEQ ID NO: 670539 - RNA, 64 nt, hsa; identical to SEQ ID NO: 392569

SEQ ID NO: 670540 - RNA, 64 nt, hsa; identical to SEQ ID NO: 392570

SEQ ID NO: 670541 - RNA, 64 nt, hsa; identical to SEQ ID NO: 392571

SEQ ID NO: 670542 - RNA, 64 nt, hsa; identical to SEQ ID NO: 392572

SEQ ID NO: 670543 - RNA, 64 nt, hsa; identical to SEQ ID NO: 392573

SEQ ID NO: 670544 - RNA, 64 nt, hsa; identical to SEQ ID NO: 392574

SEQ ID NO: 670545 - RNA, 64 nt, hsa; identical to SEQ ID NO: 392575

SEQ ID NO: 670546 - RNA, 64 nt, hsa; identical to SEQ ID NO: 392576

SEQ ID NO: 670547 - RNA, 64 nt, hsa; identical to SEQ ID NO: 392577

SEQ ID NO: 670548 - RNA, 64 nt, hsa; identical to SEQ ID NO: 392578

SEQ ID NO: 670549 - RNA, 64 nt, hsa; identical to SEQ ID NO: 392579

SEQ ID NO: 670550 - RNA, 64 nt, hsa; identical to SEQ ID NO: 392580

SEQ ID NO: 670551 - RNA, 64 nt, hsa; identical to SEQ ID NO: 392581

SEQ ID NO: 670552 - RNA, 64 nt, hsa; identical to SEQ ID NO: 392582

SEQ ID NO: 670553 - RNA, 64 nt, hsa; identical to SEQ ID NO: 392583

SEQ ID NO: 670554 - RNA, 64 nt, hsa; identical to SEQ ID NO: 392584

SEQ ID NO: 670555 - RNA, 64 nt, hsa; identical to SEQ ID NO: 392585

SEQ ID NO: 670556 - RNA, 64 nt, hsa; identical to SEQ ID NO: 392586

SEQ ID NO: 670557 - RNA, 64 nt, hsa; identical to SEQ ID NO: 392587

SEQ ID NO: 670558 - RNA, 64 nt, hsa; identical to SEQ ID NO: 392588

SEQ ID NO: 670559 - RNA, 61 nt, hsa
auggaguaaccgacaauauauuuauuuauaaagcacauauucauaauaacgagaagaauuc

SEQ ID NO: 670560 - RNA, 61 nt, hsa
caagcaccaugaucccuaggggcaugagaaaagcacauaauggauguggaugugauaggug

SEQ ID NO: 670561 - RNA, 61 nt, hsa
aaacugauggaaauaauagucaccaaaguacagcacauaccauuuugugucuaauaacaau

SEQ ID NO: 670562 - RNA, 61 nt, hsa
ucagggaaacauuggcugggggcacggaauaagcacauaguaaaaagggaacaucaggguc

SEQ ID NO: 670563 - RNA, 61 nt, hsa
gagacagcaaguccacccuaacuuguuacacagcacauaccacagguucuggaauucucau

SEQ ID NO: 670564 - RNA, 61 nt, hsa
uaacagcuguucccacccaccaguuccucuaagcacauacucugcuuuucugucaacaucc

SEQ ID NO: 670565 - RNA, 61 nt, hsa
uaggcuucugaugaucauuguugccagaugcagcacauauacuaaauaugagacaggguaa

SEQ ID NO: 670566 - RNA, 61 nt, hsa
ugucacagcuggccugcagcaggucccugugagcacauaagcagaggcugcaggaacuugu

SEQ ID NO: 670567 - RNA, 61 nt, hsa
uucuucccaauuuaguaacuuagaugcuuccagcacauacguagguagcuaccccagccgg

SEQ ID NO: 670568 - RNA, 61 nt, hsa
aaaccaucguuaauauacugaagugagcuauagcacauaucaugugcuuaguuuguuuauu

SEQ ID NO: 670569 - RNA, 61 nt, hsa
ugagcucacuuugauuuuuaaucccaccacaagcacauacuaauuuuauuuaugauucaaa

SEQ ID NO: 670570 - RNA, 61 nt, hsa
caggcuuucuaccucgacucucaccacagccagcacauacaccuaggcuguuuuuccuucc

SEQ ID NO: 670571 - RNA, 64 nt, hsa
ggagaugugccuucccaauaacucuuuuuuuuuuuccuuucagaacauuuuccagauggcgagg

SEQ ID NO: 670572 - RNA, 64 nt, hsa
uccccuucccuucccuucacccccauccucuuacuccuuucaugucccauuucagacagaguaa

SEQ ID NO: 670573 - RNA, 64 nt, hsa
aauaagcccaaccaacuugccaaagguaucuuuguccuuucaccugggccucauaccaacagcc

SEQ ID NO: 670574 - RNA, 64 nt, hsa
cuacauauuuuaguauaaaucacuaagacauauuuccuuucacuuggcaggauuccuuucaaaa

SEQ ID NO: 670575 - RNA, 64 nt, hsa
ucacuaagacauauuuccuuucacuuggcaggauuccuuucaaaauggaaucugaguauuagac

SEQ ID NO: 670576 - RNA, 64 nt, hsa
aauagcauuagcaguuauaauucuguuuauaauuuccuuucagcauuuacagugaaaagugaga

SEQ ID NO: 670577 - RNA, 64 nt, hsa
guagacauuucauauccagcuuccuugcuuagucuccuuucaguauuuggcaauaaaagaaaga

SEQ ID NO: 670578 - RNA, 64 nt, hsa
aucucuuuucuauacugcuccuuucugaugcuuauccuuucaucugugugauuguuuuuucccc

SEQ ID NO: 670579 - RNA, 64 nt, hsa
cccuagacucugugucacucucaacacacacagcuccuuucacuccugccugacugccaagcca

SEQ ID NO: 670580 - RNA, 64 nt, hsa
ggaccccaaaaaaccagaacaaguucugugugccuccuuucagcacagaagggagacaucucau

SEQ ID NO: 670581 - RNA, 64 nt, hsa
accuuuuuuaugcuuauuuuugucaaacauguacuccuuucauacggguggcuuuuacaaggca

SEQ ID NO: 670582 - RNA, 64 nt, hsa
uagggcuuaauaagcagccguuugcuaaugugcuuccuuucaaaggguuggaccuuuaaauugc

SEQ ID NO: 670583 - RNA, 64 nt, hsa
gugggaaaccucaaagaugguugcccauuuuaaauccuuucaucucucaucucucuuucuucuc

SEQ ID NO: 670584 - RNA, 64 nt, hsa
cagguugguucacacagugaugcagggacucagcuccuuucauccugugcucugcccuccccgg

SEQ ID NO: 670585 - RNA, 64 nt, hsa
cccaaaguuaggccuccuauaauguccaaaacauuccuuucagccuuuuuauuucuuacuguac

SEQ ID NO: 670586 - RNA, 64 nt, hsa
uggauauuguauuacccuggguauuaaaaagaacuccuuucacauuuuaaaauaacaaucugag

SEQ ID NO: 670587 - RNA, 64 nt, hsa
gccguucucaugcaaaauaccugugucagaauacuccuuucauccaucacucagccagagucuu

SEQ ID NO: 670588 - RNA, 64 nt, hsa
uuuguucuguucugcugccuuuuacguuuucuuguccuuucaaaaguguucuugaaagaaacaa

SEQ ID NO: 670589 - RNA, 64 nt, hsa
caacauccucugauucuaggugugguguugacuguccuuucaaggaaaaacuugcaauagaggg

SEQ ID NO: 670590 - RNA, 64 nt, hsa
agcugagcaguguguuaugggaagcugcucaauuuccuuucauucaauuccaccuccuuccuga

SEQ ID NO: 670591 - RNA, 64 nt, hsa
uuucuauaaacacuauaagugauaguuucccccauccuuucauugacauuauuugccaaugcug

SEQ ID NO: 670592 - RNA, 64 nt, hsa
auuuauugguuuuuuuuuaaccaucuguguacauuccuuucauaggguagaguucuaguucuag

SEQ ID NO: 670593 - RNA, 64 nt, hsa
uguucuucuucccuagcauccuccuccccacaucuccuuucacccucuuggcuucuuauccugu

SEQ ID NO: 670594 - RNA, 64 nt, hsa
ucuuauucuguggagaagaagggcgggaagaacuuccuuucaggaggaagcuggaacuuacuga

SEQ ID NO: 670595 - RNA, 64 nt, hsa
ggcugucuuguucauuccauccuacauuucugacuccuuucagacucaacacaguucccuucuu

SEQ ID NO: 670596 - RNA, 64 nt, hsa
ucaggcuaaccuuugagaucacucagcucccaucuccuuucagaaaaauucaagguccuccucu

SEQ ID NO: 670597 - RNA, 64 nt, hsa
cuccacccguucugccucagugguuucaaaucucuccuuucagggcuuuauuugaauggacagu

SEQ ID NO: 670598 - RNA, 64 nt, hsa
cucugcucccgcccggcaccagcccuccaguagauccuuucacgaccuuggccucuaaggcuuc

SEQ ID NO: 670599 - RNA, 64 nt, hsa
caaacccauuuauuacuggcuugaccaggacaaauccuuucagugacaggacugcugcuccugg

SEQ ID NO: 670600 - RNA, 64 nt, hsa
agcagcgcggauuucucuuucucucucacucucuuccuuucauucuaguauucuuuauuauuuu

SEQ ID NO: 670601 - RNA, 64 nt, hsa
ccccuuuuucuuucccuucuuuuucccuuuccuuuccuuucauuuucuuuccuuuccccuuccc

SEQ ID NO: 670602 - RNA, 64 nt, hsa
uauccaaauaauuuaaaaaacacuuuucaccuacuccuuucaugguuauaacacauuggcagac

SEQ ID NO: 670603 - RNA, 64 nt, hsa
agacauaaaggagggugaugugauuuucagcuaguccuuucacauuuucaauaaugagguaauc

SEQ ID NO: 670604 - RNA, 64 nt, hsa
uucagaagagcuuuuuacuaauuuauuugucaguguucccuauuuguuacuuaaccaugauccu

SEQ ID NO: 670605 - RNA, 64 nt, hsa
uguauuuuuguauuuuaaaagcuucuucacuuguguucccuaaauauucauauugcugcccaaa

SEQ ID NO: 670606 - RNA, 64 nt, hsa
uucuguaauucauucaguggugccaaagcuggggguucccuacaauggcuauuuagacuuuccc

SEQ ID NO: 670607 - RNA, 64 nt, hsa
uccuaaacauuaccauuuauguggcagaaguucuguucccuauaaucugcaaugcugaaguauc

SEQ ID NO: 670608 - RNA, 64 nt, hsa
gguugauucaaucaagauguauguagaccuaaaacuacaccaauaggcugauucaaucaagauc

SEQ ID NO: 670609 - RNA, 64 nt, hsa
aacugacaacacuacuuacugauagaccaaaaaacuacaccaguagguugauucaaucaagaug

SEQ ID NO: 670610 - RNA, 64 nt, hsa; identical to SEQ ID NO: 88331

SEQ ID NO: 670611 - RNA, 64 nt, hsa; identical to SEQ ID NO: 88332

SEQ ID NO: 670612 - RNA, 64 nt, hsa; identical to SEQ ID NO: 88333

SEQ ID NO: 670613 - RNA, 64 nt, hsa; identical to SEQ ID NO: 88334

SEQ ID NO: 670614 - RNA, 64 nt, hsa; identical to SEQ ID NO: 88335

SEQ ID NO: 670615 - RNA, 64 nt, hsa; identical to SEQ ID NO: 88336

SEQ ID NO: 670616 - RNA, 64 nt, hsa; identical to SEQ ID NO: 88337

SEQ ID NO: 670617 - RNA, 64 nt, hsa; identical to SEQ ID NO: 88338

SEQ ID NO: 670618 - RNA, 64 nt, hsa; identical to SEQ ID NO: 573683

SEQ ID NO: 670619 - RNA, 64 nt, hsa; identical to SEQ ID NO: 573684

SEQ ID NO: 670620 - RNA, 64 nt, hsa; identical to SEQ ID NO: 573685

SEQ ID NO: 670621 - RNA, 64 nt, hsa; identical to SEQ ID NO: 573686

SEQ ID NO: 670622 - RNA, 64 nt, hsa; identical to SEQ ID NO: 573687

SEQ ID NO: 670623 - RNA, 64 nt, hsa; identical to SEQ ID NO: 573688

SEQ ID NO: 670624 - RNA, 64 nt, hsa; identical to SEQ ID NO: 573689

SEQ ID NO: 670625 - RNA, 64 nt, hsa; identical to SEQ ID NO: 573690

SEQ ID NO: 670626 - RNA, 64 nt, hsa; identical to SEQ ID NO: 573691

SEQ ID NO: 670627 - RNA, 64 nt, hsa; identical to SEQ ID NO: 573692

SEQ ID NO: 670628 - RNA, 64 nt, hsa; identical to SEQ ID NO: 573693

SEQ ID NO: 670629 - RNA, 64 nt, hsa; identical to SEQ ID NO: 573694

SEQ ID NO: 670630 - RNA, 64 nt, hsa; identical to SEQ ID NO: 573695

SEQ ID NO: 670631 - RNA, 64 nt, hsa; identical to SEQ ID NO: 573696

SEQ ID NO: 670632 - RNA, 64 nt, hsa; identical to SEQ ID NO: 573697

SEQ ID NO: 670633 - RNA, 64 nt, hsa; identical to SEQ ID NO: 573698

SEQ ID NO: 670634 - RNA, 64 nt, hsa; identical to SEQ ID NO: 573699

SEQ ID NO: 670635 - RNA, 64 nt, hsa; identical to SEQ ID NO: 573700

SEQ ID NO: 670636 - RNA, 64 nt, hsa; identical to SEQ ID NO: 573701

SEQ ID NO: 670637 - RNA, 64 nt, hsa; identical to SEQ ID NO: 573702

SEQ ID NO: 670638 - RNA, 64 nt, hsa; identical to SEQ ID NO: 573703

SEQ ID NO: 670639 - RNA, 64 nt, hsa; identical to SEQ ID NO: 573704

SEQ ID NO: 670640 - RNA, 64 nt, hsa; identical to SEQ ID NO: 573705

SEQ ID NO: 670641 - RNA, 64 nt, hsa; identical to SEQ ID NO: 573706

SEQ ID NO: 670642 - RNA, 64 nt, hsa; identical to SEQ ID NO: 573707

SEQ ID NO: 670643 - RNA, 64 nt, hsa; identical to SEQ ID NO: 573708

SEQ ID NO: 670644 - RNA, 64 nt, hsa; identical to SEQ ID NO: 573709

SEQ ID NO: 670645 - RNA, 64 nt, hsa; identical to SEQ ID NO: 573710

SEQ ID NO: 670646 - RNA, 64 nt, hsa; identical to SEQ ID NO: 573711

SEQ ID NO: 670647 - RNA, 64 nt, hsa; identical to SEQ ID NO: 573712

SEQ ID NO: 670648 - RNA, 64 nt, hsa; identical to SEQ ID NO: 573713

SEQ ID NO: 670649 - RNA, 64 nt, hsa; identical to SEQ ID NO: 573714

SEQ ID NO: 670650 - RNA, 64 nt, hsa; identical to SEQ ID NO: 573715

SEQ ID NO: 670651 - RNA, 64 nt, hsa; identical to SEQ ID NO: 573716

SEQ ID NO: 670652 - RNA, 64 nt, hsa; identical to SEQ ID NO: 573717

SEQ ID NO: 670653 - RNA, 64 nt, hsa; identical to SEQ ID NO: 573718

SEQ ID NO: 670654 - RNA, 64 nt, hsa; identical to SEQ ID NO: 573719

SEQ ID NO: 670655 - RNA, 64 nt, hsa; identical to SEQ ID NO: 573720

SEQ ID NO: 670656 - RNA, 64 nt, hsa; identical to SEQ ID NO: 573721

SEQ ID NO: 670657 - RNA, 64 nt, hsa; identical to SEQ ID NO: 573722

SEQ ID NO: 670658 - RNA, 63 nt, hsa; identical to SEQ ID NO: 573723

SEQ ID NO: 670659 - RNA, 64 nt, hsa; identical to SEQ ID NO: 573724

SEQ ID NO: 670660 - RNA, 64 nt, hsa; identical to SEQ ID NO: 573725

SEQ ID NO: 670661 - RNA, 64 nt, hsa; identical to SEQ ID NO: 573726

SEQ ID NO: 670662 - RNA, 64 nt, hsa; identical to SEQ ID NO: 573727

SEQ ID NO: 670663 - RNA, 64 nt, hsa; identical to SEQ ID NO: 573728

SEQ ID NO: 670664 - RNA, 64 nt, hsa; identical to SEQ ID NO: 573729

SEQ ID NO: 670665 - RNA, 64 nt, hsa; identical to SEQ ID NO: 573730

SEQ ID NO: 670666 - RNA, 64 nt, hsa; identical to SEQ ID NO: 573731

SEQ ID NO: 670667 - RNA, 64 nt, hsa; identical to SEQ ID NO: 573732

SEQ ID NO: 670668 - RNA, 64 nt, hsa; identical to SEQ ID NO: 573733

SEQ ID NO: 670669 - RNA, 64 nt, hsa; identical to SEQ ID NO: 573734

SEQ ID NO: 670670 - RNA, 64 nt, hsa; identical to SEQ ID NO: 573735

SEQ ID NO: 670671 - RNA, 64 nt, hsa; identical to SEQ ID NO: 573736

SEQ ID NO: 670672 - RNA, 64 nt, hsa; identical to SEQ ID NO: 573737

SEQ ID NO: 670673 - RNA, 64 nt, hsa; identical to SEQ ID NO: 573738

SEQ ID NO: 670674 - RNA, 64 nt, hsa; identical to SEQ ID NO: 573739

SEQ ID NO: 670675 - RNA, 64 nt, hsa; identical to SEQ ID NO: 573740

SEQ ID NO: 670676 - RNA, 64 nt, hsa; identical to SEQ ID NO: 573741

SEQ ID NO: 670677 - RNA, 64 nt, hsa; identical to SEQ ID NO: 573742

SEQ ID NO: 670678 - RNA, 64 nt, hsa; identical to SEQ ID NO: 573743

SEQ ID NO: 670679 - RNA, 64 nt, hsa; identical to SEQ ID NO: 573744

SEQ ID NO: 670680 - RNA, 64 nt, hsa; identical to SEQ ID NO: 573745

SEQ ID NO: 670681 - RNA, 64 nt, hsa; identical to SEQ ID NO: 573746

SEQ ID NO: 670682 - RNA, 64 nt, hsa; identical to SEQ ID NO: 573747

SEQ ID NO: 670683 - RNA, 64 nt, hsa; identical to SEQ ID NO: 573748

SEQ ID NO: 670684 - RNA, 64 nt, hsa; identical to SEQ ID NO: 573749

SEQ ID NO: 670685 - RNA, 64 nt, hsa; identical to SEQ ID NO: 573750

SEQ ID NO: 670686 - RNA, 64 nt, hsa; identical to SEQ ID NO: 573751

SEQ ID NO: 670687 - RNA, 64 nt, hsa; identical to SEQ ID NO: 573752

SEQ ID NO: 670688 - RNA, 64 nt, hsa; identical to SEQ ID NO: 573753

SEQ ID NO: 670689 - RNA, 64 nt, hsa; identical to SEQ ID NO: 573754

SEQ ID NO: 670690 - RNA, 64 nt, hsa; identical to SEQ ID NO: 573755

SEQ ID NO: 670691 - RNA, 64 nt, hsa; identical to SEQ ID NO: 573756

SEQ ID NO: 670692 - RNA, 64 nt, hsa; identical to SEQ ID NO: 573757

SEQ ID NO: 670693 - RNA, 64 nt, hsa; identical to SEQ ID NO: 573758

SEQ ID NO: 670694 - RNA, 64 nt, hsa; identical to SEQ ID NO: 573759

SEQ ID NO: 670695 - RNA, 64 nt, hsa; identical to SEQ ID NO: 573760

SEQ ID NO: 670696 - RNA, 64 nt, hsa; identical to SEQ ID NO: 573761

SEQ ID NO: 670697 - RNA, 64 nt, hsa; identical to SEQ ID NO: 573762

SEQ ID NO: 670698 - RNA, 64 nt, hsa; identical to SEQ ID NO: 573763

SEQ ID NO: 670699 - RNA, 64 nt, hsa; identical to SEQ ID NO: 573764

SEQ ID NO: 670700 - RNA, 64 nt, hsa; identical to SEQ ID NO: 573765

SEQ ID NO: 670701 - RNA, 64 nt, hsa; identical to SEQ ID NO: 573766

SEQ ID NO: 670702 - RNA, 64 nt, hsa; identical to SEQ ID NO: 573767

SEQ ID NO: 670703 - RNA, 62 nt, hsa
augaagugauccuuaacccccaaguaaucauuaacccccagaccagccucagaacugaagga

SEQ ID NO: 670704 - RNA, 62 nt, hsa
agauccccugaggacuugaugaagugauccuuaacccccaaguaaucauuaacccccagacc

SEQ ID NO: 670705 - RNA, 62 nt, hsa
acaguuuuguuuguuauacucuuugcaccuuaaacccccaccacuccccgacacuauugccu

SEQ ID NO: 670706 - RNA, 62 nt, hsa
ugggcuguaggcaggguccuccauggguuuccaacccccaucacuggcaccaggaucuccca

SEQ ID NO: 670707 - RNA, 62 nt, hsa
acuuguuggugcuaccccuuacuccccucugcaacccccauuuugggaguugaccccagcaa

SEQ ID NO: 670708 - RNA, 62 nt, hsa
gauaugcuggugauucccaaauacauagcuccaacccccaacuucccccagacuuuagaucu

SEQ ID NO: 670709 - RNA, 62 nt, hsa
uaugaguagccuaccacccccucccuuacaguaacccccaccccuucaggaucagucaaggg

SEQ ID NO: 670710 - RNA, 62 nt, hsa
cuacugcaacuaacuguugccccccaaccccgaacccccaguugaggaguugagagagugca

SEQ ID NO: 670711 - RNA, 62 nt, hsa
cagacaaaacaauccccaucagguagcugucuaacccccagcugggucuaauccuucucauu

SEQ ID NO: 670712 - RNA, 62 nt, hsa
cacaugccacugccugcaccuuucggcagaggaacccccaccagacaucacccuuugccuua

SEQ ID NO: 670713 - RNA, 62 nt, hsa
uaccugcacccaggccucagaguuucagggcuaacccccagaauacugguaggggccaaggc

SEQ ID NO: 670714 - RNA, 62 nt, hsa
gggguugaauaugcaaaagcaguuccgcugggaacccccauccaaucaacugcuguacccau

SEQ ID NO: 670715 - RNA, 62 nt, hsa
cucaaaaaaacaaaacaaaaaaacaccaaaaaaacccccaaaccugaagaaauucagauaca

SEQ ID NO: 670716 - RNA, 62 nt, hsa
ccugguuugcgggagauuuccuccccucagucaacccccauaaccuggggauugggcagugu

SEQ ID NO: 670717 - RNA, 62 nt, hsa
ggaguucaagaccagccuguccaacauggugaaacccccaucucuacuaaaaauaccaaaaa

SEQ ID NO: 670718 - RNA, 62 nt, hsa
guugugagacuucuguuugaucacugugaaccaacccccaucucccuagcccaccccccucc

SEQ ID NO: 670719 - RNA, 62 nt, hsa
gggccuaggcagggcugggaugaggcuuguacaacccccaccaccaauuucccagggacucc

SEQ ID NO: 670720 - RNA, 62 nt, hsa
ugaggccaguauccuccagcccucccaaugccaacccccaccccguuucccuggugcccaga

SEQ ID NO: 670721 - RNA, 62 nt, hsa
cccaagucuuccuacccucugcacccucaagaaacccccagugccuuguaugaagcccaccc

SEQ ID NO: 670722 - RNA, 62 nt, hsa
gaggccccauuauuaacagauacucccauaauaacccccaaauacagaccccaugucaccca

SEQ ID NO: 670723 - RNA, 62 nt, hsa
cuccuccuccguccuaucccaacucacccccaaacccccaucccuuccccaccuccagcagu

SEQ ID NO: 670724 - RNA, 62 nt, hsa
gacccccggcccggcccggaacuuuucuccccaacccccaaacccacgacucacuuccacac

SEQ ID NO: 670725 - RNA, 62 nt, hsa
ccugggcuucggaggggggugcuugugccccuaacccccaugcucuugugccuucccccucu

SEQ ID NO: 670726 - RNA, 62 nt, hsa
ugcuccuuuucugggcccuagcacagguggguaacccccacccaacccagcuccugcugcug

SEQ ID NO: 670727 - RNA, 62 nt, hsa
gaagaaagccccagacgcuugguuuuucucagaacccccaaaagaugugcaauagcuguugu

SEQ ID NO: 670728 - RNA, 62 nt, hsa
gacaguaagacaguaaacuauuuuaggaagucaacccccauugcacucuguggcaguuauuc

SEQ ID NO: 670729 - RNA, 64 nt, hsa; identical to SEQ ID NO: 173443

SEQ ID NO: 670730 - RNA, 64 nt, hsa; identical to SEQ ID NO: 173444

SEQ ID NO: 670731 - RNA, 64 nt, hsa; identical to SEQ ID NO: 173445

SEQ ID NO: 670732 - RNA, 64 nt, hsa; identical to SEQ ID NO: 173446

SEQ ID NO: 670733 - RNA, 62 nt, hsa
agacuggcugggagaagguuuaaaaacaaaaaauccaggaguaagagccuuaggucaguuug

SEQ ID NO: 670734 - RNA, 62 nt, hsa
ucucucagcuuuuucaggaggcgugccugggaauccaggaacuuuuugaugcuaauuagaag

SEQ ID NO: 670735 - RNA, 62 nt, hsa
uggaaaccugacaaugcaaaccuguugagaagauccaggagaacaagaugcuaguucccaug

SEQ ID NO: 670736 - RNA, 56 nt, hsa
cuuuuggcauucucuuccagguucugauccaggaugaaaauuuggaggaaaagugg

SEQ ID NO: 670737 - RNA, 62 nt, hsa
uucauuugauucagagcuaaauauucaccauaauccaggagggucuccuuccccacugcaga

SEQ ID NO: 670738 - RNA, 62 nt, hsa
aaaauggauagaaacaaaauucucuaguacucauccaggaaaccauucuucaauguugcaug

SEQ ID NO: 670739 - RNA, 62 nt, hsa
agcuuaaaaagagcucaggcuuuuccaggaagauccaggagggcuaauuagaaaucaacuug

SEQ ID NO: 670740 - RNA, 62 nt, hsa
ucucccacugcaacuugugaacuccaucauucauccaggacugagaugcaaaugucacagua

SEQ ID NO: 670741 - RNA, 62 nt, hsa
ucagugcccagggcgaggaauguggccaggggauccaggaccugggauccagggcccugggc

SEQ ID NO: 670742 - RNA, 62 nt, hsa
cugccgcuacuucucuggggaauguggguuccauccaggauugggggccucucugcucaccc

SEQ ID NO: 670743 - RNA, 62 nt, hsa
gggauugccuuuccccaggaucugugucggccauccaggaagaacuguacuggccaagccug

SEQ ID NO: 670744 - RNA, 62 nt, hsa
aaaggaggccccugagccaugacaaggggcacauccaggauuuccgccacccugaauuuagu

SEQ ID NO: 670745 - RNA, 62 nt, hsa
gaaccaacuuggaaaacacucugcaggauauuauccaggagaacuuccccaaucuagcaagg

SEQ ID NO: 670746 - RNA, 62 nt, hsa
uuagaucaaugagacagaaaguuaacaaggauauccaggaauugaacacagcucugcaccaa

SEQ ID NO: 670747 - RNA, 62 nt, hsa
gagacacaaaaaaaccuucaaaaaauuaauguauccaggagcugguuuuuugaaaggaucaa

SEQ ID NO: 670748 - RNA, 62 nt, hsa
cugauagccaaguaaguuuuaaaaaccaaagcauccaggaugcacaccccugcaccauuugc

SEQ ID NO: 670749 - RNA, 62 nt, hsa
guagccuugacuccuugagacuguagauuucgauccaggaaacauuuauuuagcaccugcca

SEQ ID NO: 670750 - RNA, 62 nt, hsa
ccuccacggcuguguacgccuguugcaaccccauccaggagacauauuuccagcagcuggca

SEQ ID NO: 670751 - RNA, 62 nt, hsa
gacccgcaggcccuuguuauugccucgcuuagauccaggacagagaggaaacaagcuuccca

SEQ ID NO: 670752 - RNA, 62 nt, hsa
ccccaucgccagucgucuucugccacaaugacauccaggaagguaggagaaggcaucugagu

SEQ ID NO: 670753 - RNA, 62 nt, hsa
ccuauucuuugggcuucagguaccuaaaacagauccaggaccugcccccaacuggccucccu

SEQ ID NO: 670754 - RNA, 64 nt, hsa; identical to SEQ ID NO: 358062

SEQ ID NO: 670755 - RNA, 64 nt, hsa; identical to SEQ ID NO: 358063

SEQ ID NO: 670756 - RNA, 64 nt, hsa; identical to SEQ ID NO: 358064

SEQ ID NO: 670757 - RNA, 64 nt, hsa; identical to SEQ ID NO: 358065

SEQ ID NO: 670758 - RNA, 64 nt, hsa; identical to SEQ ID NO: 358066

SEQ ID NO: 670759 - RNA, 64 nt, hsa; identical to SEQ ID NO: 358067

SEQ ID NO: 670760 - RNA, 64 nt, hsa
ugaaauuuggggaaaagugaauaagaagacuaucuaggacaaaaagccaaagccgaaaauagua

SEQ ID NO: 670761 - RNA, 64 nt, hsa
auuguguucauaucauuuucuuggggauuauuuguaggacaaccaaccuggaguuuugccucuc

SEQ ID NO: 670762 - RNA, 64 nt, hsa
uuguuacuuucuuuuuaauaggacaagcaugaguuaggacaaacucuaaaaauucauauucuuc

SEQ ID NO: 670763 - RNA, 64 nt, hsa
aacuuauaguaacacuuuguuacuuucuuuuuaauaggacaagcaugaguuaggacaaacucua

SEQ ID NO: 670764 - RNA, 64 nt, hsa; identical to SEQ ID NO: 126459

SEQ ID NO: 670765 - RNA, 64 nt, hsa; identical to SEQ ID NO: 126460

SEQ ID NO: 670766 - RNA, 64 nt, hsa; identical to SEQ ID NO: 126461

SEQ ID NO: 670767 - RNA, 64 nt, hsa; identical to SEQ ID NO: 126462

SEQ ID NO: 670768 - RNA, 64 nt, hsa; identical to SEQ ID NO: 126463

SEQ ID NO: 670769 - RNA, 64 nt, hsa; identical to SEQ ID NO: 126464

SEQ ID NO: 670770 - RNA, 64 nt, hsa; identical to SEQ ID NO: 126465

SEQ ID NO: 670771 - RNA, 60 nt, hsa; identical to SEQ ID NO: 126466

SEQ ID NO: 670772 - RNA, 64 nt, hsa; identical to SEQ ID NO: 126467

SEQ ID NO: 670773 - RNA, 64 nt, hsa; identical to SEQ ID NO: 126468

SEQ ID NO: 670774 - RNA, 64 nt, hsa; identical to SEQ ID NO: 126469

SEQ ID NO: 670775 - RNA, 64 nt, hsa; identical to SEQ ID NO: 126470

SEQ ID NO: 670776 - RNA, 64 nt, hsa; identical to SEQ ID NO: 126471

SEQ ID NO: 670777 - RNA, 64 nt, hsa; identical to SEQ ID NO: 126472

SEQ ID NO: 670778 - RNA, 64 nt, hsa; identical to SEQ ID NO: 126473

SEQ ID NO: 670779 - RNA, 64 nt, hsa; identical to SEQ ID NO: 126474

SEQ ID NO: 670780 - RNA, 64 nt, hsa; identical to SEQ ID NO: 126475

SEQ ID NO: 670781 - RNA, 64 nt, hsa; identical to SEQ ID NO: 126476

SEQ ID NO: 670782 - RNA, 64 nt, hsa; identical to SEQ ID NO: 126477

SEQ ID NO: 670783 - RNA, 64 nt, hsa; identical to SEQ ID NO: 126478

SEQ ID NO: 670784 - RNA, 64 nt, hsa; identical to SEQ ID NO: 126479

SEQ ID NO: 670785 - RNA, 64 nt, hsa; identical to SEQ ID NO: 126480

SEQ ID NO: 670786 - RNA, 64 nt, hsa; identical to SEQ ID NO: 126481

SEQ ID NO: 670787 - RNA, 64 nt, hsa; identical to SEQ ID NO: 126482

SEQ ID NO: 670788 - RNA, 64 nt, hsa; identical to SEQ ID NO: 126483

SEQ ID NO: 670789 - RNA, 64 nt, hsa; identical to SEQ ID NO: 126484

SEQ ID NO: 670790 - RNA, 64 nt, hsa; identical to SEQ ID NO: 126485

SEQ ID NO: 670791 - RNA, 64 nt, hsa; identical to SEQ ID NO: 126486

SEQ ID NO: 670792 - RNA, 64 nt, hsa; identical to SEQ ID NO: 126487

SEQ ID NO: 670793 - RNA, 64 nt, hsa; identical to SEQ ID NO: 126488

SEQ ID NO: 670794 - RNA, 64 nt, hsa; identical to SEQ ID NO: 126489

SEQ ID NO: 670795 - RNA, 64 nt, hsa; identical to SEQ ID NO: 126490

SEQ ID NO: 670796 - RNA, 64 nt, hsa; identical to SEQ ID NO: 126491

SEQ ID NO: 670797 - RNA, 64 nt, hsa; identical to SEQ ID NO: 126492

SEQ ID NO: 670798 - RNA, 64 nt, hsa; identical to SEQ ID NO: 126493

SEQ ID NO: 670799 - RNA, 64 nt, hsa; identical to SEQ ID NO: 126494

SEQ ID NO: 670800 - RNA, 64 nt, hsa; identical to SEQ ID NO: 126495

SEQ ID NO: 670801 - RNA, 64 nt, hsa; identical to SEQ ID NO: 126496

SEQ ID NO: 670802 - RNA, 64 nt, hsa; identical to SEQ ID NO: 126497

SEQ ID NO: 670803 - RNA, 64 nt, hsa; identical to SEQ ID NO: 126498

SEQ ID NO: 670804 - RNA, 64 nt, hsa; identical to SEQ ID NO: 126499

SEQ ID NO: 670805 - RNA, 64 nt, hsa; identical to SEQ ID NO: 126500

SEQ ID NO: 670806 - RNA, 64 nt, hsa; identical to SEQ ID NO: 126501

SEQ ID NO: 670807 - RNA, 56 nt, hsa; identical to SEQ ID NO: 126502

SEQ ID NO: 670808 - RNA, 64 nt, hsa; identical to SEQ ID NO: 126460

SEQ ID NO: 670809 - RNA, 64 nt, hsa; identical to SEQ ID NO: 126504

SEQ ID NO: 670810 - RNA, 64 nt, hsa; identical to SEQ ID NO: 126505

SEQ ID NO: 670811 - RNA, 64 nt, hsa; identical to SEQ ID NO: 126506

SEQ ID NO: 670812 - RNA, 64 nt, hsa; identical to SEQ ID NO: 126507

SEQ ID NO: 670813 - RNA, 64 nt, hsa; identical to SEQ ID NO: 126508

SEQ ID NO: 670814 - RNA, 64 nt, hsa; identical to SEQ ID NO: 126509

SEQ ID NO: 670815 - RNA, 64 nt, hsa; identical to SEQ ID NO: 126510

SEQ ID NO: 670816 - RNA, 64 nt, hsa; identical to SEQ ID NO: 126511

SEQ ID NO: 670817 - RNA, 64 nt, hsa; identical to SEQ ID NO: 126512

SEQ ID NO: 670818 - RNA, 64 nt, hsa; identical to SEQ ID NO: 126513

SEQ ID NO: 670819 - RNA, 64 nt, hsa; identical to SEQ ID NO: 126514

SEQ ID NO: 670820 - RNA, 64 nt, hsa; identical to SEQ ID NO: 126515

SEQ ID NO: 670821 - RNA, 64 nt, hsa; identical to SEQ ID NO: 126516

SEQ ID NO: 670822 - RNA, 64 nt, hsa; identical to SEQ ID NO: 126517

SEQ ID NO: 670823 - RNA, 64 nt, hsa; identical to SEQ ID NO: 84890

SEQ ID NO: 670824 - RNA, 64 nt, hsa; identical to SEQ ID NO: 84891

SEQ ID NO: 670825 - RNA, 64 nt, hsa; identical to SEQ ID NO: 84892

SEQ ID NO: 670826 - RNA, 64 nt, hsa; identical to SEQ ID NO: 84893

SEQ ID NO: 670827 - RNA, 64 nt, hsa; identical to SEQ ID NO: 84894

SEQ ID NO: 670828 - RNA, 64 nt, hsa; identical to SEQ ID NO: 84895

SEQ ID NO: 670829 - RNA, 64 nt, hsa; identical to SEQ ID NO: 84896

SEQ ID NO: 670830 - RNA, 64 nt, hsa; identical to SEQ ID NO: 84897

SEQ ID NO: 670831 - RNA, 64 nt, hsa; identical to SEQ ID NO: 84898

SEQ ID NO: 670832 - RNA, 64 nt, hsa; identical to SEQ ID NO: 84899

SEQ ID NO: 670833 - RNA, 64 nt, hsa; identical to SEQ ID NO: 84900

SEQ ID NO: 670834 - RNA, 64 nt, hsa; identical to SEQ ID NO: 84901

SEQ ID NO: 670835 - RNA, 64 nt, hsa; identical to SEQ ID NO: 84902

SEQ ID NO: 670836 - RNA, 64 nt, hsa; identical to SEQ ID NO: 84903

SEQ ID NO: 670837 - RNA, 64 nt, hsa; identical to SEQ ID NO: 84904

SEQ ID NO: 670838 - RNA, 64 nt, hsa; identical to SEQ ID NO: 84905

SEQ ID NO: 670839 - RNA, 52 nt, hsa; identical to SEQ ID NO: 84906

SEQ ID NO: 670840 - RNA, 64 nt, hsa; identical to SEQ ID NO: 84907

SEQ ID NO: 670841 - RNA, 64 nt, hsa; identical to SEQ ID NO: 84908

SEQ ID NO: 670842 - RNA, 64 nt, hsa; identical to SEQ ID NO: 84909

SEQ ID NO: 670843 - RNA, 64 nt, hsa; identical to SEQ ID NO: 84910

SEQ ID NO: 670844 - RNA, 64 nt, hsa; identical to SEQ ID NO: 84911

SEQ ID NO: 670845 - RNA, 64 nt, hsa; identical to SEQ ID NO: 84912

SEQ ID NO: 670846 - RNA, 64 nt, hsa; identical to SEQ ID NO: 84913

SEQ ID NO: 670847 - RNA, 64 nt, hsa; identical to SEQ ID NO: 84914

SEQ ID NO: 670848 - RNA, 64 nt, hsa; identical to SEQ ID NO: 84915

SEQ ID NO: 670849 - RNA, 64 nt, hsa; identical to SEQ ID NO: 84916

SEQ ID NO: 670850 - RNA, 64 nt, hsa; identical to SEQ ID NO: 84917

SEQ ID NO: 670851 - RNA, 64 nt, hsa; identical to SEQ ID NO: 84918

SEQ ID NO: 670852 - RNA, 64 nt, hsa; identical to SEQ ID NO: 84919

SEQ ID NO: 670853 - RNA, 64 nt, hsa; identical to SEQ ID NO: 84920

SEQ ID NO: 670854 - RNA, 64 nt, hsa; identical to SEQ ID NO: 84921

SEQ ID NO: 670855 - RNA, 64 nt, hsa; identical to SEQ ID NO: 84922

SEQ ID NO: 670856 - RNA, 64 nt, hsa; identical to SEQ ID NO: 84923

SEQ ID NO: 670857 - RNA, 64 nt, hsa; identical to SEQ ID NO: 84924

SEQ ID NO: 670858 - RNA, 64 nt, hsa; identical to SEQ ID NO: 84925

SEQ ID NO: 670859 - RNA, 64 nt, hsa; identical to SEQ ID NO: 84926

SEQ ID NO: 670860 - RNA, 64 nt, hsa; identical to SEQ ID NO: 84927

SEQ ID NO: 670861 - RNA, 64 nt, hsa; identical to SEQ ID NO: 84928

SEQ ID NO: 670862 - RNA, 64 nt, hsa; identical to SEQ ID NO: 84929

SEQ ID NO: 670863 - RNA, 64 nt, hsa; identical to SEQ ID NO: 84930

SEQ ID NO: 670864 - RNA, 64 nt, hsa; identical to SEQ ID NO: 84931

SEQ ID NO: 670865 - RNA, 64 nt, hsa; identical to SEQ ID NO: 84932

SEQ ID NO: 670866 - RNA, 64 nt, hsa; identical to SEQ ID NO: 84933

SEQ ID NO: 670867 - RNA, 64 nt, hsa; identical to SEQ ID NO: 84934

SEQ ID NO: 670868 - RNA, 64 nt, hsa; identical to SEQ ID NO: 84935

SEQ ID NO: 670869 - RNA, 64 nt, hsa; identical to SEQ ID NO: 84936

SEQ ID NO: 670870 - RNA, 64 nt, hsa; identical to SEQ ID NO: 84937

SEQ ID NO: 670871 - RNA, 64 nt, hsa; identical to SEQ ID NO: 84938

SEQ ID NO: 670872 - RNA, 64 nt, hsa; identical to SEQ ID NO: 84939

SEQ ID NO: 670873 - RNA, 64 nt, hsa; identical to SEQ ID NO: 84940

SEQ ID NO: 670874 - RNA, 64 nt, hsa; identical to SEQ ID NO: 84941

SEQ ID NO: 670875 - RNA, 64 nt, hsa; identical to SEQ ID NO: 84942

SEQ ID NO: 670876 - RNA, 64 nt, hsa; identical to SEQ ID NO: 84943

SEQ ID NO: 670877 - RNA, 64 nt, hsa; identical to SEQ ID NO: 84944

SEQ ID NO: 670878 - RNA, 64 nt, hsa; identical to SEQ ID NO: 84945

SEQ ID NO: 670879 - RNA, 64 nt, hsa; identical to SEQ ID NO: 84946

SEQ ID NO: 670880 - RNA, 64 nt, hsa; identical to SEQ ID NO: 84947

SEQ ID NO: 670881 - RNA, 64 nt, hsa; identical to SEQ ID NO: 84948

SEQ ID NO: 670882 - RNA, 64 nt, hsa; identical to SEQ ID NO: 84949

SEQ ID NO: 670883 - RNA, 64 nt, hsa; identical to SEQ ID NO: 84950

SEQ ID NO: 670884 - RNA, 64 nt, hsa; identical to SEQ ID NO: 84951

SEQ ID NO: 670885 - RNA, 64 nt, hsa; identical to SEQ ID NO: 84952

SEQ ID NO: 670886 - RNA, 64 nt, hsa; identical to SEQ ID NO: 84953

SEQ ID NO: 670887 - RNA, 64 nt, hsa; identical to SEQ ID NO: 84954

SEQ ID NO: 670888 - RNA, 64 nt, hsa; identical to SEQ ID NO: 84955

SEQ ID NO: 670889 - RNA, 64 nt, hsa; identical to SEQ ID NO: 84956

SEQ ID NO: 670890 - RNA, 64 nt, hsa; identical to SEQ ID NO: 84957

SEQ ID NO: 670891 - RNA, 64 nt, hsa; identical to SEQ ID NO: 84958

SEQ ID NO: 670892 - RNA, 64 nt, hsa; identical to SEQ ID NO: 84959

SEQ ID NO: 670893 - RNA, 64 nt, hsa; identical to SEQ ID NO: 84960

SEQ ID NO: 670894 - RNA, 64 nt, hsa; identical to SEQ ID NO: 84961

SEQ ID NO: 670895 - RNA, 64 nt, hsa; identical to SEQ ID NO: 84962

SEQ ID NO: 670896 - RNA, 64 nt, hsa; identical to SEQ ID NO: 84963

SEQ ID NO: 670897 - RNA, 64 nt, hsa; identical to SEQ ID NO: 84964

SEQ ID NO: 670898 - RNA, 64 nt, hsa; identical to SEQ ID NO: 84965

SEQ ID NO: 670899 - RNA, 64 nt, hsa; identical to SEQ ID NO: 84966

SEQ ID NO: 670900 - RNA, 64 nt, hsa; identical to SEQ ID NO: 84967

SEQ ID NO: 670901 - RNA, 64 nt, hsa; identical to SEQ ID NO: 84968

SEQ ID NO: 670902 - RNA, 64 nt, hsa; identical to SEQ ID NO: 84969

SEQ ID NO: 670903 - RNA, 64 nt, hsa; identical to SEQ ID NO: 84970

SEQ ID NO: 670904 - RNA, 64 nt, hsa; identical to SEQ ID NO: 84971

SEQ ID NO: 670905 - RNA, 64 nt, hsa; identical to SEQ ID NO: 84972

SEQ ID NO: 670906 - RNA, 58 nt, hsa; identical to SEQ ID NO: 84973

SEQ ID NO: 670907 - RNA, 64 nt, hsa; identical to SEQ ID NO: 84974

SEQ ID NO: 670908 - RNA, 64 nt, hsa; identical to SEQ ID NO: 84975

SEQ ID NO: 670909 - RNA, 64 nt, hsa; identical to SEQ ID NO: 84976

SEQ ID NO: 670910 - RNA, 64 nt, hsa; identical to SEQ ID NO: 84977

SEQ ID NO: 670911 - RNA, 64 nt, hsa; identical to SEQ ID NO: 84978

SEQ ID NO: 670912 - RNA, 64 nt, hsa; identical to SEQ ID NO: 84979

SEQ ID NO: 670913 - RNA, 64 nt, hsa; identical to SEQ ID NO: 84980

SEQ ID NO: 670914 - RNA, 64 nt, hsa; identical to SEQ ID NO: 84981

SEQ ID NO: 670915 - RNA, 64 nt, hsa; identical to SEQ ID NO: 84982

SEQ ID NO: 670916 - RNA, 64 nt, hsa; identical to SEQ ID NO: 84983

SEQ ID NO: 670917 - RNA, 64 nt, hsa; identical to SEQ ID NO: 84984

SEQ ID NO: 670918 - RNA, 64 nt, hsa; identical to SEQ ID NO: 84985

SEQ ID NO: 670919 - RNA, 64 nt, hsa; identical to SEQ ID NO: 84986

SEQ ID NO: 670920 - RNA, 64 nt, hsa; identical to SEQ ID NO: 84987

SEQ ID NO: 670921 - RNA, 64 nt, hsa; identical to SEQ ID NO: 84988

SEQ ID NO: 670922 - RNA, 64 nt, hsa; identical to SEQ ID NO: 84989

SEQ ID NO: 670923 - RNA, 64 nt, hsa; identical to SEQ ID NO: 84990

SEQ ID NO: 670924 - RNA, 64 nt, hsa; identical to SEQ ID NO: 84991

SEQ ID NO: 670925 - RNA, 64 nt, hsa; identical to SEQ ID NO: 84992

SEQ ID NO: 670926 - RNA, 64 nt, hsa; identical to SEQ ID NO: 84993

SEQ ID NO: 670927 - RNA, 64 nt, hsa; identical to SEQ ID NO: 84994

SEQ ID NO: 670928 - RNA, 64 nt, hsa; identical to SEQ ID NO: 84995

SEQ ID NO: 670929 - RNA, 64 nt, hsa; identical to SEQ ID NO: 84996

SEQ ID NO: 670930 - RNA, 64 nt, hsa; identical to SEQ ID NO: 84997

SEQ ID NO: 670931 - RNA, 64 nt, hsa; identical to SEQ ID NO: 84998

SEQ ID NO: 670932 - RNA, 64 nt, hsa; identical to SEQ ID NO: 84999

SEQ ID NO: 670933 - RNA, 64 nt, hsa; identical to SEQ ID NO: 85000

SEQ ID NO: 670934 - RNA, 64 nt, hsa; identical to SEQ ID NO: 85001

SEQ ID NO: 670935 - RNA, 64 nt, hsa; identical to SEQ ID NO: 85002

SEQ ID NO: 670936 - RNA, 64 nt, hsa; identical to SEQ ID NO: 85003

SEQ ID NO: 670937 - RNA, 64 nt, hsa; identical to SEQ ID NO: 415481

SEQ ID NO: 670938 - RNA, 64 nt, hsa; identical to SEQ ID NO: 415482

SEQ ID NO: 670939 - RNA, 64 nt, hsa; identical to SEQ ID NO: 415483

SEQ ID NO: 670940 - RNA, 64 nt, hsa; identical to SEQ ID NO: 415484

SEQ ID NO: 670941 - RNA, 64 nt, hsa; identical to SEQ ID NO: 415485

SEQ ID NO: 670942 - RNA, 64 nt, hsa; identical to SEQ ID NO: 415486

SEQ ID NO: 670943 - RNA, 64 nt, hsa; identical to SEQ ID NO: 415487

SEQ ID NO: 670944 - RNA, 64 nt, hsa; identical to SEQ ID NO: 415488

SEQ ID NO: 670945 - RNA, 64 nt, hsa; identical to SEQ ID NO: 415489

SEQ ID NO: 670946 - RNA, 64 nt, hsa; identical to SEQ ID NO: 415490

SEQ ID NO: 670947 - RNA, 64 nt, hsa; identical to SEQ ID NO: 415491

SEQ ID NO: 670948 - RNA, 64 nt, hsa; identical to SEQ ID NO: 415492

SEQ ID NO: 670949 - RNA, 64 nt, hsa; identical to SEQ ID NO: 415493

SEQ ID NO: 670950 - RNA, 64 nt, hsa; identical to SEQ ID NO: 415494

SEQ ID NO: 670951 - RNA, 64 nt, hsa; identical to SEQ ID NO: 415495

SEQ ID NO: 670952 - RNA, 64 nt, hsa; identical to SEQ ID NO: 415496

SEQ ID NO: 670953 - RNA, 64 nt, hsa; identical to SEQ ID NO: 415497

SEQ ID NO: 670954 - RNA, 64 nt, hsa; identical to SEQ ID NO: 415498

SEQ ID NO: 670955 - RNA, 64 nt, hsa; identical to SEQ ID NO: 415499

SEQ ID NO: 670956 - RNA, 64 nt, hsa; identical to SEQ ID NO: 415500

SEQ ID NO: 670957 - RNA, 64 nt, hsa; identical to SEQ ID NO: 415501

SEQ ID NO: 670958 - RNA, 64 nt, hsa; identical to SEQ ID NO: 415502

SEQ ID NO: 670959 - RNA, 58 nt, hsa; identical to SEQ ID NO: 415503

SEQ ID NO: 670960 - RNA, 64 nt, hsa; identical to SEQ ID NO: 415504

SEQ ID NO: 670961 - RNA, 64 nt, hsa; identical to SEQ ID NO: 415505

SEQ ID NO: 670962 - RNA, 64 nt, hsa; identical to SEQ ID NO: 415506

SEQ ID NO: 670963 - RNA, 64 nt, hsa; identical to SEQ ID NO: 415507

SEQ ID NO: 670964 - RNA, 64 nt, hsa; identical to SEQ ID NO: 415508

SEQ ID NO: 670965 - RNA, 64 nt, hsa; identical to SEQ ID NO: 415509

SEQ ID NO: 670966 - RNA, 64 nt, hsa; identical to SEQ ID NO: 415510

SEQ ID NO: 670967 - RNA, 64 nt, hsa; identical to SEQ ID NO: 415511

SEQ ID NO: 670968 - RNA, 64 nt, hsa; identical to SEQ ID NO: 415512

SEQ ID NO: 670969 - RNA, 63 nt, hsa; identical to SEQ ID NO: 415513

SEQ ID NO: 670970 - RNA, 64 nt, hsa; identical to SEQ ID NO: 415514

SEQ ID NO: 670971 - RNA, 64 nt, hsa; identical to SEQ ID NO: 415515

SEQ ID NO: 670972 - RNA, 64 nt, hsa; identical to SEQ ID NO: 415516

SEQ ID NO: 670973 - RNA, 64 nt, hsa; identical to SEQ ID NO: 415517

SEQ ID NO: 670974 - RNA, 64 nt, hsa; identical to SEQ ID NO: 415518

SEQ ID NO: 670975 - RNA, 64 nt, hsa; identical to SEQ ID NO: 415519

SEQ ID NO: 670976 - RNA, 64 nt, hsa; identical to SEQ ID NO: 415520

SEQ ID NO: 670977 - RNA, 64 nt, hsa; identical to SEQ ID NO: 415521

SEQ ID NO: 670978 - RNA, 57 nt, hsa; identical to SEQ ID NO: 415522

SEQ ID NO: 670979 - RNA, 64 nt, hsa; identical to SEQ ID NO: 415523

SEQ ID NO: 670980 - RNA, 64 nt, hsa; identical to SEQ ID NO: 415524

SEQ ID NO: 670981 - RNA, 64 nt, hsa; identical to SEQ ID NO: 415525

SEQ ID NO: 670982 - RNA, 63 nt, hsa
aucuuuuuauggguggagcagagagucaaucccugcagccacccugcagccagccaucucugc

SEQ ID NO: 670983 - RNA, 63 nt, hsa
gguggagcagagagucaaucccugcagccacccugcagccagccaucucugcaguucucucag

SEQ ID NO: 670984 - RNA, 63 nt, hsa
cugccucaucccaaagaucagguaugggcugaaugcagccaucugagcaagggcugagggaag

SEQ ID NO: 670985 - RNA, 63 nt, hsa
cuugcauggaugcaguugugacucuggggacaaugcagccagaagcugagggaccagcacuug

SEQ ID NO: 670986 - RNA, 63 nt, hsa
ugcuuuauugccaaagggcuaguuucgguuuucugcagccauugcgguuaaaaaauauaagua

SEQ ID NO: 670987 - RNA, 63 nt, hsa
aacugaauagauuagaaugggugacaaaugcagugcagccaguguuuccauuaugcaacuugu

SEQ ID NO: 670988 - RNA, 63 nt, hsa
agccagacaccuuguacugggcacgcgucagacugcagccaguccguuuccuuucuuuagcca

SEQ ID NO: 670989 - RNA, 63 nt, hsa
acagcgcgguggcugggucugcacacuggccucugcagccagauuucuauauugggaguuuuu

SEQ ID NO: 670990 - RNA, 63 nt, hsa
uggcggaucuagugaccagauauauagaaggacugcagccacugauucucucuuguccuucac

SEQ ID NO: 670991 - RNA, 63 nt, hsa
gcaaagccagaaaaagaucuuucauuuugcaccugcagccaagcaaaugccugccaaauuuua

SEQ ID NO: 670992 - RNA, 63 nt, hsa
uucugcagagaaaauguccccccacccgccaucugcagccaggugugugccacacggcagccu

SEQ ID NO: 670993 - RNA, 63 nt, hsa
cucccacccacuuccaucacccauccaauaaaaugcagccagguuuagccuuuggcuuugguc

SEQ ID NO: 670994 - RNA, 63 nt, hsa
cgguuaguccauaaucuagagccauuguggaacugcagccaugagguguguuuaucccacagu

SEQ ID NO: 670995 - RNA, 63 nt, hsa
uuuccaccuuucacauccaaggggugggucaagugcagccagcaauuuauuuucauuguuggc

SEQ ID NO: 670996 - RNA, 63 nt, hsa
ggacucgcugauccugggccgcagccuggggugugcagccaucucauucugugaaugugccaa

SEQ ID NO: 670997 - RNA, 63 nt, hsa
cuggaggccggcuuaguucuuccauuucacccuugcagccagcuguuggccacggccccugcc

SEQ ID NO: 670998 - RNA, 63 nt, hsa
uggccuugcuggaggcacagggcucugcggaccugcagccaucugugaggcccgcggggaugg

SEQ ID NO: 670999 - RNA, 63 nt, hsa
gcaaaagacccaacgccaacaccuggugccuucugcagccagcgcccacccauccgugcccgg

SEQ ID NO: 671000 - RNA, 63 nt, hsa
aagagauacauacucucuucaaagagcaugagaugcagccauucuuucagcaaagcuucauug

SEQ ID NO: 671001 - RNA, 63 nt, hsa
gcaggugaaacccagucacugugagcucccaggugcagccagaggcaccucaagaagaagagg

SEQ ID NO: 671002 - RNA, 63 nt, hsa
gucucuuauuuaucugcagaaggaacuuuggggugcagccaggacccgguaggccugagccuc

SEQ ID NO: 671003 - RNA, 63 nt, hsa
uccuggagugaguuuccauuuccagcuggaaucugcagccacccccauuuccuguuuuccauu

SEQ ID NO: 671004 - RNA, 63 nt, hsa
ccagcucuaugucugugucugaauuguggaucgugcagccaugguuauuguggaacuguggaa

SEQ ID NO: 671005 - RNA, 63 nt, hsa
gugcagccaugguuauuguggaacuguggaaccugcagccauaguuauuugacuauaucuuga

SEQ ID NO: 671006 - RNA, 63 nt, hsa
ccugcacauuccagaagcccucaugggaagggaugcagccaggcagacuccugccagaugggg

SEQ ID NO: 671007 - RNA, 63 nt, hsa
ccaagaacuuaccuucagaacauacucuaauaaugcagccaggagccgucagccagaucccaa

SEQ ID NO: 671008 - RNA, 63 nt, hsa
guuccugggaaagggguauguuuucucuccaggugcagccagaucucacaaaguacaaaacga

SEQ ID NO: 671009 - RNA, 63 nt, hsa
cacuuguuccuucaucuacauguuuuguucauuugcagccaguuuuuacugaguuuguggcaa

SEQ ID NO: 671010 - RNA, 63 nt, hsa
gccacaugccuagacuuauauacuaguuaguggugcagccagggagaggacucagauuuccug

SEQ ID NO: 671011 - RNA, 63 nt, hsa
caaagucuaucucugaaacuccaugaagacuuuugcagccaguucccaccaauaugccccaga

SEQ ID NO: 671012 - RNA, 63 nt, hsa
cuacuagaugugaacuugaagaagguugucagcugcagccacuuucugccagcaucugcagcc

SEQ ID NO: 671013 - RNA, 63 nt, hsa
gguugucagcugcagccacuuucugccagcaucugcagccacuuucugccagcaucugcagcc

SEQ ID NO: 671014 - RNA, 63 nt, hsa
ugccagcaucugcagccacuuucugccagcaucugcagccagcaagcugggacuggcaggaaa

SEQ ID NO: 671015 - RNA, 63 nt, hsa
gcagugugccgggccuccguugcaccucugaccugcagccacgucaucguugcgcagccccug

SEQ ID NO: 671016 - RNA, 63 nt, hsa
gcccuuugugcagugaacagcccuggcugggggugcagccagucguguccgaacucuccaaug

SEQ ID NO: 671017 - RNA, 63 nt, hsa
aucaaugaaaaaaaaaaaaaaaaagaccagcuuugcagccagaagccagaggauacccaggga

SEQ ID NO: 671018 - RNA, 63 nt, hsa
cuacugccugacguugucagucaagaccagccuugcagccaggugcaguggcucacaccugug

SEQ ID NO: 671019 - RNA, 63 nt, hsa
cuuacacugggcacauggaggagacguccacccugcagccaggacugggguucacgucacugc

SEQ ID NO: 671020 - RNA, 63 nt, hsa
ccucgcucuccuaaguuuaauuacaacagcacgugcagccacgucagccaaaugacuucauuu

SEQ ID NO: 671021 - RNA, 63 nt, hsa
acaagcccugggauuggacaaaagggcccaugcugcagccacugacugggggcagagcucugg

SEQ ID NO: 671022 - RNA, 63 nt, hsa
uauucaggugccauguggccuucacugcagcccugcagccacccacgcaccaucugugggucu

SEQ ID NO: 671023 - RNA, 63 nt, hsa
aucuuuaagaauccgccagcacuugguagcgucugcagccacccagguagcauacgcucuuug

SEQ ID NO: 671024 - RNA, 64 nt, hsa; identical to SEQ ID NO: 155629

SEQ ID NO: 671025 - RNA, 64 nt, hsa; identical to SEQ ID NO: 155630

SEQ ID NO: 671026 - RNA, 64 nt, hsa; identical to SEQ ID NO: 155631

SEQ ID NO: 671027 - RNA, 64 nt, hsa; identical to SEQ ID NO: 155632

SEQ ID NO: 671028 - RNA, 64 nt, hsa; identical to SEQ ID NO: 155633

SEQ ID NO: 671029 - RNA, 64 nt, hsa; identical to SEQ ID NO: 155634

SEQ ID NO: 671030 - RNA, 64 nt, hsa; identical to SEQ ID NO: 155635

SEQ ID NO: 671031 - RNA, 64 nt, hsa; identical to SEQ ID NO: 155636

SEQ ID NO: 671032 - RNA, 64 nt, hsa; identical to SEQ ID NO: 155637

SEQ ID NO: 671033 - RNA, 64 nt, hsa; identical to SEQ ID NO: 155638

SEQ ID NO: 671034 - RNA, 64 nt, hsa; identical to SEQ ID NO: 155639

SEQ ID NO: 671035 - RNA, 64 nt, hsa; identical to SEQ ID NO: 155640

SEQ ID NO: 671036 - RNA, 64 nt, hsa; identical to SEQ ID NO: 155641

SEQ ID NO: 671037 - RNA, 64 nt, hsa; identical to SEQ ID NO: 155642

SEQ ID NO: 671038 - RNA, 64 nt, hsa; identical to SEQ ID NO: 155643

SEQ ID NO: 671039 - RNA, 64 nt, hsa; identical to SEQ ID NO: 155644

SEQ ID NO: 671040 - RNA, 64 nt, hsa; identical to SEQ ID NO: 155645

SEQ ID NO: 671041 - RNA, 64 nt, hsa; identical to SEQ ID NO: 155646

SEQ ID NO: 671042 - RNA, 64 nt, hsa; identical to SEQ ID NO: 155647

SEQ ID NO: 671043 - RNA, 64 nt, hsa; identical to SEQ ID NO: 155648

SEQ ID NO: 671044 - RNA, 64 nt, hsa; identical to SEQ ID NO: 155649

SEQ ID NO: 671045 - RNA, 64 nt, hsa; identical to SEQ ID NO: 155650

SEQ ID NO: 671046 - RNA, 64 nt, hsa; identical to SEQ ID NO: 155651

SEQ ID NO: 671047 - RNA, 64 nt, hsa; identical to SEQ ID NO: 155652

SEQ ID NO: 671048 - RNA, 64 nt, hsa; identical to SEQ ID NO: 155653

SEQ ID NO: 671049 - RNA, 64 nt, hsa; identical to SEQ ID NO: 155654

SEQ ID NO: 671050 - RNA, 64 nt, hsa; identical to SEQ ID NO: 155655

SEQ ID NO: 671051 - RNA, 64 nt, hsa; identical to SEQ ID NO: 155656

SEQ ID NO: 671052 - RNA, 64 nt, hsa; identical to SEQ ID NO: 155657

SEQ ID NO: 671053 - RNA, 64 nt, hsa; identical to SEQ ID NO: 155658

SEQ ID NO: 671054 - RNA, 64 nt, hsa; identical to SEQ ID NO: 155659

SEQ ID NO: 671055 - RNA, 64 nt, hsa; identical to SEQ ID NO: 155660

SEQ ID NO: 671056 - RNA, 64 nt, hsa; identical to SEQ ID NO: 155661

SEQ ID NO: 671057 - RNA, 64 nt, hsa; identical to SEQ ID NO: 155662

SEQ ID NO: 671058 - RNA, 64 nt, hsa; identical to SEQ ID NO: 155663

SEQ ID NO: 671059 - RNA, 64 nt, hsa; identical to SEQ ID NO: 155664

SEQ ID NO: 671060 - RNA, 64 nt, hsa; identical to SEQ ID NO: 155665

SEQ ID NO: 671061 - RNA, 64 nt, hsa; identical to SEQ ID NO: 155666

SEQ ID NO: 671062 - RNA, 64 nt, hsa; identical to SEQ ID NO: 155667

SEQ ID NO: 671063 - RNA, 64 nt, hsa; identical to SEQ ID NO: 155668

SEQ ID NO: 671064 - RNA, 64 nt, hsa; identical to SEQ ID NO: 155669

SEQ ID NO: 671065 - RNA, 64 nt, hsa; identical to SEQ ID NO: 155670

SEQ ID NO: 671066 - RNA, 64 nt, hsa; identical to SEQ ID NO: 155671

SEQ ID NO: 671067 - RNA, 64 nt, hsa; identical to SEQ ID NO: 155672

SEQ ID NO: 671068 - RNA, 64 nt, hsa; identical to SEQ ID NO: 155673

SEQ ID NO: 671069 - RNA, 64 nt, hsa; identical to SEQ ID NO: 155674

SEQ ID NO: 671070 - RNA, 64 nt, hsa; identical to SEQ ID NO: 155675

SEQ ID NO: 671071 - RNA, 64 nt, hsa; identical to SEQ ID NO: 155676

SEQ ID NO: 671072 - RNA, 64 nt, hsa; identical to SEQ ID NO: 155677

SEQ ID NO: 671073 - RNA, 64 nt, hsa; identical to SEQ ID NO: 155678

SEQ ID NO: 671074 - RNA, 64 nt, hsa; identical to SEQ ID NO: 155679

SEQ ID NO: 671075 - RNA, 64 nt, hsa; identical to SEQ ID NO: 155680

SEQ ID NO: 671076 - RNA, 64 nt, hsa; identical to SEQ ID NO: 155681

SEQ ID NO: 671077 - RNA, 64 nt, hsa; identical to SEQ ID NO: 155682

SEQ ID NO: 671078 - RNA, 64 nt, hsa; identical to SEQ ID NO: 155683

SEQ ID NO: 671079 - RNA, 64 nt, hsa; identical to SEQ ID NO: 155684

SEQ ID NO: 671080 - RNA, 64 nt, hsa; identical to SEQ ID NO: 155685

SEQ ID NO: 671081 - RNA, 64 nt, hsa; identical to SEQ ID NO: 155686

SEQ ID NO: 671082 - RNA, 64 nt, hsa; identical to SEQ ID NO: 155687

SEQ ID NO: 671083 - RNA, 64 nt, hsa; identical to SEQ ID NO: 155688

SEQ ID NO: 671084 - RNA, 64 nt, hsa; identical to SEQ ID NO: 155689

SEQ ID NO: 671085 - RNA, 64 nt, hsa; identical to SEQ ID NO: 155690

SEQ ID NO: 671086 - RNA, 64 nt, hsa; identical to SEQ ID NO: 155691

SEQ ID NO: 671087 - RNA, 64 nt, hsa; identical to SEQ ID NO: 155692

SEQ ID NO: 671088 - RNA, 64 nt, hsa; identical to SEQ ID NO: 155693

SEQ ID NO: 671089 - RNA, 64 nt, hsa; identical to SEQ ID NO: 155694

SEQ ID NO: 671090 - RNA, 64 nt, hsa; identical to SEQ ID NO: 155695

SEQ ID NO: 671091 - RNA, 64 nt, hsa; identical to SEQ ID NO: 155696

SEQ ID NO: 671092 - RNA, 64 nt, hsa; identical to SEQ ID NO: 155697

SEQ ID NO: 671093 - RNA, 64 nt, hsa; identical to SEQ ID NO: 155698

SEQ ID NO: 671094 - RNA, 64 nt, hsa; identical to SEQ ID NO: 155699

SEQ ID NO: 671095 - RNA, 64 nt, hsa; identical to SEQ ID NO: 155700

SEQ ID NO: 671096 - RNA, 64 nt, hsa; identical to SEQ ID NO: 155701

SEQ ID NO: 671097 - RNA, 64 nt, hsa; identical to SEQ ID NO: 155702

SEQ ID NO: 671098 - RNA, 64 nt, hsa; identical to SEQ ID NO: 155703

SEQ ID NO: 671099 - RNA, 64 nt, hsa; identical to SEQ ID NO: 155704

SEQ ID NO: 671100 - RNA, 64 nt, hsa; identical to SEQ ID NO: 155705

SEQ ID NO: 671101 - RNA, 64 nt, hsa; identical to SEQ ID NO: 155706

SEQ ID NO: 671102 - RNA, 64 nt, hsa; identical to SEQ ID NO: 155707

SEQ ID NO: 671103 - RNA, 64 nt, hsa; identical to SEQ ID NO: 155708

SEQ ID NO: 671104 - RNA, 64 nt, hsa; identical to SEQ ID NO: 155709

SEQ ID NO: 671105 - RNA, 64 nt, hsa; identical to SEQ ID NO: 155710

SEQ ID NO: 671106 - RNA, 64 nt, hsa; identical to SEQ ID NO: 155711

SEQ ID NO: 671107 - RNA, 64 nt, hsa; identical to SEQ ID NO: 155712

SEQ ID NO: 671108 - RNA, 64 nt, hsa; identical to SEQ ID NO: 155713

SEQ ID NO: 671109 - RNA, 64 nt, hsa; identical to SEQ ID NO: 155714

SEQ ID NO: 671110 - RNA, 64 nt, hsa; identical to SEQ ID NO: 155715

SEQ ID NO: 671111 - RNA, 64 nt, hsa; identical to SEQ ID NO: 155716

SEQ ID NO: 671112 - RNA, 64 nt, hsa; identical to SEQ ID NO: 155717

SEQ ID NO: 671113 - RNA, 64 nt, hsa; identical to SEQ ID NO: 155718

SEQ ID NO: 671114 - RNA, 64 nt, hsa; identical to SEQ ID NO: 155719

SEQ ID NO: 671115 - RNA, 64 nt, hsa; identical to SEQ ID NO: 155720

SEQ ID NO: 671116 - RNA, 64 nt, hsa; identical to SEQ ID NO: 155721

SEQ ID NO: 671117 - RNA, 64 nt, hsa; identical to SEQ ID NO: 155722

SEQ ID NO: 671118 - RNA, 64 nt, hsa; identical to SEQ ID NO: 155723

SEQ ID NO: 671119 - RNA, 64 nt, hsa; identical to SEQ ID NO: 155724

SEQ ID NO: 671120 - RNA, 64 nt, hsa; identical to SEQ ID NO: 155725

SEQ ID NO: 671121 - RNA, 64 nt, hsa; identical to SEQ ID NO: 155726

SEQ ID NO: 671122 - RNA, 64 nt, hsa; identical to SEQ ID NO: 155727

SEQ ID NO: 671123 - RNA, 64 nt, hsa; identical to SEQ ID NO: 155728

SEQ ID NO: 671124 - RNA, 64 nt, hsa; identical to SEQ ID NO: 155729

SEQ ID NO: 671125 - RNA, 58 nt, hsa; identical to SEQ ID NO: 155730

SEQ ID NO: 671126 - RNA, 64 nt, hsa; identical to SEQ ID NO: 155731

SEQ ID NO: 671127 - RNA, 64 nt, hsa; identical to SEQ ID NO: 155732

SEQ ID NO: 671128 - RNA, 64 nt, hsa; identical to SEQ ID NO: 155733

SEQ ID NO: 671129 - RNA, 64 nt, hsa; identical to SEQ ID NO: 155734

SEQ ID NO: 671130 - RNA, 64 nt, hsa; identical to SEQ ID NO: 155735

SEQ ID NO: 671131 - RNA, 64 nt, hsa; identical to SEQ ID NO: 155736

SEQ ID NO: 671132 - RNA, 64 nt, hsa; identical to SEQ ID NO: 155737

SEQ ID NO: 671133 - RNA, 64 nt, hsa; identical to SEQ ID NO: 155738

SEQ ID NO: 671134 - RNA, 64 nt, hsa; identical to SEQ ID NO: 155739

SEQ ID NO: 671135 - RNA, 64 nt, hsa; identical to SEQ ID NO: 155740

SEQ ID NO: 671136 - RNA, 64 nt, hsa; identical to SEQ ID NO: 155741

SEQ ID NO: 671137 - RNA, 64 nt, hsa; identical to SEQ ID NO: 155742

SEQ ID NO: 671138 - RNA, 64 nt, hsa; identical to SEQ ID NO: 155743

SEQ ID NO: 671139 - RNA, 64 nt, hsa; identical to SEQ ID NO: 155744

SEQ ID NO: 671140 - RNA, 64 nt, hsa; identical to SEQ ID NO: 155745

SEQ ID NO: 671141 - RNA, 64 nt, hsa; identical to SEQ ID NO: 155746

SEQ ID NO: 671142 - RNA, 64 nt, hsa; identical to SEQ ID NO: 155747

SEQ ID NO: 671143 - RNA, 64 nt, hsa; identical to SEQ ID NO: 155748

SEQ ID NO: 671144 - RNA, 64 nt, hsa; identical to SEQ ID NO: 155749

SEQ ID NO: 671145 - RNA, 64 nt, hsa; identical to SEQ ID NO: 155750

SEQ ID NO: 671146 - RNA, 64 nt, hsa; identical to SEQ ID NO: 155751

SEQ ID NO: 671147 - RNA, 64 nt, hsa; identical to SEQ ID NO: 155752

SEQ ID NO: 671148 - RNA, 64 nt, hsa; identical to SEQ ID NO: 155753

SEQ ID NO: 671149 - RNA, 63 nt, hsa; identical to SEQ ID NO: 155754

SEQ ID NO: 671150 - RNA, 64 nt, hsa; identical to SEQ ID NO: 155755

SEQ ID NO: 671151 - RNA, 64 nt, hsa; identical to SEQ ID NO: 155756

SEQ ID NO: 671152 - RNA, 64 nt, hsa; identical to SEQ ID NO: 155757

SEQ ID NO: 671153 - RNA, 64 nt, hsa; identical to SEQ ID NO: 155758

SEQ ID NO: 671154 - RNA, 64 nt, hsa; identical to SEQ ID NO: 155759

SEQ ID NO: 671155 - RNA, 64 nt, hsa; identical to SEQ ID NO: 155760

SEQ ID NO: 671156 - RNA, 64 nt, hsa; identical to SEQ ID NO: 155761

SEQ ID NO: 671157 - RNA, 64 nt, hsa; identical to SEQ ID NO: 155762

SEQ ID NO: 671158 - RNA, 64 nt, hsa; identical to SEQ ID NO: 155763

SEQ ID NO: 671159 - RNA, 64 nt, hsa; identical to SEQ ID NO: 155764

SEQ ID NO: 671160 - RNA, 64 nt, hsa; identical to SEQ ID NO: 155765

SEQ ID NO: 671161 - RNA, 64 nt, hsa; identical to SEQ ID NO: 155766

SEQ ID NO: 671162 - RNA, 64 nt, hsa; identical to SEQ ID NO: 155767

SEQ ID NO: 671163 - RNA, 64 nt, hsa; identical to SEQ ID NO: 155768

SEQ ID NO: 671164 - RNA, 64 nt, hsa; identical to SEQ ID NO: 155769

SEQ ID NO: 671165 - RNA, 64 nt, hsa; identical to SEQ ID NO: 155770

SEQ ID NO: 671166 - RNA, 64 nt, hsa; identical to SEQ ID NO: 155771

SEQ ID NO: 671167 - RNA, 64 nt, hsa; identical to SEQ ID NO: 155772

SEQ ID NO: 671168 - RNA, 64 nt, hsa; identical to SEQ ID NO: 155773

SEQ ID NO: 671169 - RNA, 64 nt, hsa; identical to SEQ ID NO: 155774

SEQ ID NO: 671170 - RNA, 64 nt, hsa; identical to SEQ ID NO: 155775

SEQ ID NO: 671171 - RNA, 64 nt, hsa; identical to SEQ ID NO: 155776

SEQ ID NO: 671172 - RNA, 64 nt, hsa; identical to SEQ ID NO: 155777

SEQ ID NO: 671173 - RNA, 64 nt, hsa; identical to SEQ ID NO: 155778

SEQ ID NO: 671174 - RNA, 64 nt, hsa; identical to SEQ ID NO: 155779

SEQ ID NO: 671175 - RNA, 64 nt, hsa; identical to SEQ ID NO: 155780

SEQ ID NO: 671176 - RNA, 64 nt, hsa; identical to SEQ ID NO: 155781

SEQ ID NO: 671177 - RNA, 64 nt, hsa; identical to SEQ ID NO: 155782

SEQ ID NO: 671178 - RNA, 64 nt, hsa; identical to SEQ ID NO: 155783

SEQ ID NO: 671179 - RNA, 64 nt, hsa; identical to SEQ ID NO: 155784

SEQ ID NO: 671180 - RNA, 64 nt, hsa; identical to SEQ ID NO: 155785

SEQ ID NO: 671181 - RNA, 64 nt, hsa; identical to SEQ ID NO: 155786

SEQ ID NO: 671182 - RNA, 53 nt, hsa; identical to SEQ ID NO: 155787

SEQ ID NO: 671183 - RNA, 64 nt, hsa; identical to SEQ ID NO: 155788

SEQ ID NO: 671184 - RNA, 64 nt, hsa; identical to SEQ ID NO: 155789

SEQ ID NO: 671185 - RNA, 64 nt, hsa; identical to SEQ ID NO: 155790

SEQ ID NO: 671186 - RNA, 64 nt, hsa; identical to SEQ ID NO: 155791

SEQ ID NO: 671187 - RNA, 64 nt, hsa; identical to SEQ ID NO: 155792

SEQ ID NO: 671188 - RNA, 64 nt, hsa; identical to SEQ ID NO: 155793

SEQ ID NO: 671189 - RNA, 64 nt, hsa; identical to SEQ ID NO: 155794

SEQ ID NO: 671190 - RNA, 64 nt, hsa; identical to SEQ ID NO: 155795

SEQ ID NO: 671191 - RNA, 64 nt, hsa; identical to SEQ ID NO: 155796

SEQ ID NO: 671192 - RNA, 64 nt, hsa; identical to SEQ ID NO: 155797

SEQ ID NO: 671193 - RNA, 64 nt, hsa; identical to SEQ ID NO: 155798

SEQ ID NO: 671194 - RNA, 64 nt, hsa; identical to SEQ ID NO: 155799

SEQ ID NO: 671195 - RNA, 64 nt, hsa; identical to SEQ ID NO: 155800

SEQ ID NO: 671196 - RNA, 64 nt, hsa; identical to SEQ ID NO: 155801

SEQ ID NO: 671197 - RNA, 64 nt, hsa; identical to SEQ ID NO: 155802

SEQ ID NO: 671198 - RNA, 64 nt, hsa; identical to SEQ ID NO: 155803

SEQ ID NO: 671199 - RNA, 64 nt, hsa; identical to SEQ ID NO: 155804

SEQ ID NO: 671200 - RNA, 64 nt, hsa; identical to SEQ ID NO: 155805

SEQ ID NO: 671201 - RNA, 64 nt, hsa; identical to SEQ ID NO: 155806

SEQ ID NO: 671202 - RNA, 64 nt, hsa; identical to SEQ ID NO: 155807

SEQ ID NO: 671203 - RNA, 64 nt, hsa; identical to SEQ ID NO: 155808

SEQ ID NO: 671204 - RNA, 64 nt, hsa
uugguaaaacuuuuaaauucaacaccugaaaaucaugagggaaaaugauuaccucuugagauau

SEQ ID NO: 671205 - RNA, 64 nt, hsa
uagaaauucaguucuaaggaaagaguugauccuuaugagggagauucugaucauauuaaaaauc

SEQ ID NO: 671206 - RNA, 64 nt, hsa
augaauucugaucauauuuagucauuuugaccaaaugagggauuuggucaaaugagggauuccc

SEQ ID NO: 671207 - RNA, 64 nt, hsa
uuagucauuuugaccaaaugagggauuuggucaaaugagggauucccucaaagcaauaucaggu

SEQ ID NO: 671208 - RNA, 64 nt, hsa
cucaccucuaggccucaguguccucaucuauaaaaugagggacuucccuagaagucuucauggu

SEQ ID NO: 671209 - RNA, 64 nt, hsa
ugaaaguguuuuucuuuaaucaaaaguccuuagaaugagggaaacaaaauauuuauuuguuuug

SEQ ID NO: 671210 - RNA, 64 nt, hsa
aauguauaaagugggguuucuuccauauugacaaaugagggaacagguggugucuaucuuguau

SEQ ID NO: 671211 - RNA, 64 nt, hsa
ugucagccuuuucuguggcaccuuccagaugagaaugagggagcgaccacuccaaggacggaca

SEQ ID NO: 671212 - RNA, 64 nt, hsa
caacacagggcucccuguggugacaccaguggagaugagggaacggguagauggugugagugag

SEQ ID NO: 671213 - RNA, 64 nt, hsa
ccgagccuguauuuauuuuuguauaauucucuggaugagggagaguggucgugagcuggucuug

SEQ ID NO: 671214 - RNA, 64 nt, hsa
gaccugagcuggcuuggacccauuugaggacugaacuaggcaggcaauggcuccagugcccucc

SEQ ID NO: 671215 - RNA, 64 nt, hsa
gcugccccagaacacaguccauuacgauagaaacacuaggcaccccccaggcgagagcuagugg

SEQ ID NO: 671216 - RNA, 63 nt, hsa
ugauccuuauguuaauacaaggaagauuguuuacuucaucaaggaacacagcaucauuaugca

SEQ ID NO: 671217 - RNA, 63 nt, hsa
ccacuaccgccuuuauuucucuauuucccuugccuucaucaccuacauuuuuuucccaguccu

SEQ ID NO: 671218 - RNA, 63 nt, hsa
cucaccugacugucuggcugaccuguacaaguccuucaucaaaaacuacccaguggugucuac

SEQ ID NO: 671219 - RNA, 63 nt, hsa
ggugccucaucauucuggggagacugaaaauaccuucaucacugaccuggugguggggcugug

SEQ ID NO: 671220 - RNA, 63 nt, hsa
uuuaaagguuacuugaaugucacaaaauuaugccuucaucaaaacuuuaaaggaaaaaucaau

SEQ ID NO: 671221 - RNA, 63 nt, hsa
gcaucuugcccaggaucacucagucaagcaugucuucaucaaguggaagccaacuguccugcc

SEQ ID NO: 671222 - RNA, 63 nt, hsa
uugagauuuugcucaugaaccaucugcaacuugcuucaucauaagaauaauuuauaacuugac

SEQ ID NO: 671223 - RNA, 63 nt, hsa
uuauugcagugcaacuaaagagcaucuaugugccuucaucaagaagcccauguuuugagauuu

SEQ ID NO: 671224 - RNA, 63 nt, hsa
gcuguaguccauaugugaauacuaaauguuaaacuucaucagcgucagaccuauuguaucaua

SEQ ID NO: 671225 - RNA, 63 nt, hsa
cccaagcuucucaaacuguuagcugcugucugacuucaucaauaaaguauuuuuauuuuaaaa

SEQ ID NO: 671226 - RNA, 63 nt, hsa
acucagacaguuaaucauagaaaagauuauuugcuucaucaguucauagaaaagauuauuugc

SEQ ID NO: 671227 - RNA, 63 nt, hsa
uuugcuucaucaguucauagaaaagauuauuugcuucaucaguuaacuuguuuuuauaaauca

SEQ ID NO: 671228 - RNA, 63 nt, hsa
uagugacccauggaagcuuccaagcaguuuucucuucaucacuacuaacaaacaaaacacuaa

SEQ ID NO: 671229 - RNA, 63 nt, hsa
uuagcaguguguacacuacuguaucaucaucagcuucaucacccuguaaaccaggcuccucug

SEQ ID NO: 671230 - RNA, 63 nt, hsa
gguggaggccgcacagaaggccaaugcccacggcuucaucauggaacuccaggacggcuacag

SEQ ID NO: 671231 - RNA, 63 nt, hsa
cucaggccagaugaccagcggcaaccucaucgccuucaucaucuacgaguuuguccugggaga

SEQ ID NO: 671232 - RNA, 64 nt, hsa; identical to SEQ ID NO: 193920

SEQ ID NO: 671233 - RNA, 64 nt, hsa; identical to SEQ ID NO: 193921

SEQ ID NO: 671234 - RNA, 64 nt, hsa; identical to SEQ ID NO: 193922

SEQ ID NO: 671235 - RNA, 64 nt, hsa; identical to SEQ ID NO: 193923

SEQ ID NO: 671236 - RNA, 64 nt, hsa; identical to SEQ ID NO: 193924

SEQ ID NO: 671237 - RNA, 64 nt, hsa; identical to SEQ ID NO: 193925

SEQ ID NO: 671238 - RNA, 64 nt, hsa; identical to SEQ ID NO: 193926

SEQ ID NO: 671239 - RNA, 64 nt, hsa; identical to SEQ ID NO: 193927

SEQ ID NO: 671240 - RNA, 64 nt, hsa; identical to SEQ ID NO: 193928

SEQ ID NO: 671241 - RNA, 64 nt, hsa; identical to SEQ ID NO: 193929

SEQ ID NO: 671242 - RNA, 64 nt, hsa; identical to SEQ ID NO: 193930

SEQ ID NO: 671243 - RNA, 64 nt, hsa; identical to SEQ ID NO: 193931

SEQ ID NO: 671244 - RNA, 64 nt, hsa; identical to SEQ ID NO: 193932

SEQ ID NO: 671245 - RNA, 64 nt, hsa; identical to SEQ ID NO: 193933

SEQ ID NO: 671246 - RNA, 64 nt, hsa; identical to SEQ ID NO: 193934

SEQ ID NO: 671247 - RNA, 64 nt, hsa; identical to SEQ ID NO: 193935

SEQ ID NO: 671248 - RNA, 64 nt, hsa; identical to SEQ ID NO: 193936

SEQ ID NO: 671249 - RNA, 64 nt, hsa; identical to SEQ ID NO: 193937

SEQ ID NO: 671250 - RNA, 64 nt, hsa; identical to SEQ ID NO: 193938

SEQ ID NO: 671251 - RNA, 64 nt, hsa; identical to SEQ ID NO: 193939

SEQ ID NO: 671252 - RNA, 64 nt, hsa; identical to SEQ ID NO: 193940

SEQ ID NO: 671253 - RNA, 64 nt, hsa; identical to SEQ ID NO: 193941

SEQ ID NO: 671254 - RNA, 64 nt, hsa; identical to SEQ ID NO: 193942

SEQ ID NO: 671255 - RNA, 64 nt, hsa; identical to SEQ ID NO: 193943

SEQ ID NO: 671256 - RNA, 64 nt, hsa; identical to SEQ ID NO: 193944

SEQ ID NO: 671257 - RNA, 64 nt, hsa; identical to SEQ ID NO: 193945

SEQ ID NO: 671258 - RNA, 64 nt, hsa; identical to SEQ ID NO: 193946

SEQ ID NO: 671259 - RNA, 64 nt, hsa; identical to SEQ ID NO: 193947

SEQ ID NO: 671260 - RNA, 64 nt, hsa; identical to SEQ ID NO: 193948

SEQ ID NO: 671261 - RNA, 64 nt, hsa; identical to SEQ ID NO: 193949

SEQ ID NO: 671262 - RNA, 64 nt, hsa; identical to SEQ ID NO: 193950

SEQ ID NO: 671263 - RNA, 64 nt, hsa; identical to SEQ ID NO: 193951

SEQ ID NO: 671264 - RNA, 64 nt, hsa; identical to SEQ ID NO: 193952

SEQ ID NO: 671265 - RNA, 64 nt, hsa; identical to SEQ ID NO: 193953

SEQ ID NO: 671266 - RNA, 64 nt, hsa; identical to SEQ ID NO: 193954

SEQ ID NO: 671267 - RNA, 64 nt, hsa; identical to SEQ ID NO: 193955

SEQ ID NO: 671268 - RNA, 64 nt, hsa; identical to SEQ ID NO: 193956

SEQ ID NO: 671269 - RNA, 64 nt, hsa; identical to SEQ ID NO: 193957

SEQ ID NO: 671270 - RNA, 64 nt, hsa; identical to SEQ ID NO: 193958

SEQ ID NO: 671271 - RNA, 64 nt, hsa; identical to SEQ ID NO: 193959

SEQ ID NO: 671272 - RNA, 64 nt, hsa; identical to SEQ ID NO: 193960

SEQ ID NO: 671273 - RNA, 54 nt, hsa; identical to SEQ ID NO: 193961

SEQ ID NO: 671274 - RNA, 64 nt, hsa; identical to SEQ ID NO: 193962

SEQ ID NO: 671275 - RNA, 64 nt, hsa; identical to SEQ ID NO: 193963

SEQ ID NO: 671276 - RNA, 64 nt, hsa; identical to SEQ ID NO: 193964

SEQ ID NO: 671277 - RNA, 64 nt, hsa; identical to SEQ ID NO: 193965

SEQ ID NO: 671278 - RNA, 64 nt, hsa; identical to SEQ ID NO: 245086

SEQ ID NO: 671279 - RNA, 64 nt, hsa; identical to SEQ ID NO: 245087

SEQ ID NO: 671280 - RNA, 64 nt, hsa; identical to SEQ ID NO: 245088

SEQ ID NO: 671281 - RNA, 64 nt, hsa
uguuacuaggguggccucucucccauuucccgcuguggcugagccaaacuucauuacuuuccuu

SEQ ID NO: 671282 - RNA, 64 nt, hsa
uauuggauuccaaacugcuaugcccucuauaccaguggcugacaaggcauauagggauauaugc

SEQ ID NO: 671283 - RNA, 64 nt, hsa
ugcauggccacucuugcccccaagggcccaggcuguggcugacacauagaagguggccacauag

SEQ ID NO: 671284 - RNA, 64 nt, hsa
cugacaccacagucaauuaauuccucaggggccuguggcugaagaaaaggugcccagcccccac

SEQ ID NO: 671285 - RNA, 64 nt, hsa
cacggacuucggagcauagaguggcgcugagugaguggcugagaccgaccacgguucuugacuu

SEQ ID NO: 671286 - RNA, 64 nt, hsa
cgcuguccgaggagcuccaugcggcacugagugaguggcugacagcgauccgggcuugguuuug

SEQ ID NO: 671287 - RNA, 64 nt, hsa
cccggcuucaccuucccagaacaagaauguggugguggcugacuucgggcuggcgcgucucaug

SEQ ID NO: 671288 - RNA, 64 nt, hsa
agagagggcugaucccauggggcggagguccccaguggcugagcaaacagccccuucucucgcu

SEQ ID NO: 671289 - RNA, 64 nt, hsa
gaguaaguuugugguuuguuucugguuuacagugguggcugacaccccuuguaagaaagcauuc

SEQ ID NO: 671290 - RNA, 64 nt, hsa
aaggugcggggccagcugcuaugugguggccgcuguggcugacacugagugaagguguuugaaa

SEQ ID NO: 671291 - RNA, 64 nt, hsa
cccacagcccugagagaugguguugcuagcucagguggcugacacaugggguaugccgggcacu

SEQ ID NO: 671292 - RNA, 64 nt, hsa
uuggggcaggguuagcagauggcagcccuucucuguggcugacaggucacugagugauaagcau

SEQ ID NO: 671293 - RNA, 64 nt, hsa
gcggccaggacagcagaggcugaggggccgggguguggcugagugaccagggugucacccacug

SEQ ID NO: 671294 - RNA, 64 nt, hsa
cacagaccucgggaaggcgcugggccgagccaguguggcugagugaccggggugugcccggcag

SEQ ID NO: 671295 - RNA, 64 nt, hsa
gugauuuuuuuucugaaacucacacaacuaggaaguggcugagucaggacuugaacccaggucu

SEQ ID NO: 671296 - RNA, 64 nt, hsa
ucucccuggaucagaacaggagcucuuaacuacaguggcugaauagcuucuccaaaggcucccu

SEQ ID NO: 671297 - RNA, 64 nt, hsa; identical to SEQ ID NO: 300148

SEQ ID NO: 671298 - RNA, 64 nt, hsa; identical to SEQ ID NO: 300149

SEQ ID NO: 671299 - RNA, 64 nt, hsa; identical to SEQ ID NO: 300150

SEQ ID NO: 671300 - RNA, 64 nt, hsa; identical to SEQ ID NO: 300151

SEQ ID NO: 671301 - RNA, 64 nt, hsa; identical to SEQ ID NO: 300152

SEQ ID NO: 671302 - RNA, 64 nt, hsa; identical to SEQ ID NO: 300153

SEQ ID NO: 671303 - RNA, 64 nt, hsa; identical to SEQ ID NO: 300154

SEQ ID NO: 671304 - RNA, 64 nt, hsa; identical to SEQ ID NO: 300155

SEQ ID NO: 671305 - RNA, 64 nt, hsa; identical to SEQ ID NO: 300156

SEQ ID NO: 671306 - RNA, 64 nt, hsa; identical to SEQ ID NO: 300157

SEQ ID NO: 671307 - RNA, 64 nt, hsa; identical to SEQ ID NO: 300158

SEQ ID NO: 671308 - RNA, 64 nt, hsa; identical to SEQ ID NO: 300159

SEQ ID NO: 671309 - RNA, 64 nt, hsa; identical to SEQ ID NO: 300160

SEQ ID NO: 671310 - RNA, 64 nt, hsa; identical to SEQ ID NO: 300161

SEQ ID NO: 671311 - RNA, 64 nt, hsa; identical to SEQ ID NO: 300162

SEQ ID NO: 671312 - RNA, 64 nt, hsa; identical to SEQ ID NO: 300163

SEQ ID NO: 671313 - RNA, 64 nt, hsa; identical to SEQ ID NO: 300164

SEQ ID NO: 671314 - RNA, 64 nt, hsa; identical to SEQ ID NO: 300165

SEQ ID NO: 671315 - RNA, 64 nt, hsa; identical to SEQ ID NO: 300166

SEQ ID NO: 671316 - RNA, 64 nt, hsa; identical to SEQ ID NO: 300167

SEQ ID NO: 671317 - RNA, 64 nt, hsa; identical to SEQ ID NO: 300168

SEQ ID NO: 671318 - RNA, 64 nt, hsa; identical to SEQ ID NO: 300169

SEQ ID NO: 671319 - RNA, 64 nt, hsa; identical to SEQ ID NO: 300170

SEQ ID NO: 671320 - RNA, 64 nt, hsa; identical to SEQ ID NO: 300171

SEQ ID NO: 671321 - RNA, 64 nt, hsa; identical to SEQ ID NO: 300172

SEQ ID NO: 671322 - RNA, 64 nt, hsa; identical to SEQ ID NO: 300173

SEQ ID NO: 671323 - RNA, 64 nt, hsa; identical to SEQ ID NO: 300174

SEQ ID NO: 671324 - RNA, 64 nt, hsa; identical to SEQ ID NO: 300175

SEQ ID NO: 671325 - RNA, 64 nt, hsa; identical to SEQ ID NO: 300176

SEQ ID NO: 671326 - RNA, 64 nt, hsa; identical to SEQ ID NO: 300177

SEQ ID NO: 671327 - RNA, 64 nt, hsa; identical to SEQ ID NO: 300178

SEQ ID NO: 671328 - RNA, 64 nt, hsa; identical to SEQ ID NO: 300179

SEQ ID NO: 671329 - RNA, 64 nt, hsa; identical to SEQ ID NO: 300180

SEQ ID NO: 671330 - RNA, 64 nt, hsa; identical to SEQ ID NO: 300181

SEQ ID NO: 671331 - RNA, 64 nt, hsa; identical to SEQ ID NO: 300182

SEQ ID NO: 671332 - RNA, 64 nt, hsa; identical to SEQ ID NO: 300183

SEQ ID NO: 671333 - RNA, 64 nt, hsa; identical to SEQ ID NO: 300184

SEQ ID NO: 671334 - RNA, 64 nt, hsa; identical to SEQ ID NO: 300185

SEQ ID NO: 671335 - RNA, 64 nt, hsa; identical to SEQ ID NO: 300186

SEQ ID NO: 671336 - RNA, 64 nt, hsa; identical to SEQ ID NO: 300187

SEQ ID NO: 671337 - RNA, 64 nt, hsa; identical to SEQ ID NO: 300188

SEQ ID NO: 671338 - RNA, 64 nt, hsa; identical to SEQ ID NO: 300189

SEQ ID NO: 671339 - RNA, 64 nt, hsa; identical to SEQ ID NO: 300190

SEQ ID NO: 671340 - RNA, 64 nt, hsa; identical to SEQ ID NO: 300191

SEQ ID NO: 671341 - RNA, 64 nt, hsa; identical to SEQ ID NO: 309737

SEQ ID NO: 671342 - RNA, 64 nt, hsa; identical to SEQ ID NO: 309738

SEQ ID NO: 671343 - RNA, 64 nt, hsa; identical to SEQ ID NO: 309739

SEQ ID NO: 671344 - RNA, 64 nt, hsa; identical to SEQ ID NO: 309740

SEQ ID NO: 671345 - RNA, 64 nt, hsa; identical to SEQ ID NO: 309741

SEQ ID NO: 671346 - RNA, 64 nt, hsa; identical to SEQ ID NO: 309742

SEQ ID NO: 671347 - RNA, 64 nt, hsa
aaacucaaggcuuauauuaagcaaacacuugaagugagaagaugauccacaacuugagaagaca

SEQ ID NO: 671348 - RNA, 64 nt, hsa
gcaaacacuugaagugagaagaugauccacaacuugagaagacauuuauaauacaaauaacuga

SEQ ID NO: 671349 - RNA, 64 nt, hsa
ucaggagcacugugguagagcacuggcccugccuugagaagagacacaggucucccgucccugc

SEQ ID NO: 671350 - RNA, 64 nt, hsa
uagagaaaauauuaauuuucaaggggaaaaaaccugagaagaaagggagaaaagaccaugaaau

SEQ ID NO: 671351 - RNA, 64 nt, hsa
gggcgaaacaacugaugggggaagauaccuggggugagaagaugagaaagaaaugaugcugagg

SEQ ID NO: 671352 - RNA, 64 nt, hsa
cagacucaagccucuagacucuuggaugaaacagugagaagaaaacauuuucugacuuacccuu

SEQ ID NO: 671353 - RNA, 64 nt, hsa
ucuuaauauuucaaguuuacaucaagauaaacccugagaagaacuacggagaaaucaaauaaaa

SEQ ID NO: 671354 - RNA, 64 nt, hsa
uguggcagguagggaaggggagaugucugucucuugagaagagagaggcaugugugccggcauc

SEQ ID NO: 671355 - RNA, 64 nt, hsa
cuuuaacagugugaaucuuuauaguauuugaaaaugagaagaagcagcagauuguaauuugguu

SEQ ID NO: 671356 - RNA, 64 nt, hsa
ugguaaaaaccuguagcgauucguuacacuggggugagaagagauaagagaaaugaaagagaag

SEQ ID NO: 671357 - RNA, 64 nt, hsa
gagauuccuccagugccugagaaccgauuuuuacugagaagagauaugccuguuguuacugcag

SEQ ID NO: 671358 - RNA, 64 nt, hsa
gugcuggagaaaguaccgggaagaaggagguggcugagaagagccagaucaaccucauugauaa

SEQ ID NO: 671359 - RNA, 64 nt, hsa
uaagagaugugaaccuuggugagcucugauacagugagaagagauuauacucaugaaagagaau

SEQ ID NO: 671360 - RNA, 64 nt, hsa
aagaugcuaccaaugaaauagaaaaccaacgagaugagaagacugugauccucauguacucaga

SEQ ID NO: 671361 - RNA, 64 nt, hsa
uagauucuggguucagggguccccaucugucaaaugagaagauuggauuaucuaaucuuuuaga

SEQ ID NO: 671362 - RNA, 64 nt, hsa
gacaccugccagagugaaguuugauuccuaugggugagaagauguagaugacuauuguucucac

SEQ ID NO: 671363 - RNA, 64 nt, hsa
uuuuuuucuuaacaucgguggcucaguuaaggaaugagaagauagaggguccuccacuuucagc

SEQ ID NO: 671364 - RNA, 64 nt, hsa
aacacuaaugcacugacagauucuaaauauuuugugagaagaaauguuaaaaauuuuuagcuug

SEQ ID NO: 671365 - RNA, 64 nt, hsa
gcaucaggaaaggagaaaggcagagggagagcgcugagaagacuguucacgccagagugcuuau

SEQ ID NO: 671366 - RNA, 64 nt, hsa
acugugaggguagaguaggcucgcuuugcuuuccugagaagaugcgguggcugccuauguucuc

SEQ ID NO: 671367 - RNA, 64 nt, hsa
ugagaacuguaucuuugugggacagugagaagacugagaagaugugaauccauggucucaaagg

SEQ ID NO: 671368 - RNA, 64 nt, hsa
uggugcagcugagaacuguaucuuugugggacagugagaagacugagaagaugugaauccaugg

SEQ ID NO: 671369 - RNA, 64 nt, hsa
uuuaguaguacugugaaguucgugcuuaccuggaugagaagaauaaaugacacggauacacucc

SEQ ID NO: 671370 - RNA, 64 nt, hsa
uggaugagaagaauaaaugacacggauacacuccugagaagacacucguuaaacauugcaucgg

SEQ ID NO: 671371 - RNA, 64 nt, hsa
uuagggucucaaagcaagauuuuaaagugauuuuugagaagacuugggggggacaauaauagac

SEQ ID NO: 671372 - RNA, 64 nt, hsa
uuuuucugcuacuacuacaguuucacagaauaccugagaagacacacuuggagaaaccuuuugg

SEQ ID NO: 671373 - RNA, 64 nt, hsa
augcugcauagggcaggagccugaaaagcuaauuugagaagauaauaaguaggauuuuuguuuu

SEQ ID NO: 671374 - RNA, 64 nt, hsa
agggcugugccuucuaaagauuccaacagagaugugagaagauaauacagaugaaccaaagaug

SEQ ID NO: 671375 - RNA, 64 nt, hsa
auacuaggagcaauuaggagccauaugccugggcugagaagagcuaggcaguagugaccuuagg

SEQ ID NO: 671376 - RNA, 64 nt, hsa
cgcuccugcugaagaguuuagaaugaggcagcggugagaagaagggugggagggcgugggggcc

SEQ ID NO: 671377 - RNA, 64 nt, hsa
uauuuggacacaugaauuaaaucccaagggaaagugagaagaaaauuaauguauuagcaaccag

SEQ ID NO: 671378 - RNA, 64 nt, hsa
ggcucguccugauauuuuuuucauucauugacuuugagaagacuccaccugugcuuggaauucc

SEQ ID NO: 671379 - RNA, 64 nt, hsa
cagcagaacauuugcuggcgagaguccugucugcugagaagacaauauuguggcucguccugau

SEQ ID NO: 671380 - RNA, 64 nt, hsa
ugugacggcccaguggcucugcgugguacaugacugagaagagaaaaacaaaaauaaaucauac

SEQ ID NO: 671381 - RNA, 64 nt, hsa
ugggaucuaggaagaaagaauccaguguagaaguugagaagaacuugaacguuuugguucugga

SEQ ID NO: 671382 - RNA, 64 nt, hsa
uuuuuuugcaauaacaaggugaaaucaauauuguugagaagauucuuccaucugguaauguuga

SEQ ID NO: 671383 - RNA, 64 nt, hsa
auauuguugagaagauucuuccaucugguaauguugagaagacuucauuugguaggagucccuu

SEQ ID NO: 671384 - RNA, 64 nt, hsa
accaacuguguagugugcccucauauaguauuugugagaagaaguuuucaauguaagaggaagg

SEQ ID NO: 671385 - RNA, 64 nt, hsa
uuuccagcccuuguccuccuaauuggauuauauaugagaagagcuguuaucuauucagcauguc

SEQ ID NO: 671386 - RNA, 64 nt, hsa
aggugaaugagggaccagcccugcccugggcuguugagaagagaucaguccacccagaguuaga

SEQ ID NO: 671387 - RNA, 64 nt, hsa
ggggguagggggguggauuaggagauugaaggguugagaagaaagagaaauuguccaaagaguc

SEQ ID NO: 671388 - RNA, 64 nt, hsa
cccaauucucugaagucuacgauggagcauuuuuugagaagaaacuaaaccauacaaaguguug

SEQ ID NO: 671389 - RNA, 64 nt, hsa
cugaaucaaagacagcuuggccacuuccccuccuugagaagaccagaagucaacccaucccaaa

SEQ ID NO: 671390 - RNA, 61 nt, hsa
cuagauuccacaggccauagagauuuucuucugagaagaauuuguguuuaauuuuuugaua

SEQ ID NO: 671391 - RNA, 64 nt, hsa
guucagcucaagacuacccuaccugcuguguuugugagaagaguaggaucacacacacaggugc

SEQ ID NO: 671392 - RNA, 64 nt, hsa; identical to SEQ ID NO: 585938

SEQ ID NO: 671393 - RNA, 64 nt, hsa; identical to SEQ ID NO: 585939

SEQ ID NO: 671394 - RNA, 64 nt, hsa; identical to SEQ ID NO: 585975

SEQ ID NO: 671395 - RNA, 64 nt, hsa; identical to SEQ ID NO: 585976

SEQ ID NO: 671396 - RNA, 64 nt, hsa; identical to SEQ ID NO: 585989

SEQ ID NO: 671397 - RNA, 64 nt, hsa; identical to SEQ ID NO: 585990

SEQ ID NO: 671398 - RNA, 64 nt, hsa; identical to SEQ ID NO: 586015

SEQ ID NO: 671399 - RNA, 64 nt, hsa; identical to SEQ ID NO: 586016

SEQ ID NO: 671400 - RNA, 64 nt, hsa; identical to SEQ ID NO: 586033

SEQ ID NO: 671401 - RNA, 64 nt, hsa; identical to SEQ ID NO: 586034

SEQ ID NO: 671402 - RNA, 64 nt, hsa; identical to SEQ ID NO: 586055

SEQ ID NO: 671403 - RNA, 64 nt, hsa; identical to SEQ ID NO: 586056

SEQ ID NO: 671404 - RNA, 64 nt, hsa; identical to SEQ ID NO: 586149

SEQ ID NO: 671405 - RNA, 64 nt, hsa; identical to SEQ ID NO: 586150

SEQ ID NO: 671406 - RNA, 64 nt, hsa; identical to SEQ ID NO: 586153

SEQ ID NO: 671407 - RNA, 64 nt, hsa; identical to SEQ ID NO: 586154

SEQ ID NO: 671408 - RNA, 64 nt, hsa; identical to SEQ ID NO: 586176

SEQ ID NO: 671409 - RNA, 64 nt, hsa; identical to SEQ ID NO: 586177

SEQ ID NO: 671410 - RNA, 64 nt, hsa; identical to SEQ ID NO: 586192

SEQ ID NO: 671411 - RNA, 64 nt, hsa; identical to SEQ ID NO: 586193

SEQ ID NO: 671412 - RNA, 64 nt, hsa; identical to SEQ ID NO: 586220

SEQ ID NO: 671413 - RNA, 64 nt, hsa; identical to SEQ ID NO: 586221

SEQ ID NO: 671414 - RNA, 64 nt, hsa; identical to SEQ ID NO: 586224

SEQ ID NO: 671415 - RNA, 64 nt, hsa; identical to SEQ ID NO: 586225

SEQ ID NO: 671416 - RNA, 64 nt, hsa
guccucacguucccaggagggcggcuucacccuucguaaccaggagacaaggcggccauggauu

SEQ ID NO: 671417 - RNA, 64 nt, hsa
accgccuaagaaacagaacuucgagaaguccuaacguaaccacaguaaagcagacuccccuuuc

SEQ ID NO: 671418 - RNA, 64 nt, hsa
gaagcauaauuagaagcagaagaacaaaaugccacguaaccaaagcaucagagccaucauugca

SEQ ID NO: 671419 - RNA, 64 nt, hsa
ggaaugcaccccacauucccaugauggaagucugcguaaccaauaaauugugccuuucucacuc

SEQ ID NO: 671420 - RNA, 64 nt, hsa
gcaacauuaagugcuaugcuagucacuuagcugacguaaccagcuugguuaagcagcuuaugaa

SEQ ID NO: 671421 - RNA, 64 nt, hsa
aaagcacggacucuuacugcuaacuuuuguguaucguaaccagccagauccucuugguuauuug

SEQ ID NO: 671422 - RNA, 64 nt, hsa
uuuuaaaaaucauguuugacaucuuucuauugcucguaaccagucccuguagcugucuaaguua

SEQ ID NO: 671423 - RNA, 64 nt, hsa
gacaaugucuggcugaagcccgcuuucagcacgccguaaccaggggcugacaaugcgaggucgc

SEQ ID NO: 671424 - RNA, 64 nt, hsa
guaacauuggcuuaccuguauauuauaugccacccguaaccauaaaaacaccaggauuuagguu

SEQ ID NO: 671425 - RNA, 64 nt, hsa
gaccuugacuacucaguccagcgcucaggaauaucguaaccaguuuuuucaccuccaugucauc

SEQ ID NO: 671426 - RNA, 64 nt, hsa
ugauguccuugcaaaugcauuacccuguggaaaacguaaccacuggucagcccuagcugacaaa

SEQ ID NO: 671427 - RNA, 64 nt, hsa
acauucaauuccagaguaguuucaaguuucacaucguaaccauuuucgcccccauggcccaugu

SEQ ID NO: 671428 - RNA, 64 nt, hsa
uauuugaauagagaguaaagcuccuccgcuguuucguaaccauauccuuucccccgcuaacugg

SEQ ID NO: 671429 - RNA, 64 nt, hsa
caccccauccaccuuacagggaccagggggcccacguaaccaggacccagaggguggagcucuu

SEQ ID NO: 671430 - RNA, 64 nt, hsa
cuucuuuugcucugaggugugggcucccucaucucguaaccagagaccagcacaugucagggaa

SEQ ID NO: 671431 - RNA, 64 nt, hsa
agagggagaagggauggaggucacacugguagaacguaaccacggaaaagagcgcaucaggccu

SEQ ID NO: 671432 - RNA, 64 nt, hsa
uaacgaaccguaaaaaaaggagcagguaaugaaucguaaccaaaacuacaguugauccuccgca

SEQ ID NO: 671433 - RNA, 64 nt, hsa
auuguuaguugucaaccuuggcugauggaaaucccguaaccacuauuuguugcacugugccuug

SEQ ID NO: 671434 - RNA, 64 nt, hsa
ccaaagucaaaggauuugaaccugcaucuggaaacguaaccacucacagcaccuggcccgccaa

SEQ ID NO: 671435 - RNA, 64 nt, hsa
agauguaauuauugacagauuaaauagauaacuucguaaccaccagggggcagauucaauacau

SEQ ID NO: 671436 - RNA, 64 nt, hsa
cacagagggagcagacaguggguaccacgaucuccguaaccauuugcaugugacuuagcaaggg

SEQ ID NO: 671437 - RNA, 64 nt, hsa
gucuuuucugccaccuguuaccccucggagacuccguaaccaaacucuucggacugugagcccu

SEQ ID NO: 671438 - RNA, 64 nt, hsa
auaagcacucauguuauuaaagguuuugccuugucguaaccaaccgagccggggguguuuuguu

SEQ ID NO: 671439 - RNA, 64 nt, hsa
gccuccgcagaugagguuccugccccuuccuccucguaaccaaaacccucacugcucccaggac

SEQ ID NO: 671440 - RNA, 64 nt, hsa
uuuaaaagguaauaauacucugaaagaaaaaugacguaaccacagcguguacuaugaaagcugu

SEQ ID NO: 671441 - RNA, 64 nt, hsa
gauucaccuuucguuucccuuuccccaaaaguagcguaaccaacauuuaagcuugcuuaaaaac

SEQ ID NO: 671442 - RNA, 64 nt, hsa
ggaaucacauucuuagcacaccuacaccucuugaaaauagaacaacuugcagaauugagaguga

SEQ ID NO: 671443 - RNA, 64 nt, hsa
gaagaagauaugugaagaaaaauguauuuuuccuaaauagaaauaaaugaucccauuuuuuggu

SEQ ID NO: 671444 - RNA, 64 nt, hsa
cuaucuugcacugcuaacuuuuuucuaccuuuguaaauagaaacauuucugcauaaaagucaua

SEQ ID NO: 671445 - RNA, 64 nt, hsa
auuuacuugaaauguaaaaacuuucacugaauacaaauagaaaaagugauguguuuuauaucau

SEQ ID NO: 671446 - RNA, 64 nt, hsa
acaaauagaaaguuaauaaaggggaaugguguugaaauagaaccucauacauuuauuacaguuc

SEQ ID NO: 671447 - RNA, 64 nt, hsa
agccuggaagauuacucuuuggucaagggcauacaaauagaaaguuaauaaaggggaauggugu

SEQ ID NO: 671448 - RNA, 64 nt, hsa
uguuugccuuuauaaacuguugcaaauagaaaaaaaauagaauaaguauauauuuuuggaguaa

SEQ ID NO: 671449 - RNA, 64 nt, hsa
uugcagguguuuguuugccuuuauaaacuguugcaaauagaaaaaaaauagaauaaguauauau

SEQ ID NO: 671450 - RNA, 64 nt, hsa
uaucuugacuauuaaacuacguauaguguugcugaaauagaaagaaaacagcauuggaauugga

SEQ ID NO: 671451 - RNA, 64 nt, hsa
ugaaaacagaaacaagaaugagguaguggcaaugaaauagaauuauuaguauauuaugaacauu

SEQ ID NO: 671452 - RNA, 64 nt, hsa
aucuuaaaaaaaaaaaaacguuucucacugucuuaaauagaauuuuuaaauaguauauauucag

SEQ ID NO: 671453 - RNA, 64 nt, hsa
caacacauguuuauuuugcuuggcugcaguugaaaaauagaaauuagugcccuuuugugaccuc

SEQ ID NO: 671454 - RNA, 64 nt, hsa
aguuaaaccauuuaaacacauuugaaacauacaaaaauagaaaugugaaagcauuuggugaaag

SEQ ID NO: 671455 - RNA, 64 nt, hsa
agucagaagcugccaccuuagagaacugaaauaaaaauagaaguucuuacgcuuuuuuguggua

SEQ ID NO: 671456 - RNA, 64 nt, hsa
guuugcuuuucuuaaaacauaccaaaaaagaaaaaaauagaaaaaaaaaaaaaaaaagcuugau

SEQ ID NO: 671457 - RNA, 64 nt, hsa
gaguguuccaaaccaguaauccacaugccaauucaaauagaacagccccuugcuagauauuacc

SEQ ID NO: 671458 - RNA, 64 nt, hsa
aaucaccugugguauauuuauaaauaaaaauauuaaauagaagguaaaacaaaucagacauaca

SEQ ID NO: 671459 - RNA, 64 nt, hsa
cuuuguuuaguaauagguaggaaaaugaagaagaaaauagaauguugcagaauguggagggaug

SEQ ID NO: 671460 - RNA, 64 nt, hsa
gaaaguauauauguuagaguuuugaaugagggauaaauagaaagcagaaugaauuaauggaaaa

SEQ ID NO: 671461 - RNA, 64 nt, hsa
gaaguagacccuagaaaauugucucguuuauuuuaaauagaaucuaugcuuccaccaauaaacc

SEQ ID NO: 671462 - RNA, 64 nt, hsa
augcacaggcaacugugagaaacuguugugccaaaaauagaauuccuucuaguuuuucuuguuc

SEQ ID NO: 671463 - RNA, 64 nt, hsa
ucauauuugcauuucauguuuaaccuccggcuggaaauagaaagcauucccuuagagaugagga

SEQ ID NO: 671464 - RNA, 64 nt, hsa
ucuccuuucaguauuuggcaauaaaagaaagaagaaauagaacagcugaagucucaaaucauug

SEQ ID NO: 671465 - RNA, 64 nt, hsa
auggcgagucagggaauaaaaagucaaaagaaacaaauagaagcuuuuuuuuuuaaaaaaugua

SEQ ID NO: 671466 - RNA, 64 nt, hsa
uuaagauuucuuuauguggaacaucuauagagauaaauagaaauuuucaauaagauguaguaac

SEQ ID NO: 671467 - RNA, 64 nt, hsa
ucugguagguaaauuucuuauuaaaucaaucuugaaauagaaaauguaauaacuuucuuaccau

SEQ ID NO: 671468 - RNA, 64 nt, hsa
uacugcaaaaauccccuugucccaggauacccuaaaauagaaguauauuuugauguuuguuuau

SEQ ID NO: 671469 - RNA, 64 nt, hsa
gagaagucugaauauugugcuuuuuguuguuuguaaauagaauugaauuuaaauacaccaggau

SEQ ID NO: 671470 - RNA, 64 nt, hsa
uuuauacaaaaaaaaaagaacauuuccaaaacuaaaauagaaaaugcuuguggcauuuauuuuc

SEQ ID NO: 671471 - RNA, 64 nt, hsa
guuccaaagcuuuuucaaacuagaauaaggaggcaaauagaagaaugagauacugauguccaca

SEQ ID NO: 671472 - RNA, 64 nt, hsa
uggaacaaaauugcgaaggcuuuugccucccaguaaauagaaaggaaaauauauucuaguaggu

SEQ ID NO: 671473 - RNA, 64 nt, hsa
aaaagggucuugcccuugaauaacuaagucauacaaauagaaggaaaaacaauggugaauuuug

SEQ ID NO: 671474 - RNA, 64 nt, hsa
caaucaugucagucugcuuagaaauaacagaagaaaauagaauugacauugaaaucuaggaaaa

SEQ ID NO: 671475 - RNA, 64 nt, hsa
cuuaucuuacgaaaaaaugguagcauuuuaaacaaaauagaaaguugcaaggcaaauguuuauu

SEQ ID NO: 671476 - RNA, 64 nt, hsa
accaggguuggcuuuauuuaaaagcuagugaccuaaauagaaagcgaacuucaagagaaguugu

SEQ ID NO: 671477 - RNA, 64 nt, hsa
agcauuuaguaguagaaaugacaguugcuuaaugaaauagaauccaaacuacauauuuggauaa

SEQ ID NO: 671478 - RNA, 64 nt, hsa
auuaaauuucuaauugagcagauuagauugaauuaaauagaaacuuauugaauauacauucuuu

SEQ ID NO: 671479 - RNA, 64 nt, hsa
ggcuaauauggaaccaaacucuuguaaguaauguaaauagaaagguggguggauaaaguuuuca

SEQ ID NO: 671480 - RNA, 64 nt, hsa
uguacauauguaccuauuuuuuuuuaaaaagcagaaauagaaauacaagacugguaaacaugcc

SEQ ID NO: 671481 - RNA, 64 nt, hsa
uaccgauuagaucuauccauuguagaauucauguaaauagaauacuguaguauguacuuugccu

SEQ ID NO: 671482 - RNA, 64 nt, hsa
ugaaaauuaggaguggauuggagaaauuggggggaaauagaagaguacggagaaaggaagagau

SEQ ID NO: 671483 - RNA, 64 nt, hsa
uugucauguuucaaauaaagagaacugaaguagaaaauagaaaugccaguaaacaacauaaugu

SEQ ID NO: 671484 - RNA, 64 nt, hsa
gucacuacugaacaaaauuguucccucuucuguuaaauagaauagguuuaaaugacuagucaaa

SEQ ID NO: 671485 - RNA, 64 nt, hsa
uuaaucacauccuaggaauagcacaauaauugggaaauagaacccuuaucacuagaagaaccau

SEQ ID NO: 671486 - RNA, 64 nt, hsa
uuucugaauuuguuuaaacuguaacaauaaaguaaaauagaaugcaugaaagauauucuggcga

SEQ ID NO: 671487 - RNA, 64 nt, hsa
agauuccugcugugaauaaacauacuucuuguguaaauagaaacuguaaagucaucaggauagc

SEQ ID NO: 671488 - RNA, 64 nt, hsa
ucugauacaauagcaaacuugaaaaaaaaaaaagaaauagaagauuccugcugugaauaaacau

SEQ ID NO: 671489 - RNA, 64 nt, hsa
aucuaggagagaauucauaaccacaccaauaacgaaauagaaguuuuaaacuaugugccuaauc

SEQ ID NO: 671490 - RNA, 64 nt, hsa
aaaaauaucaggcauaagguuuucucaugcugaaaaauagaacgcgguuuuuauuuugcuuagu

SEQ ID NO: 671491 - RNA, 64 nt, hsa
cacauguagacuaaauagaaaccccucagcccuaaaauagaaaaaagaacaguucuggacuauu

SEQ ID NO: 671492 - RNA, 64 nt, hsa
cuucucacguugcucagacugacacauguagacuaaauagaaaccccucagcccuaaaauagaa

SEQ ID NO: 671493 - RNA, 64 nt, hsa
aucaauuuaaugcccuaacucucuuauuaaggagaaauagaaaagaagaaauuuauaaugaaaa

SEQ ID NO: 671494 - RNA, 64 nt, hsa
aaugggcauuucugccuuuuuuuuucuaaacgacaaauagaaauacaucuucuuuauuauccuc

SEQ ID NO: 671495 - RNA, 64 nt, hsa
caacagagugagacuccgucucaaaaaauaaauaaaauagaagcagccuuguaacuguauuuac

SEQ ID NO: 671496 - RNA, 64 nt, hsa
cuuaaaguaggaagguguuuccaaguucagauuaaaauagaagcagcuggccgggugcgguggc

SEQ ID NO: 671497 - RNA, 64 nt, hsa
caguuuuuaauuacacugagauaauuuugaaaagaaauagaaauuaagcuacuauauaaaacaa

SEQ ID NO: 671498 - RNA, 64 nt, hsa
aaaaaugcuuaguuuauacaaagauacuacacaaaaauagaacaauuagucugaauuaacguau

SEQ ID NO: 671499 - RNA, 64 nt, hsa
aauauuaaaaugugaauaaauaaauguucugauaaaauagaaaagaaaguaaauuacagugauu

SEQ ID NO: 671500 - RNA, 64 nt, hsa
uuauaggaggcaaacuguauaaaugauagguaugaaauagaauaagaaguaaaauacaucagca

SEQ ID NO: 671501 - RNA, 64 nt, hsa
auauguuugaugaaaacuggcucaagauguuuguaaauagaaucaagagcaaaacugcacaaac

SEQ ID NO: 671502 - RNA, 64 nt, hsa
uuggugacagagcacaaauagaaaaccuauuuuuaaauagaaaucacaaauagcaaguguggaa

SEQ ID NO: 671503 - RNA, 64 nt, hsa
ccauauaaaaggaaaaaaauuggugacagagcacaaauagaaaaccuauuuuuaaauagaaauc

SEQ ID NO: 671504 - RNA, 64 nt, hsa
uuuguauaauacaaauuuucauuaagccaguauaaaauagaaacuagcuuuuaaacugagcuuu

SEQ ID NO: 671505 - RNA, 64 nt, hsa
caaagauacaauuaaucugauauuauauuuguugaaauagaaauuugauuguacuauaaaugau

SEQ ID NO: 671506 - RNA, 64 nt, hsa
ccuagccaacaugacgaaaccccaucucuacugaaaauagaaaaaaaaaauuagccaggcuugc

SEQ ID NO: 671507 - RNA, 64 nt, hsa
uauuaaaaauaaaauuaauaaaaguaaaaaauaaaaauagaaacacaacucuacuaguacaggc

SEQ ID NO: 671508 - RNA, 64 nt, hsa
aguuaugaagcaaauuaaaauggaaaauacaagaaaauagaaccaauuagguugaaaaugcccc

SEQ ID NO: 671509 - RNA, 64 nt, hsa
gagcuaaucaaaauaauucagccaagucuauuugaaauagaaaacugucuauuuaauauaguaa

SEQ ID NO: 671510 - RNA, 64 nt, hsa
aauuaggaaaaaaaucuggagaacaauaugguugaaauagaaacaagagaaugcaccuagguua

SEQ ID NO: 671511 - RNA, 64 nt, hsa
cacccuguauaguaugggaauuauuuuuuauguuaaauagaaacugaauguacuggguugaaug

SEQ ID NO: 671512 - RNA, 64 nt, hsa
ggggguuccgagagagcaccguagggcuuuucucaaauagaaaagccagauuuugaaaaaauuu

SEQ ID NO: 671513 - RNA, 64 nt, hsa
gacaccaugagauguuaauauucauacauguaauaaauagaaugaugaagaaacuuuguuugua

SEQ ID NO: 671514 - RNA, 64 nt, hsa
cuaaaggagacuucugaauuguaaaugaacuuaaaaauagaauguggaugcaaaauaucacaua

SEQ ID NO: 671515 - RNA, 64 nt, hsa
auucaugcacaauccauaauuugaguuuuacauaaaauagaaauuuguuagaauuuguuagauu

SEQ ID NO: 671516 - RNA, 64 nt, hsa
acugccuuuagccuucuggauacuuucuuuuauaaaauagaaaccuuuuccacaccaguucugc

SEQ ID NO: 671517 - RNA, 64 nt, hsa
ugcuauaacauauauuuuuuucugaaauguuuuaaaauagaaguacaccuaauuguuauugguu

SEQ ID NO: 671518 - RNA, 64 nt, hsa
uugcaucauaucauuucuguccauaauuguacugaaauagaaaagugaccgcucuugcucuugg

SEQ ID NO: 671519 - RNA, 64 nt, hsa
uggugcuuuaucugaauaggccuggaucgaaguaaaauagaaaugggacuggcuuuccacagga

SEQ ID NO: 671520 - RNA, 64 nt, hsa
uuuuguuagguacagucuggaucauggcauguagaaauagaaauuuagaauuuuacugcagcuu

SEQ ID NO: 671521 - RNA, 64 nt, hsa
caauguucuugguuuuaauguuccaguugcugugaaauagaacuccuacaaucaaaagacaguu

SEQ ID NO: 671522 - RNA, 64 nt, hsa
auaguuaaccaaagaauauguuugguucaaauaaaaauagaagcuuaauacugggcauucauac

SEQ ID NO: 671523 - RNA, 64 nt, hsa
ugcaaaauuugcccagauccuauuacaauacuaaaaauagaaaauuucaccuccauauuccuga

SEQ ID NO: 671524 - RNA, 64 nt, hsa
uuaauaacuuuuaguaauuacuuuuauuaauuuaaaauagaacgcuugagaggcacuuuguaaa

SEQ ID NO: 671525 - RNA, 64 nt, hsa
uuuaaaauuaauauuaauaacuuuuauuaauuuaaaauagaaugcuuaaaauaaaauagaaugc

SEQ ID NO: 671526 - RNA, 64 nt, hsa
acuuuuauuaauuuaaaauagaaugcuuaaaauaaaauagaaugcuugagaggcacugaguaaa

SEQ ID NO: 671527 - RNA, 64 nt, hsa
uuuuacaugauucuuaaacugaaacuugguguaaaaauagaauugagauggccuuuuuuucaca

SEQ ID NO: 671528 - RNA, 64 nt, hsa
uauaguuagauuccaacuuccuccuucacucuaaaaauagaauccaaacccacucuucauauau

SEQ ID NO: 671529 - RNA, 64 nt, hsa
auaggugcaaacaaacaagcuuacuuccauugcaaaauagaagaagaggaaguuagagauaauu

SEQ ID NO: 671530 - RNA, 64 nt, hsa
ugguccauccuaauucacagaauuaaaugagcuuaaauagaaaauucaguauuuuaugauaauc

SEQ ID NO: 671531 - RNA, 64 nt, hsa
ccuuuguaagcuacuuaucuccaaaaaacuucagaaauagaaaacuacauuuuggcaggaauaa

SEQ ID NO: 671532 - RNA, 64 nt, hsa
guuuuccuguuagauggcaagagcacaaugcccaaaauagaagaugcaguuaagaauaaggggc

SEQ ID NO: 671533 - RNA, 64 nt, hsa
uuuaaaaggguaaaacaugacuauacagaaauuuaaauagaaauaguguauauacauauaaaau

SEQ ID NO: 671534 - RNA, 64 nt, hsa
aguccaggaccguggauuguauuuaaaaaaauaaaaauagaagaagaaaaggccgggcauggug

SEQ ID NO: 671535 - RNA, 64 nt, hsa
ccugaccaauauggugaaaccccaucucuacuaaaaauagaaaaauuagccagguguaguggug

SEQ ID NO: 671536 - RNA, 64 nt, hsa
gcucuuuuggguaucaacaccuaggucgccagugaaauagaacacagaacaggaacuagauuau

SEQ ID NO: 671537 - RNA, 64 nt, hsa
gcaacauagugagacccugucucuaaaaaaauaaaaauagaaauaaaguagugcuuauuguuug

SEQ ID NO: 671538 - RNA, 64 nt, hsa
agauugugcugguucuagcucauaauaaugaaaaaaauagaauuauauuuuguaugaauuguuu

SEQ ID NO: 671539 - RNA, 64 nt, hsa
ugguuaguugggcaaaaucauuuauuacaugcaaaaauagaaaauuauuuguuaaauucagaga

SEQ ID NO: 671540 - RNA, 64 nt, hsa
aaacguuuucauuuguugauuuaggaaaaagcauaaauagaaugcaguauaacaccacuuccaa

SEQ ID NO: 671541 - RNA, 64 nt, hsa
aauugcuuuguuuggcuugauuaacuuugaucagaaauagaaacguuuucauuuguugauuuag

SEQ ID NO: 671542 - RNA, 64 nt, hsa
uuuuagacaugaacccuacuauuuaguuauucuaaaauagaaaguuugcuggagaaagcgucca

SEQ ID NO: 671543 - RNA, 64 nt, hsa
aggaucuuucaaaaaugauuauaaaauucaugugaaauagaaguguaugaauugcugcgacaau

SEQ ID NO: 671544 - RNA, 64 nt, hsa
uucuauuauugaaaauuguauguaaaacuauuuaaaauagaauagaaggauacacacccaauua

SEQ ID NO: 671545 - RNA, 64 nt, hsa
aucugacccuucuuuaaguuauguguguggggagaaauagaauggugcucuuaucuuucuugac

SEQ ID NO: 671546 - RNA, 64 nt, hsa
aguuucaaucaaguuuacauuauguugcuuaaaaaaauagaaauuauucuuuaucuugcaaaga

SEQ ID NO: 671547 - RNA, 64 nt, hsa
agaacucauugagggugcucuugccagcugcugaaaauagaaguuggcuacucucagaauuugg

SEQ ID NO: 671548 - RNA, 64 nt, hsa
gauugguuuuguuuuauaccauaugggaugaagaaaauagaaaugucaguagaacucauugagg

SEQ ID NO: 671549 - RNA, 64 nt, hsa
ccaauaguggauaacauguaucacucacugccaaaaauagaaagugaccaugaaaaauaaauuc

SEQ ID NO: 671550 - RNA, 64 nt, hsa
cccuuguuuuaaucguuauuuuucucuuuaaaaaaaauagaagcuauaaagaaaagagggagag

SEQ ID NO: 671551 - RNA, 64 nt, hsa
ggggguuuuguuuauuuuuggggcuggcaauccaaaauagaaaaucugauccuuugaggcucua

SEQ ID NO: 671552 - RNA, 64 nt, hsa
ggaagucaggguucuagggguuauucgucccaggaaauagaagugaaauugucuuuauuaagug

SEQ ID NO: 671553 - RNA, 64 nt, hsa
uaucucuuuguuguauuuuccaugauguuucuuaaaauagaaaguuuauuuagauucagaauau

SEQ ID NO: 671554 - RNA, 64 nt, hsa
ugguuuagugauaauaauuuuguuuuugaaauacaaauagaaaauccugaaauaauuuuuguga

SEQ ID NO: 671555 - RNA, 64 nt, hsa
gagauguguuaaauaaacugggaaaagaguuugaaaauagaauuuucaagcaacucaaagauua

SEQ ID NO: 671556 - RNA, 64 nt, hsa
caauacguucuuauaaaauacaacacaugcauaaaaauagaagacaaucugcuuguuucugaau

SEQ ID NO: 671557 - RNA, 64 nt, hsa
gaaaucaucugauguuucuauagucacuuugccagcucaaaagaaaacaauacccuauguaguu

SEQ ID NO: 671558 - RNA, 64 nt, hsa
gcauucuuagcaaaauugccuaguauguuaauuugcucaaaauacaauguuugauuuuaugcac

SEQ ID NO: 671559 - RNA, 64 nt, hsa
uaguauuagcauagcauucuuaaaggaaugcagugcucaaaaccuacccaaauucccgcaggau

SEQ ID NO: 671560 - RNA, 64 nt, hsa
ucaccuuuauuucaucuucauaagaaugagaaaggcucaaaaggaagcacuuuuagaaaucuuc

SEQ ID NO: 671561 - RNA, 64 nt, hsa
ggaaugugggaaagccuucaguuaccacuguacugcucaaaaacaugagaggaaucacacugca

SEQ ID NO: 671562 - RNA, 64 nt, hsa
agaauguggaaaagcauuccgauaccaccaaucugcucaaaaacaugaaaaggcucauacugga

SEQ ID NO: 671563 - RNA, 64 nt, hsa
uacacuucauaccuaaaggagauucagagcuaucgcucaaaaccaaaagucuugguuuuuaaau

SEQ ID NO: 671564 - RNA, 64 nt, hsa
aaacaugacugaaaguccagaguguuagcuuagagcucaaaauacuagcugcuguuucaagcug

SEQ ID NO: 671565 - RNA, 64 nt, hsa
uguucuaauauuuugcuccuuuuuaaauuuuguagcucaaaagaccuuaaaggucuguaggguu

SEQ ID NO: 671566 - RNA, 64 nt, hsa
ucagucuggaaacuuaacauuaugagccuuuucugcucaaaaaauuuucaaagauuaaaacuau

SEQ ID NO: 671567 - RNA, 64 nt, hsa; identical to SEQ ID NO: 99247

SEQ ID NO: 671568 - RNA, 64 nt, hsa; identical to SEQ ID NO: 99248

SEQ ID NO: 671569 - RNA, 64 nt, hsa; identical to SEQ ID NO: 99249

SEQ ID NO: 671570 - RNA, 64 nt, hsa; identical to SEQ ID NO: 99250

SEQ ID NO: 671571 - RNA, 64 nt, hsa; identical to SEQ ID NO: 99251

SEQ ID NO: 671572 - RNA, 64 nt, hsa; identical to SEQ ID NO: 99252

SEQ ID NO: 671573 - RNA, 64 nt, hsa; identical to SEQ ID NO: 99253

SEQ ID NO: 671574 - RNA, 64 nt, hsa; identical to SEQ ID NO: 99254

SEQ ID NO: 671575 - RNA, 64 nt, hsa; identical to SEQ ID NO: 99255

SEQ ID NO: 671576 - RNA, 64 nt, hsa; identical to SEQ ID NO: 99256

SEQ ID NO: 671577 - RNA, 64 nt, hsa; identical to SEQ ID NO: 99257

SEQ ID NO: 671578 - RNA, 64 nt, hsa; identical to SEQ ID NO: 99258

SEQ ID NO: 671579 - RNA, 64 nt, hsa; identical to SEQ ID NO: 99259

SEQ ID NO: 671580 - RNA, 64 nt, hsa; identical to SEQ ID NO: 99260

SEQ ID NO: 671581 - RNA, 64 nt, hsa; identical to SEQ ID NO: 99261

SEQ ID NO: 671582 - RNA, 64 nt, hsa; identical to SEQ ID NO: 99262

SEQ ID NO: 671583 - RNA, 64 nt, hsa; identical to SEQ ID NO: 99263

SEQ ID NO: 671584 - RNA, 64 nt, hsa; identical to SEQ ID NO: 99264

SEQ ID NO: 671585 - RNA, 64 nt, hsa; identical to SEQ ID NO: 99265

SEQ ID NO: 671586 - RNA, 64 nt, hsa; identical to SEQ ID NO: 99266

SEQ ID NO: 671587 - RNA, 64 nt, hsa; identical to SEQ ID NO: 99267

SEQ ID NO: 671588 - RNA, 64 nt, hsa; identical to SEQ ID NO: 99268

SEQ ID NO: 671589 - RNA, 64 nt, hsa; identical to SEQ ID NO: 99269

SEQ ID NO: 671590 - RNA, 64 nt, hsa; identical to SEQ ID NO: 99270

SEQ ID NO: 671591 - RNA, 64 nt, hsa; identical to SEQ ID NO: 99271

SEQ ID NO: 671592 - RNA, 63 nt, hsa
cacuaaagucacuuuaaagcuuuuggagaagcaggagggcauuggcuuaaccaagccgaaggc

SEQ ID NO: 671593 - RNA, 63 nt, hsa
gccccagcugucgccuuucugaccagcaggccuggagggcaggggcacagagcagagaggagg

SEQ ID NO: 671594 - RNA, 63 nt, hsa
gcaggccuggagggcaggggcacagagcagagaggagggcacugguggucuccugcuuagccu

SEQ ID NO: 671595 - RNA, 63 nt, hsa
caccaugcuuccccuagaaggguucugaucaccggagggcagccccaaaggccacaguccccu

SEQ ID NO: 671596 - RNA, 63 nt, hsa
uaagggacaggcacagcagaggugagagugggaggagggcacguaccgggugccagcccugga

SEQ ID NO: 671597 - RNA, 63 nt, hsa
cucuuagcccccuggcuuugugccaggccuggaggagggcagucccccauggggugccgagcc

SEQ ID NO: 671598 - RNA, 63 nt, hsa
cgcuggagcugaaggaauggacgagcccugggaggagggcagaaggcuacgcagggcugagga

SEQ ID NO: 671599 - RNA, 63 nt, hsa
uuaguguacgauguuugcugugcuucccgccguggagggcagagccaccccacaucaggaucg

SEQ ID NO: 671600 - RNA, 63 nt, hsa
ugcuggugucugggaccaaaaagggggaauaugggagggcagaguggggaggggaguccaugg

SEQ ID NO: 671601 - RNA, 63 nt, hsa
uuccuuucccaguuguuacccuagcaaggcuagggagggcaugaacacaaacauaagaacugg

SEQ ID NO: 671602 - RNA, 63 nt, hsa
gggugaaacuccagcagguggcugggcuggaaaggagggcagggcuacauccuggcucggugg

SEQ ID NO: 671603 - RNA, 63 nt, hsa
auccauagacacaugcuaggauaggccccgcugggagggcaguuacaggagagaguagguggu

SEQ ID NO: 671604 - RNA, 63 nt, hsa
gcuagccaaguuuucugcgagccuucagagcuaggagggcacccuaggcucugggaucccgug

SEQ ID NO: 671605 - RNA, 63 nt, hsa
gcccagcaguguggagacccugccacagccagaggagggcagagggagaauccaaggguugag

SEQ ID NO: 671606 - RNA, 63 nt, hsa
acucccugggacacagacccaggacccccgaggggagggcaggauggccuuuccuucccucuc

SEQ ID NO: 671607 - RNA, 63 nt, hsa
uuccuggguacccaggccugaccagagggagcgggagggcagaggugaggagggggaagaugu

SEQ ID NO: 671608 - RNA, 63 nt, hsa
ccauaauuguaaccagugccuuuccuccccacuggagggcaagcccccccacccacccaggau

SEQ ID NO: 671609 - RNA, 63 nt, hsa
cucggccaggugcugaucggugagguggccuggggagggcagaggcaagguuaccagggcacc

SEQ ID NO: 671610 - RNA, 63 nt, hsa
agggcuuggauugauguuuauacccucugaauuggagggcagugccagggcauuugcagaagc

SEQ ID NO: 671611 - RNA, 63 nt, hsa
gucuccagcuucagccuuuccagaaacccuuguggagggcaguguuggcugcagguuucauca

SEQ ID NO: 671612 - RNA, 63 nt, hsa
aguaaaugggggccguugggacggcgggugccuggagggcagcucugggcucagcgggcagug

SEQ ID NO: 671613 - RNA, 63 nt, hsa
ggagggccaugugcaauauuuggaggguuuucuggagggcagcaggaaggcuggggaauuccc

SEQ ID NO: 671614 - RNA, 63 nt, hsa
ugugucucaugcacuggcacauauggucaccuuggagggcagaccuaggagccccucugacca

SEQ ID NO: 671615 - RNA, 63 nt, hsa
acccccuucaagaggcgccauagacccuagcggggagggcaggggagggacggaaggcuggca

SEQ ID NO: 671616 - RNA, 63 nt, hsa
agcaccuggcuaagggcugggccuggccagcagggagggcaguugaugagagaggguguuccc

SEQ ID NO: 671617 - RNA, 63 nt, hsa
gagagcagagaaugggggaacuugaggguggggggagggcaccggagccuugccaccauccca

SEQ ID NO: 671618 - RNA, 63 nt, hsa
uggcgggcuggggagcggcccccagccgggacgggagggcagcgaccccgaggccucguggac

SEQ ID NO: 671619 - RNA, 63 nt, hsa
cuuucccaggguaucuguggguugccaggcuggggagggcaaccauagccacaccacaggauu

SEQ ID NO: 671620 - RNA, 63 nt, hsa
cagugcccacccagccccucagguggcacaucuggagggcagggguugaggggccaccaccac

SEQ ID NO: 671621 - RNA, 63 nt, hsa
uuagaaggggaugagucagauuuuuacagaggaggagggcagggcuuggguccaguggaggaa

SEQ ID NO: 671622 - RNA, 63 nt, hsa
gauggccaucagacagagacuucaaaugcugauggagggcagaggaaguacuuagggagguug

SEQ ID NO: 671623 - RNA, 63 nt, hsa
ucaggcaggagggcagggaugguggcagccauaggagggcaggguaggguagggccucugagg

SEQ ID NO: 671624 - RNA, 63 nt, hsa
agcugagcagagaggccuaaccaggaucaggcaggagggcagggaugguggcagccauaggag

SEQ ID NO: 671625 - RNA, 63 nt, hsa
caacaaggagcuggguguggaccaggagucagaggagggcaaaggcaaaacaagcccugauaa

SEQ ID NO: 671626 - RNA, 63 nt, hsa
cuuugacaguuucaucugcugcuucguuaggcuggagggcauguucaguaagugggagagggg

SEQ ID NO: 671627 - RNA, 63 nt, hsa
ccugacuggcuccuagggaaggggaaggcuccuggagggcagcccuaccucucccaugcccuu

SEQ ID NO: 671628 - RNA, 63 nt, hsa
ugaaaucuuggauuuggggcugaggggugggagggagggcagagcucugcacacucaaaggcu

SEQ ID NO: 671629 - RNA, 63 nt, hsa
uggcagcacagccacacccguucccacgucagaggagggcaaggcuggguacucagcagccac

SEQ ID NO: 671630 - RNA, 63 nt, hsa
cagccuggagccagcccggggacuguccuggguggagggcaggugaacacaagcugcugccgg

SEQ ID NO: 671631 - RNA, 63 nt, hsa
gaggccagggacagucuugccagacgacucugaggagggcaagggacaguuccauggcccuuc

SEQ ID NO: 671632 - RNA, 63 nt, hsa
ggcagaaggaaaauggggaggcacugggguuguggagggcauggguauggcugaggagggugc

SEQ ID NO: 671633 - RNA, 63 nt, hsa
uggagcuggucacgcugggcgcccaggaggaagggagggcagagggggcuguggccgucagug

SEQ ID NO: 671634 - RNA, 63 nt, hsa
ggcagcagaacuagugccagggguggcugaguuggagggcaagggcuggggcugggaugggag

SEQ ID NO: 671635 - RNA, 63 nt, hsa
ucaagaugcccaagaugaccaugcccaagcuagggagggcagaguccccaucacguggcaagc

SEQ ID NO: 671636 - RNA, 63 nt, hsa
ccccuuaaagcagagagggagggcaggcgggagggagggcauuggcaugcggcgcugugcaug

SEQ ID NO: 671637 - RNA, 63 nt, hsa
cccaaaagccccagauccccuuaaagcagagagggagggcaggcgggagggagggcauuggca

SEQ ID NO: 671638 - RNA, 63 nt, hsa
caccucccuagagggagggagggagggcaggguggagggcaaggcuggggggaggggauuggg

SEQ ID NO: 671639 - RNA, 63 nt, hsa
ugcaggaccucacaccucccuagagggagggagggagggcaggguggagggcaaggcuggggg

SEQ ID NO: 671640 - RNA, 63 nt, hsa
cuggaggagagacggggcugggcgcaagguggcggagggcaguguggguucugugucugucug

SEQ ID NO: 671641 - RNA, 63 nt, hsa
augcccugaagaggcaggguacacauggggcugggagggcaaagauggggcggggccuccccc

SEQ ID NO: 671642 - RNA, 63 nt, hsa
gcuacgccacagcuggacacacaugcagccccuggagggcagccucuuccugugccucgaugg

SEQ ID NO: 671643 - RNA, 63 nt, hsa
gcagccucuuccugugccucgauggggugggugggagggcaucuucugugcguugggucaguu

SEQ ID NO: 671644 - RNA, 63 nt, hsa
accuuguuuugccagugauaagagcaguggguuggagggcacuuggccaguuuucuguucagc

SEQ ID NO: 671645 - RNA, 63 nt, hsa
uccaacagagggaggaaugugugccuuguucaaggagggcacgacccuuaggccuuuuucaac

SEQ ID NO: 671646 - RNA, 65 nt, hsa; identical to SEQ ID NO: 65698

SEQ ID NO: 671647 - RNA, 65 nt, hsa; identical to SEQ ID NO: 65699

SEQ ID NO: 671648 - RNA, 65 nt, hsa; identical to SEQ ID NO: 65706

SEQ ID NO: 671649 - RNA, 65 nt, hsa; identical to SEQ ID NO: 65707

SEQ ID NO: 671650 - RNA, 65 nt, hsa; identical to SEQ ID NO: 65720

SEQ ID NO: 671651 - RNA, 65 nt, hsa; identical to SEQ ID NO: 65721

SEQ ID NO: 671652 - RNA, 65 nt, hsa; identical to SEQ ID NO: 65744

SEQ ID NO: 671653 - RNA, 65 nt, hsa; identical to SEQ ID NO: 65745

SEQ ID NO: 671654 - RNA, 65 nt, hsa; identical to SEQ ID NO: 65788

SEQ ID NO: 671655 - RNA, 65 nt, hsa; identical to SEQ ID NO: 65789

SEQ ID NO: 671656 - RNA, 65 nt, hsa; identical to SEQ ID NO: 65808

SEQ ID NO: 671657 - RNA, 65 nt, hsa; identical to SEQ ID NO: 65809

SEQ ID NO: 671658 - RNA, 65 nt, hsa; identical to SEQ ID NO: 65810

SEQ ID NO: 671659 - RNA, 65 nt, hsa; identical to SEQ ID NO: 65811

SEQ ID NO: 671660 - RNA, 65 nt, hsa; identical to SEQ ID NO: 65827

SEQ ID NO: 671661 - RNA, 65 nt, hsa; identical to SEQ ID NO: 65828

SEQ ID NO: 671662 - RNA, 65 nt, hsa; identical to SEQ ID NO: 65831

SEQ ID NO: 671663 - RNA, 56 nt, hsa; identical to SEQ ID NO: 61369

SEQ ID NO: 671664 - RNA, 65 nt, hsa; identical to SEQ ID NO: 65853

SEQ ID NO: 671665 - RNA, 65 nt, hsa; identical to SEQ ID NO: 65854

SEQ ID NO: 671666 - RNA, 65 nt, hsa; identical to SEQ ID NO: 65891

SEQ ID NO: 671667 - RNA, 65 nt, hsa; identical to SEQ ID NO: 65892

SEQ ID NO: 671668 - RNA, 65 nt, hsa; identical to SEQ ID NO: 65896

SEQ ID NO: 671669 - RNA, 65 nt, hsa; identical to SEQ ID NO: 65897

SEQ ID NO: 671670 - RNA, 64 nt, hsa
gcacagugcugagaaacaguucauccauggugccauguuaaagaaguuggaaauauaucuugaa

SEQ ID NO: 671671 - RNA, 64 nt, hsa
auagucuuaugugcaguaacuauaaugguaaagaauguuaaauaauaaaauuuaacauuuucca

SEQ ID NO: 671672 - RNA, 64 nt, hsa
ccugcuccccucaaaagauuuuuagucauacagaauguuaaauauuauguauucugacuuuuuu

SEQ ID NO: 671673 - RNA, 64 nt, hsa
gaacuuuuauauauucaauuccuuuucugguguaauguuaaaguuguauagauuauuaaugcau

SEQ ID NO: 671674 - RNA, 64 nt, hsa
auuaauggccccuaacagcaguuguacuguuuguauguuaaacuugauacauuuagaaguuaau

SEQ ID NO: 671675 - RNA, 64 nt, hsa
guuuguauguuaaacuugauacauuuagaaguuaauguuaaagccuaauccuaaauuuuuaaaa

SEQ ID NO: 671676 - RNA, 64 nt, hsa
caaauaugaaugaauauuguucaaagcaaggaguauguuaaaaugaccagacaccuguuugaua

SEQ ID NO: 671677 - RNA, 64 nt, hsa
auuugacuuuaugacauugcuuuucaacaagcaaauguuaaauguguuaagccuuguaguacua

SEQ ID NO: 671678 - RNA, 64 nt, hsa
aucugauuccugugauaacuuaaaaggcucuuuuauguuaaaagagaggugaaucuucuuugac

SEQ ID NO: 671679 - RNA, 64 nt, hsa
auucacuuuaguuucucacagaaucauugcaauuauguuaaaagaaaucucuacauaaaucgua

SEQ ID NO: 671680 - RNA, 64 nt, hsa
aggaaucuaauuauaucgaaauacaguuauuaaaauguuaaaagauaaguuuguuauauauuaa

SEQ ID NO: 671681 - RNA, 64 nt, hsa
uaaaaaaagaggauucaacacauauuuuuauauuauguuaaaguaaagaaaugcauaaaagaca

SEQ ID NO: 671682 - RNA, 64 nt, hsa
guuuuguagauuaucuuuuaaugaacuauuuuaaauguuaaauuaggugccacuuaaauuuauu

SEQ ID NO: 671683 - RNA, 64 nt, hsa
aagagaauagauguuucccaaaacaacaaucuuuauguuaaaaauagucauuaaaagaucuguu

SEQ ID NO: 671684 - RNA, 64 nt, hsa
acgaguccuaauuuacaacagcuagucuuuccagauguuaaagaacuucuaucaauagaguaac

SEQ ID NO: 671685 - RNA, 64 nt, hsa
cuguuucuucuagauguucugaaguaccugauacauguuaaaauuagagguaguaaaaugacac

SEQ ID NO: 671686 - RNA, 64 nt, hsa
auacuuuauaauaaaacacuuuuauugcugcagaauguuaaacugcauaacaggcaccagaugg

SEQ ID NO: 671687 - RNA, 64 nt, hsa
uguguugcuucaugccuuggugauggaugccagcauguuaaacugcugaaguuugauuuucuga

SEQ ID NO: 671688 - RNA, 64 nt, hsa
aaaagauauaagugcuguauaaaaucagccaauuauguuaaacuagcauaucugccuuuauugu

SEQ ID NO: 671689 - RNA, 64 nt, hsa
auugccauauugcacaugucuuaaugaaguuugaauguuaaauaaauuguauauucacuuuaaa

SEQ ID NO: 671690 - RNA, 64 nt, hsa
aaaguuuuuuuuuauuauuuuuuuaaaauuuuguauguuaaagagaaugaguccuugauuucaa

SEQ ID NO: 671691 - RNA, 64 nt, hsa
uaauccccuaaaauaacaguaugugggauauugaauguuaaagggauauuuuuuucuauuauuu

SEQ ID NO: 671692 - RNA, 64 nt, hsa
ucuauuauuuuuauaauuguacaaaauuaagcaaauguuaaaaguuuuauaugcuuuauuaaug

SEQ ID NO: 671693 - RNA, 64 nt, hsa
uuauaggcuuuuuguuaaaauagugaaggaacaaauguuaaaggguaagauaauuucccugcaa

SEQ ID NO: 671694 - RNA, 64 nt, hsa
cugcauuaguauaaagagucuguauuuuuaauaaauguuaaauaagcuaacaauguuuguacuu

SEQ ID NO: 671695 - RNA, 64 nt, hsa
gauucccaauauuuguuguacuuuuuuguagcaaauguuaaaaaucacgaguuaccauguauag

SEQ ID NO: 671696 - RNA, 64 nt, hsa
acagaagugacuucauucuuuuuagacaucagaaauguuaaaguugauucccaauauuuguugu

SEQ ID NO: 671697 - RNA, 64 nt, hsa
guuaaaggagauauggcuaguggcaauaaguuccauguuaaaauagacaacucuuccauuuauu

SEQ ID NO: 671698 - RNA, 64 nt, hsa
ucauuaaauuggaauuuucuuacccauauaucuuauguuaaaggagauauggcuaguggcaaua

SEQ ID NO: 671699 - RNA, 64 nt, hsa
gugauaaagcuauaaaauucaauaacuuuuuagaauguuaaaugaagacacuguuuccuaacau

SEQ ID NO: 671700 - RNA, 64 nt, hsa
cacuauauuuuuuccaaaaaauaugugauuauauauguuaaaguauagauaacauuucacacuu

SEQ ID NO: 671701 - RNA, 64 nt, hsa
uuucuucacuaaaaccuauuuucauaugauauacauguuaaauuucccuuuuauuuuggucaug

SEQ ID NO: 671702 - RNA, 64 nt, hsa
ucuuuuccuauucuuuuuuauaaugcuuacaggaauguuaaauacuuagacagaucuuaaguac

SEQ ID NO: 671703 - RNA, 64 nt, hsa
gauuuguuuauacacauuuuauuuguaucauuucauguuaaaccucaaauaaaugcuuccuuau

SEQ ID NO: 671704 - RNA, 64 nt, hsa
ggcauacaccagaaaacgcuguccuguggaggagauguuaaaguaacccaucuugcaggacgac

SEQ ID NO: 671705 - RNA, 64 nt, hsa
aaaccacuggguaugaggaauaugcuagaaagaaauguuaaaaauagauuguuggcucacacuu

SEQ ID NO: 671706 - RNA, 64 nt, hsa
acuucagaguuugcaaccuugcccugagugaaucauguuaaagcugucugagucuaaagcaccg

SEQ ID NO: 671707 - RNA, 64 nt, hsa
cuaagauuacauuguaaaauuccagguuuucauaauguuaaaauaggaaaguagaauauaaagu

SEQ ID NO: 671708 - RNA, 64 nt, hsa
auuuuuacacauuuuuacaauauugccucagauuauguuaaauuugggucagucuucucugaac

SEQ ID NO: 671709 - RNA, 64 nt, hsa
aaaaaagugaauuugugaagcaaaguuuugccagauguuaaacuuugaauuuaauauaccagau

SEQ ID NO: 671710 - RNA, 64 nt, hsa
aaaucucauuugucuaauugcaauuaaaagaaaaauguuaaaauauuaaaaugaaaauaaaagc

SEQ ID NO: 671711 - RNA, 64 nt, hsa
ggccugcaucacaauugagguaauguagagcaacauguuaaagaaugaugguuagcagaagcug

SEQ ID NO: 671712 - RNA, 64 nt, hsa
gucucuucugaugagguaacaauuagaugaaaccauguuaaagcugagaugaacacuuagaaau

SEQ ID NO: 671713 - RNA, 64 nt, hsa
auucuaccaucccuugggucuuuguguauaaacaauguuaaauaaagguagacucagucuuuaa

SEQ ID NO: 671714 - RNA, 64 nt, hsa
uaacuuagggacauuuugacaccccccuucccaaauguuaaaugccuucuccuuuuuaccgaua

SEQ ID NO: 671715 - RNA, 64 nt, hsa
cccuacugugaccaaauuucuguauuacgauuuuauguuaaauuaaacuaauauggcagguuau

SEQ ID NO: 671716 - RNA, 64 nt, hsa
aguaacugccaguuaggaagaacaguaaacagugauguuaaaauaaaacaaugauuugcuaagg

SEQ ID NO: 671717 - RNA, 64 nt, hsa
aaacgaucuguauuauuaaauaaauaauuuucaaauguuaaacaguauuaaauggcaccugauu

SEQ ID NO: 671718 - RNA, 64 nt, hsa
cuguuagguugauuuuuuuuggaaucaauaugcaauguuaaacacuuuuuuaauguaaucauuu

SEQ ID NO: 671719 - RNA, 64 nt, hsa
ggagugcuuuucuucucaauuguuagaagaauuuauguuaaacuuuaagguaaggguguaaaaa

SEQ ID NO: 671720 - RNA, 64 nt, hsa
cccaaguaagguucucaaauguagaaaauuauaaauguuaaaaggaaguuauugaagaaaauaa

SEQ ID NO: 671721 - RNA, 64 nt, hsa
aacucuaugguauuuuucuuauucuuguuugaucauguuaaaaauuggaccuaauaaaaguauu

SEQ ID NO: 671722 - RNA, 64 nt, hsa
ugcucagccacauacuguagagagaggcaauuuaauguuaaaugacgcaccauccucccuccca

SEQ ID NO: 671723 - RNA, 64 nt, hsa
uucugaguagcucagguguggcuuuuggcugcagauguuaaauuuugauaccauguaaaccuac

SEQ ID NO: 671724 - RNA, 64 nt, hsa
agcuuuacaucauuuuuacauaucaagugguuucauguuaaaaaacaaacuccuaguccuuuag

SEQ ID NO: 671725 - RNA, 64 nt, hsa
guaucugcuccauagguuucuguuuuuaauuucaauguuaaauacaacuacaauaugagcgaga

SEQ ID NO: 671726 - RNA, 64 nt, hsa
gccuugcaggaaugagucacucuuacuuaaugaaauguuaaagccaauuaaaaagcaugcugug

SEQ ID NO: 671727 - RNA, 64 nt, hsa
gauaccagcuucaugcaccuucuaguuguacaaaauguuaaagacguuguuuguauuuguaagg

SEQ ID NO: 671728 - RNA, 64 nt, hsa
guuaaauagaugagauuauggaauguguauauuaauguuaaaaauuguaccuugaucaauguac

SEQ ID NO: 671729 - RNA, 64 nt, hsa
gagaaaaaaauaacaacaacaaaggccuguguuaauguuaaauagaugagauuauggaaugugu

SEQ ID NO: 671730 - RNA, 64 nt, hsa
ucuuaugaugaggcuaaauaaaagucuaauaaaaauguuaaauaugugaaugguggaaauggug

SEQ ID NO: 671731 - RNA, 64 nt, hsa
agagugauguuaucuaaguuuaaguaguuuaaguauguuaaauguggaucuuuuacaccacauc

SEQ ID NO: 671732 - RNA, 64 nt, hsa
ccaaauaauucuguaagauauaccucuuccucauauguuaaauauuuuguaaaguuuaccaauu

SEQ ID NO: 671733 - RNA, 64 nt, hsa
uaugaugagcaaauauaaguuaaugccaaacguuauguuaaaguuauuuuuucaaauacaggau

SEQ ID NO: 671734 - RNA, 64 nt, hsa
agauuuuuguaaauguuaaaacaucuauauuuaaauguuaaaacacuaaauauagagaggggcu

SEQ ID NO: 671735 - RNA, 64 nt, hsa
aguugugacuucuauauucaauagauuuuuguaaauguuaaaacaucuauauuuaaauguuaaa

SEQ ID NO: 671736 - RNA, 64 nt, hsa
ccuguuauaaacguugaacuuucacaauguuaaaauguuaaauauuuggauauagcaacuucuu

SEQ ID NO: 671737 - RNA, 64 nt, hsa
uaaaaagcccuguuauaaacguugaacuuucacaauguuaaaauguuaaauauuuggauauagc

SEQ ID NO: 671738 - RNA, 64 nt, hsa
uggcugaauguuugcuauauauauguuacuugaaauguuaaauuuaauaugcagcauaccauag

SEQ ID NO: 671739 - RNA, 64 nt, hsa
uuaaaaagaaauuuauauaaaauuuaaaauacaaauguuaaauuauccagaaauacagaauagu

SEQ ID NO: 671740 - RNA, 64 nt, hsa
uaaauagguauuuuaaaacauuguuuaaaacagaauguuaaaacacuguuguuuaagcauguuu

SEQ ID NO: 671741 - RNA, 64 nt, hsa
ugaccuuuuaagaauguuuaauuuuaugaauacuauguuaaaauguaaaucuguugguuuuuuu

SEQ ID NO: 671742 - RNA, 64 nt, hsa
aauguuugaccugaugacugauguuguaugguuuauguuaaauguauauucuuuuaaucaauga

SEQ ID NO: 671743 - RNA, 64 nt, hsa
cccaguuuuaagugguacgaauguugugcauuuaauguuaaaggacagucugcaauaauaaagu

SEQ ID NO: 671744 - RNA, 64 nt, hsa
uuuuuguuuuuccacuuaucuugaguucacuuugauguuaaaucuauugcuacuucaguuguaa

SEQ ID NO: 671745 - RNA, 64 nt, hsa
uucucuuccauuguacauguggguuauauaccauauguuaaauaugcaauaaaguguuuacagg

SEQ ID NO: 671746 - RNA, 64 nt, hsa
uacauuaaaauacuuguaugaggacugugacguuauguuaaaaaaaaaaagguguuaagucaca

SEQ ID NO: 671747 - RNA, 64 nt, hsa
cccuggaaugacuaugucagcacagagccccacaauguuaaauucuguagaucccaauguuggc

SEQ ID NO: 671748 - RNA, 64 nt, hsa
acuauggauuucaaaugcuuaaucucacaaagaaauguuaaauugauauaauccuguaaguaau

SEQ ID NO: 671749 - RNA, 64 nt, hsa
acaaugaauuuaaauguguuucucauauucagguauguuaaauuguauaugguugcuuaauugu

SEQ ID NO: 671750 - RNA, 64 nt, hsa
cagugagaaugcauuugaucuugaagccaugagcauguuaaauagagcucaggaaaggguaugu

SEQ ID NO: 671751 - RNA, 64 nt, hsa
uguuugaaggcaucagaguaaucuucaguguggaauguuaaauaacgcuuuuauacuguauuuu

SEQ ID NO: 671752 - RNA, 64 nt, hsa
acuaguuuaucauuaaccacuuaucaguguauugauguuaaagcauuucccuguuagcuaaaag

SEQ ID NO: 671753 - RNA, 64 nt, hsa
ugcucugcucuaccauguuuaaagaaauauuuggauguuaaauuaacucacuaugguuuuucac

SEQ ID NO: 671754 - RNA, 64 nt, hsa
cuaccugccuugccuguuaggucuguugaagugcauguuaaaauaauuauaugaagcagaauga

SEQ ID NO: 671755 - RNA, 64 nt, hsa
aauauacucauuuggauauaaaucuuacccuucaauguuaaaucuacaaacuuuuauaaauguu

SEQ ID NO: 671756 - RNA, 64 nt, hsa
uuaauuuucuuguauuuauauguuaaaaucaaaaauguuaaaaucaaugaaauaaauuugcagu

SEQ ID NO: 671757 - RNA, 64 nt, hsa
ucuuuucugauuuauuuaauuuucuuguauuuauauguuaaaaucaaaaauguuaaaaucaaug

SEQ ID NO: 671758 - RNA, 64 nt, hsa
aaauuguccuuguacucucagcuccugcauggaucugggucaaguagaagguacuggggauggg

SEQ ID NO: 671759 - RNA, 64 nt, hsa
ggaggaagccuggugaauuuagugagcagcuggccugggucacagugaccugaccucaaaccag

SEQ ID NO: 671760 - RNA, 64 nt, hsa
agagccaauguucgucauugcagcucucagcaaacugggucauagcuuuccccacagcucagcc

SEQ ID NO: 671761 - RNA, 64 nt, hsa
accuccccacccccaggggaggccaggcagaagccugggucacagcacccagaacugcaugguu

SEQ ID NO: 671762 - RNA, 64 nt, hsa
caaaacugagcauccaucccagaucugucugacucugggucagugacccugcuccgauuccaua

SEQ ID NO: 671763 - RNA, 64 nt, hsa
uuuuauuuucuuauacaccaaaaguccugcuuuucugggucaauuuucaacuauuauuacuaau

SEQ ID NO: 671764 - RNA, 64 nt, hsa
acaaggaggcccgggccagggacuucaccaggggcugggucacaagggcacaggguguguggaa

SEQ ID NO: 671765 - RNA, 64 nt, hsa
ggggucuaaacagaacaggcugagagaggcgggacugggucaaguggguggagcuccuccuugc

SEQ ID NO: 671766 - RNA, 64 nt, hsa
cccgguccggagcguggugagcuuuguuugccuucugggucagcuuucgcugugucuccugugu

SEQ ID NO: 671767 - RNA, 64 nt, hsa
augcagaagcagaagagggaggggaaaccugccucugggucacccuguuagcacagcguucuca

SEQ ID NO: 671768 - RNA, 64 nt, hsa
gcagauuuauuuuugaaacaaacauggauacuuccugggucaagugcuaaccuuuucaccucca

SEQ ID NO: 671769 - RNA, 64 nt, hsa
cuuugccccagggaaaguuggagaguacggcuaccugggucaacccaacgcggugcgcaccaac

SEQ ID NO: 671770 - RNA, 64 nt, hsa
gaugcuggagaagagcugccaggaaguguuuuuucugggucaguaaauaacaacugucauaggg

SEQ ID NO: 671771 - RNA, 64 nt, hsa
gagccacguugcuccuaagccuggcucugucaagcugggucaggggccuugaaacuggagaagu

SEQ ID NO: 671772 - RNA, 64 nt, hsa; identical to SEQ ID NO: 153638

SEQ ID NO: 671773 - RNA, 64 nt, hsa; identical to SEQ ID NO: 153639

SEQ ID NO: 671774 - RNA, 64 nt, hsa; identical to SEQ ID NO: 153640

SEQ ID NO: 671775 - RNA, 64 nt, hsa; identical to SEQ ID NO: 153641

SEQ ID NO: 671776 - RNA, 64 nt, hsa; identical to SEQ ID NO: 153642

SEQ ID NO: 671777 - RNA, 64 nt, hsa; identical to SEQ ID NO: 153643

SEQ ID NO: 671778 - RNA, 64 nt, hsa; identical to SEQ ID NO: 153644

SEQ ID NO: 671779 - RNA, 64 nt, hsa; identical to SEQ ID NO: 153645

SEQ ID NO: 671780 - RNA, 64 nt, hsa; identical to SEQ ID NO: 153646

SEQ ID NO: 671781 - RNA, 64 nt, hsa; identical to SEQ ID NO: 153647

SEQ ID NO: 671782 - RNA, 64 nt, hsa; identical to SEQ ID NO: 153648

SEQ ID NO: 671783 - RNA, 64 nt, hsa; identical to SEQ ID NO: 153649

SEQ ID NO: 671784 - RNA, 64 nt, hsa; identical to SEQ ID NO: 153650

SEQ ID NO: 671785 - RNA, 64 nt, hsa; identical to SEQ ID NO: 153651

SEQ ID NO: 671786 - RNA, 64 nt, hsa; identical to SEQ ID NO: 153652

SEQ ID NO: 671787 - RNA, 64 nt, hsa; identical to SEQ ID NO: 153653

SEQ ID NO: 671788 - RNA, 64 nt, hsa; identical to SEQ ID NO: 153654

SEQ ID NO: 671789 - RNA, 64 nt, hsa; identical to SEQ ID NO: 153655

SEQ ID NO: 671790 - RNA, 64 nt, hsa; identical to SEQ ID NO: 153656

SEQ ID NO: 671791 - RNA, 64 nt, hsa; identical to SEQ ID NO: 153657

SEQ ID NO: 671792 - RNA, 64 nt, hsa; identical to SEQ ID NO: 153658

SEQ ID NO: 671793 - RNA, 64 nt, hsa; identical to SEQ ID NO: 153659

SEQ ID NO: 671794 - RNA, 64 nt, hsa; identical to SEQ ID NO: 153660

SEQ ID NO: 671795 - RNA, 64 nt, hsa; identical to SEQ ID NO: 153661

SEQ ID NO: 671796 - RNA, 64 nt, hsa; identical to SEQ ID NO: 153662

SEQ ID NO: 671797 - RNA, 64 nt, hsa; identical to SEQ ID NO: 153663

SEQ ID NO: 671798 - RNA, 64 nt, hsa; identical to SEQ ID NO: 153664

SEQ ID NO: 671799 - RNA, 64 nt, hsa; identical to SEQ ID NO: 153665

SEQ ID NO: 671800 - RNA, 64 nt, hsa; identical to SEQ ID NO: 153666

SEQ ID NO: 671801 - RNA, 64 nt, hsa; identical to SEQ ID NO: 153667

SEQ ID NO: 671802 - RNA, 64 nt, hsa; identical to SEQ ID NO: 153668

SEQ ID NO: 671803 - RNA, 64 nt, hsa; identical to SEQ ID NO: 153669

SEQ ID NO: 671804 - RNA, 64 nt, hsa; identical to SEQ ID NO: 153670

SEQ ID NO: 671805 - RNA, 64 nt, hsa; identical to SEQ ID NO: 153671

SEQ ID NO: 671806 - RNA, 64 nt, hsa; identical to SEQ ID NO: 153672

SEQ ID NO: 671807 - RNA, 64 nt, hsa; identical to SEQ ID NO: 153673

SEQ ID NO: 671808 - RNA, 64 nt, hsa; identical to SEQ ID NO: 275490

SEQ ID NO: 671809 - RNA, 64 nt, hsa; identical to SEQ ID NO: 275491

SEQ ID NO: 671810 - RNA, 64 nt, hsa; identical to SEQ ID NO: 275492

SEQ ID NO: 671811 - RNA, 64 nt, hsa; identical to SEQ ID NO: 275493

SEQ ID NO: 671812 - RNA, 64 nt, hsa; identical to SEQ ID NO: 275494

SEQ ID NO: 671813 - RNA, 64 nt, hsa; identical to SEQ ID NO: 275495

SEQ ID NO: 671814 - RNA, 64 nt, hsa; identical to SEQ ID NO: 275496

SEQ ID NO: 671815 - RNA, 64 nt, hsa; identical to SEQ ID NO: 275497

SEQ ID NO: 671816 - RNA, 64 nt, hsa; identical to SEQ ID NO: 275498

SEQ ID NO: 671817 - RNA, 64 nt, hsa; identical to SEQ ID NO: 275499

SEQ ID NO: 671818 - RNA, 64 nt, hsa; identical to SEQ ID NO: 275500

SEQ ID NO: 671819 - RNA, 64 nt, hsa; identical to SEQ ID NO: 275501

SEQ ID NO: 671820 - RNA, 64 nt, hsa; identical to SEQ ID NO: 275502

SEQ ID NO: 671821 - RNA, 64 nt, hsa; identical to SEQ ID NO: 275503

SEQ ID NO: 671822 - RNA, 64 nt, hsa; identical to SEQ ID NO: 275504

SEQ ID NO: 671823 - RNA, 64 nt, hsa; identical to SEQ ID NO: 275505

SEQ ID NO: 671824 - RNA, 64 nt, hsa; identical to SEQ ID NO: 275506

SEQ ID NO: 671825 - RNA, 64 nt, hsa; identical to SEQ ID NO: 275507

SEQ ID NO: 671826 - RNA, 64 nt, hsa; identical to SEQ ID NO: 275508

SEQ ID NO: 671827 - RNA, 64 nt, hsa; identical to SEQ ID NO: 275509

SEQ ID NO: 671828 - RNA, 64 nt, hsa; identical to SEQ ID NO: 275510

SEQ ID NO: 671829 - RNA, 64 nt, hsa; identical to SEQ ID NO: 275511

SEQ ID NO: 671830 - RNA, 64 nt, hsa; identical to SEQ ID NO: 275512

SEQ ID NO: 671831 - RNA, 64 nt, hsa; identical to SEQ ID NO: 275513

SEQ ID NO: 671832 - RNA, 64 nt, hsa; identical to SEQ ID NO: 275514

SEQ ID NO: 671833 - RNA, 64 nt, hsa; identical to SEQ ID NO: 275515

SEQ ID NO: 671834 - RNA, 64 nt, hsa; identical to SEQ ID NO: 275516

SEQ ID NO: 671835 - RNA, 64 nt, hsa; identical to SEQ ID NO: 275517

SEQ ID NO: 671836 - RNA, 64 nt, hsa
cugccccugcccccuggcccccacucccccggcuccguguaaaauaaauguuccagcccaaccu

SEQ ID NO: 671837 - RNA, 64 nt, hsa
ugaaaccacgcugcgcuuccgaugcccccgcuugccguguaaugguucagcuaaucccauggcg

SEQ ID NO: 671838 - RNA, 64 nt, hsa
ggguauuccagaguggggauaugauuuaaaucagccguguaaccauggacccaauauuuaccag

SEQ ID NO: 671839 - RNA, 64 nt, hsa
uguggcauugucuguaaugacaaauaaguggaaaccguguaaauaccugucaauacuauggagu

SEQ ID NO: 671840 - RNA, 64 nt, hsa
cauauucuaugugcuuccccugaagagugaggacccguguaacuggcaguguuacauugacccc

SEQ ID NO: 671841 - RNA, 64 nt, hsa
cauuaauuuuuauuuacagauugaaaaagagggaccguguaaagaaaauggaaaauaaauaucu

SEQ ID NO: 671842 - RNA, 64 nt, hsa
cuuagaugcccaucuggacgugaugccgcgccugccguguaagaaggugcaauccuagauaaca

SEQ ID NO: 671843 - RNA, 64 nt, hsa
uguaugaccaauguagccauugcuuuaaaauguaccguguaaauauaaacacauccuaucagau

SEQ ID NO: 671844 - RNA, 64 nt, hsa
uagaggcaacucccaggccagugagcuuuacuugccguguaaaaggaggaaagggguggaaaaa

SEQ ID NO: 671845 - RNA, 64 nt, hsa
gcucuagaaaaaccaccaaacaugacuguucuuuccguguaagcuaucccaccucagcggcacc

SEQ ID NO: 671846 - RNA, 64 nt, hsa
caguuugagcguuccccugagaugugcguagccuccguguaaauguccacucccauggcuuaau

SEQ ID NO: 671847 - RNA, 64 nt, hsa
aaagagauuaauuuuaacguaacucuuucuaugcccguguaaaguaugugaaucgcaaggccug

SEQ ID NO: 671848 - RNA, 60 nt, hsa
cugacugccaugcguuguagcugauggucuccguguaagccaaaggcccacagaggagca

SEQ ID NO: 671849 - RNA, 64 nt, hsa
aaggcaaaauuuagccugcugacaauuucccacaccguguaaaccaaagcccuaaaauuccacu

SEQ ID NO: 671850 - RNA, 64 nt, hsa
acgcaagcaccaggcauccuuuguguugucaacuccguguaaccaguaacuacagccauuuaca

SEQ ID NO: 671851 - RNA, 64 nt, hsa
ggaugugugaaaggcaucacauuuccauuuuccuccguguaaauguuuuauguguucgccuacu

SEQ ID NO: 671852 - RNA, 64 nt, hsa
auuacacugaggugaggcuacaagggguguguaaccguguaacacgugaaggcaaugcucaccu

SEQ ID NO: 671853 - RNA, 64 nt, hsa
auauuacggaaauacggaaccuuuagggauaguuccguguaagggcuuugaugccagcauccuu

SEQ ID NO: 671854 - RNA, 64 nt, hsa
uuauugggaguagaagaacacaauauaaauauuuccguguaauagccaccaacuuuucaggcau

SEQ ID NO: 671855 - RNA, 64 nt, hsa
cauguuauuaaaagcagaccuuugggcuguuuaaccguguaacaaaaaugccacgugaaaaaua

SEQ ID NO: 671856 - RNA, 64 nt, hsa
acauucuaacugugcaaaauuaucuuggccuuggccguguaaugugagguuuaccugauucucu

SEQ ID NO: 671857 - RNA, 64 nt, hsa
agcauggugaacauuaccaggcaugcuagcuggcccguguaaucccaagacaaggaaaacauuc

SEQ ID NO: 671858 - RNA, 64 nt, hsa
acuggggggcugugacagcagcugggccaggaggccguguaaugaccacacacuccucucaagc

SEQ ID NO: 671859 - RNA, 64 nt, hsa
cccagaagagaggccgggcugcugcagaaccccgccguguaaagaggcagaaaaguugguuugg

SEQ ID NO: 671860 - RNA, 64 nt, hsa
aaauuguggcacaaaaucuguucagguugguguaccguguaaaguggggaugggguaaaagugg

SEQ ID NO: 671861 - RNA, 64 nt, hsa
uaagcuaacaaagaucauaauuuucaaugauuagccguguaacuccugcaaugaauguuuaugu

SEQ ID NO: 671862 - RNA, 64 nt, hsa
gcccugcaccugugcagcgaagcuuagcguucauccguguaacccgcucaucacuggaugaaga

SEQ ID NO: 671863 - RNA, 64 nt, hsa
gauccuagacagcgccuuaucuaugauugaguguccguguaaauaaauuccuacuuagacuuac

SEQ ID NO: 671864 - RNA, 64 nt, hsa
ugacaaauguuugacuuugguuguguuuaaauguccguguaaaauagcugccuuuuauuuuuua

SEQ ID NO: 671865 - RNA, 64 nt, hsa
gaauauuuguauuuuccagauggaauaaaaaggcccguguaauuaaccuucaccaucagcgccu

SEQ ID NO: 671866 - RNA, 64 nt, hsa
aaaaacacaagaaggcauuuugcuucaauauauuccguguaauguuuuauugcauugauaaugu

SEQ ID NO: 671867 - RNA, 64 nt, hsa
gagucugugcagguccuuguguauggaauugcacccguguaaaggaggaaauggucagugugca

SEQ ID NO: 671868 - RNA, 64 nt, hsa
aaaaauguacacuagcauaauauuuguggcauauccguguaauggaagauuaugcaggcauuaa

SEQ ID NO: 671869 - RNA, 64 nt, hsa
agucucuuaccuucccugaucuuugcagggugguccguguaaauaguauaaauucuccaaauua

SEQ ID NO: 671870 - RNA, 64 nt, hsa
aagaggaguacacggugcggauccagcugcaagaccguguaaaugagcuccaggaggugagggu

SEQ ID NO: 671871 - RNA, 64 nt, hsa
uaauuuauaggguuuuugggaggauuaagucaauccguguaaaauucuuaauuaucugacacau

SEQ ID NO: 671872 - RNA, 64 nt, hsa
gcgaaugcauccuaggcgcguccuccucugauccccguguaagacugcccuggugucggcacuu

SEQ ID NO: 671873 - RNA, 64 nt, hsa
uaaccuucagcguugcccauggcccugccacaucccguguaacauaaguggugcccaccauguu

SEQ ID NO: 671874 - RNA, 64 nt, hsa
agggcauguuguccauaucccuguggaauacagaccguguaacuggacagcugagugucauaaa

SEQ ID NO: 671875 - RNA, 64 nt, hsa
uacuacucaguaugcaccacagaauaagaguuugccguguaaagacaauauccccauucgucau

SEQ ID NO: 671876 - RNA, 64 nt, hsa
ggcugugcaguccuggguccuccuuucugagggcccguguaaauauguacauuucucaggcuag

SEQ ID NO: 671877 - RNA, 64 nt, hsa
ugacgggaccugccacugcacaccagcccagcucccguguaaauaauuuauuacaagcauaaca

SEQ ID NO: 671878 - RNA, 64 nt, hsa
aaagcugcuaaauguucucuuugccauaaagacuccguguaacugugugaacacuugggauuuu

SEQ ID NO: 671879 - RNA, 64 nt, hsa
ugcagggacaaccuguguuugccagcuggguguuccguguaaauagccagccugucucuuucuc

SEQ ID NO: 671880 - RNA, 64 nt, hsa
aggcccggcugagccccccaugccccuccccuccccguguaaaaagccuccuugugcaauuguc

SEQ ID NO: 671881 - RNA, 64 nt, hsa
uuauauuaaaaggggccuccuuuuuaaauauaugccguguaaaaaauguacuuauaggaacauc

SEQ ID NO: 671882 - RNA, 64 nt, hsa
ugcucuguagacaaguagaauuaaaccugcgaauccguguaaaaauucagugaagacaugcacu

SEQ ID NO: 671883 - RNA, 64 nt, hsa
caaccagaugauuaaacguuguauuaaaaagaccccguguaaaccugagcccccccgucccccc

SEQ ID NO: 671884 - RNA, 64 nt, hsa
auuagugaaccccugaguuaacccguaaggccuuccguguaaccugcaucuagaguuuaagaag

SEQ ID NO: 671885 - RNA, 64 nt, hsa
ggagaaggggucagaccaaagauggugguuugucccguguaagggaacagguguggggaagagg

SEQ ID NO: 671886 - RNA, 64 nt, hsa
ucugcccaccccuuccguugucacgagugccgugccguguaauaaagucccagugcucauccac

SEQ ID NO: 671887 - RNA, 64 nt, hsa
uuuaauuuaauguguuaaaaacacaaugucccuaccguguaaauagaauccaagucaauuguga

SEQ ID NO: 671888 - RNA, 64 nt, hsa
ugccugcguugcaaacugggcuuuguagcgucugccguguaacacccuuccucugaucgcaccg

SEQ ID NO: 671889 - RNA, 64 nt, hsa
ggcuaaaauuacauuagauaaacuaaaauucuguccguguaacuauaaauuuugugaaugcauu

SEQ ID NO: 671890 - RNA, 64 nt, hsa
aauaauccuuuugauuuguggcauuguaacaacuccguguaaagauuaucugaaaaguaaaaaa

SEQ ID NO: 671891 - RNA, 64 nt, hsa; identical to SEQ ID NO: 395856

SEQ ID NO: 671892 - RNA, 64 nt, hsa; identical to SEQ ID NO: 395857

SEQ ID NO: 671893 - RNA, 64 nt, hsa; identical to SEQ ID NO: 395858

SEQ ID NO: 671894 - RNA, 64 nt, hsa; identical to SEQ ID NO: 395859

SEQ ID NO: 671895 - RNA, 64 nt, hsa; identical to SEQ ID NO: 395860

SEQ ID NO: 671896 - RNA, 64 nt, hsa; identical to SEQ ID NO: 395861

SEQ ID NO: 671897 - RNA, 64 nt, hsa; identical to SEQ ID NO: 395862

SEQ ID NO: 671898 - RNA, 64 nt, hsa; identical to SEQ ID NO: 395863

SEQ ID NO: 671899 - RNA, 64 nt, hsa; identical to SEQ ID NO: 395864

SEQ ID NO: 671900 - RNA, 64 nt, hsa; identical to SEQ ID NO: 395865

SEQ ID NO: 671901 - RNA, 61 nt, hsa
ggaaaagccagccauuuacuaauucagaggaacagcauagccaaggcuagcgaggcauacu

SEQ ID NO: 671902 - RNA, 61 nt, hsa
gcuugucugggcagagacagaagcugauuuaacagcauagagcacagcgcccuacuucccc

SEQ ID NO: 671903 - RNA, 61 nt, hsa
ugccaaaaugcucuggcuuuguauuuucuuuacagcauagauagaaaaaugcacauuuuuc

SEQ ID NO: 671904 - RNA, 61 nt, hsa
gugacaggcucuagucuccucccuguuguuuacagcauauuuaagucuugugaaacuguau

SEQ ID NO: 671905 - RNA, 61 nt, hsa
acaauuuaauaaugugauauuuccuaugucuacagcauaccuuauuagguauaaaaccuac

SEQ ID NO: 671906 - RNA, 61 nt, hsa
agauguucuaauucucuuuguaugcuuggaaacagcauagauauguugcugugguuuucag

SEQ ID NO: 671907 - RNA, 61 nt, hsa
gccugaagcagaucagagggcuuugcaaaagacagcauagagccaucuuccugcaacuuua

SEQ ID NO: 671908 - RNA, 61 nt, hsa
cccggguucaagcgauucuucugcugggauuacagcauaugccaccaugcccagauuauuu

SEQ ID NO: 671909 - RNA, 64 nt, hsa; identical to SEQ ID NO: 134270

SEQ ID NO: 671910 - RNA, 64 nt, hsa; identical to SEQ ID NO: 134271

SEQ ID NO: 671911 - RNA, 64 nt, hsa; identical to SEQ ID NO: 134272

SEQ ID NO: 671912 - RNA, 64 nt, hsa; identical to SEQ ID NO: 134273

SEQ ID NO: 671913 - RNA, 64 nt, hsa; identical to SEQ ID NO: 134274

SEQ ID NO: 671914 - RNA, 64 nt, hsa; identical to SEQ ID NO: 134275

SEQ ID NO: 671915 - RNA, 64 nt, hsa; identical to SEQ ID NO: 134276

SEQ ID NO: 671916 - RNA, 64 nt, hsa; identical to SEQ ID NO: 134277

SEQ ID NO: 671917 - RNA, 64 nt, hsa; identical to SEQ ID NO: 134278

SEQ ID NO: 671918 - RNA, 64 nt, hsa; identical to SEQ ID NO: 134279

SEQ ID NO: 671919 - RNA, 64 nt, hsa; identical to SEQ ID NO: 134280

SEQ ID NO: 671920 - RNA, 64 nt, hsa; identical to SEQ ID NO: 134281

SEQ ID NO: 671921 - RNA, 64 nt, hsa; identical to SEQ ID NO: 134282

SEQ ID NO: 671922 - RNA, 64 nt, hsa; identical to SEQ ID NO: 134283

SEQ ID NO: 671923 - RNA, 64 nt, hsa; identical to SEQ ID NO: 134284

SEQ ID NO: 671924 - RNA, 64 nt, hsa; identical to SEQ ID NO: 134285

SEQ ID NO: 671925 - RNA, 64 nt, hsa; identical to SEQ ID NO: 134286

SEQ ID NO: 671926 - RNA, 64 nt, hsa; identical to SEQ ID NO: 134287

SEQ ID NO: 671927 - RNA, 64 nt, hsa; identical to SEQ ID NO: 134288

SEQ ID NO: 671928 - RNA, 64 nt, hsa; identical to SEQ ID NO: 134289

SEQ ID NO: 671929 - RNA, 64 nt, hsa; identical to SEQ ID NO: 134290

SEQ ID NO: 671930 - RNA, 64 nt, hsa; identical to SEQ ID NO: 134291

SEQ ID NO: 671931 - RNA, 64 nt, hsa; identical to SEQ ID NO: 134292

SEQ ID NO: 671932 - RNA, 64 nt, hsa; identical to SEQ ID NO: 134293

SEQ ID NO: 671933 - RNA, 64 nt, hsa; identical to SEQ ID NO: 134294

SEQ ID NO: 671934 - RNA, 64 nt, hsa; identical to SEQ ID NO: 134295

SEQ ID NO: 671935 - RNA, 64 nt, hsa; identical to SEQ ID NO: 134296

SEQ ID NO: 671936 - RNA, 64 nt, hsa; identical to SEQ ID NO: 134297

SEQ ID NO: 671937 - RNA, 64 nt, hsa; identical to SEQ ID NO: 134298

SEQ ID NO: 671938 - RNA, 64 nt, hsa; identical to SEQ ID NO: 134299

SEQ ID NO: 671939 - RNA, 64 nt, hsa; identical to SEQ ID NO: 134300

SEQ ID NO: 671940 - RNA, 64 nt, hsa; identical to SEQ ID NO: 134301

SEQ ID NO: 671941 - RNA, 64 nt, hsa; identical to SEQ ID NO: 134302

SEQ ID NO: 671942 - RNA, 64 nt, hsa; identical to SEQ ID NO: 134303

SEQ ID NO: 671943 - RNA, 64 nt, hsa; identical to SEQ ID NO: 169280

SEQ ID NO: 671944 - RNA, 64 nt, hsa; identical to SEQ ID NO: 169281

SEQ ID NO: 671945 - RNA, 64 nt, hsa; identical to SEQ ID NO: 169282

SEQ ID NO: 671946 - RNA, 64 nt, hsa; identical to SEQ ID NO: 169283

SEQ ID NO: 671947 - RNA, 64 nt, hsa; identical to SEQ ID NO: 169284

SEQ ID NO: 671948 - RNA, 64 nt, hsa; identical to SEQ ID NO: 169285

SEQ ID NO: 671949 - RNA, 64 nt, hsa; identical to SEQ ID NO: 169286

SEQ ID NO: 671950 - RNA, 64 nt, hsa; identical to SEQ ID NO: 169287

SEQ ID NO: 671951 - RNA, 64 nt, hsa; identical to SEQ ID NO: 169288

SEQ ID NO: 671952 - RNA, 64 nt, hsa; identical to SEQ ID NO: 169289

SEQ ID NO: 671953 - RNA, 64 nt, hsa; identical to SEQ ID NO: 169290

SEQ ID NO: 671954 - RNA, 64 nt, hsa; identical to SEQ ID NO: 169291

SEQ ID NO: 671955 - RNA, 64 nt, hsa; identical to SEQ ID NO: 169292

SEQ ID NO: 671956 - RNA, 64 nt, hsa; identical to SEQ ID NO: 169293

SEQ ID NO: 671957 - RNA, 64 nt, hsa; identical to SEQ ID NO: 169294

SEQ ID NO: 671958 - RNA, 64 nt, hsa; identical to SEQ ID NO: 169295

SEQ ID NO: 671959 - RNA, 64 nt, hsa; identical to SEQ ID NO: 169296

SEQ ID NO: 671960 - RNA, 64 nt, hsa; identical to SEQ ID NO: 169297

SEQ ID NO: 671961 - RNA, 64 nt, hsa; identical to SEQ ID NO: 169298

SEQ ID NO: 671962 - RNA, 64 nt, hsa; identical to SEQ ID NO: 169299

SEQ ID NO: 671963 - RNA, 64 nt, hsa; identical to SEQ ID NO: 169300

SEQ ID NO: 671964 - RNA, 64 nt, hsa; identical to SEQ ID NO: 169301

SEQ ID NO: 671965 - RNA, 64 nt, hsa; identical to SEQ ID NO: 169302

SEQ ID NO: 671966 - RNA, 64 nt, hsa; identical to SEQ ID NO: 169303

SEQ ID NO: 671967 - RNA, 64 nt, hsa; identical to SEQ ID NO: 169304

SEQ ID NO: 671968 - RNA, 64 nt, hsa; identical to SEQ ID NO: 169305

SEQ ID NO: 671969 - RNA, 64 nt, hsa; identical to SEQ ID NO: 169306

SEQ ID NO: 671970 - RNA, 64 nt, hsa; identical to SEQ ID NO: 169307

SEQ ID NO: 671971 - RNA, 64 nt, hsa; identical to SEQ ID NO: 97134

SEQ ID NO: 671972 - RNA, 64 nt, hsa; identical to SEQ ID NO: 97135

SEQ ID NO: 671973 - RNA, 64 nt, hsa; identical to SEQ ID NO: 97136

SEQ ID NO: 671974 - RNA, 64 nt, hsa; identical to SEQ ID NO: 97137

SEQ ID NO: 671975 - RNA, 64 nt, hsa; identical to SEQ ID NO: 97138

SEQ ID NO: 671976 - RNA, 64 nt, hsa; identical to SEQ ID NO: 97139

SEQ ID NO: 671977 - RNA, 64 nt, hsa; identical to SEQ ID NO: 126678

SEQ ID NO: 671978 - RNA, 64 nt, hsa; identical to SEQ ID NO: 126679

SEQ ID NO: 671979 - RNA, 64 nt, hsa; identical to SEQ ID NO: 126680

SEQ ID NO: 671980 - RNA, 64 nt, hsa; identical to SEQ ID NO: 126681

SEQ ID NO: 671981 - RNA, 64 nt, hsa; identical to SEQ ID NO: 126682

SEQ ID NO: 671982 - RNA, 64 nt, hsa; identical to SEQ ID NO: 126683

SEQ ID NO: 671983 - RNA, 64 nt, hsa; identical to SEQ ID NO: 126684

SEQ ID NO: 671984 - RNA, 64 nt, hsa; identical to SEQ ID NO: 126685

SEQ ID NO: 671985 - RNA, 64 nt, hsa; identical to SEQ ID NO: 126686

SEQ ID NO: 671986 - RNA, 64 nt, hsa; identical to SEQ ID NO: 126687

SEQ ID NO: 671987 - RNA, 64 nt, hsa; identical to SEQ ID NO: 126688

SEQ ID NO: 671988 - RNA, 64 nt, hsa; identical to SEQ ID NO: 126689

SEQ ID NO: 671989 - RNA, 64 nt, hsa; identical to SEQ ID NO: 126690

SEQ ID NO: 671990 - RNA, 64 nt, hsa; identical to SEQ ID NO: 126691

SEQ ID NO: 671991 - RNA, 64 nt, hsa
cuguagaaaaauauuccagcacuugaguuguguguggcagcagcauuugaguccaugaaugcua

SEQ ID NO: 671992 - RNA, 64 nt, hsa
aagugaccacuuuucuucucuuugaggcacuaccuggcagcaccaucuaaaccuguaucaucug

SEQ ID NO: 671993 - RNA, 64 nt, hsa
cagcacucugcagugagagggacagucccauguguggcagcauugucccacuucagaugccagg

SEQ ID NO: 671994 - RNA, 64 nt, hsa
cucguuugauccaguugaguugaaaggguugccuuggcagcagaggcuccucugauggcugaca

SEQ ID NO: 671995 - RNA, 64 nt, hsa
ucagaggcuuagcucgccucuuuaggguccaugguggcagcagagaggcagaagugggagucca

SEQ ID NO: 671996 - RNA, 64 nt, hsa
aggaugguuccuggccccucugagugacagcugguggcagcacuccuugcuggggggcacuguu

SEQ ID NO: 671997 - RNA, 64 nt, hsa
aauacaugggcuccccgauucgcagcugucgucuuggcagcacuugucacguuggcagcacuuu

SEQ ID NO: 671998 - RNA, 64 nt, hsa
uucgcagcugucgucuuggcagcacuugucacguuggcagcacuuugagagcaagucugagugg

SEQ ID NO: 671999 - RNA, 64 nt, hsa
aauucuacugagucccuggcaagacugucuuaccuggcagcaaacugcugccugauuuguuggg

SEQ ID NO: 672000 - RNA, 64 nt, hsa
acugcguaggagagggagaugauccagagacauguggcagcaggcauggcuuccccuuggccuc

SEQ ID NO: 672001 - RNA, 64 nt, hsa
ugaaucuauugcgcgcauuugucauuuagcaagauggcagcaguccagcuguucuuugcagcug

SEQ ID NO: 672002 - RNA, 64 nt, hsa
gguccuaggugugaccugauaccaccacccuuuguggcagcaccgggcuggacugcccugaucc

SEQ ID NO: 672003 - RNA, 64 nt, hsa
augaggccaggccgccucccgcaccccuaccccguggcagcagcauaccucugcauuucuggaa

SEQ ID NO: 672004 - RNA, 64 nt, hsa
agggccccagggugacauguguccagcuuuucuauggcagcagaggccuuucccucagacaagc

SEQ ID NO: 672005 - RNA, 64 nt, hsa
uagccaugucugccuugggcacgggagagggaaguggcagcaugcaugcuguuucuuggccuuu

SEQ ID NO: 672006 - RNA, 64 nt, hsa
gggggauggaaaaggggagcaccucuaggcugccuggcagcagugagcccugggccuguggcua

SEQ ID NO: 672007 - RNA, 64 nt, hsa
gcagcucucguucugagacaugagccuugggauguggcagcaucagugggacaagauggacacu

SEQ ID NO: 672008 - RNA, 64 nt, hsa
aagcagccgcccacagagacaggcacugugugccuggcagcaggacuuccuacccagaggaggu

SEQ ID NO: 672009 - RNA, 64 nt, hsa
aaaggguaccccugcaaacaacuguggugggggcuggcagcagaccccccaccuggcagggcuu

SEQ ID NO: 672010 - RNA, 64 nt, hsa
uuuuauauaaaaaugcacaccuuuaaucucuauauggcagcauauacauauauauauauaaaau

SEQ ID NO: 672011 - RNA, 64 nt, hsa
uauauauauaaaaugcacacuuuuaaucucuauauggcagcauuuuugaggcuuuauaucugcc

SEQ ID NO: 672012 - RNA, 64 nt, hsa
gugugcucugcacuugccuugcuccaggaugggguggcagcagaggaaugucacaggucagcag

SEQ ID NO: 672013 - RNA, 64 nt, hsa
cccgcccguccagcagggcugucagcuuccuguguggcagcaccuggcacacuggcucuggcca

SEQ ID NO: 672014 - RNA, 64 nt, hsa
cuuuaaagaagcgagagaggaggccccacccuccuggcagcagaugccuggggcaaggccaggg

SEQ ID NO: 672015 - RNA, 64 nt, hsa
cgucuucaggacugcaggcuccggagaguggcucuggcagcaggcgggcgcgugggugcagcug

SEQ ID NO: 672016 - RNA, 64 nt, hsa
gcauagggacguggggugcaggcgccaacaucaguggcagcagccagggccgugguccaguccc

SEQ ID NO: 672017 - RNA, 64 nt, hsa
gcgcccagcucccugguggccgcggcagccucaguggcagcagcugccgguggugaccuggguu

SEQ ID NO: 672018 - RNA, 64 nt, hsa
cuccacccucccccaacagcagggaugggucagguggcagcauccaaaaccacggugaagauac

SEQ ID NO: 672019 - RNA, 64 nt, hsa
uuucuuagcaagucaguguguuuuagaagggagguggcagcauugagggaaaccaggucaccau

SEQ ID NO: 672020 - RNA, 64 nt, hsa
augggcaagggagagcggguggagggcccugagguggcagcaggggucagggaagugggcuucc

SEQ ID NO: 672021 - RNA, 64 nt, hsa
ggggcugugucgguaguggugcccacccuggauguggcagcaccgacuguggggguggaccugg

SEQ ID NO: 672022 - RNA, 64 nt, hsa
ggccucaacagaggccaaggaguucugugagcccuggcagcaaaaaacaccuuggggggugaag

SEQ ID NO: 672023 - RNA, 64 nt, hsa
uuagucggcagaauuaagugcuggugucuuucacuggcagcaugaaguuagccaccaaguccuc

SEQ ID NO: 672024 - RNA, 64 nt, hsa
cccuggcagcaugggaccugccaacagcugaggguggcagcagucugugcugggaucugugccc

SEQ ID NO: 672025 - RNA, 64 nt, hsa
gggagcacagcagccucugacccuagcccugcccuggcagcaugggaccugccaacagcugagg

SEQ ID NO: 672026 - RNA, 62 nt, hsa
uuguuguaggacugcaagacacuggaccgaaagccuccaacacaaacccuagcugccaaccu

SEQ ID NO: 672027 - RNA, 62 nt, hsa
cgcuccuccaccccuuccagaccaagcucaacgccuccaagaccagcaggccaaggccaagc

SEQ ID NO: 672028 - RNA, 62 nt, hsa
cuccaacgccccuguggccaacugcaaaaaaagccuccaaggguuucgacugguccagcucu

SEQ ID NO: 672029 - RNA, 54 nt, hsa
ucgacaucgaggacccauaagcaggccuccaacgccccuguggccaacugcaaa

SEQ ID NO: 672030 - RNA, 62 nt, hsa
uggucucacauacuuguaaucaaguuuuuccagccuccaagucaccuggccugggaaaguac

SEQ ID NO: 672031 - RNA, 62 nt, hsa
cucugccaaacugaagacagccuuugugcggugccuccaacuuugccucaaaugggacagug

SEQ ID NO: 672032 - RNA, 62 nt, hsa
cucacuacccucuguauauaaaaucugccccagccuccaacuuggagagacagauuugggcc

SEQ ID NO: 672033 - RNA, 62 nt, hsa
aaggcugggucccauucuguccuucuugucaugccuccaauuuccccugguguagagcuugu

SEQ ID NO: 672034 - RNA, 62 nt, hsa
acagcucagguucccacaccucacuuuucacagccuccaagggcagcagugcacauggagga

SEQ ID NO: 672035 - RNA, 62 nt, hsa
cacauggaggagacgucucccacgaggccaaggccuccaaugcucaccgaugcccucugcga

SEQ ID NO: 672036 - RNA, 64 nt, hsa; identical to SEQ ID NO: 355670

SEQ ID NO: 672037 - RNA, 64 nt, hsa; identical to SEQ ID NO: 355671

SEQ ID NO: 672038 - RNA, 64 nt, hsa; identical to SEQ ID NO: 355672

SEQ ID NO: 672039 - RNA, 64 nt, hsa; identical to SEQ ID NO: 355673

SEQ ID NO: 672040 - RNA, 64 nt, hsa; identical to SEQ ID NO: 355674

SEQ ID NO: 672041 - RNA, 64 nt, hsa; identical to SEQ ID NO: 355675

SEQ ID NO: 672042 - RNA, 64 nt, hsa; identical to SEQ ID NO: 355676

SEQ ID NO: 672043 - RNA, 64 nt, hsa; identical to SEQ ID NO: 355677

SEQ ID NO: 672044 - RNA, 64 nt, hsa; identical to SEQ ID NO: 355678

SEQ ID NO: 672045 - RNA, 64 nt, hsa; identical to SEQ ID NO: 355679

SEQ ID NO: 672046 - RNA, 64 nt, hsa; identical to SEQ ID NO: 355680

SEQ ID NO: 672047 - RNA, 64 nt, hsa; identical to SEQ ID NO: 355681

SEQ ID NO: 672048 - RNA, 64 nt, hsa; identical to SEQ ID NO: 510924

SEQ ID NO: 672049 - RNA, 64 nt, hsa; identical to SEQ ID NO: 510925

SEQ ID NO: 672050 - RNA, 57 nt, hsa; identical to SEQ ID NO: 510926

SEQ ID NO: 672051 - RNA, 64 nt, hsa; identical to SEQ ID NO: 510927

SEQ ID NO: 672052 - RNA, 64 nt, hsa; identical to SEQ ID NO: 510928

SEQ ID NO: 672053 - RNA, 64 nt, hsa; identical to SEQ ID NO: 510929

SEQ ID NO: 672054 - RNA, 64 nt, hsa; identical to SEQ ID NO: 510930

SEQ ID NO: 672055 - RNA, 64 nt, hsa; identical to SEQ ID NO: 510931

SEQ ID NO: 672056 - RNA, 64 nt, hsa; identical to SEQ ID NO: 510932

SEQ ID NO: 672057 - RNA, 64 nt, hsa; identical to SEQ ID NO: 510933

SEQ ID NO: 672058 - RNA, 64 nt, hsa; identical to SEQ ID NO: 510934

SEQ ID NO: 672059 - RNA, 64 nt, hsa; identical to SEQ ID NO: 510935

SEQ ID NO: 672060 - RNA, 64 nt, hsa; identical to SEQ ID NO: 510936

SEQ ID NO: 672061 - RNA, 64 nt, hsa; identical to SEQ ID NO: 510937

SEQ ID NO: 672062 - RNA, 64 nt, hsa; identical to SEQ ID NO: 510938

SEQ ID NO: 672063 - RNA, 64 nt, hsa; identical to SEQ ID NO: 510939

SEQ ID NO: 672064 - RNA, 64 nt, hsa; identical to SEQ ID NO: 510940

SEQ ID NO: 672065 - RNA, 64 nt, hsa; identical to SEQ ID NO: 510941

SEQ ID NO: 672066 - RNA, 64 nt, hsa; identical to SEQ ID NO: 510942

SEQ ID NO: 672067 - RNA, 64 nt, hsa; identical to SEQ ID NO: 510943

SEQ ID NO: 672068 - RNA, 64 nt, hsa; identical to SEQ ID NO: 510944

SEQ ID NO: 672069 - RNA, 64 nt, hsa; identical to SEQ ID NO: 510945

SEQ ID NO: 672070 - RNA, 64 nt, hsa; identical to SEQ ID NO: 510946

SEQ ID NO: 672071 - RNA, 64 nt, hsa; identical to SEQ ID NO: 510947

SEQ ID NO: 672072 - RNA, 64 nt, hsa; identical to SEQ ID NO: 510948

SEQ ID NO: 672073 - RNA, 64 nt, hsa; identical to SEQ ID NO: 510949

SEQ ID NO: 672074 - RNA, 64 nt, hsa; identical to SEQ ID NO: 510950

SEQ ID NO: 672075 - RNA, 64 nt, hsa; identical to SEQ ID NO: 510951

SEQ ID NO: 672076 - RNA, 64 nt, hsa; identical to SEQ ID NO: 510952

SEQ ID NO: 672077 - RNA, 64 nt, hsa; identical to SEQ ID NO: 510953

SEQ ID NO: 672078 - RNA, 64 nt, hsa; identical to SEQ ID NO: 510954

SEQ ID NO: 672079 - RNA, 64 nt, hsa; identical to SEQ ID NO: 510955

SEQ ID NO: 672080 - RNA, 64 nt, hsa; identical to SEQ ID NO: 510956

SEQ ID NO: 672081 - RNA, 64 nt, hsa; identical to SEQ ID NO: 510957

SEQ ID NO: 672082 - RNA, 64 nt, hsa; identical to SEQ ID NO: 510958

SEQ ID NO: 672083 - RNA, 64 nt, hsa; identical to SEQ ID NO: 510959

SEQ ID NO: 672084 - RNA, 64 nt, hsa; identical to SEQ ID NO: 510960

SEQ ID NO: 672085 - RNA, 64 nt, hsa; identical to SEQ ID NO: 510961

SEQ ID NO: 672086 - RNA, 64 nt, hsa; identical to SEQ ID NO: 510962

SEQ ID NO: 672087 - RNA, 64 nt, hsa; identical to SEQ ID NO: 510963

SEQ ID NO: 672088 - RNA, 64 nt, hsa; identical to SEQ ID NO: 510964

SEQ ID NO: 672089 - RNA, 64 nt, hsa; identical to SEQ ID NO: 510965

SEQ ID NO: 672090 - RNA, 64 nt, hsa; identical to SEQ ID NO: 510966

SEQ ID NO: 672091 - RNA, 64 nt, hsa; identical to SEQ ID NO: 510967

SEQ ID NO: 672092 - RNA, 64 nt, hsa; identical to SEQ ID NO: 510968

SEQ ID NO: 672093 - RNA, 64 nt, hsa; identical to SEQ ID NO: 510969

SEQ ID NO: 672094 - RNA, 64 nt, hsa; identical to SEQ ID NO: 510970

SEQ ID NO: 672095 - RNA, 64 nt, hsa; identical to SEQ ID NO: 510971

SEQ ID NO: 672096 - RNA, 64 nt, hsa; identical to SEQ ID NO: 510972

SEQ ID NO: 672097 - RNA, 64 nt, hsa; identical to SEQ ID NO: 510973

SEQ ID NO: 672098 - RNA, 64 nt, hsa; identical to SEQ ID NO: 510974

SEQ ID NO: 672099 - RNA, 64 nt, hsa; identical to SEQ ID NO: 510975

SEQ ID NO: 672100 - RNA, 64 nt, hsa; identical to SEQ ID NO: 510976

SEQ ID NO: 672101 - RNA, 64 nt, hsa; identical to SEQ ID NO: 510977

SEQ ID NO: 672102 - RNA, 64 nt, hsa; identical to SEQ ID NO: 510978

SEQ ID NO: 672103 - RNA, 64 nt, hsa; identical to SEQ ID NO: 510979

SEQ ID NO: 672104 - RNA, 64 nt, hsa; identical to SEQ ID NO: 510980

SEQ ID NO: 672105 - RNA, 64 nt, hsa; identical to SEQ ID NO: 510981

SEQ ID NO: 672106 - RNA, 64 nt, hsa; identical to SEQ ID NO: 510982

SEQ ID NO: 672107 - RNA, 64 nt, hsa; identical to SEQ ID NO: 510983

SEQ ID NO: 672108 - RNA, 64 nt, hsa
ccaauuuccugggcaguugaugcaucucugggaaaaacaccagaaagcuugcugaaauggaaaa

SEQ ID NO: 672109 - RNA, 64 nt, hsa
aaauuuaccuccuuuccuuuucccuuuccccuuaaaacaccagacaaaucgauaacaacuuaua

SEQ ID NO: 672110 - RNA, 64 nt, hsa
acauggcacaaaacaccaaauauugguuaugaugaaacaccacauuuuagcaaaacuuuacuaa

SEQ ID NO: 672111 - RNA, 64 nt, hsa
ugugaaacugacaauccuguggccacauggcacaaaacaccaaauauugguuaugaugaaacac

SEQ ID NO: 672112 - RNA, 64 nt, hsa
cucaagggcaugucuuaacgaagaucagcaaagaaaacaccaggcacccucugccacuuagaca

SEQ ID NO: 672113 - RNA, 64 nt, hsa
caaacacuuacugacaaaucggguccugaguugaaaacaccauuugucaaagaggccuuugaag

SEQ ID NO: 672114 - RNA, 64 nt, hsa
cauccuuuucuucugccucgccugaaucccccauaaacaccagaugauugagucuaccuucuuu

SEQ ID NO: 672115 - RNA, 64 nt, hsa
ucccuuuuucuucugccucacuugaaucccccguaaacaccagacgauugagucuaccuucuuu

SEQ ID NO: 672116 - RNA, 64 nt, hsa
ugaaaaagacgucaauaucugcucacaucuuacuaaacaccagagaguucaugcuuaauaaaag

SEQ ID NO: 672117 - RNA, 64 nt, hsa
ugggaaaacaaauuuucaaaaacuacagcuuagaaaacaccagaguuuauacgaaaauauauuu

SEQ ID NO: 672118 - RNA, 64 nt, hsa
aucucuuuagaauuacacagcuaaaaaggaaaaaaaacaccaaaauaagauaaaauaaaacaaa

SEQ ID NO: 672119 - RNA, 64 nt, hsa
aaaacaccaaaauaagauaaaauaaaacaaauuuaaacaccaaaauaagauauaauaaaacauu

SEQ ID NO: 672120 - RNA, 60 nt, hsa
uuuuucugccuuacgauauaaaaauauuuaucuuagaauuugagauguucauagcauguu

SEQ ID NO: 672121 - RNA, 60 nt, hsa
uucucucauauuuaaaaacguaaucucuucucuuagaaguauagaucauuuugaaacuua

SEQ ID NO: 672122 - RNA, 60 nt, hsa
cuuuuccucaagauaacugaccaaguguuuucuuagaaccaaaguuuuuaaaguugcuaa

SEQ ID NO: 672123 - RNA, 60 nt, hsa
uuauuaaucugaagauuaaccauuuuuuugucuuagaauaucaaaaagaaaaagaaaaag

SEQ ID NO: 672124 - RNA, 60 nt, hsa
cacugcuucaagguuucuuuuguauauaauucuuagaaugcucauuucuuuuaaaugguu

SEQ ID NO: 672125 - RNA, 60 nt, hsa
guggaagaaacgucuucuugccaagcucauucuuagaacuuacacaucuagaacagcuuc

SEQ ID NO: 672126 - RNA, 60 nt, hsa
agcauguugagauauuuuuagauuugaucaucuuagaaaacucaaguacauuauauacag

SEQ ID NO: 672127 - RNA, 60 nt, hsa
aauguuuuaaaggaauaaaucccuagcaggucuuagaauuagaaacuuugauggguuaac

SEQ ID NO: 672128 - RNA, 60 nt, hsa
uaaaaguuaagguuguucacuaugauggcaucuuagaauuaaacaaaacuuuuacuaggg

SEQ ID NO: 672129 - RNA, 60 nt, hsa
guggaccauccuaguuuauucucccauaagucuuagaagcuuuauggugauuauuuugag

SEQ ID NO: 672130 - RNA, 60 nt, hsa
uuuuuggauuuuguaaaagcauuuucauucucuuagaaauucaaguauuuucaaggggag

SEQ ID NO: 672131 - RNA, 60 nt, hsa
caaguuguucucuggagguuucuaugagguucuuagaaaaauuugguuuuaaaaucauuu

SEQ ID NO: 672132 - RNA, 60 nt, hsa
gcuuaaaccaccacucuuaggucugcucacucuuagaacacacaauggaagaggaagggu

SEQ ID NO: 672133 - RNA, 60 nt, hsa
ucacggauauguauaguuuuauguuuguuuucuuagaaacaaauguguuucuuugggugg

SEQ ID NO: 672134 - RNA, 60 nt, hsa
augucuugaugaagucuuuucauuagucacucuuagaauucuaaagugcuuugcacuuuu

SEQ ID NO: 672135 - RNA, 60 nt, hsa
cauugauuauguucaacuuuaugugugcauucuuagaagaguaagaacaaauaaaguaca

SEQ ID NO: 672136 - RNA, 60 nt, hsa
aggaaaaaaauacaacuaaugaugcacauuucuuagaacacaauaguccauugauauacu

SEQ ID NO: 672137 - RNA, 60 nt, hsa
agggcugugcuccugcucccagcagcccucucuuagaauauuucagauggaugagcuucu

SEQ ID NO: 672138 - RNA, 60 nt, hsa
aagaggcagaaacagguaagggggauaguaucuuagaaaaccuguugguuaaggcagcug

SEQ ID NO: 672139 - RNA, 60 nt, hsa
cuuuagggagcagccacacauacaggaagcucuuagaaaagaacuuuuuuuuuuuuuuga

SEQ ID NO: 672140 - RNA, 60 nt, hsa
aaucuuuguuagauauuaggucccaucaauucuuagaauaucuaaacaucuuuguugaug

SEQ ID NO: 672141 - RNA, 60 nt, hsa
ucacugaugcuucuaucaggucccaucaauucuuagaauaucuaagaaucuuuguuagau

SEQ ID NO: 672142 - RNA, 60 nt, hsa
caguuuaggaauauguuguucuaaaauaugucuuagaauccugaaagcauagauuuugaa

SEQ ID NO: 672143 - RNA, 60 nt, hsa
ucauuugcaaagcacucagcucaauuaucuucuuagaaagaaagaaaaaguaugaauggu

SEQ ID NO: 672144 - RNA, 60 nt, hsa
uuuuaugaaaauuaaguacagaggcugcgaucuuagaaauaaugaaggugccauuuggcu

SEQ ID NO: 672145 - RNA, 60 nt, hsa
gauuaaugaaaaugaaugcccaaaaauaagucuuagaaaauccuccauuuuuaugguaaa

SEQ ID NO: 672146 - RNA, 60 nt, hsa
aagcgaucagcaucaagggcuuugcuucugucuuagaauugagcuagcuugagucaauuu

SEQ ID NO: 672147 - RNA, 60 nt, hsa
auccaaagacuuugcacaugcuguugucuuucuuagaaugcccuuccccuaggccugcau

SEQ ID NO: 672148 - RNA, 64 nt, hsa; identical to SEQ ID NO: 248128

SEQ ID NO: 672149 - RNA, 64 nt, hsa; identical to SEQ ID NO: 248129

SEQ ID NO: 672150 - RNA, 64 nt, hsa; identical to SEQ ID NO: 248130

SEQ ID NO: 672151 - RNA, 64 nt, hsa; identical to SEQ ID NO: 248131

SEQ ID NO: 672152 - RNA, 64 nt, hsa; identical to SEQ ID NO: 248132

SEQ ID NO: 672153 - RNA, 64 nt, hsa; identical to SEQ ID NO: 248133

SEQ ID NO: 672154 - RNA, 64 nt, hsa; identical to SEQ ID NO: 248134

SEQ ID NO: 672155 - RNA, 64 nt, hsa; identical to SEQ ID NO: 248135

SEQ ID NO: 672156 - RNA, 64 nt, hsa; identical to SEQ ID NO: 248136

SEQ ID NO: 672157 - RNA, 64 nt, hsa; identical to SEQ ID NO: 248137

SEQ ID NO: 672158 - RNA, 64 nt, hsa; identical to SEQ ID NO: 248138

SEQ ID NO: 672159 - RNA, 64 nt, hsa; identical to SEQ ID NO: 248139

SEQ ID NO: 672160 - RNA, 64 nt, hsa; identical to SEQ ID NO: 248140

SEQ ID NO: 672161 - RNA, 64 nt, hsa; identical to SEQ ID NO: 248141

SEQ ID NO: 672162 - RNA, 62 nt, hsa
auucugugggagaguguggaaaggcacucuuuuuucuccauauuaguuaacaagaggugucu

SEQ ID NO: 672163 - RNA, 62 nt, hsa
ggcuaauuucauauuuuuuaguagagacaggauuucuccauguuggucaggcuggucuugaa

SEQ ID NO: 672164 - RNA, 62 nt, hsa
caaaucaaauauuuacauauugcuuaucacuuuuucuccauuuuaauaauggaaugaacuaa

SEQ ID NO: 672165 - RNA, 62 nt, hsa
aguuguucacagauauuuuauguuuuuuuaauuuucuccaagaauauuuauagaauuccaaa

SEQ ID NO: 672166 - RNA, 62 nt, hsa
uugucccuguguugucccaucugcccucccuguuucuccacaacagccugggguuguccccg

SEQ ID NO: 672167 - RNA, 62 nt, hsa
auuuuuguuuauuuuccuuaaauuuuuagccauuucuccaugggccaccgcccagcucaugu

SEQ ID NO: 672168 - RNA, 62 nt, hsa
uggacaaggcgcuucaucucucugggccucuauuucuccauuuguaaaacaaguggcugcag

SEQ ID NO: 672169 - RNA, 62 nt, hsa
acuguuuucaaacugcucacauuuauucaguauuucuccaaguugcuaucuacucagccuua

SEQ ID NO: 672170 - RNA, 62 nt, hsa
agaggccugggccucugauaacacuuuggcuuuuucuccauucacgcugauuuggcaaaagg

SEQ ID NO: 672171 - RNA, 62 nt, hsa
aguauguucuucuuuuuuauguaagggacagcuuucuccacagaguccuuucugcuggugag

SEQ ID NO: 672172 - RNA, 62 nt, hsa
ccaugagugcacaaucccugaacucacugucuuuucuccacacuuguccuaagccaagguag

SEQ ID NO: 672173 - RNA, 62 nt, hsa
ccaacuuaggcucuuuauuaauugguuaagguuuucuccaaaaagggcauuucaacaauggg

SEQ ID NO: 672174 - RNA, 62 nt, hsa
guguguugugaaaguuuggaaggucagaccuuuuucuccaagaaggacaagccccuguguaa

SEQ ID NO: 672175 - RNA, 62 nt, hsa
ucuacauauuauucaugaagcauaauguugcauuucuccaaauuuuaugccugaaaggguag

SEQ ID NO: 672176 - RNA, 62 nt, hsa
auucuuucuccauaucuuuuaaggaauuauucuuucuccauaucaucuuuuaauuccuguua

SEQ ID NO: 672177 - RNA, 62 nt, hsa
cuuaccuguaaaguuaucuuacggaauuauucuuucuccauaucuuuuaaggaauuauucuu

SEQ ID NO: 672178 - RNA, 62 nt, hsa
ccuguaccuuuugaggagccccagcuacccuuuuucuccagcugggcucugcaauuccccuc

SEQ ID NO: 672179 - RNA, 62 nt, hsa
uucucucggcuccccauguguccugguucccguuucuccaccuagacuguaaaccucucgag

SEQ ID NO: 672180 - RNA, 62 nt, hsa
ggaauaucaaguauaaugauguaguaaaaagauuucuccagaaaacacuuugagauacuuaa

SEQ ID NO: 672181 - RNA, 62 nt, hsa
gguaguucuguucuguggguuugugcuuccucuuucuccagaagccuucuggcugauuguuc

SEQ ID NO: 672182 - RNA, 62 nt, hsa
uguuuagcaagcauauguuguuccucagcucuuuucuccagcuuuugcaguguccuggcauc

SEQ ID NO: 672183 - RNA, 62 nt, hsa
aagugauaauuuuguguuuuucucauauaaguuuucuccagagcacccaccuucucuuccuu

SEQ ID NO: 672184 - RNA, 62 nt, hsa
augugggaauaggugggccaagagcccuccccuuucuccaucccuccagcuaggaggaaaug

SEQ ID NO: 672185 - RNA, 62 nt, hsa
ugguccacuccagccaucagucagcacggcccuuucuccagcacagcagacuauuguccgug

SEQ ID NO: 672186 - RNA, 62 nt, hsa
ucagcugguggcuagguuucuagcgcauuugauuucuccagguuugcugugucucacagagg

SEQ ID NO: 672187 - RNA, 62 nt, hsa
auucuagaagcagaagguuguuuuuuuuuuuuuuucuccauucugaaaauagcaggacauuu

SEQ ID NO: 672188 - RNA, 62 nt, hsa
gucaaguuuucuaggguugaauuuuuuucuuuuuucuccaugguguuaaugauauuagagau

SEQ ID NO: 672189 - RNA, 62 nt, hsa
ucaguuuuauuuauuuauuuuuaauuuguuuuuuucuccaaguccaccagucucugaaauua

SEQ ID NO: 672190 - RNA, 62 nt, hsa
aauggagaagaaacauccaaaagcacauuucauuucuccaaacuuuguguuuuaaauuauag

SEQ ID NO: 672191 - RNA, 62 nt, hsa
uguaagguaauuuuaaauugucccucguauuauuucuccacgucuguuuuaguuuaaugucu

SEQ ID NO: 672192 - RNA, 62 nt, hsa
guaaaaaggugguauguaauuuaugcaagguauuucuccaguugggacucaggauauuaguu

SEQ ID NO: 672193 - RNA, 62 nt, hsa
aagaaugaaaaugcaguccugaggagaggaguuuucuccauaucaaaacgagggcugaugga

SEQ ID NO: 672194 - RNA, 62 nt, hsa
auuuucaguuuuaaaugugggcaaaaaggcauuuucuccaagauuuuaaaacuaauucuuau

SEQ ID NO: 672195 - RNA, 62 nt, hsa
uuucaagagcuauuuuguaaacagaugauguauuucuccauugaaaacacaauaaaaaaaaa

SEQ ID NO: 672196 - RNA, 62 nt, hsa
uuuucuucuaucuguuccaucugcuguauucauuucuccaaucucauguccauuuuggugug

SEQ ID NO: 672197 - RNA, 62 nt, hsa
aaacuacauauuuuauuauagaaaaaguauuuuuucuccaccagacaaauggaaaaaaagag

SEQ ID NO: 672198 - RNA, 62 nt, hsa
uaccuucccuucccuugaaaguagagaugagguuucuccauguuggucaggcuggucucgaa

SEQ ID NO: 672199 - RNA, 62 nt, hsa
gcaacuggccugagcaacacagggagacucaguuucuccaaaaaaauaaaaaauuagccgau

SEQ ID NO: 672200 - RNA, 62 nt, hsa
uaucucggcauccucuugaaugauagugcaaguuucuccaguugggauguugucucugcccg

SEQ ID NO: 672201 - RNA, 62 nt, hsa
ggaauauuaaaccaaacucuccccgguccuuuuuucuccaacuuuucucaaagaguuuacau

SEQ ID NO: 672202 - RNA, 62 nt, hsa
ggugauggaaaaagcgcuguuuccuugccugcuuucuccaagacagauuuucggaacacauu

SEQ ID NO: 672203 - RNA, 62 nt, hsa
guucugcugagacugagcaccuuacagauauuuuucuccagaagauggugcuggguaauaaa

SEQ ID NO: 672204 - RNA, 62 nt, hsa
ccacagcuucucacugccgaaguuucuccagauuucuccaauguguccugacaggucagccc

SEQ ID NO: 672205 - RNA, 62 nt, hsa
cuucccucauccacagcuucucacugccgaaguuucuccagauuucuccaauguguccugac

SEQ ID NO: 672206 - RNA, 62 nt, hsa
gcugcuaugguuugaauggaugccaucacucuuuucuccacauacagugcagagagcugucu

SEQ ID NO: 672207 - RNA, 62 nt, hsa
uauuauaauaccaaauuguaaaucaugagcguuuucuccacugugcaccugaggcagaucau

SEQ ID NO: 672208 - RNA, 62 nt, hsa
uuacugaauggcuucauuucagauuuaguugauuucuccaccaaaugcaugucauguauucu

SEQ ID NO: 672209 - RNA, 54 nt, hsa; identical to SEQ ID NO: 221267

SEQ ID NO: 672210 - RNA, 62 nt, hsa
gcuuaccugaucucauguuaggccuaagaggcuuucuccaggaggauuagcuuggaguucuc

SEQ ID NO: 672211 - RNA, 62 nt, hsa
agagaaaguaaaggcaguaaugccuucuccuauuucuccaaagccuugugugaacucaccaa

SEQ ID NO: 672212 - RNA, 62 nt, hsa
caggccgacuccacucccacgccgcagguagguuucuccagugcgcucuugcugggaggucc

SEQ ID NO: 672213 - RNA, 62 nt, hsa
gccucagcuccucccuggggaaggaacuagucuuucuccaagaagaacucgacuugucugaa

SEQ ID NO: 672214 - RNA, 62 nt, hsa
uugucaucuuuguaucuccaguuugucuuucuuuucuccauagcccugccucuacuuuccuu

SEQ ID NO: 672215 - RNA, 62 nt, hsa
cuggguccuccaucgggaacuuuucaugcuucuuucuccaccugaggucuuggucugaagaa

SEQ ID NO: 672216 - RNA, 64 nt, hsa
agccucggccucccugagcucugaccccagccucacccgaaaggccagccuggggcucuccggc

SEQ ID NO: 672217 - RNA, 64 nt, hsa
cugugccaauaauaccauuaugugccauguacugacccgaaaggcucggccgcagagccggggc

SEQ ID NO: 672218 - RNA, 64 nt, hsa
uucugcaaguuaauaacugccuugaauuguuugaacccgaaauaaggguucuuugguaccucua

SEQ ID NO: 672219 - RNA, 64 nt, hsa
aagcgcugagauucuuccaucuaaaaaacccucgacccgaaacccucaccagauaaacuacagu

SEQ ID NO: 672220 - RNA, 64 nt, hsa
ugcaguuuccauagcaacccauguuuccugggaaacccgaaaaagguugucauggcaucucuug

SEQ ID NO: 672221 - RNA, 64 nt, hsa
uuuucuuccuaggccuugcuaucacuauuuccauacccgaaaggugaaaccagcuuucauuaua

SEQ ID NO: 672222 - RNA, 64 nt, hsa
aggcaagagacaggccccagggcuucuggcuagaacccgaaacaaaaggagcugaaggcaggug

SEQ ID NO: 672223 - RNA, 64 nt, hsa
uuucgguaccugugaaugcauggggacgugcugaacccgaaaaaaagugccuuuccauaaggac

SEQ ID NO: 672224 - RNA, 64 nt, hsa
ccuuuuuacuugugugguuauguguggggcuggcacccgaaaugugugacauucagcuucuaaa

SEQ ID NO: 672225 - RNA, 64 nt, hsa
ccuucaccagugagaagaacaaugaaugucaugaacccgaaaaaagcuucagucuggacucuac

SEQ ID NO: 672226 - RNA, 64 nt, hsa
caguuaugguguagcugcugcaauuccugugaauacccgaaaccugcuguuauaacucagaguc

SEQ ID NO: 672227 - RNA, 64 nt, hsa
gggcccagccccaggcugcagcccauucgcaggcacccgaaagaacuuccccaguauggugguc

SEQ ID NO: 672228 - RNA, 64 nt, hsa
ccaugugacucagcaauccugcugcuggguauauacccgaaagaaaggaaaaggaagccaguau

SEQ ID NO: 672229 - RNA, 64 nt, hsa
agaaggggguuuaaaaugaccuuuuuuucaguugacccgaaaguugugguuagaugauuaaaaa

SEQ ID NO: 672230 - RNA, 64 nt, hsa
cgccccugcugucuuccccaccgcagucaccaccacccgaaaugccacguggucacugugcacu

SEQ ID NO: 672231 - RNA, 64 nt, hsa
gcaucuuuuuuuaguuucuuaccauaagaguuugacccgaaacugcucacuucacauuggauga

SEQ ID NO: 672232 - RNA, 64 nt, hsa
ccucccugugcccccagccucagcccaacuucuuacccgaaagcaucacugccuuggccccucc

SEQ ID NO: 672233 - RNA, 64 nt, hsa
gcagcuccuggacagccucuuggcuccagcccccacccgaaaguggacacuggcuccgcccugg

SEQ ID NO: 672234 - RNA, 64 nt, hsa
gcaccacuugaaggagcucuaucaccagccucaaacccgaaagacugaggcauuuuccagucua

SEQ ID NO: 672235 - RNA, 64 nt, hsa
gggccucggauaccugcugcccagagcagcccggacccgaaaccuuucaggccccgcuugcaag

SEQ ID NO: 672236 - RNA, 64 nt, hsa
auucaccguguguacugagugcaguuuuuuucacacccgaaagucuuuacuggcuuucauagcu

SEQ ID NO: 672237 - RNA, 64 nt, hsa
ugaacgugaagcugauaggaaaucaccccagggaacccgaaaaagaaacuugauuccucuauug

SEQ ID NO: 672238 - RNA, 64 nt, hsa
cagaaucaagaaaauugagaugagauuugaaaggacccgaaaaugcagggguuggcuuucugac

SEQ ID NO: 672239 - RNA, 64 nt, hsa
cccuuuugugugaauugacuaccguuguuugcaaacccgaaaauaaaagacguucauuauguau

SEQ ID NO: 672240 - RNA, 64 nt, hsa
cgccuaggaaccagaccugaaaccaaggaaccagacccgaaaccaggccugggccggccugacc

SEQ ID NO: 672241 - RNA, 64 nt, hsa
uacuggauugccuuaaauucuucucuuacaccccacccgaaaguauucagcuggcauuuagaga

SEQ ID NO: 672242 - RNA, 64 nt, hsa
uucuuugacaauuugugaugucugaaaaaacagaacccgaaaagcuauggugauauguacaggc

SEQ ID NO: 672243 - RNA, 64 nt, hsa
acagaaaccgugccaaaagacuucuacagagugaacccgaaaauccuuccuugguaaaaccauu

SEQ ID NO: 672244 - RNA, 64 nt, hsa
ugacuauagcaaccagcuggacccggccucuggcacccgaaacuuccacccccgacggcuccug

SEQ ID NO: 672245 - RNA, 64 nt, hsa
ugacggccugccugcaaaccugcugguggggcagacccgaaaauccagcgugcaccccgccgga

SEQ ID NO: 672246 - RNA, 64 nt, hsa
ucacgccgucccgcagggcccagcacagccccagacccgaaaaaaguguucugcccaagauucc

SEQ ID NO: 672247 - RNA, 64 nt, hsa
cggggccucggggcacacagcuggggcugcccccacccgaaagacccuccacgcucguccucua

SEQ ID NO: 672248 - RNA, 64 nt, hsa
uuguguggcccauggauuugaaagaagcugcugcacccgaaacugccagugugcggugacaacg

SEQ ID NO: 672249 - RNA, 64 nt, hsa
gaucuacagggccagucuacauuaaaaauuagcaacccgaaaggauggguaaccuucgaggaag

SEQ ID NO: 672250 - RNA, 64 nt, hsa; identical to SEQ ID NO: 465832

SEQ ID NO: 672251 - RNA, 64 nt, hsa; identical to SEQ ID NO: 465833

SEQ ID NO: 672252 - RNA, 64 nt, hsa; identical to SEQ ID NO: 465834

SEQ ID NO: 672253 - RNA, 64 nt, hsa; identical to SEQ ID NO: 465835

SEQ ID NO: 672254 - RNA, 64 nt, hsa; identical to SEQ ID NO: 465836

SEQ ID NO: 672255 - RNA, 64 nt, hsa; identical to SEQ ID NO: 465837

SEQ ID NO: 672256 - RNA, 64 nt, hsa; identical to SEQ ID NO: 465838

SEQ ID NO: 672257 - RNA, 64 nt, hsa; identical to SEQ ID NO: 465839

SEQ ID NO: 672258 - RNA, 64 nt, hsa; identical to SEQ ID NO: 465840

SEQ ID NO: 672259 - RNA, 64 nt, hsa; identical to SEQ ID NO: 465841

SEQ ID NO: 672260 - RNA, 64 nt, hsa; identical to SEQ ID NO: 465842

SEQ ID NO: 672261 - RNA, 64 nt, hsa; identical to SEQ ID NO: 465843

SEQ ID NO: 672262 - RNA, 64 nt, hsa; identical to SEQ ID NO: 465844

SEQ ID NO: 672263 - RNA, 64 nt, hsa; identical to SEQ ID NO: 465845

SEQ ID NO: 672264 - RNA, 64 nt, hsa; identical to SEQ ID NO: 465846

SEQ ID NO: 672265 - RNA, 64 nt, hsa; identical to SEQ ID NO: 465847

SEQ ID NO: 672266 - RNA, 64 nt, hsa; identical to SEQ ID NO: 465848

SEQ ID NO: 672267 - RNA, 64 nt, hsa; identical to SEQ ID NO: 465849

SEQ ID NO: 672268 - RNA, 64 nt, hsa; identical to SEQ ID NO: 465850

SEQ ID NO: 672269 - RNA, 64 nt, hsa; identical to SEQ ID NO: 465851

SEQ ID NO: 672270 - RNA, 64 nt, hsa; identical to SEQ ID NO: 465852

SEQ ID NO: 672271 - RNA, 64 nt, hsa; identical to SEQ ID NO: 465853

SEQ ID NO: 672272 - RNA, 64 nt, hsa; identical to SEQ ID NO: 465854

SEQ ID NO: 672273 - RNA, 64 nt, hsa; identical to SEQ ID NO: 465855

SEQ ID NO: 672274 - RNA, 64 nt, hsa; identical to SEQ ID NO: 465856

SEQ ID NO: 672275 - RNA, 64 nt, hsa; identical to SEQ ID NO: 465857

SEQ ID NO: 672276 - RNA, 64 nt, hsa; identical to SEQ ID NO: 465858

SEQ ID NO: 672277 - RNA, 64 nt, hsa; identical to SEQ ID NO: 465859

SEQ ID NO: 672278 - RNA, 64 nt, hsa; identical to SEQ ID NO: 465860

SEQ ID NO: 672279 - RNA, 64 nt, hsa; identical to SEQ ID NO: 465861

SEQ ID NO: 672280 - RNA, 64 nt, hsa; identical to SEQ ID NO: 465862

SEQ ID NO: 672281 - RNA, 64 nt, hsa; identical to SEQ ID NO: 465863

SEQ ID NO: 672282 - RNA, 64 nt, hsa; identical to SEQ ID NO: 465864

SEQ ID NO: 672283 - RNA, 64 nt, hsa; identical to SEQ ID NO: 465865

SEQ ID NO: 672284 - RNA, 64 nt, hsa; identical to SEQ ID NO: 465866

SEQ ID NO: 672285 - RNA, 64 nt, hsa; identical to SEQ ID NO: 465867

SEQ ID NO: 672286 - RNA, 64 nt, hsa; identical to SEQ ID NO: 465868

SEQ ID NO: 672287 - RNA, 64 nt, hsa; identical to SEQ ID NO: 465869

SEQ ID NO: 672288 - RNA, 64 nt, hsa; identical to SEQ ID NO: 465870

SEQ ID NO: 672289 - RNA, 64 nt, hsa; identical to SEQ ID NO: 465871

SEQ ID NO: 672290 - RNA, 64 nt, hsa; identical to SEQ ID NO: 465872

SEQ ID NO: 672291 - RNA, 64 nt, hsa; identical to SEQ ID NO: 465873

SEQ ID NO: 672292 - RNA, 64 nt, hsa; identical to SEQ ID NO: 465874

SEQ ID NO: 672293 - RNA, 64 nt, hsa; identical to SEQ ID NO: 465875

SEQ ID NO: 672294 - RNA, 64 nt, hsa; identical to SEQ ID NO: 465876

SEQ ID NO: 672295 - RNA, 64 nt, hsa; identical to SEQ ID NO: 465877

SEQ ID NO: 672296 - RNA, 64 nt, hsa; identical to SEQ ID NO: 465878

SEQ ID NO: 672297 - RNA, 64 nt, hsa; identical to SEQ ID NO: 465879

SEQ ID NO: 672298 - RNA, 64 nt, hsa; identical to SEQ ID NO: 465880

SEQ ID NO: 672299 - RNA, 64 nt, hsa; identical to SEQ ID NO: 465881

SEQ ID NO: 672300 - RNA, 64 nt, hsa; identical to SEQ ID NO: 465882

SEQ ID NO: 672301 - RNA, 64 nt, hsa; identical to SEQ ID NO: 465883

SEQ ID NO: 672302 - RNA, 64 nt, hsa; identical to SEQ ID NO: 154420

SEQ ID NO: 672303 - RNA, 64 nt, hsa; identical to SEQ ID NO: 154421

SEQ ID NO: 672304 - RNA, 64 nt, hsa; identical to SEQ ID NO: 154422

SEQ ID NO: 672305 - RNA, 64 nt, hsa; identical to SEQ ID NO: 154423

SEQ ID NO: 672306 - RNA, 64 nt, hsa; identical to SEQ ID NO: 154424

SEQ ID NO: 672307 - RNA, 64 nt, hsa; identical to SEQ ID NO: 154425

SEQ ID NO: 672308 - RNA, 64 nt, hsa; identical to SEQ ID NO: 154426

SEQ ID NO: 672309 - RNA, 64 nt, hsa; identical to SEQ ID NO: 154427

SEQ ID NO: 672310 - RNA, 64 nt, hsa; identical to SEQ ID NO: 154428

SEQ ID NO: 672311 - RNA, 64 nt, hsa; identical to SEQ ID NO: 154429

SEQ ID NO: 672312 - RNA, 64 nt, hsa; identical to SEQ ID NO: 154430

SEQ ID NO: 672313 - RNA, 64 nt, hsa; identical to SEQ ID NO: 154431

SEQ ID NO: 672314 - RNA, 64 nt, hsa; identical to SEQ ID NO: 154432

SEQ ID NO: 672315 - RNA, 64 nt, hsa; identical to SEQ ID NO: 154433

SEQ ID NO: 672316 - RNA, 64 nt, hsa; identical to SEQ ID NO: 154434

SEQ ID NO: 672317 - RNA, 64 nt, hsa; identical to SEQ ID NO: 154435

SEQ ID NO: 672318 - RNA, 64 nt, hsa; identical to SEQ ID NO: 154436

SEQ ID NO: 672319 - RNA, 64 nt, hsa; identical to SEQ ID NO: 626237

SEQ ID NO: 672320 - RNA, 64 nt, hsa; identical to SEQ ID NO: 626238

SEQ ID NO: 672321 - RNA, 64 nt, hsa; identical to SEQ ID NO: 626239

SEQ ID NO: 672322 - RNA, 64 nt, hsa; identical to SEQ ID NO: 626240

SEQ ID NO: 672323 - RNA, 64 nt, hsa; identical to SEQ ID NO: 626241

SEQ ID NO: 672324 - RNA, 64 nt, hsa; identical to SEQ ID NO: 626242

SEQ ID NO: 672325 - RNA, 64 nt, hsa; identical to SEQ ID NO: 626243

SEQ ID NO: 672326 - RNA, 64 nt, hsa; identical to SEQ ID NO: 626244

SEQ ID NO: 672327 - RNA, 64 nt, hsa; identical to SEQ ID NO: 626245

SEQ ID NO: 672328 - RNA, 64 nt, hsa; identical to SEQ ID NO: 626246

SEQ ID NO: 672329 - RNA, 64 nt, hsa; identical to SEQ ID NO: 626247

SEQ ID NO: 672330 - RNA, 64 nt, hsa; identical to SEQ ID NO: 626248

SEQ ID NO: 672331 - RNA, 64 nt, hsa; identical to SEQ ID NO: 626249

SEQ ID NO: 672332 - RNA, 64 nt, hsa; identical to SEQ ID NO: 626250

SEQ ID NO: 672333 - RNA, 64 nt, hsa; identical to SEQ ID NO: 626251

SEQ ID NO: 672334 - RNA, 55 nt, hsa; identical to SEQ ID NO: 626252

SEQ ID NO: 672335 - RNA, 64 nt, hsa; identical to SEQ ID NO: 626253

SEQ ID NO: 672336 - RNA, 64 nt, hsa; identical to SEQ ID NO: 626254

SEQ ID NO: 672337 - RNA, 64 nt, hsa; identical to SEQ ID NO: 626255

SEQ ID NO: 672338 - RNA, 64 nt, hsa; identical to SEQ ID NO: 626256

SEQ ID NO: 672339 - RNA, 64 nt, hsa; identical to SEQ ID NO: 626257

SEQ ID NO: 672340 - RNA, 64 nt, hsa; identical to SEQ ID NO: 626258

SEQ ID NO: 672341 - RNA, 64 nt, hsa; identical to SEQ ID NO: 626259

SEQ ID NO: 672342 - RNA, 64 nt, hsa; identical to SEQ ID NO: 626260

SEQ ID NO: 672343 - RNA, 64 nt, hsa; identical to SEQ ID NO: 626261

SEQ ID NO: 672344 - RNA, 64 nt, hsa; identical to SEQ ID NO: 626262

SEQ ID NO: 672345 - RNA, 64 nt, hsa; identical to SEQ ID NO: 626263

SEQ ID NO: 672346 - RNA, 64 nt, hsa; identical to SEQ ID NO: 626264

SEQ ID NO: 672347 - RNA, 64 nt, hsa; identical to SEQ ID NO: 626265

SEQ ID NO: 672348 - RNA, 64 nt, hsa; identical to SEQ ID NO: 626266

SEQ ID NO: 672349 - RNA, 64 nt, hsa; identical to SEQ ID NO: 626267

SEQ ID NO: 672350 - RNA, 64 nt, hsa; identical to SEQ ID NO: 626268

SEQ ID NO: 672351 - RNA, 64 nt, hsa; identical to SEQ ID NO: 626269

SEQ ID NO: 672352 - RNA, 64 nt, hsa; identical to SEQ ID NO: 626270

SEQ ID NO: 672353 - RNA, 64 nt, hsa; identical to SEQ ID NO: 626271

SEQ ID NO: 672354 - RNA, 64 nt, hsa; identical to SEQ ID NO: 626272

SEQ ID NO: 672355 - RNA, 64 nt, hsa; identical to SEQ ID NO: 626273

SEQ ID NO: 672356 - RNA, 64 nt, hsa; identical to SEQ ID NO: 626274

SEQ ID NO: 672357 - RNA, 64 nt, hsa; identical to SEQ ID NO: 626275

SEQ ID NO: 672358 - RNA, 64 nt, hsa; identical to SEQ ID NO: 626276

SEQ ID NO: 672359 - RNA, 64 nt, hsa; identical to SEQ ID NO: 626277

SEQ ID NO: 672360 - RNA, 64 nt, hsa; identical to SEQ ID NO: 626278

SEQ ID NO: 672361 - RNA, 64 nt, hsa; identical to SEQ ID NO: 626279

SEQ ID NO: 672362 - RNA, 64 nt, hsa; identical to SEQ ID NO: 626280

SEQ ID NO: 672363 - RNA, 64 nt, hsa; identical to SEQ ID NO: 626281

SEQ ID NO: 672364 - RNA, 64 nt, hsa; identical to SEQ ID NO: 626282

SEQ ID NO: 672365 - RNA, 64 nt, hsa; identical to SEQ ID NO: 626283

SEQ ID NO: 672366 - RNA, 64 nt, hsa; identical to SEQ ID NO: 626284

SEQ ID NO: 672367 - RNA, 65 nt, hsa
uuagaaaucagaauaaguaaaaggaacguucacucacaggguacgcucauggagagagggcgcag

SEQ ID NO: 672368 - RNA, 65 nt, hsa
gugcaauucgauccucaaucaguggguggaggauaacaggguagauucacuugugugcacuugua

SEQ ID NO: 672369 - RNA, 65 nt, hsa
ucaaguccuucccauacucaaguggccaggaccucacaggguauggcugucaagaggcaggggcu

SEQ ID NO: 672370 - RNA, 65 nt, hsa
agacagagggcacagucccaugucaugcagaggugacaggguaucccuuccccucugccccagug

SEQ ID NO: 672371 - RNA, 64 nt, hsa; identical to SEQ ID NO: 119840

SEQ ID NO: 672372 - RNA, 64 nt, hsa; identical to SEQ ID NO: 119841

SEQ ID NO: 672373 - RNA, 64 nt, hsa; identical to SEQ ID NO: 183604

SEQ ID NO: 672374 - RNA, 64 nt, hsa; identical to SEQ ID NO: 183605

SEQ ID NO: 672375 - RNA, 64 nt, hsa; identical to SEQ ID NO: 183606

SEQ ID NO: 672376 - RNA, 64 nt, hsa; identical to SEQ ID NO: 183607

SEQ ID NO: 672377 - RNA, 64 nt, hsa; identical to SEQ ID NO: 183608

SEQ ID NO: 672378 - RNA, 64 nt, hsa; identical to SEQ ID NO: 183609

SEQ ID NO: 672379 - RNA, 64 nt, hsa; identical to SEQ ID NO: 183610

SEQ ID NO: 672380 - RNA, 64 nt, hsa; identical to SEQ ID NO: 183611

SEQ ID NO: 672381 - RNA, 64 nt, hsa; identical to SEQ ID NO: 183610

SEQ ID NO: 672382 - RNA, 64 nt, hsa; identical to SEQ ID NO: 183613

SEQ ID NO: 672383 - RNA, 64 nt, hsa; identical to SEQ ID NO: 183614

SEQ ID NO: 672384 - RNA, 64 nt, hsa; identical to SEQ ID NO: 183615

SEQ ID NO: 672385 - RNA, 64 nt, hsa; identical to SEQ ID NO: 183616

SEQ ID NO: 672386 - RNA, 64 nt, hsa; identical to SEQ ID NO: 183617

SEQ ID NO: 672387 - RNA, 64 nt, hsa; identical to SEQ ID NO: 183610

SEQ ID NO: 672388 - RNA, 64 nt, hsa; identical to SEQ ID NO: 183619

SEQ ID NO: 672389 - RNA, 64 nt, hsa; identical to SEQ ID NO: 183620

SEQ ID NO: 672390 - RNA, 64 nt, hsa; identical to SEQ ID NO: 183621

SEQ ID NO: 672391 - RNA, 64 nt, hsa; identical to SEQ ID NO: 183622

SEQ ID NO: 672392 - RNA, 64 nt, hsa; identical to SEQ ID NO: 183623

SEQ ID NO: 672393 - RNA, 64 nt, hsa; identical to SEQ ID NO: 183624

SEQ ID NO: 672394 - RNA, 64 nt, hsa; identical to SEQ ID NO: 178992

SEQ ID NO: 672395 - RNA, 64 nt, hsa; identical to SEQ ID NO: 178993

SEQ ID NO: 672396 - RNA, 64 nt, hsa; identical to SEQ ID NO: 178994

SEQ ID NO: 672397 - RNA, 64 nt, hsa; identical to SEQ ID NO: 178995

SEQ ID NO: 672398 - RNA, 64 nt, hsa; identical to SEQ ID NO: 178996

SEQ ID NO: 672399 - RNA, 64 nt, hsa; identical to SEQ ID NO: 178997

SEQ ID NO: 672400 - RNA, 64 nt, hsa; identical to SEQ ID NO: 178998

SEQ ID NO: 672401 - RNA, 64 nt, hsa; identical to SEQ ID NO: 178999

SEQ ID NO: 672402 - RNA, 64 nt, hsa; identical to SEQ ID NO: 179000

SEQ ID NO: 672403 - RNA, 64 nt, hsa; identical to SEQ ID NO: 179001

SEQ ID NO: 672404 - RNA, 64 nt, hsa; identical to SEQ ID NO: 179002

SEQ ID NO: 672405 - RNA, 64 nt, hsa; identical to SEQ ID NO: 179003

SEQ ID NO: 672406 - RNA, 64 nt, hsa; identical to SEQ ID NO: 179004

SEQ ID NO: 672407 - RNA, 64 nt, hsa; identical to SEQ ID NO: 179005

SEQ ID NO: 672408 - RNA, 64 nt, hsa; identical to SEQ ID NO: 179006

SEQ ID NO: 672409 - RNA, 64 nt, hsa; identical to SEQ ID NO: 179007

SEQ ID NO: 672410 - RNA, 64 nt, hsa; identical to SEQ ID NO: 179008

SEQ ID NO: 672411 - RNA, 64 nt, hsa; identical to SEQ ID NO: 47605

SEQ ID NO: 672412 - RNA, 64 nt, hsa; identical to SEQ ID NO: 47606

SEQ ID NO: 672413 - RNA, 64 nt, hsa; identical to SEQ ID NO: 47607

SEQ ID NO: 672414 - RNA, 64 nt, hsa; identical to SEQ ID NO: 47608

SEQ ID NO: 672415 - RNA, 64 nt, hsa; identical to SEQ ID NO: 47609

SEQ ID NO: 672416 - RNA, 64 nt, hsa; identical to SEQ ID NO: 47610

SEQ ID NO: 672417 - RNA, 64 nt, hsa; identical to SEQ ID NO: 47611

SEQ ID NO: 672418 - RNA, 64 nt, hsa; identical to SEQ ID NO: 47612

SEQ ID NO: 672419 - RNA, 64 nt, hsa; identical to SEQ ID NO: 47613

SEQ ID NO: 672420 - RNA, 64 nt, hsa; identical to SEQ ID NO: 47614

SEQ ID NO: 672421 - RNA, 64 nt, hsa; identical to SEQ ID NO: 47615

SEQ ID NO: 672422 - RNA, 64 nt, hsa; identical to SEQ ID NO: 47616

SEQ ID NO: 672423 - RNA, 64 nt, hsa; identical to SEQ ID NO: 47617

SEQ ID NO: 672424 - RNA, 64 nt, hsa; identical to SEQ ID NO: 47618

SEQ ID NO: 672425 - RNA, 64 nt, hsa; identical to SEQ ID NO: 47619

SEQ ID NO: 672426 - RNA, 64 nt, hsa; identical to SEQ ID NO: 47620

SEQ ID NO: 672427 - RNA, 64 nt, hsa; identical to SEQ ID NO: 47621

SEQ ID NO: 672428 - RNA, 64 nt, hsa; identical to SEQ ID NO: 47622

SEQ ID NO: 672429 - RNA, 64 nt, hsa; identical to SEQ ID NO: 47623

SEQ ID NO: 672430 - RNA, 64 nt, hsa; identical to SEQ ID NO: 47624

SEQ ID NO: 672431 - RNA, 64 nt, hsa; identical to SEQ ID NO: 47625

SEQ ID NO: 672432 - RNA, 64 nt, hsa; identical to SEQ ID NO: 47626

SEQ ID NO: 672433 - RNA, 64 nt, hsa; identical to SEQ ID NO: 47627

SEQ ID NO: 672434 - RNA, 64 nt, hsa; identical to SEQ ID NO: 47628

SEQ ID NO: 672435 - RNA, 64 nt, hsa; identical to SEQ ID NO: 47629

SEQ ID NO: 672436 - RNA, 64 nt, hsa; identical to SEQ ID NO: 47630

SEQ ID NO: 672437 - RNA, 64 nt, hsa; identical to SEQ ID NO: 47631

SEQ ID NO: 672438 - RNA, 64 nt, hsa; identical to SEQ ID NO: 47632

SEQ ID NO: 672439 - RNA, 64 nt, hsa; identical to SEQ ID NO: 47633

SEQ ID NO: 672440 - RNA, 64 nt, hsa; identical to SEQ ID NO: 47634

SEQ ID NO: 672441 - RNA, 64 nt, hsa; identical to SEQ ID NO: 47635

SEQ ID NO: 672442 - RNA, 64 nt, hsa; identical to SEQ ID NO: 47636

SEQ ID NO: 672443 - RNA, 64 nt, hsa; identical to SEQ ID NO: 47637

SEQ ID NO: 672444 - RNA, 64 nt, hsa; identical to SEQ ID NO: 47638

SEQ ID NO: 672445 - RNA, 64 nt, hsa; identical to SEQ ID NO: 47639

SEQ ID NO: 672446 - RNA, 64 nt, hsa; identical to SEQ ID NO: 47640

SEQ ID NO: 672447 - RNA, 64 nt, hsa; identical to SEQ ID NO: 47641

SEQ ID NO: 672448 - RNA, 64 nt, hsa; identical to SEQ ID NO: 47642

SEQ ID NO: 672449 - RNA, 64 nt, hsa; identical to SEQ ID NO: 47643

SEQ ID NO: 672450 - RNA, 64 nt, hsa; identical to SEQ ID NO: 47644

SEQ ID NO: 672451 - RNA, 64 nt, hsa; identical to SEQ ID NO: 47645

SEQ ID NO: 672452 - RNA, 64 nt, hsa; identical to SEQ ID NO: 47646

SEQ ID NO: 672453 - RNA, 64 nt, hsa; identical to SEQ ID NO: 47647

SEQ ID NO: 672454 - RNA, 64 nt, hsa; identical to SEQ ID NO: 47648

SEQ ID NO: 672455 - RNA, 64 nt, hsa; identical to SEQ ID NO: 47649

SEQ ID NO: 672456 - RNA, 64 nt, hsa; identical to SEQ ID NO: 47650

SEQ ID NO: 672457 - RNA, 64 nt, hsa; identical to SEQ ID NO: 47651

SEQ ID NO: 672458 - RNA, 64 nt, hsa; identical to SEQ ID NO: 47652

SEQ ID NO: 672459 - RNA, 64 nt, hsa; identical to SEQ ID NO: 47653

SEQ ID NO: 672460 - RNA, 64 nt, hsa; identical to SEQ ID NO: 47654

SEQ ID NO: 672461 - RNA, 64 nt, hsa; identical to SEQ ID NO: 47655

SEQ ID NO: 672462 - RNA, 64 nt, hsa; identical to SEQ ID NO: 47656

SEQ ID NO: 672463 - RNA, 64 nt, hsa; identical to SEQ ID NO: 47657

SEQ ID NO: 672464 - RNA, 64 nt, hsa; identical to SEQ ID NO: 47658

SEQ ID NO: 672465 - RNA, 64 nt, hsa; identical to SEQ ID NO: 47659

SEQ ID NO: 672466 - RNA, 64 nt, hsa; identical to SEQ ID NO: 47660

SEQ ID NO: 672467 - RNA, 64 nt, hsa; identical to SEQ ID NO: 47659

SEQ ID NO: 672468 - RNA, 64 nt, hsa; identical to SEQ ID NO: 47662

SEQ ID NO: 672469 - RNA, 64 nt, hsa; identical to SEQ ID NO: 47663

SEQ ID NO: 672470 - RNA, 64 nt, hsa; identical to SEQ ID NO: 47664

SEQ ID NO: 672471 - RNA, 64 nt, hsa; identical to SEQ ID NO: 47665

SEQ ID NO: 672472 - RNA, 64 nt, hsa; identical to SEQ ID NO: 47666

SEQ ID NO: 672473 - RNA, 64 nt, hsa; identical to SEQ ID NO: 47667

SEQ ID NO: 672474 - RNA, 64 nt, hsa; identical to SEQ ID NO: 47668

SEQ ID NO: 672475 - RNA, 64 nt, hsa; identical to SEQ ID NO: 47669

SEQ ID NO: 672476 - RNA, 64 nt, hsa; identical to SEQ ID NO: 47670

SEQ ID NO: 672477 - RNA, 64 nt, hsa; identical to SEQ ID NO: 47671

SEQ ID NO: 672478 - RNA, 64 nt, hsa; identical to SEQ ID NO: 47672

SEQ ID NO: 672479 - RNA, 64 nt, hsa; identical to SEQ ID NO: 47673

SEQ ID NO: 672480 - RNA, 64 nt, hsa; identical to SEQ ID NO: 47674

SEQ ID NO: 672481 - RNA, 64 nt, hsa; identical to SEQ ID NO: 441022

SEQ ID NO: 672482 - RNA, 64 nt, hsa; identical to SEQ ID NO: 441023

SEQ ID NO: 672483 - RNA, 64 nt, hsa; identical to SEQ ID NO: 441024

SEQ ID NO: 672484 - RNA, 64 nt, hsa; identical to SEQ ID NO: 441025

SEQ ID NO: 672485 - RNA, 64 nt, hsa; identical to SEQ ID NO: 441026

SEQ ID NO: 672486 - RNA, 64 nt, hsa; identical to SEQ ID NO: 441027

SEQ ID NO: 672487 - RNA, 64 nt, hsa; identical to SEQ ID NO: 441028

SEQ ID NO: 672488 - RNA, 64 nt, hsa; identical to SEQ ID NO: 441029

SEQ ID NO: 672489 - RNA, 64 nt, hsa; identical to SEQ ID NO: 441030

SEQ ID NO: 672490 - RNA, 64 nt, hsa; identical to SEQ ID NO: 441031

SEQ ID NO: 672491 - RNA, 64 nt, hsa; identical to SEQ ID NO: 441032

SEQ ID NO: 672492 - RNA, 64 nt, hsa; identical to SEQ ID NO: 441033

SEQ ID NO: 672493 - RNA, 64 nt, hsa; identical to SEQ ID NO: 441034

SEQ ID NO: 672494 - RNA, 64 nt, hsa; identical to SEQ ID NO: 441035

SEQ ID NO: 672495 - RNA, 64 nt, hsa; identical to SEQ ID NO: 441036

SEQ ID NO: 672496 - RNA, 64 nt, hsa; identical to SEQ ID NO: 441037

SEQ ID NO: 672497 - RNA, 64 nt, hsa; identical to SEQ ID NO: 441038

SEQ ID NO: 672498 - RNA, 64 nt, hsa; identical to SEQ ID NO: 441039

SEQ ID NO: 672499 - RNA, 64 nt, hsa; identical to SEQ ID NO: 441040

SEQ ID NO: 672500 - RNA, 64 nt, hsa; identical to SEQ ID NO: 441041

SEQ ID NO: 672501 - RNA, 64 nt, hsa; identical to SEQ ID NO: 441042

SEQ ID NO: 672502 - RNA, 64 nt, hsa
uuaagaugaaacauuccgguuuucucacaacacauuagcacauacuguccauuagcauaucugg

SEQ ID NO: 672503 - RNA, 64 nt, hsa
auuuguauuauccaaaugugcuuauuucuuugccuuagcacacguuuuauggaguacuuguuau

SEQ ID NO: 672504 - RNA, 64 nt, hsa
gccucacaacauggcaaguacaguacuuugaauuuuagcacauugcauaguaguuuuaaguaug

SEQ ID NO: 672505 - RNA, 64 nt, hsa
ugugaauccagugaaaauaagccaugagaauguuuuagcacagcguuaugugucugccacauua

SEQ ID NO: 672506 - RNA, 64 nt, hsa
cccauugucagcaccccagccaugcggccaccccuuagcacaccugcucgucccauuuagcuua

SEQ ID NO: 672507 - RNA, 64 nt, hsa
uucuugcuugacucaaucuacccagagaugccccuuagcacaccuagagggcagggaccauagg

SEQ ID NO: 672508 - RNA, 64 nt, hsa
uuuuaugguucucagaagccaaaauacacaacuuuuagcacauaaacaccaacgauggccucuu

SEQ ID NO: 672509 - RNA, 64 nt, hsa
uauuuguguuuauuuuuaauauuugaauuauuacuuagcacauggauauaagaggcacuuuauu

SEQ ID NO: 672510 - RNA, 64 nt, hsa; identical to SEQ ID NO: 297969

SEQ ID NO: 672511 - RNA, 64 nt, hsa; identical to SEQ ID NO: 297970

SEQ ID NO: 672512 - RNA, 64 nt, hsa; identical to SEQ ID NO: 297971

SEQ ID NO: 672513 - RNA, 64 nt, hsa; identical to SEQ ID NO: 297972

SEQ ID NO: 672514 - RNA, 64 nt, hsa; identical to SEQ ID NO: 297973

SEQ ID NO: 672515 - RNA, 64 nt, hsa; identical to SEQ ID NO: 297974

SEQ ID NO: 672516 - RNA, 64 nt, hsa; identical to SEQ ID NO: 297975

SEQ ID NO: 672517 - RNA, 64 nt, hsa; identical to SEQ ID NO: 297976

SEQ ID NO: 672518 - RNA, 64 nt, hsa; identical to SEQ ID NO: 297977

SEQ ID NO: 672519 - RNA, 64 nt, hsa; identical to SEQ ID NO: 297978

SEQ ID NO: 672520 - RNA, 64 nt, hsa; identical to SEQ ID NO: 297979

SEQ ID NO: 672521 - RNA, 64 nt, hsa; identical to SEQ ID NO: 297980

SEQ ID NO: 672522 - RNA, 64 nt, hsa; identical to SEQ ID NO: 297981

SEQ ID NO: 672523 - RNA, 64 nt, hsa; identical to SEQ ID NO: 297982

SEQ ID NO: 672524 - RNA, 64 nt, hsa; identical to SEQ ID NO: 297983

SEQ ID NO: 672525 - RNA, 64 nt, hsa; identical to SEQ ID NO: 297984

SEQ ID NO: 672526 - RNA, 64 nt, hsa; identical to SEQ ID NO: 297985

SEQ ID NO: 672527 - RNA, 64 nt, hsa; identical to SEQ ID NO: 297986

SEQ ID NO: 672528 - RNA, 64 nt, hsa; identical to SEQ ID NO: 297987

SEQ ID NO: 672529 - RNA, 64 nt, hsa; identical to SEQ ID NO: 297988

SEQ ID NO: 672530 - RNA, 64 nt, hsa; identical to SEQ ID NO: 297989

SEQ ID NO: 672531 - RNA, 64 nt, hsa; identical to SEQ ID NO: 297990

SEQ ID NO: 672532 - RNA, 64 nt, hsa; identical to SEQ ID NO: 297991

SEQ ID NO: 672533 - RNA, 64 nt, hsa; identical to SEQ ID NO: 297992

SEQ ID NO: 672534 - RNA, 64 nt, hsa; identical to SEQ ID NO: 297993

SEQ ID NO: 672535 - RNA, 64 nt, hsa
aauuggugucaguacuuaggaagaccacagcuagauggacaaacagcauugggaggccuuagcc

SEQ ID NO: 672536 - RNA, 64 nt, hsa
auuugaggaacagcacaucagcuuugcccuugacauggacaauagguuuuuuacuuugacggug

SEQ ID NO: 672537 - RNA, 64 nt, hsa
gcauacguaugagauaggcacaugcaucuucuguauggacaaaggugggguaccuacaggagag

SEQ ID NO: 672538 - RNA, 64 nt, hsa
uuguuauuuuuaaucaauuaggggcaauaguagaauggacaauuuccaagaaugaugccuuuca

SEQ ID NO: 672539 - RNA, 64 nt, hsa
guuccgauggugcccguggucaaaagcgaaaaacauggacaauuccuauucauucuuagcacuu

SEQ ID NO: 672540 - RNA, 64 nt, hsa
gugucaagcccucguuagcugaugagguaaaugcauggacaacuuccuaggacuucucggcucu

SEQ ID NO: 672541 - RNA, 64 nt, hsa
aacaaaauaaaagcucggcauuguaauuuuuuuaauggacaagucuuauggauacgaaggguac

SEQ ID NO: 672542 - RNA, 64 nt, hsa
cuaauaggcuaauauugcugaggccuuaaaggaaauggacaaaaauuauccagaagggguacuu

SEQ ID NO: 672543 - RNA, 64 nt, hsa
aaaagugggcuaacaccaauucacucagcagcagauggacaaaaugcacagugucuagaacugc

SEQ ID NO: 672544 - RNA, 64 nt, hsa
caaagauacauauuauuuaaagaguaugaucucuauggacaagagcuaaaauugacauaacuua

SEQ ID NO: 672545 - RNA, 64 nt, hsa
agagauauuagaaacugacucacuugauuggaaaauggacaaaagugccuugacguggagggug

SEQ ID NO: 672546 - RNA, 64 nt, hsa
ucacccucuuucauaucccuugcccugcccugaaauggacaaucacuuuuugggauagguugaa

SEQ ID NO: 672547 - RNA, 64 nt, hsa
acuggacuggaagaacaagucuauaaaaauaaaaauggacaauuaacaguggugaguggccguc

SEQ ID NO: 672548 - RNA, 64 nt, hsa
aauaaaaauguauauaaagcauaugagcacacaaauggacaauaaaugccacagcgcaaaagcg

SEQ ID NO: 672549 - RNA, 64 nt, hsa
auucucaaauaugaaaugggaccuaauaccaguaugugauaaauguugauguuuucuguguaca

SEQ ID NO: 672550 - RNA, 64 nt, hsa
cuuaguaugugugguaucaggauauuuuuuaaacugugauaauacaacagauagcuuugaauga

SEQ ID NO: 672551 - RNA, 64 nt, hsa
agugcaacucuuuuccuucagcugcaugugauuuugugauaaaguucagguaacaggaugggca

SEQ ID NO: 672552 - RNA, 64 nt, hsa
ugcuggcaacuacuguuuaauggucaguuaaaucugugauaaugguuggaagugggugggguua

SEQ ID NO: 672553 - RNA, 64 nt, hsa
uuuuugcauugugaaaaaaacaaaauaaauuuugugugauaauuuugaugaugaaagguggaag

SEQ ID NO: 672554 - RNA, 64 nt, hsa
uuuuaugcaugcaaaucauuguuuuuacagaguuugugauaacucauaauuauuuuaauggcag

SEQ ID NO: 672555 - RNA, 64 nt, hsa
uuuuaacuagguaucuuauggugagauggugggaugugauaaccaagauguaaguauuacauuu

SEQ ID NO: 672556 - RNA, 64 nt, hsa
gaaacuaauucagcaggcugaaggaaaugguucaugugauaaugugggcugguauccucuagag

SEQ ID NO: 672557 - RNA, 64 nt, hsa
gaguuuaaaaacugcguuguuauuuuuagagauuugugauaauacaacuuguuauaaaauuuau

SEQ ID NO: 672558 - RNA, 64 nt, hsa
uaauugcauacacaugccuccaugcauauaugugugugauaauacacaugcauuuaugugcgug

SEQ ID NO: 672559 - RNA, 64 nt, hsa
cuguuaaaaguugguaucaguaagauuuguguuuugugauaaucccuaaaucaacauaccacuu

SEQ ID NO: 672560 - RNA, 64 nt, hsa
cugccauacggagguucggaaccuggagaacggcugugauaaguagguuuugauugagugaaag

SEQ ID NO: 672561 - RNA, 64 nt, hsa
uaugacaugugauaagauggaaagccaauaaaccugugauaaguuucuaagaauaugagaauau

SEQ ID NO: 672562 - RNA, 64 nt, hsa
uuuuguuucuauuuaauguuuucgagauaugacaugugauaagauggaaagccaauaaaccugu

SEQ ID NO: 672563 - RNA, 64 nt, hsa
ugauacauaagagauguauauguuuugggguauaugugauaauuugauacauucagauagugug

SEQ ID NO: 672564 - RNA, 64 nt, hsa
acuaugugaaaaauuauauuugugcauaauaaaaugugauaacuuuuuacaacagaaugugauu

SEQ ID NO: 672565 - RNA, 64 nt, hsa
uuuccuuuuugcacacauuacaggugguguguucugugauaaugaaaagcaucagaaaagcuuu

SEQ ID NO: 672566 - RNA, 64 nt, hsa
aagcaguuccucauucacaucaacagagcgaggcugugauaacuuaggaggcagcaauccuaau

SEQ ID NO: 672567 - RNA, 64 nt, hsa
aagcauccaccccaaauguugguuguauuuaugcugugauaaaaauaggugagagaucauauga

SEQ ID NO: 672568 - RNA, 64 nt, hsa
augugaaugguacauacaaaaccuggcauuuucuugugauaaguuuacauuuuuaggagagugg

SEQ ID NO: 672569 - RNA, 64 nt, hsa
aaaaaagaaaguauccucuuuggugguuaagguuugugauaaagaguuuuaacacacucgcaac

SEQ ID NO: 672570 - RNA, 64 nt, hsa
cuauguuuguuaugagauucaaauaaaaaaauuuugugauaaaacaacaaguaaaucauauaac

SEQ ID NO: 672571 - RNA, 64 nt, hsa
auacagucugauuuagaagucaucuuuucagccgugugauaauuaacaugguaagccuuagcag

SEQ ID NO: 672572 - RNA, 64 nt, hsa
aaugcauuauuuuuuuaaagagcuugaugagauuugugauaagugauaguacucaaaaaccuga

SEQ ID NO: 672573 - RNA, 64 nt, hsa
cuaguuuaccuguugauucuauuguguuuucuauguaaaugauuuugucagcuauaaauaauaa

SEQ ID NO: 672574 - RNA, 64 nt, hsa
uauucuguuagauuaauuccuauuucuaguugcuguaaaugauaucuuauguuuuauuacauuu

SEQ ID NO: 672575 - RNA, 64 nt, hsa
ucuaaguggcaacauuuuuauucuucagagucagguaaaugacuauaauaguuugguuucuaau

SEQ ID NO: 672576 - RNA, 64 nt, hsa
gucaccuuuccaguuacaggaucauauuaacuguguaaaugaauucauggguagaugauuugug

SEQ ID NO: 672577 - RNA, 64 nt, hsa
uaaaaauauuuuaugcauguuaaguauggucgcaguaaaugaaauuguguuuaagacuaaauuu

SEQ ID NO: 672578 - RNA, 64 nt, hsa
acaauuaagucuauucuucuuuuagaaauuauauguaaaugauauuauugauacucuuucuaaa

SEQ ID NO: 672579 - RNA, 64 nt, hsa
aauagagcucaugaaauacuguaacuuggggauuguaaaugaauggauacaauagguuaaggcc

SEQ ID NO: 672580 - RNA, 64 nt, hsa
uacugugccuuaacguguuucuuaaacuuuuguaguaaaugaacauuugaaauccauuuugaua

SEQ ID NO: 672581 - RNA, 64 nt, hsa
uugaaaaggaauuuugaaaucuccaucaacugaaguaaaugaugucugaguguuacaguaaagg

SEQ ID NO: 672582 - RNA, 64 nt, hsa
ucuaccucuguaucuaaauguauaccauccacuuguaaaugacuauaaacuauuaugugauugc

SEQ ID NO: 672583 - RNA, 64 nt, hsa
uacauuaccauugccacugauuuuuuuuuaaaugguaaaugaccuuguauauaaauauugccau

SEQ ID NO: 672584 - RNA, 64 nt, hsa
acaggacaauaaauacuucaaauacuuuuaggaaguaaaugaguaggaguuuaggagggauaaa

SEQ ID NO: 672585 - RNA, 64 nt, hsa
ugaguuugcuacugcugugggggcauguggguggguaaaugauguaaaugaugugaucuguaca

SEQ ID NO: 672586 - RNA, 64 nt, hsa
uacugcugugggggcauguggguggguaaaugauguaaaugaugugaucuguacaaguaugugg

SEQ ID NO: 672587 - RNA, 64 nt, hsa
aagccaccaaauguaucuuuauguauaaauccuuguaaaugauagauuccaugggugagacuuu

SEQ ID NO: 672588 - RNA, 64 nt, hsa
agccuagcauuuauaacagaauuguugaacgucuguaaaugauuuuuuuuuuuuuugcaaagga

SEQ ID NO: 672589 - RNA, 64 nt, hsa
ucucuauuagacuuuagaaauaaauguaccugauguaccugaugcuauggucagguuauacucc

SEQ ID NO: 672590 - RNA, 64 nt, hsa
aaaaacuguucucuauuagacuuuagaaauaaauguaccugauguaccugaugcuauggucagg

SEQ ID NO: 672591 - RNA, 64 nt, hsa
ggggcacacagcugggggugcagagcccaccuggguaccugacccccaggggaugaaaaugcaa

SEQ ID NO: 672592 - RNA, 64 nt, hsa
uuuucucucuugggagcaauggucacagucccugguaccugaaaagguaccuaggucuaggccc

SEQ ID NO: 672593 - RNA, 64 nt, hsa
gguguaaagccaacucgaggggaaucugaauaagcuuccaaaauuuuuuuuuuuaagaaauaaa

SEQ ID NO: 672594 - RNA, 64 nt, hsa
uaggccacuacuuuauacuuucucucuucuguaacuuccaaagcaucccucucaguucucaugc

SEQ ID NO: 672595 - RNA, 64 nt, hsa
cuuuuauuugcaacauuuacaguccuucaaaauccuuccaaagaauucuuauacacauuggggc

SEQ ID NO: 672596 - RNA, 64 nt, hsa
cauuacuugauuaagauuuuacaaaagaggagcacuuccaaaauucuuauuuuuccuaacaaaa

SEQ ID NO: 672597 - RNA, 64 nt, hsa
acuugagccuuuaauggacuuauuucuucaaauccuuccaaaaauuauuauaagcauugaaauu

SEQ ID NO: 672598 - RNA, 64 nt, hsa
uuaugagcuugcuguauuucuugguaucauguugcuuccaaauuuuguuuuuacuguagaagac

SEQ ID NO: 672599 - RNA, 64 nt, hsa
augaucagguaccugcuuucauuuuagacugcuacuuccaaacuaagcuagauucuugguuuua

SEQ ID NO: 672600 - RNA, 64 nt, hsa
cugacuguuaucccgguuccaagccuagaggauccuuccaaaccagguaagaagucuguggcca

SEQ ID NO: 672601 - RNA, 64 nt, hsa
cugacuauuaucccgguuccaagacgagaggauacuuccaaacaagguaagaagucuguggcca

SEQ ID NO: 672602 - RNA, 64 nt, hsa
ggcaagaagaggacaguggaccagcuccugggaccuuccaaaacauuggcuuugacaucugcca

SEQ ID NO: 672603 - RNA, 64 nt, hsa
cauacaaguaucuaucuggacuucccugcuagcacuuccaaacaagcucagagauguuccuccc

SEQ ID NO: 672604 - RNA, 64 nt, hsa
gcaagcagcuggucagucuuugcucaguguccagcuuccaaagccuagacaaccuuucuguagc

SEQ ID NO: 672605 - RNA, 64 nt, hsa
auugcuuagaacguuaaacuauuagaguauuucccuuccaaagagggauguuuggaaaaaacuc

SEQ ID NO: 672606 - RNA, 64 nt, hsa
ugagccuuaggauccaaugaguggagaauggggacuuccaaaacccaagguuggcuauaaucuc

SEQ ID NO: 672607 - RNA, 64 nt, hsa
uucaccauuccucaaaccuguaaguuucucacuucuuccaaauuggcuuuggcucuuucugcaa

SEQ ID NO: 672608 - RNA, 64 nt, hsa
caucugccacaggccauauuuguggcccgugcagcuuccaaaucucauacacaacuguucccga

SEQ ID NO: 672609 - RNA, 64 nt, hsa
aaguccuucucuuuagggcucuuacaaucuaucacuuccaaaaaguaaauggugacugauaaaa

SEQ ID NO: 672610 - RNA, 64 nt, hsa
uggggcuugggggucaacuccccccaggacuuaccuuccaaaacaaacuuucuucacuuuguau

SEQ ID NO: 672611 - RNA, 64 nt, hsa
guuuccccuaaucguggggguuggaccccagagucuuccaaagaauuuucacugguugccugca

SEQ ID NO: 672612 - RNA, 64 nt, hsa
uacgacccgucagagccgacggaggaggaggagccuuccaaacagagaggugaguggggagcug

SEQ ID NO: 672613 - RNA, 64 nt, hsa
gaucucauggccaaagucagagcgaugcuugcagcuuccaaaaaccugcaaaccagcgcuuccu

SEQ ID NO: 672614 - RNA, 64 nt, hsa
cugccauuuaaaaaguuguagcagauuguuuccucuuccaaaguaaaauugcugugcuuuaugg

SEQ ID NO: 672615 - RNA, 64 nt, hsa
acaugaacacccuuagaaaauguguccuaucuaucuuccaaaugcaauuugauugacugcccau

SEQ ID NO: 672616 - RNA, 64 nt, hsa
uuuauuacauugacuucucccaagaugaaucuuccuuccaaauguguuuucuccacacaagccu

SEQ ID NO: 672617 - RNA, 64 nt, hsa
gcaucugguucugaaaaaguauagcauguagcagcuuccaaacauauucauauugcuuaagagg

SEQ ID NO: 672618 - RNA, 64 nt, hsa
uacagcccuggcagcccauggcaacucaaagugccuuccaaaccaaacugccccucaugagguu

SEQ ID NO: 672619 - RNA, 64 nt, hsa
aaagacagaaacugauguuccaugcaugucccugcuuccaaagccugaccuuccaaagcuugcu

SEQ ID NO: 672620 - RNA, 64 nt, hsa
uguuccaugcaugucccugcuuccaaagccugaccuuccaaagcuugcuuccuuccuccuggcu

SEQ ID NO: 672621 - RNA, 64 nt, hsa
ggccgugcccgaugugcaccucccagaagugcagcuuccaaaagucccagagaugaagcucccu

SEQ ID NO: 672622 - RNA, 64 nt, hsa
gaaagugccagagaugaaagucccugagaugaagcuuccaaaggugccugagaugaaacuuccu

SEQ ID NO: 672623 - RNA, 64 nt, hsa
ugaagugaagcuccccaaggcuccugaggucaagcuuccaaaagugcccgaggcagcccuucca

SEQ ID NO: 672624 - RNA, 64 nt, hsa
agggauuuuuuuuuugguugaccacucccccacacuuccaaaauuaaacaguguuuucuuagca

SEQ ID NO: 672625 - RNA, 64 nt, hsa
uucauuaggucaguuaagggaaauauuuguaccacuuccaaacuuuucagcguuggauaaaaug

SEQ ID NO: 672626 - RNA, 64 nt, hsa
cuguguguuuccaacaucaugguagcagcacacacuuccaaagcucagccagggacacuuaaua

SEQ ID NO: 672627 - RNA, 64 nt, hsa
aaaagaaaacuguuuuuagaaauacauaaaaucacuuccaaauccuguugcuuauguuggguua

SEQ ID NO: 672628 - RNA, 64 nt, hsa; identical to SEQ ID NO: 181919

SEQ ID NO: 672629 - RNA, 64 nt, hsa; identical to SEQ ID NO: 181920

SEQ ID NO: 672630 - RNA, 64 nt, hsa; identical to SEQ ID NO: 181921

SEQ ID NO: 672631 - RNA, 64 nt, hsa; identical to SEQ ID NO: 181922

SEQ ID NO: 672632 - RNA, 64 nt, hsa; identical to SEQ ID NO: 181923

SEQ ID NO: 672633 - RNA, 64 nt, hsa; identical to SEQ ID NO: 181924

SEQ ID NO: 672634 - RNA, 64 nt, hsa; identical to SEQ ID NO: 181925

SEQ ID NO: 672635 - RNA, 64 nt, hsa; identical to SEQ ID NO: 181926

SEQ ID NO: 672636 - RNA, 64 nt, hsa; identical to SEQ ID NO: 181927

SEQ ID NO: 672637 - RNA, 64 nt, hsa; identical to SEQ ID NO: 181928

SEQ ID NO: 672638 - RNA, 64 nt, hsa; identical to SEQ ID NO: 181929

SEQ ID NO: 672639 - RNA, 64 nt, hsa; identical to SEQ ID NO: 181930

SEQ ID NO: 672640 - RNA, 64 nt, hsa; identical to SEQ ID NO: 181931

SEQ ID NO: 672641 - RNA, 64 nt, hsa; identical to SEQ ID NO: 181932

SEQ ID NO: 672642 - RNA, 64 nt, hsa; identical to SEQ ID NO: 181933

SEQ ID NO: 672643 - RNA, 64 nt, hsa; identical to SEQ ID NO: 181934

SEQ ID NO: 672644 - RNA, 64 nt, hsa; identical to SEQ ID NO: 181935

SEQ ID NO: 672645 - RNA, 64 nt, hsa; identical to SEQ ID NO: 181936

SEQ ID NO: 672646 - RNA, 64 nt, hsa; identical to SEQ ID NO: 181937

SEQ ID NO: 672647 - RNA, 64 nt, hsa; identical to SEQ ID NO: 181938

SEQ ID NO: 672648 - RNA, 64 nt, hsa; identical to SEQ ID NO: 181939

SEQ ID NO: 672649 - RNA, 64 nt, hsa; identical to SEQ ID NO: 181940

SEQ ID NO: 672650 - RNA, 64 nt, hsa; identical to SEQ ID NO: 181941

SEQ ID NO: 672651 - RNA, 64 nt, hsa; identical to SEQ ID NO: 181942

SEQ ID NO: 672652 - RNA, 64 nt, hsa; identical to SEQ ID NO: 181943

SEQ ID NO: 672653 - RNA, 64 nt, hsa; identical to SEQ ID NO: 181944

SEQ ID NO: 672654 - RNA, 64 nt, hsa; identical to SEQ ID NO: 181945

SEQ ID NO: 672655 - RNA, 64 nt, hsa; identical to SEQ ID NO: 181946

SEQ ID NO: 672656 - RNA, 64 nt, hsa; identical to SEQ ID NO: 181947

SEQ ID NO: 672657 - RNA, 64 nt, hsa; identical to SEQ ID NO: 181948

SEQ ID NO: 672658 - RNA, 64 nt, hsa; identical to SEQ ID NO: 181949

SEQ ID NO: 672659 - RNA, 64 nt, hsa; identical to SEQ ID NO: 181950

SEQ ID NO: 672660 - RNA, 64 nt, hsa; identical to SEQ ID NO: 181951

SEQ ID NO: 672661 - RNA, 64 nt, hsa; identical to SEQ ID NO: 181952

SEQ ID NO: 672662 - RNA, 64 nt, hsa; identical to SEQ ID NO: 98538

SEQ ID NO: 672663 - RNA, 64 nt, hsa; identical to SEQ ID NO: 98539

SEQ ID NO: 672664 - RNA, 64 nt, hsa; identical to SEQ ID NO: 98540

SEQ ID NO: 672665 - RNA, 64 nt, hsa; identical to SEQ ID NO: 98541

SEQ ID NO: 672666 - RNA, 64 nt, hsa; identical to SEQ ID NO: 98542

SEQ ID NO: 672667 - RNA, 64 nt, hsa; identical to SEQ ID NO: 98543

SEQ ID NO: 672668 - RNA, 64 nt, hsa; identical to SEQ ID NO: 98544

SEQ ID NO: 672669 - RNA, 64 nt, hsa; identical to SEQ ID NO: 98545

SEQ ID NO: 672670 - RNA, 64 nt, hsa; identical to SEQ ID NO: 98546

SEQ ID NO: 672671 - RNA, 64 nt, hsa; identical to SEQ ID NO: 98547

SEQ ID NO: 672672 - RNA, 64 nt, hsa; identical to SEQ ID NO: 98548

SEQ ID NO: 672673 - RNA, 64 nt, hsa; identical to SEQ ID NO: 98549

SEQ ID NO: 672674 - RNA, 64 nt, hsa; identical to SEQ ID NO: 98550

SEQ ID NO: 672675 - RNA, 64 nt, hsa; identical to SEQ ID NO: 98551

SEQ ID NO: 672676 - RNA, 64 nt, hsa; identical to SEQ ID NO: 98552

SEQ ID NO: 672677 - RNA, 64 nt, hsa; identical to SEQ ID NO: 98553

SEQ ID NO: 672678 - RNA, 64 nt, hsa; identical to SEQ ID NO: 98554

SEQ ID NO: 672679 - RNA, 64 nt, hsa; identical to SEQ ID NO: 98555

SEQ ID NO: 672680 - RNA, 64 nt, hsa; identical to SEQ ID NO: 98556

SEQ ID NO: 672681 - RNA, 64 nt, hsa; identical to SEQ ID NO: 98557

SEQ ID NO: 672682 - RNA, 64 nt, hsa; identical to SEQ ID NO: 98558

SEQ ID NO: 672683 - RNA, 64 nt, hsa; identical to SEQ ID NO: 98559

SEQ ID NO: 672684 - RNA, 64 nt, hsa; identical to SEQ ID NO: 98560

SEQ ID NO: 672685 - RNA, 64 nt, hsa; identical to SEQ ID NO: 98561

SEQ ID NO: 672686 - RNA, 64 nt, hsa; identical to SEQ ID NO: 98562

SEQ ID NO: 672687 - RNA, 64 nt, hsa; identical to SEQ ID NO: 98563

SEQ ID NO: 672688 - RNA, 64 nt, hsa; identical to SEQ ID NO: 98564

SEQ ID NO: 672689 - RNA, 64 nt, hsa; identical to SEQ ID NO: 98565

SEQ ID NO: 672690 - RNA, 64 nt, hsa; identical to SEQ ID NO: 98566

SEQ ID NO: 672691 - RNA, 64 nt, hsa; identical to SEQ ID NO: 98567

SEQ ID NO: 672692 - RNA, 64 nt, hsa; identical to SEQ ID NO: 98568

SEQ ID NO: 672693 - RNA, 64 nt, hsa; identical to SEQ ID NO: 98569

SEQ ID NO: 672694 - RNA, 64 nt, hsa; identical to SEQ ID NO: 98570

SEQ ID NO: 672695 - RNA, 64 nt, hsa; identical to SEQ ID NO: 225837

SEQ ID NO: 672696 - RNA, 64 nt, hsa; identical to SEQ ID NO: 225838

SEQ ID NO: 672697 - RNA, 64 nt, hsa; identical to SEQ ID NO: 225839

SEQ ID NO: 672698 - RNA, 64 nt, hsa; identical to SEQ ID NO: 225840

SEQ ID NO: 672699 - RNA, 64 nt, hsa; identical to SEQ ID NO: 225841

SEQ ID NO: 672700 - RNA, 64 nt, hsa; identical to SEQ ID NO: 225842

SEQ ID NO: 672701 - RNA, 64 nt, hsa; identical to SEQ ID NO: 225843

SEQ ID NO: 672702 - RNA, 64 nt, hsa; identical to SEQ ID NO: 225844

SEQ ID NO: 672703 - RNA, 64 nt, hsa; identical to SEQ ID NO: 225845

SEQ ID NO: 672704 - RNA, 64 nt, hsa; identical to SEQ ID NO: 225846

SEQ ID NO: 672705 - RNA, 59 nt, hsa
cuccauuccugaccaauaaccacccauaacuacggcauucucugugacuuccuuaaaca

SEQ ID NO: 672706 - RNA, 59 nt, hsa
gacggccgcuccugcuccauggacucugccuacggcacccucuccccaaccuccuuaca

SEQ ID NO: 672707 - RNA, 59 nt, hsa
gggagaggcauguucuugggcagggcuggcuacggcaagagggaaccaauuccuuuccc

SEQ ID NO: 672708 - RNA, 59 nt, hsa
cccacaaucccaccuagcccaggagagagcuacggcaggguguguguuuugacacugag

SEQ ID NO: 672709 - RNA, 59 nt, hsa
ucuugcaccauuaaauaguguguuaagugcuacggcagcaaauugcuacaugugcugga

SEQ ID NO: 672710 - RNA, 59 nt, hsa
caucuugguucugccauccucuugccuuccuacggcagcagcuguucauggcacugaag

SEQ ID NO: 672711 - RNA, 59 nt, hsa
ucuuuucuaaacugcauuccugugcccaccuacggcaugccucuauguauuggcuacua

SEQ ID NO: 672712 - RNA, 59 nt, hsa
uacgucagccagaacuaacccuggaugggcuacggcagcugaaguggacgccucacuua

SEQ ID NO: 672713 - RNA, 59 nt, hsa
ccccuggccuaggguggggacccccaaaccuacggcaaagccagcaacaguagcagccu

SEQ ID NO: 672714 - RNA, 59 nt, hsa
aagaaagaacggagugaagccauuuaugccuacggcagcagaaagagaugaaaucuuga

SEQ ID NO: 672715 - RNA, 59 nt, hsa
cuuugaacucaucuuugguggcuagacugcuacggcagcuucucugaugggaaaguucc

SEQ ID NO: 672716 - RNA, 59 nt, hsa
cagcccaagucucaagccuccaaaccugccuacggcaacucuccauacuggacaaacua

SEQ ID NO: 672717 - RNA, 59 nt, hsa
gcccggcaaaagcuagacucuccucgugucuacggcaucucuuaugaucauuggcugcc

SEQ ID NO: 672718 - RNA, 59 nt, hsa
uuccaagaaauuaagcauaacagucucaucuacggcaguucauuacacugucaauguua

SEQ ID NO: 672719 - RNA, 59 nt, hsa
acagggcacaugauaccaacugcugcccacuacggcacgccgcaccggagcacggcacc

SEQ ID NO: 672720 - RNA, 59 nt, hsa
aaccccaaagccgugagugucauagaacucuacggcauccuggacccaaccacccgaga

SEQ ID NO: 672721 - RNA, 59 nt, hsa
gaaauagaaaggcagugggaagacagauucuacggcacugcuuucauuuaauugggcuu

SEQ ID NO: 672722 - RNA, 59 nt, hsa
uuccccaucaucaugaugguguccaacaucuacggcaaguacuacaagguaggccugcc

SEQ ID NO: 672723 - RNA, 59 nt, hsa
agagugcaacaaaugcuucuauuccauagcuacggcauugcucaguaaguugaggucaa

SEQ ID NO: 672724 - RNA, 59 nt, hsa
ccucacuguccccaugucccacccacguccuacggcacucaggaagcacuuggugagga

SEQ ID NO: 672725 - RNA, 59 nt, hsa
cgggcuccccacccccggcacccagcucucuacggcagguccgggagggcuggggcuuc

SEQ ID NO: 672726 - RNA, 59 nt, hsa
uuaugugacucuucauauaacccuuuuuucuacggcagcauuaaaauugucuuuuugcu

SEQ ID NO: 672727 - RNA, 59 nt, hsa
acccgguuucccucccuguuuuccuaccucuacggcaagcccaaagugucuucccggga

SEQ ID NO: 672728 - RNA, 59 nt, hsa
gagagccauguauauggcuucaaagccaccuacggcagggacacacucgugagcaugug

SEQ ID NO: 672729 - RNA, 64 nt, hsa; identical to SEQ ID NO: 60353

SEQ ID NO: 672730 - RNA, 64 nt, hsa; identical to SEQ ID NO: 60354

SEQ ID NO: 672731 - RNA, 64 nt, hsa; identical to SEQ ID NO: 60355

SEQ ID NO: 672732 - RNA, 64 nt, hsa; identical to SEQ ID NO: 60356

SEQ ID NO: 672733 - RNA, 64 nt, hsa; identical to SEQ ID NO: 60357

SEQ ID NO: 672734 - RNA, 64 nt, hsa; identical to SEQ ID NO: 60358

SEQ ID NO: 672735 - RNA, 64 nt, hsa; identical to SEQ ID NO: 60359

SEQ ID NO: 672736 - RNA, 64 nt, hsa; identical to SEQ ID NO: 60360

SEQ ID NO: 672737 - RNA, 64 nt, hsa; identical to SEQ ID NO: 60361

SEQ ID NO: 672738 - RNA, 64 nt, hsa; identical to SEQ ID NO: 60362

SEQ ID NO: 672739 - RNA, 64 nt, hsa; identical to SEQ ID NO: 60363

SEQ ID NO: 672740 - RNA, 64 nt, hsa; identical to SEQ ID NO: 60364

SEQ ID NO: 672741 - RNA, 64 nt, hsa; identical to SEQ ID NO: 60365

SEQ ID NO: 672742 - RNA, 64 nt, hsa; identical to SEQ ID NO: 60366

SEQ ID NO: 672743 - RNA, 64 nt, hsa; identical to SEQ ID NO: 60367

SEQ ID NO: 672744 - RNA, 64 nt, hsa; identical to SEQ ID NO: 60368

SEQ ID NO: 672745 - RNA, 64 nt, hsa; identical to SEQ ID NO: 60369

SEQ ID NO: 672746 - RNA, 64 nt, hsa; identical to SEQ ID NO: 60370

SEQ ID NO: 672747 - RNA, 64 nt, hsa; identical to SEQ ID NO: 60371

SEQ ID NO: 672748 - RNA, 64 nt, hsa; identical to SEQ ID NO: 60372

SEQ ID NO: 672749 - RNA, 64 nt, hsa; identical to SEQ ID NO: 60373

SEQ ID NO: 672750 - RNA, 64 nt, hsa; identical to SEQ ID NO: 60374

SEQ ID NO: 672751 - RNA, 64 nt, hsa; identical to SEQ ID NO: 223465

SEQ ID NO: 672752 - RNA, 64 nt, hsa; identical to SEQ ID NO: 223466

SEQ ID NO: 672753 - RNA, 64 nt, hsa; identical to SEQ ID NO: 223467

SEQ ID NO: 672754 - RNA, 64 nt, hsa; identical to SEQ ID NO: 223468

SEQ ID NO: 672755 - RNA, 64 nt, hsa; identical to SEQ ID NO: 223469

SEQ ID NO: 672756 - RNA, 64 nt, hsa; identical to SEQ ID NO: 223470

SEQ ID NO: 672757 - RNA, 64 nt, hsa; identical to SEQ ID NO: 223471

SEQ ID NO: 672758 - RNA, 64 nt, hsa; identical to SEQ ID NO: 223472

SEQ ID NO: 672759 - RNA, 64 nt, hsa; identical to SEQ ID NO: 223473

SEQ ID NO: 672760 - RNA, 64 nt, hsa; identical to SEQ ID NO: 223474

SEQ ID NO: 672761 - RNA, 64 nt, hsa; identical to SEQ ID NO: 223475

SEQ ID NO: 672762 - RNA, 64 nt, hsa; identical to SEQ ID NO: 223476

SEQ ID NO: 672763 - RNA, 64 nt, hsa; identical to SEQ ID NO: 223477

SEQ ID NO: 672764 - RNA, 64 nt, hsa; identical to SEQ ID NO: 223478

SEQ ID NO: 672765 - RNA, 64 nt, hsa; identical to SEQ ID NO: 223479

SEQ ID NO: 672766 - RNA, 64 nt, hsa; identical to SEQ ID NO: 223480

SEQ ID NO: 672767 - RNA, 64 nt, hsa; identical to SEQ ID NO: 223481

SEQ ID NO: 672768 - RNA, 64 nt, hsa; identical to SEQ ID NO: 223482

SEQ ID NO: 672769 - RNA, 64 nt, hsa; identical to SEQ ID NO: 223483

SEQ ID NO: 672770 - RNA, 64 nt, hsa; identical to SEQ ID NO: 223484

SEQ ID NO: 672771 - RNA, 64 nt, hsa; identical to SEQ ID NO: 223485

SEQ ID NO: 672772 - RNA, 64 nt, hsa; identical to SEQ ID NO: 223486

SEQ ID NO: 672773 - RNA, 64 nt, hsa; identical to SEQ ID NO: 223487

SEQ ID NO: 672774 - RNA, 64 nt, hsa; identical to SEQ ID NO: 223488

SEQ ID NO: 672775 - RNA, 64 nt, hsa; identical to SEQ ID NO: 223489

SEQ ID NO: 672776 - RNA, 64 nt, hsa; identical to SEQ ID NO: 223490

SEQ ID NO: 672777 - RNA, 64 nt, hsa; identical to SEQ ID NO: 223491

SEQ ID NO: 672778 - RNA, 64 nt, hsa; identical to SEQ ID NO: 223492

SEQ ID NO: 672779 - RNA, 64 nt, hsa; identical to SEQ ID NO: 223493

SEQ ID NO: 672780 - RNA, 64 nt, hsa; identical to SEQ ID NO: 223494

SEQ ID NO: 672781 - RNA, 64 nt, hsa; identical to SEQ ID NO: 223495

SEQ ID NO: 672782 - RNA, 64 nt, hsa; identical to SEQ ID NO: 223496

SEQ ID NO: 672783 - RNA, 64 nt, hsa; identical to SEQ ID NO: 223497

SEQ ID NO: 672784 - RNA, 64 nt, hsa; identical to SEQ ID NO: 223498

SEQ ID NO: 672785 - RNA, 64 nt, hsa; identical to SEQ ID NO: 223499

SEQ ID NO: 672786 - RNA, 64 nt, hsa; identical to SEQ ID NO: 223500

SEQ ID NO: 672787 - RNA, 64 nt, hsa; identical to SEQ ID NO: 223501

SEQ ID NO: 672788 - RNA, 64 nt, hsa; identical to SEQ ID NO: 223502

SEQ ID NO: 672789 - RNA, 64 nt, hsa; identical to SEQ ID NO: 223503

SEQ ID NO: 672790 - RNA, 64 nt, hsa; identical to SEQ ID NO: 223504

SEQ ID NO: 672791 - RNA, 64 nt, hsa; identical to SEQ ID NO: 223505

SEQ ID NO: 672792 - RNA, 64 nt, hsa; identical to SEQ ID NO: 223506

SEQ ID NO: 672793 - RNA, 64 nt, hsa; identical to SEQ ID NO: 223507

SEQ ID NO: 672794 - RNA, 64 nt, hsa; identical to SEQ ID NO: 223508

SEQ ID NO: 672795 - RNA, 64 nt, hsa; identical to SEQ ID NO: 223509

SEQ ID NO: 672796 - RNA, 64 nt, hsa; identical to SEQ ID NO: 223510

SEQ ID NO: 672797 - RNA, 64 nt, hsa; identical to SEQ ID NO: 223511

SEQ ID NO: 672798 - RNA, 64 nt, hsa; identical to SEQ ID NO: 223512

SEQ ID NO: 672799 - RNA, 64 nt, hsa; identical to SEQ ID NO: 223513

SEQ ID NO: 672800 - RNA, 64 nt, hsa; identical to SEQ ID NO: 223514

SEQ ID NO: 672801 - RNA, 64 nt, hsa; identical to SEQ ID NO: 223515

SEQ ID NO: 672802 - RNA, 64 nt, hsa; identical to SEQ ID NO: 223516

SEQ ID NO: 672803 - RNA, 64 nt, hsa; identical to SEQ ID NO: 223517

SEQ ID NO: 672804 - RNA, 64 nt, hsa; identical to SEQ ID NO: 223518

SEQ ID NO: 672805 - RNA, 64 nt, hsa; identical to SEQ ID NO: 223519

SEQ ID NO: 672806 - RNA, 64 nt, hsa; identical to SEQ ID NO: 223520

SEQ ID NO: 672807 - RNA, 64 nt, hsa; identical to SEQ ID NO: 223521

SEQ ID NO: 672808 - RNA, 64 nt, hsa; identical to SEQ ID NO: 223522

SEQ ID NO: 672809 - RNA, 64 nt, hsa; identical to SEQ ID NO: 223523

SEQ ID NO: 672810 - RNA, 64 nt, hsa; identical to SEQ ID NO: 223524

SEQ ID NO: 672811 - RNA, 64 nt, hsa; identical to SEQ ID NO: 223525

SEQ ID NO: 672812 - RNA, 64 nt, hsa; identical to SEQ ID NO: 223526

SEQ ID NO: 672813 - RNA, 64 nt, hsa; identical to SEQ ID NO: 223527

SEQ ID NO: 672814 - RNA, 64 nt, hsa; identical to SEQ ID NO: 223528

SEQ ID NO: 672815 - RNA, 64 nt, hsa; identical to SEQ ID NO: 223529

SEQ ID NO: 672816 - RNA, 64 nt, hsa; identical to SEQ ID NO: 223530

SEQ ID NO: 672817 - RNA, 64 nt, hsa; identical to SEQ ID NO: 223531

SEQ ID NO: 672818 - RNA, 64 nt, hsa; identical to SEQ ID NO: 223532

SEQ ID NO: 672819 - RNA, 64 nt, hsa; identical to SEQ ID NO: 223533

SEQ ID NO: 672820 - RNA, 64 nt, hsa; identical to SEQ ID NO: 223534

SEQ ID NO: 672821 - RNA, 64 nt, hsa; identical to SEQ ID NO: 223535

SEQ ID NO: 672822 - RNA, 64 nt, hsa; identical to SEQ ID NO: 223536

SEQ ID NO: 672823 - RNA, 64 nt, hsa; identical to SEQ ID NO: 223537

SEQ ID NO: 672824 - RNA, 64 nt, hsa; identical to SEQ ID NO: 223538

SEQ ID NO: 672825 - RNA, 64 nt, hsa; identical to SEQ ID NO: 223539

SEQ ID NO: 672826 - RNA, 64 nt, hsa; identical to SEQ ID NO: 223540

SEQ ID NO: 672827 - RNA, 64 nt, hsa; identical to SEQ ID NO: 223541

SEQ ID NO: 672828 - RNA, 64 nt, hsa; identical to SEQ ID NO: 223542

SEQ ID NO: 672829 - RNA, 64 nt, hsa; identical to SEQ ID NO: 223543

SEQ ID NO: 672830 - RNA, 64 nt, hsa; identical to SEQ ID NO: 223544

SEQ ID NO: 672831 - RNA, 64 nt, hsa; identical to SEQ ID NO: 223545

SEQ ID NO: 672832 - RNA, 64 nt, hsa; identical to SEQ ID NO: 223546

SEQ ID NO: 672833 - RNA, 64 nt, hsa; identical to SEQ ID NO: 223547

SEQ ID NO: 672834 - RNA, 64 nt, hsa; identical to SEQ ID NO: 223548

SEQ ID NO: 672835 - RNA, 64 nt, hsa; identical to SEQ ID NO: 223549

SEQ ID NO: 672836 - RNA, 64 nt, hsa; identical to SEQ ID NO: 223550

SEQ ID NO: 672837 - RNA, 64 nt, hsa; identical to SEQ ID NO: 223551

SEQ ID NO: 672838 - RNA, 64 nt, hsa; identical to SEQ ID NO: 223552

SEQ ID NO: 672839 - RNA, 64 nt, hsa; identical to SEQ ID NO: 223553

SEQ ID NO: 672840 - RNA, 64 nt, hsa; identical to SEQ ID NO: 223554

SEQ ID NO: 672841 - RNA, 64 nt, hsa; identical to SEQ ID NO: 223555

SEQ ID NO: 672842 - RNA, 64 nt, hsa; identical to SEQ ID NO: 223556

SEQ ID NO: 672843 - RNA, 64 nt, hsa; identical to SEQ ID NO: 223557

SEQ ID NO: 672844 - RNA, 64 nt, hsa; identical to SEQ ID NO: 223558

SEQ ID NO: 672845 - RNA, 64 nt, hsa; identical to SEQ ID NO: 223559

SEQ ID NO: 672846 - RNA, 64 nt, hsa; identical to SEQ ID NO: 223560

SEQ ID NO: 672847 - RNA, 64 nt, hsa; identical to SEQ ID NO: 223561

SEQ ID NO: 672848 - RNA, 64 nt, hsa; identical to SEQ ID NO: 223562

SEQ ID NO: 672849 - RNA, 64 nt, hsa; identical to SEQ ID NO: 223563

SEQ ID NO: 672850 - RNA, 64 nt, hsa; identical to SEQ ID NO: 223564

SEQ ID NO: 672851 - RNA, 64 nt, hsa; identical to SEQ ID NO: 223565

SEQ ID NO: 672852 - RNA, 64 nt, hsa; identical to SEQ ID NO: 223566

SEQ ID NO: 672853 - RNA, 64 nt, hsa; identical to SEQ ID NO: 223567

SEQ ID NO: 672854 - RNA, 64 nt, hsa; identical to SEQ ID NO: 223568

SEQ ID NO: 672855 - RNA, 64 nt, hsa; identical to SEQ ID NO: 223569

SEQ ID NO: 672856 - RNA, 64 nt, hsa; identical to SEQ ID NO: 223570

SEQ ID NO: 672857 - RNA, 64 nt, hsa; identical to SEQ ID NO: 223571

SEQ ID NO: 672858 - RNA, 64 nt, hsa; identical to SEQ ID NO: 343068

SEQ ID NO: 672859 - RNA, 64 nt, hsa; identical to SEQ ID NO: 343069

SEQ ID NO: 672860 - RNA, 64 nt, hsa; identical to SEQ ID NO: 343070

SEQ ID NO: 672861 - RNA, 64 nt, hsa; identical to SEQ ID NO: 343071

SEQ ID NO: 672862 - RNA, 64 nt, hsa; identical to SEQ ID NO: 343072

SEQ ID NO: 672863 - RNA, 64 nt, hsa; identical to SEQ ID NO: 343073

SEQ ID NO: 672864 - RNA, 64 nt, hsa
aggcccugggaucgggaguuacacuacccugucccaagccgagggggccgguggaaugacuuga

SEQ ID NO: 672865 - RNA, 64 nt, hsa
agcuuuuggagaagcaggagggcauuggcuuaaccaagccgaaggcugcuggcugggcugccua

SEQ ID NO: 672866 - RNA, 64 nt, hsa
agaaucgcuugaacccgggagguggagguugcagcaagccgagauugugccacuguacuccagc

SEQ ID NO: 672867 - RNA, 64 nt, hsa
gccacagccuucggacagacauaugggauauucccaagccgaccuucccuccgccuucucccac

SEQ ID NO: 672868 - RNA, 64 nt, hsa
ccagagaacccggggccgggagaaggugguucuucaagccgagaggcacgagcuggggacaguu

SEQ ID NO: 672869 - RNA, 64 nt, hsa
guccuggccacacugaggaauuaugacuacuaugcaagccgaguuccagaaucuauuaaaaaug

SEQ ID NO: 672870 - RNA, 64 nt, hsa
acugccgcgugauucccgcggccauucagaaguucaagccgagaugcugacguugcugagcaac

SEQ ID NO: 672871 - RNA, 64 nt, hsa
ugccaaccuaucgcugcuggcagcacuuuuugagcaagccgagagcacccauuuuggcuggggg

SEQ ID NO: 672872 - RNA, 64 nt, hsa
cuggucaugcaagcauuuacagugccaugcuccucaagccgauuuuuucuuguagaaauguugc

SEQ ID NO: 672873 - RNA, 64 nt, hsa
uuauguccuuucuauagguuaagugaccccuguucaagccgaugggaugaaagaagcuugucuc

SEQ ID NO: 672874 - RNA, 64 nt, hsa
gcugguggaaaaucacgauuguggcuugauguggcaagccgaaaccacuuggcucuggaaaucu

SEQ ID NO: 672875 - RNA, 64 nt, hsa
cacuuuagcaguaucuguuuacaugcgcaaggaucaagccgacuaccugugcugucuacuggga

SEQ ID NO: 672876 - RNA, 64 nt, hsa
gaaucccacauuagcuuguuaguaaugcucugaccaagccgagaugcccauucucuuagugaug

SEQ ID NO: 672877 - RNA, 64 nt, hsa
cagggacaaacuuuccgauagggcucaguaggaucaagccgacccagagugggcaugggaugcu

SEQ ID NO: 672878 - RNA, 64 nt, hsa
ggaucuucaguuauucgaggggaaugaggcaggucaagccgaugcuagccacuaguuugauuuu

SEQ ID NO: 672879 - RNA, 64 nt, hsa
auucugauaggauguauaaauacuuagaugcauacaagccgauggauagaaagacagauaaaua

SEQ ID NO: 672880 - RNA, 64 nt, hsa
cccguuauuuuuauuuuuuacuuuuugccugagacaagccgaguaugaggugguuugauuuaag

SEQ ID NO: 672881 - RNA, 57 nt, hsa
auccugucacgucgggcuaggaggggccaagccgaagagccacccaggccacaguuc

SEQ ID NO: 672882 - RNA, 64 nt, hsa
gcuuaauaaauacuaguuauuuacaacuuuugcucaagccgagggcagaggccuuuguacgcag

SEQ ID NO: 672883 - RNA, 64 nt, hsa
acuaggagcugauguuugccucauuuaaaguaggcaagccgagccaacugcagccaucauucau

SEQ ID NO: 672884 - RNA, 64 nt, hsa
gaggcagaaacaccagccucugccaacaccggaacaagccgacgcuuccagacaaggcggaaaa

SEQ ID NO: 672885 - RNA, 64 nt, hsa
cccacugucagccacacaccugcccccaucacaccaagccgaccucagaguuguucaucuuccu

SEQ ID NO: 672886 - RNA, 64 nt, hsa
gugcucaagagguucucgacuggaggaccacacucaagccgacuuaugcccaccaucccaccuc

SEQ ID NO: 672887 - RNA, 64 nt, hsa
uaaauuuuccaauugcaaccaaacguauagcagucaagccgagcaaccuguauaagcagcccaa

SEQ ID NO: 672888 - RNA, 64 nt, hsa
gagcucugagacagagcaaacacccaccccagaacaagccgacacacagggagacgggggccug

SEQ ID NO: 672889 - RNA, 64 nt, hsa
uuggcuuuuucugguaugugcugugcuccacgaccaagccgagaaaggaccuaggguggggaag

SEQ ID NO: 672890 - RNA, 64 nt, hsa
uauauucuaguuguuuuuguacuuuuuuugcauacaagccgaacguuugugcuucccgugcaug

SEQ ID NO: 672891 - RNA, 64 nt, hsa
aagcccuccuuuggagcaaagaaggagcugagaacaagccgaaugaggaguuuuuauaagauug

SEQ ID NO: 672892 - RNA, 64 nt, hsa
cauguuuaaagaucugguccccuuuaugagaaugcaagccgauccacauccugacuuaagagau

SEQ ID NO: 672893 - RNA, 64 nt, hsa
gaagauucuaucccccgcagcgcucuccuuugagcaagccgagcucuccuuguuaccguguucu

SEQ ID NO: 672894 - RNA, 64 nt, hsa
ccacgugaggacacagugagaagguggccgucugcaagccgaggagggggccucaggagaaacc

SEQ ID NO: 672895 - RNA, 64 nt, hsa
agcccugaaccagaagccugagcaacuacggacgcaagccgaggaccgugcugccgccguccac

SEQ ID NO: 672896 - RNA, 64 nt, hsa
uaagcaugagaguguggagcagagucggcgagcgcaagccgagcccaucaaccuggacagcugu

SEQ ID NO: 672897 - RNA, 64 nt, hsa
aguuuuacucugcugcaaaaugaaggcgggccugcaagccgacuacaccuacggaggcuguuga

SEQ ID NO: 672898 - RNA, 64 nt, hsa
uuauacaaaaggccacagugaggccaccuugagucaagccgacuaaggccccucaacccuguca

SEQ ID NO: 672899 - RNA, 64 nt, hsa
ccgccgugacugcguuuuaguucucuaaauuauccaagccgauguugcucuguccuuccucaca

SEQ ID NO: 672900 - RNA, 64 nt, hsa
gagcuguucuguagccgggaugacagcucucgcccaagccgagcaugccccgggcccccgccuc

SEQ ID NO: 672901 - RNA, 64 nt, hsa
ucccacaccugcuugggaggccagagaggccagacaagccgagagccccuucuguugugggcag

SEQ ID NO: 672902 - RNA, 64 nt, hsa
ucuuccacuguggcccugcagagauccccugagccaagccgaggcaguuuccacauaagccaca

SEQ ID NO: 672903 - RNA, 64 nt, hsa
ccuguaaucucuguaaagguuuuugggggauaaggguguuuaaccaccucccagcuuucuucuu

SEQ ID NO: 672904 - RNA, 64 nt, hsa
augccuauucguagaguucccucagaagagccaugguguuuaugaagagaagaguagugauugc

SEQ ID NO: 672905 - RNA, 64 nt, hsa
cugaauuuuaaaguuucagacuuaucuuuuccuugguguuuaaauuuacuaucauugcuaaaca

SEQ ID NO: 672906 - RNA, 64 nt, hsa
gaaccugugauauaccuccauuuguccacaagaugguguuuaaaacaauuuguucagaagaacu

SEQ ID NO: 672907 - RNA, 64 nt, hsa
cagagaugcauacaaagaauuauauauaaagaaggguguuuaauaaugauaguuauaauaauaa

SEQ ID NO: 672908 - RNA, 64 nt, hsa
acuuggguuugcaacagcuuucugagaaaagcuagguguuuaauaguuuaacugaaaguuuaac

SEQ ID NO: 672909 - RNA, 64 nt, hsa
uaauaaaaacagaaggaaauugagauuagagggagguguuuaaagagagguuauagaguagaag

SEQ ID NO: 672910 - RNA, 64 nt, hsa
aggaagcagauacauaugaguguggaagccggaggguguuuauguaagagcaccuuccucacuu

SEQ ID NO: 672911 - RNA, 64 nt, hsa
auauaggcacauuaccauucauaguaagaauucugguguuuacacaaccaaauuugaugcgauc

SEQ ID NO: 672912 - RNA, 64 nt, hsa
acauuuuucacuuuugcuaaaaagaaaaaaaaaagguguuuauuuuuaacucuuggaagagguu

SEQ ID NO: 672913 - RNA, 64 nt, hsa; identical to SEQ ID NO: 73845

SEQ ID NO: 672914 - RNA, 64 nt, hsa; identical to SEQ ID NO: 73846

SEQ ID NO: 672915 - RNA, 64 nt, hsa; identical to SEQ ID NO: 73847

SEQ ID NO: 672916 - RNA, 64 nt, hsa; identical to SEQ ID NO: 73848

SEQ ID NO: 672917 - RNA, 64 nt, hsa; identical to SEQ ID NO: 73849

SEQ ID NO: 672918 - RNA, 64 nt, hsa; identical to SEQ ID NO: 73850

SEQ ID NO: 672919 - RNA, 64 nt, hsa; identical to SEQ ID NO: 73851

SEQ ID NO: 672920 - RNA, 64 nt, hsa; identical to SEQ ID NO: 73852

SEQ ID NO: 672921 - RNA, 64 nt, hsa; identical to SEQ ID NO: 73853

SEQ ID NO: 672922 - RNA, 64 nt, hsa; identical to SEQ ID NO: 73854

SEQ ID NO: 672923 - RNA, 64 nt, hsa; identical to SEQ ID NO: 73855

SEQ ID NO: 672924 - RNA, 64 nt, hsa; identical to SEQ ID NO: 73856

SEQ ID NO: 672925 - RNA, 64 nt, hsa; identical to SEQ ID NO: 73857

SEQ ID NO: 672926 - RNA, 64 nt, hsa; identical to SEQ ID NO: 73858

SEQ ID NO: 672927 - RNA, 64 nt, hsa; identical to SEQ ID NO: 73859

SEQ ID NO: 672928 - RNA, 62 nt, hsa; identical to SEQ ID NO: 73860

SEQ ID NO: 672929 - RNA, 64 nt, hsa; identical to SEQ ID NO: 73861

SEQ ID NO: 672930 - RNA, 64 nt, hsa; identical to SEQ ID NO: 73862

SEQ ID NO: 672931 - RNA, 64 nt, hsa; identical to SEQ ID NO: 73863

SEQ ID NO: 672932 - RNA, 64 nt, hsa; identical to SEQ ID NO: 73864

SEQ ID NO: 672933 - RNA, 64 nt, hsa; identical to SEQ ID NO: 73865

SEQ ID NO: 672934 - RNA, 64 nt, hsa; identical to SEQ ID NO: 73866

SEQ ID NO: 672935 - RNA, 64 nt, hsa; identical to SEQ ID NO: 73867

SEQ ID NO: 672936 - RNA, 64 nt, hsa; identical to SEQ ID NO: 73868

SEQ ID NO: 672937 - RNA, 64 nt, hsa; identical to SEQ ID NO: 73869

SEQ ID NO: 672938 - RNA, 64 nt, hsa; identical to SEQ ID NO: 73870

SEQ ID NO: 672939 - RNA, 64 nt, hsa; identical to SEQ ID NO: 73871

SEQ ID NO: 672940 - RNA, 64 nt, hsa; identical to SEQ ID NO: 73872

SEQ ID NO: 672941 - RNA, 64 nt, hsa; identical to SEQ ID NO: 73873

SEQ ID NO: 672942 - RNA, 64 nt, hsa; identical to SEQ ID NO: 73874

SEQ ID NO: 672943 - RNA, 64 nt, hsa; identical to SEQ ID NO: 73875

SEQ ID NO: 672944 - RNA, 64 nt, hsa; identical to SEQ ID NO: 73876

SEQ ID NO: 672945 - RNA, 64 nt, hsa; identical to SEQ ID NO: 73877

SEQ ID NO: 672946 - RNA, 64 nt, hsa; identical to SEQ ID NO: 73878

SEQ ID NO: 672947 - RNA, 64 nt, hsa; identical to SEQ ID NO: 73879

SEQ ID NO: 672948 - RNA, 64 nt, hsa; identical to SEQ ID NO: 73880

SEQ ID NO: 672949 - RNA, 64 nt, hsa; identical to SEQ ID NO: 73881

SEQ ID NO: 672950 - RNA, 64 nt, hsa; identical to SEQ ID NO: 73882

SEQ ID NO: 672951 - RNA, 64 nt, hsa; identical to SEQ ID NO: 73883

SEQ ID NO: 672952 - RNA, 64 nt, hsa; identical to SEQ ID NO: 73884

SEQ ID NO: 672953 - RNA, 64 nt, hsa; identical to SEQ ID NO: 73885

SEQ ID NO: 672954 - RNA, 64 nt, hsa; identical to SEQ ID NO: 73886

SEQ ID NO: 672955 - RNA, 64 nt, hsa; identical to SEQ ID NO: 73887

SEQ ID NO: 672956 - RNA, 64 nt, hsa; identical to SEQ ID NO: 73888

SEQ ID NO: 672957 - RNA, 64 nt, hsa; identical to SEQ ID NO: 73889

SEQ ID NO: 672958 - RNA, 64 nt, hsa; identical to SEQ ID NO: 160405

SEQ ID NO: 672959 - RNA, 64 nt, hsa; identical to SEQ ID NO: 160406

SEQ ID NO: 672960 - RNA, 64 nt, hsa; identical to SEQ ID NO: 160407

SEQ ID NO: 672961 - RNA, 64 nt, hsa; identical to SEQ ID NO: 160408

SEQ ID NO: 672962 - RNA, 64 nt, hsa; identical to SEQ ID NO: 160409

SEQ ID NO: 672963 - RNA, 64 nt, hsa; identical to SEQ ID NO: 160410

SEQ ID NO: 672964 - RNA, 64 nt, hsa; identical to SEQ ID NO: 160411

SEQ ID NO: 672965 - RNA, 64 nt, hsa; identical to SEQ ID NO: 160412

SEQ ID NO: 672966 - RNA, 64 nt, hsa; identical to SEQ ID NO: 160413

SEQ ID NO: 672967 - RNA, 64 nt, hsa; identical to SEQ ID NO: 160414

SEQ ID NO: 672968 - RNA, 64 nt, hsa; identical to SEQ ID NO: 160415

SEQ ID NO: 672969 - RNA, 64 nt, hsa; identical to SEQ ID NO: 160416

SEQ ID NO: 672970 - RNA, 64 nt, hsa; identical to SEQ ID NO: 160417

SEQ ID NO: 672971 - RNA, 64 nt, hsa; identical to SEQ ID NO: 160418

SEQ ID NO: 672972 - RNA, 64 nt, hsa; identical to SEQ ID NO: 160419

SEQ ID NO: 672973 - RNA, 64 nt, hsa; identical to SEQ ID NO: 160420

SEQ ID NO: 672974 - RNA, 64 nt, hsa; identical to SEQ ID NO: 160421

SEQ ID NO: 672975 - RNA, 64 nt, hsa; identical to SEQ ID NO: 160422

SEQ ID NO: 672976 - RNA, 64 nt, hsa; identical to SEQ ID NO: 160423

SEQ ID NO: 672977 - RNA, 64 nt, hsa; identical to SEQ ID NO: 160424

SEQ ID NO: 672978 - RNA, 64 nt, hsa; identical to SEQ ID NO: 160425

SEQ ID NO: 672979 - RNA, 64 nt, hsa; identical to SEQ ID NO: 160426

SEQ ID NO: 672980 - RNA, 64 nt, hsa; identical to SEQ ID NO: 160427

SEQ ID NO: 672981 - RNA, 64 nt, hsa; identical to SEQ ID NO: 160428

SEQ ID NO: 672982 - RNA, 64 nt, hsa; identical to SEQ ID NO: 160429

SEQ ID NO: 672983 - RNA, 64 nt, hsa; identical to SEQ ID NO: 160430

SEQ ID NO: 672984 - RNA, 61 nt, hsa; identical to SEQ ID NO: 160431

SEQ ID NO: 672985 - RNA, 64 nt, hsa; identical to SEQ ID NO: 160432

SEQ ID NO: 672986 - RNA, 64 nt, hsa; identical to SEQ ID NO: 160433

SEQ ID NO: 672987 - RNA, 64 nt, hsa; identical to SEQ ID NO: 160434

SEQ ID NO: 672988 - RNA, 64 nt, hsa; identical to SEQ ID NO: 160435

SEQ ID NO: 672989 - RNA, 64 nt, hsa; identical to SEQ ID NO: 160436

SEQ ID NO: 672990 - RNA, 64 nt, hsa; identical to SEQ ID NO: 160437

SEQ ID NO: 672991 - RNA, 64 nt, hsa; identical to SEQ ID NO: 160438

SEQ ID NO: 672992 - RNA, 64 nt, hsa; identical to SEQ ID NO: 160439

SEQ ID NO: 672993 - RNA, 64 nt, hsa; identical to SEQ ID NO: 160440

SEQ ID NO: 672994 - RNA, 64 nt, hsa; identical to SEQ ID NO: 160441

SEQ ID NO: 672995 - RNA, 64 nt, hsa; identical to SEQ ID NO: 160442

SEQ ID NO: 672996 - RNA, 64 nt, hsa; identical to SEQ ID NO: 160443

SEQ ID NO: 672997 - RNA, 64 nt, hsa; identical to SEQ ID NO: 160444

SEQ ID NO: 672998 - RNA, 64 nt, hsa; identical to SEQ ID NO: 160445

SEQ ID NO: 672999 - RNA, 64 nt, hsa; identical to SEQ ID NO: 160446

SEQ ID NO: 673000 - RNA, 64 nt, hsa; identical to SEQ ID NO: 160447

SEQ ID NO: 673001 - RNA, 64 nt, hsa; identical to SEQ ID NO: 160448

SEQ ID NO: 673002 - RNA, 64 nt, hsa; identical to SEQ ID NO: 160449

SEQ ID NO: 673003 - RNA, 64 nt, hsa; identical to SEQ ID NO: 160450

SEQ ID NO: 673004 - RNA, 64 nt, hsa; identical to SEQ ID NO: 160451

SEQ ID NO: 673005 - RNA, 64 nt, hsa; identical to SEQ ID NO: 160452

SEQ ID NO: 673006 - RNA, 64 nt, hsa; identical to SEQ ID NO: 160453

SEQ ID NO: 673007 - RNA, 64 nt, hsa; identical to SEQ ID NO: 160454

SEQ ID NO: 673008 - RNA, 64 nt, hsa; identical to SEQ ID NO: 160455

SEQ ID NO: 673009 - RNA, 64 nt, hsa; identical to SEQ ID NO: 160456

SEQ ID NO: 673010 - RNA, 64 nt, hsa; identical to SEQ ID NO: 160457

SEQ ID NO: 673011 - RNA, 64 nt, hsa; identical to SEQ ID NO: 160458

SEQ ID NO: 673012 - RNA, 64 nt, hsa; identical to SEQ ID NO: 160459

SEQ ID NO: 673013 - RNA, 64 nt, hsa; identical to SEQ ID NO: 160460

SEQ ID NO: 673014 - RNA, 64 nt, hsa; identical to SEQ ID NO: 160461

SEQ ID NO: 673015 - RNA, 64 nt, hsa; identical to SEQ ID NO: 160462

SEQ ID NO: 673016 - RNA, 64 nt, hsa; identical to SEQ ID NO: 160463

SEQ ID NO: 673017 - RNA, 64 nt, hsa; identical to SEQ ID NO: 160464

SEQ ID NO: 673018 - RNA, 64 nt, hsa; identical to SEQ ID NO: 356502

SEQ ID NO: 673019 - RNA, 64 nt, hsa; identical to SEQ ID NO: 356503

SEQ ID NO: 673020 - RNA, 64 nt, hsa; identical to SEQ ID NO: 356504

SEQ ID NO: 673021 - RNA, 64 nt, hsa; identical to SEQ ID NO: 356505

SEQ ID NO: 673022 - RNA, 64 nt, hsa; identical to SEQ ID NO: 356506

SEQ ID NO: 673023 - RNA, 64 nt, hsa; identical to SEQ ID NO: 356507

SEQ ID NO: 673024 - RNA, 64 nt, hsa; identical to SEQ ID NO: 356508

SEQ ID NO: 673025 - RNA, 64 nt, hsa; identical to SEQ ID NO: 356509

SEQ ID NO: 673026 - RNA, 64 nt, hsa; identical to SEQ ID NO: 356510

SEQ ID NO: 673027 - RNA, 64 nt, hsa; identical to SEQ ID NO: 356511

SEQ ID NO: 673028 - RNA, 64 nt, hsa; identical to SEQ ID NO: 356512

SEQ ID NO: 673029 - RNA, 64 nt, hsa; identical to SEQ ID NO: 356513

SEQ ID NO: 673030 - RNA, 64 nt, hsa; identical to SEQ ID NO: 356514

SEQ ID NO: 673031 - RNA, 64 nt, hsa; identical to SEQ ID NO: 356515

SEQ ID NO: 673032 - RNA, 64 nt, hsa; identical to SEQ ID NO: 356516

SEQ ID NO: 673033 - RNA, 64 nt, hsa; identical to SEQ ID NO: 356517

SEQ ID NO: 673034 - RNA, 64 nt, hsa; identical to SEQ ID NO: 356518

SEQ ID NO: 673035 - RNA, 64 nt, hsa; identical to SEQ ID NO: 356519

SEQ ID NO: 673036 - RNA, 64 nt, hsa; identical to SEQ ID NO: 356520

SEQ ID NO: 673037 - RNA, 64 nt, hsa; identical to SEQ ID NO: 356521

SEQ ID NO: 673038 - RNA, 64 nt, hsa; identical to SEQ ID NO: 356522

SEQ ID NO: 673039 - RNA, 64 nt, hsa; identical to SEQ ID NO: 356523

SEQ ID NO: 673040 - RNA, 64 nt, hsa; identical to SEQ ID NO: 356524

SEQ ID NO: 673041 - RNA, 64 nt, hsa; identical to SEQ ID NO: 356525

SEQ ID NO: 673042 - RNA, 64 nt, hsa; identical to SEQ ID NO: 356526

SEQ ID NO: 673043 - RNA, 64 nt, hsa; identical to SEQ ID NO: 356527

SEQ ID NO: 673044 - RNA, 64 nt, hsa; identical to SEQ ID NO: 356528

SEQ ID NO: 673045 - RNA, 64 nt, hsa; identical to SEQ ID NO: 356529

SEQ ID NO: 673046 - RNA, 64 nt, hsa; identical to SEQ ID NO: 356530

SEQ ID NO: 673047 - RNA, 64 nt, hsa; identical to SEQ ID NO: 356531

SEQ ID NO: 673048 - RNA, 64 nt, hsa; identical to SEQ ID NO: 356532

SEQ ID NO: 673049 - RNA, 64 nt, hsa; identical to SEQ ID NO: 356533

SEQ ID NO: 673050 - RNA, 64 nt, hsa; identical to SEQ ID NO: 356534

SEQ ID NO: 673051 - RNA, 64 nt, hsa; identical to SEQ ID NO: 356535

SEQ ID NO: 673052 - RNA, 64 nt, hsa; identical to SEQ ID NO: 356536

SEQ ID NO: 673053 - RNA, 64 nt, hsa; identical to SEQ ID NO: 356537

SEQ ID NO: 673054 - RNA, 64 nt, hsa; identical to SEQ ID NO: 356538

SEQ ID NO: 673055 - RNA, 64 nt, hsa; identical to SEQ ID NO: 356539

SEQ ID NO: 673056 - RNA, 64 nt, hsa; identical to SEQ ID NO: 356540

SEQ ID NO: 673057 - RNA, 64 nt, hsa; identical to SEQ ID NO: 247878

SEQ ID NO: 673058 - RNA, 64 nt, hsa; identical to SEQ ID NO: 247879

SEQ ID NO: 673059 - RNA, 64 nt, hsa; identical to SEQ ID NO: 247880

SEQ ID NO: 673060 - RNA, 64 nt, hsa; identical to SEQ ID NO: 247881

SEQ ID NO: 673061 - RNA, 64 nt, hsa; identical to SEQ ID NO: 460726

SEQ ID NO: 673062 - RNA, 64 nt, hsa; identical to SEQ ID NO: 460727

SEQ ID NO: 673063 - RNA, 64 nt, hsa; identical to SEQ ID NO: 460728

SEQ ID NO: 673064 - RNA, 64 nt, hsa; identical to SEQ ID NO: 460729

SEQ ID NO: 673065 - RNA, 64 nt, hsa; identical to SEQ ID NO: 460730

SEQ ID NO: 673066 - RNA, 64 nt, hsa; identical to SEQ ID NO: 460731

SEQ ID NO: 673067 - RNA, 64 nt, hsa; identical to SEQ ID NO: 460732

SEQ ID NO: 673068 - RNA, 64 nt, hsa
auagguaacccacaggcccagugccagcccucaaaggacauagacuuugaaacaagcgaauuaa

SEQ ID NO: 673069 - RNA, 64 nt, hsa
acccaggaagggaugaucaggagaggcuucccugaggacauaauguguaagagaggugagaagu

SEQ ID NO: 673070 - RNA, 64 nt, hsa
acgcucguugacuccgugggugaauacagcaguuaggacauacacaccaucaccuuugaaagug

SEQ ID NO: 673071 - RNA, 64 nt, hsa
caucaccuuugaaagugcuuguuugggggagggaaggacauacggguaacuagaacuacccagc

SEQ ID NO: 673072 - RNA, 64 nt, hsa; identical to SEQ ID NO: 284748

SEQ ID NO: 673073 - RNA, 64 nt, hsa; identical to SEQ ID NO: 284749

SEQ ID NO: 673074 - RNA, 64 nt, hsa; identical to SEQ ID NO: 284750

SEQ ID NO: 673075 - RNA, 64 nt, hsa; identical to SEQ ID NO: 284751

SEQ ID NO: 673076 - RNA, 64 nt, hsa; identical to SEQ ID NO: 284752

SEQ ID NO: 673077 - RNA, 64 nt, hsa; identical to SEQ ID NO: 284753

SEQ ID NO: 673078 - RNA, 64 nt, hsa; identical to SEQ ID NO: 284754

SEQ ID NO: 673079 - RNA, 64 nt, hsa; identical to SEQ ID NO: 284755

SEQ ID NO: 673080 - RNA, 64 nt, hsa; identical to SEQ ID NO: 284756

SEQ ID NO: 673081 - RNA, 64 nt, hsa; identical to SEQ ID NO: 284757

SEQ ID NO: 673082 - RNA, 64 nt, hsa; identical to SEQ ID NO: 284758

SEQ ID NO: 673083 - RNA, 64 nt, hsa; identical to SEQ ID NO: 284759

SEQ ID NO: 673084 - RNA, 64 nt, hsa; identical to SEQ ID NO: 284760

SEQ ID NO: 673085 - RNA, 64 nt, hsa; identical to SEQ ID NO: 284761

SEQ ID NO: 673086 - RNA, 64 nt, hsa; identical to SEQ ID NO: 284762

SEQ ID NO: 673087 - RNA, 64 nt, hsa; identical to SEQ ID NO: 284763

SEQ ID NO: 673088 - RNA, 64 nt, hsa; identical to SEQ ID NO: 284764

SEQ ID NO: 673089 - RNA, 64 nt, hsa; identical to SEQ ID NO: 284765

SEQ ID NO: 673090 - RNA, 64 nt, hsa; identical to SEQ ID NO: 284766

SEQ ID NO: 673091 - RNA, 64 nt, hsa; identical to SEQ ID NO: 284767

SEQ ID NO: 673092 - RNA, 64 nt, hsa; identical to SEQ ID NO: 284768

SEQ ID NO: 673093 - RNA, 64 nt, hsa; identical to SEQ ID NO: 284769

SEQ ID NO: 673094 - RNA, 64 nt, hsa; identical to SEQ ID NO: 284770

SEQ ID NO: 673095 - RNA, 64 nt, hsa; identical to SEQ ID NO: 284771

SEQ ID NO: 673096 - RNA, 64 nt, hsa; identical to SEQ ID NO: 284772

SEQ ID NO: 673097 - RNA, 64 nt, hsa; identical to SEQ ID NO: 284773

SEQ ID NO: 673098 - RNA, 64 nt, hsa; identical to SEQ ID NO: 284774

SEQ ID NO: 673099 - RNA, 64 nt, hsa; identical to SEQ ID NO: 284775

SEQ ID NO: 673100 - RNA, 64 nt, hsa; identical to SEQ ID NO: 284776

SEQ ID NO: 673101 - RNA, 64 nt, hsa; identical to SEQ ID NO: 284777

SEQ ID NO: 673102 - RNA, 64 nt, hsa; identical to SEQ ID NO: 284778

SEQ ID NO: 673103 - RNA, 64 nt, hsa; identical to SEQ ID NO: 284779

SEQ ID NO: 673104 - RNA, 64 nt, hsa; identical to SEQ ID NO: 284780

SEQ ID NO: 673105 - RNA, 64 nt, hsa; identical to SEQ ID NO: 284781

SEQ ID NO: 673106 - RNA, 64 nt, hsa; identical to SEQ ID NO: 284782

SEQ ID NO: 673107 - RNA, 64 nt, hsa; identical to SEQ ID NO: 284783

SEQ ID NO: 673108 - RNA, 64 nt, hsa; identical to SEQ ID NO: 284784

SEQ ID NO: 673109 - RNA, 64 nt, hsa; identical to SEQ ID NO: 284785

SEQ ID NO: 673110 - RNA, 64 nt, hsa; identical to SEQ ID NO: 284786

SEQ ID NO: 673111 - RNA, 64 nt, hsa; identical to SEQ ID NO: 284787

SEQ ID NO: 673112 - RNA, 64 nt, hsa; identical to SEQ ID NO: 284788

SEQ ID NO: 673113 - RNA, 64 nt, hsa; identical to SEQ ID NO: 284789

SEQ ID NO: 673114 - RNA, 64 nt, hsa; identical to SEQ ID NO: 284790

SEQ ID NO: 673115 - RNA, 64 nt, hsa; identical to SEQ ID NO: 284791

SEQ ID NO: 673116 - RNA, 64 nt, hsa; identical to SEQ ID NO: 284792

SEQ ID NO: 673117 - RNA, 64 nt, hsa; identical to SEQ ID NO: 284793

SEQ ID NO: 673118 - RNA, 64 nt, hsa; identical to SEQ ID NO: 284794

SEQ ID NO: 673119 - RNA, 64 nt, hsa; identical to SEQ ID NO: 284795

SEQ ID NO: 673120 - RNA, 64 nt, hsa; identical to SEQ ID NO: 284796

SEQ ID NO: 673121 - RNA, 64 nt, hsa; identical to SEQ ID NO: 284797

SEQ ID NO: 673122 - RNA, 64 nt, hsa; identical to SEQ ID NO: 284798

SEQ ID NO: 673123 - RNA, 64 nt, hsa; identical to SEQ ID NO: 284799

SEQ ID NO: 673124 - RNA, 64 nt, hsa; identical to SEQ ID NO: 284800

SEQ ID NO: 673125 - RNA, 64 nt, hsa; identical to SEQ ID NO: 284801

SEQ ID NO: 673126 - RNA, 64 nt, hsa; identical to SEQ ID NO: 284802

SEQ ID NO: 673127 - RNA, 64 nt, hsa; identical to SEQ ID NO: 284803

SEQ ID NO: 673128 - RNA, 64 nt, hsa; identical to SEQ ID NO: 284804

SEQ ID NO: 673129 - RNA, 64 nt, hsa; identical to SEQ ID NO: 284805

SEQ ID NO: 673130 - RNA, 64 nt, hsa; identical to SEQ ID NO: 284806

SEQ ID NO: 673131 - RNA, 64 nt, hsa; identical to SEQ ID NO: 284807

SEQ ID NO: 673132 - RNA, 64 nt, hsa; identical to SEQ ID NO: 284808

SEQ ID NO: 673133 - RNA, 64 nt, hsa; identical to SEQ ID NO: 284809

SEQ ID NO: 673134 - RNA, 64 nt, hsa; identical to SEQ ID NO: 284810

SEQ ID NO: 673135 - RNA, 64 nt, hsa; identical to SEQ ID NO: 284811

SEQ ID NO: 673136 - RNA, 64 nt, hsa; identical to SEQ ID NO: 284812

SEQ ID NO: 673137 - RNA, 64 nt, hsa; identical to SEQ ID NO: 284813

SEQ ID NO: 673138 - RNA, 64 nt, hsa; identical to SEQ ID NO: 284814

SEQ ID NO: 673139 - RNA, 64 nt, hsa; identical to SEQ ID NO: 284815

SEQ ID NO: 673140 - RNA, 64 nt, hsa; identical to SEQ ID NO: 284816

SEQ ID NO: 673141 - RNA, 64 nt, hsa; identical to SEQ ID NO: 284817

SEQ ID NO: 673142 - RNA, 64 nt, hsa; identical to SEQ ID NO: 284818

SEQ ID NO: 673143 - RNA, 64 nt, hsa; identical to SEQ ID NO: 284819

SEQ ID NO: 673144 - RNA, 64 nt, hsa; identical to SEQ ID NO: 284820

SEQ ID NO: 673145 - RNA, 64 nt, hsa; identical to SEQ ID NO: 284821

SEQ ID NO: 673146 - RNA, 64 nt, hsa; identical to SEQ ID NO: 284822

SEQ ID NO: 673147 - RNA, 64 nt, hsa; identical to SEQ ID NO: 284823

SEQ ID NO: 673148 - RNA, 64 nt, hsa; identical to SEQ ID NO: 284824

SEQ ID NO: 673149 - RNA, 57 nt, hsa; identical to SEQ ID NO: 284825

SEQ ID NO: 673150 - RNA, 52 nt, hsa; identical to SEQ ID NO: 284826

SEQ ID NO: 673151 - RNA, 64 nt, hsa; identical to SEQ ID NO: 284827

SEQ ID NO: 673152 - RNA, 64 nt, hsa; identical to SEQ ID NO: 284828

SEQ ID NO: 673153 - RNA, 64 nt, hsa; identical to SEQ ID NO: 284829

SEQ ID NO: 673154 - RNA, 64 nt, hsa; identical to SEQ ID NO: 284830

SEQ ID NO: 673155 - RNA, 64 nt, hsa; identical to SEQ ID NO: 284831

SEQ ID NO: 673156 - RNA, 64 nt, hsa; identical to SEQ ID NO: 284832

SEQ ID NO: 673157 - RNA, 64 nt, hsa; identical to SEQ ID NO: 284833

SEQ ID NO: 673158 - RNA, 64 nt, hsa; identical to SEQ ID NO: 284834

SEQ ID NO: 673159 - RNA, 64 nt, hsa; identical to SEQ ID NO: 284835

SEQ ID NO: 673160 - RNA, 64 nt, hsa; identical to SEQ ID NO: 284836

SEQ ID NO: 673161 - RNA, 64 nt, hsa; identical to SEQ ID NO: 284837

SEQ ID NO: 673162 - RNA, 64 nt, hsa; identical to SEQ ID NO: 284838

SEQ ID NO: 673163 - RNA, 64 nt, hsa; identical to SEQ ID NO: 284839

SEQ ID NO: 673164 - RNA, 64 nt, hsa; identical to SEQ ID NO: 284840

SEQ ID NO: 673165 - RNA, 64 nt, hsa; identical to SEQ ID NO: 552939

SEQ ID NO: 673166 - RNA, 64 nt, hsa; identical to SEQ ID NO: 552940

SEQ ID NO: 673167 - RNA, 64 nt, hsa; identical to SEQ ID NO: 552941

SEQ ID NO: 673168 - RNA, 64 nt, hsa; identical to SEQ ID NO: 552942

SEQ ID NO: 673169 - RNA, 64 nt, hsa; identical to SEQ ID NO: 552943

SEQ ID NO: 673170 - RNA, 64 nt, hsa; identical to SEQ ID NO: 552944

SEQ ID NO: 673171 - RNA, 64 nt, hsa; identical to SEQ ID NO: 552945

SEQ ID NO: 673172 - RNA, 64 nt, hsa; identical to SEQ ID NO: 552946

SEQ ID NO: 673173 - RNA, 64 nt, hsa; identical to SEQ ID NO: 552947

SEQ ID NO: 673174 - RNA, 64 nt, hsa; identical to SEQ ID NO: 552948

SEQ ID NO: 673175 - RNA, 64 nt, hsa; identical to SEQ ID NO: 552949

SEQ ID NO: 673176 - RNA, 64 nt, hsa; identical to SEQ ID NO: 552950

SEQ ID NO: 673177 - RNA, 64 nt, hsa; identical to SEQ ID NO: 552951

SEQ ID NO: 673178 - RNA, 64 nt, hsa; identical to SEQ ID NO: 552952

SEQ ID NO: 673179 - RNA, 64 nt, hsa; identical to SEQ ID NO: 552953

SEQ ID NO: 673180 - RNA, 64 nt, hsa; identical to SEQ ID NO: 552954

SEQ ID NO: 673181 - RNA, 64 nt, hsa; identical to SEQ ID NO: 552955

SEQ ID NO: 673182 - RNA, 64 nt, hsa; identical to SEQ ID NO: 552956

SEQ ID NO: 673183 - RNA, 64 nt, hsa; identical to SEQ ID NO: 552957

SEQ ID NO: 673184 - RNA, 64 nt, hsa; identical to SEQ ID NO: 552958

SEQ ID NO: 673185 - RNA, 64 nt, hsa; identical to SEQ ID NO: 552959

SEQ ID NO: 673186 - RNA, 64 nt, hsa; identical to SEQ ID NO: 552960

SEQ ID NO: 673187 - RNA, 64 nt, hsa; identical to SEQ ID NO: 552961

SEQ ID NO: 673188 - RNA, 64 nt, hsa; identical to SEQ ID NO: 552962

SEQ ID NO: 673189 - RNA, 64 nt, hsa; identical to SEQ ID NO: 552963

SEQ ID NO: 673190 - RNA, 64 nt, hsa; identical to SEQ ID NO: 552964

SEQ ID NO: 673191 - RNA, 64 nt, hsa; identical to SEQ ID NO: 552965

SEQ ID NO: 673192 - RNA, 64 nt, hsa; identical to SEQ ID NO: 552966

SEQ ID NO: 673193 - RNA, 64 nt, hsa; identical to SEQ ID NO: 552967

SEQ ID NO: 673194 - RNA, 64 nt, hsa; identical to SEQ ID NO: 552968

SEQ ID NO: 673195 - RNA, 64 nt, hsa; identical to SEQ ID NO: 552969

SEQ ID NO: 673196 - RNA, 64 nt, hsa; identical to SEQ ID NO: 552970

SEQ ID NO: 673197 - RNA, 64 nt, hsa; identical to SEQ ID NO: 552971

SEQ ID NO: 673198 - RNA, 64 nt, hsa; identical to SEQ ID NO: 552972

SEQ ID NO: 673199 - RNA, 64 nt, hsa; identical to SEQ ID NO: 552973

SEQ ID NO: 673200 - RNA, 64 nt, hsa; identical to SEQ ID NO: 552974

SEQ ID NO: 673201 - RNA, 64 nt, hsa; identical to SEQ ID NO: 552975

SEQ ID NO: 673202 - RNA, 64 nt, hsa; identical to SEQ ID NO: 552976

SEQ ID NO: 673203 - RNA, 64 nt, hsa; identical to SEQ ID NO: 552977

SEQ ID NO: 673204 - RNA, 64 nt, hsa; identical to SEQ ID NO: 552978

SEQ ID NO: 673205 - RNA, 64 nt, hsa; identical to SEQ ID NO: 552979

SEQ ID NO: 673206 - RNA, 64 nt, hsa; identical to SEQ ID NO: 552980

SEQ ID NO: 673207 - RNA, 64 nt, hsa; identical to SEQ ID NO: 552981

SEQ ID NO: 673208 - RNA, 64 nt, hsa; identical to SEQ ID NO: 552982

SEQ ID NO: 673209 - RNA, 64 nt, hsa; identical to SEQ ID NO: 552983

SEQ ID NO: 673210 - RNA, 64 nt, hsa; identical to SEQ ID NO: 552984

SEQ ID NO: 673211 - RNA, 64 nt, hsa; identical to SEQ ID NO: 552985

SEQ ID NO: 673212 - RNA, 64 nt, hsa; identical to SEQ ID NO: 552986

SEQ ID NO: 673213 - RNA, 64 nt, hsa; identical to SEQ ID NO: 552987

SEQ ID NO: 673214 - RNA, 64 nt, hsa; identical to SEQ ID NO: 552988

SEQ ID NO: 673215 - RNA, 64 nt, hsa; identical to SEQ ID NO: 552989

SEQ ID NO: 673216 - RNA, 64 nt, hsa; identical to SEQ ID NO: 552990

SEQ ID NO: 673217 - RNA, 64 nt, hsa; identical to SEQ ID NO: 552991

SEQ ID NO: 673218 - RNA, 64 nt, hsa; identical to SEQ ID NO: 552992

SEQ ID NO: 673219 - RNA, 64 nt, hsa; identical to SEQ ID NO: 552993

SEQ ID NO: 673220 - RNA, 64 nt, hsa; identical to SEQ ID NO: 552994

SEQ ID NO: 673221 - RNA, 64 nt, hsa; identical to SEQ ID NO: 552995

SEQ ID NO: 673222 - RNA, 64 nt, hsa; identical to SEQ ID NO: 552996

SEQ ID NO: 673223 - RNA, 64 nt, hsa; identical to SEQ ID NO: 552997

SEQ ID NO: 673224 - RNA, 64 nt, hsa; identical to SEQ ID NO: 552998

SEQ ID NO: 673225 - RNA, 64 nt, hsa; identical to SEQ ID NO: 552999

SEQ ID NO: 673226 - RNA, 64 nt, hsa; identical to SEQ ID NO: 553000

SEQ ID NO: 673227 - RNA, 64 nt, hsa; identical to SEQ ID NO: 553001

SEQ ID NO: 673228 - RNA, 64 nt, hsa; identical to SEQ ID NO: 553002

SEQ ID NO: 673229 - RNA, 64 nt, hsa; identical to SEQ ID NO: 553003

SEQ ID NO: 673230 - RNA, 64 nt, hsa; identical to SEQ ID NO: 553004

SEQ ID NO: 673231 - RNA, 64 nt, hsa; identical to SEQ ID NO: 553005

SEQ ID NO: 673232 - RNA, 64 nt, hsa; identical to SEQ ID NO: 553006

SEQ ID NO: 673233 - RNA, 64 nt, hsa; identical to SEQ ID NO: 553007

SEQ ID NO: 673234 - RNA, 64 nt, hsa; identical to SEQ ID NO: 553008

SEQ ID NO: 673235 - RNA, 64 nt, hsa; identical to SEQ ID NO: 553009

SEQ ID NO: 673236 - RNA, 64 nt, hsa
gaucacaucacuguacuccagccugggugacaaaaugagacauugucucuaaaauacauaagua

SEQ ID NO: 673237 - RNA, 64 nt, hsa
cuuaauaauagagcaccagaaaaauuucuaccaaaugagacaacaacuuuaggauaaguucauc

SEQ ID NO: 673238 - RNA, 64 nt, hsa
uucaagauucaaaaagaauuuuaaauacaccaacaugagacaucaguagucaguugguuuucag

SEQ ID NO: 673239 - RNA, 64 nt, hsa
acacaguauaacugaugcucuucuggaauaccacaugagacauggucagaaacagugcuuggaa

SEQ ID NO: 673240 - RNA, 64 nt, hsa
ucuguacaggaagcaucccagcgcccacaugggcaugagacagucugcacugcgccuggugaaa

SEQ ID NO: 673241 - RNA, 64 nt, hsa
cuguaaacaggaacaccuauguguaacugaaggcaugagacaucuguacaggaagcaucccagc

SEQ ID NO: 673242 - RNA, 64 nt, hsa
gacaaucauauuauuuuagaaucauuuauuuuaaaugagacaaucauuuuaaguuuuaagauaa

SEQ ID NO: 673243 - RNA, 64 nt, hsa
gauauacauuauuuuagaaucauuuacuauuuaaaugagacaaucauauuauuuuagaaucauu

SEQ ID NO: 673244 - RNA, 63 nt, hsa
gcaggcaaaauggacucuaguccacuuccucccaugagacagagugauggccagcuuggggac

SEQ ID NO: 673245 - RNA, 64 nt, hsa
gauuuucccucaaaucuaucuagauuauuuuaagaugagacaagauuauugucaaucccugaau

SEQ ID NO: 673246 - RNA, 64 nt, hsa
aaacuccuuguuauccuuguuuccuuagcuugguaugagacagaucggauccaguuucccaugc

SEQ ID NO: 673247 - RNA, 64 nt, hsa
cuaaaaaugcaucuggcuacuuuuucauguauguaugagacagaaacuaauccuuacuauccua

SEQ ID NO: 673248 - RNA, 64 nt, hsa
aauuuuggcugaucuagauaccaugagacacaaaaugagacaguuaaaaggucaguaugaacua

SEQ ID NO: 673249 - RNA, 60 nt, hsa
aaggacagaauuuuggcugaucuagauaccaugagacacaaaaugagacaguuaaaaggu

SEQ ID NO: 673250 - RNA, 64 nt, hsa
acgaucuuucucuaguuucauucaacugauuuccaugagacaaugacagaaacccuaccuaucu

SEQ ID NO: 673251 - RNA, 64 nt, hsa
guaccuuguucuggucacuguugggagcuuuuagaugagacaucuuuccaggaguagaaggguu

SEQ ID NO: 673252 - RNA, 64 nt, hsa
cauccgagaagccuccucaguaguuacucugcucaugagacagaucugggcuccaagccaggaa

SEQ ID NO: 673253 - RNA, 64 nt, hsa
cucgcugccaggcugcucagagucccgcccacauaugagacaggcacuggcugaagacaggcaa

SEQ ID NO: 673254 - RNA, 64 nt, hsa
gaaaacauacuaaugggggucuuucugugaugugaugagacauacauguaaguguauauaugug

SEQ ID NO: 673255 - RNA, 64 nt, hsa
uugaauaucuccugcgguguauauuaacaucuugaugagacagauuuccaggcaacaaaauaau

SEQ ID NO: 673256 - RNA, 64 nt, hsa; identical to SEQ ID NO: 146515

SEQ ID NO: 673257 - RNA, 64 nt, hsa; identical to SEQ ID NO: 146516

SEQ ID NO: 673258 - RNA, 64 nt, hsa; identical to SEQ ID NO: 146517

SEQ ID NO: 673259 - RNA, 64 nt, hsa; identical to SEQ ID NO: 146518

SEQ ID NO: 673260 - RNA, 64 nt, hsa; identical to SEQ ID NO: 146519

SEQ ID NO: 673261 - RNA, 64 nt, hsa; identical to SEQ ID NO: 146520

SEQ ID NO: 673262 - RNA, 64 nt, hsa; identical to SEQ ID NO: 146521

SEQ ID NO: 673263 - RNA, 64 nt, hsa; identical to SEQ ID NO: 146522

SEQ ID NO: 673264 - RNA, 64 nt, hsa; identical to SEQ ID NO: 146523

SEQ ID NO: 673265 - RNA, 64 nt, hsa; identical to SEQ ID NO: 146524

SEQ ID NO: 673266 - RNA, 64 nt, hsa; identical to SEQ ID NO: 146525

SEQ ID NO: 673267 - RNA, 64 nt, hsa; identical to SEQ ID NO: 146526

SEQ ID NO: 673268 - RNA, 64 nt, hsa; identical to SEQ ID NO: 146527

SEQ ID NO: 673269 - RNA, 64 nt, hsa; identical to SEQ ID NO: 146528

SEQ ID NO: 673270 - RNA, 64 nt, hsa; identical to SEQ ID NO: 146529

SEQ ID NO: 673271 - RNA, 64 nt, hsa; identical to SEQ ID NO: 146530

SEQ ID NO: 673272 - RNA, 64 nt, hsa; identical to SEQ ID NO: 146531

SEQ ID NO: 673273 - RNA, 64 nt, hsa; identical to SEQ ID NO: 146532

SEQ ID NO: 673274 - RNA, 64 nt, hsa; identical to SEQ ID NO: 146533

SEQ ID NO: 673275 - RNA, 64 nt, hsa; identical to SEQ ID NO: 146534

SEQ ID NO: 673276 - RNA, 64 nt, hsa; identical to SEQ ID NO: 146535

SEQ ID NO: 673277 - RNA, 64 nt, hsa; identical to SEQ ID NO: 146536

SEQ ID NO: 673278 - RNA, 64 nt, hsa; identical to SEQ ID NO: 146537

SEQ ID NO: 673279 - RNA, 64 nt, hsa; identical to SEQ ID NO: 146538

SEQ ID NO: 673280 - RNA, 64 nt, hsa; identical to SEQ ID NO: 146539

SEQ ID NO: 673281 - RNA, 64 nt, hsa; identical to SEQ ID NO: 146540

SEQ ID NO: 673282 - RNA, 64 nt, hsa; identical to SEQ ID NO: 146541

SEQ ID NO: 673283 - RNA, 64 nt, hsa; identical to SEQ ID NO: 146542

SEQ ID NO: 673284 - RNA, 64 nt, hsa; identical to SEQ ID NO: 146543

SEQ ID NO: 673285 - RNA, 64 nt, hsa; identical to SEQ ID NO: 146544

SEQ ID NO: 673286 - RNA, 64 nt, hsa; identical to SEQ ID NO: 146545

SEQ ID NO: 673287 - RNA, 64 nt, hsa; identical to SEQ ID NO: 146546

SEQ ID NO: 673288 - RNA, 64 nt, hsa; identical to SEQ ID NO: 146547

SEQ ID NO: 673289 - RNA, 64 nt, hsa; identical to SEQ ID NO: 146548

SEQ ID NO: 673290 - RNA, 64 nt, hsa; identical to SEQ ID NO: 146549

SEQ ID NO: 673291 - RNA, 64 nt, hsa; identical to SEQ ID NO: 146550

SEQ ID NO: 673292 - RNA, 64 nt, hsa; identical to SEQ ID NO: 146551

SEQ ID NO: 673293 - RNA, 64 nt, hsa; identical to SEQ ID NO: 146552

SEQ ID NO: 673294 - RNA, 64 nt, hsa; identical to SEQ ID NO: 146553

SEQ ID NO: 673295 - RNA, 64 nt, hsa; identical to SEQ ID NO: 146554

SEQ ID NO: 673296 - RNA, 64 nt, hsa; identical to SEQ ID NO: 146555

SEQ ID NO: 673297 - RNA, 64 nt, hsa; identical to SEQ ID NO: 146556

SEQ ID NO: 673298 - RNA, 64 nt, hsa; identical to SEQ ID NO: 146557

SEQ ID NO: 673299 - RNA, 64 nt, hsa; identical to SEQ ID NO: 146558

SEQ ID NO: 673300 - RNA, 64 nt, hsa; identical to SEQ ID NO: 146559

SEQ ID NO: 673301 - RNA, 64 nt, hsa; identical to SEQ ID NO: 146560

SEQ ID NO: 673302 - RNA, 64 nt, hsa; identical to SEQ ID NO: 146561

SEQ ID NO: 673303 - RNA, 64 nt, hsa; identical to SEQ ID NO: 146562

SEQ ID NO: 673304 - RNA, 64 nt, hsa; identical to SEQ ID NO: 146563

SEQ ID NO: 673305 - RNA, 64 nt, hsa; identical to SEQ ID NO: 146564

SEQ ID NO: 673306 - RNA, 64 nt, hsa; identical to SEQ ID NO: 146565

SEQ ID NO: 673307 - RNA, 64 nt, hsa; identical to SEQ ID NO: 146566

SEQ ID NO: 673308 - RNA, 64 nt, hsa; identical to SEQ ID NO: 146567

SEQ ID NO: 673309 - RNA, 64 nt, hsa; identical to SEQ ID NO: 146568

SEQ ID NO: 673310 - RNA, 64 nt, hsa; identical to SEQ ID NO: 146569

SEQ ID NO: 673311 - RNA, 64 nt, hsa; identical to SEQ ID NO: 146570

SEQ ID NO: 673312 - RNA, 64 nt, hsa; identical to SEQ ID NO: 146571

SEQ ID NO: 673313 - RNA, 64 nt, hsa; identical to SEQ ID NO: 146572

SEQ ID NO: 673314 - RNA, 64 nt, hsa; identical to SEQ ID NO: 146573

SEQ ID NO: 673315 - RNA, 64 nt, hsa; identical to SEQ ID NO: 146574

SEQ ID NO: 673316 - RNA, 64 nt, hsa; identical to SEQ ID NO: 146575

SEQ ID NO: 673317 - RNA, 64 nt, hsa; identical to SEQ ID NO: 146576

SEQ ID NO: 673318 - RNA, 64 nt, hsa; identical to SEQ ID NO: 146577

SEQ ID NO: 673319 - RNA, 64 nt, hsa; identical to SEQ ID NO: 146578

SEQ ID NO: 673320 - RNA, 64 nt, hsa; identical to SEQ ID NO: 146579

SEQ ID NO: 673321 - RNA, 64 nt, hsa; identical to SEQ ID NO: 146580

SEQ ID NO: 673322 - RNA, 64 nt, hsa; identical to SEQ ID NO: 146581

SEQ ID NO: 673323 - RNA, 64 nt, hsa; identical to SEQ ID NO: 146582

SEQ ID NO: 673324 - RNA, 64 nt, hsa; identical to SEQ ID NO: 146583

SEQ ID NO: 673325 - RNA, 64 nt, hsa; identical to SEQ ID NO: 146584

SEQ ID NO: 673326 - RNA, 64 nt, hsa; identical to SEQ ID NO: 146585

SEQ ID NO: 673327 - RNA, 64 nt, hsa; identical to SEQ ID NO: 146586

SEQ ID NO: 673328 - RNA, 64 nt, hsa; identical to SEQ ID NO: 146587

SEQ ID NO: 673329 - RNA, 64 nt, hsa; identical to SEQ ID NO: 146588

SEQ ID NO: 673330 - RNA, 64 nt, hsa; identical to SEQ ID NO: 146589

SEQ ID NO: 673331 - RNA, 64 nt, hsa; identical to SEQ ID NO: 146590

SEQ ID NO: 673332 - RNA, 64 nt, hsa; identical to SEQ ID NO: 146591

SEQ ID NO: 673333 - RNA, 64 nt, hsa; identical to SEQ ID NO: 146592

SEQ ID NO: 673334 - RNA, 64 nt, hsa; identical to SEQ ID NO: 146593

SEQ ID NO: 673335 - RNA, 64 nt, hsa; identical to SEQ ID NO: 146594

SEQ ID NO: 673336 - RNA, 64 nt, hsa; identical to SEQ ID NO: 146595

SEQ ID NO: 673337 - RNA, 64 nt, hsa; identical to SEQ ID NO: 146596

SEQ ID NO: 673338 - RNA, 64 nt, hsa; identical to SEQ ID NO: 146597

SEQ ID NO: 673339 - RNA, 64 nt, hsa; identical to SEQ ID NO: 146598

SEQ ID NO: 673340 - RNA, 64 nt, hsa; identical to SEQ ID NO: 146599

SEQ ID NO: 673341 - RNA, 64 nt, hsa; identical to SEQ ID NO: 146595

SEQ ID NO: 673342 - RNA, 64 nt, hsa; identical to SEQ ID NO: 146601

SEQ ID NO: 673343 - RNA, 64 nt, hsa; identical to SEQ ID NO: 146602

SEQ ID NO: 673344 - RNA, 64 nt, hsa; identical to SEQ ID NO: 146603

SEQ ID NO: 673345 - RNA, 64 nt, hsa; identical to SEQ ID NO: 146604

SEQ ID NO: 673346 - RNA, 64 nt, hsa; identical to SEQ ID NO: 146605

SEQ ID NO: 673347 - RNA, 64 nt, hsa; identical to SEQ ID NO: 146606

SEQ ID NO: 673348 - RNA, 64 nt, hsa; identical to SEQ ID NO: 146607

SEQ ID NO: 673349 - RNA, 64 nt, hsa; identical to SEQ ID NO: 146608

SEQ ID NO: 673350 - RNA, 64 nt, hsa; identical to SEQ ID NO: 146609

SEQ ID NO: 673351 - RNA, 64 nt, hsa; identical to SEQ ID NO: 146610

SEQ ID NO: 673352 - RNA, 64 nt, hsa; identical to SEQ ID NO: 146611

SEQ ID NO: 673353 - RNA, 64 nt, hsa; identical to SEQ ID NO: 146612

SEQ ID NO: 673354 - RNA, 64 nt, hsa; identical to SEQ ID NO: 146613

SEQ ID NO: 673355 - RNA, 64 nt, hsa; identical to SEQ ID NO: 146614

SEQ ID NO: 673356 - RNA, 64 nt, hsa; identical to SEQ ID NO: 146615

SEQ ID NO: 673357 - RNA, 64 nt, hsa; identical to SEQ ID NO: 146616

SEQ ID NO: 673358 - RNA, 64 nt, hsa; identical to SEQ ID NO: 146617

SEQ ID NO: 673359 - RNA, 64 nt, hsa; identical to SEQ ID NO: 146618

SEQ ID NO: 673360 - RNA, 64 nt, hsa; identical to SEQ ID NO: 146619

SEQ ID NO: 673361 - RNA, 64 nt, hsa; identical to SEQ ID NO: 146620

SEQ ID NO: 673362 - RNA, 64 nt, hsa; identical to SEQ ID NO: 146621

SEQ ID NO: 673363 - RNA, 64 nt, hsa; identical to SEQ ID NO: 146622

SEQ ID NO: 673364 - RNA, 64 nt, hsa; identical to SEQ ID NO: 146623

SEQ ID NO: 673365 - RNA, 64 nt, hsa; identical to SEQ ID NO: 146624

SEQ ID NO: 673366 - RNA, 64 nt, hsa; identical to SEQ ID NO: 146625

SEQ ID NO: 673367 - RNA, 64 nt, hsa; identical to SEQ ID NO: 146626

SEQ ID NO: 673368 - RNA, 64 nt, hsa; identical to SEQ ID NO: 146627

SEQ ID NO: 673369 - RNA, 64 nt, hsa; identical to SEQ ID NO: 146628

SEQ ID NO: 673370 - RNA, 64 nt, hsa; identical to SEQ ID NO: 146629

SEQ ID NO: 673371 - RNA, 64 nt, hsa; identical to SEQ ID NO: 146630

SEQ ID NO: 673372 - RNA, 64 nt, hsa; identical to SEQ ID NO: 146631

SEQ ID NO: 673373 - RNA, 64 nt, hsa; identical to SEQ ID NO: 146632

SEQ ID NO: 673374 - RNA, 64 nt, hsa; identical to SEQ ID NO: 146633

SEQ ID NO: 673375 - RNA, 64 nt, hsa; identical to SEQ ID NO: 146634

SEQ ID NO: 673376 - RNA, 64 nt, hsa; identical to SEQ ID NO: 146635

SEQ ID NO: 673377 - RNA, 64 nt, hsa; identical to SEQ ID NO: 146636

SEQ ID NO: 673378 - RNA, 64 nt, hsa; identical to SEQ ID NO: 146637

SEQ ID NO: 673379 - RNA, 64 nt, hsa; identical to SEQ ID NO: 146638

SEQ ID NO: 673380 - RNA, 64 nt, hsa; identical to SEQ ID NO: 146639

SEQ ID NO: 673381 - RNA, 64 nt, hsa; identical to SEQ ID NO: 146640

SEQ ID NO: 673382 - RNA, 64 nt, hsa; identical to SEQ ID NO: 146641

SEQ ID NO: 673383 - RNA, 64 nt, hsa; identical to SEQ ID NO: 146642

SEQ ID NO: 673384 - RNA, 64 nt, hsa; identical to SEQ ID NO: 146643

SEQ ID NO: 673385 - RNA, 64 nt, hsa; identical to SEQ ID NO: 146644

SEQ ID NO: 673386 - RNA, 64 nt, hsa; identical to SEQ ID NO: 146645

SEQ ID NO: 673387 - RNA, 64 nt, hsa; identical to SEQ ID NO: 146646

SEQ ID NO: 673388 - RNA, 64 nt, hsa; identical to SEQ ID NO: 146647

SEQ ID NO: 673389 - RNA, 64 nt, hsa; identical to SEQ ID NO: 146648

SEQ ID NO: 673390 - RNA, 64 nt, hsa; identical to SEQ ID NO: 146649

SEQ ID NO: 673391 - RNA, 64 nt, hsa; identical to SEQ ID NO: 146650

SEQ ID NO: 673392 - RNA, 64 nt, hsa; identical to SEQ ID NO: 146651

SEQ ID NO: 673393 - RNA, 64 nt, hsa; identical to SEQ ID NO: 146652

SEQ ID NO: 673394 - RNA, 64 nt, hsa; identical to SEQ ID NO: 146653

SEQ ID NO: 673395 - RNA, 64 nt, hsa; identical to SEQ ID NO: 146654

SEQ ID NO: 673396 - RNA, 64 nt, hsa; identical to SEQ ID NO: 146655

SEQ ID NO: 673397 - RNA, 64 nt, hsa; identical to SEQ ID NO: 146656

SEQ ID NO: 673398 - RNA, 64 nt, hsa; identical to SEQ ID NO: 146657

SEQ ID NO: 673399 - RNA, 64 nt, hsa; identical to SEQ ID NO: 146658

SEQ ID NO: 673400 - RNA, 64 nt, hsa; identical to SEQ ID NO: 146659

SEQ ID NO: 673401 - RNA, 64 nt, hsa; identical to SEQ ID NO: 146660

SEQ ID NO: 673402 - RNA, 64 nt, hsa; identical to SEQ ID NO: 146661

SEQ ID NO: 673403 - RNA, 64 nt, hsa; identical to SEQ ID NO: 146662

SEQ ID NO: 673404 - RNA, 64 nt, hsa; identical to SEQ ID NO: 146663

SEQ ID NO: 673405 - RNA, 64 nt, hsa; identical to SEQ ID NO: 146664

SEQ ID NO: 673406 - RNA, 64 nt, hsa; identical to SEQ ID NO: 146665

SEQ ID NO: 673407 - RNA, 64 nt, hsa; identical to SEQ ID NO: 146666

SEQ ID NO: 673408 - RNA, 64 nt, hsa; identical to SEQ ID NO: 146667

SEQ ID NO: 673409 - RNA, 64 nt, hsa; identical to SEQ ID NO: 146668

SEQ ID NO: 673410 - RNA, 64 nt, hsa; identical to SEQ ID NO: 146669

SEQ ID NO: 673411 - RNA, 64 nt, hsa; identical to SEQ ID NO: 146670

SEQ ID NO: 673412 - RNA, 64 nt, hsa; identical to SEQ ID NO: 146671

SEQ ID NO: 673413 - RNA, 64 nt, hsa; identical to SEQ ID NO: 146672

SEQ ID NO: 673414 - RNA, 64 nt, hsa; identical to SEQ ID NO: 146673

SEQ ID NO: 673415 - RNA, 64 nt, hsa; identical to SEQ ID NO: 146674

SEQ ID NO: 673416 - RNA, 64 nt, hsa; identical to SEQ ID NO: 146675

SEQ ID NO: 673417 - RNA, 64 nt, hsa; identical to SEQ ID NO: 146676

SEQ ID NO: 673418 - RNA, 64 nt, hsa; identical to SEQ ID NO: 146677

SEQ ID NO: 673419 - RNA, 64 nt, hsa; identical to SEQ ID NO: 146678

SEQ ID NO: 673420 - RNA, 64 nt, hsa; identical to SEQ ID NO: 146679

SEQ ID NO: 673421 - RNA, 64 nt, hsa; identical to SEQ ID NO: 146680

SEQ ID NO: 673422 - RNA, 64 nt, hsa; identical to SEQ ID NO: 146681

SEQ ID NO: 673423 - RNA, 64 nt, hsa; identical to SEQ ID NO: 146682

SEQ ID NO: 673424 - RNA, 64 nt, hsa; identical to SEQ ID NO: 146683

SEQ ID NO: 673425 - RNA, 64 nt, hsa; identical to SEQ ID NO: 146684

SEQ ID NO: 673426 - RNA, 64 nt, hsa; identical to SEQ ID NO: 146685

SEQ ID NO: 673427 - RNA, 64 nt, hsa; identical to SEQ ID NO: 146686

SEQ ID NO: 673428 - RNA, 64 nt, hsa; identical to SEQ ID NO: 146687

SEQ ID NO: 673429 - RNA, 64 nt, hsa; identical to SEQ ID NO: 294192

SEQ ID NO: 673430 - RNA, 64 nt, hsa; identical to SEQ ID NO: 294193

SEQ ID NO: 673431 - RNA, 64 nt, hsa; identical to SEQ ID NO: 294194

SEQ ID NO: 673432 - RNA, 64 nt, hsa; identical to SEQ ID NO: 294195

SEQ ID NO: 673433 - RNA, 64 nt, hsa; identical to SEQ ID NO: 146515

SEQ ID NO: 673434 - RNA, 64 nt, hsa; identical to SEQ ID NO: 146516

SEQ ID NO: 673435 - RNA, 64 nt, hsa; identical to SEQ ID NO: 146517

SEQ ID NO: 673436 - RNA, 64 nt, hsa; identical to SEQ ID NO: 146518

SEQ ID NO: 673437 - RNA, 64 nt, hsa; identical to SEQ ID NO: 146519

SEQ ID NO: 673438 - RNA, 64 nt, hsa; identical to SEQ ID NO: 146520

SEQ ID NO: 673439 - RNA, 64 nt, hsa; identical to SEQ ID NO: 146521

SEQ ID NO: 673440 - RNA, 64 nt, hsa; identical to SEQ ID NO: 146522

SEQ ID NO: 673441 - RNA, 64 nt, hsa; identical to SEQ ID NO: 146523

SEQ ID NO: 673442 - RNA, 64 nt, hsa; identical to SEQ ID NO: 146524

SEQ ID NO: 673443 - RNA, 64 nt, hsa; identical to SEQ ID NO: 146525

SEQ ID NO: 673444 - RNA, 64 nt, hsa; identical to SEQ ID NO: 146526

SEQ ID NO: 673445 - RNA, 64 nt, hsa; identical to SEQ ID NO: 146527

SEQ ID NO: 673446 - RNA, 64 nt, hsa; identical to SEQ ID NO: 146528

SEQ ID NO: 673447 - RNA, 64 nt, hsa; identical to SEQ ID NO: 146529

SEQ ID NO: 673448 - RNA, 64 nt, hsa; identical to SEQ ID NO: 146530

SEQ ID NO: 673449 - RNA, 64 nt, hsa; identical to SEQ ID NO: 146531

SEQ ID NO: 673450 - RNA, 64 nt, hsa; identical to SEQ ID NO: 146532

SEQ ID NO: 673451 - RNA, 64 nt, hsa; identical to SEQ ID NO: 146533

SEQ ID NO: 673452 - RNA, 64 nt, hsa; identical to SEQ ID NO: 146534

SEQ ID NO: 673453 - RNA, 64 nt, hsa; identical to SEQ ID NO: 146535

SEQ ID NO: 673454 - RNA, 64 nt, hsa; identical to SEQ ID NO: 146536

SEQ ID NO: 673455 - RNA, 64 nt, hsa; identical to SEQ ID NO: 146537

SEQ ID NO: 673456 - RNA, 64 nt, hsa; identical to SEQ ID NO: 146538

SEQ ID NO: 673457 - RNA, 64 nt, hsa; identical to SEQ ID NO: 146539

SEQ ID NO: 673458 - RNA, 64 nt, hsa; identical to SEQ ID NO: 146540

SEQ ID NO: 673459 - RNA, 64 nt, hsa; identical to SEQ ID NO: 146541

SEQ ID NO: 673460 - RNA, 64 nt, hsa; identical to SEQ ID NO: 146542

SEQ ID NO: 673461 - RNA, 64 nt, hsa; identical to SEQ ID NO: 146543

SEQ ID NO: 673462 - RNA, 64 nt, hsa; identical to SEQ ID NO: 146544

SEQ ID NO: 673463 - RNA, 64 nt, hsa; identical to SEQ ID NO: 146545

SEQ ID NO: 673464 - RNA, 64 nt, hsa; identical to SEQ ID NO: 146546

SEQ ID NO: 673465 - RNA, 64 nt, hsa; identical to SEQ ID NO: 146547

SEQ ID NO: 673466 - RNA, 64 nt, hsa; identical to SEQ ID NO: 146548

SEQ ID NO: 673467 - RNA, 64 nt, hsa; identical to SEQ ID NO: 146549

SEQ ID NO: 673468 - RNA, 64 nt, hsa; identical to SEQ ID NO: 146550

SEQ ID NO: 673469 - RNA, 64 nt, hsa; identical to SEQ ID NO: 146551

SEQ ID NO: 673470 - RNA, 64 nt, hsa; identical to SEQ ID NO: 146552

SEQ ID NO: 673471 - RNA, 64 nt, hsa; identical to SEQ ID NO: 146553

SEQ ID NO: 673472 - RNA, 64 nt, hsa; identical to SEQ ID NO: 146554

SEQ ID NO: 673473 - RNA, 64 nt, hsa; identical to SEQ ID NO: 146555

SEQ ID NO: 673474 - RNA, 64 nt, hsa; identical to SEQ ID NO: 146556

SEQ ID NO: 673475 - RNA, 64 nt, hsa; identical to SEQ ID NO: 146557

SEQ ID NO: 673476 - RNA, 64 nt, hsa; identical to SEQ ID NO: 146558

SEQ ID NO: 673477 - RNA, 64 nt, hsa; identical to SEQ ID NO: 146559

SEQ ID NO: 673478 - RNA, 64 nt, hsa; identical to SEQ ID NO: 146560

SEQ ID NO: 673479 - RNA, 64 nt, hsa; identical to SEQ ID NO: 146561

SEQ ID NO: 673480 - RNA, 64 nt, hsa; identical to SEQ ID NO: 146562

SEQ ID NO: 673481 - RNA, 64 nt, hsa; identical to SEQ ID NO: 146563

SEQ ID NO: 673482 - RNA, 64 nt, hsa; identical to SEQ ID NO: 146564

SEQ ID NO: 673483 - RNA, 64 nt, hsa; identical to SEQ ID NO: 146565

SEQ ID NO: 673484 - RNA, 64 nt, hsa; identical to SEQ ID NO: 146566

SEQ ID NO: 673485 - RNA, 64 nt, hsa; identical to SEQ ID NO: 146567

SEQ ID NO: 673486 - RNA, 64 nt, hsa; identical to SEQ ID NO: 146568

SEQ ID NO: 673487 - RNA, 64 nt, hsa; identical to SEQ ID NO: 146569

SEQ ID NO: 673488 - RNA, 64 nt, hsa; identical to SEQ ID NO: 146570

SEQ ID NO: 673489 - RNA, 64 nt, hsa; identical to SEQ ID NO: 146571

SEQ ID NO: 673490 - RNA, 64 nt, hsa; identical to SEQ ID NO: 146572

SEQ ID NO: 673491 - RNA, 64 nt, hsa; identical to SEQ ID NO: 146573

SEQ ID NO: 673492 - RNA, 64 nt, hsa; identical to SEQ ID NO: 146574

SEQ ID NO: 673493 - RNA, 64 nt, hsa; identical to SEQ ID NO: 146575

SEQ ID NO: 673494 - RNA, 64 nt, hsa; identical to SEQ ID NO: 146576

SEQ ID NO: 673495 - RNA, 64 nt, hsa; identical to SEQ ID NO: 146577

SEQ ID NO: 673496 - RNA, 64 nt, hsa; identical to SEQ ID NO: 146578

SEQ ID NO: 673497 - RNA, 64 nt, hsa; identical to SEQ ID NO: 146579

SEQ ID NO: 673498 - RNA, 64 nt, hsa; identical to SEQ ID NO: 146580

SEQ ID NO: 673499 - RNA, 64 nt, hsa; identical to SEQ ID NO: 146581

SEQ ID NO: 673500 - RNA, 64 nt, hsa; identical to SEQ ID NO: 146582

SEQ ID NO: 673501 - RNA, 64 nt, hsa; identical to SEQ ID NO: 146583

SEQ ID NO: 673502 - RNA, 64 nt, hsa; identical to SEQ ID NO: 146584

SEQ ID NO: 673503 - RNA, 64 nt, hsa; identical to SEQ ID NO: 146585

SEQ ID NO: 673504 - RNA, 64 nt, hsa; identical to SEQ ID NO: 146586

SEQ ID NO: 673505 - RNA, 64 nt, hsa; identical to SEQ ID NO: 146587

SEQ ID NO: 673506 - RNA, 64 nt, hsa; identical to SEQ ID NO: 146588

SEQ ID NO: 673507 - RNA, 64 nt, hsa; identical to SEQ ID NO: 146589

SEQ ID NO: 673508 - RNA, 64 nt, hsa; identical to SEQ ID NO: 146590

SEQ ID NO: 673509 - RNA, 64 nt, hsa; identical to SEQ ID NO: 146591

SEQ ID NO: 673510 - RNA, 64 nt, hsa; identical to SEQ ID NO: 146592

SEQ ID NO: 673511 - RNA, 64 nt, hsa; identical to SEQ ID NO: 146593

SEQ ID NO: 673512 - RNA, 64 nt, hsa; identical to SEQ ID NO: 146594

SEQ ID NO: 673513 - RNA, 64 nt, hsa; identical to SEQ ID NO: 146595

SEQ ID NO: 673514 - RNA, 64 nt, hsa; identical to SEQ ID NO: 146596

SEQ ID NO: 673515 - RNA, 64 nt, hsa; identical to SEQ ID NO: 146597

SEQ ID NO: 673516 - RNA, 64 nt, hsa; identical to SEQ ID NO: 146598

SEQ ID NO: 673517 - RNA, 64 nt, hsa; identical to SEQ ID NO: 146599

SEQ ID NO: 673518 - RNA, 64 nt, hsa; identical to SEQ ID NO: 146595

SEQ ID NO: 673519 - RNA, 64 nt, hsa; identical to SEQ ID NO: 146601

SEQ ID NO: 673520 - RNA, 64 nt, hsa; identical to SEQ ID NO: 146602

SEQ ID NO: 673521 - RNA, 64 nt, hsa; identical to SEQ ID NO: 146603

SEQ ID NO: 673522 - RNA, 64 nt, hsa; identical to SEQ ID NO: 146604

SEQ ID NO: 673523 - RNA, 64 nt, hsa; identical to SEQ ID NO: 146605

SEQ ID NO: 673524 - RNA, 64 nt, hsa; identical to SEQ ID NO: 146606

SEQ ID NO: 673525 - RNA, 64 nt, hsa; identical to SEQ ID NO: 146607

SEQ ID NO: 673526 - RNA, 64 nt, hsa; identical to SEQ ID NO: 146608

SEQ ID NO: 673527 - RNA, 64 nt, hsa; identical to SEQ ID NO: 146609

SEQ ID NO: 673528 - RNA, 64 nt, hsa; identical to SEQ ID NO: 146610

SEQ ID NO: 673529 - RNA, 64 nt, hsa; identical to SEQ ID NO: 146611

SEQ ID NO: 673530 - RNA, 64 nt, hsa; identical to SEQ ID NO: 146612

SEQ ID NO: 673531 - RNA, 64 nt, hsa; identical to SEQ ID NO: 146613

SEQ ID NO: 673532 - RNA, 64 nt, hsa; identical to SEQ ID NO: 146614

SEQ ID NO: 673533 - RNA, 64 nt, hsa; identical to SEQ ID NO: 146615

SEQ ID NO: 673534 - RNA, 64 nt, hsa; identical to SEQ ID NO: 146616

SEQ ID NO: 673535 - RNA, 64 nt, hsa; identical to SEQ ID NO: 146617

SEQ ID NO: 673536 - RNA, 64 nt, hsa; identical to SEQ ID NO: 146618

SEQ ID NO: 673537 - RNA, 64 nt, hsa; identical to SEQ ID NO: 146619

SEQ ID NO: 673538 - RNA, 64 nt, hsa; identical to SEQ ID NO: 146620

SEQ ID NO: 673539 - RNA, 64 nt, hsa; identical to SEQ ID NO: 146621

SEQ ID NO: 673540 - RNA, 64 nt, hsa; identical to SEQ ID NO: 146622

SEQ ID NO: 673541 - RNA, 64 nt, hsa; identical to SEQ ID NO: 146623

SEQ ID NO: 673542 - RNA, 64 nt, hsa; identical to SEQ ID NO: 146624

SEQ ID NO: 673543 - RNA, 64 nt, hsa; identical to SEQ ID NO: 146625

SEQ ID NO: 673544 - RNA, 64 nt, hsa; identical to SEQ ID NO: 146626

SEQ ID NO: 673545 - RNA, 64 nt, hsa; identical to SEQ ID NO: 146627

SEQ ID NO: 673546 - RNA, 64 nt, hsa; identical to SEQ ID NO: 146628

SEQ ID NO: 673547 - RNA, 64 nt, hsa; identical to SEQ ID NO: 146629

SEQ ID NO: 673548 - RNA, 64 nt, hsa; identical to SEQ ID NO: 146630

SEQ ID NO: 673549 - RNA, 64 nt, hsa; identical to SEQ ID NO: 146631

SEQ ID NO: 673550 - RNA, 64 nt, hsa; identical to SEQ ID NO: 146632

SEQ ID NO: 673551 - RNA, 64 nt, hsa; identical to SEQ ID NO: 146633

SEQ ID NO: 673552 - RNA, 64 nt, hsa; identical to SEQ ID NO: 146634

SEQ ID NO: 673553 - RNA, 64 nt, hsa; identical to SEQ ID NO: 146635

SEQ ID NO: 673554 - RNA, 64 nt, hsa; identical to SEQ ID NO: 146636

SEQ ID NO: 673555 - RNA, 64 nt, hsa; identical to SEQ ID NO: 146637

SEQ ID NO: 673556 - RNA, 64 nt, hsa; identical to SEQ ID NO: 146638

SEQ ID NO: 673557 - RNA, 64 nt, hsa; identical to SEQ ID NO: 146639

SEQ ID NO: 673558 - RNA, 64 nt, hsa; identical to SEQ ID NO: 146640

SEQ ID NO: 673559 - RNA, 64 nt, hsa; identical to SEQ ID NO: 146641

SEQ ID NO: 673560 - RNA, 64 nt, hsa; identical to SEQ ID NO: 146642

SEQ ID NO: 673561 - RNA, 64 nt, hsa; identical to SEQ ID NO: 146643

SEQ ID NO: 673562 - RNA, 64 nt, hsa; identical to SEQ ID NO: 146644

SEQ ID NO: 673563 - RNA, 64 nt, hsa; identical to SEQ ID NO: 146645

SEQ ID NO: 673564 - RNA, 64 nt, hsa; identical to SEQ ID NO: 146646

SEQ ID NO: 673565 - RNA, 64 nt, hsa; identical to SEQ ID NO: 146647

SEQ ID NO: 673566 - RNA, 64 nt, hsa; identical to SEQ ID NO: 146648

SEQ ID NO: 673567 - RNA, 64 nt, hsa; identical to SEQ ID NO: 146649

SEQ ID NO: 673568 - RNA, 64 nt, hsa; identical to SEQ ID NO: 146650

SEQ ID NO: 673569 - RNA, 64 nt, hsa; identical to SEQ ID NO: 146651

SEQ ID NO: 673570 - RNA, 64 nt, hsa; identical to SEQ ID NO: 146652

SEQ ID NO: 673571 - RNA, 64 nt, hsa; identical to SEQ ID NO: 146653

SEQ ID NO: 673572 - RNA, 64 nt, hsa; identical to SEQ ID NO: 146654

SEQ ID NO: 673573 - RNA, 64 nt, hsa; identical to SEQ ID NO: 146655

SEQ ID NO: 673574 - RNA, 64 nt, hsa; identical to SEQ ID NO: 146656

SEQ ID NO: 673575 - RNA, 64 nt, hsa; identical to SEQ ID NO: 146657

SEQ ID NO: 673576 - RNA, 64 nt, hsa; identical to SEQ ID NO: 146658

SEQ ID NO: 673577 - RNA, 64 nt, hsa; identical to SEQ ID NO: 146659

SEQ ID NO: 673578 - RNA, 64 nt, hsa; identical to SEQ ID NO: 146660

SEQ ID NO: 673579 - RNA, 64 nt, hsa; identical to SEQ ID NO: 146661

SEQ ID NO: 673580 - RNA, 64 nt, hsa; identical to SEQ ID NO: 146662

SEQ ID NO: 673581 - RNA, 64 nt, hsa; identical to SEQ ID NO: 146663

SEQ ID NO: 673582 - RNA, 64 nt, hsa; identical to SEQ ID NO: 146664

SEQ ID NO: 673583 - RNA, 64 nt, hsa; identical to SEQ ID NO: 146665

SEQ ID NO: 673584 - RNA, 64 nt, hsa; identical to SEQ ID NO: 146666

SEQ ID NO: 673585 - RNA, 64 nt, hsa; identical to SEQ ID NO: 146667

SEQ ID NO: 673586 - RNA, 64 nt, hsa; identical to SEQ ID NO: 146668

SEQ ID NO: 673587 - RNA, 64 nt, hsa; identical to SEQ ID NO: 146669

SEQ ID NO: 673588 - RNA, 64 nt, hsa; identical to SEQ ID NO: 146670

SEQ ID NO: 673589 - RNA, 64 nt, hsa; identical to SEQ ID NO: 146671

SEQ ID NO: 673590 - RNA, 64 nt, hsa; identical to SEQ ID NO: 146672

SEQ ID NO: 673591 - RNA, 64 nt, hsa; identical to SEQ ID NO: 146673

SEQ ID NO: 673592 - RNA, 64 nt, hsa; identical to SEQ ID NO: 146674

SEQ ID NO: 673593 - RNA, 64 nt, hsa; identical to SEQ ID NO: 146675

SEQ ID NO: 673594 - RNA, 64 nt, hsa; identical to SEQ ID NO: 146676

SEQ ID NO: 673595 - RNA, 64 nt, hsa; identical to SEQ ID NO: 146677

SEQ ID NO: 673596 - RNA, 64 nt, hsa; identical to SEQ ID NO: 146678

SEQ ID NO: 673597 - RNA, 64 nt, hsa; identical to SEQ ID NO: 146679

SEQ ID NO: 673598 - RNA, 64 nt, hsa; identical to SEQ ID NO: 146680

SEQ ID NO: 673599 - RNA, 64 nt, hsa; identical to SEQ ID NO: 146681

SEQ ID NO: 673600 - RNA, 64 nt, hsa; identical to SEQ ID NO: 146682

SEQ ID NO: 673601 - RNA, 64 nt, hsa; identical to SEQ ID NO: 146683

SEQ ID NO: 673602 - RNA, 64 nt, hsa; identical to SEQ ID NO: 146684

SEQ ID NO: 673603 - RNA, 64 nt, hsa; identical to SEQ ID NO: 146685

SEQ ID NO: 673604 - RNA, 64 nt, hsa; identical to SEQ ID NO: 146686

SEQ ID NO: 673605 - RNA, 64 nt, hsa; identical to SEQ ID NO: 146687

SEQ ID NO: 673606 - RNA, 64 nt, hsa; identical to SEQ ID NO: 294192

SEQ ID NO: 673607 - RNA, 64 nt, hsa; identical to SEQ ID NO: 294193

SEQ ID NO: 673608 - RNA, 64 nt, hsa; identical to SEQ ID NO: 294194

SEQ ID NO: 673609 - RNA, 64 nt, hsa; identical to SEQ ID NO: 294195

SEQ ID NO: 673610 - RNA, 64 nt, hsa; identical to SEQ ID NO: 603736

SEQ ID NO: 673611 - RNA, 64 nt, hsa; identical to SEQ ID NO: 603737

SEQ ID NO: 673612 - RNA, 64 nt, hsa; identical to SEQ ID NO: 153216

SEQ ID NO: 673613 - RNA, 64 nt, hsa; identical to SEQ ID NO: 153217

SEQ ID NO: 673614 - RNA, 64 nt, hsa; identical to SEQ ID NO: 153218

SEQ ID NO: 673615 - RNA, 64 nt, hsa; identical to SEQ ID NO: 153219

SEQ ID NO: 673616 - RNA, 64 nt, hsa; identical to SEQ ID NO: 153220

SEQ ID NO: 673617 - RNA, 64 nt, hsa; identical to SEQ ID NO: 153221

SEQ ID NO: 673618 - RNA, 64 nt, hsa; identical to SEQ ID NO: 153222

SEQ ID NO: 673619 - RNA, 64 nt, hsa; identical to SEQ ID NO: 153223

SEQ ID NO: 673620 - RNA, 64 nt, hsa; identical to SEQ ID NO: 153224

SEQ ID NO: 673621 - RNA, 64 nt, hsa; identical to SEQ ID NO: 153225

SEQ ID NO: 673622 - RNA, 64 nt, hsa; identical to SEQ ID NO: 153226

SEQ ID NO: 673623 - RNA, 64 nt, hsa; identical to SEQ ID NO: 153227

SEQ ID NO: 673624 - RNA, 64 nt, hsa; identical to SEQ ID NO: 153228

SEQ ID NO: 673625 - RNA, 64 nt, hsa; identical to SEQ ID NO: 153229

SEQ ID NO: 673626 - RNA, 64 nt, hsa; identical to SEQ ID NO: 153230

SEQ ID NO: 673627 - RNA, 64 nt, hsa; identical to SEQ ID NO: 153231

SEQ ID NO: 673628 - RNA, 64 nt, hsa; identical to SEQ ID NO: 153232

SEQ ID NO: 673629 - RNA, 64 nt, hsa; identical to SEQ ID NO: 153233

SEQ ID NO: 673630 - RNA, 64 nt, hsa; identical to SEQ ID NO: 153234

SEQ ID NO: 673631 - RNA, 64 nt, hsa; identical to SEQ ID NO: 153235

SEQ ID NO: 673632 - RNA, 64 nt, hsa; identical to SEQ ID NO: 153236

SEQ ID NO: 673633 - RNA, 64 nt, hsa; identical to SEQ ID NO: 282432

SEQ ID NO: 673634 - RNA, 64 nt, hsa; identical to SEQ ID NO: 282433

SEQ ID NO: 673635 - RNA, 64 nt, hsa; identical to SEQ ID NO: 199794

SEQ ID NO: 673636 - RNA, 64 nt, hsa; identical to SEQ ID NO: 199795

SEQ ID NO: 673637 - RNA, 64 nt, hsa; identical to SEQ ID NO: 199796

SEQ ID NO: 673638 - RNA, 64 nt, hsa; identical to SEQ ID NO: 199797

SEQ ID NO: 673639 - RNA, 64 nt, hsa; identical to SEQ ID NO: 199798

SEQ ID NO: 673640 - RNA, 64 nt, hsa; identical to SEQ ID NO: 199799

SEQ ID NO: 673641 - RNA, 64 nt, hsa; identical to SEQ ID NO: 199800

SEQ ID NO: 673642 - RNA, 64 nt, hsa; identical to SEQ ID NO: 199801

SEQ ID NO: 673643 - RNA, 64 nt, hsa; identical to SEQ ID NO: 199802

SEQ ID NO: 673644 - RNA, 64 nt, hsa; identical to SEQ ID NO: 199803

SEQ ID NO: 673645 - RNA, 64 nt, hsa; identical to SEQ ID NO: 199804

SEQ ID NO: 673646 - RNA, 55 nt, hsa; identical to SEQ ID NO: 199805

SEQ ID NO: 673647 - RNA, 64 nt, hsa; identical to SEQ ID NO: 199806

SEQ ID NO: 673648 - RNA, 64 nt, hsa; identical to SEQ ID NO: 199807

SEQ ID NO: 673649 - RNA, 64 nt, hsa; identical to SEQ ID NO: 199808

SEQ ID NO: 673650 - RNA, 64 nt, hsa; identical to SEQ ID NO: 199809

SEQ ID NO: 673651 - RNA, 64 nt, hsa; identical to SEQ ID NO: 199810

SEQ ID NO: 673652 - RNA, 51 nt, hsa; identical to SEQ ID NO: 199811

SEQ ID NO: 673653 - RNA, 64 nt, hsa; identical to SEQ ID NO: 199812

SEQ ID NO: 673654 - RNA, 64 nt, hsa; identical to SEQ ID NO: 199813

SEQ ID NO: 673655 - RNA, 64 nt, hsa; identical to SEQ ID NO: 199814

SEQ ID NO: 673656 - RNA, 64 nt, hsa; identical to SEQ ID NO: 199815

SEQ ID NO: 673657 - RNA, 64 nt, hsa; identical to SEQ ID NO: 199816

SEQ ID NO: 673658 - RNA, 64 nt, hsa; identical to SEQ ID NO: 199817

SEQ ID NO: 673659 - RNA, 64 nt, hsa; identical to SEQ ID NO: 199818

SEQ ID NO: 673660 - RNA, 64 nt, hsa; identical to SEQ ID NO: 199819

SEQ ID NO: 673661 - RNA, 64 nt, hsa; identical to SEQ ID NO: 199820

SEQ ID NO: 673662 - RNA, 64 nt, hsa; identical to SEQ ID NO: 199821

SEQ ID NO: 673663 - RNA, 64 nt, hsa; identical to SEQ ID NO: 199822

SEQ ID NO: 673664 - RNA, 64 nt, hsa; identical to SEQ ID NO: 199823

SEQ ID NO: 673665 - RNA, 64 nt, hsa; identical to SEQ ID NO: 199824

SEQ ID NO: 673666 - RNA, 64 nt, hsa; identical to SEQ ID NO: 536781

SEQ ID NO: 673667 - RNA, 64 nt, hsa; identical to SEQ ID NO: 536782

SEQ ID NO: 673668 - RNA, 64 nt, hsa; identical to SEQ ID NO: 536783

SEQ ID NO: 673669 - RNA, 64 nt, hsa; identical to SEQ ID NO: 536784

SEQ ID NO: 673670 - RNA, 64 nt, hsa; identical to SEQ ID NO: 536785

SEQ ID NO: 673671 - RNA, 64 nt, hsa; identical to SEQ ID NO: 536786

SEQ ID NO: 673672 - RNA, 64 nt, hsa; identical to SEQ ID NO: 536787

SEQ ID NO: 673673 - RNA, 64 nt, hsa; identical to SEQ ID NO: 536788

SEQ ID NO: 673674 - RNA, 64 nt, hsa; identical to SEQ ID NO: 536789

SEQ ID NO: 673675 - RNA, 64 nt, hsa; identical to SEQ ID NO: 536790

SEQ ID NO: 673676 - RNA, 64 nt, hsa; identical to SEQ ID NO: 536791

SEQ ID NO: 673677 - RNA, 64 nt, hsa; identical to SEQ ID NO: 536792

SEQ ID NO: 673678 - RNA, 64 nt, hsa; identical to SEQ ID NO: 536793

SEQ ID NO: 673679 - RNA, 64 nt, hsa; identical to SEQ ID NO: 536794

SEQ ID NO: 673680 - RNA, 64 nt, hsa; identical to SEQ ID NO: 536795

SEQ ID NO: 673681 - RNA, 64 nt, hsa; identical to SEQ ID NO: 536796

SEQ ID NO: 673682 - RNA, 64 nt, hsa; identical to SEQ ID NO: 536797

SEQ ID NO: 673683 - RNA, 64 nt, hsa; identical to SEQ ID NO: 536798

SEQ ID NO: 673684 - RNA, 64 nt, hsa; identical to SEQ ID NO: 536799

SEQ ID NO: 673685 - RNA, 64 nt, hsa; identical to SEQ ID NO: 536800

SEQ ID NO: 673686 - RNA, 64 nt, hsa; identical to SEQ ID NO: 536801

SEQ ID NO: 673687 - RNA, 64 nt, hsa; identical to SEQ ID NO: 536802

SEQ ID NO: 673688 - RNA, 64 nt, hsa; identical to SEQ ID NO: 536803

SEQ ID NO: 673689 - RNA, 64 nt, hsa; identical to SEQ ID NO: 536804

SEQ ID NO: 673690 - RNA, 64 nt, hsa; identical to SEQ ID NO: 536805

SEQ ID NO: 673691 - RNA, 64 nt, hsa; identical to SEQ ID NO: 536806

SEQ ID NO: 673692 - RNA, 64 nt, hsa; identical to SEQ ID NO: 536807

SEQ ID NO: 673693 - RNA, 64 nt, hsa; identical to SEQ ID NO: 536808

SEQ ID NO: 673694 - RNA, 64 nt, hsa; identical to SEQ ID NO: 536809

SEQ ID NO: 673695 - RNA, 64 nt, hsa; identical to SEQ ID NO: 536810

SEQ ID NO: 673696 - RNA, 64 nt, hsa; identical to SEQ ID NO: 536811

SEQ ID NO: 673697 - RNA, 64 nt, hsa; identical to SEQ ID NO: 536812

SEQ ID NO: 673698 - RNA, 64 nt, hsa; identical to SEQ ID NO: 536813

SEQ ID NO: 673699 - RNA, 64 nt, hsa; identical to SEQ ID NO: 536814

SEQ ID NO: 673700 - RNA, 64 nt, hsa; identical to SEQ ID NO: 536815

SEQ ID NO: 673701 - RNA, 64 nt, hsa; identical to SEQ ID NO: 536816

SEQ ID NO: 673702 - RNA, 64 nt, hsa; identical to SEQ ID NO: 536817

SEQ ID NO: 673703 - RNA, 64 nt, hsa; identical to SEQ ID NO: 536818

SEQ ID NO: 673704 - RNA, 64 nt, hsa; identical to SEQ ID NO: 536819

SEQ ID NO: 673705 - RNA, 64 nt, hsa; identical to SEQ ID NO: 536820

SEQ ID NO: 673706 - RNA, 64 nt, hsa; identical to SEQ ID NO: 536821

SEQ ID NO: 673707 - RNA, 64 nt, hsa; identical to SEQ ID NO: 536822

SEQ ID NO: 673708 - RNA, 64 nt, hsa; identical to SEQ ID NO: 536823

SEQ ID NO: 673709 - RNA, 64 nt, hsa; identical to SEQ ID NO: 536824

SEQ ID NO: 673710 - RNA, 64 nt, hsa; identical to SEQ ID NO: 536825

SEQ ID NO: 673711 - RNA, 64 nt, hsa
uuucauggaauuaauuuacacguaaugagggaaguccuaggauggauagaaaaaaagcacuuac

SEQ ID NO: 673712 - RNA, 64 nt, hsa
aucaggaaggggcugccucaggaaaauuccuagauccuaggaauucagugagacccugggaagg

SEQ ID NO: 673713 - RNA, 64 nt, hsa
uacaaaaacagaaaugcagaauuucuggggcugcuccuaggaccagaacaagugaaggguccug

SEQ ID NO: 673714 - RNA, 64 nt, hsa
uuuccccaagcauaacugcaaggagaggaggaauuccuaggagccaaagaguuuugugggguga

SEQ ID NO: 673715 - RNA, 64 nt, hsa
uguuucucucuucuucccaaaaugaccuuagcuguccuaggauaguuaguaaaagacuuuuuag

SEQ ID NO: 673716 - RNA, 64 nt, hsa
uauucgaagauguguugacagucgugaguguguauccuaggaaaggcgagcuggacucugucuc

SEQ ID NO: 673717 - RNA, 64 nt, hsa; identical to SEQ ID NO: 117329

SEQ ID NO: 673718 - RNA, 64 nt, hsa; identical to SEQ ID NO: 117330

SEQ ID NO: 673719 - RNA, 64 nt, hsa; identical to SEQ ID NO: 117331

SEQ ID NO: 673720 - RNA, 64 nt, hsa; identical to SEQ ID NO: 117332

SEQ ID NO: 673721 - RNA, 64 nt, hsa; identical to SEQ ID NO: 117333

SEQ ID NO: 673722 - RNA, 64 nt, hsa; identical to SEQ ID NO: 117334

SEQ ID NO: 673723 - RNA, 64 nt, hsa; identical to SEQ ID NO: 117335

SEQ ID NO: 673724 - RNA, 64 nt, hsa; identical to SEQ ID NO: 117336

SEQ ID NO: 673725 - RNA, 64 nt, hsa; identical to SEQ ID NO: 117337

SEQ ID NO: 673726 - RNA, 64 nt, hsa; identical to SEQ ID NO: 117338

SEQ ID NO: 673727 - RNA, 64 nt, hsa; identical to SEQ ID NO: 117339

SEQ ID NO: 673728 - RNA, 64 nt, hsa; identical to SEQ ID NO: 117340

SEQ ID NO: 673729 - RNA, 64 nt, hsa; identical to SEQ ID NO: 117341

SEQ ID NO: 673730 - RNA, 64 nt, hsa; identical to SEQ ID NO: 117342

SEQ ID NO: 673731 - RNA, 64 nt, hsa; identical to SEQ ID NO: 117343

SEQ ID NO: 673732 - RNA, 64 nt, hsa; identical to SEQ ID NO: 117344

SEQ ID NO: 673733 - RNA, 64 nt, hsa; identical to SEQ ID NO: 117345

SEQ ID NO: 673734 - RNA, 64 nt, hsa; identical to SEQ ID NO: 117346

SEQ ID NO: 673735 - RNA, 64 nt, hsa; identical to SEQ ID NO: 117347

SEQ ID NO: 673736 - RNA, 64 nt, hsa; identical to SEQ ID NO: 117348

SEQ ID NO: 673737 - RNA, 64 nt, hsa; identical to SEQ ID NO: 117349

SEQ ID NO: 673738 - RNA, 64 nt, hsa; identical to SEQ ID NO: 117350

SEQ ID NO: 673739 - RNA, 64 nt, hsa; identical to SEQ ID NO: 117351

SEQ ID NO: 673740 - RNA, 64 nt, hsa; identical to SEQ ID NO: 117352

SEQ ID NO: 673741 - RNA, 64 nt, hsa; identical to SEQ ID NO: 117353

SEQ ID NO: 673742 - RNA, 64 nt, hsa; identical to SEQ ID NO: 117354

SEQ ID NO: 673743 - RNA, 64 nt, hsa; identical to SEQ ID NO: 117355

SEQ ID NO: 673744 - RNA, 64 nt, hsa; identical to SEQ ID NO: 117356

SEQ ID NO: 673745 - RNA, 64 nt, hsa; identical to SEQ ID NO: 117357

SEQ ID NO: 673746 - RNA, 64 nt, hsa; identical to SEQ ID NO: 117358

SEQ ID NO: 673747 - RNA, 64 nt, hsa; identical to SEQ ID NO: 117359

SEQ ID NO: 673748 - RNA, 64 nt, hsa; identical to SEQ ID NO: 117360

SEQ ID NO: 673749 - RNA, 64 nt, hsa; identical to SEQ ID NO: 117361

SEQ ID NO: 673750 - RNA, 64 nt, hsa; identical to SEQ ID NO: 117362

SEQ ID NO: 673751 - RNA, 64 nt, hsa; identical to SEQ ID NO: 394703

SEQ ID NO: 673752 - RNA, 64 nt, hsa; identical to SEQ ID NO: 394704

SEQ ID NO: 673753 - RNA, 64 nt, hsa; identical to SEQ ID NO: 170734

SEQ ID NO: 673754 - RNA, 64 nt, hsa; identical to SEQ ID NO: 170735

SEQ ID NO: 673755 - RNA, 64 nt, hsa; identical to SEQ ID NO: 170736

SEQ ID NO: 673756 - RNA, 64 nt, hsa; identical to SEQ ID NO: 170737

SEQ ID NO: 673757 - RNA, 64 nt, hsa; identical to SEQ ID NO: 170738

SEQ ID NO: 673758 - RNA, 64 nt, hsa; identical to SEQ ID NO: 170739

SEQ ID NO: 673759 - RNA, 64 nt, hsa; identical to SEQ ID NO: 170740

SEQ ID NO: 673760 - RNA, 64 nt, hsa; identical to SEQ ID NO: 170741

SEQ ID NO: 673761 - RNA, 64 nt, hsa; identical to SEQ ID NO: 170742

SEQ ID NO: 673762 - RNA, 64 nt, hsa; identical to SEQ ID NO: 170743

SEQ ID NO: 673763 - RNA, 64 nt, hsa; identical to SEQ ID NO: 170744

SEQ ID NO: 673764 - RNA, 64 nt, hsa; identical to SEQ ID NO: 170745

SEQ ID NO: 673765 - RNA, 64 nt, hsa; identical to SEQ ID NO: 170746

SEQ ID NO: 673766 - RNA, 64 nt, hsa; identical to SEQ ID NO: 170747

SEQ ID NO: 673767 - RNA, 64 nt, hsa; identical to SEQ ID NO: 170748

SEQ ID NO: 673768 - RNA, 64 nt, hsa; identical to SEQ ID NO: 170749

SEQ ID NO: 673769 - RNA, 64 nt, hsa; identical to SEQ ID NO: 170750

SEQ ID NO: 673770 - RNA, 64 nt, hsa; identical to SEQ ID NO: 170751

SEQ ID NO: 673771 - RNA, 64 nt, hsa; identical to SEQ ID NO: 170752

SEQ ID NO: 673772 - RNA, 64 nt, hsa; identical to SEQ ID NO: 170753

SEQ ID NO: 673773 - RNA, 64 nt, hsa; identical to SEQ ID NO: 170754

SEQ ID NO: 673774 - RNA, 64 nt, hsa; identical to SEQ ID NO: 170755

SEQ ID NO: 673775 - RNA, 64 nt, hsa; identical to SEQ ID NO: 170756

SEQ ID NO: 673776 - RNA, 64 nt, hsa; identical to SEQ ID NO: 170757

SEQ ID NO: 673777 - RNA, 64 nt, hsa; identical to SEQ ID NO: 170758

SEQ ID NO: 673778 - RNA, 64 nt, hsa
uuggccaggagacccugaaacaugaaaccaaacaggcuuugauauuuuuuuuuuuuuaauuacu

SEQ ID NO: 673779 - RNA, 64 nt, hsa
aaauacauagaaguacacagcuauuauaugcuguggcuuugagaaguuaacuuuuguggaauau

SEQ ID NO: 673780 - RNA, 64 nt, hsa
uaaaaaaaaaaaaaaaaucccaauaguccaugaaggcuuugaucucuugggaaguucuucauag

SEQ ID NO: 673781 - RNA, 64 nt, hsa
aagccuuuucaggcacaugguuucaacaaagccuggcuuugacauuccuuguccugaggagcac

SEQ ID NO: 673782 - RNA, 64 nt, hsa
uauccuaaucuuccuagcccuucaggcuagaguaggcuuugauccugagaaccuugcuguugcu

SEQ ID NO: 673783 - RNA, 64 nt, hsa
uguuaaggaagggaaagauugucauagaugguagggcuuugaaaaugcaggguaucagcugcca

SEQ ID NO: 673784 - RNA, 64 nt, hsa
acaacuucauuucuuucuggggucaccugugaugggcuuugauguggugucaauuuggggccuu

SEQ ID NO: 673785 - RNA, 64 nt, hsa
guguguucacuuguguuggauagagcaguggcauggcuuugaccuaguaugaacuggugucugc

SEQ ID NO: 673786 - RNA, 64 nt, hsa
guuugcaaugggcuuaccauccaaauaucccaaaggcuuugaccagcaaccaaguaaaaucagu

SEQ ID NO: 673787 - RNA, 64 nt, hsa
uuuuuaaggucucuaucacuuuaaucuggaucaaggcuuugaagcaaugccucucugcauuuuu

SEQ ID NO: 673788 - RNA, 64 nt, hsa; identical to SEQ ID NO: 72602

SEQ ID NO: 673789 - RNA, 64 nt, hsa; identical to SEQ ID NO: 72603

SEQ ID NO: 673790 - RNA, 64 nt, hsa; identical to SEQ ID NO: 72604

SEQ ID NO: 673791 - RNA, 64 nt, hsa; identical to SEQ ID NO: 72605

SEQ ID NO: 673792 - RNA, 64 nt, hsa; identical to SEQ ID NO: 72606

SEQ ID NO: 673793 - RNA, 64 nt, hsa; identical to SEQ ID NO: 72607

SEQ ID NO: 673794 - RNA, 64 nt, hsa; identical to SEQ ID NO: 72608

SEQ ID NO: 673795 - RNA, 64 nt, hsa; identical to SEQ ID NO: 72609

SEQ ID NO: 673796 - RNA, 64 nt, hsa; identical to SEQ ID NO: 72610

SEQ ID NO: 673797 - RNA, 64 nt, hsa; identical to SEQ ID NO: 72611

SEQ ID NO: 673798 - RNA, 64 nt, hsa; identical to SEQ ID NO: 72612

SEQ ID NO: 673799 - RNA, 64 nt, hsa; identical to SEQ ID NO: 72613

SEQ ID NO: 673800 - RNA, 64 nt, hsa; identical to SEQ ID NO: 72614

SEQ ID NO: 673801 - RNA, 64 nt, hsa; identical to SEQ ID NO: 72615

SEQ ID NO: 673802 - RNA, 64 nt, hsa; identical to SEQ ID NO: 72616

SEQ ID NO: 673803 - RNA, 64 nt, hsa; identical to SEQ ID NO: 72617

SEQ ID NO: 673804 - RNA, 64 nt, hsa; identical to SEQ ID NO: 72618

SEQ ID NO: 673805 - RNA, 64 nt, hsa; identical to SEQ ID NO: 72619

SEQ ID NO: 673806 - RNA, 64 nt, hsa; identical to SEQ ID NO: 72620

SEQ ID NO: 673807 - RNA, 64 nt, hsa; identical to SEQ ID NO: 72621

SEQ ID NO: 673808 - RNA, 64 nt, hsa; identical to SEQ ID NO: 72622

SEQ ID NO: 673809 - RNA, 64 nt, hsa; identical to SEQ ID NO: 72623

SEQ ID NO: 673810 - RNA, 64 nt, hsa; identical to SEQ ID NO: 72624

SEQ ID NO: 673811 - RNA, 64 nt, hsa; identical to SEQ ID NO: 72625

SEQ ID NO: 673812 - RNA, 64 nt, hsa; identical to SEQ ID NO: 72626

SEQ ID NO: 673813 - RNA, 64 nt, hsa; identical to SEQ ID NO: 72627

SEQ ID NO: 673814 - RNA, 64 nt, hsa; identical to SEQ ID NO: 72628

SEQ ID NO: 673815 - RNA, 64 nt, hsa; identical to SEQ ID NO: 72629

SEQ ID NO: 673816 - RNA, 64 nt, hsa; identical to SEQ ID NO: 72630

SEQ ID NO: 673817 - RNA, 64 nt, hsa; identical to SEQ ID NO: 72631

SEQ ID NO: 673818 - RNA, 64 nt, hsa; identical to SEQ ID NO: 72632

SEQ ID NO: 673819 - RNA, 64 nt, hsa; identical to SEQ ID NO: 72633

SEQ ID NO: 673820 - RNA, 64 nt, hsa; identical to SEQ ID NO: 72634

SEQ ID NO: 673821 - RNA, 64 nt, hsa; identical to SEQ ID NO: 72635

SEQ ID NO: 673822 - RNA, 64 nt, hsa; identical to SEQ ID NO: 72636

SEQ ID NO: 673823 - RNA, 64 nt, hsa; identical to SEQ ID NO: 72637

SEQ ID NO: 673824 - RNA, 64 nt, hsa; identical to SEQ ID NO: 72638

SEQ ID NO: 673825 - RNA, 64 nt, hsa; identical to SEQ ID NO: 72639

SEQ ID NO: 673826 - RNA, 64 nt, hsa; identical to SEQ ID NO: 72640

SEQ ID NO: 673827 - RNA, 64 nt, hsa; identical to SEQ ID NO: 72641

SEQ ID NO: 673828 - RNA, 64 nt, hsa; identical to SEQ ID NO: 72642

SEQ ID NO: 673829 - RNA, 64 nt, hsa; identical to SEQ ID NO: 72643

SEQ ID NO: 673830 - RNA, 64 nt, hsa; identical to SEQ ID NO: 72644

SEQ ID NO: 673831 - RNA, 64 nt, hsa; identical to SEQ ID NO: 72645

SEQ ID NO: 673832 - RNA, 64 nt, hsa; identical to SEQ ID NO: 156063

SEQ ID NO: 673833 - RNA, 64 nt, hsa; identical to SEQ ID NO: 156064

SEQ ID NO: 673834 - RNA, 64 nt, hsa; identical to SEQ ID NO: 156065

SEQ ID NO: 673835 - RNA, 64 nt, hsa; identical to SEQ ID NO: 156066

SEQ ID NO: 673836 - RNA, 64 nt, hsa; identical to SEQ ID NO: 156067

SEQ ID NO: 673837 - RNA, 64 nt, hsa; identical to SEQ ID NO: 156068

SEQ ID NO: 673838 - RNA, 64 nt, hsa; identical to SEQ ID NO: 156069

SEQ ID NO: 673839 - RNA, 64 nt, hsa; identical to SEQ ID NO: 156070

SEQ ID NO: 673840 - RNA, 64 nt, hsa; identical to SEQ ID NO: 156071

SEQ ID NO: 673841 - RNA, 64 nt, hsa; identical to SEQ ID NO: 156072

SEQ ID NO: 673842 - RNA, 64 nt, hsa; identical to SEQ ID NO: 156073

SEQ ID NO: 673843 - RNA, 64 nt, hsa; identical to SEQ ID NO: 156074

SEQ ID NO: 673844 - RNA, 64 nt, hsa; identical to SEQ ID NO: 156075

SEQ ID NO: 673845 - RNA, 64 nt, hsa; identical to SEQ ID NO: 156076

SEQ ID NO: 673846 - RNA, 64 nt, hsa; identical to SEQ ID NO: 156077

SEQ ID NO: 673847 - RNA, 64 nt, hsa; identical to SEQ ID NO: 156078

SEQ ID NO: 673848 - RNA, 64 nt, hsa; identical to SEQ ID NO: 156079

SEQ ID NO: 673849 - RNA, 64 nt, hsa; identical to SEQ ID NO: 156080

SEQ ID NO: 673850 - RNA, 64 nt, hsa; identical to SEQ ID NO: 156081

SEQ ID NO: 673851 - RNA, 64 nt, hsa; identical to SEQ ID NO: 156082

SEQ ID NO: 673852 - RNA, 64 nt, hsa; identical to SEQ ID NO: 156083

SEQ ID NO: 673853 - RNA, 64 nt, hsa; identical to SEQ ID NO: 156084

SEQ ID NO: 673854 - RNA, 64 nt, hsa; identical to SEQ ID NO: 156085

SEQ ID NO: 673855 - RNA, 64 nt, hsa; identical to SEQ ID NO: 156086

SEQ ID NO: 673856 - RNA, 64 nt, hsa; identical to SEQ ID NO: 156087

SEQ ID NO: 673857 - RNA, 64 nt, hsa; identical to SEQ ID NO: 156088

SEQ ID NO: 673858 - RNA, 64 nt, hsa; identical to SEQ ID NO: 156089

SEQ ID NO: 673859 - RNA, 64 nt, hsa; identical to SEQ ID NO: 156090

SEQ ID NO: 673860 - RNA, 64 nt, hsa; identical to SEQ ID NO: 156091

SEQ ID NO: 673861 - RNA, 64 nt, hsa; identical to SEQ ID NO: 156092

SEQ ID NO: 673862 - RNA, 64 nt, hsa; identical to SEQ ID NO: 156093

SEQ ID NO: 673863 - RNA, 64 nt, hsa; identical to SEQ ID NO: 156094

SEQ ID NO: 673864 - RNA, 64 nt, hsa; identical to SEQ ID NO: 156095

SEQ ID NO: 673865 - RNA, 64 nt, hsa; identical to SEQ ID NO: 156096

SEQ ID NO: 673866 - RNA, 64 nt, hsa; identical to SEQ ID NO: 156097

SEQ ID NO: 673867 - RNA, 64 nt, hsa; identical to SEQ ID NO: 156098

SEQ ID NO: 673868 - RNA, 64 nt, hsa; identical to SEQ ID NO: 156099

SEQ ID NO: 673869 - RNA, 64 nt, hsa; identical to SEQ ID NO: 156100

SEQ ID NO: 673870 - RNA, 64 nt, hsa; identical to SEQ ID NO: 156101

SEQ ID NO: 673871 - RNA, 64 nt, hsa; identical to SEQ ID NO: 156102

SEQ ID NO: 673872 - RNA, 64 nt, hsa; identical to SEQ ID NO: 156103

SEQ ID NO: 673873 - RNA, 64 nt, hsa; identical to SEQ ID NO: 156104

SEQ ID NO: 673874 - RNA, 64 nt, hsa; identical to SEQ ID NO: 156105

SEQ ID NO: 673875 - RNA, 64 nt, hsa; identical to SEQ ID NO: 156106

SEQ ID NO: 673876 - RNA, 64 nt, hsa; identical to SEQ ID NO: 156107

SEQ ID NO: 673877 - RNA, 64 nt, hsa; identical to SEQ ID NO: 156108

SEQ ID NO: 673878 - RNA, 64 nt, hsa; identical to SEQ ID NO: 156109

SEQ ID NO: 673879 - RNA, 64 nt, hsa; identical to SEQ ID NO: 156110

SEQ ID NO: 673880 - RNA, 64 nt, hsa; identical to SEQ ID NO: 156111

SEQ ID NO: 673881 - RNA, 64 nt, hsa; identical to SEQ ID NO: 112922

SEQ ID NO: 673882 - RNA, 64 nt, hsa; identical to SEQ ID NO: 112923

SEQ ID NO: 673883 - RNA, 64 nt, hsa; identical to SEQ ID NO: 112924

SEQ ID NO: 673884 - RNA, 64 nt, hsa; identical to SEQ ID NO: 112925

SEQ ID NO: 673885 - RNA, 64 nt, hsa; identical to SEQ ID NO: 112926

SEQ ID NO: 673886 - RNA, 64 nt, hsa; identical to SEQ ID NO: 112927

SEQ ID NO: 673887 - RNA, 64 nt, hsa; identical to SEQ ID NO: 112928

SEQ ID NO: 673888 - RNA, 64 nt, hsa; identical to SEQ ID NO: 112929

SEQ ID NO: 673889 - RNA, 64 nt, hsa; identical to SEQ ID NO: 112930

SEQ ID NO: 673890 - RNA, 64 nt, hsa; identical to SEQ ID NO: 112931

SEQ ID NO: 673891 - RNA, 64 nt, hsa; identical to SEQ ID NO: 112932

SEQ ID NO: 673892 - RNA, 64 nt, hsa; identical to SEQ ID NO: 112933

SEQ ID NO: 673893 - RNA, 64 nt, hsa; identical to SEQ ID NO: 112934

SEQ ID NO: 673894 - RNA, 64 nt, hsa; identical to SEQ ID NO: 112935

SEQ ID NO: 673895 - RNA, 64 nt, hsa; identical to SEQ ID NO: 112936

SEQ ID NO: 673896 - RNA, 64 nt, hsa; identical to SEQ ID NO: 112937

SEQ ID NO: 673897 - RNA, 64 nt, hsa; identical to SEQ ID NO: 112938

SEQ ID NO: 673898 - RNA, 64 nt, hsa; identical to SEQ ID NO: 112939

SEQ ID NO: 673899 - RNA, 64 nt, hsa; identical to SEQ ID NO: 112940

SEQ ID NO: 673900 - RNA, 64 nt, hsa; identical to SEQ ID NO: 112941

SEQ ID NO: 673901 - RNA, 64 nt, hsa; identical to SEQ ID NO: 112942

SEQ ID NO: 673902 - RNA, 64 nt, hsa; identical to SEQ ID NO: 112943

SEQ ID NO: 673903 - RNA, 64 nt, hsa; identical to SEQ ID NO: 112944

SEQ ID NO: 673904 - RNA, 64 nt, hsa; identical to SEQ ID NO: 112945

SEQ ID NO: 673905 - RNA, 64 nt, hsa; identical to SEQ ID NO: 112946

SEQ ID NO: 673906 - RNA, 64 nt, hsa; identical to SEQ ID NO: 112947

SEQ ID NO: 673907 - RNA, 64 nt, hsa; identical to SEQ ID NO: 112948

SEQ ID NO: 673908 - RNA, 64 nt, hsa; identical to SEQ ID NO: 112949

SEQ ID NO: 673909 - RNA, 64 nt, hsa; identical to SEQ ID NO: 112950

SEQ ID NO: 673910 - RNA, 64 nt, hsa; identical to SEQ ID NO: 112951

SEQ ID NO: 673911 - RNA, 64 nt, hsa; identical to SEQ ID NO: 112952

SEQ ID NO: 673912 - RNA, 64 nt, hsa; identical to SEQ ID NO: 112953

SEQ ID NO: 673913 - RNA, 64 nt, hsa; identical to SEQ ID NO: 112954

SEQ ID NO: 673914 - RNA, 50 nt, hsa; identical to SEQ ID NO: 112955

SEQ ID NO: 673915 - RNA, 64 nt, hsa; identical to SEQ ID NO: 112956

SEQ ID NO: 673916 - RNA, 64 nt, hsa; identical to SEQ ID NO: 112957

SEQ ID NO: 673917 - RNA, 64 nt, hsa; identical to SEQ ID NO: 112958

SEQ ID NO: 673918 - RNA, 64 nt, hsa; identical to SEQ ID NO: 112959

SEQ ID NO: 673919 - RNA, 64 nt, hsa; identical to SEQ ID NO: 112960

SEQ ID NO: 673920 - RNA, 64 nt, hsa; identical to SEQ ID NO: 112961

SEQ ID NO: 673921 - RNA, 64 nt, hsa
gugaagcacuguugauguuuuguucaccggauauguuggguagcagaaaaggccuagaaccagu

SEQ ID NO: 673922 - RNA, 64 nt, hsa
uguaguguugcuuagcacuuugcgcauuguguaaguuggguaacaaaaauggcaaaagaaaugc

SEQ ID NO: 673923 - RNA, 64 nt, hsa
ggcacccuguuggguauuggguacuuggcacccuguuggguauuggguacaauggugagccaga

SEQ ID NO: 673924 - RNA, 64 nt, hsa
uauuuugagugccuuuuguguuccuuggcacccuguuggguauuggguacuuggcacccuguug

SEQ ID NO: 673925 - RNA, 64 nt, hsa; identical to SEQ ID NO: 229156

SEQ ID NO: 673926 - RNA, 64 nt, hsa; identical to SEQ ID NO: 229157

SEQ ID NO: 673927 - RNA, 64 nt, hsa; identical to SEQ ID NO: 229158

SEQ ID NO: 673928 - RNA, 64 nt, hsa; identical to SEQ ID NO: 229159

SEQ ID NO: 673929 - RNA, 64 nt, hsa; identical to SEQ ID NO: 229160

SEQ ID NO: 673930 - RNA, 62 nt, hsa; identical to SEQ ID NO: 229161

SEQ ID NO: 673931 - RNA, 64 nt, hsa; identical to SEQ ID NO: 229162

SEQ ID NO: 673932 - RNA, 64 nt, hsa; identical to SEQ ID NO: 229163

SEQ ID NO: 673933 - RNA, 64 nt, hsa; identical to SEQ ID NO: 229164

SEQ ID NO: 673934 - RNA, 64 nt, hsa; identical to SEQ ID NO: 229165

SEQ ID NO: 673935 - RNA, 64 nt, hsa; identical to SEQ ID NO: 229166

SEQ ID NO: 673936 - RNA, 64 nt, hsa; identical to SEQ ID NO: 229167

SEQ ID NO: 673937 - RNA, 64 nt, hsa; identical to SEQ ID NO: 78101

SEQ ID NO: 673938 - RNA, 62 nt, hsa; identical to SEQ ID NO: 78102

SEQ ID NO: 673939 - RNA, 64 nt, hsa; identical to SEQ ID NO: 78103

SEQ ID NO: 673940 - RNA, 55 nt, hsa; identical to SEQ ID NO: 78104

SEQ ID NO: 673941 - RNA, 64 nt, hsa; identical to SEQ ID NO: 78105

SEQ ID NO: 673942 - RNA, 64 nt, hsa; identical to SEQ ID NO: 78106

SEQ ID NO: 673943 - RNA, 64 nt, hsa; identical to SEQ ID NO: 78107

SEQ ID NO: 673944 - RNA, 64 nt, hsa; identical to SEQ ID NO: 78108

SEQ ID NO: 673945 - RNA, 64 nt, hsa; identical to SEQ ID NO: 78109

SEQ ID NO: 673946 - RNA, 64 nt, hsa; identical to SEQ ID NO: 78110

SEQ ID NO: 673947 - RNA, 64 nt, hsa; identical to SEQ ID NO: 78111

SEQ ID NO: 673948 - RNA, 64 nt, hsa; identical to SEQ ID NO: 78112

SEQ ID NO: 673949 - RNA, 64 nt, hsa; identical to SEQ ID NO: 78113

SEQ ID NO: 673950 - RNA, 64 nt, hsa; identical to SEQ ID NO: 78114

SEQ ID NO: 673951 - RNA, 64 nt, hsa; identical to SEQ ID NO: 78115

SEQ ID NO: 673952 - RNA, 64 nt, hsa; identical to SEQ ID NO: 78116

SEQ ID NO: 673953 - RNA, 64 nt, hsa; identical to SEQ ID NO: 78117

SEQ ID NO: 673954 - RNA, 64 nt, hsa; identical to SEQ ID NO: 78118

SEQ ID NO: 673955 - RNA, 64 nt, hsa; identical to SEQ ID NO: 78119

SEQ ID NO: 673956 - RNA, 64 nt, hsa; identical to SEQ ID NO: 78120

SEQ ID NO: 673957 - RNA, 64 nt, hsa; identical to SEQ ID NO: 78121

SEQ ID NO: 673958 - RNA, 64 nt, hsa; identical to SEQ ID NO: 78122

SEQ ID NO: 673959 - RNA, 64 nt, hsa; identical to SEQ ID NO: 78123

SEQ ID NO: 673960 - RNA, 64 nt, hsa; identical to SEQ ID NO: 78124

SEQ ID NO: 673961 - RNA, 64 nt, hsa; identical to SEQ ID NO: 78125

SEQ ID NO: 673962 - RNA, 64 nt, hsa; identical to SEQ ID NO: 78126

SEQ ID NO: 673963 - RNA, 64 nt, hsa; identical to SEQ ID NO: 78127

SEQ ID NO: 673964 - RNA, 64 nt, hsa; identical to SEQ ID NO: 78128

SEQ ID NO: 673965 - RNA, 64 nt, hsa; identical to SEQ ID NO: 78129

SEQ ID NO: 673966 - RNA, 64 nt, hsa; identical to SEQ ID NO: 78130

SEQ ID NO: 673967 - RNA, 64 nt, hsa; identical to SEQ ID NO: 78131

SEQ ID NO: 673968 - RNA, 64 nt, hsa; identical to SEQ ID NO: 78132

SEQ ID NO: 673969 - RNA, 64 nt, hsa; identical to SEQ ID NO: 78133

SEQ ID NO: 673970 - RNA, 64 nt, hsa; identical to SEQ ID NO: 78134

SEQ ID NO: 673971 - RNA, 64 nt, hsa; identical to SEQ ID NO: 78135

SEQ ID NO: 673972 - RNA, 64 nt, hsa; identical to SEQ ID NO: 78136

SEQ ID NO: 673973 - RNA, 64 nt, hsa; identical to SEQ ID NO: 78137

SEQ ID NO: 673974 - RNA, 64 nt, hsa; identical to SEQ ID NO: 78138

SEQ ID NO: 673975 - RNA, 64 nt, hsa; identical to SEQ ID NO: 78139

SEQ ID NO: 673976 - RNA, 64 nt, hsa; identical to SEQ ID NO: 78140

SEQ ID NO: 673977 - RNA, 64 nt, hsa; identical to SEQ ID NO: 78141

SEQ ID NO: 673978 - RNA, 64 nt, hsa; identical to SEQ ID NO: 78142

SEQ ID NO: 673979 - RNA, 64 nt, hsa; identical to SEQ ID NO: 78143

SEQ ID NO: 673980 - RNA, 64 nt, hsa; identical to SEQ ID NO: 78144

SEQ ID NO: 673981 - RNA, 64 nt, hsa; identical to SEQ ID NO: 78145

SEQ ID NO: 673982 - RNA, 64 nt, hsa; identical to SEQ ID NO: 78146

SEQ ID NO: 673983 - RNA, 64 nt, hsa; identical to SEQ ID NO: 78147

SEQ ID NO: 673984 - RNA, 64 nt, hsa; identical to SEQ ID NO: 78148

SEQ ID NO: 673985 - RNA, 64 nt, hsa; identical to SEQ ID NO: 78149

SEQ ID NO: 673986 - RNA, 64 nt, hsa; identical to SEQ ID NO: 78150

SEQ ID NO: 673987 - RNA, 64 nt, hsa; identical to SEQ ID NO: 78151

SEQ ID NO: 673988 - RNA, 64 nt, hsa; identical to SEQ ID NO: 78152

SEQ ID NO: 673989 - RNA, 64 nt, hsa; identical to SEQ ID NO: 78153

SEQ ID NO: 673990 - RNA, 64 nt, hsa; identical to SEQ ID NO: 78154

SEQ ID NO: 673991 - RNA, 64 nt, hsa; identical to SEQ ID NO: 78155

SEQ ID NO: 673992 - RNA, 64 nt, hsa; identical to SEQ ID NO: 78156

SEQ ID NO: 673993 - RNA, 64 nt, hsa; identical to SEQ ID NO: 78157

SEQ ID NO: 673994 - RNA, 64 nt, hsa; identical to SEQ ID NO: 78158

SEQ ID NO: 673995 - RNA, 64 nt, hsa; identical to SEQ ID NO: 78159

SEQ ID NO: 673996 - RNA, 64 nt, hsa; identical to SEQ ID NO: 78160

SEQ ID NO: 673997 - RNA, 64 nt, hsa; identical to SEQ ID NO: 78161

SEQ ID NO: 673998 - RNA, 64 nt, hsa; identical to SEQ ID NO: 78162

SEQ ID NO: 673999 - RNA, 64 nt, hsa; identical to SEQ ID NO: 78163

SEQ ID NO: 674000 - RNA, 64 nt, hsa; identical to SEQ ID NO: 78164

SEQ ID NO: 674001 - RNA, 64 nt, hsa; identical to SEQ ID NO: 78165

SEQ ID NO: 674002 - RNA, 64 nt, hsa; identical to SEQ ID NO: 78166

SEQ ID NO: 674003 - RNA, 64 nt, hsa; identical to SEQ ID NO: 78167

SEQ ID NO: 674004 - RNA, 64 nt, hsa; identical to SEQ ID NO: 78168

SEQ ID NO: 674005 - RNA, 64 nt, hsa; identical to SEQ ID NO: 78169

SEQ ID NO: 674006 - RNA, 64 nt, hsa; identical to SEQ ID NO: 78170

SEQ ID NO: 674007 - RNA, 64 nt, hsa; identical to SEQ ID NO: 78171

SEQ ID NO: 674008 - RNA, 64 nt, hsa; identical to SEQ ID NO: 78172

SEQ ID NO: 674009 - RNA, 64 nt, hsa; identical to SEQ ID NO: 78173

SEQ ID NO: 674010 - RNA, 64 nt, hsa; identical to SEQ ID NO: 78174

SEQ ID NO: 674011 - RNA, 64 nt, hsa; identical to SEQ ID NO: 78175

SEQ ID NO: 674012 - RNA, 64 nt, hsa; identical to SEQ ID NO: 78176

SEQ ID NO: 674013 - RNA, 64 nt, hsa; identical to SEQ ID NO: 78177

SEQ ID NO: 674014 - RNA, 64 nt, hsa; identical to SEQ ID NO: 78178

SEQ ID NO: 674015 - RNA, 64 nt, hsa; identical to SEQ ID NO: 78179

SEQ ID NO: 674016 - RNA, 64 nt, hsa; identical to SEQ ID NO: 78180

SEQ ID NO: 674017 - RNA, 64 nt, hsa; identical to SEQ ID NO: 78181

SEQ ID NO: 674018 - RNA, 64 nt, hsa; identical to SEQ ID NO: 78182

SEQ ID NO: 674019 - RNA, 64 nt, hsa; identical to SEQ ID NO: 78183

SEQ ID NO: 674020 - RNA, 64 nt, hsa; identical to SEQ ID NO: 78184

SEQ ID NO: 674021 - RNA, 64 nt, hsa; identical to SEQ ID NO: 78185

SEQ ID NO: 674022 - RNA, 64 nt, hsa; identical to SEQ ID NO: 78186

SEQ ID NO: 674023 - RNA, 64 nt, hsa; identical to SEQ ID NO: 78187

SEQ ID NO: 674024 - RNA, 64 nt, hsa; identical to SEQ ID NO: 78188

SEQ ID NO: 674025 - RNA, 64 nt, hsa; identical to SEQ ID NO: 78189

SEQ ID NO: 674026 - RNA, 64 nt, hsa; identical to SEQ ID NO: 78190

SEQ ID NO: 674027 - RNA, 64 nt, hsa; identical to SEQ ID NO: 78191

SEQ ID NO: 674028 - RNA, 64 nt, hsa; identical to SEQ ID NO: 78192

SEQ ID NO: 674029 - RNA, 64 nt, hsa; identical to SEQ ID NO: 78193

SEQ ID NO: 674030 - RNA, 64 nt, hsa; identical to SEQ ID NO: 78194

SEQ ID NO: 674031 - RNA, 64 nt, hsa; identical to SEQ ID NO: 78195

SEQ ID NO: 674032 - RNA, 64 nt, hsa; identical to SEQ ID NO: 78196

SEQ ID NO: 674033 - RNA, 64 nt, hsa; identical to SEQ ID NO: 78197

SEQ ID NO: 674034 - RNA, 64 nt, hsa; identical to SEQ ID NO: 78198

SEQ ID NO: 674035 - RNA, 64 nt, hsa; identical to SEQ ID NO: 78199

SEQ ID NO: 674036 - RNA, 64 nt, hsa; identical to SEQ ID NO: 78200

SEQ ID NO: 674037 - RNA, 64 nt, hsa; identical to SEQ ID NO: 78201

SEQ ID NO: 674038 - RNA, 64 nt, hsa; identical to SEQ ID NO: 78202

SEQ ID NO: 674039 - RNA, 64 nt, hsa; identical to SEQ ID NO: 78203

SEQ ID NO: 674040 - RNA, 64 nt, hsa; identical to SEQ ID NO: 78204

SEQ ID NO: 674041 - RNA, 64 nt, hsa; identical to SEQ ID NO: 78205

SEQ ID NO: 674042 - RNA, 64 nt, hsa; identical to SEQ ID NO: 78206

SEQ ID NO: 674043 - RNA, 64 nt, hsa; identical to SEQ ID NO: 78207

SEQ ID NO: 674044 - RNA, 64 nt, hsa; identical to SEQ ID NO: 78208

SEQ ID NO: 674045 - RNA, 64 nt, hsa; identical to SEQ ID NO: 78209

SEQ ID NO: 674046 - RNA, 64 nt, hsa; identical to SEQ ID NO: 78210

SEQ ID NO: 674047 - RNA, 64 nt, hsa; identical to SEQ ID NO: 78211

SEQ ID NO: 674048 - RNA, 64 nt, hsa; identical to SEQ ID NO: 78212

SEQ ID NO: 674049 - RNA, 64 nt, hsa; identical to SEQ ID NO: 78213

SEQ ID NO: 674050 - RNA, 64 nt, hsa; identical to SEQ ID NO: 78214

SEQ ID NO: 674051 - RNA, 64 nt, hsa; identical to SEQ ID NO: 78215

SEQ ID NO: 674052 - RNA, 64 nt, hsa; identical to SEQ ID NO: 78216

SEQ ID NO: 674053 - RNA, 64 nt, hsa; identical to SEQ ID NO: 78217

SEQ ID NO: 674054 - RNA, 64 nt, hsa; identical to SEQ ID NO: 78218

SEQ ID NO: 674055 - RNA, 64 nt, hsa
gaggaauauaacauugcagaaauuucucauaggggcaugccagugagcaauuacuuuauaaaaa

SEQ ID NO: 674056 - RNA, 64 nt, hsa
uacuguggauuaaaaagccuucccuaaaaagagagcaugccagucauagagacacuaauuuggc

SEQ ID NO: 674057 - RNA, 64 nt, hsa
ugauauaugagacuuuauguggagugaaaauugggcaugccauuacauugcuuuuucuuguuug

SEQ ID NO: 674058 - RNA, 64 nt, hsa
aacaagauuugcugcauuuccggcaaugcccugugcaugccauggucccuagacaccucaguuc

SEQ ID NO: 674059 - RNA, 64 nt, hsa
ucccaccucugccucccaaguaacugggacuauagcaugccaccacacccagcugauuaucaua

SEQ ID NO: 674060 - RNA, 64 nt, hsa
ucccacuucugccucccaaguaacugggacuauagcaugccaccacacccagcugauuaucaua

SEQ ID NO: 674061 - RNA, 64 nt, hsa; identical to SEQ ID NO: 453035

SEQ ID NO: 674062 - RNA, 64 nt, hsa; identical to SEQ ID NO: 453036

SEQ ID NO: 674063 - RNA, 64 nt, hsa; identical to SEQ ID NO: 637303

SEQ ID NO: 674064 - RNA, 64 nt, hsa; identical to SEQ ID NO: 637304

SEQ ID NO: 674065 - RNA, 64 nt, hsa; identical to SEQ ID NO: 637305

SEQ ID NO: 674066 - RNA, 64 nt, hsa; identical to SEQ ID NO: 637306

SEQ ID NO: 674067 - RNA, 64 nt, hsa; identical to SEQ ID NO: 637307

SEQ ID NO: 674068 - RNA, 64 nt, hsa; identical to SEQ ID NO: 637308

SEQ ID NO: 674069 - RNA, 64 nt, hsa; identical to SEQ ID NO: 637309

SEQ ID NO: 674070 - RNA, 64 nt, hsa; identical to SEQ ID NO: 637310

SEQ ID NO: 674071 - RNA, 64 nt, hsa; identical to SEQ ID NO: 637311

SEQ ID NO: 674072 - RNA, 64 nt, hsa; identical to SEQ ID NO: 637312

SEQ ID NO: 674073 - RNA, 64 nt, hsa; identical to SEQ ID NO: 637313

SEQ ID NO: 674074 - RNA, 64 nt, hsa; identical to SEQ ID NO: 637314

SEQ ID NO: 674075 - RNA, 64 nt, hsa; identical to SEQ ID NO: 637315

SEQ ID NO: 674076 - RNA, 64 nt, hsa; identical to SEQ ID NO: 637316

SEQ ID NO: 674077 - RNA, 64 nt, hsa; identical to SEQ ID NO: 637317

SEQ ID NO: 674078 - RNA, 64 nt, hsa; identical to SEQ ID NO: 637318

SEQ ID NO: 674079 - RNA, 64 nt, hsa; identical to SEQ ID NO: 637319

SEQ ID NO: 674080 - RNA, 64 nt, hsa; identical to SEQ ID NO: 637320

SEQ ID NO: 674081 - RNA, 64 nt, hsa; identical to SEQ ID NO: 637321

SEQ ID NO: 674082 - RNA, 64 nt, hsa; identical to SEQ ID NO: 637322

SEQ ID NO: 674083 - RNA, 64 nt, hsa; identical to SEQ ID NO: 637323

SEQ ID NO: 674084 - RNA, 64 nt, hsa; identical to SEQ ID NO: 637324

SEQ ID NO: 674085 - RNA, 64 nt, hsa; identical to SEQ ID NO: 637325

SEQ ID NO: 674086 - RNA, 64 nt, hsa; identical to SEQ ID NO: 637326

SEQ ID NO: 674087 - RNA, 64 nt, hsa; identical to SEQ ID NO: 348336

SEQ ID NO: 674088 - RNA, 64 nt, hsa; identical to SEQ ID NO: 348337

SEQ ID NO: 674089 - RNA, 64 nt, hsa; identical to SEQ ID NO: 348338

SEQ ID NO: 674090 - RNA, 64 nt, hsa; identical to SEQ ID NO: 348339

SEQ ID NO: 674091 - RNA, 64 nt, hsa; identical to SEQ ID NO: 348340

SEQ ID NO: 674092 - RNA, 64 nt, hsa; identical to SEQ ID NO: 348341

SEQ ID NO: 674093 - RNA, 64 nt, hsa; identical to SEQ ID NO: 348342

SEQ ID NO: 674094 - RNA, 64 nt, hsa; identical to SEQ ID NO: 348343

SEQ ID NO: 674095 - RNA, 64 nt, hsa; identical to SEQ ID NO: 348344

SEQ ID NO: 674096 - RNA, 64 nt, hsa; identical to SEQ ID NO: 348345

SEQ ID NO: 674097 - RNA, 64 nt, hsa; identical to SEQ ID NO: 348346

SEQ ID NO: 674098 - RNA, 64 nt, hsa; identical to SEQ ID NO: 348347

SEQ ID NO: 674099 - RNA, 64 nt, hsa; identical to SEQ ID NO: 348348

SEQ ID NO: 674100 - RNA, 64 nt, hsa; identical to SEQ ID NO: 348349

SEQ ID NO: 674101 - RNA, 64 nt, hsa; identical to SEQ ID NO: 348350

SEQ ID NO: 674102 - RNA, 64 nt, hsa; identical to SEQ ID NO: 348351

SEQ ID NO: 674103 - RNA, 64 nt, hsa; identical to SEQ ID NO: 516747

SEQ ID NO: 674104 - RNA, 64 nt, hsa; identical to SEQ ID NO: 516748

SEQ ID NO: 674105 - RNA, 64 nt, hsa; identical to SEQ ID NO: 516749

SEQ ID NO: 674106 - RNA, 64 nt, hsa; identical to SEQ ID NO: 516750

SEQ ID NO: 674107 - RNA, 64 nt, hsa; identical to SEQ ID NO: 516751

SEQ ID NO: 674108 - RNA, 64 nt, hsa; identical to SEQ ID NO: 516752

SEQ ID NO: 674109 - RNA, 64 nt, hsa; identical to SEQ ID NO: 516753

SEQ ID NO: 674110 - RNA, 64 nt, hsa; identical to SEQ ID NO: 516754

SEQ ID NO: 674111 - RNA, 64 nt, hsa; identical to SEQ ID NO: 516755

SEQ ID NO: 674112 - RNA, 64 nt, hsa; identical to SEQ ID NO: 516756

SEQ ID NO: 674113 - RNA, 64 nt, hsa; identical to SEQ ID NO: 516757

SEQ ID NO: 674114 - RNA, 64 nt, hsa; identical to SEQ ID NO: 516758

SEQ ID NO: 674115 - RNA, 64 nt, hsa; identical to SEQ ID NO: 516759

SEQ ID NO: 674116 - RNA, 64 nt, hsa; identical to SEQ ID NO: 516760

SEQ ID NO: 674117 - RNA, 64 nt, hsa; identical to SEQ ID NO: 516761

SEQ ID NO: 674118 - RNA, 64 nt, hsa; identical to SEQ ID NO: 516762

SEQ ID NO: 674119 - RNA, 64 nt, hsa; identical to SEQ ID NO: 516763

SEQ ID NO: 674120 - RNA, 64 nt, hsa; identical to SEQ ID NO: 516764

SEQ ID NO: 674121 - RNA, 64 nt, hsa; identical to SEQ ID NO: 516765

SEQ ID NO: 674122 - RNA, 64 nt, hsa; identical to SEQ ID NO: 516766

SEQ ID NO: 674123 - RNA, 64 nt, hsa; identical to SEQ ID NO: 516767

SEQ ID NO: 674124 - RNA, 64 nt, hsa; identical to SEQ ID NO: 516768

SEQ ID NO: 674125 - RNA, 64 nt, hsa; identical to SEQ ID NO: 516769

SEQ ID NO: 674126 - RNA, 64 nt, hsa; identical to SEQ ID NO: 516770

SEQ ID NO: 674127 - RNA, 64 nt, hsa; identical to SEQ ID NO: 516771

SEQ ID NO: 674128 - RNA, 64 nt, hsa; identical to SEQ ID NO: 516772

SEQ ID NO: 674129 - RNA, 64 nt, hsa; identical to SEQ ID NO: 516773

SEQ ID NO: 674130 - RNA, 64 nt, hsa; identical to SEQ ID NO: 516774

SEQ ID NO: 674131 - RNA, 64 nt, hsa; identical to SEQ ID NO: 516775

SEQ ID NO: 674132 - RNA, 64 nt, hsa; identical to SEQ ID NO: 516776

SEQ ID NO: 674133 - RNA, 64 nt, hsa; identical to SEQ ID NO: 516777

SEQ ID NO: 674134 - RNA, 64 nt, hsa; identical to SEQ ID NO: 660962

SEQ ID NO: 674135 - RNA, 64 nt, hsa; identical to SEQ ID NO: 660963

SEQ ID NO: 674136 - RNA, 64 nt, hsa; identical to SEQ ID NO: 660964

SEQ ID NO: 674137 - RNA, 64 nt, hsa; identical to SEQ ID NO: 660965

SEQ ID NO: 674138 - RNA, 64 nt, hsa; identical to SEQ ID NO: 660966

SEQ ID NO: 674139 - RNA, 64 nt, hsa; identical to SEQ ID NO: 660967

SEQ ID NO: 674140 - RNA, 64 nt, hsa; identical to SEQ ID NO: 660968

SEQ ID NO: 674141 - RNA, 64 nt, hsa; identical to SEQ ID NO: 660969

SEQ ID NO: 674142 - RNA, 64 nt, hsa; identical to SEQ ID NO: 660970

SEQ ID NO: 674143 - RNA, 64 nt, hsa; identical to SEQ ID NO: 660971

SEQ ID NO: 674144 - RNA, 64 nt, hsa; identical to SEQ ID NO: 660972

SEQ ID NO: 674145 - RNA, 64 nt, hsa; identical to SEQ ID NO: 660973

SEQ ID NO: 674146 - RNA, 64 nt, hsa; identical to SEQ ID NO: 660974

SEQ ID NO: 674147 - RNA, 64 nt, hsa; identical to SEQ ID NO: 660975

SEQ ID NO: 674148 - RNA, 64 nt, hsa; identical to SEQ ID NO: 660976

SEQ ID NO: 674149 - RNA, 64 nt, hsa; identical to SEQ ID NO: 660977

SEQ ID NO: 674150 - RNA, 64 nt, hsa; identical to SEQ ID NO: 660978

SEQ ID NO: 674151 - RNA, 64 nt, hsa; identical to SEQ ID NO: 660979

SEQ ID NO: 674152 - RNA, 64 nt, hsa; identical to SEQ ID NO: 215540

SEQ ID NO: 674153 - RNA, 64 nt, hsa; identical to SEQ ID NO: 215541

SEQ ID NO: 674154 - RNA, 64 nt, hsa; identical to SEQ ID NO: 215542

SEQ ID NO: 674155 - RNA, 64 nt, hsa; identical to SEQ ID NO: 215543

SEQ ID NO: 674156 - RNA, 64 nt, hsa; identical to SEQ ID NO: 215544

SEQ ID NO: 674157 - RNA, 64 nt, hsa; identical to SEQ ID NO: 215545

SEQ ID NO: 674158 - RNA, 64 nt, hsa; identical to SEQ ID NO: 215546

SEQ ID NO: 674159 - RNA, 64 nt, hsa; identical to SEQ ID NO: 215547

SEQ ID NO: 674160 - RNA, 64 nt, hsa; identical to SEQ ID NO: 215548

SEQ ID NO: 674161 - RNA, 64 nt, hsa; identical to SEQ ID NO: 215549

SEQ ID NO: 674162 - RNA, 64 nt, hsa; identical to SEQ ID NO: 215550

SEQ ID NO: 674163 - RNA, 64 nt, hsa; identical to SEQ ID NO: 215551

SEQ ID NO: 674164 - RNA, 64 nt, hsa; identical to SEQ ID NO: 215552

SEQ ID NO: 674165 - RNA, 64 nt, hsa; identical to SEQ ID NO: 215553

SEQ ID NO: 674166 - RNA, 64 nt, hsa; identical to SEQ ID NO: 215554

SEQ ID NO: 674167 - RNA, 64 nt, hsa; identical to SEQ ID NO: 215555

SEQ ID NO: 674168 - RNA, 64 nt, hsa; identical to SEQ ID NO: 215556

SEQ ID NO: 674169 - RNA, 64 nt, hsa; identical to SEQ ID NO: 215557

SEQ ID NO: 674170 - RNA, 64 nt, hsa; identical to SEQ ID NO: 215558

SEQ ID NO: 674171 - RNA, 64 nt, hsa; identical to SEQ ID NO: 215559

SEQ ID NO: 674172 - RNA, 64 nt, hsa; identical to SEQ ID NO: 215560

SEQ ID NO: 674173 - RNA, 64 nt, hsa; identical to SEQ ID NO: 215561

SEQ ID NO: 674174 - RNA, 64 nt, hsa; identical to SEQ ID NO: 215562

SEQ ID NO: 674175 - RNA, 64 nt, hsa; identical to SEQ ID NO: 215563

SEQ ID NO: 674176 - RNA, 64 nt, hsa; identical to SEQ ID NO: 215564

SEQ ID NO: 674177 - RNA, 64 nt, hsa; identical to SEQ ID NO: 215565

SEQ ID NO: 674178 - RNA, 64 nt, hsa; identical to SEQ ID NO: 215566

SEQ ID NO: 674179 - RNA, 64 nt, hsa; identical to SEQ ID NO: 215567

SEQ ID NO: 674180 - RNA, 64 nt, hsa; identical to SEQ ID NO: 215568

SEQ ID NO: 674181 - RNA, 64 nt, hsa; identical to SEQ ID NO: 104346

SEQ ID NO: 674182 - RNA, 64 nt, hsa; identical to SEQ ID NO: 104347

SEQ ID NO: 674183 - RNA, 64 nt, hsa; identical to SEQ ID NO: 104348

SEQ ID NO: 674184 - RNA, 64 nt, hsa; identical to SEQ ID NO: 104349

SEQ ID NO: 674185 - RNA, 64 nt, hsa; identical to SEQ ID NO: 104350

SEQ ID NO: 674186 - RNA, 64 nt, hsa; identical to SEQ ID NO: 104351

SEQ ID NO: 674187 - RNA, 64 nt, hsa; identical to SEQ ID NO: 104352

SEQ ID NO: 674188 - RNA, 64 nt, hsa; identical to SEQ ID NO: 104353

SEQ ID NO: 674189 - RNA, 64 nt, hsa; identical to SEQ ID NO: 104354

SEQ ID NO: 674190 - RNA, 64 nt, hsa; identical to SEQ ID NO: 104355

SEQ ID NO: 674191 - RNA, 64 nt, hsa; identical to SEQ ID NO: 104356

SEQ ID NO: 674192 - RNA, 64 nt, hsa; identical to SEQ ID NO: 104357

SEQ ID NO: 674193 - RNA, 64 nt, hsa; identical to SEQ ID NO: 104358

SEQ ID NO: 674194 - RNA, 64 nt, hsa; identical to SEQ ID NO: 104359

SEQ ID NO: 674195 - RNA, 64 nt, hsa; identical to SEQ ID NO: 104360

SEQ ID NO: 674196 - RNA, 64 nt, hsa; identical to SEQ ID NO: 104361

SEQ ID NO: 674197 - RNA, 64 nt, hsa; identical to SEQ ID NO: 104362

SEQ ID NO: 674198 - RNA, 64 nt, hsa; identical to SEQ ID NO: 104363

SEQ ID NO: 674199 - RNA, 64 nt, hsa; identical to SEQ ID NO: 104364

SEQ ID NO: 674200 - RNA, 64 nt, hsa; identical to SEQ ID NO: 104365

SEQ ID NO: 674201 - RNA, 64 nt, hsa; identical to SEQ ID NO: 104366

SEQ ID NO: 674202 - RNA, 64 nt, hsa; identical to SEQ ID NO: 104367

SEQ ID NO: 674203 - RNA, 64 nt, hsa; identical to SEQ ID NO: 104368

SEQ ID NO: 674204 - RNA, 64 nt, hsa; identical to SEQ ID NO: 104369

SEQ ID NO: 674205 - RNA, 64 nt, hsa; identical to SEQ ID NO: 104370

SEQ ID NO: 674206 - RNA, 64 nt, hsa; identical to SEQ ID NO: 104371

SEQ ID NO: 674207 - RNA, 64 nt, hsa; identical to SEQ ID NO: 104372

SEQ ID NO: 674208 - RNA, 64 nt, hsa; identical to SEQ ID NO: 104373

SEQ ID NO: 674209 - RNA, 64 nt, hsa; identical to SEQ ID NO: 104374

SEQ ID NO: 674210 - RNA, 64 nt, hsa; identical to SEQ ID NO: 104375

SEQ ID NO: 674211 - RNA, 64 nt, hsa; identical to SEQ ID NO: 104376

SEQ ID NO: 674212 - RNA, 64 nt, hsa; identical to SEQ ID NO: 104377

SEQ ID NO: 674213 - RNA, 64 nt, hsa; identical to SEQ ID NO: 104378

SEQ ID NO: 674214 - RNA, 64 nt, hsa; identical to SEQ ID NO: 104379

SEQ ID NO: 674215 - RNA, 64 nt, hsa; identical to SEQ ID NO: 104380

SEQ ID NO: 674216 - RNA, 64 nt, hsa; identical to SEQ ID NO: 104381

SEQ ID NO: 674217 - RNA, 64 nt, hsa; identical to SEQ ID NO: 104382

SEQ ID NO: 674218 - RNA, 64 nt, hsa; identical to SEQ ID NO: 104383

SEQ ID NO: 674219 - RNA, 64 nt, hsa; identical to SEQ ID NO: 104384

SEQ ID NO: 674220 - RNA, 64 nt, hsa; identical to SEQ ID NO: 104385

SEQ ID NO: 674221 - RNA, 64 nt, hsa; identical to SEQ ID NO: 104386

SEQ ID NO: 674222 - RNA, 64 nt, hsa; identical to SEQ ID NO: 104387

SEQ ID NO: 674223 - RNA, 64 nt, hsa; identical to SEQ ID NO: 104388

SEQ ID NO: 674224 - RNA, 64 nt, hsa; identical to SEQ ID NO: 104389

SEQ ID NO: 674225 - RNA, 64 nt, hsa; identical to SEQ ID NO: 104390

SEQ ID NO: 674226 - RNA, 64 nt, hsa; identical to SEQ ID NO: 104391

SEQ ID NO: 674227 - RNA, 64 nt, hsa; identical to SEQ ID NO: 104392

SEQ ID NO: 674228 - RNA, 64 nt, hsa; identical to SEQ ID NO: 104393

SEQ ID NO: 674229 - RNA, 64 nt, hsa; identical to SEQ ID NO: 104394

SEQ ID NO: 674230 - RNA, 64 nt, hsa; identical to SEQ ID NO: 104395

SEQ ID NO: 674231 - RNA, 64 nt, hsa; identical to SEQ ID NO: 104396

SEQ ID NO: 674232 - RNA, 64 nt, hsa; identical to SEQ ID NO: 104397

SEQ ID NO: 674233 - RNA, 64 nt, hsa; identical to SEQ ID NO: 104398

SEQ ID NO: 674234 - RNA, 64 nt, hsa; identical to SEQ ID NO: 104399

SEQ ID NO: 674235 - RNA, 64 nt, hsa; identical to SEQ ID NO: 104400

SEQ ID NO: 674236 - RNA, 64 nt, hsa; identical to SEQ ID NO: 104401

SEQ ID NO: 674237 - RNA, 64 nt, hsa; identical to SEQ ID NO: 104402

SEQ ID NO: 674238 - RNA, 64 nt, hsa; identical to SEQ ID NO: 104403

SEQ ID NO: 674239 - RNA, 64 nt, hsa; identical to SEQ ID NO: 104404

SEQ ID NO: 674240 - RNA, 64 nt, hsa; identical to SEQ ID NO: 104405

SEQ ID NO: 674241 - RNA, 64 nt, hsa; identical to SEQ ID NO: 104406

SEQ ID NO: 674242 - RNA, 64 nt, hsa; identical to SEQ ID NO: 104407

SEQ ID NO: 674243 - RNA, 64 nt, hsa; identical to SEQ ID NO: 104408

SEQ ID NO: 674244 - RNA, 64 nt, hsa; identical to SEQ ID NO: 104409

SEQ ID NO: 674245 - RNA, 64 nt, hsa; identical to SEQ ID NO: 104410

SEQ ID NO: 674246 - RNA, 64 nt, hsa; identical to SEQ ID NO: 104411

SEQ ID NO: 674247 - RNA, 64 nt, hsa; identical to SEQ ID NO: 104412

SEQ ID NO: 674248 - RNA, 64 nt, hsa; identical to SEQ ID NO: 104413

SEQ ID NO: 674249 - RNA, 64 nt, hsa; identical to SEQ ID NO: 104414

SEQ ID NO: 674250 - RNA, 64 nt, hsa; identical to SEQ ID NO: 104415

SEQ ID NO: 674251 - RNA, 64 nt, hsa; identical to SEQ ID NO: 104416

SEQ ID NO: 674252 - RNA, 64 nt, hsa; identical to SEQ ID NO: 104417

SEQ ID NO: 674253 - RNA, 64 nt, hsa; identical to SEQ ID NO: 104418

SEQ ID NO: 674254 - RNA, 64 nt, hsa; identical to SEQ ID NO: 104419

SEQ ID NO: 674255 - RNA, 64 nt, hsa; identical to SEQ ID NO: 104420

SEQ ID NO: 674256 - RNA, 64 nt, hsa; identical to SEQ ID NO: 104421

SEQ ID NO: 674257 - RNA, 64 nt, hsa; identical to SEQ ID NO: 104422

SEQ ID NO: 674258 - RNA, 64 nt, hsa; identical to SEQ ID NO: 104423

SEQ ID NO: 674259 - RNA, 64 nt, hsa; identical to SEQ ID NO: 104424

SEQ ID NO: 674260 - RNA, 64 nt, hsa; identical to SEQ ID NO: 104425

SEQ ID NO: 674261 - RNA, 64 nt, hsa; identical to SEQ ID NO: 143825

SEQ ID NO: 674262 - RNA, 64 nt, hsa; identical to SEQ ID NO: 143826

SEQ ID NO: 674263 - RNA, 64 nt, hsa; identical to SEQ ID NO: 143827

SEQ ID NO: 674264 - RNA, 64 nt, hsa; identical to SEQ ID NO: 143828

SEQ ID NO: 674265 - RNA, 64 nt, hsa; identical to SEQ ID NO: 143829

SEQ ID NO: 674266 - RNA, 64 nt, hsa; identical to SEQ ID NO: 143830

SEQ ID NO: 674267 - RNA, 64 nt, hsa; identical to SEQ ID NO: 143831

SEQ ID NO: 674268 - RNA, 64 nt, hsa; identical to SEQ ID NO: 143832

SEQ ID NO: 674269 - RNA, 64 nt, hsa; identical to SEQ ID NO: 143833

SEQ ID NO: 674270 - RNA, 64 nt, hsa; identical to SEQ ID NO: 143834

SEQ ID NO: 674271 - RNA, 64 nt, hsa; identical to SEQ ID NO: 143835

SEQ ID NO: 674272 - RNA, 64 nt, hsa; identical to SEQ ID NO: 143836

SEQ ID NO: 674273 - RNA, 64 nt, hsa; identical to SEQ ID NO: 143837

SEQ ID NO: 674274 - RNA, 64 nt, hsa; identical to SEQ ID NO: 143838

SEQ ID NO: 674275 - RNA, 64 nt, hsa; identical to SEQ ID NO: 143839

SEQ ID NO: 674276 - RNA, 64 nt, hsa; identical to SEQ ID NO: 143840

SEQ ID NO: 674277 - RNA, 64 nt, hsa; identical to SEQ ID NO: 143841

SEQ ID NO: 674278 - RNA, 64 nt, hsa; identical to SEQ ID NO: 143842

SEQ ID NO: 674279 - RNA, 64 nt, hsa; identical to SEQ ID NO: 143843

SEQ ID NO: 674280 - RNA, 64 nt, hsa; identical to SEQ ID NO: 143844

SEQ ID NO: 674281 - RNA, 57 nt, hsa; identical to SEQ ID NO: 143845

SEQ ID NO: 674282 - RNA, 54 nt, hsa; identical to SEQ ID NO: 143846

SEQ ID NO: 674283 - RNA, 64 nt, hsa; identical to SEQ ID NO: 143847

SEQ ID NO: 674284 - RNA, 64 nt, hsa; identical to SEQ ID NO: 143848

SEQ ID NO: 674285 - RNA, 64 nt, hsa; identical to SEQ ID NO: 143849

SEQ ID NO: 674286 - RNA, 64 nt, hsa; identical to SEQ ID NO: 143850

SEQ ID NO: 674287 - RNA, 64 nt, hsa; identical to SEQ ID NO: 143851

SEQ ID NO: 674288 - RNA, 64 nt, hsa; identical to SEQ ID NO: 143852

SEQ ID NO: 674289 - RNA, 64 nt, hsa; identical to SEQ ID NO: 143853

SEQ ID NO: 674290 - RNA, 64 nt, hsa; identical to SEQ ID NO: 143854

SEQ ID NO: 674291 - RNA, 64 nt, hsa; identical to SEQ ID NO: 143855

SEQ ID NO: 674292 - RNA, 64 nt, hsa; identical to SEQ ID NO: 143856

SEQ ID NO: 674293 - RNA, 64 nt, hsa; identical to SEQ ID NO: 143857

SEQ ID NO: 674294 - RNA, 64 nt, hsa; identical to SEQ ID NO: 143858

SEQ ID NO: 674295 - RNA, 64 nt, hsa; identical to SEQ ID NO: 143859

SEQ ID NO: 674296 - RNA, 64 nt, hsa; identical to SEQ ID NO: 143860

SEQ ID NO: 674297 - RNA, 64 nt, hsa; identical to SEQ ID NO: 143861

SEQ ID NO: 674298 - RNA, 64 nt, hsa; identical to SEQ ID NO: 143862

SEQ ID NO: 674299 - RNA, 64 nt, hsa; identical to SEQ ID NO: 143863

SEQ ID NO: 674300 - RNA, 64 nt, hsa; identical to SEQ ID NO: 143864

SEQ ID NO: 674301 - RNA, 64 nt, hsa; identical to SEQ ID NO: 143865

SEQ ID NO: 674302 - RNA, 64 nt, hsa; identical to SEQ ID NO: 143866

SEQ ID NO: 674303 - RNA, 64 nt, hsa; identical to SEQ ID NO: 143867

SEQ ID NO: 674304 - RNA, 64 nt, hsa; identical to SEQ ID NO: 143868

SEQ ID NO: 674305 - RNA, 64 nt, hsa; identical to SEQ ID NO: 143869

SEQ ID NO: 674306 - RNA, 64 nt, hsa; identical to SEQ ID NO: 143870

SEQ ID NO: 674307 - RNA, 64 nt, hsa; identical to SEQ ID NO: 143871

SEQ ID NO: 674308 - RNA, 64 nt, hsa; identical to SEQ ID NO: 143872

SEQ ID NO: 674309 - RNA, 64 nt, hsa; identical to SEQ ID NO: 143873

SEQ ID NO: 674310 - RNA, 64 nt, hsa; identical to SEQ ID NO: 143874

SEQ ID NO: 674311 - RNA, 64 nt, hsa; identical to SEQ ID NO: 143875

SEQ ID NO: 674312 - RNA, 64 nt, hsa; identical to SEQ ID NO: 143876

SEQ ID NO: 674313 - RNA, 64 nt, hsa; identical to SEQ ID NO: 143877

SEQ ID NO: 674314 - RNA, 64 nt, hsa; identical to SEQ ID NO: 143878

SEQ ID NO: 674315 - RNA, 64 nt, hsa; identical to SEQ ID NO: 143879

SEQ ID NO: 674316 - RNA, 64 nt, hsa; identical to SEQ ID NO: 143880

SEQ ID NO: 674317 - RNA, 64 nt, hsa; identical to SEQ ID NO: 143881

SEQ ID NO: 674318 - RNA, 64 nt, hsa; identical to SEQ ID NO: 143882

SEQ ID NO: 674319 - RNA, 64 nt, hsa; identical to SEQ ID NO: 143883

SEQ ID NO: 674320 - RNA, 64 nt, hsa; identical to SEQ ID NO: 143884

SEQ ID NO: 674321 - RNA, 64 nt, hsa; identical to SEQ ID NO: 143885

SEQ ID NO: 674322 - RNA, 64 nt, hsa; identical to SEQ ID NO: 143886

SEQ ID NO: 674323 - RNA, 64 nt, hsa; identical to SEQ ID NO: 143887

SEQ ID NO: 674324 - RNA, 64 nt, hsa; identical to SEQ ID NO: 143888

SEQ ID NO: 674325 - RNA, 64 nt, hsa; identical to SEQ ID NO: 143889

SEQ ID NO: 674326 - RNA, 64 nt, hsa; identical to SEQ ID NO: 143890

SEQ ID NO: 674327 - RNA, 64 nt, hsa; identical to SEQ ID NO: 143891

SEQ ID NO: 674328 - RNA, 64 nt, hsa; identical to SEQ ID NO: 143892

SEQ ID NO: 674329 - RNA, 64 nt, hsa; identical to SEQ ID NO: 143893

SEQ ID NO: 674330 - RNA, 64 nt, hsa; identical to SEQ ID NO: 143894

SEQ ID NO: 674331 - RNA, 64 nt, hsa; identical to SEQ ID NO: 143895

SEQ ID NO: 674332 - RNA, 64 nt, hsa; identical to SEQ ID NO: 143896

SEQ ID NO: 674333 - RNA, 64 nt, hsa; identical to SEQ ID NO: 143897

SEQ ID NO: 674334 - RNA, 64 nt, hsa; identical to SEQ ID NO: 143898

SEQ ID NO: 674335 - RNA, 64 nt, hsa; identical to SEQ ID NO: 143899

SEQ ID NO: 674336 - RNA, 64 nt, hsa; identical to SEQ ID NO: 143900

SEQ ID NO: 674337 - RNA, 64 nt, hsa; identical to SEQ ID NO: 143901

SEQ ID NO: 674338 - RNA, 64 nt, hsa; identical to SEQ ID NO: 143902

SEQ ID NO: 674339 - RNA, 64 nt, hsa; identical to SEQ ID NO: 143903

SEQ ID NO: 674340 - RNA, 64 nt, hsa; identical to SEQ ID NO: 143904

SEQ ID NO: 674341 - RNA, 64 nt, hsa; identical to SEQ ID NO: 143905

SEQ ID NO: 674342 - RNA, 64 nt, hsa; identical to SEQ ID NO: 143906

SEQ ID NO: 674343 - RNA, 60 nt, hsa; identical to SEQ ID NO: 143907

SEQ ID NO: 674344 - RNA, 64 nt, hsa; identical to SEQ ID NO: 143908

SEQ ID NO: 674345 - RNA, 64 nt, hsa; identical to SEQ ID NO: 143909

SEQ ID NO: 674346 - RNA, 64 nt, hsa; identical to SEQ ID NO: 143910

SEQ ID NO: 674347 - RNA, 64 nt, hsa; identical to SEQ ID NO: 143911

SEQ ID NO: 674348 - RNA, 64 nt, hsa; identical to SEQ ID NO: 143912

SEQ ID NO: 674349 - RNA, 64 nt, hsa; identical to SEQ ID NO: 143913

SEQ ID NO: 674350 - RNA, 64 nt, hsa; identical to SEQ ID NO: 143914

SEQ ID NO: 674351 - RNA, 64 nt, hsa; identical to SEQ ID NO: 143915

SEQ ID NO: 674352 - RNA, 64 nt, hsa; identical to SEQ ID NO: 143916

SEQ ID NO: 674353 - RNA, 64 nt, hsa; identical to SEQ ID NO: 143917

SEQ ID NO: 674354 - RNA, 64 nt, hsa; identical to SEQ ID NO: 143918

SEQ ID NO: 674355 - RNA, 64 nt, hsa; identical to SEQ ID NO: 143919

SEQ ID NO: 674356 - RNA, 64 nt, hsa; identical to SEQ ID NO: 143920

SEQ ID NO: 674357 - RNA, 64 nt, hsa; identical to SEQ ID NO: 143921

SEQ ID NO: 674358 - RNA, 64 nt, hsa; identical to SEQ ID NO: 143922

SEQ ID NO: 674359 - RNA, 64 nt, hsa; identical to SEQ ID NO: 143923

SEQ ID NO: 674360 - RNA, 64 nt, hsa; identical to SEQ ID NO: 143924

SEQ ID NO: 674361 - RNA, 64 nt, hsa; identical to SEQ ID NO: 143925

SEQ ID NO: 674362 - RNA, 64 nt, hsa; identical to SEQ ID NO: 143926

SEQ ID NO: 674363 - RNA, 64 nt, hsa; identical to SEQ ID NO: 143927

SEQ ID NO: 674364 - RNA, 64 nt, hsa; identical to SEQ ID NO: 143928

SEQ ID NO: 674365 - RNA, 64 nt, hsa; identical to SEQ ID NO: 143929

SEQ ID NO: 674366 - RNA, 64 nt, hsa; identical to SEQ ID NO: 143930

SEQ ID NO: 674367 - RNA, 64 nt, hsa; identical to SEQ ID NO: 143931

SEQ ID NO: 674368 - RNA, 64 nt, hsa; identical to SEQ ID NO: 143932

SEQ ID NO: 674369 - RNA, 64 nt, hsa; identical to SEQ ID NO: 143933

SEQ ID NO: 674370 - RNA, 64 nt, hsa; identical to SEQ ID NO: 143934

SEQ ID NO: 674371 - RNA, 64 nt, hsa; identical to SEQ ID NO: 143935

SEQ ID NO: 674372 - RNA, 64 nt, hsa; identical to SEQ ID NO: 143936

SEQ ID NO: 674373 - RNA, 64 nt, hsa; identical to SEQ ID NO: 143937

SEQ ID NO: 674374 - RNA, 64 nt, hsa; identical to SEQ ID NO: 143938

SEQ ID NO: 674375 - RNA, 64 nt, hsa; identical to SEQ ID NO: 143939

SEQ ID NO: 674376 - RNA, 64 nt, hsa; identical to SEQ ID NO: 143940

SEQ ID NO: 674377 - RNA, 64 nt, hsa; identical to SEQ ID NO: 143941

SEQ ID NO: 674378 - RNA, 64 nt, hsa; identical to SEQ ID NO: 143942

SEQ ID NO: 674379 - RNA, 64 nt, hsa; identical to SEQ ID NO: 143943

SEQ ID NO: 674380 - RNA, 64 nt, hsa; identical to SEQ ID NO: 143944

SEQ ID NO: 674381 - RNA, 64 nt, hsa; identical to SEQ ID NO: 143945

SEQ ID NO: 674382 - RNA, 64 nt, hsa; identical to SEQ ID NO: 143946

SEQ ID NO: 674383 - RNA, 64 nt, hsa; identical to SEQ ID NO: 143947

SEQ ID NO: 674384 - RNA, 64 nt, hsa; identical to SEQ ID NO: 143948

SEQ ID NO: 674385 - RNA, 64 nt, hsa; identical to SEQ ID NO: 143949

SEQ ID NO: 674386 - RNA, 64 nt, hsa; identical to SEQ ID NO: 143950

SEQ ID NO: 674387 - RNA, 64 nt, hsa; identical to SEQ ID NO: 143951

SEQ ID NO: 674388 - RNA, 64 nt, hsa; identical to SEQ ID NO: 143952

SEQ ID NO: 674389 - RNA, 64 nt, hsa; identical to SEQ ID NO: 143953

SEQ ID NO: 674390 - RNA, 64 nt, hsa; identical to SEQ ID NO: 143954

SEQ ID NO: 674391 - RNA, 64 nt, hsa; identical to SEQ ID NO: 143955

SEQ ID NO: 674392 - RNA, 64 nt, hsa; identical to SEQ ID NO: 143956

SEQ ID NO: 674393 - RNA, 64 nt, hsa; identical to SEQ ID NO: 143957

SEQ ID NO: 674394 - RNA, 64 nt, hsa; identical to SEQ ID NO: 143958

SEQ ID NO: 674395 - RNA, 64 nt, hsa; identical to SEQ ID NO: 143959

SEQ ID NO: 674396 - RNA, 64 nt, hsa; identical to SEQ ID NO: 583839

SEQ ID NO: 674397 - RNA, 64 nt, hsa; identical to SEQ ID NO: 583840

SEQ ID NO: 674398 - RNA, 64 nt, hsa; identical to SEQ ID NO: 583841

SEQ ID NO: 674399 - RNA, 64 nt, hsa; identical to SEQ ID NO: 583842

SEQ ID NO: 674400 - RNA, 64 nt, hsa; identical to SEQ ID NO: 583843

SEQ ID NO: 674401 - RNA, 64 nt, hsa; identical to SEQ ID NO: 583844

SEQ ID NO: 674402 - RNA, 64 nt, hsa; identical to SEQ ID NO: 583845

SEQ ID NO: 674403 - RNA, 64 nt, hsa; identical to SEQ ID NO: 583846

SEQ ID NO: 674404 - RNA, 64 nt, hsa
aauugaaguaucucuccuuaaccccaauugucaaggguaguagcuguauacuaccacuuugaau

SEQ ID NO: 674405 - RNA, 64 nt, hsa
aaaagggaaaauauauaaagauuauuucaugauuggguaguaaaacuauucagcuagucagcua

SEQ ID NO: 674406 - RNA, 64 nt, hsa
ugauggagaaaucucaaguuacuggcuuuuauacuuaccaaacaucaguucuucaaauaaggac

SEQ ID NO: 674407 - RNA, 64 nt, hsa
cugcuugauucuacuauacaucuugggcaacuaguuaccaaaugaauugugccaccauaacuga

SEQ ID NO: 674408 - RNA, 64 nt, hsa
aauggguguaauguuuauuuacugaugcuuuauguuaccaaaacauacaguaaaaaaguagaaa

SEQ ID NO: 674409 - RNA, 64 nt, hsa
augaaauacuuuugauaaaaaguuuauuuugugcuuaccaaaaggaaugcuuucacaauagugu

SEQ ID NO: 674410 - RNA, 64 nt, hsa
aacacauaaauuaugagauuuuuuuuaaaaguuguuaccaaauacacauuucacauugaaucau

SEQ ID NO: 674411 - RNA, 64 nt, hsa
uuaugcauucuuauaacauaaccucagaguaucuuuaccaaagguuuuuaaaguaaaucucuuu

SEQ ID NO: 674412 - RNA, 64 nt, hsa
ugauacaagucucuguaccagcgcuuuauguuaauuaccaaaacucuccugcaucagagcauga

SEQ ID NO: 674413 - RNA, 64 nt, hsa
acaugcaaccaugugauuacuuuggucauacuauuuaccaaauuguuggcaaacuugauguaac

SEQ ID NO: 674414 - RNA, 64 nt, hsa
cuuuuaaaaaugcuuuugggaacccuccagccucuuaccaaaagaggcuuuaaaccucaucuug

SEQ ID NO: 674415 - RNA, 64 nt, hsa
aaagaaccacuguguuaaguuuaggauuauuuacuuaccaaauuagaaguuugacuuuuaugug

SEQ ID NO: 674416 - RNA, 64 nt, hsa
ucugagaacaguagugaccccuggcagcaauucauuaccaaaacacagacaaaccaaagguaac

SEQ ID NO: 674417 - RNA, 64 nt, hsa
cccuaacacuugucuagcaaauggagagccuaauuuaccaaaaugaaacuuguaaauuuuugug

SEQ ID NO: 674418 - RNA, 64 nt, hsa
gcacugagauaaauaccuggcaaaacuaaauaaauuaccaaaaaggaaaaaaaauccaccaaac

SEQ ID NO: 674419 - RNA, 64 nt, hsa
ccccuuacgaggguguaacaucuauuuguuccucuuaccaaagcaaaaggauuggcuucauaca

SEQ ID NO: 674420 - RNA, 64 nt, hsa
aaccauuuucuugauggaacucuuccuagaguuuuuaccaaauagcuaacuuuaguaguaaaac

SEQ ID NO: 674421 - RNA, 64 nt, hsa
uuauauccaaagauacacuauaaaaauagaguuuuuaccaaaaaaagauguuuguucucaucuc

SEQ ID NO: 674422 - RNA, 64 nt, hsa
cuuacucaggaaagccagcccccauaauauuguauuaccaaacaguaucgcuuuguuaggaagg

SEQ ID NO: 674423 - RNA, 64 nt, hsa
gggcuugucacaacgugaagggcuggaauguauauuaccaaaugggaauuuccauuguagguuu

SEQ ID NO: 674424 - RNA, 64 nt, hsa
aaaaaccugcaucuucuugaagcaucaguuuuacuuaccaaaugguuuagagucauaagaugac

SEQ ID NO: 674425 - RNA, 64 nt, hsa
gucuggaauggcuuucugcaacucuuuuuguaguuuaccaaauauauucuaauuacagguaaua

SEQ ID NO: 674426 - RNA, 64 nt, hsa
ucugcuauuuaugcaaaauucuguuuaucccguguuaccaaauuaccauuucagugagaagcuu

SEQ ID NO: 674427 - RNA, 64 nt, hsa
uuccaaagauaacaacuuacauaagcauaguucauuaccaaauacaggaaagugaaauuguuac

SEQ ID NO: 674428 - RNA, 64 nt, hsa
uuuuauuuugaaauaaguuuagauucacaaaaucuuaccaaaauauuccagaguucuugcccuu

SEQ ID NO: 674429 - RNA, 64 nt, hsa
gacaacaaaauaaaaacagagguugcuugacucauuaccaaagaggcaaagcaugugcgacccu

SEQ ID NO: 674430 - RNA, 64 nt, hsa
gaggcaaagcaugugcgacccuuucugucuuauuuuaccaaaagauggugcaaaucuaugaccu

SEQ ID NO: 674431 - RNA, 64 nt, hsa
uaccaucggguauuuuuuaaaguauucauugaguuuaccaaaaguuacuguagcuuaaaagguu

SEQ ID NO: 674432 - RNA, 64 nt, hsa
uucuauuaauuaugcaucagacaaaagccauuuguuaccaaacugggaaaacagaggcuuuucu

SEQ ID NO: 674433 - RNA, 64 nt, hsa
aaaguuccaacaaagucccuuuuucaauaucacauuaccaaaaagauggcugcaaauguaauuu

SEQ ID NO: 674434 - RNA, 64 nt, hsa
cucauacuuguuaacaauugguaucuuugaguauuuaccaaagagcugccaagguuacagugaa

SEQ ID NO: 674435 - RNA, 64 nt, hsa
ucacgagguguaauuuuuaauuugaucagaacuguuaccaaaaaacaacugucaguuuuauuga

SEQ ID NO: 674436 - RNA, 64 nt, hsa
agagggacaaagccacagccacacucuucaacgguuaccaaacuguuuuuggaaauucacacca

SEQ ID NO: 674437 - RNA, 64 nt, hsa
ugauuuugaacugguaauauaaucuaaaucaagauuaccaaaauaauuucagagguugaugugg

SEQ ID NO: 674438 - RNA, 64 nt, hsa
accaaaccacaagaaauccaaaaucauuuuagguuuaccaaacauugguggaauuccaucuuuc

SEQ ID NO: 674439 - RNA, 64 nt, hsa
uggaaucauuauuugugcaaagggacagacagaucacuuagauugcuauacuaguggacauagg

SEQ ID NO: 674440 - RNA, 64 nt, hsa
aaauaucuuaaaauaucuaaaacauuuuuuaaagcacuuagauugucuuacguaugugcauacu

SEQ ID NO: 674441 - RNA, 64 nt, hsa
acugcuaacuuaagaagaggugaauuugcauuuacacuuagacacuuucuaaaaacagggugaa

SEQ ID NO: 674442 - RNA, 64 nt, hsa
aagauuucuucaagcuccauuuugcagagaccaccacuuagagaaucaaaaaauuccuguuuug

SEQ ID NO: 674443 - RNA, 64 nt, hsa
aguccaaugugcuaugagcaucagcuuacuuugucacuuagagcaagcaaaacccagugcaaga

SEQ ID NO: 674444 - RNA, 64 nt, hsa
gauuauaaaacccuucauaaaucaagaaggccaucacuuagaacgaaccccaaacaaaaaugcc

SEQ ID NO: 674445 - RNA, 64 nt, hsa
uacccaccaagcucauacagggaaccacacccaacacuuagacaugcgaacaagcagcccccag

SEQ ID NO: 674446 - RNA, 64 nt, hsa
guugacuuaauauauuugcuuuuuuucucaccugcacuuagaggaaauuugaacaaguuggaaa

SEQ ID NO: 674447 - RNA, 64 nt, hsa
uuuguuacucugguuguugugccaaauugugguacacuuagaaaauucuacagucgucgauuuu

SEQ ID NO: 674448 - RNA, 64 nt, hsa
cccacaaggaggaaggaagggcaaccuaaaagcccacuuagaaacuuuuuggauaugccacugc

SEQ ID NO: 674449 - RNA, 64 nt, hsa
uaggaaacuaagguuugagggagaaagaguuugucacuuagaccucuuggcuguuaacugaaac

SEQ ID NO: 674450 - RNA, 64 nt, hsa
uggguuccuuaaaacaaagggaaauuauuauugccacuuagaaaaauucagaaaagcacacacu

SEQ ID NO: 674451 - RNA, 64 nt, hsa
auucuuacuaaauucagaggaauaggauaaagaucacuuagagaaagggugcuuauggacauag

SEQ ID NO: 674452 - RNA, 64 nt, hsa
ggggguucugccccuugugaaggcccauuccuggcacuuagagacagaaagaacucagcaaucu

SEQ ID NO: 674453 - RNA, 64 nt, hsa
aaaccuuuaugucugagucugaaaugaaccuguucacuuagacuagauuuuauaguaacaaaau

SEQ ID NO: 674454 - RNA, 64 nt, hsa
agaaaacuauugaaagaaaucacaggggaaacugcacuuagacugacagaauugaacaccaaag

SEQ ID NO: 674455 - RNA, 64 nt, hsa
gauauuuuuaaaacaggguacaacccccugcugcacacgcuagcauaucuggaaccuacuauga

SEQ ID NO: 674456 - RNA, 64 nt, hsa
cgacagggcagaccaaugaugccaggcagcugucacacgcuaguauuggcuucauugugaucug

SEQ ID NO: 674457 - RNA, 64 nt, hsa
ucccuuuguauuuccucuuuccaaguugauuccaacacgcuagagcaggguuguccaauagaaa

SEQ ID NO: 674458 - RNA, 64 nt, hsa
uauuucguuuaaauuuguuucauuuaaguuuccuacacgcuaacuucguuugugcgauugaaau

SEQ ID NO: 674459 - RNA, 64 nt, hsa
uuacugcaguucaucucaugggaggggcugaaauacacgcuaguaacuccucugcccuucagcc

SEQ ID NO: 674460 - RNA, 64 nt, hsa
cguggguuguauccugccagguugaguggggcucacacgcuagggugagaugucagaaagcgcu

SEQ ID NO: 674461 - RNA, 64 nt, hsa
auuuguuuuauauggauuuuuauucacucuucagacacgcuacucaagagugccccucagcugc

SEQ ID NO: 674462 - RNA, 64 nt, hsa
cugcuuuugaaggggcuuacagccacaccagaagacacgcuaaauauuuauuauacuauccuac

SEQ ID NO: 674463 - RNA, 64 nt, hsa
cugccuucuuccucuguugccaugugaucucugcacacgcuagcucuccuucgccuucugccau

SEQ ID NO: 674464 - RNA, 64 nt, hsa
auaucuguauuacuugugugaaugguuguguugaacacgcuaagaacaauuugaauuuuauuaa

SEQ ID NO: 674465 - RNA, 64 nt, hsa
aguguggggcucugccaugaggaagucacagcagacacgcuagacagcauaguccuggaugcaa

SEQ ID NO: 674466 - RNA, 64 nt, hsa
uuuaccaugccuggaaauuuuacaggggaagaaaacacgcuaguuauuuaacugcaagcuacua

SEQ ID NO: 674467 - RNA, 64 nt, hsa
ugugguaguaugaaauguuacuguuaacuuucaaacacgcuaugcgugauaauuuuuuuguuua

SEQ ID NO: 674468 - RNA, 64 nt, hsa
ccccacccccacucccggccccgguucccacaggacacgcuaagaagcacagggagcauuuaac

SEQ ID NO: 674469 - RNA, 64 nt, hsa
auucagacuguuuuucagggagguggcuggguuuacacgcuaaucccgauucacccuguccaaa

SEQ ID NO: 674470 - RNA, 64 nt, hsa
ucguagaucugauaacccuaucuaaaagaaagucacacgcuaaauguauucuuacauagugcuu

SEQ ID NO: 674471 - RNA, 64 nt, hsa
cccuugaaacuugcaggauuuacuuaauaaaaauacacgcuaugagucauaauugugccaaguu

SEQ ID NO: 674472 - RNA, 64 nt, hsa
cccgcugugcguugagguuagagaccuaccguuuacacgcuagagccgagaggacguucaaguu

SEQ ID NO: 674473 - RNA, 64 nt, hsa
agagaagauuuuugucaugauuuuaaauacacugacacgcuacuguugguuaaauuuaaacaug

SEQ ID NO: 674474 - RNA, 64 nt, hsa
uccugcacggggcuccacggagcccagcucccagacacgcuacuaagugccuaggguugcccgc

SEQ ID NO: 674475 - RNA, 64 nt, hsa
accagccgugggaauggcugggcugccaggccagacacgcuagguucuuccaaagagucccaag

SEQ ID NO: 674476 - RNA, 64 nt, hsa
cauuugggaagcaaguagccauaguacacacacaacacgcuaucagcuuggguaaggacagugg

SEQ ID NO: 674477 - RNA, 64 nt, hsa
aaacagaccgugaacacaaaacaucaaguuccacacacgcuauggaaugguuaugaagggaagc

SEQ ID NO: 674478 - RNA, 64 nt, hsa
cacccacaaacaggcuccgaggaaaaucacuccuacacgcuaucccuggagccugagacugggu

SEQ ID NO: 674479 - RNA, 64 nt, hsa
agauaggggauuuuuuuuuuuccauguccgauucacacgcuacacacccacaugaacacauucg

SEQ ID NO: 674480 - RNA, 64 nt, hsa
cacacacacaaacccccagaaacccacaauauguacacgcuaaggaaaaacuagcacccuucug

SEQ ID NO: 674481 - RNA, 64 nt, hsa
caguaggccugaugacuaaaagauaugcuuuauuacacgcuauuuucaccucuugaaagucaaa

SEQ ID NO: 674482 - RNA, 64 nt, hsa; identical to SEQ ID NO: 195947

SEQ ID NO: 674483 - RNA, 64 nt, hsa; identical to SEQ ID NO: 195948

SEQ ID NO: 674484 - RNA, 64 nt, hsa; identical to SEQ ID NO: 195949

SEQ ID NO: 674485 - RNA, 64 nt, hsa; identical to SEQ ID NO: 195950

SEQ ID NO: 674486 - RNA, 64 nt, hsa; identical to SEQ ID NO: 195951

SEQ ID NO: 674487 - RNA, 64 nt, hsa; identical to SEQ ID NO: 195952

SEQ ID NO: 674488 - RNA, 64 nt, hsa; identical to SEQ ID NO: 195953

SEQ ID NO: 674489 - RNA, 64 nt, hsa; identical to SEQ ID NO: 195954

SEQ ID NO: 674490 - RNA, 64 nt, hsa; identical to SEQ ID NO: 195955

SEQ ID NO: 674491 - RNA, 64 nt, hsa; identical to SEQ ID NO: 195956

SEQ ID NO: 674492 - RNA, 64 nt, hsa; identical to SEQ ID NO: 195957

SEQ ID NO: 674493 - RNA, 64 nt, hsa; identical to SEQ ID NO: 195958

SEQ ID NO: 674494 - RNA, 64 nt, hsa; identical to SEQ ID NO: 195959

SEQ ID NO: 674495 - RNA, 64 nt, hsa; identical to SEQ ID NO: 195960

SEQ ID NO: 674496 - RNA, 64 nt, hsa; identical to SEQ ID NO: 56439

SEQ ID NO: 674497 - RNA, 64 nt, hsa; identical to SEQ ID NO: 56440

SEQ ID NO: 674498 - RNA, 64 nt, hsa; identical to SEQ ID NO: 56441

SEQ ID NO: 674499 - RNA, 64 nt, hsa; identical to SEQ ID NO: 56442

SEQ ID NO: 674500 - RNA, 64 nt, hsa; identical to SEQ ID NO: 56443

SEQ ID NO: 674501 - RNA, 64 nt, hsa; identical to SEQ ID NO: 56444

SEQ ID NO: 674502 - RNA, 64 nt, hsa; identical to SEQ ID NO: 56445

SEQ ID NO: 674503 - RNA, 64 nt, hsa; identical to SEQ ID NO: 56446

SEQ ID NO: 674504 - RNA, 64 nt, hsa; identical to SEQ ID NO: 56447

SEQ ID NO: 674505 - RNA, 64 nt, hsa; identical to SEQ ID NO: 56448

SEQ ID NO: 674506 - RNA, 64 nt, hsa; identical to SEQ ID NO: 56449

SEQ ID NO: 674507 - RNA, 64 nt, hsa; identical to SEQ ID NO: 56450

SEQ ID NO: 674508 - RNA, 64 nt, hsa; identical to SEQ ID NO: 56451

SEQ ID NO: 674509 - RNA, 64 nt, hsa; identical to SEQ ID NO: 56452

SEQ ID NO: 674510 - RNA, 64 nt, hsa; identical to SEQ ID NO: 56453

SEQ ID NO: 674511 - RNA, 64 nt, hsa; identical to SEQ ID NO: 56454

SEQ ID NO: 674512 - RNA, 64 nt, hsa; identical to SEQ ID NO: 56455

SEQ ID NO: 674513 - RNA, 64 nt, hsa; identical to SEQ ID NO: 56456

SEQ ID NO: 674514 - RNA, 64 nt, hsa; identical to SEQ ID NO: 56457

SEQ ID NO: 674515 - RNA, 64 nt, hsa; identical to SEQ ID NO: 56458

SEQ ID NO: 674516 - RNA, 64 nt, hsa; identical to SEQ ID NO: 56459

SEQ ID NO: 674517 - RNA, 64 nt, hsa; identical to SEQ ID NO: 56460

SEQ ID NO: 674518 - RNA, 64 nt, hsa; identical to SEQ ID NO: 56461

SEQ ID NO: 674519 - RNA, 64 nt, hsa; identical to SEQ ID NO: 56462

SEQ ID NO: 674520 - RNA, 64 nt, hsa; identical to SEQ ID NO: 56463

SEQ ID NO: 674521 - RNA, 64 nt, hsa; identical to SEQ ID NO: 56464

SEQ ID NO: 674522 - RNA, 64 nt, hsa; identical to SEQ ID NO: 56465

SEQ ID NO: 674523 - RNA, 64 nt, hsa; identical to SEQ ID NO: 56466

SEQ ID NO: 674524 - RNA, 64 nt, hsa; identical to SEQ ID NO: 56467

SEQ ID NO: 674525 - RNA, 50 nt, hsa; identical to SEQ ID NO: 56468

SEQ ID NO: 674526 - RNA, 64 nt, hsa; identical to SEQ ID NO: 56469

SEQ ID NO: 674527 - RNA, 64 nt, hsa; identical to SEQ ID NO: 56470

SEQ ID NO: 674528 - RNA, 64 nt, hsa; identical to SEQ ID NO: 56471

SEQ ID NO: 674529 - RNA, 64 nt, hsa; identical to SEQ ID NO: 56472

SEQ ID NO: 674530 - RNA, 64 nt, hsa; identical to SEQ ID NO: 56473

SEQ ID NO: 674531 - RNA, 64 nt, hsa; identical to SEQ ID NO: 56474

SEQ ID NO: 674532 - RNA, 64 nt, hsa; identical to SEQ ID NO: 56475

SEQ ID NO: 674533 - RNA, 64 nt, hsa; identical to SEQ ID NO: 56476

SEQ ID NO: 674534 - RNA, 64 nt, hsa; identical to SEQ ID NO: 56477

SEQ ID NO: 674535 - RNA, 64 nt, hsa; identical to SEQ ID NO: 56478

SEQ ID NO: 674536 - RNA, 64 nt, hsa; identical to SEQ ID NO: 56479

SEQ ID NO: 674537 - RNA, 64 nt, hsa; identical to SEQ ID NO: 56480

SEQ ID NO: 674538 - RNA, 64 nt, hsa; identical to SEQ ID NO: 56481

SEQ ID NO: 674539 - RNA, 64 nt, hsa; identical to SEQ ID NO: 56482

SEQ ID NO: 674540 - RNA, 64 nt, hsa; identical to SEQ ID NO: 56483

SEQ ID NO: 674541 - RNA, 64 nt, hsa; identical to SEQ ID NO: 56484

SEQ ID NO: 674542 - RNA, 64 nt, hsa; identical to SEQ ID NO: 56485

SEQ ID NO: 674543 - RNA, 64 nt, hsa; identical to SEQ ID NO: 56486

SEQ ID NO: 674544 - RNA, 64 nt, hsa; identical to SEQ ID NO: 56487

SEQ ID NO: 674545 - RNA, 64 nt, hsa; identical to SEQ ID NO: 56488

SEQ ID NO: 674546 - RNA, 64 nt, hsa; identical to SEQ ID NO: 56489

SEQ ID NO: 674547 - RNA, 64 nt, hsa; identical to SEQ ID NO: 56490

SEQ ID NO: 674548 - RNA, 64 nt, hsa; identical to SEQ ID NO: 56491

SEQ ID NO: 674549 - RNA, 64 nt, hsa; identical to SEQ ID NO: 56492

SEQ ID NO: 674550 - RNA, 64 nt, hsa; identical to SEQ ID NO: 56493

SEQ ID NO: 674551 - RNA, 64 nt, hsa; identical to SEQ ID NO: 56494

SEQ ID NO: 674552 - RNA, 64 nt, hsa; identical to SEQ ID NO: 56495

SEQ ID NO: 674553 - RNA, 64 nt, hsa; identical to SEQ ID NO: 56496

SEQ ID NO: 674554 - RNA, 64 nt, hsa; identical to SEQ ID NO: 56497

SEQ ID NO: 674555 - RNA, 64 nt, hsa; identical to SEQ ID NO: 56498

SEQ ID NO: 674556 - RNA, 64 nt, hsa; identical to SEQ ID NO: 56499

SEQ ID NO: 674557 - RNA, 64 nt, hsa; identical to SEQ ID NO: 56500

SEQ ID NO: 674558 - RNA, 64 nt, hsa; identical to SEQ ID NO: 56501

SEQ ID NO: 674559 - RNA, 64 nt, hsa; identical to SEQ ID NO: 56502

SEQ ID NO: 674560 - RNA, 64 nt, hsa; identical to SEQ ID NO: 56503

SEQ ID NO: 674561 - RNA, 64 nt, hsa; identical to SEQ ID NO: 56504

SEQ ID NO: 674562 - RNA, 64 nt, hsa; identical to SEQ ID NO: 56505

SEQ ID NO: 674563 - RNA, 64 nt, hsa; identical to SEQ ID NO: 56506

SEQ ID NO: 674564 - RNA, 64 nt, hsa; identical to SEQ ID NO: 56507

SEQ ID NO: 674565 - RNA, 64 nt, hsa; identical to SEQ ID NO: 56508

SEQ ID NO: 674566 - RNA, 64 nt, hsa; identical to SEQ ID NO: 56509

SEQ ID NO: 674567 - RNA, 64 nt, hsa; identical to SEQ ID NO: 56510

SEQ ID NO: 674568 - RNA, 64 nt, hsa; identical to SEQ ID NO: 56511

SEQ ID NO: 674569 - RNA, 64 nt, hsa; identical to SEQ ID NO: 56512

SEQ ID NO: 674570 - RNA, 64 nt, hsa; identical to SEQ ID NO: 56513

SEQ ID NO: 674571 - RNA, 64 nt, hsa; identical to SEQ ID NO: 56514

SEQ ID NO: 674572 - RNA, 64 nt, hsa; identical to SEQ ID NO: 56515

SEQ ID NO: 674573 - RNA, 64 nt, hsa; identical to SEQ ID NO: 56516

SEQ ID NO: 674574 - RNA, 64 nt, hsa; identical to SEQ ID NO: 56517

SEQ ID NO: 674575 - RNA, 64 nt, hsa; identical to SEQ ID NO: 56518

SEQ ID NO: 674576 - RNA, 64 nt, hsa; identical to SEQ ID NO: 56519

SEQ ID NO: 674577 - RNA, 64 nt, hsa; identical to SEQ ID NO: 56520

SEQ ID NO: 674578 - RNA, 64 nt, hsa; identical to SEQ ID NO: 56521

SEQ ID NO: 674579 - RNA, 64 nt, hsa; identical to SEQ ID NO: 56522

SEQ ID NO: 674580 - RNA, 64 nt, hsa; identical to SEQ ID NO: 56523

SEQ ID NO: 674581 - RNA, 64 nt, hsa; identical to SEQ ID NO: 56524

SEQ ID NO: 674582 - RNA, 64 nt, hsa; identical to SEQ ID NO: 56525

SEQ ID NO: 674583 - RNA, 64 nt, hsa; identical to SEQ ID NO: 56526

SEQ ID NO: 674584 - RNA, 64 nt, hsa; identical to SEQ ID NO: 56527

SEQ ID NO: 674585 - RNA, 64 nt, hsa; identical to SEQ ID NO: 56528

SEQ ID NO: 674586 - RNA, 64 nt, hsa; identical to SEQ ID NO: 56529

SEQ ID NO: 674587 - RNA, 64 nt, hsa; identical to SEQ ID NO: 56530

SEQ ID NO: 674588 - RNA, 64 nt, hsa; identical to SEQ ID NO: 56531

SEQ ID NO: 674589 - RNA, 64 nt, hsa; identical to SEQ ID NO: 56532

SEQ ID NO: 674590 - RNA, 64 nt, hsa; identical to SEQ ID NO: 56533

SEQ ID NO: 674591 - RNA, 64 nt, hsa; identical to SEQ ID NO: 56534

SEQ ID NO: 674592 - RNA, 59 nt, hsa; identical to SEQ ID NO: 56535

SEQ ID NO: 674593 - RNA, 64 nt, hsa; identical to SEQ ID NO: 56536

SEQ ID NO: 674594 - RNA, 64 nt, hsa; identical to SEQ ID NO: 56537

SEQ ID NO: 674595 - RNA, 64 nt, hsa; identical to SEQ ID NO: 56538

SEQ ID NO: 674596 - RNA, 64 nt, hsa; identical to SEQ ID NO: 56539

SEQ ID NO: 674597 - RNA, 64 nt, hsa; identical to SEQ ID NO: 56540

SEQ ID NO: 674598 - RNA, 64 nt, hsa; identical to SEQ ID NO: 56541

SEQ ID NO: 674599 - RNA, 64 nt, hsa; identical to SEQ ID NO: 56542

SEQ ID NO: 674600 - RNA, 64 nt, hsa; identical to SEQ ID NO: 56543

SEQ ID NO: 674601 - RNA, 64 nt, hsa; identical to SEQ ID NO: 56544

SEQ ID NO: 674602 - RNA, 64 nt, hsa; identical to SEQ ID NO: 56545

SEQ ID NO: 674603 - RNA, 64 nt, hsa; identical to SEQ ID NO: 56546

SEQ ID NO: 674604 - RNA, 64 nt, hsa; identical to SEQ ID NO: 56547

SEQ ID NO: 674605 - RNA, 64 nt, hsa; identical to SEQ ID NO: 56548

SEQ ID NO: 674606 - RNA, 64 nt, hsa; identical to SEQ ID NO: 56549

SEQ ID NO: 674607 - RNA, 64 nt, hsa; identical to SEQ ID NO: 56550

SEQ ID NO: 674608 - RNA, 64 nt, hsa; identical to SEQ ID NO: 56551

SEQ ID NO: 674609 - RNA, 64 nt, hsa; identical to SEQ ID NO: 56552

SEQ ID NO: 674610 - RNA, 64 nt, hsa; identical to SEQ ID NO: 56553

SEQ ID NO: 674611 - RNA, 64 nt, hsa; identical to SEQ ID NO: 56554

SEQ ID NO: 674612 - RNA, 64 nt, hsa; identical to SEQ ID NO: 56555

SEQ ID NO: 674613 - RNA, 64 nt, hsa; identical to SEQ ID NO: 56556

SEQ ID NO: 674614 - RNA, 62 nt, hsa; identical to SEQ ID NO: 56557

SEQ ID NO: 674615 - RNA, 58 nt, hsa; identical to SEQ ID NO: 56558

SEQ ID NO: 674616 - RNA, 64 nt, hsa; identical to SEQ ID NO: 56559

SEQ ID NO: 674617 - RNA, 64 nt, hsa; identical to SEQ ID NO: 56560

SEQ ID NO: 674618 - RNA, 64 nt, hsa; identical to SEQ ID NO: 56561

SEQ ID NO: 674619 - RNA, 64 nt, hsa; identical to SEQ ID NO: 56562

SEQ ID NO: 674620 - RNA, 64 nt, hsa; identical to SEQ ID NO: 56563

SEQ ID NO: 674621 - RNA, 64 nt, hsa; identical to SEQ ID NO: 56564

SEQ ID NO: 674622 - RNA, 64 nt, hsa; identical to SEQ ID NO: 56565

SEQ ID NO: 674623 - RNA, 64 nt, hsa; identical to SEQ ID NO: 56566

SEQ ID NO: 674624 - RNA, 64 nt, hsa; identical to SEQ ID NO: 56567

SEQ ID NO: 674625 - RNA, 64 nt, hsa; identical to SEQ ID NO: 56568

SEQ ID NO: 674626 - RNA, 64 nt, hsa; identical to SEQ ID NO: 56569

SEQ ID NO: 674627 - RNA, 64 nt, hsa; identical to SEQ ID NO: 56570

SEQ ID NO: 674628 - RNA, 64 nt, hsa; identical to SEQ ID NO: 56571

SEQ ID NO: 674629 - RNA, 64 nt, hsa; identical to SEQ ID NO: 56572

SEQ ID NO: 674630 - RNA, 64 nt, hsa; identical to SEQ ID NO: 56573

SEQ ID NO: 674631 - RNA, 64 nt, hsa; identical to SEQ ID NO: 56574

SEQ ID NO: 674632 - RNA, 64 nt, hsa; identical to SEQ ID NO: 56575

SEQ ID NO: 674633 - RNA, 64 nt, hsa; identical to SEQ ID NO: 56576

SEQ ID NO: 674634 - RNA, 64 nt, hsa; identical to SEQ ID NO: 56577

SEQ ID NO: 674635 - RNA, 64 nt, hsa; identical to SEQ ID NO: 56578

SEQ ID NO: 674636 - RNA, 64 nt, hsa; identical to SEQ ID NO: 56579

SEQ ID NO: 674637 - RNA, 64 nt, hsa; identical to SEQ ID NO: 56580

SEQ ID NO: 674638 - RNA, 64 nt, hsa; identical to SEQ ID NO: 56581

SEQ ID NO: 674639 - RNA, 64 nt, hsa; identical to SEQ ID NO: 56582

SEQ ID NO: 674640 - RNA, 64 nt, hsa
gguccagggcagucgugugucuuacccagcuacacagggugacauuuuggucuagaaccuaguc

SEQ ID NO: 674641 - RNA, 64 nt, hsa
cuauacccaaggaguccugugauuugagcuucagcagggugaucuacauuugggugcuuguuuc

SEQ ID NO: 674642 - RNA, 64 nt, hsa
uacuuuucaaguacggugucauuuucacagucuccagggugacaaaugccaauagauaugugag

SEQ ID NO: 674643 - RNA, 64 nt, hsa
cuguugaaucauuacaucaaggagcugccccugucagggugaguguaauuaggaacgauaccag

SEQ ID NO: 674644 - RNA, 64 nt, hsa
caguauaaagauacguuugcaaucagugacuacucagggugacacccuugcccuaaagcaggag

SEQ ID NO: 674645 - RNA, 64 nt, hsa
guggcagcucucccuggacuugcccugccuggaacagggugauuugcuggaauggaguuaccac

SEQ ID NO: 674646 - RNA, 64 nt, hsa
ugaaauguuuuacuuuucacuggagaagacaaaacagggugaucuucauguuauuguuuuauac

SEQ ID NO: 674647 - RNA, 64 nt, hsa
uaaccucgauauuaaaaucauccuugacaugaaacagggugaagagaagcuguccguggcggcu

SEQ ID NO: 674648 - RNA, 64 nt, hsa
caugugccuucaggggguuguuacuugagagcuccagggugaagggagaaagccugugcucugg

SEQ ID NO: 674649 - RNA, 64 nt, hsa
aaugugggcuuccuuuaaagggagggggagaagccagggugauagcccagacucugcccuguug

SEQ ID NO: 674650 - RNA, 64 nt, hsa
gggaguggagaguaggguggucuugugaguugugcagggugaagaccgcuucccugagacaggg

SEQ ID NO: 674651 - RNA, 64 nt, hsa
accugccugcccccgggcagcacgggagggagagcagggugagcacgcuuguugguuucagaug

SEQ ID NO: 674652 - RNA, 64 nt, hsa
ugugccuucaguacccagccagguucucuggguccagggugacucuccaaagaaauuggccuuc

SEQ ID NO: 674653 - RNA, 64 nt, hsa
aaugaagguuuggcuacuuguauaggucugccugcagggugaaaaugccagugugaauauucua

SEQ ID NO: 674654 - RNA, 64 nt, hsa
ccaggguggcacuguucacuggcgcugggacagucagggugaccccaccgccuaccucucuaca

SEQ ID NO: 674655 - RNA, 64 nt, hsa
augaggaggguggcaggucuuugcagcucccggccagggugaggcggaagugagcccucauccu

SEQ ID NO: 674656 - RNA, 64 nt, hsa
aaaugccccaguguuauuuauuccccagugacuccagggugacaaggccugcuugacuuuccag

SEQ ID NO: 674657 - RNA, 64 nt, hsa
ucuaagcaaccacacugcuuggcccuucaagggucagggugagacgugaugggcuaggccuccg

SEQ ID NO: 674658 - RNA, 64 nt, hsa; identical to SEQ ID NO: 337076

SEQ ID NO: 674659 - RNA, 64 nt, hsa; identical to SEQ ID NO: 337077

SEQ ID NO: 674660 - RNA, 64 nt, hsa; identical to SEQ ID NO: 337078

SEQ ID NO: 674661 - RNA, 64 nt, hsa; identical to SEQ ID NO: 337079

SEQ ID NO: 674662 - RNA, 64 nt, hsa; identical to SEQ ID NO: 337080

SEQ ID NO: 674663 - RNA, 64 nt, hsa; identical to SEQ ID NO: 337081

SEQ ID NO: 674664 - RNA, 64 nt, hsa; identical to SEQ ID NO: 337082

SEQ ID NO: 674665 - RNA, 64 nt, hsa; identical to SEQ ID NO: 337083

SEQ ID NO: 674666 - RNA, 64 nt, hsa; identical to SEQ ID NO: 337084

SEQ ID NO: 674667 - RNA, 64 nt, hsa; identical to SEQ ID NO: 337085

SEQ ID NO: 674668 - RNA, 64 nt, hsa; identical to SEQ ID NO: 337086

SEQ ID NO: 674669 - RNA, 64 nt, hsa; identical to SEQ ID NO: 337087

SEQ ID NO: 674670 - RNA, 64 nt, hsa; identical to SEQ ID NO: 337088

SEQ ID NO: 674671 - RNA, 64 nt, hsa; identical to SEQ ID NO: 337089

SEQ ID NO: 674672 - RNA, 64 nt, hsa; identical to SEQ ID NO: 337090

SEQ ID NO: 674673 - RNA, 64 nt, hsa; identical to SEQ ID NO: 337091

SEQ ID NO: 674674 - RNA, 64 nt, hsa; identical to SEQ ID NO: 337092

SEQ ID NO: 674675 - RNA, 64 nt, hsa; identical to SEQ ID NO: 337093

SEQ ID NO: 674676 - RNA, 64 nt, hsa; identical to SEQ ID NO: 337094

SEQ ID NO: 674677 - RNA, 64 nt, hsa; identical to SEQ ID NO: 337095

SEQ ID NO: 674678 - RNA, 64 nt, hsa; identical to SEQ ID NO: 337096

SEQ ID NO: 674679 - RNA, 64 nt, hsa; identical to SEQ ID NO: 337097

SEQ ID NO: 674680 - RNA, 64 nt, hsa; identical to SEQ ID NO: 337098

SEQ ID NO: 674681 - RNA, 64 nt, hsa; identical to SEQ ID NO: 337099

SEQ ID NO: 674682 - RNA, 64 nt, hsa; identical to SEQ ID NO: 337100

SEQ ID NO: 674683 - RNA, 64 nt, hsa; identical to SEQ ID NO: 337101

SEQ ID NO: 674684 - RNA, 64 nt, hsa; identical to SEQ ID NO: 337102

SEQ ID NO: 674685 - RNA, 64 nt, hsa; identical to SEQ ID NO: 337103

SEQ ID NO: 674686 - RNA, 64 nt, hsa; identical to SEQ ID NO: 337104

SEQ ID NO: 674687 - RNA, 64 nt, hsa; identical to SEQ ID NO: 337105

SEQ ID NO: 674688 - RNA, 64 nt, hsa; identical to SEQ ID NO: 337106

SEQ ID NO: 674689 - RNA, 64 nt, hsa; identical to SEQ ID NO: 337107

SEQ ID NO: 674690 - RNA, 64 nt, hsa; identical to SEQ ID NO: 337108

SEQ ID NO: 674691 - RNA, 64 nt, hsa; identical to SEQ ID NO: 147421

SEQ ID NO: 674692 - RNA, 64 nt, hsa; identical to SEQ ID NO: 147422

SEQ ID NO: 674693 - RNA, 64 nt, hsa; identical to SEQ ID NO: 147423

SEQ ID NO: 674694 - RNA, 64 nt, hsa; identical to SEQ ID NO: 147424

SEQ ID NO: 674695 - RNA, 64 nt, hsa; identical to SEQ ID NO: 147425

SEQ ID NO: 674696 - RNA, 64 nt, hsa; identical to SEQ ID NO: 147426

SEQ ID NO: 674697 - RNA, 64 nt, hsa; identical to SEQ ID NO: 147427

SEQ ID NO: 674698 - RNA, 64 nt, hsa; identical to SEQ ID NO: 147428

SEQ ID NO: 674699 - RNA, 64 nt, hsa
ggccccuccauuuuccccauuuucuuaucucccugaccaaaauugcuuugacuucuaaauguuu

SEQ ID NO: 674700 - RNA, 64 nt, hsa
aauacucccaggaaauagcgcaggacaucacaaggaccaaaaaggcaauucuuauuuaaauguu

SEQ ID NO: 674701 - RNA, 64 nt, hsa
uccuuucccacuggcucuguauaaaaaacuucuggaccaaaagccaucauuggaagauuuaaaa

SEQ ID NO: 674702 - RNA, 64 nt, hsa
agaugcgcucugcauacgcuuuucuauacacugggaccaaaaugauguugacuuaauuccaaau

SEQ ID NO: 674703 - RNA, 64 nt, hsa
gauucagauggugcacuggccccgggaggagucugaccaaaaauggagcccgcucuguggggaa

SEQ ID NO: 674704 - RNA, 64 nt, hsa
ggcccucaggguggggcacuuagcacccagaagggaccaaaagcagggcauggcggugcagagg

SEQ ID NO: 674705 - RNA, 64 nt, hsa
uauucucagauucaaagaaagagcaacuacuuuggaccaaaagcccauggccuggggagcuggg

SEQ ID NO: 674706 - RNA, 64 nt, hsa
ggauaggguucuaaaggugguuuucuauccaaacgaccaaaaaaccaacaguaacaccagugaa

SEQ ID NO: 674707 - RNA, 64 nt, hsa
uuaugggaccacauaguauaagugguccguuguugaccaaaauguuguuaugcaggcaugacug

SEQ ID NO: 674708 - RNA, 64 nt, hsa
uauagaaacuuaauuauuagacugguaaaauaaagaccaaaauaugcagauuucuaauuggcau

SEQ ID NO: 674709 - RNA, 64 nt, hsa
gaaaacaccaugucauggaguguaggaaagagcagaccaaaaucagcccuagagccaaccaguc

SEQ ID NO: 674710 - RNA, 64 nt, hsa
accaaaggcaacagagucuagcucauggccaccagaccaaaagcauccagcuucugugcaccuc

SEQ ID NO: 674711 - RNA, 64 nt, hsa
uuuucuacccagagaccaagguguucuucccaaagaccaaaauauucuacccauaugucaggac

SEQ ID NO: 674712 - RNA, 64 nt, hsa
uuuucuacccagagaccaagguuaucuuccuaaagaccaaaauauucuacccauaugucaggac

SEQ ID NO: 674713 - RNA, 64 nt, hsa
cagggguuggcugggaggaggaagaccauucugugaccaaaauaccuuggucauuuuuuuuaua

SEQ ID NO: 674714 - RNA, 64 nt, hsa
auuuuuuugaaugaguuuuuuaaauuuuuuagaugaccaaaacuugcagggcaggggaugccca

SEQ ID NO: 674715 - RNA, 64 nt, hsa
acaggaagcacaugauugagaacaucuugggacagaccaaaaccacugacagauggcaaggcuc

SEQ ID NO: 674716 - RNA, 64 nt, hsa
ugaagccugaaauaauuuaggacucugauucacugaccaaaagucaguguugcagagauuucuc

SEQ ID NO: 674717 - RNA, 64 nt, hsa
aggaccccaagagcagugauucagagaacagugugaccaaaaacccacuaagaaaaacagauuc

SEQ ID NO: 674718 - RNA, 64 nt, hsa
ugaugccauggaacucaagcccaacggcggugcugaccaaaaaugucucaaagucaacagccca

SEQ ID NO: 674719 - RNA, 64 nt, hsa
ccacuuggguaugugaauuauucaugucccagaagaccaaaaagugcucugguucugagaugag

SEQ ID NO: 674720 - RNA, 64 nt, hsa
cacacaccugggaaagggaugcugccccaagggggaccaaaagggccggacguuacagggugaa

SEQ ID NO: 674721 - RNA, 64 nt, hsa; identical to SEQ ID NO: 74019

SEQ ID NO: 674722 - RNA, 64 nt, hsa; identical to SEQ ID NO: 74020

SEQ ID NO: 674723 - RNA, 64 nt, hsa; identical to SEQ ID NO: 74021

SEQ ID NO: 674724 - RNA, 64 nt, hsa; identical to SEQ ID NO: 74022

SEQ ID NO: 674725 - RNA, 64 nt, hsa; identical to SEQ ID NO: 74023

SEQ ID NO: 674726 - RNA, 64 nt, hsa; identical to SEQ ID NO: 74024

SEQ ID NO: 674727 - RNA, 64 nt, hsa; identical to SEQ ID NO: 74025

SEQ ID NO: 674728 - RNA, 64 nt, hsa; identical to SEQ ID NO: 74026

SEQ ID NO: 674729 - RNA, 64 nt, hsa; identical to SEQ ID NO: 74027

SEQ ID NO: 674730 - RNA, 64 nt, hsa; identical to SEQ ID NO: 74028

SEQ ID NO: 674731 - RNA, 64 nt, hsa; identical to SEQ ID NO: 74029

SEQ ID NO: 674732 - RNA, 64 nt, hsa; identical to SEQ ID NO: 74030

SEQ ID NO: 674733 - RNA, 64 nt, hsa; identical to SEQ ID NO: 74031

SEQ ID NO: 674734 - RNA, 64 nt, hsa; identical to SEQ ID NO: 74032

SEQ ID NO: 674735 - RNA, 64 nt, hsa; identical to SEQ ID NO: 74033

SEQ ID NO: 674736 - RNA, 64 nt, hsa; identical to SEQ ID NO: 74034

SEQ ID NO: 674737 - RNA, 64 nt, hsa; identical to SEQ ID NO: 74035

SEQ ID NO: 674738 - RNA, 64 nt, hsa; identical to SEQ ID NO: 74036

SEQ ID NO: 674739 - RNA, 64 nt, hsa; identical to SEQ ID NO: 74037

SEQ ID NO: 674740 - RNA, 64 nt, hsa; identical to SEQ ID NO: 74038

SEQ ID NO: 674741 - RNA, 64 nt, hsa; identical to SEQ ID NO: 74039

SEQ ID NO: 674742 - RNA, 64 nt, hsa; identical to SEQ ID NO: 74040

SEQ ID NO: 674743 - RNA, 64 nt, hsa; identical to SEQ ID NO: 74041

SEQ ID NO: 674744 - RNA, 64 nt, hsa; identical to SEQ ID NO: 74042

SEQ ID NO: 674745 - RNA, 64 nt, hsa; identical to SEQ ID NO: 74043

SEQ ID NO: 674746 - RNA, 64 nt, hsa; identical to SEQ ID NO: 74044

SEQ ID NO: 674747 - RNA, 64 nt, hsa; identical to SEQ ID NO: 74045

SEQ ID NO: 674748 - RNA, 64 nt, hsa; identical to SEQ ID NO: 74046

SEQ ID NO: 674749 - RNA, 64 nt, hsa; identical to SEQ ID NO: 74047

SEQ ID NO: 674750 - RNA, 64 nt, hsa; identical to SEQ ID NO: 74048

SEQ ID NO: 674751 - RNA, 64 nt, hsa; identical to SEQ ID NO: 74049

SEQ ID NO: 674752 - RNA, 64 nt, hsa; identical to SEQ ID NO: 74050

SEQ ID NO: 674753 - RNA, 64 nt, hsa; identical to SEQ ID NO: 74051

SEQ ID NO: 674754 - RNA, 64 nt, hsa; identical to SEQ ID NO: 74052

SEQ ID NO: 674755 - RNA, 64 nt, hsa; identical to SEQ ID NO: 74053

SEQ ID NO: 674756 - RNA, 64 nt, hsa; identical to SEQ ID NO: 74054

SEQ ID NO: 674757 - RNA, 64 nt, hsa; identical to SEQ ID NO: 74055

SEQ ID NO: 674758 - RNA, 64 nt, hsa; identical to SEQ ID NO: 74056

SEQ ID NO: 674759 - RNA, 64 nt, hsa; identical to SEQ ID NO: 74057

SEQ ID NO: 674760 - RNA, 64 nt, hsa; identical to SEQ ID NO: 74058

SEQ ID NO: 674761 - RNA, 64 nt, hsa; identical to SEQ ID NO: 74059

SEQ ID NO: 674762 - RNA, 64 nt, hsa; identical to SEQ ID NO: 74060

SEQ ID NO: 674763 - RNA, 64 nt, hsa; identical to SEQ ID NO: 74061

SEQ ID NO: 674764 - RNA, 61 nt, hsa
agacuguuuuugacaauuuuuuuaucaagaaagagcaaauaaaaagcagugguaaugaucc

SEQ ID NO: 674765 - RNA, 61 nt, hsa
acagcucagaauuccagcaguucauccagucagagcaaaaugguuaauugcccaguuuguc

SEQ ID NO: 674766 - RNA, 61 nt, hsa
aaauucuacacaaggcuuucaagaccaucagagagcaaaaccacauguucugucuugagga

SEQ ID NO: 674767 - RNA, 61 nt, hsa
acauguucugucuugaggagccauagcagaaagagcaaauuagucauuauuuacugaacau

SEQ ID NO: 674768 - RNA, 61 nt, hsa
ucuagauuggagugcugcacaaacaaacauaagagcaaagcaaaacuguaucacauagggu

SEQ ID NO: 674769 - RNA, 61 nt, hsa
ugcuggucuugcaaguuugucuaccaguaagagagcaaaguuuccuuccuuucuucucuuu

SEQ ID NO: 674770 - RNA, 61 nt, hsa
uaaguugucacccaauaucuuagacacuuugagagcaaagggggugcuguaaauaaguaua

SEQ ID NO: 674771 - RNA, 61 nt, hsa
cuccaccucagaaauucugaaauggguaguaagagcaaauuuucauuuuaaagcacaccug

SEQ ID NO: 674772 - RNA, 61 nt, hsa
uugugcagugcuguguauggauuuuacucuaagagcaaaggaaagccacugaagaguauaa

SEQ ID NO: 674773 - RNA, 61 nt, hsa
agcuuggggaagagaauuccauacugaaagaagagcaaauacaaaagccugaaggaaagaa

SEQ ID NO: 674774 - RNA, 61 nt, hsa
uaccauauuauuguuuuuaaaaaagcaguuuagagcaaacugucacuaaacuuggauaaau

SEQ ID NO: 674775 - RNA, 61 nt, hsa
uuuaacuauagccuagagaaaagaggguugaagagcaaagcagauuuuuuuuuuccuuuuc

SEQ ID NO: 674776 - RNA, 61 nt, hsa
gaucgugccacuucacuccagccugggcaaaagagcaaaacgccaucucaaaaaauauaca

SEQ ID NO: 674777 - RNA, 61 nt, hsa
uaauaauaaacuuuuucagaaagaauugaguagagcaaaaaugacaaagauguguagcugu

SEQ ID NO: 674778 - RNA, 61 nt, hsa
ggguaaccuagacuucagagagaaugagcagagagcaaaggagaaaucuggcuguccuucc

SEQ ID NO: 674779 - RNA, 61 nt, hsa
uccuccugugucacugaauaucaacucugaaagagcaaaccuaacaggagaaaggacaacc

SEQ ID NO: 674780 - RNA, 61 nt, hsa
accaauauggaauaaagaagaaggcagaaagagagcaaaugaaaaauuucaacuuguauau

SEQ ID NO: 674781 - RNA, 61 nt, hsa
cucugggagcugaagcacacggccauguuggagagcaaaacuuaauaauaauucuuuuuua

SEQ ID NO: 674782 - RNA, 61 nt, hsa
gcuauuuuuguuaauguaaaguaaauauuucagagcaaauuuuuuaaacuuauugcacuaa

SEQ ID NO: 674783 - RNA, 61 nt, hsa
uauauaacuaacaauuguccaaauagaugagagagcaaaucaugugagaaaauucagaaua

SEQ ID NO: 674784 - RNA, 61 nt, hsa
uaugauuuagcuggcaggccagguuuucucaagagcaaaaucacccucuggccccuuggca

SEQ ID NO: 674785 - RNA, 61 nt, hsa
uguguguggauuccagggcaacucuagcaucagagcaaaagccuuggguuucucgcauuca

SEQ ID NO: 674786 - RNA, 61 nt, hsa
aucgcgccauugcacuccagccuggguaacaagagcaaaacucuguccaaaaaaaaaaaaa

SEQ ID NO: 674787 - RNA, 61 nt, hsa
gaugagaguacuaacuggaaaaaggcugaagagagcaaauauauuauuaagauggguugga

SEQ ID NO: 674788 - RNA, 54 nt, hsa; identical to SEQ ID NO: 587659

SEQ ID NO: 674789 - RNA, 61 nt, hsa
gagcauaccacuugaagaaggaaagaaccgaagagcaaacaaaaguucugcguaaugagac

SEQ ID NO: 674790 - RNA, 61 nt, hsa
aguuuuagcggggagggggauaggaagacgcagagcaaaugagcuccggagucccugcagg

SEQ ID NO: 674791 - RNA, 61 nt, hsa
cuuuaaauaagguagaauggaaaaaacccagagagcaaagugcauuacuuaaagaugcagu

SEQ ID NO: 674792 - RNA, 61 nt, hsa
gucccucgccauacacugaugccuggcagcuagagcaaauggcucguguucuuugucgaag

SEQ ID NO: 674793 - RNA, 61 nt, hsa
auuacauuggcaaauaagguuuggaagcagaagagcaaaaaaaagauauuguuaaaaugag

SEQ ID NO: 674794 - RNA, 61 nt, hsa
gguauuuguuaaauacguuuguuuuuauugcagagcaaaaauaaaucaaauuagaagcaau

SEQ ID NO: 674795 - RNA, 61 nt, hsa
aauacaugccacaaggaugaagcuugugaguagagcaaacaaacguuuuuccaaagaauuc

SEQ ID NO: 674796 - RNA, 61 nt, hsa
aucccacaaaauggcccuugguggcagcaauagagcaaagguuaccuuuuuguauggugaa

SEQ ID NO: 674797 - RNA, 61 nt, hsa
ugggcgccucacacucagaaccucauaccccagagcaaaccgauggucagggagagggcua

SEQ ID NO: 674798 - RNA, 61 nt, hsa
accaugccauuacacucaagcuugggcaacgagagcaaaacucugucucaaaaaaaaaauu

SEQ ID NO: 674799 - RNA, 61 nt, hsa
ggagcggacucacuugauguuuccuggaagcagagcaaaaugcucuugucccugucgcguc

SEQ ID NO: 674800 - RNA, 61 nt, hsa
uuccagaaccgacgcaugaaguggaaaaaggagagcaaacugcucagcgcgucucagcuca

SEQ ID NO: 674801 - RNA, 64 nt, hsa; identical to SEQ ID NO: 264152

SEQ ID NO: 674802 - RNA, 64 nt, hsa; identical to SEQ ID NO: 264153

SEQ ID NO: 674803 - RNA, 64 nt, hsa; identical to SEQ ID NO: 264154

SEQ ID NO: 674804 - RNA, 64 nt, hsa; identical to SEQ ID NO: 264155

SEQ ID NO: 674805 - RNA, 64 nt, hsa; identical to SEQ ID NO: 264156

SEQ ID NO: 674806 - RNA, 64 nt, hsa; identical to SEQ ID NO: 264157

SEQ ID NO: 674807 - RNA, 64 nt, hsa; identical to SEQ ID NO: 264158

SEQ ID NO: 674808 - RNA, 64 nt, hsa; identical to SEQ ID NO: 264159

SEQ ID NO: 674809 - RNA, 64 nt, hsa; identical to SEQ ID NO: 264160

SEQ ID NO: 674810 - RNA, 64 nt, hsa; identical to SEQ ID NO: 264161

SEQ ID NO: 674811 - RNA, 64 nt, hsa; identical to SEQ ID NO: 264162

SEQ ID NO: 674812 - RNA, 64 nt, hsa; identical to SEQ ID NO: 264163

SEQ ID NO: 674813 - RNA, 64 nt, hsa; identical to SEQ ID NO: 264164

SEQ ID NO: 674814 - RNA, 64 nt, hsa; identical to SEQ ID NO: 264165

SEQ ID NO: 674815 - RNA, 64 nt, hsa; identical to SEQ ID NO: 264166

SEQ ID NO: 674816 - RNA, 64 nt, hsa; identical to SEQ ID NO: 264167

SEQ ID NO: 674817 - RNA, 64 nt, hsa; identical to SEQ ID NO: 264168

SEQ ID NO: 674818 - RNA, 64 nt, hsa; identical to SEQ ID NO: 264169

SEQ ID NO: 674819 - RNA, 64 nt, hsa; identical to SEQ ID NO: 264170

SEQ ID NO: 674820 - RNA, 64 nt, hsa; identical to SEQ ID NO: 264171

SEQ ID NO: 674821 - RNA, 64 nt, hsa; identical to SEQ ID NO: 520094

SEQ ID NO: 674822 - RNA, 64 nt, hsa; identical to SEQ ID NO: 520095

SEQ ID NO: 674823 - RNA, 64 nt, hsa; identical to SEQ ID NO: 520096

SEQ ID NO: 674824 - RNA, 64 nt, hsa; identical to SEQ ID NO: 520097

SEQ ID NO: 674825 - RNA, 64 nt, hsa; identical to SEQ ID NO: 520098

SEQ ID NO: 674826 - RNA, 64 nt, hsa; identical to SEQ ID NO: 520099

SEQ ID NO: 674827 - RNA, 64 nt, hsa; identical to SEQ ID NO: 520100

SEQ ID NO: 674828 - RNA, 64 nt, hsa; identical to SEQ ID NO: 520101

SEQ ID NO: 674829 - RNA, 64 nt, hsa; identical to SEQ ID NO: 520102

SEQ ID NO: 674830 - RNA, 64 nt, hsa; identical to SEQ ID NO: 520103

SEQ ID NO: 674831 - RNA, 64 nt, hsa; identical to SEQ ID NO: 520104

SEQ ID NO: 674832 - RNA, 64 nt, hsa; identical to SEQ ID NO: 520105

SEQ ID NO: 674833 - RNA, 64 nt, hsa; identical to SEQ ID NO: 520106

SEQ ID NO: 674834 - RNA, 64 nt, hsa; identical to SEQ ID NO: 520107

SEQ ID NO: 674835 - RNA, 64 nt, hsa; identical to SEQ ID NO: 520108

SEQ ID NO: 674836 - RNA, 64 nt, hsa; identical to SEQ ID NO: 520109

SEQ ID NO: 674837 - RNA, 64 nt, hsa; identical to SEQ ID NO: 520110

SEQ ID NO: 674838 - RNA, 64 nt, hsa; identical to SEQ ID NO: 520111

SEQ ID NO: 674839 - RNA, 64 nt, hsa; identical to SEQ ID NO: 520112

SEQ ID NO: 674840 - RNA, 64 nt, hsa; identical to SEQ ID NO: 150737

SEQ ID NO: 674841 - RNA, 64 nt, hsa; identical to SEQ ID NO: 150738

SEQ ID NO: 674842 - RNA, 64 nt, hsa; identical to SEQ ID NO: 201973

SEQ ID NO: 674843 - RNA, 64 nt, hsa; identical to SEQ ID NO: 201974

SEQ ID NO: 674844 - RNA, 64 nt, hsa; identical to SEQ ID NO: 201975

SEQ ID NO: 674845 - RNA, 64 nt, hsa; identical to SEQ ID NO: 201976

SEQ ID NO: 674846 - RNA, 64 nt, hsa; identical to SEQ ID NO: 201977

SEQ ID NO: 674847 - RNA, 64 nt, hsa; identical to SEQ ID NO: 201978

SEQ ID NO: 674848 - RNA, 64 nt, hsa; identical to SEQ ID NO: 201979

SEQ ID NO: 674849 - RNA, 64 nt, hsa; identical to SEQ ID NO: 201980

SEQ ID NO: 674850 - RNA, 64 nt, hsa; identical to SEQ ID NO: 201981

SEQ ID NO: 674851 - RNA, 64 nt, hsa; identical to SEQ ID NO: 201982

SEQ ID NO: 674852 - RNA, 64 nt, hsa; identical to SEQ ID NO: 201983

SEQ ID NO: 674853 - RNA, 64 nt, hsa; identical to SEQ ID NO: 201984

SEQ ID NO: 674854 - RNA, 64 nt, hsa; identical to SEQ ID NO: 201985

SEQ ID NO: 674855 - RNA, 64 nt, hsa; identical to SEQ ID NO: 201986

SEQ ID NO: 674856 - RNA, 64 nt, hsa; identical to SEQ ID NO: 201987

SEQ ID NO: 674857 - RNA, 64 nt, hsa; identical to SEQ ID NO: 201988

SEQ ID NO: 674858 - RNA, 64 nt, hsa; identical to SEQ ID NO: 201989

SEQ ID NO: 674859 - RNA, 64 nt, hsa; identical to SEQ ID NO: 201990

SEQ ID NO: 674860 - RNA, 64 nt, hsa; identical to SEQ ID NO: 201991

SEQ ID NO: 674861 - RNA, 64 nt, hsa; identical to SEQ ID NO: 201992

SEQ ID NO: 674862 - RNA, 64 nt, hsa; identical to SEQ ID NO: 201993

SEQ ID NO: 674863 - RNA, 64 nt, hsa; identical to SEQ ID NO: 201994

SEQ ID NO: 674864 - RNA, 64 nt, hsa; identical to SEQ ID NO: 201995

SEQ ID NO: 674865 - RNA, 64 nt, hsa; identical to SEQ ID NO: 201996

SEQ ID NO: 674866 - RNA, 64 nt, hsa; identical to SEQ ID NO: 201997

SEQ ID NO: 674867 - RNA, 64 nt, hsa; identical to SEQ ID NO: 201998

SEQ ID NO: 674868 - RNA, 64 nt, hsa; identical to SEQ ID NO: 201999

SEQ ID NO: 674869 - RNA, 64 nt, hsa; identical to SEQ ID NO: 202000

SEQ ID NO: 674870 - RNA, 64 nt, hsa; identical to SEQ ID NO: 202001

SEQ ID NO: 674871 - RNA, 64 nt, hsa; identical to SEQ ID NO: 202002

SEQ ID NO: 674872 - RNA, 64 nt, hsa; identical to SEQ ID NO: 202003

SEQ ID NO: 674873 - RNA, 64 nt, hsa; identical to SEQ ID NO: 202004

SEQ ID NO: 674874 - RNA, 64 nt, hsa; identical to SEQ ID NO: 202005

SEQ ID NO: 674875 - RNA, 64 nt, hsa; identical to SEQ ID NO: 202006

SEQ ID NO: 674876 - RNA, 64 nt, hsa; identical to SEQ ID NO: 99150

SEQ ID NO: 674877 - RNA, 64 nt, hsa; identical to SEQ ID NO: 99151

SEQ ID NO: 674878 - RNA, 64 nt, hsa; identical to SEQ ID NO: 99152

SEQ ID NO: 674879 - RNA, 64 nt, hsa; identical to SEQ ID NO: 99153

SEQ ID NO: 674880 - RNA, 64 nt, hsa
ugacaguuucugauugcccugagcaccaggucucaucuugcaucucauccuggccuggagaaca

SEQ ID NO: 674881 - RNA, 64 nt, hsa
gggugcuuauuuaucuguuugccaugcagaaaauaucuugcacaaaauuaccucuguuaaggaa

SEQ ID NO: 674882 - RNA, 64 nt, hsa
caguugggauacuuuaaucagaaaaaaagaacuuaucuugcagcauuuuaucaacaaauuucau

SEQ ID NO: 674883 - RNA, 64 nt, hsa
ccuaacaacucacugcagugcucuucauagacacaucuugcagcauuuuucuuaaggcuaugcu

SEQ ID NO: 674884 - RNA, 64 nt, hsa
gaagcugcauuuuuaggauugcccaucuuaagagaucuugcaggaagagauuguauuagauauu

SEQ ID NO: 674885 - RNA, 64 nt, hsa
auuuaauuuacauucauaaacuacuauauuucccaucuugcaaaucauuuuaugucucaucugu

SEQ ID NO: 674886 - RNA, 64 nt, hsa
uuuuuuccuagucauugggaauguagagcaguguaucuugcaugucaucggaagaauagauuuu

SEQ ID NO: 674887 - RNA, 64 nt, hsa
ugugauuuuuccaguauuaaacaugcaugcauuaaucuugcaguuuauuuucucauuguguaug

SEQ ID NO: 674888 - RNA, 64 nt, hsa
cuuuucuagucuguccacacagggauuaccugucaucuugcaugcaaucaggagaaucucauag

SEQ ID NO: 674889 - RNA, 64 nt, hsa
cccgggucuccugcugcacagagcugaacuuuguaucuugcaaugcgcuggcugccucccugug

SEQ ID NO: 674890 - RNA, 64 nt, hsa
aaacuggaaacagaauuggaaaacugccugacuuaucuugcaucccuuugaaugaguuuacaga

SEQ ID NO: 674891 - RNA, 64 nt, hsa
ccuuauccuuuugaaaaggucuucugacacacuuaucuugcacaaagaaaaagaaaauuucuuu

SEQ ID NO: 674892 - RNA, 64 nt, hsa; identical to SEQ ID NO: 56583

SEQ ID NO: 674893 - RNA, 64 nt, hsa; identical to SEQ ID NO: 56584

SEQ ID NO: 674894 - RNA, 64 nt, hsa; identical to SEQ ID NO: 56585

SEQ ID NO: 674895 - RNA, 64 nt, hsa; identical to SEQ ID NO: 56586

SEQ ID NO: 674896 - RNA, 64 nt, hsa; identical to SEQ ID NO: 56587

SEQ ID NO: 674897 - RNA, 64 nt, hsa; identical to SEQ ID NO: 56588

SEQ ID NO: 674898 - RNA, 64 nt, hsa; identical to SEQ ID NO: 56589

SEQ ID NO: 674899 - RNA, 64 nt, hsa; identical to SEQ ID NO: 56590

SEQ ID NO: 674900 - RNA, 64 nt, hsa; identical to SEQ ID NO: 56591

SEQ ID NO: 674901 - RNA, 64 nt, hsa; identical to SEQ ID NO: 56592

SEQ ID NO: 674902 - RNA, 64 nt, hsa; identical to SEQ ID NO: 56593

SEQ ID NO: 674903 - RNA, 64 nt, hsa; identical to SEQ ID NO: 56594

SEQ ID NO: 674904 - RNA, 64 nt, hsa; identical to SEQ ID NO: 56595

SEQ ID NO: 674905 - RNA, 64 nt, hsa; identical to SEQ ID NO: 56596

SEQ ID NO: 674906 - RNA, 64 nt, hsa; identical to SEQ ID NO: 56597

SEQ ID NO: 674907 - RNA, 64 nt, hsa; identical to SEQ ID NO: 56598

SEQ ID NO: 674908 - RNA, 60 nt, hsa
uuuaugaguaaugcuuggaauaaaaacucuuaaggcaacucacugauuuacuucuagcaa

SEQ ID NO: 674909 - RNA, 60 nt, hsa
guauuguauauaauagaucagcgauuuuuguaaggcaaacagaauuuguaaguuggcaga

SEQ ID NO: 674910 - RNA, 60 nt, hsa
aaucuggacucucuggcuugcugugaccccuaaggcaaugcuucucuucccuggauuccu

SEQ ID NO: 674911 - RNA, 60 nt, hsa
guggauuucauuuuguagcugcugagauguuaaggcaagccucagcaucugccccugcug

SEQ ID NO: 674912 - RNA, 64 nt, hsa
uuguuaauagucuuacccuccuugaaacacuugaacacuugaugacuuuagcuuugaggagaua

SEQ ID NO: 674913 - RNA, 64 nt, hsa
cuaaguccuuguuaauagucuuacccuccuugaaacacuugaacacuugaugacuuuagcuuug

SEQ ID NO: 674914 - RNA, 64 nt, hsa
ugcaaagaguaguuuacaucuucacuuucugaagacacuugaauuuaggaccgauguaucugug

SEQ ID NO: 674915 - RNA, 64 nt, hsa
uuucuuuuuaauacaaaaaaauguauaaaaauaaacacuugaaaaggcaaaauacuggcugguc

SEQ ID NO: 674916 - RNA, 64 nt, hsa
gccccuccucccugagggagcauggcacagccucacacuugaaagacgguguuugguuucccau

SEQ ID NO: 674917 - RNA, 64 nt, hsa
aggguggaggaauagacuucuaguucauucugggacacuugagccagagaguugaaagcuugga

SEQ ID NO: 674918 - RNA, 64 nt, hsa
aggggugggugucagggaucacuugggaucuuugacacuugaaaaauuacaccuggcagcugcg

SEQ ID NO: 674919 - RNA, 64 nt, hsa
uuacaugaagauaagauacucacuguucaugaauacacuugauguucaaguauuaagaccuaug

SEQ ID NO: 674920 - RNA, 64 nt, hsa
aaaagauaaaucucaacuuuaauaaguuauccugacacuugauaaaaauaaauauuugguauuu

SEQ ID NO: 674921 - RNA, 64 nt, hsa
acugucgaaguauuccuucuuuuaauuauuuuagacacuugaguucuaguuaaaucuuaaccau

SEQ ID NO: 674922 - RNA, 64 nt, hsa
gcacagggcaucaacauggccaacagcauugccaaccugagacugaaggccaaggaauauaguu

SEQ ID NO: 674923 - RNA, 64 nt, hsa
ugucacagacuauuugguagaagaaauauuuuucaccugagagaggaagagaaauuucucuagu

SEQ ID NO: 674924 - RNA, 64 nt, hsa
uauuaguguguucucaugcuguugauaaagacacaccugagaugguaauuuguaaagaaaaagg

SEQ ID NO: 674925 - RNA, 64 nt, hsa
aauuccuaaggagaaacagagugaggccuuuuuaaccugagauuacagauacuuauaaaacccu

SEQ ID NO: 674926 - RNA, 64 nt, hsa
agccuuucaauaaaaguuaugcacaaaugugaacaccugagauggagcugaacauuucuucacu

SEQ ID NO: 674927 - RNA, 64 nt, hsa
gcuuugugaguacacagcuaacagaugcgucgagaccugagaugugcucguuuuuauuccuccu

SEQ ID NO: 674928 - RNA, 64 nt, hsa
ccuuccucccaguaagaagggaaggugggugggcaccugagagauuaagacuauucucccaguc

SEQ ID NO: 674929 - RNA, 64 nt, hsa
ucugagggcucaggccuccaccugagagguuauaaccugagagacagcucuacccuuccuccca

SEQ ID NO: 674930 - RNA, 64 nt, hsa
uacuaggcaguagggucugagggcucaggccuccaccugagagguuauaaccugagagacagcu

SEQ ID NO: 674931 - RNA, 64 nt, hsa
cccccauccaacccuuagacucacgaacaaauccaccugagaucagcagagccacccuagauca

SEQ ID NO: 674932 - RNA, 64 nt, hsa
aguaaaaagggaacaucagggucaaauggaaaucaccugagacaggaaacagggaguucauuug

SEQ ID NO: 674933 - RNA, 64 nt, hsa
ugucccuccgucccagggggcugugcuagcacagaccugagaauggggacacaggucauucaga

SEQ ID NO: 674934 - RNA, 64 nt, hsa
uggggcugugggcucagagcucaggagucgccuuaccugagagagauguucuagcugagagggc

SEQ ID NO: 674935 - RNA, 64 nt, hsa
gaacuucugggccuugcuggugaugguuaaaacaaccugagauggagaggccaggagagaguau

SEQ ID NO: 674936 - RNA, 64 nt, hsa
ggauagcagcaaaccaccuaucuggccccaacacaccugagagaauucagcagcccagacugag

SEQ ID NO: 674937 - RNA, 64 nt, hsa
ccuggugugagaaucaaccaggcuuuccugcuccaccugagauaaccaacucccucccguaauc

SEQ ID NO: 674938 - RNA, 64 nt, hsa
cgccacagaggaagcugccugccggaggacccccaccugagagauggaugagcugcuccaaagg

SEQ ID NO: 674939 - RNA, 64 nt, hsa; identical to SEQ ID NO: 179154

SEQ ID NO: 674940 - RNA, 64 nt, hsa; identical to SEQ ID NO: 179155

SEQ ID NO: 674941 - RNA, 64 nt, hsa; identical to SEQ ID NO: 179156

SEQ ID NO: 674942 - RNA, 64 nt, hsa; identical to SEQ ID NO: 179157

SEQ ID NO: 674943 - RNA, 64 nt, hsa; identical to SEQ ID NO: 179158

SEQ ID NO: 674944 - RNA, 64 nt, hsa; identical to SEQ ID NO: 179159

SEQ ID NO: 674945 - RNA, 64 nt, hsa; identical to SEQ ID NO: 179160

SEQ ID NO: 674946 - RNA, 64 nt, hsa; identical to SEQ ID NO: 179161

SEQ ID NO: 674947 - RNA, 64 nt, hsa; identical to SEQ ID NO: 179162

SEQ ID NO: 674948 - RNA, 64 nt, hsa; identical to SEQ ID NO: 179163

SEQ ID NO: 674949 - RNA, 64 nt, hsa; identical to SEQ ID NO: 179164

SEQ ID NO: 674950 - RNA, 64 nt, hsa; identical to SEQ ID NO: 179165

SEQ ID NO: 674951 - RNA, 64 nt, hsa; identical to SEQ ID NO: 179166

SEQ ID NO: 674952 - RNA, 64 nt, hsa; identical to SEQ ID NO: 179167

SEQ ID NO: 674953 - RNA, 64 nt, hsa; identical to SEQ ID NO: 179168

SEQ ID NO: 674954 - RNA, 64 nt, hsa; identical to SEQ ID NO: 179169

SEQ ID NO: 674955 - RNA, 64 nt, hsa; identical to SEQ ID NO: 179170

SEQ ID NO: 674956 - RNA, 64 nt, hsa; identical to SEQ ID NO: 179171

SEQ ID NO: 674957 - RNA, 64 nt, hsa; identical to SEQ ID NO: 179172

SEQ ID NO: 674958 - RNA, 64 nt, hsa; identical to SEQ ID NO: 179173

SEQ ID NO: 674959 - RNA, 64 nt, hsa; identical to SEQ ID NO: 179174

SEQ ID NO: 674960 - RNA, 64 nt, hsa; identical to SEQ ID NO: 179175

SEQ ID NO: 674961 - RNA, 64 nt, hsa; identical to SEQ ID NO: 179176

SEQ ID NO: 674962 - RNA, 64 nt, hsa; identical to SEQ ID NO: 179177

SEQ ID NO: 674963 - RNA, 64 nt, hsa; identical to SEQ ID NO: 179178

SEQ ID NO: 674964 - RNA, 64 nt, hsa; identical to SEQ ID NO: 179179

SEQ ID NO: 674965 - RNA, 64 nt, hsa; identical to SEQ ID NO: 179180

SEQ ID NO: 674966 - RNA, 64 nt, hsa; identical to SEQ ID NO: 179181

SEQ ID NO: 674967 - RNA, 64 nt, hsa; identical to SEQ ID NO: 179182

SEQ ID NO: 674968 - RNA, 64 nt, hsa; identical to SEQ ID NO: 179183

SEQ ID NO: 674969 - RNA, 64 nt, hsa; identical to SEQ ID NO: 179184

SEQ ID NO: 674970 - RNA, 64 nt, hsa; identical to SEQ ID NO: 179185

SEQ ID NO: 674971 - RNA, 64 nt, hsa; identical to SEQ ID NO: 179186

SEQ ID NO: 674972 - RNA, 64 nt, hsa; identical to SEQ ID NO: 179187

SEQ ID NO: 674973 - RNA, 64 nt, hsa; identical to SEQ ID NO: 179188

SEQ ID NO: 674974 - RNA, 64 nt, hsa; identical to SEQ ID NO: 179189

SEQ ID NO: 674975 - RNA, 64 nt, hsa; identical to SEQ ID NO: 179190

SEQ ID NO: 674976 - RNA, 64 nt, hsa; identical to SEQ ID NO: 179191

SEQ ID NO: 674977 - RNA, 64 nt, hsa; identical to SEQ ID NO: 179192

SEQ ID NO: 674978 - RNA, 64 nt, hsa; identical to SEQ ID NO: 179193

SEQ ID NO: 674979 - RNA, 64 nt, hsa; identical to SEQ ID NO: 179194

SEQ ID NO: 674980 - RNA, 64 nt, hsa; identical to SEQ ID NO: 179195

SEQ ID NO: 674981 - RNA, 64 nt, hsa; identical to SEQ ID NO: 179196

SEQ ID NO: 674982 - RNA, 64 nt, hsa; identical to SEQ ID NO: 179197

SEQ ID NO: 674983 - RNA, 64 nt, hsa; identical to SEQ ID NO: 179198

SEQ ID NO: 674984 - RNA, 64 nt, hsa; identical to SEQ ID NO: 179199

SEQ ID NO: 674985 - RNA, 64 nt, hsa; identical to SEQ ID NO: 179200

SEQ ID NO: 674986 - RNA, 64 nt, hsa; identical to SEQ ID NO: 179201

SEQ ID NO: 674987 - RNA, 64 nt, hsa; identical to SEQ ID NO: 179202

SEQ ID NO: 674988 - RNA, 64 nt, hsa; identical to SEQ ID NO: 179203

SEQ ID NO: 674989 - RNA, 64 nt, hsa; identical to SEQ ID NO: 179204

SEQ ID NO: 674990 - RNA, 64 nt, hsa; identical to SEQ ID NO: 179205

SEQ ID NO: 674991 - RNA, 64 nt, hsa; identical to SEQ ID NO: 179206

SEQ ID NO: 674992 - RNA, 64 nt, hsa; identical to SEQ ID NO: 179207

SEQ ID NO: 674993 - RNA, 64 nt, hsa; identical to SEQ ID NO: 179208

SEQ ID NO: 674994 - RNA, 64 nt, hsa; identical to SEQ ID NO: 179209

SEQ ID NO: 674995 - RNA, 64 nt, hsa; identical to SEQ ID NO: 179210

SEQ ID NO: 674996 - RNA, 64 nt, hsa; identical to SEQ ID NO: 179211

SEQ ID NO: 674997 - RNA, 64 nt, hsa; identical to SEQ ID NO: 179212

SEQ ID NO: 674998 - RNA, 64 nt, hsa; identical to SEQ ID NO: 179213

SEQ ID NO: 674999 - RNA, 64 nt, hsa; identical to SEQ ID NO: 179214

SEQ ID NO: 675000 - RNA, 64 nt, hsa; identical to SEQ ID NO: 179215

SEQ ID NO: 675001 - RNA, 64 nt, hsa; identical to SEQ ID NO: 179216

SEQ ID NO: 675002 - RNA, 64 nt, hsa; identical to SEQ ID NO: 179217

SEQ ID NO: 675003 - RNA, 64 nt, hsa; identical to SEQ ID NO: 179218

SEQ ID NO: 675004 - RNA, 64 nt, hsa; identical to SEQ ID NO: 179219

SEQ ID NO: 675005 - RNA, 64 nt, hsa; identical to SEQ ID NO: 179220

SEQ ID NO: 675006 - RNA, 64 nt, hsa; identical to SEQ ID NO: 179221

SEQ ID NO: 675007 - RNA, 64 nt, hsa; identical to SEQ ID NO: 179222

SEQ ID NO: 675008 - RNA, 64 nt, hsa; identical to SEQ ID NO: 179223

SEQ ID NO: 675009 - RNA, 64 nt, hsa; identical to SEQ ID NO: 179224

SEQ ID NO: 675010 - RNA, 64 nt, hsa; identical to SEQ ID NO: 179225

SEQ ID NO: 675011 - RNA, 64 nt, hsa; identical to SEQ ID NO: 179226

SEQ ID NO: 675012 - RNA, 64 nt, hsa; identical to SEQ ID NO: 179227

SEQ ID NO: 675013 - RNA, 64 nt, hsa; identical to SEQ ID NO: 179228

SEQ ID NO: 675014 - RNA, 64 nt, hsa; identical to SEQ ID NO: 179229

SEQ ID NO: 675015 - RNA, 64 nt, hsa; identical to SEQ ID NO: 179230

SEQ ID NO: 675016 - RNA, 64 nt, hsa; identical to SEQ ID NO: 179231

SEQ ID NO: 675017 - RNA, 64 nt, hsa; identical to SEQ ID NO: 179232

SEQ ID NO: 675018 - RNA, 64 nt, hsa; identical to SEQ ID NO: 179233

SEQ ID NO: 675019 - RNA, 64 nt, hsa; identical to SEQ ID NO: 179234

SEQ ID NO: 675020 - RNA, 64 nt, hsa; identical to SEQ ID NO: 179235

SEQ ID NO: 675021 - RNA, 57 nt, hsa; identical to SEQ ID NO: 179236

SEQ ID NO: 675022 - RNA, 64 nt, hsa; identical to SEQ ID NO: 179237

SEQ ID NO: 675023 - RNA, 64 nt, hsa; identical to SEQ ID NO: 179238

SEQ ID NO: 675024 - RNA, 64 nt, hsa; identical to SEQ ID NO: 179239

SEQ ID NO: 675025 - RNA, 64 nt, hsa; identical to SEQ ID NO: 179240

SEQ ID NO: 675026 - RNA, 64 nt, hsa; identical to SEQ ID NO: 179241

SEQ ID NO: 675027 - RNA, 57 nt, hsa; identical to SEQ ID NO: 179242

SEQ ID NO: 675028 - RNA, 64 nt, hsa; identical to SEQ ID NO: 179243

SEQ ID NO: 675029 - RNA, 64 nt, hsa; identical to SEQ ID NO: 179244

SEQ ID NO: 675030 - RNA, 64 nt, hsa; identical to SEQ ID NO: 179245

SEQ ID NO: 675031 - RNA, 64 nt, hsa; identical to SEQ ID NO: 179246

SEQ ID NO: 675032 - RNA, 64 nt, hsa; identical to SEQ ID NO: 179247

SEQ ID NO: 675033 - RNA, 64 nt, hsa; identical to SEQ ID NO: 179248

SEQ ID NO: 675034 - RNA, 64 nt, hsa; identical to SEQ ID NO: 179249

SEQ ID NO: 675035 - RNA, 64 nt, hsa; identical to SEQ ID NO: 179250

SEQ ID NO: 675036 - RNA, 64 nt, hsa; identical to SEQ ID NO: 179251

SEQ ID NO: 675037 - RNA, 64 nt, hsa; identical to SEQ ID NO: 179252

SEQ ID NO: 675038 - RNA, 64 nt, hsa; identical to SEQ ID NO: 179253

SEQ ID NO: 675039 - RNA, 64 nt, hsa; identical to SEQ ID NO: 179254

SEQ ID NO: 675040 - RNA, 64 nt, hsa; identical to SEQ ID NO: 179255

SEQ ID NO: 675041 - RNA, 64 nt, hsa; identical to SEQ ID NO: 179256

SEQ ID NO: 675042 - RNA, 64 nt, hsa; identical to SEQ ID NO: 179257

SEQ ID NO: 675043 - RNA, 64 nt, hsa; identical to SEQ ID NO: 179258

SEQ ID NO: 675044 - RNA, 64 nt, hsa; identical to SEQ ID NO: 179259

SEQ ID NO: 675045 - RNA, 64 nt, hsa; identical to SEQ ID NO: 179260

SEQ ID NO: 675046 - RNA, 64 nt, hsa; identical to SEQ ID NO: 179261

SEQ ID NO: 675047 - RNA, 64 nt, hsa; identical to SEQ ID NO: 179262

SEQ ID NO: 675048 - RNA, 64 nt, hsa; identical to SEQ ID NO: 179263

SEQ ID NO: 675049 - RNA, 64 nt, hsa; identical to SEQ ID NO: 179264

SEQ ID NO: 675050 - RNA, 64 nt, hsa; identical to SEQ ID NO: 179265

SEQ ID NO: 675051 - RNA, 64 nt, hsa; identical to SEQ ID NO: 179266

SEQ ID NO: 675052 - RNA, 64 nt, hsa; identical to SEQ ID NO: 179267

SEQ ID NO: 675053 - RNA, 64 nt, hsa; identical to SEQ ID NO: 179268

SEQ ID NO: 675054 - RNA, 64 nt, hsa; identical to SEQ ID NO: 179269

SEQ ID NO: 675055 - RNA, 64 nt, hsa; identical to SEQ ID NO: 179270

SEQ ID NO: 675056 - RNA, 64 nt, hsa; identical to SEQ ID NO: 179271

SEQ ID NO: 675057 - RNA, 64 nt, hsa; identical to SEQ ID NO: 179272

SEQ ID NO: 675058 - RNA, 64 nt, hsa; identical to SEQ ID NO: 179273

SEQ ID NO: 675059 - RNA, 64 nt, hsa; identical to SEQ ID NO: 179274

SEQ ID NO: 675060 - RNA, 64 nt, hsa; identical to SEQ ID NO: 179275

SEQ ID NO: 675061 - RNA, 64 nt, hsa; identical to SEQ ID NO: 179276

SEQ ID NO: 675062 - RNA, 64 nt, hsa; identical to SEQ ID NO: 179277

SEQ ID NO: 675063 - RNA, 64 nt, hsa; identical to SEQ ID NO: 179278

SEQ ID NO: 675064 - RNA, 64 nt, hsa; identical to SEQ ID NO: 179279

SEQ ID NO: 675065 - RNA, 64 nt, hsa; identical to SEQ ID NO: 179280

SEQ ID NO: 675066 - RNA, 64 nt, hsa; identical to SEQ ID NO: 179281

SEQ ID NO: 675067 - RNA, 64 nt, hsa; identical to SEQ ID NO: 179282

SEQ ID NO: 675068 - RNA, 64 nt, hsa; identical to SEQ ID NO: 179283

SEQ ID NO: 675069 - RNA, 64 nt, hsa; identical to SEQ ID NO: 179284

SEQ ID NO: 675070 - RNA, 64 nt, hsa; identical to SEQ ID NO: 179285

SEQ ID NO: 675071 - RNA, 64 nt, hsa; identical to SEQ ID NO: 179286

SEQ ID NO: 675072 - RNA, 64 nt, hsa; identical to SEQ ID NO: 179287

SEQ ID NO: 675073 - RNA, 64 nt, hsa; identical to SEQ ID NO: 179288

SEQ ID NO: 675074 - RNA, 64 nt, hsa; identical to SEQ ID NO: 179289

SEQ ID NO: 675075 - RNA, 64 nt, hsa; identical to SEQ ID NO: 179290

SEQ ID NO: 675076 - RNA, 64 nt, hsa; identical to SEQ ID NO: 179291

SEQ ID NO: 675077 - RNA, 64 nt, hsa; identical to SEQ ID NO: 179292

SEQ ID NO: 675078 - RNA, 64 nt, hsa; identical to SEQ ID NO: 179293

SEQ ID NO: 675079 - RNA, 64 nt, hsa; identical to SEQ ID NO: 179294

SEQ ID NO: 675080 - RNA, 64 nt, hsa; identical to SEQ ID NO: 179295

SEQ ID NO: 675081 - RNA, 64 nt, hsa; identical to SEQ ID NO: 179296

SEQ ID NO: 675082 - RNA, 64 nt, hsa; identical to SEQ ID NO: 179297

SEQ ID NO: 675083 - RNA, 64 nt, hsa; identical to SEQ ID NO: 179298

SEQ ID NO: 675084 - RNA, 64 nt, hsa; identical to SEQ ID NO: 179299

SEQ ID NO: 675085 - RNA, 64 nt, hsa; identical to SEQ ID NO: 179300

SEQ ID NO: 675086 - RNA, 64 nt, hsa; identical to SEQ ID NO: 179301

SEQ ID NO: 675087 - RNA, 64 nt, hsa; identical to SEQ ID NO: 179302

SEQ ID NO: 675088 - RNA, 64 nt, hsa; identical to SEQ ID NO: 179303

SEQ ID NO: 675089 - RNA, 64 nt, hsa; identical to SEQ ID NO: 179304

SEQ ID NO: 675090 - RNA, 64 nt, hsa; identical to SEQ ID NO: 179305

SEQ ID NO: 675091 - RNA, 64 nt, hsa; identical to SEQ ID NO: 179306

SEQ ID NO: 675092 - RNA, 64 nt, hsa; identical to SEQ ID NO: 179307

SEQ ID NO: 675093 - RNA, 64 nt, hsa; identical to SEQ ID NO: 179308

SEQ ID NO: 675094 - RNA, 64 nt, hsa; identical to SEQ ID NO: 179309

SEQ ID NO: 675095 - RNA, 64 nt, hsa; identical to SEQ ID NO: 179310

SEQ ID NO: 675096 - RNA, 64 nt, hsa; identical to SEQ ID NO: 179311

SEQ ID NO: 675097 - RNA, 64 nt, hsa; identical to SEQ ID NO: 179312

SEQ ID NO: 675098 - RNA, 64 nt, hsa; identical to SEQ ID NO: 179313

SEQ ID NO: 675099 - RNA, 64 nt, hsa; identical to SEQ ID NO: 179314

SEQ ID NO: 675100 - RNA, 64 nt, hsa; identical to SEQ ID NO: 179315

SEQ ID NO: 675101 - RNA, 64 nt, hsa; identical to SEQ ID NO: 179316

SEQ ID NO: 675102 - RNA, 64 nt, hsa; identical to SEQ ID NO: 179317

SEQ ID NO: 675103 - RNA, 64 nt, hsa; identical to SEQ ID NO: 179318

SEQ ID NO: 675104 - RNA, 64 nt, hsa; identical to SEQ ID NO: 179319

SEQ ID NO: 675105 - RNA, 64 nt, hsa; identical to SEQ ID NO: 179320

SEQ ID NO: 675106 - RNA, 64 nt, hsa; identical to SEQ ID NO: 179321

SEQ ID NO: 675107 - RNA, 64 nt, hsa; identical to SEQ ID NO: 179322

SEQ ID NO: 675108 - RNA, 64 nt, hsa; identical to SEQ ID NO: 179323

SEQ ID NO: 675109 - RNA, 64 nt, hsa; identical to SEQ ID NO: 179324

SEQ ID NO: 675110 - RNA, 64 nt, hsa; identical to SEQ ID NO: 179325

SEQ ID NO: 675111 - RNA, 64 nt, hsa; identical to SEQ ID NO: 179326

SEQ ID NO: 675112 - RNA, 64 nt, hsa; identical to SEQ ID NO: 179327

SEQ ID NO: 675113 - RNA, 64 nt, hsa; identical to SEQ ID NO: 179328

SEQ ID NO: 675114 - RNA, 64 nt, hsa; identical to SEQ ID NO: 179329

SEQ ID NO: 675115 - RNA, 64 nt, hsa; identical to SEQ ID NO: 179330

SEQ ID NO: 675116 - RNA, 64 nt, hsa; identical to SEQ ID NO: 179331

SEQ ID NO: 675117 - RNA, 64 nt, hsa; identical to SEQ ID NO: 179332

SEQ ID NO: 675118 - RNA, 64 nt, hsa; identical to SEQ ID NO: 179333

SEQ ID NO: 675119 - RNA, 64 nt, hsa; identical to SEQ ID NO: 179334

SEQ ID NO: 675120 - RNA, 64 nt, hsa; identical to SEQ ID NO: 179335

SEQ ID NO: 675121 - RNA, 64 nt, hsa; identical to SEQ ID NO: 179336

SEQ ID NO: 675122 - RNA, 64 nt, hsa; identical to SEQ ID NO: 179337

SEQ ID NO: 675123 - RNA, 64 nt, hsa; identical to SEQ ID NO: 179338

SEQ ID NO: 675124 - RNA, 64 nt, hsa; identical to SEQ ID NO: 179339

SEQ ID NO: 675125 - RNA, 64 nt, hsa; identical to SEQ ID NO: 179340

SEQ ID NO: 675126 - RNA, 64 nt, hsa; identical to SEQ ID NO: 179341

SEQ ID NO: 675127 - RNA, 64 nt, hsa; identical to SEQ ID NO: 179342

SEQ ID NO: 675128 - RNA, 64 nt, hsa; identical to SEQ ID NO: 179343

SEQ ID NO: 675129 - RNA, 64 nt, hsa; identical to SEQ ID NO: 179344

SEQ ID NO: 675130 - RNA, 64 nt, hsa; identical to SEQ ID NO: 179345

SEQ ID NO: 675131 - RNA, 64 nt, hsa; identical to SEQ ID NO: 179346

SEQ ID NO: 675132 - RNA, 64 nt, hsa; identical to SEQ ID NO: 179347

SEQ ID NO: 675133 - RNA, 64 nt, hsa; identical to SEQ ID NO: 179348

SEQ ID NO: 675134 - RNA, 64 nt, hsa; identical to SEQ ID NO: 179349

SEQ ID NO: 675135 - RNA, 64 nt, hsa; identical to SEQ ID NO: 179350

SEQ ID NO: 675136 - RNA, 64 nt, hsa; identical to SEQ ID NO: 179351

SEQ ID NO: 675137 - RNA, 64 nt, hsa; identical to SEQ ID NO: 179352

SEQ ID NO: 675138 - RNA, 64 nt, hsa; identical to SEQ ID NO: 179353

SEQ ID NO: 675139 - RNA, 64 nt, hsa; identical to SEQ ID NO: 179354

SEQ ID NO: 675140 - RNA, 64 nt, hsa; identical to SEQ ID NO: 179355

SEQ ID NO: 675141 - RNA, 64 nt, hsa; identical to SEQ ID NO: 179356

SEQ ID NO: 675142 - RNA, 64 nt, hsa; identical to SEQ ID NO: 179357

SEQ ID NO: 675143 - RNA, 64 nt, hsa; identical to SEQ ID NO: 179358

SEQ ID NO: 675144 - RNA, 64 nt, hsa; identical to SEQ ID NO: 179359

SEQ ID NO: 675145 - RNA, 64 nt, hsa; identical to SEQ ID NO: 179360

SEQ ID NO: 675146 - RNA, 64 nt, hsa; identical to SEQ ID NO: 179361

SEQ ID NO: 675147 - RNA, 64 nt, hsa; identical to SEQ ID NO: 179362

SEQ ID NO: 675148 - RNA, 64 nt, hsa; identical to SEQ ID NO: 179363

SEQ ID NO: 675149 - RNA, 64 nt, hsa; identical to SEQ ID NO: 179364

SEQ ID NO: 675150 - RNA, 64 nt, hsa; identical to SEQ ID NO: 179365

SEQ ID NO: 675151 - RNA, 64 nt, hsa; identical to SEQ ID NO: 179366

SEQ ID NO: 675152 - RNA, 64 nt, hsa; identical to SEQ ID NO: 179367

SEQ ID NO: 675153 - RNA, 64 nt, hsa; identical to SEQ ID NO: 179368

SEQ ID NO: 675154 - RNA, 64 nt, hsa; identical to SEQ ID NO: 179369

SEQ ID NO: 675155 - RNA, 64 nt, hsa; identical to SEQ ID NO: 179370

SEQ ID NO: 675156 - RNA, 64 nt, hsa; identical to SEQ ID NO: 179371

SEQ ID NO: 675157 - RNA, 64 nt, hsa; identical to SEQ ID NO: 179372

SEQ ID NO: 675158 - RNA, 64 nt, hsa; identical to SEQ ID NO: 179373

SEQ ID NO: 675159 - RNA, 64 nt, hsa; identical to SEQ ID NO: 179374

SEQ ID NO: 675160 - RNA, 64 nt, hsa; identical to SEQ ID NO: 179375

SEQ ID NO: 675161 - RNA, 60 nt, hsa
guagaacacugagcaggacaacugaccugucuccuucacauaguccauaucaccacaaau

SEQ ID NO: 675162 - RNA, 60 nt, hsa
ugcaggacucacuggauagauguuauucgacuccuucagguuaucuugaacugccugacu

SEQ ID NO: 675163 - RNA, 60 nt, hsa
ugcaggacucacuggauagauguuauucaacuccuucaguuuaucuuggacugacugacu

SEQ ID NO: 675164 - RNA, 60 nt, hsa
agccucucugucaucuccccuucccagccccuccuucauccccugccuccuucaccagcc

SEQ ID NO: 675165 - RNA, 60 nt, hsa
ccccuucccagccccuccuucauccccugccuccuucaccagccuggcuuuugccuggag

SEQ ID NO: 675166 - RNA, 54 nt, hsa; identical to SEQ ID NO: 100148

SEQ ID NO: 675167 - RNA, 60 nt, hsa
gggacuuugugcuaagccugaugaaaugugcuccuucaaucuccaugaaaccaucguaac

SEQ ID NO: 675168 - RNA, 60 nt, hsa
aaaacacuguucucugcccuccaagaccuucuccuucaccuuuguccccaccgcagacag

SEQ ID NO: 675169 - RNA, 60 nt, hsa
gggcuggguucuacccaggugcuaggaacacuccuucacagaugggugcuuggaggaagg

SEQ ID NO: 675170 - RNA, 60 nt, hsa
cuagaauuuauuuuccuagcacuucaccaccuccuucaucuucuccuucaacaauaaacc

SEQ ID NO: 675171 - RNA, 60 nt, hsa
uuccuagcacuucaccaccuccuucaucuucuccuucaacaauaaacccugagaucuuug

SEQ ID NO: 675172 - RNA, 60 nt, hsa
cuuuauaaggcaaaaagaucuguauuuacacuccuucaccuagggauguguuuguugccc

SEQ ID NO: 675173 - RNA, 60 nt, hsa
agcaggacugacucugggcucuacaaccagcuccuucacauaaaggguuuagagacuccc

SEQ ID NO: 675174 - RNA, 64 nt, hsa; identical to SEQ ID NO: 476364

SEQ ID NO: 675175 - RNA, 64 nt, hsa; identical to SEQ ID NO: 476365

SEQ ID NO: 675176 - RNA, 64 nt, hsa; identical to SEQ ID NO: 476366

SEQ ID NO: 675177 - RNA, 64 nt, hsa; identical to SEQ ID NO: 476367

SEQ ID NO: 675178 - RNA, 64 nt, hsa; identical to SEQ ID NO: 476368

SEQ ID NO: 675179 - RNA, 64 nt, hsa; identical to SEQ ID NO: 476369

SEQ ID NO: 675180 - RNA, 64 nt, hsa; identical to SEQ ID NO: 476370

SEQ ID NO: 675181 - RNA, 64 nt, hsa; identical to SEQ ID NO: 476371

SEQ ID NO: 675182 - RNA, 64 nt, hsa; identical to SEQ ID NO: 476372

SEQ ID NO: 675183 - RNA, 64 nt, hsa; identical to SEQ ID NO: 476373

SEQ ID NO: 675184 - RNA, 64 nt, hsa; identical to SEQ ID NO: 476374

SEQ ID NO: 675185 - RNA, 64 nt, hsa; identical to SEQ ID NO: 476375

SEQ ID NO: 675186 - RNA, 64 nt, hsa; identical to SEQ ID NO: 476376

SEQ ID NO: 675187 - RNA, 64 nt, hsa; identical to SEQ ID NO: 476377

SEQ ID NO: 675188 - RNA, 64 nt, hsa; identical to SEQ ID NO: 476378

SEQ ID NO: 675189 - RNA, 64 nt, hsa; identical to SEQ ID NO: 476379

SEQ ID NO: 675190 - RNA, 64 nt, hsa; identical to SEQ ID NO: 476380

SEQ ID NO: 675191 - RNA, 64 nt, hsa; identical to SEQ ID NO: 476381

SEQ ID NO: 675192 - RNA, 64 nt, hsa; identical to SEQ ID NO: 476382

SEQ ID NO: 675193 - RNA, 64 nt, hsa; identical to SEQ ID NO: 476383

SEQ ID NO: 675194 - RNA, 64 nt, hsa; identical to SEQ ID NO: 520974

SEQ ID NO: 675195 - RNA, 64 nt, hsa; identical to SEQ ID NO: 520975

SEQ ID NO: 675196 - RNA, 64 nt, hsa; identical to SEQ ID NO: 520976

SEQ ID NO: 675197 - RNA, 64 nt, hsa; identical to SEQ ID NO: 520977

SEQ ID NO: 675198 - RNA, 50 nt, hsa; identical to SEQ ID NO: 520978

SEQ ID NO: 675199 - RNA, 64 nt, hsa; identical to SEQ ID NO: 520979

SEQ ID NO: 675200 - RNA, 64 nt, hsa; identical to SEQ ID NO: 520980

SEQ ID NO: 675201 - RNA, 64 nt, hsa; identical to SEQ ID NO: 520981

SEQ ID NO: 675202 - RNA, 64 nt, hsa; identical to SEQ ID NO: 520982

SEQ ID NO: 675203 - RNA, 64 nt, hsa; identical to SEQ ID NO: 520983

SEQ ID NO: 675204 - RNA, 64 nt, hsa; identical to SEQ ID NO: 520984

SEQ ID NO: 675205 - RNA, 64 nt, hsa; identical to SEQ ID NO: 520985

SEQ ID NO: 675206 - RNA, 64 nt, hsa; identical to SEQ ID NO: 520986

SEQ ID NO: 675207 - RNA, 64 nt, hsa; identical to SEQ ID NO: 520987

SEQ ID NO: 675208 - RNA, 64 nt, hsa; identical to SEQ ID NO: 520988

SEQ ID NO: 675209 - RNA, 64 nt, hsa; identical to SEQ ID NO: 520989

SEQ ID NO: 675210 - RNA, 64 nt, hsa; identical to SEQ ID NO: 520990

SEQ ID NO: 675211 - RNA, 64 nt, hsa; identical to SEQ ID NO: 520991

SEQ ID NO: 675212 - RNA, 63 nt, hsa
cccacagcaagacugcuugggucucaaggaaaucgagcuuaaugaaugagagcaaacccucuu

SEQ ID NO: 675213 - RNA, 63 nt, hsa
gcuuagacugugcaaagggcuuagcuaaguuaucgagcuuaaaacccgucaauuaaacaaaca

SEQ ID NO: 675214 - RNA, 63 nt, hsa
guauuuauguguauauuuguagauuuauccagccgagcuuaggaauucgcuuccaggccgugg

SEQ ID NO: 675215 - RNA, 63 nt, hsa
acagaagcuauuauuaacuacugcaagcuaagccgagcuuaaaaaugccuuuuguuuuaaaug

SEQ ID NO: 675216 - RNA, 63 nt, hsa
cacagcuugugaggagggcaagguugugacguucgagcuuaguucugguguuauucugucucc

SEQ ID NO: 675217 - RNA, 63 nt, hsa
cucuccccaucuccagaagaggggagcagaguccgagcuuaucuaaauaugaauguggccaca

SEQ ID NO: 675218 - RNA, 63 nt, hsa
cuucccaagguacagcuguauauaaacgugucccgagcuuagauucuguaugcggugacggcg

SEQ ID NO: 675219 - RNA, 63 nt, hsa
caccccguucccagcgcauggcgccccgggccgcgagcuuagcuuagaccgugguguccucug

SEQ ID NO: 675220 - RNA, 63 nt, hsa
aaguccaagaaaguacuugaagcucucuuccagcgagcuuaauugcguaaucccuguuguccu

SEQ ID NO: 675221 - RNA, 63 nt, hsa
aauggagugcucuuccucccucacucugccuuccgagcuuaugguuccuuuucucaggagagg

SEQ ID NO: 675222 - RNA, 63 nt, hsa
cuuccccagcgcccaggaugagcgguuuaccaucgagcuuacccgggcccggcuccugucaag

SEQ ID NO: 675223 - RNA, 63 nt, hsa
cacagguucucacuagaugacuguaaguagacacgagcuuaaucaacagaaguaucaagccau

SEQ ID NO: 675224 - RNA, 63 nt, hsa
aauuauauuaauuggaaugucagucuuuaaugucgagcuuauuguaggguagaaaagagcuuu

SEQ ID NO: 675225 - RNA, 63 nt, hsa
guggcuggguucugacaacuguaacgguuuugucgagcuuaggccccuuuggagggagaauca

SEQ ID NO: 675226 - RNA, 63 nt, hsa
caggauguggaaugcagccgugaucacacuuaccgagcuuacuuugaucuguuugucaauagc

SEQ ID NO: 675227 - RNA, 63 nt, hsa
ugucacccagaaaagagaccugucaggcagaaucgagcuuaauucaccugcucuaaacaauug

SEQ ID NO: 675228 - RNA, 63 nt, hsa
aaaagaaaauacaacaaaauguauauuuagacacgagcuuacauggcauaccuuauauuugua

SEQ ID NO: 675229 - RNA, 63 nt, hsa
uagugauacacaaauuguuuaagguuauacacucgagcuuaaauagauauuuuuaaccaggug

SEQ ID NO: 675230 - RNA, 63 nt, hsa
ccaccccauccucggucuuugcaaagaagggcccgagcuuaguuuccccaggacuggccuagg

SEQ ID NO: 675231 - RNA, 63 nt, hsa
gccccugaguggcagggcugacucccgucgacacgagcuuagaaaguggauucacugcuuucu

SEQ ID NO: 675232 - RNA, 63 nt, hsa
uucacuccugccuccucagcuuugcuucauguucgagcuuaccuacucuuccaggacucucug

SEQ ID NO: 675233 - RNA, 63 nt, hsa
gaggagcgcagucacuccacuuggccccgaccccgagcuuagccccuaagcccuccuuuaccc

SEQ ID NO: 675234 - RNA, 63 nt, hsa
ucccaucgcccacaaaagggggggcacgagggacgagcuuagcugagcugggaggagcagggu

SEQ ID NO: 675235 - RNA, 63 nt, hsa
aaaucucuuucagcugcgcucuucccaccgagccgagcuuacugugaguguggagauguuauc

SEQ ID NO: 675236 - RNA, 63 nt, hsa
gugucaccucuccuccuucagccaugcuggccccgagcuuagggaugugcuugcaaacccuuc

SEQ ID NO: 675237 - RNA, 64 nt, hsa; identical to SEQ ID NO: 72674

SEQ ID NO: 675238 - RNA, 64 nt, hsa; identical to SEQ ID NO: 72675

SEQ ID NO: 675239 - RNA, 64 nt, hsa; identical to SEQ ID NO: 72676

SEQ ID NO: 675240 - RNA, 64 nt, hsa; identical to SEQ ID NO: 72677

SEQ ID NO: 675241 - RNA, 64 nt, hsa; identical to SEQ ID NO: 72678

SEQ ID NO: 675242 - RNA, 64 nt, hsa; identical to SEQ ID NO: 72679

SEQ ID NO: 675243 - RNA, 64 nt, hsa; identical to SEQ ID NO: 72680

SEQ ID NO: 675244 - RNA, 64 nt, hsa; identical to SEQ ID NO: 72681

SEQ ID NO: 675245 - RNA, 64 nt, hsa; identical to SEQ ID NO: 72682

SEQ ID NO: 675246 - RNA, 64 nt, hsa; identical to SEQ ID NO: 72683

SEQ ID NO: 675247 - RNA, 64 nt, hsa; identical to SEQ ID NO: 72684

SEQ ID NO: 675248 - RNA, 64 nt, hsa; identical to SEQ ID NO: 72685

SEQ ID NO: 675249 - RNA, 64 nt, hsa; identical to SEQ ID NO: 72686

SEQ ID NO: 675250 - RNA, 64 nt, hsa; identical to SEQ ID NO: 72687

SEQ ID NO: 675251 - RNA, 64 nt, hsa; identical to SEQ ID NO: 72688

SEQ ID NO: 675252 - RNA, 64 nt, hsa; identical to SEQ ID NO: 72689

SEQ ID NO: 675253 - RNA, 64 nt, hsa; identical to SEQ ID NO: 72690

SEQ ID NO: 675254 - RNA, 64 nt, hsa; identical to SEQ ID NO: 72691

SEQ ID NO: 675255 - RNA, 64 nt, hsa; identical to SEQ ID NO: 72692

SEQ ID NO: 675256 - RNA, 64 nt, hsa; identical to SEQ ID NO: 72693

SEQ ID NO: 675257 - RNA, 64 nt, hsa; identical to SEQ ID NO: 72694

SEQ ID NO: 675258 - RNA, 64 nt, hsa; identical to SEQ ID NO: 72695

SEQ ID NO: 675259 - RNA, 64 nt, hsa; identical to SEQ ID NO: 72696

SEQ ID NO: 675260 - RNA, 64 nt, hsa; identical to SEQ ID NO: 72697

SEQ ID NO: 675261 - RNA, 64 nt, hsa; identical to SEQ ID NO: 72698

SEQ ID NO: 675262 - RNA, 64 nt, hsa; identical to SEQ ID NO: 72699

SEQ ID NO: 675263 - RNA, 64 nt, hsa; identical to SEQ ID NO: 72700

SEQ ID NO: 675264 - RNA, 64 nt, hsa; identical to SEQ ID NO: 72701

SEQ ID NO: 675265 - RNA, 64 nt, hsa; identical to SEQ ID NO: 72702

SEQ ID NO: 675266 - RNA, 64 nt, hsa; identical to SEQ ID NO: 72703

SEQ ID NO: 675267 - RNA, 64 nt, hsa; identical to SEQ ID NO: 72704

SEQ ID NO: 675268 - RNA, 64 nt, hsa; identical to SEQ ID NO: 72705

SEQ ID NO: 675269 - RNA, 64 nt, hsa; identical to SEQ ID NO: 72706

SEQ ID NO: 675270 - RNA, 64 nt, hsa; identical to SEQ ID NO: 72707

SEQ ID NO: 675271 - RNA, 64 nt, hsa; identical to SEQ ID NO: 72708

SEQ ID NO: 675272 - RNA, 64 nt, hsa; identical to SEQ ID NO: 72709

SEQ ID NO: 675273 - RNA, 64 nt, hsa; identical to SEQ ID NO: 72710

SEQ ID NO: 675274 - RNA, 64 nt, hsa; identical to SEQ ID NO: 72711

SEQ ID NO: 675275 - RNA, 64 nt, hsa; identical to SEQ ID NO: 72712

SEQ ID NO: 675276 - RNA, 64 nt, hsa; identical to SEQ ID NO: 72713

SEQ ID NO: 675277 - RNA, 64 nt, hsa; identical to SEQ ID NO: 72714

SEQ ID NO: 675278 - RNA, 64 nt, hsa; identical to SEQ ID NO: 72715

SEQ ID NO: 675279 - RNA, 64 nt, hsa; identical to SEQ ID NO: 72716

SEQ ID NO: 675280 - RNA, 64 nt, hsa; identical to SEQ ID NO: 72717

SEQ ID NO: 675281 - RNA, 64 nt, hsa; identical to SEQ ID NO: 72718

SEQ ID NO: 675282 - RNA, 64 nt, hsa; identical to SEQ ID NO: 72719

SEQ ID NO: 675283 - RNA, 64 nt, hsa; identical to SEQ ID NO: 453107

SEQ ID NO: 675284 - RNA, 64 nt, hsa; identical to SEQ ID NO: 453108

SEQ ID NO: 675285 - RNA, 64 nt, hsa; identical to SEQ ID NO: 453109

SEQ ID NO: 675286 - RNA, 64 nt, hsa; identical to SEQ ID NO: 453110

SEQ ID NO: 675287 - RNA, 64 nt, hsa; identical to SEQ ID NO: 453111

SEQ ID NO: 675288 - RNA, 64 nt, hsa; identical to SEQ ID NO: 453112

SEQ ID NO: 675289 - RNA, 64 nt, hsa; identical to SEQ ID NO: 453113

SEQ ID NO: 675290 - RNA, 64 nt, hsa; identical to SEQ ID NO: 453114

SEQ ID NO: 675291 - RNA, 64 nt, hsa; identical to SEQ ID NO: 453115

SEQ ID NO: 675292 - RNA, 64 nt, hsa; identical to SEQ ID NO: 453116

SEQ ID NO: 675293 - RNA, 64 nt, hsa; identical to SEQ ID NO: 453117

SEQ ID NO: 675294 - RNA, 64 nt, hsa; identical to SEQ ID NO: 453118

SEQ ID NO: 675295 - RNA, 64 nt, hsa; identical to SEQ ID NO: 453119

SEQ ID NO: 675296 - RNA, 64 nt, hsa; identical to SEQ ID NO: 453120

SEQ ID NO: 675297 - RNA, 64 nt, hsa; identical to SEQ ID NO: 453121

SEQ ID NO: 675298 - RNA, 64 nt, hsa; identical to SEQ ID NO: 453122

SEQ ID NO: 675299 - RNA, 64 nt, hsa; identical to SEQ ID NO: 453123

SEQ ID NO: 675300 - RNA, 64 nt, hsa; identical to SEQ ID NO: 453124

SEQ ID NO: 675301 - RNA, 64 nt, hsa; identical to SEQ ID NO: 453125

SEQ ID NO: 675302 - RNA, 64 nt, hsa; identical to SEQ ID NO: 453126

SEQ ID NO: 675303 - RNA, 64 nt, hsa
uuuggggguauucguuucuuaaacaauccaaaucuaagcuuagaagaaaaguuuagcguuaagc

SEQ ID NO: 675304 - RNA, 64 nt, hsa
ggaguuggaacauuguuauccuuguaagaaauacuaagcuuauguugauuuuuaaguaauuaua

SEQ ID NO: 675305 - RNA, 64 nt, hsa
agcuguuuugauuaaaauuuauauucuuguuuaauaagcuuauuuuuaaacaauuuaaaagcua

SEQ ID NO: 675306 - RNA, 64 nt, hsa
gaguaacuacagaagaacuuuaaaaaauaaaaaauaagcuuaccuuggauucuuggcuuagagu

SEQ ID NO: 675307 - RNA, 64 nt, hsa
aauauagaaguguuugaaauguucaagcucacaauaagcuuaaauuuauagaaaaugcuaaggu

SEQ ID NO: 675308 - RNA, 64 nt, hsa
auaaaucaaucccaguuugggaaaagauuauuuuuaagcuuaaaaggcugacaugugccauuau

SEQ ID NO: 675309 - RNA, 64 nt, hsa
ucauuguaaaacuuuuuuacauugcuuaauguuuuaagcuuaauagccuuugcacuuuuaaaau

SEQ ID NO: 675310 - RNA, 64 nt, hsa
augggagagaauguaaaugugcaaagguacauauuaagcuuagggauuuuugaauuuuuacguc

SEQ ID NO: 675311 - RNA, 64 nt, hsa; identical to SEQ ID NO: 287439

SEQ ID NO: 675312 - RNA, 64 nt, hsa; identical to SEQ ID NO: 287440

SEQ ID NO: 675313 - RNA, 64 nt, hsa; identical to SEQ ID NO: 287441

SEQ ID NO: 675314 - RNA, 64 nt, hsa; identical to SEQ ID NO: 287442

SEQ ID NO: 675315 - RNA, 64 nt, hsa; identical to SEQ ID NO: 287443

SEQ ID NO: 675316 - RNA, 64 nt, hsa; identical to SEQ ID NO: 287444

SEQ ID NO: 675317 - RNA, 64 nt, hsa; identical to SEQ ID NO: 287445

SEQ ID NO: 675318 - RNA, 64 nt, hsa; identical to SEQ ID NO: 287446

SEQ ID NO: 675319 - RNA, 64 nt, hsa; identical to SEQ ID NO: 287447

SEQ ID NO: 675320 - RNA, 64 nt, hsa; identical to SEQ ID NO: 287448

SEQ ID NO: 675321 - RNA, 64 nt, hsa; identical to SEQ ID NO: 287449

SEQ ID NO: 675322 - RNA, 64 nt, hsa; identical to SEQ ID NO: 287450

SEQ ID NO: 675323 - RNA, 64 nt, hsa; identical to SEQ ID NO: 287451

SEQ ID NO: 675324 - RNA, 64 nt, hsa; identical to SEQ ID NO: 287452

SEQ ID NO: 675325 - RNA, 64 nt, hsa; identical to SEQ ID NO: 287453

SEQ ID NO: 675326 - RNA, 64 nt, hsa; identical to SEQ ID NO: 287454

SEQ ID NO: 675327 - RNA, 64 nt, hsa; identical to SEQ ID NO: 287455

SEQ ID NO: 675328 - RNA, 64 nt, hsa; identical to SEQ ID NO: 287456

SEQ ID NO: 675329 - RNA, 64 nt, hsa; identical to SEQ ID NO: 287457

SEQ ID NO: 675330 - RNA, 64 nt, hsa; identical to SEQ ID NO: 287458

SEQ ID NO: 675331 - RNA, 64 nt, hsa; identical to SEQ ID NO: 287459

SEQ ID NO: 675332 - RNA, 64 nt, hsa; identical to SEQ ID NO: 287460

SEQ ID NO: 675333 - RNA, 64 nt, hsa; identical to SEQ ID NO: 287461

SEQ ID NO: 675334 - RNA, 64 nt, hsa; identical to SEQ ID NO: 287462

SEQ ID NO: 675335 - RNA, 64 nt, hsa; identical to SEQ ID NO: 287463

SEQ ID NO: 675336 - RNA, 64 nt, hsa; identical to SEQ ID NO: 287464

SEQ ID NO: 675337 - RNA, 64 nt, hsa; identical to SEQ ID NO: 287465

SEQ ID NO: 675338 - RNA, 64 nt, hsa; identical to SEQ ID NO: 287466

SEQ ID NO: 675339 - RNA, 64 nt, hsa; identical to SEQ ID NO: 287467

SEQ ID NO: 675340 - RNA, 64 nt, hsa; identical to SEQ ID NO: 287468

SEQ ID NO: 675341 - RNA, 64 nt, hsa; identical to SEQ ID NO: 287469

SEQ ID NO: 675342 - RNA, 64 nt, hsa; identical to SEQ ID NO: 287470

SEQ ID NO: 675343 - RNA, 64 nt, hsa; identical to SEQ ID NO: 287471

SEQ ID NO: 675344 - RNA, 64 nt, hsa; identical to SEQ ID NO: 287472

SEQ ID NO: 675345 - RNA, 64 nt, hsa; identical to SEQ ID NO: 287473

SEQ ID NO: 675346 - RNA, 64 nt, hsa; identical to SEQ ID NO: 287474

SEQ ID NO: 675347 - RNA, 64 nt, hsa; identical to SEQ ID NO: 287475

SEQ ID NO: 675348 - RNA, 64 nt, hsa; identical to SEQ ID NO: 287476

SEQ ID NO: 675349 - RNA, 64 nt, hsa; identical to SEQ ID NO: 287477

SEQ ID NO: 675350 - RNA, 64 nt, hsa; identical to SEQ ID NO: 287478

SEQ ID NO: 675351 - RNA, 64 nt, hsa; identical to SEQ ID NO: 287479

SEQ ID NO: 675352 - RNA, 64 nt, hsa; identical to SEQ ID NO: 287480

SEQ ID NO: 675353 - RNA, 64 nt, hsa; identical to SEQ ID NO: 287481

SEQ ID NO: 675354 - RNA, 64 nt, hsa; identical to SEQ ID NO: 287482

SEQ ID NO: 675355 - RNA, 64 nt, hsa; identical to SEQ ID NO: 287483

SEQ ID NO: 675356 - RNA, 64 nt, hsa; identical to SEQ ID NO: 287484

SEQ ID NO: 675357 - RNA, 64 nt, hsa; identical to SEQ ID NO: 287485

SEQ ID NO: 675358 - RNA, 64 nt, hsa; identical to SEQ ID NO: 287486

SEQ ID NO: 675359 - RNA, 64 nt, hsa; identical to SEQ ID NO: 287487

SEQ ID NO: 675360 - RNA, 64 nt, hsa
auuauuuauuuuaccuuuuacugacaaugugaaacucgaagaaaauguucucuuuuuaaauaua

SEQ ID NO: 675361 - RNA, 64 nt, hsa
uuaacccaaauuagaguaccaacuuaauguuuuucucgaagaaugugaaaauaauuagaccugu

SEQ ID NO: 675362 - RNA, 64 nt, hsa
ccucuuaaaauuguauguuacuuauuuccagaaucucgaagaaaaaagaaaaaagagugguauu

SEQ ID NO: 675363 - RNA, 64 nt, hsa
cacgucucucugccugcugggcucuuaacuguugcucgaagacugugacaucagaaguaacucc

SEQ ID NO: 675364 - RNA, 64 nt, hsa
gaaggacaguggggcuguaccuagaauagugguucucgaagaaugcggccugcagauccuggga

SEQ ID NO: 675365 - RNA, 64 nt, hsa
auuucauuccauucuauuguuuacacaacgauuacucgaagaugacugcaaagguaaaaggaaa

SEQ ID NO: 675366 - RNA, 64 nt, hsa
agaaaaguauauagaucuguaauuggacagcucucucgaagagaucuuacagacuguaucaguc

SEQ ID NO: 675367 - RNA, 64 nt, hsa
auaccgucugacauagaauccucaaaaucuuccacucgaagaaugaaauccucuugugauagag

SEQ ID NO: 675368 - RNA, 64 nt, hsa
uaauuaacagcugagucccugaugucauccuuaucucgaagagcuuagaaacaaagagugggaa

SEQ ID NO: 675369 - RNA, 64 nt, hsa
aaagccacauuuugcauuagacagaugacggcugcucgaagaacaaugucagaaacucgaugaa

SEQ ID NO: 675370 - RNA, 64 nt, hsa
ccggcccaaggaugccaggaucugcaaagcacugcucgaagacuuuucucucaaugaaacucgc

SEQ ID NO: 675371 - RNA, 64 nt, hsa
aacagcauuagcaagugggaucagacacuggcagcucgaagacgcgacguccauuugucgaaag

SEQ ID NO: 675372 - RNA, 64 nt, hsa
acuggaaaugaaacagaggacaggugacaaccaccucgaagagcucccagagauuguagaaaga

SEQ ID NO: 675373 - RNA, 64 nt, hsa
ucauuucugaagagaauagucaucaaauuuauaucucgaagauuuuaauuaaggaauugcuuau

SEQ ID NO: 675374 - RNA, 64 nt, hsa
ugaccacuaguggggagccguggcacuccauacccucgaagauguuguacuccaccgccugcac

SEQ ID NO: 675375 - RNA, 64 nt, hsa
gcaucugccccugcugggugcacaaugcugcuuccucgaagagaagacacagaguccaaguggc

SEQ ID NO: 675376 - RNA, 64 nt, hsa
auacuacacacccaguuauggaauguccagaguucucgaagaaaauaaaugacuuuaggaagag

SEQ ID NO: 675377 - RNA, 64 nt, hsa
gacuggugucagauucaucaaacaaaaaauaaaucucgaagaaaaaaaaugcacuuacaugugc

SEQ ID NO: 675378 - RNA, 64 nt, hsa
gcuuggcacccucugcuuccuggugcugcucugacucgaagacgggacagucccuggugcacau

SEQ ID NO: 675379 - RNA, 64 nt, hsa
acuuugucacagccucuaucacacaucuguuuuucucgaagaaaaaaauauaauuaauaaaaau

SEQ ID NO: 675380 - RNA, 64 nt, hsa
cucauuguuucccccacgucucccucuauacccccucgaagacucgagagggggaggggguaag

SEQ ID NO: 675381 - RNA, 64 nt, hsa
gcgacaccucuucagggguguguggaguaaauagcucgaagagcugaagacagaaaaccaguuu

SEQ ID NO: 675382 - RNA, 64 nt, hsa
cguuuuacuuuucuuuuuuuuuaacuuuuacucucucgaagaagaggaccuucccacauccacg

SEQ ID NO: 675383 - RNA, 64 nt, hsa
gaagccccaauagcuggacagaccucggccuccccucgaagacaccucaauucacagacucuca

SEQ ID NO: 675384 - RNA, 64 nt, hsa
ugauaaugcugcagcccugcugguuugggcuugccucgaagauuuuauuaaggcacgaagaagu

SEQ ID NO: 675385 - RNA, 64 nt, hsa
gcaggcugccaccccuucuaccucaccacugccccucgaagaauuuugcaaauggccccuugcc

SEQ ID NO: 675386 - RNA, 60 nt, hsa
uuuaaauuuugucugacaggauuugaacuucucgaagagcuaccaacacccaaguucagc

SEQ ID NO: 675387 - RNA, 64 nt, hsa
caugugaucauagucccagagacagaguugaggucucgaagaaaagauccaugaucggcuuucu

SEQ ID NO: 675388 - RNA, 64 nt, hsa
cuuugaugauaauuuuuuuuuuaaaaauuauucucucgaagagcaacuuacgagaggacagccu

SEQ ID NO: 675389 - RNA, 64 nt, hsa
uauuaaugcccccuuacagcagaagacacugcagcucgaagacagcuuaaguggcagaauaaug

SEQ ID NO: 675390 - RNA, 64 nt, hsa
ucuauggcauccaagacagugacacucucauccucucgaagaagaaaggagaggcucuguuucc

SEQ ID NO: 675391 - RNA, 64 nt, hsa
cguacccuggggaaucaaccaaggaguucuuguucucgaagaaccccaggccucaugauggucu

SEQ ID NO: 675392 - RNA, 64 nt, hsa
cuucuauuauuucucucucccuuauauuuuacuacucgaagaaaggcagaagaaguuacaaaua

SEQ ID NO: 675393 - RNA, 64 nt, hsa
cgggcgcggggaggccggcgcagcgcagagcgggcucgaagaaaauaauucucuauuauuuuua

SEQ ID NO: 675394 - RNA, 64 nt, hsa
accagugaauaagaagaccccacuucaacuuccccucgaagacguugugccucacagcgaggcc

SEQ ID NO: 675395 - RNA, 64 nt, hsa
uuuguuuccggaauuucaauaaagcucgauucggcucgaagaagaccccguucuuccgggaaaa

SEQ ID NO: 675396 - RNA, 64 nt, hsa
uggugggauggaauuaauagacauccaucuauugcucgaagacuaaaggaaacuucauccauca

SEQ ID NO: 675397 - RNA, 64 nt, hsa
ugcagcugcugugccugauguccggacagcccugcucgaagauauagaaagagugaccugcaca

SEQ ID NO: 675398 - RNA, 64 nt, hsa
gcacuccagccuggucaacagagcaagacuccaucucgaagaaaaaaaaaaaaaauuccccacc

SEQ ID NO: 675399 - RNA, 64 nt, hsa
cugccagcucaccgugcccagccuccugcauccccucgaagagccuggccagagagggaagaca

SEQ ID NO: 675400 - RNA, 64 nt, hsa
uuccuugaacagaaauucuacaugaccauaaaaccucgaagauggguauggcacaguucaugcc

SEQ ID NO: 675401 - RNA, 64 nt, hsa
acgcagccaaucgcuuuccuggaggagcgccaaccucgaagacaacucagcacugggcggguuc

SEQ ID NO: 675402 - RNA, 64 nt, hsa
uuugcccucagugccagccaauccgggcaggacccucgaagaggagaccgagggucccagagga

SEQ ID NO: 675403 - RNA, 64 nt, hsa
ucaucugucaaaugggguuaauaacagaaccuaccucgaagaguugugaggcuaaaaaggguuc

SEQ ID NO: 675404 - RNA, 64 nt, hsa
cuuugcuuugggguucuucuauuuacuuuguuuucucgaagacaaacuuuccucuaugucugga

SEQ ID NO: 675405 - RNA, 64 nt, hsa
cauaaaauuauuuuguuuggcauuauuuuucucacucgaagaaacuauauaggguuguuuuucc

SEQ ID NO: 675406 - RNA, 64 nt, hsa
gagaaguaggaccaggccauccuuggcuccagagcucgaagaccccaagacagcccucugcucu

SEQ ID NO: 675407 - RNA, 64 nt, hsa
augcagguggggggacaugguguggcacuaggggcucgaagacugguuucuagcacuaccgguc

SEQ ID NO: 675408 - RNA, 64 nt, hsa
ugagaugcugacccagcauggagcccaagagcagcucgaagaccauccuggccauagcagccaa

SEQ ID NO: 675409 - RNA, 64 nt, hsa
cuuuccaccaaagccagguuuccugguaaggucacucgaagauaagggauggggaugggggcug

SEQ ID NO: 675410 - RNA, 64 nt, hsa
ggcgugggaguugggcaaggugaaagggcugaagcucgaagagcuauggcuagaagggaacccg

SEQ ID NO: 675411 - RNA, 64 nt, hsa
ccgaaaaccuccuguaugccacgcccuuugaggacucgaagaucauggucucugacuuuggacu

SEQ ID NO: 675412 - RNA, 64 nt, hsa
guccuucuaacuccgcccgcgcccuuaauuuaaaucgcaguauacuguauuuaucggggccccg

SEQ ID NO: 675413 - RNA, 64 nt, hsa
aaaaaaaaaaaaaucugccccaugauucuaacacucgcaguagugauaguguaucuaguuguuc

SEQ ID NO: 675414 - RNA, 64 nt, hsa
uccucgugcuguguuuucuagugcaugccacaguucgcaguagaggguguuuucaccuuccaag

SEQ ID NO: 675415 - RNA, 64 nt, hsa
gugcuuaaaaaacagugccgagaguauguucaguucgcaguaaguagauuuauuggaauaaaua

SEQ ID NO: 675416 - RNA, 64 nt, hsa
acaggaccacuugagugggcagccaagcccaggcucgcaguaucaauaaagcaguucucugagg

SEQ ID NO: 675417 - RNA, 64 nt, hsa
uauuuuaaaaauauuuuaugcauguuaaguauggucgcaguaaaugaaauuguguuuaagacua

SEQ ID NO: 675418 - RNA, 64 nt, hsa
caugguuccuuuggcagaagugcuuuuuuuuuaaucgcaguacuauuuuuauaaagcaagaacu

SEQ ID NO: 675419 - RNA, 64 nt, hsa
ggggugaggacagagaggagucgaggguuuauucucgcaguagaggaacuccugguggugggaa

SEQ ID NO: 675420 - RNA, 64 nt, hsa
uugcugcuuuuacaaaaggacauucuauuuauuuucgcaguaauucucauguccccauaagcag

SEQ ID NO: 675421 - RNA, 64 nt, hsa
guagcucaggagagcaccccuccaccccauuugcucgcaguauccuagaaucuuugugcucucg

SEQ ID NO: 675422 - RNA, 64 nt, hsa
ccuagguacuguuuaguaugcaauauuuucauuuucgcaguauaauaauugcaccuguuaaaua

SEQ ID NO: 675423 - RNA, 64 nt, hsa
gagccaagguggugucagagggcaacuggaugacucgcaguaccacagcacugggacagacaga

SEQ ID NO: 675424 - RNA, 64 nt, hsa
guaagcuucguacaaaugugaaguauuaauauuaucgcaguauuauuguuguuauuauuauugu

SEQ ID NO: 675425 - RNA, 64 nt, hsa
augacguugcagggucuucaugcaauuuuccaccucgcaguaguuaguauuuacuugccuuaaa

SEQ ID NO: 675426 - RNA, 64 nt, hsa
uauugauggaaaaagaaaaagaagaaaagcaaucucgcaguacauguuacuugucgaaaaaauu

SEQ ID NO: 675427 - RNA, 64 nt, hsa
aagauacgaaauuagguggucguuggaauccugaucgcaguaaagugguccuugguaacugcuc

SEQ ID NO: 675428 - RNA, 64 nt, hsa
ugugguguugagccaccuuaagaugagggcugcuucgcaguaaaguuuccagccugggccccuc

SEQ ID NO: 675429 - RNA, 64 nt, hsa
cugcauggacuguauacucgauuucauguguaugucgcaguaaacaaaaccaaaccucuuucug

SEQ ID NO: 675430 - RNA, 64 nt, hsa
uguuucaggugcccacaucacccucauuuccuccucgcaguagcccugcaccguggccagaaac

SEQ ID NO: 675431 - RNA, 64 nt, hsa
uuagccagacuauaccuuguguagcuucaagaacucgcaguacauuaccagcugugauucucca

SEQ ID NO: 675432 - RNA, 64 nt, hsa
cuggguugagugagauguuggauauugcuaucaaucgcaguagucuuuccccugugugaggcug

SEQ ID NO: 675433 - RNA, 64 nt, hsa
uacauucugccccugaaugauucugucuagaaaagcucuggaguauugaucacuacuggaaaaa

SEQ ID NO: 675434 - RNA, 64 nt, hsa
guucaucuccagggccccaccucagaucaaagcagcucuggaugagaugggaccugcagcucuc

SEQ ID NO: 675435 - RNA, 64 nt, hsa
ccuuagauuagcucuggaccagccuguuggacccgcucuggaccaacccuguuuccugaguuug

SEQ ID NO: 675436 - RNA, 64 nt, hsa
ccaugaaucaaagacauggaauuaccuuagauuagcucuggaccagccuguuggacccgcucug

SEQ ID NO: 675437 - RNA, 64 nt, hsa
agacauacuuuuguagaaguggaccaacuucaaagcucuggacaggagacaccugcuccaggcc

SEQ ID NO: 675438 - RNA, 64 nt, hsa
gucuuggcccuaaugagaaacccuuuguaagugggcucuggauuuuugguuuuguuuucuuuuu

SEQ ID NO: 675439 - RNA, 64 nt, hsa
agaagacgagccacguaugaggugccugcccugggcucuggaccccgggcacacgagggacggu

SEQ ID NO: 675440 - RNA, 64 nt, hsa
ugugccucuggguacaaaagugccucaacgacaugcucuggaaaucccaaaugccacagucuga

SEQ ID NO: 675441 - RNA, 64 nt, hsa
cucccaccucugugaccucaggcacuagccuuuggcucuggagacagccccagagcaggguguu

SEQ ID NO: 675442 - RNA, 64 nt, hsa
accuccccacgcccuccccuccccugcugcaggggcucuggagagaaacaauaaagagauucac

SEQ ID NO: 675443 - RNA, 64 nt, hsa
cugacuucagccugugaggggaggguugagggaggcucuggaaagcccagccacaccugagucc

SEQ ID NO: 675444 - RNA, 64 nt, hsa
agcguagggagaggguggauuugugcagggugcagcucuggagaagaagcuggaucacucuugg

SEQ ID NO: 675445 - RNA, 64 nt, hsa
agggugugugggauagcgauugcauuuuccuuuugcucuggaguuucacuccccuucugggucc

SEQ ID NO: 675446 - RNA, 64 nt, hsa
gaggacuccaguugccucagguugguucugcugugcucuggaaaguaacugcagccaccaggua

SEQ ID NO: 675447 - RNA, 64 nt, hsa
ccuauuguuacuuccaauuuauaaucaagaaggggcucuggauccccuuuuaaauuacacacac

SEQ ID NO: 675448 - RNA, 64 nt, hsa
agugaccuacccaaaccuuuuguucuguaaaacugcucuggaaauaccgggaagcccaguuuuc

SEQ ID NO: 675449 - RNA, 64 nt, hsa
cugcagaugcugacaggcccugggaggcugcugugcucuggagaagcuggagcagcucauuucu

SEQ ID NO: 675450 - RNA, 64 nt, hsa
aguaaauuccugugcucugaaaugccacuugguagcucuggacaaugaaggacaauugacucaa

SEQ ID NO: 675451 - RNA, 64 nt, hsa
cggggagggguuaaagacaggaucucacucuggcgcucuggagugcaguggugugauuagggau

SEQ ID NO: 675452 - RNA, 64 nt, hsa
uaaguuauaauaaacagaaauguauuggcucagagcucuggaggcugggaaguccauaguggag

SEQ ID NO: 675453 - RNA, 64 nt, hsa
cuagggcaggggcagaguuuuggaaacagugcaggcucuggagccagacuggcgagauucaaau

SEQ ID NO: 675454 - RNA, 64 nt, hsa
ggggcagaucgggggcuugaacccagguggucaggcucuggagcccacaauugucuuacccacu

SEQ ID NO: 675455 - RNA, 64 nt, hsa
ccagcauugcugugcauggcucccucaggaagaagcucuggaguggggccgaggccccagaugc

SEQ ID NO: 675456 - RNA, 64 nt, hsa
ggugacccugccccuggcugggagcuccccuggggcucuggaaccugaagcccugagaaggaga

SEQ ID NO: 675457 - RNA, 64 nt, hsa
guggagugggcgcaggcacgccaggccuucuuuagcucuggaaagaauaaggcugccuuggagg

SEQ ID NO: 675458 - RNA, 64 nt, hsa
ugagucuccuaacccaagauggaagagccagagggcucuggagugagcagaaccucaccccauu

SEQ ID NO: 675459 - RNA, 64 nt, hsa; identical to SEQ ID NO: 603790

SEQ ID NO: 675460 - RNA, 64 nt, hsa; identical to SEQ ID NO: 603791

SEQ ID NO: 675461 - RNA, 64 nt, hsa; identical to SEQ ID NO: 603792

SEQ ID NO: 675462 - RNA, 64 nt, hsa; identical to SEQ ID NO: 603793

SEQ ID NO: 675463 - RNA, 64 nt, hsa; identical to SEQ ID NO: 603794

SEQ ID NO: 675464 - RNA, 64 nt, hsa; identical to SEQ ID NO: 603795

SEQ ID NO: 675465 - RNA, 64 nt, hsa; identical to SEQ ID NO: 603796

SEQ ID NO: 675466 - RNA, 64 nt, hsa; identical to SEQ ID NO: 603797

SEQ ID NO: 675467 - RNA, 64 nt, hsa; identical to SEQ ID NO: 603798

SEQ ID NO: 675468 - RNA, 64 nt, hsa; identical to SEQ ID NO: 603799

SEQ ID NO: 675469 - RNA, 64 nt, hsa; identical to SEQ ID NO: 603800

SEQ ID NO: 675470 - RNA, 64 nt, hsa; identical to SEQ ID NO: 603801

SEQ ID NO: 675471 - RNA, 64 nt, hsa; identical to SEQ ID NO: 603802

SEQ ID NO: 675472 - RNA, 64 nt, hsa; identical to SEQ ID NO: 603803

SEQ ID NO: 675473 - RNA, 64 nt, hsa; identical to SEQ ID NO: 409271

SEQ ID NO: 675474 - RNA, 64 nt, hsa; identical to SEQ ID NO: 409272

SEQ ID NO: 675475 - RNA, 64 nt, hsa; identical to SEQ ID NO: 409273

SEQ ID NO: 675476 - RNA, 64 nt, hsa; identical to SEQ ID NO: 409274

SEQ ID NO: 675477 - RNA, 64 nt, hsa; identical to SEQ ID NO: 125298

SEQ ID NO: 675478 - RNA, 64 nt, hsa; identical to SEQ ID NO: 125299

SEQ ID NO: 675479 - RNA, 64 nt, hsa; identical to SEQ ID NO: 125300

SEQ ID NO: 675480 - RNA, 64 nt, hsa; identical to SEQ ID NO: 125301

SEQ ID NO: 675481 - RNA, 64 nt, hsa; identical to SEQ ID NO: 125302

SEQ ID NO: 675482 - RNA, 64 nt, hsa; identical to SEQ ID NO: 125303

SEQ ID NO: 675483 - RNA, 64 nt, hsa; identical to SEQ ID NO: 125304

SEQ ID NO: 675484 - RNA, 64 nt, hsa; identical to SEQ ID NO: 125305

SEQ ID NO: 675485 - RNA, 64 nt, hsa; identical to SEQ ID NO: 125306

SEQ ID NO: 675486 - RNA, 64 nt, hsa; identical to SEQ ID NO: 125307

SEQ ID NO: 675487 - RNA, 64 nt, hsa; identical to SEQ ID NO: 125308

SEQ ID NO: 675488 - RNA, 64 nt, hsa; identical to SEQ ID NO: 125309

SEQ ID NO: 675489 - RNA, 64 nt, hsa; identical to SEQ ID NO: 125310

SEQ ID NO: 675490 - RNA, 64 nt, hsa; identical to SEQ ID NO: 125311

SEQ ID NO: 675491 - RNA, 64 nt, hsa; identical to SEQ ID NO: 125312

SEQ ID NO: 675492 - RNA, 64 nt, hsa; identical to SEQ ID NO: 125313

SEQ ID NO: 675493 - RNA, 64 nt, hsa; identical to SEQ ID NO: 603880

SEQ ID NO: 675494 - RNA, 64 nt, hsa; identical to SEQ ID NO: 603881

SEQ ID NO: 675495 - RNA, 64 nt, hsa; identical to SEQ ID NO: 603882

SEQ ID NO: 675496 - RNA, 64 nt, hsa; identical to SEQ ID NO: 603883

SEQ ID NO: 675497 - RNA, 64 nt, hsa; identical to SEQ ID NO: 603884

SEQ ID NO: 675498 - RNA, 64 nt, hsa; identical to SEQ ID NO: 603885

SEQ ID NO: 675499 - RNA, 64 nt, hsa; identical to SEQ ID NO: 603886

SEQ ID NO: 675500 - RNA, 64 nt, hsa; identical to SEQ ID NO: 603887

SEQ ID NO: 675501 - RNA, 64 nt, hsa; identical to SEQ ID NO: 603888

SEQ ID NO: 675502 - RNA, 64 nt, hsa; identical to SEQ ID NO: 603889

SEQ ID NO: 675503 - RNA, 64 nt, hsa; identical to SEQ ID NO: 603890

SEQ ID NO: 675504 - RNA, 64 nt, hsa; identical to SEQ ID NO: 603891

SEQ ID NO: 675505 - RNA, 64 nt, hsa; identical to SEQ ID NO: 603892

SEQ ID NO: 675506 - RNA, 64 nt, hsa; identical to SEQ ID NO: 603893

SEQ ID NO: 675507 - RNA, 64 nt, hsa; identical to SEQ ID NO: 603894

SEQ ID NO: 675508 - RNA, 64 nt, hsa; identical to SEQ ID NO: 603895

SEQ ID NO: 675509 - RNA, 64 nt, hsa; identical to SEQ ID NO: 603896

SEQ ID NO: 675510 - RNA, 64 nt, hsa; identical to SEQ ID NO: 603897

SEQ ID NO: 675511 - RNA, 64 nt, hsa; identical to SEQ ID NO: 603898

SEQ ID NO: 675512 - RNA, 64 nt, hsa; identical to SEQ ID NO: 603899

SEQ ID NO: 675513 - RNA, 64 nt, hsa; identical to SEQ ID NO: 603900

SEQ ID NO: 675514 - RNA, 64 nt, hsa; identical to SEQ ID NO: 603901

SEQ ID NO: 675515 - RNA, 64 nt, hsa; identical to SEQ ID NO: 603902

SEQ ID NO: 675516 - RNA, 64 nt, hsa; identical to SEQ ID NO: 603903

SEQ ID NO: 675517 - RNA, 64 nt, hsa; identical to SEQ ID NO: 603904

SEQ ID NO: 675518 - RNA, 64 nt, hsa; identical to SEQ ID NO: 603905

SEQ ID NO: 675519 - RNA, 64 nt, hsa; identical to SEQ ID NO: 603906

SEQ ID NO: 675520 - RNA, 64 nt, hsa; identical to SEQ ID NO: 603907

SEQ ID NO: 675521 - RNA, 64 nt, hsa; identical to SEQ ID NO: 603908

SEQ ID NO: 675522 - RNA, 64 nt, hsa; identical to SEQ ID NO: 603909

SEQ ID NO: 675523 - RNA, 64 nt, hsa; identical to SEQ ID NO: 603910

SEQ ID NO: 675524 - RNA, 64 nt, hsa; identical to SEQ ID NO: 603911

SEQ ID NO: 675525 - RNA, 64 nt, hsa; identical to SEQ ID NO: 603912

SEQ ID NO: 675526 - RNA, 64 nt, hsa; identical to SEQ ID NO: 603913

SEQ ID NO: 675527 - RNA, 64 nt, hsa; identical to SEQ ID NO: 603914

SEQ ID NO: 675528 - RNA, 64 nt, hsa
cuuuugcuuuuaaaauaguuacaauauuuuucaugauagccacaguauugccacaguuuauuau

SEQ ID NO: 675529 - RNA, 64 nt, hsa
uggagaacuccauguacuuuggaaucuccuccaagauagccagaguuuaauacaucuucauucu

SEQ ID NO: 675530 - RNA, 64 nt, hsa
ugacaacacuagggcuguuguacaaaauaguaaugauagccauggaaguuuuaccuuauucugu

SEQ ID NO: 675531 - RNA, 64 nt, hsa
ugauaaaggccaauuccagguagcucuugaaggugauagccaucuacuuuccaguggcugccaa

SEQ ID NO: 675532 - RNA, 64 nt, hsa
agagccuccccgacccacuaccuggagauagccagauagccagaugcccugcuccuggccaccu

SEQ ID NO: 675533 - RNA, 64 nt, hsa
gcagucucagagccuccccgacccacuaccuggagauagccagauagccagaugcccugcuccu

SEQ ID NO: 675534 - RNA, 64 nt, hsa; identical to SEQ ID NO: 51971

SEQ ID NO: 675535 - RNA, 64 nt, hsa; identical to SEQ ID NO: 51972

SEQ ID NO: 675536 - RNA, 64 nt, hsa; identical to SEQ ID NO: 51973

SEQ ID NO: 675537 - RNA, 64 nt, hsa; identical to SEQ ID NO: 51974

SEQ ID NO: 675538 - RNA, 64 nt, hsa; identical to SEQ ID NO: 51975

SEQ ID NO: 675539 - RNA, 64 nt, hsa; identical to SEQ ID NO: 51976

SEQ ID NO: 675540 - RNA, 52 nt, hsa; identical to SEQ ID NO: 51977

SEQ ID NO: 675541 - RNA, 64 nt, hsa; identical to SEQ ID NO: 51978

SEQ ID NO: 675542 - RNA, 64 nt, hsa; identical to SEQ ID NO: 51979

SEQ ID NO: 675543 - RNA, 64 nt, hsa; identical to SEQ ID NO: 51980

SEQ ID NO: 675544 - RNA, 64 nt, hsa; identical to SEQ ID NO: 51981

SEQ ID NO: 675545 - RNA, 64 nt, hsa; identical to SEQ ID NO: 51982

SEQ ID NO: 675546 - RNA, 64 nt, hsa; identical to SEQ ID NO: 51983

SEQ ID NO: 675547 - RNA, 64 nt, hsa; identical to SEQ ID NO: 51984

SEQ ID NO: 675548 - RNA, 64 nt, hsa; identical to SEQ ID NO: 51985

SEQ ID NO: 675549 - RNA, 64 nt, hsa; identical to SEQ ID NO: 51986

SEQ ID NO: 675550 - RNA, 64 nt, hsa; identical to SEQ ID NO: 51987

SEQ ID NO: 675551 - RNA, 64 nt, hsa; identical to SEQ ID NO: 51988

SEQ ID NO: 675552 - RNA, 64 nt, hsa; identical to SEQ ID NO: 51989

SEQ ID NO: 675553 - RNA, 64 nt, hsa; identical to SEQ ID NO: 51990

SEQ ID NO: 675554 - RNA, 64 nt, hsa; identical to SEQ ID NO: 51991

SEQ ID NO: 675555 - RNA, 64 nt, hsa; identical to SEQ ID NO: 51992

SEQ ID NO: 675556 - RNA, 64 nt, hsa; identical to SEQ ID NO: 51993

SEQ ID NO: 675557 - RNA, 64 nt, hsa; identical to SEQ ID NO: 51994

SEQ ID NO: 675558 - RNA, 64 nt, hsa; identical to SEQ ID NO: 51995

SEQ ID NO: 675559 - RNA, 64 nt, hsa; identical to SEQ ID NO: 51996

SEQ ID NO: 675560 - RNA, 64 nt, hsa; identical to SEQ ID NO: 51997

SEQ ID NO: 675561 - RNA, 64 nt, hsa; identical to SEQ ID NO: 51998

SEQ ID NO: 675562 - RNA, 64 nt, hsa; identical to SEQ ID NO: 51999

SEQ ID NO: 675563 - RNA, 64 nt, hsa; identical to SEQ ID NO: 52000

SEQ ID NO: 675564 - RNA, 64 nt, hsa; identical to SEQ ID NO: 52001

SEQ ID NO: 675565 - RNA, 64 nt, hsa; identical to SEQ ID NO: 52002

SEQ ID NO: 675566 - RNA, 64 nt, hsa; identical to SEQ ID NO: 52003

SEQ ID NO: 675567 - RNA, 64 nt, hsa; identical to SEQ ID NO: 485050

SEQ ID NO: 675568 - RNA, 64 nt, hsa; identical to SEQ ID NO: 485051

SEQ ID NO: 675569 - RNA, 64 nt, hsa; identical to SEQ ID NO: 485052

SEQ ID NO: 675570 - RNA, 64 nt, hsa; identical to SEQ ID NO: 485053

SEQ ID NO: 675571 - RNA, 64 nt, hsa; identical to SEQ ID NO: 485054

SEQ ID NO: 675572 - RNA, 64 nt, hsa; identical to SEQ ID NO: 485055

SEQ ID NO: 675573 - RNA, 64 nt, hsa; identical to SEQ ID NO: 485056

SEQ ID NO: 675574 - RNA, 64 nt, hsa; identical to SEQ ID NO: 485057

SEQ ID NO: 675575 - RNA, 64 nt, hsa; identical to SEQ ID NO: 485058

SEQ ID NO: 675576 - RNA, 64 nt, hsa; identical to SEQ ID NO: 485059

SEQ ID NO: 675577 - RNA, 64 nt, hsa; identical to SEQ ID NO: 485060

SEQ ID NO: 675578 - RNA, 64 nt, hsa; identical to SEQ ID NO: 485061

SEQ ID NO: 675579 - RNA, 64 nt, hsa; identical to SEQ ID NO: 485062

SEQ ID NO: 675580 - RNA, 64 nt, hsa; identical to SEQ ID NO: 485063

SEQ ID NO: 675581 - RNA, 64 nt, hsa; identical to SEQ ID NO: 485064

SEQ ID NO: 675582 - RNA, 64 nt, hsa; identical to SEQ ID NO: 485065

SEQ ID NO: 675583 - RNA, 64 nt, hsa; identical to SEQ ID NO: 485066

SEQ ID NO: 675584 - RNA, 64 nt, hsa; identical to SEQ ID NO: 485067

SEQ ID NO: 675585 - RNA, 64 nt, hsa; identical to SEQ ID NO: 485068

SEQ ID NO: 675586 - RNA, 64 nt, hsa; identical to SEQ ID NO: 485069

SEQ ID NO: 675587 - RNA, 64 nt, hsa; identical to SEQ ID NO: 485070

SEQ ID NO: 675588 - RNA, 64 nt, hsa; identical to SEQ ID NO: 485071

SEQ ID NO: 675589 - RNA, 64 nt, hsa; identical to SEQ ID NO: 485072

SEQ ID NO: 675590 - RNA, 64 nt, hsa; identical to SEQ ID NO: 485073

SEQ ID NO: 675591 - RNA, 64 nt, hsa; identical to SEQ ID NO: 485074

SEQ ID NO: 675592 - RNA, 64 nt, hsa; identical to SEQ ID NO: 485075

SEQ ID NO: 675593 - RNA, 64 nt, hsa; identical to SEQ ID NO: 485076

SEQ ID NO: 675594 - RNA, 64 nt, hsa; identical to SEQ ID NO: 485077

SEQ ID NO: 675595 - RNA, 64 nt, hsa; identical to SEQ ID NO: 485078

SEQ ID NO: 675596 - RNA, 64 nt, hsa; identical to SEQ ID NO: 485079

SEQ ID NO: 675597 - RNA, 64 nt, hsa; identical to SEQ ID NO: 485080

SEQ ID NO: 675598 - RNA, 64 nt, hsa; identical to SEQ ID NO: 485081

SEQ ID NO: 675599 - RNA, 64 nt, hsa; identical to SEQ ID NO: 485082

SEQ ID NO: 675600 - RNA, 64 nt, hsa; identical to SEQ ID NO: 485083

SEQ ID NO: 675601 - RNA, 64 nt, hsa; identical to SEQ ID NO: 485084

SEQ ID NO: 675602 - RNA, 64 nt, hsa; identical to SEQ ID NO: 485085

SEQ ID NO: 675603 - RNA, 64 nt, hsa; identical to SEQ ID NO: 485086

SEQ ID NO: 675604 - RNA, 64 nt, hsa; identical to SEQ ID NO: 485087

SEQ ID NO: 675605 - RNA, 64 nt, hsa; identical to SEQ ID NO: 485088

SEQ ID NO: 675606 - RNA, 64 nt, hsa; identical to SEQ ID NO: 485089

SEQ ID NO: 675607 - RNA, 64 nt, hsa; identical to SEQ ID NO: 485090

SEQ ID NO: 675608 - RNA, 64 nt, hsa; identical to SEQ ID NO: 53018

SEQ ID NO: 675609 - RNA, 64 nt, hsa; identical to SEQ ID NO: 53019

SEQ ID NO: 675610 - RNA, 64 nt, hsa; identical to SEQ ID NO: 53020

SEQ ID NO: 675611 - RNA, 64 nt, hsa; identical to SEQ ID NO: 53021

SEQ ID NO: 675612 - RNA, 64 nt, hsa; identical to SEQ ID NO: 53022

SEQ ID NO: 675613 - RNA, 64 nt, hsa; identical to SEQ ID NO: 53023

SEQ ID NO: 675614 - RNA, 64 nt, hsa; identical to SEQ ID NO: 53024

SEQ ID NO: 675615 - RNA, 64 nt, hsa; identical to SEQ ID NO: 53025

SEQ ID NO: 675616 - RNA, 64 nt, hsa; identical to SEQ ID NO: 53026

SEQ ID NO: 675617 - RNA, 64 nt, hsa; identical to SEQ ID NO: 53027

SEQ ID NO: 675618 - RNA, 64 nt, hsa; identical to SEQ ID NO: 53028

SEQ ID NO: 675619 - RNA, 64 nt, hsa; identical to SEQ ID NO: 53029

SEQ ID NO: 675620 - RNA, 64 nt, hsa; identical to SEQ ID NO: 53030

SEQ ID NO: 675621 - RNA, 64 nt, hsa; identical to SEQ ID NO: 53031

SEQ ID NO: 675622 - RNA, 64 nt, hsa; identical to SEQ ID NO: 53032

SEQ ID NO: 675623 - RNA, 64 nt, hsa; identical to SEQ ID NO: 53033

SEQ ID NO: 675624 - RNA, 64 nt, hsa; identical to SEQ ID NO: 53034

SEQ ID NO: 675625 - RNA, 64 nt, hsa; identical to SEQ ID NO: 53035

SEQ ID NO: 675626 - RNA, 64 nt, hsa; identical to SEQ ID NO: 53036

SEQ ID NO: 675627 - RNA, 64 nt, hsa; identical to SEQ ID NO: 53037

SEQ ID NO: 675628 - RNA, 64 nt, hsa; identical to SEQ ID NO: 53038

SEQ ID NO: 675629 - RNA, 64 nt, hsa; identical to SEQ ID NO: 53039

SEQ ID NO: 675630 - RNA, 64 nt, hsa; identical to SEQ ID NO: 53040

SEQ ID NO: 675631 - RNA, 64 nt, hsa; identical to SEQ ID NO: 53041

SEQ ID NO: 675632 - RNA, 64 nt, hsa; identical to SEQ ID NO: 53042

SEQ ID NO: 675633 - RNA, 64 nt, hsa; identical to SEQ ID NO: 53043

SEQ ID NO: 675634 - RNA, 64 nt, hsa; identical to SEQ ID NO: 53044

SEQ ID NO: 675635 - RNA, 64 nt, hsa; identical to SEQ ID NO: 53045

SEQ ID NO: 675636 - RNA, 64 nt, hsa; identical to SEQ ID NO: 53046

SEQ ID NO: 675637 - RNA, 64 nt, hsa; identical to SEQ ID NO: 53047

SEQ ID NO: 675638 - RNA, 64 nt, hsa; identical to SEQ ID NO: 53048

SEQ ID NO: 675639 - RNA, 64 nt, hsa; identical to SEQ ID NO: 53049

SEQ ID NO: 675640 - RNA, 64 nt, hsa; identical to SEQ ID NO: 53050

SEQ ID NO: 675641 - RNA, 64 nt, hsa; identical to SEQ ID NO: 53051

SEQ ID NO: 675642 - RNA, 64 nt, hsa; identical to SEQ ID NO: 53052

SEQ ID NO: 675643 - RNA, 64 nt, hsa; identical to SEQ ID NO: 53053

SEQ ID NO: 675644 - RNA, 64 nt, hsa; identical to SEQ ID NO: 53054

SEQ ID NO: 675645 - RNA, 64 nt, hsa; identical to SEQ ID NO: 53055

SEQ ID NO: 675646 - RNA, 64 nt, hsa; identical to SEQ ID NO: 53056

SEQ ID NO: 675647 - RNA, 64 nt, hsa; identical to SEQ ID NO: 53057

SEQ ID NO: 675648 - RNA, 64 nt, hsa; identical to SEQ ID NO: 53058

SEQ ID NO: 675649 - RNA, 64 nt, hsa; identical to SEQ ID NO: 53059

SEQ ID NO: 675650 - RNA, 64 nt, hsa; identical to SEQ ID NO: 101929

SEQ ID NO: 675651 - RNA, 64 nt, hsa; identical to SEQ ID NO: 101930

SEQ ID NO: 675652 - RNA, 64 nt, hsa; identical to SEQ ID NO: 101931

SEQ ID NO: 675653 - RNA, 64 nt, hsa; identical to SEQ ID NO: 101932

SEQ ID NO: 675654 - RNA, 64 nt, hsa; identical to SEQ ID NO: 101933

SEQ ID NO: 675655 - RNA, 64 nt, hsa; identical to SEQ ID NO: 101934

SEQ ID NO: 675656 - RNA, 64 nt, hsa; identical to SEQ ID NO: 101935

SEQ ID NO: 675657 - RNA, 64 nt, hsa; identical to SEQ ID NO: 101936

SEQ ID NO: 675658 - RNA, 64 nt, hsa; identical to SEQ ID NO: 101937

SEQ ID NO: 675659 - RNA, 64 nt, hsa; identical to SEQ ID NO: 101938

SEQ ID NO: 675660 - RNA, 64 nt, hsa; identical to SEQ ID NO: 101939

SEQ ID NO: 675661 - RNA, 64 nt, hsa; identical to SEQ ID NO: 101940

SEQ ID NO: 675662 - RNA, 64 nt, hsa; identical to SEQ ID NO: 101941

SEQ ID NO: 675663 - RNA, 64 nt, hsa; identical to SEQ ID NO: 101942

SEQ ID NO: 675664 - RNA, 64 nt, hsa; identical to SEQ ID NO: 101943

SEQ ID NO: 675665 - RNA, 64 nt, hsa; identical to SEQ ID NO: 101944

SEQ ID NO: 675666 - RNA, 64 nt, hsa; identical to SEQ ID NO: 101945

SEQ ID NO: 675667 - RNA, 64 nt, hsa; identical to SEQ ID NO: 101946

SEQ ID NO: 675668 - RNA, 64 nt, hsa; identical to SEQ ID NO: 101947

SEQ ID NO: 675669 - RNA, 64 nt, hsa; identical to SEQ ID NO: 279900

SEQ ID NO: 675670 - RNA, 64 nt, hsa; identical to SEQ ID NO: 279901

SEQ ID NO: 675671 - RNA, 64 nt, hsa; identical to SEQ ID NO: 279902

SEQ ID NO: 675672 - RNA, 64 nt, hsa; identical to SEQ ID NO: 279903

SEQ ID NO: 675673 - RNA, 64 nt, hsa; identical to SEQ ID NO: 279904

SEQ ID NO: 675674 - RNA, 64 nt, hsa; identical to SEQ ID NO: 279905

SEQ ID NO: 675675 - RNA, 64 nt, hsa; identical to SEQ ID NO: 279906

SEQ ID NO: 675676 - RNA, 64 nt, hsa; identical to SEQ ID NO: 279907

SEQ ID NO: 675677 - RNA, 64 nt, hsa; identical to SEQ ID NO: 279908

SEQ ID NO: 675678 - RNA, 64 nt, hsa; identical to SEQ ID NO: 279909

SEQ ID NO: 675679 - RNA, 64 nt, hsa; identical to SEQ ID NO: 279910

SEQ ID NO: 675680 - RNA, 64 nt, hsa; identical to SEQ ID NO: 279911

SEQ ID NO: 675681 - RNA, 64 nt, hsa; identical to SEQ ID NO: 279912

SEQ ID NO: 675682 - RNA, 64 nt, hsa; identical to SEQ ID NO: 279913

SEQ ID NO: 675683 - RNA, 64 nt, hsa; identical to SEQ ID NO: 279914

SEQ ID NO: 675684 - RNA, 64 nt, hsa; identical to SEQ ID NO: 279915

SEQ ID NO: 675685 - RNA, 64 nt, hsa; identical to SEQ ID NO: 279916

SEQ ID NO: 675686 - RNA, 64 nt, hsa; identical to SEQ ID NO: 279917

SEQ ID NO: 675687 - RNA, 64 nt, hsa; identical to SEQ ID NO: 279918

SEQ ID NO: 675688 - RNA, 64 nt, hsa; identical to SEQ ID NO: 279919

SEQ ID NO: 675689 - RNA, 64 nt, hsa; identical to SEQ ID NO: 279920

SEQ ID NO: 675690 - RNA, 64 nt, hsa; identical to SEQ ID NO: 279921

SEQ ID NO: 675691 - RNA, 64 nt, hsa; identical to SEQ ID NO: 279922

SEQ ID NO: 675692 - RNA, 57 nt, hsa; identical to SEQ ID NO: 244788

SEQ ID NO: 675693 - RNA, 64 nt, hsa; identical to SEQ ID NO: 279924

SEQ ID NO: 675694 - RNA, 64 nt, hsa; identical to SEQ ID NO: 279925

SEQ ID NO: 675695 - RNA, 64 nt, hsa; identical to SEQ ID NO: 279926

SEQ ID NO: 675696 - RNA, 64 nt, hsa; identical to SEQ ID NO: 279927

SEQ ID NO: 675697 - RNA, 64 nt, hsa; identical to SEQ ID NO: 279928

SEQ ID NO: 675698 - RNA, 64 nt, hsa; identical to SEQ ID NO: 279929

SEQ ID NO: 675699 - RNA, 64 nt, hsa; identical to SEQ ID NO: 279930

SEQ ID NO: 675700 - RNA, 64 nt, hsa; identical to SEQ ID NO: 279931

SEQ ID NO: 675701 - RNA, 64 nt, hsa; identical to SEQ ID NO: 279932

SEQ ID NO: 675702 - RNA, 64 nt, hsa; identical to SEQ ID NO: 279933

SEQ ID NO: 675703 - RNA, 64 nt, hsa; identical to SEQ ID NO: 279934

SEQ ID NO: 675704 - RNA, 64 nt, hsa; identical to SEQ ID NO: 279935

SEQ ID NO: 675705 - RNA, 64 nt, hsa; identical to SEQ ID NO: 279936

SEQ ID NO: 675706 - RNA, 64 nt, hsa; identical to SEQ ID NO: 279937

SEQ ID NO: 675707 - RNA, 64 nt, hsa; identical to SEQ ID NO: 279938

SEQ ID NO: 675708 - RNA, 64 nt, hsa
ggcugucaugguccuuugcagagcugcugcuuuuggcauucauagauaaacagcucaggcauaa

SEQ ID NO: 675709 - RNA, 64 nt, hsa
gugaaauggagaugauaacacugugucuuagguuggcauucaggucacaugaaaggugugugga

SEQ ID NO: 675710 - RNA, 64 nt, hsa
aagaaucuagucuuuguaauagaaguuucccaguggcauucacuagugagaguuuuagacaaau

SEQ ID NO: 675711 - RNA, 64 nt, hsa
cuuuggugaaauguccuguacagaacaguaccuuggcauucagcagcuguaauuggggaacauu

SEQ ID NO: 675712 - RNA, 64 nt, hsa
accaccugucccaggcuguggugccacccucucuggcauucaugcagagcaaagcacuuuaacc

SEQ ID NO: 675713 - RNA, 64 nt, hsa
ggcucaaacugaaagaguguggguucuaaguacaggcauucaaggcugggggaaggaaagcuac

SEQ ID NO: 675714 - RNA, 64 nt, hsa
ggcuuccugcguguguaaaagucgagguauugcuggcauucagggugacaugaugguacuaaau

SEQ ID NO: 675715 - RNA, 64 nt, hsa
guaaauacuguaauauauuuauuaauauuugaaaggcauucauucaguggacagugggaauuaa

SEQ ID NO: 675716 - RNA, 64 nt, hsa
cugucagaggagccuuucgauaucuggggaacuuggcauucaacauuaaaaagcggauccaaag

SEQ ID NO: 675717 - RNA, 64 nt, hsa
cugcagucggaaguuuccuuuuccgugggagggaggcauucaucuacagacuccaacaaggccu

SEQ ID NO: 675718 - RNA, 64 nt, hsa; identical to SEQ ID NO: 246526

SEQ ID NO: 675719 - RNA, 64 nt, hsa; identical to SEQ ID NO: 246527

SEQ ID NO: 675720 - RNA, 64 nt, hsa; identical to SEQ ID NO: 246528

SEQ ID NO: 675721 - RNA, 64 nt, hsa; identical to SEQ ID NO: 246529

SEQ ID NO: 675722 - RNA, 64 nt, hsa; identical to SEQ ID NO: 246530

SEQ ID NO: 675723 - RNA, 64 nt, hsa; identical to SEQ ID NO: 246531

SEQ ID NO: 675724 - RNA, 64 nt, hsa; identical to SEQ ID NO: 246532

SEQ ID NO: 675725 - RNA, 64 nt, hsa; identical to SEQ ID NO: 246533

SEQ ID NO: 675726 - RNA, 64 nt, hsa; identical to SEQ ID NO: 246534

SEQ ID NO: 675727 - RNA, 64 nt, hsa; identical to SEQ ID NO: 246535

SEQ ID NO: 675728 - RNA, 64 nt, hsa; identical to SEQ ID NO: 246536

SEQ ID NO: 675729 - RNA, 64 nt, hsa; identical to SEQ ID NO: 246537

SEQ ID NO: 675730 - RNA, 59 nt, hsa; identical to SEQ ID NO: 246538

SEQ ID NO: 675731 - RNA, 64 nt, hsa; identical to SEQ ID NO: 246539

SEQ ID NO: 675732 - RNA, 64 nt, hsa; identical to SEQ ID NO: 246540

SEQ ID NO: 675733 - RNA, 64 nt, hsa; identical to SEQ ID NO: 246541

SEQ ID NO: 675734 - RNA, 64 nt, hsa
uuguacauuuaaagcagcuguuuuggggucugugagaguacauguauuauauacaagcacaaca

SEQ ID NO: 675735 - RNA, 64 nt, hsa
uugcugcaaauucugcagcugucugcugcucuaaagaguacagugcacuagagggaaguguucc

SEQ ID NO: 675736 - RNA, 64 nt, hsa
ccaagcccaccccauugccaacagggccagggcaagaguacacacaggggccucauaccauaug

SEQ ID NO: 675737 - RNA, 64 nt, hsa
gaccucauuccccagaaaaggcuccucccacaccagaguacagccuggguagggggaaaaucag

SEQ ID NO: 675738 - RNA, 64 nt, hsa
ugagaguacaccccaacagcacccucuccagaugagaguacaccccaacagcacccucuccaga

SEQ ID NO: 675739 - RNA, 64 nt, hsa; identical to SEQ ID NO: 675738

SEQ ID NO: 675740 - RNA, 64 nt, hsa
augggagugcccccaacagcacccucuccagaugagaguacaccccaacagcacccucuccaga

SEQ ID NO: 675741 - RNA, 64 nt, hsa
caccaccacgaggggcaucugcaaagagggcaacgcuagacacagaauccguggaaggugcagc

SEQ ID NO: 675742 - RNA, 64 nt, hsa
acugugccucaggauaaggacccgccaugcccuggcuagacagugugugguuaguaggaaucuc

SEQ ID NO: 675743 - RNA, 64 nt, hsa
caccuuccagugaaauucugaaagucuuaucuuaaaaaucgauccgcuuaccaugggccuauuc

SEQ ID NO: 675744 - RNA, 64 nt, hsa
agcuuuuuguaaaugcguccugauaaugauuaggaaaaucgaccuuuucauccaugaugaccau

SEQ ID NO: 675745 - RNA, 64 nt, hsa; identical to SEQ ID NO: 127462

SEQ ID NO: 675746 - RNA, 64 nt, hsa; identical to SEQ ID NO: 127463

SEQ ID NO: 675747 - RNA, 64 nt, hsa; identical to SEQ ID NO: 127464

SEQ ID NO: 675748 - RNA, 64 nt, hsa; identical to SEQ ID NO: 127465

SEQ ID NO: 675749 - RNA, 64 nt, hsa; identical to SEQ ID NO: 127466

SEQ ID NO: 675750 - RNA, 64 nt, hsa; identical to SEQ ID NO: 127467

SEQ ID NO: 675751 - RNA, 64 nt, hsa; identical to SEQ ID NO: 127468

SEQ ID NO: 675752 - RNA, 64 nt, hsa; identical to SEQ ID NO: 127469

SEQ ID NO: 675753 - RNA, 64 nt, hsa; identical to SEQ ID NO: 127470

SEQ ID NO: 675754 - RNA, 64 nt, hsa; identical to SEQ ID NO: 127471

SEQ ID NO: 675755 - RNA, 64 nt, hsa; identical to SEQ ID NO: 127472

SEQ ID NO: 675756 - RNA, 64 nt, hsa; identical to SEQ ID NO: 127473

SEQ ID NO: 675757 - RNA, 64 nt, hsa; identical to SEQ ID NO: 127474

SEQ ID NO: 675758 - RNA, 64 nt, hsa; identical to SEQ ID NO: 127475

SEQ ID NO: 675759 - RNA, 64 nt, hsa; identical to SEQ ID NO: 127476

SEQ ID NO: 675760 - RNA, 64 nt, hsa; identical to SEQ ID NO: 127477

SEQ ID NO: 675761 - RNA, 64 nt, hsa; identical to SEQ ID NO: 127476

SEQ ID NO: 675762 - RNA, 64 nt, hsa; identical to SEQ ID NO: 127477

SEQ ID NO: 675763 - RNA, 64 nt, hsa; identical to SEQ ID NO: 127480

SEQ ID NO: 675764 - RNA, 64 nt, hsa; identical to SEQ ID NO: 127477

SEQ ID NO: 675765 - RNA, 64 nt, hsa; identical to SEQ ID NO: 127482

SEQ ID NO: 675766 - RNA, 64 nt, hsa; identical to SEQ ID NO: 127483

SEQ ID NO: 675767 - RNA, 64 nt, hsa; identical to SEQ ID NO: 127484

SEQ ID NO: 675768 - RNA, 64 nt, hsa; identical to SEQ ID NO: 127485

SEQ ID NO: 675769 - RNA, 64 nt, hsa; identical to SEQ ID NO: 127486

SEQ ID NO: 675770 - RNA, 64 nt, hsa; identical to SEQ ID NO: 127487

SEQ ID NO: 675771 - RNA, 64 nt, hsa; identical to SEQ ID NO: 127488

SEQ ID NO: 675772 - RNA, 64 nt, hsa; identical to SEQ ID NO: 127489

SEQ ID NO: 675773 - RNA, 64 nt, hsa; identical to SEQ ID NO: 127490

SEQ ID NO: 675774 - RNA, 64 nt, hsa; identical to SEQ ID NO: 127491

SEQ ID NO: 675775 - RNA, 64 nt, hsa; identical to SEQ ID NO: 127492

SEQ ID NO: 675776 - RNA, 64 nt, hsa; identical to SEQ ID NO: 127493

SEQ ID NO: 675777 - RNA, 64 nt, hsa; identical to SEQ ID NO: 127494

SEQ ID NO: 675778 - RNA, 64 nt, hsa; identical to SEQ ID NO: 127495

SEQ ID NO: 675779 - RNA, 62 nt, hsa
aaucuccucaaacccagaagguuuaaucacuucaucccaaaaaugggauugugaaugucagc

SEQ ID NO: 675780 - RNA, 62 nt, hsa
aaaagucuagguuuuaaggcugugccagaacccaucccaauaaagagaccgagucugaaguc

SEQ ID NO: 675781 - RNA, 62 nt, hsa
cugucaugugucucgaaaucagcagcccuccccaucccaaucccaggcagcuuguguguaca

SEQ ID NO: 675782 - RNA, 62 nt, hsa
uaaggaaaauuggagaugcuaacauccucccccaucccaacugcaccuuaaaauaugcaugu

SEQ ID NO: 675783 - RNA, 62 nt, hsa
aacuguaaugcuguuuuggaaucaucccaaggcaucccaagacaccauaucuucccauuuca

SEQ ID NO: 675784 - RNA, 62 nt, hsa
gccaaagaagaacuguaaugcuguuuuggaaucaucccaaggcaucccaagacaccauaucu

SEQ ID NO: 675785 - RNA, 62 nt, hsa
aguuaauacuaucauaguaauauuauuauugucaucccaagaaaaaauauauuaaaaagaua

SEQ ID NO: 675786 - RNA, 62 nt, hsa
aauuaauacuaucauguuaauacuauuauugucaucccaagaaaaaagauauuuuaaaaauu

SEQ ID NO: 675787 - RNA, 62 nt, hsa
agaggguuagaggcacuugagcaaggcccccacaucccaacucugggaguuguggugggagg

SEQ ID NO: 675788 - RNA, 62 nt, hsa
ggaucugucucuguauuccucacucccuuccccaucccaaccccuucuuucucuagauuguu

SEQ ID NO: 675789 - RNA, 64 nt, hsa; identical to SEQ ID NO: 60054

SEQ ID NO: 675790 - RNA, 64 nt, hsa; identical to SEQ ID NO: 60055

SEQ ID NO: 675791 - RNA, 64 nt, hsa; identical to SEQ ID NO: 60056

SEQ ID NO: 675792 - RNA, 64 nt, hsa; identical to SEQ ID NO: 60057

SEQ ID NO: 675793 - RNA, 64 nt, hsa; identical to SEQ ID NO: 60058

SEQ ID NO: 675794 - RNA, 64 nt, hsa; identical to SEQ ID NO: 60059

SEQ ID NO: 675795 - RNA, 64 nt, hsa; identical to SEQ ID NO: 60060

SEQ ID NO: 675796 - RNA, 64 nt, hsa; identical to SEQ ID NO: 60061

SEQ ID NO: 675797 - RNA, 64 nt, hsa; identical to SEQ ID NO: 60062

SEQ ID NO: 675798 - RNA, 64 nt, hsa; identical to SEQ ID NO: 60063

SEQ ID NO: 675799 - RNA, 64 nt, hsa; identical to SEQ ID NO: 60064

SEQ ID NO: 675800 - RNA, 64 nt, hsa; identical to SEQ ID NO: 60065

SEQ ID NO: 675801 - RNA, 64 nt, hsa; identical to SEQ ID NO: 380673

SEQ ID NO: 675802 - RNA, 64 nt, hsa; identical to SEQ ID NO: 380674

SEQ ID NO: 675803 - RNA, 64 nt, hsa; identical to SEQ ID NO: 380675

SEQ ID NO: 675804 - RNA, 64 nt, hsa; identical to SEQ ID NO: 380676

SEQ ID NO: 675805 - RNA, 63 nt, hsa; identical to SEQ ID NO: 380677

SEQ ID NO: 675806 - RNA, 64 nt, hsa; identical to SEQ ID NO: 380678

SEQ ID NO: 675807 - RNA, 64 nt, hsa; identical to SEQ ID NO: 380679

SEQ ID NO: 675808 - RNA, 64 nt, hsa; identical to SEQ ID NO: 380680

SEQ ID NO: 675809 - RNA, 64 nt, hsa; identical to SEQ ID NO: 380681

SEQ ID NO: 675810 - RNA, 64 nt, hsa; identical to SEQ ID NO: 380682

SEQ ID NO: 675811 - RNA, 64 nt, hsa; identical to SEQ ID NO: 380683

SEQ ID NO: 675812 - RNA, 64 nt, hsa; identical to SEQ ID NO: 380684

SEQ ID NO: 675813 - RNA, 64 nt, hsa; identical to SEQ ID NO: 380685

SEQ ID NO: 675814 - RNA, 64 nt, hsa; identical to SEQ ID NO: 380686

SEQ ID NO: 675815 - RNA, 58 nt, hsa; identical to SEQ ID NO: 380687

SEQ ID NO: 675816 - RNA, 64 nt, hsa; identical to SEQ ID NO: 380688

SEQ ID NO: 675817 - RNA, 64 nt, hsa; identical to SEQ ID NO: 380689

SEQ ID NO: 675818 - RNA, 64 nt, hsa; identical to SEQ ID NO: 380690

SEQ ID NO: 675819 - RNA, 64 nt, hsa; identical to SEQ ID NO: 380691

SEQ ID NO: 675820 - RNA, 64 nt, hsa; identical to SEQ ID NO: 380692

SEQ ID NO: 675821 - RNA, 64 nt, hsa; identical to SEQ ID NO: 380693

SEQ ID NO: 675822 - RNA, 64 nt, hsa; identical to SEQ ID NO: 380694

SEQ ID NO: 675823 - RNA, 64 nt, hsa; identical to SEQ ID NO: 380695

SEQ ID NO: 675824 - RNA, 64 nt, hsa; identical to SEQ ID NO: 380696

SEQ ID NO: 675825 - RNA, 64 nt, hsa; identical to SEQ ID NO: 380697

SEQ ID NO: 675826 - RNA, 64 nt, hsa; identical to SEQ ID NO: 380698

SEQ ID NO: 675827 - RNA, 64 nt, hsa; identical to SEQ ID NO: 380699

SEQ ID NO: 675828 - RNA, 64 nt, hsa; identical to SEQ ID NO: 380700

SEQ ID NO: 675829 - RNA, 64 nt, hsa; identical to SEQ ID NO: 380701

SEQ ID NO: 675830 - RNA, 64 nt, hsa; identical to SEQ ID NO: 547068

SEQ ID NO: 675831 - RNA, 64 nt, hsa; identical to SEQ ID NO: 547069

SEQ ID NO: 675832 - RNA, 64 nt, hsa; identical to SEQ ID NO: 547070

SEQ ID NO: 675833 - RNA, 64 nt, hsa; identical to SEQ ID NO: 547071

SEQ ID NO: 675834 - RNA, 64 nt, hsa; identical to SEQ ID NO: 547072

SEQ ID NO: 675835 - RNA, 64 nt, hsa; identical to SEQ ID NO: 547073

SEQ ID NO: 675836 - RNA, 64 nt, hsa; identical to SEQ ID NO: 547074

SEQ ID NO: 675837 - RNA, 64 nt, hsa; identical to SEQ ID NO: 547075

SEQ ID NO: 675838 - RNA, 64 nt, hsa; identical to SEQ ID NO: 547076

SEQ ID NO: 675839 - RNA, 64 nt, hsa; identical to SEQ ID NO: 547077

SEQ ID NO: 675840 - RNA, 64 nt, hsa; identical to SEQ ID NO: 547078

SEQ ID NO: 675841 - RNA, 64 nt, hsa; identical to SEQ ID NO: 547079

SEQ ID NO: 675842 - RNA, 64 nt, hsa; identical to SEQ ID NO: 547080

SEQ ID NO: 675843 - RNA, 64 nt, hsa; identical to SEQ ID NO: 547081

SEQ ID NO: 675844 - RNA, 64 nt, hsa; identical to SEQ ID NO: 547082

SEQ ID NO: 675845 - RNA, 64 nt, hsa; identical to SEQ ID NO: 547083

SEQ ID NO: 675846 - RNA, 64 nt, hsa; identical to SEQ ID NO: 547084

SEQ ID NO: 675847 - RNA, 64 nt, hsa; identical to SEQ ID NO: 547085

SEQ ID NO: 675848 - RNA, 64 nt, hsa; identical to SEQ ID NO: 547086

SEQ ID NO: 675849 - RNA, 64 nt, hsa; identical to SEQ ID NO: 547087

SEQ ID NO: 675850 - RNA, 64 nt, hsa; identical to SEQ ID NO: 547088

SEQ ID NO: 675851 - RNA, 64 nt, hsa; identical to SEQ ID NO: 547089

SEQ ID NO: 675852 - RNA, 64 nt, hsa; identical to SEQ ID NO: 547090

SEQ ID NO: 675853 - RNA, 64 nt, hsa; identical to SEQ ID NO: 547091

SEQ ID NO: 675854 - RNA, 64 nt, hsa; identical to SEQ ID NO: 547092

SEQ ID NO: 675855 - RNA, 64 nt, hsa; identical to SEQ ID NO: 547093

SEQ ID NO: 675856 - RNA, 64 nt, hsa; identical to SEQ ID NO: 547094

SEQ ID NO: 675857 - RNA, 64 nt, hsa; identical to SEQ ID NO: 547095

SEQ ID NO: 675858 - RNA, 64 nt, hsa; identical to SEQ ID NO: 547096

SEQ ID NO: 675859 - RNA, 64 nt, hsa; identical to SEQ ID NO: 547097

SEQ ID NO: 675860 - RNA, 64 nt, hsa; identical to SEQ ID NO: 547098

SEQ ID NO: 675861 - RNA, 64 nt, hsa; identical to SEQ ID NO: 547099

SEQ ID NO: 675862 - RNA, 64 nt, hsa; identical to SEQ ID NO: 547100

SEQ ID NO: 675863 - RNA, 64 nt, hsa; identical to SEQ ID NO: 547101

SEQ ID NO: 675864 - RNA, 64 nt, hsa; identical to SEQ ID NO: 547102

SEQ ID NO: 675865 - RNA, 64 nt, hsa; identical to SEQ ID NO: 547103

SEQ ID NO: 675866 - RNA, 64 nt, hsa; identical to SEQ ID NO: 547104

SEQ ID NO: 675867 - RNA, 64 nt, hsa; identical to SEQ ID NO: 547105

SEQ ID NO: 675868 - RNA, 64 nt, hsa; identical to SEQ ID NO: 547106

SEQ ID NO: 675869 - RNA, 64 nt, hsa; identical to SEQ ID NO: 547107

SEQ ID NO: 675870 - RNA, 64 nt, hsa; identical to SEQ ID NO: 547108

SEQ ID NO: 675871 - RNA, 64 nt, hsa; identical to SEQ ID NO: 547109

SEQ ID NO: 675872 - RNA, 64 nt, hsa; identical to SEQ ID NO: 547110

SEQ ID NO: 675873 - RNA, 64 nt, hsa; identical to SEQ ID NO: 547111

SEQ ID NO: 675874 - RNA, 64 nt, hsa; identical to SEQ ID NO: 547112

SEQ ID NO: 675875 - RNA, 64 nt, hsa; identical to SEQ ID NO: 547113

SEQ ID NO: 675876 - RNA, 64 nt, hsa; identical to SEQ ID NO: 547114

SEQ ID NO: 675877 - RNA, 64 nt, hsa; identical to SEQ ID NO: 547115

SEQ ID NO: 675878 - RNA, 64 nt, hsa; identical to SEQ ID NO: 547116

SEQ ID NO: 675879 - RNA, 64 nt, hsa; identical to SEQ ID NO: 547117

SEQ ID NO: 675880 - RNA, 64 nt, hsa; identical to SEQ ID NO: 547118

SEQ ID NO: 675881 - RNA, 64 nt, hsa; identical to SEQ ID NO: 547119

SEQ ID NO: 675882 - RNA, 64 nt, hsa; identical to SEQ ID NO: 547120

SEQ ID NO: 675883 - RNA, 64 nt, hsa; identical to SEQ ID NO: 547121

SEQ ID NO: 675884 - RNA, 64 nt, hsa; identical to SEQ ID NO: 547122

SEQ ID NO: 675885 - RNA, 64 nt, hsa; identical to SEQ ID NO: 547123

SEQ ID NO: 675886 - RNA, 64 nt, hsa; identical to SEQ ID NO: 547124

SEQ ID NO: 675887 - RNA, 64 nt, hsa; identical to SEQ ID NO: 547125

SEQ ID NO: 675888 - RNA, 64 nt, hsa; identical to SEQ ID NO: 547126

SEQ ID NO: 675889 - RNA, 64 nt, hsa; identical to SEQ ID NO: 547127

SEQ ID NO: 675890 - RNA, 64 nt, hsa; identical to SEQ ID NO: 547128

SEQ ID NO: 675891 - RNA, 64 nt, hsa; identical to SEQ ID NO: 547129

SEQ ID NO: 675892 - RNA, 64 nt, hsa; identical to SEQ ID NO: 547130

SEQ ID NO: 675893 - RNA, 64 nt, hsa
gaaauaagcugcgugugguggcucacaccuguaaucccaacacuuugggacguugaaaugggag

SEQ ID NO: 675894 - RNA, 64 nt, hsa
aaacuaggccaggcgugguggcucacgccuguaaucccaacacuuugggaggccgaggcgggcg

SEQ ID NO: 675895 - RNA, 64 nt, hsa
uuagcaggaugggcgcaguggcucacgccacuaaucccaacauuuuaggaggccuaggcaggag

SEQ ID NO: 675896 - RNA, 64 nt, hsa
aaaaaaggcugggugugguggcucacacccauaaucccaacacuuuggcucagcagauugcuug

SEQ ID NO: 675897 - RNA, 64 nt, hsa
uuuagcuagaccuuugcuuccuucuugccagcucucccaacauacccaauccuggugaucaggg

SEQ ID NO: 675898 - RNA, 64 nt, hsa
ccuuuuaggagacugguugguuuuuuucccucuuucccaacauguuuaagaaauguaacauucu

SEQ ID NO: 675899 - RNA, 64 nt, hsa
aacauuggccaggcacgguggcucacgccuguaaucccaacacuuuaggagaccaaggcgggca

SEQ ID NO: 675900 - RNA, 64 nt, hsa
uuuucaagcugggccuaguggcgcacaccugcaaucccaacacuuugggaggccaagagaggaa

SEQ ID NO: 675901 - RNA, 64 nt, hsa
ccaccugagugacagaaaucuaaacacacauccgucccaacauuccccagaccauucagaauca

SEQ ID NO: 675902 - RNA, 64 nt, hsa
augcauuauaaguuucucaauguacaucuuuuuaucccaacacccucaaacuagaauauuuguc

SEQ ID NO: 675903 - RNA, 64 nt, hsa
auucuguauaccccuucaagcaguuguuucccauucccaacaaacuguacuuuauacaauucug

SEQ ID NO: 675904 - RNA, 64 nt, hsa
ucagugguacauaaauuuaucucgcccugcauauucccaacauacuuaacacagauguuuuuua

SEQ ID NO: 675905 - RNA, 64 nt, hsa
cccggacauguuccaagcccugccucaacuuuucucccaacacuaagcuuuccucccaacacac

SEQ ID NO: 675906 - RNA, 64 nt, hsa
cugccucaacuuuucucccaacacuaagcuuuccucccaacacacauccaucucguguguucau

SEQ ID NO: 675907 - RNA, 64 nt, hsa
ccgcaaagccgggcgcgguggcucacaccuguaaucccaacaguuuggaagaccgaggcgggug

SEQ ID NO: 675908 - RNA, 64 nt, hsa
augacuucucguagauaacuucacagucauccagucccaacaccugcucuugccugguaggaac

SEQ ID NO: 675909 - RNA, 64 nt, hsa
agaaaaggccgggcaugguggcucaugccuguaaucccaacacuuugggaggcuaaggcagcug

SEQ ID NO: 675910 - RNA, 64 nt, hsa
uguccuggccaguugcaguggcucacgccuauaaucccaacacuucgggaggccaaggugagag

SEQ ID NO: 675911 - RNA, 64 nt, hsa
aggggccgggggcagucugagagaggccauucuuucccaacaccucuuggggaguuuagggugg

SEQ ID NO: 675912 - RNA, 64 nt, hsa
cuugucacgccagacuucccacggcuccucgagaucccaacacugccagcauuucccuuccuuc

SEQ ID NO: 675913 - RNA, 64 nt, hsa
uccuguccgcccucuuccccucuaaugcucacgcucccaacacaaggugggcagggaggcacca

SEQ ID NO: 675914 - RNA, 64 nt, hsa
caaagcuuuccuggagagucucacuccccuccuuucccaacacuucagacugcaagugagcaaa

SEQ ID NO: 675915 - RNA, 64 nt, hsa
aaaauguagaacuuuaaccaaagacuugucccuuuuaaagcaaaauggggauugaagggacuua

SEQ ID NO: 675916 - RNA, 64 nt, hsa
accaaaguguuugagaacuucauccaaaccuacuuuaaagcauuaugugcaauuaaguuguuau

SEQ ID NO: 675917 - RNA, 64 nt, hsa
acagaggaaaucuguaacagguauuuuguuucuuuuaaagcaagcaacacagaggaauuuauac

SEQ ID NO: 675918 - RNA, 64 nt, hsa
cuaccuuaucacugcauuauucucuuuuaucuguuuaaagcauauagagaugaaguuuguaguu

SEQ ID NO: 675919 - RNA, 64 nt, hsa
aggucugcauuaaaaggugaaugauugaagaguguuaaagcauuagacuuagcacauucaauaa

SEQ ID NO: 675920 - RNA, 64 nt, hsa
acauugcucuuuaaagaacuuauaaacuaacgguuuaaagcagugguucucaaagugugguccc

SEQ ID NO: 675921 - RNA, 64 nt, hsa
aaaggcuuucugaaucuucucaggcaguucagauuuaaagcaccauccaaaccuuggaaauacg

SEQ ID NO: 675922 - RNA, 64 nt, hsa
uaacuugcauauauguuauuggauggguugucuuuuaaagcauuuacuaauguacucugaaauu

SEQ ID NO: 675923 - RNA, 64 nt, hsa
uuggaacugacauaauuagucuugacuuacuucauuaaagcaagauucaauuccuuguucauuu

SEQ ID NO: 675924 - RNA, 64 nt, hsa
acuucuaaggcgagccacuccacacccaggggaguuaaagcacaugaaaaagacaguggagaau

SEQ ID NO: 675925 - RNA, 64 nt, hsa
uugaacagugugaugagaauaggaaugugguguuuuaaagcaguguugcauuuuaaucaguaau

SEQ ID NO: 675926 - RNA, 64 nt, hsa
auucguauuuguauuagauauagagugacuauuuuuaaagcauguuaaaaauuuagguuuuauu

SEQ ID NO: 675927 - RNA, 64 nt, hsa
aacugauuuagcaacacagguaaaaaugcaccuuuuaaagcacuacguuuucacagacaauaac

SEQ ID NO: 675928 - RNA, 64 nt, hsa
aacuugugucauugauguaauuuaaaacuuuuguuuaaagcauuacaguauuuuucugugacca

SEQ ID NO: 675929 - RNA, 64 nt, hsa
gaccaucaauuaaugaggguuugugcuaccagaguuaaagcauaugcuaucauuguauucuuua

SEQ ID NO: 675930 - RNA, 64 nt, hsa
acuuuccagcccagcacucuucaugcucauucauuuaaagcauucaacauuguguaaaugaauc

SEQ ID NO: 675931 - RNA, 64 nt, hsa
aaagacacaacauaccagaaucucugggacacauuuaaagcaguguguagagggaaauuuauag

SEQ ID NO: 675932 - RNA, 64 nt, hsa
acacuccuuucugaaaagccagaagaaggggguuuuaaagcaggaucucucaauguucaguguu

SEQ ID NO: 675933 - RNA, 64 nt, hsa
uuugugaacuuuaagguuuugaaagaaucuucaauuaaagcauggcagauucaccuguaaauau

SEQ ID NO: 675934 - RNA, 64 nt, hsa
agcacaauaaauuuccuuaaaauuucauagcaauuuaaagcacaagcacaauguucaggcauaa

SEQ ID NO: 675935 - RNA, 64 nt, hsa
gugaagaaaauuaauuucuuucaaaguuugcuuuuuaaagcaaaguuaucagcucacucaguuu

SEQ ID NO: 675936 - RNA, 64 nt, hsa
caagugugaauccaaacaguauagcuuuuaaauuuuaaagcauuugguaaauuaucgcugaguu

SEQ ID NO: 675937 - RNA, 64 nt, hsa
aguaagguucuguuaaaauauauuugaagacccuuuaaagcagugaaucugaaacaauuuucac

SEQ ID NO: 675938 - RNA, 64 nt, hsa
ugucccuuuaaagcauugacgcacagacaaauguuuaaagcacaguaaauacgaauauaugccu

SEQ ID NO: 675939 - RNA, 64 nt, hsa
acuuugaaaaugaaucaccacauaguaugucccuuuaaagcauugacgcacagacaaauguuua

SEQ ID NO: 675940 - RNA, 64 nt, hsa
gacguccuccauaaguggagcacaggguaugggguuaaagcaugacagggagagucuucugugc

SEQ ID NO: 675941 - RNA, 64 nt, hsa
gccugaaggauucugucuuuacuggggucaaaucuuaaagcacacagcucuggacucaagacag

SEQ ID NO: 675942 - RNA, 64 nt, hsa
caccucuaaucaauucaggagaaacacauaucauuuaaagcaacauaggcuaaccuguagguaa

SEQ ID NO: 675943 - RNA, 64 nt, hsa
guagacuuugacuuuuuuauuaaaaaccuuuguauuaaagcaaguuauguuauuuuucuuuuau

SEQ ID NO: 675944 - RNA, 64 nt, hsa
gugaaaguagucuuguuuuaugaggaugucugcauuaaagcaguaaaauaagcuuuccauuuua

SEQ ID NO: 675945 - RNA, 64 nt, hsa
aaugauauguuagugccucuguuauaugucaaguuuaaagcagggcacauuguugcagcaaaau

SEQ ID NO: 675946 - RNA, 64 nt, hsa
gauaauguuacuaugacaacauuuuuacuguccuuuaaagcauugcaauagcguuuuuggauau

SEQ ID NO: 675947 - RNA, 64 nt, hsa
uuuaucagaacuguucacuuucagaaaugauuuuuuaaagcauuuuguugaaaaugcgguugcu

SEQ ID NO: 675948 - RNA, 64 nt, hsa
cggccaggauggucagugaaguuaccaggaauguuuaaagcacaaaggacuuugggugugugug

SEQ ID NO: 675949 - RNA, 64 nt, hsa
cccuccccccucucaucuuuagaacauuuagacauuaaagcaaguuucuggugagcaauggaau

SEQ ID NO: 675950 - RNA, 64 nt, hsa
gugcuugccaaagagauagggacgcauaugcuuuuuaaagcaaucuaaaaauaauaauaaguau

SEQ ID NO: 675951 - RNA, 64 nt, hsa
aaacaucguuuuuuacuucuucugguagaauuuuuuaaagcauaauuggaauccuuggauaaau

SEQ ID NO: 675952 - RNA, 64 nt, hsa
ggugugagccaccgugcccagccaaagacugcucuuaaagcaccuuuuugacagugaacauggu

SEQ ID NO: 675953 - RNA, 64 nt, hsa
aaaauggggacaggauaaaagguggcaacuaaauuuaaagcacagaagaaaugauuuccuucua

SEQ ID NO: 675954 - RNA, 64 nt, hsa
ugauuuuugccauggauuccuucuggccaagaaauuaaagcacaugugaucaauauaacaauau

SEQ ID NO: 675955 - RNA, 64 nt, hsa
uuuaaaaagguaacagaauuuuaacuguugcuuauuaaagcaacuucuuguaaacauuuaucau

SEQ ID NO: 675956 - RNA, 64 nt, hsa
gauacucuuuacaccaucaugccacgcauuguuuuuaaagcauugcguuaaaaaaaaaauuaac

SEQ ID NO: 675957 - RNA, 64 nt, hsa
guaaauauuuaccagcaacuuaacuuuuaguugauuaaagcaaaaaguaaaccaugaaauuggg

SEQ ID NO: 675958 - RNA, 64 nt, hsa
acuaugugcccuucauaguaauaaaaucucaaucuuaaagcaugaaucuaaaacauaaauauuu

SEQ ID NO: 675959 - RNA, 64 nt, hsa
aaauuagguuauuacuuuuuuuauaaccagauuuuuaaagcacuagguuuuaaaucagugggua

SEQ ID NO: 675960 - RNA, 64 nt, hsa
uaauuacaaaaugagacacaccuaucuugauauuuuaaagcaauaucagaggguguaaagaagg

SEQ ID NO: 675961 - RNA, 64 nt, hsa
auuucauucauauaugguauugcauuauuuuauuuuaaagcacuggugaggggaccucuuggug

SEQ ID NO: 675962 - RNA, 64 nt, hsa
uuuaggucaguguuuuuaaguuuuuguuuuuuuuuuaaagcaaauccuguauauguaucuacau

SEQ ID NO: 675963 - RNA, 64 nt, hsa
gaaaacugugaacuuucugcuucauguaucaguuuuaaagcagcccaggcaaagaucaucuaca

SEQ ID NO: 675964 - RNA, 64 nt, hsa
ccacucagcaggagugacagaggcagaaguuccuuuaaagcacaucuuccacuuaggaaaggaa

SEQ ID NO: 675965 - RNA, 64 nt, hsa
uuugccagaauguuuaaaauuuguucagaaaagguuaaagcaacaaguuuagccuuugugcaug

SEQ ID NO: 675966 - RNA, 64 nt, hsa
uugaguuuugcagacuugggguugggagaacaucuuaaagcauuaaagcauaguuuuuuguaug

SEQ ID NO: 675967 - RNA, 64 nt, hsa
ugcagacuugggguugggagaacaucuuaaagcauuaaagcauaguuuuuuguauggccaaccu

SEQ ID NO: 675968 - RNA, 64 nt, hsa; identical to SEQ ID NO: 308983

SEQ ID NO: 675969 - RNA, 64 nt, hsa; identical to SEQ ID NO: 308984

SEQ ID NO: 675970 - RNA, 64 nt, hsa; identical to SEQ ID NO: 308985

SEQ ID NO: 675971 - RNA, 64 nt, hsa; identical to SEQ ID NO: 308986

SEQ ID NO: 675972 - RNA, 64 nt, hsa; identical to SEQ ID NO: 308987

SEQ ID NO: 675973 - RNA, 64 nt, hsa; identical to SEQ ID NO: 308988

SEQ ID NO: 675974 - RNA, 64 nt, hsa; identical to SEQ ID NO: 308989

SEQ ID NO: 675975 - RNA, 64 nt, hsa; identical to SEQ ID NO: 308990

SEQ ID NO: 675976 - RNA, 64 nt, hsa; identical to SEQ ID NO: 308991

SEQ ID NO: 675977 - RNA, 64 nt, hsa; identical to SEQ ID NO: 308992

SEQ ID NO: 675978 - RNA, 64 nt, hsa; identical to SEQ ID NO: 308993

SEQ ID NO: 675979 - RNA, 64 nt, hsa; identical to SEQ ID NO: 308994

SEQ ID NO: 675980 - RNA, 64 nt, hsa; identical to SEQ ID NO: 308995

SEQ ID NO: 675981 - RNA, 64 nt, hsa; identical to SEQ ID NO: 308996

SEQ ID NO: 675982 - RNA, 64 nt, hsa; identical to SEQ ID NO: 308997

SEQ ID NO: 675983 - RNA, 64 nt, hsa; identical to SEQ ID NO: 308998

SEQ ID NO: 675984 - RNA, 64 nt, hsa; identical to SEQ ID NO: 308999

SEQ ID NO: 675985 - RNA, 64 nt, hsa; identical to SEQ ID NO: 309000

SEQ ID NO: 675986 - RNA, 64 nt, hsa; identical to SEQ ID NO: 309001

SEQ ID NO: 675987 - RNA, 64 nt, hsa; identical to SEQ ID NO: 309002

SEQ ID NO: 675988 - RNA, 64 nt, hsa; identical to SEQ ID NO: 309003

SEQ ID NO: 675989 - RNA, 64 nt, hsa; identical to SEQ ID NO: 309004

SEQ ID NO: 675990 - RNA, 64 nt, hsa; identical to SEQ ID NO: 309005

SEQ ID NO: 675991 - RNA, 64 nt, hsa; identical to SEQ ID NO: 309006

SEQ ID NO: 675992 - RNA, 64 nt, hsa; identical to SEQ ID NO: 309007

SEQ ID NO: 675993 - RNA, 64 nt, hsa; identical to SEQ ID NO: 309008

SEQ ID NO: 675994 - RNA, 64 nt, hsa; identical to SEQ ID NO: 309009

SEQ ID NO: 675995 - RNA, 64 nt, hsa; identical to SEQ ID NO: 309010

SEQ ID NO: 675996 - RNA, 64 nt, hsa; identical to SEQ ID NO: 309011

SEQ ID NO: 675997 - RNA, 64 nt, hsa; identical to SEQ ID NO: 309012

SEQ ID NO: 675998 - RNA, 64 nt, hsa; identical to SEQ ID NO: 309013

SEQ ID NO: 675999 - RNA, 64 nt, hsa; identical to SEQ ID NO: 309014

SEQ ID NO: 676000 - RNA, 64 nt, hsa; identical to SEQ ID NO: 309015

SEQ ID NO: 676001 - RNA, 64 nt, hsa; identical to SEQ ID NO: 309016

SEQ ID NO: 676002 - RNA, 64 nt, hsa; identical to SEQ ID NO: 309017

SEQ ID NO: 676003 - RNA, 64 nt, hsa; identical to SEQ ID NO: 309018

SEQ ID NO: 676004 - RNA, 64 nt, hsa; identical to SEQ ID NO: 309019

SEQ ID NO: 676005 - RNA, 64 nt, hsa; identical to SEQ ID NO: 309020

SEQ ID NO: 676006 - RNA, 64 nt, hsa; identical to SEQ ID NO: 309021

SEQ ID NO: 676007 - RNA, 64 nt, hsa; identical to SEQ ID NO: 309022

SEQ ID NO: 676008 - RNA, 64 nt, hsa; identical to SEQ ID NO: 309023

SEQ ID NO: 676009 - RNA, 64 nt, hsa; identical to SEQ ID NO: 309024

SEQ ID NO: 676010 - RNA, 64 nt, hsa; identical to SEQ ID NO: 309025

SEQ ID NO: 676011 - RNA, 64 nt, hsa; identical to SEQ ID NO: 309026

SEQ ID NO: 676012 - RNA, 64 nt, hsa; identical to SEQ ID NO: 309027

SEQ ID NO: 676013 - RNA, 64 nt, hsa; identical to SEQ ID NO: 309028

SEQ ID NO: 676014 - RNA, 64 nt, hsa; identical to SEQ ID NO: 309029

SEQ ID NO: 676015 - RNA, 64 nt, hsa; identical to SEQ ID NO: 309030

SEQ ID NO: 676016 - RNA, 64 nt, hsa; identical to SEQ ID NO: 309031

SEQ ID NO: 676017 - RNA, 64 nt, hsa; identical to SEQ ID NO: 309032

SEQ ID NO: 676018 - RNA, 64 nt, hsa; identical to SEQ ID NO: 309033

SEQ ID NO: 676019 - RNA, 64 nt, hsa; identical to SEQ ID NO: 309034

SEQ ID NO: 676020 - RNA, 64 nt, hsa; identical to SEQ ID NO: 309035

SEQ ID NO: 676021 - RNA, 64 nt, hsa; identical to SEQ ID NO: 309036

SEQ ID NO: 676022 - RNA, 64 nt, hsa; identical to SEQ ID NO: 309037

SEQ ID NO: 676023 - RNA, 64 nt, hsa; identical to SEQ ID NO: 309038

SEQ ID NO: 676024 - RNA, 64 nt, hsa; identical to SEQ ID NO: 309039

SEQ ID NO: 676025 - RNA, 64 nt, hsa; identical to SEQ ID NO: 309040

SEQ ID NO: 676026 - RNA, 64 nt, hsa; identical to SEQ ID NO: 309041

SEQ ID NO: 676027 - RNA, 64 nt, hsa; identical to SEQ ID NO: 309042

SEQ ID NO: 676028 - RNA, 64 nt, hsa; identical to SEQ ID NO: 309043

SEQ ID NO: 676029 - RNA, 64 nt, hsa; identical to SEQ ID NO: 309044

SEQ ID NO: 676030 - RNA, 64 nt, hsa; identical to SEQ ID NO: 309045

SEQ ID NO: 676031 - RNA, 64 nt, hsa; identical to SEQ ID NO: 309046

SEQ ID NO: 676032 - RNA, 64 nt, hsa; identical to SEQ ID NO: 309047

SEQ ID NO: 676033 - RNA, 64 nt, hsa; identical to SEQ ID NO: 309048

SEQ ID NO: 676034 - RNA, 64 nt, hsa; identical to SEQ ID NO: 309049

SEQ ID NO: 676035 - RNA, 64 nt, hsa; identical to SEQ ID NO: 309050

SEQ ID NO: 676036 - RNA, 64 nt, hsa; identical to SEQ ID NO: 309051

SEQ ID NO: 676037 - RNA, 64 nt, hsa; identical to SEQ ID NO: 309052

SEQ ID NO: 676038 - RNA, 64 nt, hsa; identical to SEQ ID NO: 309053

SEQ ID NO: 676039 - RNA, 64 nt, hsa; identical to SEQ ID NO: 309054

SEQ ID NO: 676040 - RNA, 64 nt, hsa; identical to SEQ ID NO: 309055

SEQ ID NO: 676041 - RNA, 64 nt, hsa; identical to SEQ ID NO: 309056

SEQ ID NO: 676042 - RNA, 64 nt, hsa; identical to SEQ ID NO: 309057

SEQ ID NO: 676043 - RNA, 64 nt, hsa; identical to SEQ ID NO: 309058

SEQ ID NO: 676044 - RNA, 64 nt, hsa; identical to SEQ ID NO: 309059

SEQ ID NO: 676045 - RNA, 64 nt, hsa; identical to SEQ ID NO: 309060

SEQ ID NO: 676046 - RNA, 64 nt, hsa; identical to SEQ ID NO: 309061

SEQ ID NO: 676047 - RNA, 64 nt, hsa; identical to SEQ ID NO: 309062

SEQ ID NO: 676048 - RNA, 64 nt, hsa; identical to SEQ ID NO: 309063

SEQ ID NO: 676049 - RNA, 64 nt, hsa; identical to SEQ ID NO: 309064

SEQ ID NO: 676050 - RNA, 64 nt, hsa; identical to SEQ ID NO: 309065

SEQ ID NO: 676051 - RNA, 64 nt, hsa; identical to SEQ ID NO: 309066

SEQ ID NO: 676052 - RNA, 64 nt, hsa; identical to SEQ ID NO: 309067

SEQ ID NO: 676053 - RNA, 64 nt, hsa; identical to SEQ ID NO: 309068

SEQ ID NO: 676054 - RNA, 64 nt, hsa; identical to SEQ ID NO: 309069

SEQ ID NO: 676055 - RNA, 64 nt, hsa; identical to SEQ ID NO: 309070

SEQ ID NO: 676056 - RNA, 64 nt, hsa; identical to SEQ ID NO: 309071

SEQ ID NO: 676057 - RNA, 64 nt, hsa; identical to SEQ ID NO: 309072

SEQ ID NO: 676058 - RNA, 64 nt, hsa; identical to SEQ ID NO: 309073

SEQ ID NO: 676059 - RNA, 64 nt, hsa; identical to SEQ ID NO: 309074

SEQ ID NO: 676060 - RNA, 64 nt, hsa; identical to SEQ ID NO: 309075

SEQ ID NO: 676061 - RNA, 64 nt, hsa; identical to SEQ ID NO: 309076

SEQ ID NO: 676062 - RNA, 64 nt, hsa; identical to SEQ ID NO: 309077

SEQ ID NO: 676063 - RNA, 64 nt, hsa; identical to SEQ ID NO: 309078

SEQ ID NO: 676064 - RNA, 64 nt, hsa; identical to SEQ ID NO: 309079

SEQ ID NO: 676065 - RNA, 64 nt, hsa; identical to SEQ ID NO: 309080

SEQ ID NO: 676066 - RNA, 64 nt, hsa; identical to SEQ ID NO: 309081

SEQ ID NO: 676067 - RNA, 64 nt, hsa; identical to SEQ ID NO: 309082

SEQ ID NO: 676068 - RNA, 64 nt, hsa; identical to SEQ ID NO: 309083

SEQ ID NO: 676069 - RNA, 64 nt, hsa; identical to SEQ ID NO: 309084

SEQ ID NO: 676070 - RNA, 64 nt, hsa; identical to SEQ ID NO: 309085

SEQ ID NO: 676071 - RNA, 64 nt, hsa; identical to SEQ ID NO: 309086

SEQ ID NO: 676072 - RNA, 64 nt, hsa; identical to SEQ ID NO: 309087

SEQ ID NO: 676073 - RNA, 64 nt, hsa; identical to SEQ ID NO: 309088

SEQ ID NO: 676074 - RNA, 64 nt, hsa; identical to SEQ ID NO: 309089

SEQ ID NO: 676075 - RNA, 64 nt, hsa; identical to SEQ ID NO: 309090

SEQ ID NO: 676076 - RNA, 64 nt, hsa; identical to SEQ ID NO: 309091

SEQ ID NO: 676077 - RNA, 64 nt, hsa; identical to SEQ ID NO: 309092

SEQ ID NO: 676078 - RNA, 64 nt, hsa; identical to SEQ ID NO: 309093

SEQ ID NO: 676079 - RNA, 64 nt, hsa; identical to SEQ ID NO: 309094

SEQ ID NO: 676080 - RNA, 64 nt, hsa; identical to SEQ ID NO: 309095

SEQ ID NO: 676081 - RNA, 64 nt, hsa; identical to SEQ ID NO: 309096

SEQ ID NO: 676082 - RNA, 64 nt, hsa; identical to SEQ ID NO: 309097

SEQ ID NO: 676083 - RNA, 64 nt, hsa; identical to SEQ ID NO: 309098

SEQ ID NO: 676084 - RNA, 64 nt, hsa; identical to SEQ ID NO: 309099

SEQ ID NO: 676085 - RNA, 64 nt, hsa; identical to SEQ ID NO: 309100

SEQ ID NO: 676086 - RNA, 64 nt, hsa; identical to SEQ ID NO: 309101

SEQ ID NO: 676087 - RNA, 64 nt, hsa; identical to SEQ ID NO: 309102

SEQ ID NO: 676088 - RNA, 64 nt, hsa; identical to SEQ ID NO: 309103

SEQ ID NO: 676089 - RNA, 64 nt, hsa; identical to SEQ ID NO: 309104

SEQ ID NO: 676090 - RNA, 64 nt, hsa; identical to SEQ ID NO: 309105

SEQ ID NO: 676091 - RNA, 64 nt, hsa; identical to SEQ ID NO: 309106

SEQ ID NO: 676092 - RNA, 64 nt, hsa; identical to SEQ ID NO: 309107

SEQ ID NO: 676093 - RNA, 64 nt, hsa; identical to SEQ ID NO: 309108

SEQ ID NO: 676094 - RNA, 64 nt, hsa; identical to SEQ ID NO: 309109

SEQ ID NO: 676095 - RNA, 64 nt, hsa; identical to SEQ ID NO: 309110

SEQ ID NO: 676096 - RNA, 64 nt, hsa; identical to SEQ ID NO: 309111

SEQ ID NO: 676097 - RNA, 64 nt, hsa; identical to SEQ ID NO: 309112

SEQ ID NO: 676098 - RNA, 64 nt, hsa; identical to SEQ ID NO: 309113

SEQ ID NO: 676099 - RNA, 64 nt, hsa; identical to SEQ ID NO: 309114

SEQ ID NO: 676100 - RNA, 64 nt, hsa; identical to SEQ ID NO: 309115

SEQ ID NO: 676101 - RNA, 64 nt, hsa; identical to SEQ ID NO: 309116

SEQ ID NO: 676102 - RNA, 64 nt, hsa; identical to SEQ ID NO: 309117

SEQ ID NO: 676103 - RNA, 64 nt, hsa; identical to SEQ ID NO: 309118

SEQ ID NO: 676104 - RNA, 64 nt, hsa; identical to SEQ ID NO: 309119

SEQ ID NO: 676105 - RNA, 64 nt, hsa; identical to SEQ ID NO: 309120

SEQ ID NO: 676106 - RNA, 64 nt, hsa; identical to SEQ ID NO: 309121

SEQ ID NO: 676107 - RNA, 64 nt, hsa; identical to SEQ ID NO: 309122

SEQ ID NO: 676108 - RNA, 64 nt, hsa; identical to SEQ ID NO: 309123

SEQ ID NO: 676109 - RNA, 64 nt, hsa; identical to SEQ ID NO: 309124

SEQ ID NO: 676110 - RNA, 53 nt, hsa; identical to SEQ ID NO: 309125

SEQ ID NO: 676111 - RNA, 64 nt, hsa; identical to SEQ ID NO: 309126

SEQ ID NO: 676112 - RNA, 64 nt, hsa; identical to SEQ ID NO: 309127

SEQ ID NO: 676113 - RNA, 64 nt, hsa; identical to SEQ ID NO: 309128

SEQ ID NO: 676114 - RNA, 64 nt, hsa; identical to SEQ ID NO: 309129

SEQ ID NO: 676115 - RNA, 64 nt, hsa; identical to SEQ ID NO: 309130

SEQ ID NO: 676116 - RNA, 64 nt, hsa; identical to SEQ ID NO: 309131

SEQ ID NO: 676117 - RNA, 64 nt, hsa; identical to SEQ ID NO: 309132

SEQ ID NO: 676118 - RNA, 64 nt, hsa; identical to SEQ ID NO: 309133

SEQ ID NO: 676119 - RNA, 64 nt, hsa; identical to SEQ ID NO: 309134

SEQ ID NO: 676120 - RNA, 64 nt, hsa; identical to SEQ ID NO: 309135

SEQ ID NO: 676121 - RNA, 64 nt, hsa; identical to SEQ ID NO: 309136

SEQ ID NO: 676122 - RNA, 64 nt, hsa; identical to SEQ ID NO: 309137

SEQ ID NO: 676123 - RNA, 64 nt, hsa; identical to SEQ ID NO: 309138

SEQ ID NO: 676124 - RNA, 64 nt, hsa; identical to SEQ ID NO: 309139

SEQ ID NO: 676125 - RNA, 64 nt, hsa; identical to SEQ ID NO: 309140

SEQ ID NO: 676126 - RNA, 64 nt, hsa; identical to SEQ ID NO: 309141

SEQ ID NO: 676127 - RNA, 64 nt, hsa; identical to SEQ ID NO: 309142

SEQ ID NO: 676128 - RNA, 64 nt, hsa; identical to SEQ ID NO: 309143

SEQ ID NO: 676129 - RNA, 64 nt, hsa; identical to SEQ ID NO: 309144

SEQ ID NO: 676130 - RNA, 64 nt, hsa; identical to SEQ ID NO: 309145

SEQ ID NO: 676131 - RNA, 64 nt, hsa; identical to SEQ ID NO: 309146

SEQ ID NO: 676132 - RNA, 64 nt, hsa; identical to SEQ ID NO: 309147

SEQ ID NO: 676133 - RNA, 64 nt, hsa; identical to SEQ ID NO: 309148

SEQ ID NO: 676134 - RNA, 64 nt, hsa; identical to SEQ ID NO: 309149

SEQ ID NO: 676135 - RNA, 64 nt, hsa; identical to SEQ ID NO: 309150

SEQ ID NO: 676136 - RNA, 64 nt, hsa; identical to SEQ ID NO: 309151

SEQ ID NO: 676137 - RNA, 64 nt, hsa; identical to SEQ ID NO: 309152

SEQ ID NO: 676138 - RNA, 64 nt, hsa
cccauucauccauuugucccauuaguugcuguggauuaucaaguuuugaaggaacuguacaucc

SEQ ID NO: 676139 - RNA, 64 nt, hsa
uacauguuguacaagcucucaauuuuguucauuuauuaucaaauuuuuaaaauacaaguuuggu

SEQ ID NO: 676140 - RNA, 64 nt, hsa
aaacauugcugguuucaagaaaugaggugauccuauuaucaaauucaaucugaugucaaauagc

SEQ ID NO: 676141 - RNA, 64 nt, hsa
cuaccauuugcuggaaauuugacauguguguggcauuaucaaaaugaagaggagcaaggaguga

SEQ ID NO: 676142 - RNA, 64 nt, hsa
auacuuuaaaaucuguggcacccguucuacaugaauuaucaauauuugguaaauucaaucugua

SEQ ID NO: 676143 - RNA, 64 nt, hsa
auuuauguaauagguauauauuuaguggccauuuauuaucaaugguaacacaauggaguacuaa

SEQ ID NO: 676144 - RNA, 64 nt, hsa
caacuucaguuucauucacuaccauuguuuccaaauuaucaaucucugcuaguaauuaugaauu

SEQ ID NO: 676145 - RNA, 64 nt, hsa
ucucugcuaguaauuaugaauuuaagaccauauuauuaucaaaaaccuagagaccaaucauaua

SEQ ID NO: 676146 - RNA, 64 nt, hsa
cugagaugcauuuucauuuuuccuuucucuuuuuauuaucaauauugucauuuuucccuaauaa

SEQ ID NO: 676147 - RNA, 64 nt, hsa
guagacauuccuuaaguauuuguauuuauuuaugauuaucaauuuuacauaacauuaauauugu

SEQ ID NO: 676148 - RNA, 64 nt, hsa
ccaauuucuaguaaaaauauccuauauaaccauaauuaucaaaaccagaaaaacaacauuggua

SEQ ID NO: 676149 - RNA, 64 nt, hsa
gcuguuuucuugaguuuugugagcccuguagcaaauuaucaaaccugaguagggcagugggaac

SEQ ID NO: 676150 - RNA, 64 nt, hsa; identical to SEQ ID NO: 240065

SEQ ID NO: 676151 - RNA, 64 nt, hsa; identical to SEQ ID NO: 240066

SEQ ID NO: 676152 - RNA, 64 nt, hsa; identical to SEQ ID NO: 240067

SEQ ID NO: 676153 - RNA, 64 nt, hsa; identical to SEQ ID NO: 240068

SEQ ID NO: 676154 - RNA, 64 nt, hsa; identical to SEQ ID NO: 240069

SEQ ID NO: 676155 - RNA, 64 nt, hsa; identical to SEQ ID NO: 240070

SEQ ID NO: 676156 - RNA, 61 nt, hsa; identical to SEQ ID NO: 240071

SEQ ID NO: 676157 - RNA, 64 nt, hsa; identical to SEQ ID NO: 240072

SEQ ID NO: 676158 - RNA, 64 nt, hsa; identical to SEQ ID NO: 240073

SEQ ID NO: 676159 - RNA, 64 nt, hsa; identical to SEQ ID NO: 240074

SEQ ID NO: 676160 - RNA, 64 nt, hsa; identical to SEQ ID NO: 240075

SEQ ID NO: 676161 - RNA, 64 nt, hsa; identical to SEQ ID NO: 240076

SEQ ID NO: 676162 - RNA, 64 nt, hsa; identical to SEQ ID NO: 240077

SEQ ID NO: 676163 - RNA, 64 nt, hsa; identical to SEQ ID NO: 240078

SEQ ID NO: 676164 - RNA, 64 nt, hsa; identical to SEQ ID NO: 240079

SEQ ID NO: 676165 - RNA, 64 nt, hsa; identical to SEQ ID NO: 240080

SEQ ID NO: 676166 - RNA, 64 nt, hsa; identical to SEQ ID NO: 240081

SEQ ID NO: 676167 - RNA, 64 nt, hsa; identical to SEQ ID NO: 240082

SEQ ID NO: 676168 - RNA, 64 nt, hsa; identical to SEQ ID NO: 240083

SEQ ID NO: 676169 - RNA, 64 nt, hsa; identical to SEQ ID NO: 240084

SEQ ID NO: 676170 - RNA, 64 nt, hsa; identical to SEQ ID NO: 240085

SEQ ID NO: 676171 - RNA, 64 nt, hsa; identical to SEQ ID NO: 240086

SEQ ID NO: 676172 - RNA, 64 nt, hsa; identical to SEQ ID NO: 181517

SEQ ID NO: 676173 - RNA, 64 nt, hsa; identical to SEQ ID NO: 181518

SEQ ID NO: 676174 - RNA, 64 nt, hsa; identical to SEQ ID NO: 181519

SEQ ID NO: 676175 - RNA, 64 nt, hsa; identical to SEQ ID NO: 181520

SEQ ID NO: 676176 - RNA, 64 nt, hsa; identical to SEQ ID NO: 181521

SEQ ID NO: 676177 - RNA, 64 nt, hsa; identical to SEQ ID NO: 181522

SEQ ID NO: 676178 - RNA, 64 nt, hsa; identical to SEQ ID NO: 181523

SEQ ID NO: 676179 - RNA, 64 nt, hsa; identical to SEQ ID NO: 181524

SEQ ID NO: 676180 - RNA, 64 nt, hsa; identical to SEQ ID NO: 181525

SEQ ID NO: 676181 - RNA, 64 nt, hsa; identical to SEQ ID NO: 181526

SEQ ID NO: 676182 - RNA, 64 nt, hsa; identical to SEQ ID NO: 181527

SEQ ID NO: 676183 - RNA, 64 nt, hsa; identical to SEQ ID NO: 181528

SEQ ID NO: 676184 - RNA, 64 nt, hsa; identical to SEQ ID NO: 181529

SEQ ID NO: 676185 - RNA, 64 nt, hsa; identical to SEQ ID NO: 181530

SEQ ID NO: 676186 - RNA, 64 nt, hsa; identical to SEQ ID NO: 181531

SEQ ID NO: 676187 - RNA, 64 nt, hsa; identical to SEQ ID NO: 181532

SEQ ID NO: 676188 - RNA, 64 nt, hsa; identical to SEQ ID NO: 181533

SEQ ID NO: 676189 - RNA, 64 nt, hsa; identical to SEQ ID NO: 181534

SEQ ID NO: 676190 - RNA, 64 nt, hsa; identical to SEQ ID NO: 181535

SEQ ID NO: 676191 - RNA, 64 nt, hsa; identical to SEQ ID NO: 181536

SEQ ID NO: 676192 - RNA, 64 nt, hsa; identical to SEQ ID NO: 181537

SEQ ID NO: 676193 - RNA, 64 nt, hsa; identical to SEQ ID NO: 181538

SEQ ID NO: 676194 - RNA, 64 nt, hsa; identical to SEQ ID NO: 181539

SEQ ID NO: 676195 - RNA, 64 nt, hsa; identical to SEQ ID NO: 181540

SEQ ID NO: 676196 - RNA, 64 nt, hsa; identical to SEQ ID NO: 181541

SEQ ID NO: 676197 - RNA, 64 nt, hsa; identical to SEQ ID NO: 181542

SEQ ID NO: 676198 - RNA, 64 nt, hsa; identical to SEQ ID NO: 181543

SEQ ID NO: 676199 - RNA, 64 nt, hsa; identical to SEQ ID NO: 181544

SEQ ID NO: 676200 - RNA, 64 nt, hsa; identical to SEQ ID NO: 181545

SEQ ID NO: 676201 - RNA, 64 nt, hsa; identical to SEQ ID NO: 181546

SEQ ID NO: 676202 - RNA, 64 nt, hsa; identical to SEQ ID NO: 181547

SEQ ID NO: 676203 - RNA, 64 nt, hsa; identical to SEQ ID NO: 181548

SEQ ID NO: 676204 - RNA, 53 nt, hsa; identical to SEQ ID NO: 181549

SEQ ID NO: 676205 - RNA, 59 nt, hsa; identical to SEQ ID NO: 181550

SEQ ID NO: 676206 - RNA, 64 nt, hsa; identical to SEQ ID NO: 181551

SEQ ID NO: 676207 - RNA, 64 nt, hsa; identical to SEQ ID NO: 181552

SEQ ID NO: 676208 - RNA, 64 nt, hsa; identical to SEQ ID NO: 181553

SEQ ID NO: 676209 - RNA, 64 nt, hsa; identical to SEQ ID NO: 181554

SEQ ID NO: 676210 - RNA, 64 nt, hsa; identical to SEQ ID NO: 181555

SEQ ID NO: 676211 - RNA, 64 nt, hsa; identical to SEQ ID NO: 181556

SEQ ID NO: 676212 - RNA, 64 nt, hsa; identical to SEQ ID NO: 181557

SEQ ID NO: 676213 - RNA, 64 nt, hsa; identical to SEQ ID NO: 181558

SEQ ID NO: 676214 - RNA, 64 nt, hsa; identical to SEQ ID NO: 181559

SEQ ID NO: 676215 - RNA, 64 nt, hsa; identical to SEQ ID NO: 181560

SEQ ID NO: 676216 - RNA, 64 nt, hsa; identical to SEQ ID NO: 181561

SEQ ID NO: 676217 - RNA, 64 nt, hsa; identical to SEQ ID NO: 181562

SEQ ID NO: 676218 - RNA, 64 nt, hsa; identical to SEQ ID NO: 181563

SEQ ID NO: 676219 - RNA, 64 nt, hsa; identical to SEQ ID NO: 181564

SEQ ID NO: 676220 - RNA, 64 nt, hsa; identical to SEQ ID NO: 181565

SEQ ID NO: 676221 - RNA, 64 nt, hsa; identical to SEQ ID NO: 181566

SEQ ID NO: 676222 - RNA, 64 nt, hsa; identical to SEQ ID NO: 181567

SEQ ID NO: 676223 - RNA, 64 nt, hsa; identical to SEQ ID NO: 181568

SEQ ID NO: 676224 - RNA, 64 nt, hsa; identical to SEQ ID NO: 247936

SEQ ID NO: 676225 - RNA, 64 nt, hsa; identical to SEQ ID NO: 247937

SEQ ID NO: 676226 - RNA, 64 nt, hsa; identical to SEQ ID NO: 247938

SEQ ID NO: 676227 - RNA, 64 nt, hsa; identical to SEQ ID NO: 247939

SEQ ID NO: 676228 - RNA, 64 nt, hsa; identical to SEQ ID NO: 247940

SEQ ID NO: 676229 - RNA, 64 nt, hsa; identical to SEQ ID NO: 247941

SEQ ID NO: 676230 - RNA, 64 nt, hsa; identical to SEQ ID NO: 247942

SEQ ID NO: 676231 - RNA, 64 nt, hsa; identical to SEQ ID NO: 247943

SEQ ID NO: 676232 - RNA, 64 nt, hsa; identical to SEQ ID NO: 247944

SEQ ID NO: 676233 - RNA, 64 nt, hsa; identical to SEQ ID NO: 247945

SEQ ID NO: 676234 - RNA, 64 nt, hsa; identical to SEQ ID NO: 247946

SEQ ID NO: 676235 - RNA, 64 nt, hsa; identical to SEQ ID NO: 247947

SEQ ID NO: 676236 - RNA, 64 nt, hsa; identical to SEQ ID NO: 247948

SEQ ID NO: 676237 - RNA, 64 nt, hsa; identical to SEQ ID NO: 247949

SEQ ID NO: 676238 - RNA, 64 nt, hsa; identical to SEQ ID NO: 247950

SEQ ID NO: 676239 - RNA, 64 nt, hsa; identical to SEQ ID NO: 247951

SEQ ID NO: 676240 - RNA, 64 nt, hsa; identical to SEQ ID NO: 247952

SEQ ID NO: 676241 - RNA, 64 nt, hsa; identical to SEQ ID NO: 247953

SEQ ID NO: 676242 - RNA, 64 nt, hsa; identical to SEQ ID NO: 247954

SEQ ID NO: 676243 - RNA, 64 nt, hsa; identical to SEQ ID NO: 247955

SEQ ID NO: 676244 - RNA, 64 nt, hsa; identical to SEQ ID NO: 247956

SEQ ID NO: 676245 - RNA, 64 nt, hsa; identical to SEQ ID NO: 247957

SEQ ID NO: 676246 - RNA, 64 nt, hsa; identical to SEQ ID NO: 247958

SEQ ID NO: 676247 - RNA, 64 nt, hsa; identical to SEQ ID NO: 247959

SEQ ID NO: 676248 - RNA, 64 nt, hsa; identical to SEQ ID NO: 247960

SEQ ID NO: 676249 - RNA, 64 nt, hsa; identical to SEQ ID NO: 247961

SEQ ID NO: 676250 - RNA, 64 nt, hsa; identical to SEQ ID NO: 247962

SEQ ID NO: 676251 - RNA, 64 nt, hsa; identical to SEQ ID NO: 247963

SEQ ID NO: 676252 - RNA, 64 nt, hsa; identical to SEQ ID NO: 247964

SEQ ID NO: 676253 - RNA, 64 nt, hsa; identical to SEQ ID NO: 247965

SEQ ID NO: 676254 - RNA, 64 nt, hsa; identical to SEQ ID NO: 247966

SEQ ID NO: 676255 - RNA, 64 nt, hsa; identical to SEQ ID NO: 247967

SEQ ID NO: 676256 - RNA, 64 nt, hsa; identical to SEQ ID NO: 247968

SEQ ID NO: 676257 - RNA, 64 nt, hsa; identical to SEQ ID NO: 247969

SEQ ID NO: 676258 - RNA, 64 nt, hsa; identical to SEQ ID NO: 247970

SEQ ID NO: 676259 - RNA, 64 nt, hsa; identical to SEQ ID NO: 247971

SEQ ID NO: 676260 - RNA, 64 nt, hsa; identical to SEQ ID NO: 247972

SEQ ID NO: 676261 - RNA, 64 nt, hsa; identical to SEQ ID NO: 247973

SEQ ID NO: 676262 - RNA, 64 nt, hsa; identical to SEQ ID NO: 247974

SEQ ID NO: 676263 - RNA, 64 nt, hsa; identical to SEQ ID NO: 247975

SEQ ID NO: 676264 - RNA, 64 nt, hsa; identical to SEQ ID NO: 247976

SEQ ID NO: 676265 - RNA, 64 nt, hsa; identical to SEQ ID NO: 247977

SEQ ID NO: 676266 - RNA, 64 nt, hsa; identical to SEQ ID NO: 247978

SEQ ID NO: 676267 - RNA, 64 nt, hsa
ccacaagcaauagcuccaugagaggcauggacugugagacuacucccuccuguuccuccuucuc

SEQ ID NO: 676268 - RNA, 64 nt, hsa
gcagaaaggggucugugcugccucuaaaggauuaugagacuacccuuuagguugaaguuugacc

SEQ ID NO: 676269 - RNA, 64 nt, hsa
gaacuuuagucuaaagaauugagacuaccguaauugagacuacuguagugacaucugagaaaug

SEQ ID NO: 676270 - RNA, 64 nt, hsa
aguuggaugaccuaugaacuuuagucuaaagaauugagacuaccguaauugagacuacuguagu

SEQ ID NO: 676271 - RNA, 64 nt, hsa
uaaaguuaaagugacuuuuaaaggccacaucaccugagacuaggguaaucaucuuuacuucugg

SEQ ID NO: 676272 - RNA, 64 nt, hsa
caagcgauccuccugucucggccucacaaaguguugagacuacaggcaugagccacugugccca

SEQ ID NO: 676273 - RNA, 64 nt, hsa
uggagggguggagggauguuccccugagccaggcugagacuagaaccccaucuucccugagcca

SEQ ID NO: 676274 - RNA, 64 nt, hsa
cugagacuagaaccccaucuucccugagccaggcugagacuagaaccccaucuuccccaccacg

SEQ ID NO: 676275 - RNA, 64 nt, hsa
uuccugcccacaggaagggccacaggcccgcuaagccccaaaggcaggaucuaggugagucccu

SEQ ID NO: 676276 - RNA, 64 nt, hsa
acuuggcuucaagaacacaaccuuaggaccuugggccccaaaagcugguggugaaaugaggagg

SEQ ID NO: 676277 - RNA, 64 nt, hsa
ccacccacccccuaccauugagccaccaugcccagccccaaagccucuuaauugcucuaacaag

SEQ ID NO: 676278 - RNA, 64 nt, hsa
gugcugggauuacacacgugagucaccaugcccagccccaaagccauuucuugaagaauuucuc

SEQ ID NO: 676279 - RNA, 64 nt, hsa
ugcagauccacuuaggccccaggguccacggauggccccaaaggcugagggccccaaagccacu

SEQ ID NO: 676280 - RNA, 64 nt, hsa
ccccaggguccacggauggccccaaaggcugagggccccaaagccacuugucuccuaggaucca

SEQ ID NO: 676281 - RNA, 64 nt, hsa
gaaagauguuccagugaggaacccugaucucucagccccaaacacccacccaauuggcccaaca

SEQ ID NO: 676282 - RNA, 64 nt, hsa
ugauaaagucucgguuccauggaggacuugaguggccccaaaggcugccacggugcccucaccc

SEQ ID NO: 676283 - RNA, 64 nt, hsa
acuuuccaaauuggggacaagggcucuaaaaaaagccccaaaaggagaagaacaucugagaacc

SEQ ID NO: 676284 - RNA, 63 nt, hsa
ccuaucugggccacaagugaagucaacaugccugccccaaacaaauaugcaaaagguucacua

SEQ ID NO: 676285 - RNA, 64 nt, hsa
cuccauccccaacccauccucauccccaacuacagccccaaacccagccccagacuaauccaca

SEQ ID NO: 676286 - RNA, 64 nt, hsa
agccauccccaacucauccucauccccaacugcagccccaaacccaacccagggccauccccaa

SEQ ID NO: 676287 - RNA, 64 nt, hsa
ccuugaaccuaggaccaagagccaccuacauccagccccaaaacuggggcuucaggccagagca

SEQ ID NO: 676288 - RNA, 64 nt, hsa
acaggacaucugugaccgcccuacccccacgccagccccaaacuaagauaucccucacacccag

SEQ ID NO: 676289 - RNA, 64 nt, hsa; identical to SEQ ID NO: 380092

SEQ ID NO: 676290 - RNA, 64 nt, hsa; identical to SEQ ID NO: 380093

SEQ ID NO: 676291 - RNA, 64 nt, hsa; identical to SEQ ID NO: 380094

SEQ ID NO: 676292 - RNA, 64 nt, hsa; identical to SEQ ID NO: 380095

SEQ ID NO: 676293 - RNA, 64 nt, hsa
gugcuaggucagucuggcacguaagaugaacaucccuaccaauacagagcucaccaucucuuau

SEQ ID NO: 676294 - RNA, 64 nt, hsa
auguucccugacacauaucuugaauggagaccucccuaccaagugaugaaaguguugaaaaacu

SEQ ID NO: 676295 - RNA, 64 nt, hsa
aagauuaagauuauuuaugugauaaaugaaaucuccuaccaauccauccagccuuuaccaggga

SEQ ID NO: 676296 - RNA, 64 nt, hsa
aauuuagcugggcaugguggugcacaucuguaguccuaccaacuugggaggcugaggcaggaga

SEQ ID NO: 676297 - RNA, 64 nt, hsa; identical to SEQ ID NO: 189259

SEQ ID NO: 676298 - RNA, 64 nt, hsa; identical to SEQ ID NO: 189260

SEQ ID NO: 676299 - RNA, 64 nt, hsa; identical to SEQ ID NO: 189261

SEQ ID NO: 676300 - RNA, 64 nt, hsa; identical to SEQ ID NO: 189262

SEQ ID NO: 676301 - RNA, 56 nt, hsa; identical to SEQ ID NO: 189263

SEQ ID NO: 676302 - RNA, 64 nt, hsa; identical to SEQ ID NO: 189264

SEQ ID NO: 676303 - RNA, 64 nt, hsa; identical to SEQ ID NO: 189265

SEQ ID NO: 676304 - RNA, 64 nt, hsa; identical to SEQ ID NO: 189266

SEQ ID NO: 676305 - RNA, 64 nt, hsa; identical to SEQ ID NO: 189267

SEQ ID NO: 676306 - RNA, 64 nt, hsa; identical to SEQ ID NO: 189268

SEQ ID NO: 676307 - RNA, 64 nt, hsa; identical to SEQ ID NO: 189269

SEQ ID NO: 676308 - RNA, 64 nt, hsa; identical to SEQ ID NO: 189270

SEQ ID NO: 676309 - RNA, 64 nt, hsa; identical to SEQ ID NO: 189271

SEQ ID NO: 676310 - RNA, 64 nt, hsa; identical to SEQ ID NO: 189272

SEQ ID NO: 676311 - RNA, 64 nt, hsa; identical to SEQ ID NO: 189273

SEQ ID NO: 676312 - RNA, 64 nt, hsa; identical to SEQ ID NO: 189274

SEQ ID NO: 676313 - RNA, 64 nt, hsa; identical to SEQ ID NO: 189275

SEQ ID NO: 676314 - RNA, 64 nt, hsa; identical to SEQ ID NO: 189276

SEQ ID NO: 676315 - RNA, 64 nt, hsa; identical to SEQ ID NO: 189277

SEQ ID NO: 676316 - RNA, 64 nt, hsa; identical to SEQ ID NO: 189278

SEQ ID NO: 676317 - RNA, 64 nt, hsa; identical to SEQ ID NO: 189279

SEQ ID NO: 676318 - RNA, 64 nt, hsa; identical to SEQ ID NO: 189280

SEQ ID NO: 676319 - RNA, 59 nt, hsa
gcaggcugcuguagucucagguaaugaaggcacagcacagcaguacuccacauuguuuc

SEQ ID NO: 676320 - RNA, 59 nt, hsa
cugcuguagucucagguaaugaaggcacagcacagcaguacuccacauuguuuccuauu

SEQ ID NO: 676321 - RNA, 59 nt, hsa
ccaccacagccccagcugccucagagcaggcacagcacaaggcaggcccagccccaugg

SEQ ID NO: 676322 - RNA, 59 nt, hsa
cuugacugugacuggcaggcaggugaggggcacagcaccccuccccggcaucugccagc

SEQ ID NO: 676323 - RNA, 59 nt, hsa
ccucuccuucccugacacuucucugggcugcacagcagaaacguugguaaaagggcagu

SEQ ID NO: 676324 - RNA, 59 nt, hsa
gauuccaguucugcauguaccaucuugaggcacagcagccacugcucguuguaaaugcc

SEQ ID NO: 676325 - RNA, 59 nt, hsa
cuguggcccgagggccaaccaccgagcaggcacagcacagcagugacucggugagggga

SEQ ID NO: 676326 - RNA, 59 nt, hsa
gcccgagggccaaccaccgagcaggcacagcacagcagugacucggugaggggaggaca

SEQ ID NO: 676327 - RNA, 59 nt, hsa
agagagcuggggcagagcggggagcugcagcacagcaacagugauggcgaggacuuccc

SEQ ID NO: 676328 - RNA, 55 nt, hsa; identical to SEQ ID NO: 141815

SEQ ID NO: 676329 - RNA, 59 nt, hsa
ugcccaugccgggcggccuuccagucauugcacagcaaagccaugugcagggcgucccc

SEQ ID NO: 676330 - RNA, 59 nt, hsa
ugccaaucccgcugaagaggccucccugggcacagcacaggcugcacggugcacgcauu

SEQ ID NO: 676331 - RNA, 59 nt, hsa
gggaucacacaguucugccuguucucagggcacagcaacugccaaucccgcugaagagg

SEQ ID NO: 676332 - RNA, 59 nt, hsa
gguggcccauccccccucaccaggggcaggcacagcacagggauccgacuugaauuuuc

SEQ ID NO: 676333 - RNA, 59 nt, hsa
caggacggggccggccaggugggcgggcagcacagcaaggaggcuggcuggggccuauc

SEQ ID NO: 676334 - RNA, 59 nt, hsa
cucccaccaaccaaccacacccggugggggcacagcacagaccccagagccaggaaccu

SEQ ID NO: 676335 - RNA, 59 nt, hsa
cucccaccaaccagccacacccggugggggcacagcacagaccccagaggcaggaaccu

SEQ ID NO: 676336 - RNA, 59 nt, hsa
cucccaccaaccagccacacccagugggggcacagcacagaccccagagccaggaaccu

SEQ ID NO: 676337 - RNA, 59 nt, hsa
aaaggaaaaaagaaaaaagcaauuagguagcacagcacuuugguuuugcugagaucgaa

SEQ ID NO: 676338 - RNA, 59 nt, hsa
agagcccgcgugcuggagaauugacugaagcacagcaccgggggagagggacacuccuc

SEQ ID NO: 676339 - RNA, 59 nt, hsa
acccgcccgcccugcugcagauacaugcggcacagcaggcacgugccuggagagaacag

SEQ ID NO: 676340 - RNA, 59 nt, hsa
ggcacgugccuggagagaacagcuccugagcacagcacccuuggagcccucaccccgcu

SEQ ID NO: 676341 - RNA, 59 nt, hsa
ugcccagccuguucacaugcuggggaccagcacagcaccugaagccaugugggacaguu

SEQ ID NO: 676342 - RNA, 59 nt, hsa
uuaaugccagguggcccaggaguacccaugcacagcagcuguggggugugggcaucuuc

SEQ ID NO: 676343 - RNA, 59 nt, hsa
ucuuuccugccagauagaaauugugcacagcacagcaucaaguaauucguuagaugcuu

SEQ ID NO: 676344 - RNA, 59 nt, hsa
aaaguucuuuccugccagauagaaauugugcacagcacagcaucaaguaauucguuaga

SEQ ID NO: 676345 - RNA, 64 nt, hsa
ucauuccaacuaaucaucaucuucaaguuuuccaccaagguaccuacauucuaccacgccuggg

SEQ ID NO: 676346 - RNA, 64 nt, hsa
gccauuuaggugccuaagcaaaaggacaggcuguccaagguagaaacuguacauagccggugac

SEQ ID NO: 676347 - RNA, 64 nt, hsa
uaucaccaugacaccugccauaccguauagagagccaagguacagccguuagagacuaucuaau

SEQ ID NO: 676348 - RNA, 64 nt, hsa
gugccccuacugcugaccaugcaggagggcaacuccaagguaagccaggugagugugcgugggc

SEQ ID NO: 676349 - RNA, 64 nt, hsa
cuauagaugaagacauaaaagacacugguaaacaccaagguaaaagggcccccaagguggucau

SEQ ID NO: 676350 - RNA, 64 nt, hsa
gaaagaacccugcacccagagggccugccuggugccaagguaucccagccuggacaggcaugga

SEQ ID NO: 676351 - RNA, 64 nt, hsa
gaguuugcuguuggugcaggaauaagggaaaggcccaagguauccaagccuggggaagggcagg

SEQ ID NO: 676352 - RNA, 64 nt, hsa
uaguuuaagccuauaaucucagcccuuuuggaggccaagguaagaggaucgcuugaggucagga

SEQ ID NO: 676353 - RNA, 64 nt, hsa
gcuaaccuuuuagaggcuuuauauguuguacugaccaagguagguuuguauagcagcccuauac

SEQ ID NO: 676354 - RNA, 64 nt, hsa
uuacuauuucucuacuucagacaaaauguugcauccaagguacaucaagugaccauuugccuug

SEQ ID NO: 676355 - RNA, 64 nt, hsa
gaaaagaugaagcuggagagagaggaaccaguugccaagguagagagcugcccgcuccugcccu

SEQ ID NO: 676356 - RNA, 64 nt, hsa
caaccugucagagaauguucuuaggcaucaaaauccaagguagcuguaagaaaaauacuggagc

SEQ ID NO: 676357 - RNA, 64 nt, hsa
agcacugaugucucuuuaccgauggguuccagacccaagguaguccuggcacugcccuguggac

SEQ ID NO: 676358 - RNA, 64 nt, hsa
cagggucagggagccccugguguggaaagaggccccaagguaguaaacccugccccuguuacug

SEQ ID NO: 676359 - RNA, 64 nt, hsa
uaggauagauuuuaacauccuuugcggucccaguccaagguaggcuggugucauagucuucuca

SEQ ID NO: 676360 - RNA, 64 nt, hsa
auucacucagcaaauguucauggaucaccggcuaccaagguaccaggcaccaugcuagguauug

SEQ ID NO: 676361 - RNA, 64 nt, hsa
gagcuuggugauauuuuauccccaagauaugacaccaagguagacaggaaaauccauauuuaaa

SEQ ID NO: 676362 - RNA, 64 nt, hsa
caccugucucaaacucuaaggucggcacuugacaccaagguaacuucucuccugcucauguguc

SEQ ID NO: 676363 - RNA, 64 nt, hsa
gcuagauagcuagauagucuugugucuuguuugaccaagguaaccguaauaaaagaguccaucc

SEQ ID NO: 676364 - RNA, 64 nt, hsa
uacauuaaaaugauauucuuaaaauuuuuucccaccaagguauuccaaagaaaauauuaagguc

SEQ ID NO: 676365 - RNA, 64 nt, hsa
uauaaugauacugcuuuucaccaaaauuucuacaccaagguaaacagguguuugccuuauuuaa

SEQ ID NO: 676366 - RNA, 64 nt, hsa
cuagagccuagaaaucucacuuuuuaaaaugcuuccaagguaagucugaugccuacccuagguu

SEQ ID NO: 676367 - RNA, 64 nt, hsa
gacaaauugaaaagcaggaaggaagaggguugugccaagguauugaugacaaauggggugauuu

SEQ ID NO: 676368 - RNA, 64 nt, hsa
uggcucaugcuuguaauccuagcacuuuuugaggccaagguaggaggauugcuugaguccggga

SEQ ID NO: 676369 - RNA, 64 nt, hsa
uggcucccgccuguaaucccaguacuuuggaaagccaagguaagaggauugcuugagcccagaa

SEQ ID NO: 676370 - RNA, 64 nt, hsa
aaagaaaugacacuuuucaugugugauuuccccuccaagguaugguuaauaaguuucacugacu

SEQ ID NO: 676371 - RNA, 64 nt, hsa
uucaaugagaaaugaguuuaauagcauaacauuaccaagguaaucaaacuaauaaaauuccaua

SEQ ID NO: 676372 - RNA, 64 nt, hsa
uuuauauuuggacuaagguucuugagcuuaucucccaagguacuuuccauaauuuaacacagcu

SEQ ID NO: 676373 - RNA, 64 nt, hsa
agaugaaguucuuagcuccagguuuugggguaaaccaagguaggaacauuuuggcauuuauuuc

SEQ ID NO: 676374 - RNA, 64 nt, hsa
ggaagaauuuaggaccacugcauccugucuuaauccaagguacuggaaaaccuuccacaugccc

SEQ ID NO: 676375 - RNA, 64 nt, hsa
auccuuuuacugauuaugcagcuucuuauaacccccaagguacagauuauuucagcuuaaaaga

SEQ ID NO: 676376 - RNA, 64 nt, hsa
aauaaauaugcaguagugauauaaagaauuauauccaagguaauauaaaagccauuacguauga

SEQ ID NO: 676377 - RNA, 64 nt, hsa
cacuguuuaaagcuuugaauaucugcaaucuuugccaagguacuuuuuuauuuaaaaaaaaaca

SEQ ID NO: 676378 - RNA, 64 nt, hsa
gguggcucauuuuucauagcauuccuuguguaagccaagguauaugaccugcguuuucugcaga

SEQ ID NO: 676379 - RNA, 64 nt, hsa
gcugaaugucugagagaaccagaguuguucucguccaagguagaaagguacgaagauacaauac

SEQ ID NO: 676380 - RNA, 64 nt, hsa
agguccagcuuuacuguggcugucuggauccuucccaagguacagcuguauauaaacguguccc

SEQ ID NO: 676381 - RNA, 64 nt, hsa
uuuuuuuucuuuuuuuuuucuuaaagaagggcagccaagguaguaaccuaaaaauagugcccag

SEQ ID NO: 676382 - RNA, 64 nt, hsa
cucuggagagacagaucugaauguucaguucuagccaagguagauuuuacuuucaacuuuuuaa

SEQ ID NO: 676383 - RNA, 64 nt, hsa
auacaaugaagaaaacagauaacaaauuuuaagaccaagguaagauaacuaaucaaggccauuu

SEQ ID NO: 676384 - RNA, 64 nt, hsa
ggggggcgaucugggaaucaguccccuguggauaccaagguacaacuguauuuauuaacgcuua

SEQ ID NO: 676385 - RNA, 64 nt, hsa
gaacucacugucuuuucuccacacuuguccuaagccaagguagauuuguacguagacagacugg

SEQ ID NO: 676386 - RNA, 64 nt, hsa
uauuucauauuugccuccuuauauauaucaaagaccaagguauuuccuucugcuucaaaagaac

SEQ ID NO: 676387 - RNA, 64 nt, hsa
aagguaccauuugugccuggaucugaccaauagaccaagguaaaaaucucaaagaaugagacuu

SEQ ID NO: 676388 - RNA, 64 nt, hsa
cacuugguguuugcccuucagauuuuagauuucaccaagguauuucagucuuccaguuuucaau

SEQ ID NO: 676389 - RNA, 64 nt, hsa
gaagcaaucgggcuccgccaccacaaaaugaaacccaagguacauuuucaaaucaauguauagu

SEQ ID NO: 676390 - RNA, 64 nt, hsa
uggcucacgccuguaaucccagcacuuuaggaggccaagguagguggaucacuugagguuggga

SEQ ID NO: 676391 - RNA, 64 nt, hsa
auuagguuaauuaauccaauuaaugacccaaaugccaagguaauuuuaaauuuacauuuuuaau

SEQ ID NO: 676392 - RNA, 64 nt, hsa
aacuuucaauguccaucuuucaaaggaaguaacaccaagguacaauguuaaaggaauauucacu

SEQ ID NO: 676393 - RNA, 64 nt, hsa
uggcucaugccuguaaucccagcacuuugggaggccaagguaggcagaucaccugaggucagga

SEQ ID NO: 676394 - RNA, 64 nt, hsa
cuuguaagcuugggcucugccgcuuuugcaaaagccaagguaaagccaggaucgcugccaaguu

SEQ ID NO: 676395 - RNA, 64 nt, hsa
cauuaugacuuuuuucucuuaguuuaaauaaacuccaagguaacuggacuucuaaagcaccuuu

SEQ ID NO: 676396 - RNA, 64 nt, hsa
gaaagagccauggagauaguagcagacaggcugcccaagguaugaagcagaugagggaccagca

SEQ ID NO: 676397 - RNA, 64 nt, hsa
cacuauguccccuugaacauuaugugggagaacaccaagguagccuaggccacccaaaagugag

SEQ ID NO: 676398 - RNA, 64 nt, hsa
uauaccagcauucaugauagcauuucagcauuuuccaagguaccaaguguacuuauuuuguugu

SEQ ID NO: 676399 - RNA, 64 nt, hsa
aagugcaaagaccuugacaggaaagagggaggggccaagguaagaacugagaagggaggcauga

SEQ ID NO: 676400 - RNA, 64 nt, hsa
uaggaaacauuuacuuguuugugaaaacaauaccccaagguaauaggaaaaguuugaguuaagu

SEQ ID NO: 676401 - RNA, 64 nt, hsa
ugguucccuuccguggaccagccguaauaaagagccaagguagugaugguggccacgugccucg

SEQ ID NO: 676402 - RNA, 64 nt, hsa
gugaugcuacucacuuugauugcaaugaugauguccaagguaagcuauuaaaaggcagguuacu

SEQ ID NO: 676403 - RNA, 64 nt, hsa
uuugcuugccuccccaggaaagaaggaauugcauccaagguauacauacauauucaucgauguu

SEQ ID NO: 676404 - RNA, 64 nt, hsa
ucgcccgcccauucuacuacucaaccccucccccccaagguauuuccagaacuaaacccuuccu

SEQ ID NO: 676405 - RNA, 64 nt, hsa
agagaggugcuauucaagugauucugaaggcaccccaagguauaucuguaauuuaaagauuacu

SEQ ID NO: 676406 - RNA, 64 nt, hsa
aaugagguauaccuagaugucaaguaagacagauccaagguaacuggguaggaaaucuuuugac

SEQ ID NO: 676407 - RNA, 64 nt, hsa
uggcucaugccuauaaucuuagcacuuugggaggccaagguaggaggauugcuugaagcuagga

SEQ ID NO: 676408 - RNA, 64 nt, hsa
uccguuauuauuuccaauggagaccuagcccaggccaagguaaaguuaguuaauagcauuggga

SEQ ID NO: 676409 - RNA, 64 nt, hsa
aagguaauuuuacaauauaugcugagauuaaaaaccaagguaaaaaugaucaaacauauaugaa

SEQ ID NO: 676410 - RNA, 64 nt, hsa
aagaaaacagaaacguggcaucauuugggaagaaccaagguagaauuuaauuuucuggacuuua

SEQ ID NO: 676411 - RNA, 64 nt, hsa
aguggacuugggcagaggaggucacaccaccccaccaagguagacuuagauuagagaugacuug

SEQ ID NO: 676412 - RNA, 64 nt, hsa
cagccccuggcaaugagcugccugaugaugagucccaagguacauuguucuacuguuuuauacc

SEQ ID NO: 676413 - RNA, 64 nt, hsa
gggaaaaugcaguccaguguucucaccucugccuccaagguaggagaugucugugggugaggcu

SEQ ID NO: 676414 - RNA, 64 nt, hsa
guuauaaacaacaaacuuaaagcuuagcuuauguccaagguaaguauuuuagcauggcugucaa

SEQ ID NO: 676415 - RNA, 64 nt, hsa
ugaguuuuccuuuuggugcauggaacugugguugccaagguauuuaaaagggcuuuccugccuc

SEQ ID NO: 676416 - RNA, 64 nt, hsa
ugaaucaaagugucuagacauauuugcauagaggccaagguauucuauucuaauaacugcuuac

SEQ ID NO: 676417 - RNA, 64 nt, hsa
ugcuuucucagccccacccccagguccacaguguccaagguaauggcacacauauucaugcaca

SEQ ID NO: 676418 - RNA, 64 nt, hsa
agauguguauuuccccugaccuucaaaaaauguuccaagguaagccucguaaaggucaucccac

SEQ ID NO: 676419 - RNA, 64 nt, hsa
auuaauuucugccccugugauugggccacgguugccaagguaacaguggagcuggagcuaacuu

SEQ ID NO: 676420 - RNA, 64 nt, hsa
acucuucugccugcaacauuuguucaaaaacuaaccaagguaaaauauuuauuugaaagcccaa

SEQ ID NO: 676421 - RNA, 64 nt, hsa
ggaaacuucccgucccauauccugccucagcccgccaagguagccaucccaugaacacacugug

SEQ ID NO: 676422 - RNA, 64 nt, hsa
gaaggauccauguuuguagugagagaaaaaaaccccaagguaacccgauaugauuuaggaugca

SEQ ID NO: 676423 - RNA, 64 nt, hsa
ucaguagggaugaucaugggaggccuauuugacuccaagguagcagugugguaggauagagaca

SEQ ID NO: 676424 - RNA, 64 nt, hsa
auuauguggaagaagcaaaccugauacaauuugcccaagguaaacaguuugaaaagacaaaugg

SEQ ID NO: 676425 - RNA, 64 nt, hsa
aagcaagcagaugagagguuuuccauuuugucauccaagguagcugugcacuugccuuguugcu

SEQ ID NO: 676426 - RNA, 64 nt, hsa
aaggguaaggauggacacuaaaaugaaacaaauaccaagguauuccuucugcugcagccuggag

SEQ ID NO: 676427 - RNA, 64 nt, hsa
aacuuuccauacgaguauaucagaacacacccuuccaagguauguaugcucuguuguuccuguc

SEQ ID NO: 676428 - RNA, 64 nt, hsa
uaugaccuacuuuuguaacagaccaugguuguguccaagguaaaaccacagugauauuuuugga

SEQ ID NO: 676429 - RNA, 64 nt, hsa
uaacccucacucugcuagcaccuccucccuuuccccaagguagcacaucuggcucacuccccac

SEQ ID NO: 676430 - RNA, 64 nt, hsa
cugugguauggaccugguggcuucuccauccuacccaagguaacagugucuugcuucaucccac

SEQ ID NO: 676431 - RNA, 64 nt, hsa
ggccugacucccaugcaaguagcuggcuguacugccaagguaccuagguuggaguccagccuaa

SEQ ID NO: 676432 - RNA, 64 nt, hsa
auguucugcuuaaacucaagauggaaaguccaguccaagguacacuguucaucuuuuucuucac

SEQ ID NO: 676433 - RNA, 64 nt, hsa
agccaagaaaguaucuguuaucuccugcguaguaccaagguaggggacuaguggaucuuaucau

SEQ ID NO: 676434 - RNA, 64 nt, hsa
cagugguauuaucuuuuaaguugucagcaaguuaccaagguauucauuaaagaacuuguaauau

SEQ ID NO: 676435 - RNA, 64 nt, hsa
uaguggaguauuuggacuuugguacugcugucuuccaagguagcucuaaguuuugauguguggg

SEQ ID NO: 676436 - RNA, 64 nt, hsa
ugagcaauugaggagugucucaggauagcacaggccaagguaggggaguaaaaaggaggucagg

SEQ ID NO: 676437 - RNA, 64 nt, hsa
accugugaaauguuacguuugugcuucauuuuugccaagguaaaaauguuccaucauuucuagc

SEQ ID NO: 676438 - RNA, 64 nt, hsa
accaagaccuugucuagauauuuuuaguuuguugccaagguagcacugugagaaaucucacuug

SEQ ID NO: 676439 - RNA, 64 nt, hsa
ugccacuaggaucccagaaggaaacuaaauucauccaagguaguucaauuaaauugacuuuuug

SEQ ID NO: 676440 - RNA, 64 nt, hsa
caucauagggauaagauuuuuuguaggcacaagaccaagguauacaucuuccccuaaugccuau

SEQ ID NO: 676441 - RNA, 64 nt, hsa
uugauuuuuacagacuguuuugacaauguauaaaccaagguauuuuguuuuuuggaaguaugua

SEQ ID NO: 676442 - RNA, 64 nt, hsa
cguaaauauuuauauuccuugaaagcaauuuuugccaagguaguucaguuuaggaauauguugu

SEQ ID NO: 676443 - RNA, 64 nt, hsa
uggucagaagucaacuugcacaucuaguuaaaguccaagguaacugcaaacaguggaacauggc

SEQ ID NO: 676444 - RNA, 64 nt, hsa
ucuggaaauuuuuacuuuaaaaaguaaccagaauccaagguauuuuuauuuuagcuucccuuaa

SEQ ID NO: 676445 - RNA, 64 nt, hsa
cccugaugcucccgacuccccuccccaccaccucccaagguauuucugaugacuccgccccagu

SEQ ID NO: 676446 - RNA, 64 nt, hsa
gcagaacuuccaacguguagcaauacuauaagaaccaagguagcuuagaacguccuggacagac

SEQ ID NO: 676447 - RNA, 64 nt, hsa
uaggcccugagccgacugugaauucggugcuuggccaagguaacacucaucguauucacggagu

SEQ ID NO: 676448 - RNA, 64 nt, hsa
ggcugugauuaaaaucuuuaagcauuuguuccugccaagguaguuuucuugcauuuugcucucc

SEQ ID NO: 676449 - RNA, 64 nt, hsa
ccaggggaaaaaaacuuucuuagacacacuggcaccaagguaagagguggggcugcccaggcaa

SEQ ID NO: 676450 - RNA, 64 nt, hsa
acuuuaauggaaugcuuuuuaaaaaaauauaaaaccaagguaaauuauuguuucaucuucacgu

SEQ ID NO: 676451 - RNA, 64 nt, hsa
gaauuuguuucuuaaccuugaaaaaucauuaaagccaagguauuaaaaccuuugugcauuaaua

SEQ ID NO: 676452 - RNA, 64 nt, hsa
gaauuuucuucauuuucuguuuaguccaguguuaccaagguaagcuggggaaugaaguauacca

SEQ ID NO: 676453 - RNA, 64 nt, hsa
gaaggaacaacagcaacaagaccaguaugauauaccaagguaauaaaugcuguuuaugacuucu

SEQ ID NO: 676454 - RNA, 64 nt, hsa
ugcugggagagcccaugggaaccuugcuuagcgcccaagguagaugagagacagggcagggaau

SEQ ID NO: 676455 - RNA, 64 nt, hsa
aguuguuguuugaagcauugcuaugaccuaauucccaagguaucuuuccucucuugguguucua

SEQ ID NO: 676456 - RNA, 64 nt, hsa
gcuuucucuccaaagacuaagaugaagacguggcccaagguaggggguagggggagccuggguc

SEQ ID NO: 676457 - RNA, 64 nt, hsa
gguauaagaaaagcaucagaacucucagcuuggcccaagguaccuucugugguuccccugggug

SEQ ID NO: 676458 - RNA, 64 nt, hsa
guaaaauuucuccuccuuuaacuccuccuaccccccaagguaagaaacaaaaaacaaacaaaca

SEQ ID NO: 676459 - RNA, 64 nt, hsa
augacaacauggugagaaaagugcaguacuacuuccaagguagcuaguguaaaggacacuugag

SEQ ID NO: 676460 - RNA, 64 nt, hsa
ugaaauguauuacauuacguuaaagaacgggaugccaagguaaguggagguauacuucgaauuu

SEQ ID NO: 676461 - RNA, 64 nt, hsa
cucuagccgccuaaugcacuucacagguaacuccccaagguaaaacuagacucucuuguugguu

SEQ ID NO: 676462 - RNA, 64 nt, hsa
cagugcucagucaagggcuaaugauugcccacccccaagguaaagagccucauugcacucuacc

SEQ ID NO: 676463 - RNA, 64 nt, hsa
acagauaaacauguaucuguaagaucagccuuucccaagguauacuuuuaaaauuuaaagcgug

SEQ ID NO: 676464 - RNA, 64 nt, hsa
cagcaaggcucuuucguucuuccagcaaaggcuuccaagguacaacucaaacaagccaugguuc

SEQ ID NO: 676465 - RNA, 64 nt, hsa
cccugcuccuguaccagcaggggccacuucaaagccaagguacagggugauaacuuguggucca

SEQ ID NO: 676466 - RNA, 64 nt, hsa
uuuuuuuucccgagaccaaguuucacucuguugcccaagguagagugcaguggcgugaucucug

SEQ ID NO: 676467 - RNA, 64 nt, hsa
acagugguguguagugcugcuguguaucaaaagaccaagguauuaugggaccugguuucagaau

SEQ ID NO: 676468 - RNA, 64 nt, hsa
ucagcugcaacaccuguuuaugauccuggccucaccaagguauguggaccgagugacugaauuc

SEQ ID NO: 676469 - RNA, 64 nt, hsa
aaugcuacuuuuaucuucucuaaaauuauuucccccaagguagugaaguaauuggaaugaagga

SEQ ID NO: 676470 - RNA, 64 nt, hsa
caucuggauuuucacacaguaaagcaggaagccuccaagguaacccggcuaugggacugcagug

SEQ ID NO: 676471 - RNA, 64 nt, hsa
ugauguccugugugcuccacagcucaccugcuugccaagguacgucuggguaguaguuucugga

SEQ ID NO: 676472 - RNA, 64 nt, hsa
acagcuaccgcacaccacccugaaacagccacagccaagguaggcaugcauaugaggucuuccc

SEQ ID NO: 676473 - RNA, 64 nt, hsa
aaccuuugaccuuucuguucaaggugaguagcuuccaagguagauuuuacuauugugguuuuuu

SEQ ID NO: 676474 - RNA, 64 nt, hsa
ccgcauggcacucuucccaccucagugcccacagccaagguagggucacuaaccaagccagaaa

SEQ ID NO: 676475 - RNA, 64 nt, hsa
aguuuuacauuuaaauucaggcaguguuaauaugccaagguagggaaugugccuuuuucagagu

SEQ ID NO: 676476 - RNA, 64 nt, hsa
uuuuuuuuccuuugaacgugcuucuuuguaaugaccaagguaccgauuucugcuaaguucuccc

SEQ ID NO: 676477 - RNA, 64 nt, hsa
uuaaaaauaugaaucaaaauuccuguguugugugccaagguauaaaguggagaaguuagaugag

SEQ ID NO: 676478 - RNA, 64 nt, hsa
acuucauuucaugguauuucuuccuccucaaugcccaagguaaugugggacuaaagcccagaaa

SEQ ID NO: 676479 - RNA, 64 nt, hsa
ccuucccuccaagaaggauuugguccgucauaacccaagguaccauccuaggcugacaccuaac

SEQ ID NO: 676480 - RNA, 64 nt, hsa
uuccccauuuccucuuaugaaacaccgucugagcccaagguacacauugggcggccugcaggaa

SEQ ID NO: 676481 - RNA, 64 nt, hsa
gugaucaggguccugcaagcaguggggaagggggccaagguauuggaggacucccucccagcuu

SEQ ID NO: 676482 - RNA, 64 nt, hsa
gaagaaucaauaucaugaaaauggcccauacugcccaagguaauuuauagauucaaugccaucc

SEQ ID NO: 676483 - RNA, 64 nt, hsa
ucugucucuucccaccuuccaucugcacacacccccaagguaaggguacagcccggcuggcggc

SEQ ID NO: 676484 - RNA, 64 nt, hsa
acugauguccccuuccccguguaugcccccuuccccaagguagcaagauggagggauggggcuc

SEQ ID NO: 676485 - RNA, 64 nt, hsa
cagucuguaaaucagucaccuguguugcugcaggccaagguagaaacgcccuccgugugugcau

SEQ ID NO: 676486 - RNA, 64 nt, hsa
cuagugucacguucccccgacccuggcacacgggccaagguacccacaggaucccauccccucc

SEQ ID NO: 676487 - RNA, 64 nt, hsa
uuaagggaaaaagaauuucuuaacaaaaugauggccaagguaguuccauauauauacauauauu

SEQ ID NO: 676488 - RNA, 64 nt, hsa
cgauuuggggcucgagcaaaggaaguugcugaggccaagguagccaaggucagcccugaggcca

SEQ ID NO: 676489 - RNA, 64 nt, hsa
caugaaugcauaagaaaaaaauucugucauguucccaagguagaauuguaauaagcaugugcca

SEQ ID NO: 676490 - RNA, 64 nt, hsa
uuugugcgagccuguguugcaggguuguauaaaaccaagguacuucguuaguuuugcccauuca

SEQ ID NO: 676491 - RNA, 64 nt, hsa
ggauguuuaugcuguuugacuuuucuccuguguaccaagguauugcuuuuauuuacacgacagc

SEQ ID NO: 676492 - RNA, 64 nt, hsa
auuaaugucuuaugucucccuaaaauguauaaaaccaagguaugccccaaccaucuuggccaca

SEQ ID NO: 676493 - RNA, 64 nt, hsa
uccuaugauuucauagauguagcuuaggauaaggccaagguagguguugccuauauaagguuuu

SEQ ID NO: 676494 - RNA, 64 nt, hsa
gacccccagguauugucuuuugacauccagcaguccaagguauugagacauauuacuggaagua

SEQ ID NO: 676495 - RNA, 64 nt, hsa
aacguuuccuguaguauguuucuucaucucaucgccaagguaggcuuguguuuuucagugugug

SEQ ID NO: 676496 - RNA, 64 nt, hsa
uggcgucacagcugagcaccgugccgggagguggccaagguacagcccgcaaugggccuguaaa

SEQ ID NO: 676497 - RNA, 64 nt, hsa
uaguauaucaaccuuuuguuuuuaaauugaccugccaagguagcugaagaccuuuuagacaguu

SEQ ID NO: 676498 - RNA, 64 nt, hsa
caagcauauaaaguauacuuguauguaaugauugccaagguaacagaauugcugacaucugucu

SEQ ID NO: 676499 - RNA, 64 nt, hsa
uacucuugcuuugucaagcuguuugcuauaguuuccaagguauuauguuacucuaacucugaaa

SEQ ID NO: 676500 - RNA, 64 nt, hsa
uuguugcuuuuuuaaaaaaagcgcugaaguuagaccaagguauacaguuuuguucuaacagaca

SEQ ID NO: 676501 - RNA, 64 nt, hsa
agcuuuuuuuuuuacuaguuuuaaaacccaucuuccaagguauaugaauucuagaguauuuauc

SEQ ID NO: 676502 - RNA, 64 nt, hsa
uuugauguuuaccuaagccuuuaaggcugugucaccaagguauggccacaaggaagaauagugu

SEQ ID NO: 676503 - RNA, 64 nt, hsa
agcuguuugguuuuaaaauacuguagauaauuaaccaagguagaaugaccuuguaauguaacug

SEQ ID NO: 676504 - RNA, 64 nt, hsa
ccugagaggcuauacgugacaaaugaccaaaagcccaagguaggggaguuuccucugcucacag

SEQ ID NO: 676505 - RNA, 64 nt, hsa
caccccugagucccuugacuuuuguauucugacuccaagguauuguucagaccucagcuccugg

SEQ ID NO: 676506 - RNA, 64 nt, hsa
aagucagcucugggagcagcccucacuggcuggaccaagguacucuuccuggaguuugccgugu

SEQ ID NO: 676507 - RNA, 64 nt, hsa
acuauaaucacauuuaugguuuggaaccaucaccccaagguaaaaaaaaaauaaaagguauucc

SEQ ID NO: 676508 - RNA, 64 nt, hsa; identical to SEQ ID NO: 76855

SEQ ID NO: 676509 - RNA, 64 nt, hsa; identical to SEQ ID NO: 76856

SEQ ID NO: 676510 - RNA, 64 nt, hsa; identical to SEQ ID NO: 76857

SEQ ID NO: 676511 - RNA, 64 nt, hsa; identical to SEQ ID NO: 76858

SEQ ID NO: 676512 - RNA, 64 nt, hsa; identical to SEQ ID NO: 76859

SEQ ID NO: 676513 - RNA, 64 nt, hsa; identical to SEQ ID NO: 76860

SEQ ID NO: 676514 - RNA, 64 nt, hsa; identical to SEQ ID NO: 76861

SEQ ID NO: 676515 - RNA, 64 nt, hsa; identical to SEQ ID NO: 76862

SEQ ID NO: 676516 - RNA, 64 nt, hsa; identical to SEQ ID NO: 76863

SEQ ID NO: 676517 - RNA, 64 nt, hsa; identical to SEQ ID NO: 76864

SEQ ID NO: 676518 - RNA, 64 nt, hsa; identical to SEQ ID NO: 76865

SEQ ID NO: 676519 - RNA, 64 nt, hsa; identical to SEQ ID NO: 76866

SEQ ID NO: 676520 - RNA, 64 nt, hsa; identical to SEQ ID NO: 76867

SEQ ID NO: 676521 - RNA, 64 nt, hsa; identical to SEQ ID NO: 76868

SEQ ID NO: 676522 - RNA, 64 nt, hsa; identical to SEQ ID NO: 76869

SEQ ID NO: 676523 - RNA, 64 nt, hsa; identical to SEQ ID NO: 76870

SEQ ID NO: 676524 - RNA, 64 nt, hsa
ggaagggacaguaucguuuguuuaugaaaugccacugggacagcuggcugggccuucaccaagc

SEQ ID NO: 676525 - RNA, 64 nt, hsa
acagcuucccuauuuugaaugcagaaaacagggucugggacauuagucguuauauuugacuuga

SEQ ID NO: 676526 - RNA, 64 nt, hsa
ggaaggaaagcacaacuggguccuuuauucauuucugggacagaaagagggucaguggacuuuu

SEQ ID NO: 676527 - RNA, 64 nt, hsa
ccauccaccucccccgcacacacacaaagaugaccugggacaugauuuuuuuauucccacauuu

SEQ ID NO: 676528 - RNA, 64 nt, hsa
aauauagccacagaaauaaaggagggaccaauaucugggacagugucuucucagaaacaaccag

SEQ ID NO: 676529 - RNA, 64 nt, hsa
aauauagccacagaaauaaagaagggacaacaaucugggacagugucuccucagaaacaaucgg

SEQ ID NO: 676530 - RNA, 64 nt, hsa
aauauagccacagaaauaaaggauggagaaaaaucugggacagugucuucucagaaacaaccag

SEQ ID NO: 676531 - RNA, 64 nt, hsa
aacauagccacagaaauaaaggauggagaaaaaucugggacagugucuucucagaaaccaccag

SEQ ID NO: 676532 - RNA, 64 nt, hsa
uucccuccagucccuggaggggcuucuaguauuacugggacaaugaccacgcugccuguuuguc

SEQ ID NO: 676533 - RNA, 64 nt, hsa
agagcaggggugaacuguagcuugaugcaguaaucugggacaagacugguugcuagcacauacu

SEQ ID NO: 676534 - RNA, 64 nt, hsa
ccuggcuacgccggcucuucgguggcaacacuaccugggacacugccuccccagucaccaaggg

SEQ ID NO: 676535 - RNA, 64 nt, hsa
acccagcuuuggccccaugccccuguaggucccucugggacagucaccgcugggguccuggcug

SEQ ID NO: 676536 - RNA, 64 nt, hsa
aggcauuguguguuuuguuccgggacugguuuggcugggacaaaguuagaacugccugaaguuc

SEQ ID NO: 676537 - RNA, 64 nt, hsa
uaucuuugggaagccaugugucugguuugucgugcugggacagucaugggacugcaucuuccga

SEQ ID NO: 676538 - RNA, 64 nt, hsa
uguuaaggcuguuuugcuuggagaagacuugggacugggacagucuuuagauauuauuugaaau

SEQ ID NO: 676539 - RNA, 64 nt, hsa
ggcauuuaaaacuuugaaugaauuauaccuaaaucugggacagggaggugacaguggaacaggc

SEQ ID NO: 676540 - RNA, 64 nt, hsa
cuccucugucaucacagcgccagggcagcugugccugggacaggagccacacagucagaggggg

SEQ ID NO: 676541 - RNA, 64 nt, hsa
cccuucccccagugagaaggaaaaugggauaagucugggacacuguuucaguucaauaaagagg

SEQ ID NO: 676542 - RNA, 64 nt, hsa
gaacaucucccuuccagcaucugcugguagcaggcugggacagucccuuccuucccugaaaccc

SEQ ID NO: 676543 - RNA, 64 nt, hsa
agagggcaacuggaugacucgcaguaccacagcacugggacagacagaagccacaccuuucuuu

SEQ ID NO: 676544 - RNA, 64 nt, hsa
ugcucuucagcggcucccugaaggccaucaaggucugggacaucgugggcacugagcugaaguu

SEQ ID NO: 676545 - RNA, 64 nt, hsa
accuguacagcggcuccuaccagacaaucaagaucugggacauccgaacccuugacugcaucca

SEQ ID NO: 676546 - RNA, 64 nt, hsa
cccguccggagggagccaucucuugcucccgaggcugggacaguccuuucugugggggcucuag

SEQ ID NO: 676547 - RNA, 64 nt, hsa
cugacugacuucccaguggaacugccuucuugggcugggacagccccuuuccucugucccuucu

SEQ ID NO: 676548 - RNA, 64 nt, hsa
ugugccuucucuacugauggcaguguuuuagcugcugggacacaugacggaaguguguauuuuu

SEQ ID NO: 676549 - RNA, 64 nt, hsa
aucuuugcuguaaagugcaaggaaauuuuaaauucugggacacugaguuagaugguaaauacug

SEQ ID NO: 676550 - RNA, 64 nt, hsa
acgacgcaugauugguguuugaggcguuugccagcugggacaaacugcguuuggagcugugguu

SEQ ID NO: 676551 - RNA, 64 nt, hsa
augcaagauuuuaauggugacuuguccuggcuuacugggacagucuguaugaggcaugucacca

SEQ ID NO: 676552 - RNA, 64 nt, hsa
cuuugaaaaaagugcagauaaaacccucaucucccugggacaaagcacgugggggaaaggggug

SEQ ID NO: 676553 - RNA, 64 nt, hsa
ggagagcucuggcuggcaucuggugggugccccucugggacaaagcuuccagaggaaggaacag

SEQ ID NO: 676554 - RNA, 64 nt, hsa
gaaccaacaauucgucggaggcaucauggaaagacugggacagcccaggaaacaaggggucuga

SEQ ID NO: 676555 - RNA, 64 nt, hsa
gcccuguggcaggacacacauggugagccuagcccugggacaucaggagacugggcucuggcuc

SEQ ID NO: 676556 - RNA, 64 nt, hsa
ccuccgaagaccgcucgggcauuccgccugcgcccugggacagcggagagacggcuucucuuua

SEQ ID NO: 676557 - RNA, 64 nt, hsa
agggagcugagcgugcaggcgcuccagggcaggccugggacagagucaaggcucagagaauaaa

SEQ ID NO: 676558 - RNA, 64 nt, hsa
gugggguuggggaguaggggggaucccacauugccugggacaucugaaugcugauacgaaugga

SEQ ID NO: 676559 - RNA, 64 nt, hsa
cgaauggacaggaaagggagccagagcuguauaccugggacaggccagggagccuuuagugcca

SEQ ID NO: 676560 - RNA, 64 nt, hsa; identical to SEQ ID NO: 99947

SEQ ID NO: 676561 - RNA, 64 nt, hsa; identical to SEQ ID NO: 99948

SEQ ID NO: 676562 - RNA, 64 nt, hsa; identical to SEQ ID NO: 99949

SEQ ID NO: 676563 - RNA, 64 nt, hsa; identical to SEQ ID NO: 99950

SEQ ID NO: 676564 - RNA, 64 nt, hsa; identical to SEQ ID NO: 99951

SEQ ID NO: 676565 - RNA, 64 nt, hsa; identical to SEQ ID NO: 99952

SEQ ID NO: 676566 - RNA, 64 nt, hsa; identical to SEQ ID NO: 99953

SEQ ID NO: 676567 - RNA, 64 nt, hsa; identical to SEQ ID NO: 99954

SEQ ID NO: 676568 - RNA, 64 nt, hsa; identical to SEQ ID NO: 99955

SEQ ID NO: 676569 - RNA, 64 nt, hsa; identical to SEQ ID NO: 99956

SEQ ID NO: 676570 - RNA, 64 nt, hsa; identical to SEQ ID NO: 99957

SEQ ID NO: 676571 - RNA, 64 nt, hsa; identical to SEQ ID NO: 99958

SEQ ID NO: 676572 - RNA, 64 nt, hsa; identical to SEQ ID NO: 99959

SEQ ID NO: 676573 - RNA, 64 nt, hsa; identical to SEQ ID NO: 99960

SEQ ID NO: 676574 - RNA, 64 nt, hsa; identical to SEQ ID NO: 99961

SEQ ID NO: 676575 - RNA, 64 nt, hsa; identical to SEQ ID NO: 99962

SEQ ID NO: 676576 - RNA, 64 nt, hsa; identical to SEQ ID NO: 99963

SEQ ID NO: 676577 - RNA, 64 nt, hsa; identical to SEQ ID NO: 99964

SEQ ID NO: 676578 - RNA, 64 nt, hsa; identical to SEQ ID NO: 99965

SEQ ID NO: 676579 - RNA, 64 nt, hsa; identical to SEQ ID NO: 99966

SEQ ID NO: 676580 - RNA, 64 nt, hsa; identical to SEQ ID NO: 99967

SEQ ID NO: 676581 - RNA, 64 nt, hsa; identical to SEQ ID NO: 99968

SEQ ID NO: 676582 - RNA, 64 nt, hsa; identical to SEQ ID NO: 99969

SEQ ID NO: 676583 - RNA, 64 nt, hsa; identical to SEQ ID NO: 99970

SEQ ID NO: 676584 - RNA, 64 nt, hsa; identical to SEQ ID NO: 99971

SEQ ID NO: 676585 - RNA, 64 nt, hsa; identical to SEQ ID NO: 99972

SEQ ID NO: 676586 - RNA, 64 nt, hsa; identical to SEQ ID NO: 307447

SEQ ID NO: 676587 - RNA, 64 nt, hsa; identical to SEQ ID NO: 307448

SEQ ID NO: 676588 - RNA, 64 nt, hsa; identical to SEQ ID NO: 307449

SEQ ID NO: 676589 - RNA, 64 nt, hsa; identical to SEQ ID NO: 307450

SEQ ID NO: 676590 - RNA, 64 nt, hsa; identical to SEQ ID NO: 307451

SEQ ID NO: 676591 - RNA, 64 nt, hsa; identical to SEQ ID NO: 307452

SEQ ID NO: 676592 - RNA, 64 nt, hsa; identical to SEQ ID NO: 307453

SEQ ID NO: 676593 - RNA, 64 nt, hsa; identical to SEQ ID NO: 307454

SEQ ID NO: 676594 - RNA, 64 nt, hsa; identical to SEQ ID NO: 307455

SEQ ID NO: 676595 - RNA, 64 nt, hsa; identical to SEQ ID NO: 307456

SEQ ID NO: 676596 - RNA, 64 nt, hsa; identical to SEQ ID NO: 307457

SEQ ID NO: 676597 - RNA, 64 nt, hsa; identical to SEQ ID NO: 307458

SEQ ID NO: 676598 - RNA, 64 nt, hsa; identical to SEQ ID NO: 307459

SEQ ID NO: 676599 - RNA, 64 nt, hsa; identical to SEQ ID NO: 307460

SEQ ID NO: 676600 - RNA, 64 nt, hsa; identical to SEQ ID NO: 307461

SEQ ID NO: 676601 - RNA, 64 nt, hsa; identical to SEQ ID NO: 307462

SEQ ID NO: 676602 - RNA, 64 nt, hsa; identical to SEQ ID NO: 307463

SEQ ID NO: 676603 - RNA, 64 nt, hsa; identical to SEQ ID NO: 307464

SEQ ID NO: 676604 - RNA, 64 nt, hsa; identical to SEQ ID NO: 307465

SEQ ID NO: 676605 - RNA, 64 nt, hsa; identical to SEQ ID NO: 307466

SEQ ID NO: 676606 - RNA, 64 nt, hsa; identical to SEQ ID NO: 307467

SEQ ID NO: 676607 - RNA, 64 nt, hsa; identical to SEQ ID NO: 307468

SEQ ID NO: 676608 - RNA, 64 nt, hsa; identical to SEQ ID NO: 307469

SEQ ID NO: 676609 - RNA, 64 nt, hsa; identical to SEQ ID NO: 307470

SEQ ID NO: 676610 - RNA, 64 nt, hsa; identical to SEQ ID NO: 307471

SEQ ID NO: 676611 - RNA, 64 nt, hsa; identical to SEQ ID NO: 307472

SEQ ID NO: 676612 - RNA, 64 nt, hsa; identical to SEQ ID NO: 307473

SEQ ID NO: 676613 - RNA, 64 nt, hsa; identical to SEQ ID NO: 307474

SEQ ID NO: 676614 - RNA, 64 nt, hsa; identical to SEQ ID NO: 307475

SEQ ID NO: 676615 - RNA, 64 nt, hsa; identical to SEQ ID NO: 307476

SEQ ID NO: 676616 - RNA, 64 nt, hsa; identical to SEQ ID NO: 307477

SEQ ID NO: 676617 - RNA, 64 nt, hsa; identical to SEQ ID NO: 307478

SEQ ID NO: 676618 - RNA, 64 nt, hsa; identical to SEQ ID NO: 307479

SEQ ID NO: 676619 - RNA, 64 nt, hsa; identical to SEQ ID NO: 307480

SEQ ID NO: 676620 - RNA, 64 nt, hsa; identical to SEQ ID NO: 307481

SEQ ID NO: 676621 - RNA, 64 nt, hsa; identical to SEQ ID NO: 307482

SEQ ID NO: 676622 - RNA, 64 nt, hsa; identical to SEQ ID NO: 307483

SEQ ID NO: 676623 - RNA, 64 nt, hsa; identical to SEQ ID NO: 307484

SEQ ID NO: 676624 - RNA, 64 nt, hsa; identical to SEQ ID NO: 307485

SEQ ID NO: 676625 - RNA, 64 nt, hsa; identical to SEQ ID NO: 307486

SEQ ID NO: 676626 - RNA, 64 nt, hsa; identical to SEQ ID NO: 307487

SEQ ID NO: 676627 - RNA, 64 nt, hsa; identical to SEQ ID NO: 307488

SEQ ID NO: 676628 - RNA, 64 nt, hsa; identical to SEQ ID NO: 206878

SEQ ID NO: 676629 - RNA, 64 nt, hsa; identical to SEQ ID NO: 206879

SEQ ID NO: 676630 - RNA, 64 nt, hsa; identical to SEQ ID NO: 206880

SEQ ID NO: 676631 - RNA, 64 nt, hsa; identical to SEQ ID NO: 206881

SEQ ID NO: 676632 - RNA, 64 nt, hsa; identical to SEQ ID NO: 206882

SEQ ID NO: 676633 - RNA, 64 nt, hsa; identical to SEQ ID NO: 206883

SEQ ID NO: 676634 - RNA, 62 nt, hsa; identical to SEQ ID NO: 206884

SEQ ID NO: 676635 - RNA, 64 nt, hsa; identical to SEQ ID NO: 206885

SEQ ID NO: 676636 - RNA, 64 nt, hsa; identical to SEQ ID NO: 206886

SEQ ID NO: 676637 - RNA, 64 nt, hsa; identical to SEQ ID NO: 206887

SEQ ID NO: 676638 - RNA, 64 nt, hsa; identical to SEQ ID NO: 206888

SEQ ID NO: 676639 - RNA, 64 nt, hsa; identical to SEQ ID NO: 206889

SEQ ID NO: 676640 - RNA, 64 nt, hsa; identical to SEQ ID NO: 111411

SEQ ID NO: 676641 - RNA, 64 nt, hsa; identical to SEQ ID NO: 111412

SEQ ID NO: 676642 - RNA, 64 nt, hsa; identical to SEQ ID NO: 111413

SEQ ID NO: 676643 - RNA, 64 nt, hsa; identical to SEQ ID NO: 111414

SEQ ID NO: 676644 - RNA, 64 nt, hsa; identical to SEQ ID NO: 111415

SEQ ID NO: 676645 - RNA, 64 nt, hsa; identical to SEQ ID NO: 111416

SEQ ID NO: 676646 - RNA, 64 nt, hsa; identical to SEQ ID NO: 111417

SEQ ID NO: 676647 - RNA, 64 nt, hsa; identical to SEQ ID NO: 111418

SEQ ID NO: 676648 - RNA, 64 nt, hsa; identical to SEQ ID NO: 111419

SEQ ID NO: 676649 - RNA, 64 nt, hsa; identical to SEQ ID NO: 111420

SEQ ID NO: 676650 - RNA, 64 nt, hsa; identical to SEQ ID NO: 111421

SEQ ID NO: 676651 - RNA, 64 nt, hsa; identical to SEQ ID NO: 111422

SEQ ID NO: 676652 - RNA, 64 nt, hsa; identical to SEQ ID NO: 111423

SEQ ID NO: 676653 - RNA, 64 nt, hsa; identical to SEQ ID NO: 111424

SEQ ID NO: 676654 - RNA, 64 nt, hsa; identical to SEQ ID NO: 111425

SEQ ID NO: 676655 - RNA, 64 nt, hsa; identical to SEQ ID NO: 111426

SEQ ID NO: 676656 - RNA, 64 nt, hsa; identical to SEQ ID NO: 111427

SEQ ID NO: 676657 - RNA, 64 nt, hsa; identical to SEQ ID NO: 111428

SEQ ID NO: 676658 - RNA, 64 nt, hsa; identical to SEQ ID NO: 111429

SEQ ID NO: 676659 - RNA, 64 nt, hsa; identical to SEQ ID NO: 111430

SEQ ID NO: 676660 - RNA, 64 nt, hsa; identical to SEQ ID NO: 111431

SEQ ID NO: 676661 - RNA, 64 nt, hsa; identical to SEQ ID NO: 111432

SEQ ID NO: 676662 - RNA, 64 nt, hsa; identical to SEQ ID NO: 111433

SEQ ID NO: 676663 - RNA, 64 nt, hsa; identical to SEQ ID NO: 111434

SEQ ID NO: 676664 - RNA, 58 nt, hsa; identical to SEQ ID NO: 111435

SEQ ID NO: 676665 - RNA, 64 nt, hsa; identical to SEQ ID NO: 111436

SEQ ID NO: 676666 - RNA, 64 nt, hsa; identical to SEQ ID NO: 111437

SEQ ID NO: 676667 - RNA, 64 nt, hsa; identical to SEQ ID NO: 111438

SEQ ID NO: 676668 - RNA, 64 nt, hsa; identical to SEQ ID NO: 111439

SEQ ID NO: 676669 - RNA, 64 nt, hsa; identical to SEQ ID NO: 111440

SEQ ID NO: 676670 - RNA, 64 nt, hsa; identical to SEQ ID NO: 111441

SEQ ID NO: 676671 - RNA, 64 nt, hsa; identical to SEQ ID NO: 111442

SEQ ID NO: 676672 - RNA, 64 nt, hsa; identical to SEQ ID NO: 111443

SEQ ID NO: 676673 - RNA, 64 nt, hsa; identical to SEQ ID NO: 111444

SEQ ID NO: 676674 - RNA, 64 nt, hsa; identical to SEQ ID NO: 111445

SEQ ID NO: 676675 - RNA, 64 nt, hsa; identical to SEQ ID NO: 111446

SEQ ID NO: 676676 - RNA, 64 nt, hsa; identical to SEQ ID NO: 111447

SEQ ID NO: 676677 - RNA, 64 nt, hsa; identical to SEQ ID NO: 111448

SEQ ID NO: 676678 - RNA, 64 nt, hsa; identical to SEQ ID NO: 111449

SEQ ID NO: 676679 - RNA, 64 nt, hsa; identical to SEQ ID NO: 111450

SEQ ID NO: 676680 - RNA, 64 nt, hsa; identical to SEQ ID NO: 111451

SEQ ID NO: 676681 - RNA, 64 nt, hsa; identical to SEQ ID NO: 111452

SEQ ID NO: 676682 - RNA, 64 nt, hsa; identical to SEQ ID NO: 111453

SEQ ID NO: 676683 - RNA, 64 nt, hsa; identical to SEQ ID NO: 111454

SEQ ID NO: 676684 - RNA, 64 nt, hsa; identical to SEQ ID NO: 111455

SEQ ID NO: 676685 - RNA, 64 nt, hsa; identical to SEQ ID NO: 111456

SEQ ID NO: 676686 - RNA, 64 nt, hsa; identical to SEQ ID NO: 111457

SEQ ID NO: 676687 - RNA, 64 nt, hsa; identical to SEQ ID NO: 111458

SEQ ID NO: 676688 - RNA, 64 nt, hsa; identical to SEQ ID NO: 111459

SEQ ID NO: 676689 - RNA, 52 nt, hsa; identical to SEQ ID NO: 111460

SEQ ID NO: 676690 - RNA, 64 nt, hsa; identical to SEQ ID NO: 111461

SEQ ID NO: 676691 - RNA, 64 nt, hsa; identical to SEQ ID NO: 111462

SEQ ID NO: 676692 - RNA, 64 nt, hsa; identical to SEQ ID NO: 111463

SEQ ID NO: 676693 - RNA, 64 nt, hsa; identical to SEQ ID NO: 111464

SEQ ID NO: 676694 - RNA, 64 nt, hsa; identical to SEQ ID NO: 111465

SEQ ID NO: 676695 - RNA, 64 nt, hsa; identical to SEQ ID NO: 111466

SEQ ID NO: 676696 - RNA, 64 nt, hsa; identical to SEQ ID NO: 111467

SEQ ID NO: 676697 - RNA, 64 nt, hsa
agaagcauuuuccccauguggcucucucacugugcguugcuaccuugcuucugugagaauucag

SEQ ID NO: 676698 - RNA, 64 nt, hsa
aggguuuuaucuaauaaagugucucuuccauucacguugcuaccuuacccacacuuucccuucu

SEQ ID NO: 676699 - RNA, 64 nt, hsa
aaaucucccagggugcuguguguuagucuguuugcguugcuauaaaagaauaccugagacuggg

SEQ ID NO: 676700 - RNA, 64 nt, hsa
ucuuccauguucccuucuuaacugucguguggcucguugcuaaaucaugacaauggcugccuau

SEQ ID NO: 676701 - RNA, 64 nt, hsa
gaacgguggcagagucuccuuggcaaucaaccaacguugcuaugaaauaugccucacacuguau

SEQ ID NO: 676702 - RNA, 64 nt, hsa
cugggagaaaaccugcacucgguggcaccuacaacguugcuaauuuauuuccuuuugauaugca

SEQ ID NO: 676703 - RNA, 64 nt, hsa
cccgacgaaucucugcaaucucuguugcugaacgcguugcuaaagaaagagcagagaggguggg

SEQ ID NO: 676704 - RNA, 64 nt, hsa
acaaguggagccagguagaggaaaaggguuugggcguugcuaggcugaaagggaagccacacca

SEQ ID NO: 676705 - RNA, 64 nt, hsa
guguguuguuuuuuuaaagaggugauucaaguaccguugcuaagcugucaacauaccaagcugu

SEQ ID NO: 676706 - RNA, 64 nt, hsa
accguuuauaugcacuuucauggagacugcaauacguugcuaugagcacuuucuuuauccuugg

SEQ ID NO: 676707 - RNA, 64 nt, hsa
ucucagggucucauaaacuccccagugauguaaacguugcuauugaagguucucauguggugaa

SEQ ID NO: 676708 - RNA, 53 nt, hsa
aaucagaaagucuaauguaauuucguugcuauaguaguuugcuaaaagaugau

SEQ ID NO: 676709 - RNA, 64 nt, hsa
guugaucaguugugacacuuacugguuaaacuuacguugcuaaagauuucucuauaauaagcca

SEQ ID NO: 676710 - RNA, 64 nt, hsa
aaagagccaagguagugaugguggccacgugccucguugcuauuuuuaaaguaauauucagaug

SEQ ID NO: 676711 - RNA, 64 nt, hsa
guagaauggaagcuguucugcauucacugauuaacguugcuaaacucuuggugaggcacgagcu

SEQ ID NO: 676712 - RNA, 64 nt, hsa
gcagccagugcacauuuggaauugacggaaacaacguugcuauuuccacccauuuguuuucggc

SEQ ID NO: 676713 - RNA, 64 nt, hsa
gugaauauauuuaacacuguguuaaauuaauuuacguugcuauuuuauuuuaaucauaaacaac

SEQ ID NO: 676714 - RNA, 64 nt, hsa
gcuggaacugucuaccccagggacacacccauuucguugcuacccaaguggauucugagacagg

SEQ ID NO: 676715 - RNA, 64 nt, hsa
ccucacuccaccacuuuucuauuucagugggugucguugcuacgaugaagacuuuggaaauuuc

SEQ ID NO: 676716 - RNA, 64 nt, hsa
ucaaaaaccagcaaauuuuaauuuugucccacagcguugcuaggguggcauggcuccccaucuc

SEQ ID NO: 676717 - RNA, 64 nt, hsa
aaccagguaacccaguuagccaagauguuggaugcguugcuagaaggagaaauagaagaccuug

SEQ ID NO: 676718 - RNA, 64 nt, hsa
uaagugagugucccuaugcgauuaugucucuuuacguugcuaaggggggagggugaggauuaag

SEQ ID NO: 676719 - RNA, 64 nt, hsa
uacugaauuuuauugcuugcuaauugugccuuuccguugcuaaauuaagaaaugcuauguguac

SEQ ID NO: 676720 - RNA, 64 nt, hsa
cgccaacucuguaaaccccaaguauaacacaggacguugcuauuuguugacugacacauagugc

SEQ ID NO: 676721 - RNA, 64 nt, hsa
cuaugggacugaacuuugagacacacuaugagagcguugcuaccuguggggcaagagcauguac

SEQ ID NO: 676722 - RNA, 64 nt, hsa
cuagguugccccuuauuuuuuauuuucccuguugcguugcuauagaugaagggugaggacaauc

SEQ ID NO: 676723 - RNA, 64 nt, hsa
cugccucacaagcagugacaccucggguccuuuccguugcuauggugaaaauuccuggauggaa

SEQ ID NO: 676724 - RNA, 64 nt, hsa
gaaggugucugggccauccugggcggccggucagcguugcuaggcaggcucggcugucuggccg

SEQ ID NO: 676725 - RNA, 64 nt, hsa
uccuagcaagcaggaaguuaagagcaggaggaagcguugcuaccuucacuucuccccagcucug

SEQ ID NO: 676726 - RNA, 64 nt, hsa
agcgauaaacauucucagacccuuggagagaaaccguugcuagcuugcuggucccgaaagauug

SEQ ID NO: 676727 - RNA, 64 nt, hsa
cagugucagaggggccgcccgguggggcuaucuccguugcuauauuaauggcaagacuaaauga

SEQ ID NO: 676728 - RNA, 64 nt, hsa
acaauauaccuucucagucuacuaggcauagcaccguugcuaccgagugucugucuaagaacac

SEQ ID NO: 676729 - RNA, 64 nt, hsa
cuaaaucugcauguccucugugugacugauagagcguugcuauuucauuuuuuuaagacaaaau

SEQ ID NO: 676730 - RNA, 64 nt, hsa
uuuguuuuguuuuuguuuuuguuuccauuguuaccguugcuauggcccuuugccugucucucca

SEQ ID NO: 676731 - RNA, 64 nt, hsa
gaaaaaaaaaacacaaaaaacaaaaaacauggcacguugcuaguuuacaggguuuugugaguuu

SEQ ID NO: 676732 - RNA, 64 nt, hsa
uuuuguuguuuguuuggaaggcagggcaggcugccguugcuaaaugauuuaauaauauuguaau

SEQ ID NO: 676733 - RNA, 64 nt, hsa
uuuagauaaguguaauuuucucuauaggagaccacguugcuacaucuguuaaugccugucagug

SEQ ID NO: 676734 - RNA, 64 nt, hsa
ggucaagcccccuuugauugaguucaucaugagccguugcuaaugccaggccaguaaaaguaua

SEQ ID NO: 676735 - RNA, 64 nt, hsa
ggaccucuguuguacauuccgguugggggaugagcguugcuauuuaauuacuaauauuauugaa

SEQ ID NO: 676736 - RNA, 64 nt, hsa
gacugucuccauaacaucauugggauccccaucccguugcuauuucuuuuucaccguuuuuacc

SEQ ID NO: 676737 - RNA, 64 nt, hsa
cgccgcccugcgguugggccgguggaggcccaggcguugcuaggauugcaucaguuuuccuguu

SEQ ID NO: 676738 - RNA, 64 nt, hsa
acacacacacacacacacacacacagagucaggccguugcuagucaguucucuucuuuccaccc

SEQ ID NO: 676739 - RNA, 64 nt, hsa
accuccuucucuucuggacauguccaggaguggccguugcuacaagucaccuggugcuacgacc

SEQ ID NO: 676740 - RNA, 64 nt, hsa; identical to SEQ ID NO: 127504

SEQ ID NO: 676741 - RNA, 64 nt, hsa; identical to SEQ ID NO: 127505

SEQ ID NO: 676742 - RNA, 64 nt, hsa; identical to SEQ ID NO: 127506

SEQ ID NO: 676743 - RNA, 64 nt, hsa; identical to SEQ ID NO: 127507

SEQ ID NO: 676744 - RNA, 64 nt, hsa; identical to SEQ ID NO: 127508

SEQ ID NO: 676745 - RNA, 64 nt, hsa; identical to SEQ ID NO: 127509

SEQ ID NO: 676746 - RNA, 64 nt, hsa; identical to SEQ ID NO: 127510

SEQ ID NO: 676747 - RNA, 64 nt, hsa; identical to SEQ ID NO: 127511

SEQ ID NO: 676748 - RNA, 64 nt, hsa; identical to SEQ ID NO: 127512

SEQ ID NO: 676749 - RNA, 64 nt, hsa; identical to SEQ ID NO: 127513

SEQ ID NO: 676750 - RNA, 64 nt, hsa; identical to SEQ ID NO: 127514

SEQ ID NO: 676751 - RNA, 64 nt, hsa; identical to SEQ ID NO: 127514

SEQ ID NO: 676752 - RNA, 64 nt, hsa; identical to SEQ ID NO: 127516

SEQ ID NO: 676753 - RNA, 64 nt, hsa; identical to SEQ ID NO: 127517

SEQ ID NO: 676754 - RNA, 64 nt, hsa; identical to SEQ ID NO: 127518

SEQ ID NO: 676755 - RNA, 64 nt, hsa; identical to SEQ ID NO: 127519

SEQ ID NO: 676756 - RNA, 64 nt, hsa; identical to SEQ ID NO: 127520

SEQ ID NO: 676757 - RNA, 64 nt, hsa; identical to SEQ ID NO: 127521

SEQ ID NO: 676758 - RNA, 64 nt, hsa; identical to SEQ ID NO: 127522

SEQ ID NO: 676759 - RNA, 64 nt, hsa; identical to SEQ ID NO: 127523

SEQ ID NO: 676760 - RNA, 64 nt, hsa; identical to SEQ ID NO: 127524

SEQ ID NO: 676761 - RNA, 64 nt, hsa; identical to SEQ ID NO: 127525

SEQ ID NO: 676762 - RNA, 64 nt, hsa; identical to SEQ ID NO: 127526

SEQ ID NO: 676763 - RNA, 64 nt, hsa; identical to SEQ ID NO: 127527

SEQ ID NO: 676764 - RNA, 64 nt, hsa; identical to SEQ ID NO: 127528

SEQ ID NO: 676765 - RNA, 64 nt, hsa; identical to SEQ ID NO: 127529

SEQ ID NO: 676766 - RNA, 64 nt, hsa; identical to SEQ ID NO: 127530

SEQ ID NO: 676767 - RNA, 64 nt, hsa; identical to SEQ ID NO: 127531

SEQ ID NO: 676768 - RNA, 64 nt, hsa; identical to SEQ ID NO: 127532

SEQ ID NO: 676769 - RNA, 64 nt, hsa; identical to SEQ ID NO: 127533

SEQ ID NO: 676770 - RNA, 64 nt, hsa; identical to SEQ ID NO: 127534

SEQ ID NO: 676771 - RNA, 64 nt, hsa; identical to SEQ ID NO: 127535

SEQ ID NO: 676772 - RNA, 64 nt, hsa; identical to SEQ ID NO: 127536

SEQ ID NO: 676773 - RNA, 64 nt, hsa; identical to SEQ ID NO: 127537

SEQ ID NO: 676774 - RNA, 64 nt, hsa; identical to SEQ ID NO: 127538

SEQ ID NO: 676775 - RNA, 64 nt, hsa; identical to SEQ ID NO: 127539

SEQ ID NO: 676776 - RNA, 64 nt, hsa; identical to SEQ ID NO: 127540

SEQ ID NO: 676777 - RNA, 64 nt, hsa; identical to SEQ ID NO: 127541

SEQ ID NO: 676778 - RNA, 64 nt, hsa; identical to SEQ ID NO: 127542

SEQ ID NO: 676779 - RNA, 64 nt, hsa; identical to SEQ ID NO: 127543

SEQ ID NO: 676780 - RNA, 64 nt, hsa; identical to SEQ ID NO: 127544

SEQ ID NO: 676781 - RNA, 64 nt, hsa; identical to SEQ ID NO: 127545

SEQ ID NO: 676782 - RNA, 64 nt, hsa; identical to SEQ ID NO: 127546

SEQ ID NO: 676783 - RNA, 64 nt, hsa; identical to SEQ ID NO: 127547

SEQ ID NO: 676784 - RNA, 64 nt, hsa; identical to SEQ ID NO: 127548

SEQ ID NO: 676785 - RNA, 64 nt, hsa; identical to SEQ ID NO: 127549

SEQ ID NO: 676786 - RNA, 64 nt, hsa; identical to SEQ ID NO: 127550

SEQ ID NO: 676787 - RNA, 64 nt, hsa; identical to SEQ ID NO: 127551

SEQ ID NO: 676788 - RNA, 64 nt, hsa; identical to SEQ ID NO: 127552

SEQ ID NO: 676789 - RNA, 64 nt, hsa; identical to SEQ ID NO: 127553

SEQ ID NO: 676790 - RNA, 64 nt, hsa; identical to SEQ ID NO: 127554

SEQ ID NO: 676791 - RNA, 64 nt, hsa; identical to SEQ ID NO: 127555

SEQ ID NO: 676792 - RNA, 64 nt, hsa; identical to SEQ ID NO: 127556

SEQ ID NO: 676793 - RNA, 64 nt, hsa; identical to SEQ ID NO: 582350

SEQ ID NO: 676794 - RNA, 64 nt, hsa; identical to SEQ ID NO: 582351

SEQ ID NO: 676795 - RNA, 64 nt, hsa; identical to SEQ ID NO: 582352

SEQ ID NO: 676796 - RNA, 64 nt, hsa; identical to SEQ ID NO: 582353

SEQ ID NO: 676797 - RNA, 64 nt, hsa; identical to SEQ ID NO: 582354

SEQ ID NO: 676798 - RNA, 64 nt, hsa; identical to SEQ ID NO: 582355

SEQ ID NO: 676799 - RNA, 64 nt, hsa; identical to SEQ ID NO: 582356

SEQ ID NO: 676800 - RNA, 64 nt, hsa; identical to SEQ ID NO: 582357

SEQ ID NO: 676801 - RNA, 64 nt, hsa; identical to SEQ ID NO: 582358

SEQ ID NO: 676802 - RNA, 64 nt, hsa; identical to SEQ ID NO: 582359

SEQ ID NO: 676803 - RNA, 64 nt, hsa; identical to SEQ ID NO: 582360

SEQ ID NO: 676804 - RNA, 64 nt, hsa; identical to SEQ ID NO: 582361

SEQ ID NO: 676805 - RNA, 64 nt, hsa; identical to SEQ ID NO: 582362

SEQ ID NO: 676806 - RNA, 64 nt, hsa; identical to SEQ ID NO: 582363

SEQ ID NO: 676807 - RNA, 64 nt, hsa; identical to SEQ ID NO: 582364

SEQ ID NO: 676808 - RNA, 64 nt, hsa; identical to SEQ ID NO: 582365

SEQ ID NO: 676809 - RNA, 64 nt, hsa; identical to SEQ ID NO: 582366

SEQ ID NO: 676810 - RNA, 64 nt, hsa; identical to SEQ ID NO: 582367

SEQ ID NO: 676811 - RNA, 64 nt, hsa; identical to SEQ ID NO: 582368

SEQ ID NO: 676812 - RNA, 64 nt, hsa; identical to SEQ ID NO: 582369

SEQ ID NO: 676813 - RNA, 64 nt, hsa; identical to SEQ ID NO: 582370

SEQ ID NO: 676814 - RNA, 64 nt, hsa; identical to SEQ ID NO: 582371

SEQ ID NO: 676815 - RNA, 64 nt, hsa; identical to SEQ ID NO: 245756

SEQ ID NO: 676816 - RNA, 64 nt, hsa; identical to SEQ ID NO: 245757

SEQ ID NO: 676817 - RNA, 64 nt, hsa; identical to SEQ ID NO: 245758

SEQ ID NO: 676818 - RNA, 64 nt, hsa; identical to SEQ ID NO: 245759

SEQ ID NO: 676819 - RNA, 64 nt, hsa; identical to SEQ ID NO: 105402

SEQ ID NO: 676820 - RNA, 64 nt, hsa; identical to SEQ ID NO: 105403

SEQ ID NO: 676821 - RNA, 64 nt, hsa; identical to SEQ ID NO: 619660

SEQ ID NO: 676822 - RNA, 64 nt, hsa; identical to SEQ ID NO: 619661

SEQ ID NO: 676823 - RNA, 64 nt, hsa; identical to SEQ ID NO: 619662

SEQ ID NO: 676824 - RNA, 64 nt, hsa; identical to SEQ ID NO: 619663

SEQ ID NO: 676825 - RNA, 58 nt, hsa
ccaagcaguuucuuucaaagaagccagcaggcgaaaagcagggacugccacugcauuu

SEQ ID NO: 676826 - RNA, 58 nt, hsa
caaaggagggugucuuggcugugcuugaaggcgaaacccugccauauccccagugcca

SEQ ID NO: 676827 - RNA, 58 nt, hsa
uauuauuuuauuccaagaaagaucagguaggcgaaaagaugacaggauacagagucaa

SEQ ID NO: 676828 - RNA, 58 nt, hsa
ugcuuagcccagcucagggguggggaagaggcgaaagcgugggggaggugagcgcagc

SEQ ID NO: 676829 - RNA, 58 nt, hsa
gaggccaaaaguuaaacguucuaaaaagaggcgaaaggaagcaagcaguucagaagag

SEQ ID NO: 676830 - RNA, 58 nt, hsa
cuggaaagcaacuucaucccagcugcugaggcgaaauauaaaacugagacuguauaug

SEQ ID NO: 676831 - RNA, 58 nt, hsa
uagacugcucgcuaguggaacacgacagaggcgaaauccugccccgucucccguggac

SEQ ID NO: 676832 - RNA, 58 nt, hsa
cccuucagcugugacaucgugccugggaaggcgaaauauacccccagccccuuccaac

SEQ ID NO: 676833 - RNA, 58 nt, hsa
gccugcagcacaccccacagccaaguagaggcgaaagcaguggcucauccuaccuguu

SEQ ID NO: 676834 - RNA, 58 nt, hsa
gacacacacucgcagacgagccgccccgaggcgaaaccucgcgguuccucuucccuuc

SEQ ID NO: 676835 - RNA, 58 nt, hsa
uuguggaaagacggugugugucgugugaaggcgaaacccgguguacauaaccccuccc

SEQ ID NO: 676836 - RNA, 58 nt, hsa
acaggagggccaggcauguauuccucagaggcgaaacugccaaacucuuucuccuguc

SEQ ID NO: 676837 - RNA, 58 nt, hsa
ugauucacuuuuugccccuagggaugagaggcgaaagccacuucucauacaagccccu

SEQ ID NO: 676838 - RNA, 58 nt, hsa
gcugaugagcaaggcaggcaggucugagaggcgaaacgaaucucccggcagugcuugg

SEQ ID NO: 676839 - RNA, 58 nt, hsa
ccagugggguccggacacugggccccgcaggcgaaagcacguuccagccaccaggagg

SEQ ID NO: 676840 - RNA, 58 nt, hsa
cgggaguuggagacccgccuggcuaacaaggcgaaauccugucuguacuaaaaauaca

SEQ ID NO: 676841 - RNA, 58 nt, hsa
cagguaaguauugcuuccgccacugcagaggcgaaagccagugcuuugguaaaggucc

SEQ ID NO: 676842 - RNA, 58 nt, hsa
acugaucugccuaaagcacgcgagaugcaggcgaaaagcagccacaccccucugccac

SEQ ID NO: 676843 - RNA, 58 nt, hsa
ugacuucauauacaaagccuguaauuuuaggcgaaauggaagcagaaaucuaggaagu

SEQ ID NO: 676844 - RNA, 58 nt, hsa
acucuagcacugguguauaugagaaggaaggcgaaagcaugacaggaaaccugccgcc

SEQ ID NO: 676845 - RNA, 58 nt, hsa
gccugagccgauggggccccccaggcccaggcgaaagggcagcagcauguggcccaug

SEQ ID NO: 676846 - RNA, 58 nt, hsa
cugauaugugccuguuucuggacaauggaggcgaaagaguggaauuucauucaaaggc

SEQ ID NO: 676847 - RNA, 58 nt, hsa
caggaguucaagaccagccuggccaacaaggcgaaacccugucucuacuaaaaauaaa

SEQ ID NO: 676848 - RNA, 58 nt, hsa
uagggcuggaagccaguucuaggcuuccaggcgaaagcugagggaaggaagaaacucc

SEQ ID NO: 676849 - RNA, 58 nt, hsa
gcuguggugauuggcccuguggucuaucaggcgaaaaccacagauucuccuucuaguu

SEQ ID NO: 676850 - RNA, 58 nt, hsa
ccucacucucuguaagcauauaaaccacaggcgaaagaggaugcugcauugcgaggac

SEQ ID NO: 676851 - RNA, 58 nt, hsa
cgcccaggcuccucucugacacgccuuuaggcgaaacaugccccaagacacagggacc

SEQ ID NO: 676852 - RNA, 58 nt, hsa
caggaguucgagaucauucuggccaacaaggcgaaacccugucucuaccaaaaauaca

SEQ ID NO: 676853 - RNA, 58 nt, hsa
acuaugccuguugaucuaugggaaaucuaggcgaaaguaauggggaagauuagaaaga

SEQ ID NO: 676854 - RNA, 58 nt, hsa
uaaugcuaaucuugugaaaauaauugacaggcgaaagaaaacucuauuuagaugcaua

SEQ ID NO: 676855 - RNA, 64 nt, hsa
acuuaacacucaaauauuaacauuuuagguuucucuugcagauaugagagauagcacagaugga

SEQ ID NO: 676856 - RNA, 64 nt, hsa
uuuugagagauuacagaagaggaggccugcuucacuugcagauaaguuuauuauaauucuccag

SEQ ID NO: 676857 - RNA, 64 nt, hsa
aaggguuucaccaaggauggagaaagggagacagcuugcagauggcgcguucucacggugggcu

SEQ ID NO: 676858 - RNA, 64 nt, hsa
agcaaaaaucaguaacaaaaaauaguaacaauaccuugcagaggaaaggugggagagaggaaaa

SEQ ID NO: 676859 - RNA, 64 nt, hsa
caagaugcagcaaggagaggaugcagaacagcuucuugcagaagcaccugcuccggcauccagc

SEQ ID NO: 676860 - RNA, 64 nt, hsa
gugcucccagcagaggcugugcgugucaguucuucuugcagaaugugcucugguggaacaaguu

SEQ ID NO: 676861 - RNA, 64 nt, hsa
agccacugcucccaguuaaaggugggucaguagccuugcagaacuguccugagaaguuauugcu

SEQ ID NO: 676862 - RNA, 64 nt, hsa
cacuuuucacuuuccagcuaggucuguuuuucagcuugcagacaagauugagaaauccuugaaa

SEQ ID NO: 676863 - RNA, 64 nt, hsa
aaguaaagccuuuuucugccccagcucugagacacuugcagaucuuaaggucugagacuugcug

SEQ ID NO: 676864 - RNA, 64 nt, hsa
ucaaggccagcaagccccucaggccagcacuucgcuugcagaagccauccauucacuccugggg

SEQ ID NO: 676865 - RNA, 64 nt, hsa
cccugccacaggcugcagcuaccuaggaacauuccuugcagaccccgcauugcccuuugggggu

SEQ ID NO: 676866 - RNA, 64 nt, hsa
gaagugcagucuuugauuugauuucccuaguaaccuugcagauauguuuaaccaagccauagcc

SEQ ID NO: 676867 - RNA, 64 nt, hsa
auucucaucgaggccccucgcuucuaugacugugcuugcagaagaguaaacacucucggaugcc

SEQ ID NO: 676868 - RNA, 64 nt, hsa
caacccaacggcaaagacacagaaaccagguccccuugcagacggcucucccaucuuccugcaa

SEQ ID NO: 676869 - RNA, 64 nt, hsa
gucuuuaaugacagaaacacaaaaaccagcuggccuugcagacggcuuuucuaacucacaaguc

SEQ ID NO: 676870 - RNA, 64 nt, hsa
cccuuuauuuugguccucucguaguugugaaacacuugcagagcaaacaaagcagaggcaagaa

SEQ ID NO: 676871 - RNA, 64 nt, hsa
uuuuuuaaaaauggaguccugcuauuuuccacuccuugcagauaauacaaauucaguuugucag

SEQ ID NO: 676872 - RNA, 64 nt, hsa
ggaaaaaaguuuuaaaaaagaaauugaaaauugccuugcagauauuuagguacaauggaguuuu

SEQ ID NO: 676873 - RNA, 64 nt, hsa
ccagcgcuacggacuccucccaauucugacaucucuugcagacaauacuaugcucucuacacac

SEQ ID NO: 676874 - RNA, 64 nt, hsa
aaggaagcgacccagaaauggcagggacacuucucuugcagaccaagagggacccuggagcacc

SEQ ID NO: 676875 - RNA, 64 nt, hsa
gugcggcaagcccagcuggucaggaaagagaauacuugcagagggguucagguuccucuuuuuc

SEQ ID NO: 676876 - RNA, 64 nt, hsa
ggggcaguggcagugugcaaagaauugauuacuccuugcagagccuguggcuugcauuuccuac

SEQ ID NO: 676877 - RNA, 64 nt, hsa
gcuaaccacacaggccauuccccucucccagcaccuugcagacuugggcccaucaagagcuacu

SEQ ID NO: 676878 - RNA, 60 nt, hsa
agugaggccauagcaacuccccuacaucaaaugcucaagcccugaguugccgccgagaag

SEQ ID NO: 676879 - RNA, 60 nt, hsa
agugaggccauagcaauuccccuacaucaaaugcucaagcccccagcuggaaguuaagag

SEQ ID NO: 676880 - RNA, 60 nt, hsa
aggauccuccacugaugguaaaaucugaggaugcucaagucccuuguauaaaauggcaua

SEQ ID NO: 676881 - RNA, 60 nt, hsa
acaucauucuauaagucaguauacuuuuggaugcucaaaaugccauaucuucaaccagua

SEQ ID NO: 676882 - RNA, 60 nt, hsa
agaaaauucauuuuugagaaaauguguuucaugcucaauuccaagcauaauaaauuuuau

SEQ ID NO: 676883 - RNA, 64 nt, hsa; identical to SEQ ID NO: 368838

SEQ ID NO: 676884 - RNA, 64 nt, hsa; identical to SEQ ID NO: 368839

SEQ ID NO: 676885 - RNA, 64 nt, hsa; identical to SEQ ID NO: 368840

SEQ ID NO: 676886 - RNA, 64 nt, hsa; identical to SEQ ID NO: 368841

SEQ ID NO: 676887 - RNA, 64 nt, hsa; identical to SEQ ID NO: 368842

SEQ ID NO: 676888 - RNA, 64 nt, hsa; identical to SEQ ID NO: 368843

SEQ ID NO: 676889 - RNA, 64 nt, hsa; identical to SEQ ID NO: 368844

SEQ ID NO: 676890 - RNA, 64 nt, hsa; identical to SEQ ID NO: 368845

SEQ ID NO: 676891 - RNA, 64 nt, hsa; identical to SEQ ID NO: 368846

SEQ ID NO: 676892 - RNA, 64 nt, hsa; identical to SEQ ID NO: 368847

SEQ ID NO: 676893 - RNA, 64 nt, hsa; identical to SEQ ID NO: 368848

SEQ ID NO: 676894 - RNA, 64 nt, hsa; identical to SEQ ID NO: 368849

SEQ ID NO: 676895 - RNA, 64 nt, hsa; identical to SEQ ID NO: 368850

SEQ ID NO: 676896 - RNA, 64 nt, hsa; identical to SEQ ID NO: 368851

SEQ ID NO: 676897 - RNA, 64 nt, hsa; identical to SEQ ID NO: 368852

SEQ ID NO: 676898 - RNA, 64 nt, hsa; identical to SEQ ID NO: 368853

SEQ ID NO: 676899 - RNA, 64 nt, hsa; identical to SEQ ID NO: 368854

SEQ ID NO: 676900 - RNA, 64 nt, hsa; identical to SEQ ID NO: 368855

SEQ ID NO: 676901 - RNA, 64 nt, hsa; identical to SEQ ID NO: 368856

SEQ ID NO: 676902 - RNA, 64 nt, hsa; identical to SEQ ID NO: 368857

SEQ ID NO: 676903 - RNA, 64 nt, hsa; identical to SEQ ID NO: 368858

SEQ ID NO: 676904 - RNA, 64 nt, hsa; identical to SEQ ID NO: 368859

SEQ ID NO: 676905 - RNA, 64 nt, hsa; identical to SEQ ID NO: 368860

SEQ ID NO: 676906 - RNA, 64 nt, hsa; identical to SEQ ID NO: 368861

SEQ ID NO: 676907 - RNA, 64 nt, hsa
ugggggucuuacucaaguacuaguaauuuaacuucaucaugaaugaacuauaauuuuuaaguua

SEQ ID NO: 676908 - RNA, 64 nt, hsa
gaacuauaaauaaauaucuagaaucugacuggcucaucaugacauccuacucauaacauaaauc

SEQ ID NO: 676909 - RNA, 64 nt, hsa
ucaucuaugaauucaucaugaaagacaagcaauccaucaugaaauucguucuaaaagugaauca

SEQ ID NO: 676910 - RNA, 64 nt, hsa
gcaauuuaagaaauaggaaagucaucuaugaauucaucaugaaagacaagcaauccaucaugaa

SEQ ID NO: 676911 - RNA, 64 nt, hsa
gaaaugccauauaugauacaaauccugcaaaagacaucaugagaaaauaccagcaguaucuauc

SEQ ID NO: 676912 - RNA, 64 nt, hsa
ccaccucuguauucccccgugcuuuaccuucuggcaucaugaaaagcugccaugauucuguggu

SEQ ID NO: 676913 - RNA, 64 nt, hsa
aggaauucauugagucuugucaaaaggaugagaacaucaugagguccaugcagcucuuugacaa

SEQ ID NO: 676914 - RNA, 64 nt, hsa
aggacggcugcaucaccaaggaggaaaugcuugacaucaugaaguccaucuaugacaugauggg

SEQ ID NO: 676915 - RNA, 64 nt, hsa
uguccauuucuagccucuuucaaaaagcacagugcaucaugagcaacagaaaagcaguagaauc

SEQ ID NO: 676916 - RNA, 64 nt, hsa
gaaggcacacuucuuuuggucugaagguaacccccaucaugacuagacgagaaccgucuuuacc

SEQ ID NO: 676917 - RNA, 64 nt, hsa
guggagcaguggcauuuccaugccucaugcucaccaucaugagguuaacuucccgccgucgccu

SEQ ID NO: 676918 - RNA, 64 nt, hsa
ucucacugucacccaggcuggagugcaguggugccaucaugacucacugcagccuugaccuccc

SEQ ID NO: 676919 - RNA, 64 nt, hsa; identical to SEQ ID NO: 85370

SEQ ID NO: 676920 - RNA, 64 nt, hsa; identical to SEQ ID NO: 85371

SEQ ID NO: 676921 - RNA, 64 nt, hsa; identical to SEQ ID NO: 85372

SEQ ID NO: 676922 - RNA, 64 nt, hsa; identical to SEQ ID NO: 85373

SEQ ID NO: 676923 - RNA, 64 nt, hsa; identical to SEQ ID NO: 85374

SEQ ID NO: 676924 - RNA, 64 nt, hsa; identical to SEQ ID NO: 85375

SEQ ID NO: 676925 - RNA, 64 nt, hsa; identical to SEQ ID NO: 85376

SEQ ID NO: 676926 - RNA, 64 nt, hsa; identical to SEQ ID NO: 85377

SEQ ID NO: 676927 - RNA, 64 nt, hsa; identical to SEQ ID NO: 85378

SEQ ID NO: 676928 - RNA, 64 nt, hsa; identical to SEQ ID NO: 85379

SEQ ID NO: 676929 - RNA, 64 nt, hsa; identical to SEQ ID NO: 85380

SEQ ID NO: 676930 - RNA, 64 nt, hsa; identical to SEQ ID NO: 85381

SEQ ID NO: 676931 - RNA, 64 nt, hsa; identical to SEQ ID NO: 85382

SEQ ID NO: 676932 - RNA, 64 nt, hsa; identical to SEQ ID NO: 85383

SEQ ID NO: 676933 - RNA, 64 nt, hsa; identical to SEQ ID NO: 85384

SEQ ID NO: 676934 - RNA, 64 nt, hsa; identical to SEQ ID NO: 85385

SEQ ID NO: 676935 - RNA, 64 nt, hsa; identical to SEQ ID NO: 85386

SEQ ID NO: 676936 - RNA, 61 nt, hsa
agaccugcacagaugaaggagcagagguucugaccgagaggcugagccaggccggggucug

SEQ ID NO: 676937 - RNA, 61 nt, hsa
uccaucaccauucaccccaggggacagccucgaccgagacaaggaggcccuuaaaugacag

SEQ ID NO: 676938 - RNA, 61 nt, hsa
ugugugugugugugcgcgcgcgccagugcaagaccgagauugagggaaagcaugucugcug

SEQ ID NO: 676939 - RNA, 61 nt, hsa
uauuuauuggccaggaaguuggugcugcuaagaccgagaaauuuaaagaaucggacagaug

SEQ ID NO: 676940 - RNA, 61 nt, hsa
gagugggagggagacgcaguagacagagacagaccgagagaggaauggagagacagagggg

SEQ ID NO: 676941 - RNA, 61 nt, hsa
uggagcuacugcaaaugcuauauugcacugugaccgagaacuuuuaagaggauagaauaca

SEQ ID NO: 676942 - RNA, 61 nt, hsa
ggcucagaagagacugagcuugcacagaucagaccgagaagcagggugagagauucuaacg

SEQ ID NO: 676943 - RNA, 61 nt, hsa
ggagcaagacuucuaacggcugauugguauggaccgagauuaucuuucaauugaagugacu

SEQ ID NO: 676944 - RNA, 61 nt, hsa
ugugccacugcacacuccaaucugggugaaagaccgagacuccgccucaaaaaaaaaaaaa

SEQ ID NO: 676945 - RNA, 61 nt, hsa
cuuacuguacuggaaacgucaccggaaucaggaccgagagcccuaaauaagucacacagca

SEQ ID NO: 676946 - RNA, 61 nt, hsa
cugugcggagcuggugcugccugaaaccccagaccgagaaguugaugcucggcccacgccg

SEQ ID NO: 676947 - RNA, 61 nt, hsa
uuaucugugugucugacagugugagauguuagaccgagagaaaagcaaacaaauaaaucac

SEQ ID NO: 676948 - RNA, 59 nt, hsa
gcauccuagucucuaucauuaaaguucuagugaccgagacccgggcugcguucucuggg

SEQ ID NO: 676949 - RNA, 61 nt, hsa
guuugaaacucauuguuuccuugugguaagugaccgagaugcugccacaggaccugagaca

SEQ ID NO: 676950 - RNA, 61 nt, hsa
uuccaaagcaaaagaggaagccagaccuugggaccgagaacugagaaucacaagggaguug

SEQ ID NO: 676951 - RNA, 61 nt, hsa
gaucgccccacugcacuccagccuggcaauagaccgagacuccgucuccaaaaaaaaaaaa

SEQ ID NO: 676952 - RNA, 61 nt, hsa
ugggcgagcugggcuggggagagccugugaggaccgagaggagaaaugagaagaaggaaca

SEQ ID NO: 676953 - RNA, 61 nt, hsa
uccucagccggggccguccagacagcaacaagaccgagaaccggcguaucacacacaucuc

SEQ ID NO: 676954 - RNA, 61 nt, hsa
gagcgugccgcuacacuccagccugaugacagaccgagacacugucucaaaaaaauaaaaa

SEQ ID NO: 676955 - RNA, 61 nt, hsa
gacucaggacuuggacgccauaguggcccgggaccgagaccuucagcaguugaggcugggg

SEQ ID NO: 676956 - RNA, 61 nt, hsa
aucgcaccacugcacuccagccugggcgacagaccgagacuccgucucaaaaaaaaaaaaa

SEQ ID NO: 676957 - RNA, 61 nt, hsa
uuuuaaaaauccccuucacacuuaauguacugaccgagacagaaguaccugaaaacagcug

SEQ ID NO: 676958 - RNA, 61 nt, hsa
ucaagaggaaccauuggccuagagcuccugugaccgagagcgccacggaagccuggggaug

SEQ ID NO: 676959 - RNA, 61 nt, hsa
uguauaccguaucuaucuacccgacagcagcgaccgagacccggugggacacuccccuucu

SEQ ID NO: 676960 - RNA, 61 nt, hsa
auuggcccuaaauagcagaaagaagagaagugaccgagagaaccucagauucuucauugag

SEQ ID NO: 676961 - RNA, 61 nt, hsa
gaggagguggagcugcagcugggacugugaggaccgagaagcaauggcccagcagacgaga

SEQ ID NO: 676962 - RNA, 61 nt, hsa
guacauuggacaccugacaacccucugccaugaccgagacccccugauccuccguggacuc

SEQ ID NO: 676963 - RNA, 61 nt, hsa
uacaaaaaggaauauuucccaaaccucuucagaccgagaaugcauggguaaaauuauuaaa

SEQ ID NO: 676964 - RNA, 61 nt, hsa
uuaagauugcugugagcuuuaucagauaagagaccgagagaaguaagcugggucuuguuau

SEQ ID NO: 676965 - RNA, 61 nt, hsa
caggccugggccucugcaacugcccugacaggaccgagaggccuugccccuccaccuggug

SEQ ID NO: 676966 - RNA, 61 nt, hsa
gcguccaccugggaggcauuugggguugcaggaccgagacccacauccucucacucacuuc

SEQ ID NO: 676967 - RNA, 61 nt, hsa
acacuccguaaacagcccagcuguaacgccagaccgagacgaacacucugccuaacuauca

SEQ ID NO: 676968 - RNA, 61 nt, hsa
caccuucuggcaaauucaagaggcaugaguggaccgagagcacauccagcauuugcaucac

SEQ ID NO: 676969 - RNA, 61 nt, hsa
ccaugugauguccaccaguggaugaaugcuggaccgagagcccuagcuucuggauccaggu

SEQ ID NO: 676970 - RNA, 61 nt, hsa
ggaguaggggggguguggguguguaaccagagaccgagagcaugaguggggugugccucgu

SEQ ID NO: 676971 - RNA, 61 nt, hsa
aaaucuucuucagaggaucacccgggaaaacgaccgagaccgaagauuggcuacuguaaag

SEQ ID NO: 676972 - RNA, 61 nt, hsa
agauggccaccauccucaaucuggagcgggugaccgagauccucgauuacuggggacccaa

SEQ ID NO: 676973 - RNA, 61 nt, hsa
ggaacuuacugacuguaagagguuagagguggaccgagaaggacuuuucccagucuucagu

SEQ ID NO: 676974 - RNA, 61 nt, hsa
ccaggcgguuucacgccccacacuuuguacagaccgagaggccaguugaucugcucuguuu

SEQ ID NO: 676975 - RNA, 61 nt, hsa
ggcccaacucuaaaguggaagaaccuuguuagaccgagagcuugccauccagccaagcugc

SEQ ID NO: 676976 - RNA, 61 nt, hsa
gacagccucccagccagggcuggcgauaaaggaccgagauagauggagggggcgaguaggg

SEQ ID NO: 676977 - RNA, 61 nt, hsa
gauggacuuguauagugagagaggaggccuggaccgagaugugaguccuguugaagacuuc

SEQ ID NO: 676978 - RNA, 61 nt, hsa
caguugcagggaggguagauggccccacccagaccgagagacacagugaugaccucagccu

SEQ ID NO: 676979 - RNA, 61 nt, hsa
ccuuggaagaguccggccuggccucccccaggaccgagaucaccgcccaguaugggcuaga

SEQ ID NO: 676980 - RNA, 61 nt, hsa
uauccccuucuuuuuaugggguuaaggaagggaccgagagaucagauaguugcuguuuugu

SEQ ID NO: 676981 - RNA, 61 nt, hsa
accccacccgguggggcccuuggccccagaggaccgagagaguggagagugcggcgugggg

SEQ ID NO: 676982 - RNA, 61 nt, hsa
ccaacccuccugcauccuugccuugcagcgugaccgagauaggucaucagcccagggcuuc

SEQ ID NO: 676983 - RNA, 61 nt, hsa
uagggacucagccacuugcagaacaggaugggaccgagauuucagcgagcccuccuggcgc

SEQ ID NO: 676984 - RNA, 61 nt, hsa
aggccgaggcgagcagaucacgaggucaggagaccgagaccauccuggcuaacauggugaa

SEQ ID NO: 676985 - RNA, 61 nt, hsa
cggucagaacugugugacucacuugaggcaggaccgagagugacauccaguugcaccuuuc

SEQ ID NO: 676986 - RNA, 61 nt, hsa
guuccuaugacaggcccacucaaccugggcagaccgagaggcccgugcacuuuggaauggg

SEQ ID NO: 676987 - RNA, 61 nt, hsa
cugucggaccuucacuucacaucaugguggggaccgagauagagagggagaccccauucca

SEQ ID NO: 676988 - RNA, 61 nt, hsa
ccuuccuagaguguuuggucggguucacagugaccgagagucagguccagcacacaccugg

SEQ ID NO: 676989 - RNA, 61 nt, hsa
caguucaauuaacuguauaggucuuucauuagaccgagacaucacuagaaauucugggcac

SEQ ID NO: 676990 - RNA, 64 nt, hsa
uaaaauauguaugaagaaaagguguacaaaaauuugcccuuaugcacggaacucuguuucuaag

SEQ ID NO: 676991 - RNA, 64 nt, hsa
ggaauugcagaugggucuucuauacccuucuaccugcccuuagaucuccauuuuuaucaaauag

SEQ ID NO: 676992 - RNA, 64 nt, hsa
ugggaaggcagacaccugguucuagaacuagcucugcccuuagcccccuguaugacccuaugca

SEQ ID NO: 676993 - RNA, 64 nt, hsa
cacaccucuccccucaaccuugaccaucuccaucugcccuuaaaugcuguaugcuuuuuugcca

SEQ ID NO: 676994 - RNA, 64 nt, hsa
aaacacaccucaugaucaucuuguggguuucuuuugcccuuacuggaugacucucagaggacau

SEQ ID NO: 676995 - RNA, 64 nt, hsa
cucgagaauucaaagggacauuuaaggugggguaugcccuuaauuugguaugacuuauugacaa

SEQ ID NO: 676996 - RNA, 64 nt, hsa
cauuugaugauucuggauuuuugcuguuuguuauugcccuuagaggggcucugaguaucuacuu

SEQ ID NO: 676997 - RNA, 64 nt, hsa
ugaaguuauauagccuugaaaacucagugcagguugcccuuaauuuuccccaaaccccuccauc

SEQ ID NO: 676998 - RNA, 64 nt, hsa
gaggugcgucccccguugugccugguucgugccaugcccuuacacgugcgugugagugugugug

SEQ ID NO: 676999 - RNA, 64 nt, hsa
ccaagccacuagcccacuccccaguuggcccuucugcccuuaccccacacacaguccaacucuu

SEQ ID NO: 677000 - RNA, 64 nt, hsa
uaccuguaauuccagucuuugugcauuugucaucugcccuuaaaggaaugauuuucaaccuuuc

SEQ ID NO: 677001 - RNA, 64 nt, hsa
uuacuaucaaccuaauuucagaucaugucuccccugcccuuagucuucauuuaugaagugaauu

SEQ ID NO: 677002 - RNA, 64 nt, hsa
ugccgcucuguggccuugcccuguaaucacucagugcccuuagcuagccugacuaagucccaga

SEQ ID NO: 677003 - RNA, 64 nt, hsa
ggucucucuugacuaccucguccaaagagagcacugcccuuagacaagaguugcuuguccugcu

SEQ ID NO: 677004 - RNA, 64 nt, hsa
gacagugcuggagacauaguuggggguggagaacugcccuuauggagcuugcaguccagugagg

SEQ ID NO: 677005 - RNA, 64 nt, hsa
accccagcccagaucugaauggcaugggaggugcugcccuuaaccaugacaccauuguaagagc

SEQ ID NO: 677006 - RNA, 64 nt, hsa
guuauucugaucucuguuaaggucgcagaaucaaugcccuuacugauacaccuaccuuauagga

SEQ ID NO: 677007 - RNA, 64 nt, hsa
uaauguccaaguaauccuuggaaagaaaagaacgugcccuuaacuaacuuuguccugcuuccca

SEQ ID NO: 677008 - RNA, 59 nt, hsa
cauugggcuccccagccggaacugguuaccaaggacaaggacacucugacauucggcuu

SEQ ID NO: 677009 - RNA, 59 nt, hsa
gcuccccagccggaacugguuaccaaggacaaggacacucugacauucggcuugaucca

SEQ ID NO: 677010 - RNA, 59 nt, hsa
cacacaggcacugccccaggacaacacaacaaggacagucacaacaaggacaacaagga

SEQ ID NO: 677011 - RNA, 59 nt, hsa
ccaggacaacacaacaaggacagucacaacaaggacaacaaggacacaacacaacacac

SEQ ID NO: 677012 - RNA, 59 nt, hsa
cacaacaaggacagucacaacaaggacaacaaggacacaacacaacacacaacaaggac

SEQ ID NO: 677013 - RNA, 59 nt, hsa
ggacaacaaggacacaacacaacacacaacaaggacagucacaacaagccuagagccag

SEQ ID NO: 677014 - RNA, 59 nt, hsa
cgucuccaccaaccuuugugugacaaaaacaaggacaaauuccugcuacuaagacaugc

SEQ ID NO: 677015 - RNA, 59 nt, hsa
uuccgcagagaccagagaucucuguacuucaaggacagccuuggcuggcuccccaucca

SEQ ID NO: 677016 - RNA, 59 nt, hsa
gaaggcguccauccauucaucucauuggccaaggacaaacucuccucugggacgucugg

SEQ ID NO: 677017 - RNA, 59 nt, hsa
acagggaccuucaaaccucgacagugaugcaaggacacagagaguaccagauagguagc

SEQ ID NO: 677018 - RNA, 59 nt, hsa
aacgugcucaaguucaucggggugcucuacaaggacaagaggcucaacuucaucacuga

SEQ ID NO: 677019 - RNA, 59 nt, hsa
uacccauggagccagagagugagcuuugccaaggacaucgcaucagggauggugaguga

SEQ ID NO: 677020 - RNA, 59 nt, hsa
acaaguggauucagacugaacccccaguacaaggacauuguuuugaacuagguggacau

SEQ ID NO: 677021 - RNA, 59 nt, hsa
caguugcuguguugaguucucuuuaaaaacaaggacaaaaccaaccagcguucaaagga

SEQ ID NO: 677022 - RNA, 59 nt, hsa
acuuaagauagccacaaucagaaaaaggacaaggacaugagacaguggugauggccauc

SEQ ID NO: 677023 - RNA, 59 nt, hsa
agggcuuggagcucgggugguggagaugacaaggacacuguggggucuggguccccaga

SEQ ID NO: 677024 - RNA, 59 nt, hsa
caagaggaauuuucccucggccuuacugacaaggacaccaaccuagggugcaaacagau

SEQ ID NO: 677025 - RNA, 59 nt, hsa
ccuagggugcaaacagauggacuaugguucaaggacacuggaauugaggagcugaucaa

SEQ ID NO: 677026 - RNA, 59 nt, hsa
gaaaaaggaagagaaaaaguuugauaugccaaggacagauuuugaaacagacuugguaa

SEQ ID NO: 677027 - RNA, 59 nt, hsa
gcuaauaauauuugaaggagauugccuaccaaggacaaaacaauaaauuuaaaaaucaa

SEQ ID NO: 677028 - RNA, 59 nt, hsa
ugcagcuucuucuucgagucggagagcuacaaggacagcguccaggguagggugagagg

SEQ ID NO: 677029 - RNA, 59 nt, hsa
agagaaguugagaggacccaugaaggaagcaaggacacggggcaggcaccuggauguug

SEQ ID NO: 677030 - RNA, 59 nt, hsa
uuguacuuccgugggcccuccuuccagaacaaggacaacaaggacaagguugaaggguc

SEQ ID NO: 677031 - RNA, 59 nt, hsa
cgugggcccuccuuccagaacaaggacaacaaggacaagguugaagggucuucucaucu

SEQ ID NO: 677032 - RNA, 59 nt, hsa
gccggggcggccccagcggggaggaggagcaaggacauguaccaugccagcaagagugc

SEQ ID NO: 677033 - RNA, 59 nt, hsa
accugccagugucuugggcauuuccuuggcaaggacauuaaagugauuucaucacagug

SEQ ID NO: 677034 - RNA, 64 nt, hsa; identical to SEQ ID NO: 163826

SEQ ID NO: 677035 - RNA, 64 nt, hsa; identical to SEQ ID NO: 163827

SEQ ID NO: 677036 - RNA, 64 nt, hsa; identical to SEQ ID NO: 163828

SEQ ID NO: 677037 - RNA, 64 nt, hsa; identical to SEQ ID NO: 163829

SEQ ID NO: 677038 - RNA, 64 nt, hsa; identical to SEQ ID NO: 163830

SEQ ID NO: 677039 - RNA, 64 nt, hsa; identical to SEQ ID NO: 163831

SEQ ID NO: 677040 - RNA, 64 nt, hsa; identical to SEQ ID NO: 163832

SEQ ID NO: 677041 - RNA, 64 nt, hsa; identical to SEQ ID NO: 163833

SEQ ID NO: 677042 - RNA, 64 nt, hsa; identical to SEQ ID NO: 163834

SEQ ID NO: 677043 - RNA, 64 nt, hsa; identical to SEQ ID NO: 163835

SEQ ID NO: 677044 - RNA, 64 nt, hsa; identical to SEQ ID NO: 163836

SEQ ID NO: 677045 - RNA, 64 nt, hsa; identical to SEQ ID NO: 163837

SEQ ID NO: 677046 - RNA, 64 nt, hsa; identical to SEQ ID NO: 163838

SEQ ID NO: 677047 - RNA, 64 nt, hsa; identical to SEQ ID NO: 163839

SEQ ID NO: 677048 - RNA, 64 nt, hsa; identical to SEQ ID NO: 163840

SEQ ID NO: 677049 - RNA, 64 nt, hsa; identical to SEQ ID NO: 163841

SEQ ID NO: 677050 - RNA, 64 nt, hsa; identical to SEQ ID NO: 163842

SEQ ID NO: 677051 - RNA, 64 nt, hsa; identical to SEQ ID NO: 163843

SEQ ID NO: 677052 - RNA, 64 nt, hsa; identical to SEQ ID NO: 163844

SEQ ID NO: 677053 - RNA, 64 nt, hsa; identical to SEQ ID NO: 163845

SEQ ID NO: 677054 - RNA, 64 nt, hsa; identical to SEQ ID NO: 163846

SEQ ID NO: 677055 - RNA, 64 nt, hsa; identical to SEQ ID NO: 163847

SEQ ID NO: 677056 - RNA, 64 nt, hsa; identical to SEQ ID NO: 163848

SEQ ID NO: 677057 - RNA, 64 nt, hsa; identical to SEQ ID NO: 163849

SEQ ID NO: 677058 - RNA, 64 nt, hsa; identical to SEQ ID NO: 163850

SEQ ID NO: 677059 - RNA, 64 nt, hsa; identical to SEQ ID NO: 163851

SEQ ID NO: 677060 - RNA, 64 nt, hsa; identical to SEQ ID NO: 163852

SEQ ID NO: 677061 - RNA, 64 nt, hsa; identical to SEQ ID NO: 163853

SEQ ID NO: 677062 - RNA, 64 nt, hsa; identical to SEQ ID NO: 163854

SEQ ID NO: 677063 - RNA, 64 nt, hsa; identical to SEQ ID NO: 163855

SEQ ID NO: 677064 - RNA, 64 nt, hsa; identical to SEQ ID NO: 163856

SEQ ID NO: 677065 - RNA, 64 nt, hsa; identical to SEQ ID NO: 163857

SEQ ID NO: 677066 - RNA, 64 nt, hsa; identical to SEQ ID NO: 163858

SEQ ID NO: 677067 - RNA, 64 nt, hsa; identical to SEQ ID NO: 163859

SEQ ID NO: 677068 - RNA, 64 nt, hsa; identical to SEQ ID NO: 163860

SEQ ID NO: 677069 - RNA, 64 nt, hsa; identical to SEQ ID NO: 163861

SEQ ID NO: 677070 - RNA, 64 nt, hsa; identical to SEQ ID NO: 163862

SEQ ID NO: 677071 - RNA, 64 nt, hsa; identical to SEQ ID NO: 163863

SEQ ID NO: 677072 - RNA, 64 nt, hsa; identical to SEQ ID NO: 163864

SEQ ID NO: 677073 - RNA, 64 nt, hsa; identical to SEQ ID NO: 163865

SEQ ID NO: 677074 - RNA, 64 nt, hsa; identical to SEQ ID NO: 163866

SEQ ID NO: 677075 - RNA, 64 nt, hsa; identical to SEQ ID NO: 163867

SEQ ID NO: 677076 - RNA, 64 nt, hsa; identical to SEQ ID NO: 163868

SEQ ID NO: 677077 - RNA, 64 nt, hsa; identical to SEQ ID NO: 163869

SEQ ID NO: 677078 - RNA, 64 nt, hsa; identical to SEQ ID NO: 163870

SEQ ID NO: 677079 - RNA, 64 nt, hsa; identical to SEQ ID NO: 163871

SEQ ID NO: 677080 - RNA, 64 nt, hsa; identical to SEQ ID NO: 163872

SEQ ID NO: 677081 - RNA, 64 nt, hsa; identical to SEQ ID NO: 163873

SEQ ID NO: 677082 - RNA, 64 nt, hsa; identical to SEQ ID NO: 163874

SEQ ID NO: 677083 - RNA, 64 nt, hsa; identical to SEQ ID NO: 163875

SEQ ID NO: 677084 - RNA, 64 nt, hsa; identical to SEQ ID NO: 163876

SEQ ID NO: 677085 - RNA, 64 nt, hsa; identical to SEQ ID NO: 163877

SEQ ID NO: 677086 - RNA, 64 nt, hsa; identical to SEQ ID NO: 163878

SEQ ID NO: 677087 - RNA, 64 nt, hsa; identical to SEQ ID NO: 163879

SEQ ID NO: 677088 - RNA, 64 nt, hsa; identical to SEQ ID NO: 163880

SEQ ID NO: 677089 - RNA, 64 nt, hsa; identical to SEQ ID NO: 163881

SEQ ID NO: 677090 - RNA, 64 nt, hsa; identical to SEQ ID NO: 163882

SEQ ID NO: 677091 - RNA, 64 nt, hsa; identical to SEQ ID NO: 163883

SEQ ID NO: 677092 - RNA, 64 nt, hsa; identical to SEQ ID NO: 163884

SEQ ID NO: 677093 - RNA, 64 nt, hsa; identical to SEQ ID NO: 163885

SEQ ID NO: 677094 - RNA, 64 nt, hsa; identical to SEQ ID NO: 163886

SEQ ID NO: 677095 - RNA, 64 nt, hsa; identical to SEQ ID NO: 163887

SEQ ID NO: 677096 - RNA, 64 nt, hsa; identical to SEQ ID NO: 163888

SEQ ID NO: 677097 - RNA, 64 nt, hsa; identical to SEQ ID NO: 163889

SEQ ID NO: 677098 - RNA, 64 nt, hsa; identical to SEQ ID NO: 163890

SEQ ID NO: 677099 - RNA, 64 nt, hsa; identical to SEQ ID NO: 163891

SEQ ID NO: 677100 - RNA, 64 nt, hsa; identical to SEQ ID NO: 163892

SEQ ID NO: 677101 - RNA, 64 nt, hsa; identical to SEQ ID NO: 163893

SEQ ID NO: 677102 - RNA, 64 nt, hsa; identical to SEQ ID NO: 163894

SEQ ID NO: 677103 - RNA, 64 nt, hsa; identical to SEQ ID NO: 163895

SEQ ID NO: 677104 - RNA, 64 nt, hsa; identical to SEQ ID NO: 163896

SEQ ID NO: 677105 - RNA, 64 nt, hsa; identical to SEQ ID NO: 163897

SEQ ID NO: 677106 - RNA, 64 nt, hsa; identical to SEQ ID NO: 163898

SEQ ID NO: 677107 - RNA, 64 nt, hsa; identical to SEQ ID NO: 163899

SEQ ID NO: 677108 - RNA, 64 nt, hsa; identical to SEQ ID NO: 163900

SEQ ID NO: 677109 - RNA, 64 nt, hsa; identical to SEQ ID NO: 163901

SEQ ID NO: 677110 - RNA, 64 nt, hsa; identical to SEQ ID NO: 163902

SEQ ID NO: 677111 - RNA, 64 nt, hsa; identical to SEQ ID NO: 163903

SEQ ID NO: 677112 - RNA, 64 nt, hsa; identical to SEQ ID NO: 163904

SEQ ID NO: 677113 - RNA, 64 nt, hsa; identical to SEQ ID NO: 163905

SEQ ID NO: 677114 - RNA, 64 nt, hsa; identical to SEQ ID NO: 163906

SEQ ID NO: 677115 - RNA, 64 nt, hsa; identical to SEQ ID NO: 163907

SEQ ID NO: 677116 - RNA, 64 nt, hsa; identical to SEQ ID NO: 163908

SEQ ID NO: 677117 - RNA, 64 nt, hsa; identical to SEQ ID NO: 163909

SEQ ID NO: 677118 - RNA, 64 nt, hsa; identical to SEQ ID NO: 163910

SEQ ID NO: 677119 - RNA, 64 nt, hsa; identical to SEQ ID NO: 163911

SEQ ID NO: 677120 - RNA, 64 nt, hsa; identical to SEQ ID NO: 163912

SEQ ID NO: 677121 - RNA, 64 nt, hsa; identical to SEQ ID NO: 163913

SEQ ID NO: 677122 - RNA, 64 nt, hsa; identical to SEQ ID NO: 163914

SEQ ID NO: 677123 - RNA, 64 nt, hsa; identical to SEQ ID NO: 163915

SEQ ID NO: 677124 - RNA, 64 nt, hsa; identical to SEQ ID NO: 163916

SEQ ID NO: 677125 - RNA, 64 nt, hsa; identical to SEQ ID NO: 163917

SEQ ID NO: 677126 - RNA, 64 nt, hsa; identical to SEQ ID NO: 163918

SEQ ID NO: 677127 - RNA, 64 nt, hsa; identical to SEQ ID NO: 163919

SEQ ID NO: 677128 - RNA, 64 nt, hsa; identical to SEQ ID NO: 163920

SEQ ID NO: 677129 - RNA, 64 nt, hsa; identical to SEQ ID NO: 163921

SEQ ID NO: 677130 - RNA, 64 nt, hsa; identical to SEQ ID NO: 163922

SEQ ID NO: 677131 - RNA, 64 nt, hsa; identical to SEQ ID NO: 163923

SEQ ID NO: 677132 - RNA, 64 nt, hsa; identical to SEQ ID NO: 163924

SEQ ID NO: 677133 - RNA, 64 nt, hsa; identical to SEQ ID NO: 163925

SEQ ID NO: 677134 - RNA, 64 nt, hsa; identical to SEQ ID NO: 163926

SEQ ID NO: 677135 - RNA, 64 nt, hsa; identical to SEQ ID NO: 163927

SEQ ID NO: 677136 - RNA, 64 nt, hsa; identical to SEQ ID NO: 163928

SEQ ID NO: 677137 - RNA, 64 nt, hsa; identical to SEQ ID NO: 163929

SEQ ID NO: 677138 - RNA, 64 nt, hsa; identical to SEQ ID NO: 163930

SEQ ID NO: 677139 - RNA, 64 nt, hsa; identical to SEQ ID NO: 163931

SEQ ID NO: 677140 - RNA, 64 nt, hsa; identical to SEQ ID NO: 163932

SEQ ID NO: 677141 - RNA, 64 nt, hsa; identical to SEQ ID NO: 163933

SEQ ID NO: 677142 - RNA, 64 nt, hsa; identical to SEQ ID NO: 163934

SEQ ID NO: 677143 - RNA, 64 nt, hsa; identical to SEQ ID NO: 163935

SEQ ID NO: 677144 - RNA, 64 nt, hsa; identical to SEQ ID NO: 163936

SEQ ID NO: 677145 - RNA, 64 nt, hsa; identical to SEQ ID NO: 163937

SEQ ID NO: 677146 - RNA, 64 nt, hsa; identical to SEQ ID NO: 163938

SEQ ID NO: 677147 - RNA, 64 nt, hsa; identical to SEQ ID NO: 163939

SEQ ID NO: 677148 - RNA, 64 nt, hsa; identical to SEQ ID NO: 163940

SEQ ID NO: 677149 - RNA, 64 nt, hsa
aucuuacacgaaagccacagaguugaaagccacagaguugaaagccacagaguuaagugaccuc

SEQ ID NO: 677150 - RNA, 64 nt, hsa
uggcccuauaccgccaucuuacacgaaagccacagaguugaaagccacagaguugaaagccaca

SEQ ID NO: 677151 - RNA, 64 nt, hsa
gugcucuucuccccauuuuacaaaugagaaaucugaguugaaagagguuauaaaacucauucag

SEQ ID NO: 677152 - RNA, 64 nt, hsa
aacucauucaggguugcucaguuaguaaguuauagaguugaaauuggagccaggccuaucugac

SEQ ID NO: 677153 - RNA, 64 nt, hsa
agagcauggaguuuguuaagugcucucuggauuugaguugaagagcauccauuugaguugaagg

SEQ ID NO: 677154 - RNA, 64 nt, hsa
ugcucucuggauuugaguugaagagcauccauuugaguugaaggccacagggcacaaugagcuc

SEQ ID NO: 677155 - RNA, 64 nt, hsa
gcccugacuucugccucccucugaguggcacagggaguugaauacugcauggcgaguguaauga

SEQ ID NO: 677156 - RNA, 64 nt, hsa
cauguagagaaaccaaacugggaaaucuuacaaggaguugaaaagauuaaugucccaaccugau

SEQ ID NO: 677157 - RNA, 64 nt, hsa
ucgaguguguuuguacacaaacccuuaggauggugaguugaagcaucacccucgcgcuaucuuc

SEQ ID NO: 677158 - RNA, 64 nt, hsa
agagaaauaggggugguuauuuuuccagauuggagaguugaaagucccugacugauuucagcca

SEQ ID NO: 677159 - RNA, 64 nt, hsa
ccuuauacuguggacgcaguagccuugcuguagggaguugaagaguacuccacaacaguaucuu

SEQ ID NO: 677160 - RNA, 64 nt, hsa
cccucuauuugucaggcucugugcuuggaauacagaguugaaucagacaugaucucuacccucc

SEQ ID NO: 677161 - RNA, 64 nt, hsa; identical to SEQ ID NO: 563739

SEQ ID NO: 677162 - RNA, 64 nt, hsa; identical to SEQ ID NO: 563740

SEQ ID NO: 677163 - RNA, 64 nt, hsa; identical to SEQ ID NO: 563741

SEQ ID NO: 677164 - RNA, 64 nt, hsa; identical to SEQ ID NO: 563742

SEQ ID NO: 677165 - RNA, 64 nt, hsa; identical to SEQ ID NO: 563743

SEQ ID NO: 677166 - RNA, 64 nt, hsa; identical to SEQ ID NO: 563744

SEQ ID NO: 677167 - RNA, 64 nt, hsa; identical to SEQ ID NO: 563745

SEQ ID NO: 677168 - RNA, 64 nt, hsa; identical to SEQ ID NO: 563746

SEQ ID NO: 677169 - RNA, 64 nt, hsa; identical to SEQ ID NO: 563747

SEQ ID NO: 677170 - RNA, 64 nt, hsa; identical to SEQ ID NO: 563748

SEQ ID NO: 677171 - RNA, 64 nt, hsa; identical to SEQ ID NO: 563749

SEQ ID NO: 677172 - RNA, 64 nt, hsa; identical to SEQ ID NO: 563750

SEQ ID NO: 677173 - RNA, 64 nt, hsa; identical to SEQ ID NO: 563751

SEQ ID NO: 677174 - RNA, 64 nt, hsa; identical to SEQ ID NO: 563752

SEQ ID NO: 677175 - RNA, 64 nt, hsa; identical to SEQ ID NO: 563753

SEQ ID NO: 677176 - RNA, 64 nt, hsa; identical to SEQ ID NO: 563754

SEQ ID NO: 677177 - RNA, 64 nt, hsa; identical to SEQ ID NO: 563755

SEQ ID NO: 677178 - RNA, 64 nt, hsa; identical to SEQ ID NO: 563756

SEQ ID NO: 677179 - RNA, 64 nt, hsa; identical to SEQ ID NO: 563757

SEQ ID NO: 677180 - RNA, 64 nt, hsa; identical to SEQ ID NO: 563758

SEQ ID NO: 677181 - RNA, 64 nt, hsa; identical to SEQ ID NO: 563759

SEQ ID NO: 677182 - RNA, 64 nt, hsa; identical to SEQ ID NO: 563760

SEQ ID NO: 677183 - RNA, 64 nt, hsa; identical to SEQ ID NO: 563761

SEQ ID NO: 677184 - RNA, 64 nt, hsa; identical to SEQ ID NO: 563762

SEQ ID NO: 677185 - RNA, 64 nt, hsa; identical to SEQ ID NO: 563763

SEQ ID NO: 677186 - RNA, 64 nt, hsa; identical to SEQ ID NO: 563764

SEQ ID NO: 677187 - RNA, 64 nt, hsa; identical to SEQ ID NO: 563765

SEQ ID NO: 677188 - RNA, 64 nt, hsa; identical to SEQ ID NO: 563766

SEQ ID NO: 677189 - RNA, 64 nt, hsa; identical to SEQ ID NO: 563767

SEQ ID NO: 677190 - RNA, 64 nt, hsa; identical to SEQ ID NO: 563768

SEQ ID NO: 677191 - RNA, 64 nt, hsa; identical to SEQ ID NO: 563769

SEQ ID NO: 677192 - RNA, 64 nt, hsa; identical to SEQ ID NO: 563770

SEQ ID NO: 677193 - RNA, 64 nt, hsa; identical to SEQ ID NO: 563771

SEQ ID NO: 677194 - RNA, 64 nt, hsa; identical to SEQ ID NO: 563772

SEQ ID NO: 677195 - RNA, 64 nt, hsa; identical to SEQ ID NO: 563773

SEQ ID NO: 677196 - RNA, 64 nt, hsa; identical to SEQ ID NO: 563774

SEQ ID NO: 677197 - RNA, 64 nt, hsa; identical to SEQ ID NO: 563775

SEQ ID NO: 677198 - RNA, 64 nt, hsa; identical to SEQ ID NO: 563776

SEQ ID NO: 677199 - RNA, 64 nt, hsa; identical to SEQ ID NO: 563777

SEQ ID NO: 677200 - RNA, 64 nt, hsa; identical to SEQ ID NO: 563778

SEQ ID NO: 677201 - RNA, 64 nt, hsa; identical to SEQ ID NO: 563779

SEQ ID NO: 677202 - RNA, 64 nt, hsa; identical to SEQ ID NO: 563780

SEQ ID NO: 677203 - RNA, 64 nt, hsa; identical to SEQ ID NO: 563781

SEQ ID NO: 677204 - RNA, 64 nt, hsa; identical to SEQ ID NO: 563782

SEQ ID NO: 677205 - RNA, 64 nt, hsa; identical to SEQ ID NO: 563783

SEQ ID NO: 677206 - RNA, 64 nt, hsa; identical to SEQ ID NO: 563784

SEQ ID NO: 677207 - RNA, 64 nt, hsa; identical to SEQ ID NO: 563785

SEQ ID NO: 677208 - RNA, 64 nt, hsa; identical to SEQ ID NO: 563786

SEQ ID NO: 677209 - RNA, 64 nt, hsa; identical to SEQ ID NO: 563787

SEQ ID NO: 677210 - RNA, 64 nt, hsa; identical to SEQ ID NO: 563788

SEQ ID NO: 677211 - RNA, 64 nt, hsa; identical to SEQ ID NO: 563789

SEQ ID NO: 677212 - RNA, 64 nt, hsa; identical to SEQ ID NO: 563790

SEQ ID NO: 677213 - RNA, 64 nt, hsa; identical to SEQ ID NO: 563791

SEQ ID NO: 677214 - RNA, 64 nt, hsa; identical to SEQ ID NO: 563792

SEQ ID NO: 677215 - RNA, 64 nt, hsa; identical to SEQ ID NO: 563793

SEQ ID NO: 677216 - RNA, 64 nt, hsa; identical to SEQ ID NO: 563794

SEQ ID NO: 677217 - RNA, 64 nt, hsa; identical to SEQ ID NO: 563795

SEQ ID NO: 677218 - RNA, 64 nt, hsa; identical to SEQ ID NO: 563796

SEQ ID NO: 677219 - RNA, 64 nt, hsa; identical to SEQ ID NO: 563797

SEQ ID NO: 677220 - RNA, 64 nt, hsa; identical to SEQ ID NO: 563798

SEQ ID NO: 677221 - RNA, 64 nt, hsa; identical to SEQ ID NO: 563799

SEQ ID NO: 677222 - RNA, 64 nt, hsa; identical to SEQ ID NO: 563800

SEQ ID NO: 677223 - RNA, 64 nt, hsa; identical to SEQ ID NO: 563801

SEQ ID NO: 677224 - RNA, 64 nt, hsa; identical to SEQ ID NO: 563802

SEQ ID NO: 677225 - RNA, 64 nt, hsa; identical to SEQ ID NO: 563803

SEQ ID NO: 677226 - RNA, 64 nt, hsa; identical to SEQ ID NO: 563803

SEQ ID NO: 677227 - RNA, 64 nt, hsa; identical to SEQ ID NO: 563803

SEQ ID NO: 677228 - RNA, 64 nt, hsa; identical to SEQ ID NO: 563803

SEQ ID NO: 677229 - RNA, 64 nt, hsa; identical to SEQ ID NO: 563807

SEQ ID NO: 677230 - RNA, 64 nt, hsa; identical to SEQ ID NO: 563808

SEQ ID NO: 677231 - RNA, 64 nt, hsa; identical to SEQ ID NO: 563809

SEQ ID NO: 677232 - RNA, 64 nt, hsa; identical to SEQ ID NO: 563810

SEQ ID NO: 677233 - RNA, 64 nt, hsa; identical to SEQ ID NO: 563811

SEQ ID NO: 677234 - RNA, 64 nt, hsa; identical to SEQ ID NO: 563812

SEQ ID NO: 677235 - RNA, 64 nt, hsa; identical to SEQ ID NO: 563813

SEQ ID NO: 677236 - RNA, 64 nt, hsa; identical to SEQ ID NO: 563814

SEQ ID NO: 677237 - RNA, 64 nt, hsa; identical to SEQ ID NO: 563815

SEQ ID NO: 677238 - RNA, 64 nt, hsa; identical to SEQ ID NO: 563816

SEQ ID NO: 677239 - RNA, 64 nt, hsa; identical to SEQ ID NO: 563817

SEQ ID NO: 677240 - RNA, 63 nt, hsa
cauuccaaacucaccaagguggcuuauagaacagaagcagauggauaugaagaggagagggga

SEQ ID NO: 677241 - RNA, 63 nt, hsa
gaagaaaagagggcaaagggaacaaugugaaaagaagcagaaaaucauaaaagaccauguguu

SEQ ID NO: 677242 - RNA, 63 nt, hsa
cugcccgccagcccugcucuuguuguggagaaggaagcagaugugaucacaucaccccgucau

SEQ ID NO: 677243 - RNA, 63 nt, hsa
uccagcugucuucuaccacuagaagacccaagagaagcagaagucgcucgcacuggucagucg

SEQ ID NO: 677244 - RNA, 63 nt, hsa
gauguaagggaugagaaggauggcggggcuagggaagcagagagcagagcacacacuggcuca

SEQ ID NO: 677245 - RNA, 63 nt, hsa
gaggugaggaaacuuuuaggugguggaaccagggaagcagagagcagagcaugcagugaugga

SEQ ID NO: 677246 - RNA, 63 nt, hsa
ugugacgaaaguggaaauggagaugguccugcagaagcagaagugcaauccagcccaugccga

SEQ ID NO: 677247 - RNA, 63 nt, hsa
caaggugaagagauacagccuuccguauccaucgaagcagaugcucugaacccugagcaggca

SEQ ID NO: 677248 - RNA, 63 nt, hsa
acccugcuccuaccaaucuuuuuuaaagcaguugaagcagaauguauaggugucagagaagaa

SEQ ID NO: 677249 - RNA, 63 nt, hsa
ccaacuugccagccauguaagggagccaucuuggaagcagauccuccagccuccagucaaguc

SEQ ID NO: 677250 - RNA, 63 nt, hsa
cugagcccauguuuucugcucaguagcagcuuggaagcagauuuggaaugguuuacuauuuug

SEQ ID NO: 677251 - RNA, 63 nt, hsa
guuuacuauuuuggcugcucuuggggacugcgagaagcagagagaaugagagaccaguggcaa

SEQ ID NO: 677252 - RNA, 63 nt, hsa
ggagagaaagaggagcccucccgcucagccucagaagcagacucugaagccggagagcugcgg

SEQ ID NO: 677253 - RNA, 63 nt, hsa
caccaugaggugcaaaacgagacagaagagugagaagcagauggaggagaagagaagagccaa

SEQ ID NO: 677254 - RNA, 63 nt, hsa
ggagcugaguuuggcaacaacccaagugagccugaagcagauucgccccagagccuccaggcg

SEQ ID NO: 677255 - RNA, 63 nt, hsa
ucuaacucuauacuguagagaugagucugguccgaagcagauuaguaauuuagagauaagcca

SEQ ID NO: 677256 - RNA, 63 nt, hsa
cccagaugggccaaagaaagagccuaugaaggagaagcagaagcagacggcuggccuggcuca

SEQ ID NO: 677257 - RNA, 63 nt, hsa
ugggccaaagaaagagccuaugaaggagaagcagaagcagacggcuggccuggcucaccuucc

SEQ ID NO: 677258 - RNA, 63 nt, hsa
gcuuacaucaguuguuuguuugauuagaaaaaugaagcagacacacacacacacacacacaca

SEQ ID NO: 677259 - RNA, 63 nt, hsa
ugaauuucauauuugagagacauuugucuucaugaagcagauuugcacuggaaccauugcuuu

SEQ ID NO: 677260 - RNA, 63 nt, hsa
agcuuaucaacgaccgcuguguggacaugcagagaagcagagaagaagaaaggagcugaggag

SEQ ID NO: 677261 - RNA, 63 nt, hsa
gaagcguuugaaggccaagaaccugauguaccugaagcagauccuguauuugcuggagaaauu

SEQ ID NO: 677262 - RNA, 63 nt, hsa
uucucuaggauaagcuugugugguucugccagugaagcagagaaccaccugugcuguugugga

SEQ ID NO: 677263 - RNA, 63 nt, hsa
aguuagccagacuguuuuuaaagcaccuggcgggaagcagaagguuggauccaagcccuuguu

SEQ ID NO: 677264 - RNA, 63 nt, hsa
gcuccccugugcuguuacuccuucugccaacuggaagcagauggugaccaggcucuggagaag

SEQ ID NO: 677265 - RNA, 63 nt, hsa
cgccugcaccgccgcgaagccgaagccgaagccgaagcagagcucggcgccgcugcucccgcc

SEQ ID NO: 677266 - RNA, 63 nt, hsa
ucauauacaaagccuguaauuuuaggcgaaauggaagcagaaaucuaggaaguugugcuugcu

SEQ ID NO: 677267 - RNA, 63 nt, hsa
gagggaggaaaggguaggaagggugggaagggagaagcagacauagucauuuaugauuugaaa

SEQ ID NO: 677268 - RNA, 63 nt, hsa
gaaaugcgcccgccuggcggacagcucccuucugaagcagagaagccuccauggucacgaagc

SEQ ID NO: 677269 - RNA, 63 nt, hsa
aaagucugaguugggagugacaguggcuggagagaagcagaucugugcaacgugcagggcaag

SEQ ID NO: 677270 - RNA, 63 nt, hsa
cacccugggacugcggccuuucccagcuuuauugaagcagaaugguggaacuugugccggagg

SEQ ID NO: 677271 - RNA, 63 nt, hsa
cgugcgccuguagucccagcuacucgggaggcugaagcagaagaaucgcuugaacccgggagg

SEQ ID NO: 677272 - RNA, 63 nt, hsa
gaucacacaacauuuauucuucuuacagguaaagaagcagauuuuagaugaaaagaucuacug

SEQ ID NO: 677273 - RNA, 63 nt, hsa
cucgcagauggagcggcagcgccucgcucgagagaagcagaugagggaggaggcugaacgcac

SEQ ID NO: 677274 - RNA, 64 nt, hsa; identical to SEQ ID NO: 563739

SEQ ID NO: 677275 - RNA, 64 nt, hsa; identical to SEQ ID NO: 563740

SEQ ID NO: 677276 - RNA, 64 nt, hsa; identical to SEQ ID NO: 563741

SEQ ID NO: 677277 - RNA, 64 nt, hsa; identical to SEQ ID NO: 563742

SEQ ID NO: 677278 - RNA, 64 nt, hsa; identical to SEQ ID NO: 563743

SEQ ID NO: 677279 - RNA, 64 nt, hsa; identical to SEQ ID NO: 563744

SEQ ID NO: 677280 - RNA, 64 nt, hsa; identical to SEQ ID NO: 563745

SEQ ID NO: 677281 - RNA, 64 nt, hsa; identical to SEQ ID NO: 563746

SEQ ID NO: 677282 - RNA, 64 nt, hsa; identical to SEQ ID NO: 563747

SEQ ID NO: 677283 - RNA, 64 nt, hsa; identical to SEQ ID NO: 563748

SEQ ID NO: 677284 - RNA, 64 nt, hsa; identical to SEQ ID NO: 563749

SEQ ID NO: 677285 - RNA, 64 nt, hsa; identical to SEQ ID NO: 563750

SEQ ID NO: 677286 - RNA, 64 nt, hsa; identical to SEQ ID NO: 563751

SEQ ID NO: 677287 - RNA, 64 nt, hsa; identical to SEQ ID NO: 563752

SEQ ID NO: 677288 - RNA, 64 nt, hsa; identical to SEQ ID NO: 563753

SEQ ID NO: 677289 - RNA, 64 nt, hsa; identical to SEQ ID NO: 563754

SEQ ID NO: 677290 - RNA, 64 nt, hsa; identical to SEQ ID NO: 563755

SEQ ID NO: 677291 - RNA, 64 nt, hsa; identical to SEQ ID NO: 563756

SEQ ID NO: 677292 - RNA, 64 nt, hsa; identical to SEQ ID NO: 563757

SEQ ID NO: 677293 - RNA, 64 nt, hsa; identical to SEQ ID NO: 563758

SEQ ID NO: 677294 - RNA, 64 nt, hsa; identical to SEQ ID NO: 563759

SEQ ID NO: 677295 - RNA, 64 nt, hsa; identical to SEQ ID NO: 563760

SEQ ID NO: 677296 - RNA, 64 nt, hsa; identical to SEQ ID NO: 563761

SEQ ID NO: 677297 - RNA, 64 nt, hsa; identical to SEQ ID NO: 563762

SEQ ID NO: 677298 - RNA, 64 nt, hsa; identical to SEQ ID NO: 563763

SEQ ID NO: 677299 - RNA, 64 nt, hsa; identical to SEQ ID NO: 563764

SEQ ID NO: 677300 - RNA, 64 nt, hsa; identical to SEQ ID NO: 563765

SEQ ID NO: 677301 - RNA, 64 nt, hsa; identical to SEQ ID NO: 563766

SEQ ID NO: 677302 - RNA, 64 nt, hsa; identical to SEQ ID NO: 563767

SEQ ID NO: 677303 - RNA, 64 nt, hsa; identical to SEQ ID NO: 563768

SEQ ID NO: 677304 - RNA, 64 nt, hsa; identical to SEQ ID NO: 563769

SEQ ID NO: 677305 - RNA, 64 nt, hsa; identical to SEQ ID NO: 563770

SEQ ID NO: 677306 - RNA, 64 nt, hsa; identical to SEQ ID NO: 563771

SEQ ID NO: 677307 - RNA, 64 nt, hsa; identical to SEQ ID NO: 563772

SEQ ID NO: 677308 - RNA, 64 nt, hsa; identical to SEQ ID NO: 563773

SEQ ID NO: 677309 - RNA, 64 nt, hsa; identical to SEQ ID NO: 563774

SEQ ID NO: 677310 - RNA, 64 nt, hsa; identical to SEQ ID NO: 563775

SEQ ID NO: 677311 - RNA, 64 nt, hsa; identical to SEQ ID NO: 563776

SEQ ID NO: 677312 - RNA, 64 nt, hsa; identical to SEQ ID NO: 563777

SEQ ID NO: 677313 - RNA, 64 nt, hsa; identical to SEQ ID NO: 563778

SEQ ID NO: 677314 - RNA, 64 nt, hsa; identical to SEQ ID NO: 563779

SEQ ID NO: 677315 - RNA, 64 nt, hsa; identical to SEQ ID NO: 563780

SEQ ID NO: 677316 - RNA, 64 nt, hsa; identical to SEQ ID NO: 563781

SEQ ID NO: 677317 - RNA, 64 nt, hsa; identical to SEQ ID NO: 563782

SEQ ID NO: 677318 - RNA, 64 nt, hsa; identical to SEQ ID NO: 563783

SEQ ID NO: 677319 - RNA, 64 nt, hsa; identical to SEQ ID NO: 563784

SEQ ID NO: 677320 - RNA, 64 nt, hsa; identical to SEQ ID NO: 563785

SEQ ID NO: 677321 - RNA, 64 nt, hsa; identical to SEQ ID NO: 563786

SEQ ID NO: 677322 - RNA, 64 nt, hsa; identical to SEQ ID NO: 563787

SEQ ID NO: 677323 - RNA, 64 nt, hsa; identical to SEQ ID NO: 563788

SEQ ID NO: 677324 - RNA, 64 nt, hsa; identical to SEQ ID NO: 563789

SEQ ID NO: 677325 - RNA, 64 nt, hsa; identical to SEQ ID NO: 563790

SEQ ID NO: 677326 - RNA, 64 nt, hsa; identical to SEQ ID NO: 563791

SEQ ID NO: 677327 - RNA, 64 nt, hsa; identical to SEQ ID NO: 563792

SEQ ID NO: 677328 - RNA, 64 nt, hsa; identical to SEQ ID NO: 563793

SEQ ID NO: 677329 - RNA, 64 nt, hsa; identical to SEQ ID NO: 563794

SEQ ID NO: 677330 - RNA, 64 nt, hsa; identical to SEQ ID NO: 563795

SEQ ID NO: 677331 - RNA, 64 nt, hsa; identical to SEQ ID NO: 563796

SEQ ID NO: 677332 - RNA, 64 nt, hsa; identical to SEQ ID NO: 563797

SEQ ID NO: 677333 - RNA, 64 nt, hsa; identical to SEQ ID NO: 563798

SEQ ID NO: 677334 - RNA, 64 nt, hsa; identical to SEQ ID NO: 563799

SEQ ID NO: 677335 - RNA, 64 nt, hsa; identical to SEQ ID NO: 563800

SEQ ID NO: 677336 - RNA, 64 nt, hsa; identical to SEQ ID NO: 563801

SEQ ID NO: 677337 - RNA, 64 nt, hsa; identical to SEQ ID NO: 563802

SEQ ID NO: 677338 - RNA, 64 nt, hsa; identical to SEQ ID NO: 563803

SEQ ID NO: 677339 - RNA, 64 nt, hsa; identical to SEQ ID NO: 563803

SEQ ID NO: 677340 - RNA, 64 nt, hsa; identical to SEQ ID NO: 563803

SEQ ID NO: 677341 - RNA, 64 nt, hsa; identical to SEQ ID NO: 563803

SEQ ID NO: 677342 - RNA, 64 nt, hsa; identical to SEQ ID NO: 563807

SEQ ID NO: 677343 - RNA, 64 nt, hsa; identical to SEQ ID NO: 563808

SEQ ID NO: 677344 - RNA, 64 nt, hsa; identical to SEQ ID NO: 563809

SEQ ID NO: 677345 - RNA, 64 nt, hsa; identical to SEQ ID NO: 563810

SEQ ID NO: 677346 - RNA, 64 nt, hsa; identical to SEQ ID NO: 563811

SEQ ID NO: 677347 - RNA, 64 nt, hsa; identical to SEQ ID NO: 563812

SEQ ID NO: 677348 - RNA, 64 nt, hsa; identical to SEQ ID NO: 563813

SEQ ID NO: 677349 - RNA, 64 nt, hsa; identical to SEQ ID NO: 563814

SEQ ID NO: 677350 - RNA, 64 nt, hsa; identical to SEQ ID NO: 563815

SEQ ID NO: 677351 - RNA, 64 nt, hsa; identical to SEQ ID NO: 563816

SEQ ID NO: 677352 - RNA, 64 nt, hsa; identical to SEQ ID NO: 563817

SEQ ID NO: 677353 - RNA, 63 nt, hsa
ucaccugaaaucagccaggaggagcaaggacaagaugcgcacagggugguuuuccucauggau

SEQ ID NO: 677354 - RNA, 63 nt, hsa
aagaugauuauuccugaaaguguggaugcgcuggaugcgcagggaacaucaggaaaaggccac

SEQ ID NO: 677355 - RNA, 63 nt, hsa
cuaauucaauccuacuuuucgaacaccaaaaaugaugcgcaucaauguauuuuaucuuauuuu

SEQ ID NO: 677356 - RNA, 63 nt, hsa
gcaggggccugcaucuggccagcaggacacagggaugcgcagggcgcccccuucuguuccagg

SEQ ID NO: 677357 - RNA, 63 nt, hsa
caaggagaugaggagcggugaugccagcaccgggaugcgcagagcacuggaagggcuggugca

SEQ ID NO: 677358 - RNA, 63 nt, hsa
ggcggggagaagagcauccggcaugagggcugagaugcgcaaagagugugcucgggaguggcc

SEQ ID NO: 677359 - RNA, 63 nt, hsa
agugugcugaugggcguacgcuggugcugaguagaugcgcagccccaucugugcauucuccug

SEQ ID NO: 677360 - RNA, 63 nt, hsa
uuagccugcuauaugucaugguuuuaacuugcagaugcgcacaauuuugcaauguuuuacaga

SEQ ID NO: 677361 - RNA, 63 nt, hsa
uuaacuagccccuuuuccucuucacccucccaugaugcgcaguguucagaaagcugguaaguc

SEQ ID NO: 677362 - RNA, 63 nt, hsa
gugguuugcacccaccacugaaaaagccgcggagaugcgcagcgcguacacugacuuuggggc

SEQ ID NO: 677363 - RNA, 63 nt, hsa
cccuguggccgucacagugucugcugugauugagaugcgcacagguugggggagguagggccu

SEQ ID NO: 677364 - RNA, 63 nt, hsa
acauuccccaugcucaaggcccagccuucuguagaugcgcaaguggauguugaugguaguaca

SEQ ID NO: 677365 - RNA, 63 nt, hsa
uaagugcuuauccaguagaauuaauaaguaccugaugcgcauugaacgacaaucuuaagcccu

SEQ ID NO: 677366 - RNA, 63 nt, hsa
ucuggggcuaccccaggugaacagagguggugagaugcgcagggaagaccagcucucuccagg

SEQ ID NO: 677367 - RNA, 63 nt, hsa
uuauuuuaccuguuuuuguuucuuguuuugaaagaugcgcauucuaaccuggaggucaauguu

SEQ ID NO: 677368 - RNA, 63 nt, hsa
augcagauaauuugcugaugaagcagaagaggggaugcgcauggcaagaacuugccuuacccc

SEQ ID NO: 677369 - RNA, 63 nt, hsa
cuauaucacucuuguugugcucuuugugcccaagaugcgcaggcugaucacccgaggggaaug

SEQ ID NO: 677370 - RNA, 63 nt, hsa
guaccaaggguaacccggcuccugguauggacggaugcgcaggauuuaggauaagcugucacc

SEQ ID NO: 677371 - RNA, 63 nt, hsa
auaaauaguaaauuguugaugauaugauugacugaugcgcaguccagagcauguaugaauaau

SEQ ID NO: 677372 - RNA, 63 nt, hsa
ccggccuccagaacuuagcaauuuccgccuggugaugcgcaguugcugucagucuugaccucu

SEQ ID NO: 677373 - RNA, 63 nt, hsa
cggccucaacccggguccgcggggcacccgccggaugcgcagccuggccucuacuacagcgcc

SEQ ID NO: 677374 - RNA, 63 nt, hsa
aguagugagaugaugcugguggaaguauuuauagaugcgcagugcaugaguacuuggcaagga

SEQ ID NO: 677375 - RNA, 63 nt, hsa
cuguuuauuuacuguauacgucgaccuauuuuagaugcgcaucaguaugaaauugucucaauc

SEQ ID NO: 677376 - RNA, 63 nt, hsa
gugaacagucccugacugccuguaggcugcguggaugcgcaacacacccccuccuucucugcu

SEQ ID NO: 677377 - RNA, 63 nt, hsa
ucuagcuguggcccaggcugggccccgaccugggaugcgcacaguguccccaacgcaggcccc

SEQ ID NO: 677378 - RNA, 63 nt, hsa
cucggcagaaagacguuuccacaccucuuaggggaugcgcauuaaacuucuuuugcccccuuc

SEQ ID NO: 677379 - RNA, 63 nt, hsa
guggguacgggaggguaaggcugugggucgcgugaugcgcaugucacggagggugacgggggu

SEQ ID NO: 677380 - RNA, 63 nt, hsa
uacguaguuuggcagaaaccacuuacggcugaugaugcgcaacccugcugacuguuucaguua

SEQ ID NO: 677381 - RNA, 63 nt, hsa
cuuuuuuacauuccuugcaauacugauggugaugaugcgcaggucucauugguuucauucuug

SEQ ID NO: 677382 - RNA, 63 nt, hsa
cccaggauucuggcaagagaggugaagaaaguggaugcgcagaguucggcuggaaaagaggac

SEQ ID NO: 677383 - RNA, 63 nt, hsa
aacugagaccaaagaagcugcuguucuuagcaagaugcgcacugcauuccacaggugggagga

SEQ ID NO: 677384 - RNA, 63 nt, hsa
ccugaacagacagacagacgcacacacacaacagaugcgcagcaacuccccgcccagggaccc

SEQ ID NO: 677385 - RNA, 63 nt, hsa
gccggcacacgggcggcucacccuggacacugugaugcgcaugggcaaggccagcgcccgggg

SEQ ID NO: 677386 - RNA, 63 nt, hsa
ggcccaggaggcggggagggaggaggaggagaagaugcgcaguuaccucaugucggugcccgc

SEQ ID NO: 677387 - RNA, 63 nt, hsa
ggauggauggguggauggccguggauggccguggaugcgcagugccuugcauacccaaaccag

SEQ ID NO: 677388 - RNA, 63 nt, hsa
ccaggaggaagaagaucgggaaguaaagaagcugaugcgcaaguacaccgugcuccggcuaau

SEQ ID NO: 677389 - RNA, 63 nt, hsa
gauuuuaaggaguggggaauugugaagcccacagaugcgcacgcaaugaccagcaggaaccgg

SEQ ID NO: 677390 - RNA, 63 nt, hsa
gacacagccacaaaccaaggaaggccgaggauggaugcgcauccccaucccaagaagucggga

SEQ ID NO: 677391 - RNA, 63 nt, hsa
cuguucauuucuacuuaaauuauggcacagauugaugcgcaccagucuugaggaaacgaucuc

SEQ ID NO: 677392 - RNA, 63 nt, hsa
cuuucagaugcugggagaguacauuaacugagugaugcgcaacuuccucucucuuagggaauu

SEQ ID NO: 677393 - RNA, 63 nt, hsa
agagcuggaacgagugcagaguaggaacgcuuugaugcgcaugcacauuggggaagaugcgcu

SEQ ID NO: 677394 - RNA, 64 nt, hsa; identical to SEQ ID NO: 361150

SEQ ID NO: 677395 - RNA, 64 nt, hsa; identical to SEQ ID NO: 361151

SEQ ID NO: 677396 - RNA, 64 nt, hsa; identical to SEQ ID NO: 361152

SEQ ID NO: 677397 - RNA, 64 nt, hsa; identical to SEQ ID NO: 361153

SEQ ID NO: 677398 - RNA, 64 nt, hsa; identical to SEQ ID NO: 361154

SEQ ID NO: 677399 - RNA, 64 nt, hsa; identical to SEQ ID NO: 361155

SEQ ID NO: 677400 - RNA, 64 nt, hsa; identical to SEQ ID NO: 361156

SEQ ID NO: 677401 - RNA, 64 nt, hsa; identical to SEQ ID NO: 361157

SEQ ID NO: 677402 - RNA, 64 nt, hsa; identical to SEQ ID NO: 361158

SEQ ID NO: 677403 - RNA, 64 nt, hsa; identical to SEQ ID NO: 361159

SEQ ID NO: 677404 - RNA, 64 nt, hsa; identical to SEQ ID NO: 361160

SEQ ID NO: 677405 - RNA, 64 nt, hsa; identical to SEQ ID NO: 361161

SEQ ID NO: 677406 - RNA, 64 nt, hsa; identical to SEQ ID NO: 361162

SEQ ID NO: 677407 - RNA, 64 nt, hsa; identical to SEQ ID NO: 361163

SEQ ID NO: 677408 - RNA, 64 nt, hsa; identical to SEQ ID NO: 361164

SEQ ID NO: 677409 - RNA, 64 nt, hsa; identical to SEQ ID NO: 361165

SEQ ID NO: 677410 - RNA, 64 nt, hsa; identical to SEQ ID NO: 361166

SEQ ID NO: 677411 - RNA, 64 nt, hsa; identical to SEQ ID NO: 361167

SEQ ID NO: 677412 - RNA, 64 nt, hsa; identical to SEQ ID NO: 361168

SEQ ID NO: 677413 - RNA, 64 nt, hsa; identical to SEQ ID NO: 361169

SEQ ID NO: 677414 - RNA, 64 nt, hsa; identical to SEQ ID NO: 361170

SEQ ID NO: 677415 - RNA, 64 nt, hsa; identical to SEQ ID NO: 361171

SEQ ID NO: 677416 - RNA, 64 nt, hsa
uuauaugugcuccugaagcgagcacucuuuuuaucuaugauacuuccauaauaaucucuucuau

SEQ ID NO: 677417 - RNA, 64 nt, hsa
uuacacgugcugcugaagggagcaugguuuuuaucuaugauacuuaguuaacauauauauuaca

SEQ ID NO: 677418 - RNA, 64 nt, hsa
guuaaguucauuaggaauauaaaaacuugcaguucuaugauagauugcauuuauuaaaaauguu

SEQ ID NO: 677419 - RNA, 64 nt, hsa
uagauacacugucagaaacuugagaucuuuuggccuaugauaauaccauuaauuuuugcauugc

SEQ ID NO: 677420 - RNA, 64 nt, hsa
cuuguuuuuuucccaguuuuauauagaggaaacacuaugauaggauuuccuaaaguauuugugg

SEQ ID NO: 677421 - RNA, 64 nt, hsa
guuuuuucccaguuuuauauagaggaaacacugucuaugauaggauuuccaaaaguauuugugg

SEQ ID NO: 677422 - RNA, 64 nt, hsa
uugggccuuccuuuuuggaauguacgcuguuaugcuaugauaaaugauauaaugaguaaaaauu

SEQ ID NO: 677423 - RNA, 64 nt, hsa
acaugugaagauuuuauaaauuuuaggaaagugucuaugauauauagugaaaagugugggaaaa

SEQ ID NO: 677424 - RNA, 50 nt, hsa; identical to SEQ ID NO: 495921

SEQ ID NO: 677425 - RNA, 64 nt, hsa
auguaauacuuaauuaaaauaaugauggaagagcuaucuggagauuaugaguaagcugauuuga

SEQ ID NO: 677426 - RNA, 64 nt, hsa
aauauccaucagaaaaaugacacacaaaacaaaauaucuggaccuuuacagaagacguuugcug

SEQ ID NO: 677427 - RNA, 64 nt, hsa
gaagcucuaaaacagugucauugauuaaaaagaauaucuggaauguagccccacucuuugagug

SEQ ID NO: 677428 - RNA, 64 nt, hsa
ugggagacuguggccugaacaggagauuuuauuauaucuggagacccugagagacccugagacc

SEQ ID NO: 677429 - RNA, 64 nt, hsa
gaagagccgucaucagugucucacuugugauuuuuaucuggaaaaggaagaaacaccccagcac

SEQ ID NO: 677430 - RNA, 64 nt, hsa
uaucuggagaccacaaguaccacuccuauucuguuaucuggacuagaauuuucaaucaaugugu

SEQ ID NO: 677431 - RNA, 64 nt, hsa
augaagaaaaguauuuuugucugacaguggaauauaucuggagaccacaaguaccacuccuauu

SEQ ID NO: 677432 - RNA, 64 nt, hsa
ggcuuuguggcaaugaccuugaacugagagccuguaucuggauuuagcacuugaaagaucuaac

SEQ ID NO: 677433 - RNA, 64 nt, hsa
gauuugcucaagacguccaacugucucucugacuuaucuggaaguauuucuuuuugugaagcca

SEQ ID NO: 677434 - RNA, 64 nt, hsa
ucacaucuuccaccagcaccuuacugcccaggccuaucuggaagccaccucaccaaggaccuug

SEQ ID NO: 677435 - RNA, 64 nt, hsa
cuuuaugugcaaaaucuguuauagcuuuaaaauauaucuggaacuuuuuagauuauuccaagcc

SEQ ID NO: 677436 - RNA, 64 nt, hsa
ccuuccuguuucugcaugaucagucuguauguacuaucuggaaagauaacacauacuccagcca

SEQ ID NO: 677437 - RNA, 64 nt, hsa
gggagccgaggaggacggcgugggcccuguccuguaucuggaauuccugggaaggcuggcugcu

SEQ ID NO: 677438 - RNA, 64 nt, hsa
uuacagacgugagccaccgugccuggccuggaauuaucuggacuuucaaagaagauggcauuau

SEQ ID NO: 677439 - RNA, 64 nt, hsa
uuguaauuuauuaaaaaccuuauuuacaaggaauuaucuggacuuuuuuuuuuuuuuuuuuuuu

SEQ ID NO: 677440 - RNA, 64 nt, hsa
uaccuuacuuucauuguaaauaagccugucuuccuaucuggauuuuuugugugcauacauauuc

SEQ ID NO: 677441 - RNA, 64 nt, hsa
gcacccauugccccgggaaccguuucugcuguacuaucuggauacuaaaauguuacggaaguag

SEQ ID NO: 677442 - RNA, 64 nt, hsa; identical to SEQ ID NO: 167179

SEQ ID NO: 677443 - RNA, 64 nt, hsa; identical to SEQ ID NO: 167180

SEQ ID NO: 677444 - RNA, 64 nt, hsa; identical to SEQ ID NO: 167181

SEQ ID NO: 677445 - RNA, 64 nt, hsa; identical to SEQ ID NO: 167182

SEQ ID NO: 677446 - RNA, 51 nt, hsa; identical to SEQ ID NO: 167183

SEQ ID NO: 677447 - RNA, 64 nt, hsa; identical to SEQ ID NO: 167184

SEQ ID NO: 677448 - RNA, 64 nt, hsa; identical to SEQ ID NO: 167185

SEQ ID NO: 677449 - RNA, 64 nt, hsa; identical to SEQ ID NO: 167186

SEQ ID NO: 677450 - RNA, 58 nt, hsa; identical to SEQ ID NO: 167187

SEQ ID NO: 677451 - RNA, 64 nt, hsa; identical to SEQ ID NO: 167188

SEQ ID NO: 677452 - RNA, 64 nt, hsa; identical to SEQ ID NO: 167189

SEQ ID NO: 677453 - RNA, 64 nt, hsa; identical to SEQ ID NO: 167190

SEQ ID NO: 677454 - RNA, 64 nt, hsa; identical to SEQ ID NO: 167191

SEQ ID NO: 677455 - RNA, 64 nt, hsa; identical to SEQ ID NO: 167192

SEQ ID NO: 677456 - RNA, 64 nt, hsa; identical to SEQ ID NO: 167193

SEQ ID NO: 677457 - RNA, 64 nt, hsa; identical to SEQ ID NO: 167194

SEQ ID NO: 677458 - RNA, 64 nt, hsa; identical to SEQ ID NO: 167195

SEQ ID NO: 677459 - RNA, 64 nt, hsa; identical to SEQ ID NO: 167196

SEQ ID NO: 677460 - RNA, 64 nt, hsa; identical to SEQ ID NO: 167197

SEQ ID NO: 677461 - RNA, 64 nt, hsa; identical to SEQ ID NO: 167198

SEQ ID NO: 677462 - RNA, 64 nt, hsa; identical to SEQ ID NO: 167199

SEQ ID NO: 677463 - RNA, 64 nt, hsa; identical to SEQ ID NO: 167200

SEQ ID NO: 677464 - RNA, 64 nt, hsa; identical to SEQ ID NO: 167201

SEQ ID NO: 677465 - RNA, 64 nt, hsa; identical to SEQ ID NO: 167202

SEQ ID NO: 677466 - RNA, 64 nt, hsa; identical to SEQ ID NO: 167203

SEQ ID NO: 677467 - RNA, 64 nt, hsa; identical to SEQ ID NO: 167204

SEQ ID NO: 677468 - RNA, 64 nt, hsa; identical to SEQ ID NO: 167205

SEQ ID NO: 677469 - RNA, 64 nt, hsa; identical to SEQ ID NO: 167206

SEQ ID NO: 677470 - RNA, 64 nt, hsa; identical to SEQ ID NO: 167207

SEQ ID NO: 677471 - RNA, 64 nt, hsa; identical to SEQ ID NO: 167208

SEQ ID NO: 677472 - RNA, 64 nt, hsa; identical to SEQ ID NO: 167209

SEQ ID NO: 677473 - RNA, 64 nt, hsa; identical to SEQ ID NO: 167210

SEQ ID NO: 677474 - RNA, 64 nt, hsa; identical to SEQ ID NO: 167211

SEQ ID NO: 677475 - RNA, 64 nt, hsa; identical to SEQ ID NO: 167212

SEQ ID NO: 677476 - RNA, 64 nt, hsa; identical to SEQ ID NO: 167213

SEQ ID NO: 677477 - RNA, 64 nt, hsa; identical to SEQ ID NO: 167214

SEQ ID NO: 677478 - RNA, 64 nt, hsa; identical to SEQ ID NO: 167215

SEQ ID NO: 677479 - RNA, 64 nt, hsa; identical to SEQ ID NO: 167216

SEQ ID NO: 677480 - RNA, 64 nt, hsa; identical to SEQ ID NO: 167217

SEQ ID NO: 677481 - RNA, 64 nt, hsa; identical to SEQ ID NO: 167218

SEQ ID NO: 677482 - RNA, 64 nt, hsa; identical to SEQ ID NO: 167219

SEQ ID NO: 677483 - RNA, 64 nt, hsa; identical to SEQ ID NO: 167220

SEQ ID NO: 677484 - RNA, 64 nt, hsa; identical to SEQ ID NO: 167221

SEQ ID NO: 677485 - RNA, 64 nt, hsa; identical to SEQ ID NO: 167222

SEQ ID NO: 677486 - RNA, 64 nt, hsa; identical to SEQ ID NO: 167223

SEQ ID NO: 677487 - RNA, 64 nt, hsa; identical to SEQ ID NO: 167224

SEQ ID NO: 677488 - RNA, 64 nt, hsa; identical to SEQ ID NO: 167225

SEQ ID NO: 677489 - RNA, 64 nt, hsa; identical to SEQ ID NO: 167226

SEQ ID NO: 677490 - RNA, 64 nt, hsa; identical to SEQ ID NO: 167227

SEQ ID NO: 677491 - RNA, 64 nt, hsa; identical to SEQ ID NO: 167228

SEQ ID NO: 677492 - RNA, 64 nt, hsa; identical to SEQ ID NO: 167229

SEQ ID NO: 677493 - RNA, 64 nt, hsa; identical to SEQ ID NO: 167230

SEQ ID NO: 677494 - RNA, 64 nt, hsa; identical to SEQ ID NO: 167231

SEQ ID NO: 677495 - RNA, 64 nt, hsa; identical to SEQ ID NO: 167232

SEQ ID NO: 677496 - RNA, 64 nt, hsa; identical to SEQ ID NO: 167233

SEQ ID NO: 677497 - RNA, 64 nt, hsa; identical to SEQ ID NO: 167234

SEQ ID NO: 677498 - RNA, 64 nt, hsa; identical to SEQ ID NO: 167235

SEQ ID NO: 677499 - RNA, 64 nt, hsa; identical to SEQ ID NO: 167236

SEQ ID NO: 677500 - RNA, 64 nt, hsa; identical to SEQ ID NO: 167237

SEQ ID NO: 677501 - RNA, 64 nt, hsa; identical to SEQ ID NO: 167238

SEQ ID NO: 677502 - RNA, 64 nt, hsa; identical to SEQ ID NO: 167239

SEQ ID NO: 677503 - RNA, 64 nt, hsa; identical to SEQ ID NO: 167240

SEQ ID NO: 677504 - RNA, 64 nt, hsa; identical to SEQ ID NO: 167241

SEQ ID NO: 677505 - RNA, 64 nt, hsa; identical to SEQ ID NO: 167242

SEQ ID NO: 677506 - RNA, 64 nt, hsa; identical to SEQ ID NO: 167243

SEQ ID NO: 677507 - RNA, 64 nt, hsa; identical to SEQ ID NO: 167244

SEQ ID NO: 677508 - RNA, 64 nt, hsa; identical to SEQ ID NO: 167245

SEQ ID NO: 677509 - RNA, 64 nt, hsa; identical to SEQ ID NO: 167246

SEQ ID NO: 677510 - RNA, 64 nt, hsa; identical to SEQ ID NO: 167247

SEQ ID NO: 677511 - RNA, 64 nt, hsa; identical to SEQ ID NO: 167248

SEQ ID NO: 677512 - RNA, 64 nt, hsa; identical to SEQ ID NO: 167249

SEQ ID NO: 677513 - RNA, 64 nt, hsa; identical to SEQ ID NO: 167250

SEQ ID NO: 677514 - RNA, 64 nt, hsa; identical to SEQ ID NO: 167251

SEQ ID NO: 677515 - RNA, 64 nt, hsa; identical to SEQ ID NO: 167252

SEQ ID NO: 677516 - RNA, 64 nt, hsa; identical to SEQ ID NO: 167253

SEQ ID NO: 677517 - RNA, 64 nt, hsa; identical to SEQ ID NO: 167254

SEQ ID NO: 677518 - RNA, 64 nt, hsa; identical to SEQ ID NO: 167255

SEQ ID NO: 677519 - RNA, 64 nt, hsa; identical to SEQ ID NO: 167256

SEQ ID NO: 677520 - RNA, 64 nt, hsa; identical to SEQ ID NO: 167257

SEQ ID NO: 677521 - RNA, 64 nt, hsa; identical to SEQ ID NO: 167258

SEQ ID NO: 677522 - RNA, 64 nt, hsa; identical to SEQ ID NO: 167259

SEQ ID NO: 677523 - RNA, 64 nt, hsa; identical to SEQ ID NO: 167260

SEQ ID NO: 677524 - RNA, 64 nt, hsa; identical to SEQ ID NO: 167261

SEQ ID NO: 677525 - RNA, 63 nt, hsa; identical to SEQ ID NO: 167262

SEQ ID NO: 677526 - RNA, 64 nt, hsa; identical to SEQ ID NO: 167263

SEQ ID NO: 677527 - RNA, 64 nt, hsa; identical to SEQ ID NO: 167264

SEQ ID NO: 677528 - RNA, 64 nt, hsa; identical to SEQ ID NO: 167265

SEQ ID NO: 677529 - RNA, 64 nt, hsa; identical to SEQ ID NO: 167266

SEQ ID NO: 677530 - RNA, 64 nt, hsa; identical to SEQ ID NO: 167267

SEQ ID NO: 677531 - RNA, 64 nt, hsa; identical to SEQ ID NO: 167268

SEQ ID NO: 677532 - RNA, 64 nt, hsa; identical to SEQ ID NO: 167269

SEQ ID NO: 677533 - RNA, 64 nt, hsa; identical to SEQ ID NO: 167270

SEQ ID NO: 677534 - RNA, 64 nt, hsa; identical to SEQ ID NO: 167271

SEQ ID NO: 677535 - RNA, 64 nt, hsa; identical to SEQ ID NO: 167272

SEQ ID NO: 677536 - RNA, 64 nt, hsa; identical to SEQ ID NO: 167273

SEQ ID NO: 677537 - RNA, 64 nt, hsa; identical to SEQ ID NO: 167274

SEQ ID NO: 677538 - RNA, 64 nt, hsa; identical to SEQ ID NO: 167275

SEQ ID NO: 677539 - RNA, 64 nt, hsa; identical to SEQ ID NO: 167276

SEQ ID NO: 677540 - RNA, 64 nt, hsa; identical to SEQ ID NO: 167277

SEQ ID NO: 677541 - RNA, 64 nt, hsa; identical to SEQ ID NO: 167278

SEQ ID NO: 677542 - RNA, 64 nt, hsa; identical to SEQ ID NO: 167279

SEQ ID NO: 677543 - RNA, 64 nt, hsa; identical to SEQ ID NO: 167280

SEQ ID NO: 677544 - RNA, 64 nt, hsa; identical to SEQ ID NO: 167281

SEQ ID NO: 677545 - RNA, 64 nt, hsa; identical to SEQ ID NO: 167282

SEQ ID NO: 677546 - RNA, 64 nt, hsa; identical to SEQ ID NO: 167283

SEQ ID NO: 677547 - RNA, 64 nt, hsa; identical to SEQ ID NO: 167284

SEQ ID NO: 677548 - RNA, 64 nt, hsa; identical to SEQ ID NO: 167285

SEQ ID NO: 677549 - RNA, 64 nt, hsa; identical to SEQ ID NO: 167286

SEQ ID NO: 677550 - RNA, 64 nt, hsa; identical to SEQ ID NO: 167287

SEQ ID NO: 677551 - RNA, 64 nt, hsa; identical to SEQ ID NO: 167288

SEQ ID NO: 677552 - RNA, 64 nt, hsa; identical to SEQ ID NO: 167289

SEQ ID NO: 677553 - RNA, 64 nt, hsa; identical to SEQ ID NO: 167290

SEQ ID NO: 677554 - RNA, 64 nt, hsa; identical to SEQ ID NO: 167291

SEQ ID NO: 677555 - RNA, 64 nt, hsa; identical to SEQ ID NO: 167292

SEQ ID NO: 677556 - RNA, 64 nt, hsa; identical to SEQ ID NO: 167293

SEQ ID NO: 677557 - RNA, 64 nt, hsa; identical to SEQ ID NO: 167294

SEQ ID NO: 677558 - RNA, 64 nt, hsa; identical to SEQ ID NO: 167295

SEQ ID NO: 677559 - RNA, 64 nt, hsa; identical to SEQ ID NO: 167296

SEQ ID NO: 677560 - RNA, 64 nt, hsa; identical to SEQ ID NO: 167297

SEQ ID NO: 677561 - RNA, 64 nt, hsa; identical to SEQ ID NO: 167298

SEQ ID NO: 677562 - RNA, 64 nt, hsa; identical to SEQ ID NO: 167299

SEQ ID NO: 677563 - RNA, 64 nt, hsa; identical to SEQ ID NO: 167300

SEQ ID NO: 677564 - RNA, 64 nt, hsa; identical to SEQ ID NO: 167301

SEQ ID NO: 677565 - RNA, 64 nt, hsa; identical to SEQ ID NO: 167302

SEQ ID NO: 677566 - RNA, 64 nt, hsa; identical to SEQ ID NO: 167303

SEQ ID NO: 677567 - RNA, 64 nt, hsa; identical to SEQ ID NO: 167304

SEQ ID NO: 677568 - RNA, 64 nt, hsa; identical to SEQ ID NO: 167305

SEQ ID NO: 677569 - RNA, 64 nt, hsa; identical to SEQ ID NO: 167306

SEQ ID NO: 677570 - RNA, 64 nt, hsa
agcugcaaaacaggcugauuucaauuaggcagcacuucccaaagugcacugaggaagguggccc

SEQ ID NO: 677571 - RNA, 64 nt, hsa
acuccugaccucaggcgauccacccccaccucggcuucccaaagugcugagauuacagguguga

SEQ ID NO: 677572 - RNA, 64 nt, hsa
uuucuucauucugcauauucuuucccuaggguuucuucccaacaccaaaggacuuaccaucugu

SEQ ID NO: 677573 - RNA, 64 nt, hsa
uuucagcuuaaauuuugccuccucagagagaugccuucccaaacuccccaucugaagcuggccu

SEQ ID NO: 677574 - RNA, 64 nt, hsa
ugaaaggugaggucacguggccucccaggccugacuucccaaccuacagcauugacgccaacuu

SEQ ID NO: 677575 - RNA, 64 nt, hsa
uuuuauucauauuuauguucaugguugauuguaccuucccaagcccgcccagugggaugggagg

SEQ ID NO: 677576 - RNA, 64 nt, hsa
ucugacccagaggguggaaccggccuggacuccucuucccaacuuccuccaggucauuucccag

SEQ ID NO: 677577 - RNA, 64 nt, hsa
ggacuuguggaucauuccuuccucccugcaggagcuucccaagcuggucacagagucuccuggg

SEQ ID NO: 677578 - RNA, 64 nt, hsa
aacccuaaaucugagucaguaauucucuuacauccuucccaaaaaucagugucuagggacuagu

SEQ ID NO: 677579 - RNA, 64 nt, hsa
gcccuaaaucugagucaguaauucucuaaaaauccuucccaaaaaucagugucuagggacuggu

SEQ ID NO: 677580 - RNA, 64 nt, hsa
uggacgagccuugccugaccucuucggugcugaccuucccaaagugaugccuuacugguuuugu

SEQ ID NO: 677581 - RNA, 64 nt, hsa
uuauguugaguuaccaauggaagccaaaaguucucuucccaaacugccaagaaugauacaggcc

SEQ ID NO: 677582 - RNA, 64 nt, hsa
guuaacaugggaccuucuguuuagcuuccucuugcuucccaaagauuuuaagcauuuuguaaau

SEQ ID NO: 677583 - RNA, 64 nt, hsa
guuucagugggggagaagcugaaagaccaagacucuucccaaguuagcuugucuccucuccugu

SEQ ID NO: 677584 - RNA, 64 nt, hsa
aaaccguucuggguuuugaaagccucaggccaaccuucccaacugcugcgugagcagacaccuu

SEQ ID NO: 677585 - RNA, 64 nt, hsa
cccacagcacucugaacaggcacagcccucccaucuucccaaugaggaaacggauucaggaaga

SEQ ID NO: 677586 - RNA, 64 nt, hsa
uacaaucaguaaaaguuugauaaucaguauaucccuucccaacccccauugugacaguuucuuu

SEQ ID NO: 677587 - RNA, 64 nt, hsa
uuuuuuuccuaccaagaucauucuugaucaucagcuucccaaacuaguaagucugugcaucauu

SEQ ID NO: 677588 - RNA, 64 nt, hsa
caguuggagacugucuggccccccugguccccuccuucccaagugagucucucugggccuuagg

SEQ ID NO: 677589 - RNA, 64 nt, hsa
ccguggcccuugaguccccauugaggcuugguuccuucccaauccaguggacuucgcaguccac

SEQ ID NO: 677590 - RNA, 64 nt, hsa
cagcccugaggacagaugccuccuuccucuuuuccuucccaaagcaagcaagaggccguggcug

SEQ ID NO: 677591 - RNA, 64 nt, hsa
uccugcguccucuguccccggguuucagagacaacuucccaaagcacaaagcaguuuuuccccc

SEQ ID NO: 677592 - RNA, 64 nt, hsa
ucuccacaccccccuuggggccuccccuccacuccuucccaaaucugucuccccagaagacaca

SEQ ID NO: 677593 - RNA, 64 nt, hsa
ggcagcaucuguccccagaaucaggcagaauccacuucccaaacagagccccacgcagguucac

SEQ ID NO: 677594 - RNA, 64 nt, hsa
auugguuuugaaaccagcuguuucccaaacucugcuucccaagggcaaccguugcuguucacac

SEQ ID NO: 677595 - RNA, 64 nt, hsa
gagguggcaugauuguggauccccugagaucuggcuucccaagagcacuuauugacccuuccuc

SEQ ID NO: 677596 - RNA, 64 nt, hsa
cagcuccuccccuuucaccaccagcuccucuccacuucccaagggagacuccggcaaccuucag

SEQ ID NO: 677597 - RNA, 64 nt, hsa
ucccucccagccacgugccaguggccacagcccacuucccaacccacuguuguacccaggccuc

SEQ ID NO: 677598 - RNA, 64 nt, hsa
gaacuccugaccucaggugauccucccaccccggcuucccaaaguucugggauuauaggcguga

SEQ ID NO: 677599 - RNA, 64 nt, hsa
gaucaaaaaauaugucuaauguaauuaaaacacaaguucacagauuuacagugaacuugaucua

SEQ ID NO: 677600 - RNA, 64 nt, hsa
caaguucacagauuuacagugaacuugaucuacaaguucacagauccauugugugguuuaauag

SEQ ID NO: 677601 - RNA, 64 nt, hsa
aaacugcuaagaccaaguguggagaugucaagcuaguucacacucugaggcucagaauauguag

SEQ ID NO: 677602 - RNA, 64 nt, hsa
uguucucaagagggccaucagaaggaagccaaagaguucacagccucagcaccaacaacucaac

SEQ ID NO: 677603 - RNA, 64 nt, hsa
cauguaaauuaauuauuuuaucaauacuagauagaguucacaugcugacucccuggauaccuac

SEQ ID NO: 677604 - RNA, 64 nt, hsa
uguaauuuaaaaauuaaugugagcguuuguuuuaaguucacagaaaacuuaauaauucaaauuc

SEQ ID NO: 677605 - RNA, 64 nt, hsa
uuguggacagcuguacacugaagagucaucagagaguucacacuggagaaagaccuuuugaaug

SEQ ID NO: 677606 - RNA, 64 nt, hsa
uuagccaaaauucccaccucauucggcaccaaaaaguucacacuagggaaagaacuuacaaaug

SEQ ID NO: 677607 - RNA, 64 nt, hsa
uuaaccaaaauucucaucucauucagcaccagaaaguucacaccagauaaagaauguauauaua

SEQ ID NO: 677608 - RNA, 51 nt, hsa
cagucuuauuaaacacuugagaguucacacaggagaaaggccuuaugaaug

SEQ ID NO: 677609 - RNA, 64 nt, hsa
uucgccgaagcucuucacucuugcagcaucagagaguucacacuagagaaaggccuuaugaaug

SEQ ID NO: 677610 - RNA, 64 nt, hsa
uuagccgaaaaucuagccuuauuauacaucugagaguucacacuggagaaaggccuuaugagug

SEQ ID NO: 677611 - RNA, 64 nt, hsa
uugcugaaaacuccagccuuauuaaacacuugagaguucacacuggagaaaggccauaugaaug

SEQ ID NO: 677612 - RNA, 64 nt, hsa
cuugcccaggcuuuuugcuccuucaaggccagagaguucacaccagaucaagguguuaugagug

SEQ ID NO: 677613 - RNA, 64 nt, hsa
cucugaguguugaaggggcaacccaaggcaucacaguucacagguaaccauguuguguucuucu

SEQ ID NO: 677614 - RNA, 64 nt, hsa
uaaauuauuuauauuacugaauuggcaaaauuacaguucacacugcagagcuagguuguccuau

SEQ ID NO: 677615 - RNA, 64 nt, hsa; identical to SEQ ID NO: 238476

SEQ ID NO: 677616 - RNA, 64 nt, hsa; identical to SEQ ID NO: 238477

SEQ ID NO: 677617 - RNA, 53 nt, hsa; identical to SEQ ID NO: 238478

SEQ ID NO: 677618 - RNA, 64 nt, hsa; identical to SEQ ID NO: 238479

SEQ ID NO: 677619 - RNA, 64 nt, hsa; identical to SEQ ID NO: 238480

SEQ ID NO: 677620 - RNA, 64 nt, hsa; identical to SEQ ID NO: 238481

SEQ ID NO: 677621 - RNA, 64 nt, hsa; identical to SEQ ID NO: 238482

SEQ ID NO: 677622 - RNA, 64 nt, hsa; identical to SEQ ID NO: 238483

SEQ ID NO: 677623 - RNA, 64 nt, hsa; identical to SEQ ID NO: 238484

SEQ ID NO: 677624 - RNA, 64 nt, hsa; identical to SEQ ID NO: 238485

SEQ ID NO: 677625 - RNA, 64 nt, hsa; identical to SEQ ID NO: 238486

SEQ ID NO: 677626 - RNA, 64 nt, hsa; identical to SEQ ID NO: 238487

SEQ ID NO: 677627 - RNA, 64 nt, hsa; identical to SEQ ID NO: 238488

SEQ ID NO: 677628 - RNA, 64 nt, hsa; identical to SEQ ID NO: 238489

SEQ ID NO: 677629 - RNA, 64 nt, hsa
aucuaacaaaaaguggcauaaaauauuacaaaacauccaacacuagaaagcaaugacuaacauu

SEQ ID NO: 677630 - RNA, 64 nt, hsa
uugacuccucuauuucuguuucaacucucgucuaauccaacagcaaauccccuugaugcuaccu

SEQ ID NO: 677631 - RNA, 64 nt, hsa
aaaugauaagcuauucuaguagccuuuaguuuaaauccaacagaaaucuagaagucacaagcaa

SEQ ID NO: 677632 - RNA, 64 nt, hsa
acaguuugaauguauaaucaguaguguuuacaagauccaacagugcacucaucauuaguuaaca

SEQ ID NO: 677633 - RNA, 64 nt, hsa
auccaucugcaguuaugugcugaggugauaauucauccaacauauuuguuagcauaaauauuau

SEQ ID NO: 677634 - RNA, 64 nt, hsa
uuuucucuuuucucugauguuuuaccuuuaaaagauccaacauccuuaccguugguauuuuuag

SEQ ID NO: 677635 - RNA, 64 nt, hsa; identical to SEQ ID NO: 343068

SEQ ID NO: 677636 - RNA, 64 nt, hsa; identical to SEQ ID NO: 343069

SEQ ID NO: 677637 - RNA, 64 nt, hsa; identical to SEQ ID NO: 343070

SEQ ID NO: 677638 - RNA, 64 nt, hsa; identical to SEQ ID NO: 343071

SEQ ID NO: 677639 - RNA, 64 nt, hsa; identical to SEQ ID NO: 343072

SEQ ID NO: 677640 - RNA, 64 nt, hsa; identical to SEQ ID NO: 343073

SEQ ID NO: 677641 - RNA, 63 nt, hsa; identical to SEQ ID NO: 354303

SEQ ID NO: 677642 - RNA, 63 nt, hsa; identical to SEQ ID NO: 354304

SEQ ID NO: 677643 - RNA, 63 nt, hsa; identical to SEQ ID NO: 354305

SEQ ID NO: 677644 - RNA, 63 nt, hsa; identical to SEQ ID NO: 354306

SEQ ID NO: 677645 - RNA, 63 nt, hsa; identical to SEQ ID NO: 354307

SEQ ID NO: 677646 - RNA, 63 nt, hsa; identical to SEQ ID NO: 354308

SEQ ID NO: 677647 - RNA, 63 nt, hsa; identical to SEQ ID NO: 354309

SEQ ID NO: 677648 - RNA, 63 nt, hsa; identical to SEQ ID NO: 354310

SEQ ID NO: 677649 - RNA, 64 nt, hsa
ccccugcagcccacacagcacaacgucuuaccgugccuauuaccaagcgaguguuuguaaccau

SEQ ID NO: 677650 - RNA, 64 nt, hsa
gauaugugcucugagcuucccugaaccaggaucugccuauuacugcugugccccauggggggcu

SEQ ID NO: 677651 - RNA, 64 nt, hsa
ccaguuuacagucccacccacaaugcaugagagugccuauuaaaucuuuguaaguguuaucaaa

SEQ ID NO: 677652 - RNA, 64 nt, hsa
ggucaagauacaaauguguauuaaaaaaaaaaaagccuauuaauaggguuucugcgcggugcag

SEQ ID NO: 677653 - RNA, 64 nt, hsa
ccuacuucuuuuccaaauaagcaucagauuuaucgccuauuaugcaguaacagucaauaaaaug

SEQ ID NO: 677654 - RNA, 64 nt, hsa
ugacagcugcuuauaaaagcaucuuagcagauaagccuauuaaaauugugcuuuuguaacaaug

SEQ ID NO: 677655 - RNA, 64 nt, hsa
accucugcagacugugaauccuagcugccaguuugccuauuauaugccaaggcauuugcaaaaa

SEQ ID NO: 677656 - RNA, 64 nt, hsa
cugguuauugcaucuggugauagaggccuucaaagccuauuauuucuaaccuaaguaaaggccc

SEQ ID NO: 677657 - RNA, 64 nt, hsa
gagaugauuccuuuacucaaaccugcaggaaucagccuauuaacaggcaggggaaacgguacuu

SEQ ID NO: 677658 - RNA, 64 nt, hsa
augguguuuguauauaccacauuuucauuauccagccuauuauuaaugcacauuuagguugauu

SEQ ID NO: 677659 - RNA, 64 nt, hsa
uauuucauguucccguggcuucuuuucaguuguugccuauuacaguaugagaguuuaagguuau

SEQ ID NO: 677660 - RNA, 64 nt, hsa
gugcugggguuacaagcaugagccaccacaccuggccuauuaugaccuuuuucauuuuucucug

SEQ ID NO: 677661 - RNA, 64 nt, hsa
ugugauuaggauggucaaggucaucaggaguacagccuauuauauucccacauccugagaaagg

SEQ ID NO: 677662 - RNA, 64 nt, hsa
cagugaacaagucuucauccuggcccaggaaauagccuauuaaaaaaugcuguccaggccaggc

SEQ ID NO: 677663 - RNA, 64 nt, hsa
aaugaagauacgugaaauucaaaugucacaacuugccuauuauuuauuuuagugcauuuuuuug

SEQ ID NO: 677664 - RNA, 64 nt, hsa
cuggcacaaaacaaaugcucaguggauggaagcugccuauuauuauugucguuguuguuguuug

SEQ ID NO: 677665 - RNA, 64 nt, hsa
aagcccauggagcagggaugucacgucuugaaaagccuauuagauguuuuacaaauuuaauuuu

SEQ ID NO: 677666 - RNA, 64 nt, hsa
aguugugaguuguuuuccucuuauuuaaacauuggccuauuauaaucuguguugguuauuuuuc

SEQ ID NO: 677667 - RNA, 64 nt, hsa
uugugcucauccucauacaaccauuuggggaugugccuauuagggcuccguaagaacucagaug

SEQ ID NO: 677668 - RNA, 64 nt, hsa
caggggcaaguacacuucaccacagcaauagcuugccuauuagucugcugagcagucaugaauu

SEQ ID NO: 677669 - RNA, 64 nt, hsa
gaagucaugggauuaacuugagggucacuauugagccuauuaauuaauuauuguuuuaauaaaa

SEQ ID NO: 677670 - RNA, 64 nt, hsa
ucacuuugguaaauacuucaugcuuucaguuuuagccuauuaauuuuagguggacaaauuuaac

SEQ ID NO: 677671 - RNA, 64 nt, hsa
auauaaaacuuuugauucuaaaauuaaaccagcagccuauuacaagcacauucuuugauugagu

SEQ ID NO: 677672 - RNA, 64 nt, hsa
augcugcuagacacuuuucuuucccagccgaaaagccuauuauguaauuuuuacauucauaauu

SEQ ID NO: 677673 - RNA, 64 nt, hsa
aucaaauggaaaggagaggaaagaacucagugcugccuauuaguaguuaauucugucacucacc

SEQ ID NO: 677674 - RNA, 64 nt, hsa
uuuuuuuaauaacugggggcuauuuuaucagcuugccuauuaaaggacuaugguaaguauagaa

SEQ ID NO: 677675 - RNA, 64 nt, hsa
uuaggcuguaacuacuuuauaacuaacauguccugccuauuaucugucagcugcaagguacucu

SEQ ID NO: 677676 - RNA, 64 nt, hsa
uuuucuuaguucauucugcagaauggaaacccaugccuauuagaaaugacaguacuuauuaauu

SEQ ID NO: 677677 - RNA, 64 nt, hsa
augucuucuuugaaaacugacuucuaaucuugaggccuauuaauaauuucauuugucugucacu

SEQ ID NO: 677678 - RNA, 64 nt, hsa
ggaggaugauguggugggacagaggaccucaguggccuauuacggagcccucuucccagacuaa

SEQ ID NO: 677679 - RNA, 64 nt, hsa
aggguauaauuauacugcuuaaaauacaguuagugccuauuaauagcuuuuuauuuccuauggg

SEQ ID NO: 677680 - RNA, 64 nt, hsa
aucagggauuauuauucuuauuaauaacauguuggccuauuaucuggaugucccuugccuagag

SEQ ID NO: 677681 - RNA, 64 nt, hsa
acaaaguaaaauaaauaaauaaauacacauuuuggccuauuagcaaagauuaagaaaugauaac

SEQ ID NO: 677682 - RNA, 64 nt, hsa
aauaaugucuucucuuuaauauucacauaaggcagccuauuaacugugucuuagcaauguugua

SEQ ID NO: 677683 - RNA, 64 nt, hsa
uuaauaaaauuuuaugccuguuuuguaauucagggccuauuaugauuuuagaaauaagauaauc

SEQ ID NO: 677684 - RNA, 64 nt, hsa
uuauacuuauuaaaguauacauuuuuaaauguuagccuauuaauuuacucuugauuaucaaaca

SEQ ID NO: 677685 - RNA, 64 nt, hsa
uccuccacgacauuccuugacuuaauccauuugggccuauuauagacaaaauagagcuucuuuc

SEQ ID NO: 677686 - RNA, 64 nt, hsa
gcuucuaccaagaagguauuuaauauauguguuggccuauuauugauguaaaaguuauuuaaau

SEQ ID NO: 677687 - RNA, 64 nt, hsa
ucugacuuuuuguccuaagugguauguucaaggagccuauuaauauauuuauaguuuuugaaug

SEQ ID NO: 677688 - RNA, 64 nt, hsa
cuuuaaaaauuccaaagcucaggccauaucccaggccuauuaaaucacaaucuuuggugacggg

SEQ ID NO: 677689 - RNA, 64 nt, hsa
uuccaggaguggguacugauuccagacuccagaugccuauuauuaguuaggcuucugagcuugc

SEQ ID NO: 677690 - RNA, 64 nt, hsa
ucaacaugcagauuugccuacucauagggacuuugccuauuaagucuaccaaauuaaaagucuu

SEQ ID NO: 677691 - RNA, 64 nt, hsa
gcaaaauuuguaacaaaaugguuauauggaacaugccuauuaaaugaauuuuacuaucuucccu

SEQ ID NO: 677692 - RNA, 64 nt, hsa
ugucagccuuagauaaacguucagcauuaaaaacgccuauuauuucauuuacuagcauuuuagg

SEQ ID NO: 677693 - RNA, 64 nt, hsa
ccuacuuuucugcuucguuuuuacauaugucuuugccuauuaaagauauuaucccucuguuuua

SEQ ID NO: 677694 - RNA, 64 nt, hsa
auugugcuaucuagggaggacauauucuuaaguugccuauuaaagaaagugagcugaagaaacu

SEQ ID NO: 677695 - RNA, 64 nt, hsa
aaggguuuagauuuuaagaauggugcucuuucaugccuauuaucaguaaggggacuuguauuag

SEQ ID NO: 677696 - RNA, 64 nt, hsa
gugcugggauuacaggugugagcuaccgcgcccggccuauuaucuuguacuuucuaacugagcc

SEQ ID NO: 677697 - RNA, 64 nt, hsa
uugugaugggagggauaccuuuuuguuguuaaaagccuauuauuguuaaaggccuuuuauggaa

SEQ ID NO: 677698 - RNA, 64 nt, hsa
gagguuucuugcagugaacgaaaugaauuuuaaugccuauuauuucuggguacuuuaacaauau

SEQ ID NO: 677699 - RNA, 64 nt, hsa
uaagcugaugaagcuuggcuccuagugauugguggccuauuaugauaaauaggacaaaucauuu

SEQ ID NO: 677700 - RNA, 64 nt, hsa
aguuacaguaaauacacugugaagagacuuuauugccuauuauaauuauuuuuaucugaagcua

SEQ ID NO: 677701 - RNA, 64 nt, hsa
aaguuauacagauugauacuguuugcuuacaguugccuauuacaacuugcuauagaaaguuggu

SEQ ID NO: 677702 - RNA, 64 nt, hsa
ccuccgaaccaacccugccccucagaaaugcccugccuauuaaaugagcucccagaaaacagug

SEQ ID NO: 677703 - RNA, 64 nt, hsa
uuaagaaacuguagcugcuucuuuuacaaguggugccuauuaaagucaguaauggccauuauug

SEQ ID NO: 677704 - RNA, 64 nt, hsa
uguuguauuuggcuaauuuugcugucuuaaugcagccuauuaagaguuggguuaaaaaucagua

SEQ ID NO: 677705 - RNA, 64 nt, hsa
guuaauuuggaaaauuugggagaaaucuaaucaugccuauuaaggauguaagacauuacagccu

SEQ ID NO: 677706 - RNA, 64 nt, hsa
gaagccuucccauuuuuucaaagucuguuuaauugccuauuacuucucucaaagagaaccugaa

SEQ ID NO: 677707 - RNA, 64 nt, hsa
uuggauguuugguacuguccaugucugggugugugccuauuaccucagcauuucucacaaagug

SEQ ID NO: 677708 - RNA, 64 nt, hsa
augcuucccuucccuucccacauaucaucucacugccuauuaucuggugucaccucauguaucg

SEQ ID NO: 677709 - RNA, 64 nt, hsa
ccguuuuauccaucagagucagugcuauaaaauugccuauuaagguaaaagaaaaauguggaga

SEQ ID NO: 677710 - RNA, 64 nt, hsa
cacuaucuacauuuuucauauguguucagacagagccuauuacaagucucauaaauuucaguaa

SEQ ID NO: 677711 - RNA, 64 nt, hsa
ucacucccugaguuuaguauggcuguauauuucugccuauuaauauuuggaauuuuuuuuagaa

SEQ ID NO: 677712 - RNA, 64 nt, hsa
cacuuggggacccugccucgugucgucuuuaucugccuauuacucagccuaaggaaacaaguac

SEQ ID NO: 677713 - RNA, 64 nt, hsa
ugaugaacaagcauuuagaucguaacaugguaaagccuauuaccagccaauguuguuagcaucu

SEQ ID NO: 677714 - RNA, 64 nt, hsa
uuuugagguuuuuccucaauaacuuguuucccaggccuauuaggccaucucuaaaauugaucua

SEQ ID NO: 677715 - RNA, 64 nt, hsa
guugaaauuauguauguuuacauaucaccucauggccuauuauauuaaaauauggcuauaaaua

SEQ ID NO: 677716 - RNA, 64 nt, hsa
aauaaucuugaagggaagucagaguuuucucccugccuauuaacaaaaacccaauuuuguucau

SEQ ID NO: 677717 - RNA, 64 nt, hsa
ggaauggggucccuagcagacuugccuggaaggagccuauuauagaggguugguuauguuggga

SEQ ID NO: 677718 - RNA, 64 nt, hsa
ccagauuucaguauauucucugauggccugacaggccuauuaaguagaugugauauuuucuccc

SEQ ID NO: 677719 - RNA, 64 nt, hsa
uaaaacucaaccccuucgauagcaagucccaucagccuauuauuuuuuuaaagaaaacuugcac

SEQ ID NO: 677720 - RNA, 64 nt, hsa
uucacagugaaauaaucaaugaucacuauuuuuggccuauuaguuucuaauauuaaucuccagg

SEQ ID NO: 677721 - RNA, 64 nt, hsa
cgcauuuucaaauuuauccccguaaucaaugugggccuauuaaaaaaccaaaucaugauacaag

SEQ ID NO: 677722 - RNA, 64 nt, hsa
ccacuaugguagacaaccauuucguggaagggcagccuauuaucccacacugcaucuagccuuu

SEQ ID NO: 677723 - RNA, 64 nt, hsa
uuaucuguguagaauggguguuugacuuguuuuagccuauuaaauuuuuauuuucuuucacucu

SEQ ID NO: 677724 - RNA, 64 nt, hsa
auuaguuccccugggauucugaauauaacauauagccuauuauaaaucccuguaucguggaccu

SEQ ID NO: 677725 - RNA, 64 nt, hsa
uguguugucauugucuccauugucuuuguccagagccuauuauuauggaaacaauaaaauuuau

SEQ ID NO: 677726 - RNA, 64 nt, hsa
uuauaugucgccuuuuucuguucaaauuugcauggccuauuaaguuggcuggagaguguuuuau

SEQ ID NO: 677727 - RNA, 64 nt, hsa
guuuauuuaucaaggauuauccaucuugcuaauggccuauuauuuauuucacuuuuuguugguc

SEQ ID NO: 677728 - RNA, 64 nt, hsa
uuuaaaaccuuguuauaucugagaggcuuuaaaagccuauuaacuguuucagggcaaccgcggu

SEQ ID NO: 677729 - RNA, 64 nt, hsa
ucauauuauuaguaguaucaugguuccauuacaggccuauuaacaucauacauugucauuaguc

SEQ ID NO: 677730 - RNA, 64 nt, hsa
caauuucuacugauguagccacaacuuuuuagaggccuauuaaacaugacguuauccaauugca

SEQ ID NO: 677731 - RNA, 64 nt, hsa
uauuucagagccaaaagugccuuauacaaccuuagccuauuauaguaaaucauucaaggauuca

SEQ ID NO: 677732 - RNA, 64 nt, hsa
guugugaccauguaacaugagagguuuugcuagggccuauuauuuuuaaccaccauuaauuagu

SEQ ID NO: 677733 - RNA, 64 nt, hsa
gucccucucccuuggguuccauuuucuuggagcagccuauuaguucuggugggguugccgugug

SEQ ID NO: 677734 - RNA, 64 nt, hsa
ucugggcagacuucagagacuuuguggccuggaggccuauuaagcacgacacaguaucagugga

SEQ ID NO: 677735 - RNA, 64 nt, hsa
ccaagaaguggcucaggcaacucuggacaucucugccuauuaucagugcuggggacaccccugg

SEQ ID NO: 677736 - RNA, 64 nt, hsa
acagggucuguccacgcaccaccuggggucugccgccuauuaaaagugccguauucuuaccucu

SEQ ID NO: 677737 - RNA, 64 nt, hsa
ggauaauggaaacugaaaggugacgugcaaaacugccuauuacucccaggaguggaggauaauu

SEQ ID NO: 677738 - RNA, 64 nt, hsa
uugcugggauuacaggugugagccaccgcgccuggccuauuauuuuuuguaagaauaaaacagg

SEQ ID NO: 677739 - RNA, 64 nt, hsa
aagagaaagagcuguucuccuuucucuuucuuuugccuauuaaaccucugcuccuggccaggca

SEQ ID NO: 677740 - RNA, 63 nt, hsa
agauucauaccagaguuuaaaagauacaggaaggccuauuacaaguguguuugucuuuaguga

SEQ ID NO: 677741 - RNA, 64 nt, hsa
aaaagccccagcauggccgggcaugguggcucaugccuauuaucccagcacuuugggaggccaa

SEQ ID NO: 677742 - RNA, 64 nt, hsa
gugcgagggcaggaguauuuuuguauuagaagaggccuauuaaaaaaaaaaguuguuuucugaa

SEQ ID NO: 677743 - RNA, 64 nt, hsa
ucaacaucaagacucucugucguugggauucauggccuauuaaggagguccaaggggugagucc

SEQ ID NO: 677744 - RNA, 64 nt, hsa
acucaagcaguauuaaucaauaugguaucacaaugccuauuaagaggcuuuuuacaaauuacuu

SEQ ID NO: 677745 - RNA, 64 nt, hsa
uucacaaaauuuauuacuuuuuaaaaaauaacaugccuauuaacugguugcacugauauaaaag

SEQ ID NO: 677746 - RNA, 64 nt, hsa
cacucauuccauguggaacaaacauuuaucagaugccuauuaugggcauaugucucugcuaagc

SEQ ID NO: 677747 - RNA, 64 nt, hsa
uguuccuuucauaguuuuuccccccaaaagaagugccuauuacauuuuaccuuaauguuuauuu

SEQ ID NO: 677748 - RNA, 64 nt, hsa
guuaaaugguuauccaauugcucuuucacagguagccuauuaaacuauuuuaauauguuuuuuu

SEQ ID NO: 677749 - RNA, 64 nt, hsa
uugugcagugauguaaauauacauacuucacagagccuauuauuuuuauuuuucaauucaguuu

SEQ ID NO: 677750 - RNA, 64 nt, hsa
uuuuauuuuuuacaucuaugguaguuuuugaggugccuauuauaaaguauuacggaaguuugcu

SEQ ID NO: 677751 - RNA, 64 nt, hsa
aggcucuugagcaacagugaagcugccauaaauauuucucaacugagguucuugggauacagau

SEQ ID NO: 677752 - RNA, 64 nt, hsa
caaaaaugaugcgcaucaauguauuuuaucuuauuuucucaaucuccucucucuuuccuccacc

SEQ ID NO: 677753 - RNA, 64 nt, hsa
acuugugguggaguuaugguacucuagggcagucuuucucaaacuauguaugguaaaggaccag

SEQ ID NO: 677754 - RNA, 64 nt, hsa
aaggcaucccuuuuggggcaugcacuuucuuuccuuucucaaaauaauguuauauguggccaca

SEQ ID NO: 677755 - RNA, 64 nt, hsa
aacuaccauuauuccuacugggaaaacauaaacauuucucaaguggaaaguaaacaguguuggc

SEQ ID NO: 677756 - RNA, 64 nt, hsa
guuugguaccuaguauuaugcuuucucaugacaguuucucaacaauccugugaggcaaauucgc

SEQ ID NO: 677757 - RNA, 64 nt, hsa
caaaggaaagguuauuccaguaaaaggaaauaguuuucucaaccauuuaaaaauauucuucuga

SEQ ID NO: 677758 - RNA, 64 nt, hsa
uuaacuaagguuuuguaacacuugaaaucuuuucuuucucaaauuaauuaaucuuuaagcuuca

SEQ ID NO: 677759 - RNA, 64 nt, hsa
auggaaagggauccugauugauugaaauucauguuuucucaagcuccagauuggcuagauuuca

SEQ ID NO: 677760 - RNA, 64 nt, hsa
aaacaggaaugugagcugggggagcuggcuugaguuucucaaaagccaucggaagaugcgaguu

SEQ ID NO: 677761 - RNA, 64 nt, hsa
ucucguuucugugaauuucaugaagagcagaacauuucucaagaauccucuugagccaguaauc

SEQ ID NO: 677762 - RNA, 64 nt, hsa
cuuucucuauacuuugucucugugucuuauuucuuuucucaaaaaaauuuuucuuuuuuuaacu

SEQ ID NO: 677763 - RNA, 64 nt, hsa
uggcuagguggaugacuaguuuuauucaaagccuuuucucaaagcccuuucaguuacaaccacc

SEQ ID NO: 677764 - RNA, 64 nt, hsa
aaacugacgcuuggcuccuuucuuguggauggauuuucucaaaguacacagauaaagcaugguu

SEQ ID NO: 677765 - RNA, 64 nt, hsa
cacagcuuucccuucaaagagccauugagaaacauuucucaaacaggaaauccuucuuuuacua

SEQ ID NO: 677766 - RNA, 64 nt, hsa
uuugugaccaguuucugucugcauguaauuuggauuucucaaauacauucauuaguaauuuauc

SEQ ID NO: 677767 - RNA, 64 nt, hsa
gcuuccauggucuugcacuauaaacuggaauggauuucucaaugcgggaccagauuaugacuag

SEQ ID NO: 677768 - RNA, 64 nt, hsa
ccucuggaguucagaacuuaaguaucagugcaaauuucucaaccuuucuggguuagacaaagau

SEQ ID NO: 677769 - RNA, 64 nt, hsa
ucaauuuuuucauugaucuaugcuuugaguuugcuuucucaacauuauuguauuuuccacuuau

SEQ ID NO: 677770 - RNA, 64 nt, hsa
acucucuuuaaaaauacuaaaucauuuauguccauuucucaauuuuuucauugaucuaugcuuu

SEQ ID NO: 677771 - RNA, 64 nt, hsa
gauauguacauagcuguuucuuguucuguauacauuucucaaauguacacuuguauuauaauaa

SEQ ID NO: 677772 - RNA, 64 nt, hsa
aguuuugcaauucaaaacagcuaaugucugguuauuucucaaaguaaguauuuuaaacagccug

SEQ ID NO: 677773 - RNA, 64 nt, hsa
ucuuguaucaggaagaaauacaaauuuugucauguuucucaagcaguuuuucugaguaguuucu

SEQ ID NO: 677774 - RNA, 64 nt, hsa
cauaucaaaugucaaacuuuuacaugugaaugauuuucucaaagaacauagaaaagucaauaaa

SEQ ID NO: 677775 - RNA, 64 nt, hsa
aauugcaggucuuuuaagagauuuaagcuucaguuuucucaaaacaaaacaauuauccugucuu

SEQ ID NO: 677776 - RNA, 64 nt, hsa
ccucaccugcguaaaauugucucagcuucuguuguuucucaacugagguucguaaacccaucag

SEQ ID NO: 677777 - RNA, 64 nt, hsa
cuuaguuaaaauguaaaucugauauacaguaguguuucucaaaguauaguucaugaacuccuug

SEQ ID NO: 677778 - RNA, 64 nt, hsa
guuauuuaaaacaguuuucugcagucuauaaacauuucucaacauuuuuuuaaaagucuuaguu

SEQ ID NO: 677779 - RNA, 64 nt, hsa
cagauuaauauguagcaaaaauguaugcuugauauuucucaacuguguuaauuuuucugcugua

SEQ ID NO: 677780 - RNA, 64 nt, hsa
cuauauuagaauagaugaagcagguagcuucuuuuuucucaaauguaauucagcaaaauaauac

SEQ ID NO: 677781 - RNA, 64 nt, hsa
aacauuuuauaauauauaucuuauguuuauuuuuuuucucaacuaauuguguacugcacuguaa

SEQ ID NO: 677782 - RNA, 64 nt, hsa
ugaaugaguuucuuagcuuuuauagugcgccauguuucucaaaguuuguuuuuguugacaaaac

SEQ ID NO: 677783 - RNA, 64 nt, hsa
ccaguauaaugauacaucguagccuaagaaauauuuucucaauguaauucccuucccagcuacc

SEQ ID NO: 677784 - RNA, 64 nt, hsa
uguuagcccucugggcaccaaggaaacuaacagcuuucucaaagcggugaccacucaggccagc

SEQ ID NO: 677785 - RNA, 64 nt, hsa
ugaugaaacccaauaaucucucaauaccuuccuauuucucaauagucuuuaaacccuaaaucug

SEQ ID NO: 677786 - RNA, 64 nt, hsa
cucugaugaaacccagucucucaauaccuuccuauuucucaauagucuuuaagcccuaaaucug

SEQ ID NO: 677787 - RNA, 64 nt, hsa
guccuggcucucucucugcugccucuucauacguuuucucaagaacuucaguuuauaauuggaa

SEQ ID NO: 677788 - RNA, 64 nt, hsa
gagcuccucuauccgaggccauuggagaccccaguuucucaagaauucagcucugcucugagcg

SEQ ID NO: 677789 - RNA, 64 nt, hsa
cagucugaaaauugauagcauuuagcauuucuuuuuucucaaaaagaaacuguaggaaauacau

SEQ ID NO: 677790 - RNA, 64 nt, hsa
ugaauuuuaaugucccuacuugugaauaauuagcuuucucaaauguaggcuuuuuacaaauuuu

SEQ ID NO: 677791 - RNA, 64 nt, hsa
caguucccuuaggggagcugaaauaaauucacauuuucucaaagucucauagcuuuggaggagc

SEQ ID NO: 677792 - RNA, 64 nt, hsa
caguuaucuaaacuagauuagauccaagccaaguuuucucaacagagagcaaagggccaggcag

SEQ ID NO: 677793 - RNA, 64 nt, hsa
ucuaaucagcauuucaauguauuuauuuuuaaauuuucucaaaaaguaacuaaaaaauuguguc

SEQ ID NO: 677794 - RNA, 64 nt, hsa
aaauuggaaugugauuuaaggaagaaaacagacuuuucucaaauggaccacaucaucucucacu

SEQ ID NO: 677795 - RNA, 64 nt, hsa
cuaccuccccaagacuuuacuagugccgauaaacuuucucaaagagcaaccaguaucacuuccc

SEQ ID NO: 677796 - RNA, 64 nt, hsa
guucaauuucaacauguauguauaugaugauuuuuuucucaauuuugaauuaugcuacucacca

SEQ ID NO: 677797 - RNA, 64 nt, hsa
ccauuaaaaacugggcaaaggccaugaauagaccuuucucaaaagaauacauacauguggcaau

SEQ ID NO: 677798 - RNA, 64 nt, hsa
auuaauucagccauuguggaaagcacugcagcgauuucucaaagacauaaaagaacauagcauu

SEQ ID NO: 677799 - RNA, 64 nt, hsa
gcauagauagggaugugagaguggaguaccuuccuuucucaagucucgagaugccagugaaacc

SEQ ID NO: 677800 - RNA, 64 nt, hsa
uuugcuuaugguagugggcuaacauaacagccccuuucucaagcagagaccuggccccugggcc

SEQ ID NO: 677801 - RNA, 64 nt, hsa; identical to SEQ ID NO: 89736

SEQ ID NO: 677802 - RNA, 64 nt, hsa; identical to SEQ ID NO: 89737

SEQ ID NO: 677803 - RNA, 64 nt, hsa; identical to SEQ ID NO: 89738

SEQ ID NO: 677804 - RNA, 64 nt, hsa; identical to SEQ ID NO: 89739

SEQ ID NO: 677805 - RNA, 64 nt, hsa; identical to SEQ ID NO: 89740

SEQ ID NO: 677806 - RNA, 64 nt, hsa; identical to SEQ ID NO: 89741

SEQ ID NO: 677807 - RNA, 64 nt, hsa; identical to SEQ ID NO: 89742

SEQ ID NO: 677808 - RNA, 64 nt, hsa; identical to SEQ ID NO: 89743

SEQ ID NO: 677809 - RNA, 64 nt, hsa; identical to SEQ ID NO: 89744

SEQ ID NO: 677810 - RNA, 64 nt, hsa; identical to SEQ ID NO: 89745

SEQ ID NO: 677811 - RNA, 64 nt, hsa; identical to SEQ ID NO: 89746

SEQ ID NO: 677812 - RNA, 64 nt, hsa; identical to SEQ ID NO: 89747

SEQ ID NO: 677813 - RNA, 64 nt, hsa; identical to SEQ ID NO: 89748

SEQ ID NO: 677814 - RNA, 64 nt, hsa; identical to SEQ ID NO: 89749

SEQ ID NO: 677815 - RNA, 64 nt, hsa; identical to SEQ ID NO: 89750

SEQ ID NO: 677816 - RNA, 64 nt, hsa; identical to SEQ ID NO: 89751

SEQ ID NO: 677817 - RNA, 64 nt, hsa; identical to SEQ ID NO: 89752

SEQ ID NO: 677818 - RNA, 64 nt, hsa; identical to SEQ ID NO: 89753

SEQ ID NO: 677819 - RNA, 64 nt, hsa; identical to SEQ ID NO: 89754

SEQ ID NO: 677820 - RNA, 64 nt, hsa; identical to SEQ ID NO: 89755

SEQ ID NO: 677821 - RNA, 64 nt, hsa; identical to SEQ ID NO: 89756

SEQ ID NO: 677822 - RNA, 64 nt, hsa; identical to SEQ ID NO: 89757

SEQ ID NO: 677823 - RNA, 64 nt, hsa; identical to SEQ ID NO: 162025

SEQ ID NO: 677824 - RNA, 64 nt, hsa; identical to SEQ ID NO: 162026

SEQ ID NO: 677825 - RNA, 64 nt, hsa; identical to SEQ ID NO: 162027

SEQ ID NO: 677826 - RNA, 64 nt, hsa; identical to SEQ ID NO: 162028

SEQ ID NO: 677827 - RNA, 64 nt, hsa; identical to SEQ ID NO: 162029

SEQ ID NO: 677828 - RNA, 64 nt, hsa; identical to SEQ ID NO: 162030

SEQ ID NO: 677829 - RNA, 64 nt, hsa; identical to SEQ ID NO: 162031

SEQ ID NO: 677830 - RNA, 64 nt, hsa; identical to SEQ ID NO: 162032

SEQ ID NO: 677831 - RNA, 64 nt, hsa; identical to SEQ ID NO: 162033

SEQ ID NO: 677832 - RNA, 64 nt, hsa; identical to SEQ ID NO: 162034

SEQ ID NO: 677833 - RNA, 64 nt, hsa; identical to SEQ ID NO: 162035

SEQ ID NO: 677834 - RNA, 64 nt, hsa; identical to SEQ ID NO: 162036

SEQ ID NO: 677835 - RNA, 64 nt, hsa; identical to SEQ ID NO: 162037

SEQ ID NO: 677836 - RNA, 64 nt, hsa; identical to SEQ ID NO: 162038

SEQ ID NO: 677837 - RNA, 64 nt, hsa; identical to SEQ ID NO: 162039

SEQ ID NO: 677838 - RNA, 64 nt, hsa; identical to SEQ ID NO: 162040

SEQ ID NO: 677839 - RNA, 64 nt, hsa; identical to SEQ ID NO: 162041

SEQ ID NO: 677840 - RNA, 64 nt, hsa; identical to SEQ ID NO: 162042

SEQ ID NO: 677841 - RNA, 64 nt, hsa; identical to SEQ ID NO: 162043

SEQ ID NO: 677842 - RNA, 64 nt, hsa; identical to SEQ ID NO: 162044

SEQ ID NO: 677843 - RNA, 64 nt, hsa; identical to SEQ ID NO: 162045

SEQ ID NO: 677844 - RNA, 64 nt, hsa; identical to SEQ ID NO: 162046

SEQ ID NO: 677845 - RNA, 64 nt, hsa; identical to SEQ ID NO: 162047

SEQ ID NO: 677846 - RNA, 64 nt, hsa; identical to SEQ ID NO: 162048

SEQ ID NO: 677847 - RNA, 64 nt, hsa; identical to SEQ ID NO: 162049

SEQ ID NO: 677848 - RNA, 64 nt, hsa; identical to SEQ ID NO: 162050

SEQ ID NO: 677849 - RNA, 64 nt, hsa; identical to SEQ ID NO: 162051

SEQ ID NO: 677850 - RNA, 64 nt, hsa; identical to SEQ ID NO: 162052

SEQ ID NO: 677851 - RNA, 64 nt, hsa; identical to SEQ ID NO: 162053

SEQ ID NO: 677852 - RNA, 64 nt, hsa; identical to SEQ ID NO: 162054

SEQ ID NO: 677853 - RNA, 64 nt, hsa; identical to SEQ ID NO: 162055

SEQ ID NO: 677854 - RNA, 64 nt, hsa; identical to SEQ ID NO: 162056

SEQ ID NO: 677855 - RNA, 64 nt, hsa; identical to SEQ ID NO: 162057

SEQ ID NO: 677856 - RNA, 64 nt, hsa; identical to SEQ ID NO: 225055

SEQ ID NO: 677857 - RNA, 64 nt, hsa; identical to SEQ ID NO: 225056

SEQ ID NO: 677858 - RNA, 64 nt, hsa; identical to SEQ ID NO: 225057

SEQ ID NO: 677859 - RNA, 64 nt, hsa; identical to SEQ ID NO: 225058

SEQ ID NO: 677860 - RNA, 64 nt, hsa; identical to SEQ ID NO: 225059

SEQ ID NO: 677861 - RNA, 64 nt, hsa; identical to SEQ ID NO: 225060

SEQ ID NO: 677862 - RNA, 64 nt, hsa; identical to SEQ ID NO: 225061

SEQ ID NO: 677863 - RNA, 64 nt, hsa; identical to SEQ ID NO: 225062

SEQ ID NO: 677864 - RNA, 64 nt, hsa; identical to SEQ ID NO: 225063

SEQ ID NO: 677865 - RNA, 64 nt, hsa; identical to SEQ ID NO: 225064

SEQ ID NO: 677866 - RNA, 64 nt, hsa; identical to SEQ ID NO: 225065

SEQ ID NO: 677867 - RNA, 64 nt, hsa; identical to SEQ ID NO: 225066

SEQ ID NO: 677868 - RNA, 64 nt, hsa; identical to SEQ ID NO: 225067

SEQ ID NO: 677869 - RNA, 64 nt, hsa; identical to SEQ ID NO: 225068

SEQ ID NO: 677870 - RNA, 64 nt, hsa; identical to SEQ ID NO: 225069

SEQ ID NO: 677871 - RNA, 64 nt, hsa; identical to SEQ ID NO: 225070

SEQ ID NO: 677872 - RNA, 64 nt, hsa; identical to SEQ ID NO: 225071

SEQ ID NO: 677873 - RNA, 64 nt, hsa; identical to SEQ ID NO: 225072

SEQ ID NO: 677874 - RNA, 64 nt, hsa; identical to SEQ ID NO: 225073

SEQ ID NO: 677875 - RNA, 64 nt, hsa; identical to SEQ ID NO: 225074

SEQ ID NO: 677876 - RNA, 64 nt, hsa; identical to SEQ ID NO: 225075

SEQ ID NO: 677877 - RNA, 64 nt, hsa; identical to SEQ ID NO: 225076

SEQ ID NO: 677878 - RNA, 64 nt, hsa; identical to SEQ ID NO: 225077

SEQ ID NO: 677879 - RNA, 64 nt, hsa; identical to SEQ ID NO: 225078

SEQ ID NO: 677880 - RNA, 64 nt, hsa
gacucuuccugcaugucagcaauaaaacuuccugaucuggaaccacuguggccugcgucuccug

SEQ ID NO: 677881 - RNA, 64 nt, hsa
aaguucccaaaccuccuugugccucaguuuccccaucuggaaaaaauggggccaccucuugcca

SEQ ID NO: 677882 - RNA, 64 nt, hsa
ucagagaagagucauuuuauguuguuccuauggaaucuggaaugagugcagagcuccuacccac

SEQ ID NO: 677883 - RNA, 64 nt, hsa
uaacaucauagccacagaaaucaagugccagucuaucuggaauccauguuguauugcagauaau

SEQ ID NO: 677884 - RNA, 64 nt, hsa
ucuuauuagcuccccgcuccacaagacaccugugaucuggaaaucuaccaccaaucccgaucgg

SEQ ID NO: 677885 - RNA, 64 nt, hsa
ugcccaggaaagaacuucagcugacuccacggggaucuggaaauccacgaccaaucccgaucgg

SEQ ID NO: 677886 - RNA, 64 nt, hsa
aagagccgucaucagugucucacuugugauuuuuaucuggaaaaggaagaaacaccccagcaca

SEQ ID NO: 677887 - RNA, 64 nt, hsa
auuauaaaggagaaagaagauacaagguggggaaaucuggaaaaagauuucagacauuaggcug

SEQ ID NO: 677888 - RNA, 64 nt, hsa
uuauuuugagaggugggugauaugugagagagaaaucuggaaccuucuucuggguagauacagg

SEQ ID NO: 677889 - RNA, 64 nt, hsa
uuuuucaugacaauguaauuuguguaacuguugaaucuggaaauugaucagcauuaaagggcac

SEQ ID NO: 677890 - RNA, 64 nt, hsa
gugauacagcucuggcuuucugagcacacuacggaucuggaaaauacuggaaaaugugauacuu

SEQ ID NO: 677891 - RNA, 64 nt, hsa
gaauucagaauucuuaggcaaccuucauaccuuuaucuggaaaaugccuucucuccagacaaua

SEQ ID NO: 677892 - RNA, 64 nt, hsa
aagcaggaauuuauacauuggguaccagagcuaaaucuggaaaacacauuuggaaugagcuucc

SEQ ID NO: 677893 - RNA, 64 nt, hsa
uuccuuccuucuccugggacuggugaagcuaggcaucuggaagacuucuuccuagccuggaagc

SEQ ID NO: 677894 - RNA, 64 nt, hsa
uugguauguggcaaugcuaauagauccacugaagaucuggaaaauuccaggaacuuuucaccug

SEQ ID NO: 677895 - RNA, 64 nt, hsa
cacaucuuccaccagcaccuuacugcccaggccuaucuggaagccaccucaccaaggaccuugg

SEQ ID NO: 677896 - RNA, 64 nt, hsa
uuuaugugcaaaaucuguuauagcuuuaaaauauaucuggaacuuuuuagauuauuccaagccu

SEQ ID NO: 677897 - RNA, 64 nt, hsa
cuuccuguuucugcaugaucagucuguauguacuaucuggaaagauaacacauacuccagccac

SEQ ID NO: 677898 - RNA, 64 nt, hsa
ggagccgaggaggacggcgugggcccuguccuguaucuggaauuccugggaaggcuggcugcug

SEQ ID NO: 677899 - RNA, 64 nt, hsa
ucccaggacccugaaggggccaugauggcaacagaucuggaaccucagccuggccagacacagg

SEQ ID NO: 677900 - RNA, 64 nt, hsa
aauggggccagauccagccuggggucuggaguugaucuggaacccagacucagacauuggcacc

SEQ ID NO: 677901 - RNA, 64 nt, hsa
aagaaaugaaagaaaugacucuuggagucaagagaucuggaaaucuuuuaaucaguuaaauugu

SEQ ID NO: 677902 - RNA, 64 nt, hsa
acaaaugauuucagaucauguuugcuaaagagaaaucuggaagugugagaucuguaagaaauga

SEQ ID NO: 677903 - RNA, 64 nt, hsa; identical to SEQ ID NO: 74555

SEQ ID NO: 677904 - RNA, 64 nt, hsa; identical to SEQ ID NO: 74556

SEQ ID NO: 677905 - RNA, 64 nt, hsa; identical to SEQ ID NO: 74557

SEQ ID NO: 677906 - RNA, 64 nt, hsa; identical to SEQ ID NO: 74558

SEQ ID NO: 677907 - RNA, 64 nt, hsa; identical to SEQ ID NO: 74559

SEQ ID NO: 677908 - RNA, 64 nt, hsa; identical to SEQ ID NO: 74560

SEQ ID NO: 677909 - RNA, 64 nt, hsa; identical to SEQ ID NO: 443317

SEQ ID NO: 677910 - RNA, 64 nt, hsa; identical to SEQ ID NO: 443318

SEQ ID NO: 677911 - RNA, 64 nt, hsa; identical to SEQ ID NO: 443319

SEQ ID NO: 677912 - RNA, 64 nt, hsa; identical to SEQ ID NO: 443320

SEQ ID NO: 677913 - RNA, 64 nt, hsa; identical to SEQ ID NO: 443321

SEQ ID NO: 677914 - RNA, 64 nt, hsa; identical to SEQ ID NO: 443322

SEQ ID NO: 677915 - RNA, 64 nt, hsa; identical to SEQ ID NO: 443323

SEQ ID NO: 677916 - RNA, 64 nt, hsa; identical to SEQ ID NO: 443324

SEQ ID NO: 677917 - RNA, 64 nt, hsa; identical to SEQ ID NO: 443325

SEQ ID NO: 677918 - RNA, 64 nt, hsa; identical to SEQ ID NO: 443326

SEQ ID NO: 677919 - RNA, 64 nt, hsa; identical to SEQ ID NO: 443327

SEQ ID NO: 677920 - RNA, 64 nt, hsa; identical to SEQ ID NO: 443328

SEQ ID NO: 677921 - RNA, 64 nt, hsa; identical to SEQ ID NO: 443329

SEQ ID NO: 677922 - RNA, 64 nt, hsa; identical to SEQ ID NO: 443330

SEQ ID NO: 677923 - RNA, 64 nt, hsa; identical to SEQ ID NO: 443331

SEQ ID NO: 677924 - RNA, 64 nt, hsa; identical to SEQ ID NO: 443332

SEQ ID NO: 677925 - RNA, 64 nt, hsa; identical to SEQ ID NO: 443333

SEQ ID NO: 677926 - RNA, 64 nt, hsa; identical to SEQ ID NO: 443334

SEQ ID NO: 677927 - RNA, 64 nt, hsa; identical to SEQ ID NO: 443335

SEQ ID NO: 677928 - RNA, 64 nt, hsa; identical to SEQ ID NO: 443336

SEQ ID NO: 677929 - RNA, 64 nt, hsa; identical to SEQ ID NO: 443337

SEQ ID NO: 677930 - RNA, 64 nt, hsa; identical to SEQ ID NO: 443338

SEQ ID NO: 677931 - RNA, 64 nt, hsa; identical to SEQ ID NO: 443339

SEQ ID NO: 677932 - RNA, 64 nt, hsa; identical to SEQ ID NO: 443340

SEQ ID NO: 677933 - RNA, 64 nt, hsa; identical to SEQ ID NO: 443341

SEQ ID NO: 677934 - RNA, 64 nt, hsa; identical to SEQ ID NO: 443342

SEQ ID NO: 677935 - RNA, 64 nt, hsa; identical to SEQ ID NO: 443343

SEQ ID NO: 677936 - RNA, 64 nt, hsa; identical to SEQ ID NO: 443344

SEQ ID NO: 677937 - RNA, 64 nt, hsa
aagaggaagaagaagaggaaguaguugaaaaugaugaggagauagccuuuucaggcaaggacaa

SEQ ID NO: 677938 - RNA, 64 nt, hsa
uuucaggcaaggacaagccagcuucagagaauagugaggagaagcugaucaguaaguuugacaa

SEQ ID NO: 677939 - RNA, 64 nt, hsa
gcuguaguuuuuaaaaauguuuuuaguuaaacguugaggagaaaaaaaaaaaaggcuuuucccc

SEQ ID NO: 677940 - RNA, 64 nt, hsa
auccccagaacucagcaacccagcucuuuuaucaugaggagagguagccaugcugacucaugaa

SEQ ID NO: 677941 - RNA, 64 nt, hsa
aaguacuacagaggggaaccauuugagggauacaugaggagagaguaaauugagguuuggggau

SEQ ID NO: 677942 - RNA, 64 nt, hsa
cacacgugacagaugaagaaaccaagggggcugcugaggagaccuggugcagggacuaauccug

SEQ ID NO: 677943 - RNA, 64 nt, hsa
gcaguguggaaagugagaaaaaccuccauuguggugaggagaauacuucaaugucccuuguccu

SEQ ID NO: 677944 - RNA, 64 nt, hsa
uagcaucugacuuugagucacagaaaccuuaaacugaggagacaauaguucagaaccuuuuuaa

SEQ ID NO: 677945 - RNA, 64 nt, hsa
gccauuugcucuugccaaagugagauagauguacugaggagauaauugaaaagucagacucugu

SEQ ID NO: 677946 - RNA, 64 nt, hsa
gaaugcauaagugccauccuuuaaucauagacuuugaggagagaaagcauaaaaauauagcaua

SEQ ID NO: 677947 - RNA, 64 nt, hsa
gcuuuuuugcuacauagucuacucaaaaauuacaugaggagaaauccuuuuucccuuuguuuuu

SEQ ID NO: 677948 - RNA, 64 nt, hsa
aggcugugcucucaggacagccccauuuuagggaugaggagacuucaccacgcccuccccuccc

SEQ ID NO: 677949 - RNA, 64 nt, hsa
auccugaauguccucauuuuacagaugaggacauugaggagaagagacuuacccaggcucacac

SEQ ID NO: 677950 - RNA, 64 nt, hsa
ugaaccugggggccauccugguggccugggagcgugaggagaggcccccugugugcugggugag

SEQ ID NO: 677951 - RNA, 64 nt, hsa
cccagguggcccagguggugcagguagaacagggugaggagagggggucggcucagcaggagga

SEQ ID NO: 677952 - RNA, 64 nt, hsa
gaagugcuuugcaaggcuucaggaaacagaguugugaggagaaagaagaaaauggcugcccauu

SEQ ID NO: 677953 - RNA, 64 nt, hsa
aagaccaagauaucaggaaugaggaauaggggccugaggagagaggggaaggguacagagaaac

SEQ ID NO: 677954 - RNA, 64 nt, hsa
gauucacuucuuaccaugcacuuuccuuugaugcugaggagaaauggaagugggcgaaaaaucu

SEQ ID NO: 677955 - RNA, 63 nt, hsa
acucagaaaagaccuccuagcuagguccccaugugaggagaucugcuuucagcccucaccuaa

SEQ ID NO: 677956 - RNA, 64 nt, hsa
gcugggcggcagugaggugucaccccccuccagcugaggagaccaggcccaguggcagggguuu

SEQ ID NO: 677957 - RNA, 64 nt, hsa
acgggggaagugagaggaaagaggcgggggcgggugaggagacuggccccaggccccagccacg

SEQ ID NO: 677958 - RNA, 64 nt, hsa
cuaacccagcaguugccccacccuguguaguuguugaggagaagaagccucaacuuacccagga

SEQ ID NO: 677959 - RNA, 64 nt, hsa
aaaauccucugccggaagcagaagcugggaaaauugaggagaguccuuucagugucgagguaua

SEQ ID NO: 677960 - RNA, 64 nt, hsa
aguuugaaacccucuacaaugagcacaagagcugugaggagaagucagugaagaacaccagcau

SEQ ID NO: 677961 - RNA, 64 nt, hsa
caacccaagcagaugacaggcacaggccaccgcaugaggagauggagggcgggacugggccgcc

SEQ ID NO: 677962 - RNA, 64 nt, hsa
gagggggaguugcagaaagagagggcagugagggugaggagaggggaucuggggacuugggugu

SEQ ID NO: 677963 - RNA, 64 nt, hsa
caaggguucugcgaagaggcaguggaagaaggcaugaggagagggucucuugagaauuugccaa

SEQ ID NO: 677964 - RNA, 64 nt, hsa
ccauugguguaggaaaugagacccucucugaagcugaggagagcacguugaucugaacuuuaaa

SEQ ID NO: 677965 - RNA, 64 nt, hsa
cuggagaaggugcagauucaaagugagcggcuccugaggagagccgccaaggcugcucgccuuc

SEQ ID NO: 677966 - RNA, 64 nt, hsa
ucaagagcaguugacucacugaugaaggcccuggugaggagaaagcacucuguucuucgccuac

SEQ ID NO: 677967 - RNA, 64 nt, hsa
cuccagcuauguaucgggaaccaugaucuauuuaugaggagaaggaaagccgauucuuuggaag

SEQ ID NO: 677968 - RNA, 64 nt, hsa
aagcaacaauggccaacgaagcacugaugcggucugaggagacagcugaccuguuggcugaaaa

SEQ ID NO: 677969 - RNA, 64 nt, hsa; identical to SEQ ID NO: 125533

SEQ ID NO: 677970 - RNA, 64 nt, hsa; identical to SEQ ID NO: 125534

SEQ ID NO: 677971 - RNA, 64 nt, hsa; identical to SEQ ID NO: 125535

SEQ ID NO: 677972 - RNA, 64 nt, hsa; identical to SEQ ID NO: 125536

SEQ ID NO: 677973 - RNA, 64 nt, hsa; identical to SEQ ID NO: 125537

SEQ ID NO: 677974 - RNA, 64 nt, hsa; identical to SEQ ID NO: 125538

SEQ ID NO: 677975 - RNA, 64 nt, hsa; identical to SEQ ID NO: 125539

SEQ ID NO: 677976 - RNA, 64 nt, hsa; identical to SEQ ID NO: 125540

SEQ ID NO: 677977 - RNA, 64 nt, hsa; identical to SEQ ID NO: 125541

SEQ ID NO: 677978 - RNA, 64 nt, hsa; identical to SEQ ID NO: 125542

SEQ ID NO: 677979 - RNA, 64 nt, hsa; identical to SEQ ID NO: 125543

SEQ ID NO: 677980 - RNA, 64 nt, hsa; identical to SEQ ID NO: 125544

SEQ ID NO: 677981 - RNA, 64 nt, hsa; identical to SEQ ID NO: 125545

SEQ ID NO: 677982 - RNA, 64 nt, hsa; identical to SEQ ID NO: 125546

SEQ ID NO: 677983 - RNA, 64 nt, hsa; identical to SEQ ID NO: 125547

SEQ ID NO: 677984 - RNA, 64 nt, hsa; identical to SEQ ID NO: 125548

SEQ ID NO: 677985 - RNA, 64 nt, hsa; identical to SEQ ID NO: 125549

SEQ ID NO: 677986 - RNA, 64 nt, hsa; identical to SEQ ID NO: 125550

SEQ ID NO: 677987 - RNA, 64 nt, hsa; identical to SEQ ID NO: 125551

SEQ ID NO: 677988 - RNA, 64 nt, hsa; identical to SEQ ID NO: 125552

SEQ ID NO: 677989 - RNA, 64 nt, hsa; identical to SEQ ID NO: 125553

SEQ ID NO: 677990 - RNA, 64 nt, hsa; identical to SEQ ID NO: 125554

SEQ ID NO: 677991 - RNA, 64 nt, hsa; identical to SEQ ID NO: 125555

SEQ ID NO: 677992 - RNA, 64 nt, hsa; identical to SEQ ID NO: 125556

SEQ ID NO: 677993 - RNA, 64 nt, hsa; identical to SEQ ID NO: 125557

SEQ ID NO: 677994 - RNA, 64 nt, hsa; identical to SEQ ID NO: 125558

SEQ ID NO: 677995 - RNA, 64 nt, hsa; identical to SEQ ID NO: 125559

SEQ ID NO: 677996 - RNA, 64 nt, hsa; identical to SEQ ID NO: 125560

SEQ ID NO: 677997 - RNA, 64 nt, hsa; identical to SEQ ID NO: 125561

SEQ ID NO: 677998 - RNA, 64 nt, hsa; identical to SEQ ID NO: 125562

SEQ ID NO: 677999 - RNA, 64 nt, hsa; identical to SEQ ID NO: 125563

SEQ ID NO: 678000 - RNA, 64 nt, hsa; identical to SEQ ID NO: 125564

SEQ ID NO: 678001 - RNA, 64 nt, hsa; identical to SEQ ID NO: 125565

SEQ ID NO: 678002 - RNA, 64 nt, hsa; identical to SEQ ID NO: 125566

SEQ ID NO: 678003 - RNA, 64 nt, hsa; identical to SEQ ID NO: 125567

SEQ ID NO: 678004 - RNA, 64 nt, hsa; identical to SEQ ID NO: 125568

SEQ ID NO: 678005 - RNA, 64 nt, hsa; identical to SEQ ID NO: 56766

SEQ ID NO: 678006 - RNA, 64 nt, hsa; identical to SEQ ID NO: 56767

SEQ ID NO: 678007 - RNA, 64 nt, hsa; identical to SEQ ID NO: 56768

SEQ ID NO: 678008 - RNA, 64 nt, hsa; identical to SEQ ID NO: 56769

SEQ ID NO: 678009 - RNA, 64 nt, hsa; identical to SEQ ID NO: 56770

SEQ ID NO: 678010 - RNA, 64 nt, hsa; identical to SEQ ID NO: 56771

SEQ ID NO: 678011 - RNA, 64 nt, hsa; identical to SEQ ID NO: 56772

SEQ ID NO: 678012 - RNA, 64 nt, hsa; identical to SEQ ID NO: 56773

SEQ ID NO: 678013 - RNA, 64 nt, hsa; identical to SEQ ID NO: 56774

SEQ ID NO: 678014 - RNA, 64 nt, hsa; identical to SEQ ID NO: 56775

SEQ ID NO: 678015 - RNA, 64 nt, hsa; identical to SEQ ID NO: 56776

SEQ ID NO: 678016 - RNA, 64 nt, hsa; identical to SEQ ID NO: 56777

SEQ ID NO: 678017 - RNA, 64 nt, hsa; identical to SEQ ID NO: 56778

SEQ ID NO: 678018 - RNA, 64 nt, hsa; identical to SEQ ID NO: 56779

SEQ ID NO: 678019 - RNA, 64 nt, hsa; identical to SEQ ID NO: 56780

SEQ ID NO: 678020 - RNA, 64 nt, hsa; identical to SEQ ID NO: 56781

SEQ ID NO: 678021 - RNA, 64 nt, hsa; identical to SEQ ID NO: 56782

SEQ ID NO: 678022 - RNA, 64 nt, hsa; identical to SEQ ID NO: 56783

SEQ ID NO: 678023 - RNA, 64 nt, hsa; identical to SEQ ID NO: 56784

SEQ ID NO: 678024 - RNA, 64 nt, hsa; identical to SEQ ID NO: 56785

SEQ ID NO: 678025 - RNA, 64 nt, hsa; identical to SEQ ID NO: 56786

SEQ ID NO: 678026 - RNA, 64 nt, hsa; identical to SEQ ID NO: 56787

SEQ ID NO: 678027 - RNA, 64 nt, hsa; identical to SEQ ID NO: 56788

SEQ ID NO: 678028 - RNA, 64 nt, hsa; identical to SEQ ID NO: 56789

SEQ ID NO: 678029 - RNA, 64 nt, hsa; identical to SEQ ID NO: 56790

SEQ ID NO: 678030 - RNA, 64 nt, hsa; identical to SEQ ID NO: 56791

SEQ ID NO: 678031 - RNA, 64 nt, hsa; identical to SEQ ID NO: 56792

SEQ ID NO: 678032 - RNA, 64 nt, hsa; identical to SEQ ID NO: 56793

SEQ ID NO: 678033 - RNA, 64 nt, hsa; identical to SEQ ID NO: 56794

SEQ ID NO: 678034 - RNA, 64 nt, hsa; identical to SEQ ID NO: 56795

SEQ ID NO: 678035 - RNA, 64 nt, hsa; identical to SEQ ID NO: 56796

SEQ ID NO: 678036 - RNA, 64 nt, hsa; identical to SEQ ID NO: 56797

SEQ ID NO: 678037 - RNA, 64 nt, hsa; identical to SEQ ID NO: 56798

SEQ ID NO: 678038 - RNA, 64 nt, hsa; identical to SEQ ID NO: 56799

SEQ ID NO: 678039 - RNA, 64 nt, hsa; identical to SEQ ID NO: 56800

SEQ ID NO: 678040 - RNA, 64 nt, hsa; identical to SEQ ID NO: 56801

SEQ ID NO: 678041 - RNA, 64 nt, hsa; identical to SEQ ID NO: 56802

SEQ ID NO: 678042 - RNA, 64 nt, hsa; identical to SEQ ID NO: 56803

SEQ ID NO: 678043 - RNA, 64 nt, hsa; identical to SEQ ID NO: 56804

SEQ ID NO: 678044 - RNA, 64 nt, hsa; identical to SEQ ID NO: 56805

SEQ ID NO: 678045 - RNA, 64 nt, hsa; identical to SEQ ID NO: 56806

SEQ ID NO: 678046 - RNA, 64 nt, hsa; identical to SEQ ID NO: 56807

SEQ ID NO: 678047 - RNA, 64 nt, hsa; identical to SEQ ID NO: 56808

SEQ ID NO: 678048 - RNA, 64 nt, hsa; identical to SEQ ID NO: 56809

SEQ ID NO: 678049 - RNA, 64 nt, hsa; identical to SEQ ID NO: 56810

SEQ ID NO: 678050 - RNA, 64 nt, hsa; identical to SEQ ID NO: 56811

SEQ ID NO: 678051 - RNA, 63 nt, hsa; identical to SEQ ID NO: 56812

SEQ ID NO: 678052 - RNA, 64 nt, hsa; identical to SEQ ID NO: 56813

SEQ ID NO: 678053 - RNA, 64 nt, hsa; identical to SEQ ID NO: 56814

SEQ ID NO: 678054 - RNA, 64 nt, hsa; identical to SEQ ID NO: 56815

SEQ ID NO: 678055 - RNA, 64 nt, hsa; identical to SEQ ID NO: 56816

SEQ ID NO: 678056 - RNA, 64 nt, hsa; identical to SEQ ID NO: 56817

SEQ ID NO: 678057 - RNA, 64 nt, hsa; identical to SEQ ID NO: 56818

SEQ ID NO: 678058 - RNA, 64 nt, hsa; identical to SEQ ID NO: 56819

SEQ ID NO: 678059 - RNA, 64 nt, hsa; identical to SEQ ID NO: 56820

SEQ ID NO: 678060 - RNA, 64 nt, hsa; identical to SEQ ID NO: 56821

SEQ ID NO: 678061 - RNA, 64 nt, hsa; identical to SEQ ID NO: 56822

SEQ ID NO: 678062 - RNA, 64 nt, hsa; identical to SEQ ID NO: 56823

SEQ ID NO: 678063 - RNA, 64 nt, hsa; identical to SEQ ID NO: 56824

SEQ ID NO: 678064 - RNA, 64 nt, hsa; identical to SEQ ID NO: 56825

SEQ ID NO: 678065 - RNA, 64 nt, hsa; identical to SEQ ID NO: 56826

SEQ ID NO: 678066 - RNA, 64 nt, hsa; identical to SEQ ID NO: 56827

SEQ ID NO: 678067 - RNA, 64 nt, hsa; identical to SEQ ID NO: 56828

SEQ ID NO: 678068 - RNA, 64 nt, hsa; identical to SEQ ID NO: 56829

SEQ ID NO: 678069 - RNA, 64 nt, hsa; identical to SEQ ID NO: 56830

SEQ ID NO: 678070 - RNA, 64 nt, hsa; identical to SEQ ID NO: 56831

SEQ ID NO: 678071 - RNA, 64 nt, hsa; identical to SEQ ID NO: 56832

SEQ ID NO: 678072 - RNA, 64 nt, hsa; identical to SEQ ID NO: 56833

SEQ ID NO: 678073 - RNA, 64 nt, hsa; identical to SEQ ID NO: 56834

SEQ ID NO: 678074 - RNA, 64 nt, hsa
caggggaaacaggccaccgccaaagccauggcccgccgccgagagcccaggccccacccgcacc

SEQ ID NO: 678075 - RNA, 64 nt, hsa
gaacccggccaugaccugggcgggggcgcggggcgccgccgagcccccucuucccgccuugcgc

SEQ ID NO: 678076 - RNA, 64 nt, hsa; identical to SEQ ID NO: 56439

SEQ ID NO: 678077 - RNA, 64 nt, hsa; identical to SEQ ID NO: 56440

SEQ ID NO: 678078 - RNA, 64 nt, hsa; identical to SEQ ID NO: 56441

SEQ ID NO: 678079 - RNA, 64 nt, hsa; identical to SEQ ID NO: 56442

SEQ ID NO: 678080 - RNA, 64 nt, hsa; identical to SEQ ID NO: 56443

SEQ ID NO: 678081 - RNA, 64 nt, hsa; identical to SEQ ID NO: 56444

SEQ ID NO: 678082 - RNA, 64 nt, hsa; identical to SEQ ID NO: 56445

SEQ ID NO: 678083 - RNA, 64 nt, hsa; identical to SEQ ID NO: 56446

SEQ ID NO: 678084 - RNA, 64 nt, hsa; identical to SEQ ID NO: 56447

SEQ ID NO: 678085 - RNA, 64 nt, hsa; identical to SEQ ID NO: 56448

SEQ ID NO: 678086 - RNA, 64 nt, hsa; identical to SEQ ID NO: 56449

SEQ ID NO: 678087 - RNA, 64 nt, hsa; identical to SEQ ID NO: 56450

SEQ ID NO: 678088 - RNA, 64 nt, hsa; identical to SEQ ID NO: 56451

SEQ ID NO: 678089 - RNA, 64 nt, hsa; identical to SEQ ID NO: 56452

SEQ ID NO: 678090 - RNA, 64 nt, hsa; identical to SEQ ID NO: 56453

SEQ ID NO: 678091 - RNA, 64 nt, hsa; identical to SEQ ID NO: 56454

SEQ ID NO: 678092 - RNA, 64 nt, hsa; identical to SEQ ID NO: 56455

SEQ ID NO: 678093 - RNA, 64 nt, hsa; identical to SEQ ID NO: 56456

SEQ ID NO: 678094 - RNA, 64 nt, hsa; identical to SEQ ID NO: 56457

SEQ ID NO: 678095 - RNA, 64 nt, hsa; identical to SEQ ID NO: 56458

SEQ ID NO: 678096 - RNA, 64 nt, hsa; identical to SEQ ID NO: 56459

SEQ ID NO: 678097 - RNA, 64 nt, hsa; identical to SEQ ID NO: 56460

SEQ ID NO: 678098 - RNA, 64 nt, hsa; identical to SEQ ID NO: 56461

SEQ ID NO: 678099 - RNA, 64 nt, hsa; identical to SEQ ID NO: 56462

SEQ ID NO: 678100 - RNA, 64 nt, hsa; identical to SEQ ID NO: 56463

SEQ ID NO: 678101 - RNA, 64 nt, hsa; identical to SEQ ID NO: 56464

SEQ ID NO: 678102 - RNA, 64 nt, hsa; identical to SEQ ID NO: 56465

SEQ ID NO: 678103 - RNA, 64 nt, hsa; identical to SEQ ID NO: 56466

SEQ ID NO: 678104 - RNA, 64 nt, hsa; identical to SEQ ID NO: 56467

SEQ ID NO: 678105 - RNA, 50 nt, hsa; identical to SEQ ID NO: 56468

SEQ ID NO: 678106 - RNA, 64 nt, hsa; identical to SEQ ID NO: 56469

SEQ ID NO: 678107 - RNA, 64 nt, hsa; identical to SEQ ID NO: 56470

SEQ ID NO: 678108 - RNA, 64 nt, hsa; identical to SEQ ID NO: 56471

SEQ ID NO: 678109 - RNA, 64 nt, hsa; identical to SEQ ID NO: 56472

SEQ ID NO: 678110 - RNA, 64 nt, hsa; identical to SEQ ID NO: 56473

SEQ ID NO: 678111 - RNA, 64 nt, hsa; identical to SEQ ID NO: 56474

SEQ ID NO: 678112 - RNA, 64 nt, hsa; identical to SEQ ID NO: 56475

SEQ ID NO: 678113 - RNA, 64 nt, hsa; identical to SEQ ID NO: 56476

SEQ ID NO: 678114 - RNA, 64 nt, hsa; identical to SEQ ID NO: 56477

SEQ ID NO: 678115 - RNA, 64 nt, hsa; identical to SEQ ID NO: 56478

SEQ ID NO: 678116 - RNA, 64 nt, hsa; identical to SEQ ID NO: 56479

SEQ ID NO: 678117 - RNA, 64 nt, hsa; identical to SEQ ID NO: 56480

SEQ ID NO: 678118 - RNA, 64 nt, hsa; identical to SEQ ID NO: 56481

SEQ ID NO: 678119 - RNA, 64 nt, hsa; identical to SEQ ID NO: 56482

SEQ ID NO: 678120 - RNA, 64 nt, hsa; identical to SEQ ID NO: 56483

SEQ ID NO: 678121 - RNA, 64 nt, hsa; identical to SEQ ID NO: 56484

SEQ ID NO: 678122 - RNA, 64 nt, hsa; identical to SEQ ID NO: 56485

SEQ ID NO: 678123 - RNA, 64 nt, hsa; identical to SEQ ID NO: 56486

SEQ ID NO: 678124 - RNA, 64 nt, hsa; identical to SEQ ID NO: 56487

SEQ ID NO: 678125 - RNA, 64 nt, hsa; identical to SEQ ID NO: 56488

SEQ ID NO: 678126 - RNA, 64 nt, hsa; identical to SEQ ID NO: 56489

SEQ ID NO: 678127 - RNA, 64 nt, hsa; identical to SEQ ID NO: 56490

SEQ ID NO: 678128 - RNA, 64 nt, hsa; identical to SEQ ID NO: 56491

SEQ ID NO: 678129 - RNA, 64 nt, hsa; identical to SEQ ID NO: 56492

SEQ ID NO: 678130 - RNA, 64 nt, hsa; identical to SEQ ID NO: 56493

SEQ ID NO: 678131 - RNA, 64 nt, hsa; identical to SEQ ID NO: 56494

SEQ ID NO: 678132 - RNA, 64 nt, hsa; identical to SEQ ID NO: 56495

SEQ ID NO: 678133 - RNA, 64 nt, hsa; identical to SEQ ID NO: 56496

SEQ ID NO: 678134 - RNA, 64 nt, hsa; identical to SEQ ID NO: 56497

SEQ ID NO: 678135 - RNA, 64 nt, hsa; identical to SEQ ID NO: 56498

SEQ ID NO: 678136 - RNA, 64 nt, hsa; identical to SEQ ID NO: 56499

SEQ ID NO: 678137 - RNA, 64 nt, hsa; identical to SEQ ID NO: 56500

SEQ ID NO: 678138 - RNA, 64 nt, hsa; identical to SEQ ID NO: 56501

SEQ ID NO: 678139 - RNA, 64 nt, hsa; identical to SEQ ID NO: 56502

SEQ ID NO: 678140 - RNA, 64 nt, hsa; identical to SEQ ID NO: 56503

SEQ ID NO: 678141 - RNA, 64 nt, hsa; identical to SEQ ID NO: 56504

SEQ ID NO: 678142 - RNA, 64 nt, hsa; identical to SEQ ID NO: 56505

SEQ ID NO: 678143 - RNA, 64 nt, hsa; identical to SEQ ID NO: 56506

SEQ ID NO: 678144 - RNA, 64 nt, hsa; identical to SEQ ID NO: 56507

SEQ ID NO: 678145 - RNA, 64 nt, hsa; identical to SEQ ID NO: 56508

SEQ ID NO: 678146 - RNA, 64 nt, hsa; identical to SEQ ID NO: 56509

SEQ ID NO: 678147 - RNA, 64 nt, hsa; identical to SEQ ID NO: 56510

SEQ ID NO: 678148 - RNA, 64 nt, hsa; identical to SEQ ID NO: 56511

SEQ ID NO: 678149 - RNA, 64 nt, hsa; identical to SEQ ID NO: 56512

SEQ ID NO: 678150 - RNA, 64 nt, hsa; identical to SEQ ID NO: 56513

SEQ ID NO: 678151 - RNA, 64 nt, hsa; identical to SEQ ID NO: 56514

SEQ ID NO: 678152 - RNA, 64 nt, hsa; identical to SEQ ID NO: 56515

SEQ ID NO: 678153 - RNA, 64 nt, hsa; identical to SEQ ID NO: 56516

SEQ ID NO: 678154 - RNA, 64 nt, hsa; identical to SEQ ID NO: 56517

SEQ ID NO: 678155 - RNA, 64 nt, hsa; identical to SEQ ID NO: 56518

SEQ ID NO: 678156 - RNA, 64 nt, hsa; identical to SEQ ID NO: 56519

SEQ ID NO: 678157 - RNA, 64 nt, hsa; identical to SEQ ID NO: 56520

SEQ ID NO: 678158 - RNA, 64 nt, hsa; identical to SEQ ID NO: 56521

SEQ ID NO: 678159 - RNA, 64 nt, hsa; identical to SEQ ID NO: 56522

SEQ ID NO: 678160 - RNA, 64 nt, hsa; identical to SEQ ID NO: 56523

SEQ ID NO: 678161 - RNA, 64 nt, hsa; identical to SEQ ID NO: 56524

SEQ ID NO: 678162 - RNA, 64 nt, hsa; identical to SEQ ID NO: 56525

SEQ ID NO: 678163 - RNA, 64 nt, hsa; identical to SEQ ID NO: 56526

SEQ ID NO: 678164 - RNA, 64 nt, hsa; identical to SEQ ID NO: 56527

SEQ ID NO: 678165 - RNA, 64 nt, hsa; identical to SEQ ID NO: 56528

SEQ ID NO: 678166 - RNA, 64 nt, hsa; identical to SEQ ID NO: 56529

SEQ ID NO: 678167 - RNA, 64 nt, hsa; identical to SEQ ID NO: 56530

SEQ ID NO: 678168 - RNA, 64 nt, hsa; identical to SEQ ID NO: 56531

SEQ ID NO: 678169 - RNA, 64 nt, hsa; identical to SEQ ID NO: 56532

SEQ ID NO: 678170 - RNA, 64 nt, hsa; identical to SEQ ID NO: 56533

SEQ ID NO: 678171 - RNA, 64 nt, hsa; identical to SEQ ID NO: 56534

SEQ ID NO: 678172 - RNA, 59 nt, hsa; identical to SEQ ID NO: 56535

SEQ ID NO: 678173 - RNA, 64 nt, hsa; identical to SEQ ID NO: 56536

SEQ ID NO: 678174 - RNA, 64 nt, hsa; identical to SEQ ID NO: 56537

SEQ ID NO: 678175 - RNA, 64 nt, hsa; identical to SEQ ID NO: 56538

SEQ ID NO: 678176 - RNA, 64 nt, hsa; identical to SEQ ID NO: 56539

SEQ ID NO: 678177 - RNA, 64 nt, hsa; identical to SEQ ID NO: 56540

SEQ ID NO: 678178 - RNA, 64 nt, hsa; identical to SEQ ID NO: 56541

SEQ ID NO: 678179 - RNA, 64 nt, hsa; identical to SEQ ID NO: 56542

SEQ ID NO: 678180 - RNA, 64 nt, hsa; identical to SEQ ID NO: 56543

SEQ ID NO: 678181 - RNA, 64 nt, hsa; identical to SEQ ID NO: 56544

SEQ ID NO: 678182 - RNA, 64 nt, hsa; identical to SEQ ID NO: 56545

SEQ ID NO: 678183 - RNA, 64 nt, hsa; identical to SEQ ID NO: 56546

SEQ ID NO: 678184 - RNA, 64 nt, hsa; identical to SEQ ID NO: 56547

SEQ ID NO: 678185 - RNA, 64 nt, hsa; identical to SEQ ID NO: 56548

SEQ ID NO: 678186 - RNA, 64 nt, hsa; identical to SEQ ID NO: 56549

SEQ ID NO: 678187 - RNA, 64 nt, hsa; identical to SEQ ID NO: 56550

SEQ ID NO: 678188 - RNA, 64 nt, hsa; identical to SEQ ID NO: 56551

SEQ ID NO: 678189 - RNA, 64 nt, hsa; identical to SEQ ID NO: 56552

SEQ ID NO: 678190 - RNA, 64 nt, hsa; identical to SEQ ID NO: 56553

SEQ ID NO: 678191 - RNA, 64 nt, hsa; identical to SEQ ID NO: 56554

SEQ ID NO: 678192 - RNA, 64 nt, hsa; identical to SEQ ID NO: 56555

SEQ ID NO: 678193 - RNA, 64 nt, hsa; identical to SEQ ID NO: 56556

SEQ ID NO: 678194 - RNA, 62 nt, hsa; identical to SEQ ID NO: 56557

SEQ ID NO: 678195 - RNA, 58 nt, hsa; identical to SEQ ID NO: 56558

SEQ ID NO: 678196 - RNA, 64 nt, hsa; identical to SEQ ID NO: 56559

SEQ ID NO: 678197 - RNA, 64 nt, hsa; identical to SEQ ID NO: 56560

SEQ ID NO: 678198 - RNA, 64 nt, hsa; identical to SEQ ID NO: 56561

SEQ ID NO: 678199 - RNA, 64 nt, hsa; identical to SEQ ID NO: 56562

SEQ ID NO: 678200 - RNA, 64 nt, hsa; identical to SEQ ID NO: 56563

SEQ ID NO: 678201 - RNA, 64 nt, hsa; identical to SEQ ID NO: 56564

SEQ ID NO: 678202 - RNA, 64 nt, hsa; identical to SEQ ID NO: 56565

SEQ ID NO: 678203 - RNA, 64 nt, hsa; identical to SEQ ID NO: 56566

SEQ ID NO: 678204 - RNA, 64 nt, hsa; identical to SEQ ID NO: 56567

SEQ ID NO: 678205 - RNA, 64 nt, hsa; identical to SEQ ID NO: 56568

SEQ ID NO: 678206 - RNA, 64 nt, hsa; identical to SEQ ID NO: 56569

SEQ ID NO: 678207 - RNA, 64 nt, hsa; identical to SEQ ID NO: 56570

SEQ ID NO: 678208 - RNA, 64 nt, hsa; identical to SEQ ID NO: 56571

SEQ ID NO: 678209 - RNA, 64 nt, hsa; identical to SEQ ID NO: 56572

SEQ ID NO: 678210 - RNA, 64 nt, hsa; identical to SEQ ID NO: 56573

SEQ ID NO: 678211 - RNA, 64 nt, hsa; identical to SEQ ID NO: 56574

SEQ ID NO: 678212 - RNA, 64 nt, hsa; identical to SEQ ID NO: 56575

SEQ ID NO: 678213 - RNA, 64 nt, hsa; identical to SEQ ID NO: 56576

SEQ ID NO: 678214 - RNA, 64 nt, hsa; identical to SEQ ID NO: 56577

SEQ ID NO: 678215 - RNA, 64 nt, hsa; identical to SEQ ID NO: 56578

SEQ ID NO: 678216 - RNA, 64 nt, hsa; identical to SEQ ID NO: 56579

SEQ ID NO: 678217 - RNA, 64 nt, hsa; identical to SEQ ID NO: 56580

SEQ ID NO: 678218 - RNA, 64 nt, hsa; identical to SEQ ID NO: 56581

SEQ ID NO: 678219 - RNA, 64 nt, hsa; identical to SEQ ID NO: 56582

SEQ ID NO: 678220 - RNA, 60 nt, hsa
cuccccgccuucuuggugacaaauagugagggcuccuauaccuuguccuuccugcuugcc

SEQ ID NO: 678221 - RNA, 60 nt, hsa
aagacaacucuaggggaccauuuugccuggggcuccuagcaaaccuuuuuauuuauuuua

SEQ ID NO: 678222 - RNA, 60 nt, hsa
aucaacgcgcggcugaacaugggcauccuaggcuccuacgacccucagcagaucuucaag

SEQ ID NO: 678223 - RNA, 60 nt, hsa
cugguggcugcccagagcuaccuguacagcggcuccuaccagacaaucaaggugcgcuug

SEQ ID NO: 678224 - RNA, 60 nt, hsa
uaccagaagggcuucaaagauauaggguguggcuccuaccagcaaacagcugaaagagga

SEQ ID NO: 678225 - RNA, 60 nt, hsa
ccuaaggaagccagucaccuucugggcaagggcuccuaucuuuccucccuauccauggca

SEQ ID NO: 678226 - RNA, 64 nt, hsa; identical to SEQ ID NO: 363631

SEQ ID NO: 678227 - RNA, 64 nt, hsa; identical to SEQ ID NO: 363632

SEQ ID NO: 678228 - RNA, 64 nt, hsa; identical to SEQ ID NO: 363633

SEQ ID NO: 678229 - RNA, 64 nt, hsa; identical to SEQ ID NO: 363634

SEQ ID NO: 678230 - RNA, 64 nt, hsa; identical to SEQ ID NO: 363635

SEQ ID NO: 678231 - RNA, 64 nt, hsa; identical to SEQ ID NO: 363636

SEQ ID NO: 678232 - RNA, 64 nt, hsa; identical to SEQ ID NO: 363637

SEQ ID NO: 678233 - RNA, 64 nt, hsa; identical to SEQ ID NO: 363638

SEQ ID NO: 678234 - RNA, 64 nt, hsa; identical to SEQ ID NO: 363639

SEQ ID NO: 678235 - RNA, 64 nt, hsa; identical to SEQ ID NO: 363640

SEQ ID NO: 678236 - RNA, 64 nt, hsa; identical to SEQ ID NO: 363641

SEQ ID NO: 678237 - RNA, 64 nt, hsa; identical to SEQ ID NO: 363642

SEQ ID NO: 678238 - RNA, 63 nt, hsa; identical to SEQ ID NO: 363643

SEQ ID NO: 678239 - RNA, 64 nt, hsa; identical to SEQ ID NO: 363644

SEQ ID NO: 678240 - RNA, 64 nt, hsa; identical to SEQ ID NO: 363645

SEQ ID NO: 678241 - RNA, 64 nt, hsa; identical to SEQ ID NO: 363646

SEQ ID NO: 678242 - RNA, 64 nt, hsa; identical to SEQ ID NO: 363647

SEQ ID NO: 678243 - RNA, 64 nt, hsa; identical to SEQ ID NO: 363648

SEQ ID NO: 678244 - RNA, 64 nt, hsa; identical to SEQ ID NO: 363649

SEQ ID NO: 678245 - RNA, 64 nt, hsa; identical to SEQ ID NO: 363650

SEQ ID NO: 678246 - RNA, 64 nt, hsa; identical to SEQ ID NO: 363651

SEQ ID NO: 678247 - RNA, 64 nt, hsa; identical to SEQ ID NO: 363652

SEQ ID NO: 678248 - RNA, 64 nt, hsa; identical to SEQ ID NO: 363653

SEQ ID NO: 678249 - RNA, 64 nt, hsa; identical to SEQ ID NO: 363654

SEQ ID NO: 678250 - RNA, 64 nt, hsa; identical to SEQ ID NO: 363655

SEQ ID NO: 678251 - RNA, 64 nt, hsa; identical to SEQ ID NO: 363656

SEQ ID NO: 678252 - RNA, 64 nt, hsa; identical to SEQ ID NO: 363657

SEQ ID NO: 678253 - RNA, 64 nt, hsa; identical to SEQ ID NO: 363658

SEQ ID NO: 678254 - RNA, 64 nt, hsa; identical to SEQ ID NO: 363659

SEQ ID NO: 678255 - RNA, 64 nt, hsa; identical to SEQ ID NO: 363660

SEQ ID NO: 678256 - RNA, 64 nt, hsa; identical to SEQ ID NO: 363661

SEQ ID NO: 678257 - RNA, 64 nt, hsa; identical to SEQ ID NO: 363662

SEQ ID NO: 678258 - RNA, 64 nt, hsa; identical to SEQ ID NO: 363663

SEQ ID NO: 678259 - RNA, 64 nt, hsa; identical to SEQ ID NO: 363664

SEQ ID NO: 678260 - RNA, 64 nt, hsa; identical to SEQ ID NO: 363665

SEQ ID NO: 678261 - RNA, 57 nt, hsa; identical to SEQ ID NO: 262389

SEQ ID NO: 678262 - RNA, 64 nt, hsa; identical to SEQ ID NO: 363667

SEQ ID NO: 678263 - RNA, 64 nt, hsa; identical to SEQ ID NO: 363668

SEQ ID NO: 678264 - RNA, 64 nt, hsa; identical to SEQ ID NO: 363669

SEQ ID NO: 678265 - RNA, 64 nt, hsa; identical to SEQ ID NO: 363670

SEQ ID NO: 678266 - RNA, 64 nt, hsa; identical to SEQ ID NO: 363671

SEQ ID NO: 678267 - RNA, 64 nt, hsa; identical to SEQ ID NO: 363672

SEQ ID NO: 678268 - RNA, 64 nt, hsa; identical to SEQ ID NO: 363673

SEQ ID NO: 678269 - RNA, 64 nt, hsa; identical to SEQ ID NO: 363674

SEQ ID NO: 678270 - RNA, 64 nt, hsa; identical to SEQ ID NO: 363675

SEQ ID NO: 678271 - RNA, 64 nt, hsa; identical to SEQ ID NO: 363676

SEQ ID NO: 678272 - RNA, 64 nt, hsa; identical to SEQ ID NO: 363677

SEQ ID NO: 678273 - RNA, 64 nt, hsa; identical to SEQ ID NO: 363678

SEQ ID NO: 678274 - RNA, 64 nt, hsa; identical to SEQ ID NO: 363679

SEQ ID NO: 678275 - RNA, 64 nt, hsa; identical to SEQ ID NO: 363680

SEQ ID NO: 678276 - RNA, 64 nt, hsa; identical to SEQ ID NO: 209092

SEQ ID NO: 678277 - RNA, 64 nt, hsa; identical to SEQ ID NO: 209093

SEQ ID NO: 678278 - RNA, 64 nt, hsa; identical to SEQ ID NO: 209094

SEQ ID NO: 678279 - RNA, 64 nt, hsa; identical to SEQ ID NO: 209095

SEQ ID NO: 678280 - RNA, 64 nt, hsa; identical to SEQ ID NO: 209096

SEQ ID NO: 678281 - RNA, 64 nt, hsa; identical to SEQ ID NO: 209097

SEQ ID NO: 678282 - RNA, 64 nt, hsa; identical to SEQ ID NO: 209098

SEQ ID NO: 678283 - RNA, 64 nt, hsa; identical to SEQ ID NO: 209099

SEQ ID NO: 678284 - RNA, 64 nt, hsa; identical to SEQ ID NO: 209100

SEQ ID NO: 678285 - RNA, 64 nt, hsa; identical to SEQ ID NO: 209101

SEQ ID NO: 678286 - RNA, 64 nt, hsa; identical to SEQ ID NO: 209102

SEQ ID NO: 678287 - RNA, 64 nt, hsa; identical to SEQ ID NO: 209103

SEQ ID NO: 678288 - RNA, 64 nt, hsa; identical to SEQ ID NO: 209104

SEQ ID NO: 678289 - RNA, 64 nt, hsa; identical to SEQ ID NO: 209105

SEQ ID NO: 678290 - RNA, 64 nt, hsa; identical to SEQ ID NO: 209106

SEQ ID NO: 678291 - RNA, 64 nt, hsa; identical to SEQ ID NO: 209107

SEQ ID NO: 678292 - RNA, 64 nt, hsa; identical to SEQ ID NO: 209108

SEQ ID NO: 678293 - RNA, 64 nt, hsa; identical to SEQ ID NO: 209109

SEQ ID NO: 678294 - RNA, 64 nt, hsa; identical to SEQ ID NO: 209110

SEQ ID NO: 678295 - RNA, 64 nt, hsa; identical to SEQ ID NO: 209111

SEQ ID NO: 678296 - RNA, 64 nt, hsa; identical to SEQ ID NO: 209112

SEQ ID NO: 678297 - RNA, 64 nt, hsa; identical to SEQ ID NO: 209113

SEQ ID NO: 678298 - RNA, 59 nt, hsa; identical to SEQ ID NO: 209114

SEQ ID NO: 678299 - RNA, 64 nt, hsa; identical to SEQ ID NO: 209115

SEQ ID NO: 678300 - RNA, 64 nt, hsa; identical to SEQ ID NO: 209116

SEQ ID NO: 678301 - RNA, 64 nt, hsa; identical to SEQ ID NO: 209117

SEQ ID NO: 678302 - RNA, 64 nt, hsa; identical to SEQ ID NO: 209118

SEQ ID NO: 678303 - RNA, 64 nt, hsa; identical to SEQ ID NO: 209119

SEQ ID NO: 678304 - RNA, 64 nt, hsa; identical to SEQ ID NO: 209120

SEQ ID NO: 678305 - RNA, 64 nt, hsa; identical to SEQ ID NO: 209121

SEQ ID NO: 678306 - RNA, 64 nt, hsa; identical to SEQ ID NO: 209122

SEQ ID NO: 678307 - RNA, 64 nt, hsa; identical to SEQ ID NO: 209123

SEQ ID NO: 678308 - RNA, 64 nt, hsa; identical to SEQ ID NO: 209124

SEQ ID NO: 678309 - RNA, 64 nt, hsa; identical to SEQ ID NO: 209125

SEQ ID NO: 678310 - RNA, 64 nt, hsa; identical to SEQ ID NO: 209126

SEQ ID NO: 678311 - RNA, 64 nt, hsa; identical to SEQ ID NO: 209127

SEQ ID NO: 678312 - RNA, 64 nt, hsa; identical to SEQ ID NO: 209128

SEQ ID NO: 678313 - RNA, 64 nt, hsa; identical to SEQ ID NO: 209129

SEQ ID NO: 678314 - RNA, 64 nt, hsa; identical to SEQ ID NO: 209130

SEQ ID NO: 678315 - RNA, 64 nt, hsa; identical to SEQ ID NO: 209131

SEQ ID NO: 678316 - RNA, 64 nt, hsa; identical to SEQ ID NO: 209132

SEQ ID NO: 678317 - RNA, 64 nt, hsa; identical to SEQ ID NO: 209133

SEQ ID NO: 678318 - RNA, 64 nt, hsa; identical to SEQ ID NO: 209134

SEQ ID NO: 678319 - RNA, 64 nt, hsa; identical to SEQ ID NO: 209135

SEQ ID NO: 678320 - RNA, 64 nt, hsa; identical to SEQ ID NO: 209136

SEQ ID NO: 678321 - RNA, 64 nt, hsa; identical to SEQ ID NO: 209137

SEQ ID NO: 678322 - RNA, 64 nt, hsa; identical to SEQ ID NO: 209138

SEQ ID NO: 678323 - RNA, 64 nt, hsa; identical to SEQ ID NO: 209139

SEQ ID NO: 678324 - RNA, 64 nt, hsa; identical to SEQ ID NO: 209140

SEQ ID NO: 678325 - RNA, 64 nt, hsa; identical to SEQ ID NO: 209141

SEQ ID NO: 678326 - RNA, 64 nt, hsa; identical to SEQ ID NO: 209142

SEQ ID NO: 678327 - RNA, 64 nt, hsa; identical to SEQ ID NO: 209143

SEQ ID NO: 678328 - RNA, 64 nt, hsa; identical to SEQ ID NO: 209144

SEQ ID NO: 678329 - RNA, 64 nt, hsa; identical to SEQ ID NO: 209145

SEQ ID NO: 678330 - RNA, 64 nt, hsa; identical to SEQ ID NO: 556078

SEQ ID NO: 678331 - RNA, 64 nt, hsa; identical to SEQ ID NO: 556079

SEQ ID NO: 678332 - RNA, 64 nt, hsa; identical to SEQ ID NO: 556080

SEQ ID NO: 678333 - RNA, 64 nt, hsa; identical to SEQ ID NO: 556081

SEQ ID NO: 678334 - RNA, 64 nt, hsa; identical to SEQ ID NO: 556082

SEQ ID NO: 678335 - RNA, 64 nt, hsa; identical to SEQ ID NO: 556083

SEQ ID NO: 678336 - RNA, 64 nt, hsa; identical to SEQ ID NO: 556084

SEQ ID NO: 678337 - RNA, 64 nt, hsa; identical to SEQ ID NO: 556085

SEQ ID NO: 678338 - RNA, 64 nt, hsa; identical to SEQ ID NO: 556086

SEQ ID NO: 678339 - RNA, 64 nt, hsa; identical to SEQ ID NO: 556087

SEQ ID NO: 678340 - RNA, 64 nt, hsa; identical to SEQ ID NO: 556088

SEQ ID NO: 678341 - RNA, 64 nt, hsa; identical to SEQ ID NO: 556089

SEQ ID NO: 678342 - RNA, 64 nt, hsa; identical to SEQ ID NO: 556090

SEQ ID NO: 678343 - RNA, 64 nt, hsa; identical to SEQ ID NO: 556091

SEQ ID NO: 678344 - RNA, 64 nt, hsa; identical to SEQ ID NO: 556092

SEQ ID NO: 678345 - RNA, 64 nt, hsa; identical to SEQ ID NO: 556093

SEQ ID NO: 678346 - RNA, 64 nt, hsa; identical to SEQ ID NO: 556094

SEQ ID NO: 678347 - RNA, 64 nt, hsa; identical to SEQ ID NO: 556095

SEQ ID NO: 678348 - RNA, 61 nt, hsa
acauccauaauuuggggcccugaguuuuacccagacucaaggaguugguaaaggguuaaua

SEQ ID NO: 678349 - RNA, 61 nt, hsa
aagggcaggaccaauggcugagccucguguccagacucagagggcuggauuuugguucccu

SEQ ID NO: 678350 - RNA, 61 nt, hsa
ggccccgcuccugcccauuccucugucccugcagacucagugcagcacuuccacaccaaga

SEQ ID NO: 678351 - RNA, 61 nt, hsa
ugggcgggcagcagcuccccaucuucucuggcagacucagcccacugccuugccagucuug

SEQ ID NO: 678352 - RNA, 61 nt, hsa
caccucggaaaaauaccaacucagugaaauacagacucaaguuucgcuuuggauaauauuc

SEQ ID NO: 678353 - RNA, 61 nt, hsa
ccugccucagccucccaaguagcugggauuacagacucaugccaccacgccagcuaauuuu

SEQ ID NO: 678354 - RNA, 61 nt, hsa
aggcuccaccgcacagaagagccacagucuccagacucauggcguucccuccagaacuccc

SEQ ID NO: 678355 - RNA, 61 nt, hsa
cccagugcuauucaggguccuuucuugaggccagacucaucaccaucuacuauugauuuua

SEQ ID NO: 678356 - RNA, 61 nt, hsa
auggccagcauuacccuuuaccugugggcaucagacucagcgugggcugagugcugagugu

SEQ ID NO: 678357 - RNA, 61 nt, hsa
aacuuguucaaccaucaccacuaucuaauuccagacucacgcuuuuuuaaacaauaaaugu

SEQ ID NO: 678358 - RNA, 64 nt, hsa; identical to SEQ ID NO: 276395

SEQ ID NO: 678359 - RNA, 64 nt, hsa; identical to SEQ ID NO: 276396

SEQ ID NO: 678360 - RNA, 64 nt, hsa; identical to SEQ ID NO: 276397

SEQ ID NO: 678361 - RNA, 64 nt, hsa; identical to SEQ ID NO: 276398

SEQ ID NO: 678362 - RNA, 64 nt, hsa; identical to SEQ ID NO: 276399

SEQ ID NO: 678363 - RNA, 64 nt, hsa; identical to SEQ ID NO: 276400

SEQ ID NO: 678364 - RNA, 64 nt, hsa; identical to SEQ ID NO: 276401

SEQ ID NO: 678365 - RNA, 64 nt, hsa; identical to SEQ ID NO: 276402

SEQ ID NO: 678366 - RNA, 64 nt, hsa; identical to SEQ ID NO: 276403

SEQ ID NO: 678367 - RNA, 64 nt, hsa; identical to SEQ ID NO: 276404

SEQ ID NO: 678368 - RNA, 64 nt, hsa; identical to SEQ ID NO: 276405

SEQ ID NO: 678369 - RNA, 64 nt, hsa; identical to SEQ ID NO: 276406

SEQ ID NO: 678370 - RNA, 64 nt, hsa; identical to SEQ ID NO: 276407

SEQ ID NO: 678371 - RNA, 64 nt, hsa; identical to SEQ ID NO: 276408

SEQ ID NO: 678372 - RNA, 64 nt, hsa; identical to SEQ ID NO: 276409

SEQ ID NO: 678373 - RNA, 64 nt, hsa; identical to SEQ ID NO: 276410

SEQ ID NO: 678374 - RNA, 64 nt, hsa; identical to SEQ ID NO: 276411

SEQ ID NO: 678375 - RNA, 64 nt, hsa; identical to SEQ ID NO: 276412

SEQ ID NO: 678376 - RNA, 64 nt, hsa; identical to SEQ ID NO: 276413

SEQ ID NO: 678377 - RNA, 64 nt, hsa; identical to SEQ ID NO: 276414

SEQ ID NO: 678378 - RNA, 64 nt, hsa; identical to SEQ ID NO: 276415

SEQ ID NO: 678379 - RNA, 64 nt, hsa; identical to SEQ ID NO: 276416

SEQ ID NO: 678380 - RNA, 64 nt, hsa; identical to SEQ ID NO: 276417

SEQ ID NO: 678381 - RNA, 64 nt, hsa; identical to SEQ ID NO: 276418

SEQ ID NO: 678382 - RNA, 64 nt, hsa; identical to SEQ ID NO: 276419

SEQ ID NO: 678383 - RNA, 64 nt, hsa; identical to SEQ ID NO: 276420

SEQ ID NO: 678384 - RNA, 64 nt, hsa
uggcccugggcccaggugggggucgccugcuuccuucccggacaggguccugcaguggccaaug

SEQ ID NO: 678385 - RNA, 64 nt, hsa
uggcugagagcaguccugcagccucauuccuuaguucccggagcuggcaagggcuggagccccg

SEQ ID NO: 678386 - RNA, 64 nt, hsa
uggggugggcccauaauaguuagcccucagucaguucccggagcacagcccugggagggggcua

SEQ ID NO: 678387 - RNA, 64 nt, hsa
gugugugcugcgcugagugaguuaugaggugccuuucccggaacccuccucucgccuggaccca

SEQ ID NO: 678388 - RNA, 64 nt, hsa
ugguuuuugacuuaaauuccuauuugaauccccuuucccggaauuuuaagugucucuacaacuu

SEQ ID NO: 678389 - RNA, 64 nt, hsa
cccugugucuuuuucgccaaacugucucugccucuucccggagaauccagcugggcuagaggcu

SEQ ID NO: 678390 - RNA, 64 nt, hsa
uagccaugauggaaaggaucuuggguccuaucccuucccggaugauccgaaagacaaggugaac

SEQ ID NO: 678391 - RNA, 64 nt, hsa
uccugcacugguccuaucccccaggacugauucuuucccggagaugggguggccacuuaucugu

SEQ ID NO: 678392 - RNA, 64 nt, hsa
gaugucaugagaucccuggcuucuccccauguuguucccggacaagggcagaagggaggcaugg

SEQ ID NO: 678393 - RNA, 64 nt, hsa
ggcacgcagcuuccuucaaguacacugugugugcuucccggaccugcggcgaugccacgggccu

SEQ ID NO: 678394 - RNA, 64 nt, hsa
aagcugucuuuauaagcaggaugcucauagugguuucccggagccaguagucacgguggaccau

SEQ ID NO: 678395 - RNA, 64 nt, hsa
caguagggugugaagcugggagcagaucauguauuucccggagacgugggaccuugcuggcaug

SEQ ID NO: 678396 - RNA, 62 nt, hsa
cagccuaugccucccacuaggccgcgugaagguucccggaggaugggucucagccgagccuc

SEQ ID NO: 678397 - RNA, 64 nt, hsa
gugcccuccuucccagcacuaucaugugucacguuucccggacucugccccuacaucucagcug

SEQ ID NO: 678398 - RNA, 64 nt, hsa
cugccgccucacccuucagcauucacugggcaccuucccggagcggacacugacucccaugcac

SEQ ID NO: 678399 - RNA, 64 nt, hsa
aggaccuggucaccccagcaagugcuauggacaguucccggaaacgguugcccacuucacaggu

SEQ ID NO: 678400 - RNA, 64 nt, hsa
aggugggaccgauguggcacacgccagcugcgguuucccggagcguggagaggcagugcugcug

SEQ ID NO: 678401 - RNA, 64 nt, hsa
uauagcaauucacgcauucuucaagcagcaaaaguucccggaacaauuagggaagacguauggu

SEQ ID NO: 678402 - RNA, 64 nt, hsa
cucccacccaggugccccguuggaaagcagauauuucccggacccagcgcggccucaaccaggg

SEQ ID NO: 678403 - RNA, 64 nt, hsa
cggaggccggcgccuuccccucgucgcuuccgcuuucccggacgcuugugcagcgcggcgccgc

SEQ ID NO: 678404 - RNA, 64 nt, hsa
ugggaaaaaucgugaugauggguaaggggaaaacuucccggaaggcaauggggcaaggaaaaag

SEQ ID NO: 678405 - RNA, 64 nt, hsa
ccggugccccaggggcggcuggcacagugcccccuucccggacggguggcaggcccuggagagg

SEQ ID NO: 678406 - RNA, 64 nt, hsa
ucccacucccucugccgcacgccgcccgucuauguucccggacuuuguccagugcagugcccuc

SEQ ID NO: 678407 - RNA, 64 nt, hsa
ucuuuggcaacuucuguauuaugcacgugaagccuucccggagccagcgagcauaugcugcaug

SEQ ID NO: 678408 - RNA, 64 nt, hsa
gguaaaaaaaaaaaaaaaaaucauacagcucuucuucccggaacgccccugcaccucugcuccg

SEQ ID NO: 678409 - RNA, 64 nt, hsa
gucugcucccgucuggcugccagacguccuucucuucccggauaagaagcagaggaccuuccag

SEQ ID NO: 678410 - RNA, 64 nt, hsa
uacugcucagaauuuggagggagggagcaguaccuucccggaguccacgcaugugaguuggguc

SEQ ID NO: 678411 - RNA, 59 nt, hsa
ccugccgccggaaaagaugaagcuggcccuucccggagucaccccgaugauuacucuuu

SEQ ID NO: 678412 - RNA, 64 nt, hsa
auuacugguuuuguaacuuguucugguaauguccuucccggacucuuuuuaaaugucucccccu

SEQ ID NO: 678413 - RNA, 64 nt, hsa
cggucacagccaguccagaggccaguugccugccuucccggaccccuccccggguuggcucucc

SEQ ID NO: 678414 - RNA, 64 nt, hsa
cugcguccucagcgggcugagcugccagagagucuucccggaccuauucccguccuaugcauuc

SEQ ID NO: 678415 - RNA, 64 nt, hsa
cgccuggguccaaugcucaggugcuggggccugguucccggagaagugugccuucucucucccu

SEQ ID NO: 678416 - RNA, 64 nt, hsa
auuuguaaucuuuuaccacuuugggguugcuuuuuucccggaauucaucagaacuuugaauuuu

SEQ ID NO: 678417 - RNA, 64 nt, hsa
ugaguccugagacacuuagcuucccucucccucauucccggacccuuccaccccacugggccca

SEQ ID NO: 678418 - RNA, 64 nt, hsa
ccaacaaggcaaggucaccugccucuuucccuuguucccggauggggcauucaucauugugcug

SEQ ID NO: 678419 - RNA, 64 nt, hsa
ugaaauacaggagcagaguacagucuguugugguuucccggauuccgcgccuagcucagccaau

SEQ ID NO: 678420 - RNA, 64 nt, hsa
cugaccacacucccuacucagggcuagucuguucuucccggacaucuucugguagccgugcagg

SEQ ID NO: 678421 - RNA, 64 nt, hsa
acgggaaccugagacagcuccagcuucgcagcccuucccggagcuacagggggauccucuagca

SEQ ID NO: 678422 - RNA, 64 nt, hsa
agaggccugaggagcccagagcacuugacugagcuucccggaaacuggcccuaaccugucuguc

SEQ ID NO: 678423 - RNA, 64 nt, hsa
caccccuccaguuuugccugagaaggggcagauguucccggagcagaagacgucuccccuucuc

SEQ ID NO: 678424 - RNA, 64 nt, hsa
ugugaaaccugggagaccagaguccccuuuaggguucccggagcuccgggaagacccgcccauc

SEQ ID NO: 678425 - RNA, 64 nt, hsa
cuuaucuuggauguuuuagauugaaacagccugauucccggaagaauccucuucauucauugcu

SEQ ID NO: 678426 - RNA, 64 nt, hsa
cccucucaggagagugugcaacuggccagccaauuucccggagccaucacccucacccacucug

SEQ ID NO: 678427 - RNA, 64 nt, hsa
cucugccgaggcugcuggaaucgacuggggcaucuucccggaaucagauucaaaggugaggagg

SEQ ID NO: 678428 - RNA, 64 nt, hsa
acauuucccugugcugacggaagccaacuuggcuuucccggacugcaagcagggcucugcccca

SEQ ID NO: 678429 - RNA, 64 nt, hsa
ugcugagggaggaccucaguuaaccaauuaccuuuucccggauuccagggaauucauacuguga

SEQ ID NO: 678430 - RNA, 64 nt, hsa
ccucuccccugccugcccuggugacaucagguuuuucccggacuuagaaaaccagcucagcacu

SEQ ID NO: 678431 - RNA, 64 nt, hsa
gcaucgcugacccccacgccgagggcuugccguuuucccggaggacguggacuuuugugagaca

SEQ ID NO: 678432 - RNA, 64 nt, hsa
cuggcccuguggccaggaggcgagaagguggcuguucccggauugacggcuuuuucccgggggc

SEQ ID NO: 678433 - RNA, 64 nt, hsa
agggacgcuguuugguucuaugugguuggucuguuucccggacaagaaaaauugcaaucaaaug

SEQ ID NO: 678434 - RNA, 64 nt, hsa
aggccccgacccuguugugacccaccugggcaccuucccggaccagcuccgccuccccugcccu

SEQ ID NO: 678435 - RNA, 64 nt, hsa
ccccgcuggagaggcaccaugggcguggaggggcuucccggacaccgcccacccgggacccgcc

SEQ ID NO: 678436 - RNA, 64 nt, hsa
ugguuuguaauggaaccuuuucugugccccuaucuucccggagaccacgcuucuccuccgugcc

SEQ ID NO: 678437 - RNA, 64 nt, hsa
acucugaggagggcaagggacaguuccauggcccuucccggacugcacuaggcugggagcucug

SEQ ID NO: 678438 - RNA, 64 nt, hsa
cagggagccgccgugaugagcacagccaacccaguucccggagggcuggggcggugcaggcucu

SEQ ID NO: 678439 - RNA, 64 nt, hsa
gaagcagugacacucccgucgcucggugaggacguucccggacagugccucacucaccugggac

SEQ ID NO: 678440 - RNA, 64 nt, hsa
acccaggggacgcgcuggaaagcaaacaggaagauucccggagggaaacugugaaugcuucuga

SEQ ID NO: 678441 - RNA, 64 nt, hsa
gggcccugaccagccccggcaccugccaugcugguucccggaaugaaucagcugcugacugucu

SEQ ID NO: 678442 - RNA, 64 nt, hsa
cugcagcgcgagggcuccggcgaccagaggauucuucccggaaggcauuccugccgcgcucccc

SEQ ID NO: 678443 - RNA, 64 nt, hsa
ccccacacccuugauccgccccgcaggcagguacuucccggagcgagcggggaacgcgacguac

SEQ ID NO: 678444 - RNA, 64 nt, hsa
auccaggcuuaccugcuuggucuagaauggauuuuucccggagccggaagccaggaggaaacua

SEQ ID NO: 678445 - RNA, 64 nt, hsa
ugcucugugccaucggcuccuuguuggucugaguuucccggaugagcucuggguguuugugagu

SEQ ID NO: 678446 - RNA, 61 nt, hsa; identical to SEQ ID NO: 286917

SEQ ID NO: 678447 - RNA, 64 nt, hsa; identical to SEQ ID NO: 286918

SEQ ID NO: 678448 - RNA, 64 nt, hsa; identical to SEQ ID NO: 286919

SEQ ID NO: 678449 - RNA, 64 nt, hsa; identical to SEQ ID NO: 286920

SEQ ID NO: 678450 - RNA, 64 nt, hsa; identical to SEQ ID NO: 286921

SEQ ID NO: 678451 - RNA, 64 nt, hsa; identical to SEQ ID NO: 286922

SEQ ID NO: 678452 - RNA, 64 nt, hsa; identical to SEQ ID NO: 286923

SEQ ID NO: 678453 - RNA, 64 nt, hsa; identical to SEQ ID NO: 286924

SEQ ID NO: 678454 - RNA, 64 nt, hsa; identical to SEQ ID NO: 286925

SEQ ID NO: 678455 - RNA, 64 nt, hsa; identical to SEQ ID NO: 286926

SEQ ID NO: 678456 - RNA, 64 nt, hsa; identical to SEQ ID NO: 286927

SEQ ID NO: 678457 - RNA, 64 nt, hsa; identical to SEQ ID NO: 286928

SEQ ID NO: 678458 - RNA, 64 nt, hsa; identical to SEQ ID NO: 286929

SEQ ID NO: 678459 - RNA, 64 nt, hsa; identical to SEQ ID NO: 286930

SEQ ID NO: 678460 - RNA, 64 nt, hsa; identical to SEQ ID NO: 286931

SEQ ID NO: 678461 - RNA, 64 nt, hsa; identical to SEQ ID NO: 286932

SEQ ID NO: 678462 - RNA, 64 nt, hsa; identical to SEQ ID NO: 286933

SEQ ID NO: 678463 - RNA, 64 nt, hsa; identical to SEQ ID NO: 286934

SEQ ID NO: 678464 - RNA, 64 nt, hsa; identical to SEQ ID NO: 286935

SEQ ID NO: 678465 - RNA, 64 nt, hsa; identical to SEQ ID NO: 286936

SEQ ID NO: 678466 - RNA, 64 nt, hsa; identical to SEQ ID NO: 286937

SEQ ID NO: 678467 - RNA, 64 nt, hsa; identical to SEQ ID NO: 286938

SEQ ID NO: 678468 - RNA, 64 nt, hsa; identical to SEQ ID NO: 286939

SEQ ID NO: 678469 - RNA, 64 nt, hsa; identical to SEQ ID NO: 286940

SEQ ID NO: 678470 - RNA, 64 nt, hsa; identical to SEQ ID NO: 286941

SEQ ID NO: 678471 - RNA, 64 nt, hsa; identical to SEQ ID NO: 286942

SEQ ID NO: 678472 - RNA, 64 nt, hsa; identical to SEQ ID NO: 286943

SEQ ID NO: 678473 - RNA, 64 nt, hsa; identical to SEQ ID NO: 286944

SEQ ID NO: 678474 - RNA, 64 nt, hsa; identical to SEQ ID NO: 286945

SEQ ID NO: 678475 - RNA, 64 nt, hsa; identical to SEQ ID NO: 286946

SEQ ID NO: 678476 - RNA, 64 nt, hsa; identical to SEQ ID NO: 286947

SEQ ID NO: 678477 - RNA, 64 nt, hsa; identical to SEQ ID NO: 286948

SEQ ID NO: 678478 - RNA, 64 nt, hsa; identical to SEQ ID NO: 286949

SEQ ID NO: 678479 - RNA, 64 nt, hsa; identical to SEQ ID NO: 286950

SEQ ID NO: 678480 - RNA, 64 nt, hsa; identical to SEQ ID NO: 286951

SEQ ID NO: 678481 - RNA, 64 nt, hsa; identical to SEQ ID NO: 286952

SEQ ID NO: 678482 - RNA, 64 nt, hsa; identical to SEQ ID NO: 286953

SEQ ID NO: 678483 - RNA, 64 nt, hsa; identical to SEQ ID NO: 286954

SEQ ID NO: 678484 - RNA, 64 nt, hsa; identical to SEQ ID NO: 286955

SEQ ID NO: 678485 - RNA, 64 nt, hsa; identical to SEQ ID NO: 286956

SEQ ID NO: 678486 - RNA, 64 nt, hsa; identical to SEQ ID NO: 286957

SEQ ID NO: 678487 - RNA, 64 nt, hsa; identical to SEQ ID NO: 286958

SEQ ID NO: 678488 - RNA, 64 nt, hsa; identical to SEQ ID NO: 286959

SEQ ID NO: 678489 - RNA, 64 nt, hsa; identical to SEQ ID NO: 286960

SEQ ID NO: 678490 - RNA, 64 nt, hsa; identical to SEQ ID NO: 286961

SEQ ID NO: 678491 - RNA, 64 nt, hsa; identical to SEQ ID NO: 286962

SEQ ID NO: 678492 - RNA, 64 nt, hsa; identical to SEQ ID NO: 286963

SEQ ID NO: 678493 - RNA, 64 nt, hsa; identical to SEQ ID NO: 286964

SEQ ID NO: 678494 - RNA, 64 nt, hsa; identical to SEQ ID NO: 286965

SEQ ID NO: 678495 - RNA, 64 nt, hsa; identical to SEQ ID NO: 286966

SEQ ID NO: 678496 - RNA, 64 nt, hsa; identical to SEQ ID NO: 286967

SEQ ID NO: 678497 - RNA, 64 nt, hsa; identical to SEQ ID NO: 286968

SEQ ID NO: 678498 - RNA, 64 nt, hsa; identical to SEQ ID NO: 286969

SEQ ID NO: 678499 - RNA, 64 nt, hsa; identical to SEQ ID NO: 286970

SEQ ID NO: 678500 - RNA, 64 nt, hsa; identical to SEQ ID NO: 286971

SEQ ID NO: 678501 - RNA, 64 nt, hsa; identical to SEQ ID NO: 286972

SEQ ID NO: 678502 - RNA, 64 nt, hsa; identical to SEQ ID NO: 286973

SEQ ID NO: 678503 - RNA, 64 nt, hsa; identical to SEQ ID NO: 286974

SEQ ID NO: 678504 - RNA, 64 nt, hsa; identical to SEQ ID NO: 286975

SEQ ID NO: 678505 - RNA, 64 nt, hsa; identical to SEQ ID NO: 286976

SEQ ID NO: 678506 - RNA, 64 nt, hsa; identical to SEQ ID NO: 286977

SEQ ID NO: 678507 - RNA, 64 nt, hsa; identical to SEQ ID NO: 286978

SEQ ID NO: 678508 - RNA, 64 nt, hsa; identical to SEQ ID NO: 286979

SEQ ID NO: 678509 - RNA, 64 nt, hsa; identical to SEQ ID NO: 286980

SEQ ID NO: 678510 - RNA, 64 nt, hsa; identical to SEQ ID NO: 286981

SEQ ID NO: 678511 - RNA, 64 nt, hsa; identical to SEQ ID NO: 286982

SEQ ID NO: 678512 - RNA, 64 nt, hsa; identical to SEQ ID NO: 286983

SEQ ID NO: 678513 - RNA, 64 nt, hsa; identical to SEQ ID NO: 286984

SEQ ID NO: 678514 - RNA, 64 nt, hsa; identical to SEQ ID NO: 286985

SEQ ID NO: 678515 - RNA, 64 nt, hsa; identical to SEQ ID NO: 286986

SEQ ID NO: 678516 - RNA, 64 nt, hsa; identical to SEQ ID NO: 286987

SEQ ID NO: 678517 - RNA, 64 nt, hsa; identical to SEQ ID NO: 286988

SEQ ID NO: 678518 - RNA, 64 nt, hsa; identical to SEQ ID NO: 286989

SEQ ID NO: 678519 - RNA, 64 nt, hsa; identical to SEQ ID NO: 286990

SEQ ID NO: 678520 - RNA, 64 nt, hsa
agggcagacgccgugugucuguuucacggauuccguuggugaaccuguaaaaacaaaacaaaca

SEQ ID NO: 678521 - RNA, 64 nt, hsa
aggcccuuaaaugacagccugcauuugcuagacgguuggugaguggcaucaaaugugugacuua

SEQ ID NO: 678522 - RNA, 64 nt, hsa
aucacaucagaguggcugagggcaguugcucuguguuggugaaauugcuguggggguaucgggg

SEQ ID NO: 678523 - RNA, 64 nt, hsa
agccuuccugucaacagcgacaggaaaucucuagguuggugagugcuggugaugugagccuaca

SEQ ID NO: 678524 - RNA, 64 nt, hsa
ucauuuuacaaagcaguuuucugaauggggauuaguuggugauuguuuguaacaaauaugcuaa

SEQ ID NO: 678525 - RNA, 64 nt, hsa
uuauuacugccacaucuccaugcaucagcaaaauguuggugacauuuuucuagccuggcagaac

SEQ ID NO: 678526 - RNA, 64 nt, hsa
ccgaaucugacuuuggugacaguccuaaagcacaguuggugauugugagaucuguuagcggcag

SEQ ID NO: 678527 - RNA, 64 nt, hsa
ccccaucugggauuccugggcccuuuggaaaagaguuggugaaaugcgcagccggcuguggacg

SEQ ID NO: 678528 - RNA, 64 nt, hsa
gcagaacuuaucucaggaaaggaaaauaugcaugguuggugagaaucuaauaacauuaaaaugc

SEQ ID NO: 678529 - RNA, 64 nt, hsa
uuuuaggcauagaacuacagacauuucugaaaagguuggugaugaagaacuucagucuucugag

SEQ ID NO: 678530 - RNA, 64 nt, hsa
uuaauaucaucuaaaaauaaagcauugaagugaaguuggugaaaauuuguuccuggucuaauuu

SEQ ID NO: 678531 - RNA, 64 nt, hsa
cuucacauuuuuuccaccacacccaccaguagcuguuggugauugcauggugucucggugcaug

SEQ ID NO: 678532 - RNA, 64 nt, hsa; identical to SEQ ID NO: 189531

SEQ ID NO: 678533 - RNA, 64 nt, hsa; identical to SEQ ID NO: 189532

SEQ ID NO: 678534 - RNA, 64 nt, hsa; identical to SEQ ID NO: 189533

SEQ ID NO: 678535 - RNA, 64 nt, hsa; identical to SEQ ID NO: 189534

SEQ ID NO: 678536 - RNA, 64 nt, hsa; identical to SEQ ID NO: 189535

SEQ ID NO: 678537 - RNA, 64 nt, hsa; identical to SEQ ID NO: 189536

SEQ ID NO: 678538 - RNA, 64 nt, hsa; identical to SEQ ID NO: 189537

SEQ ID NO: 678539 - RNA, 64 nt, hsa; identical to SEQ ID NO: 189538

SEQ ID NO: 678540 - RNA, 64 nt, hsa; identical to SEQ ID NO: 189539

SEQ ID NO: 678541 - RNA, 64 nt, hsa; identical to SEQ ID NO: 189540

SEQ ID NO: 678542 - RNA, 64 nt, hsa; identical to SEQ ID NO: 189541

SEQ ID NO: 678543 - RNA, 64 nt, hsa; identical to SEQ ID NO: 189542

SEQ ID NO: 678544 - RNA, 64 nt, hsa; identical to SEQ ID NO: 189543

SEQ ID NO: 678545 - RNA, 64 nt, hsa; identical to SEQ ID NO: 189544

SEQ ID NO: 678546 - RNA, 64 nt, hsa; identical to SEQ ID NO: 189545

SEQ ID NO: 678547 - RNA, 64 nt, hsa; identical to SEQ ID NO: 189546

SEQ ID NO: 678548 - RNA, 64 nt, hsa; identical to SEQ ID NO: 189547

SEQ ID NO: 678549 - RNA, 64 nt, hsa; identical to SEQ ID NO: 189548

SEQ ID NO: 678550 - RNA, 64 nt, hsa; identical to SEQ ID NO: 189549

SEQ ID NO: 678551 - RNA, 64 nt, hsa; identical to SEQ ID NO: 189550

SEQ ID NO: 678552 - RNA, 64 nt, hsa; identical to SEQ ID NO: 189551

SEQ ID NO: 678553 - RNA, 64 nt, hsa; identical to SEQ ID NO: 189552

SEQ ID NO: 678554 - RNA, 64 nt, hsa; identical to SEQ ID NO: 189553

SEQ ID NO: 678555 - RNA, 64 nt, hsa; identical to SEQ ID NO: 189554

SEQ ID NO: 678556 - RNA, 64 nt, hsa; identical to SEQ ID NO: 189555

SEQ ID NO: 678557 - RNA, 64 nt, hsa; identical to SEQ ID NO: 189556

SEQ ID NO: 678558 - RNA, 64 nt, hsa; identical to SEQ ID NO: 189557

SEQ ID NO: 678559 - RNA, 64 nt, hsa; identical to SEQ ID NO: 189558

SEQ ID NO: 678560 - RNA, 64 nt, hsa; identical to SEQ ID NO: 189559

SEQ ID NO: 678561 - RNA, 53 nt, hsa; identical to SEQ ID NO: 189560

SEQ ID NO: 678562 - RNA, 64 nt, hsa; identical to SEQ ID NO: 189561

SEQ ID NO: 678563 - RNA, 64 nt, hsa; identical to SEQ ID NO: 189562

SEQ ID NO: 678564 - RNA, 63 nt, hsa; identical to SEQ ID NO: 189563

SEQ ID NO: 678565 - RNA, 64 nt, hsa; identical to SEQ ID NO: 189564

SEQ ID NO: 678566 - RNA, 64 nt, hsa; identical to SEQ ID NO: 189565

SEQ ID NO: 678567 - RNA, 64 nt, hsa; identical to SEQ ID NO: 189566

SEQ ID NO: 678568 - RNA, 64 nt, hsa; identical to SEQ ID NO: 189567

SEQ ID NO: 678569 - RNA, 64 nt, hsa; identical to SEQ ID NO: 189568

SEQ ID NO: 678570 - RNA, 64 nt, hsa; identical to SEQ ID NO: 189569

SEQ ID NO: 678571 - RNA, 64 nt, hsa; identical to SEQ ID NO: 189570

SEQ ID NO: 678572 - RNA, 64 nt, hsa; identical to SEQ ID NO: 189571

SEQ ID NO: 678573 - RNA, 64 nt, hsa; identical to SEQ ID NO: 189572

SEQ ID NO: 678574 - RNA, 64 nt, hsa; identical to SEQ ID NO: 189573

SEQ ID NO: 678575 - RNA, 64 nt, hsa; identical to SEQ ID NO: 189574

SEQ ID NO: 678576 - RNA, 64 nt, hsa; identical to SEQ ID NO: 189575

SEQ ID NO: 678577 - RNA, 64 nt, hsa; identical to SEQ ID NO: 189576

SEQ ID NO: 678578 - RNA, 64 nt, hsa; identical to SEQ ID NO: 189577

SEQ ID NO: 678579 - RNA, 64 nt, hsa; identical to SEQ ID NO: 189578

SEQ ID NO: 678580 - RNA, 64 nt, hsa; identical to SEQ ID NO: 189579

SEQ ID NO: 678581 - RNA, 64 nt, hsa; identical to SEQ ID NO: 189580

SEQ ID NO: 678582 - RNA, 64 nt, hsa; identical to SEQ ID NO: 189581

SEQ ID NO: 678583 - RNA, 64 nt, hsa; identical to SEQ ID NO: 189582

SEQ ID NO: 678584 - RNA, 64 nt, hsa; identical to SEQ ID NO: 189583

SEQ ID NO: 678585 - RNA, 64 nt, hsa; identical to SEQ ID NO: 189584

SEQ ID NO: 678586 - RNA, 64 nt, hsa; identical to SEQ ID NO: 189585

SEQ ID NO: 678587 - RNA, 64 nt, hsa; identical to SEQ ID NO: 189586

SEQ ID NO: 678588 - RNA, 64 nt, hsa; identical to SEQ ID NO: 189587

SEQ ID NO: 678589 - RNA, 64 nt, hsa; identical to SEQ ID NO: 189588

SEQ ID NO: 678590 - RNA, 64 nt, hsa; identical to SEQ ID NO: 189589

SEQ ID NO: 678591 - RNA, 64 nt, hsa; identical to SEQ ID NO: 189590

SEQ ID NO: 678592 - RNA, 64 nt, hsa; identical to SEQ ID NO: 189591

SEQ ID NO: 678593 - RNA, 64 nt, hsa; identical to SEQ ID NO: 189592

SEQ ID NO: 678594 - RNA, 64 nt, hsa; identical to SEQ ID NO: 189593

SEQ ID NO: 678595 - RNA, 64 nt, hsa; identical to SEQ ID NO: 189594

SEQ ID NO: 678596 - RNA, 64 nt, hsa; identical to SEQ ID NO: 189595

SEQ ID NO: 678597 - RNA, 64 nt, hsa; identical to SEQ ID NO: 189596

SEQ ID NO: 678598 - RNA, 64 nt, hsa; identical to SEQ ID NO: 189597

SEQ ID NO: 678599 - RNA, 64 nt, hsa; identical to SEQ ID NO: 189598

SEQ ID NO: 678600 - RNA, 64 nt, hsa; identical to SEQ ID NO: 94750

SEQ ID NO: 678601 - RNA, 64 nt, hsa; identical to SEQ ID NO: 94751

SEQ ID NO: 678602 - RNA, 64 nt, hsa; identical to SEQ ID NO: 94752

SEQ ID NO: 678603 - RNA, 64 nt, hsa; identical to SEQ ID NO: 94753

SEQ ID NO: 678604 - RNA, 64 nt, hsa; identical to SEQ ID NO: 94754

SEQ ID NO: 678605 - RNA, 64 nt, hsa; identical to SEQ ID NO: 94755

SEQ ID NO: 678606 - RNA, 64 nt, hsa; identical to SEQ ID NO: 94756

SEQ ID NO: 678607 - RNA, 64 nt, hsa; identical to SEQ ID NO: 94757

SEQ ID NO: 678608 - RNA, 64 nt, hsa; identical to SEQ ID NO: 94758

SEQ ID NO: 678609 - RNA, 64 nt, hsa; identical to SEQ ID NO: 94759

SEQ ID NO: 678610 - RNA, 64 nt, hsa; identical to SEQ ID NO: 94760

SEQ ID NO: 678611 - RNA, 64 nt, hsa; identical to SEQ ID NO: 94761

SEQ ID NO: 678612 - RNA, 64 nt, hsa; identical to SEQ ID NO: 94762

SEQ ID NO: 678613 - RNA, 64 nt, hsa; identical to SEQ ID NO: 94763

SEQ ID NO: 678614 - RNA, 64 nt, hsa; identical to SEQ ID NO: 94764

SEQ ID NO: 678615 - RNA, 64 nt, hsa; identical to SEQ ID NO: 94765

SEQ ID NO: 678616 - RNA, 64 nt, hsa; identical to SEQ ID NO: 94766

SEQ ID NO: 678617 - RNA, 64 nt, hsa; identical to SEQ ID NO: 94767

SEQ ID NO: 678618 - RNA, 64 nt, hsa; identical to SEQ ID NO: 94768

SEQ ID NO: 678619 - RNA, 64 nt, hsa; identical to SEQ ID NO: 94769

SEQ ID NO: 678620 - RNA, 64 nt, hsa; identical to SEQ ID NO: 94770

SEQ ID NO: 678621 - RNA, 64 nt, hsa; identical to SEQ ID NO: 94771

SEQ ID NO: 678622 - RNA, 64 nt, hsa; identical to SEQ ID NO: 94772

SEQ ID NO: 678623 - RNA, 64 nt, hsa; identical to SEQ ID NO: 94773

SEQ ID NO: 678624 - RNA, 64 nt, hsa; identical to SEQ ID NO: 94774

SEQ ID NO: 678625 - RNA, 64 nt, hsa; identical to SEQ ID NO: 94775

SEQ ID NO: 678626 - RNA, 64 nt, hsa; identical to SEQ ID NO: 94776

SEQ ID NO: 678627 - RNA, 64 nt, hsa; identical to SEQ ID NO: 94777

SEQ ID NO: 678628 - RNA, 64 nt, hsa; identical to SEQ ID NO: 94778

SEQ ID NO: 678629 - RNA, 64 nt, hsa; identical to SEQ ID NO: 94779

SEQ ID NO: 678630 - RNA, 64 nt, hsa; identical to SEQ ID NO: 94780

SEQ ID NO: 678631 - RNA, 64 nt, hsa; identical to SEQ ID NO: 94781

SEQ ID NO: 678632 - RNA, 64 nt, hsa; identical to SEQ ID NO: 94782

SEQ ID NO: 678633 - RNA, 64 nt, hsa; identical to SEQ ID NO: 94783

SEQ ID NO: 678634 - RNA, 64 nt, hsa; identical to SEQ ID NO: 94784

SEQ ID NO: 678635 - RNA, 64 nt, hsa; identical to SEQ ID NO: 94785

SEQ ID NO: 678636 - RNA, 64 nt, hsa; identical to SEQ ID NO: 94786

SEQ ID NO: 678637 - RNA, 64 nt, hsa; identical to SEQ ID NO: 94787

SEQ ID NO: 678638 - RNA, 64 nt, hsa; identical to SEQ ID NO: 94788

SEQ ID NO: 678639 - RNA, 64 nt, hsa; identical to SEQ ID NO: 94789

SEQ ID NO: 678640 - RNA, 64 nt, hsa; identical to SEQ ID NO: 94790

SEQ ID NO: 678641 - RNA, 64 nt, hsa; identical to SEQ ID NO: 94791

SEQ ID NO: 678642 - RNA, 64 nt, hsa; identical to SEQ ID NO: 94792

SEQ ID NO: 678643 - RNA, 64 nt, hsa; identical to SEQ ID NO: 94793

SEQ ID NO: 678644 - RNA, 64 nt, hsa; identical to SEQ ID NO: 94794

SEQ ID NO: 678645 - RNA, 64 nt, hsa; identical to SEQ ID NO: 94795

SEQ ID NO: 678646 - RNA, 64 nt, hsa; identical to SEQ ID NO: 94796

SEQ ID NO: 678647 - RNA, 64 nt, hsa; identical to SEQ ID NO: 94797

SEQ ID NO: 678648 - RNA, 64 nt, hsa; identical to SEQ ID NO: 94798

SEQ ID NO: 678649 - RNA, 64 nt, hsa; identical to SEQ ID NO: 94799

SEQ ID NO: 678650 - RNA, 64 nt, hsa; identical to SEQ ID NO: 94800

SEQ ID NO: 678651 - RNA, 64 nt, hsa; identical to SEQ ID NO: 94801

SEQ ID NO: 678652 - RNA, 64 nt, hsa; identical to SEQ ID NO: 94802

SEQ ID NO: 678653 - RNA, 64 nt, hsa; identical to SEQ ID NO: 94803

SEQ ID NO: 678654 - RNA, 64 nt, hsa; identical to SEQ ID NO: 94804

SEQ ID NO: 678655 - RNA, 64 nt, hsa; identical to SEQ ID NO: 94805

SEQ ID NO: 678656 - RNA, 64 nt, hsa; identical to SEQ ID NO: 94806

SEQ ID NO: 678657 - RNA, 64 nt, hsa; identical to SEQ ID NO: 94807

SEQ ID NO: 678658 - RNA, 64 nt, hsa; identical to SEQ ID NO: 94808

SEQ ID NO: 678659 - RNA, 64 nt, hsa; identical to SEQ ID NO: 94809

SEQ ID NO: 678660 - RNA, 64 nt, hsa; identical to SEQ ID NO: 94810

SEQ ID NO: 678661 - RNA, 64 nt, hsa; identical to SEQ ID NO: 94811

SEQ ID NO: 678662 - RNA, 64 nt, hsa; identical to SEQ ID NO: 94812

SEQ ID NO: 678663 - RNA, 64 nt, hsa; identical to SEQ ID NO: 94813

SEQ ID NO: 678664 - RNA, 64 nt, hsa; identical to SEQ ID NO: 94814

SEQ ID NO: 678665 - RNA, 64 nt, hsa; identical to SEQ ID NO: 94815

SEQ ID NO: 678666 - RNA, 64 nt, hsa; identical to SEQ ID NO: 94816

SEQ ID NO: 678667 - RNA, 64 nt, hsa; identical to SEQ ID NO: 94817

SEQ ID NO: 678668 - RNA, 64 nt, hsa; identical to SEQ ID NO: 94818

SEQ ID NO: 678669 - RNA, 64 nt, hsa; identical to SEQ ID NO: 94819

SEQ ID NO: 678670 - RNA, 64 nt, hsa; identical to SEQ ID NO: 94820

SEQ ID NO: 678671 - RNA, 64 nt, hsa; identical to SEQ ID NO: 94821

SEQ ID NO: 678672 - RNA, 64 nt, hsa; identical to SEQ ID NO: 94822

SEQ ID NO: 678673 - RNA, 64 nt, hsa; identical to SEQ ID NO: 94823

SEQ ID NO: 678674 - RNA, 64 nt, hsa; identical to SEQ ID NO: 94824

SEQ ID NO: 678675 - RNA, 64 nt, hsa; identical to SEQ ID NO: 94825

SEQ ID NO: 678676 - RNA, 64 nt, hsa; identical to SEQ ID NO: 94826

SEQ ID NO: 678677 - RNA, 64 nt, hsa; identical to SEQ ID NO: 94827

SEQ ID NO: 678678 - RNA, 64 nt, hsa; identical to SEQ ID NO: 94828

SEQ ID NO: 678679 - RNA, 64 nt, hsa; identical to SEQ ID NO: 94829

SEQ ID NO: 678680 - RNA, 64 nt, hsa; identical to SEQ ID NO: 94830

SEQ ID NO: 678681 - RNA, 64 nt, hsa; identical to SEQ ID NO: 94831

SEQ ID NO: 678682 - RNA, 64 nt, hsa; identical to SEQ ID NO: 94832

SEQ ID NO: 678683 - RNA, 64 nt, hsa; identical to SEQ ID NO: 94833

SEQ ID NO: 678684 - RNA, 64 nt, hsa; identical to SEQ ID NO: 94834

SEQ ID NO: 678685 - RNA, 64 nt, hsa; identical to SEQ ID NO: 94835

SEQ ID NO: 678686 - RNA, 64 nt, hsa
guuuuucuuauccaaguaaagaugucaauaggaauugcauuaguccaaggccuuuuucauaaac

SEQ ID NO: 678687 - RNA, 64 nt, hsa
uuuauuucuguaaaauuuguuuagaaguacguuuuugcauuauucauaugcuucccagagaagc

SEQ ID NO: 678688 - RNA, 64 nt, hsa
uauguagaagggcuguuaaaaauguaaaacuugguugcauuauuuguggaggcucaaacuugug

SEQ ID NO: 678689 - RNA, 64 nt, hsa
cagauucauguaaggacuaagugguccucaugaauugcauuaagacucuguacugcucauauua

SEQ ID NO: 678690 - RNA, 64 nt, hsa
gcaguauaaacacuagguauaauaggauuugaaauugcauuacaguucauaaaaauugaaaaug

SEQ ID NO: 678691 - RNA, 64 nt, hsa
uguuuauuuucugaguuucaacgcugaccuuuucuugcauuauuguuucauuuuaaugauagug

SEQ ID NO: 678692 - RNA, 64 nt, hsa
aucauagcaccaccuaucagcacugaaaacucuuuugcauuaagggaucauugcaagagcagcg

SEQ ID NO: 678693 - RNA, 64 nt, hsa
cagauuucauaauuuuuuucaaaguuuggaauauuugcauuauacuuaccaguugggcauccca

SEQ ID NO: 678694 - RNA, 64 nt, hsa
aucacaaaaugcagucgaauauauauaugaaaacuugcauuaggugauaaagugacuauuuuaa

SEQ ID NO: 678695 - RNA, 64 nt, hsa
cuaugaaauuguccagauguguucaggaacaugauugcauuagagcaaugacuguauuuuguug

SEQ ID NO: 678696 - RNA, 64 nt, hsa
caaaccgaaugugaaauaccagguaauaauuauuuugcauuaaacucuuuuuaucgggaauagu

SEQ ID NO: 678697 - RNA, 64 nt, hsa
cgagaaauacaacauuuaaaaaauuaagaguauuuugcauuagugauuaugauucuuaucccaa

SEQ ID NO: 678698 - RNA, 64 nt, hsa
aaauuauguaaauuauguaaauuaucaggcaaauuugcauuaaauuacagaaauuuaauucaga

SEQ ID NO: 678699 - RNA, 64 nt, hsa
gugaaagggagaagugacauugcaucaaagcaucuugcauuaugcaauuuuuauauuaaccaga

SEQ ID NO: 678700 - RNA, 64 nt, hsa
ugccgagugagaaggccacaguaucucaugcuguuugcauuacagaacugcagcuuuucuacuc

SEQ ID NO: 678701 - RNA, 64 nt, hsa
gaaaugugcuuuuuagagcuuccuaaugcauguguugcauuauugcagcauuagaaaaggagag

SEQ ID NO: 678702 - RNA, 64 nt, hsa
auuaagauuuuuaaacugaaguugaccauacagguugcauuagcccuaacuggcuucauguaag

SEQ ID NO: 678703 - RNA, 64 nt, hsa
agugccuggccugggaaagaaggggaagaaacaauugcauuauauccaaagauacacuauaaaa

SEQ ID NO: 678704 - RNA, 64 nt, hsa
uaaaguaccuguaucuagauuaaauuaaaauugguugcauuauuuucugaacuauaauaggguu

SEQ ID NO: 678705 - RNA, 64 nt, hsa
gugcuaaccugcuuuucucuuuuuguaaacguuuuugcauuacaggcugcauucuugccuuacu

SEQ ID NO: 678706 - RNA, 64 nt, hsa
cgccccccucaucuccacccucccccauaucuguuugcauuaggaguuccacgaccauggugga

SEQ ID NO: 678707 - RNA, 64 nt, hsa
aagauuggaacccagacuugcaguccagcgcuguuugcauuaaaagggugggugagucaggacc

SEQ ID NO: 678708 - RNA, 64 nt, hsa
guacacguagacagacacacauacacccaaauuauugcauuaagaauccuggagcagaccauag

SEQ ID NO: 678709 - RNA, 64 nt, hsa
uauuucaaaacacauuuaacuguuuucuaaugcuuugcauuaucaguuacaaccuagagagauu

SEQ ID NO: 678710 - RNA, 64 nt, hsa
aauuauauuguugaagcaauaaccuagccagcuguugcauuagcuaaagcagccucuugcaaug

SEQ ID NO: 678711 - RNA, 64 nt, hsa
gaguugcucuaaaauguuuggaaaagagcugcuuuugcauuaugaauuauauuguugaagcaau

SEQ ID NO: 678712 - RNA, 64 nt, hsa
aagugguagaagguccugaucuuggugguuacucuugcauuacuguguuaggucaagcagugcc

SEQ ID NO: 678713 - RNA, 64 nt, hsa
ucuucgaguaguuugauuugguuuaguaaccagauugcauuaugaaaugggccuuuuguaaaug

SEQ ID NO: 678714 - RNA, 64 nt, hsa
uguacacauauccaguuauauaauugcuuccuaguugcauuauauggcaaaugagauuuuguac

SEQ ID NO: 678715 - RNA, 64 nt, hsa
auauguguuuaaauauuauauuagcuuauuucucuugcauuaauaguacugcuguuuuuguuuu

SEQ ID NO: 678716 - RNA, 64 nt, hsa
gaguuaaauauauauuguuaaaggagaccuguagcagucaaagauuuuauugauuuaaugacaa

SEQ ID NO: 678717 - RNA, 64 nt, hsa
uucagagggccaggcaagagcacuucagaugaggcagucaaaaucauuuuuuuccagugaggau

SEQ ID NO: 678718 - RNA, 64 nt, hsa
gugugcuaggaacagccuucccuccguuuccccucagucaaacuugagccagccucuggaucga

SEQ ID NO: 678719 - RNA, 64 nt, hsa
uccuaaacauucuucagugaaaauaauuuuauuucagucaaacauuuaugaggaaaugagauca

SEQ ID NO: 678720 - RNA, 64 nt, hsa
aagcacaugaauguaaugaauguggaaaagcuuucagucaaaccucaugccuuauucagcauca

SEQ ID NO: 678721 - RNA, 64 nt, hsa
aauuccauugcugcaaugaaugugaaaaagccaucagucaaagaaacuaccuuguuuaguauca

SEQ ID NO: 678722 - RNA, 64 nt, hsa
uucuuuuguuuguuuugauuugcucuguuuuauucagucaaaucuagaguuugaauccucugcu

SEQ ID NO: 678723 - RNA, 64 nt, hsa
uguugaaaaaaaaaacuggcaaagugaaaagauacagucaaaaaucuagaauuucuuuaauuuu

SEQ ID NO: 678724 - RNA, 64 nt, hsa
auugcacagaaaugggaaauaacuaauuuuaaaucagucaaauuggcuucuuauuaaauacaau

SEQ ID NO: 678725 - RNA, 64 nt, hsa
cgccugcaucuagugcugcuucugcagaucaacacagucaaagcggcucuagcucugauaacac

SEQ ID NO: 678726 - RNA, 64 nt, hsa
acagcagguuacucagcaguuugugccuccuacacagucaaagaaagagaaaaaagauaaagua

SEQ ID NO: 678727 - RNA, 64 nt, hsa
gaaauugaagaguucuaaggcuuucaaaaacacucagucaaaaauuuaaaaucuuaaaugugua

SEQ ID NO: 678728 - RNA, 64 nt, hsa
acaaccccaucucuauucuuggcuucuguugaaacagucaaauaaauccacaaguuaaugccua

SEQ ID NO: 678729 - RNA, 64 nt, hsa; identical to SEQ ID NO: 340884

SEQ ID NO: 678730 - RNA, 64 nt, hsa; identical to SEQ ID NO: 340885

SEQ ID NO: 678731 - RNA, 64 nt, hsa
gggugucguuuucacauaugacaauguugcauuuaugaugcaguuucaaguaccaaaacguuga

SEQ ID NO: 678732 - RNA, 64 nt, hsa
augaugcaguuucaaguaccaaaacguugaauugaugaugcaguuuucauauaucgagauguuc

SEQ ID NO: 678733 - RNA, 64 nt, hsa
cacaccuaagcgucaucgucauugccauagcaucaugaugcaacacaucuacguguagcacuac

SEQ ID NO: 678734 - RNA, 64 nt, hsa
ucaggcuguuuccuaaaggaugugugaacgggagaugaugcacuguguuuugaaaguugucauu

SEQ ID NO: 678735 - RNA, 64 nt, hsa
cuccauuuccccucuucugagcuguguauucauguagagggauguauucagccuuuuuagugaa

SEQ ID NO: 678736 - RNA, 64 nt, hsa
ggggaguguuccagcugcugguaguggaucagcuuagagggaacacucccacagccaaaagaau

SEQ ID NO: 678737 - RNA, 64 nt, hsa
gagggggagaaaacuguacucuguccagacaugauagagggacagagccaaaaggauagagaaa

SEQ ID NO: 678738 - RNA, 64 nt, hsa
gaacaguugaggucugcaggaccucacaccucccuagagggagggagggagggcaggguggagg

SEQ ID NO: 678739 - RNA, 64 nt, hsa; identical to SEQ ID NO: 281104

SEQ ID NO: 678740 - RNA, 64 nt, hsa; identical to SEQ ID NO: 281105

SEQ ID NO: 678741 - RNA, 64 nt, hsa; identical to SEQ ID NO: 281106

SEQ ID NO: 678742 - RNA, 64 nt, hsa; identical to SEQ ID NO: 281107

SEQ ID NO: 678743 - RNA, 64 nt, hsa; identical to SEQ ID NO: 281108

SEQ ID NO: 678744 - RNA, 64 nt, hsa; identical to SEQ ID NO: 281109

SEQ ID NO: 678745 - RNA, 64 nt, hsa; identical to SEQ ID NO: 281110

SEQ ID NO: 678746 - RNA, 64 nt, hsa; identical to SEQ ID NO: 281111

SEQ ID NO: 678747 - RNA, 64 nt, hsa; identical to SEQ ID NO: 281112

SEQ ID NO: 678748 - RNA, 64 nt, hsa; identical to SEQ ID NO: 281113

SEQ ID NO: 678749 - RNA, 64 nt, hsa; identical to SEQ ID NO: 281114

SEQ ID NO: 678750 - RNA, 64 nt, hsa; identical to SEQ ID NO: 281115

SEQ ID NO: 678751 - RNA, 64 nt, hsa; identical to SEQ ID NO: 281116

SEQ ID NO: 678752 - RNA, 64 nt, hsa; identical to SEQ ID NO: 281117

SEQ ID NO: 678753 - RNA, 64 nt, hsa; identical to SEQ ID NO: 281118

SEQ ID NO: 678754 - RNA, 64 nt, hsa; identical to SEQ ID NO: 281119

SEQ ID NO: 678755 - RNA, 64 nt, hsa; identical to SEQ ID NO: 299842

SEQ ID NO: 678756 - RNA, 64 nt, hsa; identical to SEQ ID NO: 299843

SEQ ID NO: 678757 - RNA, 64 nt, hsa; identical to SEQ ID NO: 299844

SEQ ID NO: 678758 - RNA, 64 nt, hsa; identical to SEQ ID NO: 299845

SEQ ID NO: 678759 - RNA, 64 nt, hsa; identical to SEQ ID NO: 299846

SEQ ID NO: 678760 - RNA, 64 nt, hsa; identical to SEQ ID NO: 299847

SEQ ID NO: 678761 - RNA, 64 nt, hsa; identical to SEQ ID NO: 299848

SEQ ID NO: 678762 - RNA, 64 nt, hsa; identical to SEQ ID NO: 299849

SEQ ID NO: 678763 - RNA, 64 nt, hsa; identical to SEQ ID NO: 299850

SEQ ID NO: 678764 - RNA, 64 nt, hsa; identical to SEQ ID NO: 299851

SEQ ID NO: 678765 - RNA, 64 nt, hsa; identical to SEQ ID NO: 299852

SEQ ID NO: 678766 - RNA, 64 nt, hsa; identical to SEQ ID NO: 299853

SEQ ID NO: 678767 - RNA, 64 nt, hsa; identical to SEQ ID NO: 299854

SEQ ID NO: 678768 - RNA, 64 nt, hsa; identical to SEQ ID NO: 299855

SEQ ID NO: 678769 - RNA, 64 nt, hsa; identical to SEQ ID NO: 299856

SEQ ID NO: 678770 - RNA, 64 nt, hsa; identical to SEQ ID NO: 299857

SEQ ID NO: 678771 - RNA, 64 nt, hsa; identical to SEQ ID NO: 299858

SEQ ID NO: 678772 - RNA, 64 nt, hsa; identical to SEQ ID NO: 299859

SEQ ID NO: 678773 - RNA, 64 nt, hsa; identical to SEQ ID NO: 299860

SEQ ID NO: 678774 - RNA, 64 nt, hsa; identical to SEQ ID NO: 286003

SEQ ID NO: 678775 - RNA, 64 nt, hsa; identical to SEQ ID NO: 286004

SEQ ID NO: 678776 - RNA, 64 nt, hsa; identical to SEQ ID NO: 286005

SEQ ID NO: 678777 - RNA, 64 nt, hsa; identical to SEQ ID NO: 286006

SEQ ID NO: 678778 - RNA, 64 nt, hsa; identical to SEQ ID NO: 286007

SEQ ID NO: 678779 - RNA, 64 nt, hsa; identical to SEQ ID NO: 286008

SEQ ID NO: 678780 - RNA, 64 nt, hsa; identical to SEQ ID NO: 286009

SEQ ID NO: 678781 - RNA, 64 nt, hsa; identical to SEQ ID NO: 286010

SEQ ID NO: 678782 - RNA, 64 nt, hsa; identical to SEQ ID NO: 286011

SEQ ID NO: 678783 - RNA, 64 nt, hsa; identical to SEQ ID NO: 286012

SEQ ID NO: 678784 - RNA, 64 nt, hsa; identical to SEQ ID NO: 286013

SEQ ID NO: 678785 - RNA, 64 nt, hsa; identical to SEQ ID NO: 286014

SEQ ID NO: 678786 - RNA, 64 nt, hsa; identical to SEQ ID NO: 286015

SEQ ID NO: 678787 - RNA, 64 nt, hsa; identical to SEQ ID NO: 286016

SEQ ID NO: 678788 - RNA, 64 nt, hsa; identical to SEQ ID NO: 286017

SEQ ID NO: 678789 - RNA, 64 nt, hsa; identical to SEQ ID NO: 286018

SEQ ID NO: 678790 - RNA, 64 nt, hsa; identical to SEQ ID NO: 286019

SEQ ID NO: 678791 - RNA, 64 nt, hsa; identical to SEQ ID NO: 286020

SEQ ID NO: 678792 - RNA, 64 nt, hsa; identical to SEQ ID NO: 286021

SEQ ID NO: 678793 - RNA, 64 nt, hsa; identical to SEQ ID NO: 286022

SEQ ID NO: 678794 - RNA, 64 nt, hsa; identical to SEQ ID NO: 286023

SEQ ID NO: 678795 - RNA, 64 nt, hsa; identical to SEQ ID NO: 286024

SEQ ID NO: 678796 - RNA, 64 nt, hsa; identical to SEQ ID NO: 108245

SEQ ID NO: 678797 - RNA, 64 nt, hsa; identical to SEQ ID NO: 108246

SEQ ID NO: 678798 - RNA, 64 nt, hsa; identical to SEQ ID NO: 108247

SEQ ID NO: 678799 - RNA, 64 nt, hsa; identical to SEQ ID NO: 108248

SEQ ID NO: 678800 - RNA, 64 nt, hsa; identical to SEQ ID NO: 108249

SEQ ID NO: 678801 - RNA, 64 nt, hsa; identical to SEQ ID NO: 108250

SEQ ID NO: 678802 - RNA, 64 nt, hsa; identical to SEQ ID NO: 108251

SEQ ID NO: 678803 - RNA, 64 nt, hsa; identical to SEQ ID NO: 108252

SEQ ID NO: 678804 - RNA, 64 nt, hsa; identical to SEQ ID NO: 108253

SEQ ID NO: 678805 - RNA, 64 nt, hsa; identical to SEQ ID NO: 108254

SEQ ID NO: 678806 - RNA, 64 nt, hsa; identical to SEQ ID NO: 108255

SEQ ID NO: 678807 - RNA, 64 nt, hsa; identical to SEQ ID NO: 108256

SEQ ID NO: 678808 - RNA, 64 nt, hsa; identical to SEQ ID NO: 108257

SEQ ID NO: 678809 - RNA, 64 nt, hsa; identical to SEQ ID NO: 108258

SEQ ID NO: 678810 - RNA, 64 nt, hsa; identical to SEQ ID NO: 108259

SEQ ID NO: 678811 - RNA, 64 nt, hsa; identical to SEQ ID NO: 108260

SEQ ID NO: 678812 - RNA, 64 nt, hsa; identical to SEQ ID NO: 108261

SEQ ID NO: 678813 - RNA, 64 nt, hsa; identical to SEQ ID NO: 108262

SEQ ID NO: 678814 - RNA, 64 nt, hsa; identical to SEQ ID NO: 108263

SEQ ID NO: 678815 - RNA, 64 nt, hsa; identical to SEQ ID NO: 108264

SEQ ID NO: 678816 - RNA, 64 nt, hsa; identical to SEQ ID NO: 108265

SEQ ID NO: 678817 - RNA, 64 nt, hsa; identical to SEQ ID NO: 108266

SEQ ID NO: 678818 - RNA, 64 nt, hsa; identical to SEQ ID NO: 108267

SEQ ID NO: 678819 - RNA, 64 nt, hsa; identical to SEQ ID NO: 108268

SEQ ID NO: 678820 - RNA, 64 nt, hsa; identical to SEQ ID NO: 108269

SEQ ID NO: 678821 - RNA, 64 nt, hsa; identical to SEQ ID NO: 108270

SEQ ID NO: 678822 - RNA, 64 nt, hsa; identical to SEQ ID NO: 108271

SEQ ID NO: 678823 - RNA, 64 nt, hsa; identical to SEQ ID NO: 108272

SEQ ID NO: 678824 - RNA, 64 nt, hsa; identical to SEQ ID NO: 108273

SEQ ID NO: 678825 - RNA, 64 nt, hsa; identical to SEQ ID NO: 108274

SEQ ID NO: 678826 - RNA, 64 nt, hsa; identical to SEQ ID NO: 108275

SEQ ID NO: 678827 - RNA, 64 nt, hsa; identical to SEQ ID NO: 108276

SEQ ID NO: 678828 - RNA, 64 nt, hsa; identical to SEQ ID NO: 108277

SEQ ID NO: 678829 - RNA, 64 nt, hsa; identical to SEQ ID NO: 108278

SEQ ID NO: 678830 - RNA, 64 nt, hsa; identical to SEQ ID NO: 108279

SEQ ID NO: 678831 - RNA, 64 nt, hsa; identical to SEQ ID NO: 108280

SEQ ID NO: 678832 - RNA, 64 nt, hsa; identical to SEQ ID NO: 108281

SEQ ID NO: 678833 - RNA, 64 nt, hsa; identical to SEQ ID NO: 108282

SEQ ID NO: 678834 - RNA, 64 nt, hsa; identical to SEQ ID NO: 108283

SEQ ID NO: 678835 - RNA, 64 nt, hsa; identical to SEQ ID NO: 108284

SEQ ID NO: 678836 - RNA, 64 nt, hsa; identical to SEQ ID NO: 58517

SEQ ID NO: 678837 - RNA, 64 nt, hsa; identical to SEQ ID NO: 58518

SEQ ID NO: 678838 - RNA, 64 nt, hsa; identical to SEQ ID NO: 58519

SEQ ID NO: 678839 - RNA, 64 nt, hsa; identical to SEQ ID NO: 58520

SEQ ID NO: 678840 - RNA, 64 nt, hsa; identical to SEQ ID NO: 58521

SEQ ID NO: 678841 - RNA, 64 nt, hsa; identical to SEQ ID NO: 58522

SEQ ID NO: 678842 - RNA, 64 nt, hsa; identical to SEQ ID NO: 58523

SEQ ID NO: 678843 - RNA, 64 nt, hsa; identical to SEQ ID NO: 58524

SEQ ID NO: 678844 - RNA, 64 nt, hsa; identical to SEQ ID NO: 58525

SEQ ID NO: 678845 - RNA, 64 nt, hsa; identical to SEQ ID NO: 58526

SEQ ID NO: 678846 - RNA, 64 nt, hsa; identical to SEQ ID NO: 58527

SEQ ID NO: 678847 - RNA, 64 nt, hsa; identical to SEQ ID NO: 58528

SEQ ID NO: 678848 - RNA, 64 nt, hsa; identical to SEQ ID NO: 58529

SEQ ID NO: 678849 - RNA, 64 nt, hsa; identical to SEQ ID NO: 58530

SEQ ID NO: 678850 - RNA, 64 nt, hsa; identical to SEQ ID NO: 58531

SEQ ID NO: 678851 - RNA, 64 nt, hsa; identical to SEQ ID NO: 58532

SEQ ID NO: 678852 - RNA, 64 nt, hsa; identical to SEQ ID NO: 382264

SEQ ID NO: 678853 - RNA, 64 nt, hsa; identical to SEQ ID NO: 382265

SEQ ID NO: 678854 - RNA, 64 nt, hsa; identical to SEQ ID NO: 382266

SEQ ID NO: 678855 - RNA, 64 nt, hsa; identical to SEQ ID NO: 382267

SEQ ID NO: 678856 - RNA, 64 nt, hsa; identical to SEQ ID NO: 382268

SEQ ID NO: 678857 - RNA, 64 nt, hsa; identical to SEQ ID NO: 382269

SEQ ID NO: 678858 - RNA, 64 nt, hsa; identical to SEQ ID NO: 382270

SEQ ID NO: 678859 - RNA, 64 nt, hsa; identical to SEQ ID NO: 382271

SEQ ID NO: 678860 - RNA, 64 nt, hsa; identical to SEQ ID NO: 382272

SEQ ID NO: 678861 - RNA, 64 nt, hsa; identical to SEQ ID NO: 382273

SEQ ID NO: 678862 - RNA, 62 nt, hsa
guuggggcugaagacgagcaggggcaaccugccagcaucacagaauucaguguaguuuauac

SEQ ID NO: 678863 - RNA, 62 nt, hsa
caagggggcugcugaaaucgcagagacuuuugcagcaucagaucugaggaguaaaacggcac

SEQ ID NO: 678864 - RNA, 62 nt, hsa
cagagugggggcuccuuaagccuccaggccagcagcaucagcaucaccugggagauuguuag

SEQ ID NO: 678865 - RNA, 62 nt, hsa
gggggcuccuuaagccuccaggccagcagcaucagcaucaccugggagauuguuaggaaugc

SEQ ID NO: 678866 - RNA, 62 nt, hsa
aauccacacacaacucugagaauacccacugccagcaucaaaaagcaaagauacuaauuuuu

SEQ ID NO: 678867 - RNA, 62 nt, hsa
ugugcuuucuuuaccaacuggcuagaacggaacagcaucacagcaacgcugcggaucuuggu

SEQ ID NO: 678868 - RNA, 62 nt, hsa
guguccagacuuugaacuugccugccagccuucagcaucaggaaaggccaaguccugggugu

SEQ ID NO: 678869 - RNA, 62 nt, hsa
acauguuuucgaacacagaauagcucuuuucucagcaucauuauugcucuuucagcaucugu

SEQ ID NO: 678870 - RNA, 62 nt, hsa
uccccuggccguccugucaucccugugugcugcagcaucaccacggccuacuucccaauauc

SEQ ID NO: 678871 - RNA, 62 nt, hsa
gaaaguccgcuuguaaaagcacaagugagaggcagcaucaggccccuggagggcuguggucc

SEQ ID NO: 678872 - RNA, 62 nt, hsa
gaaaagacuucagauugaauucacaucuuauucagcaucaaagaauucacacaggagagaaa

SEQ ID NO: 678873 - RNA, 62 nt, hsa
gaaaagcuuucagucaaaccucaugccuuauucagcaucacaaaaugcauaggaaagagaaa

SEQ ID NO: 678874 - RNA, 62 nt, hsa
guaaagccuucagucauagcucagccauugcucagcaucagauaauucacaccagagagaaa

SEQ ID NO: 678875 - RNA, 62 nt, hsa
aaaaccauacacacacacacacacacacaaaucagcaucauaagggaauguagccuuccaac

SEQ ID NO: 678876 - RNA, 62 nt, hsa
gaacacacuugugaccuuaguacuuggucauccagcaucauacaggcaucuccaaguuagac

SEQ ID NO: 678877 - RNA, 62 nt, hsa
aucauacaggcaucuccaaguuagacucuaugcagcaucaucuuuugcagcauuccucugcu

SEQ ID NO: 678878 - RNA, 62 nt, hsa
cuggccugcagucagcaucauugugcaugugacagcaucaaugugauuaguaauuugucugu

SEQ ID NO: 678879 - RNA, 62 nt, hsa
agcccugagauggugacaggcuggccugcagucagcaucauugugcaugugacagcaucaau

SEQ ID NO: 678880 - RNA, 62 nt, hsa
agaguccccagaacucauguggccauuuccgccagcaucacuccccggugccuauggggucc

SEQ ID NO: 678881 - RNA, 62 nt, hsa
cacaaggggccucccaaaaaggagccccaccucagcaucacugccuuaaucguggccucccu

SEQ ID NO: 678882 - RNA, 62 nt, hsa
gccucauggaauggaaugucuccacuucacuccagcaucaacaaguggggaauucugaugga

SEQ ID NO: 678883 - RNA, 62 nt, hsa
caguuuauaccuugccuguaguccagucucuccagcaucaauuccaucagcacaaagacaua

SEQ ID NO: 678884 - RNA, 62 nt, hsa
gugaguuacccagggcuccagggagcccacagcagcaucagacccauccaggggcuacaggg

SEQ ID NO: 678885 - RNA, 62 nt, hsa
ucccacuguuaaggacucuguccaaagaaccucagcaucagcucccucaagcuuaaugaucc

SEQ ID NO: 678886 - RNA, 62 nt, hsa
cccuugguggcugcuggaaggggagagguucucagcaucaggccaccuccaccccaaugcca

SEQ ID NO: 678887 - RNA, 62 nt, hsa
uggauaaugggaggaaaaguugcugcuuccuucagcaucaaagccuuuccuugggaaucugc

SEQ ID NO: 678888 - RNA, 62 nt, hsa
uuaugugaugacuugaucgaggcaggcuuuuccagcaucacuguccugguuccaucucugcu

SEQ ID NO: 678889 - RNA, 62 nt, hsa
gccuuagaauucggaaguguuuuggaauccagcagcaucauaagauaaccaaacucguccuc

SEQ ID NO: 678890 - RNA, 64 nt, hsa
gaaaggucacagaaggaaaauaauauaauaaagugacaacuaugcaaaucacaucuugaugaga

SEQ ID NO: 678891 - RNA, 64 nt, hsa
aaggucacagaaggaaaauaauauuauauaaagugacaacuaugcaaaucacaucuugaugagg

SEQ ID NO: 678892 - RNA, 64 nt, hsa
gagccccuucugguccuggcuagggcaaauuuuagacaacuauuuucucuguaagugaagauug

SEQ ID NO: 678893 - RNA, 64 nt, hsa
agguaaauugcuuaaucauuuggccaaauaauuagacaacuauaagauuuuggauauauuauuu

SEQ ID NO: 678894 - RNA, 64 nt, hsa
agauuacaggcaugacccaccgcgucaagccucugacaacuauugaauuuguaagcugcuaugc

SEQ ID NO: 678895 - RNA, 64 nt, hsa
gacaucuguugaaauaagcucauaugguggaaacgacaacuauauuaugaauuauuuucagaaa

SEQ ID NO: 678896 - RNA, 64 nt, hsa
gaucagugccagaacugugcccaggcccaaaggagacaacuaacuaaaguagugagauagauuc

SEQ ID NO: 678897 - RNA, 64 nt, hsa
aauaaaacaaagggcacagcaucuguagucagccgacaacuauuucggccuuuugggggugggu

SEQ ID NO: 678898 - RNA, 64 nt, hsa
uuccuuuccuagagucaccuuuuagaugauaauggacaacuauagacuugcucauuguucagac

SEQ ID NO: 678899 - RNA, 64 nt, hsa
ucuuagccuagauugagcuuagauugccucucuagacaacuaccccuuaguuauaauucugugu

SEQ ID NO: 678900 - RNA, 64 nt, hsa
uucuacauuuucauuuggacuaaaucccacgaaugacaacuaccaccuuuuuuuccuuuuuaau

SEQ ID NO: 678901 - RNA, 64 nt, hsa
aauaaccuuuggacugcagguaaaaugcaauuaggacaacuaaccaaguagacgaaacaaguuc

SEQ ID NO: 678902 - RNA, 64 nt, hsa
auauauguaaacuuuuuuuguaagaaaaguuggugacaacuaaaccaacuuuuuccaaagugcg

SEQ ID NO: 678903 - RNA, 64 nt, hsa
uccuuggaggguaucagcagucucagugugaugugacaacuauggaccugugggugugcccugg

SEQ ID NO: 678904 - RNA, 64 nt, hsa
ugaaaccacugagcuauugggaacaagacuuagagacaacuauuugcguggauuuuuuuuuuuu

SEQ ID NO: 678905 - RNA, 64 nt, hsa
ugauaaauaguaacugagguaccagaugaaucaggacaacuaugcacucuuauaagagcauuua

SEQ ID NO: 678906 - RNA, 64 nt, hsa
ugccgcuuauucauugccuugauuuucuucaaaagacaacuauaaucauucaaaaauuccaagu

SEQ ID NO: 678907 - RNA, 64 nt, hsa
uaugccagagccuugcaggauggagcaccucugggacaacuaagagccaaggcccaccaaggag

SEQ ID NO: 678908 - RNA, 64 nt, hsa
ucucuucugcccccagccauauuuggggaggauggacaacuacaauagguaagaaaaugcagcc

SEQ ID NO: 678909 - RNA, 64 nt, hsa
caugggauuuuaucuguggauucagcuucuguuggacaacuagccucaucuccaguauccugcu

SEQ ID NO: 678910 - RNA, 64 nt, hsa
uuuucuuguuauuauucucuaaauaauacaguaugacaacuauuuccacagcauuuacauugua

SEQ ID NO: 678911 - RNA, 64 nt, hsa
ccuaaccuaagcaaaaccacugagcuucugggaagacaacuaggauacuuucuacuuuuucuag

SEQ ID NO: 678912 - RNA, 64 nt, hsa
ccaggcagggccagaauuacagaaaacaauucuggacaacuaaacuaccucggaucaagccacc

SEQ ID NO: 678913 - RNA, 64 nt, hsa
auuagcuuaguuuucucaugcuugauuaaaacaagacaacuaaagcuaaucauuccucuucuag

SEQ ID NO: 678914 - RNA, 64 nt, hsa
aguauuguucguucugauaugugaauuuguuugugacaacuaaacaaggcauucagcaguuucu

SEQ ID NO: 678915 - RNA, 64 nt, hsa
acuuaaugcagacauauaaaguaacauugagaaugacaacuaaaacauuccauuguuauggucc

SEQ ID NO: 678916 - RNA, 64 nt, hsa
augcauagcuugggcaauagcccuaaauugcuaugacaacuaaugaaccagcuacguauacugg

SEQ ID NO: 678917 - RNA, 64 nt, hsa
cucaguucaucugauuucuggucccuccuuucucgacaacuauaauacuaacccuuuucucagg

SEQ ID NO: 678918 - RNA, 64 nt, hsa
cuaacagaaauacaaggcuacgaacaguuuaguggacaacuaaaucagacucuugccuuugcac

SEQ ID NO: 678919 - RNA, 64 nt, hsa
gaagauuuaugguuaugggucuggcugggaagaagacaacuauaaauacauauucuuggguguc

SEQ ID NO: 678920 - RNA, 64 nt, hsa
acuccccaacucugccuguaucaccgguugaauggacaacuaacccgagcuggaccaacacaau

SEQ ID NO: 678921 - RNA, 64 nt, hsa
uaauaagcuggggaagugaggacuguccugcugggacaacuaagaagagagaauguggacucug

SEQ ID NO: 678922 - RNA, 64 nt, hsa
cuagcuuucaucaaaaaugggagcauggcuauaagacaacuauauuuuauuauauguuuucuga

SEQ ID NO: 678923 - RNA, 64 nt, hsa
aaggucacauugcuuacccaggugcucccuuuuggacaacuacaaaaaauuuuauuguaauauu

SEQ ID NO: 678924 - RNA, 62 nt, hsa
acucuucgaagagggauuaaaaggugcaaaaagacaacuaaaauacccauuuggaccaaaag

SEQ ID NO: 678925 - RNA, 64 nt, hsa
uucugcuguauaaaaaccaagagccagacaauuagacaacuauggaggaaugaaaggcaauuca

SEQ ID NO: 678926 - RNA, 64 nt, hsa
aaaagaggaggucagagugauccuguauaagaaagacaacuacuuuugaaggaaguuaaaaggu

SEQ ID NO: 678927 - RNA, 64 nt, hsa
cuugagcucagucaaucuggugcagaugaggcuggacaacuacuaaccaauaaaaucaggaguu

SEQ ID NO: 678928 - RNA, 64 nt, hsa
aaaaucaugaaaaucagcuguuuuauuugcauaggacaacuaaccugucuguguaacuuuguuu

SEQ ID NO: 678929 - RNA, 64 nt, hsa
ucuaacuugauuggaauuaggaaagugaaguccugacaacuagugguguguuagcccacaguuc

SEQ ID NO: 678930 - RNA, 64 nt, hsa
aaauguuucagauuaaaugauaguaaaaacaccugacaacuaaacauaguaaguaauacuagac

SEQ ID NO: 678931 - RNA, 64 nt, hsa
acgaggggcaucguuugaagaacagugccauuaagacaacuacagcccucauuagccuuucuug

SEQ ID NO: 678932 - RNA, 64 nt, hsa
agaagacuguuuuuaguagcuuauugugaaguaagacaacuauaaugaaugucugucuuguuug

SEQ ID NO: 678933 - RNA, 64 nt, hsa
ucaaaaguuaauuaaugacugccucugaaaccuugacaacuaauucagauuuuuuagcaauaac

SEQ ID NO: 678934 - RNA, 64 nt, hsa
cagaucuccaaaauggaagcuaaaugguggacuugacaacuauucacccuaccucagaucauag

SEQ ID NO: 678935 - RNA, 64 nt, hsa
cagcgagcuccguguagaccugguggacuuugaggacaacuaccaguuugcuaaguacagauca

SEQ ID NO: 678936 - RNA, 64 nt, hsa
aacaaugugugcucuguaugguuuuuuuugguaugacaacuaauuaagcaacugacauggaacu

SEQ ID NO: 678937 - RNA, 64 nt, hsa
auaccaaaacaacaaaauuauaaagcuguauuuggacaacuaaaaaacaccaaacuaucucauu

SEQ ID NO: 678938 - RNA, 64 nt, hsa
uuuucugaucaugaaacugauuguaaagcuuuuugacaacuaauaaaugucuugguaauugcua

SEQ ID NO: 678939 - RNA, 64 nt, hsa
cuagccucaccgaggugccggagagggagcgcuggacaacuagaauguugaccucgagccgagg

SEQ ID NO: 678940 - RNA, 64 nt, hsa
gacaaguauuuucaaugacugaaauauagcuucugacaacuaugcagaggcauuuuagagacau

SEQ ID NO: 678941 - RNA, 64 nt, hsa
uauagaugccagccaccuccugguagucacuauggacaacuaaugagaugcaaagucuuuugga

SEQ ID NO: 678942 - RNA, 64 nt, hsa
aaaaauuuaagaaaauuacagauuauauauuauagacaacuaaauauuuaagacuuuaagacuu

SEQ ID NO: 678943 - RNA, 64 nt, hsa
aacauucaguaauacgcuauuucuccaacaucaagacaacuaaaacaaaugauaaaaauguuua

SEQ ID NO: 678944 - RNA, 64 nt, hsa
agaacaagcuuuauuuuauuacgaguauauuaaugacaacuaauuccuguuccaauucuaccug

SEQ ID NO: 678945 - RNA, 64 nt, hsa
aaucauguggcaucuauguauaauaaaagaaagagacaacuauauuacucaauuucauauacau

SEQ ID NO: 678946 - RNA, 64 nt, hsa
guguaaauauaugucugauaaugauuugcucuuugacaacuaaaauuaggacuguauaaguacu

SEQ ID NO: 678947 - RNA, 64 nt, hsa
uagcccaaacucugcuucuaugguagggcaugaggacaacuauucagcaugguuuuagcuucuu

SEQ ID NO: 678948 - RNA, 64 nt, hsa
uugucuguuaaaugaacuugauagcuaauaaaaagacaacuagccaucaaaaucauauguuucu

SEQ ID NO: 678949 - RNA, 64 nt, hsa
aagaggggugagaaaacaaagaaggggaaaaacugacaacuaacaaaaccagcaccacaucgcu

SEQ ID NO: 678950 - RNA, 64 nt, hsa
ccuccuucccaaacccucuugggaacuccucagggacaacuacugcugaguuugggugcacccu

SEQ ID NO: 678951 - RNA, 64 nt, hsa
aagacaauuuauuguuuaaaaaaaaaauuggcaagacaacuauaugguuaagaauuuccaguau

SEQ ID NO: 678952 - RNA, 64 nt, hsa
uguauuuaucacuaaaaaguacaugaacuuaagagacaacuaagccuuucguguuuuuccacag

SEQ ID NO: 678953 - RNA, 64 nt, hsa
guagaagauuucacacacacacgcgugugugggagacaacuaaagguauugaagguacuaauua

SEQ ID NO: 678954 - RNA, 64 nt, hsa
gaagaugcauaagaaaugcccaagucacucagaggacaacuacccauauuccagacucugagcu

SEQ ID NO: 678955 - RNA, 64 nt, hsa
aaaaaagaguguguugauggcaguuccaaugaaggacaacuaauuuauaacuuguucuauauug

SEQ ID NO: 678956 - RNA, 64 nt, hsa
cagcauauugucacuuaggucaaaccaauaaagugacaacuaauguuaauaagaucucaguugc

SEQ ID NO: 678957 - RNA, 64 nt, hsa
aaacaauauaacuuucuugagugcaaaggugcuagacaacuaggagcccagcugggauuggugu

SEQ ID NO: 678958 - RNA, 64 nt, hsa
uauuuuuguuaauauuaaaaagucuguauggcaugacaacuacuuuaaggggaagauaagauuu

SEQ ID NO: 678959 - RNA, 64 nt, hsa
uugauguuuuugcauucuuugaguucaguuuaaagacaacuacgagcaucuguaaccaaucuga

SEQ ID NO: 678960 - RNA, 64 nt, hsa
aagaugaucuagcucccgguagaggaucaccggugacaacuauagcaguuguauuguguaacaa

SEQ ID NO: 678961 - RNA, 64 nt, hsa
ugacccagagcaaagcuuucccuaugguuccaaagacaacuaguauucaacaaaccuuguauag

SEQ ID NO: 678962 - RNA, 64 nt, hsa
aaaaagguggauuauuuaauaaacagcacuuuuagacaacuagcuaucaaagcuagaucucagc

SEQ ID NO: 678963 - RNA, 64 nt, hsa; identical to SEQ ID NO: 678959

SEQ ID NO: 678964 - RNA, 64 nt, hsa
gaucacuugagcccaggaguuuuagacuagccuggacaacuaagugagacuccaucucuacaaa

SEQ ID NO: 678965 - RNA, 64 nt, hsa
ucaccauuuuggucagaagcauacauuccugucagacaacuaguugucugacagaaauguuagg

SEQ ID NO: 678966 - RNA, 64 nt, hsa
ugaggguuuacugugaagugcugaggacaguguugacaacuaacucguuuuccuagauggaaac

SEQ ID NO: 678967 - RNA, 64 nt, hsa
ugcugugagugcgccucaccagaaccaguuaagagacaacuaucaauucuugagacccaaauua

SEQ ID NO: 678968 - RNA, 64 nt, hsa
aucacuguggccucacuugaccuagucauggcaggacaacuagugguuaguuacuaacuggacu

SEQ ID NO: 678969 - RNA, 64 nt, hsa
gauaggggaaauggugaagcaauggaaaagaacagacaacuaaugauuugcuucuauguccaga

SEQ ID NO: 678970 - RNA, 64 nt, hsa
cagggcccagcaguguuccuccaucagcauguuagacaacuacacaguauguuguuaguuuuga

SEQ ID NO: 678971 - RNA, 64 nt, hsa
ucugugguugccaccugccaucuccaagcauuuggacaacuagcccugaugcauuaggcugcaa

SEQ ID NO: 678972 - RNA, 64 nt, hsa
gaacuuuucuuagucuuuggguaaaggugaacaagacaacuacaguuccugccuuugcugagac

SEQ ID NO: 678973 - RNA, 64 nt, hsa
cucaugcaucaguucauagcauaaaaucuagcuggacaacuaagaagcuaugguagcaaacagu

SEQ ID NO: 678974 - RNA, 64 nt, hsa
ccugaaucccuucugggaaguaauaaugaccauugacaacuaagaaguagacaccaugcuaaag

SEQ ID NO: 678975 - RNA, 64 nt, hsa
ccaacaugaugcaguuaucuugcauacaacugaagacaacuaacccuuuccccaacagagccca

SEQ ID NO: 678976 - RNA, 64 nt, hsa
ccucuuccccuggaagcugcacaucacgcagaaggacaacuacagggucuacaacacgaugcca

SEQ ID NO: 678977 - RNA, 64 nt, hsa
acaggucuucuuuccugccagagggagcucugaagacaacuagagaauucugggccugaaauuu

SEQ ID NO: 678978 - RNA, 64 nt, hsa
uuugaaagccccagaaaucaguguuggccaugaugacaacuacagaaaaaccagaggcagcuuc

SEQ ID NO: 678979 - RNA, 64 nt, hsa
uauccuggugccuaagaaacuucugccucccacagacaacuaagugcuuauucaaagacuaggu

SEQ ID NO: 678980 - RNA, 64 nt, hsa
uuacccaugggacaacagagcuccuucauuuuuggacaacuacuguaaucauuuuuuuuuuagg

SEQ ID NO: 678981 - RNA, 64 nt, hsa
uuuuuuuucuguaaucauagcccauaauggcaaagacaacuaaauuuaagugaaggucaugcau

SEQ ID NO: 678982 - RNA, 64 nt, hsa
gguaaugaguagugcuguucauauuacuuuaguucuauagcauacuugcaucuuuaacaugcua

SEQ ID NO: 678983 - RNA, 64 nt, hsa
acuagcccagaacaguuuaaugguacuuacugagcuauagcauagcugcuuaguuguuuuugag

SEQ ID NO: 678984 - RNA, 64 nt, hsa
uauuucuuuguuuggguauuagcucuauuuugaucuauagcacaguuuuguaauucagaucauc

SEQ ID NO: 678985 - RNA, 64 nt, hsa
auucucuguuauaaaggggcaacuccaucugguccuauagcaucuuuacuacugauuuuuuuuu

SEQ ID NO: 678986 - RNA, 64 nt, hsa
gaucuagcucccgguagaggaucaccggugacaacuauagcaguuguauuguguaacaaguacu

SEQ ID NO: 678987 - RNA, 64 nt, hsa
uuuuuuuaaaccaucguuaauauacugaagugagcuauagcacauaucaugugcuuaguuuguu

SEQ ID NO: 678988 - RNA, 64 nt, hsa
gauccucccaccucugccucccaaguaacugggacuauagcaugccaccacacccagcugauua

SEQ ID NO: 678989 - RNA, 64 nt, hsa
gauccucccacuucugccucccaaguaacugggacuauagcaugccaccacacccagcugauua

SEQ ID NO: 678990 - RNA, 64 nt, hsa
uaagucugauguucuuuccaugaaucauuguggugguugagauggagcuuuguaaugggaauaa

SEQ ID NO: 678991 - RNA, 64 nt, hsa
agaauuauccagacaaaaauaucaauggugcugagguugagaaaaccugacuuaaggggcuggg

SEQ ID NO: 678992 - RNA, 64 nt, hsa
gucaaagguacgggccagcuugugccuaauagaagguugagaccagcagagacugcugugaguu

SEQ ID NO: 678993 - RNA, 64 nt, hsa
cgcaaaucugagguuucccguugguuguuaauuugguugagauaaacauuccuuuuuaaggaaa

SEQ ID NO: 678994 - RNA, 64 nt, hsa
aggagaacaguaucuugguuaauugcuacugaaagguugagaaaggaaugguuugauauuuacc

SEQ ID NO: 678995 - RNA, 64 nt, hsa
uguuccugcugccaguucuuuccucuuuaggcgugguugagaaaaagcagaaacuuuacauaaa

SEQ ID NO: 678996 - RNA, 64 nt, hsa
aggguugccaacccauuuguaugacuucaacaacgucaaggagggcauuuagaauuuagaaucu

SEQ ID NO: 678997 - RNA, 64 nt, hsa
uuuuaacuugcuauucacaaucaggacaaccaaagucaaggacccagaugaaccacaaggcagc

SEQ ID NO: 678998 - RNA, 64 nt, hsa
ucugcucaauuaaagauguuugaauccaaaggaagucaaggaagaaaaagcauggaaaggaaga

SEQ ID NO: 678999 - RNA, 64 nt, hsa
gaaagguuuggaugacugaaauauuuccucuacagucaaggacuuuggcaugugguggcugaaa

SEQ ID NO: 679000 - RNA, 64 nt, hsa
uccggaggaccacaucuuucaagacuucugaugggucaaggaaaaagaugccaacauacccgua

SEQ ID NO: 679001 - RNA, 64 nt, hsa
ugcuaccauacuuacuucaaacccaaugacuacugucaaggacauauuuucaguacauaaauac

SEQ ID NO: 679002 - RNA, 63 nt, hsa; identical to SEQ ID NO: 530191

SEQ ID NO: 679003 - RNA, 64 nt, hsa; identical to SEQ ID NO: 530192

SEQ ID NO: 679004 - RNA, 64 nt, hsa; identical to SEQ ID NO: 530193

SEQ ID NO: 679005 - RNA, 64 nt, hsa; identical to SEQ ID NO: 530194

SEQ ID NO: 679006 - RNA, 64 nt, hsa; identical to SEQ ID NO: 530195

SEQ ID NO: 679007 - RNA, 64 nt, hsa; identical to SEQ ID NO: 530196

SEQ ID NO: 679008 - RNA, 64 nt, hsa; identical to SEQ ID NO: 530197

SEQ ID NO: 679009 - RNA, 64 nt, hsa; identical to SEQ ID NO: 530198

SEQ ID NO: 679010 - RNA, 64 nt, hsa; identical to SEQ ID NO: 530199

SEQ ID NO: 679011 - RNA, 64 nt, hsa; identical to SEQ ID NO: 530200

SEQ ID NO: 679012 - RNA, 64 nt, hsa; identical to SEQ ID NO: 530201

SEQ ID NO: 679013 - RNA, 64 nt, hsa; identical to SEQ ID NO: 530202

SEQ ID NO: 679014 - RNA, 64 nt, hsa; identical to SEQ ID NO: 530203

SEQ ID NO: 679015 - RNA, 64 nt, hsa; identical to SEQ ID NO: 530204

SEQ ID NO: 679016 - RNA, 64 nt, hsa; identical to SEQ ID NO: 530205

SEQ ID NO: 679017 - RNA, 64 nt, hsa; identical to SEQ ID NO: 530206

SEQ ID NO: 679018 - RNA, 64 nt, hsa; identical to SEQ ID NO: 530207

SEQ ID NO: 679019 - RNA, 64 nt, hsa; identical to SEQ ID NO: 530208

SEQ ID NO: 679020 - RNA, 64 nt, hsa; identical to SEQ ID NO: 530209

SEQ ID NO: 679021 - RNA, 64 nt, hsa; identical to SEQ ID NO: 530210

SEQ ID NO: 679022 - RNA, 64 nt, hsa; identical to SEQ ID NO: 530211

SEQ ID NO: 679023 - RNA, 64 nt, hsa; identical to SEQ ID NO: 530212

SEQ ID NO: 679024 - RNA, 64 nt, hsa; identical to SEQ ID NO: 530213

SEQ ID NO: 679025 - RNA, 64 nt, hsa; identical to SEQ ID NO: 530214

SEQ ID NO: 679026 - RNA, 64 nt, hsa; identical to SEQ ID NO: 530215

SEQ ID NO: 679027 - RNA, 64 nt, hsa; identical to SEQ ID NO: 530216

SEQ ID NO: 679028 - RNA, 64 nt, hsa; identical to SEQ ID NO: 530217

SEQ ID NO: 679029 - RNA, 64 nt, hsa; identical to SEQ ID NO: 530218

SEQ ID NO: 679030 - RNA, 64 nt, hsa; identical to SEQ ID NO: 530219

SEQ ID NO: 679031 - RNA, 64 nt, hsa; identical to SEQ ID NO: 530220

SEQ ID NO: 679032 - RNA, 64 nt, hsa; identical to SEQ ID NO: 530221

SEQ ID NO: 679033 - RNA, 63 nt, hsa; identical to SEQ ID NO: 530222

SEQ ID NO: 679034 - RNA, 64 nt, hsa; identical to SEQ ID NO: 530223

SEQ ID NO: 679035 - RNA, 64 nt, hsa; identical to SEQ ID NO: 530224

SEQ ID NO: 679036 - RNA, 64 nt, hsa; identical to SEQ ID NO: 530225

SEQ ID NO: 679037 - RNA, 64 nt, hsa; identical to SEQ ID NO: 530226

SEQ ID NO: 679038 - RNA, 64 nt, hsa; identical to SEQ ID NO: 530227

SEQ ID NO: 679039 - RNA, 64 nt, hsa; identical to SEQ ID NO: 530228

SEQ ID NO: 679040 - RNA, 64 nt, hsa; identical to SEQ ID NO: 530229

SEQ ID NO: 679041 - RNA, 64 nt, hsa; identical to SEQ ID NO: 530230

SEQ ID NO: 679042 - RNA, 64 nt, hsa; identical to SEQ ID NO: 530231

SEQ ID NO: 679043 - RNA, 64 nt, hsa; identical to SEQ ID NO: 530232

SEQ ID NO: 679044 - RNA, 64 nt, hsa; identical to SEQ ID NO: 530233

SEQ ID NO: 679045 - RNA, 64 nt, hsa; identical to SEQ ID NO: 530234

SEQ ID NO: 679046 - RNA, 64 nt, hsa; identical to SEQ ID NO: 530235

SEQ ID NO: 679047 - RNA, 64 nt, hsa; identical to SEQ ID NO: 530236

SEQ ID NO: 679048 - RNA, 64 nt, hsa; identical to SEQ ID NO: 530237

SEQ ID NO: 679049 - RNA, 64 nt, hsa; identical to SEQ ID NO: 530238

SEQ ID NO: 679050 - RNA, 64 nt, hsa; identical to SEQ ID NO: 530239

SEQ ID NO: 679051 - RNA, 64 nt, hsa; identical to SEQ ID NO: 530240

SEQ ID NO: 679052 - RNA, 64 nt, hsa; identical to SEQ ID NO: 530241

SEQ ID NO: 679053 - RNA, 64 nt, hsa; identical to SEQ ID NO: 530242

SEQ ID NO: 679054 - RNA, 64 nt, hsa; identical to SEQ ID NO: 530243

SEQ ID NO: 679055 - RNA, 64 nt, hsa; identical to SEQ ID NO: 530244

SEQ ID NO: 679056 - RNA, 64 nt, hsa; identical to SEQ ID NO: 530245

SEQ ID NO: 679057 - RNA, 64 nt, hsa; identical to SEQ ID NO: 530246

SEQ ID NO: 679058 - RNA, 64 nt, hsa; identical to SEQ ID NO: 530247

SEQ ID NO: 679059 - RNA, 64 nt, hsa; identical to SEQ ID NO: 530248

SEQ ID NO: 679060 - RNA, 64 nt, hsa; identical to SEQ ID NO: 530249

SEQ ID NO: 679061 - RNA, 64 nt, hsa; identical to SEQ ID NO: 530250

SEQ ID NO: 679062 - RNA, 64 nt, hsa; identical to SEQ ID NO: 530251

SEQ ID NO: 679063 - RNA, 64 nt, hsa; identical to SEQ ID NO: 530252

SEQ ID NO: 679064 - RNA, 64 nt, hsa; identical to SEQ ID NO: 530253

SEQ ID NO: 679065 - RNA, 64 nt, hsa; identical to SEQ ID NO: 530254

SEQ ID NO: 679066 - RNA, 64 nt, hsa; identical to SEQ ID NO: 530255

SEQ ID NO: 679067 - RNA, 64 nt, hsa; identical to SEQ ID NO: 530256

SEQ ID NO: 679068 - RNA, 64 nt, hsa; identical to SEQ ID NO: 530257

SEQ ID NO: 679069 - RNA, 64 nt, hsa; identical to SEQ ID NO: 530258

SEQ ID NO: 679070 - RNA, 64 nt, hsa; identical to SEQ ID NO: 530259

SEQ ID NO: 679071 - RNA, 64 nt, hsa; identical to SEQ ID NO: 530260

SEQ ID NO: 679072 - RNA, 64 nt, hsa; identical to SEQ ID NO: 530261

SEQ ID NO: 679073 - RNA, 64 nt, hsa; identical to SEQ ID NO: 530262

SEQ ID NO: 679074 - RNA, 64 nt, hsa; identical to SEQ ID NO: 530263

SEQ ID NO: 679075 - RNA, 64 nt, hsa; identical to SEQ ID NO: 530264

SEQ ID NO: 679076 - RNA, 64 nt, hsa; identical to SEQ ID NO: 530265

SEQ ID NO: 679077 - RNA, 64 nt, hsa; identical to SEQ ID NO: 530266

SEQ ID NO: 679078 - RNA, 64 nt, hsa; identical to SEQ ID NO: 530267

SEQ ID NO: 679079 - RNA, 64 nt, hsa; identical to SEQ ID NO: 530268

SEQ ID NO: 679080 - RNA, 64 nt, hsa; identical to SEQ ID NO: 530269

SEQ ID NO: 679081 - RNA, 64 nt, hsa; identical to SEQ ID NO: 530270

SEQ ID NO: 679082 - RNA, 64 nt, hsa; identical to SEQ ID NO: 530271

SEQ ID NO: 679083 - RNA, 64 nt, hsa; identical to SEQ ID NO: 530272

SEQ ID NO: 679084 - RNA, 64 nt, hsa; identical to SEQ ID NO: 530273

SEQ ID NO: 679085 - RNA, 64 nt, hsa; identical to SEQ ID NO: 530274

SEQ ID NO: 679086 - RNA, 64 nt, hsa; identical to SEQ ID NO: 530275

SEQ ID NO: 679087 - RNA, 64 nt, hsa; identical to SEQ ID NO: 530276

SEQ ID NO: 679088 - RNA, 64 nt, hsa; identical to SEQ ID NO: 530277

SEQ ID NO: 679089 - RNA, 64 nt, hsa; identical to SEQ ID NO: 530278

SEQ ID NO: 679090 - RNA, 64 nt, hsa; identical to SEQ ID NO: 530279

SEQ ID NO: 679091 - RNA, 64 nt, hsa; identical to SEQ ID NO: 530280

SEQ ID NO: 679092 - RNA, 64 nt, hsa; identical to SEQ ID NO: 530281

SEQ ID NO: 679093 - RNA, 64 nt, hsa; identical to SEQ ID NO: 530282

SEQ ID NO: 679094 - RNA, 64 nt, hsa; identical to SEQ ID NO: 530283

SEQ ID NO: 679095 - RNA, 64 nt, hsa; identical to SEQ ID NO: 530284

SEQ ID NO: 679096 - RNA, 64 nt, hsa; identical to SEQ ID NO: 530285

SEQ ID NO: 679097 - RNA, 64 nt, hsa; identical to SEQ ID NO: 530286

SEQ ID NO: 679098 - RNA, 64 nt, hsa; identical to SEQ ID NO: 530287

SEQ ID NO: 679099 - RNA, 64 nt, hsa; identical to SEQ ID NO: 530288

SEQ ID NO: 679100 - RNA, 64 nt, hsa; identical to SEQ ID NO: 530289

SEQ ID NO: 679101 - RNA, 64 nt, hsa; identical to SEQ ID NO: 530290

SEQ ID NO: 679102 - RNA, 64 nt, hsa; identical to SEQ ID NO: 530291

SEQ ID NO: 679103 - RNA, 64 nt, hsa; identical to SEQ ID NO: 530292

SEQ ID NO: 679104 - RNA, 64 nt, hsa; identical to SEQ ID NO: 530293

SEQ ID NO: 679105 - RNA, 64 nt, hsa; identical to SEQ ID NO: 530294

SEQ ID NO: 679106 - RNA, 64 nt, hsa; identical to SEQ ID NO: 530295

SEQ ID NO: 679107 - RNA, 64 nt, hsa; identical to SEQ ID NO: 530296

SEQ ID NO: 679108 - RNA, 64 nt, hsa; identical to SEQ ID NO: 530297

SEQ ID NO: 679109 - RNA, 64 nt, hsa; identical to SEQ ID NO: 530298

SEQ ID NO: 679110 - RNA, 64 nt, hsa; identical to SEQ ID NO: 530299

SEQ ID NO: 679111 - RNA, 64 nt, hsa; identical to SEQ ID NO: 530300

SEQ ID NO: 679112 - RNA, 64 nt, hsa; identical to SEQ ID NO: 530301

SEQ ID NO: 679113 - RNA, 64 nt, hsa; identical to SEQ ID NO: 530302

SEQ ID NO: 679114 - RNA, 64 nt, hsa; identical to SEQ ID NO: 530303

SEQ ID NO: 679115 - RNA, 64 nt, hsa; identical to SEQ ID NO: 530304

SEQ ID NO: 679116 - RNA, 64 nt, hsa; identical to SEQ ID NO: 530305

SEQ ID NO: 679117 - RNA, 64 nt, hsa; identical to SEQ ID NO: 530306

SEQ ID NO: 679118 - RNA, 64 nt, hsa; identical to SEQ ID NO: 530307

SEQ ID NO: 679119 - RNA, 64 nt, hsa; identical to SEQ ID NO: 530308

SEQ ID NO: 679120 - RNA, 64 nt, hsa; identical to SEQ ID NO: 530309

SEQ ID NO: 679121 - RNA, 64 nt, hsa; identical to SEQ ID NO: 530310

SEQ ID NO: 679122 - RNA, 64 nt, hsa; identical to SEQ ID NO: 530311

SEQ ID NO: 679123 - RNA, 64 nt, hsa; identical to SEQ ID NO: 530312

SEQ ID NO: 679124 - RNA, 64 nt, hsa; identical to SEQ ID NO: 530313

SEQ ID NO: 679125 - RNA, 64 nt, hsa; identical to SEQ ID NO: 530314

SEQ ID NO: 679126 - RNA, 64 nt, hsa; identical to SEQ ID NO: 530315

SEQ ID NO: 679127 - RNA, 64 nt, hsa; identical to SEQ ID NO: 530316

SEQ ID NO: 679128 - RNA, 64 nt, hsa; identical to SEQ ID NO: 530317

SEQ ID NO: 679129 - RNA, 64 nt, hsa; identical to SEQ ID NO: 530318

SEQ ID NO: 679130 - RNA, 64 nt, hsa; identical to SEQ ID NO: 530319

SEQ ID NO: 679131 - RNA, 64 nt, hsa; identical to SEQ ID NO: 530320

SEQ ID NO: 679132 - RNA, 64 nt, hsa; identical to SEQ ID NO: 530321

SEQ ID NO: 679133 - RNA, 64 nt, hsa; identical to SEQ ID NO: 530322

SEQ ID NO: 679134 - RNA, 64 nt, hsa; identical to SEQ ID NO: 530323

SEQ ID NO: 679135 - RNA, 64 nt, hsa; identical to SEQ ID NO: 530324

SEQ ID NO: 679136 - RNA, 64 nt, hsa; identical to SEQ ID NO: 530325

SEQ ID NO: 679137 - RNA, 64 nt, hsa; identical to SEQ ID NO: 530326

SEQ ID NO: 679138 - RNA, 64 nt, hsa; identical to SEQ ID NO: 530327

SEQ ID NO: 679139 - RNA, 64 nt, hsa; identical to SEQ ID NO: 530328

SEQ ID NO: 679140 - RNA, 64 nt, hsa; identical to SEQ ID NO: 530329

SEQ ID NO: 679141 - RNA, 64 nt, hsa; identical to SEQ ID NO: 530330

SEQ ID NO: 679142 - RNA, 64 nt, hsa; identical to SEQ ID NO: 530331

SEQ ID NO: 679143 - RNA, 64 nt, hsa; identical to SEQ ID NO: 530332

SEQ ID NO: 679144 - RNA, 64 nt, hsa; identical to SEQ ID NO: 530333

SEQ ID NO: 679145 - RNA, 64 nt, hsa; identical to SEQ ID NO: 530334

SEQ ID NO: 679146 - RNA, 64 nt, hsa; identical to SEQ ID NO: 530335

SEQ ID NO: 679147 - RNA, 64 nt, hsa; identical to SEQ ID NO: 530336

SEQ ID NO: 679148 - RNA, 64 nt, hsa; identical to SEQ ID NO: 530337

SEQ ID NO: 679149 - RNA, 64 nt, hsa; identical to SEQ ID NO: 530338

SEQ ID NO: 679150 - RNA, 64 nt, hsa; identical to SEQ ID NO: 530339

SEQ ID NO: 679151 - RNA, 64 nt, hsa; identical to SEQ ID NO: 530340

SEQ ID NO: 679152 - RNA, 64 nt, hsa; identical to SEQ ID NO: 530341

SEQ ID NO: 679153 - RNA, 64 nt, hsa; identical to SEQ ID NO: 530342

SEQ ID NO: 679154 - RNA, 64 nt, hsa; identical to SEQ ID NO: 530343

SEQ ID NO: 679155 - RNA, 64 nt, hsa; identical to SEQ ID NO: 530344

SEQ ID NO: 679156 - RNA, 64 nt, hsa; identical to SEQ ID NO: 530345

SEQ ID NO: 679157 - RNA, 64 nt, hsa; identical to SEQ ID NO: 82929

SEQ ID NO: 679158 - RNA, 64 nt, hsa; identical to SEQ ID NO: 82930

SEQ ID NO: 679159 - RNA, 64 nt, hsa; identical to SEQ ID NO: 82931

SEQ ID NO: 679160 - RNA, 64 nt, hsa; identical to SEQ ID NO: 82932

SEQ ID NO: 679161 - RNA, 64 nt, hsa; identical to SEQ ID NO: 82933

SEQ ID NO: 679162 - RNA, 64 nt, hsa; identical to SEQ ID NO: 82934

SEQ ID NO: 679163 - RNA, 64 nt, hsa; identical to SEQ ID NO: 82935

SEQ ID NO: 679164 - RNA, 64 nt, hsa; identical to SEQ ID NO: 82936

SEQ ID NO: 679165 - RNA, 64 nt, hsa; identical to SEQ ID NO: 82937

SEQ ID NO: 679166 - RNA, 64 nt, hsa; identical to SEQ ID NO: 82938

SEQ ID NO: 679167 - RNA, 64 nt, hsa; identical to SEQ ID NO: 82939

SEQ ID NO: 679168 - RNA, 64 nt, hsa; identical to SEQ ID NO: 82940

SEQ ID NO: 679169 - RNA, 64 nt, hsa; identical to SEQ ID NO: 82941

SEQ ID NO: 679170 - RNA, 64 nt, hsa; identical to SEQ ID NO: 82942

SEQ ID NO: 679171 - RNA, 64 nt, hsa; identical to SEQ ID NO: 82943

SEQ ID NO: 679172 - RNA, 64 nt, hsa; identical to SEQ ID NO: 82944

SEQ ID NO: 679173 - RNA, 64 nt, hsa; identical to SEQ ID NO: 82945

SEQ ID NO: 679174 - RNA, 64 nt, hsa; identical to SEQ ID NO: 82946

SEQ ID NO: 679175 - RNA, 64 nt, hsa; identical to SEQ ID NO: 82947

SEQ ID NO: 679176 - RNA, 64 nt, hsa; identical to SEQ ID NO: 82948

SEQ ID NO: 679177 - RNA, 64 nt, hsa; identical to SEQ ID NO: 82949

SEQ ID NO: 679178 - RNA, 64 nt, hsa; identical to SEQ ID NO: 82950

SEQ ID NO: 679179 - RNA, 64 nt, hsa; identical to SEQ ID NO: 82951

SEQ ID NO: 679180 - RNA, 64 nt, hsa; identical to SEQ ID NO: 82952

SEQ ID NO: 679181 - RNA, 64 nt, hsa; identical to SEQ ID NO: 82953

SEQ ID NO: 679182 - RNA, 64 nt, hsa; identical to SEQ ID NO: 82954

SEQ ID NO: 679183 - RNA, 64 nt, hsa; identical to SEQ ID NO: 82955

SEQ ID NO: 679184 - RNA, 64 nt, hsa; identical to SEQ ID NO: 82956

SEQ ID NO: 679185 - RNA, 64 nt, hsa; identical to SEQ ID NO: 82957

SEQ ID NO: 679186 - RNA, 64 nt, hsa; identical to SEQ ID NO: 82958

SEQ ID NO: 679187 - RNA, 64 nt, hsa; identical to SEQ ID NO: 82959

SEQ ID NO: 679188 - RNA, 64 nt, hsa; identical to SEQ ID NO: 82960

SEQ ID NO: 679189 - RNA, 64 nt, hsa; identical to SEQ ID NO: 82961

SEQ ID NO: 679190 - RNA, 64 nt, hsa; identical to SEQ ID NO: 82962

SEQ ID NO: 679191 - RNA, 64 nt, hsa; identical to SEQ ID NO: 82963

SEQ ID NO: 679192 - RNA, 64 nt, hsa; identical to SEQ ID NO: 82964

SEQ ID NO: 679193 - RNA, 64 nt, hsa; identical to SEQ ID NO: 82965

SEQ ID NO: 679194 - RNA, 64 nt, hsa; identical to SEQ ID NO: 82966

SEQ ID NO: 679195 - RNA, 64 nt, hsa; identical to SEQ ID NO: 82967

SEQ ID NO: 679196 - RNA, 64 nt, hsa; identical to SEQ ID NO: 82968

SEQ ID NO: 679197 - RNA, 64 nt, hsa; identical to SEQ ID NO: 82969

SEQ ID NO: 679198 - RNA, 64 nt, hsa; identical to SEQ ID NO: 82970

SEQ ID NO: 679199 - RNA, 64 nt, hsa; identical to SEQ ID NO: 82971

SEQ ID NO: 679200 - RNA, 64 nt, hsa; identical to SEQ ID NO: 82972

SEQ ID NO: 679201 - RNA, 64 nt, hsa; identical to SEQ ID NO: 82973

SEQ ID NO: 679202 - RNA, 64 nt, hsa; identical to SEQ ID NO: 82974

SEQ ID NO: 679203 - RNA, 64 nt, hsa; identical to SEQ ID NO: 82975

SEQ ID NO: 679204 - RNA, 64 nt, hsa; identical to SEQ ID NO: 82976

SEQ ID NO: 679205 - RNA, 64 nt, hsa; identical to SEQ ID NO: 82977

SEQ ID NO: 679206 - RNA, 64 nt, hsa; identical to SEQ ID NO: 82978

SEQ ID NO: 679207 - RNA, 64 nt, hsa; identical to SEQ ID NO: 82979

SEQ ID NO: 679208 - RNA, 64 nt, hsa; identical to SEQ ID NO: 82980

SEQ ID NO: 679209 - RNA, 64 nt, hsa; identical to SEQ ID NO: 82981

SEQ ID NO: 679210 - RNA, 64 nt, hsa; identical to SEQ ID NO: 82982

SEQ ID NO: 679211 - RNA, 64 nt, hsa
agcuuccaaggcacuuugaaaucauuccaguauauuugggaagaauugagugaaugagaaugcu

SEQ ID NO: 679212 - RNA, 64 nt, hsa
acgucaggauuuuaacuaguacugcuuuguugacuuugggaaauggugccacucaaaagcaacu

SEQ ID NO: 679213 - RNA, 64 nt, hsa
gcuuugaggaauuuugacagcuguugacaugggauuugggaaaggugaagcugugacuggaggg

SEQ ID NO: 679214 - RNA, 64 nt, hsa
gaacacccguggacuuguguauauggucauaggcuuugggaagacaggacguaaaggaaaauga

SEQ ID NO: 679215 - RNA, 64 nt, hsa
ggcuacugccauccagcuuucaguggcaucuuguuuugggaacugauuauagagaaucauauau

SEQ ID NO: 679216 - RNA, 64 nt, hsa
agucuuaagagaguuuuauugugucuauggcagguuugggaaagguaagaaauggguccuuuuu

SEQ ID NO: 679217 - RNA, 64 nt, hsa
uuggggcagugagggcuuaggacaccccaagugguuugggaaaggaggaggggagugguggguu

SEQ ID NO: 679218 - RNA, 64 nt, hsa
agcaaaguucaguuucagcaacaaacaaacuuuguuugggaagcuauggaggaggacuuuuaga

SEQ ID NO: 679219 - RNA, 64 nt, hsa
gucauauaggaaacagaaagcaugacaguggccuuuugggaacccaaguuacguccuggugaaa

SEQ ID NO: 679220 - RNA, 64 nt, hsa
ggagguaauugggucuuggcuucaaugccacccuuuugggaagcccuaaaccaagugagguguu

SEQ ID NO: 679221 - RNA, 64 nt, hsa
uucuucauugugcacacaggacaaaucugaucucuuugggaaaaaauagaaauaaaacaaucuc

SEQ ID NO: 679222 - RNA, 64 nt, hsa
gcuuuucuauaauaaaaagagguucuaaccauuauuugggaacaaagagaguuuucaucuuuuu

SEQ ID NO: 679223 - RNA, 64 nt, hsa
ugcuguccugcaguagaaggugccgugagcaggcuuugggaacacuggccugggucucccuggu

SEQ ID NO: 679224 - RNA, 64 nt, hsa
auccuagcuuuuuccuggaaagcccgcuagaagguuugggaacgaggggaaaguucucagaacu

SEQ ID NO: 679225 - RNA, 64 nt, hsa
uaaguugacaccaaugugucauaauauucuuuauuuugggaaauuaguguauuuuauaaaaauu

SEQ ID NO: 679226 - RNA, 64 nt, hsa
auagaaaucccaguucucuaauuugguuuucuucuuugggaaaccaaacauacaaaugaaucag

SEQ ID NO: 679227 - RNA, 64 nt, hsa
ccuuaauguguauagagaccccagucuacuauuauuugggaaaauuguuuagguuauaugggaa

SEQ ID NO: 679228 - RNA, 64 nt, hsa
uuucucuaauccacugaaauuauugugugcuaaauuugggaaacagaucuauucuaacucauua

SEQ ID NO: 679229 - RNA, 64 nt, hsa
gguauauauccgccuggcauuucacaaaacagccuuugggaaaugcugaauuaaagugaauugu

SEQ ID NO: 679230 - RNA, 64 nt, hsa
uaggcaugguggcucacaccuguaaucccagcauuuugggaagcuaagauggguggaucacuug

SEQ ID NO: 679231 - RNA, 64 nt, hsa
guuuuaagaggaagaaaacagaaacguggcaucauuugggaagaaccaagguagaauuuaauuu

SEQ ID NO: 679232 - RNA, 64 nt, hsa
guuugacaggaguggaaaagcgguucaucggcuguuugggaaauggcaugaaagcaucuacugu

SEQ ID NO: 679233 - RNA, 64 nt, hsa
uauuugagaaucucuaccaccauucccuucucuauuugggaaacaauacucucuuauuuugcua

SEQ ID NO: 679234 - RNA, 64 nt, hsa
accaguaacagcagggcuggacuuccuccagcguuuugggaaggaaagagauguuccccugagc

SEQ ID NO: 679235 - RNA, 64 nt, hsa
cgagugugguggcuuaugccuguaaucccugcacuuugggaagccaaggcgggcagcucaccug

SEQ ID NO: 679236 - RNA, 64 nt, hsa
gggaggagcaacguggaacuuccaugaggccccguuugggaaaauaaaaggauccucuucacuu

SEQ ID NO: 679237 - RNA, 64 nt, hsa
auuuuucaguuacccuuuaaggagucccuuugucuuugggaaaguagcagaaugguccgcuucu

SEQ ID NO: 679238 - RNA, 64 nt, hsa
aaauaaacuaaagccuggauuugauauuacaaauuuugggaaaucuuagaauaaagaacgagaa

SEQ ID NO: 679239 - RNA, 64 nt, hsa
uugggggaaaaaggggauucuguggucagaugaguuugggaaaugcugaacacuucauucuucu

SEQ ID NO: 679240 - RNA, 64 nt, hsa
aguauguagugaagaaaauuuaguuguuaguugcuuugggaagccuacuuauggaguggaaacc

SEQ ID NO: 679241 - RNA, 64 nt, hsa
gagagcacacacucccuaauugucagaugguuuuuuugggaaaacucuuagauaguacagugag

SEQ ID NO: 679242 - RNA, 64 nt, hsa
ccuacucuccuucuuuuucugcuuucauuuuaauuuugggaaauuuuaaaguaaaaguuucaaa

SEQ ID NO: 679243 - RNA, 64 nt, hsa
gcaggcuucccuggugccgauguaaagggcuacauuugggaacauuugacuuccuugggacucu

SEQ ID NO: 679244 - RNA, 64 nt, hsa
cagaugaaaugucaauauaagaaaaaucaagguauuugggaaacaugggcauaaucagguaguu

SEQ ID NO: 679245 - RNA, 64 nt, hsa
cuucccggugccagguccagauuucccuccaugauuugggaaccagcuuaggcaaaagaguccc

SEQ ID NO: 679246 - RNA, 64 nt, hsa
uauaauaacucuguacuuugguuucagggugacauuugggaaggauuuuguuuagaauuaaugg

SEQ ID NO: 679247 - RNA, 64 nt, hsa
auauuaauggaggauauuccucggaaaaacagacuuugggaaugaaggagggacucaggaucau

SEQ ID NO: 679248 - RNA, 64 nt, hsa
cauaagcauuugcccucaccaugguuuauaaaacuuugggaaaacggaauauucagaaauaggu

SEQ ID NO: 679249 - RNA, 64 nt, hsa
agauuuaauacuuuaauguuuuaagugugggggguuugggaaggaaggaauguaauauuaugga

SEQ ID NO: 679250 - RNA, 64 nt, hsa
gcccgcugaggacuagcuuucugucuuucauacauuugggaaagauaggaaugacuguuucaaa

SEQ ID NO: 679251 - RNA, 64 nt, hsa
guagcuucuguguucccguaaggauacagcuuccuuugggaagccccaucuauggcuguagauc

SEQ ID NO: 679252 - RNA, 64 nt, hsa
aaucaaagguaauuuuauuaccuguagaccugucuuugggaaacauuaaaggauguuugagggc

SEQ ID NO: 679253 - RNA, 64 nt, hsa
cacuacagcugaacuuuucaucaucucauucacauuugggaaacgaacaggagaugagcaaagc

SEQ ID NO: 679254 - RNA, 64 nt, hsa
guauacuuauaaugggaaacuuugcaaggacauuuuugggaagcaaugcugggcagcguuuuug

SEQ ID NO: 679255 - RNA, 64 nt, hsa
uaaguauaaugcugaucugacaauugacguguaauuugggaagucauuuugauaauuuugcuua

SEQ ID NO: 679256 - RNA, 64 nt, hsa
gauaagggccuccccaguccucuccgggagaugauuugggaaauuuuauaaugcuuguucuguu

SEQ ID NO: 679257 - RNA, 64 nt, hsa
aauugccugaccucguuaucacaugagcuuauauuuugggaacacauagaacugauggaggcuu

SEQ ID NO: 679258 - RNA, 64 nt, hsa
uguauugagacuguauuguuaugagccuaggaaauuugggaacaugauuguauuguauuaaaau

SEQ ID NO: 679259 - RNA, 64 nt, hsa
aagauguauaaaaauccugaaguuuuuauuuaguuuugggaauaggcaucaaugggugguauuu

SEQ ID NO: 679260 - RNA, 64 nt, hsa
cuguauuggguagugggaggugggagggaagggcuuugggaaggggaugaauaucucuuuuuac

SEQ ID NO: 679261 - RNA, 64 nt, hsa
cagcuuucaugagguuacagaaaagggcuacagauuugggaagcuguguguaauggucuugaga

SEQ ID NO: 679262 - RNA, 64 nt, hsa
cccuggcucaccaaugcgucugguccacauggcauuugggaaagcagaugggucaugcuuuugc

SEQ ID NO: 679263 - RNA, 64 nt, hsa
cgggcauguuggcucccgccuguaaucccagcacuuugggaagcccaagugggugaaucaccug

SEQ ID NO: 679264 - RNA, 64 nt, hsa
aggccuggcccagagucacgcuggcaaccacgaguuugggaagcagucguauucucucucucuc

SEQ ID NO: 679265 - RNA, 64 nt, hsa
cagaguagauaauguucauuuaucaaaaaucugguuugggaaauaccaaagaggcuuugauuga

SEQ ID NO: 679266 - RNA, 64 nt, hsa
uuucuauuuagcaaaaaugagugcucugcuuuuauuugggaauuucgaugaaaaagcguucaga

SEQ ID NO: 679267 - RNA, 64 nt, hsa
uucuaaccuuaacagauaauaugccucaugugcauuugggaacaggauagcuugagccauauuc

SEQ ID NO: 679268 - RNA, 54 nt, hsa
acaggagaauucacagguagucauuuugggaaagccucuugccagauguaggcc

SEQ ID NO: 679269 - RNA, 64 nt, hsa
uuaaaaaaaaggucagaaggacaaagcugguuuguuugggaaauggacugaucgaaagaaaacu

SEQ ID NO: 679270 - RNA, 64 nt, hsa
ucagccauaccucuuaacaccucauagaacacacuuugggaaacaguggggguaggaaaacucg

SEQ ID NO: 679271 - RNA, 64 nt, hsa
aaagggaagaaaacacuguuaucauuuuuuccuguuugggaagagcuuagaaacuggaaauacu

SEQ ID NO: 679272 - RNA, 64 nt, hsa
ugcuugaacuuacaggugauuaacuuggaugaguuuugggaaguuaaagggaagaaaacacugu

SEQ ID NO: 679273 - RNA, 64 nt, hsa
cacagcuaaccauuaugccaaucaccaugcuuauuuugggaaacucuuuaucuuuuuuaaauuc

SEQ ID NO: 679274 - RNA, 64 nt, hsa
cuucucacugucagugacaccaucuuggaauaccuuugggaagcagcaggaaaugugcaugugg

SEQ ID NO: 679275 - RNA, 64 nt, hsa; identical to SEQ ID NO: 674439

SEQ ID NO: 679276 - RNA, 64 nt, hsa; identical to SEQ ID NO: 674440

SEQ ID NO: 679277 - RNA, 64 nt, hsa; identical to SEQ ID NO: 674441

SEQ ID NO: 679278 - RNA, 64 nt, hsa; identical to SEQ ID NO: 674442

SEQ ID NO: 679279 - RNA, 64 nt, hsa; identical to SEQ ID NO: 674443

SEQ ID NO: 679280 - RNA, 64 nt, hsa; identical to SEQ ID NO: 674444

SEQ ID NO: 679281 - RNA, 64 nt, hsa; identical to SEQ ID NO: 674445

SEQ ID NO: 679282 - RNA, 64 nt, hsa; identical to SEQ ID NO: 674446

SEQ ID NO: 679283 - RNA, 64 nt, hsa; identical to SEQ ID NO: 674447

SEQ ID NO: 679284 - RNA, 64 nt, hsa; identical to SEQ ID NO: 674448

SEQ ID NO: 679285 - RNA, 64 nt, hsa; identical to SEQ ID NO: 674449

SEQ ID NO: 679286 - RNA, 64 nt, hsa; identical to SEQ ID NO: 674450

SEQ ID NO: 679287 - RNA, 64 nt, hsa; identical to SEQ ID NO: 674451

SEQ ID NO: 679288 - RNA, 64 nt, hsa; identical to SEQ ID NO: 674452

SEQ ID NO: 679289 - RNA, 64 nt, hsa; identical to SEQ ID NO: 674453

SEQ ID NO: 679290 - RNA, 64 nt, hsa; identical to SEQ ID NO: 674454

SEQ ID NO: 679291 - RNA, 64 nt, hsa; identical to SEQ ID NO: 113667

SEQ ID NO: 679292 - RNA, 64 nt, hsa; identical to SEQ ID NO: 113668

SEQ ID NO: 679293 - RNA, 64 nt, hsa; identical to SEQ ID NO: 113669

SEQ ID NO: 679294 - RNA, 64 nt, hsa; identical to SEQ ID NO: 113670

SEQ ID NO: 679295 - RNA, 64 nt, hsa; identical to SEQ ID NO: 113671

SEQ ID NO: 679296 - RNA, 64 nt, hsa; identical to SEQ ID NO: 113672

SEQ ID NO: 679297 - RNA, 64 nt, hsa; identical to SEQ ID NO: 113673

SEQ ID NO: 679298 - RNA, 64 nt, hsa; identical to SEQ ID NO: 113674

SEQ ID NO: 679299 - RNA, 64 nt, hsa; identical to SEQ ID NO: 113675

SEQ ID NO: 679300 - RNA, 64 nt, hsa; identical to SEQ ID NO: 113676

SEQ ID NO: 679301 - RNA, 64 nt, hsa; identical to SEQ ID NO: 113677

SEQ ID NO: 679302 - RNA, 64 nt, hsa; identical to SEQ ID NO: 113678

SEQ ID NO: 679303 - RNA, 64 nt, hsa; identical to SEQ ID NO: 113679

SEQ ID NO: 679304 - RNA, 64 nt, hsa; identical to SEQ ID NO: 113680

SEQ ID NO: 679305 - RNA, 64 nt, hsa; identical to SEQ ID NO: 113681

SEQ ID NO: 679306 - RNA, 64 nt, hsa; identical to SEQ ID NO: 113682

SEQ ID NO: 679307 - RNA, 64 nt, hsa; identical to SEQ ID NO: 113683

SEQ ID NO: 679308 - RNA, 64 nt, hsa; identical to SEQ ID NO: 113684

SEQ ID NO: 679309 - RNA, 64 nt, hsa; identical to SEQ ID NO: 113685

SEQ ID NO: 679310 - RNA, 64 nt, hsa; identical to SEQ ID NO: 113686

SEQ ID NO: 679311 - RNA, 64 nt, hsa; identical to SEQ ID NO: 113687

SEQ ID NO: 679312 - RNA, 64 nt, hsa; identical to SEQ ID NO: 113688

SEQ ID NO: 679313 - RNA, 64 nt, hsa; identical to SEQ ID NO: 113689

SEQ ID NO: 679314 - RNA, 62 nt, hsa; identical to SEQ ID NO: 113690

SEQ ID NO: 679315 - RNA, 64 nt, hsa; identical to SEQ ID NO: 113691

SEQ ID NO: 679316 - RNA, 59 nt, hsa; identical to SEQ ID NO: 113692

SEQ ID NO: 679317 - RNA, 64 nt, hsa; identical to SEQ ID NO: 113693

SEQ ID NO: 679318 - RNA, 64 nt, hsa; identical to SEQ ID NO: 113694

SEQ ID NO: 679319 - RNA, 64 nt, hsa; identical to SEQ ID NO: 113695

SEQ ID NO: 679320 - RNA, 64 nt, hsa; identical to SEQ ID NO: 113696

SEQ ID NO: 679321 - RNA, 64 nt, hsa; identical to SEQ ID NO: 113697

SEQ ID NO: 679322 - RNA, 64 nt, hsa; identical to SEQ ID NO: 113698

SEQ ID NO: 679323 - RNA, 64 nt, hsa; identical to SEQ ID NO: 113699

SEQ ID NO: 679324 - RNA, 64 nt, hsa; identical to SEQ ID NO: 113700

SEQ ID NO: 679325 - RNA, 64 nt, hsa; identical to SEQ ID NO: 113701

SEQ ID NO: 679326 - RNA, 64 nt, hsa; identical to SEQ ID NO: 113702

SEQ ID NO: 679327 - RNA, 64 nt, hsa; identical to SEQ ID NO: 113703

SEQ ID NO: 679328 - RNA, 64 nt, hsa; identical to SEQ ID NO: 113704

SEQ ID NO: 679329 - RNA, 64 nt, hsa; identical to SEQ ID NO: 113705

SEQ ID NO: 679330 - RNA, 64 nt, hsa; identical to SEQ ID NO: 113706

SEQ ID NO: 679331 - RNA, 64 nt, hsa; identical to SEQ ID NO: 113707

SEQ ID NO: 679332 - RNA, 64 nt, hsa; identical to SEQ ID NO: 113708

SEQ ID NO: 679333 - RNA, 64 nt, hsa; identical to SEQ ID NO: 113709

SEQ ID NO: 679334 - RNA, 64 nt, hsa; identical to SEQ ID NO: 113710

SEQ ID NO: 679335 - RNA, 64 nt, hsa; identical to SEQ ID NO: 113711

SEQ ID NO: 679336 - RNA, 64 nt, hsa; identical to SEQ ID NO: 113712

SEQ ID NO: 679337 - RNA, 64 nt, hsa; identical to SEQ ID NO: 113713

SEQ ID NO: 679338 - RNA, 64 nt, hsa; identical to SEQ ID NO: 113714

SEQ ID NO: 679339 - RNA, 64 nt, hsa; identical to SEQ ID NO: 113715

SEQ ID NO: 679340 - RNA, 64 nt, hsa; identical to SEQ ID NO: 113716

SEQ ID NO: 679341 - RNA, 64 nt, hsa; identical to SEQ ID NO: 113717

SEQ ID NO: 679342 - RNA, 64 nt, hsa; identical to SEQ ID NO: 113718

SEQ ID NO: 679343 - RNA, 64 nt, hsa; identical to SEQ ID NO: 113719

SEQ ID NO: 679344 - RNA, 64 nt, hsa; identical to SEQ ID NO: 113720

SEQ ID NO: 679345 - RNA, 64 nt, hsa; identical to SEQ ID NO: 113721

SEQ ID NO: 679346 - RNA, 64 nt, hsa; identical to SEQ ID NO: 113722

SEQ ID NO: 679347 - RNA, 64 nt, hsa; identical to SEQ ID NO: 113723

SEQ ID NO: 679348 - RNA, 64 nt, hsa; identical to SEQ ID NO: 113724

SEQ ID NO: 679349 - RNA, 64 nt, hsa; identical to SEQ ID NO: 113725

SEQ ID NO: 679350 - RNA, 64 nt, hsa; identical to SEQ ID NO: 113726

SEQ ID NO: 679351 - RNA, 64 nt, hsa; identical to SEQ ID NO: 113727

SEQ ID NO: 679352 - RNA, 64 nt, hsa; identical to SEQ ID NO: 113728

SEQ ID NO: 679353 - RNA, 64 nt, hsa; identical to SEQ ID NO: 113729

SEQ ID NO: 679354 - RNA, 64 nt, hsa; identical to SEQ ID NO: 113730

SEQ ID NO: 679355 - RNA, 64 nt, hsa; identical to SEQ ID NO: 113731

SEQ ID NO: 679356 - RNA, 64 nt, hsa; identical to SEQ ID NO: 113732

SEQ ID NO: 679357 - RNA, 64 nt, hsa; identical to SEQ ID NO: 113733

SEQ ID NO: 679358 - RNA, 64 nt, hsa; identical to SEQ ID NO: 113734

SEQ ID NO: 679359 - RNA, 64 nt, hsa; identical to SEQ ID NO: 113735

SEQ ID NO: 679360 - RNA, 64 nt, hsa; identical to SEQ ID NO: 113736

SEQ ID NO: 679361 - RNA, 64 nt, hsa; identical to SEQ ID NO: 113737

SEQ ID NO: 679362 - RNA, 64 nt, hsa; identical to SEQ ID NO: 113738

SEQ ID NO: 679363 - RNA, 64 nt, hsa; identical to SEQ ID NO: 113739

SEQ ID NO: 679364 - RNA, 64 nt, hsa; identical to SEQ ID NO: 113740

SEQ ID NO: 679365 - RNA, 64 nt, hsa; identical to SEQ ID NO: 113741

SEQ ID NO: 679366 - RNA, 64 nt, hsa; identical to SEQ ID NO: 113742

SEQ ID NO: 679367 - RNA, 64 nt, hsa; identical to SEQ ID NO: 113743

SEQ ID NO: 679368 - RNA, 64 nt, hsa; identical to SEQ ID NO: 113744

SEQ ID NO: 679369 - RNA, 64 nt, hsa; identical to SEQ ID NO: 113745

SEQ ID NO: 679370 - RNA, 64 nt, hsa; identical to SEQ ID NO: 113746

SEQ ID NO: 679371 - RNA, 64 nt, hsa; identical to SEQ ID NO: 113747

SEQ ID NO: 679372 - RNA, 64 nt, hsa; identical to SEQ ID NO: 113748

SEQ ID NO: 679373 - RNA, 64 nt, hsa; identical to SEQ ID NO: 113749

SEQ ID NO: 679374 - RNA, 64 nt, hsa; identical to SEQ ID NO: 113750

SEQ ID NO: 679375 - RNA, 64 nt, hsa; identical to SEQ ID NO: 113751

SEQ ID NO: 679376 - RNA, 64 nt, hsa; identical to SEQ ID NO: 113752

SEQ ID NO: 679377 - RNA, 64 nt, hsa; identical to SEQ ID NO: 113753

SEQ ID NO: 679378 - RNA, 64 nt, hsa; identical to SEQ ID NO: 113754

SEQ ID NO: 679379 - RNA, 64 nt, hsa; identical to SEQ ID NO: 113755

SEQ ID NO: 679380 - RNA, 64 nt, hsa; identical to SEQ ID NO: 113756

SEQ ID NO: 679381 - RNA, 64 nt, hsa; identical to SEQ ID NO: 113757

SEQ ID NO: 679382 - RNA, 64 nt, hsa; identical to SEQ ID NO: 113758

SEQ ID NO: 679383 - RNA, 64 nt, hsa; identical to SEQ ID NO: 113759

SEQ ID NO: 679384 - RNA, 64 nt, hsa; identical to SEQ ID NO: 113760

SEQ ID NO: 679385 - RNA, 64 nt, hsa; identical to SEQ ID NO: 113761

SEQ ID NO: 679386 - RNA, 64 nt, hsa; identical to SEQ ID NO: 113762

SEQ ID NO: 679387 - RNA, 64 nt, hsa; identical to SEQ ID NO: 113763

SEQ ID NO: 679388 - RNA, 64 nt, hsa; identical to SEQ ID NO: 113764

SEQ ID NO: 679389 - RNA, 61 nt, hsa; identical to SEQ ID NO: 113765

SEQ ID NO: 679390 - RNA, 64 nt, hsa; identical to SEQ ID NO: 113766

SEQ ID NO: 679391 - RNA, 64 nt, hsa; identical to SEQ ID NO: 113767

SEQ ID NO: 679392 - RNA, 64 nt, hsa; identical to SEQ ID NO: 113768

SEQ ID NO: 679393 - RNA, 64 nt, hsa; identical to SEQ ID NO: 113769

SEQ ID NO: 679394 - RNA, 64 nt, hsa; identical to SEQ ID NO: 113770

SEQ ID NO: 679395 - RNA, 64 nt, hsa; identical to SEQ ID NO: 113771

SEQ ID NO: 679396 - RNA, 64 nt, hsa; identical to SEQ ID NO: 113772

SEQ ID NO: 679397 - RNA, 64 nt, hsa; identical to SEQ ID NO: 113773

SEQ ID NO: 679398 - RNA, 64 nt, hsa; identical to SEQ ID NO: 113774

SEQ ID NO: 679399 - RNA, 64 nt, hsa; identical to SEQ ID NO: 113775

SEQ ID NO: 679400 - RNA, 64 nt, hsa; identical to SEQ ID NO: 113776

SEQ ID NO: 679401 - RNA, 64 nt, hsa; identical to SEQ ID NO: 113777

SEQ ID NO: 679402 - RNA, 64 nt, hsa; identical to SEQ ID NO: 113778

SEQ ID NO: 679403 - RNA, 64 nt, hsa; identical to SEQ ID NO: 113779

SEQ ID NO: 679404 - RNA, 64 nt, hsa; identical to SEQ ID NO: 113780

SEQ ID NO: 679405 - RNA, 64 nt, hsa; identical to SEQ ID NO: 113781

SEQ ID NO: 679406 - RNA, 64 nt, hsa; identical to SEQ ID NO: 113782

SEQ ID NO: 679407 - RNA, 64 nt, hsa; identical to SEQ ID NO: 113783

SEQ ID NO: 679408 - RNA, 64 nt, hsa; identical to SEQ ID NO: 113784

SEQ ID NO: 679409 - RNA, 64 nt, hsa; identical to SEQ ID NO: 113785

SEQ ID NO: 679410 - RNA, 64 nt, hsa; identical to SEQ ID NO: 113786

SEQ ID NO: 679411 - RNA, 64 nt, hsa; identical to SEQ ID NO: 113787

SEQ ID NO: 679412 - RNA, 64 nt, hsa; identical to SEQ ID NO: 113788

SEQ ID NO: 679413 - RNA, 64 nt, hsa; identical to SEQ ID NO: 113789

SEQ ID NO: 679414 - RNA, 64 nt, hsa; identical to SEQ ID NO: 113790

SEQ ID NO: 679415 - RNA, 64 nt, hsa; identical to SEQ ID NO: 113791

SEQ ID NO: 679416 - RNA, 64 nt, hsa; identical to SEQ ID NO: 113792

SEQ ID NO: 679417 - RNA, 64 nt, hsa; identical to SEQ ID NO: 113793

SEQ ID NO: 679418 - RNA, 64 nt, hsa; identical to SEQ ID NO: 113794

SEQ ID NO: 679419 - RNA, 64 nt, hsa; identical to SEQ ID NO: 113795

SEQ ID NO: 679420 - RNA, 64 nt, hsa; identical to SEQ ID NO: 113796

SEQ ID NO: 679421 - RNA, 64 nt, hsa; identical to SEQ ID NO: 113797

SEQ ID NO: 679422 - RNA, 64 nt, hsa; identical to SEQ ID NO: 113798

SEQ ID NO: 679423 - RNA, 64 nt, hsa; identical to SEQ ID NO: 113799

SEQ ID NO: 679424 - RNA, 64 nt, hsa; identical to SEQ ID NO: 113800

SEQ ID NO: 679425 - RNA, 64 nt, hsa; identical to SEQ ID NO: 113801

SEQ ID NO: 679426 - RNA, 64 nt, hsa; identical to SEQ ID NO: 113802

SEQ ID NO: 679427 - RNA, 64 nt, hsa; identical to SEQ ID NO: 113803

SEQ ID NO: 679428 - RNA, 64 nt, hsa; identical to SEQ ID NO: 113804

SEQ ID NO: 679429 - RNA, 64 nt, hsa; identical to SEQ ID NO: 113805

SEQ ID NO: 679430 - RNA, 64 nt, hsa; identical to SEQ ID NO: 113806

SEQ ID NO: 679431 - RNA, 64 nt, hsa; identical to SEQ ID NO: 113807

SEQ ID NO: 679432 - RNA, 64 nt, hsa; identical to SEQ ID NO: 113808

SEQ ID NO: 679433 - RNA, 64 nt, hsa; identical to SEQ ID NO: 113809

SEQ ID NO: 679434 - RNA, 64 nt, hsa; identical to SEQ ID NO: 113810

SEQ ID NO: 679435 - RNA, 64 nt, hsa; identical to SEQ ID NO: 113811

SEQ ID NO: 679436 - RNA, 63 nt, hsa
gcaggagaacgccaccgccuagugugaaugcuaggucagaagcugcuuuuucacacugaaacc

SEQ ID NO: 679437 - RNA, 52 nt, hsa
uuuaacagauaaaagaaugaugggucagaauuucuaccacguuucuggauac

SEQ ID NO: 679438 - RNA, 63 nt, hsa
gugacggagcaucguggcacggcagucucaaugggucagaaacccaggccagcugggcucuaa

SEQ ID NO: 679439 - RNA, 63 nt, hsa
accuggacacaggccugcucucuuuuucuccagggucagaaacaggaccggguggaagggaug

SEQ ID NO: 679440 - RNA, 63 nt, hsa
gcaucguuuggagauacaaagcgagcaguucuuggucagaacccuccucugcuuuucauugug

SEQ ID NO: 679441 - RNA, 63 nt, hsa
gcauuuugggaggcugagguggccagaucccaaggucagaagaucgagaccauccuggcuaac

SEQ ID NO: 679442 - RNA, 63 nt, hsa
acuuugguagacugaugugaguggaucaccuaaggucagaaguucaagagcacccuggcuaac

SEQ ID NO: 679443 - RNA, 63 nt, hsa
acgguuggaggccaaggcacauaggucacuugaggucagaaguuugaaaccagcauggccaac

SEQ ID NO: 679444 - RNA, 64 nt, hsa; identical to SEQ ID NO: 383478

SEQ ID NO: 679445 - RNA, 64 nt, hsa; identical to SEQ ID NO: 383479

SEQ ID NO: 679446 - RNA, 64 nt, hsa; identical to SEQ ID NO: 383480

SEQ ID NO: 679447 - RNA, 64 nt, hsa; identical to SEQ ID NO: 383481

SEQ ID NO: 679448 - RNA, 64 nt, hsa; identical to SEQ ID NO: 383482

SEQ ID NO: 679449 - RNA, 64 nt, hsa; identical to SEQ ID NO: 383483

SEQ ID NO: 679450 - RNA, 64 nt, hsa; identical to SEQ ID NO: 383484

SEQ ID NO: 679451 - RNA, 64 nt, hsa; identical to SEQ ID NO: 383485

SEQ ID NO: 679452 - RNA, 64 nt, hsa; identical to SEQ ID NO: 383486

SEQ ID NO: 679453 - RNA, 64 nt, hsa; identical to SEQ ID NO: 383487

SEQ ID NO: 679454 - RNA, 64 nt, hsa; identical to SEQ ID NO: 383488

SEQ ID NO: 679455 - RNA, 64 nt, hsa; identical to SEQ ID NO: 383489

SEQ ID NO: 679456 - RNA, 64 nt, hsa; identical to SEQ ID NO: 383490

SEQ ID NO: 679457 - RNA, 64 nt, hsa; identical to SEQ ID NO: 383491

SEQ ID NO: 679458 - RNA, 64 nt, hsa; identical to SEQ ID NO: 383492

SEQ ID NO: 679459 - RNA, 64 nt, hsa; identical to SEQ ID NO: 383493

SEQ ID NO: 679460 - RNA, 64 nt, hsa; identical to SEQ ID NO: 383494

SEQ ID NO: 679461 - RNA, 64 nt, hsa; identical to SEQ ID NO: 383495

SEQ ID NO: 679462 - RNA, 64 nt, hsa; identical to SEQ ID NO: 383496

SEQ ID NO: 679463 - RNA, 64 nt, hsa; identical to SEQ ID NO: 383497

SEQ ID NO: 679464 - RNA, 64 nt, hsa; identical to SEQ ID NO: 383498

SEQ ID NO: 679465 - RNA, 64 nt, hsa; identical to SEQ ID NO: 383499

SEQ ID NO: 679466 - RNA, 64 nt, hsa; identical to SEQ ID NO: 383500

SEQ ID NO: 679467 - RNA, 64 nt, hsa; identical to SEQ ID NO: 383501

SEQ ID NO: 679468 - RNA, 64 nt, hsa; identical to SEQ ID NO: 383502

SEQ ID NO: 679469 - RNA, 64 nt, hsa; identical to SEQ ID NO: 383503

SEQ ID NO: 679470 - RNA, 64 nt, hsa; identical to SEQ ID NO: 383504

SEQ ID NO: 679471 - RNA, 64 nt, hsa; identical to SEQ ID NO: 383505

SEQ ID NO: 679472 - RNA, 64 nt, hsa; identical to SEQ ID NO: 383506

SEQ ID NO: 679473 - RNA, 64 nt, hsa; identical to SEQ ID NO: 383507

SEQ ID NO: 679474 - RNA, 64 nt, hsa; identical to SEQ ID NO: 383508

SEQ ID NO: 679475 - RNA, 64 nt, hsa; identical to SEQ ID NO: 383509

SEQ ID NO: 679476 - RNA, 64 nt, hsa; identical to SEQ ID NO: 383510

SEQ ID NO: 679477 - RNA, 64 nt, hsa; identical to SEQ ID NO: 383511

SEQ ID NO: 679478 - RNA, 64 nt, hsa; identical to SEQ ID NO: 383512

SEQ ID NO: 679479 - RNA, 64 nt, hsa; identical to SEQ ID NO: 383513

SEQ ID NO: 679480 - RNA, 64 nt, hsa; identical to SEQ ID NO: 383514

SEQ ID NO: 679481 - RNA, 64 nt, hsa; identical to SEQ ID NO: 383515

SEQ ID NO: 679482 - RNA, 64 nt, hsa; identical to SEQ ID NO: 383516

SEQ ID NO: 679483 - RNA, 64 nt, hsa; identical to SEQ ID NO: 383517

SEQ ID NO: 679484 - RNA, 64 nt, hsa; identical to SEQ ID NO: 383518

SEQ ID NO: 679485 - RNA, 64 nt, hsa; identical to SEQ ID NO: 383519

SEQ ID NO: 679486 - RNA, 64 nt, hsa; identical to SEQ ID NO: 383520

SEQ ID NO: 679487 - RNA, 64 nt, hsa; identical to SEQ ID NO: 383521

SEQ ID NO: 679488 - RNA, 64 nt, hsa; identical to SEQ ID NO: 383522

SEQ ID NO: 679489 - RNA, 64 nt, hsa; identical to SEQ ID NO: 383523

SEQ ID NO: 679490 - RNA, 64 nt, hsa; identical to SEQ ID NO: 383524

SEQ ID NO: 679491 - RNA, 64 nt, hsa; identical to SEQ ID NO: 383525

SEQ ID NO: 679492 - RNA, 64 nt, hsa; identical to SEQ ID NO: 383526

SEQ ID NO: 679493 - RNA, 64 nt, hsa; identical to SEQ ID NO: 383527

SEQ ID NO: 679494 - RNA, 64 nt, hsa; identical to SEQ ID NO: 383528

SEQ ID NO: 679495 - RNA, 64 nt, hsa; identical to SEQ ID NO: 383529

SEQ ID NO: 679496 - RNA, 64 nt, hsa; identical to SEQ ID NO: 383530

SEQ ID NO: 679497 - RNA, 64 nt, hsa; identical to SEQ ID NO: 383531

SEQ ID NO: 679498 - RNA, 64 nt, hsa; identical to SEQ ID NO: 383532

SEQ ID NO: 679499 - RNA, 64 nt, hsa; identical to SEQ ID NO: 383533

SEQ ID NO: 679500 - RNA, 64 nt, hsa; identical to SEQ ID NO: 383534

SEQ ID NO: 679501 - RNA, 64 nt, hsa; identical to SEQ ID NO: 383535

SEQ ID NO: 679502 - RNA, 64 nt, hsa; identical to SEQ ID NO: 383536

SEQ ID NO: 679503 - RNA, 64 nt, hsa; identical to SEQ ID NO: 383537

SEQ ID NO: 679504 - RNA, 64 nt, hsa; identical to SEQ ID NO: 383538

SEQ ID NO: 679505 - RNA, 64 nt, hsa; identical to SEQ ID NO: 383539

SEQ ID NO: 679506 - RNA, 64 nt, hsa; identical to SEQ ID NO: 383540

SEQ ID NO: 679507 - RNA, 64 nt, hsa; identical to SEQ ID NO: 383541

SEQ ID NO: 679508 - RNA, 64 nt, hsa; identical to SEQ ID NO: 383542

SEQ ID NO: 679509 - RNA, 64 nt, hsa; identical to SEQ ID NO: 383543

SEQ ID NO: 679510 - RNA, 64 nt, hsa; identical to SEQ ID NO: 383544

SEQ ID NO: 679511 - RNA, 64 nt, hsa; identical to SEQ ID NO: 383545

SEQ ID NO: 679512 - RNA, 64 nt, hsa; identical to SEQ ID NO: 383546

SEQ ID NO: 679513 - RNA, 64 nt, hsa; identical to SEQ ID NO: 383547

SEQ ID NO: 679514 - RNA, 64 nt, hsa; identical to SEQ ID NO: 383548

SEQ ID NO: 679515 - RNA, 64 nt, hsa; identical to SEQ ID NO: 383549

SEQ ID NO: 679516 - RNA, 64 nt, hsa; identical to SEQ ID NO: 383550

SEQ ID NO: 679517 - RNA, 64 nt, hsa; identical to SEQ ID NO: 383551

SEQ ID NO: 679518 - RNA, 64 nt, hsa; identical to SEQ ID NO: 383552

SEQ ID NO: 679519 - RNA, 64 nt, hsa; identical to SEQ ID NO: 383553

SEQ ID NO: 679520 - RNA, 64 nt, hsa; identical to SEQ ID NO: 383554

SEQ ID NO: 679521 - RNA, 64 nt, hsa; identical to SEQ ID NO: 383555

SEQ ID NO: 679522 - RNA, 64 nt, hsa; identical to SEQ ID NO: 383556

SEQ ID NO: 679523 - RNA, 64 nt, hsa; identical to SEQ ID NO: 383557

SEQ ID NO: 679524 - RNA, 64 nt, hsa; identical to SEQ ID NO: 383558

SEQ ID NO: 679525 - RNA, 64 nt, hsa; identical to SEQ ID NO: 383559

SEQ ID NO: 679526 - RNA, 64 nt, hsa; identical to SEQ ID NO: 383560

SEQ ID NO: 679527 - RNA, 64 nt, hsa; identical to SEQ ID NO: 383561

SEQ ID NO: 679528 - RNA, 64 nt, hsa; identical to SEQ ID NO: 383562

SEQ ID NO: 679529 - RNA, 64 nt, hsa; identical to SEQ ID NO: 383563

SEQ ID NO: 679530 - RNA, 64 nt, hsa; identical to SEQ ID NO: 383564

SEQ ID NO: 679531 - RNA, 64 nt, hsa; identical to SEQ ID NO: 383565

SEQ ID NO: 679532 - RNA, 64 nt, hsa; identical to SEQ ID NO: 383566

SEQ ID NO: 679533 - RNA, 64 nt, hsa; identical to SEQ ID NO: 383567

SEQ ID NO: 679534 - RNA, 64 nt, hsa; identical to SEQ ID NO: 383568

SEQ ID NO: 679535 - RNA, 64 nt, hsa; identical to SEQ ID NO: 383569

SEQ ID NO: 679536 - RNA, 64 nt, hsa; identical to SEQ ID NO: 383570

SEQ ID NO: 679537 - RNA, 64 nt, hsa; identical to SEQ ID NO: 383571

SEQ ID NO: 679538 - RNA, 64 nt, hsa; identical to SEQ ID NO: 383572

SEQ ID NO: 679539 - RNA, 64 nt, hsa; identical to SEQ ID NO: 383573

SEQ ID NO: 679540 - RNA, 64 nt, hsa; identical to SEQ ID NO: 383574

SEQ ID NO: 679541 - RNA, 64 nt, hsa; identical to SEQ ID NO: 383575

SEQ ID NO: 679542 - RNA, 64 nt, hsa; identical to SEQ ID NO: 383576

SEQ ID NO: 679543 - RNA, 64 nt, hsa; identical to SEQ ID NO: 383577

SEQ ID NO: 679544 - RNA, 64 nt, hsa; identical to SEQ ID NO: 383578

SEQ ID NO: 679545 - RNA, 64 nt, hsa; identical to SEQ ID NO: 383579

SEQ ID NO: 679546 - RNA, 64 nt, hsa; identical to SEQ ID NO: 383580

SEQ ID NO: 679547 - RNA, 64 nt, hsa; identical to SEQ ID NO: 383581

SEQ ID NO: 679548 - RNA, 64 nt, hsa; identical to SEQ ID NO: 383582

SEQ ID NO: 679549 - RNA, 64 nt, hsa; identical to SEQ ID NO: 383583

SEQ ID NO: 679550 - RNA, 64 nt, hsa; identical to SEQ ID NO: 383584

SEQ ID NO: 679551 - RNA, 64 nt, hsa; identical to SEQ ID NO: 383585

SEQ ID NO: 679552 - RNA, 64 nt, hsa; identical to SEQ ID NO: 383586

SEQ ID NO: 679553 - RNA, 64 nt, hsa; identical to SEQ ID NO: 383587

SEQ ID NO: 679554 - RNA, 64 nt, hsa; identical to SEQ ID NO: 383588

SEQ ID NO: 679555 - RNA, 64 nt, hsa; identical to SEQ ID NO: 383589

SEQ ID NO: 679556 - RNA, 64 nt, hsa; identical to SEQ ID NO: 383590

SEQ ID NO: 679557 - RNA, 64 nt, hsa; identical to SEQ ID NO: 383591

SEQ ID NO: 679558 - RNA, 64 nt, hsa; identical to SEQ ID NO: 383592

SEQ ID NO: 679559 - RNA, 64 nt, hsa; identical to SEQ ID NO: 383593

SEQ ID NO: 679560 - RNA, 64 nt, hsa; identical to SEQ ID NO: 383594

SEQ ID NO: 679561 - RNA, 64 nt, hsa; identical to SEQ ID NO: 383595

SEQ ID NO: 679562 - RNA, 64 nt, hsa; identical to SEQ ID NO: 383596

SEQ ID NO: 679563 - RNA, 64 nt, hsa; identical to SEQ ID NO: 383597

SEQ ID NO: 679564 - RNA, 64 nt, hsa; identical to SEQ ID NO: 383598

SEQ ID NO: 679565 - RNA, 64 nt, hsa; identical to SEQ ID NO: 383599

SEQ ID NO: 679566 - RNA, 64 nt, hsa; identical to SEQ ID NO: 383600

SEQ ID NO: 679567 - RNA, 64 nt, hsa; identical to SEQ ID NO: 383601

SEQ ID NO: 679568 - RNA, 64 nt, hsa; identical to SEQ ID NO: 383602

SEQ ID NO: 679569 - RNA, 64 nt, hsa; identical to SEQ ID NO: 383603

SEQ ID NO: 679570 - RNA, 64 nt, hsa; identical to SEQ ID NO: 383604

SEQ ID NO: 679571 - RNA, 64 nt, hsa; identical to SEQ ID NO: 383605

SEQ ID NO: 679572 - RNA, 59 nt, hsa; identical to SEQ ID NO: 383606

SEQ ID NO: 679573 - RNA, 64 nt, hsa; identical to SEQ ID NO: 383607

SEQ ID NO: 679574 - RNA, 64 nt, hsa; identical to SEQ ID NO: 383608

SEQ ID NO: 679575 - RNA, 64 nt, hsa; identical to SEQ ID NO: 383609

SEQ ID NO: 679576 - RNA, 64 nt, hsa; identical to SEQ ID NO: 383610

SEQ ID NO: 679577 - RNA, 64 nt, hsa; identical to SEQ ID NO: 383611

SEQ ID NO: 679578 - RNA, 64 nt, hsa; identical to SEQ ID NO: 383612

SEQ ID NO: 679579 - RNA, 64 nt, hsa; identical to SEQ ID NO: 383613

SEQ ID NO: 679580 - RNA, 64 nt, hsa; identical to SEQ ID NO: 383614

SEQ ID NO: 679581 - RNA, 64 nt, hsa; identical to SEQ ID NO: 383615

SEQ ID NO: 679582 - RNA, 58 nt, hsa; identical to SEQ ID NO: 383616

SEQ ID NO: 679583 - RNA, 64 nt, hsa; identical to SEQ ID NO: 383617

SEQ ID NO: 679584 - RNA, 64 nt, hsa; identical to SEQ ID NO: 383618

SEQ ID NO: 679585 - RNA, 64 nt, hsa; identical to SEQ ID NO: 383619

SEQ ID NO: 679586 - RNA, 64 nt, hsa; identical to SEQ ID NO: 383620

SEQ ID NO: 679587 - RNA, 64 nt, hsa; identical to SEQ ID NO: 383621

SEQ ID NO: 679588 - RNA, 64 nt, hsa; identical to SEQ ID NO: 383622

SEQ ID NO: 679589 - RNA, 64 nt, hsa; identical to SEQ ID NO: 383623

SEQ ID NO: 679590 - RNA, 64 nt, hsa; identical to SEQ ID NO: 383624

SEQ ID NO: 679591 - RNA, 64 nt, hsa; identical to SEQ ID NO: 383625

SEQ ID NO: 679592 - RNA, 64 nt, hsa; identical to SEQ ID NO: 383626

SEQ ID NO: 679593 - RNA, 64 nt, hsa; identical to SEQ ID NO: 383627

SEQ ID NO: 679594 - RNA, 64 nt, hsa; identical to SEQ ID NO: 383628

SEQ ID NO: 679595 - RNA, 64 nt, hsa; identical to SEQ ID NO: 383629

SEQ ID NO: 679596 - RNA, 64 nt, hsa; identical to SEQ ID NO: 383630

SEQ ID NO: 679597 - RNA, 64 nt, hsa; identical to SEQ ID NO: 383631

SEQ ID NO: 679598 - RNA, 64 nt, hsa; identical to SEQ ID NO: 383632

SEQ ID NO: 679599 - RNA, 64 nt, hsa; identical to SEQ ID NO: 383633

SEQ ID NO: 679600 - RNA, 64 nt, hsa; identical to SEQ ID NO: 383634

SEQ ID NO: 679601 - RNA, 64 nt, hsa; identical to SEQ ID NO: 383635

SEQ ID NO: 679602 - RNA, 64 nt, hsa; identical to SEQ ID NO: 383636

SEQ ID NO: 679603 - RNA, 64 nt, hsa; identical to SEQ ID NO: 383637

SEQ ID NO: 679604 - RNA, 64 nt, hsa; identical to SEQ ID NO: 383638

SEQ ID NO: 679605 - RNA, 64 nt, hsa; identical to SEQ ID NO: 383639

SEQ ID NO: 679606 - RNA, 64 nt, hsa; identical to SEQ ID NO: 383640

SEQ ID NO: 679607 - RNA, 64 nt, hsa; identical to SEQ ID NO: 383641

SEQ ID NO: 679608 - RNA, 64 nt, hsa; identical to SEQ ID NO: 383642

SEQ ID NO: 679609 - RNA, 64 nt, hsa; identical to SEQ ID NO: 383643

SEQ ID NO: 679610 - RNA, 64 nt, hsa; identical to SEQ ID NO: 383644

SEQ ID NO: 679611 - RNA, 64 nt, hsa; identical to SEQ ID NO: 383645

SEQ ID NO: 679612 - RNA, 64 nt, hsa; identical to SEQ ID NO: 383646

SEQ ID NO: 679613 - RNA, 64 nt, hsa; identical to SEQ ID NO: 383647

SEQ ID NO: 679614 - RNA, 64 nt, hsa; identical to SEQ ID NO: 293538

SEQ ID NO: 679615 - RNA, 64 nt, hsa; identical to SEQ ID NO: 293539

SEQ ID NO: 679616 - RNA, 64 nt, hsa; identical to SEQ ID NO: 293540

SEQ ID NO: 679617 - RNA, 64 nt, hsa; identical to SEQ ID NO: 293541

SEQ ID NO: 679618 - RNA, 64 nt, hsa; identical to SEQ ID NO: 293542

SEQ ID NO: 679619 - RNA, 64 nt, hsa; identical to SEQ ID NO: 293543

SEQ ID NO: 679620 - RNA, 64 nt, hsa; identical to SEQ ID NO: 293544

SEQ ID NO: 679621 - RNA, 64 nt, hsa; identical to SEQ ID NO: 293545

SEQ ID NO: 679622 - RNA, 64 nt, hsa; identical to SEQ ID NO: 293546

SEQ ID NO: 679623 - RNA, 64 nt, hsa; identical to SEQ ID NO: 293547

SEQ ID NO: 679624 - RNA, 64 nt, hsa; identical to SEQ ID NO: 293548

SEQ ID NO: 679625 - RNA, 64 nt, hsa; identical to SEQ ID NO: 293549

SEQ ID NO: 679626 - RNA, 64 nt, hsa; identical to SEQ ID NO: 293550

SEQ ID NO: 679627 - RNA, 64 nt, hsa; identical to SEQ ID NO: 293551

SEQ ID NO: 679628 - RNA, 64 nt, hsa; identical to SEQ ID NO: 293552

SEQ ID NO: 679629 - RNA, 64 nt, hsa; identical to SEQ ID NO: 293553

SEQ ID NO: 679630 - RNA, 64 nt, hsa; identical to SEQ ID NO: 293554

SEQ ID NO: 679631 - RNA, 64 nt, hsa; identical to SEQ ID NO: 293555

SEQ ID NO: 679632 - RNA, 64 nt, hsa; identical to SEQ ID NO: 293556

SEQ ID NO: 679633 - RNA, 64 nt, hsa; identical to SEQ ID NO: 293557

SEQ ID NO: 679634 - RNA, 64 nt, hsa; identical to SEQ ID NO: 293558

SEQ ID NO: 679635 - RNA, 64 nt, hsa; identical to SEQ ID NO: 293559

SEQ ID NO: 679636 - RNA, 64 nt, hsa; identical to SEQ ID NO: 293560

SEQ ID NO: 679637 - RNA, 64 nt, hsa; identical to SEQ ID NO: 293561

SEQ ID NO: 679638 - RNA, 64 nt, hsa; identical to SEQ ID NO: 293562

SEQ ID NO: 679639 - RNA, 64 nt, hsa; identical to SEQ ID NO: 293563

SEQ ID NO: 679640 - RNA, 64 nt, hsa; identical to SEQ ID NO: 293564

SEQ ID NO: 679641 - RNA, 64 nt, hsa; identical to SEQ ID NO: 293565

SEQ ID NO: 679642 - RNA, 64 nt, hsa; identical to SEQ ID NO: 293566

SEQ ID NO: 679643 - RNA, 64 nt, hsa; identical to SEQ ID NO: 293567

SEQ ID NO: 679644 - RNA, 64 nt, hsa; identical to SEQ ID NO: 293568

SEQ ID NO: 679645 - RNA, 64 nt, hsa; identical to SEQ ID NO: 293569

SEQ ID NO: 679646 - RNA, 64 nt, hsa; identical to SEQ ID NO: 293570

SEQ ID NO: 679647 - RNA, 64 nt, hsa; identical to SEQ ID NO: 293571

SEQ ID NO: 679648 - RNA, 64 nt, hsa; identical to SEQ ID NO: 221340

SEQ ID NO: 679649 - RNA, 64 nt, hsa; identical to SEQ ID NO: 221341

SEQ ID NO: 679650 - RNA, 64 nt, hsa; identical to SEQ ID NO: 221342

SEQ ID NO: 679651 - RNA, 64 nt, hsa; identical to SEQ ID NO: 221343

SEQ ID NO: 679652 - RNA, 64 nt, hsa; identical to SEQ ID NO: 221344

SEQ ID NO: 679653 - RNA, 64 nt, hsa; identical to SEQ ID NO: 221345

SEQ ID NO: 679654 - RNA, 64 nt, hsa; identical to SEQ ID NO: 221346

SEQ ID NO: 679655 - RNA, 64 nt, hsa; identical to SEQ ID NO: 221347

SEQ ID NO: 679656 - RNA, 64 nt, hsa; identical to SEQ ID NO: 221348

SEQ ID NO: 679657 - RNA, 64 nt, hsa; identical to SEQ ID NO: 221349

SEQ ID NO: 679658 - RNA, 64 nt, hsa; identical to SEQ ID NO: 221350

SEQ ID NO: 679659 - RNA, 64 nt, hsa; identical to SEQ ID NO: 221351

SEQ ID NO: 679660 - RNA, 64 nt, hsa; identical to SEQ ID NO: 221352

SEQ ID NO: 679661 - RNA, 64 nt, hsa; identical to SEQ ID NO: 221353

SEQ ID NO: 679662 - RNA, 64 nt, hsa; identical to SEQ ID NO: 221354

SEQ ID NO: 679663 - RNA, 64 nt, hsa; identical to SEQ ID NO: 221355

SEQ ID NO: 679664 - RNA, 64 nt, hsa; identical to SEQ ID NO: 221356

SEQ ID NO: 679665 - RNA, 64 nt, hsa; identical to SEQ ID NO: 221357

SEQ ID NO: 679666 - RNA, 64 nt, hsa; identical to SEQ ID NO: 221358

SEQ ID NO: 679667 - RNA, 64 nt, hsa; identical to SEQ ID NO: 221359

SEQ ID NO: 679668 - RNA, 64 nt, hsa; identical to SEQ ID NO: 221360

SEQ ID NO: 679669 - RNA, 64 nt, hsa; identical to SEQ ID NO: 221361

SEQ ID NO: 679670 - RNA, 64 nt, hsa; identical to SEQ ID NO: 221362

SEQ ID NO: 679671 - RNA, 64 nt, hsa; identical to SEQ ID NO: 221363

SEQ ID NO: 679672 - RNA, 64 nt, hsa; identical to SEQ ID NO: 221364

SEQ ID NO: 679673 - RNA, 64 nt, hsa; identical to SEQ ID NO: 221365

SEQ ID NO: 679674 - RNA, 64 nt, hsa; identical to SEQ ID NO: 221366

SEQ ID NO: 679675 - RNA, 64 nt, hsa; identical to SEQ ID NO: 221367

SEQ ID NO: 679676 - RNA, 64 nt, hsa; identical to SEQ ID NO: 221368

SEQ ID NO: 679677 - RNA, 64 nt, hsa; identical to SEQ ID NO: 221369

SEQ ID NO: 679678 - RNA, 64 nt, hsa; identical to SEQ ID NO: 221370

SEQ ID NO: 679679 - RNA, 64 nt, hsa; identical to SEQ ID NO: 221371

SEQ ID NO: 679680 - RNA, 64 nt, hsa; identical to SEQ ID NO: 221372

SEQ ID NO: 679681 - RNA, 64 nt, hsa; identical to SEQ ID NO: 221373

SEQ ID NO: 679682 - RNA, 64 nt, hsa; identical to SEQ ID NO: 221374

SEQ ID NO: 679683 - RNA, 64 nt, hsa; identical to SEQ ID NO: 221375

SEQ ID NO: 679684 - RNA, 64 nt, hsa; identical to SEQ ID NO: 221376

SEQ ID NO: 679685 - RNA, 64 nt, hsa; identical to SEQ ID NO: 221377

SEQ ID NO: 679686 - RNA, 64 nt, hsa; identical to SEQ ID NO: 221378

SEQ ID NO: 679687 - RNA, 64 nt, hsa; identical to SEQ ID NO: 221379

SEQ ID NO: 679688 - RNA, 64 nt, hsa; identical to SEQ ID NO: 221380

SEQ ID NO: 679689 - RNA, 64 nt, hsa; identical to SEQ ID NO: 221381

SEQ ID NO: 679690 - RNA, 64 nt, hsa; identical to SEQ ID NO: 221382

SEQ ID NO: 679691 - RNA, 64 nt, hsa; identical to SEQ ID NO: 221383

SEQ ID NO: 679692 - RNA, 64 nt, hsa; identical to SEQ ID NO: 221384

SEQ ID NO: 679693 - RNA, 64 nt, hsa; identical to SEQ ID NO: 221385

SEQ ID NO: 679694 - RNA, 64 nt, hsa; identical to SEQ ID NO: 221386

SEQ ID NO: 679695 - RNA, 64 nt, hsa; identical to SEQ ID NO: 221387

SEQ ID NO: 679696 - RNA, 64 nt, hsa; identical to SEQ ID NO: 245089

SEQ ID NO: 679697 - RNA, 64 nt, hsa; identical to SEQ ID NO: 245090

SEQ ID NO: 679698 - RNA, 64 nt, hsa; identical to SEQ ID NO: 245091

SEQ ID NO: 679699 - RNA, 56 nt, hsa; identical to SEQ ID NO: 238493

SEQ ID NO: 679700 - RNA, 64 nt, hsa; identical to SEQ ID NO: 245093

SEQ ID NO: 679701 - RNA, 64 nt, hsa; identical to SEQ ID NO: 245094

SEQ ID NO: 679702 - RNA, 64 nt, hsa; identical to SEQ ID NO: 245095

SEQ ID NO: 679703 - RNA, 64 nt, hsa; identical to SEQ ID NO: 245096

SEQ ID NO: 679704 - RNA, 64 nt, hsa; identical to SEQ ID NO: 245097

SEQ ID NO: 679705 - RNA, 64 nt, hsa; identical to SEQ ID NO: 245098

SEQ ID NO: 679706 - RNA, 64 nt, hsa; identical to SEQ ID NO: 245099

SEQ ID NO: 679707 - RNA, 64 nt, hsa; identical to SEQ ID NO: 245100

SEQ ID NO: 679708 - RNA, 64 nt, hsa; identical to SEQ ID NO: 245101

SEQ ID NO: 679709 - RNA, 64 nt, hsa; identical to SEQ ID NO: 245102

SEQ ID NO: 679710 - RNA, 64 nt, hsa; identical to SEQ ID NO: 533731

SEQ ID NO: 679711 - RNA, 64 nt, hsa; identical to SEQ ID NO: 533732

SEQ ID NO: 679712 - RNA, 64 nt, hsa; identical to SEQ ID NO: 533733

SEQ ID NO: 679713 - RNA, 64 nt, hsa; identical to SEQ ID NO: 533734

SEQ ID NO: 679714 - RNA, 64 nt, hsa; identical to SEQ ID NO: 533735

SEQ ID NO: 679715 - RNA, 64 nt, hsa; identical to SEQ ID NO: 533736

SEQ ID NO: 679716 - RNA, 64 nt, hsa; identical to SEQ ID NO: 533737

SEQ ID NO: 679717 - RNA, 64 nt, hsa; identical to SEQ ID NO: 533738

SEQ ID NO: 679718 - RNA, 64 nt, hsa
caggguuuuuuuuuuuuuguuuaagcugacucuuugcucuaauuuuggaaaaaaagaaauguga

SEQ ID NO: 679719 - RNA, 64 nt, hsa
gcacguuguggggucgggggguggggcggggaagugcucuaacuuuucuuaagguuuuguugcu

SEQ ID NO: 679720 - RNA, 64 nt, hsa
uuauuuuugucuauuucuauuuuaguuguggcuuugcucuaagaauggguaauaguuguacuac

SEQ ID NO: 679721 - RNA, 64 nt, hsa
uuagcuauuauuuuuuuaaugacaacauagacugugcucuaaguuuaaaagauggggaagcuua

SEQ ID NO: 679722 - RNA, 64 nt, hsa
uucugacuuagauacugauuuuaaugccaguaucugcucuaaauauuuaugauaaaaaugcauu

SEQ ID NO: 679723 - RNA, 64 nt, hsa
acuaaucauagauccugaccagcauuuguaacacugcucuaacuaggacacagcaugcagcagc

SEQ ID NO: 679724 - RNA, 64 nt, hsa
auuauaaaguauuaagacaacaccacaggccgcaugcucuaaucggucucuuuauauacucagg

SEQ ID NO: 679725 - RNA, 64 nt, hsa
agggaguaccucuaaagacagauuaaucagaaugugcucuaaagcuuauuguuugaauuuauac

SEQ ID NO: 679726 - RNA, 64 nt, hsa; identical to SEQ ID NO: 276789

SEQ ID NO: 679727 - RNA, 64 nt, hsa; identical to SEQ ID NO: 276790

SEQ ID NO: 679728 - RNA, 64 nt, hsa; identical to SEQ ID NO: 276791

SEQ ID NO: 679729 - RNA, 64 nt, hsa; identical to SEQ ID NO: 276792

SEQ ID NO: 679730 - RNA, 64 nt, hsa; identical to SEQ ID NO: 276793

SEQ ID NO: 679731 - RNA, 64 nt, hsa; identical to SEQ ID NO: 276794

SEQ ID NO: 679732 - RNA, 64 nt, hsa; identical to SEQ ID NO: 276795

SEQ ID NO: 679733 - RNA, 64 nt, hsa; identical to SEQ ID NO: 276796

SEQ ID NO: 679734 - RNA, 64 nt, hsa; identical to SEQ ID NO: 276797

SEQ ID NO: 679735 - RNA, 64 nt, hsa; identical to SEQ ID NO: 276798

SEQ ID NO: 679736 - RNA, 64 nt, hsa; identical to SEQ ID NO: 276799

SEQ ID NO: 679737 - RNA, 64 nt, hsa; identical to SEQ ID NO: 276800

SEQ ID NO: 679738 - RNA, 64 nt, hsa; identical to SEQ ID NO: 276801

SEQ ID NO: 679739 - RNA, 64 nt, hsa; identical to SEQ ID NO: 276802

SEQ ID NO: 679740 - RNA, 64 nt, hsa; identical to SEQ ID NO: 276803

SEQ ID NO: 679741 - RNA, 64 nt, hsa; identical to SEQ ID NO: 276804

SEQ ID NO: 679742 - RNA, 64 nt, hsa; identical to SEQ ID NO: 276805

SEQ ID NO: 679743 - RNA, 64 nt, hsa; identical to SEQ ID NO: 276806

SEQ ID NO: 679744 - RNA, 64 nt, hsa; identical to SEQ ID NO: 276807

SEQ ID NO: 679745 - RNA, 64 nt, hsa; identical to SEQ ID NO: 276808

SEQ ID NO: 679746 - RNA, 64 nt, hsa; identical to SEQ ID NO: 276809

SEQ ID NO: 679747 - RNA, 64 nt, hsa; identical to SEQ ID NO: 276810

SEQ ID NO: 679748 - RNA, 64 nt, hsa; identical to SEQ ID NO: 276811

SEQ ID NO: 679749 - RNA, 64 nt, hsa; identical to SEQ ID NO: 276812

SEQ ID NO: 679750 - RNA, 64 nt, hsa; identical to SEQ ID NO: 276813

SEQ ID NO: 679751 - RNA, 64 nt, hsa; identical to SEQ ID NO: 276814

SEQ ID NO: 679752 - RNA, 64 nt, hsa; identical to SEQ ID NO: 276815

SEQ ID NO: 679753 - RNA, 64 nt, hsa; identical to SEQ ID NO: 276816

SEQ ID NO: 679754 - RNA, 64 nt, hsa; identical to SEQ ID NO: 276817

SEQ ID NO: 679755 - RNA, 64 nt, hsa; identical to SEQ ID NO: 276818

SEQ ID NO: 679756 - RNA, 64 nt, hsa; identical to SEQ ID NO: 276819

SEQ ID NO: 679757 - RNA, 64 nt, hsa; identical to SEQ ID NO: 276820

SEQ ID NO: 679758 - RNA, 64 nt, hsa; identical to SEQ ID NO: 276821

SEQ ID NO: 679759 - RNA, 64 nt, hsa; identical to SEQ ID NO: 276822

SEQ ID NO: 679760 - RNA, 64 nt, hsa; identical to SEQ ID NO: 276823

SEQ ID NO: 679761 - RNA, 64 nt, hsa; identical to SEQ ID NO: 276824

SEQ ID NO: 679762 - RNA, 64 nt, hsa; identical to SEQ ID NO: 276825

SEQ ID NO: 679763 - RNA, 64 nt, hsa; identical to SEQ ID NO: 276826

SEQ ID NO: 679764 - RNA, 64 nt, hsa; identical to SEQ ID NO: 276827

SEQ ID NO: 679765 - RNA, 64 nt, hsa; identical to SEQ ID NO: 276828

SEQ ID NO: 679766 - RNA, 64 nt, hsa; identical to SEQ ID NO: 276829

SEQ ID NO: 679767 - RNA, 64 nt, hsa; identical to SEQ ID NO: 276830

SEQ ID NO: 679768 - RNA, 64 nt, hsa; identical to SEQ ID NO: 276831

SEQ ID NO: 679769 - RNA, 64 nt, hsa; identical to SEQ ID NO: 276832

SEQ ID NO: 679770 - RNA, 64 nt, hsa; identical to SEQ ID NO: 276833

SEQ ID NO: 679771 - RNA, 64 nt, hsa; identical to SEQ ID NO: 276834

SEQ ID NO: 679772 - RNA, 64 nt, hsa; identical to SEQ ID NO: 276835

SEQ ID NO: 679773 - RNA, 64 nt, hsa; identical to SEQ ID NO: 276836

SEQ ID NO: 679774 - RNA, 64 nt, hsa; identical to SEQ ID NO: 276837

SEQ ID NO: 679775 - RNA, 64 nt, hsa; identical to SEQ ID NO: 276838

SEQ ID NO: 679776 - RNA, 64 nt, hsa; identical to SEQ ID NO: 276839

SEQ ID NO: 679777 - RNA, 64 nt, hsa; identical to SEQ ID NO: 276840

SEQ ID NO: 679778 - RNA, 64 nt, hsa; identical to SEQ ID NO: 276841

SEQ ID NO: 679779 - RNA, 64 nt, hsa; identical to SEQ ID NO: 276842

SEQ ID NO: 679780 - RNA, 64 nt, hsa; identical to SEQ ID NO: 276843

SEQ ID NO: 679781 - RNA, 64 nt, hsa; identical to SEQ ID NO: 276844

SEQ ID NO: 679782 - RNA, 64 nt, hsa; identical to SEQ ID NO: 276845

SEQ ID NO: 679783 - RNA, 64 nt, hsa; identical to SEQ ID NO: 276846

SEQ ID NO: 679784 - RNA, 64 nt, hsa; identical to SEQ ID NO: 276847

SEQ ID NO: 679785 - RNA, 64 nt, hsa; identical to SEQ ID NO: 276848

SEQ ID NO: 679786 - RNA, 64 nt, hsa; identical to SEQ ID NO: 276849

SEQ ID NO: 679787 - RNA, 64 nt, hsa; identical to SEQ ID NO: 276850

SEQ ID NO: 679788 - RNA, 64 nt, hsa; identical to SEQ ID NO: 276851

SEQ ID NO: 679789 - RNA, 64 nt, hsa; identical to SEQ ID NO: 276852

SEQ ID NO: 679790 - RNA, 64 nt, hsa; identical to SEQ ID NO: 276853

SEQ ID NO: 679791 - RNA, 64 nt, hsa; identical to SEQ ID NO: 276854

SEQ ID NO: 679792 - RNA, 64 nt, hsa; identical to SEQ ID NO: 276855

SEQ ID NO: 679793 - RNA, 64 nt, hsa; identical to SEQ ID NO: 276856

SEQ ID NO: 679794 - RNA, 64 nt, hsa; identical to SEQ ID NO: 276857

SEQ ID NO: 679795 - RNA, 64 nt, hsa; identical to SEQ ID NO: 172184

SEQ ID NO: 679796 - RNA, 64 nt, hsa; identical to SEQ ID NO: 172185

SEQ ID NO: 679797 - RNA, 64 nt, hsa; identical to SEQ ID NO: 172186

SEQ ID NO: 679798 - RNA, 64 nt, hsa; identical to SEQ ID NO: 172187

SEQ ID NO: 679799 - RNA, 64 nt, hsa; identical to SEQ ID NO: 172188

SEQ ID NO: 679800 - RNA, 64 nt, hsa; identical to SEQ ID NO: 172189

SEQ ID NO: 679801 - RNA, 64 nt, hsa; identical to SEQ ID NO: 172190

SEQ ID NO: 679802 - RNA, 64 nt, hsa; identical to SEQ ID NO: 172191

SEQ ID NO: 679803 - RNA, 64 nt, hsa; identical to SEQ ID NO: 172192

SEQ ID NO: 679804 - RNA, 64 nt, hsa; identical to SEQ ID NO: 172193

SEQ ID NO: 679805 - RNA, 64 nt, hsa; identical to SEQ ID NO: 172194

SEQ ID NO: 679806 - RNA, 64 nt, hsa; identical to SEQ ID NO: 172195

SEQ ID NO: 679807 - RNA, 64 nt, hsa; identical to SEQ ID NO: 172196

SEQ ID NO: 679808 - RNA, 64 nt, hsa; identical to SEQ ID NO: 172197

SEQ ID NO: 679809 - RNA, 64 nt, hsa; identical to SEQ ID NO: 172198

SEQ ID NO: 679810 - RNA, 64 nt, hsa; identical to SEQ ID NO: 172199

SEQ ID NO: 679811 - RNA, 64 nt, hsa; identical to SEQ ID NO: 172200

SEQ ID NO: 679812 - RNA, 64 nt, hsa; identical to SEQ ID NO: 172201

SEQ ID NO: 679813 - RNA, 64 nt, hsa; identical to SEQ ID NO: 172202

SEQ ID NO: 679814 - RNA, 64 nt, hsa; identical to SEQ ID NO: 172203

SEQ ID NO: 679815 - RNA, 64 nt, hsa; identical to SEQ ID NO: 172204

SEQ ID NO: 679816 - RNA, 64 nt, hsa; identical to SEQ ID NO: 172205

SEQ ID NO: 679817 - RNA, 64 nt, hsa; identical to SEQ ID NO: 172206

SEQ ID NO: 679818 - RNA, 64 nt, hsa; identical to SEQ ID NO: 172207

SEQ ID NO: 679819 - RNA, 64 nt, hsa; identical to SEQ ID NO: 172208

SEQ ID NO: 679820 - RNA, 64 nt, hsa; identical to SEQ ID NO: 172209

SEQ ID NO: 679821 - RNA, 64 nt, hsa; identical to SEQ ID NO: 172210

SEQ ID NO: 679822 - RNA, 64 nt, hsa; identical to SEQ ID NO: 172211

SEQ ID NO: 679823 - RNA, 64 nt, hsa; identical to SEQ ID NO: 172212

SEQ ID NO: 679824 - RNA, 64 nt, hsa; identical to SEQ ID NO: 172213

SEQ ID NO: 679825 - RNA, 64 nt, hsa; identical to SEQ ID NO: 172214

SEQ ID NO: 679826 - RNA, 64 nt, hsa; identical to SEQ ID NO: 172215

SEQ ID NO: 679827 - RNA, 64 nt, hsa; identical to SEQ ID NO: 172216

SEQ ID NO: 679828 - RNA, 64 nt, hsa; identical to SEQ ID NO: 172217

SEQ ID NO: 679829 - RNA, 64 nt, hsa; identical to SEQ ID NO: 172218

SEQ ID NO: 679830 - RNA, 64 nt, hsa; identical to SEQ ID NO: 172219

SEQ ID NO: 679831 - RNA, 64 nt, hsa; identical to SEQ ID NO: 172220

SEQ ID NO: 679832 - RNA, 64 nt, hsa; identical to SEQ ID NO: 172221

SEQ ID NO: 679833 - RNA, 64 nt, hsa; identical to SEQ ID NO: 172222

SEQ ID NO: 679834 - RNA, 64 nt, hsa; identical to SEQ ID NO: 172223

SEQ ID NO: 679835 - RNA, 64 nt, hsa; identical to SEQ ID NO: 172224

SEQ ID NO: 679836 - RNA, 64 nt, hsa; identical to SEQ ID NO: 172225

SEQ ID NO: 679837 - RNA, 64 nt, hsa; identical to SEQ ID NO: 172226

SEQ ID NO: 679838 - RNA, 64 nt, hsa; identical to SEQ ID NO: 172227

SEQ ID NO: 679839 - RNA, 64 nt, hsa; identical to SEQ ID NO: 172228

SEQ ID NO: 679840 - RNA, 64 nt, hsa; identical to SEQ ID NO: 172229

SEQ ID NO: 679841 - RNA, 64 nt, hsa; identical to SEQ ID NO: 172230

SEQ ID NO: 679842 - RNA, 64 nt, hsa; identical to SEQ ID NO: 172231

SEQ ID NO: 679843 - RNA, 64 nt, hsa; identical to SEQ ID NO: 172232

SEQ ID NO: 679844 - RNA, 64 nt, hsa; identical to SEQ ID NO: 172233

SEQ ID NO: 679845 - RNA, 64 nt, hsa; identical to SEQ ID NO: 172234

SEQ ID NO: 679846 - RNA, 64 nt, hsa; identical to SEQ ID NO: 172235

SEQ ID NO: 679847 - RNA, 64 nt, hsa; identical to SEQ ID NO: 172236

SEQ ID NO: 679848 - RNA, 64 nt, hsa; identical to SEQ ID NO: 172237

SEQ ID NO: 679849 - RNA, 64 nt, hsa; identical to SEQ ID NO: 172238

SEQ ID NO: 679850 - RNA, 64 nt, hsa
acaucuaaaacuaaauaaauagaaaacaccaggccagaacuauagucauacucacacaaaggga

SEQ ID NO: 679851 - RNA, 64 nt, hsa
guccaaggggacaaauaaaggcagagagaagagacagaacuaaaaauacgaggaaaggagagug

SEQ ID NO: 679852 - RNA, 64 nt, hsa
cccgggggccucagaacuaccccuuccagggccucagaacuaccccuacaguuucuccugcgua

SEQ ID NO: 679853 - RNA, 64 nt, hsa
cccuggaccugcagcuccgcacccccgggggccucagaacuaccccuuccagggccucagaacu

SEQ ID NO: 679854 - RNA, 64 nt, hsa
augcauugauucuaacaaacuguaaugcccucaacagaacuaauuuuacuaauacaauacugug

SEQ ID NO: 679855 - RNA, 64 nt, hsa
auagccaaucuauacaucauggguaaacuuaacccagaacuauaaaauguaguugucucagucc

SEQ ID NO: 679856 - RNA, 64 nt, hsa
uaguuuccucuccugcucugugcaguagcuuuuccagaacuauggacaaauugaucagaagaag

SEQ ID NO: 679857 - RNA, 64 nt, hsa
ccuuacaguuuuccuagcugaugagggacagaaccagaacuagagccugagcccaacccacauc

SEQ ID NO: 679858 - RNA, 64 nt, hsa
gccuucuagggauuuauuuuucccauaguguaucaguuguuaugccacaauaacaacaauaaua

SEQ ID NO: 679859 - RNA, 64 nt, hsa
aacauuacuaagccccaguucuaucguuggaaggaguuguuauucuuuuguuguucccuuaugc

SEQ ID NO: 679860 - RNA, 64 nt, hsa
uggguagcucccugauuuggagccagcuguuuccaguuguuacugaaguuaucuguguuauuug

SEQ ID NO: 679861 - RNA, 64 nt, hsa
acucaaaguaagauuuaugaauuauuuaaaugauaguuguuacuuggaacagccacuugagagg

SEQ ID NO: 679862 - RNA, 64 nt, hsa
auucauguugaaugccuuuuugcaaugaugacugaguuguuaucauaguauuuuaaaaccugua

SEQ ID NO: 679863 - RNA, 64 nt, hsa
cuaccaggcuuuccaucugaauaguaaauuaaacaguuguuaucaaaaugauuuuaaagacuau

SEQ ID NO: 679864 - RNA, 64 nt, hsa
auucacagcgcuaugcaauucuuaauuuucauuaaguuguuauuucaguuuuaaauguaccuuc

SEQ ID NO: 679865 - RNA, 64 nt, hsa
cuucuacuucagucuucucucacuuugauuugcuaguuguuaucaauuaaugacaauuacaaac

SEQ ID NO: 679866 - RNA, 64 nt, hsa
aaauaucauuuuuaguauaucuugucgaucuuuaaguuguuacuauuguguuauucaugucuuu

SEQ ID NO: 679867 - RNA, 64 nt, hsa
auuuauaacacuuaauacaauguaaaugcuauguaguuguuauaccauacugguuagugaauaa

SEQ ID NO: 679868 - RNA, 64 nt, hsa
aacucuuagccuacaagguggcucuuauguacauaguuguuaauacauccaauuaaugaugucu

SEQ ID NO: 679869 - RNA, 64 nt, hsa
uugacgucuuuggaguugacauggaacagcagguaguuguuauguagagcuaguucucaaagcu

SEQ ID NO: 679870 - RNA, 64 nt, hsa
cggaaaacucaaaaugguggcaguucuuauuaccaguuguuaguauuguuucuggaaacugcuu

SEQ ID NO: 679871 - RNA, 64 nt, hsa
aagcacauugcagauuguucuuggagaauucuggaguuguuaugaacaugaauaccaacggaaa

SEQ ID NO: 679872 - RNA, 64 nt, hsa
auaagguauuugcauuuuagaagcucuggccaguaguuguuaagauguuggcauuaauggcauu

SEQ ID NO: 679873 - RNA, 64 nt, hsa
augggggacagugaggaggacacaccagcccauuaguuguuaaucaucaaucacaucugauugu

SEQ ID NO: 679874 - RNA, 64 nt, hsa
aaucuuuucccauauaauccaacugcacuuuugaaguuguuaaaauacauagaggugauaagua

SEQ ID NO: 679875 - RNA, 64 nt, hsa
gcaagaaaucacauaacuuuuauuucuaagagacaguuguuaggcaguuguugcaaauagauga

SEQ ID NO: 679876 - RNA, 64 nt, hsa
cuuauaccuaucacaauguaaauacuauguaaauaguuguuauacuguauuuuucaauuugcau

SEQ ID NO: 679877 - RNA, 64 nt, hsa
ucaacuggggaaggauccacauccagacuaacauaguuguuacccaauguauuuccgugaggcc

SEQ ID NO: 679878 - RNA, 64 nt, hsa
aacuucaagcaaaugaaauggacaaugcagauaaaguuguuaucaacacgucgggaguaugugu

SEQ ID NO: 679879 - RNA, 64 nt, hsa
gaagcaauuccuuuuauuucuuucaccuuucauaaguuguuaucuagucaauguaauguauauu

SEQ ID NO: 679880 - RNA, 64 nt, hsa
guugugacuccaagagcagagugaggaagacccccaagcauagacucggguacugugaugaugg

SEQ ID NO: 679881 - RNA, 64 nt, hsa
ggucaugacuccaagagcagagcagggaagagcccaagcauagacuuggugccguggugauggc

SEQ ID NO: 679882 - RNA, 64 nt, hsa
aggggaauaugcuaaauguuaccaccagagggcacaagcauaucacuuuuaguaaggaaauuac

SEQ ID NO: 679883 - RNA, 64 nt, hsa
gcuacacuaagacugaauuaucuuauuagucuggcaagcauauaaaguauacuuguauguaaug

SEQ ID NO: 679884 - RNA, 64 nt, hsa
gugugugguggugguugugguauuuauaauaaugcaagcauacccucccuugagucucaauuga

SEQ ID NO: 679885 - RNA, 64 nt, hsa
caacuugggauccugaagauaaauauguguuggacaagcauagaaagugauuuauauuuuuaau

SEQ ID NO: 679886 - RNA, 64 nt, hsa; identical to SEQ ID NO: 179925

SEQ ID NO: 679887 - RNA, 64 nt, hsa; identical to SEQ ID NO: 179926

SEQ ID NO: 679888 - RNA, 64 nt, hsa; identical to SEQ ID NO: 179927

SEQ ID NO: 679889 - RNA, 64 nt, hsa; identical to SEQ ID NO: 179928

SEQ ID NO: 679890 - RNA, 64 nt, hsa; identical to SEQ ID NO: 179929

SEQ ID NO: 679891 - RNA, 64 nt, hsa; identical to SEQ ID NO: 179930

SEQ ID NO: 679892 - RNA, 64 nt, hsa; identical to SEQ ID NO: 179931

SEQ ID NO: 679893 - RNA, 64 nt, hsa; identical to SEQ ID NO: 179932

SEQ ID NO: 679894 - RNA, 64 nt, hsa; identical to SEQ ID NO: 179933

SEQ ID NO: 679895 - RNA, 64 nt, hsa; identical to SEQ ID NO: 179934

SEQ ID NO: 679896 - RNA, 64 nt, hsa; identical to SEQ ID NO: 179935

SEQ ID NO: 679897 - RNA, 64 nt, hsa; identical to SEQ ID NO: 179936

SEQ ID NO: 679898 - RNA, 64 nt, hsa; identical to SEQ ID NO: 179937

SEQ ID NO: 679899 - RNA, 64 nt, hsa; identical to SEQ ID NO: 179938

SEQ ID NO: 679900 - RNA, 64 nt, hsa; identical to SEQ ID NO: 179939

SEQ ID NO: 679901 - RNA, 64 nt, hsa; identical to SEQ ID NO: 179940

SEQ ID NO: 679902 - RNA, 64 nt, hsa; identical to SEQ ID NO: 179941

SEQ ID NO: 679903 - RNA, 64 nt, hsa; identical to SEQ ID NO: 179942

SEQ ID NO: 679904 - RNA, 64 nt, hsa; identical to SEQ ID NO: 179943

SEQ ID NO: 679905 - RNA, 64 nt, hsa; identical to SEQ ID NO: 247175

SEQ ID NO: 679906 - RNA, 64 nt, hsa; identical to SEQ ID NO: 247176

SEQ ID NO: 679907 - RNA, 64 nt, hsa; identical to SEQ ID NO: 247177

SEQ ID NO: 679908 - RNA, 64 nt, hsa; identical to SEQ ID NO: 247178

SEQ ID NO: 679909 - RNA, 64 nt, hsa; identical to SEQ ID NO: 247179

SEQ ID NO: 679910 - RNA, 64 nt, hsa; identical to SEQ ID NO: 247180

SEQ ID NO: 679911 - RNA, 64 nt, hsa; identical to SEQ ID NO: 247181

SEQ ID NO: 679912 - RNA, 64 nt, hsa; identical to SEQ ID NO: 247182

SEQ ID NO: 679913 - RNA, 64 nt, hsa; identical to SEQ ID NO: 247183

SEQ ID NO: 679914 - RNA, 64 nt, hsa; identical to SEQ ID NO: 247184

SEQ ID NO: 679915 - RNA, 64 nt, hsa; identical to SEQ ID NO: 247185

SEQ ID NO: 679916 - RNA, 64 nt, hsa; identical to SEQ ID NO: 247186

SEQ ID NO: 679917 - RNA, 64 nt, hsa; identical to SEQ ID NO: 247187

SEQ ID NO: 679918 - RNA, 64 nt, hsa; identical to SEQ ID NO: 247188

SEQ ID NO: 679919 - RNA, 64 nt, hsa; identical to SEQ ID NO: 247189

SEQ ID NO: 679920 - RNA, 64 nt, hsa; identical to SEQ ID NO: 247190

SEQ ID NO: 679921 - RNA, 64 nt, hsa; identical to SEQ ID NO: 247191

SEQ ID NO: 679922 - RNA, 64 nt, hsa; identical to SEQ ID NO: 247192

SEQ ID NO: 679923 - RNA, 64 nt, hsa; identical to SEQ ID NO: 247193

SEQ ID NO: 679924 - RNA, 64 nt, hsa; identical to SEQ ID NO: 247194

SEQ ID NO: 679925 - RNA, 64 nt, hsa; identical to SEQ ID NO: 247195

SEQ ID NO: 679926 - RNA, 64 nt, hsa; identical to SEQ ID NO: 247196

SEQ ID NO: 679927 - RNA, 64 nt, hsa; identical to SEQ ID NO: 247197

SEQ ID NO: 679928 - RNA, 64 nt, hsa; identical to SEQ ID NO: 247198

SEQ ID NO: 679929 - RNA, 64 nt, hsa; identical to SEQ ID NO: 247199

SEQ ID NO: 679930 - RNA, 64 nt, hsa; identical to SEQ ID NO: 247200

SEQ ID NO: 679931 - RNA, 64 nt, hsa; identical to SEQ ID NO: 247201

SEQ ID NO: 679932 - RNA, 61 nt, hsa; identical to SEQ ID NO: 247202

SEQ ID NO: 679933 - RNA, 64 nt, hsa; identical to SEQ ID NO: 247203

SEQ ID NO: 679934 - RNA, 64 nt, hsa; identical to SEQ ID NO: 247204

SEQ ID NO: 679935 - RNA, 64 nt, hsa; identical to SEQ ID NO: 247205

SEQ ID NO: 679936 - RNA, 64 nt, hsa; identical to SEQ ID NO: 247206

SEQ ID NO: 679937 - RNA, 64 nt, hsa; identical to SEQ ID NO: 247207

SEQ ID NO: 679938 - RNA, 64 nt, hsa; identical to SEQ ID NO: 247208

SEQ ID NO: 679939 - RNA, 64 nt, hsa; identical to SEQ ID NO: 247209

SEQ ID NO: 679940 - RNA, 64 nt, hsa; identical to SEQ ID NO: 247210

SEQ ID NO: 679941 - RNA, 64 nt, hsa; identical to SEQ ID NO: 247211

SEQ ID NO: 679942 - RNA, 64 nt, hsa; identical to SEQ ID NO: 247212

SEQ ID NO: 679943 - RNA, 64 nt, hsa; identical to SEQ ID NO: 247213

SEQ ID NO: 679944 - RNA, 64 nt, hsa; identical to SEQ ID NO: 247214

SEQ ID NO: 679945 - RNA, 64 nt, hsa; identical to SEQ ID NO: 247215

SEQ ID NO: 679946 - RNA, 64 nt, hsa; identical to SEQ ID NO: 247216

SEQ ID NO: 679947 - RNA, 64 nt, hsa; identical to SEQ ID NO: 247217

SEQ ID NO: 679948 - RNA, 64 nt, hsa; identical to SEQ ID NO: 247218

SEQ ID NO: 679949 - RNA, 64 nt, hsa; identical to SEQ ID NO: 247219

SEQ ID NO: 679950 - RNA, 64 nt, hsa; identical to SEQ ID NO: 247220

SEQ ID NO: 679951 - RNA, 64 nt, hsa; identical to SEQ ID NO: 247221

SEQ ID NO: 679952 - RNA, 64 nt, hsa; identical to SEQ ID NO: 247222

SEQ ID NO: 679953 - RNA, 64 nt, hsa; identical to SEQ ID NO: 247223

SEQ ID NO: 679954 - RNA, 64 nt, hsa; identical to SEQ ID NO: 247224

SEQ ID NO: 679955 - RNA, 64 nt, hsa; identical to SEQ ID NO: 247225

SEQ ID NO: 679956 - RNA, 64 nt, hsa; identical to SEQ ID NO: 247226

SEQ ID NO: 679957 - RNA, 64 nt, hsa; identical to SEQ ID NO: 247227

SEQ ID NO: 679958 - RNA, 64 nt, hsa; identical to SEQ ID NO: 247228

SEQ ID NO: 679959 - RNA, 64 nt, hsa; identical to SEQ ID NO: 247229

SEQ ID NO: 679960 - RNA, 64 nt, hsa; identical to SEQ ID NO: 247230

SEQ ID NO: 679961 - RNA, 64 nt, hsa; identical to SEQ ID NO: 247231

SEQ ID NO: 679962 - RNA, 64 nt, hsa; identical to SEQ ID NO: 247232

SEQ ID NO: 679963 - RNA, 64 nt, hsa; identical to SEQ ID NO: 247233

SEQ ID NO: 679964 - RNA, 64 nt, hsa; identical to SEQ ID NO: 247234

SEQ ID NO: 679965 - RNA, 64 nt, hsa; identical to SEQ ID NO: 247235

SEQ ID NO: 679966 - RNA, 64 nt, hsa; identical to SEQ ID NO: 247236

SEQ ID NO: 679967 - RNA, 64 nt, hsa; identical to SEQ ID NO: 247237

SEQ ID NO: 679968 - RNA, 64 nt, hsa; identical to SEQ ID NO: 247238

SEQ ID NO: 679969 - RNA, 64 nt, hsa; identical to SEQ ID NO: 247239

SEQ ID NO: 679970 - RNA, 64 nt, hsa; identical to SEQ ID NO: 247240

SEQ ID NO: 679971 - RNA, 64 nt, hsa; identical to SEQ ID NO: 247241

SEQ ID NO: 679972 - RNA, 64 nt, hsa; identical to SEQ ID NO: 247242

SEQ ID NO: 679973 - RNA, 64 nt, hsa; identical to SEQ ID NO: 247243

SEQ ID NO: 679974 - RNA, 64 nt, hsa; identical to SEQ ID NO: 247244

SEQ ID NO: 679975 - RNA, 64 nt, hsa; identical to SEQ ID NO: 247245

SEQ ID NO: 679976 - RNA, 64 nt, hsa; identical to SEQ ID NO: 247246

SEQ ID NO: 679977 - RNA, 64 nt, hsa; identical to SEQ ID NO: 247247

SEQ ID NO: 679978 - RNA, 64 nt, hsa; identical to SEQ ID NO: 247248

SEQ ID NO: 679979 - RNA, 64 nt, hsa; identical to SEQ ID NO: 247249

SEQ ID NO: 679980 - RNA, 64 nt, hsa; identical to SEQ ID NO: 247250

SEQ ID NO: 679981 - RNA, 64 nt, hsa; identical to SEQ ID NO: 247251

SEQ ID NO: 679982 - RNA, 64 nt, hsa; identical to SEQ ID NO: 247252

SEQ ID NO: 679983 - RNA, 64 nt, hsa; identical to SEQ ID NO: 74555

SEQ ID NO: 679984 - RNA, 64 nt, hsa; identical to SEQ ID NO: 74556

SEQ ID NO: 679985 - RNA, 64 nt, hsa; identical to SEQ ID NO: 74557

SEQ ID NO: 679986 - RNA, 64 nt, hsa; identical to SEQ ID NO: 74558

SEQ ID NO: 679987 - RNA, 64 nt, hsa; identical to SEQ ID NO: 74559

SEQ ID NO: 679988 - RNA, 64 nt, hsa; identical to SEQ ID NO: 74560

SEQ ID NO: 679989 - RNA, 64 nt, hsa
uugacaguggccugcugcacuggcggauuggugggggggacaccacugagcauauccagaccca

SEQ ID NO: 679990 - RNA, 64 nt, hsa
agauggcugugguacugcuggccaaccuggcucagggggacagccuggcagcucgugccauugc

SEQ ID NO: 679991 - RNA, 64 nt, hsa
uguaauauuaagugccuugagcuggaauggggaagggggacaagggucagucugucgggugggg

SEQ ID NO: 679992 - RNA, 64 nt, hsa
agugacauauguauuguuuaucuggguuagggaugggggacagauaacagaacgagcaaaguaa

SEQ ID NO: 679993 - RNA, 64 nt, hsa
uguggggagaguggaagaggcagggaguaauccugggggacagcagggaggaggcacuucuucc

SEQ ID NO: 679994 - RNA, 64 nt, hsa
gaacugaccacggccuggaggacuggcccaggcagggggacagggaaaauggagcccaaguagc

SEQ ID NO: 679995 - RNA, 64 nt, hsa
ucucaaugcccucguaucaauaagaccgggguaagggggacaggauacuugucacauauuugaa

SEQ ID NO: 679996 - RNA, 64 nt, hsa
ugcagcucccacuucuuuagccgggcagcuguuugggggacaagagagggccagggucugugcu

SEQ ID NO: 679997 - RNA, 64 nt, hsa
cagccaaggaggugggggcaagggucagggcaaugggggacaaugccgcucagggugcagugag

SEQ ID NO: 679998 - RNA, 64 nt, hsa
gcagggugggagcaggggcuggcgugggaggucugggggacagacaaggaugauggaccccuca

SEQ ID NO: 679999 - RNA, 64 nt, hsa
agcccaggccuugggaccuggggguuggugauuugggggacagugcuacacucgucuccacugu

SEQ ID NO: 680000 - RNA, 64 nt, hsa
ccuuucaaugucccuggaguugggagggaggaaugggggacauaaagccuguccugucucuauu

SEQ ID NO: 680001 - RNA, 64 nt, hsa; identical to SEQ ID NO: 80199

SEQ ID NO: 680002 - RNA, 64 nt, hsa; identical to SEQ ID NO: 80200

SEQ ID NO: 680003 - RNA, 64 nt, hsa; identical to SEQ ID NO: 80201

SEQ ID NO: 680004 - RNA, 64 nt, hsa; identical to SEQ ID NO: 80202

SEQ ID NO: 680005 - RNA, 64 nt, hsa; identical to SEQ ID NO: 80203

SEQ ID NO: 680006 - RNA, 64 nt, hsa; identical to SEQ ID NO: 80204

SEQ ID NO: 680007 - RNA, 64 nt, hsa; identical to SEQ ID NO: 80205

SEQ ID NO: 680008 - RNA, 64 nt, hsa; identical to SEQ ID NO: 80206

SEQ ID NO: 680009 - RNA, 64 nt, hsa; identical to SEQ ID NO: 80207

SEQ ID NO: 680010 - RNA, 64 nt, hsa; identical to SEQ ID NO: 80208

SEQ ID NO: 680011 - RNA, 64 nt, hsa; identical to SEQ ID NO: 80209

SEQ ID NO: 680012 - RNA, 64 nt, hsa; identical to SEQ ID NO: 80210

SEQ ID NO: 680013 - RNA, 64 nt, hsa; identical to SEQ ID NO: 80211

SEQ ID NO: 680014 - RNA, 64 nt, hsa; identical to SEQ ID NO: 80212

SEQ ID NO: 680015 - RNA, 64 nt, hsa; identical to SEQ ID NO: 80213

SEQ ID NO: 680016 - RNA, 64 nt, hsa; identical to SEQ ID NO: 80214

SEQ ID NO: 680017 - RNA, 64 nt, hsa; identical to SEQ ID NO: 80215

SEQ ID NO: 680018 - RNA, 64 nt, hsa; identical to SEQ ID NO: 80216

SEQ ID NO: 680019 - RNA, 64 nt, hsa; identical to SEQ ID NO: 80217

SEQ ID NO: 680020 - RNA, 64 nt, hsa; identical to SEQ ID NO: 80218

SEQ ID NO: 680021 - RNA, 64 nt, hsa; identical to SEQ ID NO: 80219

SEQ ID NO: 680022 - RNA, 64 nt, hsa; identical to SEQ ID NO: 80220

SEQ ID NO: 680023 - RNA, 64 nt, hsa; identical to SEQ ID NO: 80221

SEQ ID NO: 680024 - RNA, 64 nt, hsa; identical to SEQ ID NO: 80222

SEQ ID NO: 680025 - RNA, 64 nt, hsa; identical to SEQ ID NO: 80223

SEQ ID NO: 680026 - RNA, 64 nt, hsa; identical to SEQ ID NO: 80224

SEQ ID NO: 680027 - RNA, 64 nt, hsa; identical to SEQ ID NO: 80225

SEQ ID NO: 680028 - RNA, 64 nt, hsa; identical to SEQ ID NO: 80226

SEQ ID NO: 680029 - RNA, 64 nt, hsa; identical to SEQ ID NO: 80227

SEQ ID NO: 680030 - RNA, 64 nt, hsa; identical to SEQ ID NO: 80228

SEQ ID NO: 680031 - RNA, 64 nt, hsa; identical to SEQ ID NO: 80229

SEQ ID NO: 680032 - RNA, 64 nt, hsa; identical to SEQ ID NO: 80230

SEQ ID NO: 680033 - RNA, 64 nt, hsa; identical to SEQ ID NO: 80231

SEQ ID NO: 680034 - RNA, 52 nt, hsa; identical to SEQ ID NO: 80232

SEQ ID NO: 680035 - RNA, 64 nt, hsa; identical to SEQ ID NO: 80233

SEQ ID NO: 680036 - RNA, 64 nt, hsa; identical to SEQ ID NO: 80234

SEQ ID NO: 680037 - RNA, 64 nt, hsa; identical to SEQ ID NO: 80235

SEQ ID NO: 680038 - RNA, 64 nt, hsa; identical to SEQ ID NO: 80236

SEQ ID NO: 680039 - RNA, 64 nt, hsa; identical to SEQ ID NO: 80237

SEQ ID NO: 680040 - RNA, 64 nt, hsa; identical to SEQ ID NO: 80238

SEQ ID NO: 680041 - RNA, 64 nt, hsa; identical to SEQ ID NO: 80239

SEQ ID NO: 680042 - RNA, 64 nt, hsa; identical to SEQ ID NO: 80240

SEQ ID NO: 680043 - RNA, 64 nt, hsa; identical to SEQ ID NO: 80241

SEQ ID NO: 680044 - RNA, 64 nt, hsa; identical to SEQ ID NO: 80242

SEQ ID NO: 680045 - RNA, 64 nt, hsa; identical to SEQ ID NO: 80243

SEQ ID NO: 680046 - RNA, 64 nt, hsa; identical to SEQ ID NO: 80244

SEQ ID NO: 680047 - RNA, 64 nt, hsa; identical to SEQ ID NO: 80245

SEQ ID NO: 680048 - RNA, 64 nt, hsa; identical to SEQ ID NO: 80246

SEQ ID NO: 680049 - RNA, 64 nt, hsa; identical to SEQ ID NO: 80247

SEQ ID NO: 680050 - RNA, 64 nt, hsa; identical to SEQ ID NO: 80248

SEQ ID NO: 680051 - RNA, 64 nt, hsa; identical to SEQ ID NO: 80249

SEQ ID NO: 680052 - RNA, 64 nt, hsa; identical to SEQ ID NO: 80250

SEQ ID NO: 680053 - RNA, 64 nt, hsa; identical to SEQ ID NO: 80251

SEQ ID NO: 680054 - RNA, 64 nt, hsa; identical to SEQ ID NO: 80252

SEQ ID NO: 680055 - RNA, 64 nt, hsa; identical to SEQ ID NO: 80253

SEQ ID NO: 680056 - RNA, 64 nt, hsa; identical to SEQ ID NO: 80254

SEQ ID NO: 680057 - RNA, 64 nt, hsa; identical to SEQ ID NO: 80255

SEQ ID NO: 680058 - RNA, 64 nt, hsa; identical to SEQ ID NO: 80256

SEQ ID NO: 680059 - RNA, 64 nt, hsa; identical to SEQ ID NO: 80257

SEQ ID NO: 680060 - RNA, 64 nt, hsa; identical to SEQ ID NO: 80258

SEQ ID NO: 680061 - RNA, 64 nt, hsa; identical to SEQ ID NO: 80259

SEQ ID NO: 680062 - RNA, 64 nt, hsa; identical to SEQ ID NO: 80260

SEQ ID NO: 680063 - RNA, 64 nt, hsa; identical to SEQ ID NO: 80261

SEQ ID NO: 680064 - RNA, 64 nt, hsa; identical to SEQ ID NO: 80262

SEQ ID NO: 680065 - RNA, 64 nt, hsa; identical to SEQ ID NO: 80263

SEQ ID NO: 680066 - RNA, 64 nt, hsa; identical to SEQ ID NO: 80264

SEQ ID NO: 680067 - RNA, 64 nt, hsa; identical to SEQ ID NO: 80265

SEQ ID NO: 680068 - RNA, 64 nt, hsa; identical to SEQ ID NO: 80266

SEQ ID NO: 680069 - RNA, 64 nt, hsa; identical to SEQ ID NO: 80267

SEQ ID NO: 680070 - RNA, 64 nt, hsa; identical to SEQ ID NO: 80268

SEQ ID NO: 680071 - RNA, 64 nt, hsa; identical to SEQ ID NO: 80269

SEQ ID NO: 680072 - RNA, 64 nt, hsa; identical to SEQ ID NO: 80270

SEQ ID NO: 680073 - RNA, 64 nt, hsa; identical to SEQ ID NO: 80271

SEQ ID NO: 680074 - RNA, 64 nt, hsa; identical to SEQ ID NO: 80272

SEQ ID NO: 680075 - RNA, 64 nt, hsa; identical to SEQ ID NO: 80273

SEQ ID NO: 680076 - RNA, 64 nt, hsa; identical to SEQ ID NO: 80274

SEQ ID NO: 680077 - RNA, 64 nt, hsa; identical to SEQ ID NO: 80275

SEQ ID NO: 680078 - RNA, 64 nt, hsa; identical to SEQ ID NO: 80276

SEQ ID NO: 680079 - RNA, 64 nt, hsa; identical to SEQ ID NO: 80277

SEQ ID NO: 680080 - RNA, 64 nt, hsa; identical to SEQ ID NO: 80278

SEQ ID NO: 680081 - RNA, 64 nt, hsa; identical to SEQ ID NO: 80279

SEQ ID NO: 680082 - RNA, 64 nt, hsa; identical to SEQ ID NO: 80280

SEQ ID NO: 680083 - RNA, 64 nt, hsa; identical to SEQ ID NO: 80281

SEQ ID NO: 680084 - RNA, 64 nt, hsa; identical to SEQ ID NO: 80282

SEQ ID NO: 680085 - RNA, 64 nt, hsa; identical to SEQ ID NO: 80283

SEQ ID NO: 680086 - RNA, 64 nt, hsa; identical to SEQ ID NO: 80284

SEQ ID NO: 680087 - RNA, 64 nt, hsa; identical to SEQ ID NO: 80285

SEQ ID NO: 680088 - RNA, 64 nt, hsa; identical to SEQ ID NO: 80286

SEQ ID NO: 680089 - RNA, 64 nt, hsa; identical to SEQ ID NO: 80287

SEQ ID NO: 680090 - RNA, 64 nt, hsa; identical to SEQ ID NO: 80288

SEQ ID NO: 680091 - RNA, 64 nt, hsa; identical to SEQ ID NO: 80289

SEQ ID NO: 680092 - RNA, 64 nt, hsa; identical to SEQ ID NO: 80290

SEQ ID NO: 680093 - RNA, 64 nt, hsa; identical to SEQ ID NO: 80291

SEQ ID NO: 680094 - RNA, 64 nt, hsa; identical to SEQ ID NO: 80292

SEQ ID NO: 680095 - RNA, 64 nt, hsa; identical to SEQ ID NO: 80293

SEQ ID NO: 680096 - RNA, 64 nt, hsa; identical to SEQ ID NO: 80294

SEQ ID NO: 680097 - RNA, 64 nt, hsa; identical to SEQ ID NO: 80295

SEQ ID NO: 680098 - RNA, 64 nt, hsa; identical to SEQ ID NO: 80296

SEQ ID NO: 680099 - RNA, 64 nt, hsa; identical to SEQ ID NO: 80297

SEQ ID NO: 680100 - RNA, 64 nt, hsa; identical to SEQ ID NO: 80298

SEQ ID NO: 680101 - RNA, 64 nt, hsa; identical to SEQ ID NO: 80299

SEQ ID NO: 680102 - RNA, 64 nt, hsa; identical to SEQ ID NO: 80300

SEQ ID NO: 680103 - RNA, 64 nt, hsa; identical to SEQ ID NO: 80301

SEQ ID NO: 680104 - RNA, 64 nt, hsa; identical to SEQ ID NO: 80302

SEQ ID NO: 680105 - RNA, 64 nt, hsa; identical to SEQ ID NO: 80303

SEQ ID NO: 680106 - RNA, 64 nt, hsa; identical to SEQ ID NO: 80304

SEQ ID NO: 680107 - RNA, 64 nt, hsa; identical to SEQ ID NO: 80305

SEQ ID NO: 680108 - RNA, 64 nt, hsa; identical to SEQ ID NO: 80306

SEQ ID NO: 680109 - RNA, 64 nt, hsa; identical to SEQ ID NO: 80307

SEQ ID NO: 680110 - RNA, 64 nt, hsa; identical to SEQ ID NO: 80308

SEQ ID NO: 680111 - RNA, 64 nt, hsa; identical to SEQ ID NO: 80309

SEQ ID NO: 680112 - RNA, 64 nt, hsa; identical to SEQ ID NO: 80310

SEQ ID NO: 680113 - RNA, 64 nt, hsa; identical to SEQ ID NO: 80311

SEQ ID NO: 680114 - RNA, 64 nt, hsa; identical to SEQ ID NO: 80312

SEQ ID NO: 680115 - RNA, 64 nt, hsa; identical to SEQ ID NO: 80313

SEQ ID NO: 680116 - RNA, 64 nt, hsa; identical to SEQ ID NO: 80314

SEQ ID NO: 680117 - RNA, 64 nt, hsa; identical to SEQ ID NO: 80315

SEQ ID NO: 680118 - RNA, 64 nt, hsa; identical to SEQ ID NO: 80316

SEQ ID NO: 680119 - RNA, 64 nt, hsa; identical to SEQ ID NO: 80317

SEQ ID NO: 680120 - RNA, 64 nt, hsa; identical to SEQ ID NO: 80318

SEQ ID NO: 680121 - RNA, 64 nt, hsa; identical to SEQ ID NO: 80319

SEQ ID NO: 680122 - RNA, 64 nt, hsa; identical to SEQ ID NO: 80320

SEQ ID NO: 680123 - RNA, 64 nt, hsa; identical to SEQ ID NO: 80321

SEQ ID NO: 680124 - RNA, 64 nt, hsa; identical to SEQ ID NO: 80322

SEQ ID NO: 680125 - RNA, 64 nt, hsa; identical to SEQ ID NO: 80323

SEQ ID NO: 680126 - RNA, 64 nt, hsa; identical to SEQ ID NO: 80324

SEQ ID NO: 680127 - RNA, 51 nt, hsa; identical to SEQ ID NO: 80325

SEQ ID NO: 680128 - RNA, 64 nt, hsa; identical to SEQ ID NO: 80326

SEQ ID NO: 680129 - RNA, 64 nt, hsa; identical to SEQ ID NO: 80327

SEQ ID NO: 680130 - RNA, 64 nt, hsa; identical to SEQ ID NO: 80328

SEQ ID NO: 680131 - RNA, 64 nt, hsa; identical to SEQ ID NO: 80329

SEQ ID NO: 680132 - RNA, 64 nt, hsa; identical to SEQ ID NO: 80330

SEQ ID NO: 680133 - RNA, 62 nt, hsa; identical to SEQ ID NO: 80331

SEQ ID NO: 680134 - RNA, 64 nt, hsa; identical to SEQ ID NO: 80332

SEQ ID NO: 680135 - RNA, 64 nt, hsa; identical to SEQ ID NO: 80333

SEQ ID NO: 680136 - RNA, 64 nt, hsa; identical to SEQ ID NO: 80334

SEQ ID NO: 680137 - RNA, 54 nt, hsa; identical to SEQ ID NO: 80335

SEQ ID NO: 680138 - RNA, 64 nt, hsa; identical to SEQ ID NO: 80336

SEQ ID NO: 680139 - RNA, 64 nt, hsa; identical to SEQ ID NO: 80337

SEQ ID NO: 680140 - RNA, 64 nt, hsa; identical to SEQ ID NO: 80338

SEQ ID NO: 680141 - RNA, 64 nt, hsa; identical to SEQ ID NO: 80339

SEQ ID NO: 680142 - RNA, 64 nt, hsa; identical to SEQ ID NO: 80340

SEQ ID NO: 680143 - RNA, 64 nt, hsa; identical to SEQ ID NO: 80341

SEQ ID NO: 680144 - RNA, 64 nt, hsa; identical to SEQ ID NO: 80342

SEQ ID NO: 680145 - RNA, 64 nt, hsa; identical to SEQ ID NO: 80343

SEQ ID NO: 680146 - RNA, 64 nt, hsa; identical to SEQ ID NO: 80344

SEQ ID NO: 680147 - RNA, 64 nt, hsa; identical to SEQ ID NO: 80345

SEQ ID NO: 680148 - RNA, 64 nt, hsa; identical to SEQ ID NO: 80346

SEQ ID NO: 680149 - RNA, 64 nt, hsa; identical to SEQ ID NO: 80347

SEQ ID NO: 680150 - RNA, 64 nt, hsa; identical to SEQ ID NO: 80348

SEQ ID NO: 680151 - RNA, 64 nt, hsa; identical to SEQ ID NO: 80349

SEQ ID NO: 680152 - RNA, 64 nt, hsa; identical to SEQ ID NO: 80350

SEQ ID NO: 680153 - RNA, 64 nt, hsa; identical to SEQ ID NO: 80351

SEQ ID NO: 680154 - RNA, 59 nt, hsa; identical to SEQ ID NO: 80352

SEQ ID NO: 680155 - RNA, 64 nt, hsa; identical to SEQ ID NO: 80353

SEQ ID NO: 680156 - RNA, 64 nt, hsa; identical to SEQ ID NO: 80354

SEQ ID NO: 680157 - RNA, 64 nt, hsa; identical to SEQ ID NO: 80355

SEQ ID NO: 680158 - RNA, 64 nt, hsa; identical to SEQ ID NO: 80356

SEQ ID NO: 680159 - RNA, 64 nt, hsa; identical to SEQ ID NO: 80357

SEQ ID NO: 680160 - RNA, 64 nt, hsa; identical to SEQ ID NO: 80358

SEQ ID NO: 680161 - RNA, 64 nt, hsa; identical to SEQ ID NO: 80359

SEQ ID NO: 680162 - RNA, 64 nt, hsa; identical to SEQ ID NO: 80360

SEQ ID NO: 680163 - RNA, 64 nt, hsa; identical to SEQ ID NO: 80361

SEQ ID NO: 680164 - RNA, 64 nt, hsa; identical to SEQ ID NO: 80362

SEQ ID NO: 680165 - RNA, 64 nt, hsa; identical to SEQ ID NO: 80363

SEQ ID NO: 680166 - RNA, 64 nt, hsa; identical to SEQ ID NO: 80364

SEQ ID NO: 680167 - RNA, 64 nt, hsa; identical to SEQ ID NO: 80365

SEQ ID NO: 680168 - RNA, 64 nt, hsa; identical to SEQ ID NO: 80366

SEQ ID NO: 680169 - RNA, 64 nt, hsa; identical to SEQ ID NO: 80367

SEQ ID NO: 680170 - RNA, 64 nt, hsa; identical to SEQ ID NO: 80368

SEQ ID NO: 680171 - RNA, 64 nt, hsa; identical to SEQ ID NO: 80369

SEQ ID NO: 680172 - RNA, 64 nt, hsa; identical to SEQ ID NO: 80370

SEQ ID NO: 680173 - RNA, 64 nt, hsa; identical to SEQ ID NO: 80371

SEQ ID NO: 680174 - RNA, 64 nt, hsa; identical to SEQ ID NO: 80372

SEQ ID NO: 680175 - RNA, 64 nt, hsa; identical to SEQ ID NO: 80373

SEQ ID NO: 680176 - RNA, 64 nt, hsa; identical to SEQ ID NO: 80374

SEQ ID NO: 680177 - RNA, 64 nt, hsa; identical to SEQ ID NO: 80375

SEQ ID NO: 680178 - RNA, 64 nt, hsa; identical to SEQ ID NO: 80376

SEQ ID NO: 680179 - RNA, 64 nt, hsa; identical to SEQ ID NO: 80377

SEQ ID NO: 680180 - RNA, 64 nt, hsa; identical to SEQ ID NO: 80378

SEQ ID NO: 680181 - RNA, 64 nt, hsa; identical to SEQ ID NO: 80379

SEQ ID NO: 680182 - RNA, 64 nt, hsa; identical to SEQ ID NO: 80380

SEQ ID NO: 680183 - RNA, 64 nt, hsa; identical to SEQ ID NO: 80381

SEQ ID NO: 680184 - RNA, 64 nt, hsa; identical to SEQ ID NO: 80382

SEQ ID NO: 680185 - RNA, 64 nt, hsa; identical to SEQ ID NO: 80383

SEQ ID NO: 680186 - RNA, 64 nt, hsa; identical to SEQ ID NO: 80384

SEQ ID NO: 680187 - RNA, 64 nt, hsa; identical to SEQ ID NO: 80385

SEQ ID NO: 680188 - RNA, 64 nt, hsa; identical to SEQ ID NO: 80386

SEQ ID NO: 680189 - RNA, 64 nt, hsa; identical to SEQ ID NO: 80387

SEQ ID NO: 680190 - RNA, 64 nt, hsa; identical to SEQ ID NO: 80388

SEQ ID NO: 680191 - RNA, 64 nt, hsa; identical to SEQ ID NO: 80389

SEQ ID NO: 680192 - RNA, 64 nt, hsa; identical to SEQ ID NO: 80390

SEQ ID NO: 680193 - RNA, 64 nt, hsa; identical to SEQ ID NO: 80391

SEQ ID NO: 680194 - RNA, 53 nt, hsa; identical to SEQ ID NO: 80392

SEQ ID NO: 680195 - RNA, 64 nt, hsa; identical to SEQ ID NO: 80393

SEQ ID NO: 680196 - RNA, 64 nt, hsa; identical to SEQ ID NO: 80394

SEQ ID NO: 680197 - RNA, 64 nt, hsa; identical to SEQ ID NO: 80395

SEQ ID NO: 680198 - RNA, 64 nt, hsa; identical to SEQ ID NO: 80396

SEQ ID NO: 680199 - RNA, 64 nt, hsa; identical to SEQ ID NO: 80397

SEQ ID NO: 680200 - RNA, 64 nt, hsa; identical to SEQ ID NO: 80398

SEQ ID NO: 680201 - RNA, 64 nt, hsa; identical to SEQ ID NO: 80399

SEQ ID NO: 680202 - RNA, 64 nt, hsa; identical to SEQ ID NO: 80400

SEQ ID NO: 680203 - RNA, 64 nt, hsa; identical to SEQ ID NO: 80401

SEQ ID NO: 680204 - RNA, 64 nt, hsa; identical to SEQ ID NO: 80402

SEQ ID NO: 680205 - RNA, 64 nt, hsa; identical to SEQ ID NO: 80403

SEQ ID NO: 680206 - RNA, 64 nt, hsa; identical to SEQ ID NO: 80404

SEQ ID NO: 680207 - RNA, 64 nt, hsa; identical to SEQ ID NO: 80405

SEQ ID NO: 680208 - RNA, 64 nt, hsa; identical to SEQ ID NO: 80406

SEQ ID NO: 680209 - RNA, 64 nt, hsa; identical to SEQ ID NO: 80407

SEQ ID NO: 680210 - RNA, 64 nt, hsa; identical to SEQ ID NO: 80408

SEQ ID NO: 680211 - RNA, 64 nt, hsa; identical to SEQ ID NO: 80409

SEQ ID NO: 680212 - RNA, 64 nt, hsa; identical to SEQ ID NO: 80410

SEQ ID NO: 680213 - RNA, 64 nt, hsa; identical to SEQ ID NO: 80411

SEQ ID NO: 680214 - RNA, 64 nt, hsa; identical to SEQ ID NO: 80412

SEQ ID NO: 680215 - RNA, 64 nt, hsa; identical to SEQ ID NO: 80413

SEQ ID NO: 680216 - RNA, 64 nt, hsa; identical to SEQ ID NO: 80414

SEQ ID NO: 680217 - RNA, 64 nt, hsa; identical to SEQ ID NO: 80415

SEQ ID NO: 680218 - RNA, 64 nt, hsa; identical to SEQ ID NO: 80416

SEQ ID NO: 680219 - RNA, 64 nt, hsa; identical to SEQ ID NO: 80417

SEQ ID NO: 680220 - RNA, 64 nt, hsa; identical to SEQ ID NO: 80418

SEQ ID NO: 680221 - RNA, 64 nt, hsa
cacugcauuccaaccugggugaugaagugagacucuccaaaaaaaaaaaagaaauuauuaaucc

SEQ ID NO: 680222 - RNA, 64 nt, hsa
caacuuaggcucuuuauuaauugguuaagguuuucuccaaaaagggcauuucaacaaugggaau

SEQ ID NO: 680223 - RNA, 64 nt, hsa
uuuuaacaguuacagcaauaaagaauaguuaguacuccaaaaauauuauauuuaagaugcucaa

SEQ ID NO: 680224 - RNA, 64 nt, hsa
ucuuuccucugcucacuuuaagaacuuuuaccgacuccaaaaaucucaggaauuaaacuuuuaa

SEQ ID NO: 680225 - RNA, 64 nt, hsa
ugggucacuuccaccacugguaaagccagaacuucuccaaaaagaaccuugcaaaaaguccagu

SEQ ID NO: 680226 - RNA, 64 nt, hsa
gauggggaacagcuugaccuucauccaccccuaacuccaaaacuaucaagguacgacaguggca

SEQ ID NO: 680227 - RNA, 64 nt, hsa
guacuugaacuugguaguguuuccuuagaaccuccuccaaaaauaugcauuuaccaggcuuguu

SEQ ID NO: 680228 - RNA, 64 nt, hsa
ucauuuuuaauuuauaucagauuuauaucagacccuccaaaaaguauuugaaauauauuacagu

SEQ ID NO: 680229 - RNA, 64 nt, hsa
uggcaccgcccugcaucccuaauaccaaaucugacuccaaaauuguggggugugacauacaagu

SEQ ID NO: 680230 - RNA, 64 nt, hsa
auuacuacgccuccccacacgcccagaccccucacuccaaaauccuacuggcuguagcagagaa

SEQ ID NO: 680231 - RNA, 64 nt, hsa
uggaggaagacuuuugccuccguccaaaagauuccuccaaaaaaagauuuaaaaaaagauuucg

SEQ ID NO: 680232 - RNA, 64 nt, hsa
guauccagggcucauguucacuugaugaaaacuccuccaaaagguccuucgagaaaaaauuuau

SEQ ID NO: 680233 - RNA, 64 nt, hsa
gguaaugccgcugucaucaaauaugaggagaaaccuccaaaaccagcauuucagaaugguuccu

SEQ ID NO: 680234 - RNA, 64 nt, hsa
gcacuccagccugggcaacagagcaagacuccgucuccaaaaaaaaaaaaaaaaaaaaagaauu

SEQ ID NO: 680235 - RNA, 64 nt, hsa
gcacuggcccccaaggucagcucccugggucugucuccaaaaaugguugcugaugacaucacca

SEQ ID NO: 680236 - RNA, 64 nt, hsa
gccugggcgcugguccuuucuuccggccccuccccuccaaaaugugccuauugcuagagcuccu

SEQ ID NO: 680237 - RNA, 64 nt, hsa
aaaugaauuugaagacaagccaacaaacccugcacuccaaaaaagcaaaacagacccuaauuuu

SEQ ID NO: 680238 - RNA, 64 nt, hsa
gucuacauguuccuaaaucuuuacuccaaaacaacuccaaaaacaacucacaaagcaugaacca

SEQ ID NO: 680239 - RNA, 64 nt, hsa
auauucucuuugucuacauguuccuaaaucuuuacuccaaaacaacuccaaaaacaacucacaa

SEQ ID NO: 680240 - RNA, 64 nt, hsa
ggaaacaucaugccaacaacuuacaucucagucacuccaaaaaacuggcauggguaaaccagcu

SEQ ID NO: 680241 - RNA, 64 nt, hsa
ccuaaaacagugguauccaaagaagaaucaaggccuccaaaauuugucauugaaucugucacuc

SEQ ID NO: 680242 - RNA, 64 nt, hsa
accaccuuuaacuauuuccaaaacauuuucaucacuccaaaauaaaugccuguacacacuagca

SEQ ID NO: 680243 - RNA, 64 nt, hsa
uaaggcuuugccucaggcacaaaauuuaagggggcuccaaaaaacucaggaaucaagaucagca

SEQ ID NO: 680244 - RNA, 64 nt, hsa; identical to SEQ ID NO: 237976

SEQ ID NO: 680245 - RNA, 64 nt, hsa; identical to SEQ ID NO: 237977

SEQ ID NO: 680246 - RNA, 64 nt, hsa; identical to SEQ ID NO: 237978

SEQ ID NO: 680247 - RNA, 64 nt, hsa; identical to SEQ ID NO: 237979

SEQ ID NO: 680248 - RNA, 64 nt, hsa; identical to SEQ ID NO: 237980

SEQ ID NO: 680249 - RNA, 64 nt, hsa; identical to SEQ ID NO: 237981

SEQ ID NO: 680250 - RNA, 64 nt, hsa; identical to SEQ ID NO: 237982

SEQ ID NO: 680251 - RNA, 64 nt, hsa; identical to SEQ ID NO: 237983

SEQ ID NO: 680252 - RNA, 64 nt, hsa; identical to SEQ ID NO: 237984

SEQ ID NO: 680253 - RNA, 64 nt, hsa; identical to SEQ ID NO: 237985

SEQ ID NO: 680254 - RNA, 64 nt, hsa; identical to SEQ ID NO: 237986

SEQ ID NO: 680255 - RNA, 64 nt, hsa; identical to SEQ ID NO: 237987

SEQ ID NO: 680256 - RNA, 64 nt, hsa; identical to SEQ ID NO: 237988

SEQ ID NO: 680257 - RNA, 64 nt, hsa; identical to SEQ ID NO: 237989

SEQ ID NO: 680258 - RNA, 64 nt, hsa; identical to SEQ ID NO: 237990

SEQ ID NO: 680259 - RNA, 64 nt, hsa; identical to SEQ ID NO: 237991

SEQ ID NO: 680260 - RNA, 64 nt, hsa; identical to SEQ ID NO: 237992

SEQ ID NO: 680261 - RNA, 64 nt, hsa; identical to SEQ ID NO: 237993

SEQ ID NO: 680262 - RNA, 64 nt, hsa; identical to SEQ ID NO: 237994

SEQ ID NO: 680263 - RNA, 64 nt, hsa; identical to SEQ ID NO: 237995

SEQ ID NO: 680264 - RNA, 64 nt, hsa; identical to SEQ ID NO: 237996

SEQ ID NO: 680265 - RNA, 64 nt, hsa; identical to SEQ ID NO: 237997

SEQ ID NO: 680266 - RNA, 64 nt, hsa; identical to SEQ ID NO: 237998

SEQ ID NO: 680267 - RNA, 64 nt, hsa; identical to SEQ ID NO: 237999

SEQ ID NO: 680268 - RNA, 64 nt, hsa; identical to SEQ ID NO: 238000

SEQ ID NO: 680269 - RNA, 64 nt, hsa; identical to SEQ ID NO: 238001

SEQ ID NO: 680270 - RNA, 64 nt, hsa; identical to SEQ ID NO: 238002

SEQ ID NO: 680271 - RNA, 64 nt, hsa; identical to SEQ ID NO: 238003

SEQ ID NO: 680272 - RNA, 64 nt, hsa; identical to SEQ ID NO: 238004

SEQ ID NO: 680273 - RNA, 64 nt, hsa; identical to SEQ ID NO: 238005

SEQ ID NO: 680274 - RNA, 64 nt, hsa; identical to SEQ ID NO: 238006

SEQ ID NO: 680275 - RNA, 64 nt, hsa; identical to SEQ ID NO: 238007

SEQ ID NO: 680276 - RNA, 64 nt, hsa; identical to SEQ ID NO: 238008

SEQ ID NO: 680277 - RNA, 64 nt, hsa; identical to SEQ ID NO: 238009

SEQ ID NO: 680278 - RNA, 64 nt, hsa; identical to SEQ ID NO: 238010

SEQ ID NO: 680279 - RNA, 64 nt, hsa; identical to SEQ ID NO: 238011

SEQ ID NO: 680280 - RNA, 64 nt, hsa; identical to SEQ ID NO: 238012

SEQ ID NO: 680281 - RNA, 64 nt, hsa; identical to SEQ ID NO: 238013

SEQ ID NO: 680282 - RNA, 64 nt, hsa; identical to SEQ ID NO: 238014

SEQ ID NO: 680283 - RNA, 64 nt, hsa; identical to SEQ ID NO: 238015

SEQ ID NO: 680284 - RNA, 64 nt, hsa; identical to SEQ ID NO: 238016

SEQ ID NO: 680285 - RNA, 64 nt, hsa; identical to SEQ ID NO: 238017

SEQ ID NO: 680286 - RNA, 64 nt, hsa; identical to SEQ ID NO: 238018

SEQ ID NO: 680287 - RNA, 64 nt, hsa; identical to SEQ ID NO: 238019

SEQ ID NO: 680288 - RNA, 64 nt, hsa; identical to SEQ ID NO: 238020

SEQ ID NO: 680289 - RNA, 64 nt, hsa; identical to SEQ ID NO: 238021

SEQ ID NO: 680290 - RNA, 64 nt, hsa; identical to SEQ ID NO: 238022

SEQ ID NO: 680291 - RNA, 64 nt, hsa; identical to SEQ ID NO: 238023

SEQ ID NO: 680292 - RNA, 64 nt, hsa; identical to SEQ ID NO: 238024

SEQ ID NO: 680293 - RNA, 64 nt, hsa; identical to SEQ ID NO: 238025

SEQ ID NO: 680294 - RNA, 64 nt, hsa; identical to SEQ ID NO: 102753

SEQ ID NO: 680295 - RNA, 64 nt, hsa; identical to SEQ ID NO: 102754

SEQ ID NO: 680296 - RNA, 64 nt, hsa; identical to SEQ ID NO: 102755

SEQ ID NO: 680297 - RNA, 64 nt, hsa; identical to SEQ ID NO: 102756

SEQ ID NO: 680298 - RNA, 64 nt, hsa; identical to SEQ ID NO: 102757

SEQ ID NO: 680299 - RNA, 64 nt, hsa; identical to SEQ ID NO: 102758

SEQ ID NO: 680300 - RNA, 64 nt, hsa; identical to SEQ ID NO: 102759

SEQ ID NO: 680301 - RNA, 64 nt, hsa; identical to SEQ ID NO: 102760

SEQ ID NO: 680302 - RNA, 64 nt, hsa; identical to SEQ ID NO: 102761

SEQ ID NO: 680303 - RNA, 64 nt, hsa; identical to SEQ ID NO: 102762

SEQ ID NO: 680304 - RNA, 64 nt, hsa; identical to SEQ ID NO: 102763

SEQ ID NO: 680305 - RNA, 64 nt, hsa; identical to SEQ ID NO: 102764

SEQ ID NO: 680306 - RNA, 64 nt, hsa; identical to SEQ ID NO: 102765

SEQ ID NO: 680307 - RNA, 64 nt, hsa; identical to SEQ ID NO: 102766

SEQ ID NO: 680308 - RNA, 64 nt, hsa; identical to SEQ ID NO: 102767

SEQ ID NO: 680309 - RNA, 64 nt, hsa; identical to SEQ ID NO: 102768

SEQ ID NO: 680310 - RNA, 64 nt, hsa; identical to SEQ ID NO: 102769

SEQ ID NO: 680311 - RNA, 64 nt, hsa; identical to SEQ ID NO: 102770

SEQ ID NO: 680312 - RNA, 64 nt, hsa; identical to SEQ ID NO: 102771

SEQ ID NO: 680313 - RNA, 64 nt, hsa; identical to SEQ ID NO: 102772

SEQ ID NO: 680314 - RNA, 64 nt, hsa; identical to SEQ ID NO: 102773

SEQ ID NO: 680315 - RNA, 64 nt, hsa; identical to SEQ ID NO: 102774

SEQ ID NO: 680316 - RNA, 64 nt, hsa; identical to SEQ ID NO: 102775

SEQ ID NO: 680317 - RNA, 64 nt, hsa; identical to SEQ ID NO: 102776

SEQ ID NO: 680318 - RNA, 64 nt, hsa; identical to SEQ ID NO: 102777

SEQ ID NO: 680319 - RNA, 64 nt, hsa; identical to SEQ ID NO: 102778

SEQ ID NO: 680320 - RNA, 64 nt, hsa; identical to SEQ ID NO: 102779

SEQ ID NO: 680321 - RNA, 64 nt, hsa; identical to SEQ ID NO: 102780

SEQ ID NO: 680322 - RNA, 64 nt, hsa; identical to SEQ ID NO: 102781

SEQ ID NO: 680323 - RNA, 64 nt, hsa; identical to SEQ ID NO: 102782

SEQ ID NO: 680324 - RNA, 64 nt, hsa; identical to SEQ ID NO: 102783

SEQ ID NO: 680325 - RNA, 64 nt, hsa; identical to SEQ ID NO: 102784

SEQ ID NO: 680326 - RNA, 64 nt, hsa; identical to SEQ ID NO: 102785

SEQ ID NO: 680327 - RNA, 64 nt, hsa; identical to SEQ ID NO: 102786

SEQ ID NO: 680328 - RNA, 64 nt, hsa; identical to SEQ ID NO: 102787

SEQ ID NO: 680329 - RNA, 64 nt, hsa; identical to SEQ ID NO: 102788

SEQ ID NO: 680330 - RNA, 64 nt, hsa; identical to SEQ ID NO: 102789

SEQ ID NO: 680331 - RNA, 64 nt, hsa; identical to SEQ ID NO: 102790

SEQ ID NO: 680332 - RNA, 64 nt, hsa; identical to SEQ ID NO: 102791

SEQ ID NO: 680333 - RNA, 64 nt, hsa; identical to SEQ ID NO: 102792

SEQ ID NO: 680334 - RNA, 64 nt, hsa; identical to SEQ ID NO: 102793

SEQ ID NO: 680335 - RNA, 64 nt, hsa; identical to SEQ ID NO: 102794

SEQ ID NO: 680336 - RNA, 64 nt, hsa; identical to SEQ ID NO: 102795

SEQ ID NO: 680337 - RNA, 64 nt, hsa; identical to SEQ ID NO: 102796

SEQ ID NO: 680338 - RNA, 64 nt, hsa; identical to SEQ ID NO: 102797

SEQ ID NO: 680339 - RNA, 64 nt, hsa; identical to SEQ ID NO: 102798

SEQ ID NO: 680340 - RNA, 64 nt, hsa; identical to SEQ ID NO: 102799

SEQ ID NO: 680341 - RNA, 64 nt, hsa; identical to SEQ ID NO: 102800

SEQ ID NO: 680342 - RNA, 64 nt, hsa; identical to SEQ ID NO: 102801

SEQ ID NO: 680343 - RNA, 64 nt, hsa; identical to SEQ ID NO: 102802

SEQ ID NO: 680344 - RNA, 64 nt, hsa; identical to SEQ ID NO: 102803

SEQ ID NO: 680345 - RNA, 64 nt, hsa; identical to SEQ ID NO: 102804

SEQ ID NO: 680346 - RNA, 64 nt, hsa; identical to SEQ ID NO: 102805

SEQ ID NO: 680347 - RNA, 64 nt, hsa; identical to SEQ ID NO: 102806

SEQ ID NO: 680348 - RNA, 64 nt, hsa; identical to SEQ ID NO: 102807

SEQ ID NO: 680349 - RNA, 64 nt, hsa; identical to SEQ ID NO: 102808

SEQ ID NO: 680350 - RNA, 64 nt, hsa; identical to SEQ ID NO: 102809

SEQ ID NO: 680351 - RNA, 64 nt, hsa; identical to SEQ ID NO: 102810

SEQ ID NO: 680352 - RNA, 64 nt, hsa; identical to SEQ ID NO: 102811

SEQ ID NO: 680353 - RNA, 64 nt, hsa; identical to SEQ ID NO: 102812

SEQ ID NO: 680354 - RNA, 64 nt, hsa; identical to SEQ ID NO: 102813

SEQ ID NO: 680355 - RNA, 64 nt, hsa; identical to SEQ ID NO: 102814

SEQ ID NO: 680356 - RNA, 64 nt, hsa; identical to SEQ ID NO: 102815

SEQ ID NO: 680357 - RNA, 64 nt, hsa
gucacucacauugagaguaagcacguugcccaagguugcacagcaagaaaagggagaaguugag

SEQ ID NO: 680358 - RNA, 64 nt, hsa
gcggaagagcauguggugauuggccacacacugaguugcacauauugagaaccuaaugcacucu

SEQ ID NO: 680359 - RNA, 64 nt, hsa
uuuagaauuuuuuguagggacagggccucacucuguugcacaagcuggucuugaacuccuggcc

SEQ ID NO: 680360 - RNA, 64 nt, hsa
auggguuucagcaagaaagucugugaugugaccaguugcacauguuuuccccuaaaagcuuacu

SEQ ID NO: 680361 - RNA, 64 nt, hsa
ccuugagugccacccccagggaagaacauaaaggguugcacaaugccacccauccacuccuugc

SEQ ID NO: 680362 - RNA, 64 nt, hsa
ggcuagagcccaggucugccgacacccugugcuuguugcacacuugauuugcuaaggcuggaga

SEQ ID NO: 680363 - RNA, 64 nt, hsa; identical to SEQ ID NO: 216073

SEQ ID NO: 680364 - RNA, 64 nt, hsa; identical to SEQ ID NO: 216074

SEQ ID NO: 680365 - RNA, 64 nt, hsa; identical to SEQ ID NO: 216075

SEQ ID NO: 680366 - RNA, 64 nt, hsa; identical to SEQ ID NO: 216076

SEQ ID NO: 680367 - RNA, 64 nt, hsa; identical to SEQ ID NO: 216077

SEQ ID NO: 680368 - RNA, 64 nt, hsa; identical to SEQ ID NO: 216078

SEQ ID NO: 680369 - RNA, 64 nt, hsa; identical to SEQ ID NO: 216079

SEQ ID NO: 680370 - RNA, 64 nt, hsa; identical to SEQ ID NO: 216080

SEQ ID NO: 680371 - RNA, 64 nt, hsa; identical to SEQ ID NO: 216081

SEQ ID NO: 680372 - RNA, 64 nt, hsa; identical to SEQ ID NO: 216082

SEQ ID NO: 680373 - RNA, 64 nt, hsa; identical to SEQ ID NO: 216083

SEQ ID NO: 680374 - RNA, 64 nt, hsa; identical to SEQ ID NO: 216084

SEQ ID NO: 680375 - RNA, 64 nt, hsa; identical to SEQ ID NO: 216085

SEQ ID NO: 680376 - RNA, 64 nt, hsa; identical to SEQ ID NO: 216086

SEQ ID NO: 680377 - RNA, 64 nt, hsa; identical to SEQ ID NO: 216087

SEQ ID NO: 680378 - RNA, 64 nt, hsa; identical to SEQ ID NO: 216088

SEQ ID NO: 680379 - RNA, 64 nt, hsa; identical to SEQ ID NO: 216089

SEQ ID NO: 680380 - RNA, 64 nt, hsa; identical to SEQ ID NO: 216090

SEQ ID NO: 680381 - RNA, 64 nt, hsa; identical to SEQ ID NO: 216091

SEQ ID NO: 680382 - RNA, 64 nt, hsa; identical to SEQ ID NO: 216092

SEQ ID NO: 680383 - RNA, 64 nt, hsa; identical to SEQ ID NO: 216093

SEQ ID NO: 680384 - RNA, 64 nt, hsa; identical to SEQ ID NO: 216094

SEQ ID NO: 680385 - RNA, 64 nt, hsa; identical to SEQ ID NO: 216095

SEQ ID NO: 680386 - RNA, 64 nt, hsa; identical to SEQ ID NO: 216096

SEQ ID NO: 680387 - RNA, 64 nt, hsa; identical to SEQ ID NO: 216097

SEQ ID NO: 680388 - RNA, 64 nt, hsa; identical to SEQ ID NO: 216098

SEQ ID NO: 680389 - RNA, 64 nt, hsa; identical to SEQ ID NO: 216099

SEQ ID NO: 680390 - RNA, 64 nt, hsa; identical to SEQ ID NO: 216100

SEQ ID NO: 680391 - RNA, 64 nt, hsa; identical to SEQ ID NO: 216101

SEQ ID NO: 680392 - RNA, 64 nt, hsa; identical to SEQ ID NO: 216102

SEQ ID NO: 680393 - RNA, 64 nt, hsa; identical to SEQ ID NO: 216103

SEQ ID NO: 680394 - RNA, 64 nt, hsa; identical to SEQ ID NO: 216104

SEQ ID NO: 680395 - RNA, 64 nt, hsa; identical to SEQ ID NO: 216105

SEQ ID NO: 680396 - RNA, 64 nt, hsa; identical to SEQ ID NO: 216106

SEQ ID NO: 680397 - RNA, 64 nt, hsa; identical to SEQ ID NO: 216107

SEQ ID NO: 680398 - RNA, 64 nt, hsa; identical to SEQ ID NO: 216108

SEQ ID NO: 680399 - RNA, 64 nt, hsa; identical to SEQ ID NO: 216109

SEQ ID NO: 680400 - RNA, 64 nt, hsa; identical to SEQ ID NO: 216110

SEQ ID NO: 680401 - RNA, 64 nt, hsa; identical to SEQ ID NO: 216111

SEQ ID NO: 680402 - RNA, 64 nt, hsa; identical to SEQ ID NO: 216112

SEQ ID NO: 680403 - RNA, 64 nt, hsa; identical to SEQ ID NO: 216113

SEQ ID NO: 680404 - RNA, 64 nt, hsa; identical to SEQ ID NO: 216114

SEQ ID NO: 680405 - RNA, 64 nt, hsa; identical to SEQ ID NO: 216115

SEQ ID NO: 680406 - RNA, 64 nt, hsa; identical to SEQ ID NO: 216116

SEQ ID NO: 680407 - RNA, 64 nt, hsa; identical to SEQ ID NO: 216117

SEQ ID NO: 680408 - RNA, 64 nt, hsa; identical to SEQ ID NO: 216118

SEQ ID NO: 680409 - RNA, 64 nt, hsa; identical to SEQ ID NO: 216119

SEQ ID NO: 680410 - RNA, 64 nt, hsa; identical to SEQ ID NO: 216120

SEQ ID NO: 680411 - RNA, 64 nt, hsa; identical to SEQ ID NO: 216121

SEQ ID NO: 680412 - RNA, 64 nt, hsa; identical to SEQ ID NO: 216121

SEQ ID NO: 680413 - RNA, 64 nt, hsa; identical to SEQ ID NO: 216123

SEQ ID NO: 680414 - RNA, 64 nt, hsa; identical to SEQ ID NO: 216124

SEQ ID NO: 680415 - RNA, 64 nt, hsa; identical to SEQ ID NO: 216125

SEQ ID NO: 680416 - RNA, 64 nt, hsa; identical to SEQ ID NO: 216126

SEQ ID NO: 680417 - RNA, 64 nt, hsa; identical to SEQ ID NO: 216127

SEQ ID NO: 680418 - RNA, 64 nt, hsa; identical to SEQ ID NO: 216128

SEQ ID NO: 680419 - RNA, 64 nt, hsa; identical to SEQ ID NO: 216129

SEQ ID NO: 680420 - RNA, 64 nt, hsa; identical to SEQ ID NO: 216130

SEQ ID NO: 680421 - RNA, 64 nt, hsa; identical to SEQ ID NO: 216131

SEQ ID NO: 680422 - RNA, 64 nt, hsa; identical to SEQ ID NO: 216132

SEQ ID NO: 680423 - RNA, 64 nt, hsa; identical to SEQ ID NO: 216133

SEQ ID NO: 680424 - RNA, 64 nt, hsa; identical to SEQ ID NO: 216134

SEQ ID NO: 680425 - RNA, 64 nt, hsa; identical to SEQ ID NO: 216135

SEQ ID NO: 680426 - RNA, 64 nt, hsa; identical to SEQ ID NO: 216136

SEQ ID NO: 680427 - RNA, 64 nt, hsa; identical to SEQ ID NO: 216137

SEQ ID NO: 680428 - RNA, 64 nt, hsa; identical to SEQ ID NO: 216138

SEQ ID NO: 680429 - RNA, 64 nt, hsa; identical to SEQ ID NO: 216139

SEQ ID NO: 680430 - RNA, 64 nt, hsa; identical to SEQ ID NO: 216140

SEQ ID NO: 680431 - RNA, 64 nt, hsa; identical to SEQ ID NO: 216141

SEQ ID NO: 680432 - RNA, 64 nt, hsa; identical to SEQ ID NO: 216142

SEQ ID NO: 680433 - RNA, 64 nt, hsa; identical to SEQ ID NO: 216143

SEQ ID NO: 680434 - RNA, 63 nt, hsa
uuucccucugcuguggguucugggcugucaugucuccaccacuuaaggaugucuuuacacuga

SEQ ID NO: 680435 - RNA, 63 nt, hsa
ucuccugugucuguccuccggaccuacccaggucuccaccaucaggacccugucuuuggguuu

SEQ ID NO: 680436 - RNA, 63 nt, hsa
gaggauucgagcaucaggcuaagacccuguguccuccaccaugcacucaccccuagcccuggu

SEQ ID NO: 680437 - RNA, 63 nt, hsa
ggagaguacauuugcuuuaaugagugcaccugccuccaccagcaaggggaccccgagaacccu

SEQ ID NO: 680438 - RNA, 63 nt, hsa
aaaggaaaggcugauguuuccauauagcuugcucuccaccaggccuaucauuuuucuuuuuag

SEQ ID NO: 680439 - RNA, 63 nt, hsa
gagcugggcggcguccacaccuaagaacagcagcuccaccaaaugaagucccucucacgcagc

SEQ ID NO: 680440 - RNA, 63 nt, hsa
gcugcuugugggggcaccugggaggucaaaggucuccaccacaucaaccuauuuuguuuuacc

SEQ ID NO: 680441 - RNA, 63 nt, hsa
aggccuuccaaacagcuccgucgccccuagcaacuccaccauugggcacugccaugcagagac

SEQ ID NO: 680442 - RNA, 63 nt, hsa
ucuauggugugacaucaccuuauucacagacaacuccaccaauuguacagguaacuaauucug

SEQ ID NO: 680443 - RNA, 63 nt, hsa
uggugggacauucuacagaaccccuuucugccccuccaccaguaccaguggugccacaugugg

SEQ ID NO: 680444 - RNA, 63 nt, hsa
cacaauuuagccaugucaucugguggugaccagcuccaccaagccccuuucugagcccuuccu

SEQ ID NO: 680445 - RNA, 63 nt, hsa
augguagcuggacuuccccagggcccucuuccccuccaccacacccagguggacuugcagccc

SEQ ID NO: 680446 - RNA, 63 nt, hsa
uaaaacugagguggggauggggagaggcuuugccuccaccauucccaccccacccuccccuua

SEQ ID NO: 680447 - RNA, 63 nt, hsa
uucaggaauuuuguaaucucauaacuuuccaagcuccaccacuuccuaaaucuuaagaacuuu

SEQ ID NO: 680448 - RNA, 63 nt, hsa
gcccuuggcugccagccuacccugccugcacuccuccaccaucacaaucucacccaaacuccu

SEQ ID NO: 680449 - RNA, 63 nt, hsa
aggcggguuuccuggguccccucuccagcaagccuccaccagcaagcucggcccagagcuucc

SEQ ID NO: 680450 - RNA, 63 nt, hsa
augaccgagacccccugauccuccguggacucacuccaccagcuuccuauaacuuggacgaug

SEQ ID NO: 680451 - RNA, 63 nt, hsa
cggccaguuaacaagaagauggugugagguguucuccaccagucucuccuguuugagacuguu

SEQ ID NO: 680452 - RNA, 63 nt, hsa
cugggacccuuuccuuccuucccuggcuuguaacuccaccaacccaucagaaggagaaggaag

SEQ ID NO: 680453 - RNA, 63 nt, hsa
cgugauguaggguaaggugccuucuuauucucacuccaccacccaaaagucaaaaggugccug

SEQ ID NO: 680454 - RNA, 63 nt, hsa
agaguaacugcacgccuuugugcagcucuggagcuccaccaacucucggccugccaguucuca

SEQ ID NO: 680455 - RNA, 63 nt, hsa
gagcccucgggaccugcugcaccaggaaagccacuccaccaguagugcugguugccuccuacu

SEQ ID NO: 680456 - RNA, 63 nt, hsa
gcugcuccacgaggaagcucaggccugcacaggcuccaccaggccuuggaugcccucuaguug

SEQ ID NO: 680457 - RNA, 63 nt, hsa
gggggugggggcuucaaguacagauugggcacacuccaccagaccccagcaaggucagcugcc

SEQ ID NO: 680458 - RNA, 63 nt, hsa
ucuauagacauuaggaagggagugagacggcuccuccaccauccucagccagugcaacccauu

SEQ ID NO: 680459 - RNA, 63 nt, hsa
ccccugaacuccugagcgacagaagccccaggccuccaccagccuugaacccuugcaaagggg

SEQ ID NO: 680460 - RNA, 63 nt, hsa
ggguggggaggagaaaaucccaccuccccugaccuccaccaccuccaccaccaccaccaccac

SEQ ID NO: 680461 - RNA, 63 nt, hsa
ggagaaaaucccaccuccccugaccuccaccaccuccaccaccaccaccaccaccaccaccac

SEQ ID NO: 680462 - RNA, 63 nt, hsa; identical to SEQ ID NO: 680447

SEQ ID NO: 680463 - RNA, 63 nt, hsa
uaaaacugagguggggauggggagagccuuugccuccaccauucccacccacccuccccuuaa

SEQ ID NO: 680464 - RNA, 63 nt, hsa
uaugcacccagaggggacucagcuucaaagcugcuccaccaugcugggucccaggcagcuuuc

SEQ ID NO: 680465 - RNA, 63 nt, hsa
cagaaaggagaugccaauucugcuaucacagaacuccaccagcaacuccacccgaccccagca

SEQ ID NO: 680466 - RNA, 63 nt, hsa
ccaggugugcacaggggccucccaggcuccuggcuccaccagccaaggaggugggggcaaggg

SEQ ID NO: 680467 - RNA, 63 nt, hsa
ucaucuccuuggucacccucugcuccaggccuucuccaccacaggaccucagcugucccuccu

SEQ ID NO: 680468 - RNA, 64 nt, hsa; identical to SEQ ID NO: 216073

SEQ ID NO: 680469 - RNA, 64 nt, hsa; identical to SEQ ID NO: 216074

SEQ ID NO: 680470 - RNA, 64 nt, hsa; identical to SEQ ID NO: 216075

SEQ ID NO: 680471 - RNA, 64 nt, hsa; identical to SEQ ID NO: 216076

SEQ ID NO: 680472 - RNA, 64 nt, hsa; identical to SEQ ID NO: 216077

SEQ ID NO: 680473 - RNA, 64 nt, hsa; identical to SEQ ID NO: 216078

SEQ ID NO: 680474 - RNA, 64 nt, hsa; identical to SEQ ID NO: 216079

SEQ ID NO: 680475 - RNA, 64 nt, hsa; identical to SEQ ID NO: 216080

SEQ ID NO: 680476 - RNA, 64 nt, hsa; identical to SEQ ID NO: 216081

SEQ ID NO: 680477 - RNA, 64 nt, hsa; identical to SEQ ID NO: 216082

SEQ ID NO: 680478 - RNA, 64 nt, hsa; identical to SEQ ID NO: 216083

SEQ ID NO: 680479 - RNA, 64 nt, hsa; identical to SEQ ID NO: 216084

SEQ ID NO: 680480 - RNA, 64 nt, hsa; identical to SEQ ID NO: 216085

SEQ ID NO: 680481 - RNA, 64 nt, hsa; identical to SEQ ID NO: 216086

SEQ ID NO: 680482 - RNA, 64 nt, hsa; identical to SEQ ID NO: 216087

SEQ ID NO: 680483 - RNA, 64 nt, hsa; identical to SEQ ID NO: 216088

SEQ ID NO: 680484 - RNA, 64 nt, hsa; identical to SEQ ID NO: 216089

SEQ ID NO: 680485 - RNA, 64 nt, hsa; identical to SEQ ID NO: 216090

SEQ ID NO: 680486 - RNA, 64 nt, hsa; identical to SEQ ID NO: 216091

SEQ ID NO: 680487 - RNA, 64 nt, hsa; identical to SEQ ID NO: 216092

SEQ ID NO: 680488 - RNA, 64 nt, hsa; identical to SEQ ID NO: 216093

SEQ ID NO: 680489 - RNA, 64 nt, hsa; identical to SEQ ID NO: 216094

SEQ ID NO: 680490 - RNA, 64 nt, hsa; identical to SEQ ID NO: 216095

SEQ ID NO: 680491 - RNA, 64 nt, hsa; identical to SEQ ID NO: 216096

SEQ ID NO: 680492 - RNA, 64 nt, hsa; identical to SEQ ID NO: 216097

SEQ ID NO: 680493 - RNA, 64 nt, hsa; identical to SEQ ID NO: 216098

SEQ ID NO: 680494 - RNA, 64 nt, hsa; identical to SEQ ID NO: 216099

SEQ ID NO: 680495 - RNA, 64 nt, hsa; identical to SEQ ID NO: 216100

SEQ ID NO: 680496 - RNA, 64 nt, hsa; identical to SEQ ID NO: 216101

SEQ ID NO: 680497 - RNA, 64 nt, hsa; identical to SEQ ID NO: 216102

SEQ ID NO: 680498 - RNA, 64 nt, hsa; identical to SEQ ID NO: 216103

SEQ ID NO: 680499 - RNA, 64 nt, hsa; identical to SEQ ID NO: 216104

SEQ ID NO: 680500 - RNA, 64 nt, hsa; identical to SEQ ID NO: 216105

SEQ ID NO: 680501 - RNA, 64 nt, hsa; identical to SEQ ID NO: 216106

SEQ ID NO: 680502 - RNA, 64 nt, hsa; identical to SEQ ID NO: 216107

SEQ ID NO: 680503 - RNA, 64 nt, hsa; identical to SEQ ID NO: 216108

SEQ ID NO: 680504 - RNA, 64 nt, hsa; identical to SEQ ID NO: 216109

SEQ ID NO: 680505 - RNA, 64 nt, hsa; identical to SEQ ID NO: 216110

SEQ ID NO: 680506 - RNA, 64 nt, hsa; identical to SEQ ID NO: 216111

SEQ ID NO: 680507 - RNA, 64 nt, hsa; identical to SEQ ID NO: 216112

SEQ ID NO: 680508 - RNA, 64 nt, hsa; identical to SEQ ID NO: 216113

SEQ ID NO: 680509 - RNA, 64 nt, hsa; identical to SEQ ID NO: 216114

SEQ ID NO: 680510 - RNA, 64 nt, hsa; identical to SEQ ID NO: 216115

SEQ ID NO: 680511 - RNA, 64 nt, hsa; identical to SEQ ID NO: 216116

SEQ ID NO: 680512 - RNA, 64 nt, hsa; identical to SEQ ID NO: 216117

SEQ ID NO: 680513 - RNA, 64 nt, hsa; identical to SEQ ID NO: 216118

SEQ ID NO: 680514 - RNA, 64 nt, hsa; identical to SEQ ID NO: 216119

SEQ ID NO: 680515 - RNA, 64 nt, hsa; identical to SEQ ID NO: 216120

SEQ ID NO: 680516 - RNA, 64 nt, hsa; identical to SEQ ID NO: 216121

SEQ ID NO: 680517 - RNA, 64 nt, hsa; identical to SEQ ID NO: 216121

SEQ ID NO: 680518 - RNA, 64 nt, hsa; identical to SEQ ID NO: 216123

SEQ ID NO: 680519 - RNA, 64 nt, hsa; identical to SEQ ID NO: 216124

SEQ ID NO: 680520 - RNA, 64 nt, hsa; identical to SEQ ID NO: 216125

SEQ ID NO: 680521 - RNA, 64 nt, hsa; identical to SEQ ID NO: 216126

SEQ ID NO: 680522 - RNA, 64 nt, hsa; identical to SEQ ID NO: 216127

SEQ ID NO: 680523 - RNA, 64 nt, hsa; identical to SEQ ID NO: 216128

SEQ ID NO: 680524 - RNA, 64 nt, hsa; identical to SEQ ID NO: 216129

SEQ ID NO: 680525 - RNA, 64 nt, hsa; identical to SEQ ID NO: 216130

SEQ ID NO: 680526 - RNA, 64 nt, hsa; identical to SEQ ID NO: 216131

SEQ ID NO: 680527 - RNA, 64 nt, hsa; identical to SEQ ID NO: 216132

SEQ ID NO: 680528 - RNA, 64 nt, hsa; identical to SEQ ID NO: 216133

SEQ ID NO: 680529 - RNA, 64 nt, hsa; identical to SEQ ID NO: 216134

SEQ ID NO: 680530 - RNA, 64 nt, hsa; identical to SEQ ID NO: 216135

SEQ ID NO: 680531 - RNA, 64 nt, hsa; identical to SEQ ID NO: 216136

SEQ ID NO: 680532 - RNA, 64 nt, hsa; identical to SEQ ID NO: 216137

SEQ ID NO: 680533 - RNA, 64 nt, hsa; identical to SEQ ID NO: 216138

SEQ ID NO: 680534 - RNA, 64 nt, hsa; identical to SEQ ID NO: 216139

SEQ ID NO: 680535 - RNA, 64 nt, hsa; identical to SEQ ID NO: 216140

SEQ ID NO: 680536 - RNA, 64 nt, hsa; identical to SEQ ID NO: 216141

SEQ ID NO: 680537 - RNA, 64 nt, hsa; identical to SEQ ID NO: 216142

SEQ ID NO: 680538 - RNA, 64 nt, hsa; identical to SEQ ID NO: 216143

SEQ ID NO: 680539 - RNA, 63 nt, hsa; identical to SEQ ID NO: 680434

SEQ ID NO: 680540 - RNA, 63 nt, hsa; identical to SEQ ID NO: 680435

SEQ ID NO: 680541 - RNA, 63 nt, hsa; identical to SEQ ID NO: 680436

SEQ ID NO: 680542 - RNA, 63 nt, hsa; identical to SEQ ID NO: 680437

SEQ ID NO: 680543 - RNA, 63 nt, hsa; identical to SEQ ID NO: 680438

SEQ ID NO: 680544 - RNA, 63 nt, hsa; identical to SEQ ID NO: 680439

SEQ ID NO: 680545 - RNA, 63 nt, hsa; identical to SEQ ID NO: 680440

SEQ ID NO: 680546 - RNA, 63 nt, hsa; identical to SEQ ID NO: 680441

SEQ ID NO: 680547 - RNA, 63 nt, hsa; identical to SEQ ID NO: 680442

SEQ ID NO: 680548 - RNA, 63 nt, hsa; identical to SEQ ID NO: 680443

SEQ ID NO: 680549 - RNA, 63 nt, hsa; identical to SEQ ID NO: 680444

SEQ ID NO: 680550 - RNA, 63 nt, hsa; identical to SEQ ID NO: 680445

SEQ ID NO: 680551 - RNA, 63 nt, hsa; identical to SEQ ID NO: 680446

SEQ ID NO: 680552 - RNA, 63 nt, hsa; identical to SEQ ID NO: 680447

SEQ ID NO: 680553 - RNA, 63 nt, hsa; identical to SEQ ID NO: 680448

SEQ ID NO: 680554 - RNA, 63 nt, hsa; identical to SEQ ID NO: 680449

SEQ ID NO: 680555 - RNA, 63 nt, hsa; identical to SEQ ID NO: 680450

SEQ ID NO: 680556 - RNA, 63 nt, hsa; identical to SEQ ID NO: 680451

SEQ ID NO: 680557 - RNA, 63 nt, hsa; identical to SEQ ID NO: 680452

SEQ ID NO: 680558 - RNA, 63 nt, hsa; identical to SEQ ID NO: 680453

SEQ ID NO: 680559 - RNA, 63 nt, hsa; identical to SEQ ID NO: 680454

SEQ ID NO: 680560 - RNA, 63 nt, hsa; identical to SEQ ID NO: 680455

SEQ ID NO: 680561 - RNA, 63 nt, hsa; identical to SEQ ID NO: 680456

SEQ ID NO: 680562 - RNA, 63 nt, hsa; identical to SEQ ID NO: 680457

SEQ ID NO: 680563 - RNA, 63 nt, hsa; identical to SEQ ID NO: 680458

SEQ ID NO: 680564 - RNA, 63 nt, hsa; identical to SEQ ID NO: 680459

SEQ ID NO: 680565 - RNA, 63 nt, hsa; identical to SEQ ID NO: 680460

SEQ ID NO: 680566 - RNA, 63 nt, hsa; identical to SEQ ID NO: 680461

SEQ ID NO: 680567 - RNA, 63 nt, hsa; identical to SEQ ID NO: 680447

SEQ ID NO: 680568 - RNA, 63 nt, hsa; identical to SEQ ID NO: 680463

SEQ ID NO: 680569 - RNA, 63 nt, hsa; identical to SEQ ID NO: 680464

SEQ ID NO: 680570 - RNA, 63 nt, hsa; identical to SEQ ID NO: 680465

SEQ ID NO: 680571 - RNA, 63 nt, hsa; identical to SEQ ID NO: 680466

SEQ ID NO: 680572 - RNA, 63 nt, hsa; identical to SEQ ID NO: 680467

SEQ ID NO: 680573 - RNA, 64 nt, hsa; identical to SEQ ID NO: 331879

SEQ ID NO: 680574 - RNA, 64 nt, hsa; identical to SEQ ID NO: 331880

SEQ ID NO: 680575 - RNA, 64 nt, hsa; identical to SEQ ID NO: 331881

SEQ ID NO: 680576 - RNA, 64 nt, hsa; identical to SEQ ID NO: 331882

SEQ ID NO: 680577 - RNA, 64 nt, hsa; identical to SEQ ID NO: 331883

SEQ ID NO: 680578 - RNA, 64 nt, hsa; identical to SEQ ID NO: 331884

SEQ ID NO: 680579 - RNA, 64 nt, hsa
cugaccccaguggaaaacaaagccaaacaaaacugaaccacaaaaaaaaaggcugguguucacc

SEQ ID NO: 680580 - RNA, 64 nt, hsa
uuugcuggaagaaacuaaaaauauagcaaaugcagaaccacaaacaauucgaaugggguagaaa

SEQ ID NO: 680581 - RNA, 64 nt, hsa
ccuuggccucccaaugcucugggauuacagacaugaaccacagugccuguuguagaaauuuuua

SEQ ID NO: 680582 - RNA, 64 nt, hsa
auuggaaaguggcagcuaaacauuaaauucgcaugaaccacagaugcuggagaucaccagaccg

SEQ ID NO: 680583 - RNA, 64 nt, hsa
uagggacacuguguuaucaaccauuaagaagaaagaaccacaagccucccaaguauuuggguuc

SEQ ID NO: 680584 - RNA, 64 nt, hsa
agcaauccuccugccucagcuuccugaguagcuggaaccacaggugugugcuaccgugccuggc

SEQ ID NO: 680585 - RNA, 64 nt, hsa
uguuaugagcaagagugugaggcaagagaagcuggaaccacauucagagaguauccuguagauu

SEQ ID NO: 680586 - RNA, 64 nt, hsa
uggguugccuucugcagcuguaguaucaguuuuugaaccacaguaaugggaagaaagacaaaug

SEQ ID NO: 680587 - RNA, 64 nt, hsa
cccugauucucccucuggguaaccagucccaggugaaccacaccauccugcaguacuaucgcug

SEQ ID NO: 680588 - RNA, 64 nt, hsa
uucuguaacacacuaacaaaagcaugaaaaauaggaaccacaccaaugcaacauuugugcagaa

SEQ ID NO: 680589 - RNA, 64 nt, hsa; identical to SEQ ID NO: 209384

SEQ ID NO: 680590 - RNA, 64 nt, hsa; identical to SEQ ID NO: 209385

SEQ ID NO: 680591 - RNA, 64 nt, hsa; identical to SEQ ID NO: 209386

SEQ ID NO: 680592 - RNA, 64 nt, hsa; identical to SEQ ID NO: 209387

SEQ ID NO: 680593 - RNA, 64 nt, hsa; identical to SEQ ID NO: 209388

SEQ ID NO: 680594 - RNA, 64 nt, hsa; identical to SEQ ID NO: 209389

SEQ ID NO: 680595 - RNA, 64 nt, hsa; identical to SEQ ID NO: 209390

SEQ ID NO: 680596 - RNA, 64 nt, hsa; identical to SEQ ID NO: 209391

SEQ ID NO: 680597 - RNA, 64 nt, hsa; identical to SEQ ID NO: 209392

SEQ ID NO: 680598 - RNA, 64 nt, hsa; identical to SEQ ID NO: 209393

SEQ ID NO: 680599 - RNA, 64 nt, hsa; identical to SEQ ID NO: 209394

SEQ ID NO: 680600 - RNA, 64 nt, hsa; identical to SEQ ID NO: 209395

SEQ ID NO: 680601 - RNA, 61 nt, hsa; identical to SEQ ID NO: 209396

SEQ ID NO: 680602 - RNA, 64 nt, hsa; identical to SEQ ID NO: 209397

SEQ ID NO: 680603 - RNA, 64 nt, hsa; identical to SEQ ID NO: 209398

SEQ ID NO: 680604 - RNA, 64 nt, hsa; identical to SEQ ID NO: 209399

SEQ ID NO: 680605 - RNA, 64 nt, hsa; identical to SEQ ID NO: 209400

SEQ ID NO: 680606 - RNA, 64 nt, hsa; identical to SEQ ID NO: 209401

SEQ ID NO: 680607 - RNA, 64 nt, hsa; identical to SEQ ID NO: 209402

SEQ ID NO: 680608 - RNA, 64 nt, hsa; identical to SEQ ID NO: 209403

SEQ ID NO: 680609 - RNA, 64 nt, hsa; identical to SEQ ID NO: 209404

SEQ ID NO: 680610 - RNA, 64 nt, hsa; identical to SEQ ID NO: 209405

SEQ ID NO: 680611 - RNA, 64 nt, hsa; identical to SEQ ID NO: 209406

SEQ ID NO: 680612 - RNA, 64 nt, hsa; identical to SEQ ID NO: 209407

SEQ ID NO: 680613 - RNA, 64 nt, hsa; identical to SEQ ID NO: 74140

SEQ ID NO: 680614 - RNA, 64 nt, hsa; identical to SEQ ID NO: 74141

SEQ ID NO: 680615 - RNA, 64 nt, hsa; identical to SEQ ID NO: 74142

SEQ ID NO: 680616 - RNA, 64 nt, hsa; identical to SEQ ID NO: 74143

SEQ ID NO: 680617 - RNA, 64 nt, hsa; identical to SEQ ID NO: 74144

SEQ ID NO: 680618 - RNA, 64 nt, hsa; identical to SEQ ID NO: 74145

SEQ ID NO: 680619 - RNA, 64 nt, hsa; identical to SEQ ID NO: 74146

SEQ ID NO: 680620 - RNA, 64 nt, hsa; identical to SEQ ID NO: 74147

SEQ ID NO: 680621 - RNA, 64 nt, hsa; identical to SEQ ID NO: 74148

SEQ ID NO: 680622 - RNA, 64 nt, hsa; identical to SEQ ID NO: 74149

SEQ ID NO: 680623 - RNA, 64 nt, hsa; identical to SEQ ID NO: 74150

SEQ ID NO: 680624 - RNA, 64 nt, hsa; identical to SEQ ID NO: 74151

SEQ ID NO: 680625 - RNA, 64 nt, hsa; identical to SEQ ID NO: 74152

SEQ ID NO: 680626 - RNA, 64 nt, hsa; identical to SEQ ID NO: 74153

SEQ ID NO: 680627 - RNA, 64 nt, hsa; identical to SEQ ID NO: 74154

SEQ ID NO: 680628 - RNA, 64 nt, hsa; identical to SEQ ID NO: 74155

SEQ ID NO: 680629 - RNA, 64 nt, hsa; identical to SEQ ID NO: 74156

SEQ ID NO: 680630 - RNA, 64 nt, hsa; identical to SEQ ID NO: 74157

SEQ ID NO: 680631 - RNA, 64 nt, hsa; identical to SEQ ID NO: 74158

SEQ ID NO: 680632 - RNA, 64 nt, hsa; identical to SEQ ID NO: 74159

SEQ ID NO: 680633 - RNA, 64 nt, hsa; identical to SEQ ID NO: 74160

SEQ ID NO: 680634 - RNA, 64 nt, hsa; identical to SEQ ID NO: 74161

SEQ ID NO: 680635 - RNA, 64 nt, hsa; identical to SEQ ID NO: 74162

SEQ ID NO: 680636 - RNA, 64 nt, hsa; identical to SEQ ID NO: 74163

SEQ ID NO: 680637 - RNA, 64 nt, hsa; identical to SEQ ID NO: 74164

SEQ ID NO: 680638 - RNA, 64 nt, hsa; identical to SEQ ID NO: 74165

SEQ ID NO: 680639 - RNA, 64 nt, hsa; identical to SEQ ID NO: 74166

SEQ ID NO: 680640 - RNA, 64 nt, hsa; identical to SEQ ID NO: 74167

SEQ ID NO: 680641 - RNA, 64 nt, hsa; identical to SEQ ID NO: 74168

SEQ ID NO: 680642 - RNA, 64 nt, hsa; identical to SEQ ID NO: 74169

SEQ ID NO: 680643 - RNA, 64 nt, hsa; identical to SEQ ID NO: 74170

SEQ ID NO: 680644 - RNA, 64 nt, hsa; identical to SEQ ID NO: 74171

SEQ ID NO: 680645 - RNA, 64 nt, hsa; identical to SEQ ID NO: 74172

SEQ ID NO: 680646 - RNA, 64 nt, hsa; identical to SEQ ID NO: 74173

SEQ ID NO: 680647 - RNA, 64 nt, hsa; identical to SEQ ID NO: 74174

SEQ ID NO: 680648 - RNA, 64 nt, hsa; identical to SEQ ID NO: 74175

SEQ ID NO: 680649 - RNA, 64 nt, hsa; identical to SEQ ID NO: 74176

SEQ ID NO: 680650 - RNA, 64 nt, hsa; identical to SEQ ID NO: 74177

SEQ ID NO: 680651 - RNA, 64 nt, hsa; identical to SEQ ID NO: 74178

SEQ ID NO: 680652 - RNA, 64 nt, hsa; identical to SEQ ID NO: 74179

SEQ ID NO: 680653 - RNA, 64 nt, hsa; identical to SEQ ID NO: 74180

SEQ ID NO: 680654 - RNA, 64 nt, hsa; identical to SEQ ID NO: 74181

SEQ ID NO: 680655 - RNA, 64 nt, hsa; identical to SEQ ID NO: 74182

SEQ ID NO: 680656 - RNA, 64 nt, hsa; identical to SEQ ID NO: 74183

SEQ ID NO: 680657 - RNA, 64 nt, hsa; identical to SEQ ID NO: 74184

SEQ ID NO: 680658 - RNA, 64 nt, hsa; identical to SEQ ID NO: 74185

SEQ ID NO: 680659 - RNA, 64 nt, hsa; identical to SEQ ID NO: 74186

SEQ ID NO: 680660 - RNA, 64 nt, hsa; identical to SEQ ID NO: 74187

SEQ ID NO: 680661 - RNA, 64 nt, hsa; identical to SEQ ID NO: 74188

SEQ ID NO: 680662 - RNA, 64 nt, hsa; identical to SEQ ID NO: 74189

SEQ ID NO: 680663 - RNA, 64 nt, hsa; identical to SEQ ID NO: 74190

SEQ ID NO: 680664 - RNA, 64 nt, hsa; identical to SEQ ID NO: 74191

SEQ ID NO: 680665 - RNA, 64 nt, hsa; identical to SEQ ID NO: 74192

SEQ ID NO: 680666 - RNA, 64 nt, hsa; identical to SEQ ID NO: 74193

SEQ ID NO: 680667 - RNA, 64 nt, hsa; identical to SEQ ID NO: 74194

SEQ ID NO: 680668 - RNA, 64 nt, hsa; identical to SEQ ID NO: 74195

SEQ ID NO: 680669 - RNA, 64 nt, hsa; identical to SEQ ID NO: 74196

SEQ ID NO: 680670 - RNA, 64 nt, hsa; identical to SEQ ID NO: 74197
